United States Patent 8,445,666 (RIBONUCLEIC ACID INTERFERENCE MOLECULES) - sequence listing, part 5

SEQ ID NO: 89141 - DNA, 75 bp, Mus musculus
agcatctgaagatcactggcagctgtgagctgatgccctcagtgtcctcacagaaccccgtcctctgtcctggct

SEQ ID NO: 89142 - DNA, 125 bp, Mus musculus
gcatggtgctgccctcacctgctctggctgcttgggttcctggcatgctgatttgtgacttgagattaaaatcacattgccagggattaccacgcaaccatgaccttggctgctcctgcagaacc

SEQ ID NO: 89143 - DNA, 112 bp, Mus musculus
ccggcgatgacctctctaacaaggtgcagagcttagctgattggtgaacagtgattggtttccgctttgttcacagtggctaagttctgcacctgaagagaaggtgagatgg

SEQ ID NO: 89144 - DNA, 107 bp, Mus musculus
gctgtgattggacccgccctccggtgcctactgagctgatatcagttctcatttcacacactggctcagttcagcaggaacaggagtcgagcccttgagcaaaaagc

SEQ ID NO: 89145 - DNA, 72 bp, Mus musculus
gggagaggggagacatattatagcgtgtgtggaggtcgaaggacaacttgtggtagttggttctcttcttcc

SEQ ID NO: 89146 - DNA, 86 bp, Mus musculus
taccatttatgcaaacctcaggcacacatttaaaaatatttttaagatttattttaatgtgtctgagtgttttgcttgaatctgtg

SEQ ID NO: 89147 - DNA, 66 bp, Mus musculus
ggtagatctctgaggctctctgagtgtgaggctagcctgatctacagagtgagttctagatcagcc

SEQ ID NO: 89148 - DNA, 65 bp, Mus musculus
tagtgtgtctgtctgtgtgtgtctgtgtgatggtttgtatatgctcagcccagggagtggcacta

SEQ ID NO: 89149 - DNA, 73 bp, Mus musculus
tgtgctgtctagggctggaaagatggctcaatggtcaggagtactgactgctctttcagaggtcctgagttca

SEQ ID NO: 89150 - DNA, 81 bp, Mus musculus
gggcagagttgtggaatgaatagagagaggagacaggcacctgagtgccagcatgctgctgtttctgattccgaatgaccc

SEQ ID NO: 89151 - DNA, 85 bp, Mus musculus
tttctgctgcatgtgctcatttttctccatggtaaacctgtgtttgtttatcaatgaacagtttggtgggtgtttggagcagaga

SEQ ID NO: 89152 - DNA, 118 bp, Mus musculus
ggttcttagggattctctgagtgggatactgtgtgggaaagatgacatcactgtcttctgactctgtgtcaccctgtcccatgcaatgatgtccagctgtacggtgatcctttgtctc

SEQ ID NO: 89153 - DNA, 152 bp, Mus musculus
tacttacatgtatgtatgtttgtatgtatgtatgtatgccatatatatatatatatatgtatgtgtgtgtgtatatatatatgtgtgtgtgtatatatatatatatatatatatatatatatatatatatatatatagtattagggttttac

SEQ ID NO: 89154 - DNA, 94 bp, Mus musculus
gattctaataagaagcctgacagtggtaagagtggacagtctcttcgtctctctggattgagctcaccacatcactcaggagaaggttggtttc

SEQ ID NO: 89155 - DNA, 62 bp, Mus musculus
tatacatacatatacatgtatatatatatacatacatacatatacatgtgtgtgtgtgtata

SEQ ID NO: 89156 - DNA, 137 bp, Mus musculus
gtggagaccggaggctaatgatgggtgtcttcctcagtcactctccatcctattctttgagacagtgtctctcactgaacctgatgcttgccatttaagactggctggcaagccagagtctcaggacatgtctgtct

SEQ ID NO: 89157 - DNA, 94 bp, Mus musculus
tgcttttcaaaatgtacatgaatatatatgtgcatatgtatttgtgaatatatgtgtatgtacatatgtatatttatatacattttgaaaagca

SEQ ID NO: 89158 - DNA, 112 bp, Mus musculus
gtgtgtgtgagtcctttggtctggagagatggctcagttgttaagagcattgtctgctcttccagaggtcctgagtacaattcccaacaaccacttggtggctcacaaccat

SEQ ID NO: 89159 - DNA, 73 bp, Mus musculus
ctttctctgtctctctatgtttctgcatacacacataaacacacatgagagagagagagagaggcagagagag

SEQ ID NO: 89160 - DNA, 104 bp, Mus musculus
agctcccagctatgttgccagcaccttgtctccctgtgtgtctccatgctgctcaccatgatgataacaggctaagcctctgatttgacatcaagctgctagtt

SEQ ID NO: 89161 - DNA, 62 bp, Mus musculus
gcaccgctgtgacagcaagagcatgtggcagagctactcatgcagtagctggaacaggaagc

SEQ ID NO: 89162 - DNA, 97 bp, Mus musculus
ctaggaagtagcctgacagaaaatagtgaccagaacttttaactcaattttattgtttgttttgagtcaggatctcatgtaccccaggctggccttg

SEQ ID NO: 89163 - DNA, 82 bp, Mus musculus
agggcagcagccagagctgagagcggtgattctcaaccttcctgatgcttcaaccctttaatacagtttttcatgttgtgct

SEQ ID NO: 89164 - DNA, 80 bp, Mus musculus
tttattgttgtgagaagaaacagtcctctgtcgatgaaaacatttcctaggcagggagtccttcttggtataaatgtaga

SEQ ID NO: 89165 - DNA, 110 bp, Mus musculus
gacaagtgatatttgaagacagtataaatagagctaaacagacagtgaccacacatgctacctttgcaatgcttcattgatcttgcatctttgctgatctttgctttgtt

SEQ ID NO: 89166 - DNA, 115 bp, Mus musculus
atgtaagaatatacgtgtggttttcattttatgtttctgcgtgtatgtctgtttgtacatctgtgcatgtatgtaaatgttcttctgtttctctggcctatgtatatctgtatgt

SEQ ID NO: 89167 - DNA, 111 bp, Mus musculus
atgtgacagtcacagatgtggatttaggattgaactggaattcattaaatacctcttccagaatattttttattctttgcaagccttcctcagtcatcttggcttatacat

SEQ ID NO: 89168 - DNA, 112 bp, Mus musculus
tctgatatttgagaatggttagatggttacatttacatgaaactgttgagtatatttttgatactttaaatagttgtgaaaatttagaattctgagatttttagatttcaga

SEQ ID NO: 89169 - DNA, 85 bp, Mus musculus; identical to SEQ ID NO: 58391

SEQ ID NO: 89170 - DNA, 71 bp, Mus musculus
gtcagtccagaaaggcaagggtatatgttgttgtctttcaggagcattcagtgcagcttttgtggattgcc

SEQ ID NO: 89171 - DNA, 69 bp, Mus musculus
gtatgcatgtacacttgtgaaattgatgaaacagatggtcaggcccagctagtatgtgtgtgtgtgtac

SEQ ID NO: 89172 - DNA, 104 bp, Mus musculus
ctgatccctgcatctcttctttggtacttgtttgatgatttaaatcaaaacatcttagttcttgtcaaatatatatgtggctagagagatagctcagcagttag

SEQ ID NO: 89173 - DNA, 117 bp, Mus musculus
taattctgtgcaaattgacagaaatcttctgggcacagattttgtccacagcaacttagacagtgtgtgtgtgtcagtctgtcttaaagccttcatttttcgcagtctccggaattg

SEQ ID NO: 89174 - DNA, 114 bp, Mus musculus
tcattttattgtgtgtgtatagagtgtgaatgtatatactatgtgtgacttagcaggttgttgtgtccttcccaatatactatctcataccacagatttaccacagatagttga

SEQ ID NO: 89175 - DNA, 239 bp, Mus musculus
tcagttgagttcagtgcaatgtagtcagttgggagtgagcgcagtgagtgcagtgagagtgcagtgagagtgcagtgagagtgcagtatgagtgcagtgtgagtgcagtgagtgcagtgagtgcagtgagagtgcagtgtgagtgcagtgtgagtgcagtgagtgcagtgtgagtgcagtgtgagttcagtgagcgcagtgagcacagtgcggtgcagctgagtttgttcatgaagtca

SEQ ID NO: 89176 - DNA, 59 bp, Mus musculus
agtattctgtaatatgtatgtacgtatgtatgtatgtatttatagattgcagactgact

SEQ ID NO: 89177 - DNA, 83 bp, Mus musculus
ctgccctctgtcacagtgattgacaggcgtggtgactgacaggagcctggtcctgccctctgtcactgtgactgacagggttg

SEQ ID NO: 89178 - DNA, 83 bp, Mus musculus
gcaaagatttcgattgattcgcaggggtttatttaggttttacttattgagtctgagtccctgcgagcctcacttgtcactgc

SEQ ID NO: 89179 - DNA, 114 bp, Mus musculus
tttatggagacccttcatctagagtgatttatatgtccatagaattcactgaccacactgtggtgaagttcttgtgggagatatttccattagtgatttttctcacttaatgaa

SEQ ID NO: 89180 - DNA, 79 bp, Mus musculus
tgctagtgatgggtgccaagttgtttggtagcattcttgttagctaggagattgcctggcacactgtttgccattagca

SEQ ID NO: 89181 - DNA, 85 bp, Mus musculus; identical to SEQ ID NO: 57470

SEQ ID NO: 89182 - DNA, 83 bp, Mus musculus
gtctcatgctgtctttgaattgtaaatatctttgtactttagccgtccatcagactgttaacagtctgaagacactgtgagat

SEQ ID NO: 89183 - DNA, 131 bp, Mus musculus
tgtcccatgtttcatgttgggtgaactttttttgtaagtgggtatatcggaccctgagaagggtgtgaggccagagttaccaccattctcatgggtatatttagttaaaatctcctttaaagttctgtcca

SEQ ID NO: 89184 - DNA, 85 bp, Mus musculus
ggccatggtggtttgataggatacatgggacaatttcaatatttttgtatctgttgaggcctgttatgtgaccaattatatggtc

SEQ ID NO: 89185 - DNA, 95 bp, Mus musculus
tttgaattttcccaacctcttcacagtaaggtcactgtcactgactgagaaattagaggtaaatgcgtgactatgtgcagaaaggagagtctgaa

SEQ ID NO: 89186 - DNA, 123 bp, Mus musculus
gtcacaaacagggactctgggaagggcgcttccgtgtttcttctgcgcctgtgtgtgtctccctctctggcggtcttctccaaagttgggccagtgtcgggtcctgtgcgcgctctggtagca

SEQ ID NO: 89187 - DNA, 76 bp, Mus musculus
agcctcagctactgttcattgtggtatttctggaagatttttttttttttcagagcaaatgagtgtagtagaggtt

SEQ ID NO: 89188 - DNA, 78 bp, Mus musculus
gttgttctctggttgtggtatttattcatgtgtgcacagatgacagacagatacacacactctgagtcagagagatac

SEQ ID NO: 89189 - DNA, 80 bp, Mus musculus
tgacaaattcaatttggataaactttgcagcagacactcccagggtgtctagcagttgagttttagatgtggtgttgtca

SEQ ID NO: 89190 - DNA, 93 bp, Mus musculus
gggatgcatttgattggtgaatatctgatgtcagttgtgaaacatagtgcagttcttattttattattgatacagatcctaaaaagtcatctc

SEQ ID NO: 89191 - DNA, 118 bp, Mus musculus
acctacatacagcaaattatcaggttctctgagtataaccacaggattgaattagtagtgagagtgcagagactggttccattcggttgaggtcattatgggaattaatctgtaaggt

SEQ ID NO: 89192 - DNA, 118 bp, Mus musculus
agacgaagtctgccgtgccttccaggtcactgtgtaactctgagctcctctgaactgagtcaggtcaggctaggccaacagtccagtgaggagtgcggcgggtggctcttcaaggtct

SEQ ID NO: 89193 - DNA, 69 bp, Mus musculus
agagtgagtctgtctttcagtgtgtgagttaataaactcagttctctctgttgaatatcagacttctct

SEQ ID NO: 89194 - DNA, 74 bp, Mus musculus
cacatttatgtatgtatgtatgtatgtatgtatgtatgtatgtatgtatgtatgtatgtacatgtgtatgtgtg

SEQ ID NO: 89195 - DNA, 109 bp, Mus musculus
gagacaacaatgtacagagtctggcagattagagagcaatgtacagatcgtgacagagtagagagcaatgtacagagcctggcagattacagatgaacagagccatttc

SEQ ID NO: 89196 - DNA, 60 bp, Mus musculus
gggggcattgattgctcgtgtgtcctggtgacagaagaaccacagtcagtctctgtcttc

SEQ ID NO: 89197 - DNA, 72 bp, Mus musculus
ctatgaagatcagatgtatatgtgtgtatgtatatgtatatatgaaacatacatgtatttcaggatgtatag

SEQ ID NO: 89198 - DNA, 64 bp, Mus musculus
cagatactgtctcactgaaggtgtctgtcacatccatcagacactgtctcactgaggctgtctg

SEQ ID NO: 89199 - DNA, 68 bp, Mus musculus
gtttagagaagacagagacctcaggattctcctcttggctcatcctgagtttgggtctgcatatgggc

SEQ ID NO: 89200 - DNA, 85 bp, Mus musculus
ctagttctgtttcttattcatggatgttactcttcaatcagatactgagtgagcacagaggggcaggggtgtgagccagccctgg

SEQ ID NO: 89201 - DNA, 112 bp, Mus musculus
ctgctctcacaccacgtgtcttgtgaagggcagtggcatgttagctgcagagtgtgcacagtgcctgcagcaagatagagtcttcccaatattgacacgtgagtgacagtgg

SEQ ID NO: 89202 - DNA, 96 bp, Mus musculus
gatcagccttagtccatggtgatatgataggatgcatgggacaatttcaatatttttgtatctgttgaagcctgttttgtgaccaattatatggtc

SEQ ID NO: 89203 - DNA, 68 bp, Mus musculus
tgtggtgctgttggccagtgaaagtcagcttcctggaaatgtgttgactcactgactctctgcccaca

SEQ ID NO: 89204 - DNA, 79 bp, Mus musculus
gggaatgtgggaaggggtggcgagttctctctgggcagtggggaaagcccaggttctgactccctctctccatgtgccc

SEQ ID NO: 89205 - DNA, 117 bp, Mus musculus
ctttgggaccccatgttcccccttgcagtggtcattaaatcccactagaattatatatttatatctggtacatatttgttcagactgtgtgatggtttgtatatgcttggcccagag

SEQ ID NO: 89206 - DNA, 64 bp, Mus musculus
agtctttgtgatcacagtcaccacacccagcttctgggtcatgggttaccaggggccagagact

SEQ ID NO: 89207 - DNA, 134 bp, Mus musculus
gtgtgcatatttgtgcgcatatgtgtttgtgcatgtgtgtttgtgtgaatgtgcacatgtgtgattgtgcatgtgcatatgagtgtatatgtgtctgtgcactgtgtgcacatgtgtgtttgtgcatgtgtgca

SEQ ID NO: 89208 - DNA, 75 bp, Mus musculus
tatgtgtgtgtgtctgtgcatgtgtctgtgtgtgtctgtatgattgagcatgtatatatgtgtgaaaacaacatg

SEQ ID NO: 89209 - DNA, 78 bp, Mus musculus
acagtgcaaaggtcctaaagtcagagctgcatcatgagatgaactgcttgctctctctgtctttgagaaaaagcctgt

SEQ ID NO: 89210 - DNA, 73 bp, Mus musculus
aagggtgttgtgaagattgtagactggttgtagacaacccgtattctactggggcatcacagctaaactcctt

SEQ ID NO: 89211 - DNA, 79 bp, Mus musculus
aacaggagttgtacatgcttataaatacttagctagtactatgtattgtttagccagggtgcatgtggtgctgtctgtt

SEQ ID NO: 89212 - DNA, 70 bp, Mus musculus
gcatgcatgcacacatatgtaggtacctgtatgtctatgtgtacttgtctgtgtatgtgtctgtgtatgt

SEQ ID NO: 89213 - DNA, 113 bp, Mus musculus
gtcaggaacctcacgaacagagtaattcatggaagatgggttgtgatgacaggtctcactctctgtctctgccactgccctttctatttgtgtagccaatgaagtgaaacgac

SEQ ID NO: 89214 - DNA, 88 bp, Mus musculus
caggaatctactggttgtttactgatgacaaagatgatgaatgctctcaatatttatatttgagtcagggtaagactaggtgagactg

SEQ ID NO: 89215 - DNA, 93 bp, Mus musculus
agaacaccgagctgctcagccataacatatatacagatccatatatgctccctgatatctgtgtgcctgactgagtcacagtaaggtgattct

SEQ ID NO: 89216 - DNA, 129 bp, Mus musculus
gtgactagagagagacttgctctcatgctgggctcagcatcttaggtttcttgtttagatcatgtcaggagagagagaggtgttgccagcaatgtgcacctcacagtttgcagctccttttctttgtgc

SEQ ID NO: 89217 - DNA, 85 bp, Mus musculus; identical to SEQ ID NO: 57470

SEQ ID NO: 89218 - DNA, 111 bp, Mus musculus
agattcaccttctaattttcatctatgaatatgtctgtgtgcctgtgtgagtgcctatcgtgtgtgtgtgtatttatggaggccagaagaggaaaatagatccttggagct

SEQ ID NO: 89219 - DNA, 73 bp, Mus musculus
gtgtgtatgtatatgtatatatgtatgtgtgtctatatacacacaaacatatacacacatatatcatacacac

SEQ ID NO: 89220 - DNA, 76 bp, Mus musculus
gcagagtcatatatatatgtatatatacacatacatatatagtgtgtgtatgatatatgtgtgtatatgtttgtgt

SEQ ID NO: 89221 - DNA, 116 bp, Mus musculus
cagacctaagttgccactgtgaatgagaccacctgtggtggagccttctgacctacatggttctattgttctgtcaccaaggtggttctattgttctgtcaccaactcctgttctg

SEQ ID NO: 89222 - DNA, 78 bp, Mus musculus
ttaggttaccatatgcactggctggttttctgtgtcaatttgacacaagatagagtcatcagagaggaagaagcctaa

SEQ ID NO: 89223 - DNA, 83 bp, Mus musculus
ctgtctgtgtgtctgtgtgcctgccatgtgtgtgcagctacgtgtagaggccagagggtgttgtagctggaattacaggtggc

SEQ ID NO: 89224 - DNA, 108 bp, Mus musculus
ggtggattcacatggctgtcgaatctgagtgtaggaccaggctgtcactgtcactcatagtacttctgtgcagtctcctccttttttcttcttagatgtgtgttcact

SEQ ID NO: 89225 - DNA, 118 bp, Mus musculus
gtatttttggttttgtttccttataatcccacctagagcagggcttcctgacacagtctctgactgtagcaaggctctgtctcctggccccaagagtgaggtgaggagccatagaaac

SEQ ID NO: 89226 - DNA, 106 bp, Mus musculus
gttgtcccaccctggctctggatcaaacacactgacactctgaaagtccaggaaggaaagattcccatcatctcaggttagtgttccaaaccctaggtgctcaaac

SEQ ID NO: 89227 - DNA, 78 bp, Mus musculus
gcactctcatgtaaagttgtgtggacatttttgctgaagagcttcatatagtgtctcaacataattgaaatattgtgc

SEQ ID NO: 89228 - DNA, 98 bp, Mus musculus
cctagacagtgttgatttgcatctgtgtctgggctcacttatcactagggtgattgcttcatggatatggtatgtattcctcaacattcttatttagg

SEQ ID NO: 89229 - DNA, 99 bp, Mus musculus
ctgaacacgagaggcccttgtgagcacagactgaggagacaaggggccactgatggaatattgatttctggtgtttgtttacagcactgtctggttcag

SEQ ID NO: 89230 - DNA, 78 bp, Mus musculus
tatggaaggatgactgaagagagtctgaagcatgccaccaaggcgccacagctactaaccagccatgcacttgccatg

SEQ ID NO: 89231 - DNA, 125 bp, Mus musculus
tctgtccaatcgacttcaaatgaggagataaaatagacaacactattttaactcatccagctttggagtgatagattgattactgggtagcaaagagctggtctcagtgataccaaacctggatg

SEQ ID NO: 89232 - DNA, 89 bp, Mus musculus
ttcattaccacagtgcattaagggccaaggggggcaggtggaatccaatttgctactgcctcagtgactctgtgttttaatcaaatgga

SEQ ID NO: 89233 - DNA, 85 bp, Mus musculus
ggccatggtggtctgataggatacatgggacaatttctatatttttgaatctgttgaggcctgttttgtgaccaattatatggtc

SEQ ID NO: 89234 - DNA, 81 bp, Mus musculus
gcacagctttcactctgtgtctgaaacaggcagtgggcaccatcttgtccactgcctctctcaacaggatgagggttgagt

SEQ ID NO: 89235 - DNA, 110 bp, Mus musculus
gtgcatgtgcatgtgtgtgcatgtgtgcatgagtgtgtgattgtatgtgcatgtgcatgtgtgtctctgtgtgtgagagggagaatgtgtgagtgtatgtgtgagacaga

SEQ ID NO: 89236 - DNA, 80 bp, Mus musculus
ctggattttacagtcaagagtgaaagctgaagtagggatttctctctaggcttgcagcctgtcctgtcatggttttccag

SEQ ID NO: 89237 - DNA, 103 bp, Mus musculus
tacatgtctgtatttacagtaacactgctctctgtctgtgtctaaccagtgccaccaaccttgaccttattcagacacatggtgtgttatgaaacaggcagta

SEQ ID NO: 89238 - DNA, 93 bp, Mus musculus
ccttcatgttcaagagagagatgagagaagtttctgaacactgactgtatcagaaagagttcttgaaatttgccatccaaaccttggataagg

SEQ ID NO: 89239 - DNA, 115 bp, Mus musculus
gtgtgcatgggttgtatttggagcacacatgtctgtgtgtttggagcacacatgtctgtgtgtttggagcacacacgtccgagtgtgcatctgctttatttcatttgtgtatcac

SEQ ID NO: 89240 - DNA, 115 bp, Mus musculus
ctgttcatgaaactgtaatagtccagacagatagagacaatggctgaacagacacaggacaaggaagctagcagacaggactttaggagtctgactttacagttctgagggacag

SEQ ID NO: 89241 - DNA, 107 bp, Mus musculus
gttatatactgtgcagtttagctggagagatagctcagcagttaagagcactgactgctcttccagaggttctgagttcaattcccagcaatagcatggtggctcac

SEQ ID NO: 89242 - DNA, 123 bp, Mus musculus
caggggcaggggcttgcttgtccattgctgtatgtaggaagcatgcacagtcactgtctcccattatgcccactgttcagtcagcactcccttggctagcaggatgccatggttgagggtggc

SEQ ID NO: 89243 - DNA, 106 bp, Mus musculus
aaagtcactcggtgtacctggccaaccattcttgacaggatttttcagtgcctggtactgaggtttttgttagtctgtggtttttatgggaagcattgtcagcttt

SEQ ID NO: 89244 - DNA, 66 bp, Mus musculus
gtgcgctcagtgctgtctgtatctgtacccaccctgcagcagacactctcagtcactgatggtcac

SEQ ID NO: 89245 - DNA, 117 bp, Mus musculus
gaggtcaggctgagaatggtggagctagtgaggccccctactctgtctctgtgacaggccggaatttgagggatgcccagagaaactggtagattccactagggtgttggtcagctc

SEQ ID NO: 89246 - DNA, 81 bp, Mus musculus
ctctcagtctgatggcactgggagaagagtctgtgagatcactctgaggaatttcctttgtgcctttgtgacagtcaggag

SEQ ID NO: 89247 - DNA, 114 bp, Mus musculus
tctatgtgcctgtgtgtgcagcatgtgggtgtgcatacacatgcttttggcagacagaagaatgtatgcagagcctcacttttgctaggctaatacactgcctctgaggcatat

SEQ ID NO: 89248 - DNA, 81 bp, Mus musculus
gtatgtggtatgtgtgtatatcatgtgtatgtggcatgtgtgtgtatcacgtgtatgtggtatgtatatatatatatgtgc

SEQ ID NO: 89249 - DNA, 95 bp, Mus musculus
tatacatatatatacacacatatatatatgcaaacacatacacacctttctttgagttttgtttatatgtatatgtgtgtgcttgtttatgtata

SEQ ID NO: 89250 - DNA, 74 bp, Mus musculus
atatacgcatgtgtatgcatgtacatatatagtatatttgtatattataagtgcatgcatatgtatgtatatat

SEQ ID NO: 89251 - DNA, 84 bp, Mus musculus
ttttctctctctctctctatgcctatatatatatatatctatatagatatatatgtacccagagagagagagagagagagagag

SEQ ID NO: 89252 - DNA, 81 bp, Mus musculus
gctctgagtgttctgtctgtggtctgaggaggcacaatggcagcctgaggatctcagacaccggtccacagaattcagagc

SEQ ID NO: 89253 - DNA, 83 bp, Mus musculus
acccacactgcataggcagtattatatttagaccaaactatggaactatgtatgactcttggaaagtaaatgcagtgcggtgt

SEQ ID NO: 89254 - DNA, 73 bp, Mus musculus
tcatgagtgttcaggaggactgtgacactcactgtcttagtcacggtttctattcctgcacaaaacatcatga

SEQ ID NO: 89255 - DNA, 109 bp, Mus musculus
aggactcctggggattagacaacggccagttcctcaaacactccagtcactcactctctcatggctgcacagttacaatggttgattttgtttaacccaatggaagctt

SEQ ID NO: 89256 - DNA, 88 bp, Mus musculus
atatatatatatatatatacatatacatatacatatacatatacatatacatatatgcatatgtatatgtatatatgtgtgtgtgtat

SEQ ID NO: 89257 - DNA, 108 bp, Mus musculus
tatgtgtgcatgtgtttacatgtttgcacatatgtatccgtgtatgcatgtatgtatgtgtatgtatatatgtatgtgtgtaagtatgcatgtgagtatgtatatgta

SEQ ID NO: 89258 - DNA, 106 bp, Mus musculus
gccttagtgcatggtgatctggtaggatacatgggacaatttcaatatttttgaatttgttgaggcctgttttgtgacctattatgtggtcaattttggagaaggt

SEQ ID NO: 89259 - DNA, 75 bp, Mus musculus
caatgctctgaagaagcaggtgagactaggaagtgccaggctccctctctgcatgctttctgagcctagacattg

SEQ ID NO: 89260 - DNA, 74 bp, Mus musculus
atgtatctatgtacatccatatctatgtgtatatatatatgtatatatacatatgtatgtatatatgtatgcat

SEQ ID NO: 89261 - DNA, 82 bp, Mus musculus
gtgtatgtatcatctatatgtatatatgtacatatgtatgtatctatatatcatctatgtatatacatatgtatgcatatat

SEQ ID NO: 89262 - DNA, 70 bp, Mus musculus
catctatgtttgtacatatgtatgtatgtatctatcatttatatatgtacacatgtataatgtatggatg

SEQ ID NO: 89263 - DNA, 109 bp, Mus musculus
agatttgtctatcactgtcaggtggtgggtcctggaatgagtcactctgtgcctgtgcacatcacacttctcaattacaatgccagggacctgcatctgtgatatttct

SEQ ID NO: 89264 - DNA, 95 bp, Mus musculus
gaatccagtctgtctctgggaagagagtttcactgacccacactcacacagtgcatgctcattgtttttggctgttacaggcaaaaactggattc

SEQ ID NO: 89265 - DNA, 90 bp, Mus musculus
tgtatttctgtatgtatgtatgtatgtatgcattgtatgtatatactgcatgtatttattgcttgtatgtatgtatacattgactgtaca

SEQ ID NO: 89266 - DNA, 74 bp, Mus musculus
cagtgtctctcactgtgtgcagaggacatggagtcactgaatgtcttgaaggtgcagagtggaaagaggaaatg

SEQ ID NO: 89267 - DNA, 105 bp, Mus musculus
cagcacttgaactaagagcaatgtctgtattgcacatctctggggctgaggtctcagtactttaccagctatgtctgatgagatgtttctcatggttctttgttg

SEQ ID NO: 89268 - DNA, 72 bp, Mus musculus
cagagatttccctaaactcatagattgtgaggccaggaggccagcaggctgagtgtagagagagagaatttg

SEQ ID NO: 89269 - DNA, 74 bp, Mus musculus
aggccagacagagatgctgcctggcagcctgtgtgggtgcacacagccaggtaaggggtgtacttgtctgttct

SEQ ID NO: 89270 - DNA, 64 bp, Mus musculus
cacacacatgggcagggatgcatattcatacatacgtatgaatatgtaaagatgtatgtggatg

SEQ ID NO: 89271 - DNA, 141 bp, Mus musculus
gtgtttgtgtttatgagtgtgtgtggtatttatttgtatataagtacatatgtgtattgtatatgtatgtatatatgaatgaatgcatgtgtgtgtggtgtgtatttgtttataagtgtgcatgtgtatgtgtgtgtgcat

SEQ ID NO: 89272 - DNA, 77 bp, Mus musculus
aagaagactggagtgactgagcacacgcatgcacgcacacacacgctactgctgctgttgaaacctccagccttgtt

SEQ ID NO: 89273 - DNA, 120 bp, Mus musculus
atccacacagcagagggctcccaccagatgcctctagttagacaacacagaaatgaatgtcactgtctgactctaaccacaagatgccggctcacgaggaagcagcaggctgacagggat

SEQ ID NO: 89274 - DNA, 92 bp, Mus musculus
tttcttatccactgcacagtcctagtcaccagacccatttgttgtgaggaatgatctgtgacgtgagcttttgtgacttggatcatatgaaa

SEQ ID NO: 89275 - DNA, 78 bp, Mus musculus
gtctcactttgggttctgccatctgtgagctgtgggtataatgatgacttacatgagttgtgagcagaatggtgagac

SEQ ID NO: 89276 - DNA, 116 bp, Mus musculus
tgtaagtaccttaaccagtctgtttttgtggaaggtgacttttaattttgtaaaatttatttttaatcaatacacagagggaaagctccacagactaacagatgtgagttctgaca

SEQ ID NO: 89277 - DNA, 105 bp, Mus musculus
tcctgttcctcagtttctctgctggtgtccttgtcccctctgattacactgagctgacagtgggaagttaggagcctcacagcaagctcaattagaccaatagga

SEQ ID NO: 89278 - DNA, 66 bp, Mus musculus
gataaacacctctttctgaggcgcggaagctcacacctgtgagtctgtccctctgtgagtgtcatc

SEQ ID NO: 89279 - DNA, 68 bp, Mus musculus
ataggccctgcacagtatcactcagacccactcacactgtcgatctggagaagcagctgtgcacctgt

SEQ ID NO: 89280 - DNA, 74 bp, Mus musculus
ttcatgtgcacatgtgcatatgtatatgcatgcacatgtatgtatgtatgtatatgtgtatgtatgtgtgtgag

SEQ ID NO: 89281 - DNA, 101 bp, Mus musculus
caaaccctctgacttgtgtcccatgctgacaagatgtgtctctctgtgtgtacaaagcacacggttgagatcttttgtctatggtcctagaagaggcattg

SEQ ID NO: 89282 - DNA, 118 bp, Mus musculus
ccagtgaaattgtggacaggcaaatgatgtgtgtatatgtgcttgtgcatgtgcatctatgtgcgtgcgtgtgtgtgtgtgtgtgtgtgtgtgtgtgtgtaggaggaataaattttgg

SEQ ID NO: 89283 - DNA, 92 bp, Mus musculus
cagggtgtcacttctatcctcgtctctgacattgtctctcaataattttcgttgacagacaacagactctttgaagtagttacacagccttg

SEQ ID NO: 89284 - DNA, 68 bp, Mus musculus
gaagctctggaatgtagtctgctgcttgggaaacaagaagctgacagttccttctccaaatcagcttc

SEQ ID NO: 89285 - DNA, 150 bp, Mus musculus
tatacagagatttcctgtggcttgcttttttcatccttaaaatatatatttattttcggtgtgtatgtgtgtctgtgtctctgtgtgtgtacgtgcacacctgcctgcatgtggatatgtacacatgaatgcaggtgcctacagaggcca

SEQ ID NO: 89286 - DNA, 107 bp, Mus musculus
ggctgagcaagggcttttcttgtttgcacacacacacactgatagtcacaaacaagcatttcaaaatcctagcgtgtgctcaggtgcagggaagaaatggctctgtc

SEQ ID NO: 89287 - DNA, 91 bp, Mus musculus
gcaggacaatcagaaggatttgtggtgaggagctgatattgaggttgtcacagaagtcagagatctcaaaccaaaccaaatgacccaatgc

SEQ ID NO: 89288 - DNA, 120 bp, Mus musculus
agtgttgtctatgtgtctctgtgtggaagtgttgtctatgtgctctatgtgtgtttgttatctgtgtgtctgtctgtgagaagagctgtctgtgtgtctatgtatggataagagggtgct

SEQ ID NO: 89289 - DNA, 125 bp, Mus musculus
tgtgtgtgtgtgtgtgtgtgtgtgtgtaactatctgggtccattcagcgttgcttatgtatatatatgtatgtatataggtatttagggctgacaacatgggattggagaaatctacccgggcat

SEQ ID NO: 89290 - DNA, 118 bp, Mus musculus
gagctgttgcctgttgacctttggccactaggtccagggacaagaaaacaatgaaaggcagagtctttctctgtcacggtgttctttgagactaaggaggcagagcagattgctgttc

SEQ ID NO: 89291 - DNA, 107 bp, Mus musculus
tatccctggctcaggctgcagaggctgctcagcgagtttgaagagtaaacacaaatgatattgttcttgataagctgagaaggtgtccctccctggtatcagcagta

SEQ ID NO: 89292 - DNA, 85 bp, Mus musculus
gtccatggtggtctgataggatgcatggaacaatttcaatatttttgtatctgttgaggcctgttttgtgaccaattgtatggtc

SEQ ID NO: 89293 - DNA, 93 bp, Mus musculus
gagcacttgagccacttgtgtgtaccacagttagttggaaagtcagaaaggtgatgaatgggggctggattaggcacaagaaggagattgttt

SEQ ID NO: 89294 - DNA, 112 bp, Mus musculus
cctttgagtttatggctagcctgggacagagcaagtgccagatctaagcatagtaatatatatctttaatttgagttacaccctctgctggaggcctacataaggacattgg

SEQ ID NO: 89295 - DNA, 70 bp, Mus musculus
ggtatttgggtcacaggtgttggctcttgatgacaagggactgaggacacttgctgttgctccatatgct

SEQ ID NO: 89296 - DNA, 105 bp, Mus musculus
ttgaaaaggaggctttgtgggttgtagagatggcttcgaagttaaaagcactgactgctcttccagaggtcctaagttcaattcccagcaaccacatgatggctc

SEQ ID NO: 89297 - DNA, 106 bp, Mus musculus
gccttagtgcatggtgatctgataggatgcatgggacaatttcaatatatttgtatatgttgaggcctgttttgtgacctattatgtggtcaattttggagaaggt

SEQ ID NO: 89298 - DNA, 74 bp, Mus musculus
catacatgcatatataaatatgtaggtgtgtatgtatatgtgtatatatatacacacacacatatgcgtgtgtg

SEQ ID NO: 89299 - DNA, 94 bp, Mus musculus
accaagtgtggatatgaaaacgtaggaacaagacctcattctgcatgtggatatggtgctgtgctatgacaacatccttctcagacacacaggt

SEQ ID NO: 89300 - DNA, 110 bp, Mus musculus
cgtcaagcagaaccacgtgagtaggttaagtttcctgccacatggacatagactcatgagtctgtgctcagtgctttcaggagtcaggcccacccttggctgtgtttgtg

SEQ ID NO: 89301 - DNA, 97 bp, Mus musculus
taagttcatgagctggagagatgactcagtagctaagagcactgactgctgttccagaggtcctgagttcaattcctagcaaccacatggtggctta

SEQ ID NO: 89302 - DNA, 90 bp, Mus musculus
aggcccagtcctttcccacctgttccaagtcctgctcaagactttcaggcccgacttggcctctctgtcactctgattcagtgtgggaac

SEQ ID NO: 89303 - DNA, 122 bp, Mus musculus
cacatgtgtgtgcatgcacacgtttgtacatgtgtgcgtgtgtgcatgttcacatgtgtctgtgtgtatgtccacgtgtgtgtgcatgtttgtgcacatacacgtgtgtgtttgcatgtaca

SEQ ID NO: 89304 - DNA, 64 bp, Mus musculus
agtttgcatctatctatctatctgatccataagcagaagtgggtggtggggatggaggtaggct

SEQ ID NO: 89305 - DNA, 116 bp, Mus musculus
ggcacggatgaagcttttcttccttttctctgaaatggtagctggatgaccaactgtcacacccagcctgtgtgcctcaggctgaaggccaagaagcagcagcacctcccaaggct

SEQ ID NO: 89306 - DNA, 97 bp, Mus musculus
gggatatgctctcggatgctgcaggcatcaatgactaggagtcccagggtctttccttagtctctgacactgtctgttctactgggagacacttttc

SEQ ID NO: 89307 - DNA, 78 bp, Mus musculus
ctcacaccctgtgtctcagccgccccctgtgacccactgaggcagggacctgtggctctcttgaagcatctgtgtgag

SEQ ID NO: 89308 - DNA, 74 bp, Mus musculus
cttccaatgcaagtgagactggctctgtgtctccatccctgagagcacagacatctcccgctgcagtggcctgg

SEQ ID NO: 89309 - DNA, 74 bp, Mus musculus
gtgtggctagggataggtttgagggttcaaaagtccatgttaggtcttgtctctctgtctgtccctgtctctgc

SEQ ID NO: 89310 - DNA, 112 bp, Mus musculus
ttcacaatagttcttttgctttagggcttgagtgcagactttacagttgtgtgtcaccacatacacccagtatagtttcaattgcattttcctaaaggataatgttgttgaa

SEQ ID NO: 89311 - DNA, 105 bp, Mus musculus
ttttggctaaagtttcctgagtgttttctaaagctaacgtttactttaggttgtcagtagatagagacgtgggtcccaagcagagcaggaaggaggggtacagaa

SEQ ID NO: 89312 - DNA, 113 bp, Mus musculus
cagagtgaaaagggtcagagtgagagctggagagttggctcagtggttaagagcactgactgctcttcctgagttcaaatctcagcaaccacacattggctcacaaccatctg

SEQ ID NO: 89313 - DNA, 120 bp, Mus musculus
tatacagctatgtattacactcaagttatgatgatatgtgtatatatataaagaaagcattttgtaatatatatataactttcatttagacaatatgaatgttacaatatattatgtata

SEQ ID NO: 89314 - DNA, 77 bp, Mus musculus
acacacatacagaaaagcaacactaaatggactcattagcctgtacctattagttctgtgtatctctgtgtgtgagt

SEQ ID NO: 89315 - DNA, 64 bp, Mus musculus
gtgtatgtatgtatgtatgtatgtatatgtctataatatgatatacatatataggtgtatatat

SEQ ID NO: 89316 - DNA, 80 bp, Mus musculus
cctgcctaaaggtgttctgtctgtgtgtctctgtccctaacaaagggctttgcatacctctgggtcaggggcattgaaga

SEQ ID NO: 89317 - DNA, 150 bp, Mus musculus
tatattatacatatttgtatatgtgcatacatatataatctgaatttttatatgtctattgccaacaaaaattcaattttatatatatgggtgtatatatatatgtgtgtatgtgtgtgtatgcatatatatgtatatatgtatatatat

SEQ ID NO: 89318 - DNA, 79 bp, Mus musculus
acttctgttagtttcactgtgtctctgtttagtttctgtttccaggatctatccattgatgacagtggagtattgaagt

SEQ ID NO: 89319 - DNA, 118 bp, Mus musculus
gcctgtccttactgtgatcctggttgtgtcagaattcccctgatcaagctttctctgtgattctgtgattatgggatcctgtgatcctgagattctgggtgtgtcagagttcttggca

SEQ ID NO: 89320 - DNA, 77 bp, Mus musculus
acaggcacttgactgagtctggatgatctgtatctaaggtcactcagtgactcactctcaaactacaagttcactgt

SEQ ID NO: 89321 - DNA, 100 bp, Mus musculus
gtatgtatgtatgtatgtatgtatgtatgtatgtatatatatacacatacacacacacatatatcactttatatatatatatatatatatatatatatac

SEQ ID NO: 89322 - DNA, 87 bp, Mus musculus
gcttcattacttctgttagtttcactgtgtctctgtttagtttctgtttccaggatctgtacattgatgagagtggggtgttgaagt

SEQ ID NO: 89323 - DNA, 119 bp, Mus musculus
gtctcacaagaaagagctctatctgggtcctttcagcaaaatcttgctagtgtgtgcaatgttgtcagggattggaagctgattataggatggatccccggatatggcagtctctagat

SEQ ID NO: 89324 - DNA, 82 bp, Mus musculus
ggataactggtggaggaagccatggaaaggagagggtgtatccctgggaaccgagcctttgacagcctctcactcactgtcc

SEQ ID NO: 89325 - DNA, 67 bp, Mus musculus
ctcccagtgaaaaatggaagactgctaagtggtttgaggctcactcagtgtttcagattaaagggag

SEQ ID NO: 89326 - DNA, 110 bp, Mus musculus
tggttcatttttatggtcatccaaaagcggcatgaattcaatgaattgaagtatgaatttttctgtctcaagcattgtgaagtatagcgctctgtggattccctgagtca

SEQ ID NO: 89327 - DNA, 80 bp, Mus musculus
agaggagtcagaacagacagaggttaacagagtgttattcttggatataagaacactcagtttctgtagactcatcctct

SEQ ID NO: 89328 - DNA, 80 bp, Mus musculus
atggctcatagtgcttcacagatgaccagagaccaagccaaaccagtgtgtctgtttctctgagactatctctgagctat

SEQ ID NO: 89329 - DNA, 87 bp, Mus musculus
ctgctttctttgtcactctcactgttacccacatcaaatggcaaaataacagtcagatggtaatagtcagggccacagaagaagcgg

SEQ ID NO: 89330 - DNA, 81 bp, Mus musculus
cctcctagcttcaggtctcagtcagagacactctcagaagagaaagtggttgatgtattgagggatgaggctctaagtggg

SEQ ID NO: 89331 - DNA, 57 bp, Mus musculus
tttatgggtctgtttgtgtacctgtatgtatatatacatatatatgtgacccatagg

SEQ ID NO: 89332 - DNA, 119 bp, Mus musculus
atgtgttggaggaggggagcaaaccctaggatttgcaggctctgatatctcaattcaaaaaaagattgtagatttatatgcccattttttgtgttttcttgctttactcaaacaggtcc

SEQ ID NO: 89333 - DNA, 115 bp, Mus musculus
gtatacatatgaaccttgtcaatgcctgtacttaggggttttgtgcatatatgtgcatatgcatgtgcatcttgttttttccttaggttaatgtagattccagcataattgtaac

SEQ ID NO: 89334 - DNA, 110 bp, Mus musculus
tatgtatttgtacacatacatgtatatatatatatacacacacgcatatatgtatatatatgtatgtgtgtgtgtgtatgtatgtatatatatatatgtatatatatatg

SEQ ID NO: 89335 - DNA, 72 bp, Mus musculus
cactccttcacttttgattatgtttttgtgcagtcatccagcacaaaaatgtgaaaattcaatgacagagtg

SEQ ID NO: 89336 - DNA, 109 bp, Mus musculus
gagcaggctgattcagaccttgctgccactgtgaatgagaccacctggggtggagccttcagacctagatggttctattgttctgtcacctgccaatgctcttctctgc

SEQ ID NO: 89337 - DNA, 82 bp, Mus musculus
gcttggagactggttctgagagaaggggtgtctgggagcagcaaattgctttctctctggctctctcaggagatctccatac

SEQ ID NO: 89338 - DNA, 93 bp, Mus musculus
aagctagcaggcagattttctcagagttcagcatcttggcccctaagtcagtcaccctgactctctgccctaaacctctccagccagtggctt

SEQ ID NO: 89339 - DNA, 76 bp, Mus musculus
ggtctgtactgaagcaggaatcatggaagaaagttggtcagtgactcattctctggctctctcctttacacagacc

SEQ ID NO: 89340 - DNA, 80 bp, Mus musculus
gattttccaattttattgagtataggtttctaaagtattatctattgattctttggatctcctgtctctgttgttatgtc

SEQ ID NO: 89341 - DNA, 116 bp, Mus musculus
gatggctgcagatgtcacaggtagaaaatgatgtaattctcatattgtatatgtcaaaaagtgggccatgtctgtgtgatagaatacgccagctctgaattttatctgagtgaatc

SEQ ID NO: 89342 - DNA, 137 bp, Mus musculus
tgcggagacatcccatttacagctttgtgctctaaggtctttcattctctgcataatgtctgactctgtgtctctgtatctgttctcatctactgaaggataaagcttttctgatgatggctgagcaaggcactggt

SEQ ID NO: 89343 - DNA, 66 bp, Mus musculus
gtatacatgtatgcatgtttgtatatttgttcaagtatgtgtgtgcgtgcgtgcgtgcgtgcgtgc

SEQ ID NO: 89344 - DNA, 97 bp, Mus musculus
atgttcatgtgtgtgtatctgtatgtgtaggagcatgtgagtgtatgtgtgcacatatgtgtatatgtatatgtgaatatgtggggaattgtgcgtg

SEQ ID NO: 89345 - DNA, 92 bp, Mus musculus
aggaaaagaaatacctggaagaggagtgaatttcttttttaacatgttaaataatttggaaattatagaaacattttttcctttctttttct

SEQ ID NO: 89346 - DNA, 99 bp, Mus musculus
gcatcagtgggttctttaggaagagactctttaggcttatgaattatttttgtttcattagtagattagttttgagctggagggatggttcaatggtgc

SEQ ID NO: 89347 - DNA, 84 bp, Mus musculus
tatatatatgtatatatatatacatgtatgtgtatatgtatatatatgtatgtgtgtatgtatatatacatatgtgtgtatata

SEQ ID NO: 89348 - DNA, 62 bp, Mus musculus
ggcttttcactctgtgcactgatttgtgtgtgtgaccacagactgtacagggttgagttgtc

SEQ ID NO: 89349 - DNA, 107 bp, Mus musculus
tattgaagatcagccttagtccgtggtgatctgacaggatgcatgggataatttcaatatttttgtatctgttgaggcctctattatgactgattatattgtcagtg

SEQ ID NO: 89350 - DNA, 72 bp, Mus musculus
ttgaaaatagggctgaagagatggctcagcggttaagagcactgactgctcttccagaggtcctgagttcaa

SEQ ID NO: 89351 - DNA, 63 bp, Mus musculus
ttttgttgacaggactctgacatagctctctcttgtgagtctatgtcactgcctgtcacagaa

SEQ ID NO: 89352 - DNA, 96 bp, Mus musculus
gatcagccttggtccatggtgttctgataggatgcattggataatttcaatatttttgtatctgttgaggcctgttatgtgaccaattatatggtc

SEQ ID NO: 89353 - DNA, 146 bp, Mus musculus
tgtgcatgtgtacatgggtatatataattgcaggatattaagtgagtatgtcatgtgtatatgtatatgtatgaatatatgcatatatgtatatatgcatttgtgtatatgtgcatatatgcatattatgcatgtataaacatgtg

SEQ ID NO: 89354 - DNA, 70 bp, Mus musculus
agatcaagtgaccataggtgtgtgggttgatctctgggtcgtcaattctattccattggtctacttgtct

SEQ ID NO: 89355 - DNA, 60 bp, Mus musculus
tctccataggaggcagagagaaaatgggatgtctcccactctccctctgtctccaggaga

SEQ ID NO: 89356 - DNA, 66 bp, Mus musculus
cttgggcatactgtcacaatctctgttagttcatatttgtgtctgaagggatctagtaggcctgag

SEQ ID NO: 89357 - DNA, 80 bp, Mus musculus
caaacacacacactgaaatggacatacacgcatgcacaattcttgctctgtatgtgtgtgtgtgtgcctgtgtctgtttg

SEQ ID NO: 89358 - DNA, 89 bp, Mus musculus
ttaagcctttatttaccttacttgtatgattattattttgcagtgatgcaggaaaatgtagtgatattgttgtttacgtaaagggttaa

SEQ ID NO: 89359 - DNA, 74 bp, Mus musculus
tgttggtgggattgcaagctggtacaaccactttgcaaatcagtctggctgttctatctgtgggcccagcaata

SEQ ID NO: 89360 - DNA, 91 bp, Mus musculus
gtgagactgattgttgttctttgaatttggatgtatagtttgcactgtacactagattatgtttgaaaaagaaaattgccacagtatatac

SEQ ID NO: 89361 - DNA, 85 bp, Mus musculus
ggccatggtggtctgataggatacatgggacaatttcaatatttttgtatctattgacgcctgttttgtgaccaattatatggtc

SEQ ID NO: 89362 - DNA, 115 bp, Mus musculus
cattaacttggatccaatggctgactttctggcctgaggctctatgtttttaattatatgatccttccaaagtggaccagagatatggtgcggttatttggaggccagtttcttg

SEQ ID NO: 89363 - DNA, 117 bp, Mus musculus
gtttctcattgtggctttaatttgacgaccagtgaagatgaatatattttcatatacttgttgtatttgccggtattcatttatgaaatgtctgtccaaattttttcatggagttgc

SEQ ID NO: 89364 - DNA, 76 bp, Mus musculus
gcagacagacagacacacactgagaacttttcatgagtacccagaaaggctcaaggtggactttctgttggttgac

SEQ ID NO: 89365 - DNA, 93 bp, Mus musculus
atttatatgtatgtgtgtgactatgtttatatatatatgtacatgtatatgtatatatgtgccacaaatgtataaatgtgggcatatcagata

SEQ ID NO: 89366 - DNA, 59 bp, Mus musculus
cttatgtgtctctgtgtgtgtgcatgcccatgcgcacatgttctagcagaagccagaag

SEQ ID NO: 89367 - DNA, 98 bp, Mus musculus
ttgatgctctggcagttgccatcaatgagtttgagggtgtcatgaaactagtcagccatgacttcagactcatccagcaagttgcacaggagaattgg

SEQ ID NO: 89368 - DNA, 65 bp, Mus musculus
gtgtgtgtgtgtgtatgtgtagtgtgtgtgtcaaagacagacagaagacagacagacagacagat

SEQ ID NO: 89369 - DNA, 73 bp, Mus musculus
gcctacagagactctgtgtgtgtgtgcgccggcgcgcgcgagtgtgggcgtgcacatatgcatgtgtgtatgc

SEQ ID NO: 89370 - DNA, 84 bp, Mus musculus
gcagttttctccatgaaggtcagagatgagtgagtgctgctattgtggacagcacaaatgtcatctgggctgaacctctactgc

SEQ ID NO: 89371 - DNA, 90 bp, Mus musculus
gtgtggtggtaggtgggactctgtatgtctgtggtcttcctgagccatggggtagagggcagatgtatgggatccttcccctgcctgcac

SEQ ID NO: 89372 - DNA, 85 bp, Mus musculus; identical to SEQ ID NO: 57439

SEQ ID NO: 89373 - DNA, 117 bp, Mus musculus
ggccataattatgaattgaaaaaagaaaatgtacttcagatacttcagagaaggcagtgaccactgtctcaataactgctgcaaagtctgtgtacatcttcaaagcttcatatggtt

SEQ ID NO: 89374 - DNA, 85 bp, Mus musculus; identical to SEQ ID NO: 57470

SEQ ID NO: 89375 - DNA, 73 bp, Mus musculus
tttgtctgcatgttcatatacatgtatgtatgtatgtatgcatgcatgtatattttgtgcatgcagtaccaga

SEQ ID NO: 89376 - DNA, 99 bp, Mus musculus
aaatattctattgaggtaaggccagttctggaaaggaaagcaggggattttcttgttcacatttgcagaactgaggtccaaattccaagatttgtgttt

SEQ ID NO: 89377 - DNA, 79 bp, Mus musculus
acttctgttagtttcactgtgtctctgtttagtttctgtttctaggatttgtccattgatgagagtgggatgttgaagt

SEQ ID NO: 89378 - DNA, 85 bp, Mus musculus; identical to SEQ ID NO: 57470

SEQ ID NO: 89379 - DNA, 85 bp, Mus musculus; identical to SEQ ID NO: 57470

SEQ ID NO: 89380 - DNA, 83 bp, Mus musculus
ccttttcaatttatgtcacttgatttcctttaggtgtcttattgctctagctggaactcaaagtactaggttgaatagatagg

SEQ ID NO: 89381 - DNA, 94 bp, Mus musculus
ttctaatacacatatgtgtatatgtgtatgcatatgtatgtgtatatgaaagtatgtgtgcatttgtatacacatagaacatatttgtgcagaa

SEQ ID NO: 89382 - DNA, 98 bp, Mus musculus
ttgtctttattaaagtgcttgttatatgtatgtatgtatgtatgtgatatatgtctgcatgtacatatgtatgtatgttcatgtttggatgaggagag

SEQ ID NO: 89383 - DNA, 67 bp, Mus musculus
tctgagggagagttttgtatttctttcaatatattttgtgaaggagatattaaatatgccctttaga

SEQ ID NO: 89384 - DNA, 92 bp, Mus musculus
tgatgagttgaaactagtgtgtagaagagagaattttgacagcacacattgaagctgtgttgtgattcgatcctggatgctgatttccatta

SEQ ID NO: 89385 - DNA, 115 bp, Mus musculus
atgtatgtatgtatgtatggtagtatactgaacatatatcacgctcatttatatattgatatattatacccaacatgttccagaagtgtctctaccgattgtatgcttcaagcat

SEQ ID NO: 89386 - DNA, 89 bp, Mus musculus
gtgcatatgtattcatgcatgcatgcttgagtgcctgtgcttctgtgtgcatgtgcatgtgcgtgtgtgtggtgtatatatctcaagta

SEQ ID NO: 89387 - DNA, 85 bp, Mus musculus; identical to SEQ ID NO: 57470

SEQ ID NO: 89388 - DNA, 59 bp, Mus musculus
gtctgtctgtctgtctgtcttgtgctttgagacagagtctcccacagtgcagctcaggc

SEQ ID NO: 89389 - DNA, 95 bp, Mus musculus
gtatctcttatgcatttatatcaaatgtatgtatgtatgtatgtatgtatgtatgtatgtatggcatatgtgtgtgagggtgtataagttcatac

SEQ ID NO: 89390 - DNA, 97 bp, Mus musculus
cactcttgtcttgccagggtctcactgggcactgggggaaggtgacaaatcacagtttactaatctagaggcagacagaacttgcttgacaggcatg

SEQ ID NO: 89391 - DNA, 68 bp, Mus musculus
ctgtgagtcactggggcagggtctcagccactctcactcagcggctacacccgctctcagtgctctag

SEQ ID NO: 89392 - DNA, 94 bp, Mus musculus
tctttccttatgaaaatgtagcaatgcaggcaaggtgtgatgataatcaaagaactcactaagctgaggcaagaacattaacatgagtctaaga

SEQ ID NO: 89393 - DNA, 56 bp, Mus musculus
tctctgtactggctggctttgtgtgtctccttgacacaagccagtcaccacagaga

SEQ ID NO: 89394 - DNA, 74 bp, Mus musculus
acaggcacacacatgtgcacacacacactcagtgagaaatgaagagtacagatgtggtcatagagtgtgctggt

SEQ ID NO: 89395 - DNA, 80 bp, Mus musculus
acttctggctctgactctctcacgccataaagagacacagccatgagctgtggggtggggtggggggtgaggggtggggt

SEQ ID NO: 89396 - DNA, 79 bp, Mus musculus
gagaaatgacacagtagagtgtgtggcactggtaggactgacaactataggtgcctatctctctaagtcatgagatttc

SEQ ID NO: 89397 - DNA, 75 bp, Mus musculus
actatttaagtatgtagaaatgtatttaaatatgtagatatgtatttaaatatgtagatatgtatttaaatatgt

SEQ ID NO: 89398 - DNA, 87 bp, Mus musculus
gaagtggtgactggtgaggaaatgagttttcaaggctgagattttttttctttcattagaggcatgatttcccaaacatcccacttc

SEQ ID NO: 89399 - DNA, 111 bp, Mus musculus
gcaggaagattgagccatggatatagtatcagagaatatgaagttaggaaaataggaactgattatatatataactttgctttatctccattcaaaacctgtaatttttcc

SEQ ID NO: 89400 - DNA, 78 bp, Mus musculus
gtgaggcaggtctctcagtcagactcagagaactgacagggcaagcagctccctccctctgggtatccctgtctctac

SEQ ID NO: 89401 - DNA, 78 bp, Mus musculus
gtgtccatggtcaggaagcagagagagatgagtcagatgcacacaggcagtctcacactgtgtccatggtcaggaagc

SEQ ID NO: 89402 - DNA, 80 bp, Mus musculus
tcctctgactctcacagttagtcaaaaggttcataaaggagagccccatacctagtctgggaggagatgaagtcagagga

SEQ ID NO: 89403 - DNA, 101 bp, Mus musculus
cttgtgatttttccctgttgtaaaactatttattacatgtatgtatgtatgtatgtatgtatgtatgtatgtgtctatggacacacaggtagaggtctgag

SEQ ID NO: 89404 - DNA, 82 bp, Mus musculus
ctctcctgcgtgtgtgtctgtctgtcattcatccacgctttgcccacccgcgtcgagagaccagttacatgcagacacaggg

SEQ ID NO: 89405 - DNA, 114 bp, Mus musculus
ctggagctgtggattcctgtgaaccactatgcgtgtgtgagaagtcaaaccagcaccttctgcaacagcaactggcccttctctccgcccatggaccaacaattttacttctag

SEQ ID NO: 89406 - DNA, 58 bp, Mus musculus
atatatacatgtatatatgatatgcatcatacatatataaatatgtatgtgtatatat

SEQ ID NO: 89407 - DNA, 119 bp, Mus musculus
tctggttttgtgtgctctctacatatatgcatgtatatataagtggatatatatttatgaatatgtgtgtatatatatatatgtgcatatgtttacacatgcagatatgtgaataacta

SEQ ID NO: 89408 - DNA, 110 bp, Mus musculus
ttgaagatcagccttagtgcatggtgatctgataggatgcatgggacaatttcaatatttttgtatctgttgaggcctgttttgtgaccatttatatggtcaattttgga

SEQ ID NO: 89409 - DNA, 67 bp, Mus musculus
atgaggacaacagaaggtggtggtggtttgaatgagaagcatcccccactgtctctgtctctggcat

SEQ ID NO: 89410 - DNA, 81 bp, Mus musculus
gtcaaggagctcaggccaatgcttgtttgtgagcatctgcatcttgtctcagtcagctgttggtagagcctctcagaggac

SEQ ID NO: 89411 - DNA, 93 bp, Mus musculus
tccatgttgatctgataggatgcatgggacaatttcaatatttttgtatctgttgaggcctgttttgtgaccaattatgtggtcaattttgga

SEQ ID NO: 89412 - DNA, 85 bp, Mus musculus
ggccatggtggtctgataggatacatgcaacaatttcaatatttttgtatctgttgaggcctgttttgtgaccaattatatggtc

SEQ ID NO: 89413 - DNA, 93 bp, Mus musculus
tttgagggatgtttgtgtttcctccttaaggacttgttcctgtttagcagttttcttctgtatttctttaagtgagttattaatgcccttaaa

SEQ ID NO: 89414 - DNA, 107 bp, Mus musculus
agatataactgctcactttaggcccagtgctataaagtttctttttaaattgtctcattaatccaggatacagtggcactgggggggggggtcgacctaggatatct

SEQ ID NO: 89415 - DNA, 100 bp, Mus musculus
ggaatttgatggggaaaaatggcttaggggcaagcattccaaggtctctaactctctcaaagtcctgttgtgagtttctgtattagttttcatctgtttc

SEQ ID NO: 89416 - DNA, 103 bp, Mus musculus
gatttatttactgtttaatattgggcaagtatcttgtgggccctatatattctgtgagcttcttgtttttactgtgcctaccttgagtagtgaattttgaatc

SEQ ID NO: 89417 - DNA, 105 bp, Mus musculus
aaactgacagaacttgttctacatttgagttgtagtggtgagaaaaaatgtattttttttcttgcacagtaaaagaatgagttggatgtactttctgtgatgttt

SEQ ID NO: 89418 - DNA, 78 bp, Mus musculus
gagtatgtatgaattatgtgcatatgttgtatatgtatgtatttatgtaagtgtgcatgtgtgtgtttgtgtgttctc

SEQ ID NO: 89419 - DNA, 75 bp, Mus musculus
ttgggcactgcttccagaatgacaagcacctgggtggggtaggtttgcgcatgctgtcagcacagagagtcctaa

SEQ ID NO: 89420 - DNA, 70 bp, Mus musculus; identical to SEQ ID NO: 69586

SEQ ID NO: 89421 - DNA, 91 bp, Mus musculus
tatgctttggttttgactaacagggtttacggctggtttatgttgagtcaaacatattgggaccaggcatcaatggtgaaatctagacata

SEQ ID NO: 89422 - DNA, 94 bp, Mus musculus
aagtgtaatttcatatatgggtgcatctttctagtttatgtatatatgtttccttgtgcatatgtgtgcatgtatgtgtgtgtgtttgtgtatg

SEQ ID NO: 89423 - DNA, 98 bp, Mus musculus
catttttatatgaacattttaatgtgaagttgttgaaaacatgaaaatctatttatatattttatgggaattcaatagaaatagtttgtatagaagtg

SEQ ID NO: 89424 - DNA, 105 bp, Mus musculus
ttattggggaaattgagaccatccatattaagaattttaatgtacagtgtatattgacttctgtgattttgttgttaagatgagaggttttggcctttctattag

SEQ ID NO: 89425 - DNA, 85 bp, Mus musculus; identical to SEQ ID NO: 57439

SEQ ID NO: 89426 - DNA, 76 bp, Mus musculus
tagatcattcactcaatcatggtaaaccctgttctcctgggtgggtttggtgtgtgtgtgtgtctgtgtgtatctg

SEQ ID NO: 89427 - DNA, 92 bp, Mus musculus
ttcatggcatcaagcagagctgacagaagtgtcagagaagtaactcgttgcccactgcattttcctgtgagccattctggtcatgccaagga

SEQ ID NO: 89428 - DNA, 114 bp, Mus musculus
catgagtttggcccatgcaagatgacaatgaagctagaatttgattttgtttttaaatataatccaagctcaagcctcgtttaaaatttgctatcagagtgtactaaatgtgtg

SEQ ID NO: 89429 - DNA, 71 bp, Mus musculus
ctacagtctgagtcactgtctttattctggaaagagtagtctggctatgtgagggtgactagcaggtttag

SEQ ID NO: 89430 - DNA, 76 bp, Mus musculus
tatatatccatatatatataggtatatatatatgtgtgtgtatgtatgtatgtatgtatgtatgtatgtatgtatg

SEQ ID NO: 89431 - DNA, 122 bp, Mus musculus
ggtacagctacagactttccttttgcttccttctctttttgtatctgtgtgtatgcaatgtatggatgtatgtttttgagtaggcatggtcatggggtcagtgccacagtcaacggtgggaa

SEQ ID NO: 89432 - DNA, 85 bp, Mus musculus; identical to SEQ ID NO: 59674

SEQ ID NO: 89433 - DNA, 109 bp, Mus musculus
ggtgaccttgaaggagtttttactttcggttatctagctttatgaagaccaatacactcatacagctagataaccaaagataacaactcgcttccctcacaaggctgcc

SEQ ID NO: 89434 - DNA, 108 bp, Mus musculus
ccttgtgagggaagcgagttgttatctttggttatctagctgtatgagtgtattggtcttcataaagctagataaccgaaagtaaaaactccttcaaggtcaccgagg

SEQ ID NO: 89435 - DNA, 78 bp, Mus musculus
tgataccagaggtagtatgtatgtatgtatgtatgtatgtatgtatgcatgtatgtatgtatgtatttttggcaagca

SEQ ID NO: 89436 - DNA, 110 bp, Mus musculus
aataacctgcctcccttcaacatggtctacagtgtaaggaccagagatgtgacttttctgagaagaccctgtgcacaagtgtggaagtgtggaggagaaagcagattatt

SEQ ID NO: 89437 - DNA, 112 bp, Mus musculus
gcccttaccagcttttctctgaagattcagaacttgtgtgattgaaatcctttctcacagtagtgtgaaagcacaacataaggctctgtggagatggttctgtgatggatgc

SEQ ID NO: 89438 - DNA, 81 bp, Mus musculus
ggcattggataaccagttgggaagtacttaccttgtcctggggaagactaactctccctctctcagtagtcactagttgcc

SEQ ID NO: 89439 - DNA, 100 bp, Mus musculus
gacaaatactggcagcatttcagactgcctctaggaagtgagagtgcagagtctgctctgtgttgtcacgcatttccgggttgtaaatgctgcctttgtc

SEQ ID NO: 89440 - DNA, 89 bp, Mus musculus
ttggtagtttcagggtcaacatcagagaggagagatctggaacacagatctcacagagctcaatgacaccactgaacagacaaaaccag

SEQ ID NO: 89441 - DNA, 94 bp, Mus musculus
ttgggaataaaaagtgaattttgggggctaaagagttggctaagtagttatgagtactgactgctcttccagaggtcctgggttcaattcccag

SEQ ID NO: 89442 - DNA, 107 bp, Mus musculus
tacttgtttggaagaagtgtaatcttggttttgatttctaggaatctttttatttttcaatgctagggaccaaatccaggaccttgtgtgtgctatacaagcctgta

SEQ ID NO: 89443 - DNA, 86 bp, Mus musculus
tatctgtctctctgtctgtctgtctatctatctatctatatatctatctatggacaagcagatatctatctatagagatatagata

SEQ ID NO: 89444 - DNA, 90 bp, Mus musculus
ggctaattttatgttatccagattgcattaaaggatacacagatagctggtaaaatatttgagtgtttgtatttctgtaagaaattagcc

SEQ ID NO: 89445 - DNA, 105 bp, Mus musculus
tcctgagccacattcaaaggacttcatactctacctcagagacactcagacagccatgttttgggctcctctcttcacaagaggaagaacatgaagcagctagga

SEQ ID NO: 89446 - DNA, 119 bp, Mus musculus
atctagattttctaggtttgttgagtattgacttttgtagtaggatctgattttttttttttaatttctgcagtttctgttatgtcttacttttcatttctgattttgttaatgtggat

SEQ ID NO: 89447 - DNA, 80 bp, Mus musculus
tttcgtgggtggtgactgccaaaagctgtggctgcaacagtaaatgaaaccttcacagtccctgacagtctctttcgaaa

SEQ ID NO: 89448 - DNA, 108 bp, Mus musculus
gtgtgtatgtatatgtgtatatgtgtagaaatatgtatgtatgtacctatgtatgtatgcatgtgtatgtacatatatatgtatgtatgtgtgtacatatatacacat

SEQ ID NO: 89449 - DNA, 116 bp, Mus musculus
gccttagtgcatggtgatctgataggatacatgggacaatttcaatatttttgtatatgttgaggcctgttttgtgacctattatgtggtcagttttggagaaggtaccatgaggt

SEQ ID NO: 89450 - DNA, 105 bp, Mus musculus
cttttaaatgaatcaatgaagagaaagtgcttagagcaacagccaataagtgtcattttgttgttgtaattctaaaccactcattcatagatttgtgatacaaag

SEQ ID NO: 89451 - DNA, 64 bp, Mus musculus
gggactgtgtctgactctttgactgtatttggaaccatttcctcctacagagttgactcatccc

SEQ ID NO: 89452 - DNA, 75 bp, Mus musculus
gtggataatgcatgcatgtatgtatgtatatatataagtatgtatgtatgtatgcatgcatgtatgtacatatac

SEQ ID NO: 89453 - DNA, 101 bp, Mus musculus
ctgtaaatccctagcatgttgagtgtgagatcttgcctagaaaatgtcagttttcactgtggacaaatattccacacttcagcatttgagcaatataatag

SEQ ID NO: 89454 - DNA, 98 bp, Mus musculus
ttagcattcatgctttctgtctgcctctcagtttctttcatcgatgctgcatgcaataatgaacacggtgatagatggtagacgaggacaaatgttga

SEQ ID NO: 89455 - DNA, 58 bp, Mus musculus
atatgtgtatatatatgtatgtgtatatatatatacacatatgcatatatatatatat

SEQ ID NO: 89456 - DNA, 93 bp, Mus musculus
tccatggtgatctgataggatgcatgagacaatgtcaatatttttgtatctattgaggattgttttgtgaccaattgtatggtcaattttgga

SEQ ID NO: 89457 - DNA, 88 bp, Mus musculus
gaagacaactgaggaaggagttctgtgcatgcatggtggctaaattgggtcaacatcatgtgtcttttttttttttttggtcctctac

SEQ ID NO: 89458 - DNA, 87 bp, Mus musculus
ctcttaaccacacatacacacacacacacacatatatatgtatgtatgtatatatatggatggtgacgtggttataggtaaaagtgg

SEQ ID NO: 89459 - DNA, 76 bp, Mus musculus
tgtataaatatataaacatatgtatatatacatacacacatatatgtatgtatacagatatttatttatttatata

SEQ ID NO: 89460 - DNA, 81 bp, Mus musculus
ctgtctgtctgtgtctgtgaaattcatactttctttccaggagcaactcttgcagcagtagagagcactgcagaggtacag

SEQ ID NO: 89461 - DNA, 72 bp, Mus musculus
tgttgtcactagagatcggcttgaggtttcaaagcccatctactaagcctagagtctctctctgtgcctaca

SEQ ID NO: 89462 - DNA, 68 bp, Mus musculus
ttatgaatcattatgtatgtatgtatgtgtgtgtatatatatatatgatatgcaggatggtattatga

SEQ ID NO: 89463 - DNA, 85 bp, Mus musculus
ggccatggtggtctgataggataaatgggacaatttcaatatttttgtatctattgaggcctgttttgtgaccaattatatggtc

SEQ ID NO: 89464 - DNA, 85 bp, Mus musculus; identical to SEQ ID NO: 58391

SEQ ID NO: 89465 - DNA, 85 bp, Mus musculus; identical to SEQ ID NO: 57439

SEQ ID NO: 89466 - DNA, 100 bp, Mus musculus
ggacaaaatatggctattctctttcctctgaggaaattatgtttataattttcatgatgattttgatgggcttgagagcagagtagtcttatgtgtgtgt

SEQ ID NO: 89467 - DNA, 58 bp, Mus musculus
atacatacatatacatacacatacatatatacatgtatgtatgtatatatgtatgtat

SEQ ID NO: 89468 - DNA, 85 bp, Mus musculus; identical to SEQ ID NO: 57439

SEQ ID NO: 89469 - DNA, 115 bp, Mus musculus
ggttgttgttgttttggaaatttgtcttattttctctttaacttgtatataaattttttatgctaaagagttggggatttttcagttgataaataaacaagaggacttttgtatc

SEQ ID NO: 89470 - DNA, 200 bp, Mus musculus
atgtatatatatgtatatgtgtatgtgtatgtgtatatatatatatatatacatatatatgtgtatatatatgtatatatatatatgtgtatatatatatatatatatacatacatatatacatatatatatatatatggctgtacgtatatatgtatgtatacatatatgtatgtatatatgtatatgtgtatgtgtat

SEQ ID NO: 89471 - DNA, 110 bp, Mus musculus
gctattataatgtagtttctatcttttatgtggaagattaaatgtattgatctatatatatattgaatcatttctgtatctttatgatgaaactaactttattatagtgg

SEQ ID NO: 89472 - DNA, 79 bp, Mus musculus
ctggtgtgtttgggacaaggggagtggacaatgcacaggacatggcttactttatttgtaattctgaactcacagacag

SEQ ID NO: 89473 - DNA, 77 bp, Mus musculus
ggcattcttctgggactcctaacagtggaagtaggggtgtgtctcactctttgtctgctttttgggatccttttgct

SEQ ID NO: 89474 - DNA, 113 bp, Mus musculus
acaataattttgggggctttgttttccaaaggaactatatcattctgaatatatatatatatcaagttggtgctatgttcaaatgtacatgaggctcaatcagatgttcttgt

SEQ ID NO: 89475 - DNA, 79 bp, Mus musculus
ccaaagattatccctcctgcagtgaagacagattccaggggaaacaattctactgtctgtctttgtctctaatttttgg

SEQ ID NO: 89476 - DNA, 113 bp, Mus musculus
gtagtcacacatcattggcaaaaactgatttccccttctcagcaggtatcagtagtaaatattttctttgttagaagagagattgtctagtttgatcctctgttgtttgttac

SEQ ID NO: 89477 - DNA, 115 bp, Mus musculus
actagacatggaacaaatctatgagtataacagaatatcgatagaatttatttcatttttaaagatcagttgtgttttgttttactctaggtctctgagctacccaatctctggt

SEQ ID NO: 89478 - DNA, 86 bp, Mus musculus
atcactttagttggaatgacatgagacaaaatttggaaaataaataattttccaggagttatgtgaaattcttgatctgaattgat

SEQ ID NO: 89479 - DNA, 85 bp, Mus musculus; identical to SEQ ID NO: 57439

SEQ ID NO: 89480 - DNA, 85 bp, Mus musculus; identical to SEQ ID NO: 57439

SEQ ID NO: 89481 - DNA, 97 bp, Mus musculus
gtataaaaagtttgatgcttgatttgacaaattacattcagatccagcacactctctgctgtctgtgtctgtctgtcaattcccactgactctatgc

SEQ ID NO: 89482 - DNA, 70 bp, Mus musculus
cttgagtctgagtctctctctagcttagaacttcaacaggtaaattaggctggcgaggctgggcattgag

SEQ ID NO: 89483 - DNA, 87 bp, Mus musculus
cataggataatgtttgccacagactctctgggtccctggtctgtgaagaacgggatttcttaggcagatgggcaaagaattcggatg

SEQ ID NO: 89484 - DNA, 64 bp, Mus musculus
tattattattattattattattattattattattatgatgatgatgatgatgatgctgatgatg

SEQ ID NO: 89485 - DNA, 97 bp, Mus musculus
aatgctaaatgaggtatagatttctttgtaattaaatataaatgctaatttatcttttaattacaagttatctcagttaccaggcagatttagcatt

SEQ ID NO: 89486 - DNA, 64 bp, Mus musculus
ccctctgcatctctgtgtctcactctggaggtatcttgaagtaagaaccactgacgtagggtgg

SEQ ID NO: 89487 - DNA, 74 bp, Mus musculus
ggccgggagggtggccggctgtctgaggcccaaaaagggtgctgcctcagtggctctgtggctctgcctgtccc

SEQ ID NO: 89488 - DNA, 90 bp, Mus musculus
ttttggtgtgtatgtgtggatgtatgtacatatgtatgtatgtatgtatgtatgtatgtatgtatatgcttttaagggtatccatttaaa

SEQ ID NO: 89489 - DNA, 75 bp, Mus musculus
gagggactcaaggctccagtcacatatgtcgcagaggatggcctgtgtgacatcagtgagaggagagaggccctt

SEQ ID NO: 89490 - DNA, 118 bp, Mus musculus
cctaatttctttctgtggctatttatcatttgtataaagaagactagtgatttatttgagttcattttatatctggtcattttcctgaagttgtttaaaagctgtagaagtttcctgg

SEQ ID NO: 89491 - DNA, 85 bp, Mus musculus; identical to SEQ ID NO: 57439

SEQ ID NO: 89492 - DNA, 82 bp, Mus musculus
ttgattgggttatgccatgaacactattagtgcagtctgcagaggtagatggatggatggattcatgtgtagtattcttcaa

SEQ ID NO: 89493 - DNA, 68 bp, Mus musculus
gtgtatatataaatacatacatacatatatgtatatgcatatatgtgtatatgtatttacatatatgt

SEQ ID NO: 89494 - DNA, 91 bp, Mus musculus
ttgtcatgtctcccctttcattactgattttgttaattaggatactgtctctttgaactttagttagttcggataagggtagttatgatga

SEQ ID NO: 89495 - DNA, 97 bp, Mus musculus
gtatgtatacacacacatatacagatacacacatatacctatatatatctatatatgtatatatgagatttatatgtatatatgtgtgtatgtatat

SEQ ID NO: 89496 - DNA, 99 bp, Mus musculus
agtgtgaacagagcatcaaccaagagagcacttcaggggtgggaactgtctctgcattcatgaagttttccaggtttgccttcttttctgctcatctct

SEQ ID NO: 89497 - DNA, 112 bp, Mus musculus
gtgtgataggtcattgttactttgattttattttctcttatggcttttcagaatttttgaatattttgaaggtacatagagtctgtgagacattttaatcaattattatacc

SEQ ID NO: 89498 - DNA, 116 bp, Mus musculus
atgtatgtaaaaataaattatatatccatatgtatatatatatatatatatatatgtgtgtgtataccatgtgtatgtatatatatataccatgtatatattatctttacacatat

SEQ ID NO: 89499 - DNA, 67 bp, Mus musculus
ataaaatgtgtatgcatatattatatatatacatgtagtatatacatatctgtagcacacattttat

SEQ ID NO: 89500 - DNA, 116 bp, Mus musculus
gggaactcagcccagcatacatacctctgaacattttattaattggatatgatatgtaactacttttatgttaattttgtgcagtgattgttgtgtgtttgttttgttgtttttgt

SEQ ID NO: 89501 - DNA, 83 bp, Mus musculus; identical to SEQ ID NO: 57504

SEQ ID NO: 89502 - DNA, 96 bp, Mus musculus
ctatgtatctatgtatctatgtatctatatagctatatagctatatagctatatagctatgtatctatgtatgtatatatatatttagcagatata

SEQ ID NO: 89503 - DNA, 101 bp, Mus musculus
ctatgttgtacatgtgtgagcatgaatgtgtgtgtgtgtgtgcatatatatatatatgtatacacacacacatacacacacacacacacacacacatatgg

SEQ ID NO: 89504 - DNA, 97 bp, Mus musculus
tattttatattccccattggtgatgtttgctgcaatatatttgattttttcatagttaattgcatattatggacatttaatgtggaaaagtaaaata

SEQ ID NO: 89505 - DNA, 114 bp, Mus musculus
ggtctctttcttgctatttaatgtaccattgctcaagaattgatgctgtccagttttcacagaagattgaaagctgagcatttcctgtgctttatggtgcttgtcgctttggcc

SEQ ID NO: 89506 - DNA, 106 bp, Mus musculus
tgaatatatatgtttgagtgtttgggggccaagatcacataggggaatgatgacaggcagtacattatctcagacctagagtctccctcatgtttacaagtattca

SEQ ID NO: 89507 - DNA, 85 bp, Mus musculus; identical to SEQ ID NO: 57439

SEQ ID NO: 89508 - DNA, 113 bp, Mus musculus
gtatgaaaaaatgttcctattttatatgtatttctgaatatatatttctgaatatatgatctgaatatatgatctgaatatatatatatttgaatatatacatttataaatat

SEQ ID NO: 89509 - DNA, 79 bp, Mus musculus
acttctgttagtctcacagtgtctctgtttagtttctgtttccaggatctgtccattgatgagagtggggtgttgaagt

SEQ ID NO: 89510 - DNA, 111 bp, Mus musculus
cagttgttggtgtgtatgtgtgtatatatctatgtatgtatgtatatgtgtgtatgtatgtgtgtatatatgtatgttgtatgtgcatttatatatgtgtctatgtgtctg

SEQ ID NO: 89511 - DNA, 74 bp, Mus musculus
atgtgtatgtatgtgtatatgtatatacatatatatgaatacatgtatatatgatatacacatattatacatat

SEQ ID NO: 89512 - DNA, 109 bp, Mus musculus
cattagtgtccctgggcccaggatgatggttggctgtgagtatctgcatctgtattggtcaggtagaacctctcagggaacagccattacaggcttcagtcagcaagtg

SEQ ID NO: 89513 - DNA, 68 bp, Mus musculus
tatgtatatatatacacacacacatacatatatatgtatatatatgtgtgggtgtatatatatatatg

SEQ ID NO: 89514 - DNA, 95 bp, Mus musculus
gtggccaagatgatgatggttataataatggtgatggtgatgagagtgatgttgactatgatgatgatgatgatgatgatggttataatggtgat

SEQ ID NO: 89515 - DNA, 66 bp, Mus musculus
atatgtcacaaattggcagaattccctacatgagttgatctcatatactgtcagtttctgacatat

SEQ ID NO: 89516 - DNA, 121 bp, Mus musculus
atacatatatatgtatctcctcccaaatacatatcctcccaattatatatatatatgaaatatatacatatatatggaatgtatataaggaatatatatatatgtatatatgtgtgtgtgt

SEQ ID NO: 89517 - DNA, 115 bp, Mus musculus
atatatacatatatatatattccttatatacattccatatatatgtatatatttcatatatatatataattgggaggatatgtatttgggaggagatacatatatatgtatatat

SEQ ID NO: 89518 - DNA, 96 bp, Mus musculus
ttgcttttccttttttggacagcatacagaaatacttttgattttttaaaataatcatgtgggtggttgtgtctgtgtgggatatcgtgtgagcaa

SEQ ID NO: 89519 - DNA, 70 bp, Mus musculus
cagcaagaattgggcctttggaaggctattgatgcaggcgcacaaacacctctaactgtctctctggctg

SEQ ID NO: 89520 - DNA, 103 bp, Mus musculus
ggagagcagtcacgaaaagcttttgcgtctccctggggcttgggatctcactttctcagtatctctttcaggttggcaggagcattgagcctgacacctcttc

SEQ ID NO: 89521 - DNA, 113 bp, Mus musculus
gaaattttgatggggattgcattgaatctgtagattgcttttggcaagatttttattatattaatcctgccaatccatgtgcatgagaaatctttccagcctctgagatcttc

SEQ ID NO: 89522 - DNA, 85 bp, Mus musculus; identical to SEQ ID NO: 57439

SEQ ID NO: 89523 - DNA, 102 bp, Mus musculus
caccctgtgaggactgggtgtgtgtcttcactttccttacttagaatgtgacatgccatttgaacaaggttgattactttaacacagtagccctccagagtg

SEQ ID NO: 89524 - DNA, 108 bp, Mus musculus
tgtggtgctgtatacacaaatgtctaagttttcaacagtctatatgattttcaatataagcatcaaatttaaaacttgtttaatttttgtctgtacataaggaccaca

SEQ ID NO: 89525 - DNA, 78 bp, Mus musculus
gactaggccattctcagctacatatgcagctagagtcatgagtctctctgtgtgttttctgtgactggtgatttagtc

SEQ ID NO: 89526 - DNA, 73 bp, Mus musculus
ctgggagctctcctgtgtggaatgttctctgagagaccggggatacaagatggcgttctcacctgagtcccgg

SEQ ID NO: 89527 - DNA, 91 bp, Mus musculus
tgccttgctacaaagcttgggaagagactagggatttggatttggaagaaaagagacagagtgactatctctctgtgtggttgcaagtgca

SEQ ID NO: 89528 - DNA, 125 bp, Mus musculus
cctggatagttctctagattttattggggaattcccttattagtgggacttctcttgaggggcctgatctctgggaccactgttaaatgaagctttgccttctctctgttgagttaaatccctaa

SEQ ID NO: 89529 - DNA, 90 bp, Mus musculus
gcttcacttggaatgagttcttgggagtgcaggtggtcatgcaaaactatggctcatacctccctctctgactctctgcctcagatgtgc

SEQ ID NO: 89530 - DNA, 68 bp, Mus musculus
gtgttcaggggtatgctcacatgtgtgttgggtacatagtgcctgtgcctgtgagtgtctcactgaac

SEQ ID NO: 89531 - DNA, 100 bp, Mus musculus
gaagcatttactgaacaatgtatgcagaactgaagagtggatgaagtgagcccttacctcaaacactgtcaggttttgttcaaaagtgacagcgtgcttc

SEQ ID NO: 89532 - DNA, 106 bp, Mus musculus
gagtttgcccaactggttttctgtcttgctttggcccagtatttttgaatttatatgggattactgtttcagagactacatgaatcgcagaaaatactttaaactt

SEQ ID NO: 89533 - DNA, 142 bp, Mus musculus
cacacacacacacacacacacacacacatatatatatatatatatatatatacatatgtatgtatatatatgcatatatacatatatatgtttatgtatgtgtgcatatgtgtgtgcatgtacatgtttatatgtatatatg

SEQ ID NO: 89534 - DNA, 99 bp, Mus musculus
ggccaatatggtaggggagggtatgctagtaatgtttcattttttgtaaaacaatttagttttacaaccaatcatactaaattataatatttaccagcc

SEQ ID NO: 89535 - DNA, 117 bp, Mus musculus
atatatatctttatatgatatatacatatatttacatgtatacatatatgtatatattatgtatatatgtgtatatatgtatgtgtgtatatatatccatataatattcatatatat

SEQ ID NO: 89536 - DNA, 91 bp, Mus musculus
ttgggcagttttgattgttatcaattggttctgaaattattgtattagcatcttgtgaattcagaatttgttgatatataaatctgtttgg

SEQ ID NO: 89537 - DNA, 85 bp, Mus musculus; identical to SEQ ID NO: 57439

SEQ ID NO: 89538 - DNA, 107 bp, Mus musculus
ccagatgactgttgtgacgatcaattttttgcatatgcatgaagaatggtatatattagctattttcattatatatagtaggttgaagaaagtggttatcttgatgg

SEQ ID NO: 89539 - DNA, 72 bp, Mus musculus
gggctcacaggttacgcatccctaaggtctccactcatataattatgacaggagacactgtgaacttagccc

SEQ ID NO: 89540 - DNA, 72 bp, Mus musculus
gagagatcagaacagaaacaggtataagccatgcaggggttctacttactgtgtcagtcattctgttttctc

SEQ ID NO: 89541 - DNA, 78 bp, Mus musculus
agaggaaatgataacactgaaccttcatctcacgtgtaataaacatgatgaggtacttggttcatttcttaattctct

SEQ ID NO: 89542 - DNA, 64 bp, Mus musculus
gcatgaattttacatatgtgtagatgtacatatatatgtatatatacatgtgtgtatggcatgt

SEQ ID NO: 89543 - DNA, 65 bp, Mus musculus
gcttctcattgagtgctgtcttgtgtccctcagcaggactccaatctcagtattctctcaggggc

SEQ ID NO: 89544 - DNA, 98 bp, Mus musculus
gtattgtaagaatgactgaagggattgaagagatggctcagtggttaagagcactgactgctcttccagaggtcctgagttcaattcccagcaaccac

SEQ ID NO: 89545 - DNA, 117 bp, Mus musculus
tgatgtcaggctgtatctcagtgggatggtaaatgtggtctctggatgaaggttgtattgccaggtttctccttgtgaaatgtatgttgccctctgtactaaatagggttgtcttca

SEQ ID NO: 89546 - DNA, 85 bp, Mus musculus; identical to SEQ ID NO: 57470

SEQ ID NO: 89547 - DNA, 62 bp, Mus musculus
gtgcacgtgcatgtgtatgtgcatgtgtgtgtgtgcgcgagtgtgtgcatgtgtatgtgcat

SEQ ID NO: 89548 - DNA, 89 bp, Mus musculus
ggcatttatgaatatgtatgattatatttagataactgtataattatagtcatatttaagttacaattagatgtatgaagttgatggcc

SEQ ID NO: 89549 - DNA, 71 bp, Mus musculus
tactagaatgttgcagagaaaactcgctgcccggaaaatgaatccaagcagcctctctctgtctttctgta

SEQ ID NO: 89550 - DNA, 64 bp, Mus musculus
tatgtgagtatgcacatgtgcttgtgtgcatgtttgtatgtgtgcatgtgtatatgtctccgtg

SEQ ID NO: 89551 - DNA, 80 bp, Mus musculus
gtggtttgtctgtctgtatgtctgtataccacatgtctgtagtatcagaggaggtcagaagagggtgttggatcagctgc

SEQ ID NO: 89552 - DNA, 63 bp, Mus musculus
ctcagagtctggctgtctctgggatcctacaattctgggatcctgtgatcctgagattctggg

SEQ ID NO: 89553 - DNA, 78 bp, Mus musculus
actttctctgtgtctctgagtgtgtatgtatgcgtgtgtacatgcgagtgcgcacacacacttgagtgtacagggaaa

SEQ ID NO: 89554 - DNA, 95 bp, Mus musculus
atgtagggctggcgagatggttcagagggtaaaagcacagactgctcttccagaggtcctgagttcaaatcccagcaaccacatggtggctcaca

SEQ ID NO: 89555 - DNA, 117 bp, Mus musculus
gtctggtaattttagtgtgtgatggtttgtgtttacaagttctattcaataaaattttgtttcatactttttaaaagaactttctaaataggacttaagttgcataggaaataagac

SEQ ID NO: 89556 - DNA, 63 bp, Mus musculus
caccatcaagtgagtctcatatgtttgatcttcggatcatgcttctgagaaactctgtgtgtg

SEQ ID NO: 89557 - DNA, 69 bp, Mus musculus
ggctgctgctgtgtgtgcatgtgcatgtgtgcgtttacatttgcatgtgtccaagtacacagtggtgct

SEQ ID NO: 89558 - DNA, 118 bp, Mus musculus
tttgatttttacagggggttacaattaggttgacttgagtctcagaacagactgtggattttgggctttgaaataggtttggactcaaagatcatggagacttctgaagtaggacaaa

SEQ ID NO: 89559 - DNA, 78 bp, Mus musculus
tatgtgtatgtatgcatgtatgtgtatgtatgtatgtatgtgcatgtatgtatgtgtatgtatgtatatgtatgcatg

SEQ ID NO: 89560 - DNA, 82 bp, Mus musculus
gtgtctctctgtttgtctcagggacccagaagtcccacctatgccttctgggtaattgtcccctggatttattgaatgacat

SEQ ID NO: 89561 - DNA, 110 bp, Mus musculus
aggggcttgctatataccccaagattgtaagcaggcaggcagacagacagacagacagacagacagacactctgcctaggctaaccttgaacatgcagtcctcagcctct

SEQ ID NO: 89562 - DNA, 154 bp, Mus musculus
gtgtgtgtgtgtgtgtgtgtgtgtgtgtgtatatatatatatatatacacacacatatatacatatatatgtatgtgtatatgtatatatgtgtgcgtgtgtatgtatgtatgtatgtatatatgtgtatgtatatagtaatatatatatatat

SEQ ID NO: 89563 - DNA, 77 bp, Mus musculus
ctatattgttacctcttatacagaactggcagaatcctgtctttctgtctgtctgtctgtctaacttaactttatag

SEQ ID NO: 89564 - DNA, 78 bp, Mus musculus
ggatctctgtgagtttgaagccagtgtacagagcaagttccaggacattcagggcgacccagctacacagagaaaccc

SEQ ID NO: 89565 - DNA, 72 bp, Mus musculus
gcaggagagagaacagtcagagggaggaggctttatagtggtattctcatgctgctggtgttctcttcttgt

SEQ ID NO: 89566 - DNA, 135 bp, Mus musculus
tgtggtcagttgtccacacctcacaggggactgtgtgctcatggtcagttgtccacacctcacagtagactgtgtgctcctggtcagttgttcacaccttgcagtagactgtgtgtgctcatggtcagctgtcca

SEQ ID NO: 89567 - DNA, 80 bp, Mus musculus
ggtgaagatacgtggtgataatctgtggtggggcaatgatagtgcctgactctgccactgagtgtcaacacgggagaacc

SEQ ID NO: 89568 - DNA, 70 bp, Mus musculus
aggttctgagagtaatggcagctgctgaggaggagactgattagctgcctgcctgcctgcctgcctgcct

SEQ ID NO: 89569 - DNA, 100 bp, Mus musculus
tctcctgagaggctctgccagatcctgaccatgacagatgcagatgcttgcagacaaacatcagactgagcacagggtccccaatggaggagttagggga

SEQ ID NO: 89570 - DNA, 90 bp, Mus musculus
tcaaaaagctaaggatagtatgtgttagttctttgccatcacaggagtttgtggtgagaggactgagacagcacaaagccattgctgtga

SEQ ID NO: 89571 - DNA, 91 bp, Mus musculus
tgatagcctgccaaagaagttcacagcctcatttctggagcctgtgaatatgttatgctatgtggggaaaggaactttgtaggtgtgatta

SEQ ID NO: 89572 - DNA, 72 bp, Mus musculus
gtgtgcatgtgcgtgtgtgtgcatgtgcatgtgtgtgtgtttacgtgcatgcatgcagatactgcagcaggc

SEQ ID NO: 89573 - DNA, 62 bp, Mus musculus
cgtgttgctgcagaattcggggagaacattaaaacatgtgtctctgtctgtgacgactgtcg

SEQ ID NO: 89574 - DNA, 116 bp, Mus musculus
gtgctgcctaccccctaagcttgctttctgcttctcttttgggttaatgggaaaacagaagtgataatgatgataagaaagatagagtcctgaaagagagcgtggtagacataaac

SEQ ID NO: 89575 - DNA, 166 bp, Mus musculus
tggatcccctagatctgagatatgcttggattgacattgttaatagattttatttttttaaataaaaaacttattttagttttaatttatgtgtatgtctgtctgtctctgtgggtgtatacatatatgtgtaggtactcacagaggccagaagagggcattggac

SEQ ID NO: 89576 - DNA, 85 bp, Mus musculus; identical to SEQ ID NO: 57439

SEQ ID NO: 89577 - DNA, 84 bp, Mus musculus
ggagtccactacgaggtctctgatcctaatccagtgacactgggacactgggtgaggggtctcctaaaagagtgggtaagttcc

SEQ ID NO: 89578 - DNA, 116 bp, Mus musculus
ctatgttggtattgttatattgttacattgtttacgggagagagatggctcaacagataagagtacagagttagctcttctggaggactcaggttcagtttccagcacctacttgg

SEQ ID NO: 89579 - DNA, 88 bp, Mus musculus
tctactcactgcctgacaccctctatgggaaatctactgtcaatgtttacatggaaaacaccagtcagggagcaagcactggggtagg

SEQ ID NO: 89580 - DNA, 118 bp, Mus musculus
agcctgttataaatggaaggaccttgattatgaattgatgctttctccctgagttctccgctgtcagtttctgtctctcaggagggaggtatttcagaggcatctgttcagacatgct

SEQ ID NO: 89581 - DNA, 137 bp, Mus musculus
gtgtcccgaaagaagccagccgcttccagtttgggaagataagtgtctatttctataatctgtgactctgggtggctgtcatctctaaggactgctagatgataccttgctccaaggaggtgtgaatgtgtaaggca

SEQ ID NO: 89582 - DNA, 118 bp, Mus musculus
gaacatctggagatgtgtgtgtgtgtgtgtgtgtgtgtgcatatatatgtatgtgtgcatgtgtttatatacatgtgtatatgtgtttgtgtatatgtatgtatgtgtttgtgtatat

SEQ ID NO: 89583 - DNA, 81 bp, Mus musculus
tcatatgtatgtatgtatgtatgtgcatgaatccatgcattcatatatgtatgtatgtatgtatgtatgtattatgtatga

SEQ ID NO: 89584 - DNA, 112 bp, Mus musculus
gccttagtccatggtggtctgataggatgcatgggacaatttcaatatttttgtatctgttgaggcctgttttatgaccaattatatagtcaattttggagaaggtcccgtg

SEQ ID NO: 89585 - DNA, 78 bp, Mus musculus
tgatacagggtacgagttgccgatattatgtgaaacttttgtttcagttgtgtgtctgtcagttgtgtatctgtgtgg

SEQ ID NO: 89586 - DNA, 108 bp, Mus musculus
ggaccctcagttttatttcattgtctgtacccctacccaagtgcatctggctggagtgtgtctccctcactgttactttgtaggacctcattgttactttgtaggacc

SEQ ID NO: 89587 - DNA, 112 bp, Mus musculus
gatgagaatagatataatgtggattgttttcttccaactaaattaaaaaaaatttttttttcctttttaagatagggtcttggtatctatatctatatctgtatctatatct

SEQ ID NO: 89588 - DNA, 105 bp, Mus musculus
tgaggataaaccttgagggactggagagatggctcagcagttaagagcactgactgctcttccagaggtcctgagtttaattcccagcaactacatggtggctca

SEQ ID NO: 89589 - DNA, 76 bp, Mus musculus
tctgaaacaagacagagggctgaagtccatcatgtgacttagttatgaagagctttacttctgttttgtttttaga

SEQ ID NO: 89590 - DNA, 101 bp, Mus musculus
tacagcgtgttatttgtggttctcttgagtaacagaacttacagaatgagtctgtttctctctataaaaaggacatttattggaataatttataggctgta

SEQ ID NO: 89591 - DNA, 114 bp, Mus musculus
tggcacatgatcactgataccaccatttttttatttgtttgtatgtatgtatgcatttatatatgcatatatgtatgcacttttatgtatttatgtatatcatcatgtggacca

SEQ ID NO: 89592 - DNA, 85 bp, Mus musculus; identical to SEQ ID NO: 57470

SEQ ID NO: 89593 - DNA, 102 bp, Mus musculus
atacagatatatttataaattatgtcctatatgcatacatatttttatataagtacattttgtataataggcacataacttatataatagacatacttgtat

SEQ ID NO: 89594 - DNA, 118 bp, Mus musculus
tttgttttcagctttgttgtttgtgacttttataatacataggtagtttatttttatctaaaaagaataaagtgcttatttgggatatgccagaccttagttcctttaaaaaaacaaa

SEQ ID NO: 89595 - DNA, 106 bp, Mus musculus
gctttgtattagctatgtatatatgtatgtacatatatatatatatatatatatatatatatatatatatatatgccgtgtacatacatatatatatgtacacggc

SEQ ID NO: 89596 - DNA, 137 bp, Mus musculus
ctgtgtgtcacctggcctggcacacagtagggagggtggccctgctacactctctctgtgtgtcacctggtctggcacacagtagggagggtggccctgctacactctctctgtgtgtcacctggtctggcacacag

SEQ ID NO: 89597 - DNA, 93 bp, Mus musculus
ctccctgtgtgtcacctggcctggcacacagtagggagggtggccctgctacactctccctgtgtgtcacctggcctggcacacagtagggag

SEQ ID NO: 89598 - DNA, 72 bp, Mus musculus
gataagcacgtgagtgtgctcacagcgggggagaattctagggaatctggttggagacatataaggcttttc

SEQ ID NO: 89599 - DNA, 84 bp, Mus musculus
gctaagcattgattttctgagccatttgtccctgtgagactctcggagtcagaaatcagaggttcctagttgttggtgtctagc

SEQ ID NO: 89600 - DNA, 89 bp, Mus musculus
tctcttggctttcagtgcagtttgacggatttggaagcagcaactcctgtcttcagtgatggtggcagcatcttgaagctactgtgaga

SEQ ID NO: 89601 - DNA, 58 bp, Mus musculus
agtgtgtatgagacacactgtgggtgtgacaatgtatgagtgtgtgtgtgtgtgcact

SEQ ID NO: 89602 - DNA, 82 bp, Mus musculus
gtatatgtatatgtatatatacacatgcagtattatatacatatgatattaatacaacatgtttatgtatgcagatatatac

SEQ ID NO: 89603 - DNA, 64 bp, Mus musculus
agactgctctctctctctctatatatatatatggtagagttcagaccaatgggagagcctgtct

SEQ ID NO: 89604 - DNA, 75 bp, Mus musculus
tattcagtctctgtgtgcttagaaggcttaggacttgactgaagttctgactggctctgtctgaaaggctggatg

SEQ ID NO: 89605 - DNA, 89 bp, Mus musculus
ggctgcatgtgtgtgtctttcactctgaatccaaaacatttgggtgtgtaggaaggacccagtgcacccactggggagtttagagctga

SEQ ID NO: 89606 - DNA, 100 bp, Mus musculus
caactttatttctctgcttttgagtgactgaacacagagagcatgtcaaaggatactaactccctagaacggtcaccatgtgaacagatgttaatagttg

SEQ ID NO: 89607 - DNA, 74 bp, Mus musculus
ctgggacacacgctggctctcacttagacccaggaaagggtttcagctgagcacactcagtctgttctttctgg

SEQ ID NO: 89608 - DNA, 85 bp, Mus musculus; identical to SEQ ID NO: 63165

SEQ ID NO: 89609 - DNA, 167 bp, Mus musculus
tgtgtcacagtgtgtcacacagtgcacccttttgccttggaagccgtggtgtgtcacagtgtgtcacacagtacacccttttgccttggaagccgtggtgtgtcacagtgtgtcacacagtgcacccttttgccttggaagctgtggtgtgtcacagtgtgtcacac

SEQ ID NO: 89610 - DNA, 112 bp, Mus musculus
agctcagaggtgaccattctgccgcttgtggtgtcttctttacggagtgaactattgtgacagatgaaagagaccatgcattggtaagaatgatttatttaaaactgaagct

SEQ ID NO: 89611 - DNA, 91 bp, Mus musculus
agccgagagagcactctgtagcctgtgagcactcacaggccttgttactactcagctctgtgagcctgtgagcactcacagtccgagttac

SEQ ID NO: 89612 - DNA, 99 bp, Mus musculus
agtttgcatttgtgaaatgcttatatatttatagtcatgcttatatatttatatacaaaggaggcaagactatcatgtcagtatctctagatgaaggct

SEQ ID NO: 89613 - DNA, 66 bp, Mus musculus
gcctctgtgtgtgcttctgcatgtgtcacaagacctgtgtggaagacccaaaacaacttcagaggt

SEQ ID NO: 89614 - DNA, 113 bp, Mus musculus
tgatctcacagggcactcggtcgggaccacacagctcagtagtgaatgatctcctagtatgtcacacaggctgtgtgactctccagaaaagctgagtggctcaaagctgatta

SEQ ID NO: 89615 - DNA, 57 bp, Mus musculus
ggatgatatttatacatctgtacatcacaaatatttgtatatatgtagttgtcatcc

SEQ ID NO: 89616 - DNA, 114 bp, Mus musculus
ctaggcctggccactcaccagtacaagcagctcacgaagaaggggaaaggaaaccatgattcccagtagaatgtcagctgacagccctgtgctgtaagggagggcgggttttag

SEQ ID NO: 89617 - DNA, 105 bp, Mus musculus
gtcagaggaggtgtgttgttgggaatgagctttgagatttcaaaactccatgccaggcccagtctgcctctctctgcctgctgcctatggatcagaaagtagctc

SEQ ID NO: 89618 - DNA, 165 bp, Mus musculus
tctcttctttaattactattgttatctgtgtgtgtgtgtgcgcacacacacacacacacacacacacacacacacagaggtatgtatgagtacacagagagagagacacacacatgtatattgccgagtctagcatggctttggtgggagtggaatggcttgagt

SEQ ID NO: 89619 - DNA, 105 bp, Mus musculus
cctgtttgtaatgtctagatggggttaagaggtgtgaggagagtgtgaactgagtgtgaactgcaccgttccacgggctacctacccagactgcgaacaaagggg

SEQ ID NO: 89620 - DNA, 75 bp, Mus musculus
ctagcctgggagtctcccagtctgagataatacagcatacctgtgctctttcagaacggatgaattaagagctgg

SEQ ID NO: 89621 - DNA, 84 bp, Mus musculus
acagagacagacagagagaccaacagatacacagatatatatatatatctgtgtgtgtgtgtgtgtgtgtgtgtgtgtgtgtgt

SEQ ID NO: 89622 - DNA, 93 bp, Mus musculus
gaaggcaggccccaggcctactcagagctatttttgtagacttttttagtctcatactgtctgtctgtctgtctgcctgcctgcctgtctgtc

SEQ ID NO: 89623 - DNA, 102 bp, Mus musculus
ttgttacattggtacagaattttgtatattgatataggtttaaggtttgtattggtataaatctttatatattgatacaaagcaagattaattttgttacaa

SEQ ID NO: 89624 - DNA, 88 bp, Mus musculus
tatctatatgtatgtgtgtatatatatatttatctgtatatgtatttactgtcctaaatgtatatatgtgtacatattcatatgtata

SEQ ID NO: 89625 - DNA, 89 bp, Mus musculus
tgccaggtattaatgagcagtgaatctagacagccagctcagttgccttaccagtctgagggtctttattcaacccaagaatgcatgca

SEQ ID NO: 89626 - DNA, 81 bp, Mus musculus
gctgctggcccttacctctgctagagcggcagctaaaatatctccacactgcctctctgcgtggctgggcttcctcgcagc

SEQ ID NO: 89627 - DNA, 68 bp, Mus musculus
cagctctctggctggctcactgtcagttttagcgaacttacatcctcaagcctcatgccctgggactg

SEQ ID NO: 89628 - DNA, 67 bp, Mus musculus
atactgactgtactttgtgacatcactggaggctactgttgggtggatggatgagacagtgcagtgt

SEQ ID NO: 89629 - DNA, 103 bp, Mus musculus
gagatgaattccacaggcttgcttcccatctcagaaggactgccctttctttgttggtctttagtgaagattcaaagctgtctcctaatccttatttaatctc

SEQ ID NO: 89630 - DNA, 97 bp, Mus musculus
tctctttgccctctctctcaagtttgttctctctctctctcattctgctggttgagttaataagaaacagaactcacctattaggagggctaactga

SEQ ID NO: 89631 - DNA, 100 bp, Mus musculus
tccagaatgtctcctgtgcccagattctaatgtgtcacacacagtgaatgaccccatgctgagtggcgcctggagtcagtgcctgtctgggacttcctgg

SEQ ID NO: 89632 - DNA, 84 bp, Mus musculus
gcatatggtgaaggttggggtagggtacagaagtgaaccatgtgccccatggggtgtgtgtctgtgtctatgtcaaggtggtgc

SEQ ID NO: 89633 - DNA, 56 bp, Mus musculus
gactcctgtcttacactgtctgtccttttactgacagatacatagtgtcagaggtc

SEQ ID NO: 89634 - DNA, 82 bp, Mus musculus
atatatacacatatataaatacatatacacatatatgtatatacgtatatgtgtatatgtatatctgtgtgtgcacatatat

SEQ ID NO: 89635 - DNA, 59 bp, Mus musculus
ctctgtctcatctgtgtctgtctctctctgtaggggagagggtgcagctctgtgcagag

SEQ ID NO: 89636 - DNA, 89 bp, Mus musculus
ctcagcggatgctgcaggtagtgagcggcgccttcaggcaccaatatcttccctgctctgtcaccctctccctctgtcttgctgctgag

SEQ ID NO: 89637 - DNA, 108 bp, Mus musculus
ggttaagtctgacaagttcggtaggaaggtttcttctgtttgactcaagagacagagggcagaatgaagagccacctgcttgagttccagaaaaatacctcactcacc

SEQ ID NO: 89638 - DNA, 102 bp, Mus musculus
gtgtatgtatgtctgtgtgcatgtttatgtatgtatatatgtgtatgtatatgtgtatatgtgcatgtacatttatgtgtatgtgtatggatataggtatat

SEQ ID NO: 89639 - DNA, 102 bp, Mus musculus
ctctacccagctccaccggtttaatcagtgagctaacagacacacagactgtgtaccccgtggctcgaaatgctgggcttattaaactgcatctgggtgttg

SEQ ID NO: 89640 - DNA, 111 bp, Mus musculus
gcaatgaacatttgcaagtgaagatgtgtgaacagaggggtatactgtgggacacacacacacacatatgcttccacgatgagatgttttctgtgtttttgttgttattgt

SEQ ID NO: 89641 - DNA, 76 bp, Mus musculus
gacgggtgcaggaatgtagacgaggacaggccgtgcggtctcagtcagggtctcactctgcttctgtatttctgtc

SEQ ID NO: 89642 - DNA, 97 bp, Mus musculus
gccacctgtgtagggtcaagcatctctaagttggccatctctgccttaaactgttgagtgaagtgagccaggactcctctaccctttacaatttagc

SEQ ID NO: 89643 - DNA, 87 bp, Mus musculus
cagtagggtttggctgtcaatttctgaactataaccatgagcagtcgcagtagcttgtaatgtttgggagtccatgggacctctctg

SEQ ID NO: 89644 - DNA, 106 bp, Mus musculus
accttagtccatgatgatctgataggatgcatgggacaatttcaatatttttgtatctgttgaggcttgttttgtgaccaattatgtggtcaattttggagaaggt

SEQ ID NO: 89645 - DNA, 74 bp, Mus musculus
gactgagaagtagtaaagaagattctgacacagcataactgtctcagtcagagaattttctggtcttctcgttc

SEQ ID NO: 89646 - DNA, 109 bp, Mus musculus
gcggtgtaaacaagtccatatttggtggagacatgcccctgcctccctgattggctgaagccgcgtgcctggtgaggtgacatggcctgctgtgagtggatgggggctg

SEQ ID NO: 89647 - DNA, 85 bp, Mus musculus; identical to SEQ ID NO: 57439

SEQ ID NO: 89648 - DNA, 108 bp, Mus musculus
gtatgtgcataacatatatatgtatatatgtatgtatatgtatgtgtatatgtatatatgtgtgcatacatgtatatatgttatgtatacatgtatatatatatgtgt

SEQ ID NO: 89649 - DNA, 112 bp, Mus musculus
gtgattccttgtgacaggagtataatatttataggcttttgcctgaatatttatatttatgctaaatatttatgggcaattgtaagtaaaataccttctgtctgtaaattgc

SEQ ID NO: 89650 - DNA, 74 bp, Mus musculus
aacttggggcgggggagctgaacagatggctcaacagttaagagcactgactgctcttccagaggtcctgagtt

SEQ ID NO: 89651 - DNA, 86 bp, Mus musculus
atatatatatatatacatacatacacacatacatgtatatatgtatatatacatgtatgtgtgtatgtgtagatatgtatatctat

SEQ ID NO: 89652 - DNA, 78 bp, Mus musculus
agacttgagagtgtactggatttgtaaatgtgaaaaccacaagagtggggtcgggggcggggcagggtcatgaagtct

SEQ ID NO: 89653 - DNA, 80 bp, Mus musculus
cattatgctttacttcctgtgtctctcactgtctcagagcttgccatgtagactagaggggctggccagtgagccctatg

SEQ ID NO: 89654 - DNA, 71 bp, Mus musculus
ctcacccacacactctgatgctggctgagtgtcctatagctcaggacagttctgtcactgtgtggcgttag

SEQ ID NO: 89655 - DNA, 92 bp, Mus musculus
gggaactccagtgggaaccctaggcacaggttgggcaggcaaagaatgctgatgtatgttctgcctctctctggctcactgggtcacacccc

SEQ ID NO: 89656 - DNA, 92 bp, Mus musculus
gtggctctaagtagaggcttgtttttttctcgccaggagtgggccggctccatatgtgtctccctgtctgtgtctgcctctgctgctgtcac

SEQ ID NO: 89657 - DNA, 63 bp, Mus musculus
gtgaagcacaccagttcctcttgctctcatcttcatgagagcttgttggttcttaagttttac

SEQ ID NO: 89658 - DNA, 117 bp, Mus musculus
agatctaaaaagctcatcaaggtctggagagaaagctcagcggttaagagcactgactgctcttccagaggtcctgagttcaatttccagcaaccacatggtggctcataaccatct

SEQ ID NO: 89659 - DNA, 82 bp, Mus musculus
gccacatgtctctgtcactggctcacttgtctgtccactaaatagatggagggtgagcccctgtacctggccctcatgtggc

SEQ ID NO: 89660 - DNA, 77 bp, Mus musculus
cttctgttagtttcactgtgtctctgtttagtttctgtttccaggatctgtccattgatgagagtggggtgttgaag

SEQ ID NO: 89661 - DNA, 106 bp, Mus musculus
ggaaattggtctgaagttctctatctttgttggatctttctgtggtttagatatcagagtaattgtggcttcatagaatgagttgggtagagtaccttctgtttct

SEQ ID NO: 89662 - DNA, 85 bp, Mus musculus; identical to SEQ ID NO: 57439

SEQ ID NO: 89663 - DNA, 78 bp, Mus musculus
tgggttggggagcatggggagaggggagagggggttttctacccctgtcccaccagctctgtgtgtgtctctctctca

SEQ ID NO: 89664 - DNA, 61 bp, Mus musculus
gagctgggctgtcgggtggagcagcaacggataaggtactgtctgtctgtctgtccatctc

SEQ ID NO: 89665 - DNA, 96 bp, Mus musculus
ggcagctctgctcagcgctgtaacaaatttaaaaaaaactaaagtctgaattaattagttttttttcaacttgttacagcagcgaatggagctgcc

SEQ ID NO: 89666 - DNA, 139 bp, Mus musculus
gggtgtgcctctgtgtgtgtgcatgtgtgtatgcctgtatgtatatacacatatgtgtgtgagtgcctgtgtgtgtgcctgtgtgtatatacaattatgtgggtgtgcctctgtgtgtgtgcatgtgtgtatgcatata

SEQ ID NO: 89667 - DNA, 72 bp, Mus musculus
gtgtatctgtatgtatgtatgtatatgtgtgtctgtctgactatgtatgtatgtatatgtgtgtatgtgcat

SEQ ID NO: 89668 - DNA, 107 bp, Mus musculus
gaatgaaatgtagtcttcgggggctggagagatggctcagcggttaagagcactgactgctcttccaaaggtcctgcgttcaaatcccagaaactacatggtggctc

SEQ ID NO: 89669 - DNA, 77 bp, Mus musculus
tattgatttaggagctggagagatggctctgcagtctaagagcactgactgctcttccagaggtcctgagttcaata

SEQ ID NO: 89670 - DNA, 82 bp, Mus musculus
tgttccaagaaaggtgaagagtgactgaggagaccagcatatacctcatgtctccacacactcacacgcacacacatgaaca

SEQ ID NO: 89671 - DNA, 70 bp, Mus musculus
atgagtctcagactctcagcaatctcagcctccatgcctgggactgcaggactgagtctccatggctcat

SEQ ID NO: 89672 - DNA, 107 bp, Mus musculus
gccaccactctgcttggatgcagctcctcttccttctggttaagctcagactgtctcagtgtgatttacatgaccagaggcccctcggggagcgccgcggggtgcgc

SEQ ID NO: 89673 - DNA, 95 bp, Mus musculus
tgtggaggagagccttctttttgggatgtcagctgtggaggaagatcaactgggcgctttctctgcctctgagcctctctcaggcttttaccaca

SEQ ID NO: 89674 - DNA, 91 bp, Mus musculus
ggttctttacatctgtctgtctgtctgtctgtgctcctgtgcacgctcacattggtgcactggtcaaaggatagcttgtgggatttgagcc

SEQ ID NO: 89675 - DNA, 101 bp, Mus musculus
gaaagcatcttctggggctggagagatggctcagtggttaagagcactgactgctcttccaggccctgagttcaattcccagcaaccacatggtgacttac

SEQ ID NO: 89676 - DNA, 90 bp, Mus musculus
actaaatgttcaaagtgggagtcaggaaggctgcagttcagtgggcacccaaggctcactctatgcctcacctgctcataagaatttggt

SEQ ID NO: 89677 - DNA, 70 bp, Mus musculus
tccctgtttgtttcttttgcatgtgtgtgagttcctcacgccacggtgcctctgagagactgtcagaggg

SEQ ID NO: 89678 - DNA, 112 bp, Mus musculus
atggtgtatttgtagaagaagctgagcagacaacactacttctatttatatataaacccccattttattctcatctgttctgtgaggctttgatgccaatttttgtcaccgt

SEQ ID NO: 89679 - DNA, 86 bp, Mus musculus
tccttttgtatgtgtgctctctctgtgtgagggtagacatgcactgcatgtgtacccgggcagaggtcaagggtccatgttgagga

SEQ ID NO: 89680 - DNA, 107 bp, Mus musculus
ggggcttgatgtggatttgtgttcacctatgttaatggcatgccagggaaatagattagctgcctgtctgcctgcctgtgactcgctacactgagcattttagccct

SEQ ID NO: 89681 - DNA, 80 bp, Mus musculus
gggtctttttcggtgagactctcgcagtgtctttctgggtccaattatgatgctgagttaaggtttcagaggaatgattt

SEQ ID NO: 89682 - DNA, 116 bp, Mus musculus
atacacacacacacacagactgcacatgacaaaacaataggaaaaagctaaaggtgaagtgtgtgtgtgtgtgtgtgtgtgtgtgtgtgcgcgcgcgcgcgtgcaggtatgtatgc

SEQ ID NO: 89683 - DNA, 82 bp, Mus musculus
acacacacacacacacacacacttcacctttagctttttcctattgttttgtcatgtgcagtctgtgtgtgtgtgtgtatgt

SEQ ID NO: 89684 - DNA, 67 bp, Mus musculus
tgtggtttcatttctgtctgtgtgtctgcctgatgatagacacagagcccagttgtttggtgtcacg

SEQ ID NO: 89685 - DNA, 127 bp, Mus musculus
ggccagcaatcattcctcaggagccgcctacctcatctgcctacctcatttttttaagacagggtctctcactgtgttctggggtctacaaattcaggcggactgactggccagttagcctcaggga

SEQ ID NO: 89686 - DNA, 77 bp, Mus musculus
tcaatctgtctgtcccactgactctgggaagataaatgagcccttgggtttccatctggtggaggcagatggtagga

SEQ ID NO: 89687 - DNA, 114 bp, Mus musculus
tctcgggttcctcagaggctaaacctggcaacgagtgaacattctagtctgtctcctgcctgaaaggactagcagtgtcttgcttgtgtgaagggcctcctcctatacatggga

SEQ ID NO: 89688 - DNA, 118 bp, Mus musculus
aagattcgtcttgacacaaagtcttactatgtagtccttgctgtcttggagttcacagtgtttctgtctctaagggtctgggatgacaaccaagcacgctgttcatccatgtcatctt

SEQ ID NO: 89689 - DNA, 80 bp, Mus musculus
agatgcatatacatatgaatgcatgtatgtatgaatgcacatattatgaatgcatgtacgtgtgaatgcatgtatgtatg

SEQ ID NO: 89690 - DNA, 71 bp, Mus musculus
gcactgggtcactgaatctctcagatgcaagagaagatgttaattgggaggctctgctagtaccctagagc

SEQ ID NO: 89691 - DNA, 100 bp, Mus musculus
ccagtgatctggcctactcagcgcacgtcggaccattggctcacctgtctgaatctgtctctgaccactgtttctggctccttgttgtggttggctctgg

SEQ ID NO: 89692 - DNA, 98 bp, Mus musculus
tatatgtatattagcaaacaatcccaagttgtatatttttttaaggcatcaattttatgataggtggattgtatctcagtaaagctggtgtgtgtgtg

SEQ ID NO: 89693 - DNA, 109 bp, Mus musculus
aagccttatcacctcaagaaggatgccatcattgatgtgccactcactgggtcactgcaagagcccaggtgacaagcactactcaacaccacatcagtctgaggggttt

SEQ ID NO: 89694 - DNA, 107 bp, Mus musculus
gctaacatattgctctcagaccttctggcttctggactgttgagacataaaattttgtttttcataagttacctagctcatgatattttggagtaacctgaacaagc

SEQ ID NO: 89695 - DNA, 81 bp, Mus musculus
cttatgtgcatgtattggcgtcttaccgattcccaaggatgaacacgggagtggatgagcaagtgaatgtgtgggagaaag

SEQ ID NO: 89696 - DNA, 70 bp, Mus musculus
gtgagagaagctgaatgcagaaaaggtaaagccagtgtctgtctgtctgtctgtctgtctgtctgctcac

SEQ ID NO: 89697 - DNA, 100 bp, Mus musculus
gttttctttcatttgtggttcctagattttatatacgtgtatatacatgtatgtatgtatgtatgtacatatgtaacaataagctaggagcaaagaagac

SEQ ID NO: 89698 - DNA, 108 bp, Mus musculus
tggagtttgggtggggggaggctggtgagatggctcagcggttaagagcagtgactgctcttccgaagatcctgagttcaaatatcagcaaccacatagtggctcaca

SEQ ID NO: 89699 - DNA, 62 bp, Mus musculus
atgtgtatgtgtgtgtatgcatgtatgtatttatgtgtgcatgtatgcatgtatgtatgtgt

SEQ ID NO: 89700 - DNA, 83 bp, Mus musculus
taagatcgacacaagatgaagctagtttacaattccagcatgaactggaaagggctcctgaggcttcaggccagtgtttctta

SEQ ID NO: 89701 - DNA, 97 bp, Mus musculus
tttcacgcatcattagtagatgagacgttcagactccctgaccttgaaatgtgtggactcttgtctcaggtattcatagtgaggccacttggtgaaa

SEQ ID NO: 89702 - DNA, 96 bp, Mus musculus
ggccacatttgggctggagagatggctcaaccgttaagagcaccgactgctcttccagaggtcctgagttcaattctcagcaaccacatggtggct

SEQ ID NO: 89703 - DNA, 87 bp, Mus musculus
gggtatgtatgcatgtgtgtgtgtgtgtggtgtgcatgcgtgcgtgtgcatgtgcatgtgtgtgtatgcatgcctatggaggccaga

SEQ ID NO: 89704 - DNA, 76 bp, Mus musculus
aggggtctcctacttcagtccaatgattgggtacacgtatctgtgtctgtctcagtcagctactgatagggcctct

SEQ ID NO: 89705 - DNA, 94 bp, Mus musculus
catatagtgaactcttgagaccagactatacccattatttttaatatagagagagtctctctgtatctgaaactggcatagaattcactgagtg

SEQ ID NO: 89706 - DNA, 65 bp, Mus musculus
actgagcagagcaggtaggcctagaagcctagtatgggctggtgtctgtctgtctttgtctctgt

SEQ ID NO: 89707 - DNA, 91 bp, Mus musculus
gagtaggacttgggtaacccatgacagagggttgttgacaaagagggttgaatcagcttctgtctcactgtgtgattgcttctgtcctgcc

SEQ ID NO: 89708 - DNA, 136 bp, Mus musculus
ctgtgtgtatgtctgtgtgtgcatgtatgatgcatgtgtgcgtgcgcgtgcacacacacacacacacacacacacacacggtcatgcctgtggatgccagagatccaccttgggtgctgttcctcaagggatgtcc

SEQ ID NO: 89709 - DNA, 65 bp, Mus musculus
ggaggcagaagatgatgtggaggccatgaggacatgttgctcactcactccctcagcctgctttc

SEQ ID NO: 89710 - DNA, 88 bp, Mus musculus
gagtctccaaagaaaccagaaatttctacttcagagtaagacatacactctctctgtgtgcctgtttctgtctctatgtgtctgtctc

SEQ ID NO: 89711 - DNA, 76 bp, Mus musculus
agcattgagtctgtacaaacataaattctatgaggcatgtgacacatctgcctcacagaagagagtgcagaaggct

SEQ ID NO: 89712 - DNA, 70 bp, Mus musculus
gtggggttacaccaaactgaagtgcctctgcacagcaaaggacatcagtgacagtgaagagagagcccac

SEQ ID NO: 89713 - DNA, 85 bp, Mus musculus
ctcttagggcatatgtgtatatgtatatatggtgtgtatgtatatatatatgtaactgtgtatatatgtgcatgtaacttgaaag

SEQ ID NO: 89714 - DNA, 80 bp, Mus musculus
ctcggtccctctgtcactgccaacagctaggagagtggattccattccaggcagcagcagttcacactgggtggcctgag

SEQ ID NO: 89715 - DNA, 70 bp, Mus musculus
accatcttgtggtagtggtgacgatgacgatgatgatgatggtggtggtgacgatgatgatggtggtggt

SEQ ID NO: 89716 - DNA, 56 bp, Mus musculus
aagatcactgtgagcagtctcagtggaggggactccctgggctggcttttgagctt

SEQ ID NO: 89717 - DNA, 98 bp, Mus musculus
gaaactaccttgggctggagaggtggctcaggagttaagagcactgactgctctaccagaggtcctgagttcaattctcagctaccacatggtggctc

SEQ ID NO: 89718 - DNA, 67 bp, Mus musculus
tccctctggagaacaggctgacctcagagatctgcctgtgtctgtctctgtctcctaaattctggga

SEQ ID NO: 89719 - DNA, 78 bp, Mus musculus
gacctgcaattttatgaacacacacacacacactctgtttttgtttgtttgtgcttgttttttagattcttttaggtc

SEQ ID NO: 89720 - DNA, 71 bp, Mus musculus
gagggagcattaagaggaaagctaagggctggagagatgtctcagcggttaagagcactgactgctcttcc

SEQ ID NO: 89721 - DNA, 82 bp, Mus musculus
ggtgtggggtgttctacctgttttaactgtttattttatatgaaaaaaagtgcacgttgtacaggattggggcaactatgtc

SEQ ID NO: 89722 - DNA, 110 bp, Mus musculus
tgaggccaggtctcgccgtggatcagactgtcctcaagctccaatgctgcctgcctgcctgcctgcctgcctgatggcatgaggactgtgctccactatgccctccctca

SEQ ID NO: 89723 - DNA, 113 bp, Mus musculus
attggtcaaacaaaaagtgtgcttacagttttcagagctaagagcctaactttgtttatatatatacatagaacttttggcaaggttattttgcacactcacagttttctggt

SEQ ID NO: 89724 - DNA, 84 bp, Mus musculus
aaaggtacctggttatagattgggttgaattctggagtcaagcctttctcctgtatcactcagtcactaagaaaccacaccttt

SEQ ID NO: 89725 - DNA, 115 bp, Mus musculus
agcatcatctggcagtccacaagctatcagcctccatttctaggttaatacgtttttatttaataagtctgtaatcatcttgaggctaactacattgtatggtagtcagtgatct

SEQ ID NO: 89726 - DNA, 83 bp, Mus musculus
gaggtggcagactgagaacctgcacggccctgccctggacctcaagcacacagtgccagccgacagtcagtctgtctgtcctt

SEQ ID NO: 89727 - DNA, 80 bp, Mus musculus
cagggaggaggagatggcctcagtagatagatgcttccccatttaccatccatgtctctgtctgtctctgtctgtccctg

SEQ ID NO: 89728 - DNA, 60 bp, Mus musculus
gtgacaggagagtgacaggagaggccagacagggctcacctccttagctacatccagcgc

SEQ ID NO: 89729 - DNA, 81 bp, Mus musculus
cagcacagttgtgtgtgctcagtggaagatgcgtgtcagagtcagctgccctggagtcacgtgactgtctgtctgccacac

SEQ ID NO: 89730 - DNA, 113 bp, Mus musculus
gtgtgtgtatgtgtgtgtgttctataaatctgataaaaactaagcctgtctctgtgtgtccctgaagcaattggcatagttatcacagttggcacagttggcacagctggcac

SEQ ID NO: 89731 - DNA, 69 bp, Mus musculus
cctttctctggtctgacctcgggatagaggaaagtggactcctctctcactctgggtcttacagtgagg

SEQ ID NO: 89732 - DNA, 83 bp, Mus musculus
gggagggacctgcactttcggtactgagcatgggagtccagattctgtgatgtctgtgaggacagggttgtgctgtccagacc

SEQ ID NO: 89733 - DNA, 105 bp, Mus musculus
catatatatatatatatatatatatatgtatatatatatatatatgtgtgtgtgtgtgtgtatgtgtgtgtgcatatatatgtatgtatgtatgtatgtatatgt

SEQ ID NO: 89734 - DNA, 69 bp, Mus musculus
tagccaggagagagagtgcagtgaaaaagactgagggcgtttctgaagggcacactttcttcatggcta

SEQ ID NO: 89735 - DNA, 80 bp, Mus musculus
ttttctctcaaccaggctctcacactgagtatcagagagaaattccctgtactttgggcagagcaggacaggagggaaga

SEQ ID NO: 89736 - DNA, 84 bp, Mus musculus
tgcccatcaagcaggtataggtaagaggaaaaagcagagaaattggtattttaaacattcttctctctcccagctttgagggca

SEQ ID NO: 89737 - DNA, 70 bp, Mus musculus
tggcaggtcacagaggacacagcgaggtaagagaaacgaagctaaatgtcactgcttcctcagcctgccg

SEQ ID NO: 89738 - DNA, 58 bp, Mus musculus
acacacatatatatacacacatatatatatacatatatatgtgtatatatatgtatgt

SEQ ID NO: 89739 - DNA, 73 bp, Mus musculus
caggagtgctgggagctattcagctagaaagcaaagacttccctgcttgttcctgtctctcagaccctcactg

SEQ ID NO: 89740 - DNA, 91 bp, Mus musculus
agcctcctcctctgtgcctggcagtggaccatgggcttcctggaagcctccctctgtgcctgttagtggaccgggggcttcccataccccc

SEQ ID NO: 89741 - DNA, 113 bp, Mus musculus
ggaggaatggcgtcactgggggtgggctttgaggtttcagatgctcaagccagaatcagtgtctatctgtctgtttgtctgtctgcctacctgtctctttctctctctcctgc

SEQ ID NO: 89742 - DNA, 117 bp, Mus musculus
aggttcaggttggtcttttgctctggagtccagcatctcttagtaacagtggcagatctttttctctatgtaaatcaaccaagagactagtgaggctccagagctgatcacccacct

SEQ ID NO: 89743 - DNA, 72 bp, Mus musculus
gcaccttctatcacgcctggctttctatatgggtctggctaacccagatcttcaagcttgtatagcaagtgc

SEQ ID NO: 89744 - DNA, 95 bp, Mus musculus
ggtcattcgtaaaggtcctttcttgattgagaggctggcatattgaaagcatgtgcccaactcagcctgtctgtctgtgcctcgacgcccactcc

SEQ ID NO: 89745 - DNA, 87 bp, Mus musculus
tgtgcttaatgtatatgtgtatggtgtatataatgtatgtaacaatatatgtataatgtatgtaaatatacatatatgtaagtaaca

SEQ ID NO: 89746 - DNA, 85 bp, Mus musculus; identical to SEQ ID NO: 57439

SEQ ID NO: 89747 - DNA, 114 bp, Mus musculus
cgatatatatatatatatatatatatatatatatatacacatacatatatacatatatatatgtatatatatacatatatatatgtatatatatatatgtatatatattgtttg

SEQ ID NO: 89748 - DNA, 109 bp, Mus musculus
ttgttcttgttcctgatcttgaaaacatcccttgatcaataatcaaaagtgggcttttctgaatttctatttgatttctaagatttttcaacatcagagccattaacaa

SEQ ID NO: 89749 - DNA, 67 bp, Mus musculus
cacagactgtgggacaggagcaatgaacattggtttggttcgctccgtctgtctcacctattctttg

SEQ ID NO: 89750 - DNA, 103 bp, Mus musculus
gggtcaataagagcttaagtgtggttagaatgctcagcaaaggaggatggctcagcggttaagagcacagactgcttttcctgaggtcttgagttcaattccc

SEQ ID NO: 89751 - DNA, 110 bp, Mus musculus
ggtttcagacactttgggaactggagagatggctcaatggttaagagcactgactgctcttccagagatcctgagttcaattcccagcaaccacatggtggctcacaacc

SEQ ID NO: 89752 - DNA, 83 bp, Mus musculus
gatttatgtcttaattttttgtttttttcaggacagagtttctctgtgtggctctgactatcctggaacttgctttgtagatc

SEQ ID NO: 89753 - DNA, 70 bp, Mus musculus
ggttctgagtctgcacacagcctgagggaccccagttcattcagattggttaatatagatgtcagcagcc

SEQ ID NO: 89754 - DNA, 96 bp, Mus musculus
tttcttgttgtttctggtttgagacagggtctctctgtgtatccctgactgccccagaactcactctgtagaccaggctggccttcaatttagaga

SEQ ID NO: 89755 - DNA, 99 bp, Mus musculus
gtagccctgtctgtccaggaactcactctgtagaccagtttggtcacaaactcagatctgtctgtgtctgcctcctgagtgctgggattaaaggtgtgc

SEQ ID NO: 89756 - DNA, 119 bp, Mus musculus
agctaaacaggccatttaccaacatgccttctcttcagccccatagacttatgttccatactctgacactgtgagtctgtgaaacttttaggagttagggcctggctggccgaggtgct

SEQ ID NO: 89757 - DNA, 81 bp, Mus musculus
agcttatgaatgtatagtccttctccagctccagtgtctgtcccagatgctgtctgtcagtgggactcacagacacaagtt

SEQ ID NO: 89758 - DNA, 77 bp, Mus musculus
cttgtgtctgtgagtcccactgacagacagcatctgggacagacactggagctggagaaggactatacattcataag

SEQ ID NO: 89759 - DNA, 123 bp, Mus musculus
cagtcctctgctgtatatgtgtcaggggcctcttatcagctggtgtatgctgcctggctagtgactcagtgtctgagagaccccggggtccaggctagttgagactgccagtctttcgtttcc

SEQ ID NO: 89760 - DNA, 98 bp, Mus musculus
gtctgtctgcctgtctgcctgcctgtctctgtgtctgtgcacatgcatatgtgcttgtacttagtttgtgagaccaggtctcactgtgtagctcaagc

SEQ ID NO: 89761 - DNA, 77 bp, Mus musculus
catatatgtgtgtgtgtatatatatgtgtgtgtatacatgagtgtacatacatatatattatacacacatatatatg

SEQ ID NO: 89762 - DNA, 94 bp, Mus musculus
tatgtatgtatgtatgcatgtatgtatgtatctatctatctatctatcatctatctcatctatttgtatgtgtgtgtgtgtatgtgcatgtgtg

SEQ ID NO: 89763 - DNA, 85 bp, Mus musculus; identical to SEQ ID NO: 57439

SEQ ID NO: 89764 - DNA, 85 bp, Mus musculus
gtgtgcacacagaggtcagaggacagcgtgcacacagaggtcagaggacagcgtgcacacagaggtcagaggacagcgtgcacac

SEQ ID NO: 89765 - DNA, 519 bp, Mus musculus
tttgcggggaagggcacacctagaggtcagaggacagtgtgcacacagaggtcagaggtcagggtgcacacagaggtcagaggacagggtgcacacagaggtcagaggacagtgtgcacacagaggtcagaggacagcgtgcacacagaggtcagaggacagcgtgcacacagaggtcagaggacagggtgcacacagaggtcagaggacagtgtgcacacagaggtcagaggacagcgtgcacacagaagtcagaggacagcgtgcacacagaggtcagaggacagtgtgcacacataggtcagaggacagtgtgcacacagaggtcagaggacaacgtgcacacagaggtcagaggacagcgtgcacacagaggtcagaggacagtgtgcacacagaggtcagaggacagcgtgcacacagaggtcagaggacagtgtgcacacagaggtcagaggacagtgtgcacacagaggtcagaggacaacgtgcacacagaggtcaggacaacgtgcacac

SEQ ID NO: 89766 - DNA, 73 bp, Mus musculus
tttgaggcagtgtctctctctctctagccttggctgggctggaacttgctatgtagaccaggctgtcctcaaa

SEQ ID NO: 89767 - DNA, 106 bp, Mus musculus
gaggttgacccgttttatgacccaaggacacagatgtgaggctggagctggggctggtgttctgacacccttacaggttctttttcttggaaccctggtcctcctc

SEQ ID NO: 89768 - DNA, 71 bp, Mus musculus
ggccaagatacacttctacgggggctgaatggctttacacatctcagtcaggcactctcagaaatctggcc

SEQ ID NO: 89769 - DNA, 113 bp, Mus musculus
cctcttagggtattgactaagtaggagggtttcaggtgacgccatcttgagaattatatctcagccacctttgactcagacctgatagttatggagggactctgataagatgg

SEQ ID NO: 89770 - DNA, 74 bp, Mus musculus
tatatatatatatgtatatgtatatacatacatacatatgtatgtatgtatatatatgtgtgtgtgtgtgtata

SEQ ID NO: 89771 - DNA, 118 bp, Mus musculus
ctcctttcataccctctcctgtacacctggactgcagtctagaaactatatttcattttactataaggttgtttttagttcaagtcttactgagaaggggtccactatagaaaaggag

SEQ ID NO: 89772 - DNA, 109 bp, Mus musculus
gggccaacagggcagaccatgagaggaagcatggtatgtatgtatgtatgtatgtatgcatgtatatatgtggtatgtctgtgtgttatgtgtatgtggtgtatggtgt

SEQ ID NO: 89773 - DNA, 98 bp, Mus musculus
gtgcatatatgtatacaactatgtatgtgtgtatatatatatacatatatatatatatatatatgtatatatatatgtatgtgtgtgtgtgtatatat

SEQ ID NO: 89774 - DNA, 79 bp, Mus musculus
agcacactcaagagtgtgaggtcatgttttagtagcgtctgctctacccactcatgtcctctataccatagtaagtgct

SEQ ID NO: 89775 - DNA, 96 bp, Mus musculus
tccaattaccaactttagcaatttaatatagttgaataataactaaacgggacactttgtcactcagtcattattcaagcttctgttggggatgga

SEQ ID NO: 89776 - DNA, 58 bp, Mus musculus
tatgtgtatatatatatatgtgtgtgtgcgcgcgcacgggtgtgtgtgtgtgtgtatg

SEQ ID NO: 89777 - DNA, 65 bp, Mus musculus
ctgagtcaccctgctcctcaacagaagacctgtgggtttagatgagagagagcatagtggcttgg

SEQ ID NO: 89778 - DNA, 64 bp, Mus musculus
gccagtgctctctgctcttactcgaaacctccctgcagccggtgagaaggagaggctctgtggc

SEQ ID NO: 89779 - DNA, 92 bp, Mus musculus
gagtttttgttctttccatatgaagctgaaattgttctttcaagttctaggaagaattgttttagaattttaatgaagattgcattgaattt

SEQ ID NO: 89780 - DNA, 68 bp, Mus musculus
taggtcttgagagggctagtgagattgctcagtggttaagagcactcactgctcttccagagatcctg

SEQ ID NO: 89781 - DNA, 66 bp, Mus musculus
tgtatgtgtgtatgaatgtatgtatttatgtatgcatgcatgtatacatgcacgtatacatgcatg

SEQ ID NO: 89782 - DNA, 74 bp, Mus musculus
gaattcagtcagttgggagtcagtgtggtgagtgagttcacttcagcacagttcggtgcaattcagttgagttc

SEQ ID NO: 89783 - DNA, 95 bp, Mus musculus
gagatcactggtgatatggtctaaggtacaaggttttatactattcgaagttggccacagaacttggtatgactgtccacattgctactggtttc

SEQ ID NO: 89784 - DNA, 69 bp, Mus musculus
gtgtcactgggggtaggctttgaggtctcagatgctcaactcagacccactgtctcaccctctcttcat

SEQ ID NO: 89785 - DNA, 72 bp, Mus musculus
tagagaaatcatgcacatgtatatatgtatgtacgtatgtatgtatgtatgtatgtatgtatgaattttgtg

SEQ ID NO: 89786 - DNA, 75 bp, Mus musculus
ctttgtgctctgcttctgtctgtctgtgtgggtaagggagaacactttcagatggaaaaatgggtctgcataaag

SEQ ID NO: 89787 - DNA, 76 bp, Mus musculus
aattattcttatctgtgtcactgtgactctcaggaacaagtgttcacaggaggggggggacagcagagttatggtt

SEQ ID NO: 89788 - DNA, 90 bp, Mus musculus
ggattccagaaactctacggaggaacacagttgagtcatccttttccaggggctcatgcagtcagtcttcagagagttcaaaggtcaacc

SEQ ID NO: 89789 - DNA, 103 bp, Mus musculus
aaggaaattgcaggttgcacacatgctattcacactcataaatataatgccagttatgtagaaggatgtttagtatcctggtgagatttggagtcaattcctt

SEQ ID NO: 89790 - DNA, 114 bp, Mus musculus
gagatcttgcagaatcggtgcctatagagatgacaggtgtgtggctgctcatttgtgtgtgtgtgtgcacacgtacaggtctagcttgaagatggagctgagtgatgtggtctc

SEQ ID NO: 89791 - DNA, 112 bp, Mus musculus
ctctcgggatgtagagagatgtgacttatgaatgatctgactgcctgttttcagtttaactgaaaaagaaaacagagattagcaaattaaaaggagcgacatctcctgtgag

SEQ ID NO: 89792 - DNA, 102 bp, Mus musculus
ttgtcagctttgtgtctgcatatgtatgtatgtatgtatgtatacacacacatatatgtatatatatacatatataagtatatgtgtgtatacaccctgtaa

SEQ ID NO: 89793 - DNA, 60 bp, Mus musculus
ctgggtaaaagccattgtagtgggaaagagaggctctctcactgtgggttttttatctgg

SEQ ID NO: 89794 - DNA, 86 bp, Mus musculus
atgtagaaagcatgtagaatgaagaacatagtggctagaatgttttgtgaccactgtgacttttttttttacatacatacatacat

SEQ ID NO: 89795 - DNA, 80 bp, Mus musculus
gcatatatgtatatatacatgtgtatatatatggacataggtgtagatgtagatatatatgtatgtatatacatatatgt

SEQ ID NO: 89796 - DNA, 109 bp, Mus musculus
tgtgccccagcgtgggaggaatgctcagactcctgtaacagcacctctgacacactcagtttccaaaggtcttctcagcatcttcacccttctctctgggtctagcaca

SEQ ID NO: 89797 - DNA, 101 bp, Mus musculus
cttgcatgggttatgtgactaggggggtaaatgtatgtgtgtgtctgtgcatatgcatgtgtgtatacatgcatgcttattggatatacagcttaccaaag

SEQ ID NO: 89798 - DNA, 115 bp, Mus musculus
gtgctcacaggtagctctgagtccatctgcttcctcaagtctgctcattggtttgcaagggttggcctgggttatacctaaggtggatgacgagggacacttggtgaatctgcat

SEQ ID NO: 89799 - DNA, 77 bp, Mus musculus
gctgagtcatatctgatgatgtgtgagagtagattatttttattatacatcccatccccctgtaggtagaactcagt

SEQ ID NO: 89800 - DNA, 75 bp, Mus musculus
aagtacagctgcagcatgaggtacaaccttgtttatctctggaacacaggttgtttgtgctttcagaaaatactt

SEQ ID NO: 89801 - DNA, 58 bp, Mus musculus
ctcctcgccctggaatttgtttgtggtcagtcactagacactgtccagtcagtgggag

SEQ ID NO: 89802 - DNA, 100 bp, Mus musculus
aacatgggagactgaggcaggagggtgaggaatgtatatatatatctactaaatgggtttacaacagcacacccaaaccttagtgtcacctaaatgtgtt

SEQ ID NO: 89803 - DNA, 75 bp, Mus musculus
tacagtagggcaggctttgagggtttattaactcctaaaacatattctctctctctgtgtctgtctctctctgta

SEQ ID NO: 89804 - DNA, 67 bp, Mus musculus
ggaggtcaaatattgataactagtttttgtctgaatcccacttagactgactggttaccatgccccc

SEQ ID NO: 89805 - DNA, 84 bp, Mus musculus
tatgcatatatgtttgtgtatatatgtatatgcatgtatgagtatgtatatgtatatatatatatatatatatatatgtgtgtg

SEQ ID NO: 89806 - DNA, 115 bp, Mus musculus
tagtgtcaaggattgggtaccagcccatgggatggatacaaagttaggctgacaattgctcagtctttcagtctctgttccatatttgtaggtgaatgtcttttaaagacgacta

SEQ ID NO: 89807 - DNA, 85 bp, Mus musculus
ggccatggtggtctgataggatacatgggacaatttcaatatttttgtttctgttgaggcctgttttgtgaccaattatatggtc

SEQ ID NO: 89808 - DNA, 77 bp, Mus musculus
gctttctaggaattaagtgaaatttcagtttgcctaatctatgtagggaaaatagtttcatagttttagaagaaagc

SEQ ID NO: 89809 - DNA, 114 bp, Mus musculus
ggacaaacacaaacaagaaaacagagaatagatgaatgtatgtatgtatgtatgcatgtgtatatatgtgtgtgtgtgtgtgtgtatactctatctgtatcttaatatatcttg

SEQ ID NO: 89810 - DNA, 81 bp, Mus musculus
ggagagacagagacacagagacagaaaatggtatttatacctagaggaaatttgagtattctctgtttatctctgtacccc

SEQ ID NO: 89811 - DNA, 72 bp, Mus musculus
ctgtgagtggaagagcacagtttttgttttaaattcaaaactatgctgttagagtatgcagttcagtcacag

SEQ ID NO: 89812 - DNA, 77 bp, Mus musculus
catatatatatatatatatatatatgcacatgtatacatatgtatacatacattatatgtatatgtatgtgtatgtg

SEQ ID NO: 89813 - DNA, 89 bp, Mus musculus
ttctctctctctctctctatatatatatatatatatatatatatatatatatatatatatttgggagagaaaagaactatatgagtgaa

SEQ ID NO: 89814 - DNA, 117 bp, Mus musculus
acaactaatgagaaaacttgtccttccagaaccagtatttcctctcaactgacactaactgcttgtagctttttctgtagagctgagggtctgcgagggcttctcattcacatttgt

SEQ ID NO: 89815 - DNA, 58 bp, Mus musculus
gtgtgtgtgtgtgtgtgcgagcgcgcgcctctgtgtgtgtgtgacactatgcatgtgt

SEQ ID NO: 89816 - DNA, 86 bp, Mus musculus
tgtttaaaaatatatgtgtgtatgtgtgtctatatgtgtgtgtgtatgtatgtatgtatgtatgtatgcatatagaataattaata

SEQ ID NO: 89817 - DNA, 112 bp, Mus musculus; identical to SEQ ID NO: 57513

SEQ ID NO: 89818 - DNA, 109 bp, Mus musculus
ctccagggagattgcctggctgcctgatccctgttgtttatctgttgaaatatctacaatttcacagaacattgagatcagacaaggtcattctgtccccatgatggag

SEQ ID NO: 89819 - DNA, 82 bp, Mus musculus
tgatgatatatttgtcagtgaagagtggcttttctttcctcttctcaaagaactgagcctctcacactctattatatcacca

SEQ ID NO: 89820 - DNA, 107 bp, Mus musculus
gcacatgttgtctgattcctagccttcaggtctgtctctttgtcacagctattcataattgttttcatacagtgaggctgtgcagttgatttacccagattcagagc

SEQ ID NO: 89821 - DNA, 91 bp, Mus musculus
tggagatgtttaattctgtagtattttctatagttagtaatttatttttaattaattatctgtagagataaatacgctaataaacacttca

SEQ ID NO: 89822 - DNA, 73 bp, Mus musculus
acacacacacacacacacacacacacacactatatgtaaacatgtgtatgtgtgtgtatgtctgtgtctgtgt

SEQ ID NO: 89823 - DNA, 74 bp, Mus musculus
atgcacacaagtatgtatgtatgtatgtatgtatgtatgtatgtatgtatgtatatcttcatcttcgtgtgtat

SEQ ID NO: 89824 - DNA, 115 bp, Mus musculus
gatgtatttccagcccacagaatgtgaaactttcaacaataatagttttttctttatctgatataagataaactggatttaactggaaattttaggtgtgtgtgtctgaaaggtc

SEQ ID NO: 89825 - DNA, 173 bp, Mus musculus
ccaaggtatcattgtgaagagtgttgttcaatttccacatgaatgttggatttctattatttatttttttattgaagatcaatcttaatccatggtgatatgataggatgcatgggacaatttcaatatttttgtatcagttgaggcttgttttgtgaccaattctgtggtca

SEQ ID NO: 89826 - DNA, 86 bp, Mus musculus
ctgcataggtttagacccattggcaaagggggtgctggcacatagttgtggtggaacattgtataggtctagatttaaaatggcag

SEQ ID NO: 89827 - DNA, 106 bp, Mus musculus
gtgtcaaggatagtctgtcaggtgagatgggtctcaagttggggtaccactggctggctactccctcagtctctgcctcatttttatccctgtacaacttgtaggc

SEQ ID NO: 89828 - DNA, 68 bp, Mus musculus
aggctttcatgtatgtgtatatgattataaccttcctttataatgtttgtatgcatacatgttaacct

SEQ ID NO: 89829 - DNA, 105 bp, Mus musculus
aagcaaaagttttacacatacacagaatcttggagtggtgaatttatttattataacatagatgaatatgaacttctggaagtgatggatatgattttattgttt

SEQ ID NO: 89830 - DNA, 94 bp, Mus musculus
gaaagatgtctaagtactgaggacagagatgagacagagaagaatcttttcccttactagaattttgccccctttcctcacttagagaattttc

SEQ ID NO: 89831 - DNA, 103 bp, Mus musculus
gtcttttgagacagggtttctctgtatagccttgcctgttctgggactcactctgtaactctttagaccaggctggcctcaaattcagaaatctgcctgcctc

SEQ ID NO: 89832 - DNA, 65 bp, Mus musculus
ccttcaaagtgagaaatgagtgtgcagataaattgcacattgtgatttttactttataaggaagg

SEQ ID NO: 89833 - DNA, 111 bp, Mus musculus
ctgatgaaaaatgtctaagtttttgatggatatatatatatatatatatatatatatatatatatatatatatatatatatcttttaagttttagttaatttgtttctcag

SEQ ID NO: 89834 - DNA, 95 bp, Mus musculus
gcttctctacaagaagccaagagttttaatctttcaatgtatattttttcctaagtgaaaaatgtttttattaactaatgcttctcaagggaagt

SEQ ID NO: 89835 - DNA, 77 bp, Mus musculus
ttgtattgcatgtacatgtgtacatacatgtacatgtatatgtatatgagtatgtatatgtgtgtgtgtattcccaa

SEQ ID NO: 89836 - DNA, 103 bp, Mus musculus
cactatttctaatattcaagtttatcagatgatgaatgtatatttaaatatcacatactgttgtctacttagcttgagataattttagataattttagtagtg

SEQ ID NO: 89837 - DNA, 107 bp, Mus musculus
ctggttctattttatttttattatatttagtttattcatgtttttcatgttggaatttatgagcatgtgcatgagcaggtgagtatctgtgtatatgtggagaccag

SEQ ID NO: 89838 - DNA, 116 bp, Mus musculus
ttatttagctaccctgggttttggtttctctatatgaagtcaagtctttaaaggtctgtaaagaagtatgttggatttttgatggagattgcattgaatttagaatgctttggtaa

SEQ ID NO: 89839 - DNA, 77 bp, Mus musculus
atgtgtacacatatgaatatatgtatatatatgcttattaatatatgtatatatgtgcatgtgtatatatatacata

SEQ ID NO: 89840 - DNA, 72 bp, Mus musculus
tgctttaagtcatacagggagggcatgatcattctaacgtggaagaagtgcctgactctctgtggctgtgta

SEQ ID NO: 89841 - DNA, 75 bp, Mus musculus
atatatattatataataaattatatatgtgtgtgtatatatacctatacatatgtataagtatgtatgtatgtat

SEQ ID NO: 89842 - DNA, 74 bp, Mus musculus
gcagttgtgcagtttggtccttacgtagttccctatcaattggagcacaggctgtctctgactgtgttgactgc

SEQ ID NO: 89843 - DNA, 71 bp, Mus musculus
agctcttcctctgctcaactctgctttcttccatcaggaagagagagtggacactgagcctagtttgagtt

SEQ ID NO: 89844 - DNA, 85 bp, Mus musculus
ttcagacaggaacaaatatgggtcagagatgtgactgtggaatggcaattccattcctcacttgatgttctgtcttcctgctgga

SEQ ID NO: 89845 - DNA, 113 bp, Mus musculus
cacgctaatataaaacttgaatggaggcgatggacagaggctcagtggttaagagcaatgactgctcctccagaggaccttggtttccttccttgtatccaattcactgcttg

SEQ ID NO: 89846 - DNA, 113 bp, Mus musculus
tcactgagactagatggcaaggtttgaccccaatgaaatttggatgtaaactaaagttaatgatattcactaatttgttgggactggaaaacattcccagatatgttcagtga

SEQ ID NO: 89847 - DNA, 96 bp, Mus musculus
atatatatgcgtgtgtgtatgtatgcatgtatatatgtatatgtgtatatatatacatatatatatgtatatatatatatatatatatatatatac

SEQ ID NO: 89848 - DNA, 118 bp, Mus musculus
acacacatatatatgaaaactaagaaattacatacatatatatatatatatatgaaaactaagaaattacatacatatatatatatatgtatgtatatatatatgtatgtaatttctt

SEQ ID NO: 89849 - DNA, 82 bp, Mus musculus
catatgtgtgtttgtgtgtgtataaatgaatatataatgtatataatgtacaatgtgcatatacattgtatacatatatatg

SEQ ID NO: 89850 - DNA, 108 bp, Mus musculus
accataatctatttaggtttgtttggtgggttggtttaagcaaaggaatgcatttgaaatgtatagattggtatttgctgattcacagtgtagatcaatatggtatgg

SEQ ID NO: 89851 - DNA, 83 bp, Mus musculus
atctctatataatgtatatatatacatacatgttatatatatatacatatatgtatgtatgtatgtatgtatgtatataggat

SEQ ID NO: 89852 - DNA, 107 bp, Mus musculus
tgtctctgtgagttcatatgttctttgctcaaattttctttattgattaatagattagtgataagaatgcattaagagatttactccaatgatgttcataatagaca

SEQ ID NO: 89853 - DNA, 100 bp, Mus musculus
gctgtagttgactcctaccaggttgttggatgtttagttcacaaagggagaccaagtaaactgtagtctgatacctgtgaaagatggcatcaggtacagc

SEQ ID NO: 89854 - DNA, 120 bp, Mus musculus
gtggcctagagaatctgtgtccttacaagtgccctctcttagctatcactctggctcagactctcctgaggaggactgggccagagaaggcattgtgggactgtaatggcccagagttac

SEQ ID NO: 89855 - DNA, 115 bp, Mus musculus
taatgaaagtagctagattttgggttttctcatggaagctttgaataggggaaggagactttttatatttatagctatcaaataagaccttggttagaaagctagaacttaatta

SEQ ID NO: 89856 - DNA, 90 bp, Mus musculus
tcttcctctaactttttcgttgtgttcctcaggcttagtccaatggttggctgtgagtatctgcatctgtaatggtaagttggtggtaga

SEQ ID NO: 89857 - DNA, 101 bp, Mus musculus
tatgcacatgcatgtgtgtagtattcacatatacgtatacatatatttgcttataaccaaataatatatgtatttgtatacgtcatatatatatgtttata

SEQ ID NO: 89858 - DNA, 157 bp, Mus musculus
tgtgtatgtctgtatccatgcgtgtgtgtgcattatatatatatgcatatatgtatatatacatatctatctatgtatatatatatatatatatatatatatatatatatatatatatatgatatatgtgtttgtgtgtgtgtgtgagtgtgtgtgt

SEQ ID NO: 89859 - DNA, 79 bp, Mus musculus
gaccaaggaggagaaatttattgaggttggttgtatatgaatatatggctaattttctcggtgtctctctctctctgtc

SEQ ID NO: 89860 - DNA, 84 bp, Mus musculus
tggagcatcttctgcgtatatgccaagttgtggtattgctgggtcctcatgtagtactatgtataattttctgaggaactgcca

SEQ ID NO: 89861 - DNA, 85 bp, Mus musculus; identical to SEQ ID NO: 57439

SEQ ID NO: 89862 - DNA, 94 bp, Mus musculus
tctctcccaagctcttaagcctcaggaagtgttacagtattttttgttttcattggcacttcttgttttgaaatttttaagagttcaatagtga

SEQ ID NO: 89863 - DNA, 93 bp, Mus musculus
tttaagtaaatttgcatggcattcctttcctcagaagtcactgaccactgacacaggaggatgaggggaacagaggcaggggcagggcttgga

SEQ ID NO: 89864 - DNA, 84 bp, Mus musculus
cttggaaaacattaatatttgtttttgacctaggtgccagggctatcttgtcttaggttctttgtcagtcacaaagtttccagg

SEQ ID NO: 89865 - DNA, 92 bp, Mus musculus
tgttcttcattgtagccattctgactagggatagatgtaaactaaaagtagtttgtgtttgtatatttttcaatgggtaatgatactgaaca

SEQ ID NO: 89866 - DNA, 74 bp, Mus musculus
gatcatcaaatgtacgtgactagactagaggaaaaggagggactgagtctcagtcagtctgtaattaggaggtc

SEQ ID NO: 89867 - DNA, 112 bp, Mus musculus
tctttgtccattcttctgttgggtgctatctaagttattctcattttgttgttgttatgaacagaaaataaatgaacatggctgaacatgtgtccttgtggtaggatgaaga

SEQ ID NO: 89868 - DNA, 92 bp, Mus musculus
atgtcttcattttgttcctgggactgtttatggcactccaagatgaactgcagaacgtttgaaggccacctggacagttttagggccgacat

SEQ ID NO: 89869 - DNA, 78 bp, Mus musculus
tagtcccccacagaaaccagaatgtatgtatgtatgtatgtatgtatgtatgtatgtatgtactgttttaggttgcta

SEQ ID NO: 89870 - DNA, 76 bp, Mus musculus
catttgtgcgcactctctctctctctctctgtatgtgtgtatatgtgtgtgagagagagctaagtgtgtgtgtgtg

SEQ ID NO: 89871 - DNA, 70 bp, Mus musculus
tgtttactctgtggaatatatatctatatctataggtagatatagagagatatagatatagagatagata

SEQ ID NO: 89872 - DNA, 76 bp, Mus musculus
atatatacatacatacacatatatgtatatatatacacatatatgtatatatatgtatgtgtgtatatatctatat

SEQ ID NO: 89873 - DNA, 92 bp, Mus musculus
gttggcctggtcattgtttatatgtataactgctctcttatgactgaagaaacagaacagtggacatgtaggaatacctcttactggcttgc

SEQ ID NO: 89874 - DNA, 85 bp, Mus musculus; identical to SEQ ID NO: 57439

SEQ ID NO: 89875 - DNA, 76 bp, Mus musculus
gggaggatatatatatgtgtgtgcttctgcatgtgcatgcgcatgtgcacgcacatgtttatatatatattcactc

SEQ ID NO: 89876 - DNA, 99 bp, Mus musculus
ctaaaaatgagagtttggattttagaggaagtaagagtccttatttttatagggatatcattaaagttttttaatttctaatgctctgggactttttag

SEQ ID NO: 89877 - DNA, 112 bp, Mus musculus
gattataaaatttaataaatgctagcttttatgtgtagatactcaaaacattatatttatgtttctgtaaattatatttttcgggttggcattgtagttcagtggtagggtc

SEQ ID NO: 89878 - DNA, 69 bp, Mus musculus
tataactacactgtagctgtcttcagatgatccagaagagggtgtcggatctcattacgggtggttgtg

SEQ ID NO: 89879 - DNA, 116 bp, Mus musculus
gaacaagccagaaaatgagaagaagccagcagaatagaacactatagacttatatttttttaaaacctactctgatagtggttcttaaaggcttcaaactcccatatagcttggtc

SEQ ID NO: 89880 - DNA, 79 bp, Mus musculus
tgtgtgtgtgtatgcatgtgtgtgcttatgtatgtatgcatgtatgtatgtatgtatgtatataaacacacatcacaca

SEQ ID NO: 89881 - DNA, 85 bp, Mus musculus; identical to SEQ ID NO: 57470

SEQ ID NO: 89882 - DNA, 115 bp, Mus musculus
atgatcagtttaatggtatttctataaatatgaacacatacatatgtatgtatatagtatgtatgtatgtatgcatgtatgtttataaacacacaagtacaacctgctgagtcat

SEQ ID NO: 89883 - DNA, 108 bp, Mus musculus
gtgtctagtaagagttgctgaatatcttataaggagaaatctcatattgaatagtggagtatattataatttttaacttgacattttgcctatggacttacttgacat

SEQ ID NO: 89884 - DNA, 85 bp, Mus musculus; identical to SEQ ID NO: 57439

SEQ ID NO: 89885 - DNA, 71 bp, Mus musculus
ttgtccctgtttggagtctcttactctgtttgtctgggtggccagaaagcagatgctcagcagagggatgg

SEQ ID NO: 89886 - DNA, 94 bp, Mus musculus
gctcttgtcatttaaccctacagctccttgtgactctatcactgtaactcagcttttctctgaacagtgtccagggaagtctgggatcaggagt

SEQ ID NO: 89887 - DNA, 88 bp, Mus musculus
tgagctgctatgaagtgtactctgctgtttgatctatatgacatagaagttccaaagattaattattcagtggagatgggcttgctca

SEQ ID NO: 89888 - DNA, 74 bp, Mus musculus
gaatattttgtacaggggagggaatcttggttttcatttttcggagtctctgtccctgtcatacagaaatgttc

SEQ ID NO: 89889 - DNA, 84 bp, Mus musculus
ctgcctcagcttccacagttgccaccttggttctgggactccacggaaagtaatctacacaggtcagagtgtggactgtgacag

SEQ ID NO: 89890 - DNA, 110 bp, Mus musculus
ccccgcagtctcaagttttaccagtttgtccactcactcaatttctgtgtcttccttattcctgttcatcttgtaggtatgaaaaattgtgagtcaaaggttttgtgggg

SEQ ID NO: 89891 - DNA, 133 bp, Mus musculus
gccagtgtgagtatgaatatataatgtatacatttatatatgcatatatattgggtatgcctatatatatatatatatatatatatatatatatatatattcacagataggcaagagttaagagaatatctaa

SEQ ID NO: 89892 - DNA, 75 bp, Mus musculus
cacaaggcattttcagttttggtgttgaatgactgcacaaaatatatttcatattgaaattgaaaatgtaacgtg

SEQ ID NO: 89893 - DNA, 111 bp, Mus musculus
aaaaactgtggctgtgttcacagtgattgggatccacaattctgtattttgcttgattctatataaatatatgtgataacaattaatgaataggaagaggcagtagttttt

SEQ ID NO: 89894 - DNA, 94 bp, Mus musculus
gccacctatagttaatactccagtgggcacaagagcagttctgtgtgtcttctctctgtatttctgtgtcctcctgctgtgaactatccaaggc

SEQ ID NO: 89895 - DNA, 72 bp, Mus musculus
atgtatctatgtacctatatacctatgtatgtatgtatgtatgtatgtatgtatgtatgtatatatgtatgt

SEQ ID NO: 89896 - DNA, 123 bp, Mus musculus
catataaatgtatatattatatatacatttatatataatatatagttatactatgtaaatgtatatatgtattatatatcatataaatgtatataaatgtatatattagcatattcatagcta

SEQ ID NO: 89897 - DNA, 90 bp, Mus musculus
caggcactttactgtctcccactgtctgtatgttctcattttcgttttggcggcccagtactgcaagttatgtaggacacagcatgcctg

SEQ ID NO: 89898 - DNA, 117 bp, Mus musculus
gtaatttttcaaggccaactgtgaacatgtgtagaagggttctttcacagaagttagaaagcactgctggcccctctaatgtaaaatgtgaagcagaggttatgggattccagttgc

SEQ ID NO: 89899 - DNA, 68 bp, Mus musculus
ccagagatgagagtgagctttcctggagctggaggtacaggtggttgtgagcttctcatcgatgctgg

SEQ ID NO: 89900 - DNA, 86 bp, Mus musculus
acaatgagagactcagaagatgctgagcacaggacactgaatgaagaagagaagacccgggcctcagattcttgtcttgtcattgt

SEQ ID NO: 89901 - DNA, 93 bp, Mus musculus
tgtatgtatgtatgtatgtatgtatgtatgtatgtgggatgcatgcacgagtatgtttccccatgtgtggatttgtgtgcatatgtgtgtgga

SEQ ID NO: 89902 - DNA, 115 bp, Mus musculus
gggactgaagctgtgaccagtcagaataatgtcaaagtgcttacagtgcaggtagtgatgtgtgcatctactgcagtgagggcacttgtagcattatgctgacagctgcctcggt

SEQ ID NO: 89903 - DNA, 136 bp, Mus musculus
gtcagtcggtcgcggggagggcctgctggtgctgcgtgctttttgttctaaggtgcatctagtgcagatagtgaagtagactagcatctactgccctaagtgctccttctggcataagaagttatgtcctcatcca

SEQ ID NO: 89904 - DNA, 88 bp, Mus musculus
cacaagcaaacacatatatatgtatatatgtgtgtgtatgtgtgcgcgcgcgcgcgcgcgtgtgtgtgtgtgtgtgtgtgtgtgtgtg

SEQ ID NO: 89905 - DNA, 85 bp, Mus musculus; identical to SEQ ID NO: 57439

SEQ ID NO: 89906 - DNA, 104 bp, Mus musculus
tacacacacacacatatatgtgtatgtatatatatgtttatatacatatatatgtgtatgtatgtatattcatacatatatgtgcgtgtgtgtgtgtgtgtgtg

SEQ ID NO: 89907 - DNA, 85 bp, Mus musculus
gagagtggctgtatcattttttatatagaatagtatatcatttttttatttactactttatataaagagtagtatatcttttttt

SEQ ID NO: 89908 - DNA, 104 bp, Mus musculus
gagtgagggctaaatgcttgtgtaagagaagacagtgtgcactaactagcaatacagctagtcttcactgtgtttgtgctcctaagcataccatgtaaatactt

SEQ ID NO: 89909 - DNA, 80 bp, Mus musculus
gtgtatatgtgtatgtatgtatgtatgtatgtatgtatgtctgtatgtatgtgtatacatgtgtacatatatgtgtgtgt

SEQ ID NO: 89910 - DNA, 90 bp, Mus musculus
gtcccctcatgtgttaaacatgctggcaggagcctgatatagctgtctcctgagaggctctgtcagtgcctgacaaatacagaagtggat

SEQ ID NO: 89911 - DNA, 85 bp, Mus musculus; identical to SEQ ID NO: 57470

SEQ ID NO: 89912 - DNA, 98 bp, Mus musculus
taactccatagtgtgcaggattcttacaaagtattactattcactctgcagctcaggatggtaagtatttctgatagtgtctgtgcgattatttgtta

SEQ ID NO: 89913 - DNA, 114 bp, Mus musculus
agcacaggggcgacatcattgccatactctacaggccctgagatctctgtcacagtctctgagttcatgtgcacatttctcctggttttatatggccttcttttccttagtgtt

SEQ ID NO: 89914 - DNA, 67 bp, Mus musculus
agtgtgtgcatgtgtgtgtgtgtgcatgtgtgtgtgtgcatgtgtgagtgtgtgcatgtgcatgtct

SEQ ID NO: 89915 - DNA, 78 bp, Mus musculus
agatatgaacgcgaagttaagaactcagaagacagtgaggtctgcagctgttcttcatgactttgctgtttcattttt

SEQ ID NO: 89916 - DNA, 110 bp, Mus musculus
tcagttataatatgatggggactgcttgtgacccagcacttaggaagaacagacagagcactctggagcaatctaaatttgatggaagtcataagttcccaggtaggtga

SEQ ID NO: 89917 - DNA, 96 bp, Mus musculus
tggcctttgtgtctgtggctgtggctgtgactgtgactgactgtgactgtgtgagcatttcttctatttgtaactacaactacatgtacatgtcca

SEQ ID NO: 89918 - DNA, 76 bp, Mus musculus
gctaactcactcagcctctctctgtttgtccctgcttcctctggggattttggtaatagatgctgatggccctggc

SEQ ID NO: 89919 - DNA, 79 bp, Mus musculus
cattctagatttattttcaatctcaagaacttggcatagataaaatttgtgctgttttatgagaggaatagatccagtg

SEQ ID NO: 89920 - DNA, 115 bp, Mus musculus
cagagacattggtcagtgttggagctaatatgagcttttgaattctcagtgtttttctgtcatcggcctattttgtagctcacttaactccttgcctcacagacctcggcctctg

SEQ ID NO: 89921 - DNA, 174 bp, Mus musculus
tgcaatatatatgtgtatatgtgtatatgtgcatatgtgcatatgtgtgtatatatgtgtatatgtatatatgtgtgcacatgtgtatatatatgtatatatgtgtgtgcatatatatgtgtgtgtgtgtgtgtatatatatatatatatatgtatatatatatatatatatac

SEQ ID NO: 89922 - DNA, 102 bp, Mus musculus
gtaatatatatgtatatgtgtgtatatatatatgtgtgtatatatataatgtagctgctatcacacataatatatgcatgatataattcccatatatactac

SEQ ID NO: 89923 - DNA, 117 bp, Mus musculus
tctgggctgtactactcaggtgtcagaagcttggaacagctgatcatattgcctcagagaagagagtgatgaatgcatgttttggctaaattgaattttcccattctatagtccagg

SEQ ID NO: 89924 - DNA, 85 bp, Mus musculus; identical to SEQ ID NO: 57470

SEQ ID NO: 89925 - DNA, 70 bp, Mus musculus
atatattacatacatatgaatgtaggtgtatatgatatgtatatatgtgtgtgtatgtgtgtgtgtgtgt

SEQ ID NO: 89926 - DNA, 81 bp, Mus musculus
gccagaggaaaatgtactggagttgattctcttcttctaccatatgggtcctggggattgaagtcaggcagcagacttggc

SEQ ID NO: 89927 - DNA, 77 bp, Mus musculus
tcaagtgttatcagaagagtcagagctctggtaatataaagtgaaacctggttctgggaagtttgaatgacaagtga

SEQ ID NO: 89928 - DNA, 91 bp, Mus musculus
gtcttgctgtctgtagaaagcttagttacatccttgggtacttccaactggaggccatcgacactgtctatctcacagatatggcaaggtc

SEQ ID NO: 89929 - DNA, 67 bp, Mus musculus
gtatgtatggtatgtatgtatatatgtatggtacgaatgtatgcatgcatgtatgtatggtatatat

SEQ ID NO: 89930 - DNA, 85 bp, Mus musculus
gtccatggtggtctgataggatgcatgggacaatttcaatatttttgtatctattgaggcctgttttgtgaccagttatatggtc

SEQ ID NO: 89931 - DNA, 100 bp, Mus musculus
atttttatttggagtgacaatttttgtaaggaagttacataattattatttaaaaataatttatcattctgattatacaattgtccaccctagtagaggt

SEQ ID NO: 89932 - DNA, 85 bp, Mus musculus; identical to SEQ ID NO: 57470

SEQ ID NO: 89933 - DNA, 136 bp, Mus musculus
ctgtatctgtctgagtcagcttctggggtagcctcttagaggatatgttcaggtaaaacagtgtatcattaatagtgtcaggaattgatgcttgtccatgtgacaggtttcaagttgggatggttattggttggcc

SEQ ID NO: 89934 - DNA, 99 bp, Mus musculus
ttcagggactcagagctgttaacagtctgtgattttttttttaaacaatggggaagacaaaaagtatacaagcaaagccctctgcagttaactcctgga

SEQ ID NO: 89935 - DNA, 80 bp, Mus musculus
cgtgcttaccttctctgggacagtctctgacacataaatagggttctgtcatgatgtccctactgtagagaaccagcatg

SEQ ID NO: 89936 - DNA, 106 bp, Mus musculus
atacataggcattgcctttagttttaaatatttattaattagtattctatagaaatctcatcttgagactaagcacaattagggtcctgaagactgtgctgtgtgt

SEQ ID NO: 89937 - DNA, 89 bp, Mus musculus
aagatgatatatgtatatatgtatatgtatatacacacatatatacatatatgtgtgcatatatatgtatatatatattaatcttatct

SEQ ID NO: 89938 - DNA, 81 bp, Mus musculus
tcataacttctgttactttcactgtgtctctgtttagtttctgtttccaggatctgtccattggtgagagtggggttttga

SEQ ID NO: 89939 - DNA, 104 bp, Mus musculus
cgagatgagaacaaggcctaccggtgccttgcaacaatagtgtggattacttttttatatttcatgctacagagaaaggaggcccttggttttgtggatgcttg

SEQ ID NO: 89940 - DNA, 76 bp, Mus musculus
gaagatggaggtacagttagatgactcaccactgcgtatatgtttgtctgtctatctgtctgtctgtctatctatc

SEQ ID NO: 89941 - DNA, 127 bp, Mus musculus
ttctccttagccccactctatctatatgccaccgaatattaaagtgcagagagagaagagagtggcctctccccttaaggagaaaagtctattcttagtcttgcttgtgttccctggatgtcagata

SEQ ID NO: 89942 - DNA, 86 bp, Mus musculus
tggatggttcagagcctccttaagttgtggcagccttcccgtctgtctcagtcagccaagggtggcactgtagctgtgagacacca

SEQ ID NO: 89943 - DNA, 85 bp, Mus musculus
gattatgtgagagaaaaggcagttgttctttgtcacaacagcttattgtgccctgactctgcctcagtgtttctcagatgctgtc

SEQ ID NO: 89944 - DNA, 85 bp, Mus musculus; identical to SEQ ID NO: 57439

SEQ ID NO: 89945 - DNA, 100 bp, Mus musculus
agtgaaaggggtccgcagttgtcagtacaaagtcagcactggagttctgtaactcacagaatcggtgtcatcctgtatctgcctctgctcctctggccct

SEQ ID NO: 89946 - DNA, 81 bp, Mus musculus
ggacagagtgttacgagagctaagtgaacgttacaccctctgtgactctgaagctgcctactctgtgtactctctcagtcc

SEQ ID NO: 89947 - DNA, 113 bp, Mus musculus
gatgggggcctcatatcagctggtgtatgctgcctggttggtcactcagtgtctgagagatctcgggggtgcaggttaattgagactgctggtcttcctatggagtttccctc

SEQ ID NO: 89948 - DNA, 118 bp, Mus musculus
aagcactgccacaaactgcctttcagatagccacgtgtatggcacagatcagcaggatgagatgcagtgtttaatctcagcaatatgtgcctccttgtgatctgggccatagcttggc

SEQ ID NO: 89949 - DNA, 138 bp, Mus musculus
gtgtatatatgtatatgtatgtgtatgtttatatgtacatatatatatatcttgtaggatatatatcttattatatatgtgtgtgtatgtatatatgtatataatatgtgtatatacatatgtgatatatataaaaag

SEQ ID NO: 89950 - DNA, 77 bp, Mus musculus
ccctggccagatagtagagacagtgctcagagctcaccgagttgttagactggactgtgttgttctcatccacaggg

SEQ ID NO: 89951 - DNA, 76 bp, Mus musculus
gatttctggtaaaggtgtgtgagctgagagcgggtctctgcgtctctgtttatctgctgctgcctttctggaaatc

SEQ ID NO: 89952 - DNA, 78 bp, Mus musculus
agctgggcatctcagtgtgaaagtcagcgttccaaaggcacactgcttccctgctctcactcactgtatctgcctgct

SEQ ID NO: 89953 - DNA, 80 bp, Mus musculus
cagagtcggaagggaagaaaatggagtgagctgggctagtgactgctctttctctcacagtcttccccttatagatgatg

SEQ ID NO: 89954 - DNA, 126 bp, Mus musculus
agagagagagagagagagagagagagagagagagagagagagagcatgagcatgcacatctatgtgtctgagtctgtgtatgttcttgactttctccccttcttcctcttcctttctctctggttc

SEQ ID NO: 89955 - DNA, 64 bp, Mus musculus
gtatgtatgcatctatgtatgtatgtatgtatctatgtatgtacgtatgtatctgcctacctac

SEQ ID NO: 89956 - DNA, 114 bp, Mus musculus
tactataattttgtgattactattttgagagggtattggctttgtaaaattaactttgattttataattgctacctcccagaaacatctgtatgcatatttctttttagcagta

SEQ ID NO: 89957 - DNA, 56 bp, Mus musculus
tgtatgtatgtatgtatgtatgtatgtatataatacctattatatacatacataca

SEQ ID NO: 89958 - DNA, 77 bp, Mus musculus
gtgacatatgtctgtatatgtgtatgtgacatgtgtgtgagatatgtgtgtgatgtatgcatatgagatatgtatac

SEQ ID NO: 89959 - DNA, 109 bp, Mus musculus
tgtgtatacacatatgtatacacatatgtatacatgtaatatatatgtgtatatatgtgtatatacatatatacatgtatatatgtgtgtgtatgtatgtatgtatata

SEQ ID NO: 89960 - DNA, 103 bp, Mus musculus
catacacacacacacacacacacacacacacacacacacacacacacacacatacatgtatgtatgtatgtatgtatgtatgtatgtatgtatgtatgtatgt

SEQ ID NO: 89961 - DNA, 79 bp, Mus musculus
ctcattggttctggtggcaccaacctgtatttcagctacttgggaggctgaggtagtaggttgtcagttctagtttgag

SEQ ID NO: 89962 - DNA, 117 bp, Mus musculus
tatataagtgcatatgtatacatacaacacatacatatatgaatgtgtgtatatatgttcatatgtatacacacacatatatgtgtgtatgtgtgtgtgtgcatgtgtatatatata

SEQ ID NO: 89963 - DNA, 108 bp, Mus musculus
gctccaagttctgggttcagtctgcattattaagtgtattaaacacacttcactctcagtgtcacaatacttaggtctgctgggattttatgacacagaaattagagt

SEQ ID NO: 89964 - DNA, 86 bp, Mus musculus
ctcttgctacagaaggatactcactatcgtgtgagaggggacgaatggcagtatctcacagtgactgtttctgtcattagcaggag

SEQ ID NO: 89965 - DNA, 58 bp, Mus musculus
tcctgcctgcctgtctgtctgtgtgtgcacatgtacatgccaagggcacacagctgga

SEQ ID NO: 89966 - DNA, 72 bp, Mus musculus
ggtagaccatgagagatgcggtgggaagctgctctggttagtcttagggtcgcatgtgtctgtctgtctgcc

SEQ ID NO: 89967 - DNA, 71 bp, Mus musculus
tgctgacgatggcctctgaccctctctcaatggctgacgggaagaagagggtgactgtcaaccgaacggca

SEQ ID NO: 89968 - DNA, 130 bp, Mus musculus
cttttctctttttagggtttacttttattatatttgcatgagtgtttcgtctgtctgcctgtctgtctgtgtaccacatgcatgtagtacccatggaagccagaagagagctttggaccttctggagatg

SEQ ID NO: 89969 - DNA, 112 bp, Mus musculus
gacattgctattaagcccaagcgggtcataggaggtcctgaatttatattcactgtgtcagaagtgagtgtcctaggaaccccaatcttacaggcttgaagcagtctgagtc

SEQ ID NO: 89970 - DNA, 81 bp, Mus musculus
tgggcaatggtattctgagttcaacgtggaacccaggtgtcttagctagggttttactgctgtatacagacaccatgacca

SEQ ID NO: 89971 - DNA, 97 bp, Mus musculus
cactcacacatacaaacacatacaaactctctgtgtctctgtctctcctatataaaattatttcagggacaggggatatagctcggttggtagagtg

SEQ ID NO: 89972 - DNA, 64 bp, Mus musculus
tacagacactccatgttgctgggagacagcgagacagttgctctctctctgactggtgcctgtg

SEQ ID NO: 89973 - DNA, 82 bp, Mus musculus
gtgagcacacatgacaggacagagtgtgagcacacatgatggagtgtgagcacacatgactgacaggacagagtgtgagcac

SEQ ID NO: 89974 - DNA, 120 bp, Mus musculus
gcgcggccaacagcccgcagcgaagcgccccgtccactcgctcgctcgctcggtccgtgtgaccctccctccggggggggcgggcgcccggcggcggaaaaacagccggtagggcggggc

SEQ ID NO: 89975 - DNA, 83 bp, Mus musculus
tttgctttctgtatctttagaaactagctcttttaacattgctaaatatgatgagctagttgcttggagtcttggaatataag

SEQ ID NO: 89976 - DNA, 83 bp, Mus musculus
ctgtccctcatctacccacactctcactgagacaggcacacactcacccacacagatagatggatggatggatggatggatgg

SEQ ID NO: 89977 - DNA, 83 bp, Mus musculus
gtgagatggctcagtggttaagagcactgactgctcttctagaggtcccgagttcagtgcccagcagccacatagtggctcac

SEQ ID NO: 89978 - DNA, 87 bp, Mus musculus
agatcttcattctgagatgtgtttgtgatgttcttaaagcagaggtagggactctgagaaacacattaccttacatgtttgtgttct

SEQ ID NO: 89979 - DNA, 76 bp, Mus musculus
tcgtacaagtcacatcatgttgtagccgttggacaccagtctctccaggcgctgcagtgtggtagtagcttgtaga

SEQ ID NO: 89980 - DNA, 112 bp, Mus musculus
ggaacctgctttaagaatttgtggaatctgctggagaaatggggcagaggttaagagcactgactgctcttccagaggtcctgagttcaattcccagcaagcacatggtgcc

SEQ ID NO: 89981 - DNA, 102 bp, Mus musculus
gagcttaaagcagaaccaggaggggaagatttggatggaattatggtggctactgtcactgtctcaatctccccaaagggccgtacttggatgctgtggctc

SEQ ID NO: 89982 - DNA, 86 bp, Mus musculus
tatatatatgtatatatatgtatatgtatatgtatgtatacacacatatacatacatatatatatatttatataaatatatatata

SEQ ID NO: 89983 - DNA, 79 bp, Mus musculus
gcgatgggagatgcaaacccggagacttgactaagccacccgagtgctgcctctgtctcactgtgacatctgtccttgt

SEQ ID NO: 89984 - DNA, 74 bp, Mus musculus
acacatgtatgtatgtatgtatgtatgtatgtatgtatgtatgcatgcatgcatgtgagtatgcatgtgtgtgt

SEQ ID NO: 89985 - DNA, 113 bp, Mus musculus
tatagcagggcccactgggaactgcagatgctctctctttttctcaccgtctctttcttacaaacctcctcacggttaccagtgtctgtagcggtctccattcccctggtgtg

SEQ ID NO: 89986 - DNA, 75 bp, Mus musculus
ccgaggctcagaacagtgggtgctcagtcgatccgtgttgaatgcataactgatgtgaccattttgagaaactgg

SEQ ID NO: 89987 - DNA, 85 bp, Mus musculus; identical to SEQ ID NO: 57470

SEQ ID NO: 89988 - DNA, 85 bp, Mus musculus
ggccatggttatctgataggatgcatgggataatttcaatatttttgaatctgttgagtcctcttttgtgaccaattatatggtc

SEQ ID NO: 89989 - DNA, 83 bp, Mus musculus
tgctctgtaagccctgtgtcagtcaggattggctggctcctgtgcacttcctagcctgcctgtctctgcctctcagcatctta

SEQ ID NO: 89990 - DNA, 63 bp, Mus musculus
cagacaaacatctctgggatatagccatgtttatgtgtgtgtctgtgtctatctgtctgtctg

SEQ ID NO: 89991 - DNA, 64 bp, Mus musculus
tgtgtagttgtttgaggtggtgatggcctttgagaagacagtgacctctggaaatgattgcaca

SEQ ID NO: 89992 - DNA, 85 bp, Mus musculus; identical to SEQ ID NO: 63858

SEQ ID NO: 89993 - DNA, 80 bp, Mus musculus
acctggaaccccagcctccgacaccggctccccatccacgtcaccgagcgtctctggtgtgtctgtttgtgtctccaggt

SEQ ID NO: 89994 - DNA, 66 bp, Mus musculus
gttggggagagccagtgggctgtttcctgctctgtggtcacaagctgactgtgtctctgaccctgc

SEQ ID NO: 89995 - DNA, 105 bp, Mus musculus
gggcctgagacaggctagtgaacattgggctggccctcagattgccagctggttcttctgtcagtctctctgcctgaaaccaacagagtcttccaggtgagctag

SEQ ID NO: 89996 - DNA, 99 bp, Mus musculus
ctggaaaattcacctctgtccctgagattatattattactgtctatctctctcaaaggaaagtaagctcctgaggtcaggggtcaggcctgggttccgg

SEQ ID NO: 89997 - DNA, 81 bp, Mus musculus
tctctgctctccaggcctcatcagtccctgtcagagtgtagcctgtgtggactgccaggggctgtcactgagcctcagaga

SEQ ID NO: 89998 - DNA, 71 bp, Mus musculus
gtctgtctgtctgtctgtctgtctgtctcggcaccctctttctactgcctgcagatacagatacagaatgc

SEQ ID NO: 89999 - DNA, 102 bp, Mus musculus
ctcaccaggtagctgagaggattttcttgaatttctgagtctcctacgtaccgggactgtagacagacaccagcaacaatatctactttatacagtgttgag

SEQ ID NO: 90000 - DNA, 105 bp, Mus musculus
gagtaaagctgagtgtggaggctggagagatagctcagcagttaagagcactgactgctcttccagaggtcctaagttcaattctcagcaaccacatggtggctc

SEQ ID NO: 90001 - DNA, 73 bp, Mus musculus
tccctgtggtagtttgaatagaagtggcctcctagtcataggctcatatatttgaatatttaatcattaggga

SEQ ID NO: 90002 - DNA, 97 bp, Mus musculus
agggcccacatgtccaggttagaatgggtcagatctgtgtctgtgacacaggcactcagcatcggaggctgcttcacctttgggagttcatggcctt

SEQ ID NO: 90003 - DNA, 104 bp, Mus musculus
tggggagttctgtgtggaagagttggggtaaggattgagggacccaaagaggacagggacactcacacacatactcatacaatacattcatacacactctcaca

SEQ ID NO: 90004 - DNA, 85 bp, Mus musculus; identical to SEQ ID NO: 57439

SEQ ID NO: 90005 - DNA, 84 bp, Mus musculus
gccaaggatagctacagctgcagcctgacacaaaaccatacgcatcgttacgtgatgacaggattgctgtgtggctattttggt

SEQ ID NO: 90006 - DNA, 82 bp, Mus musculus
gttttgcctgtctgtctgtctgtgtgtgtgctgtgcgcgtgcgcgtgtgcggtacccacagaggccggagatatcgtcggat

SEQ ID NO: 90007 - DNA, 115 bp, Mus musculus
tgtgcgatgagactggtatgctttcttaacatagcagctgcagtctctgacagtgtcacaatcacttcaagggcaagctggcgctgcatattattgaggttagtgtctccacaca

SEQ ID NO: 90008 - DNA, 69 bp, Mus musculus
tgtgtgagtctgtctgtctgtctgtctaaggccaggtgagttctacagcaggcagcacagtagtacaca

SEQ ID NO: 90009 - DNA, 66 bp, Mus musculus
aggacccgagtttaggaagatgcccttccttggaaactcttggggcacactctctctctgggtcct

SEQ ID NO: 90010 - DNA, 76 bp, Mus musculus
gggctgggactgtcttagagaccagggagggatattgcctatgggcttgctctctgagacacactcttatatgccc

SEQ ID NO: 90011 - DNA, 65 bp, Mus musculus
tttgtatgtatatatgtatgtatgtgtcacacacgtacatacatacatacatacatacatacaaa

SEQ ID NO: 90012 - DNA, 82 bp, Mus musculus
tcctgaagtgttaaattactgagcgatgtcacatgctccaattttctttcagctgtgggactctcagactgagaagtcagga

SEQ ID NO: 90013 - DNA, 111 bp, Mus musculus
actgtgctttgtggggaacagggcctcgggttgtaaaggggattcacagtgatgtttatatgtttatatgggttggacctgctcagtgtcccgaaccctcagaagcacggt

SEQ ID NO: 90014 - DNA, 84 bp, Mus musculus
tggggtagatatgatcaagatacaatgcatacatgtatgtatataggtgtgcatgcatgtattcatgtatgtataacaacaaca

SEQ ID NO: 90015 - DNA, 138 bp, Mus musculus
cacacacacactggcacagggaggagcgtgagctcgcacacacacactggcacagggaagagcgtgagctcgcacacacacactggcacagggaggagcgtgagcttgcacacacacactggcacagggaggagcgtg

SEQ ID NO: 90016 - DNA, 58 bp, Mus musculus
ctgttgtctccagcaggtcagccaaccgtgcgcctgcctggctgcctgtcagtcacag

SEQ ID NO: 90017 - DNA, 80 bp, Mus musculus
agcacatacagagttgtttgctggaactctgtctgtctgacagacagcccttcagagcagctgttctatctctaagtgct

SEQ ID NO: 90018 - DNA, 91 bp, Mus musculus
gtcctctgcgcctgcctgcctgcctgcctgcctgcctgcccatccacagccctctggcagggcaactctggtcaccagtgatgcagtgtcc

SEQ ID NO: 90019 - DNA, 109 bp, Mus musculus
ccagaccttttcaaaggagggctggagagatggctcagccgttatgagctctgactcctcttccagaggactgggttggattccagctgacaataacatggcagttcca

SEQ ID NO: 90020 - DNA, 75 bp, Mus musculus
ctgaaggagtcctcctttctcacactcactgttactctaccattgaccaacagtgagtctggctgacttccttag

SEQ ID NO: 90021 - DNA, 65 bp, Mus musculus
tagtgtgattctatatatctatatatctttatctatagaggtagtaggtatatagatatctgcta

SEQ ID NO: 90022 - DNA, 107 bp, Mus musculus
tatctatatagatagtatagatagtagctatctatatatagatgtatagtatctatatagatataaatagatagcagatatctatatacctactacctctatagata

SEQ ID NO: 90023 - DNA, 98 bp, Mus musculus
tgacagtgtaatatatatatatgtgtgtgtgtgtgtatacatatattttatatatatatatatatatatatatatatatatatgctatattcccactg

SEQ ID NO: 90024 - DNA, 82 bp, Mus musculus
gcaagggacagactccacttgctattgtgtaatggagctctgggcccagagtgagaacacaggggggttgagcagtcccagc

SEQ ID NO: 90025 - DNA, 77 bp, Mus musculus
tagaactctgaagagagagtccacaggtgacagagcttgagcatctgtagatgagagagtcctctgttcaaggtctg

SEQ ID NO: 90026 - DNA, 116 bp, Mus musculus
agtctgacatcaggggctccttggttgttggaccatagggaataaagaggtctgtggcttgcctcacagtcactctgtccaaggacagcaatgccaatgagtcttaggcagtggct

SEQ ID NO: 90027 - DNA, 67 bp, Mus musculus
ggttgtcatgtcttggatgggttccctggggacatcctggccaccctctctctgtcacatgacagtc

SEQ ID NO: 90028 - DNA, 66 bp, Mus musculus
caaggtcagacacataccagagcagtgtctcagagggataggggtgtgtgtgtgtgtgtgtgtgtg

SEQ ID NO: 90029 - DNA, 78 bp, Mus musculus
tgcctctccctcactgactgcaaggagaccgctacaatcgggttaagaaactgtcgtccaggtgaggctttttaggta

SEQ ID NO: 90030 - DNA, 118 bp, Mus musculus
gtgtgtgtatatatatgtgtgtgcatatatatgtgtgtgtgcatatatatatatgtgtgtgtatatatatgtgtgtgtatatatatatgtgtgtgtgtgcgcgtgtgtgtgcgcgtgt

SEQ ID NO: 90031 - DNA, 78 bp, Mus musculus
ctgcctttctctgtctgtctctctctgtgtgggtgccgtggtacacagagaggttagaggacagcctccgggagttgc

SEQ ID NO: 90032 - DNA, 69 bp, Mus musculus
tgtgatttatacatatatacgtatatatatgtatatatatatatatgtatatgtatatcatctatcaca

SEQ ID NO: 90033 - DNA, 86 bp, Mus musculus
gagtgagtgagtgagtgagtgagtgagtgagtgggtggcacgtgcctgcacctccagactccttagtcttggtacttgtcttagtt

SEQ ID NO: 90034 - DNA, 69 bp, Mus musculus
gaggaggaagacaagcagcagggctgagccacacggcacgccagccccacactgtctctctctctcttc

SEQ ID NO: 90035 - DNA, 83 bp, Mus musculus
acactacagactcatgctcctgacacgtatgtatgcatgtgctcatacatgcatgaactgtgtgtccgtctgtctgtctgtgt

SEQ ID NO: 90036 - DNA, 60 bp, Mus musculus
tgtatgcatgtatgtatgaatgtttacacagatgtgaatatgtatgcatatatgcacaca

SEQ ID NO: 90037 - DNA, 66 bp, Mus musculus
tctgtctgtttgcctgtctgtctgtcaaactgttgtatgggagcacagagggcttccagcacatga

SEQ ID NO: 90038 - DNA, 77 bp, Mus musculus
ccttgtttactcgctgtcactgactctgaggtccaggagacaggagttcgtaaacagaggcaggtgtgtttataggg

SEQ ID NO: 90039 - DNA, 160 bp, Mus musculus
tagtgctcttaacctctgagccgtttctccagcccccaggagatttttttctttttaaatattaaaaatgaccagcgggctggagagatggctcagcagttaagagcactgactgctcttccagaggtcctgagttcaattcccagcaaccacatggtgg

SEQ ID NO: 90040 - DNA, 115 bp, Mus musculus
caacagctcaatcggggccatgcctctaaccccggcactcaggaacactagtcactgtgctcagaggcactattactatgtgtgtgcatatgtggcattgcagattgatttgagg

SEQ ID NO: 90041 - DNA, 115 bp, Mus musculus
gaatcatacaggatgaccgctggaggaggcacggtgtcttctgttgtttctcggtacacagacagacagacagacaagcccagcacagtaggatatggagtttatcatcagattc

SEQ ID NO: 90042 - DNA, 57 bp, Mus musculus
tggagactgaacagagtcaccttaaatcctgggaaggtgattcatgctcagtgttta

SEQ ID NO: 90043 - DNA, 121 bp, Mus musculus
gaatttgggtcctctgcaagagtacctagttctggggctggagagatggctcagcagttaagagcactgactgctcttccagaggtcctgagttcaattcccagcaaccacatggtggctc

SEQ ID NO: 90044 - DNA, 92 bp, Mus musculus
gctggtgtaagctccatcaggacggcggctgccctccttccttgggaggtattataatggctgtgctagaattgagctcatttgacatcagt

SEQ ID NO: 90045 - DNA, 80 bp, Mus musculus
ccatgtaggttctgaggaatgaagtcaggtctgtctggtaggctgccagcaaccttttactcactcagctagctcattgg

SEQ ID NO: 90046 - DNA, 66 bp, Mus musculus
tatatgcatgtgtgctcatatgtgtctgtgtatgtatacatttgtgtgtgtgtgtgtgtgtgtgtg

SEQ ID NO: 90047 - DNA, 133 bp, Mus musculus
ggagaggttccactttgaaaaacggaagtcctagagtgcttcatgttagcaggatttatcttttttttttcgagacagggcttctctgtatagccctggctgtcttggagctcactttgtagaccaggctggc

SEQ ID NO: 90048 - DNA, 83 bp, Mus musculus
tcgaggttcatcaccgtatgataagttgtaccctggcacacactcactgtaagttgaagttaccacaaggtgatggttctcga

SEQ ID NO: 90049 - DNA, 88 bp, Mus musculus
tgtatccatcctgtcagtgaaactttggctgtgtggttctgaggatgattcactgtgcttctagtttctctgacatttctactctgca

SEQ ID NO: 90050 - DNA, 60 bp, Mus musculus
ggccagatagactgagttgtttagctgtgggcttagctagagactctgtctgactcagtc

SEQ ID NO: 90051 - DNA, 97 bp, Mus musculus
tactgtgtcgggtggtaatcctgaggaagtactttgtattgctgctttttagtgataatgtaagtattctcatcaaatgccatataaatttagggtg

SEQ ID NO: 90052 - DNA, 85 bp, Mus musculus
gtccatggtgatctgataggatgcatgggataatttcaatatttttgtatctgttgaggcctgttttgtgaccaattatatgggc

SEQ ID NO: 90053 - DNA, 68 bp, Mus musculus
ccaggtcactgacactgtctcccaaattaacccaacaaactggacggcagagcagtgaaacatcttgg

SEQ ID NO: 90054 - DNA, 61 bp, Mus musculus
ggttcagaggctgaaaagtcttgtcatcaggactgacgacctgagttcagtctctgagacc

SEQ ID NO: 90055 - DNA, 97 bp, Mus musculus
cttatgagattcagtcatgtatgtatgaatgtttgtatgtatgtatgcaggtatgtacatagttcattcattttcatagctgtataaaattcaaaag

SEQ ID NO: 90056 - DNA, 110 bp, Mus musculus
gtgtgtgcttgcacatgtgtgtatgtctgtgtgtatgtgtgtgtgaatttatatatgtgtatgttcgtgtgcatgtgcatacatgtgtgtatgcgtgtacatgtgcacat

SEQ ID NO: 90057 - DNA, 85 bp, Mus musculus; identical to SEQ ID NO: 57439

SEQ ID NO: 90058 - DNA, 117 bp, Mus musculus
cctggggcaggagttgcagatggttgtgagtcagagatgtacctttatagtcttttacttgttctcataaatacagttatacctctattacagtctctctgtccccccaccccttgg

SEQ ID NO: 90059 - DNA, 83 bp, Mus musculus
agggattcagtgaatatgtccaatttagggctgagtgttccaaggtctctcactctctgtataatatgtagctgtgtgtctct

SEQ ID NO: 90060 - DNA, 87 bp, Mus musculus
gctgggtggtctcaatgctgggaggattcaggaatagccggctccgctcttgctcctggctctctctcaggctgtggatgatgctgc

SEQ ID NO: 90061 - DNA, 115 bp, Mus musculus
atgagttcttgcaccatttgacaagactagtggcatgggatgattatttgattatgtatcatctgtcaccctacattacatcattacatcttctgtttatgggtcaaattcttat

SEQ ID NO: 90062 - DNA, 85 bp, Mus musculus; identical to SEQ ID NO: 57439

SEQ ID NO: 90063 - DNA, 99 bp, Mus musculus
gttcctctgcaccaacatatcacctcagctgtgttctctccttcctgtgatgacactggctgtattgagcactgtgtgttagaattcccagaggggaac

SEQ ID NO: 90064 - DNA, 85 bp, Mus musculus; identical to SEQ ID NO: 57470

SEQ ID NO: 90065 - DNA, 104 bp, Mus musculus
gatcaaacttattccatggtggtctgataggatgcatggatcaatttcaatatttttgtatctgttgaggcctgttctgtgaccaattgtatggttaattttgg

SEQ ID NO: 90066 - DNA, 88 bp, Mus musculus
tacttgtttttcatatcactaatatatgtatgtatgtgtataatatgtgtataatatgtgtatgtatatttatgtataagaagaagta

SEQ ID NO: 90067 - DNA, 85 bp, Mus musculus
ggccatggtggtctgataggatacatgggataatttcaatatttttgaatctgttgaggcctgttttgtgaccaattatatggtc

SEQ ID NO: 90068 - DNA, 85 bp, Mus musculus; identical to SEQ ID NO: 57439

SEQ ID NO: 90069 - DNA, 97 bp, Mus musculus
ttaattggagataaagtgacacatgagaaaaaaagtaatcatatgtatatttctttttgataattcagtgattatttgtggctgattttctagttaa

SEQ ID NO: 90070 - DNA, 77 bp, Mus musculus
gatttggcctactgaaagttaaaatgaggtcagcagagatttatctcaatctctgtcacccttttcagtttataatc

SEQ ID NO: 90071 - DNA, 106 bp, Mus musculus
gccttagtccatggttgtctgataggatacatgggacaatttcaatatttttgtatctgttgaggcctgttttgtgaccaattgtatggtcaattttggagaaggt

SEQ ID NO: 90072 - DNA, 81 bp, Mus musculus
tttgccacactcttttttaagaatataagctatgtataaaactctgtaccagagtttatcttaaagttagaggtctgtaaa

SEQ ID NO: 90073 - DNA, 81 bp, Mus musculus
ggttcctgttgccagcctgtctctccctgcctcactggtttttagagcagagataagagagacgtggtcactcccagaacc

SEQ ID NO: 90074 - DNA, 79 bp, Mus musculus; identical to SEQ ID NO: 72631

SEQ ID NO: 90075 - DNA, 78 bp, Mus musculus
tgagcccctgttaacagtacattgaaagcattctgctgatgtcaaattgtacgttgctgtttttaggtggtaatctca

SEQ ID NO: 90076 - DNA, 75 bp, Mus musculus
gacagagaatgtcactaggcttggtgtggacctttgaaacccaaagcccacactctgtctgtgacacaccttgtc

SEQ ID NO: 90077 - DNA, 86 bp, Mus musculus
tgactggagatgagtatgataggttgttgtttgtaatgtatgggctagaaaacgaatatttccttcatcagctaatctgccactca

SEQ ID NO: 90078 - DNA, 84 bp, Mus musculus
gtgggccccttccaacctatgacttgctttcagtcagaagaaatgatgatattacacagagcagactgaagtcagaggtcccac

SEQ ID NO: 90079 - DNA, 78 bp, Mus musculus
cctcagagtggatgggcacactgtccactgtgagcacacaggccctgtgcacctgctttattcattccactcgtgagg

SEQ ID NO: 90080 - DNA, 97 bp, Mus musculus
ttttctcctaaaattaattttctgtgttctagctttataaatatatatgcttggtgcataaagcaattaagctgtaaagagcagataaaggagaaaa

SEQ ID NO: 90081 - DNA, 75 bp, Mus musculus
ctaacaagtaccagaggttgaaggttgaacctagatctggcttcagagttcactttcactctcacaggcttttag

SEQ ID NO: 90082 - DNA, 84 bp, Mus musculus
ggctatgaagaaaattcacaagggaaaagcgctaaatacttaagaactgtggggtagtgcttttgttgtagtgacttctgagct

SEQ ID NO: 90083 - DNA, 67 bp, Mus musculus
aatcacagaagaatgatagtagagagcatggaggaccatgccaagatgctaccatctttctgagatt

SEQ ID NO: 90084 - DNA, 103 bp, Mus musculus
atagctgcttaattatgtatgcatatatgtatatatatatatatatatatatatatatatatatatatatatatatacacacacaaatataattgtctcctat

SEQ ID NO: 90085 - DNA, 81 bp, Mus musculus
tgtgaactctgcacattgttttccaaaatgtcaacactggctggcatcctagtgtttctgtttgtgatagtgtcattcaca

SEQ ID NO: 90086 - DNA, 76 bp, Mus musculus
gctttcaactgtcagagtgttctgctcaagttcatgagactgagcaacaggaactgagacatctgaagtcatgagc

SEQ ID NO: 90087 - DNA, 120 bp, Mus musculus
actgagggggattctggaaaacacaggtctggccttgtgcaaaactagtgattatgtagattggacaactctagcttggtataacaccacagacaagtgagttcagcatttaagttacct

SEQ ID NO: 90088 - DNA, 86 bp, Mus musculus
ctcagacctgttctgtcactgtgagctaggccacctagggtggaatcttctgtcctagatagttctattgttatgccacctctgag

SEQ ID NO: 90089 - DNA, 85 bp, Mus musculus; identical to SEQ ID NO: 57470

SEQ ID NO: 90090 - DNA, 71 bp, Mus musculus
cagttctcaggtcactctcactgagggagtcacagcaggaacccaagtcaggtgtgaggaggtaggaactg

SEQ ID NO: 90091 - DNA, 98 bp, Mus musculus
gctttaggtcagggcatggtgattccaccagaggttctttatccttgagaagagtttttgttattccagatgaatctgccgattgccctttctaattc

SEQ ID NO: 90092 - DNA, 107 bp, Mus musculus
acatatgtgactgtgttagtgtacatgtgtgtatatatctgtatatgtacatgtgtgcatgtatgcacatgtgcacatatatagcagagatatatgtatgtgtacat

SEQ ID NO: 90093 - DNA, 64 bp, Mus musculus
tatgtatatgtgtatgtgcatgtgcatgtatgtgtgcatgtatgtgtgtatgtgtgtgtatgtg

SEQ ID NO: 90094 - DNA, 61 bp, Mus musculus
gacactggctctctctgtgggtcgcctctgtagttcacatcagggtgctttttttagtgtc

SEQ ID NO: 90095 - DNA, 96 bp, Mus musculus
gatcagccttaatccatggtcatctgatatgatgcatgggataatttcaatatttttgtatctgttgagtcctgttttgtgaccaattatatggtc

SEQ ID NO: 90096 - DNA, 79 bp, Mus musculus
atttgttgatttaaaaataggagtgcttactgctcgtttagatttgggcattagtactgattttcttgaattgactaat

SEQ ID NO: 90097 - DNA, 71 bp, Mus musculus
ggcctcccattgtaaagtgtgcatgtgcatgtgtaacgttgcagaagcagcatgcaataaggtgggcagct

SEQ ID NO: 90098 - DNA, 126 bp, Mus musculus
tatatatatatatgtgtgtgtgtgtatatatatatatatatatatatatatatatatatatacacacatatatatgtacatatatatgtgtgtgtatgtatatatgtgtgtatatatatgtatgta

SEQ ID NO: 90099 - DNA, 102 bp, Mus musculus
ttagaagcaaagacgtgcctcaattttgtcagtactgaggctgcagagaaagcatctttctgatgtctgtctggcaaggaggataggatgtggctcttctaa

SEQ ID NO: 90100 - DNA, 82 bp, Mus musculus
cagactccccaggtttagagccagcatagtggcaacaatgggagggtgtcacttgcctgtctgactgtttctctggggtttg

SEQ ID NO: 90101 - DNA, 105 bp, Mus musculus
cactggccttgtctggttttgtagcttccagagagtgtcatgtgtaacagtaacagtactcattatcttctacagaggctgactttttaaattgagacactagtg

SEQ ID NO: 90102 - DNA, 71 bp, Mus musculus
gacgagggtgactctcagtgactcatgctcctaggcttggaggtagtgtttctgctgagatttctcttgcc

SEQ ID NO: 90103 - DNA, 81 bp, Mus musculus
tcagaaggttctagtaaagaggcaggcctttcatgatgcctgatgcctgcctgcctgcctgtctgcctctaatcaagctga

SEQ ID NO: 90104 - DNA, 89 bp, Mus musculus
gtttcagttgaattaggcagtagattaagtttaaggaccgaggactacttggatcactcacacagtctctgaagaggtcatactgaggc

SEQ ID NO: 90105 - DNA, 78 bp, Mus musculus
tctccctgcatcctctgagactctgtccttcggtcccggagagcagttatgtataatcatgtgtgatatgcagcatga

SEQ ID NO: 90106 - DNA, 96 bp, Mus musculus
tcttttcccctgagatgggtttccagtaagcagcaaaatgttgggttctatttgtgtagccagtctgttagtctctgtcttttattggggaattga

SEQ ID NO: 90107 - DNA, 86 bp, Mus musculus
gtccatggtggtctgataggatgcatgggacaatttcaatatttttgttatctgtggaggcctgttttgtgaccaattatatggtc

SEQ ID NO: 90108 - DNA, 73 bp, Mus musculus
agctgagatgagcagaggaaaggagcttagatgccattcaggcaaccctacactttctctcccactctcagct

SEQ ID NO: 90109 - DNA, 118 bp, Mus musculus
ttgtaatttgtgagcattttcagccaatgtgtacagatgactttatttctttttacattgctgtagccagcattactgtctcatgtcaagcatcgcttaaagtccttttcatgtacaa

SEQ ID NO: 90110 - DNA, 118 bp, Mus musculus
ctatctatctatctatctatctatctatctatctatctatctatctatttattttggaacagaggttgcaagggcagacaggtcgggatggggagatgagtaagattggggtatgtgg

SEQ ID NO: 90111 - DNA, 206 bp, Mus musculus
acatgtttatatatgtatgtgtgtgtatgtatatgtgtatatatatacacatatatatatatatgatatatatacatatgtgtgtatgtatatatgtctatacatgtgtatatatgtgtgtatttatatatgatatatatgtgtgtatgtatatgtgtctatacatgtatacatgtacctataaatatatgtatatatacaacata

SEQ ID NO: 90112 - DNA, 88 bp, Mus musculus
gtttctactttgtatcaaactcaattacttatcacaagatagtaagctctctggggtaaggacctgggtttgttttgcttgtgtttac

SEQ ID NO: 90113 - DNA, 69 bp, Mus musculus
actgaatgtacaggtttgtagtccagggagcacctgcagatttcacagactagactgtgctgagtcagt

SEQ ID NO: 90114 - DNA, 99 bp, Mus musculus
ggaagtagcaactaatgcagaaacatcaaagagggttttatggtacttgagctgacttctgtgtctatctacttccatatggaattttcctgttctgca

SEQ ID NO: 90115 - DNA, 115 bp, Mus musculus
tccttgatcaagttatcattgagtagagtgttgttcagtttccacatcaactttagttttctattatttttattgttataaaagatcagccttagtctgtggtgatctgatagga

SEQ ID NO: 90116 - DNA, 105 bp, Mus musculus
ccatcaagagcctgctgactggagcctgatataccagtctcctgtgaggctctgtcagtgcctggcaaagacagaagtgtatgctcacagtcatcctttgaatgg

SEQ ID NO: 90117 - DNA, 76 bp, Mus musculus
agatagacactaaggatatgtatgtatgtatgcatgtatgtatgtatgtatgtatgtatgtatctcctgtctttct

SEQ ID NO: 90118 - DNA, 76 bp, Mus musculus
tcagtttccatgtgaatgttggctttctattatttttttttttattgaagatcagcgttagtccatggtgatctga

SEQ ID NO: 90119 - DNA, 59 bp, Mus musculus
tgcatatgatgtatatgtatatgcatatgtctatgtgtatgtatttgtatatgtatgta

SEQ ID NO: 90120 - DNA, 68 bp, Mus musculus
atgtctctttctgtcagggtgtttttatcatgacaacagaagagaaacactacagaggcagcagacat

SEQ ID NO: 90121 - DNA, 59 bp, Mus musculus
tgtatatacacatacatatgtatgtatcatgtatgtatgtatgtatgtatgtatgtaca

SEQ ID NO: 90122 - DNA, 109 bp, Mus musculus
tgtaagtcatctctggggacagggctctctcccattgcttctctttatatatatgtgttctgggtctgggaaggtatgagagctagagtttgagtccccagaactcata

SEQ ID NO: 90123 - DNA, 113 bp, Mus musculus
tccactcaccatctgtctgcctgcctgcctgtctgtctatctatccaatttcttgctatttttatttttggttttaggacaaggtttcatgctatagcccatattgagctgga

SEQ ID NO: 90124 - DNA, 116 bp, Mus musculus
tccatagctgctaggtaagggcttaggcctgctcatgccccaccctggccatttgtggtcagtatagtgagaggagagaggccagcatggtcagtttgctttaatagacaaaggga

SEQ ID NO: 90125 - DNA, 79 bp, Mus musculus
taggagctgcttgcactgtctctgtcactctagttggttggctggagctttaagttgcagagcttctgcatgccctcct

SEQ ID NO: 90126 - DNA, 69 bp, Mus musculus
tcttggatgtgcatgtgcatgtgcatcttgtgtgtgtgtgtgtgtgtgtgtgtgtgtgtgtgtctatgg

SEQ ID NO: 90127 - DNA, 73 bp, Mus musculus
gaaagtgatgagtactctgagctgggataatcaagggagagatgttcacagaagacagagtattcagacattc

SEQ ID NO: 90128 - DNA, 72 bp, Mus musculus
gggaagatgcgagacccacaagctttgcacagctagctgtaccagcaagccaagctctgtctctgtcactcc

SEQ ID NO: 90129 - DNA, 114 bp, Mus musculus
ggttgtgaaggcagggtggcatgggctgctctggcaagggtagcatgaggctgtttactctcatctcactgtgtcagaaagcagagaatgccgtgcttagctgtcttcctcact

SEQ ID NO: 90130 - DNA, 114 bp, Mus musculus
ttgaagatcagccttagtccatggtgatctgataggatgcatgggacaatttcaatatttttgtatctattgaggcctgttttgtgaccaattaattctatggtcaattttgga

SEQ ID NO: 90131 - DNA, 75 bp, Mus musculus
gactggattgagccatgaagccttcatttattcctagtgagggaagggtcaggtagaaggttggctgctgcagtt

SEQ ID NO: 90132 - DNA, 79 bp, Mus musculus
gagtatagtagcctgaactggcatttgtgttctctctgtgtgtatgacatctgcccaggatctttggctttttatactt

SEQ ID NO: 90133 - DNA, 82 bp, Mus musculus
gatttaatgcatggatatagagccattaatatagaaggttgccttgactatattatgaatgtatttgtatatgtaatagatc

SEQ ID NO: 90134 - DNA, 74 bp, Mus musculus
gtgagaattgacagacagacagacacagacacgagagagtgtgctgaatctgaatgtattgtcatagagcgaac

SEQ ID NO: 90135 - DNA, 99 bp, Mus musculus
tcattttgatgcacagatctctgagagtgacagttgcttaagagacgtgtgagcaacgccacagtcaagagacacagctctctgttccatccccaatga

SEQ ID NO: 90136 - DNA, 79 bp, Mus musculus
ctcaggatgatgattggtggagagccttggtccctcataaaggaaatgagtgtctctctctgatacagcagtccctggg

SEQ ID NO: 90137 - DNA, 111 bp, Mus musculus
aggaaggatgcgtaaggaaattaacctgctaagactctggaagtctagacctattgttattctgtgggacttgatggagtgcagggctacgtcagatggatctgctgttct

SEQ ID NO: 90138 - DNA, 70 bp, Mus musculus
gttccatagtcctgccactctccctctgtgggatgtgcgcatgcccaggtggggagggggcagcaggaat

SEQ ID NO: 90139 - DNA, 86 bp, Mus musculus
tgacccctggagaagtgtggttgaactctgtcccactgtgtctctcacaatgtcacaatgtagcaagctttcccaccccacgggca

SEQ ID NO: 90140 - DNA, 89 bp, Mus musculus
ggcaaactcgggctccattgccaggagcaccagcattgcagggccatgtctgtaactgcttgtgcttctcagtctgtcatgttgttgcc

SEQ ID NO: 90141 - DNA, 75 bp, Mus musculus
ccacagatttactgagtctctctttgtgacagacctggcttatgcctgaggagtcagagacctgtgtgtgtgtgg

SEQ ID NO: 90142 - DNA, 88 bp, Mus musculus
cagaagctatcttttaggctttgctcatgtgttaaaagcagtgagaaatcactgaggtggttggcagaggcatgaaagatccagtctg

SEQ ID NO: 90143 - DNA, 90 bp, Mus musculus
gagattcaattttagtttttcaataagaatttgactaattaaaagttttttttcttaaaaagatgaaaagctgggctgttgagatagctc

SEQ ID NO: 90144 - DNA, 105 bp, Mus musculus
acatgaacttttgggagtgatggatggtcactgtactgactgtggtgagggcttcacaggtatatactacatagaacagaacttcccaaactttccacttcatgt

SEQ ID NO: 90145 - DNA, 91 bp, Mus musculus
gagaccctggcaaaaggtgggaggtagaggaacttgaaatctgtcactacctgcggtcttctgacaccctctcactgtgagctgtagtttc

SEQ ID NO: 90146 - DNA, 68 bp, Mus musculus
ggagcttgaggcaggattaggagttcaagagcagcatgggctgtctgagacactgtgtcaacccctcc

SEQ ID NO: 90147 - DNA, 103 bp, Mus musculus
aaatcaaaatccaaatgatcttattcatatgggcatagttttggtctctctctttcagtcctactgatctgtgcctatagtttgacatatggggtttaaattt

SEQ ID NO: 90148 - DNA, 79 bp, Mus musculus
ccatgaaagcagatctgtgtgtatatgtatgtgtctatctctctgtatatatgtatgcataaatttgtgacagtcaggg

SEQ ID NO: 90149 - DNA, 57 bp, Mus musculus
aagagtgatcagggtggtgatagagctttgggtcgagggcattgttctgtggctctt

SEQ ID NO: 90150 - DNA, 88 bp, Mus musculus
tgtgctcagtacagtgtctcacactctgatcctcactcgcaccagtggtaggagccgagggtagaagaagacattggtctcagccaca

SEQ ID NO: 90151 - DNA, 68 bp, Mus musculus
cctgtctgcctgcctgcctgccttctaagcgttggggggaaaaggcatgtaccagtgtcttagttagg

SEQ ID NO: 90152 - DNA, 119 bp, Mus musculus
ctcccgagtgctgggactaaaggcatgtgctatgacacccagctatgttcttaagtttaaatgttatatttttattatatgtctgtgtgtgacttcgtgcgtgtgagtataggagctcg

SEQ ID NO: 90153 - DNA, 84 bp, Mus musculus
gcccggctttctcctaaggagtgctaacagagttgcctagagcatggtagtctctcagtgtctgtggaaggttatttgcggggt

SEQ ID NO: 90154 - DNA, 94 bp, Mus musculus
ggtgatgtagctggggctcggtttcacttgctgctgtctgtctgtctgtctagggctccgcaggtgttgaatttctgtgtttgggaatgtcatt

SEQ ID NO: 90155 - DNA, 83 bp, Mus musculus
gtatgtgtgtgtatatatgtgtgtatataggtatatatatgtatatatacttatgtacacacacaatatataagaagatatat

SEQ ID NO: 90156 - DNA, 104 bp, Mus musculus
gcacgtgggggtggggggtgggggtctgtctgtctgtatctgacagtggaggtcagagaacagccctcagtcaggagccccattttctccttccccgatcgtgc

SEQ ID NO: 90157 - DNA, 74 bp, Mus musculus
gcaggtcagaaaaacaagacagtgagcagaagcactccttcatggcctcttcagttccctcttggacatcctgc

SEQ ID NO: 90158 - DNA, 111 bp, Mus musculus
agttccctaagatacagatacacatatatgcatgtgtatatatatatatatatatatatatatatatatatatatatatgtatatgtccttatatattgctaagttatgct

SEQ ID NO: 90159 - DNA, 81 bp, Mus musculus
gcgagaggcaggtgaatgagactgggcggcctggcttgagcttttcaagccttactacccaccctcagtcactctctctcc

SEQ ID NO: 90160 - DNA, 81 bp, Mus musculus
tttgccctgggaagtgggactcactctttctctgatgttgattccagctatgcagatcaggggtgggaggcccagggtgag

SEQ ID NO: 90161 - DNA, 77 bp, Mus musculus
gcagttgggtctttgtgtccatacctctagtcaaccacctacattggttctgaactgagtgtgcagagaacccacgc

SEQ ID NO: 90162 - DNA, 85 bp, Mus musculus
tctgtgaatgtccgtctgcctgtctgtctgtgtgtgaatgaatgccatgtgtacatgcccacggaggtcagagaaggcactggat

SEQ ID NO: 90163 - DNA, 84 bp, Mus musculus
catatgtatgcctgtacactcatgtttgtatgtatgtatgtatgtatgtatgtacatatgcatgtgtgtgtgcttgtgcctgtg

SEQ ID NO: 90164 - DNA, 114 bp, Mus musculus
ccagactatgataatgctgtgaccttagtggctcaatacccatagaaaaagactagacaatttcttgaatttaggagggtaaaataggtcctgtgttttagataatccatctgg

SEQ ID NO: 90165 - DNA, 69 bp, Mus musculus
tatgtatgtatgtatgtatgtatgtgtgtgtatgtatgcatgtatgcatgcatgtatgtatgtgtgtat

SEQ ID NO: 90166 - DNA, 63 bp, Mus musculus
gagggctggggcaacagcttcatgttaggcctgcctgcctgcctgcctgcctgcctgggactc

SEQ ID NO: 90167 - DNA, 85 bp, Mus musculus; identical to SEQ ID NO: 57470

SEQ ID NO: 90168 - DNA, 97 bp, Mus musculus
ttcctctagactctaaccacacttgacagtgtgtacagtggccccaccagacccatcacactgctctgtgttctcaatagttaatgactagggtgaa

SEQ ID NO: 90169 - DNA, 81 bp, Mus musculus
tctgtgactctgtccctgagtatctgaaaatcactagtaactttatatcttcggattaccttggagacatagactcatagg

SEQ ID NO: 90170 - DNA, 77 bp, Mus musculus
tatatatgtatgcgtgtgtatacacacatatatattacattatattatatatatatatatacatacatgcatatgta

SEQ ID NO: 90171 - DNA, 110 bp, Mus musculus
gtgcattgatggtagaatggttgaataaacatgcatatatatatatatatatatatatatatatatatatatatgcatggctggagagatggctcagcagttaagagcac

SEQ ID NO: 90172 - DNA, 59 bp, Mus musculus
tctctctctcacagtctgtgcgtgagctgtaggcttgggacacagtgtgcagactgaga

SEQ ID NO: 90173 - DNA, 63 bp, Mus musculus
ctcttctcagtctgcacactgtgtcccaagcctacagctcacgcacagactgtgagagagaga

SEQ ID NO: 90174 - DNA, 115 bp, Mus musculus
cttcagtagtgttttccaagggccttcagcttctagattcacctacttactgtctcgcacagagtctctgtctcactgtagcttctatgaaggcacttagcgatactttgctcag

SEQ ID NO: 90175 - DNA, 128 bp, Mus musculus
gcatggaggaggaggagcagaaatggaaagcaactgctgctactgctgcctgcctgctgctgcctgcctgtctgcctgccttagcttcaaggagagtcagcttagtgtgtgccacacagttctgctct

SEQ ID NO: 90176 - DNA, 105 bp, Mus musculus
gtctgtctgtctctctctgtatatgtatatgtgtgtcgttatctgtctctcacagagagacatacacacacatacacacaggcacacagacacacacacacagac

SEQ ID NO: 90177 - DNA, 64 bp, Mus musculus
gtgtgtgtgtgcatgtgtgtgtgcatgtgtgtgtgcatgtgtgtgtgcatgtgcatgtacacac

SEQ ID NO: 90178 - DNA, 110 bp, Mus musculus
cattgctgagacagaacagtagttttccagctttgatgtgtgtgagtctgggagactagagtctgagctcttccttggagaaaacaaatacttttgtgttgatttcaatg

SEQ ID NO: 90179 - DNA, 92 bp, Mus musculus
tcagatccccagtctgctgtctgctgactgacaacagaaaaagaaatttagaggtgtgagtgaagtgacagagctgtcagggcttcttctga

SEQ ID NO: 90180 - DNA, 133 bp, Mus musculus
tgaagtgactctatcttagtctgacccattcttcaagaaggaaagagtgaagaaggcctgtgagaggagtcagagcagaggccttccatggtgggtggagtgttccctttccatggctctgccccctccccac

SEQ ID NO: 90181 - DNA, 79 bp, Mus musculus
tgtgtactgtattgttattgctgagagacatacagggatgagcctctctctatctctcatgcacatgcacacgtgcaca

SEQ ID NO: 90182 - DNA, 72 bp, Mus musculus
tgtcactgatctgtcagtgtttgtgtctgtcagctttctgtcaccatgaccagatgcttgggacaagtgaca

SEQ ID NO: 90183 - DNA, 90 bp, Mus musculus
agagatccattgttctcctctcttcccagtaagcacacactgtgtgtctatctcttttatatggggttttgggattgaactcaggtcttt

SEQ ID NO: 90184 - DNA, 107 bp, Mus musculus
ggaaaggtgagccacattcccagaatcaggtgcttgtccataattctgtgactcagtcacacagacaatgtcccaagcttctggcattttggctagactccaccccc

SEQ ID NO: 90185 - DNA, 117 bp, Mus musculus
ttttctaggtgctgtgtaaggtaggggatacaggatgaatggacagactcagtctctttcttcagggaccacatttactggcttctcatttgtgtctgccatgatggtagtagggga

SEQ ID NO: 90186 - DNA, 79 bp, Mus musculus
ggcatgtcacggtagggtactgttatctgaggcagcaagaatagacgatgctgcagacagaacactgtctgggcatgtc

SEQ ID NO: 90187 - DNA, 57 bp, Mus musculus
ccttccatgggtattttattccctattctacagaggaatgaagtatccgtgcattgg

SEQ ID NO: 90188 - DNA, 90 bp, Mus musculus
gaagtagtgatctctagtgtatttgaagatgtgtaacttacagggaagcctttctgccgttgtgtctatgctgtacatagaggtaacttc

SEQ ID NO: 90189 - DNA, 90 bp, Mus musculus
tatgttgctcaggctggccccacagttttgatcctcagatccttagtactaggattacagatgtgtgtcaccacacctggcataaacatg

SEQ ID NO: 90190 - DNA, 56 bp, Mus musculus
tgtatgcatatgtgtatatatatgtacatatatatgtatacatacatatgtataca

SEQ ID NO: 90191 - DNA, 82 bp, Mus musculus
gttttacagctcagaggggattaggacaagagatgtgtttaaaatacgatgtgtctctctgtctctctgcagctgatggagc

SEQ ID NO: 90192 - DNA, 67 bp, Mus musculus
agtatggacatgtgtgtatatgcatatgtttgattgtttatgtgcatgtgcttgtgtatgtgtgact

SEQ ID NO: 90193 - DNA, 104 bp, Mus musculus
cttcccaggaaacttcttaccatgagcaattattttctggggaatgttgtcattgtacaacattgtacaacaggtaacttatggttttctaaatcctaagatag

SEQ ID NO: 90194 - DNA, 63 bp, Mus musculus
ccttgtgtctgaggtgggctaggtgacttctgacagtctgacagtggcagatttcagacaagg

SEQ ID NO: 90195 - DNA, 91 bp, Mus musculus
gagtagtgcttgcagtgtgtgcatgaggatgtggatttgtgtctagaagcacacacaaacaatacaggtgggtgcacacatgtttgtgatc

SEQ ID NO: 90196 - DNA, 82 bp, Mus musculus
agatacctctgctcccatgcctgtctgtagagagtcagctgtgaaagtctttatggtggcaggttttgtgagctttgaatct

SEQ ID NO: 90197 - DNA, 87 bp, Mus musculus
tacatgcttctgtgtgcatatgcatgtacatgtgcacatatttatgtttatatgatacatgtttgtgccctattatgcatgcatgtg

SEQ ID NO: 90198 - DNA, 77 bp, Mus musculus
agcatgacctgtgtcactctcagatagaagtgagggccaggcttgtggtttttatttgtggagaaatgcagtatgct

SEQ ID NO: 90199 - DNA, 93 bp, Mus musculus
caagaataatggaccaaacttctgaactatacaccagtcccaattaaatgtttttcttttgataaagagtggttatagtcatagggtctcttg

SEQ ID NO: 90200 - DNA, 81 bp, Mus musculus
gatatgatgtatgtgcatgtgcatatgtttgcatgcgtgtataagtttgtatgtgtgagtgcacgcacgtgcacacatgtc

SEQ ID NO: 90201 - DNA, 68 bp, Mus musculus
gcaccacagggaggcctgatgagtcctctcactgttatttgtctcagactctctctctctgcccgtgc

SEQ ID NO: 90202 - DNA, 58 bp, Mus musculus
gtgggtcagggtgggggctggcagaggtagactgactgcctctctctctgtggcccat

SEQ ID NO: 90203 - DNA, 126 bp, Mus musculus
catgtggtatatatgtgttttgtgtgtgtggtataagcgtgtgtatggtgtatatgtgtgtatgtatgtatatatgatatatgtgtgtgatatacatgtgtgcatgtgtgtatgtgtggtatatgt

SEQ ID NO: 90204 - DNA, 117 bp, Mus musculus
ctcgaggtctttccaaagtcagtcttctaccattactaagatgtcttgtcattttgtacatataaaggcaaatgagtaaagtggcagaagtgtagccattaagtcaaagcacctgag

SEQ ID NO: 90205 - DNA, 106 bp, Mus musculus
gccttagtgcatggtgatctgataggatgcatgggacaatttcaatatttttgtatctgttgaggcctgttttgtgacctattatgtggttaattttggagaaggt

SEQ ID NO: 90206 - DNA, 76 bp, Mus musculus
gtggcagggatcgcttgggttctcagaaggttgcagaacggtgcctggtctgagactctgcctgcctccctgccac

SEQ ID NO: 90207 - DNA, 82 bp, Mus musculus
gggatattcaacagcccctgtgtgtcactcattgtgcctactgctgagtggaggtgaggatctagggctgtggtttagtccc

SEQ ID NO: 90208 - DNA, 85 bp, Mus musculus
tcattagaaaacttcactgttagacactagtatgtacatccatctgtgtgtgcctgttgtgtgtctgtctgtctgtctctgctga

SEQ ID NO: 90209 - DNA, 85 bp, Mus musculus
actcagctcgctgtctctctggctctgttccagtgcaacggtgaacctgatggggtaccagggggaaggagtgcgggaagggggt

SEQ ID NO: 90210 - DNA, 68 bp, Mus musculus
ggtgagcctctctccctccctgactgtggagataaggacggtgagggtggtgagagtctctgtttgct

SEQ ID NO: 90211 - DNA, 84 bp, Mus musculus
gccttgatctatgtccagcagtgaccattaggagtgcacttaacctagcagtgcttgtgtgctgtctgggtcatggacaaaggc

SEQ ID NO: 90212 - DNA, 112 bp, Mus musculus
attgaagattcagccttggtccctggtgatcagatatgatgcatgggataatttcaatatttttgtatctgttgaggcctgttttgtgaccaattatattgtcagttttgga

SEQ ID NO: 90213 - DNA, 68 bp, Mus musculus
tcttggttcacactgacagaagcccaaggagcaacctttcagctctcttctctgtgagtgttacagga

SEQ ID NO: 90214 - DNA, 69 bp, Mus musculus
gtttttgagggacatggtttcctattggtttgagggacttcagaatttgttaatctgtcctgaaagggc

SEQ ID NO: 90215 - DNA, 73 bp, Mus musculus
cagtcctccatgatcatctgcgtcttggctccggagatccggtgctagagaacagagagatcagacaagcctg

SEQ ID NO: 90216 - DNA, 84 bp, Mus musculus
ccagcagagaggagactgagagcaccaagtaatgaataagtctgggctcggtgcagaccaggctccttttaaaacacgtactgg

SEQ ID NO: 90217 - DNA, 78 bp, Mus musculus
ctggacaccaccaggactctctacatgctgcaaccaatgcctctagtgcttggagagagaagtctcagtggttcccag

SEQ ID NO: 90218 - DNA, 114 bp, Mus musculus
ttggtgctggtctataaatatattcctctgggcacataatgagattatatttttctgtcactagagtcgtgtgactcaacgtagttaatgccatgtaagtatagattccactag

SEQ ID NO: 90219 - DNA, 78 bp, Mus musculus
gtgcatatgtgcatatgtggttttacatgttgatggcagcatctgcatgggaagggtgctatgtgtgtgtatgtgtat

SEQ ID NO: 90220 - DNA, 68 bp, Mus musculus
gtatagatagattatatatatgtgatacagatagatatagctgtttgtgtgcatgtacatgtgtatgc

SEQ ID NO: 90221 - DNA, 83 bp, Mus musculus
gaccagcactggcctttatcttgtctgagtctctgggacagtccaaaatcctagaaatgctttagatagggccccagtctgtc

SEQ ID NO: 90222 - DNA, 69 bp, Mus musculus
ctgagtatacagggggttgtgctttccttgatctgccgtcttctggatcagcctccctctgtgagtcag

SEQ ID NO: 90223 - DNA, 96 bp, Mus musculus
tttcgctcctaatattgtcgctgtcactgtctgagttgtgtcttcccagctagccctgtgcatcaggctcagctcagacagctggagggggtgggg

SEQ ID NO: 90224 - DNA, 74 bp, Mus musculus
gagggaagctcctctgtccctgtcactgtgggttctcgttcccaagggacaacatagatccaaagctatctttc

SEQ ID NO: 90225 - DNA, 56 bp, Mus musculus
ggtcagggacagacagtcagactcacccaggttggagtctcagtttgtccctgggc

SEQ ID NO: 90226 - DNA, 64 bp, Mus musculus
aggtgcatgggcacaagcagcaagcatgcaaggatgcattgtctgtctgcctgcctgtctgtct

SEQ ID NO: 90227 - DNA, 77 bp, Mus musculus
gcttcttctctgacagtctcagaccctgcttctccagtaggagaatgcattcaccctggagtctagatcctggaggc

SEQ ID NO: 90228 - DNA, 73 bp, Mus musculus
tttgagtgagtggcttagtgttctgtctgtgcacagtgaggacaatagaacacaaagcatccatgatttcaaa

SEQ ID NO: 90229 - DNA, 72 bp, Mus musculus
aggatcaggggcagtgaggagagaggcatcgagggcctgcgactggctcagtccttcactgtgtctggttct

SEQ ID NO: 90230 - DNA, 77 bp, Mus musculus
gctctctcactctttcatgtgtgtgcatgtccatgtgcacgcaggacatatgcacacacatgtagaggccagaggac

SEQ ID NO: 90231 - DNA, 92 bp, Mus musculus
ggctaggctagagtagaaggggaatgagactcaggggtactgtgggggatgtggggggcccactggctctgactctgtctgcttcagtctcc

SEQ ID NO: 90232 - DNA, 102 bp, Mus musculus
cagctagagagatcttgcagtgagaggccaagcttcctcagagagaagagacagtggatgcgtccctgtggaggaagtgcattgctgtttctcttctggttg

SEQ ID NO: 90233 - DNA, 64 bp, Mus musculus
agctttgaggggattgtattctgcctggagcctgcgttctttagcattgcttcctctcatggct

SEQ ID NO: 90234 - DNA, 96 bp, Mus musculus
cacacacacacacacacacactctggtcagtgctatgtccctgaatagctcctttgtctgactggttttgattggagcctgggtgaggtactcgtg

SEQ ID NO: 90235 - DNA, 60 bp, Mus musculus
cctatgggttccagggactagagtcaggcccccaagcctgcctgcctgcctgcctgaagg

SEQ ID NO: 90236 - DNA, 90 bp, Mus musculus
tggcatgggaggctggctggaggaggagtgggtggctgggttggaggaagaaggctcagtggctccctcactgccatgccacccaggcca

SEQ ID NO: 90237 - DNA, 100 bp, Mus musculus
tcattctgcgacaggctctgcttggatcatattttttttttgatgggccccagccccagctgcatggagaaaaatggtctcagagcccatcccagggtgg

SEQ ID NO: 90238 - DNA, 80 bp, Mus musculus
gcaggagggagggaggtcactggggcactgccttgtggtggtattaaggtaactctcctgggacctcacttcattcctgt

SEQ ID NO: 90239 - DNA, 61 bp, Mus musculus
tgctcagcctgggtgggtctgttttcctgcaaagagcctcccacactcagtcactgatgca

SEQ ID NO: 90240 - DNA, 101 bp, Mus musculus
tggaggctttgggtgaaacttttcccacctatacaggaaccctggagacccaggctcccctctgctctctctgtgtgtcttgtaggtcatcttggccccca

SEQ ID NO: 90241 - DNA, 101 bp, Mus musculus; identical to SEQ ID NO: 90240

SEQ ID NO: 90242 - DNA, 107 bp, Mus musculus
ctgtgaccatattttacaagtcttccaacctcagaccactctgtctccctccctgcttgccttggagacacagagggtcagaggtgaagtcttgctcatggctccag

SEQ ID NO: 90243 - DNA, 97 bp, Mus musculus
gccatgagcaagacttcacctctgaccctctgtgtctccaaggcaagcagggagggagacagagtggtctgaggttggaagacttgtaaaatatggt

SEQ ID NO: 90244 - DNA, 117 bp, Mus musculus
gggttacctttccaccttgggctgcagagcttcttcaacctcacactctctctcagaagaagaatcctgggctggagacaggagtgggtggagccctggttttatgtcagtttttgg

SEQ ID NO: 90245 - DNA, 117 bp, Mus musculus
tccagttggggtacaggggaacagaggctggatctcagcatctaagacagtgagtacacagggtcataggaaaggttgaacctcactagtctgggttgggcttgagcttgaaaagga

SEQ ID NO: 90246 - DNA, 75 bp, Mus musculus
tctgtctgtctgtcggtcggtctgtctaaggttgatgtgtactcaacaggagagttctggctggggggtttcaga

SEQ ID NO: 90247 - DNA, 74 bp, Mus musculus
caaggtgtggcactctctctcagacacggcactttgtccttgttctgctgagagagtgtttacagggcatcttg

SEQ ID NO: 90248 - DNA, 79 bp, Mus musculus
acagatggtcaggtgtgcatgtgtgtgtgtgtattcatgcatgcatgtatgtgcatgtgcatgtgtgtaagagaaagac

SEQ ID NO: 90249 - DNA, 70 bp, Mus musculus
cctcttcttggcagatggctcccagctggccctgaccagcttcctctgagcctctgagtctgagtagagg

SEQ ID NO: 90250 - DNA, 65 bp, Mus musculus
atgccactgagcagcagcaagagtatagaggaatgtctgcctctctctgagtcttaggttggcat

SEQ ID NO: 90251 - DNA, 86 bp, Mus musculus
ggtgacacaggctagctctctgtcacactgaaagctgttgaattcaagcatctacagatgtgctgaggtgtcctggcttggtgact

SEQ ID NO: 90252 - DNA, 91 bp, Mus musculus
actctcttgtttatgtgtgtgtgtccttctgtctctgtctgagtgtgtatgtgcacatgtgtgttcaagtgcccagagtccagatagatac

SEQ ID NO: 90253 - DNA, 76 bp, Mus musculus
ctcctcatctctctctctcaggtaccttcctcaccacaggatattagagagggaattggaagggggatatgggggg

SEQ ID NO: 90254 - DNA, 65 bp, Mus musculus
atgcatgatatatgtatgtatgcatgtatgatgtgttgtatataatgtatgcatgtatgatgtat

SEQ ID NO: 90255 - DNA, 113 bp, Mus musculus
ctcaggtgtacccgtccttgtgagccgctggacagctcgcaacactgtgggaaacacagagtagtgattttgtatataatggacagttcttggctcttaaagggatacctgag

SEQ ID NO: 90256 - DNA, 121 bp, Mus musculus
gcgtgtgtgtgtgtgtgtgtgtgtgtgtgtgtgtgtgtgtgtgtggtatgcatgtatgtatgtatgttcatgtgggcaaacatatgtgagtgcgtacacgtgcatttgtgtcttcatacat

SEQ ID NO: 90257 - DNA, 62 bp, Mus musculus
taccattcactcgcgccctctgcccctctgcgacagtggcagtagagagtgagcagcaggtg

SEQ ID NO: 90258 - DNA, 107 bp, Mus musculus
cagcttttctagggatatactgaggtgggtagggcttgcagactgaagactgtcacctttctctagcccttggatagttaacctaccttagccttgggaaactactg

SEQ ID NO: 90259 - DNA, 78 bp, Mus musculus
gttgcccctttgtcatgagaataggtggcagttggttggttacttttgcattgttaaagccacttgttttcatcagca

SEQ ID NO: 90260 - DNA, 61 bp, Mus musculus
tggctgtctgtctctgtgcatgtctgtgtaccatgtgcatgcctgccactcacagaagcca

SEQ ID NO: 90261 - DNA, 121 bp, Mus musculus
cctacttctacttttaatcatgcaagtccttaaaagttcaagagggaaacagagtaggtcagagagatgtgacagaggactctacctcaagtagctgactttgatgatggaagaagggagg

SEQ ID NO: 90262 - DNA, 109 bp, Mus musculus
tctaatcttagtgcttgagaggctgcacaggaagactgtggaagagttcagagttaccctggactaactacagaatcaaaacttaaaagctcctatagtaatgactgga

SEQ ID NO: 90263 - DNA, 74 bp, Mus musculus
gtactcaggtagccagagttagagagcagtagctctgaattgtaagctaggtctgtctgtatatctgtctgtat

SEQ ID NO: 90264 - DNA, 86 bp, Mus musculus
cagatgtcattctgttatactatccgccaagatctcccacaacttttttattttgggggaggcacagaattgattttcttgttctg

SEQ ID NO: 90265 - DNA, 111 bp, Mus musculus
gtgtgtgtctatgtttatgtgaatgtgttatgcatgtatgtgagagtgtatgtatgtgtgtgcatgtgcatgtgtgagtttattctcattatacatacctttgtcatacat

SEQ ID NO: 90266 - DNA, 93 bp, Mus musculus
ggtatgtggtacacagccgtacatatagacaaaacacctatagcttaacattatgtatgtatgtatgtatgtatgtatgtatgtgaccaagcc

SEQ ID NO: 90267 - DNA, 75 bp, Mus musculus
accaaattctccttagcttacatcacctggggcagctctgctgttccctgtctgtctgtctgaagtgagtggggt

SEQ ID NO: 90268 - DNA, 85 bp, Mus musculus
cactgtggaatccagactgagcagacagagctcccacctccatgaggctctcctggccgtgctcagtcttggcattcattctgtg

SEQ ID NO: 90269 - DNA, 100 bp, Mus musculus
gtgtttcgttttgtgttcatctaatgctggtgacatggatgttttcatatttattgttgatcatttgtgcatctgcagagaaacagctcaagattggtgc

SEQ ID NO: 90270 - DNA, 99 bp, Mus musculus
gagaacatcatgaggctagagagatggctcagtggttaggagcactgactgctcttccagaggtcctgagtttagttcccagcaaacacttggtggctc

SEQ ID NO: 90271 - DNA, 64 bp, Mus musculus
gtgacctgaatcagaactaccagtgagtggtgacctctctctgggtcactgtgcagcttttcac

SEQ ID NO: 90272 - DNA, 62 bp, Mus musculus
tcagggggctggagagatggctcagcagttaaaagctctgactgctcttccagaggtcctga

SEQ ID NO: 90273 - DNA, 93 bp, Mus musculus
cttcaggagaggggacagttagaaagagccacccgtgtcttctagagaagcgaggcttaggtctgtctgtcttactgtctgtctgtcctgagg

SEQ ID NO: 90274 - DNA, 113 bp, Mus musculus
gagctctgaggggagggattggctagagacattcatggagggatgagtgttccaaggtctctcactctctgtaatgtctggttgcaggtctttgttttttaagctctctctca

SEQ ID NO: 90275 - DNA, 92 bp, Mus musculus
tgtaagattgttggatataggggctggagagatggctcagcggttaagaacactgactgctcttccagaggtcctgagttcaattcccagca

SEQ ID NO: 90276 - DNA, 90 bp, Mus musculus
tgaactgtatgtggtgctcaaaggtgggactggactggtttattatgtttgtatatttttcatgagcacttaaattgttgcaacagttca

SEQ ID NO: 90277 - DNA, 93 bp, Mus musculus
tatgtatatatatgtacacatatatacacacatatgtatatatatgtatgtgtatatacatacatatatacatatgtacatatatacatatgt

SEQ ID NO: 90278 - DNA, 58 bp, Mus musculus
tatgtatatatgtatatatgtacatatgtatgtatgtacatatgtatatgtgtacata

SEQ ID NO: 90279 - DNA, 115 bp, Mus musculus
tgtgggaggtttctgaatctggccctcatgtttagctccaccacagacacgctctctctgcaactggtgtcagggttcttggaggaaacactagggcccctgtggctctttctca

SEQ ID NO: 90280 - DNA, 79 bp, Mus musculus
cagtaagtatgtgggcaacacaatttggacttgtttcttcttatctgtctgtctgtctgtgtgcctgcctgcctgcctg

SEQ ID NO: 90281 - DNA, 116 bp, Mus musculus
ccagcgtctgcacaacacacatcgctgatcccctctaagaaaacttttaaatgacattgtttttgaaatcacgtttttaaaaggctagcgatgtagttcagttgatcgaatgctgg

SEQ ID NO: 90282 - DNA, 71 bp, Mus musculus
tctctcattctgtctgtggttctcatgacaatgtgcttcattctgtcacaggttctcagctcagtgaggga

SEQ ID NO: 90283 - DNA, 111 bp, Mus musculus
aaaatgttacttcagttagatctatataaatgctgtctccaaatagtctcattctcacagactaagtcacagagcagtcttatgcagagggcttgacatgagttaagtttt

SEQ ID NO: 90284 - DNA, 92 bp, Mus musculus
tgaagcatgggccatggcgttcactgtggaggtcagaggtcaactctcagatagttctcttctctctctgtgagatcctgggatgtgactca

SEQ ID NO: 90285 - DNA, 99 bp, Mus musculus
gaggaaattgggtttctccgagccacagaagagagagagcattgaaaggtctgctctcagacctgcatttgtcttggccaagaagcatcccagtacttc

SEQ ID NO: 90286 - DNA, 86 bp, Mus musculus
gtccatggtgatctgataggatgcatgggacaatttcaatatttttgtatctgttgagtacctgttttgtgatcaattatatggtc

SEQ ID NO: 90287 - DNA, 59 bp, Mus musculus
ttttgttaatatgactctgtagtgtgtgaagccactactgtggggttagtaaaacagga

SEQ ID NO: 90288 - DNA, 88 bp, Mus musculus
tctgcttggtgtctgtctgtccgtgtctgtgtgtctgaagcccagggaagtacagactgatttgcagaacagttcacatccatggcag

SEQ ID NO: 90289 - DNA, 91 bp, Mus musculus
aagatgaagatgaatggattcttctgagcaatgatgtgtctgtgtcttaggtatgtctgccagagccctgggatttatccggagttagctt

SEQ ID NO: 90290 - DNA, 60 bp, Mus musculus
gtgtgtacatgtgtgtatgtgcgtatataagaatgtatgtatatatgtatatgtgtgtat

SEQ ID NO: 90291 - DNA, 73 bp, Mus musculus
ttataacatattatatatgatacatacatgtgtatacgcacatatatgtatgtatgtatgtatatgtttataa

SEQ ID NO: 90292 - DNA, 79 bp, Mus musculus
gaaaccatatcgagagttcattctgtatttcttcttgagtctttggcattgagaagtgagcttagctcaacttggtctc

SEQ ID NO: 90293 - DNA, 85 bp, Mus musculus; identical to SEQ ID NO: 57439

SEQ ID NO: 90294 - DNA, 72 bp, Mus musculus
cacctgtaaaggaaacaagcttgatttaatgaaggtgacactcccaccaggcaagtttgctgatcataggtg

SEQ ID NO: 90295 - DNA, 83 bp, Mus musculus
ggttgggagactattaatgactttttctatttctttaggggaaatgggactgtttagatcgttaatctgatcctattttaacc

SEQ ID NO: 90296 - DNA, 103 bp, Mus musculus
gatatggctcggtggtgaggagctctgactgctcttacagaggactaactttggttctagtatgtatataatgcagttccctacctcttacaactccagcttc

SEQ ID NO: 90297 - DNA, 96 bp, Mus musculus
ctttgctaaacactgtgctaaggatgaggaacacatattatttctttttaaagtgtgttagaggggatgtatctgtggggatgcgtgtgtgtggag

SEQ ID NO: 90298 - DNA, 70 bp, Mus musculus
ctgtctatttgtctgtctgtgtctctctcctcccccctctggagggtggcccagaataataatgtgtcag

SEQ ID NO: 90299 - DNA, 85 bp, Mus musculus
ccggttagtacttggatggaggcagtgctgggggataattctaagaggagatacacggcactcactctgtgtatgtgatcagagg

SEQ ID NO: 90300 - DNA, 85 bp, Mus musculus; identical to SEQ ID NO: 57439

SEQ ID NO: 90301 - DNA, 83 bp, Mus musculus
ctttcatttttctcttaaatatacaggatataagcagtttatttctatatatgaaactggttttgtagagagagaaggagaag

SEQ ID NO: 90302 - DNA, 66 bp, Mus musculus
gcacacatgtatgtacatgtagatgtgagtgtgaatttgtatgtaagaatgtatatatgtgagtgt

SEQ ID NO: 90303 - DNA, 127 bp, Mus musculus
ttgtggaaagggagaaagagaggctggggggggggggctgatgaagtatggttctggagtcagactgactcactgcatctcaaaccctgtcatgaatgaaatgcaggcaagcgtggtgagagtttga

SEQ ID NO: 90304 - DNA, 88 bp, Mus musculus
cctaaaatctggctctctgtccctctgttcacagtagttacagatgactaatgtttacaatggcaggcccccagtcaagattttctgg

SEQ ID NO: 90305 - DNA, 125 bp, Mus musculus
catttgaacttgcagagatcgggggcccgtagaggtctgtctgaggtcctctgcatatgtatgtatgtatgtatgtgtgtgtatgtatatatgtatacacacacacacacacacacacacacaca

SEQ ID NO: 90306 - DNA, 105 bp, Mus musculus
gctgtctatctgtctgtcggtgtatgtatttctatttgtctctcagtttttctctctgtatgtaagacagacagattttacacacacacacacacacacacacac

SEQ ID NO: 90307 - DNA, 85 bp, Mus musculus
ttgaggacctgactttatatgtcatcatttgtgccatcttggttgttccttcatgtggaagaagagacagtggtgagatcttcag

SEQ ID NO: 90308 - DNA, 105 bp, Mus musculus
tgtcaactctggagaccaggtgtgtgggcatgaaagagatgggagcacacttctgtttctgagtgtcccattccgcatttaaaatagtcttcctatagagagata

SEQ ID NO: 90309 - DNA, 101 bp, Mus musculus
tagaccactggtcatgcattttagggggagcaactgcatgtcaatgtgggggatttcacctgtcattaccatcagagctactgagtttgtgcctgtgtctg

SEQ ID NO: 90310 - DNA, 77 bp, Mus musculus
accttgaaggcctaagttcactgtcagcagtcagggtggggttggattctctgtatacggtatgactcaggcaaggt

SEQ ID NO: 90311 - DNA, 94 bp, Mus musculus
catgttctgaatcttagtaccttgaattgcaacttagaaatggtctctcatagtctctctgagttagcagtctaaaactaggccccagcacctg

SEQ ID NO: 90312 - DNA, 71 bp, Mus musculus
gtgtacctctgtctgtgtatgtgtctggggcggggtgcctaggctcacacatgaagcatgacatgaggcac

SEQ ID NO: 90313 - DNA, 74 bp, Mus musculus
ggcccttgtatgtgcttgtgtgtgtgtatgtatgtatgtatgtacatctatacatggccagctagacattggtc

SEQ ID NO: 90314 - DNA, 69 bp, Mus musculus
actagtgtgtctgtgagtctgtcagtgggtgttgtccactccagtccagttccagagtgaagcactggt

SEQ ID NO: 90315 - DNA, 93 bp, Mus musculus
ggctgcaccagcaggcttcatcacacctgggacagcgctggatatttctgtgatgtgcttgttcattgaattgataaatgctgagtgacagtt

SEQ ID NO: 90316 - DNA, 137 bp, Mus musculus
actgagacctagagaagggaggcttccagcccacaccaccttgaagtggtggctagtttctcttcctgtctcagtctctcttgtagtggcagagacattatgcacctgctttcaatgaccctgctaaaggatggggc

SEQ ID NO: 90317 - DNA, 149 bp, Mus musculus
tgtatgtatgtctatgtgtgtgtgtgtgtgtgtgcatatatatatatgtatacatatcagtagatttttttcattatatacatgtgtatatatatacatatgtatgtatatagatacacacacatacacacatatatataatgaaaaaa

SEQ ID NO: 90318 - DNA, 117 bp, Mus musculus
accatagtgttctgccaggatctgcttagttccctgggaatgagagcagagagtgaggagaggtcacaaaacagagtctgctacagggctgggaatgaaactgggggattgggtgtg

SEQ ID NO: 90319 - DNA, 91 bp, Mus musculus
gcttcattttgtgccctgttgtgttcctagtcaattggttcgtctctgcttgatgtacactggctgactgtacactgtgtggaatggtagc

SEQ ID NO: 90320 - DNA, 63 bp, Mus musculus
gagtacggagctcagtatggagctgaaggtgactctgaacctctgagcctctgtctccgtctc

SEQ ID NO: 90321 - DNA, 92 bp, Mus musculus
aggaaatctttaagaatagtgctcatggtctggagagatggctcagcagctaagagcactgactgctcttccagaggtcctgagttcaattc

SEQ ID NO: 90322 - DNA, 103 bp, Mus musculus
tcacttcctgttttcttgtatacgagaattatatttaaattgggatgcatatatgtgttcaggggtatgtttagaggtcagtaagctagaaaagggatcgtga

SEQ ID NO: 90323 - DNA, 116 bp, Mus musculus
gagctgattggtaacaggtggtacctctttccaggacttactagacagagaggactcactggagtcccaagggtgggctggggaaggaaggaggagccttggagagaaagaagctc

SEQ ID NO: 90324 - DNA, 97 bp, Mus musculus
ccctcttgagactgtagtgaagaatctgcctctgcgagcagtgttctgtgtctatcaggtgtagtggtgtggtgtctgcatgtgcagatggggaggg

SEQ ID NO: 90325 - DNA, 63 bp, Mus musculus
ggttccttggagtagacatttttactccttcttatggaagtagaaagagagctcagaggggcc

SEQ ID NO: 90326 - DNA, 109 bp, Mus musculus
gctatgcagtgtgttgacatcttggacaggacagtctttctcagaagtgtgtgagctgagattgacagcttctgtttgactctcttcttcatagacagactggaggagc

SEQ ID NO: 90327 - DNA, 73 bp, Mus musculus
tttccccttggctatgagcttggcagatcagtgaggcgagacctagttgccatgttgtgggctaggaggggaa

SEQ ID NO: 90328 - DNA, 67 bp, Mus musculus; identical to SEQ ID NO: 76380

SEQ ID NO: 90329 - DNA, 177 bp, Mus musculus
gcagtgtcacacctgagtgtgcagagcagtgtcacacctgagtgtacagagtgatgtcacacctgagtgtgcagagcggtgtcacacctgagtgtacagagtgatatcatacctgagtctacagagtgatgtcacacctgagtgtgcagagcggtgtcacacctgagtgtgcagagc

SEQ ID NO: 90330 - DNA, 73 bp, Mus musculus
gagtgtacagagtgatgtcacacctgagtgtgcagagcagtgtcacacctgagtgtgcagagcggtatttctc

SEQ ID NO: 90331 - DNA, 96 bp, Mus musculus
ggctgtcttagaactcactctgtaggccaggctggcctcaaacatggtgatctgtctgcctgactccctagtgttggggttaaaggatgcttggct

SEQ ID NO: 90332 - DNA, 90 bp, Mus musculus
tgcctgacaggaatgtgcagcctcccacagcagactcactcttctcagtgacttgcgctagacagtgagctgagagggccacccagagca

SEQ ID NO: 90333 - DNA, 79 bp, Mus musculus
gccaatactggtgagggagagggaggcttgagcccaaggtgagagcgtgtctgcttgcctgcctgcctgcctgtgtggc

SEQ ID NO: 90334 - DNA, 65 bp, Mus musculus
ctgtgagtctgtccctgtgtgagaaggatgtccaatcctttcctcaggagtccagagctcagaag

SEQ ID NO: 90335 - DNA, 57 bp, Mus musculus
gggggtctggagagatggctcagcagttaagagtgctgactgctcttccagaggtcc

SEQ ID NO: 90336 - DNA, 66 bp, Mus musculus
tctctctctctttctctctctctctcgtgtgtgtgtgtgtgagagacagacagacagacagacaga

SEQ ID NO: 90337 - DNA, 110 bp, Mus musculus
tttcagagtgggagctaaatgagctatgtcattagaagagactgaataagcttaatttttatattagaaagcagctgatctggtggcatgtgcttgttagaatactgaag

SEQ ID NO: 90338 - DNA, 64 bp, Mus musculus
aggggactacatacgacagcagactaggggatagaatgtccctgtgtctctgacccagtctctt

SEQ ID NO: 90339 - DNA, 70 bp, Mus musculus
tggttacagagttccaaggatggcagtggctcattccgcctcactccctggctgagactctgcacggcca

SEQ ID NO: 90340 - DNA, 84 bp, Mus musculus
aaggaccgctgcaggggggaggccttcttaaagaggctgtcctaaatctccctgggaaggccttctctctctcagtccctcctt

SEQ ID NO: 90341 - DNA, 69 bp, Mus musculus
gggtacaggagatggagagatggctcagcggttaagagcactgactcctcttccagaggtcctgagttc

SEQ ID NO: 90342 - DNA, 94 bp, Mus musculus
atagacacaaatctgtcacagtagagtgtggccacacggaaggatgtgattctgtgtgggtgctggaatcctcgctgttacttctgtggtctat

SEQ ID NO: 90343 - DNA, 105 bp, Mus musculus
gtgtgtgtctgagtatgtgtcggtatgtatatgtatctgtgtgtatgtatgtgtgtatgtatgtgtgtacgtgcatgtgtgtgtttcgaatgctttttcttacat

SEQ ID NO: 90344 - DNA, 75 bp, Mus musculus
caggagacatgtcattaaggctgtgaggctggcttcccctctgcacttggcgtctgtctcacagacagtctcagg

SEQ ID NO: 90345 - DNA, 88 bp, Mus musculus
taaggctgtcatcactctctgtggctcacttcagcggctaagtctcgctttctttctggggttgcctgggattgaacccagaaccttg

SEQ ID NO: 90346 - DNA, 69 bp, Mus musculus
tcagtctcactgtggctcaggcacttctcgccacctcatcggatagtctgggcttacatccttggctga

SEQ ID NO: 90347 - DNA, 68 bp, Mus musculus
tgctagtcaactgagccagcttacctggtgaattccagggcactgacagactctcagtgaacatggca

SEQ ID NO: 90348 - DNA, 89 bp, Mus musculus
gcacaagcattcacattggtgtgtgtgtgcactgatggcatgcacaagtgtgcacattggtgtgtgtgtgcactgatggactcttgagc

SEQ ID NO: 90349 - DNA, 100 bp, Mus musculus
atgtgtgtatgtgtatatatatatgtgtgtgtatatatatgtgtgtatatatatatatgcgtgtgtatatatatgtatgtatatatatatatacacatat

SEQ ID NO: 90350 - DNA, 64 bp, Mus musculus
gtgtcggggcacaaatgagcatggctggtcttcaatagcccagtcacactcagtgtctccccac

SEQ ID NO: 90351 - DNA, 61 bp, Mus musculus
tgtctctgtgtatgtgtgtctgtgtgtatacacatgtgcatacaggtgcctgcagaggtca

SEQ ID NO: 90352 - DNA, 103 bp, Mus musculus
ctgactccagatgcctctgatggagtgttctggaaacgttggcagtattttttttttcattgtcacagtgattagggttacttaagtggcatccagaggatag

SEQ ID NO: 90353 - DNA, 74 bp, Mus musculus
aggggctcacaaaaagtggagagagagaactgactccggagagttgttctctgactctacggacaccactccct

SEQ ID NO: 90354 - DNA, 64 bp, Mus musculus
ctgtctagctcactctctcgctcttgctccaaggcacttgtggagctcagagatcagtttgcag

SEQ ID NO: 90355 - DNA, 70 bp, Mus musculus
cacatttatgtatgtatgtatgcatgtatgtatgtatgtatatatgtatgtatgtatgtatgtgtgtgtg

SEQ ID NO: 90356 - DNA, 91 bp, Mus musculus
tatgttccatgtgcttatggtatgggtgtacctaactggcacgctgcctacagtaacacacaccctcagacccacagcacaggtgagtaca

SEQ ID NO: 90357 - DNA, 138 bp, Mus musculus
tatatatatcaacatatatatatatacacatatatatgcactttaaatgtatatatatgtgtgcatgtgtgtgtgtgtaaatatatatatatatatatatatatatacatttgcccaataaaagtgcataggtctatg

SEQ ID NO: 90358 - DNA, 60 bp, Mus musculus
tgtgtgtgtgtgtgtgtgtgtgtattgcatgccttgtacacatgctgacactcgtgtgca

SEQ ID NO: 90359 - DNA, 100 bp, Mus musculus
ttacactagttttgctttagtcatctgccacctctgcttacagtctctctgcttctctgttccacagcagtcccctgagacacagcaataaagagtgtga

SEQ ID NO: 90360 - DNA, 74 bp, Mus musculus
gcaaagagttgctttggcttacttctctccatcacagtctgtcactgggagaagtcaggccaggaattcaaggc

SEQ ID NO: 90361 - DNA, 109 bp, Mus musculus
gtgtgtgtcactggctcagccaggtgtaagcacagctgctagaggagtaacctgctctgcctcacactgtccctgtcactcgccttaattgggtccttttgcctcacat

SEQ ID NO: 90362 - DNA, 79 bp, Mus musculus
agtctttttgtgtgagaggtgtggtggtagggggagtacttgtctgtctgcctgcctgtctgcctgtctatccttgact

SEQ ID NO: 90363 - DNA, 104 bp, Mus musculus
caggtctgccttgaaacaagggagggagggagataaggaacagacagacacacagtcagacaaatgagcccatctcattgcaaaccttggttcttggtgagctg

SEQ ID NO: 90364 - DNA, 86 bp, Mus musculus
ggaagcccaggggtcagcattgctggacacaattattgtagcattaaggagccgtgtctcactgtgtgacctgtgcctcggtttcc

SEQ ID NO: 90365 - DNA, 114 bp, Mus musculus
tatctgtagaaggcatgtgtagagagaggtaggcatgtgtagagtgtttgggtgtaggagagagacagaagagtgtgtgtgtgtgtatgtatgtatgtatgtgagagacagata

SEQ ID NO: 90366 - DNA, 59 bp, Mus musculus
ggatcaagagcatgacaaaggttgacccacctcagcctctctgtctctgctgcttggcc

SEQ ID NO: 90367 - DNA, 111 bp, Mus musculus
gcaacaataattcagacgcatataggagtcacaataacacgaaatgaacaggcagcctgtctctgtctcattgctcgtctcttgtgccgatgccttctgcatttgacctgc

SEQ ID NO: 90368 - DNA, 80 bp, Mus musculus
ttcagtgttgggtgccgagttgggacagggactcctcagcaactgagggcctctctcttgctctcagtgtccttgctgag

SEQ ID NO: 90369 - DNA, 112 bp, Mus musculus
cacaggtagactggaatgcacgacggacttgcttggcctcactgtcacactgccacaggaactgaaggtttgaggtggaagtgctgtaacatcagggctggtttctcctgtg

SEQ ID NO: 90370 - DNA, 59 bp, Mus musculus
cctcaggggattcagaaccaacacagagattcacctctgctgtgtctgtgtctgtgggg

SEQ ID NO: 90371 - DNA, 76 bp, Mus musculus
ggccaagtggagcatcagacttgctggcatctctggagacaatctaggccattgtctgtctctctgtgagatggct

SEQ ID NO: 90372 - DNA, 98 bp, Mus musculus
cagaattcactgacttagctaggctagatggccagtgagtttcagggatctgtttgtctctgcctcacactgcaatcaagctggttaaaaatgtgctg

SEQ ID NO: 90373 - DNA, 82 bp, Mus musculus
ttggagtctgatgcctgcttctagggaaaaggactgctgtctacctgtctgactctcttagattcagagtgtgtgcttccaa

SEQ ID NO: 90374 - DNA, 106 bp, Mus musculus
gatgaggattttgtccttcagctccttctgtaaccatcgagtcaacttaatttgaacattttttatactgaatgagctgagaaggtaaggagacaggattctcaac

SEQ ID NO: 90375 - DNA, 71 bp, Mus musculus
ccagtgctttctctctcagtgattcacattgctcctaagctgtggactttacaagaagacggaggctctgg

SEQ ID NO: 90376 - DNA, 90 bp, Mus musculus
aaagatgacagtgacagtttctgccagagctagtagtgttgtccctgttgctgcctctgcctctggatctctgtctctgtcaccatcttt

SEQ ID NO: 90377 - DNA, 88 bp, Mus musculus
gtgtgtgtgtgtgtgtgtgtgtgtatgtgtgtgtgtgtgtgtgtgtgatgcacatgtatacacactctcgcacactcacatgtgtgta

SEQ ID NO: 90378 - DNA, 99 bp, Mus musculus
agagtggttagaacagatattttaaaagagaatcaatccaaaggtaatttttacccatgatctgtgtctctcagtgggtgtcacctagatggccactct

SEQ ID NO: 90379 - DNA, 84 bp, Mus musculus
tgttgcctggaagtgctcgttagagttcacacttgtagactgactctcagacaatcggtgaatagtagatggagctcaggctca

SEQ ID NO: 90380 - DNA, 65 bp, Mus musculus
gagagatagagagggggagagggggagggattatgtgcctctgcttgtctgtgtctgtgtgtctc

SEQ ID NO: 90381 - DNA, 61 bp, Mus musculus
cagtgggagtgtgggtgtctctgactcagttgcctgcttttgggaccctttgctccttctg

SEQ ID NO: 90382 - DNA, 73 bp, Mus musculus
gccatgctaacagagcctatcagcagccaattaactcaaggtcatgtctgtgtctctgtcacagctgaatggc

SEQ ID NO: 90383 - DNA, 112 bp, Mus musculus
gtgtttgtgtgcatatgtgtgcattcatatgtgtgtgtgcatgtgcatgtatatgcatatacgtgtttgtatgtatgtgtgcctgtgcacacatgtgtatgtacgtgtgtgt

SEQ ID NO: 90384 - DNA, 66 bp, Mus musculus
ctctatgttgtatgtgtttcacatgtgtgcagattcacatgtatgcatgtgcatgtgcatgtagag

SEQ ID NO: 90385 - DNA, 77 bp, Mus musculus
gttctggcatgttctgtacagacatcctgagcaacaggtgccagggaagacagtcaccacacatacatgaccaggac

SEQ ID NO: 90386 - DNA, 97 bp, Mus musculus
gagcgagtgagttctgaacctcgagcatagccaggtctataagtgttctgtgtagagaagtatgcagatgggtgaagagtgccaggacttagtgttc

SEQ ID NO: 90387 - DNA, 80 bp, Mus musculus
gccagttgctgtaccacttcggaggctcagtctgtcactctccactgcttggctgcttcttcagttgtaaagccactggc

SEQ ID NO: 90388 - DNA, 99 bp, Mus musculus
cagttacaatacagaatgtttcgagtatctgaaagaagagcaaccatttttccttaggcagtgcaagatttcaggttgaagacacatgtagaattgctg

SEQ ID NO: 90389 - DNA, 59 bp, Mus musculus
tatatgcaatatatatgtatatgcatatatatatgtatatgcatatgtatatgtatata

SEQ ID NO: 90390 - DNA, 88 bp, Mus musculus
cagagtccctgggtctgtgcagtgctgacagctgagactgtgaccctcttttgctccgtgggcggatgctatcagagccagggatggg

SEQ ID NO: 90391 - DNA, 90 bp, Mus musculus
gccaaataagtagatttgaactctcttcccaggattagtactagagatgaggctcgtggtagtcttgagatattgtctttgagtttgggc

SEQ ID NO: 90392 - DNA, 100 bp, Mus musculus
tcccgaggtacataatatagttttatcacacagtgagccagaaatcacagaggactggattctgtcccaaaacactggctgagtttatgaagtacatgga

SEQ ID NO: 90393 - DNA, 77 bp, Mus musculus
gtctgtctctgtgtctgtgtcctgacctcctcttcttagaaaggcatcaatcatatgcagcaagcacagtcaaggac

SEQ ID NO: 90394 - DNA, 106 bp, Mus musculus
ttgtgtgtgtgtgttgtaagtattgtttgttaaagggattgtctgagtctcagaagagattctgcactcacattttcaaacagacttgtaactattaaacacagga

SEQ ID NO: 90395 - DNA, 75 bp, Mus musculus
tcccagaccctcagtctctggctttggcttcttggctcctctgggcctccagcttgccaactttaggtcttggga

SEQ ID NO: 90396 - DNA, 112 bp, Mus musculus
ctgggcgattatatgcttcttaagtgagttttatattgaatctgagagatgtggtacaaggttatatagcttatttttgaccaggactacttgtaaaggaataccacaccag

SEQ ID NO: 90397 - DNA, 91 bp, Mus musculus
gtctgccttccttccaccacttttgaatcttctctgggacctggctatgaccacacatgagactgaggagggtggtggaatggatgtggat

SEQ ID NO: 90398 - DNA, 82 bp, Mus musculus
gtgtgaatcaggagacaggtcctaatgtttaccttcagtgtgagcactgtgcccatgaatgtgacctacctggaagtcatgc

SEQ ID NO: 90399 - DNA, 85 bp, Mus musculus
ggccaaagcatgtggaagaagattccattgcaacatcccgatcatctctggaagcttgagagtgctgtctgtctgtctgtctgcc

SEQ ID NO: 90400 - DNA, 72 bp, Mus musculus
gcgctagagcgtatacatgcagtgtagtttgcctgcaagtggcaggctgacttgtgtgtctgactctagggc

SEQ ID NO: 90401 - DNA, 91 bp, Mus musculus
cagggagagacatggcactggtagaagaatgttttagtgattcttctctaacgatacacatgaacaaaattagatatgggttccatccctg

SEQ ID NO: 90402 - DNA, 60 bp, Mus musculus
ccacatgggctaggtgggaggggcaaggttcccattccgactctcacacagtccatctgg

SEQ ID NO: 90403 - DNA, 102 bp, Mus musculus
aaaaccttgtcaaacgagcatgtggattagatatgtatacatgactatatatatatatattggaacaatctgtcacaatgctctctgtacttgataagtttt

SEQ ID NO: 90404 - DNA, 66 bp, Mus musculus
gagactgatggtttcttctactgttgtctgctgaaagatgtacatggtagaggagcccattagctt

SEQ ID NO: 90405 - DNA, 81 bp, Mus musculus
tgaccaggatggtcctgttatagtgctcaaatgatacattatctctgattacagttcaggacactgaagtctgagaggtca

SEQ ID NO: 90406 - DNA, 114 bp, Mus musculus
gagttgctgctgggacagtctcttgtgctctgtggaaaggctgtctgtctctgtgttactcacaggctgatttctgtacagggccaatagtgttatttttaggaagcaccactt

SEQ ID NO: 90407 - DNA, 74 bp, Mus musculus
gggtcatagtgacagggttcagaagagctcagaggaaatccatgcttatctgtctcactcacttaacagacacc

SEQ ID NO: 90408 - DNA, 118 bp, Mus musculus
gtttatactgtagtaaaaagacgtataacatgaaatttaccaccttgcatattttaagtatataactttgaatgtgtaagtgcaattattggtgtcagtctcatattatagaataaat

SEQ ID NO: 90409 - DNA, 64 bp, Mus musculus
aggactgggcaagggacacagagcatgcacatatgcctgctactctgagttcttgctgagtgct

SEQ ID NO: 90410 - DNA, 78 bp, Mus musculus
aattgagttctcagggctggagagatggctcagtggttaagcgcactgactgctcttccagaggtcctgagttcaatt

SEQ ID NO: 90411 - DNA, 86 bp, Mus musculus
gtagatatgtatgtatgtgtgtgcatgtatgtgtgtgtatgtatgtatgtgtgtgtatgtatgtatatatttacttacttgtctat

SEQ ID NO: 90412 - DNA, 61 bp, Mus musculus
tggggaactggatgtatgtatgtatgtatgtatgtatgtatgtatgtatgtatgttctcta

SEQ ID NO: 90413 - DNA, 118 bp, Mus musculus
ccaattcctgctagtattcaagtttggaatccgggactgtgcattaaaacgttatttattatttatactgggtggtgtgcacctttaatctcagcacttgggaggcagaggcaggtgg

SEQ ID NO: 90414 - DNA, 91 bp, Mus musculus
ccgccctattcagtaacagcatcagcttctgcaccatcagctcctccaagtgccccgccagctgttcatgcactgatcagatgttgggtgg

SEQ ID NO: 90415 - DNA, 92 bp, Mus musculus
gtgtatgtgtgcacatgtgtgtatatgtgtgtgcatgtgcatgtgtctgagtgtatgtgtgcacatgtgtgtatatgtgtgtgcatgtatgc

SEQ ID NO: 90416 - DNA, 117 bp, Mus musculus
cttggctcttcctcccgacagagcatctcagtgcccccagttgatggtactgtgtctctcagtctcttagtctccattttctgttttcctctgtcttctctgtcatgaagtcctaag

SEQ ID NO: 90417 - DNA, 118 bp, Mus musculus
cggttaggaggtctctgtgttgggcgtctgtctgcccgagtgcctgcctctctgttgctctgaaggaggcaggggctgggcctgcagctgcctgggcagagctgctccttcgagggac

SEQ ID NO: 90418 - DNA, 69 bp, Mus musculus
tgtaggcagcacagaaggagcaactgtctgccaaggccctgacactggctgcctctgtccttgccaaca

SEQ ID NO: 90419 - DNA, 117 bp, Mus musculus
agcatgattcgacttttagcacctgtcttctgattactctttttggactcaatatttcattatttactgtcttcttttaatgactctgaaggcagatgctgaaggcagccttccgtt

SEQ ID NO: 90420 - DNA, 88 bp, Mus musculus
gtgaaagataagtgcagtgtccttggatcacaagtgatgttgaacttgaatcccatcaatgtgagtttggggacatttctgtggtcac

SEQ ID NO: 90421 - DNA, 84 bp, Mus musculus
ggggacagtggacattgatgttggagccagtgaggacactccctagactaaatctatgtttatttaatgtctgattctgttcct

SEQ ID NO: 90422 - DNA, 70 bp, Mus musculus
aggcaaaaccaagaaacacttccatgtctgcttttactgaaacagcatgtggaggtcacacaggctgcct

SEQ ID NO: 90423 - DNA, 71 bp, Mus musculus
ttctgtgactgcttatcatacctggccaccaggagaaccaagtggaaagatgtctggatgcagttgttggg

SEQ ID NO: 90424 - DNA, 120 bp, Mus musculus
acctatagtggtttggcatggtgctgcttacattctagtgctaatattgggccctcaagagataagagagtctgcacatagatgctaagtgaccctagccccaagttatttctgattggt

SEQ ID NO: 90425 - DNA, 87 bp, Mus musculus
gtttcataacttctgttagtctcactgtgtctctgtttagtttctgtttccaggatctgtccattgatgagactggggtgttgaagc

SEQ ID NO: 90426 - DNA, 75 bp, Mus musculus
catctatatgtctttctgtatctattcatatgtatatagatacgtatgtatagatgtctgtatagatatatagtg

SEQ ID NO: 90427 - DNA, 105 bp, Mus musculus
tggttttgatgggattcttgagtgtgtggatggctccctctgtggctgtatctgttgcttgagtcttttcttaggctcttttccttcctttgtttgttttcccca

SEQ ID NO: 90428 - DNA, 109 bp, Mus musculus
tcttcaatcatggttttagggctaagtgtcaatagagataagattaactccttctctctctcagtgaaatattccagtccaaaaagtgctaagatcagttggtagaaga

SEQ ID NO: 90429 - DNA, 81 bp, Mus musculus
gcagattgctgtgtgtgtgcatgtattcattcatatgtgtatggtgtatgagagttgtgtgtgtgtacatagtaattgtgt

SEQ ID NO: 90430 - DNA, 67 bp, Mus musculus
aggcagggcgacaaggggatcagggaagcctcgcttactgggggtcactgggtctgtggctctgtgt

SEQ ID NO: 90431 - DNA, 84 bp, Mus musculus
tggaattttgatggggattgtattgaatctgtagattgcttttggcaagatagacattttttctatattaatcctgtcaatcca

SEQ ID NO: 90432 - DNA, 119 bp, Mus musculus
gaggtttggtctgatgctatgcattgtcatgctaagtgcaggcccccaagacctggttgctccagagatgagtgtctgcacacagacatagacccaagtaactgcatgtgactttgccc

SEQ ID NO: 90433 - DNA, 97 bp, Mus musculus
tctgcagggaaggcaccaagtggttcaccagctttttcaacgtgtctgcactgacatgtgactgtgtacagtgctcccttggatcttctggggcgga

SEQ ID NO: 90434 - DNA, 92 bp, Mus musculus
gtacatatatatatatatatatatatatatatatatatatatacacacacacatatatacatatgtatatgtatatgtatatgtatatgtat

SEQ ID NO: 90435 - DNA, 104 bp, Mus musculus
gtgagaggctttgatcaaactgataaaacagtgaccaatctgtctgtctttcagtcatttggaaggtatttgttacgtttcttgtttaagctcacaatgctcac

SEQ ID NO: 90436 - DNA, 107 bp, Mus musculus
cttccactttcagcattgaaacaccattgactccactctctgcagcctgtgcattctgccactgtctctgtgtgttcagtaggcccccatcatgctgaatctaaaag

SEQ ID NO: 90437 - DNA, 116 bp, Mus musculus
ttgaagatcagccttagtgcatggtgatctgataggatgcatgggacaatttcattatttttgtatctgttgaggcctgttttgtgacctattatgtggtcaattttggagaaggt

SEQ ID NO: 90438 - DNA, 85 bp, Mus musculus; identical to SEQ ID NO: 59744

SEQ ID NO: 90439 - DNA, 102 bp, Mus musculus
actggtgcaggggctgtccctgagcctgtttcctgcctacctgcctgcctgcctgcctgtggattctgcaccctcaaatggaaagccttctctagcctcagt

SEQ ID NO: 90440 - DNA, 111 bp, Mus musculus
gaaagtgagtctggatttgaggcctgctactgaggccagaatttttattttcttttcagagaaacacattactgctcagcaaggtaggtcatgtgagttcagaaaaagttc

SEQ ID NO: 90441 - DNA, 118 bp, Mus musculus
agcacttcctcaggttcctcttttgtaccttggaataggcatcactagaagtcattttcttctgctgataacccttgcattgccttcccatctgcattcaggatgttcaggaagccct

SEQ ID NO: 90442 - DNA, 91 bp, Mus musculus
gctatccagagcttttatatttctatatgaatctgaaaatagtcatttcaagatcagtgcagaatcatactggaatttgaattaggattgc

SEQ ID NO: 90443 - DNA, 75 bp, Mus musculus
ggctatgtttccacctttaaaatgttaagtgtgtgacttcagctctctcacactcagtgttttaactggagtgtc

SEQ ID NO: 90444 - DNA, 94 bp, Mus musculus
taagctcctcctaatgtctgactgtgggtctctgtatctgtttctgccagttgctggatggagactctcaggtggcagtcatgctaggatcttg

SEQ ID NO: 90445 - DNA, 98 bp, Mus musculus
ggaatactgtgagaggctggcctctgaacacaccatggctgttacacacacacattcacagcagctgtgtttacccatgcaagcccttcacaagatcc

SEQ ID NO: 90446 - DNA, 94 bp, Mus musculus
ggagatcatcgaaaactgtgattggacaagggctgtgagccaattgacaagatagagagcccacaaagccctcctttctgagttcatgacctct

SEQ ID NO: 90447 - DNA, 68 bp, Mus musculus
gcacttgctgtggctgctgctcatctcttgtctatgggaacaggagacagagtgcagactgcggctgc

SEQ ID NO: 90448 - DNA, 95 bp, Mus musculus
aactcctacttttaaaagatcatctaagagattggagtgctcttaacctttttagcggttaagagcactgactgctcttccagaggtcctgagtt

SEQ ID NO: 90449 - DNA, 71 bp, Mus musculus
gtgtgggaccaccggttacagggagctatagcagagagggaactagtggctagtctgtcactgtctcaaac

SEQ ID NO: 90450 - DNA, 56 bp, Mus musculus
gtatgtgtttgcatgcatccatgctaggtgttccagtgtgtgtgcatgtgcatgtc

SEQ ID NO: 90451 - DNA, 93 bp, Mus musculus
tccattgtgatctgattggatgcatgggataatttcaatatttttgtatctgttgaggcctgttttgtgaccaattatgttgtcagttttgga

SEQ ID NO: 90452 - DNA, 85 bp, Mus musculus
tgtgagaggctggcctctgaacacaccatggctgttacacacacacattcacagcagctgtgtttacctgtgcaatcccttcaca

SEQ ID NO: 90453 - DNA, 102 bp, Mus musculus
tgtgctaaactgtggaccagaagttctttgattatcttgctgttagttctaatgacatctgatttcagtgcccctgaattctgtggtctgtggacaatgcca

SEQ ID NO: 90454 - DNA, 107 bp, Mus musculus
agggggtgtgggggaatgaggtggcagaaggcatagttgaataaaacttttttttaaaagtcagtgttctatttctgtaaagagacattgtgaccatagcaactcct

SEQ ID NO: 90455 - DNA, 117 bp, Mus musculus
cctctctgtgccttgacttggcttcctctgttgcttatcactgctggttaggaaaggcacagtgaagtcacagagcactgaacactgtccaaggcagaggctttattcagatacagg

SEQ ID NO: 90456 - DNA, 195 bp, Mus musculus
atatatatatatatatatatatatatatatatatacacacacacacatatatgtgtgtgtgtatgtatgtatgtatgtatatgtatatatacgtatatgtgtgtatgtatgtatatgtatatatatatgtatatatatgtgtatagcatacatatatattcatgttcacgtgtatgtgaccatgtgtatgcatgt

SEQ ID NO: 90457 - DNA, 115 bp, Mus musculus
agcacatgcttccctctgtgtggcccacaagcctattcagtagtgtgtgaccactgctcaatcaaaggcagtgatcatcttctgaggctgcacatggaggccaagcacacaggct

SEQ ID NO: 90458 - DNA, 88 bp, Mus musculus
tgcacatgccctggtgctttaagcagtatcttcactcttggacggatctacatgtgaatgtatacatgtgtgtatttatgtatgtgca

SEQ ID NO: 90459 - DNA, 107 bp, Mus musculus
ctgttgtgcccatcatggtggctcttagctcacatactgctcctgagaggagaaagagaggtctgtggaggaggtaattgaagtagagctacgaaaggtaacagtgg

SEQ ID NO: 90460 - DNA, 92 bp, Mus musculus
gcataggaacataagcaacaggggctggagagatggttcagtggttaagagcactgactgctcttccaaaggtcctgagttcaaatcccagc

SEQ ID NO: 90461 - DNA, 71 bp, Mus musculus
gtggcaggaggtagaggagagataggagatccagataagtattatctcacttctctctctgtgtcagccac

SEQ ID NO: 90462 - DNA, 85 bp, Mus musculus; identical to SEQ ID NO: 57439

SEQ ID NO: 90463 - DNA, 85 bp, Mus musculus
acacagaacagacatccgtaaatgagagatgaccaggtggtggtgggcccctgaagaagacctcagtcagtgtgtgtgttcttgt

SEQ ID NO: 90464 - DNA, 82 bp, Mus musculus
ttaaatatgcatggtgctagggaatggacacatagcctcggtttagggcattgttaatattttttctagcatttgaatttaa

SEQ ID NO: 90465 - DNA, 104 bp, Mus musculus
tgaagatcagccttagtccatggtgatcagataggatgcatgggataatttcaatatttattgtatctcttgagacatgttttatggtcaattttggagtaggc

SEQ ID NO: 90466 - DNA, 115 bp, Mus musculus
ggggagggctatttttgtaatttcctgatcttgtacaattgtagtgaaattgttgttcatgtaaggcaacaaaccacgtgttttcacttctacaaataggttgcttgtccttgac

SEQ ID NO: 90467 - DNA, 85 bp, Mus musculus; identical to SEQ ID NO: 57439

SEQ ID NO: 90468 - DNA, 85 bp, Mus musculus; identical to SEQ ID NO: 57439

SEQ ID NO: 90469 - DNA, 98 bp, Mus musculus; identical to SEQ ID NO: 90445

SEQ ID NO: 90470 - DNA, 96 bp, Mus musculus
gatcagccttagtccatggtgatctgataggatgcatgggacaatttcaatatttttgtatatgttgaggcctgttttgttaccaattatatggtc

SEQ ID NO: 90471 - DNA, 85 bp, Mus musculus; identical to SEQ ID NO: 57439

SEQ ID NO: 90472 - DNA, 79 bp, Mus musculus
ttggtctacctgtctgtcactgtgtcagtactctgatggttcctcagaaaattgggcatagtactaccggagggtccag

SEQ ID NO: 90473 - DNA, 78 bp, Mus musculus
gtgatgtgagaagtgccagagcacagtcactgaacaatggagcacagcaagtacttctctggctgtttctgatggcac

SEQ ID NO: 90474 - DNA, 111 bp, Mus musculus
ggtcagagaaccattgtgaaagcttttaactaggaaaagcagttagtaggttagaaactattttaaattggggattccttgaaagtttctcagaagcaatgggcttccacc

SEQ ID NO: 90475 - DNA, 95 bp, Mus musculus
gtatgtttcctctgtgtcagtcactgtcactcatcctagcgataataaaaagtctcctggtgtgtgtctggtagaggtcagggagtattagatac

SEQ ID NO: 90476 - DNA, 92 bp, Mus musculus
acacagactgagcagattgtatctatgtatgtatgactataggtattcatgcatatgtgtatatgtgtgtgtatgcatgcctgtgtgtgtgc

SEQ ID NO: 90477 - DNA, 90 bp, Mus musculus
tttgggtatcagcttcatctgtatatcaggaggttcccagcacttctctgtgtgaaactctctctgtatactgtaaagtacttctctaaa

SEQ ID NO: 90478 - DNA, 95 bp, Mus musculus
ctaccttctggtctgcacagtatgaaaataagggcagagagaagagacacagatgattcctttgtatttcatagactgtggataaagagaggtgg

SEQ ID NO: 90479 - DNA, 92 bp, Mus musculus
gctgtggtgtgttgaaagacccctggacttaaagtaagaagatctgggtttgagtctcagtctgtcccttatttttctgtgtgaccttgagc

SEQ ID NO: 90480 - DNA, 110 bp, Mus musculus
tcacagggccaggatagaatgtatagacataatacagggaaccatgatgcaatgtatagatgtaagttcttgagagacaatgtctaagcagatcttcctactcttgttga

SEQ ID NO: 90481 - DNA, 106 bp, Mus musculus
cttcccagatcacttttcagaagcctacgagtgtgtgtctgcatgtgcatgtccctgtgtgtgaatgtatgaatatgagtatgtggtgtttgtgtgagtatagagg

SEQ ID NO: 90482 - DNA, 111 bp, Mus musculus
tttttggtagtgtgactttgggcacaagggttaacatctctcttatctggacctcacatctgactctgagataattagcatttcacctgaagtgaagtcactgaccataaa

SEQ ID NO: 90483 - DNA, 78 bp, Mus musculus
ttcatttatgctgtgtgtctgtgtgtgaaatgtcctactaaacatttcgtttgcttacagatctttacagtaactgag

SEQ ID NO: 90484 - DNA, 114 bp, Mus musculus
atatatatgtatgtgtatatatgtatatgtgtgtatatatatgtatatgtgtgtgtatatacatacatatatatatatatatacatatatatatatatgtacatacatatatat

SEQ ID NO: 90485 - DNA, 93 bp, Mus musculus
actgtgtacttggactggagagatggctcagccgttaagagctctgactgctcttccagaggtcctgagttcaattcctagaaaccacatagt

SEQ ID NO: 90486 - DNA, 108 bp, Mus musculus
atacatacacacacacacacatatatatatgtatatatatatgtatgtatatatatatatatatatatacatatatatgtgtatgtatgtatgtatgtatgtatatat

SEQ ID NO: 90487 - DNA, 98 bp, Mus musculus; identical to SEQ ID NO: 90445

SEQ ID NO: 90488 - DNA, 191 bp, Mus musculus
tatgtatacatatatatatatatgtatatatatatatatacacatatatatatgtgtgtatatatataatacacaaacatatatgtgtgtatatatgtacatatatatgtatacacacacacatatatatatatgtatatatatatgtgtgtgtgtgtgtgtgtatgtatatatgtttatgtataatatgt

SEQ ID NO: 90489 - DNA, 89 bp, Mus musculus
ctgaaaatggacctgagggccacaggatctctctatttgttcttctcaatggagccatagtgaacacaggtgccttctctgtttctcag

SEQ ID NO: 90490 - DNA, 79 bp, Mus musculus
tcctccatcttttgtcttgggtcaccttgaatttaagagagaaagacagactgacagacagacaaacaggaaggaagga

SEQ ID NO: 90491 - DNA, 56 bp, Mus musculus
tctgtgtctgtctgtctgtctgtatatatgtgtgtgcatatatagatagatataga

SEQ ID NO: 90492 - DNA, 106 bp, Mus musculus
caattgactcttgttactgcctaccatgtatccatgtgaggattgtagtttgtttcctaattaactctcaaacttaccgatgttagaagtagtagcagagatgttg

SEQ ID NO: 90493 - DNA, 109 bp, Mus musculus
tatatatatgtacatatgtgtatgtatatatatgtgtacatatgtatatatatgtacatatgtatatgtatatatatatatatatatatatatatatatatatataatg

SEQ ID NO: 90494 - DNA, 99 bp, Mus musculus
ggatgtaaaattaatcagctttcacagctctaatttttgcctgagacactgtgtcagtgtgtttggtatgtgctgtgttgaagcctggaagcctacgcc

SEQ ID NO: 90495 - DNA, 78 bp, Mus musculus
tatgtacaacatacacgtaagaatatatatatatatatatatatatatatatatatgtatgtatgtatatatacacac

SEQ ID NO: 90496 - DNA, 85 bp, Mus musculus; identical to SEQ ID NO: 57439

SEQ ID NO: 90497 - DNA, 69 bp, Mus musculus
gtatgtgatgctcaggctatcgatcatatagaatatatacactaaagtcagctgagagtgtgcacatgc

SEQ ID NO: 90498 - DNA, 86 bp, Mus musculus
gtgaatatgtatatatctatatatagatacatatatagcactatagcactatatatagatacatatatagatgtatatatacacac

SEQ ID NO: 90499 - DNA, 77 bp, Mus musculus
aaacacaatggagggtctcagtctgtgcctgtgatctccacagcagtcacatgagatgagcatcactattcttgttt

SEQ ID NO: 90500 - DNA, 134 bp, Mus musculus
tattttattaataaatttggattagatatatttgtgtagataaatgtgcagagctatatgtccagaatttgtttttgagatacagggtttctctgtatagccctggctgttcttgggactcactttggaggcaa

SEQ ID NO: 90501 - DNA, 85 bp, Mus musculus; identical to SEQ ID NO: 57439

SEQ ID NO: 90502 - DNA, 108 bp, Mus musculus
gtgattctaaacattactccagcagtcttcttgcaagtgcagtaaagaatttatcaatttttgtacttcatttatgagaagaaaggtctggtgaatgtggtacctgac

SEQ ID NO: 90503 - DNA, 98 bp, Mus musculus
acacagagagatagagattgatatgtatgttatatttatatataacattatatatatttatatatatatatataaatacaacctgtgtattctggagt

SEQ ID NO: 90504 - DNA, 69 bp, Mus musculus
catggatatgcatgtatataagtatgtatgtttcgatgtattacatatttatgtatgtgtgtgtgtgtg

SEQ ID NO: 90505 - DNA, 108 bp, Mus musculus
ccgggttatgggagagaggactgaggggaagagaggtttccacacaggtgagagtgagcacagctgaacagagactgtctatggttttagagctttattatagaaagg

SEQ ID NO: 90506 - DNA, 85 bp, Mus musculus; identical to SEQ ID NO: 57470

SEQ ID NO: 90507 - DNA, 79 bp, Mus musculus
caggacccagacaccatgcatcagaggactacttgagcaaggtaaagtgggatccctgtctgtctgtctgtctgtcttg

SEQ ID NO: 90508 - DNA, 62 bp, Mus musculus
agggagagggagtccattgggagtcagcacagtgagtgcagtgcagtggagttgagttcctt

SEQ ID NO: 90509 - DNA, 98 bp, Mus musculus
ggaatactgtgagaggctggcctctaaacacaccatggctgttacacacacacattcacagcagctgtgtttacctgtgcacgcccttcactagatcc

SEQ ID NO: 90510 - DNA, 109 bp, Mus musculus
gtatatattgatgtatatgttgatgtatatgatgtatatgatgtatatgatgtatatgtatatgtatatgtgtatatgatgtatatgtatatgtatatgacgtatatgt

SEQ ID NO: 90511 - DNA, 112 bp, Mus musculus
tgatatgacatatatttgtataaagtatatatgtaaacacatgtgatgtatatatgtatatatgctacatttatgtgtgtttgtatgtatgcatatatgtataacccgttca

SEQ ID NO: 90512 - DNA, 68 bp, Mus musculus
atgcatatatatatatatatgcacatatatatatgtgtatgtgtgtgtgtgtgtctatgtgtgtgcat

SEQ ID NO: 90513 - DNA, 97 bp, Mus musculus
gatatacatgaatgttttaacatggttgatgtaaataaatatgtgcttcaagtgtacatatatttatgttaatcatttgaaaatgagaaatgttttc

SEQ ID NO: 90514 - DNA, 113 bp, Mus musculus
caggtgttggattttgtcaaaagctctcagcatctaatgagatgatcatatgggatttttttcctttgagtctgtttatatactgggttacactgatggatttctgtacattg

SEQ ID NO: 90515 - DNA, 67 bp, Mus musculus
tctggatgcacgtggcaattcagtgtgacattattacatggtgccgacactgtctgtctgtgtcaga

SEQ ID NO: 90516 - DNA, 119 bp, Mus musculus
tgtatgtgtgtgtgttatatgtgtagtatatgtacatgtaatatgtatctatattatgtatacatatatgattcatatatgtgtatatgtatatatgcatatatacacaaacatgcact

SEQ ID NO: 90517 - DNA, 75 bp, Mus musculus
accaagattatattggactgtcattttctgtgtctgaagatacaagagtttaagatggttcagcttactgatggt

SEQ ID NO: 90518 - DNA, 70 bp, Mus musculus
cactaattgttattgcatgcacatatgtatttgtatatacatatataaacatgtagtagcaggaaaagtg

SEQ ID NO: 90519 - DNA, 95 bp, Mus musculus
tgcagattgtcaatgtgtgtatatgtatttgtatgtatgtaattgtgcattatatagcatggttataggtatatgcatgtgtgtacatgtttgta

SEQ ID NO: 90520 - DNA, 99 bp, Mus musculus
cttattctgtgatgatctgataggatgcatgggacaatttcaatatttttgtatctgttgagggctgttttgtgacctattatgtggtcagttttggag

SEQ ID NO: 90521 - DNA, 105 bp, Mus musculus
gccttagtcatgatgatctgataggatgcataggacaatttcaatatttttgtatatgttgaggcttgttttgtgaccaattatgtggtcagttttggagaaggt

SEQ ID NO: 90522 - DNA, 84 bp, Mus musculus
ggaagaatagaaaactgtctcagggctgaagagatggctcagcggctaagagcactgactgctcttccagaggtcctgagttca

SEQ ID NO: 90523 - DNA, 117 bp, Mus musculus
ctattctgcaactgtgaggtatatgctgtggatgaatcaaatgagtgattatgttgttgacactaagaactgatttgggacgtggctgaggaggcatagtggatgtaagacagatgg

SEQ ID NO: 90524 - DNA, 85 bp, Mus musculus; identical to SEQ ID NO: 57470

SEQ ID NO: 90525 - DNA, 107 bp, Mus musculus
acagtcagtgtagaattcaatatatgtgtgtgtgtgtatgtatatatatatacacacacacatatatagatatatgagtatatctatatgtatgtgtgtgtatgtat

SEQ ID NO: 90526 - DNA, 85 bp, Mus musculus; identical to SEQ ID NO: 57439

SEQ ID NO: 90527 - DNA, 65 bp, Mus musculus
acttgtttgtgtagtgttctcaccaccagggggcaagctctgagtgagtgagtgagtgagtgagt

SEQ ID NO: 90528 - DNA, 99 bp, Mus musculus
cggtgacagcttttagcagggcctgtgtgccagagagcctgctggattgtctggggactcctctcactctcccacacactttgttattcctggacatcg

SEQ ID NO: 90529 - DNA, 95 bp, Mus musculus
gagagagggggagagggagaaggagagagagagaaagagagagagagactgtctgtctttctgtctgtccaaatgaaggctgaagcccctctctt

SEQ ID NO: 90530 - DNA, 80 bp, Mus musculus
ttgtgaaaaccttgggcatagcttatgtccattctcaagatcctagagagaagttacattgctttccaaagtagtcatga

SEQ ID NO: 90531 - DNA, 105 bp, Mus musculus
ggagctgttgtaattgggaagctgttcagagctgctggtgggatctctgctcagtgctgagtctctctgctttagcagtctacaatcttcctaccactgtgttct

SEQ ID NO: 90532 - DNA, 116 bp, Mus musculus
tcaagctgttggtcaaggctatcccagagagttctcaaaacaatacatgtcattgctcttcattactctccagaatttataagtgggaacttactgctgaggacactacatcttgg

SEQ ID NO: 90533 - DNA, 72 bp, Mus musculus
ctagaagaaaggggtattgctgtcacacagagagtctctgtgtccctggcaaacatgtctaccccattttag

SEQ ID NO: 90534 - DNA, 72 bp, Mus musculus
tatgtacatatgtgtatatgtatgtatttgtatacatgtatatatgtatttgcatgtatatatatatatata

SEQ ID NO: 90535 - DNA, 115 bp, Mus musculus
ttaaatttaatggtgtccaaactatgactgaagtgttgtgaaagcagacatatgtttattttttgtaacattgtgagatactgtcatctatgaagttcacaccagacaaatatga

SEQ ID NO: 90536 - DNA, 77 bp, Mus musculus
tcctggtttgtttttttcacagcctcccagtgcctgcttggcactgacactgagtggctgtgaaatgaatgaatgga

SEQ ID NO: 90537 - DNA, 106 bp, Mus musculus
caccagggtacacgtcccagaccactcagtgggtaggcagtggtagaattgagtgctgcagagaatagaggcatggtgaaaacttgggcacagtggctgactggtg

SEQ ID NO: 90538 - DNA, 88 bp, Mus musculus
cagggatggggatgttgtgactatggttgtagaatgtctcctgggtgtggcagatcagagaccttctatttctttccttatccatctg

SEQ ID NO: 90539 - DNA, 116 bp, Mus musculus
ctgtttcaggagacctcctggcttcagtgcatggatgtgagggtccaagaattgctgacagaaggaagagtccagactcaaataatatgtaaaggtaaagagtgtttatgctgcag

SEQ ID NO: 90540 - DNA, 67 bp, Mus musculus
ggtgccaccaaccacctcctggctaaacatatttatttttatgtgtccgggtgtttgtgtgtgcacc

SEQ ID NO: 90541 - DNA, 62 bp, Mus musculus
ttagagaagtatggacccttttcctgtggctacaccactgaagagagtctctctctctctga

SEQ ID NO: 90542 - DNA, 83 bp, Mus musculus
ccataatgcaatcttgtcataaacagagcatatccaaaaagagtgtgtgaatgtgcatctgcatttgtgaatggcttttgtgg

SEQ ID NO: 90543 - DNA, 71 bp, Mus musculus
tgtgtgtggctctcacagacagagaggggggggtcacaggcacgcccacactctgtgtgtgaatacggacg

SEQ ID NO: 90544 - DNA, 121 bp, Mus musculus
acatgcaggtttgttctggtgtcacttccttgacgacatcttcaccctgttacactgtcttctctctgtgtcagtaagttttgtctttatcaagttccactggctgcctctgagtgtcctg

SEQ ID NO: 90545 - DNA, 75 bp, Mus musculus
cttttaagatgcagaaggcagttctctgcttttctaatgacagaggggcattcactggctgtgtctgtctaaaag

SEQ ID NO: 90546 - DNA, 91 bp, Mus musculus
gttttaaattttattctaagtacaggggtgttttgcctgcatgtatgtatgtgtgcaagtccatgcctggtgccggaggaaggtagaaggc

SEQ ID NO: 90547 - DNA, 79 bp, Mus musculus
tttgtctgtctgtctacctgcctgcctgtctgtctcacacacacagagggagagagggtaggagagagatacaaacaga

SEQ ID NO: 90548 - DNA, 64 bp, Mus musculus
ttccgggctggagagacggctcagcagttaagagcacactgactgctcttccagaggtcctgag

SEQ ID NO: 90549 - DNA, 118 bp, Mus musculus
aggggaatagagaaacttgagctgatacttagagccagggtacacgatttctgagaagcggtcagagtacagtgtgaccaggtaggagactgtgggtaaaaggaacgtctgtgctcct

SEQ ID NO: 90550 - DNA, 114 bp, Mus musculus
atggttgtgagccaccatttggttgctgggaattgaacacaggacctctgagagaaaagtctgtgctcttagccactgtgccatctctccagctcctccaaagtacatttctat

SEQ ID NO: 90551 - DNA, 96 bp, Mus musculus
aggtgagggtcagaataatcttgcaacatttggttaggcagaatatttgtttaattttatcagatacagcatgactattcattttgatgtacacct

SEQ ID NO: 90552 - DNA, 89 bp, Mus musculus
caggcctacctcactgtccctcagtcacatatgtggcaggtgttctcctttttccagctgtcatctgagagtgcttggcattaggtctg

SEQ ID NO: 90553 - DNA, 75 bp, Mus musculus
gggtcaggaagggcagagcaagaggtgcaaggctgtcattacactcttaccacatctgtctgtctgacaggatcc

SEQ ID NO: 90554 - DNA, 118 bp, Mus musculus
ttattatggagcaaacatatacagtgatagacattggagttgaatctcattttgtttatctaattatccaaattctatttggctatcagtctatcatttatgttatgtgtgttaataa

SEQ ID NO: 90555 - DNA, 116 bp, Mus musculus
gtgtcagcatttggaggctgattatgggatggatccctgggtggctcagcggttaagagcactgactgctcttccagaggtcctgagttcaattcccagcaaccacatggtggctc

SEQ ID NO: 90556 - DNA, 85 bp, Mus musculus; identical to SEQ ID NO: 57470

SEQ ID NO: 90557 - DNA, 72 bp, Mus musculus
tctctcactgttgctgagaagagcttcctgcctcctctgactctcaggctctctgcagcatcagcacagagg

SEQ ID NO: 90558 - DNA, 120 bp, Mus musculus
ggaggttgggagatactttctgtctttggtgtttgacaaatgtgagctaagttttgctggtttgctagctgctccacaactctactccttcaaattaaaaggcacagtaatttcctcccc

SEQ ID NO: 90559 - DNA, 64 bp, Mus musculus
taactctgagcacagtttatttcttatttaaaatgaatatgatgatgaatatgtgtcagagtta

SEQ ID NO: 90560 - DNA, 66 bp, Mus musculus
gcatgtatatgtatgtatatgtgtgtgcatgtgcatgtgtgtgtgcatgtgcatgtgtgtgcgtgt

SEQ ID NO: 90561 - DNA, 117 bp, Mus musculus
ctgtgtgtgtgtgtgtgagtctctctctgtatgtctgggtgtgtctctccctgtgtgtatgtgtgtggtgggagatgtccccatgagttttcagtaggcctagtaacaagaatatgg

SEQ ID NO: 90562 - DNA, 62 bp, Mus musculus
gtgctccatagtgagtgctgtcagaactgacccatgtgtctgtgacactctcaatggagtgc

SEQ ID NO: 90563 - DNA, 109 bp, Mus musculus
tctctctctctctctctctctctctctctgttgtgtgtacacacacgagtgtgtggagagagggtctgctgcgtgggaatggtagcttgcagcagatccccctctctgt

SEQ ID NO: 90564 - DNA, 104 bp, Mus musculus
gtgatagattgtatagaactaagaacagaaagcaaactttgaattgtctgagaaagcactttgtttgtttgtttttgttttttactgtatgcaaagctaagaac

SEQ ID NO: 90565 - DNA, 58 bp, Mus musculus
gtagactaggctggctttgaactcagaggtcctctgtaggtctgtgagtctgtctcac

SEQ ID NO: 90566 - DNA, 103 bp, Mus musculus
actgtatgcacattattagaacaaagagaattgtttgttttttcttaaaaaatccagtcaagacatcaactttcatacttttgtctaatacatgcatacatgt

SEQ ID NO: 90567 - DNA, 106 bp, Mus musculus
ggaccctcttcatttagtgaggacattgtgtgtgtatacgcccacatagtgaggacagtggctctctgtgtgtatacgcccacaggtcagcaccagttgtttttcc

SEQ ID NO: 90568 - DNA, 74 bp, Mus musculus
tgtaatccctgccacagagcctgcgagggcagtacaatgaaagtcttagacagttctctgggtggtggagtaca

SEQ ID NO: 90569 - DNA, 59 bp, Mus musculus
aggctcagggcagtgccatgacagggttccagctcgcctgcctgcctgcctgcctgcct

SEQ ID NO: 90570 - DNA, 79 bp, Mus musculus
ggaaagatgggcagatctagcctttggggataaggggaaggtgtcctctgtctctgtctctatctgccttctgcttgcc

SEQ ID NO: 90571 - DNA, 83 bp, Mus musculus
caagttctaagttccccaaatggtagatattaattctgagtctctctctaagagtgtatgtctgctttcccaggttaggcttg

SEQ ID NO: 90572 - DNA, 116 bp, Mus musculus
aggcgttaataggcatgatgtggaagaaatgagttaagatgactctaatttttttgttgttgaattggttgatatctatatctatatctatatctatatcatctatatctgtatct

SEQ ID NO: 90573 - DNA, 83 bp, Mus musculus
aggactcagtagcatggggctatggaggtgctgagctaggatttaccccaggcactctggccctgtgactatccaagagactt

SEQ ID NO: 90574 - DNA, 107 bp, Mus musculus
agcatatagaagcatgtggtggggctggagagatggctcagcggttaagagcactgactgctcttccagaggtcctgagttcaattcccagcaaccacatggtggct

SEQ ID NO: 90575 - DNA, 98 bp, Mus musculus
gctccaaaatgaatgaaactctgggatgtgacattttgtctgtgtgattctgtgattgacaaagtttcaagaagtcaagagaaaggagtcaaaggagc

SEQ ID NO: 90576 - DNA, 72 bp, Mus musculus
tctgtgtctcactcagtcatcatccaggaaatttcctcctgcagtagatgggacaactgaacgatgtacaga

SEQ ID NO: 90577 - DNA, 86 bp, Mus musculus
ggtcaagagtaccaggaacaggctggagaggtggctcagtggttaagagctctgactgctcttccagaggaccctggttcgagtcc

SEQ ID NO: 90578 - DNA, 68 bp, Mus musculus
gggtgtgatgctctctgagtcagtgggacaagcccataaggccctacgacatcagagtatgtcacccc

SEQ ID NO: 90579 - DNA, 96 bp, Mus musculus
atacatatatgtatgtatatgtatacatatatgtatgtgtatatacatatatgtgtgtgtatatatatgtgtatatatatatatgcatgtgtgtat

SEQ ID NO: 90580 - DNA, 86 bp, Mus musculus
gtaattttttttcatttaatttttcatttaatctaattacaaaacaaattttgtgattagtttgaaagacaattgaagaaatttgc

SEQ ID NO: 90581 - DNA, 89 bp, Mus musculus
ggcagcaaggacacttagttgaacagagagacaggacagacagcacacattgggtggcttctcatctcactctgaatgaccttcctgcc

SEQ ID NO: 90582 - DNA, 77 bp, Mus musculus
gctttgtgtctgtctctcagtcctaccaccctctgcctcagagcatcaaggtccctgtgaagcagaaacgacacaaa

SEQ ID NO: 90583 - DNA, 66 bp, Mus musculus
ctcaaaccgggctggagagatggcttagtggttaagagcactgactgctcttccaggggtcctgag

SEQ ID NO: 90584 - DNA, 93 bp, Mus musculus
tcacttctaggactggagagatggctcagcggttaagagcactgactgctcttccaaaggtcctgagttcaaatcccagcaaccacatggtgg

SEQ ID NO: 90585 - DNA, 63 bp, Mus musculus
aggccagcccagtttcccagcccactccacaagccagggtcgctgtgtgactctgactggcct

SEQ ID NO: 90586 - DNA, 67 bp, Mus musculus
gtctcaggaacggtgctctcgagtgctctgatgctccgtattcccggacactcactgtcactgggat

SEQ ID NO: 90587 - DNA, 86 bp, Mus musculus
gattttctagctgccctaagtacttgtgcctgagatctgagtgagcccagtgggaagtagcctccgggtaagctgggggttttgtc

SEQ ID NO: 90588 - DNA, 93 bp, Mus musculus
ccggtgctgcaccatgtagtgatgtggtctgcatgaacatgagcgtcctctcctgctcatgtgtgccacacacacacacatgtgtatggctgg

SEQ ID NO: 90589 - DNA, 101 bp, Mus musculus
gtgattactacgtggcttgagagatggctcagccattaagagcactgactgctcttccacaggtcctgagttcaattcccagcaaccatatggtggctcac

SEQ ID NO: 90590 - DNA, 65 bp, Mus musculus
ctggggaccttctgctagaaggttgtaaggttgtgaggaacactcccttcccagaatgaccccgg

SEQ ID NO: 90591 - DNA, 68 bp, Mus musculus
gtgggagcaggctttaaggtctcagctcaagcccaggctcagtggctcagtctcttcctgctgcctgc

SEQ ID NO: 90592 - DNA, 93 bp, Mus musculus
ccaatgtttgtttacatgtgttcattgtgtgttgtgtgtactggctacttttagtgtgtgcatgtgcatgtgggtgcatgtgggagccagagg

SEQ ID NO: 90593 - DNA, 109 bp, Mus musculus
atggcgttggtgacacccccgaatgcttttgtgaaaccagagatctttacccagtctttaacagcatcatgatctggacaacggcttccacattgccagctattgccat

SEQ ID NO: 90594 - DNA, 106 bp, Mus musculus
gtataaaaagggtttgtttgctctggctgactagtgattttattttagaaagaaatgactgattaagagtggcgcagacaccaggatcaaagcttgctcttcgtac

SEQ ID NO: 90595 - DNA, 90 bp, Mus musculus
tgtctgagcagttgccaatcattttatagatttttacaaggagatgttatttatgaacttcttggatgagtgtgaggttaggctgggata

SEQ ID NO: 90596 - DNA, 62 bp, Mus musculus
tgtgagggtcctggttgttgctcacatgccctgtccagcctgtgagcgtctctctctctcca

SEQ ID NO: 90597 - DNA, 63 bp, Mus musculus
ggacaccaccacagagattggcgagctggagagctgtctctgtgaatctcaggaggggtgtcc

SEQ ID NO: 90598 - DNA, 105 bp, Mus musculus
aggcaaatggatggacctgcttttagacctcttagtgtcttgtttctgacatgtacaaagaagagactgagctgggaaaggtgagagcatgtgtaggctctgcct

SEQ ID NO: 90599 - DNA, 89 bp, Mus musculus
gagtcagtaggtcagagggtcagtgggtcagtgagccaatgcttcgattacctctcctggctccctgcatgcctgtcctgctcagactc

SEQ ID NO: 90600 - DNA, 74 bp, Mus musculus
ggcggctagaaactgctgcatcttctccaggttacccctgtttaagaagcagcctctctgagtgtctcgctgct

SEQ ID NO: 90601 - DNA, 79 bp, Mus musculus
aggtgacaggagagtgtgaggggcagtaagtgacaggctgtgggtgcaggctctgcagctcctctatgttctgtttcct

SEQ ID NO: 90602 - DNA, 105 bp, Mus musculus
aggtgacagagggggtggggtgggtcggttcacaaaggggctcacagttgacagtgatgagagagatgcacctgtatgttcctttcaggttatctgagggctcct

SEQ ID NO: 90603 - DNA, 73 bp, Mus musculus
agaaggcacacagttaagcagaacagattttgagctcagtggtctgtctgtctgtctgtctgtctgtctgtct

SEQ ID NO: 90604 - DNA, 86 bp, Mus musculus
acaaggttgatgacagacaggcacaggaaagcttctcggattcagcctttcttacagaaactgtctgtctgtctttccgctcttgt

SEQ ID NO: 90605 - DNA, 115 bp, Mus musculus
gatctctgttattgatgtatagtgcaggctggccttgaacttgtgactacgtttttttctacatttattaagaaaaatagtctctggtcaaccccctacttcatcctgctagatc

SEQ ID NO: 90606 - DNA, 92 bp, Mus musculus
gaagacgtccagagggcccgttctcagtttgtaaatgtctattattcaagatatttgtaggcccttcaacaaaagctcaatggacaaacttc

SEQ ID NO: 90607 - DNA, 109 bp, Mus musculus
gtgagaagcttaaagaagaaattttccttctgtcggtctctctctcctttgtcagaatgccagggctggtgggggcctgctctgaaggaagtttgttccctagcctcac

SEQ ID NO: 90608 - DNA, 95 bp, Mus musculus
tttgaaaacaacagtggccaatggggctgggggaaagtctctctgaattaaatagcactctcactcagtcccagtggccataaacttgggacaaa

SEQ ID NO: 90609 - DNA, 94 bp, Mus musculus
tatggtgagtctatagctctgtatgcttatgtagctgtcatgtggttctgtgaggactgctcccaagtctgtggatgctcgggtctctgctata

SEQ ID NO: 90610 - DNA, 82 bp, Mus musculus
caggatcggtgcacatatgaactcacagagactgaagtagtagacagagtccctgtgtgggtctgtgccaattggggtcctg

SEQ ID NO: 90611 - DNA, 115 bp, Mus musculus
gaaaccctggtgcccctgtcatcttaggtaggcagctgcccttcaatgaggccattctttgtgcctgcctgcctgcctgccattttctcttagttccctgggtgatctcagtttc

SEQ ID NO: 90612 - DNA, 91 bp, Mus musculus
gggtaaatttggagttctcatctttgctgagtatgtgcacaagtatgtctgggtgcatgtaagccaaatgatgatgtcacgaatcttgctt

SEQ ID NO: 90613 - DNA, 101 bp, Mus musculus
cttggcttttgtgaatctggttctgtgaacatctgaacctgtacagatgagtgcctatcttcagttcttttgtgtgcacacctaccagcaaaattgccagg

SEQ ID NO: 90614 - DNA, 92 bp, Mus musculus
gaagggtggatagatgaacaaggggggaactagggtgttagtcttgtgggaactcagcctgccacaccctctctctgactctaatccgcatc

SEQ ID NO: 90615 - DNA, 75 bp, Mus musculus
ggaggagatgttttactaggaggatttgagatttcaaaagtctatgtcattcccagtgcctgcctctctgtctct

SEQ ID NO: 90616 - DNA, 81 bp, Mus musculus
gagtatgtgcaaagggcagggaggcaggagctagggaaggggatcacatgtgagtctctctggctgtggcaaaacaagctc

SEQ ID NO: 90617 - DNA, 83 bp, Mus musculus
cttgattcaatctcctggttttccaagtcagacagacagactgtgtaagtgtgggctgcctggtaagatgaagagatttcagg

SEQ ID NO: 90618 - DNA, 117 bp, Mus musculus
tcatttatccattagcctaactgtcaagggttggggtgaaagaggagagttgcaacatgtatatatttatttcgttctcccatctgtgtactcttcccacaatgctttggtgtttga

SEQ ID NO: 90619 - DNA, 77 bp, Mus musculus
gagtatgtgtatatgtctgcctgtgtctctgtgtgtagtaaagagaaggctgagggtgtgacaatggtacagtactt

SEQ ID NO: 90620 - DNA, 132 bp, Mus musculus
tatatgtatgtgtgtgtatatatatgtatgtgtatatatgtatacacacacacatatatatatacatatacatatatatatatgtatatatatacatatatgtatatatatgtatatatatatatatatatg

SEQ ID NO: 90621 - DNA, 106 bp, Mus musculus
gccttagtgcatggtgatctgataggatacatgggacaatttcaatatttttgtatctattgaggcctgttttgtgacctattatgtggtcaattttggagaaggt

SEQ ID NO: 90622 - DNA, 81 bp, Mus musculus
ggcagaggaggaaggaattcaggataatcttcactcatgtaatgcgttcagagattgcctgagtctgtctgtctgtctgtc

SEQ ID NO: 90623 - DNA, 105 bp, Mus musculus
tatttatatttaaaagcctatatacacatatatattaggatatatatatatatgtatatatatatatatcgcactatatatgtagtaggatttttattttaagta

SEQ ID NO: 90624 - DNA, 105 bp, Mus musculus
agttattgagaaaaatggtgggacccagcaagagtctatgaaagaatacatgaatgtatatgtgttcatcatatttgctttgtaaaagtttttctttttgtgact

SEQ ID NO: 90625 - DNA, 96 bp, Mus musculus
ctttccatttgcatccccttgatctcattttgtttttgaattgctctggctaggacttcaaatactatgttgaaaaggtatggagaaagtgggcag

SEQ ID NO: 90626 - DNA, 83 bp, Mus musculus
cccgtgtacacgtcactgatgttcactgactctccctgtgtttgagggcttatgttaggagctgcagataatgtttttaaggg

SEQ ID NO: 90627 - DNA, 108 bp, Mus musculus
tgattgattgtgtgtgtgtatctctgtgtatgtgtgtgtgtgagatatatatatatatatatatatatatatatattacaattatcacaattacacagagaatgaaca

SEQ ID NO: 90628 - DNA, 83 bp, Mus musculus
atgtgtgtatatatgtatgtatatacatatatacatatagatatgtgtattatgtatgtatgtatttatgcatgcatgtatat

SEQ ID NO: 90629 - DNA, 97 bp, Mus musculus
tggatgaggattgatattaaatttatcatgtgtatatttattcatcaaaatgagtaacctgtatatttgttgatatttttagaatgaaattatgcca

SEQ ID NO: 90630 - DNA, 65 bp, Mus musculus
atgtatgtatgtatgtatatatgtatgtattatgtatatatacatatgtgtatacatatatatat

SEQ ID NO: 90631 - DNA, 74 bp, Mus musculus
tatgtatgtatgtatgtatgtgtatgtactagggtagtatatatgtgtgaatatacatatatatttaatacata

SEQ ID NO: 90632 - DNA, 85 bp, Mus musculus; identical to SEQ ID NO: 58391

SEQ ID NO: 90633 - DNA, 72 bp, Mus musculus
cctgggagactagctttttcctgagttcaagtggtcagaacactgtctgcaggcaagctctcttcttgcagg

SEQ ID NO: 90634 - DNA, 83 bp, Mus musculus
ggccatggtggtctgacaggatacatgggacaatttcaatatttttatctgttgaggcctgttttgtgaccaattatatggtc

SEQ ID NO: 90635 - DNA, 107 bp, Mus musculus
gtgatactcatctaaatgatttcttttttagtgacagtgagcagtacaacaataaatataaatgtaagcatctctgtggtagaagttaggaccttagagtgtattac

SEQ ID NO: 90636 - DNA, 89 bp, Mus musculus
gcagaagaagttatgtaggcacaagacatagaaacttatagcctttgtaaggggagcagagtttcttcgatgaattgtttttcctctgt

SEQ ID NO: 90637 - DNA, 79 bp, Mus musculus
gtggcagctcacaactgtctgtagctctagtcctaggggatctgacaccctcacacagacacacttgtaggcaaaacac

SEQ ID NO: 90638 - DNA, 97 bp, Mus musculus
gtctgagggaggttagccaaagtagtgcctttatagtcctcacctgtgtattcggaggtcagagaacaatctgagggaattggctcaccttaccagc

SEQ ID NO: 90639 - DNA, 91 bp, Mus musculus
ggcttgactggaccgtcagggtagtacatgagggttttctgacagtcactctgtcttgccttcatcgtcatacctgccaggttttcaagtt

SEQ ID NO: 90640 - DNA, 109 bp, Mus musculus
aggccacactcctttccaagcagttctaccaactgagaccaggcattcaaacagaggagagtgtgaggactgtggtggtttgaatatgcttggccctgggagtggcact

SEQ ID NO: 90641 - DNA, 74 bp, Mus musculus
tctggatgcactgcctctctgatcctcagtgtatgaatatgagtgccaggtcggtgtgcagtccctcatcaaga

SEQ ID NO: 90642 - DNA, 115 bp, Mus musculus
tctgcctcccaagtgctgggattaaaaatgtgaactaccacttgtgattatgttgtcataattttattaaatgcaaatagtcatatgactattctgagcattgtgggattctaga

SEQ ID NO: 90643 - DNA, 72 bp, Mus musculus
gttcgggacagatgacacagtggactaagagtattggctgctcttccagaggtcctaggttcaaatcccagc

SEQ ID NO: 90644 - DNA, 93 bp, Mus musculus
gactgcccaaggctcccggtcagagatgagagtggtcaggccaagggagcccaagacccctcagtcattcactgtcagacctagaaggtagtc

SEQ ID NO: 90645 - DNA, 119 bp, Mus musculus
cctctgcaattaaggatactttgacttgggctggagagatggctcagcggttaagagcactgactgctcttccagaggtcctgagttcaattctcagtaaccatatggtggctttgggg

SEQ ID NO: 90646 - DNA, 63 bp, Mus musculus
cctaacttatatatatatgtatgtatgtatgtatatatatgtatgtatatgtatgtatagagg

SEQ ID NO: 90647 - DNA, 97 bp, Mus musculus
gtgtttgtcccttatcccttctgtctgtccctctgaggcaaataagtattcctgtgcttggtctgagaactcaattttggggatcctgagccaatac

SEQ ID NO: 90648 - DNA, 63 bp, Mus musculus
tgtgtctctgtgtgtctgtgcacatgtgtatgaacatgccaactgatgctattagaagacata

SEQ ID NO: 90649 - DNA, 75 bp, Mus musculus
tttttacttatgtgtctctgtgtgtctgtgcacatgtgtatgaacatgccaactgatgctagtagaagacataag

SEQ ID NO: 90650 - DNA, 97 bp, Mus musculus
gagtttgactcttatgcagcaactctgttttatttactactctcaacaacactgagatgggtgtgaggtcatgtgtgctgtacagatgaacagattc

SEQ ID NO: 90651 - DNA, 58 bp, Mus musculus
ctcccaatcaagagagtgagctctgagggcggagcacatcacggacttgattgtggtg

SEQ ID NO: 90652 - DNA, 99 bp, Mus musculus
gaagttcttatcatacagatctttcccttccttagttagagtcacgccaaagtatttttatattacttgtgacttgaagggtgttgtttcccgaatttc

SEQ ID NO: 90653 - DNA, 73 bp, Mus musculus
ctctgcctaggatgtgtcgctccctgattggctgcagcccatcggccgagttgtcatcacggggaaggcagag

SEQ ID NO: 90654 - DNA, 88 bp, Mus musculus
tgtgtttggtttaaaaagctcgatctgagcttcgctgccacgagactcccaggcatgagctcactctcagtcaccgaccaaaactaca

SEQ ID NO: 90655 - DNA, 76 bp, Mus musculus
ctgagagactctgtcagtgcctgtcaaatactgaggaaaggagcagggaagagaggtacttggacaggtcttgaag

SEQ ID NO: 90656 - DNA, 56 bp, Mus musculus
gggaatggttagacagatggggcagtctctgctccacactttgtctctctgtctcc

SEQ ID NO: 90657 - DNA, 111 bp, Mus musculus
gtatacatatatgtattatatatacattaaaggtaaggacaggtatatatgtgtatatccatgtatatatgtacatatatctatgtatatatgcatatatatttatacttg

SEQ ID NO: 90658 - DNA, 158 bp, Mus musculus
catatatacatataggtatatatgtaggtatatatttaaatgtatagatacatatgtatatatatgtgtgtatatatgactatgtatacatatatatatgaatgtatgtgtgtgtatatatatatatgtgtgtgtgtgtgtgtgtatatgtatgtgta

SEQ ID NO: 90659 - DNA, 85 bp, Mus musculus; identical to SEQ ID NO: 57470

SEQ ID NO: 90660 - DNA, 85 bp, Mus musculus; identical to SEQ ID NO: 57439

SEQ ID NO: 90661 - DNA, 102 bp, Mus musculus
ctggactctgcctctcaagtgctggggtaaaaacttgtgccatcgtgtctgatgtcagtgaagaaagcatctacttcagattctgttggatgtggcatccag

SEQ ID NO: 90662 - DNA, 84 bp, Mus musculus
tgtgtgtatgtgtgtatgcatatatgtatgtgtgcatgtatgtatgtatgtatgtatgtatgtatgcatgtatgtatgtatgtg

SEQ ID NO: 90663 - DNA, 82 bp, Mus musculus
tggctgttggcatggtcaggaagtcaggaagggcctctggaccccatccattgtctctcacacacacatgtctagcagcaca

SEQ ID NO: 90664 - DNA, 77 bp, Mus musculus
catgcaggcagccaacatagatatctatcaatgtatgtatgtatgaatgtatgtatttatgtatgtatgtatgtatg

SEQ ID NO: 90665 - DNA, 92 bp, Mus musculus
ggaaaaagaaaggggctagaggggctggagagatggctcaattgttaagagcactgactgctcttccagaggtcctgagttcaattcccagc

SEQ ID NO: 90666 - DNA, 101 bp, Mus musculus
gtgtaccaataaaacatggagtgtttccatattctttgaaaacatatttatgtacttcatttttaaaaactgtgtgaatatcttcatgagtttgtttgcac

SEQ ID NO: 90667 - DNA, 99 bp, Mus musculus
cactgagtggcattgtagcttttattgtgatgcagcacactatttacatagttttacatgtctgtagtaatataaataaagaaataaatccaggcggtg

SEQ ID NO: 90668 - DNA, 113 bp, Mus musculus
gcctaaatttgaatctgacactgttttttagtagctgtgggatattagacaaattaacaatctctctgtgtctcattttcctcaagatagttatttcaggcttgctaaggggt

SEQ ID NO: 90669 - DNA, 61 bp, Mus musculus
gtggggagggttcagacgggtggtgtctcttctgtctctgtgtgtgtgtgtctctctcctc

SEQ ID NO: 90670 - DNA, 72 bp, Mus musculus
gcagactgagaggtgacagagtggagacatgccttatggctctgccctggtctttgcctgtatctgtgtttg

SEQ ID NO: 90671 - DNA, 69 bp, Mus musculus
gttgtgtgggttctggagccagtgagtgacagtggctgtcactcactgaggaaaggaacccaaagagac

SEQ ID NO: 90672 - DNA, 114 bp, Mus musculus
tctgtaggagtctcttcaatcaattgtctctttttaattctataaggtatatttttttcattgttgaaattaagagctaaagaggcagtttagtaattaaaggcatttttcagg

SEQ ID NO: 90673 - DNA, 66 bp, Mus musculus
cagcattctattctttaagatcatatctgggatggccagagaagatacagaggactagttgagctg

SEQ ID NO: 90674 - DNA, 79 bp, Mus musculus
tatgtcattaatatatgaacatatgtacataaatatatatataaatataaatggtgtgtggatatgtgtatgtgacata

SEQ ID NO: 90675 - DNA, 77 bp, Mus musculus
ttgcagatgccaacaagagcttgctgacaggagattgatatagctgtctcctgagaggctctgtcagtgcctgacaa

SEQ ID NO: 90676 - DNA, 88 bp, Mus musculus
gctttcctgaaactcactttgtagaacggactaaccttgaactcagagttctgtctgtctctgtatcctgagtgctgagattaaaggc

SEQ ID NO: 90677 - DNA, 95 bp, Mus musculus
gttgcttcattattcaggattgttttagctgttcatatgaaggagaaaattaattttcaatttctgtgaggaattgtaattttgatgaggattgc

SEQ ID NO: 90678 - DNA, 114 bp, Mus musculus
agttttgtactataatatatatatatatatatataattttgtatatatatataattttgtatatatatataattttgtatatatatataattttgtatagaatagtatagatct

SEQ ID NO: 90679 - DNA, 116 bp, Mus musculus
gccttagtgcatggtgatctgataggatgcatgggacaatttcaatatttttgtatctgttgagggctgttttgtgacctattatgtggtcagttttggagaaggtaccatgaggt

SEQ ID NO: 90680 - DNA, 87 bp, Mus musculus
ccttggatgagacaaatccccccacctgccctgtcatgcaccactgcagtgagagatcagatggtggagagatgggagtgactgagg

SEQ ID NO: 90681 - DNA, 84 bp, Mus musculus
ttttgaacatttgcaggtttcatgcatgctgcctgtcacagtctctgtgaaatcatatgtgcatcagtcctgctgtgtctggaa

SEQ ID NO: 90682 - DNA, 201 bp, Mus musculus
catatatatgtgtatgtatatgtatatatgtgtatatgtgcatatgtgcatatgtgtatatgtatatatgtgtatatgtgcatatgtgtgtatatatgtatgtgtatatgtgcatatgtgtatatgtatatgtgtttatgtatatatgtgcatatgtaaatatgtatatatgtatacacacatatgcatacacacatacat

SEQ ID NO: 90683 - DNA, 86 bp, Mus musculus
ggcaggagccattgagagaagggtcactgagacttgctgacccccagcctcactccaaggtcagtcagactctgtctcaagggact

SEQ ID NO: 90684 - DNA, 91 bp, Mus musculus
ccatgccaggggatcagaggtgctgtccatttgtaaggatgattgtttttatatacagaaaggggccaggaagcatttttccaggcaatgg

SEQ ID NO: 90685 - DNA, 72 bp, Mus musculus
atgtatacacacacacacatatatatatacacacatatatgtgtgtgtgtgtgtgtgtgtgtgtgtgtgtac

SEQ ID NO: 90686 - DNA, 114 bp, Mus musculus
ggctcagcctcagtcctcactgggcccctgcataccatgtctttcaggggtcacagaagatactgtgctgacatctcatgaccaagcagggacagtcaggcaccctggggagcc

SEQ ID NO: 90687 - DNA, 87 bp, Mus musculus
gtgagggatgctttgacagatgacagacagaaatgagaacaaattctggggctttctctgggcctgtggttttagaagctctggcac

SEQ ID NO: 90688 - DNA, 65 bp, Mus musculus
gaacaagtgtggggaacaggcagagactcttcgacgtcggactctgggtctctcactgcttagtc

SEQ ID NO: 90689 - DNA, 100 bp, Mus musculus
gaatctggttctggggctggaaagatggctcaatggttaagagcactgactgctcttccagaggcactgagttcaattcccagcaaccacatgatggttc

SEQ ID NO: 90690 - DNA, 112 bp, Mus musculus
gatgaggagaataaagagttgggacccagacctggagcctgggactctgccagatcacctctgggtctgtctctctccagatctgttgtcttactgttgttgagagcctatc

SEQ ID NO: 90691 - DNA, 131 bp, Mus musculus
tttttcctttgaggcaggctttactgtgtgtaggccatgctgaccttaaactcttggtctttctgtctctgtcacatggatatggggtttttgtttaggaagggaaaatagaccacacttaggaggaaagc

SEQ ID NO: 90692 - DNA, 113 bp, Mus musculus
tgatcttccagagaacccaagttcagttcccagcatccatgtcaggtgactcacactgcctcagactgtggctacaagggatctgacatcctgttttggcctctgggggtaca

SEQ ID NO: 90693 - DNA, 165 bp, Mus musculus
actatttactggcgcgcacgtgcgcatgtatatatatatatgtgtgtgtgtgtatctatgtgtatttgtatgcctgtgtgggtgtgtctatgtgtgtgcatgtgcatgtgtgtgtggtgtctacgggtgcatatgtgcgtgtggatggaacacagggctttgcac

SEQ ID NO: 90694 - DNA, 107 bp, Mus musculus
gaagtgcgtgtcactctgctgtcatccatgtgatgctgccaggatgaactttgcacgcatttgttactccttcatatggttcaaagtgttgatatgctaatgctgtc

SEQ ID NO: 90695 - DNA, 116 bp, Mus musculus
ggctggcccttgcttacttcctttgacgggtgagcttttggcccgggttatacctgacactcacgtataagacgagcaaaaagcttgttggtcagaggagctatcatcatgcagcc

SEQ ID NO: 90696 - DNA, 119 bp, Mus musculus
aaggacaaccagggctacacagagaaaccttttctcagtcagtcaatcaatcaatcaatcaatcaatcaatcaatcaatcaatcgagagaaccaactctgtggattgttctctgacctt

SEQ ID NO: 90697 - DNA, 89 bp, Mus musculus
gcagatgtgtggcacagtcctaggctgacccaccctgctggtcactcagaccctcagtcagtctgcctgactggctgcctcacccctgc

SEQ ID NO: 90698 - DNA, 79 bp, Mus musculus
gtgtgtggcacagtcctaggctgacccaccctgctggccactcagaccctcagtcagcctgcctgactggctgcctcac

SEQ ID NO: 90699 - DNA, 96 bp, Mus musculus
tctttgagcttgaaggtgcagaggagttggaggctgggcggagctatttgaacgataatgtgtgtgtctatgtctcttaatgttcagagttggaga

SEQ ID NO: 90700 - DNA, 74 bp, Mus musculus
attctctctcatacactctcatgtaccagtattttgtctgtagtacagtacaggaggatgccagaagagggcgt

SEQ ID NO: 90701 - DNA, 81 bp, Mus musculus
tcctgttgctgttgatggaagagacagctgcagttcccttcatcgattcaccagcagtctcaatgttgactggcagcagga

SEQ ID NO: 90702 - DNA, 94 bp, Mus musculus
ggttcctaacacttcctgaggtaggataggtgctgagtacagacttcctttctctcacccagtctccctttcagtcagtcactgttaactaact

SEQ ID NO: 90703 - DNA, 112 bp, Mus musculus
gaagcggtaggttgggctcgggggttgtcagtgctctgtgtctctttctagggaaaattatttttcaatatgaaaaagacctcattccagctgccattctgccagctgtttc

SEQ ID NO: 90704 - DNA, 107 bp, Mus musculus
tctgtctcttgtctccgcctcccatctctcctcaggagctgagagtgcagacacagtgcttctttctgcctctggctttaggtgggttctggagatctggtctcaga

SEQ ID NO: 90705 - DNA, 74 bp, Mus musculus
atatacataggacagtatatgtgtatatatataggacagtgtatttatatatatgtacgacagtatatgtgtat

SEQ ID NO: 90706 - DNA, 113 bp, Mus musculus
tgaggtccctactgccctgtcacatgccttggaaacactacagagagagcacccttaaccccagcccacgccttgcctctctctctagttcctggtatatgactatgactcca

SEQ ID NO: 90707 - DNA, 93 bp, Mus musculus
tctggttttcaagcagaatgaggaaggcttgatttttttttttttaactctccgaggtcagaaaagagccagcgctggagctgcctagccaga

SEQ ID NO: 90708 - DNA, 81 bp, Mus musculus
ctgggctacagaacagaaaagaagagaggacacaaagcacggaagaagagctgagatcctggctggctcactctgtcccag

SEQ ID NO: 90709 - DNA, 94 bp, Mus musculus
cagggatgaaattagggactgtggggtttggtggcatcacctttaccagccgagccatcccactcaccctcagtctctctcctttacatccctg

SEQ ID NO: 90710 - DNA, 71 bp, Mus musculus
ggctggagagatgtctcagtggttaagagcactggctgctcttccagaggtcctgagttcaactcccagcc

SEQ ID NO: 90711 - DNA, 71 bp, Mus musculus
aactgtgggctggccagggtctctgatgaggggtggatttctctctcactcagttactgggagcagcagtt

SEQ ID NO: 90712 - DNA, 89 bp, Mus musculus
gggacaaggctaaggcccctctacactcccttacccacccctcttccaattgcaggtgactgaggagacagcgcgggccctgcagtccc

SEQ ID NO: 90713 - DNA, 90 bp, Mus musculus
tgccctggattgacacctcagactctctcacagttaacatgctatgtttattgactttaaggagatgggtcaagagtcagtttgggtgta

SEQ ID NO: 90714 - DNA, 80 bp, Mus musculus
cagctctgtcagtggaggacgactctgcctgtcacacactgtttcccggattagtgaagtcttgtctaccactggagttg

SEQ ID NO: 90715 - DNA, 80 bp, Mus musculus
tgggtgttttgtctatacatctgtctgtgcaccacatgcgtgcagtgcccacagagaccagagagagcactggattccca

SEQ ID NO: 90716 - DNA, 115 bp, Mus musculus
ggactgtttagtgacctaatcttgatttaagtttggtatgtggtatctgtctagaaaatcattaattttgtttagattgtccagttttttcaagtttgggtttttaaattaagac

SEQ ID NO: 90717 - DNA, 67 bp, Mus musculus
cagcctgtgcttagaacactagatggtgagagctgtgtgagatcactctggtaggtaagacaggctg

SEQ ID NO: 90718 - DNA, 85 bp, Mus musculus
tggggaagactaagtctccctctctcagtagatatttttgtgtgtggctcttcatctagtgagggggctccttgctacttcccca

SEQ ID NO: 90719 - DNA, 65 bp, Mus musculus
agcttgtgcttagagtgctagatggtgagagctgtgtgtgatcactctgggagataagacaggct

SEQ ID NO: 90720 - DNA, 123 bp, Mus musculus
tttttgaagttcagccttaggccatggtggtctgataggataatgggacaatttcaatatttttgtatctgttgagtcctgttttgtgaccaactatatggtcaattttggagaaggtcccgt

SEQ ID NO: 90721 - DNA, 125 bp, Mus musculus
attgctacagagaatatatatatataattataatatataactgtatattatatgtgtgtatgtatgtatgtatgtaataatatgtgcttatatttatgtgtgtgtatgtatgtgtgtggaataat

SEQ ID NO: 90722 - DNA, 103 bp, Mus musculus
ttcagtctcccaactaggtatgtacagcatgtcctttttttttttttaaatgaaaatgatctcatgccatgtcatgtcacctagatcttttgtgatgatagaa

SEQ ID NO: 90723 - DNA, 81 bp, Mus musculus
cacctgtgcctgcctgcctgtctctggatgacagagttggcagctgccaaggagttttcacagatgacccaggaatggcgc

SEQ ID NO: 90724 - DNA, 71 bp, Mus musculus
ggctctctctctctctctctaaatattttttaaaagtaagaaatacatgtctgggggctggagagatggct

SEQ ID NO: 90725 - DNA, 112 bp, Mus musculus
acaagactggtcatggctcaagagatggctcagtggttaagagctctgactgctcttccagaggtcctgagttcaatccctagcaactacatggtggctcatgaccatctgt

SEQ ID NO: 90726 - DNA, 57 bp, Mus musculus
tctgtctgtctgtctctctcagggtatcaagatacactgaggtggattacacataga

SEQ ID NO: 90727 - DNA, 74 bp, Mus musculus
gtcctggaacgctctctgtagaccaggctggtctcaaacccagagatctgtctgcctctgcctctgattaggat

SEQ ID NO: 90728 - DNA, 86 bp, Mus musculus
gaacttaagagctggtatgtagagagctatgaagtgttgacttctagatatgacatagctgttgcactcaccaatccacagagggc

SEQ ID NO: 90729 - DNA, 83 bp, Mus musculus
ctgctgcactctgactctcagaccttgcagcccttaggttggggctcacggaacctcttagagtgcgtggatttgggcagcag

SEQ ID NO: 90730 - DNA, 194 bp, Mus musculus
tatgtatatacatgtatatatgtatatacacagatatgtatgtatatatgtatacacacaaatatgtatatatatatatatgtgtgtgtatgtgtatatgtatatatgtgtatatgtgtatatgtatatatgtgtatatgtgtgtatgtttatatgtgtatatatacatatatatgtatgtatatatacagaga

SEQ ID NO: 90731 - DNA, 131 bp, Mus musculus
gtatggggtgtgtgtatatatatatatatatatatatatatatatatatatatatatacatatatatgtatatgtataaaaatatagtgtacatatatgtttatatatgtacatgcacacacatatatgta

SEQ ID NO: 90732 - DNA, 83 bp, Mus musculus
gtctgctatttactgagtttctgagaaggaatgcccatgataaaggtgtctctctttctgactacaaataagaaatagtagac

SEQ ID NO: 90733 - DNA, 112 bp, Mus musculus
ccattcccttgctccctgggaaactatcacacaaggaacagcatcaagcacatcactcttaatctgtcaggctatattccttgcctggttcaagtaggcaagtaggctttgg

SEQ ID NO: 90734 - DNA, 85 bp, Mus musculus
gctagaggaagtgtgtcactaggggccagcttggaggtctcaagggctcaagcctactgcctcttactgactgactgcctcttac

SEQ ID NO: 90735 - DNA, 78 bp, Mus musculus
cagtggttaagagcaggcaggcctctaacacaggacccagatttggttctcagtgtgtcagtggctcacaaccatctg

SEQ ID NO: 90736 - DNA, 89 bp, Mus musculus
atatgcgtgtctttagtgaagaatatagcaaggcagagcaaaccaaacaaatgctcagtgcctgtctcccactgtctgtggcgtcatat

SEQ ID NO: 90737 - DNA, 62 bp, Mus musculus
tgtaaggaacatatatgtgtatgtgtgtgtagaatgaaatgtatacatgtgtgtaccatata

SEQ ID NO: 90738 - DNA, 80 bp, Mus musculus
ggcagactgactggagaagcaggagggtgtggaggagagacaagtgagtggccacacccctctgccttagctatctgacc

SEQ ID NO: 90739 - DNA, 69 bp, Mus musculus
gagaccaaccctgtgtgggatctgtcttccttatttttgaaggcagggtctctcactgacttggatctt

SEQ ID NO: 90740 - DNA, 106 bp, Mus musculus
gccttagtgcatggtgatctgataggatacacgagacaatttcaatatttttgaatctgttgaggcctgttttgtgacctattatgtggtcaattttggagaaggt

SEQ ID NO: 90741 - DNA, 127 bp, Mus musculus
ctatgtgggaatgagttctttttaaatgtcacgtgtgtgcatttcacgggtaaaactatctagtgatttagttgtttgcaaacgtttaagcaataggctcagttgtcctaggagatgcaggatgggc

SEQ ID NO: 90742 - DNA, 97 bp, Mus musculus
gtgataaagccggacctggtcgtactcacctttaatctcagcactcctgagacagaactctgtgagctcaagtcctgatgaccctgtttcctgtcac

SEQ ID NO: 90743 - DNA, 115 bp, Mus musculus
tgctcttaaccactaagccttctaactcttcagtcccgacaacattcattttatacaaaggtttcttaagaagaatgttaaaacagcaaagagccatattttagggctaagagta

SEQ ID NO: 90744 - DNA, 70 bp, Mus musculus
gcctatatgtgtgtgtatgtgtgtctgtatgtgtgtgagcacacaccagaccacacatgtgcatggaggc

SEQ ID NO: 90745 - DNA, 75 bp, Mus musculus
tcatgggaaggtgggccaaggtcagggcacatgcagggaaggaaaaccacgtggtctgactctctctctcagtga

SEQ ID NO: 90746 - DNA, 72 bp, Mus musculus
tatgtgtgtgtgtatgaatttatatatacatatgaacttatatgtacatataaatttatatatacacatatg

SEQ ID NO: 90747 - DNA, 91 bp, Mus musculus
ctatactcagaggctactgtttggtgcatagtgggtcttcagatgtgtctgactctcgacatgttagccaaggtcaaagccgtgacgatgg

SEQ ID NO: 90748 - DNA, 107 bp, Mus musculus
gttggcctgaaagagactcaggctctttaaagaacttcagtgatggggctggggagataacacactggctgttctttcagaggtcctgaattcaattctcagcaaac

SEQ ID NO: 90749 - DNA, 64 bp, Mus musculus
ggcgtttgctttggtggagctcagggtgggacccaggccctccctcacacactctggcaatgct

SEQ ID NO: 90750 - DNA, 77 bp, Mus musculus
cttagtcactctgtcagtgcctgagacttcctaggcattcgacccatgcctgtgatctaagctgtggggaggctgag

SEQ ID NO: 90751 - DNA, 71 bp, Mus musculus
ggcttcgggagcggaaacttttatttttaattgtgatcagtcgacacgttcagagatgactgctcttggct

SEQ ID NO: 90752 - DNA, 118 bp, Mus musculus
tgagccctgaggagaagtgtttaatgaagacatcccacctaggactgagtgttccaaagtctctcagtctctgcgagttgtctagttgtggatctcatacttcttctcatctgctgca

SEQ ID NO: 90753 - DNA, 131 bp, Mus musculus
cataggggtggtgctggtggtggaggtggttgtggcaaatgcatatttatgttcatgtatgtaagtgcatgtccttgtgcatgtagacttgctggacagaggtcaccatttgtgtgtcttcctgaactgct

SEQ ID NO: 90754 - DNA, 75 bp, Mus musculus
ctgtctgtctgtctgtgtgatggtcttaaattagccaatctaatctagaactcaccatgtaacctaagcaggcag

SEQ ID NO: 90755 - DNA, 88 bp, Mus musculus
aggcagaggagtgtgaggagacaggcaggtgttcctggcagaggctgcagtgcttggaatcactggctgctggctgggccctttctgc

SEQ ID NO: 90756 - DNA, 79 bp, Mus musculus
gggcctttcaaggaagtgagaatacagtgtgctcccacggggaggggggggtgtcacttggttctcactagaagggtct

SEQ ID NO: 90757 - DNA, 103 bp, Mus musculus
gcattagtaacaacaattagcaaaacatttctaaaggtatataatgcctttagaatatgtatatatgtgtgtgctatatgtgtgtgatatatattactgatgc

SEQ ID NO: 90758 - DNA, 83 bp, Mus musculus
tacacctggctctgtctgtttgcttcacaagcttggaatatttctcgaggctgagagtagagtcagagcaggagcctcgtgtg

SEQ ID NO: 90759 - DNA, 91 bp, Mus musculus
ttctgtgcaagtatgtgtgaacatgggtttctgtgtatacatgtgtgtacatatgtatgcttgtgtccttgtgcatgcatttgtgtgtgaa

SEQ ID NO: 90760 - DNA, 112 bp, Mus musculus
aaggcaggaatggtgctggagtggcagctgtgagctcatagcctcttctgtgagaagatagagagctaatagagtgctgacatgataaaacggtatgggcttctgaaacctt

SEQ ID NO: 90761 - DNA, 109 bp, Mus musculus
atgcttctagcaatacagcgtgccatgtaacttctgacatgttgaagatttataatttatactatgacattctggcatggaagaggaaatggctgttgcccctatgcat

SEQ ID NO: 90762 - DNA, 77 bp, Mus musculus
ctccaaagtctttggatgactgtgttcctaggaggatggagttttctgcagagacactctcattcacataaaaggag

SEQ ID NO: 90763 - DNA, 116 bp, Mus musculus
taagcactttcccaaggcgagatggctggcttgctaatgattgaaggtttgcagggacctggctgcattgccccctcacacactgaaatcccagccacttcacaggaaagggtttg

SEQ ID NO: 90764 - DNA, 81 bp, Mus musculus
gctgtggacattttacagaacaaactgagcagaggagtcaggaattgatcttctctgatcaatgttgtgtggaccgcttgc

SEQ ID NO: 90765 - DNA, 87 bp, Mus musculus
ggtgtggtaaaggcataccatttgcagctgagcacatccaatctctatacattgtcaagttgtgagtctctgtgtcaattaccatct

SEQ ID NO: 90766 - DNA, 74 bp, Mus musculus
cctgtgtgtgtctgtgtgtctgctggctgtgtgaaggagacccatgcagcacggatgcccagaggaatgttagg

SEQ ID NO: 90767 - DNA, 57 bp, Mus musculus
tgtgtgtctgtgtttttaaggaatatatatatgtatattccttaaaacaggcatata

SEQ ID NO: 90768 - DNA, 110 bp, Mus musculus
tcaattggctctgatattattgagtgggcatcttgtgaattgagaatttgttgatatataaatctgactaattataagcttctagagttttgattttatcaggttattgg

SEQ ID NO: 90769 - DNA, 85 bp, Mus musculus; identical to SEQ ID NO: 57470

SEQ ID NO: 90770 - DNA, 78 bp, Mus musculus
tcataaatatgtatatatgtatgtatgtgtgcgtacacacacacatacatacatatgacaactgccaggtatttaaga

SEQ ID NO: 90771 - DNA, 73 bp, Mus musculus
gcagagagacaacctatggggaacaagagaatgccttcaaggctctctgtctgtctgtctgtctgtctgtctc

SEQ ID NO: 90772 - DNA, 74 bp, Mus musculus
cagacagacagacagacagagagccttgaaggcattctcttgttccccataggttgtctctctgcttgcttctg

SEQ ID NO: 90773 - DNA, 72 bp, Mus musculus
catcatggctggccatcacatctggcatacaataatgctgcttactatgtctgtgtggttttggccctgttg

SEQ ID NO: 90774 - DNA, 73 bp, Mus musculus
gtaaccactcatagacacccagtgcccccacattttgtcatcagcgtctggagtgtgtgtcactgtgtgttac

SEQ ID NO: 90775 - DNA, 105 bp, Mus musculus
gccaccagctgggatccatgatttgactgagagtcctttgtttgttgccactcccagacacactttcactcagaacccctctccatcctgaggctggtccttggc

SEQ ID NO: 90776 - DNA, 70 bp, Mus musculus
cctgtgtcagtctgtctctcacccatatcctgacatacagtgacatggaagtgtttagtactgaaagagg

SEQ ID NO: 90777 - DNA, 71 bp, Mus musculus
tctcgtatgcatgtatatgtgtatgtatgtatgtatatacatatatatgtacgtatgtttgtacattgaga

SEQ ID NO: 90778 - DNA, 77 bp, Mus musculus
ttgcagatgccaacaagagcttgctgacaggagcctgatatacctgtctcctgagaggctctgtcagtgcctgacaa

SEQ ID NO: 90779 - DNA, 108 bp, Mus musculus
tatagttcccacaagttaaccttccacacacacagacagacagacacacacactcaataaatgttttttgtttgtttgtgtgtttaactctgtgcctgtaaaaagaac

SEQ ID NO: 90780 - DNA, 84 bp, Mus musculus
tgtttggctgtaggtgtctgtatctgtctgagtcagctgctctgtggagcctcttagaagacaacatgctcctgtctgcaagca

SEQ ID NO: 90781 - DNA, 73 bp, Mus musculus
gtggctctcaaacacaagttaggagtgctgccaaatatactacacagtctctctgcctctgtttgctgaccac

SEQ ID NO: 90782 - DNA, 59 bp, Mus musculus
gtctgagaagtcactgtcctcaaatctgtactttaggatctctgtaggacttctcagac

SEQ ID NO: 90783 - DNA, 77 bp, Mus musculus
gctgcggcatgccttagctcttcacacacacttactgtcagacatgactgagttttgagaaggataaaggatgcagt

SEQ ID NO: 90784 - DNA, 84 bp, Mus musculus
ggttgactggctggctagttggccgtttggctgactggttggttgattggctggctgactggctgactggctggctggttgatt

SEQ ID NO: 90785 - DNA, 71 bp, Mus musculus
gcagtctcactcagtggcttttcagaggagagcaataagctagagctctgtctgtctgtctgtctgtctgc

SEQ ID NO: 90786 - DNA, 78 bp, Mus musculus
ctgcctacctgcctgcctgcctgcctctggatcccatatcccgaaatggacagccttgtctggcctcagtgggagaag

SEQ ID NO: 90787 - DNA, 125 bp, Mus musculus
ggaagccatgggagtggcagctgcctcagtcgtgactttgatgttctgcaaattccaagggtgtctgagctgactgtgctgaaagccaggcgggttcaagtttcagcagcagcagcagattaacc

SEQ ID NO: 90788 - DNA, 82 bp, Mus musculus
actgtgagagcacagtgcagacttgtaaatgcccatgtagagaactaatggagtgtgcgtgtgtgtatctgtgtgtctgtgt

SEQ ID NO: 90789 - DNA, 94 bp, Mus musculus
gggcatcatggttaaggactaacagactgactggctcagtgctggcagcaggaatgcagtgtcaggaaggtcaaagtccccagctgtgtctccc

SEQ ID NO: 90790 - DNA, 106 bp, Mus musculus
cacctttttgatagagaagatgaagcgttagttggatgaatagttaaggaaaacaaggttccacttgcagagctttgattctccctaaaggttacttctcaaggtg

SEQ ID NO: 90791 - DNA, 64 bp, Mus musculus
gagcatatgtgtgtgtatgcatgttggtgtgtgtgtgcatgtgtgtgtgcatgtgtatgtgctt

SEQ ID NO: 90792 - DNA, 87 bp, Mus musculus
agaatgtatatggaatgtggatgatggcatgtgagttgtgggtgtgcactcacctcgtctgtcttcctcagagacatgtggggttct

SEQ ID NO: 90793 - DNA, 73 bp, Mus musculus
tggggacacactctctctctcactgttctgctctacatagggcctgaagaaatggggacagatgtaggaccca

SEQ ID NO: 90794 - DNA, 91 bp, Mus musculus
gtatatcacatacatgtataaatatatatgtatgtcatatatacatactatatatgtatatatgtatatttatgccatgtatacattatat

SEQ ID NO: 90795 - DNA, 78 bp, Mus musculus
tgtatatatgacatacatatatatttatacatgtatgtgatatacatgtgtgtgcatatatatacatataaatatata

SEQ ID NO: 90796 - DNA, 88 bp, Mus musculus
gcacctgtgcctctggccctagagacagtcaacctacctcctatgtgttatagagtctgtctctgtgtgccaggtgtgacccaggagc

SEQ ID NO: 90797 - DNA, 84 bp, Mus musculus
agggttccctgagaggacacagaggacagttgggaaaaaatgtgatgttccatgtgtatcttgtcctcctagccttctagccct

SEQ ID NO: 90798 - DNA, 161 bp, Mus musculus
gcaaacatgcagttagctacacgcaggcttttgacccatgtaaactgagagtagagtgtgtgtttgtgtgtgtgtgtgtctgtcagtctgtctgtgtctgcgttggtttaacctacaatgtttttttgtaatttgttccagagcatagaaagactaataga

SEQ ID NO: 90799 - DNA, 75 bp, Mus musculus
gtggccgtgagcttcttgggaggagggagaaaacatctgtgcgtgtcgtctgttctctgtggctctgatggtggc

SEQ ID NO: 90800 - DNA, 118 bp, Mus musculus
gtaaatataaatataaacaatacatagatatataatatataacacatgttaatacatagtacattatatattaatatgtgttgaaatatagctattacataatatataatatattaac

SEQ ID NO: 90801 - DNA, 84 bp, Mus musculus
gcactgactgctcttccagaggtcctgagttcaattcccacaaccacatggtggctcacaaccatctgcaatggagtctgatgc

SEQ ID NO: 90802 - DNA, 63 bp, Mus musculus
ggagagatggctcagtggttaagagtgctgactgctcttccacagatcctgaggtcaattccc

SEQ ID NO: 90803 - DNA, 81 bp, Mus musculus
ttttgtgttctttgcaatgactcttcatgatgttcgtcaatacacttgtgaatttcatgatgacattgggtgtactcaaag

SEQ ID NO: 90804 - DNA, 99 bp, Mus musculus
tatgactttcacaatgactccttgttacctcacaaagacttgtgtgccctttacaatgtctctgtgtgactctcacaataattctctgtgaccctcgta

SEQ ID NO: 90805 - DNA, 69 bp, Mus musculus
cttgcctgggtggttgtcagccagcttttcttagcattaagacactgagcagtcaccgtgcaggccgag

SEQ ID NO: 90806 - DNA, 120 bp, Mus musculus
ctgctcactaattcttctgatcctctcacctgtcaagtccgtgaggagagaagagtctttgcactcctcggggctggggcagccgcacgggagacacatgagtcttggtgttaacagcag

SEQ ID NO: 90807 - DNA, 83 bp, Mus musculus
cagtgagtaactctgagtctcaggtctaacaaccattccacagagtgaccagacagcagcctggtatcaggtcaactacactg

SEQ ID NO: 90808 - DNA, 117 bp, Mus musculus
ggttgtttcaaaaaggagttgtaatggggcagttgttctcttctgggcaatgcctgcataagtaatgtatagaaccatcagtagaccaggtcctagtcgtctcttcctcaactaacc

SEQ ID NO: 90809 - DNA, 76 bp, Mus musculus
tctgtgacactcacacattgccaaatctcgatttagaaaccgagcatagagtttggcagtggtagtgtatactaga

SEQ ID NO: 90810 - DNA, 97 bp, Mus musculus
ggtatagagcaagagtgatgtgcccacgattgactgctagagcttttatcagaagagactgagagcagagaagatacacacactccttgttcttgcc

SEQ ID NO: 90811 - DNA, 80 bp, Mus musculus
gatcagcaaagacatgagacccacaagcgttgcacagctggttgtaccagcaagccaagctctgtctctgtccctctgtc

SEQ ID NO: 90812 - DNA, 107 bp, Mus musculus
tcccttttatggagaattgtcctccgcctcggatgtgtcgctccctgattggctgcagcccatcggccgagttgtcgtcaaggggaagtcagagcacatggagtgga

SEQ ID NO: 90813 - DNA, 85 bp, Mus musculus
ggcatgctgctgccacggcttgactctcactctcagttctatggcataaatagccattgagactccatgctgagcaggacatgtc

SEQ ID NO: 90814 - DNA, 105 bp, Mus musculus
gtcctccctgtgctgcgggctagactgtgctctgtcacacaggctgtgtgggatttcccatttgtcagtggtgttacgtggtgttagcatgttccagggtttggc

SEQ ID NO: 90815 - DNA, 64 bp, Mus musculus
cctctgtcactgagtcactgagcagaacgctattggtttcttctctgttggccatgctcagagg

SEQ ID NO: 90816 - DNA, 72 bp, Mus musculus
agggtacatgtgttctctgtcagtcagagcgggaaaggtcccgacagcctctgatcagctcatggtcttcct

SEQ ID NO: 90817 - DNA, 93 bp, Mus musculus
tgtttttacagcaggtggactttatttgattattatctgagactattacatttcagaattgtcttaattagggtttctattgctgtaaagaga

SEQ ID NO: 90818 - DNA, 81 bp, Mus musculus
tgcctctgtctgtctgtctgataatgttcttggtaacttggattgtgttcctaagcacaactcagaattcagttcagagca

SEQ ID NO: 90819 - DNA, 125 bp, Mus musculus
gggagagagagagagagagagagagagagcgagctagggggctggagagatggttcatctgttaagagcactgactgctcttccagaggtcttgagttcaattctcagcaaccacatggtggctc

SEQ ID NO: 90820 - DNA, 91 bp, Mus musculus
tgtcagcggtgccttagcagcacgtaaatattggcgttaagattctgaaattacctccagtattgactgtgctgctgaagtaaggttggca

SEQ ID NO: 90821 - DNA, 115 bp, Mus musculus
taggagttttcaaaaccaacccttggagtaaagtagcagcacataatggtttgtggatgttgaaaaggtgcaggccatactgtgctgcctcaaaatacaaggacctgatcttctg

SEQ ID NO: 90822 - DNA, 93 bp, Mus musculus
cgagcagtgcatatgtgttggtttctttgactggtttcaaagtttttgtttagtgttacttgagacaggcgtcaatatttattaccctgcttg

SEQ ID NO: 90823 - DNA, 78 bp, Mus musculus
atatgtatatatatgtatgtatgtatgtgtatatatatacatatacatacatatatatgtatatatatatatatatat

SEQ ID NO: 90824 - DNA, 80 bp, Mus musculus
gtttactattgatctgctaaatggacagtatggagctattctctatatttatatgtctacatctgtatattagtggagac

SEQ ID NO: 90825 - DNA, 114 bp, Mus musculus
gtgtgtgtgtgtgtgtgtgtgtgtgtgtgtacatatatatgtatatatacatatgtatgtgtatatatgtatgtatatatacaaatgtatatatgtgtgtgtgtgtatatgtat

SEQ ID NO: 90826 - DNA, 71 bp, Mus musculus
tgctctacctcagagctatgtccccagctctcagtgtctttgagacaggtgtgactgtgctgacaggagca

SEQ ID NO: 90827 - DNA, 94 bp, Mus musculus
gggtggacttgggggtggactttgggggtgggctttggaggttttaaatgctcaagccaggctcagtgtctcactgtcttcctgctgcctgcct

SEQ ID NO: 90828 - DNA, 66 bp, Mus musculus
aggattcatcaagatgctaggcttgctggccagtgagctgtgcaggtctctctgtctctgactcct

SEQ ID NO: 90829 - DNA, 95 bp, Mus musculus
cgccatctatcttcagcctgacttctgactcattgtgctaccctgggcgaatttacctggtgaatgagtaaggatctttgcttcgatcagtgggg

SEQ ID NO: 90830 - DNA, 70 bp, Mus musculus
gccttgaggagagagctttgagaagacatctcattaagaatcaaatgttccaaagtctctcactctctgc

SEQ ID NO: 90831 - DNA, 73 bp, Mus musculus
gctcctggctcctggtggggcccctgcttcctgttctgcagtgaacatagaaagctcacaaccatccagttgc

SEQ ID NO: 90832 - DNA, 89 bp, Mus musculus
acaaagcaactcacctgtctgtgtctcagtgcctgtatctaaaaatgggataagaggacctgtcttacacagtgtgataaaggttatgt

SEQ ID NO: 90833 - DNA, 92 bp, Mus musculus
tagaaacaatctctctgtgcaatcttgactggcttggaattttcggtctagaccagataggcctcaaacacagagagatttacttgtctctg

SEQ ID NO: 90834 - DNA, 86 bp, Mus musculus
caggctgagcccatttgccttccattctcagcacactccttccttgtgaatctaaacttcagagaaggaacagagcactcagcctg

SEQ ID NO: 90835 - DNA, 138 bp, Mus musculus
gccagtgagtacagtggccagtgagtacagtggccagtgagcacagcggccagtgagtacagtggtcagtgagcacagtggccagtgagcacagcggccagtgaacacagtggccagtgagtacagtggccagtgagc

SEQ ID NO: 90836 - DNA, 91 bp, Mus musculus
gccagagactttttttgatgtgtctgtctgtctgtctatccatctacttaatatatagacatatacttaaatactcaaattgtttttgagc

SEQ ID NO: 90837 - DNA, 59 bp, Mus musculus
agcatcactgaagaaagtgttctcactataagctagtagggtgtgagcttcaggttgct

SEQ ID NO: 90838 - DNA, 70 bp, Mus musculus
gcgtgtgcatgcaagtgtgtatatgcgtgcatgtatgtgtgagtgtgcgtgtgcatgtgcatgtgtgtgt

SEQ ID NO: 90839 - DNA, 82 bp, Mus musculus
tatagagtagtgctgttggagaacattcaagagacaattcactgttctctttaactgtccactgtctagaggctattctata

SEQ ID NO: 90840 - DNA, 118 bp, Mus musculus
gtctggcatgtttatagcccctggaccagtcagtaatcagcttttagcttgaatagcagtcatggtgttacaatccagctctttgctgagcggttcggacttagcatttgcatttgat

SEQ ID NO: 90841 - DNA, 86 bp, Mus musculus
tcaggaaacagtgcaagtctctcagtgcctgtgtgtggcccagaggacttggcaggcagggaattgggtggagggaagggatctga

SEQ ID NO: 90842 - DNA, 110 bp, Mus musculus
gcttatgattgcagagggttagagtccaagatgacagaacagaggctgcaggctgcaggcgtggcacctggagcagcccttgagagctcacatcttttgcagcaggaagc

SEQ ID NO: 90843 - DNA, 106 bp, Mus musculus
gcagttgtcataaagcctagagtgtgcctggcttgatttaggtggtgcctctctctctatgtcagtttccctatcccaggcaggctaacatttatggggatgctcc

SEQ ID NO: 90844 - DNA, 70 bp, Mus musculus
gccatgagtcactgtctctgcctgcatggagctcataggctagggtagaaaccactttgtgatttcaggc

SEQ ID NO: 90845 - DNA, 71 bp, Mus musculus
gtatctgtgtatgttcatatatatgtgtgtgtggtttgtgtgcacatgtgtgtgtgtgcatgtgtatgtgc

SEQ ID NO: 90846 - DNA, 78 bp, Mus musculus
tctgacatctgtctgtctgtttgtctgcgagtttgttgtgctggaaagccgttgtagacgtcacacagctgagttagg

SEQ ID NO: 90847 - DNA, 90 bp, Mus musculus
gtgctctggcttgtcctgattccctgaggcactggttagctttttgtcaacttgacagaagctagagttctctaaaaagaaggaacctcc

SEQ ID NO: 90848 - DNA, 89 bp, Mus musculus
ctaagaagacaaattcagggctggagaggtggctcagtggttgggagcgcactgactgctcttccagagttcctgagtttggttcctag

SEQ ID NO: 90849 - DNA, 72 bp, Mus musculus
atgtgtatgtatatctatatatgtaactgtatattcatgtgtgcatctatatgtatgtttatatatgtatat

SEQ ID NO: 90850 - DNA, 230 bp, Mus musculus
tgtatctgtatgtgtatacatatatttatgtgtatctgtatgtgcatatatgtatgtatatttgtatgtatataaatacatgtatatatatatctatgtatctatgtatatatgtgtgtatatgtatctacatgtatatacatatatgcatgtatatacatatatttatgtgtatctgtatatgtatatatatctgtatgtgtatacatatatgcatgcatatacatgta

SEQ ID NO: 90851 - DNA, 112 bp, Mus musculus
tggttttttaaattaaaaaaactacagggaacatagttaaggtcacctcaagtctgagaagtgactttgtacttttgaatactgttgggactataggggatttttaaaatta

SEQ ID NO: 90852 - DNA, 90 bp, Mus musculus
cctggcagtcctagaactcactgtgcagaccaggctggccttgaactcagagatctgcctgcctctgcctcccagtgctggaatgacagg

SEQ ID NO: 90853 - DNA, 74 bp, Mus musculus
ggaggaagagtgtcactggggttggctttgaggttacaaaagccctagccaggctcagtctcattctctcttcc

SEQ ID NO: 90854 - DNA, 105 bp, Mus musculus
ttcccagtgtggaatcctctgtttcaagcatgtggataaagatgttagctctcagctgtttctgtctccatttctgctttgccatcatggactttcccttaggaa

SEQ ID NO: 90855 - DNA, 114 bp, Mus musculus
ggtgctccttcccatcctctgtcagcagcagcattgcagctcagcctgtctctctccctccggactgcgagagatttgaggacaacgatgcttctctttctgaccaagagcatt

SEQ ID NO: 90856 - DNA, 94 bp, Mus musculus
gtatgtgtgtgtatatatatatatgtatacatatatataatatgtgtgtatgtgtgtttatgtatatgtatatttgtgtgtatgatgtatgtgt

SEQ ID NO: 90857 - DNA, 90 bp, Mus musculus
attctattttatttttttaattgatctatacatatagttgttgtatatgattatacatatatgtatatgattagttcatattgtggaata

SEQ ID NO: 90858 - DNA, 87 bp, Mus musculus
caggtaggtgactctagatcatggctgggccagggccattccttcttagccagggctctgtcatactctctctgggcgtcttacctg

SEQ ID NO: 90859 - DNA, 89 bp, Mus musculus
gccttactcagtttagccagctggtcatctaggctgaagcccaggcttattagcctaatgatctagctagtttagaatagttgatgggt

SEQ ID NO: 90860 - DNA, 86 bp, Mus musculus
cagtccttctgtgctctgcagcagccctctctctgtcagtctgccttggaggaaccgactgcagtcacagagggcaccctgagagc

SEQ ID NO: 90861 - DNA, 91 bp, Mus musculus
gaagagtgactgagagaaacacttgaagacaccctctggcctttctgtctctgtctgtctgtctgtctatctctctctctctctctctcac

SEQ ID NO: 90862 - DNA, 93 bp, Mus musculus
gtgagagagagagagagagagatagacagacagacagacagagacagaaaggccagagggtgtcttcaagtgtttctctcagtcactcttcac

SEQ ID NO: 90863 - DNA, 134 bp, Mus musculus
gtatgtacatgtattatatggcatatgtgtgatgtctgaggtatgtctgtgtggtacatgtgtatatgtatatgtgtatggagtatatatgtcctgtgtatgtggagtatgagtgtgtgtgtatgtgtgtgtat

SEQ ID NO: 90864 - DNA, 66 bp, Mus musculus
cagaacatgtgattttcttgaagagggtgaccaagaattccttggaaggaatcacatgggattctg

SEQ ID NO: 90865 - DNA, 86 bp, Mus musculus
agttgtgaggggaaatggggatggcaccttggagaagcatagcccacactaatagcattcagacattctcactctctctctctgct

SEQ ID NO: 90866 - DNA, 119 bp, Mus musculus
cctgacttcataactactctcatgtctgtgcttctcgggcccagcacagtgtctcgctctctgagagactgtttcagagctgagagccgaaggggctctagagagaggaaatgtagggg

SEQ ID NO: 90867 - DNA, 135 bp, Mus musculus
atgggggaggggtaggcatcagtgggtgagaagtagggggatggtgggcatcagtgggaagttggcagaagatagagaactctcagctctccccagcagaaccctgttcccaagacccatgctctgcatccttac

SEQ ID NO: 90868 - DNA, 102 bp, Mus musculus
cctgaaatccccaaatacttactatttgtgtgtgtgtatctgtgtgtatgtgagggcacatacagttagaggccagaagtggattagaaatggattagcagg

SEQ ID NO: 90869 - DNA, 82 bp, Mus musculus
gaaacatgctgcatgaagaactgagttatatgaatacacatgtactttgttaaaaagtttttcttatgtgcatgggtgtttt

SEQ ID NO: 90870 - DNA, 89 bp, Mus musculus
ctttgaaggttgagctgattggctatgttgacaggtatgatggctggctgatggacatggatacattgtcaggaaagacagttgtaaag

SEQ ID NO: 90871 - DNA, 84 bp, Mus musculus
ggcagaggcctggcgagtgtgtgaggagtaagtcagagtggggtggcatgctcttgtcactgtctccctgtcaggaaggtagct

SEQ ID NO: 90872 - DNA, 92 bp, Mus musculus
cattgatgatgttttctaggtcgcaggctctgtctcagtctcttgggaacagacatgagcatagagtttgtgtttgggaagagataaacttg

SEQ ID NO: 90873 - DNA, 93 bp, Mus musculus
ggcagcctcatccagcttccagtgatgtgactgccctagagaccacgttcagtcagtcagtcagtcagtcactttgttctcttgtgagttgct

SEQ ID NO: 90874 - DNA, 66 bp, Mus musculus
gggtctgtctgtctgtctgtctggagcaagtactctctgctaaggagagagctagtgcagaggtcc

SEQ ID NO: 90875 - DNA, 90 bp, Mus musculus
gctgggcaaggtgagtccatttgtggggtggcagggcatccctttggctagctttggtcccagcgtctgtctgtctcaggtctggaactc

SEQ ID NO: 90876 - DNA, 117 bp, Mus musculus
ctgggaagggacacatattcctgcctttgaggtctgtgatggcagtgattctcagggactgtgtctgtgggtatcaactgttcatgactataccctggctgaggaagcgcctgtcag

SEQ ID NO: 90877 - DNA, 69 bp, Mus musculus
tgtctcactctgtgtatgtgtgcaggcatgtgtgtttgtgtatgaatgccacatgcatgcagttatcca

SEQ ID NO: 90878 - DNA, 101 bp, Mus musculus
ttcttctgcaggattagctgagcactaatgcacacatatgtgtgtgtgcatgtacaagtgtacacagtgtgtgtgtgtgtgaatgctgattctgtggagag

SEQ ID NO: 90879 - DNA, 92 bp, Mus musculus
tcctgagcctggaggtgtctctgttttctgtaaaccacatggggtacttgtcctgtgtgtctctctgacagttggaccgtggctttgtagga

SEQ ID NO: 90880 - DNA, 65 bp, Mus musculus
ctctcagcctctctctgagcttcaatgtgccccatgggtcaatgtgagcctccctgagctgagag

SEQ ID NO: 90881 - DNA, 68 bp, Mus musculus
cctggatgactgccagactgtcactttctcagggtcctcacaggaagtggtcatgcagctcacatggg

SEQ ID NO: 90882 - DNA, 68 bp, Mus musculus
tctttatcagtcagtctgtctgtctgtctgtctaaatatagagagatagatagagatggagatggaga

SEQ ID NO: 90883 - DNA, 80 bp, Mus musculus
tatatatatgtacatacatatgtatgcatatacatatgtacatatgtatgtaggtatatgtatgtatataagtatgcatg

SEQ ID NO: 90884 - DNA, 112 bp, Mus musculus
gtacatatatatttttaacaagataaaccatacaagtctcaaatattatattttagttattatattttaatttagtgtgtgtcgagtgtgtgttaagtgtgtgtgtgtgtgc

SEQ ID NO: 90885 - DNA, 92 bp, Mus musculus
cttctgagtgctggaattacaggtgtgagctaccattaaaaatgactttttaaatttatgtatacctcatgtaatgtctgggacatttgaag

SEQ ID NO: 90886 - DNA, 86 bp, Mus musculus
ctgtgtgaagacgtggtactctccctctcacagagggccataagatttgtccctgtgactgggcctgtcacttagagatgttacag

SEQ ID NO: 90887 - DNA, 65 bp, Mus musculus
ttgagctaaccttgaccctgggctgtcatatcatcatcctgataggcagaacagacagagctcaa

SEQ ID NO: 90888 - DNA, 72 bp, Mus musculus
ggtgcatcttacatgtctctgtcactgtttatcttccttcctggtgaactaacagagcacatacaaagcacc

SEQ ID NO: 90889 - DNA, 116 bp, Mus musculus
gcatattgcttctgaatctctgtgtgtcttgcaatatcactgacactctgggtggctgtctagatagagttttattgatagtaaaatcaaggctgccgggcagtggtggtgcatgc

SEQ ID NO: 90890 - DNA, 78 bp, Mus musculus
cacatcagagagagacagagacatagagacagagggagacgtgataacccctgttcctactgcatctctttcagagtg

SEQ ID NO: 90891 - DNA, 64 bp, Mus musculus
gaaagagatgcagtaggaacaggggttatcacgtctccctctgtctctatgtctctgtctctct

SEQ ID NO: 90892 - DNA, 69 bp, Mus musculus
tgagatgagagtctcattctctcactatacagcccaggttggcataggacttgtgaccctcctatctca

SEQ ID NO: 90893 - DNA, 105 bp, Mus musculus
actgttctttcctctcttctgtgcttttacacagcaaaacatctcagacacactgtcttagttagggttttactgctgtgaaaagacaccatgaccaaagcaagt

SEQ ID NO: 90894 - DNA, 74 bp, Mus musculus
gagagagagagagagagagagatgaaggccagaggataacgtgtgagaatttactctctcttactctgtgtgtc

SEQ ID NO: 90895 - DNA, 83 bp, Mus musculus
gagtgagattcaagcaaccttccctggactgtccttgttactttctttgggtctgtggattgttgtatggttattctgtactt

SEQ ID NO: 90896 - DNA, 119 bp, Mus musculus
aggtatgggtagctgagcatgctggaatacacatttcttattgtgtgtgtgtggtctgtgtttctgtgtctgtatatgtatatgtgtgtgttcctctgtgtgtctgtgtgcttatgcct

SEQ ID NO: 90897 - DNA, 86 bp, Mus musculus
agtacgaccaaacttcaagactagactaaggctgtgcctcacagctcacagcctgctcagtagtgtcttttatttgggacaatact

SEQ ID NO: 90898 - DNA, 104 bp, Mus musculus
tttttaaagatctccaagtggttcttaaggtggcttgtgttgaaaaccacttccccaggttaacagaacttagttactaaagagctaaatactgcttttaaaga

SEQ ID NO: 90899 - DNA, 88 bp, Mus musculus
acaacacacagacacatatgtgcacacacatgcacacacacacatacacagtgcctgttgtttccaagtcatttggtctgtgttttgt

SEQ ID NO: 90900 - DNA, 94 bp, Mus musculus
tggaaatgagtagtcgcgtcattgtatcatatatattatataatataatgtattatataaatatgtataatatataagcatatttagacatcta

SEQ ID NO: 90901 - DNA, 115 bp, Mus musculus
ccttcctcaggagaaaggcctctctctccgtgttcacagcggaccttgatttaaatgtccatacaattaaggcacgcggtgaatgccaagaatggggctgtctgagcaccttggg

SEQ ID NO: 90902 - DNA, 87 bp, Mus musculus
tttttgggggggctggagagatggctcagtggttaagagcactcactgctcttccagaggtcctgagttcaaatctcagcaaccaca

SEQ ID NO: 90903 - DNA, 84 bp, Mus musculus
gagtggggctgggcattgaagctcacatctgtagtcccagtagttgggaggctgaggtaggagcttggagcctagactcgtctc

SEQ ID NO: 90904 - DNA, 81 bp, Mus musculus
tgtcagtgagtgtgtctgtctcaggttgctctggggttctctttgaggtaggggccaggccttctcaacacactgcagacg

SEQ ID NO: 90905 - DNA, 76 bp, Mus musculus
gctcgtgattgactgcaggagccgtccagtgctggggcataggagctcactctcacagactcaccacttcaccagc

SEQ ID NO: 90906 - DNA, 81 bp, Mus musculus
atctgcagtattggtcttggttatgattttgtctcactgtctctctgactgggaaacaggataacctcagatcactgtgat

SEQ ID NO: 90907 - DNA, 93 bp, Mus musculus
tttgttgagtatatctgtgtgtgtgtctgtgttactaagatgtgtatgaatgcatgtggatgccaggagtgtacataatgtgtatttgccggg

SEQ ID NO: 90908 - DNA, 94 bp, Mus musculus
cctgtccttatagacctgctgggtgtgtctgtgcctctgtttgatccccatcagtggtttgcatctcactcgctttcctctgggtgactcgtgg

SEQ ID NO: 90909 - DNA, 111 bp, Mus musculus
ctcaaggctacagatttggtttgtttttttgttttttgttttttgtttttttttttaaagaagatagctcaagcgggtaagagaactgactgttcttccagaggtcctgag

SEQ ID NO: 90910 - DNA, 73 bp, Mus musculus
agaggatcactggtaagtcagtcactctctcgatggcgtgttaaagttcctgatactgcgctctgtgtcctct

SEQ ID NO: 90911 - DNA, 87 bp, Mus musculus
caaggttagctttggatttgaggtagtcctctgcttcccaagtgaaggaagattgtacagacacagctcacctccaggcttctcttg

SEQ ID NO: 90912 - DNA, 64 bp, Mus musculus
cgtgtctatgtgcatgtccatgtgtgtacatgtgtgtgcatgcgtgtacatgtgtgtgtgcatg

SEQ ID NO: 90913 - DNA, 89 bp, Mus musculus; identical to SEQ ID NO: 90832

SEQ ID NO: 90914 - DNA, 104 bp, Mus musculus
agctggctcctgagcttgcagtggttctctgcctctctctccatgtctctgtggggatgctgggattcctggtggtgtgccacagtgcttctgggtagccagct

SEQ ID NO: 90915 - DNA, 91 bp, Mus musculus
gtgtgtatacatgcatgtgtgtatatgtgtgaatgtatatttgtatgtatgtatttatatgtatgtactgtgttaatgtatgtgtatatgt

SEQ ID NO: 90916 - DNA, 124 bp, Mus musculus
gtatatatgtatatttgtgtgtatgcatgtatgtaaatgtgtattttatgtgtatgcatatattatttatttctgtatatgtatgtacatatgtatatttatgtatttctctgtgtgtgcagca

SEQ ID NO: 90917 - DNA, 57 bp, Mus musculus
tgcttgagtggctgggcaactggacttagcactgagttcagtcactgtcacaaagca

SEQ ID NO: 90918 - DNA, 59 bp, Mus musculus; identical to SEQ ID NO: 90837

SEQ ID NO: 90919 - DNA, 93 bp, Mus musculus
gccttgctggtgaaatcttggctttctctgtttctgtcaatctgtagatatcaaagatagcaggattactctgtcacccttgggaagtcaggc

SEQ ID NO: 90920 - DNA, 94 bp, Mus musculus
gacttggcagtcttgccagtgggatccattcaagcagaccggtgtcactcggtctctgagtgatgcccacgttccagcccattgctatgcagtc

SEQ ID NO: 90921 - DNA, 118 bp, Mus musculus; identical to SEQ ID NO: 90840

SEQ ID NO: 90922 - DNA, 409 bp, Mus musculus
ctcacactctgcctgtgcaggtgtaaagttagaaaggccctaggtttgtctcactctgcttgatcagagtgtaagttaggaaggctcctgggttgtctcacactctgcctgtgcaactgtaagttaggaaggccccagggttgtctcacactctgcctgagcaggattatgttaggaaggccccagggttgtctcacactctgcctgtgcagggtgtaagttaggaaggccccagggtcgtctcacactctgcctgagcaggagtaagttaggaaggccccagggttgtctcacactctgcctgagcaggagaaagttaggaagcccccagggttgtctcacactctgcctgagcagggtgtaagttaggaaggtcccagggtcgtctcacactctgcctgagcagagt

SEQ ID NO: 90923 - DNA, 116 bp, Mus musculus
taggtccccagggttatctcatactctgcctgtaaaactgtaagttaggaaggcccctgggttgtctctcactctgcctgtgcaggtgtaagttaggaaggccccagggttgtcta

SEQ ID NO: 90924 - DNA, 137 bp, Mus musculus
ggaaggccccagggttgtctcacactttgcctgagcaggagtaaggtaggaaggcccctgggttgtctctcactctgcctgtgcaggtgtaagttaggaaggcccagggttgtctaatactctgcctgattagagta

SEQ ID NO: 90925 - DNA, 78 bp, Mus musculus
atctgcctgtacaactgtaagttaggaaggcccagggttgtctcacactctgcctgagcaggagtaagttaggaaggt

SEQ ID NO: 90926 - DNA, 117 bp, Mus musculus
acagtctgcctgtgcactgtaagttaggaaggccccagggttgtctcacactctgcctgagcagggtgtaagttaggaaggcccctggtttgtttcacagtctgcctgtgctactgt

SEQ ID NO: 90927 - DNA, 205 bp, Mus musculus
gaggcccctgggttgtctcacactctgcctgaacaggagttaatttggaaagccccagggttgtctcacactctgcctgaacaggagttaatttggaaagcccctgggttgtctcacactctgcctgtgcaactgtaagttaggaagacctctgggttgtctctcactctgcctgttcaggtgtaagttagaaggcccctgggtt

SEQ ID NO: 90928 - DNA, 181 bp, Mus musculus
aggcccctgggttgtctcacactctgcatgtgcaggtgtaagttaggaaggccccaggtttgtctcacattctgtacaagtcggaggaagttaggaaggacatagggttgtctcacactctgcctgagcaggagtaagttaggaaggcccctgggttgtctcaaactctgcctgagcagga

SEQ ID NO: 90929 - DNA, 351 bp, Mus musculus
tgagcaggattaagttaggaaggtcccagggttgtctcacactctgcctgagcaggagtaagttaagatggccccagggttttctcacactctgcctgagcagagtgtaagttaggaaggccccagggttgtctcacactctgcctgagcagagtgtaagttaggaagggcccagggttgtctcacactctgcctgagcagagtgtaagttaggaaggccccagggttgtctcatactctgcctgagcaggagtaagttaagatggccccagggttgtctcacactctgcctgagcagagtgtaagttaggaaggccccagggttgtctcacactctgcctaagcaggagt

SEQ ID NO: 90930 - DNA, 119 bp, Mus musculus
actctgcctgtgcaggtgtgagttaggaaggccccagggttgtctcacactctgcctgtgcaactgtaaggtaggaaggccccagggttgtttcatactctgcctgagcaggagtaagt

SEQ ID NO: 90931 - DNA, 256 bp, Mus musculus
tactctgcttgagcaggagtaagttaggaaggccccaaggttgtctcacactctgcctgagcaggagtaagttaggaaggccccttggttgtctcacactctgcctgagcaggagtaagttagaaaggccccaaggttgtctcacactctgcctgagcaggagtaagttaggaaggcccagggttgtctcacactctgcctgagcaggagtaagttaagaaggccccagggttttctcacactctgcctgagcaga

SEQ ID NO: 90932 - DNA, 107 bp, Mus musculus
tgcctatgcaggtgtaagttaataaggcccctgggttgtctcacactctgtctgagccgagtgtaagttaggaaggccccagggttgtctcatactctgcctgtgca

SEQ ID NO: 90933 - DNA, 103 bp, Mus musculus
tatgtgtgtatgcatgtgtatgtatttatatatatatgtatacatgtgtgtatgtaagtgtatacatgtgtatatgtatgtgtctgtctgtgcctgtgtgtgc

SEQ ID NO: 90934 - DNA, 63 bp, Mus musculus
agaacagagacacactctctgagggccagtgctgtacagcgtgacaaggagaggctcttttct

SEQ ID NO: 90935 - DNA, 75 bp, Mus musculus
ccaggctggactggacttcactatgtagcccaagttggcttcaaattcttgccaagtctctgtctcagactctgg

SEQ ID NO: 90936 - DNA, 61 bp, Mus musculus
ggtcaccacgttgagtgtggccagctcctgcttgagctgcatctccatgtccatgtgcacc

SEQ ID NO: 90937 - DNA, 112 bp, Mus musculus
tttttttttaatttttcctggtttcaaatggcaccaaaagatgagagccaatcaacattttttttttttttttgagctagaaagggagccaggagagccaggtgacagagag

SEQ ID NO: 90938 - DNA, 110 bp, Mus musculus
gtgctcttgaccactgagccatcataccaacctcaaattctttatttttaagtagccttttaagaatgtacaaaggggggctggtgagatggctcagtggataagagcac

SEQ ID NO: 90939 - DNA, 56 bp, Mus musculus
gctggagagtctatcagagctctcgtccctggaggagacagtctccctctctcagc

SEQ ID NO: 90940 - DNA, 107 bp, Mus musculus
tgataatacatgagatggaggactggagagatggctcggtggttaagagcactgactgctcttccagaggacctaagttcaatttccagcaaccacatgatagctca

SEQ ID NO: 90941 - DNA, 77 bp, Mus musculus
tatgtctgtctgtctgtctgtatgtatgtatgtatgcatgcatatatatatatatatatatatatattatatacata

SEQ ID NO: 90942 - DNA, 106 bp, Mus musculus
atatatatatacatatacatatatatgggtatatatatgtatatatgtgcatatatatgtatatatgtgtatatatgtgtgtgtatatatatatatatatatatat

SEQ ID NO: 90943 - DNA, 100 bp, Mus musculus
tgcaaacacataagggtctttattatgatctcccaagcaaggactctcactgtctctgtcacagcgggtcagaaatgaaagccttgagtctagaagtgca

SEQ ID NO: 90944 - DNA, 64 bp, Mus musculus
tctctgtttctctgtgtgtgcgtgcacgagtgtacgcatatgcgcacacagtgtttacaggtga

SEQ ID NO: 90945 - DNA, 134 bp, Mus musculus; identical to SEQ ID NO: 90863

SEQ ID NO: 90946 - DNA, 64 bp, Mus musculus
ttttgtctgtctcactcacagctactcatctttgatgagcttggagtcactggggcagaaggag

SEQ ID NO: 90947 - DNA, 86 bp, Mus musculus
cagtgctctatttacttttctgctgctgtgagaaaacactctggtcagaagcaacttgggggagcagagactttggaggaacactg

SEQ ID NO: 90948 - DNA, 66 bp, Mus musculus; identical to SEQ ID NO: 90864

SEQ ID NO: 90949 - DNA, 69 bp, Mus musculus
gttaaatgtcagagtcactgtgtttcagggctgtatctctacatggagctggtggctcacatattggac

SEQ ID NO: 90950 - DNA, 102 bp, Mus musculus; identical to SEQ ID NO: 90868

SEQ ID NO: 90951 - DNA, 136 bp, Mus musculus
tatacattatattacataaatgtgtattgtatatacatatatatgtatatattccatatatatgtgtgtatatatatatgtgtgtgtgtgtgtgtgtatatatatatatatatgtgtgtgtgtgtgtgtgtgtgtg

SEQ ID NO: 90952 - DNA, 75 bp, Mus musculus
gtggagatgtgaatctcagtggtagaacttagtggctgaactcttagaatgcacagggccctggattcaatccac

SEQ ID NO: 90953 - DNA, 83 bp, Mus musculus
aggattttggaggaggtgtgccactgggggtgggctttaagatttcagaaggccatgcccttctcactgtcagtctctgtcct

SEQ ID NO: 90954 - DNA, 61 bp, Mus musculus
acacacacactaggtgggactaggggtgaaccaagggctctgactcccactgtgcctgtgt

SEQ ID NO: 90955 - DNA, 105 bp, Mus musculus
gtttcaagtcctacctactatgctctgagcatgcccagtgagtctttttctgtgtctgatgcatggaaagtggatcattgctgatcttgctatgagtggctcagc

SEQ ID NO: 90956 - DNA, 98 bp, Mus musculus
tcagggacaccttagttttgctagtgttacacatgacaagcattaccattgttgcataagatgttgacagtagagagactgggttaaagtgtatatga

SEQ ID NO: 90957 - DNA, 74 bp, Mus musculus
tgcttcaggtgtacatgagcatgcctttcttgtaagtcatgtaaagatgtatgtttatttcagtgcttagagca

SEQ ID NO: 90958 - DNA, 74 bp, Mus musculus
actggaaaatgccaagttgtacatggaaaacaccacgtgctacagtatgtgtctgtgacagtgtgtgagccagt

SEQ ID NO: 90959 - DNA, 86 bp, Mus musculus
ccctttaagttgttctctcaggtaatctggctgcagccatgaaaaggtctgactaacacatagcctgaggaaggaaacaaaagagg

SEQ ID NO: 90960 - DNA, 68 bp, Mus musculus
tagaggcagtgcttaagaactgagactttagtgagcacacattctctctgtctctgctactgtctctg

SEQ ID NO: 90961 - DNA, 73 bp, Mus musculus
atgtctatatatgtatatacatatacatattcgtgtatgataaatatgtgtatgtatatatgatatatatcat

SEQ ID NO: 90962 - DNA, 93 bp, Mus musculus
tttgaggcagggtttctctgtgtatctctggctgtcttggacctcactctgtagaccaggctggcctcaaactcacagagatctgcctgcctc

SEQ ID NO: 90963 - DNA, 94 bp, Mus musculus
aactaatgaaggcgtcttaattcttcttcatgaaaagctatgatgcaagagctgaatttttaattttcatcagaggaagagtctttatgtggtt

SEQ ID NO: 90964 - DNA, 82 bp, Mus musculus
gtcccttttcatctgctcactgctgagtctctcagaagccctcacccctgccctgcccctgcaaggactcccagtgagggac

SEQ ID NO: 90965 - DNA, 78 bp, Mus musculus
cagagaaatgtacacttgtgtgcacaagtgtgtgtatgagagagctatacatgtgtacacaggtatgtgttacctctg

SEQ ID NO: 90966 - DNA, 83 bp, Mus musculus
gccacagaagggtgtgaggtgtcttctgtcactttcttggtctgttcctttgagacaggatctctctccctgacctctggggc

SEQ ID NO: 90967 - DNA, 101 bp, Mus musculus
agcagctgcgtagataagtgtaataactttttttcctttagaaaatgtgatcacacatgggagcaaggaaacactgttattatctttgctaggaggttgtt

SEQ ID NO: 90968 - DNA, 92 bp, Mus musculus
gcaaagtgccgagggatgtgatagacttttgatttgtggtctctctgactgacaaacttttgagtattttcaaatgcatccatttcacttgt

SEQ ID NO: 90969 - DNA, 96 bp, Mus musculus
gtctatgtcaagcaggccacgcctcttccagaactctcactctgactttcaggagacaggaacatgggtattaggagcctgattgggttagtagac

SEQ ID NO: 90970 - DNA, 75 bp, Mus musculus
acaactgcatagacaagttccttaaactagaccagtttttttctggtctgtctctgactctgtctctgtctctgt

SEQ ID NO: 90971 - DNA, 109 bp, Mus musculus
cacatatatgtgtatatatatgtatgtatgtatatatacatacacacacacacacacacacacacacacacacacatatatatatatatatatatatatatattcagtg

SEQ ID NO: 90972 - DNA, 207 bp, Mus musculus
tgttgtatatatctatctctacctctatctctacctccgtatctgtatatacctatgtatatatctatatctgtatctatatctgtatatatatatatagagagagagaacaataataatatagaacatatatactatatattataatatattataattatatataaaatatagaacatatatagtatatatgttctatattattat

SEQ ID NO: 90973 - DNA, 114 bp, Mus musculus
tactggttgtctcatcttggctgacaggaactggagagccccgggggtctgtctctgtctcccccgagttgggtttacaagtgtgtgtcccatgcctggctttgagagttggtg

SEQ ID NO: 90974 - DNA, 116 bp, Mus musculus
ccaaaattcttaaaatagaggttgtaaaatgtgttaaacgtgccagtgtccttttttgatatgtcattatatattttaatcctctagactttataaatcccagaatacgtaagtgg

SEQ ID NO: 90975 - DNA, 76 bp, Mus musculus
tctctctatgtctctctctgtatgtgggtgtgcctgtgcatgtgtctgtgtgtgtgtgagagacagtaacgggagg

SEQ ID NO: 90976 - DNA, 79 bp, Mus musculus
cagagggaaacagtggcagccattagaacatacccttgctctttcacctctcttgtctgtctgtctgtctgtctgtctg

SEQ ID NO: 90977 - DNA, 104 bp, Mus musculus
gctctaagagaaaaaatatctgcctagctccctgtctctgtctcttaatcccaactttcatgggttatgatggactgggctctaaggtttgttctctgtcttgc

SEQ ID NO: 90978 - DNA, 88 bp, Mus musculus
gtgagtcagaacggccagcaacactcttcatcagacctctccatctgaggatcgttggtttatctgtctgtctgtctgtctcactgac

SEQ ID NO: 90979 - DNA, 89 bp, Mus musculus
tgttagcatgtgttcaagatagcagagaaagcatgatctacttcttttcatgtgattatttctttgattataaaaagcacttcatggca

SEQ ID NO: 90980 - DNA, 120 bp, Mus musculus
ccaggcttctcccaggcactttattgtcaggttctgatctccatcatcatcatcatcgtcgtcatcatcatcatcatcctctgattagatcctgccatctctagtttctggaagtgaggc

SEQ ID NO: 90981 - DNA, 66 bp, Mus musculus
tgcctatatgtctagttctatatgtttttatacatacacgcttgtctagatctagatatgagggta

SEQ ID NO: 90982 - DNA, 63 bp, Mus musculus
cactgggtctgagtctgtgtgatatcacacacgaggatattaccaatgcccaggccactggtg

SEQ ID NO: 90983 - DNA, 96 bp, Mus musculus
ggagaaatcactacagatgcttcggaaatggctcagcatcctccagtagtgatggactgacagatgctagtgagcactgagatgtcgatttctacc

SEQ ID NO: 90984 - DNA, 87 bp, Mus musculus
tatttttggtcactcgctcctccatccagggttcactggcctcttcggtcacaattctggacactaggcatcaacaatccaagcata

SEQ ID NO: 90985 - DNA, 68 bp, Mus musculus
tatggtatatgattggtgtttgatatatgattatgattatatgtgatatctgattgtgatatgccatg

SEQ ID NO: 90986 - DNA, 71 bp, Mus musculus
gacagatgtacagcttggtcctcaatgtgagatctctgatagaaggagcagaggctgtctctgactctgtt

SEQ ID NO: 90987 - DNA, 99 bp, Mus musculus
ctgtttgtttttccctctttcagggcccagggcaggatggctacccagacaggagtcagtctcctgccttgtttccatgtaggaaaaaaaaaaaagcag

SEQ ID NO: 90988 - DNA, 87 bp, Mus musculus
ttatgtgggattggagaggactcttgctcaatttgtttatatataacagtgattttgcaaatcagggatccttatgatctcccatga

SEQ ID NO: 90989 - DNA, 74 bp, Mus musculus
gcagggtatttactgatgatccctccattcccctgtgaagaaggagagaagacagtgaagacatgccctccagc

SEQ ID NO: 90990 - DNA, 87 bp, Mus musculus
gaatgcgtgtccatgtgtgtatatgatcatgtgtttttctgagtatatgtgcatgtgtgtctgtatgtgtgtgaatgatgtgtgttt

SEQ ID NO: 90991 - DNA, 64 bp, Mus musculus
tacagtgtaatttttatctgctgtacctgcccttatgtggctgacagtagactgtcacaccgta

SEQ ID NO: 90992 - DNA, 70 bp, Mus musculus
atacacacacacagatatatatgtatgtaatctatatctgtatatatatatatatatctgcgaggtgtat

SEQ ID NO: 90993 - DNA, 61 bp, Mus musculus
ctaagtccatttcttcacccagtcactggactcagtgaagtggctgaggtcagggatgcag

SEQ ID NO: 90994 - DNA, 77 bp, Mus musculus
tcagaaaccagaacagagacaggtctctcctgaggtttgtggagaaaaaatggactctctgtcatcctgatttttga

SEQ ID NO: 90995 - DNA, 70 bp, Mus musculus
tctatttatctatagatgatagtatctatctatctatctatctatctatctatctatagatgatagtaga

SEQ ID NO: 90996 - DNA, 118 bp, Mus musculus
gcatgtgggcatgtgtgtgtactgtgctgtgtgtgtttgcatgtgtgtgtgtgtgtgcatgtgcatatacacatgggtgtgtgtgctgtgctgtgcatgcatgtgcatgtgtgtgtgc

SEQ ID NO: 90997 - DNA, 83 bp, Mus musculus
actttcttaggagcactttttttttcttcttctggagttgagcagagcattggaggctcaaagagactgagtgactgagtggt

SEQ ID NO: 90998 - DNA, 82 bp, Mus musculus
ctcagttatcaggataatttatctacagagcaccaaatactaacttgtgtctgtgtctgtgcctgtgcctgctctatctggg

SEQ ID NO: 90999 - DNA, 83 bp, Mus musculus
ggtgaggtgtcagttactgtctgggctccagtctcctgcaaggtggtctgacaagttgacagaacagtgagaaatctctaacc

SEQ ID NO: 91000 - DNA, 120 bp, Mus musculus
ctgagcgtccagcaataccatctaactgcatatccatcaaagctatggctcactctctcacccacaatgatttaataggggccatttctttagcaaagaggaatgcttccatgacttcag

SEQ ID NO: 91001 - DNA, 112 bp, Mus musculus
caaagctcaggagcatatgagggaagaggattgaagtctctgaacttagagtggacaaagcaaagaccgccagaaacctatctttccatctattcctgcctctgagtctgtg

SEQ ID NO: 91002 - DNA, 85 bp, Mus musculus; identical to SEQ ID NO: 57470

SEQ ID NO: 91003 - DNA, 71 bp, Mus musculus
tcagagacaaggcagaaggcagagagctcagggacagaccccaggtttggaattgccactggaagtcctgg

SEQ ID NO: 91004 - DNA, 102 bp, Mus musculus
ggtgttccctctaatgacctacggtctcggtccctctgtctgtcatggctagctctctttgcagatgtcgaccagggctgtacactctgccgacccatcacc

SEQ ID NO: 91005 - DNA, 80 bp, Mus musculus
agagtttggctcaggctggggagatggctcagcagttgggagcactgactgctcttccagaggtcctgagttcaaatcct

SEQ ID NO: 91006 - DNA, 61 bp, Mus musculus
ctgctgttcatttgtttggctggttttcaggatctgactccagccaggataagtgtcagag

SEQ ID NO: 91007 - DNA, 78 bp, Mus musculus
caagcataagtgtataagtgtatgtacatgtgcatgtgtgtgcacatatgtttgtgtgtgtgtggtgtgtgtgtttgt

SEQ ID NO: 91008 - DNA, 71 bp, Mus musculus
tggctttttatgtatgtgctggagactgaactcaggtcgtcagtcttgggtcacacgcactgactgagcca

SEQ ID NO: 91009 - DNA, 80 bp, Mus musculus
gtgtatctgactccctctgtggcatttgtgaacaccaggaatgcacatgatacacagacatacacggaagcaagataccc

SEQ ID NO: 91010 - DNA, 100 bp, Mus musculus
gcccagagtggcagggtcttaggaaaggccacctgctcttttcacagatctgactgaggagaaagagaattagtcccttgagacaatgtctatacatggc

SEQ ID NO: 91011 - DNA, 113 bp, Mus musculus
ggggggctctaacgagtggtaagggacatcaggacctcggttgttcatggcttctctcagcatctcactgactctgactcctgagtactcgccctagaccacaagctccagcc

SEQ ID NO: 91012 - DNA, 109 bp, Mus musculus
ccacgcgatgccaatcaacgatgcttaagtatatgccagttggtggtgacagaacagagtctccgaagccggtggttggggttggggttgggggtgggggtgggagtgg

SEQ ID NO: 91013 - DNA, 107 bp, Mus musculus
caaaggggaaaaaagctttaagagctagaacacagagagaagctactgagcccagatgttctcctggcctctgtgtttgatggatgggtgaggctatgtcctctggg

SEQ ID NO: 91014 - DNA, 61 bp, Mus musculus
tgattgaggcagctcaggttagggagcagcaaaaggctgtgtcactgagtgacagagatca

SEQ ID NO: 91015 - DNA, 117 bp, Mus musculus
cggagagctttagaagatgggatcaaggaagaagcaaggagaggggcgggcgacttccggtgactctggctctcagtctcttctccaggtcacccatatttgcctctagggcatttg

SEQ ID NO: 91016 - DNA, 74 bp, Mus musculus
caccttttgcctggatgcctgcctgaagatgtgtttgtatttttatagaaaagatcaaggctggctggctggtg

SEQ ID NO: 91017 - DNA, 94 bp, Mus musculus
gaagtgagctagtcagatccaccctcttgggcctgggagcttgatgaaaaagcatgaaaacaactcctgagactgtgggacccctagctactac

SEQ ID NO: 91018 - DNA, 71 bp, Mus musculus
ggaggccagcgggcagccccacattccctagatctcagaagtggctccctgcctgcctgccaatgctctcc

SEQ ID NO: 91019 - DNA, 118 bp, Mus musculus
agagtgtgagtgtgttacctggggctggagagatggctcagggattaagagcactaactgctcttccagaggtcctgagttcagttcccagcaaccacatggtggctcacagccatct

SEQ ID NO: 91020 - DNA, 70 bp, Mus musculus
caaggatacatatgtatgtgtgtgtgtacatgtatgtatatatgcatatatactcacatgtgtatgtttg

SEQ ID NO: 91021 - DNA, 74 bp, Mus musculus
gcatgtatgtatgcgtgtatgtatgcatgcatgcatgtatgtatgtgtgtatgcatgtatgtatatatgtatgt

SEQ ID NO: 91022 - DNA, 74 bp, Mus musculus
gtggtttacaaccatctgtaatgggacctgacaccctcttctggtgtgtctgaagacagagatgatgtactcac

SEQ ID NO: 91023 - DNA, 78 bp, Mus musculus
cacctgagttctcagaactgattgtaaagagaacaagttgtcctctgaccttcacactcaggctgtgacactcatgtg

SEQ ID NO: 91024 - DNA, 113 bp, Mus musculus
ccccaggagtccctagcggcccacgctgatgttgcaggtcttgcagctgggatctttcttggcgtcagcagtggacaggctcatgagctggtgcccgctgatctctcccaggg

SEQ ID NO: 91025 - DNA, 114 bp, Mus musculus
gtagtggttggccagtgagccccaggggtctgcctgtctctgtctctctggttctgggcttccaagcacatgccactcagagaggatgggccaccccttctctgtctatcaggc

SEQ ID NO: 91026 - DNA, 65 bp, Mus musculus
cagatggaggaagggatgcgggaagctgaggcgcagcaccctgactcccacactcacaccctctg

SEQ ID NO: 91027 - DNA, 112 bp, Mus musculus
tgtttgcaagtctctggggctgctcaagtatatgatatgatatgatatgatatgatatgatatgataggatatgatatgatattatcaaggaagcccactttcctgttcaca

SEQ ID NO: 91028 - DNA, 107 bp, Mus musculus
aggtgtgcacccccatgcctggcttgttagtttgtctgtctatctgtctgtttcgcatctcaggcttgtctcagactcactaagtaaccaaggatgaattggctctt

SEQ ID NO: 91029 - DNA, 66 bp, Mus musculus
cagggtagttggagagtgaggagagacagggataccatttatgtttttcccatcccccgatccctg

SEQ ID NO: 91030 - DNA, 110 bp, Mus musculus
ggaaatttaggtttagggaggtaacatgacttacacaaggtcatgacttgtgacagatccaggttgagatcttgcatttgtaaactgtgtgtaattagtgaaccagttcc

SEQ ID NO: 91031 - DNA, 71 bp, Mus musculus
tgtgtgcctgtacatactatgtatgaatttatttagatttatatgtagtatatgtgtatgagtggtatata

SEQ ID NO: 91032 - DNA, 85 bp, Mus musculus
gggtattcaaaggtgccaccaggcttgttagggctataggtggaaggctagccctcacagctggcagggtcactagagaagccct

SEQ ID NO: 91033 - DNA, 114 bp, Mus musculus
caggaagctgcttgcctagtcagggcaccatgtgggacttgctcagcttgtgtggaatgaatgaatgaatgaatgaatgaagagtccctttgttttgctttgaggtggctcctg

SEQ ID NO: 91034 - DNA, 85 bp, Mus musculus
atgtctgtgtgcacctgctgtggccagaagagggtgctgggccttctggatctggagttacaggtgacagtgagctctcagatat

SEQ ID NO: 91035 - DNA, 111 bp, Mus musculus
gagtttatttcatgagatttgtgattcagtggaacctgttgagtcattcagtgagtcactgaatgaattgtccaagtatctacccgaattgaggcatgtaaaagggaactc

SEQ ID NO: 91036 - DNA, 88 bp, Mus musculus
ggtgctaagaggtagctcagtggttgagatctgaattaggttcacaggacctgctttgtgtagctcaaaagcttgtaactctagctcc

SEQ ID NO: 91037 - DNA, 83 bp, Mus musculus
ggttattgggagagagaaggttgaggctaccagcctaagagctctttctgtgtctctgtctgtctgtctgtctaacccctctc

SEQ ID NO: 91038 - DNA, 122 bp, Mus musculus
tcgatgcttctatattgagtggcaaggtgggggactgctagtttcacaggtgtgagagtcatgagacagggctcaggcctcaagattcccatctagccattcggtgctgggacaagagagca

SEQ ID NO: 91039 - DNA, 98 bp, Mus musculus
gagacagcaagattgagtgccgcagagaggggttagacagacagacagacagagacacagaaagagctcttaggctggtagcctcaaccttctctctc

SEQ ID NO: 91040 - DNA, 72 bp, Mus musculus
gcaggctgctagaaggagggtctcctctgtactgggcagagcctgaatgtagaaagagacctcaaagcctgt

SEQ ID NO: 91041 - DNA, 64 bp, Mus musculus
tctcctctggctctcacagtctttcagttccctcttctgcatagatccatgaggcttaaggggg

SEQ ID NO: 91042 - DNA, 82 bp, Mus musculus
tgagacaagaaaagtacacaggcacaatgaagggggcaggctttgctgccattgtgactggacacactgtgctcattgctca

SEQ ID NO: 91043 - DNA, 60 bp, Mus musculus
tgtgtgtgtgcttttgatctatagttgtgtgtacacagtgaggtcagaggctgacatagg

SEQ ID NO: 91044 - DNA, 85 bp, Mus musculus; identical to SEQ ID NO: 57470

SEQ ID NO: 91045 - DNA, 62 bp, Mus musculus
ggggctctctctttagactgggctggcttgccagtgagctctgaagtctgtctgtctgctcc

SEQ ID NO: 91046 - DNA, 64 bp, Mus musculus
gaataaataattcagtgagagaccttattctttggaccagtgtctctcactgaggctgggattc

SEQ ID NO: 91047 - DNA, 117 bp, Mus musculus
gatctctcccctccttggtaatgctgagtcctggatggtgtatagtcactcctcttactgacagagactggaactgcactgtttgtaaggatgcaactccccagcagatggtgagtc

SEQ ID NO: 91048 - DNA, 75 bp, Mus musculus
tctcatcatctacatctatatctatatacatatatgtgtgtatgtatgtatgtatgtatgcatgtatatctgaga

SEQ ID NO: 91049 - DNA, 85 bp, Mus musculus; identical to SEQ ID NO: 57470

SEQ ID NO: 91050 - DNA, 85 bp, Mus musculus; identical to SEQ ID NO: 57470

SEQ ID NO: 91051 - DNA, 95 bp, Mus musculus
gaaatactagtttagcattggtaatcatggtggctatcacagcctgagttcagcagctacaatgttacaccacacttgcccaggagctttctttc

SEQ ID NO: 91052 - DNA, 114 bp, Mus musculus
tgaaacagtactttcttggtttgggtgtatcaaaggatcacagaacacagtaagcaatgcctggttatagaatgcattctttggcataactctagaagggaaattctctggtca

SEQ ID NO: 91053 - DNA, 117 bp, Mus musculus
cagatgaataatttagtagtgttgacatggctttctgtatactaccctgtttagatgctatctttatttgtaaatgtcagcttgccaatgtatgagcttgtttgggtgaactcactg

SEQ ID NO: 91054 - DNA, 98 bp, Mus musculus
gatcatatcctacattgtggtaggacatgcttgaatctatagattcaactctctatagatcagtttgccacttacaaatgcaaaacagagaaatggtc

SEQ ID NO: 91055 - DNA, 100 bp, Mus musculus
gtgtgtgtgtgtgtttgtgtgtatgtgtttgcgtttgcatttgcatttgcatgtgcatgtgtatgtgcatgtgcatgtgtgcacaaacacaggcacatgc

SEQ ID NO: 91056 - DNA, 82 bp, Mus musculus
gctcatgggaatagtagtttctcatttagtggccagcagctgtaaggagtagagaggaaagttgacttgcccagcacagagc

SEQ ID NO: 91057 - DNA, 91 bp, Mus musculus
tcccaggagatgaggaagactgaagagtctctggagtcattcatgtatgcactgggaagagactctggcatcatctatgtatgcactggga

SEQ ID NO: 91058 - DNA, 66 bp, Mus musculus
acatacacacacacatatatatacacatatatatatatgtgtgtatatatatgtgtgtgtgtatgt

SEQ ID NO: 91059 - DNA, 73 bp, Mus musculus
gggggtactttgtgcaagtgacaatgtcattgaagaaagtatgtgacagtgcagacagggcagaggttccttc

SEQ ID NO: 91060 - DNA, 119 bp, Mus musculus
gagttgaaaagccatctgagatccattaaagctgaaaatgaggccagaagatagtgagcagtggtttaactacttggcttggtctgttatttttcaatttatatggacattagtatctc

SEQ ID NO: 91061 - DNA, 72 bp, Mus musculus
ttccccaaggtcaggagctggagaggaaagcacggtgaactgtctctcaagctcactgtcattcttgtagag

SEQ ID NO: 91062 - DNA, 61 bp, Mus musculus
ctgtgtgtctgtgtgtgtcatatatatttgagtacaagcttgtgtggcagtcagggaacag

SEQ ID NO: 91063 - DNA, 85 bp, Mus musculus; identical to SEQ ID NO: 57439

SEQ ID NO: 91064 - DNA, 61 bp, Mus musculus
gaactcgtgtgcatgtatgtatgtatgtatgtatgtatgtatgtatgtgcactacatgttc

SEQ ID NO: 91065 - DNA, 58 bp, Mus musculus
catagtagcatggagagcaatggaaggctctattgctttctctctccatctctctgtg

SEQ ID NO: 91066 - DNA, 85 bp, Mus musculus; identical to SEQ ID NO: 57470

SEQ ID NO: 91067 - DNA, 115 bp, Mus musculus
gctaaacctccccagccaggcctttaccgctccctgctcactctaagtctcactctatgatctccccctacagggaagccaccccaagtcctgacactggaggacttcagtgtgc

SEQ ID NO: 91068 - DNA, 81 bp, Mus musculus
cctgacttgtcagccctgtccgcctggattcatctgcccccaaggtgagtgtcaggagagactgggcaaagacaggtgagg

SEQ ID NO: 91069 - DNA, 75 bp, Mus musculus
gcagattttgcagctataggcaggtatcatttgcctttgtgcctgtgtgcctctctgtgtgatgctggccagatc

SEQ ID NO: 91070 - DNA, 87 bp, Mus musculus
ttgcagcttgatgtctttcaggatgtagattgaatagtgatgagtaaattaaattccctatctaggaatggaaggatggagatgcag

SEQ ID NO: 91071 - DNA, 77 bp, Mus musculus
gctcctgggtcaagtcacagagcagagtcagcatcccagaaactgttacctgcccccatctttaactccccagaggc

SEQ ID NO: 91072 - DNA, 79 bp, Mus musculus
ggtttgtggcaatactggagggtcatcctcactcaatgaagatagagtcctccattgtaggggctttgccagaaatgcc

SEQ ID NO: 91073 - DNA, 78 bp, Mus musculus
tgagaaagactagtgaaaacagcctagaggcaaagaaaatttacatttttgttttgaaagctttcacagttggtgtca

SEQ ID NO: 91074 - DNA, 101 bp, Mus musculus
gcagatgtgtaacttggtctttatcctgttgctttaacagttggagtgggaggctgtctctgactctgttgcctgcatttggacccccctccccatagctg

SEQ ID NO: 91075 - DNA, 91 bp, Mus musculus
tgatgattaaccttgacagactctctgtgcctgagcctcctcaggctgaagccaggccattgtaaggagtaagccaagtgttaatacatga

SEQ ID NO: 91076 - DNA, 99 bp, Mus musculus
gtctgtctgcctgcttgtctgtcttgtctgtctgtctctgttatatggaagaaatgatatttagataagaaattgagattgaataagtggtaattaggc

SEQ ID NO: 91077 - DNA, 82 bp, Mus musculus
cctctacttagatgattttttttctagaatttatgacatgaggtcttgaaaacaaggaaagaaagctgtcagaggcttgagg

SEQ ID NO: 91078 - DNA, 105 bp, Mus musculus
atatatatatatatatacacacacatatacttatgtatgtatgtatatatatgtatgtacgtatgtgtgtacgtatgtgtgtgtgtatatgtgtgtgtgtgtgtg

SEQ ID NO: 91079 - DNA, 104 bp, Mus musculus
ttgtcatttagacttgaagttttaggaaaacacagccagttttcttcacattaaaagtcggaaaagcatgtggtatctttgttaggacttattctaaataacag

SEQ ID NO: 91080 - DNA, 86 bp, Mus musculus
gcaaactcatactgtgtgaagtcagtgaggagaagctggggttgttgcctctgcttgccaccctgacagtgcactactataaatgc

SEQ ID NO: 91081 - DNA, 81 bp, Mus musculus
ggtcacaggctggagagttggctcagaggctaagagcactggctgctcttccagaggtcctgagttcaattcccaacaacc

SEQ ID NO: 91082 - DNA, 92 bp, Mus musculus
agccaactaaaaggggtggggggctaggaaggtagttcactggttaagagcacagactgatcttccagaggacccagcaactacatgtggct

SEQ ID NO: 91083 - DNA, 86 bp, Mus musculus
tctgcgagttcttcatctagacctgtaagcagcaaggaggagactgtctctcacactgacagacctagagcatagacgaccccaga

SEQ ID NO: 91084 - DNA, 88 bp, Mus musculus
ggcgttgctctgggctttggtaggaacacgtgagaatccttgagcaggcatgtctgtgaactcatgtgtcagactgacagacatcacc

SEQ ID NO: 91085 - DNA, 106 bp, Mus musculus
gctggtgctttttctctgtcagagtgagccatgtgtgtcagtctgtgactagagcactagttttctggtatccccacaggctttcagctcatttcttgtctctggc

SEQ ID NO: 91086 - DNA, 70 bp, Mus musculus
tttgagccatagagcatgcaaacagaattttgggtggaggaacacctctctctgtgactctgggctggaa

SEQ ID NO: 91087 - DNA, 85 bp, Mus musculus; identical to SEQ ID NO: 57439

SEQ ID NO: 91088 - DNA, 62 bp, Mus musculus
gccagacagtagagggtgcatgtgagctgtgctaacaaactgacactctccttctctctggt

SEQ ID NO: 91089 - DNA, 85 bp, Mus musculus; identical to SEQ ID NO: 57470

SEQ ID NO: 91090 - DNA, 73 bp, Mus musculus
atatgtattatgtatctatgcatgtacatatgtgtatgtatatatctatgtgtataggtatatatgtatgtat

SEQ ID NO: 91091 - DNA, 104 bp, Mus musculus
ccttctacttaatttgtccgatttctctttggttatgttcctttagatgtctgaatgttctctaaggaggacataaagagggtacatccagatgtgaggggagg

SEQ ID NO: 91092 - DNA, 171 bp, Mus musculus
gttctttatatatatgtgtatatatatatatgtatatatatatatacacatatatatatacatatatatacacacacatatatatatatacgtatatatgtgtatatatatacacatatatacgtgtgtatatatatatacatacatacatatatatatatatatatatat

SEQ ID NO: 91093 - DNA, 68 bp, Mus musculus
tatatgcatttatgtatgtatgtatgtatacatgtatatatgtatgtatacatacatatttgtaagta

SEQ ID NO: 91094 - DNA, 58 bp, Mus musculus
ataagtgtgtgtgcatgtgcatgtgtacacacacacacacacacacacaaacacttat

SEQ ID NO: 91095 - DNA, 76 bp, Mus musculus
ttcctgtgtctctgtgtgtgtgtgcatgtatgcatgttcatgcacacatatgcatatgtatagatatgtgcaggaa

SEQ ID NO: 91096 - DNA, 85 bp, Mus musculus; identical to SEQ ID NO: 57439

SEQ ID NO: 91097 - DNA, 94 bp, Mus musculus
tgtatgtatataaatgagatcatattatgttctacatataatatatatgcatatgagatcacattatgctctacatatactgtatatacatata

SEQ ID NO: 91098 - DNA, 99 bp, Mus musculus
tcagtgaagtctgtggccttgcagattttctagttctgatcaagtttcaagttttggactggagagtacagagaaaacatttgcaatgctgaagggatt

SEQ ID NO: 91099 - DNA, 109 bp, Mus musculus
ctatgagctgactacaggtatggctccctctctactctgtgggtctgtgtctatggctgctttgtagatgggtccttggggaaagagcaggagtgcctgggtgctgtgg

SEQ ID NO: 91100 - DNA, 71 bp, Mus musculus
ggtgtggctatgaaaatcagtgtggctgttcttcccaggggaatagatctgcatcaagttccagccctacc

SEQ ID NO: 91101 - DNA, 69 bp, Mus musculus
tggacacactggggctttcatgaacaaagctgctgagagagtgaacagtgtgttcaacatagcgccagt

SEQ ID NO: 91102 - DNA, 98 bp, Mus musculus
cgtactttcagcctccaaaactgtattctaaaaatgtctgttgtataaaattcccagtctcaggtattttgttagagcaatggggggtgagggggatg

SEQ ID NO: 91103 - DNA, 102 bp, Mus musculus
ctttggctgtatgtgtggaacagcttgggagtctgatttctgctttcaacgtgtgttctagggattgaagttaggagcccaaatggcggacagaacctagag

SEQ ID NO: 91104 - DNA, 79 bp, Mus musculus
tgtgtgtgtgtgtgtgtgtgtgtgcatgtgggagcaggttatgcgcagctcacagcatgcatgtgaaagcgggaagaca

SEQ ID NO: 91105 - DNA, 75 bp, Mus musculus
catataaagtcatgctctctctctctcagatagacagacagacagacagacagaagagagcctatggctgctatg

SEQ ID NO: 91106 - DNA, 58 bp, Mus musculus
tctgtcaccctgtcaccctgtcacctgctattaggtggggtgagaggatgtgaccaga

SEQ ID NO: 91107 - DNA, 76 bp, Mus musculus
agacgctttaggaaagccccaggctttgagaagagattaggttttctgctttcagagtctttttctctgtgtgtct

SEQ ID NO: 91108 - DNA, 90 bp, Mus musculus
ctggggtctgtgtctatgtctgtgtctatgtctgtggcttgagttaccaccaaaggccaagaggatgtctacagtctgggctgccaccag

SEQ ID NO: 91109 - DNA, 121 bp, Mus musculus
gggagagtctgggaacagggttaacgtggtggccatgacaccaatcacagtccctctctctcagcccagctctggcctcatccatagagggggagttgagatgctgggtagaggatttgtg

SEQ ID NO: 91110 - DNA, 65 bp, Mus musculus
gtgtatctgtgtctgtgtctgtgtgtgcacgcctgtggaggccagaggacagtctcaggtgtcat

SEQ ID NO: 91111 - DNA, 73 bp, Mus musculus
gtggagtgtatatatacatatgtgtatatatgtatattgtatatgtatgtgcatatgtatgtatatgatctat

SEQ ID NO: 91112 - DNA, 72 bp, Mus musculus
gctggtccaggcaccctcactcttacactgcacgtgcctcacaggccctgaagaagaggggcctgagacagc

SEQ ID NO: 91113 - DNA, 85 bp, Mus musculus
ggcagtccctgtctcactctttgccaccaggctccaaagttcccaactgaaggtgcttaggtgaagaatgaccccaggtatggcc

SEQ ID NO: 91114 - DNA, 71 bp, Mus musculus
gtacatgagttatgtgtgtgcacatgtgtgtgcaagtgtatgtgcatttgcatgcatatgtattcatgtgc

SEQ ID NO: 91115 - DNA, 89 bp, Mus musculus
gcatgcatgtgtattcatgtgcttatgtacatgtgcatgttatgtgtgtgtgtgcatgtgtatgtgcatatgtgtgtgcatgtgcatgc

SEQ ID NO: 91116 - DNA, 133 bp, Mus musculus
tgtgtgtgcatgttcatgcatgtgcatttatgtgcttgtgtgcatgtgcataagttatgtgtgtgtgcatgtgcatgcatgtgcattcatgtgctggtgtacacgtgcatgagctgtgtgtgtatacatgtgt

SEQ ID NO: 91117 - DNA, 63 bp, Mus musculus
tactggagtagatttctgggtcctatgagatctctctctctctctcagcctctctctctagta

SEQ ID NO: 91118 - DNA, 64 bp, Mus musculus
gagagagagagagagagagagagagagagagactgtctgtctgtgtctgtctgtctgtctgtct

SEQ ID NO: 91119 - DNA, 103 bp, Mus musculus
actgctggaccacagtggtcagaatcacagcttcggtctccaggagacagtcccacactcagttgcagacacagcccctccccctgtccctcagtctcccagt

SEQ ID NO: 91120 - DNA, 112 bp, Mus musculus
gtgtgtgtgtgtgtgtgtgcatgtaagagtgcacatgcatgtgtatgtgcatgtgtgtatgaatgtgtgcatgtgcatgtataagtgtatgtatacgtgtgtgcatgtgtgt

SEQ ID NO: 91121 - DNA, 73 bp, Mus musculus
tcacagggacacagagacactgagacagtggagcacctgacagttgcttctaatctcttgtttgttttctgga

SEQ ID NO: 91122 - DNA, 74 bp, Mus musculus
agcagggagtgaggcagaaatcggggctctgaagagaatcttcagaggctcacactgtgccacttctaccagct

SEQ ID NO: 91123 - DNA, 56 bp, Mus musculus
tacacacatgtatatatgtgtacatgtatatatatatatacatctgtatgtgtgta

SEQ ID NO: 91124 - DNA, 122 bp, Mus musculus
atatgcattatacatatatatgtatatatgcatgtcctttcatatatatgtatatgtgtatatatatatgtatgtatacacatacatatatatatacacacacacacacatatatatttgaa

SEQ ID NO: 91125 - DNA, 96 bp, Mus musculus
gtcaagagtccccaaggctctgtcctgtctgtgtcaggctggcccctctggctctgtgacagggaaagacaaggcagtgtggcattctcagcagag

SEQ ID NO: 91126 - DNA, 77 bp, Mus musculus
tgaaaaccatcagggggcctggtgagatagctcagcggttaagagcactgactgctcttccagtggtcccgagttca

SEQ ID NO: 91127 - DNA, 68 bp, Mus musculus
ctgagatagtcagtggctcactggagggcacagcccagagaccacataaagccactattgttagtcag

SEQ ID NO: 91128 - DNA, 82 bp, Mus musculus
agggtgcccagtccccagagctgtgactgatcttgtttgttttaaatgagacagggtcccactctgtcgctctggctatctt

SEQ ID NO: 91129 - DNA, 111 bp, Mus musculus
gttttgtggtacctgattgtaaacctagtagatatttgggttgaaaacatgccaaacaggatttttttttttaaatccaggtaatatttgattgctttcttactaattaac

SEQ ID NO: 91130 - DNA, 109 bp, Mus musculus
tgcctgcagtgcttagtgatgggatagatacttctgagatgcatattgtcaactcagtttgttattgtgtgaacatcggtgtacttcaccagctaagagagctacagca

SEQ ID NO: 91131 - DNA, 95 bp, Mus musculus
ggcaagtcagaagcagtcgactcacagctgggtgcagatgtgtgaccctctcactgataacagctgtgaaaaagctgcccagcctgacggatacc

SEQ ID NO: 91132 - DNA, 89 bp, Mus musculus
catacatgtgttgtgttgtatacatgtgtgtatatatgtatttgtgtataatgagtgtgtacacatgtgtgtgcgtgcacatatgtatg

SEQ ID NO: 91133 - DNA, 85 bp, Mus musculus; identical to SEQ ID NO: 91034

SEQ ID NO: 91134 - DNA, 116 bp, Mus musculus
atggaatgaaaagctgttggtgagctggagagatggctcagcgattaagagcactgactgctcttccagaggtcctgagtttaattcctagcaaccacatggtggctcacaaccat

SEQ ID NO: 91135 - DNA, 83 bp, Mus musculus; identical to SEQ ID NO: 91037

SEQ ID NO: 91136 - DNA, 98 bp, Mus musculus; identical to SEQ ID NO: 91039

SEQ ID NO: 91137 - DNA, 113 bp, Mus musculus
tcttggtctcctcactgaatgtgctgcaagagttttcctagtctcctgattttgttgaggtaccttctgcatcacactgggaagataataagaaagcatgatcctgaaaaaga

SEQ ID NO: 91138 - DNA, 83 bp, Mus musculus
tgtctctctgtgtgcctgtgtatctgtgtgtgtgtatatatatatattatatatattacatatattacacatatggagaggca

SEQ ID NO: 91139 - DNA, 66 bp, Mus musculus
gtatatatacatatgtatatatgtatatgtgtgtatatatgtacatatatatgtgtgtatatatat

SEQ ID NO: 91140 - DNA, 119 bp, Mus musculus
gccatgtgcattgtcagtggtctatacaccccccaccccccaccccgagagagacagacagacagacacgggggtgggggtgggggcggggtggagactgttgtaagcaagtgctgcat

SEQ ID NO: 91141 - DNA, 60 bp, Mus musculus; identical to SEQ ID NO: 91043

SEQ ID NO: 91142 - DNA, 63 bp, Mus musculus
ctggggtgtctctgtctctgcctccccaatgctggggttgtaagtatgcatcaccacgcccag

SEQ ID NO: 91143 - DNA, 82 bp, Mus musculus
ccaactggtgggtgaattgcatgggaagaaatcagccaggtagctgatcggcccactgtctatctctgtcacccagagttgg

SEQ ID NO: 91144 - DNA, 136 bp, Mus musculus
tacaggtctctgtgaaacaatatatgtatatgtatgtgtatgtgcatgtgtatatgtgtgtatatacaggtctctgtgaaacattatatgtatatgtatatgtgtgtacatatgtgtgtatatgtgtgtgtagtgt

SEQ ID NO: 91145 - DNA, 115 bp, Mus musculus
catagagactacctataggtttatgtccagcatatgcatgtacatgtgtgtactcctgtgtctctgtgtatttctctgtgtgtgtctctgtgtatgtatatgtgtgtgtatgtgt

SEQ ID NO: 91146 - DNA, 81 bp, Mus musculus
gtttcacagatctgagtgtgatgagtgtctgcacagggcttggcactgatcagaaacaaaaggcttggaaaaaagtgggac

SEQ ID NO: 91147 - DNA, 114 bp, Mus musculus
atagtatcattctgatatatatatgtatgtatgtatatgtatatatacgtatgtatatatatgtatatgtatatatgtatatgcatatatgtatatatttatgaagatatctat

SEQ ID NO: 91148 - DNA, 114 bp, Mus musculus; identical to SEQ ID NO: 91052

SEQ ID NO: 91149 - DNA, 62 bp, Mus musculus
tatgcgtatatgtatatgatgtatacatgtatatgatgtatgtgtatatatatgtatgcatg

SEQ ID NO: 91150 - DNA, 111 bp, Mus musculus
aggcgaaaacaaaggcagtgtgaggttctgacaggaatgcttcaggctgaggctctcactgtgaggcttcttgtcaagctttgtgttcagagaagactgtctgccatccct

SEQ ID NO: 91151 - DNA, 85 bp, Mus musculus; identical to SEQ ID NO: 57439

SEQ ID NO: 91152 - DNA, 83 bp, Mus musculus
agattctctatgtgtgtgtgtagtgtgtgtgtgtgttttctcacatgtccatgcatgtatgtttatgtatatatgtgagttct

SEQ ID NO: 91153 - DNA, 96 bp, Mus musculus
tttccacaggccctatacaagtttatatttttatcagcagtcagcagaatccctcacttctggtggaagtgtaaacctgtgtagggcctgtggaaa

SEQ ID NO: 91154 - DNA, 95 bp, Mus musculus
tatgtatgtatgcatgtatatatgtatatgtatgtacagatgtatatgtatatatagatgtatataatgtgtgtatatatgtgtgtgtgtgtgtg

SEQ ID NO: 91155 - DNA, 89 bp, Mus musculus
ttggtagtgctctgtagtgaatcatgagtagcctctgaggagccacatccttgaaagagactgactcttcctctctcagcaattatcaa

SEQ ID NO: 91156 - DNA, 78 bp, Mus musculus
gtgtacctcagtgatagtcctcttactgcctgcaacatcttttttttttaaaggtaaaagtggattagatgagtatat

SEQ ID NO: 91157 - DNA, 82 bp, Mus musculus
tgtgtgtgtatatgtatgtgtgtatatatgtgtgtgcatgtgtgtgtatatatgtatgtgtgtatgtgtgtatgtatgtgta

SEQ ID NO: 91158 - DNA, 116 bp, Mus musculus
ttggaggtgggtttacatgcgtgcatgtgtgtgcatgcacgtgtgcctgtgcctgtgtgtgtgtgcatgtgcatgtgcctgtgcgtgtgtgtgtatgtgtagtactgtgctctcaa

SEQ ID NO: 91159 - DNA, 86 bp, Mus musculus
ctggtgagtgaacaaagagaggtctgggaattgctctcctgcagacctctggggagaactgctggtcccctaggagggcacaggtc

SEQ ID NO: 91160 - DNA, 173 bp, Mus musculus
tatataagtatgtgtgtgtgtatgtgaatatgtgtgtatgtatgtatgtatgtatgtgtgcatgtgtgtgtatatgtgcacgtatgtgtgtatgtatgtgtgcatgtgtatgtgtatatgtgcatgtatgtgtgtgtatgtatatgtgcacatacatgtgtgtatgtatgtgt

SEQ ID NO: 91161 - DNA, 80 bp, Mus musculus
gccaagggagcaggctcttaccacagctgtcctggcctcagagacaggagagtctgagcagtgagtgaacaaggctctct

SEQ ID NO: 91162 - DNA, 69 bp, Mus musculus
gctgctgcctcttgcttcttggggctcagtctacctctctgcctgtgtctcagaggaagaggaaggggt

SEQ ID NO: 91163 - DNA, 142 bp, Mus musculus
atacatataatacatacatatatacacatacatatatacatatatacacacacatatatgtgtgtatatatatatatatacgtatatgtatgtgtatatatatgtgtgtgtatgtatgtatgtgtgtatatatgtgtgtgta

SEQ ID NO: 91164 - DNA, 70 bp, Mus musculus
atacatatacgtatatatatatatatacacacatatatgtgtgtgtatatatgtatatatgtatgtgtat

SEQ ID NO: 91165 - DNA, 129 bp, Mus musculus
atatatgtatatgtatgtgtgtatatatgtgtatatatgtgaaatcatttatatacatatatatatatatatatgtatatatatatatatatatatacatacatacacacacatatatagttgaagtca

SEQ ID NO: 91166 - DNA, 92 bp, Mus musculus
tcctgttcttaagttccacttctcttattcacgtgtttacagcttcctgtgttggaaggctgactggagtgagtgtcatctgggagcaaggg

SEQ ID NO: 91167 - DNA, 91 bp, Mus musculus
atatatatacatatacatatatatgtatatgtgtgtgtatatatatatgtataacatacacacacacatatatatgtatatgtatgtgtgt

SEQ ID NO: 91168 - DNA, 60 bp, Mus musculus
ggtggtcgttctcaatctgtgtgtcacagtccccacaggggtcacatatcagatatcacc

SEQ ID NO: 91169 - DNA, 114 bp, Mus musculus
tggttccaatggttatggcaacccttaggacttaggagtttgccaagagcagcgcagaggtagaagtttggattgaatacaaggggaaaagtagctaagccgtgaaacatacca

SEQ ID NO: 91170 - DNA, 92 bp, Mus musculus
gaacagaaaaagctgatgtgggcagagtagggctggtgaattggcctctgtggttctctctctatttgtctgtctgtctctgactctgtctc

SEQ ID NO: 91171 - DNA, 97 bp, Mus musculus
gggttggcaatctagcctttctctacaccttatagccctcaagttccctaaatgttaaaggactgtatagaagaaagtgctcaggtctcttattctc

SEQ ID NO: 91172 - DNA, 71 bp, Mus musculus
gcactaagggggagggttggatgaagacttcccatttaggacggagtatgtcactgtctctctcactctgc

SEQ ID NO: 91173 - DNA, 100 bp, Mus musculus
gtatatatgtatgtgtatgtgtgtatctatatatatgtgtgtgtgtgtatgtatgtgtatacgcatatatatgtatatgtatacatatacattgatatat

SEQ ID NO: 91174 - DNA, 107 bp, Mus musculus
gggtttgatgtgagttcacccaggaatgttatttttttgctatagattagagattttttttttgaacactccatagcagtggacatgtgagccaggcacacatttct

SEQ ID NO: 91175 - DNA, 60 bp, Mus musculus
cctacgtttgttgatttctatggtctctgaagaactcagagacctgagagtccagaaagg

SEQ ID NO: 91176 - DNA, 72 bp, Mus musculus
acaaggctgacggtgagtgaagacttagtcaggagctcttgccttctcagtcagtctcactgcggaaaaggt

SEQ ID NO: 91177 - DNA, 72 bp, Mus musculus
gaaggaggtgtgtcactgaggtgggctttggggttttaaaagcccatgtcaggcccagtctcactctctgtc

SEQ ID NO: 91178 - DNA, 108 bp, Mus musculus
ctaggttagcagacggagacagaaagcctcagagatgacagttagctcaggagaataagttactttcacaggcattgtgctgctgtctcagtcgtcaatctgacttag

SEQ ID NO: 91179 - DNA, 78 bp, Mus musculus
actctcattcatatatatatatacatatatatatatatatatatatgtgtgtgtgtgtatatatatatgtgtgtgtgt

SEQ ID NO: 91180 - DNA, 112 bp, Mus musculus
gaatggcctatgtgcaggcttatatgggctctcctgtgagtcaagcagcatgccttgtgtgtcagattcactcactgagttttgctcctcgaagccgggggcagaggctttc

SEQ ID NO: 91181 - DNA, 75 bp, Mus musculus
gtatatgcatatacatatgtatgtgtatatatatatatgcatatacatatgtgtatatatatatgcatatatgta

SEQ ID NO: 91182 - DNA, 75 bp, Mus musculus
acatatatgaagtatattatatgtaatgtatgtatatatatatatatatctatatatacagatacacatatatgt

SEQ ID NO: 91183 - DNA, 69 bp, Mus musculus
gtctgtctgtctgtctgtctctgtgtgtgagtgccatgtgtgaggaaatgacagaaaagagcgccagac

SEQ ID NO: 91184 - DNA, 64 bp, Mus musculus
gagtgtgcccacgtgtatttttctatatgtatgtatgtatgtatgtatgcatgtgagtatgctt

SEQ ID NO: 91185 - DNA, 124 bp, Mus musculus
tgtggcttctctgtgtgctagtggatgggagagtgcttggtgcgaattcacggagcgagacagaagtcacagtgcaaactgagaagtgtgggcccatacacactgggtttgccgtgtggccttg

SEQ ID NO: 91186 - DNA, 82 bp, Mus musculus
agagacaagaaccaaagcaataagggtgagaccacactgtggccaagactgcttagttctgtctctgtcttatctttggttt

SEQ ID NO: 91187 - DNA, 101 bp, Mus musculus
gacatgcatgaaataaagtgggttctggttctaatgatgtgtgtgtgtgtgtccgtccgtccatgtccatccttgaactcactgtacagcccatgctggtc

SEQ ID NO: 91188 - DNA, 105 bp, Mus musculus
cctgagggaaactgattttacctaattttatgaattccttgtaaatttttctattttgaagcattttgaggcttatttcgttaactggtttaataaacttttagg

SEQ ID NO: 91189 - DNA, 103 bp, Mus musculus
ccctgtaattctttcagacaggaacaattatgggtcagagaagtgactgtggaatggcaaccccatacctcacttgatgtcctgtcttcctgctggaggtggg

SEQ ID NO: 91190 - DNA, 95 bp, Mus musculus
attggcacaattttcaggagggatgagggccaacaggagcagcaggaaaagttctcagctgtgtctctctcagcgaagtgaagatcagtgaagat

SEQ ID NO: 91191 - DNA, 73 bp, Mus musculus
ctaatcctggactgatgagacacagtgctcacatctgttaatgtgagaacataatgtgctcacagttgattgg

SEQ ID NO: 91192 - DNA, 107 bp, Mus musculus
ggtttacttcgagtggcaggatatctgatccttgattgaaaagggaaatttgcaaagtatagaattatcctcctccagtctgatctactaaactgctcaattcagcc

SEQ ID NO: 91193 - DNA, 98 bp, Mus musculus
tgacaaggaaatctctgagtctctctgagccctgctcacaactgtctgtgtgtacagcacctgttcctgggcttctgaggatgctgtggtcccttgca

SEQ ID NO: 91194 - DNA, 85 bp, Mus musculus; identical to SEQ ID NO: 57470

SEQ ID NO: 91195 - DNA, 120 bp, Mus musculus
ttcttttcctttctactgagcctgtgtgactatggaattctggtctcagctgttcaaacctgatagaacaatgagtgctctgaaaacgtatagagaacatttagctttagatggtggaaa

SEQ ID NO: 91196 - DNA, 90 bp, Mus musculus
tatatacatacacacacatgtctaaatatatactcatgttactgaagtttgtttatgggatatatatgtatgtatgtatgtttgtatata

SEQ ID NO: 91197 - DNA, 71 bp, Mus musculus
agcaggaggaaccttcacctgcagactgttctcttttgagacactctcacagtgtcggcttccaccttgct

SEQ ID NO: 91198 - DNA, 119 bp, Mus musculus
agagagagagagtgacaagaactgagctcttccgtgacatcactagtcactagtcagtgtggacacacttgccttaggacttgcggataagctaagttgatttgggttttctgttactt

SEQ ID NO: 91199 - DNA, 82 bp, Mus musculus
gtgtgtgtgtgtgcatgtgggtgcgtgtgcatgtatatgagtgtgtgtgtgtgtgtgtgtatctgtgtgcatgtgcatgtat

SEQ ID NO: 91200 - DNA, 71 bp, Mus musculus
agtcccacaagacggctgaagtctaggtattcagtgcctctgactgactggctggaaatccttgtggtcct

SEQ ID NO: 91201 - DNA, 85 bp, Mus musculus
tgtgtgtgggtaactaactgcatgtatgtatgtatgtatgtgtgtgtgtatgtatatcatatgtatgcttgatgcccaggaagca

SEQ ID NO: 91202 - DNA, 104 bp, Mus musculus
tatatgtatacatatatatgtgtgtgtgtgtttgtatattaaatgtatatgtatatgtatatgatgtatatttatatgtatatgtatagtatgtgtacgtgtac

SEQ ID NO: 91203 - DNA, 105 bp, Mus musculus
ctgaaaatttgagttcgaaaatacgatttcttgggctggagagatagctcagcgtttaagagcactgactgctcctccagaggtcctgaagaattcaatgcccag

SEQ ID NO: 91204 - DNA, 115 bp, Mus musculus
ctctatcaggaagaagagctggaaagaatgcaagagccaggagatagagatgttgtattgtgactttctctctctgggtataacatggctaccctaccactttcttggagtagag

SEQ ID NO: 91205 - DNA, 90 bp, Mus musculus
ttacttgaacagtgccatgaatctttctacatattggtgtatacttttattttgttagaaggaatttctaggtttgaagctgtttggtaa

SEQ ID NO: 91206 - DNA, 77 bp, Mus musculus
gtgctttgcctgcctgcctgcctgcctgtctgaataccatatatgcatgtctggtgcaggttgtcaaaagagggcac

SEQ ID NO: 91207 - DNA, 110 bp, Mus musculus
tctgcataaaaagtctgaggctcgattcgaaaattacactcagattccacacgacctctcctgtgtgtgtctgtttgtcattcatccatgctttgcccacccctgtcaga

SEQ ID NO: 91208 - DNA, 79 bp, Mus musculus
gtcccacccagtttttaggcttctctctgtgagttcagactgagcaccgctcacagggagaacaagtggaacatgggac

SEQ ID NO: 91209 - DNA, 91 bp, Mus musculus
ctccttttgacagcagtctttgctaagagccagtagttagctgtttgctaaattatcactactggaggagctagagaaagtacccaaggag

SEQ ID NO: 91210 - DNA, 116 bp, Mus musculus
taggctcctgcgctgaatttctttgatagtgagcagacatggaagtataagcaaaataaacaactttcttcttaaactgcttttgctcgtgtttcattacagcaatagagacccta

SEQ ID NO: 91211 - DNA, 96 bp, Mus musculus
ggagtctgaagtggaagtcctgtactgagaacagcagagaaacgagtcagaagaggcctccattcttagttcttacagagctaccctgcaagctct

SEQ ID NO: 91212 - DNA, 56 bp, Mus musculus
tgtatatgtacatgtacatgtgcacgtgcatgtgcatgtgtatacacacatataga

SEQ ID NO: 91213 - DNA, 113 bp, Mus musculus
tggagaatgcaaccaagcttccttcctttcttctccagaacttgccattctgaatctctgtcactgttaaacaagagtctgggtcatcggaatctttctggttgccctttcca

SEQ ID NO: 91214 - DNA, 106 bp, Mus musculus
tcatgttaaaactctaggtgtctctctgtgtatgtatgtatgtatgtatgtatgtatgtatgtatgtatgtatctgtaagatttacagttagaggtttccatatga

SEQ ID NO: 91215 - DNA, 81 bp, Mus musculus
gtctctctccctctcagggcttctcctcagcttatggtccccaggggaaaatgatgctgactgagcctggaaggagacaga

SEQ ID NO: 91216 - DNA, 96 bp, Mus musculus
ggcctaggtcagacccagattgccacttcagtctctgtgagcccctttgaacctgggttagtgaattgtgtggggatttttgtgatgtccttgacc

SEQ ID NO: 91217 - DNA, 74 bp, Mus musculus
atgtacgtatgtatgcatgtatgtgtacatatgtgcttgtgtgtgtatgcatatgtgtgcatgcatatgtgtat

SEQ ID NO: 91218 - DNA, 118 bp, Mus musculus
aggaataatggtgctattgcccaggagtctggcacagtggtttttctatgactcctctctctgttactctgactgatagccgctctgagctatctcctggtgagcagctactgcccct

SEQ ID NO: 91219 - DNA, 74 bp, Mus musculus
gggggtggggtggggtgggtgggtgggtgggtgggtgggtggatttggcctgcagccttgactctgtccctgtc

SEQ ID NO: 91220 - DNA, 155 bp, Mus musculus
attagcctccggactttgttatacagtattctccagtacattatatctcagtgattttgtagacagagaacagggaaagtatgtggggtggggtggagtgtatctgtgtgttgatgtatatacatgtttctgtctctctgtgtgtgtctgtgtct

SEQ ID NO: 91221 - DNA, 75 bp, Mus musculus
gactgcctgtatctggagcaggtgggagggtcttgtgatttgtcactctgtctctgtctgtctctctctgtggtc

SEQ ID NO: 91222 - DNA, 110 bp, Mus musculus
ttttatttcccagtgttgcagtaaagataaagcaaatgaggactgttctgtcgctgtctgtgtgcagataaataggactctgtcaaagctgtgatagctgttgggtggag

SEQ ID NO: 91223 - DNA, 99 bp, Mus musculus
gtatgtgtatgggtgtatatatatgtttgtatatgtatatgcatgtttatgtgtatgcatttgcatgtatttatgtatgtgtgtgcaatgtgtgtgtgc

SEQ ID NO: 91224 - DNA, 95 bp, Mus musculus
acagtgtcagtagaaacctgatcttgtatatatatattttctctccttgagacatggccttgatatataacctggattgggctggatggttttgt

SEQ ID NO: 91225 - DNA, 85 bp, Mus musculus; identical to SEQ ID NO: 57470

SEQ ID NO: 91226 - DNA, 72 bp, Mus musculus
gaaagacactgtagagagaagctgttgtccagggtggccagaaccacaggaatttgcttttctacgtcttcc

SEQ ID NO: 91227 - DNA, 147 bp, Mus musculus
tgtgtgtgtatatgtgtatctgtgcatgtttatgttcatatgtgcatatatatgcatctatatgtatatatgtatacatatatgtttattcacacacacacaatataatatatatatataatattgtgtgtgtgtgtatttatatat

SEQ ID NO: 91228 - DNA, 70 bp, Mus musculus
acattcatttagtgtgtgcatttgcacactagcaatgctgcagtgtgtgtgtgtgtgtgtgtgtgtgtgt

SEQ ID NO: 91229 - DNA, 108 bp, Mus musculus
atatttatatgtacatatacatgtatgtatacatatatttgtatatacatgtatattcacacatgaatatatgaatatatatatatatatatatatatatatatatat

SEQ ID NO: 91230 - DNA, 111 bp, Mus musculus
tatagcgaatcgccaggggacactgcgaaatgtcttattacagagaagaaggtagttttgtttactgtctaggatgataaagataatgtatcccactggggcaaaaatgta

SEQ ID NO: 91231 - DNA, 72 bp, Mus musculus
tggaggtgtagacagagggcatcccatctgagggtagtagtatcctcctctgtcactctctgcttatcttca

SEQ ID NO: 91232 - DNA, 113 bp, Mus musculus
ccagtcagcattggtactcattgattggttaggcagaacaagcagagctatgtctctctcagtatctaagatccacttgttccctgaccatctatgtttaccagtcgaagggc

SEQ ID NO: 91233 - DNA, 83 bp, Mus musculus
gggaaccgttgtaggtggcaacgatgtagaaggcaagatctggggtgtagcaaccagcctgtgtccctgtgactctggtttcc

SEQ ID NO: 91234 - DNA, 104 bp, Mus musculus
taccatataggtcctttgtgtatgtgtatgtatatatatatgtgtgtgtgtatatacatacatatatatgcatatatatgtgtatgtgtgtatacatatataca

SEQ ID NO: 91235 - DNA, 80 bp, Mus musculus
gctccaggggtggggaagcacagtctgggggagtctcaggctcttgggaagatctgagaacagagtgtgggcccgctggc

SEQ ID NO: 91236 - DNA, 95 bp, Mus musculus
gttgttatattaccttgtgaatgtatgtatgtatatatacatacatacatacatacatacatacatacatacatatatttcaaagtataacctgc

SEQ ID NO: 91237 - DNA, 62 bp, Mus musculus
agggtgacaacaggttggtgtcctctatcctggagaaggacacctctctcactgtcagccct

SEQ ID NO: 91238 - DNA, 99 bp, Mus musculus
ttgccttttaattttaacttcatctctgtctctgtcagccatatatcagatttatgcttctgccaattgttacaggcactgagatgtatagataagcag

SEQ ID NO: 91239 - DNA, 89 bp, Mus musculus
tggttatgtctgatgttaactgtcctgggtttctcaggccagacctggcctccttggagactgactgactgtcacatgagttatatcta

SEQ ID NO: 91240 - DNA, 69 bp, Mus musculus
gcaatcatacacacccagccatgaaacctgaaagcttcagtagtgactgagctggcaagtgtcgattgc

SEQ ID NO: 91241 - DNA, 80 bp, Mus musculus
agacaaggaaacatgggcagaatcaactaattatttgacgtaaatcataagctgtctctgcctgtcttgtctctctgtct

SEQ ID NO: 91242 - DNA, 74 bp, Mus musculus
gtaagcaacagcaggagcaggggctctccacaaatctgttgcctgcctgcctgcctgcctgcctgcctgcctgc

SEQ ID NO: 91243 - DNA, 111 bp, Mus musculus
gatcaaccttagtccatggtgatctgataggatgcatgggaaaatttcaatatttttgtatctgttgaggcctgttttgtgactaattatatgatcaattttggaggaggt

SEQ ID NO: 91244 - DNA, 103 bp, Mus musculus
tggggagggacaggatggaacgatgagcataaaaatgaatgaaagtctgccactggcagtcttcagaaggttgggggttatctccaggaagtgacagagacca

SEQ ID NO: 91245 - DNA, 91 bp, Mus musculus
ctatacacaaacatatagacaaacagacatatacatgtggatggatggacagatgtatgtatgtatgtatgtatgtatgtatgtatggatg

SEQ ID NO: 91246 - DNA, 80 bp, Mus musculus
ttttgaagattcagttctctgcctgtcttcagagggatacatcatttctaactctgagatcagtatttgcatctttggag

SEQ ID NO: 91247 - DNA, 106 bp, Mus musculus
ggaaatagtatttctggatatatctattgggactggactttgaaatttttaattttgattagttatagatttctataacagtctcctgttgcagagagatatttcc

SEQ ID NO: 91248 - DNA, 108 bp, Mus musculus
ttctaaatagataagtatgaattttcacagctatagtttgtaaagattaaatgtttacatttatttcaaatttgtagccagaaaattggtgtcatttaaatcttagaa

SEQ ID NO: 91249 - DNA, 85 bp, Mus musculus; identical to SEQ ID NO: 57439

SEQ ID NO: 91250 - DNA, 61 bp, Mus musculus
ctgtgctcatttgtctttctgtgtgggagctcagaagcttcctaaggagcagtgagcacag

SEQ ID NO: 91251 - DNA, 75 bp, Mus musculus
gaggcagcagattttgcattcttgtttatttcaatatcaaagaatattaattatgatgcagacaccagctgcttc

SEQ ID NO: 91252 - DNA, 89 bp, Mus musculus
ggttgcatgtatgagaatgcaaattgatccatatttatcaccttgcagaaagttcaagtccaagtggatcaaggatcttaacataaacc

SEQ ID NO: 91253 - DNA, 62 bp, Mus musculus
gggtggacggccatctgccgcctgaaaagggtgctgcctcagtggctctgtggctcccatct

SEQ ID NO: 91254 - DNA, 80 bp, Mus musculus
gacttatttctagaaaacactgtgtgtgcgtgcgtgcgtgcgtgtgtatacatgtatgttcatgtgtttgaagaaatgtc

SEQ ID NO: 91255 - DNA, 109 bp, Mus musculus
tcatgtatgtgctagtatttgaacccagttgctctcagagaacagtcagtgctctttaccactgagctgtctctctagccctactttttgaatttttagacgtctgtgg

SEQ ID NO: 91256 - DNA, 104 bp, Mus musculus
gttgttcaattgctaagactaggacttcaagtacaaggttgaataggtagggagaaagtggacagccttgtctagtcgctgattttagtaggattgcttccagc

SEQ ID NO: 91257 - DNA, 106 bp, Mus musculus
aaagcagagattgtgggcatcctgcagtgcaaatttcctgaaatatactgaggtgattctagtgaggagatagtgagcagtgggggatataaagacaactggcttt

SEQ ID NO: 91258 - DNA, 90 bp, Mus musculus
gaagaacatcagaactctattcagatgaggtaatgcttatatatatatataagcatttatttcctgaaatcaagaggatgcttggtcttt

SEQ ID NO: 91259 - DNA, 87 bp, Mus musculus
agagtatatactgattttgtagaagacttgagattactttggagtacacacttcagcttgctcacttctgcttgtaactccaactct

SEQ ID NO: 91260 - DNA, 116 bp, Mus musculus
ggagtctggcagggacctgggagtcacctaagccccaagtgtgtgctcactgagtctctgggtctctacctcctctaccttaccatggcatggttttatgacccacagtgaaccat

SEQ ID NO: 91261 - DNA, 94 bp, Mus musculus
tactcatattcatatgcatgcatttacacataatatacatatatttgtatacttgtatgtagtcatgtataaaatagttgcatgtttttgagtg

SEQ ID NO: 91262 - DNA, 86 bp, Mus musculus
gagttaccaagggaattgatctgaatatttttatgtatactaagtatacatactaatagacaattgtagatgaagccttcatgctc

SEQ ID NO: 91263 - DNA, 73 bp, Mus musculus
actagagacacagttctgagtggtactggttagtccataagcccataccaggctcagtctctgtgcctgtggt

SEQ ID NO: 91264 - DNA, 68 bp, Mus musculus
gtgtgtgtgtgtgaatgtatacatacatatgtttatatctatatgaatacataagcacacacacacac

SEQ ID NO: 91265 - DNA, 110 bp, Mus musculus
acatagacaggcatgttgatcgatggactggagttgaagacccagaaataaaatcacttgagtttttgatcttagcaattctgattggtgtaaggtggaatcgcagggtc

SEQ ID NO: 91266 - DNA, 66 bp, Mus musculus
agatatgtatatatgtatatgtatgtgtatagatatgtgtatatatatatatgtatataattatct

SEQ ID NO: 91267 - DNA, 86 bp, Mus musculus
ttgtctccccttctcagagatgatgcgggtgccctgagtatcttcccaccttggcttacccagtctctcccactgagaccagacaa

SEQ ID NO: 91268 - DNA, 71 bp, Mus musculus
tagagcagccttagtccattaggatgcatgggataatttcaatatttttgtatctgttgaaggctgttttg

SEQ ID NO: 91269 - DNA, 98 bp, Mus musculus
catagaagaattgtgcttctcaacatttgcagcttgtgaggaccttttttttttttgtatggacatactgccaaagttaatggagcttttcttgtatg

SEQ ID NO: 91270 - DNA, 73 bp, Mus musculus
gtctgtgtgtgtgtgtgtgtgtagctgtgtgtgttagagagacagagacagacagagagagacagagacagac

SEQ ID NO: 91271 - DNA, 85 bp, Mus musculus; identical to SEQ ID NO: 57439

SEQ ID NO: 91272 - DNA, 85 bp, Mus musculus; identical to SEQ ID NO: 57470

SEQ ID NO: 91273 - DNA, 117 bp, Mus musculus
tgctcagtctttgtaattgtctgttgagtctgttgactcttatttgtatctttttaaatattatatgcaagtttctctcagctgacatcattttgttaattagcccaagtctgagga

SEQ ID NO: 91274 - DNA, 85 bp, Mus musculus; identical to SEQ ID NO: 57439

SEQ ID NO: 91275 - DNA, 106 bp, Mus musculus
gccttagtccatggtgatctgataggatgcatgggacaatttcaatatttttgtatctgttgaggcctgttttgtgaaaaatcatatagtcaatttgggtgaaggt

SEQ ID NO: 91276 - DNA, 57 bp, Mus musculus
acacatacatgttacatagatgcattcatatatatgtatatgtgtatgtgtatgtgt

SEQ ID NO: 91277 - DNA, 77 bp, Mus musculus
aatagtatatatgtgtgtgtatatatatatgtgtatgtaggtgtgtatatgtatatattcataacatttgctctgtt

SEQ ID NO: 91278 - DNA, 168 bp, Mus musculus
tgtgtgtgtgtgtgtgtgtgtgtgtgtgtgcgcatacatatatgtgtgtgtgtatatatatatatcatataaatgtgtgtgtatgtatacatatatatatatgtgtatgcatatatatgtataaatatgtgtatatatttatgtatgcatgtatatatatatgtatat

SEQ ID NO: 91279 - DNA, 100 bp, Mus musculus
cagcagcatcatggtcctgaggtgtccctactccatgtcagcaatcccttaggtgtctagagatactgttgacctgattcttttgcatacattctcagga

SEQ ID NO: 91280 - DNA, 113 bp, Mus musculus
gatcatcttaaggcattaaggaaatagagaatgtgcaacatgagaactgtgataaaagagtgtctacagtctctcaattcctgcaattaaagcctaccacccccttattgatc

SEQ ID NO: 91281 - DNA, 85 bp, Mus musculus; identical to SEQ ID NO: 57439

SEQ ID NO: 91282 - DNA, 85 bp, Mus musculus
tatgcttctgagacattcttgggctgtccaataaatttttcactaagtttattctattattatagctatgttttgtagaagtatg

SEQ ID NO: 91283 - DNA, 92 bp, Mus musculus
attaaactgttatatatgatgtagagtgattttaaatcacatttctcaaatggatgttaagataagctttctgttgtaaatgagagtctaat

SEQ ID NO: 91284 - DNA, 85 bp, Mus musculus; identical to SEQ ID NO: 57482

SEQ ID NO: 91285 - DNA, 91 bp, Mus musculus
agagagagagagagagagagagagagcaagcacagtgtatatgtggatgtcagagcagtgtgtgagcattcattatctccttcctgtctgt

SEQ ID NO: 91286 - DNA, 87 bp, Mus musculus
gtgtatgtatgtatgtatgtatgtatgtatgtacctatgtctaaatctttatatatatatatatatatatatatatatatatatata

SEQ ID NO: 91287 - DNA, 74 bp, Mus musculus
atgaattagttaatcaactttacatacacattcatatcttatgcatgtgttgtgatattgttggctttggtcat

SEQ ID NO: 91288 - DNA, 129 bp, Mus musculus
gtgtgtatgtgtgtatgcatatgtatatatatatatatatgcttatatatgtatatatgtgtgtgtatatatgtatatatacacatatatgtatatatgtgtatatatacatacacatacatatatata

SEQ ID NO: 91289 - DNA, 116 bp, Mus musculus
ctggtggtcttaggatagcagttgtattccaggagccagggagaggtgacagaggagagtgaggtgtgtcacgttctatccatcctgggagttgttagcctgatgtggaacaaagg

SEQ ID NO: 91290 - DNA, 95 bp, Mus musculus
tatcaaagatgaataaacttgacaaccatgtgcagaagcagggattgtctttgaaaacctggaaggttgtttagtacttagctctgtcttcgata

SEQ ID NO: 91291 - DNA, 85 bp, Mus musculus
agactgaattatgtgtgactggctcagtgcctgatttgtgaggtaatatttcaatgtacattcttcggtctccttggctcagtct

SEQ ID NO: 91292 - DNA, 97 bp, Mus musculus
cactgatagcatgcagaggacttcctgaaacacagactctagcacttaggagtgaagattctgtgcagtcaccaccttgacctctccatgttgagtg

SEQ ID NO: 91293 - DNA, 85 bp, Mus musculus; identical to SEQ ID NO: 57470

SEQ ID NO: 91294 - DNA, 117 bp, Mus musculus
agtgttttgcatacatcagtgagactcttcctagagaaacttcatttttttatttgtgtacagttatcaattggagttagtttctgagttaatgatgagagctcctgtgtgaatact

SEQ ID NO: 91295 - DNA, 118 bp, Mus musculus
aaaatctctaacggggatagtgcagtgctaacaaaggaaaaagttttcaatttatatatatgaaagatgcttaatgtaactgtataaataatatctgtcccatgttgctaatggtttt

SEQ ID NO: 91296 - DNA, 110 bp, Mus musculus
gtgaagggatttgatgaaggcatccctattaggactggatattccaaagtctctcactctctttatattgtccagttgtgggtctctgttttagtttccatctcctgcac

SEQ ID NO: 91297 - DNA, 69 bp, Mus musculus
ccctaagtctacagtctatcttgatctctctagccaatgatggaccatggatggtggacagaattgggg

SEQ ID NO: 91298 - DNA, 85 bp, Mus musculus; identical to SEQ ID NO: 58391

SEQ ID NO: 91299 - DNA, 87 bp, Mus musculus
cccttggtttcatttgcttgctgaccttctaacataatccagtcagtagcctgtgactggagtctgtgacaacatttcttctggggg

SEQ ID NO: 91300 - DNA, 93 bp, Mus musculus
gaccatatatatgtagattatatgtgtgtgtgtatatatatgtgtgtatatatacatatatatacacacatatatatatatatagtctttagg

SEQ ID NO: 91301 - DNA, 76 bp, Mus musculus
ctggaaaacctcttgttagaagagattatatgattgtttttcaatttcataatctgtctgaagaagaagtagccgg

SEQ ID NO: 91302 - DNA, 122 bp, Mus musculus
gtataccccatatgtatgtatgtgtatgtgtgtgtgtatatatatatatacatatatatacacataaatacacacacatatatatgtatatatacatatacatatgcatatgcatatgcata

SEQ ID NO: 91303 - DNA, 102 bp, Mus musculus
agtactacattgaatagatagggagagagtaggcagatttgttttgtctctgattttagtggaattgcttcaagtttctctccatttaatttgatgttggct

SEQ ID NO: 91304 - DNA, 102 bp, Mus musculus
cctgtaattctttcagacaggaacaattatgggtcagagatgtgactgtggaatgggaaccccatccctcacttgatgtcctgtcttcctgctggatgtggg

SEQ ID NO: 91305 - DNA, 92 bp, Mus musculus
atagtgcagaggtccaagagatatttattcagtttttctaaatctgaaataagagaagctgtatgcacataaaggtttggagctatagctat

SEQ ID NO: 91306 - DNA, 64 bp, Mus musculus
gaggctatgactacagacaccatgagagcagattctccctgagtgttgtgtggtaccagctctc

SEQ ID NO: 91307 - DNA, 62 bp, Mus musculus
atgtttacatattttatatatgtgtatgcttatgcatatatacatatgatatatgtgtgtat

SEQ ID NO: 91308 - DNA, 74 bp, Mus musculus
attcacggtgctggagagatggctcagctcttaagagtactgactgctcttccagaggacctgagttcaattct

SEQ ID NO: 91309 - DNA, 58 bp, Mus musculus
gtgcgtgcgtgcgtgcgtgcgtgtgtgtatgtatgtatgtatgtatgtatgtatgtat

SEQ ID NO: 91310 - DNA, 110 bp, Mus musculus
aaacctgggaagtgcaggagtgtggagactgacatctagtcctgcaacatgcaaattgcagagactgtcactcagtgggagagttctgtctgctttagcaggtttatgtc

SEQ ID NO: 91311 - DNA, 114 bp, Mus musculus
tgtgtgaggttggcaccactctttccatattcaaccatgtcatgtatatatatttaaaacgtatatgtaaggtgtatgtggctatagaatggaacttgaaccagtcctcattca

SEQ ID NO: 91312 - DNA, 96 bp, Mus musculus
gaccagccttagtccatggtgatctgataggatggatgggacaatttcaatatttttgtatctgttgaggcctgttttgttaccaattatatggtc

SEQ ID NO: 91313 - DNA, 75 bp, Mus musculus
ttcattttatatatatatatacatatatgtatatctgtgtgtatatatatatgtatatgtgtaagtatatacgaa

SEQ ID NO: 91314 - DNA, 120 bp, Mus musculus
aatttatttccatttaattccacttattaatactcacaggaagtctcattttattttgttaaaagcagaatattgagtgcttaagttatcatgggctggaaggtctaaatttcaaaatga

SEQ ID NO: 91315 - DNA, 65 bp, Mus musculus
gggagtagagttgagatatagatgttctgtttaaggctcagctgtctgtatcgtctcttattctc

SEQ ID NO: 91316 - DNA, 67 bp, Mus musculus
ccgagtcccagtctgtctgtgacactcccatcgcagaggagacgaagacagatgcttgaggactggg

SEQ ID NO: 91317 - DNA, 101 bp, Mus musculus
gactgactacactacagagtgtggtgaattgtccacactgaggctctttctctctctcttcagatgggcagtttgcagcatttgattggttccatcacatc

SEQ ID NO: 91318 - DNA, 118 bp, Mus musculus
ttcctaatctatacttcggagtgctgttataactatagacgaaagtgcctttatttgtttttaaatatcgagcacattctctaggttgaactatttatgtacttacacctgcaaggag

SEQ ID NO: 91319 - DNA, 109 bp, Mus musculus
tatatatatatatatatacactggttatatgtacatacatatatatgtatgtatatatatgtatatatatatatgtatgtatgtacgtatgtatgtatgtatgtatgta

SEQ ID NO: 91320 - DNA, 86 bp, Mus musculus
gtataataatgtgtatgtatatatatgtgtgtgtatgtatatagtatatatatgcatatatatgtcatgtgcatatacacatatgc

SEQ ID NO: 91321 - DNA, 76 bp, Mus musculus
gagaggccagagagcaaatctactccttgctggccagatggaaacactacagtgagtgctctctctgctgcttctc

SEQ ID NO: 91322 - DNA, 80 bp, Mus musculus
ctaatttcaattgaggaattgcctccatcagattggcctataggccagtctgtgaaagtattttctttattaatgattgg

SEQ ID NO: 91323 - DNA, 71 bp, Mus musculus
tctctgtctctctctctcactcttacacacacacacacacacacaaagagagagagagagagagagagaga

SEQ ID NO: 91324 - DNA, 85 bp, Mus musculus; identical to SEQ ID NO: 57439

SEQ ID NO: 91325 - DNA, 73 bp, Mus musculus
tgtatatgtatatgtatatgtatatgatgtatatgtatatatacacatatatgtatgtatgtatatatgtata

SEQ ID NO: 91326 - DNA, 85 bp, Mus musculus; identical to SEQ ID NO: 57439

SEQ ID NO: 91327 - DNA, 76 bp, Mus musculus
ggatacatctgctccattcactgctgtctactcttactgccatgctagagagcatcgaaaaagagtggtgatgtct

SEQ ID NO: 91328 - DNA, 120 bp, Mus musculus
ctatatttatatatctatgtgtaaatatatagatatatataatattaatatgtacataaatatatataatatactgtatttatatctatgtataaatatatattcatatacataatatag

SEQ ID NO: 91329 - DNA, 85 bp, Mus musculus; identical to SEQ ID NO: 87029

SEQ ID NO: 91330 - DNA, 85 bp, Mus musculus; identical to SEQ ID NO: 87029

SEQ ID NO: 91331 - DNA, 112 bp, Mus musculus
aacaatgatgatgatgataaaatagaaaaatccagggataagagaaacaataaaacacagtatttttttttaatccagtggtctttgaacttctcgacgtcgggacattgtt

SEQ ID NO: 91332 - DNA, 112 bp, Mus musculus
ggctgaaggtacagcttggtggtaaagcacttgtctagcatatgtaatgaccttgatttattctttattaacatgttcatatgtgcttgagcacacatgtgtacatgcaggc

SEQ ID NO: 91333 - DNA, 79 bp, Mus musculus
acttctttcagtttcactgtgtctctgtttagtttctgtttccaggatctgtccattgatgagagtggggtgttgaagt

SEQ ID NO: 91334 - DNA, 98 bp, Mus musculus
atatatatatatgcatatatgtatatatgtgtatatatgtatatgtgtgtatgtgtatatgtatataatgtgtgtatgtgtatatgtatatatgtgtg

SEQ ID NO: 91335 - DNA, 85 bp, Mus musculus
attctaagataaatgcagatataatggctgtattgccaaattattggacaataaagaaatgtatttgtttatctgatttatgagt

SEQ ID NO: 91336 - DNA, 76 bp, Mus musculus
caaccacagttatttctgacatgagtacaatggttgggtttaagtacctgtgtctgtctcagtcagctgcttgttg

SEQ ID NO: 91337 - DNA, 86 bp, Mus musculus
gttcagccctgggtccacttccaggttatgaggccatttcttcataagtcagcctcactctctggcagccacagtggaacatgaac

SEQ ID NO: 91338 - DNA, 62 bp, Mus musculus
atgtatatgtatatgtatatgtatatgtatatgtatatgtatatgtacatgtacatgtacat

SEQ ID NO: 91339 - DNA, 101 bp, Mus musculus
gtaaatatatatatatatatatatatatatatatatatatatatatatatatatacatatatatgtatgtatatgtgtatgtgtatatgtatatgtatata

SEQ ID NO: 91340 - DNA, 108 bp, Mus musculus
atagatttttgcatttagtttgtatgcaattgcatatggtaattttattttttcatgaatctatgcctctttgacagtctgcaaactatgcatgcacaaaaagcctat

SEQ ID NO: 91341 - DNA, 90 bp, Mus musculus
tatctaagtatatatatgtatgtatatgtatgtgtatacacacacacacacacacacacatacacatttatacagtgttttctgtaggta

SEQ ID NO: 91342 - DNA, 85 bp, Mus musculus; identical to SEQ ID NO: 57439

SEQ ID NO: 91343 - DNA, 78 bp, Mus musculus
atatatatatacacacacacatgtatatatatatatatatatatatatatatacacatgtgtgagtgtatgtctgtgt

SEQ ID NO: 91344 - DNA, 85 bp, Mus musculus
gtccatggtggtctgataggatgcatgggataatttcaatatttttgtatctgttgagtcctgttttgtgaccaattatatggtc

SEQ ID NO: 91345 - DNA, 75 bp, Mus musculus
gtgtgtgtgtgtgtgtgtgtgtatgtgtatgttctcctgtttgagatcaaacacaaagccttatacatgtttcat

SEQ ID NO: 91346 - DNA, 97 bp, Mus musculus
cctcatcaattggagcactggggacacaataaatttcctgtaatttacctaggcaacttgtttaattatatattgatctccatgttatttatgtagg

SEQ ID NO: 91347 - DNA, 120 bp, Mus musculus
tgctctaggttctgggtaagagtcataggagtccattgtctgttaattctgattttcttcttgtttacaattatgaataatgatgataaattcatatgactaaagcttatcagtgtaact

SEQ ID NO: 91348 - DNA, 102 bp, Mus musculus
gtttttcatattactgtgtacaattaagtattagtaaaaaaaaatattgccctggtcatattttattgattatatagcaatgcgcagtaattttgaacctac

SEQ ID NO: 91349 - DNA, 132 bp, Mus musculus
tgggatgagtaccacagcctgctggtggtgtctgagtgtctttgtacagcacttgtctgtgacaggagagacagaagatatttgcagacaaactgtgttgttctgggtcgtcacaacttttttggtaatctg

SEQ ID NO: 91350 - DNA, 94 bp, Mus musculus
atgggagcctccaaggcctgacactatcactgattctatgatgtatttacaaaaaggatcctagcatgggctgcccctcaaagaggacccccat

SEQ ID NO: 91351 - DNA, 96 bp, Mus musculus
gatcagccttagtccatggtgatctgataggatgcatgggacaatttcaatatttttgtatctgttcaggcctgttttgtgaccaactatatggtc

SEQ ID NO: 91352 - DNA, 69 bp, Mus musculus
tagagtcttactctgggtggactggagctccctaagtagagcagtccaatctcagactcaccgactctg

SEQ ID NO: 91353 - DNA, 78 bp, Mus musculus
acagggcagagaggtaagggtgtggtactttggacactctgtctctgtcacacaactctcctttcaaccatcacctgt

SEQ ID NO: 91354 - DNA, 107 bp, Mus musculus
tcagagaatgatgcagaggtttttattgtcatgaaagtagaaagagagcagcaggcatttctttttccctcatgagtccacactgagcccctaggtgtacatgctga

SEQ ID NO: 91355 - DNA, 117 bp, Mus musculus
tcccctcatcgcggcaggtgccctcagaaccaggtgccgctcccgggattgtcttggaatttatgtgtttcttttactgtgctgggatgtgaagcagctgccactgtccgtgtggga

SEQ ID NO: 91356 - DNA, 64 bp, Mus musculus
acatatacatacatacatatatacatatatatatgtgtgtgtatatgtgtatgtgtgtgtgtgt

SEQ ID NO: 91357 - DNA, 84 bp, Mus musculus
aagtaagaaaaatagtcactgtttcatgaaatctatgtgtaatatgtcctgttacagtagtgagacaggactagagtaatattt

SEQ ID NO: 91358 - DNA, 119 bp, Mus musculus
aggaatatatgcatatattcatagaataatatattacactcatgtattcatgtataatgtatttatatacatgaacatatatgctcagtgtcacaatttatttaggaatatgttcacct

SEQ ID NO: 91359 - DNA, 85 bp, Mus musculus; identical to SEQ ID NO: 57470

SEQ ID NO: 91360 - DNA, 76 bp, Mus musculus
ctgatggttgtctgtgagtatctgcatctgtattagtcatatgctggcagaacttcgcagggcacagccacaccag

SEQ ID NO: 91361 - DNA, 120 bp, Mus musculus
caggctgacacagcaagtcagtagtaaaatatgtgccaccaaactttaccttctaccatgtatagttaggttatcagaattggtagcaaatatctttaccttctgagttatcttgttatc

SEQ ID NO: 91362 - DNA, 101 bp, Mus musculus
tgtacctactcagctagagccaaaggataatgtttctttgtatttatctaccatctatggatttttttttcactatcttttggtttgagtcttgggaagca

SEQ ID NO: 91363 - DNA, 77 bp, Mus musculus
ttgcagatgccaacaagagctttatgacaggagcctgacacagctgtcgcctgtgaggctctgtcagtgcctgacaa

SEQ ID NO: 91364 - DNA, 58 bp, Mus musculus
ccaaaccgaatggttcaatgaggcttctctcagtttctcactgaattgttcgacttgg

SEQ ID NO: 91365 - DNA, 93 bp, Mus musculus
tctgtttctcactctctcacatgcacacatatgtgtgtatgtatatgtgagagagggaacgtgtgtgtgtgtgtgtgtgtgtgtttgtgtgtg

SEQ ID NO: 91366 - DNA, 94 bp, Mus musculus
tctgtgtttacatacatatgtgtgtatatatatttgtactttcataaatatacttccatgaattttacagaatgcacatgtgtaagttatcaga

SEQ ID NO: 91367 - DNA, 108 bp, Mus musculus
gcataggtcagaggcttacatctccatccagtggctgcatggaaagtgcctgtcagtctccctgtgtcttcctgcccagagcacaggaattctggccagacatggcat

SEQ ID NO: 91368 - DNA, 88 bp, Mus musculus
cattgaactagtcataattgcttagaaagtttaattgtagatttatctgctattttgttatatttttctgagtagatgtgaacaaatg

SEQ ID NO: 91369 - DNA, 86 bp, Mus musculus
ggtctacctgtctgtcactgtatcagtgccatgcagtttttatctcaattgctctgtagtacagcttgaggtcaggcatgttgatt

SEQ ID NO: 91370 - DNA, 111 bp, Mus musculus
ccatcataatgtatatgtcatatatgtatttatctaaatatatgcctatatctaaatatataaatatgccttgttaatatgtataatgataaaacatacattatgtattgg

SEQ ID NO: 91371 - DNA, 169 bp, Mus musculus
cactgagcgcagtgggtgcagtgcagtgagttcagtgagtgcagtgagcacagtgggtgcagtgagtgcagtgagcacagtgggtacagtgcagtgagtgcagtgagctcagtgagtgcagtgagcacagtgggtgcggtgcagtgagtgcagtgagtgcagtggagtt

SEQ ID NO: 91372 - DNA, 84 bp, Mus musculus
aggaagattgcttgctgtaattagtgtgggacagaagttgctatatttcccatgtcactcactcactcagtcgggatactttct

SEQ ID NO: 91373 - DNA, 108 bp, Mus musculus
ctagcattactgaggtgaaatcctgtgggaagtgtttttgtagtacacaactatgttgtgtttcagagacagacattgtgctggcagctggacttggtaatgtgaaag

SEQ ID NO: 91374 - DNA, 130 bp, Mus musculus
agagagagagagagagagagagagagagagagagagagagagaacaagagaacaattttaagaaatcttatctttgtctctgtctctctatgcctctttctctgtctgtctgtctctctttctctttctc

SEQ ID NO: 91375 - DNA, 114 bp, Mus musculus
tccttgaccaagttatcattgagaagagtgttgttcagtttccacgtgaatgttggctttctattatttattttttattgaagatcagccttagtccatggtgatttgatagga

SEQ ID NO: 91376 - DNA, 80 bp, Mus musculus
gtccatggtgatctgataggatgcatgggacaatttcaatatttttgtttgaggcctgttttgtgaccaattatatggac

SEQ ID NO: 91377 - DNA, 82 bp, Mus musculus
tgtgtgtatgtgtatatgtgtgtatgtgtatatgtgtatatgaatatatttgtatacatatacatgtgtacatacaataaca

SEQ ID NO: 91378 - DNA, 74 bp, Mus musculus
gctgctgggtagagcctctgagaggatagttattcttggcttctgtttctctggctctgtctcccgcctcttgc

SEQ ID NO: 91379 - DNA, 88 bp, Mus musculus
cctaatgacccagttcgcagcccaggtgtgccgtccctctgtccctctgcaacgggtcagttcataaggcaccttgagttttgttagg

SEQ ID NO: 91380 - DNA, 66 bp, Mus musculus
ggttgtcatgattacatagcaagcccagcttttaaagtgcggttatgatatgtaatcaagaaaacc

SEQ ID NO: 91381 - DNA, 106 bp, Mus musculus; identical to SEQ ID NO: 63491

SEQ ID NO: 91382 - DNA, 115 bp, Mus musculus
gtacagtacacaaaaatatgataacatatatgtatatgaatatatatgtatatgtacatattacatagtatatatgtacagagtatgtgtatatatatgtatgtagtatacatat

SEQ ID NO: 91383 - DNA, 67 bp, Mus musculus
tgctcatactcaagtattcatatatatgtatatttgtacatatatgtgtgtgtgtgtgtgtgttaca

SEQ ID NO: 91384 - DNA, 116 bp, Mus musculus
aggcagagaatctaaaacagaaataaaaaatgttattgactaaagtaattataaagtacatgtttatttttatcttaggcatttgtggtttgtttcctcatgttttgtgtctgttt

SEQ ID NO: 91385 - DNA, 85 bp, Mus musculus; identical to SEQ ID NO: 57439

SEQ ID NO: 91386 - DNA, 61 bp, Mus musculus
tttcacacacacagacagacacacacacacacagagtatgtgtgtgtctgtgtgtgtgaga

SEQ ID NO: 91387 - DNA, 103 bp, Mus musculus
gattattattttctagaatcatgtcatcaaggaatacatgccatcataacatattactatgttgtgattttgaagttgtggtgcagtagctagatttaatttc

SEQ ID NO: 91388 - DNA, 99 bp, Mus musculus
ctcactaattgcattttccaatataaagtttatgtatgtatgcatgtatgtatgtaagcatgtatttatttgtgtttgtattctttgtgttcctgtgag

SEQ ID NO: 91389 - DNA, 85 bp, Mus musculus; identical to SEQ ID NO: 57439

SEQ ID NO: 91390 - DNA, 102 bp, Mus musculus
gggtacaattctatttgctgaatattgggatatgggggatatgtatatgtatatatgtatgtatatcctgttcttaatgttttaggttgaattcatgtaaac

SEQ ID NO: 91391 - DNA, 66 bp, Mus musculus
tcaggggcctcacatcagctggcattcactgcttggttagtgactcagtgtctgagagatctctgg

SEQ ID NO: 91392 - DNA, 103 bp, Mus musculus
atttcattgtgaagttggagtttcctagagcagaagatgatgatccatgtatatttttataagcttctacttcctacttaactcaaactgaagcagtgtagat

SEQ ID NO: 91393 - DNA, 105 bp, Mus musculus
ggcgcgtgcttctgtgaaggtttatatatgcttggcccagggagtgtcactaataggacgtgtgtcactgtgagtgtgggctttaagaccttcattttagctgcc

SEQ ID NO: 91394 - DNA, 86 bp, Mus musculus
ataggagatatcattcaatccactaaatgtatatatgcatatgcaaatatatatgtatgtatgtaagtattcatgaaatcttgtgt

SEQ ID NO: 91395 - DNA, 60 bp, Mus musculus
tataaaatgccagtatgtatgaatgtatgtacatacatacatacatactgcttttttata

SEQ ID NO: 91396 - DNA, 81 bp, Mus musculus
tggtgatctgataggatgcatgggaaaatttcaatatttttgaatctgttgaggcctgttttgtgacctattatgttgtca

SEQ ID NO: 91397 - DNA, 105 bp, Mus musculus
gtggtaactgataacaggaaatatatatatatatatatatatatatatatatatatatacatatatatatatgtctatgtctatgtctgtgtctatgtctatctc

SEQ ID NO: 91398 - DNA, 85 bp, Mus musculus; identical to SEQ ID NO: 57439

SEQ ID NO: 91399 - DNA, 98 bp, Mus musculus
ctgtcatgattgttagctatatttatatatgtgtatagtagtatgatatgtttctatctgtatatacatgctcatgtgtgagtttatgcatgtgagag

SEQ ID NO: 91400 - DNA, 115 bp, Mus musculus
ttgttattgaatatcagtctttggccatggtggtctgataggatacatgggacaatttcaatatttttgtatctgttgaggcctgttttgtggccaattatatggtcaattttgg

SEQ ID NO: 91401 - DNA, 86 bp, Mus musculus
taatataagaaaaattcattacagatgtaaatatatatatgtatgtgtgtatacatatataattttatctgctattttttgtatta

SEQ ID NO: 91402 - DNA, 99 bp, Mus musculus
gaagctgtggccttgttggagtaggtgtgtcactgtgtgtgtgggctataagaccctcatcctagttgcctggaagctcgtattctgctagcagccttc

SEQ ID NO: 91403 - DNA, 151 bp, Mus musculus
ttgtgcatatatatatatacatatatatatatgtgtgtgtgtgtgtttatacatacatgtgtatatatatatatatatatatatatatatatatatatgacataaatatatgatgttcacatgtgtgtatgaatgtatatatgtaaatatg

SEQ ID NO: 91404 - DNA, 64 bp, Mus musculus
ccttgggtgatgtactagctagttttgtgtcaacttgacacagctggagttatcacagaaaagg

SEQ ID NO: 91405 - DNA, 115 bp, Mus musculus
caggtctccctggaggactgactttattttacccaaatctaatttctgacagactcagacacatatcggaagtggagaaaaggaatgtaaagttgttgcaacaccagagagtatg

SEQ ID NO: 91406 - DNA, 130 bp, Mus musculus
atatatatatatatatgtgtgtgtgtgtatatatatatattactggctaatatattataatttatatatatatatatatatatatatatatatatatatatatatatatatatatttgacaaaactttgg

SEQ ID NO: 91407 - DNA, 85 bp, Mus musculus; identical to SEQ ID NO: 57439

SEQ ID NO: 91408 - DNA, 82 bp, Mus musculus
accactttctcttctatcagactcagtgtgtctagttttatgctgagttctttgatacacttggtcttgagttttgtgtggt

SEQ ID NO: 91409 - DNA, 68 bp, Mus musculus
ttttgtgtgtacatgtgtgtctgggtgtgtattcatacatgctgcagcatatatatatatatatggag

SEQ ID NO: 91410 - DNA, 107 bp, Mus musculus
gttataattttacatgcttctattgtacgtacttatattttatgtttatatatatttatactatagacaaaatttatatattcaataagtatgtattttatatgcat

SEQ ID NO: 91411 - DNA, 75 bp, Mus musculus
ctgacactcactctggcactctgtttcttccttctaacccagtgtgcaacagagaccagacacattgagtatcag

SEQ ID NO: 91412 - DNA, 74 bp, Mus musculus
gtacagtgaaggggaacaaggacaagctgcaactcacaagtgcagccgtcagttctcattttctttaactgtac

SEQ ID NO: 91413 - DNA, 85 bp, Mus musculus; identical to SEQ ID NO: 57470

SEQ ID NO: 91414 - DNA, 122 bp, Mus musculus
tatcacacacatatatatatatatatatatatatatatacatatatatgtatatatatatacacatatatatctgtgtgtgtatatatatatgtgtgtgtgttataattatatatacttatg

SEQ ID NO: 91415 - DNA, 118 bp, Mus musculus
tattacagtgatgagtcttctctttgaacacttctgtcttactgaagtcttatatttatttatagactaaaggtaatttaaaggaagaaaccacaatgggaagctcttaattaagatg

SEQ ID NO: 91416 - DNA, 85 bp, Mus musculus; identical to SEQ ID NO: 57439

SEQ ID NO: 91417 - DNA, 74 bp, Mus musculus; identical to SEQ ID NO: 91412

SEQ ID NO: 91418 - DNA, 85 bp, Mus musculus; identical to SEQ ID NO: 57470

SEQ ID NO: 91419 - DNA, 122 bp, Mus musculus; identical to SEQ ID NO: 91414

SEQ ID NO: 91420 - DNA, 118 bp, Mus musculus; identical to SEQ ID NO: 91415

SEQ ID NO: 91421 - DNA, 85 bp, Mus musculus; identical to SEQ ID NO: 57439

SEQ ID NO: 91422 - DNA, 81 bp, Mus musculus
cttcatatggaaaggtcccatggcgtttttttgcatatatatatgtatatattctgctaaatgctctccctctctttggag

SEQ ID NO: 91423 - DNA, 85 bp, Mus musculus; identical to SEQ ID NO: 57439

SEQ ID NO: 91424 - DNA, 65 bp, Mus musculus
gactctggctttctctctctttgatgtggtccttgaccctccattctagggtgggtctgtctgtc

SEQ ID NO: 91425 - DNA, 103 bp, Mus musculus
gaaacacagtggagtctgccccattttctgcacattttaaaaaaacatttttttgaaaatttgtttattttatgtgctgattattttggtctacatgtgagtc

SEQ ID NO: 91426 - DNA, 89 bp, Mus musculus
aggcagacagacagacagacagacagacagattcttgtttggctaagttaaagggattattttatctgtatctgatttgggatgggcct

SEQ ID NO: 91427 - DNA, 85 bp, Mus musculus; identical to SEQ ID NO: 57439

SEQ ID NO: 91428 - DNA, 82 bp, Mus musculus
atatcaacctgactgcagtctgtgacaattttctacaagccttttggaaagtttcagggttctggggtcagatagttagtat

SEQ ID NO: 91429 - DNA, 115 bp, Mus musculus
tttaggagagaacatgtgacaggtataaatatgtcctaaataaatgacatagagtgacagaaattttattttactaatttggggtaatgcattatcagtgatatgcttttataaa

SEQ ID NO: 91430 - DNA, 62 bp, Mus musculus
tgcttagtgctgacagaagagagtctgtgggatcctgactcagttgctgtcataaagaggca

SEQ ID NO: 91431 - DNA, 77 bp, Mus musculus
tcagagagctctttctgcaagtctatgtggaactggcctcatgtcttacatatgcatgtgcagtttggagcccggga

SEQ ID NO: 91432 - DNA, 116 bp, Mus musculus
atctttggaagtcataaggctggttccgagcatactcactttggtagtgtctggcctctctcacaatcactgaagcaatgcaagtatgtctcagcatcagccaggcactccgtgat

SEQ ID NO: 91433 - DNA, 111 bp, Mus musculus
ttgaataagccggagcaaagcaggagtgggacctattattatgtcagtcagccacactgacaaagcctcggctccacctcggatgctgacaaagcctcggctccacctcgg

SEQ ID NO: 91434 - DNA, 102 bp, Mus musculus
gtattataaatattgtgtacttatacctgtgtttcacacagtctgtgaaacaacagctttggaatttaaataggggaaagtaaaatgcaatatatataatat

SEQ ID NO: 91435 - DNA, 96 bp, Mus musculus
ggcctcgaactcagaaatctgtctgcctctgacactcccgttcttattgcaaatgaaaggtcaatggtagaacagcaacataaatgatctaggacc

SEQ ID NO: 91436 - DNA, 80 bp, Mus musculus
gcatgcatatatatatatatatatatatatatatatatatatatatatccagtatatatatgtatatgtatgtgtgtata

SEQ ID NO: 91437 - DNA, 96 bp, Mus musculus
gctcctacagtccttgccctaactggggatcctcattctcagtcgaatgattagctgtgagtatctgcatctgtattggtctggctgtggcagagc

SEQ ID NO: 91438 - DNA, 91 bp, Mus musculus
gggagatgaggctatgtttgaagagcacggtcatttgaagtcagctttgagcttcccaaagctttgttctctctctctctctctctctctc

SEQ ID NO: 91439 - DNA, 76 bp, Mus musculus
gagccaagctgccttatgttctgcctgcatagacctttctggctaatggcattggtagaattcaagaattggattc

SEQ ID NO: 91440 - DNA, 104 bp, Mus musculus
ggattgaagttacttcccataacaccaataaactatggcatctctacatatttggtgtgaagagagtgatcacacttacctggtggatattggaatttttttcc

SEQ ID NO: 91441 - DNA, 105 bp, Mus musculus
tagagtgaggtggggcaggggaattgttaattttgttttggaagcttagtaactttaactatgtttctatatttgcttaatcagccagctttttatctgactctg

SEQ ID NO: 91442 - DNA, 110 bp, Mus musculus
ggccttctatttgtagtgttttctgtacccactggctcttacaatcactctgactcttattcctccgagtttcctaagccctgcgaggaggcatttgatggaagcatacc

SEQ ID NO: 91443 - DNA, 134 bp, Mus musculus
ggccactttgccttttcatgtgggaactctgcccctggcctaggggagggattagagtagacagagagcagggagtctgttatgtgggaatggagaagctctagttgataacactttctaggtgtagcaggttc

SEQ ID NO: 91444 - DNA, 112 bp, Mus musculus
ggagcttggtcacactaggatttcagggtctcagaagaagcttgactgccaagaactctgacacactcagaatctcaggtttacaggtgcccacaatcaaaggatgagagag

SEQ ID NO: 91445 - DNA, 85 bp, Mus musculus
gtcccaagaggagacagttagtgaccctgagcaagcataccatggtgccacacggtctatctcactgacaaatccctctaaggtc

SEQ ID NO: 91446 - DNA, 74 bp, Mus musculus
tgtggtgtctagatactctttaattagcttccttgggcagacaaggtctggttttaggatgtttaaatataata

SEQ ID NO: 91447 - DNA, 102 bp, Mus musculus
ctaagtatgtggttaattttggagaatgctccaaaattagagtagaagttaatatattttctttgatgagttgttctgtaaatatttgttagctacacttgg

SEQ ID NO: 91448 - DNA, 96 bp, Mus musculus
tgtaggagtaatatttgttagtttgggtgaagtacacagtcagttctctgcactttggacaggtgtggctttccgtaattatctgtatctgctgca

SEQ ID NO: 91449 - DNA, 84 bp, Mus musculus
ctgaaatctgtaggacctctaacttgtccaactgtgtcagaatatttttttttctaagcaaggacagtgttttttaggttttgg

SEQ ID NO: 91450 - DNA, 85 bp, Mus musculus; identical to SEQ ID NO: 57439

SEQ ID NO: 91451 - DNA, 88 bp, Mus musculus
tgtgggatggatccacaggtgtggcagtctctggatggctttaccttcagtctctgctccacactttgtctctgtatctgaccccata

SEQ ID NO: 91452 - DNA, 85 bp, Mus musculus; identical to SEQ ID NO: 57439

SEQ ID NO: 91453 - DNA, 114 bp, Mus musculus
tattatctttagtcagtcaacaaaattaattgcatttttgtatgatgggttgtaacattctctttatttatctaaacaagaatttgccttatagttaatttgactttgataatg

SEQ ID NO: 91454 - DNA, 85 bp, Mus musculus; identical to SEQ ID NO: 57439

SEQ ID NO: 91455 - DNA, 113 bp, Mus musculus
tgtcataggcacaatgaagaaaggcagaactcaaaagtgaagggcagtgagtagccagtgatgccaactatgtccatgtcctttgctgctattaagggtcattgagcacagca

SEQ ID NO: 91456 - DNA, 163 bp, Mus musculus
gcacactcactctcacaagcatcagtgtgtaagttctgggcacactcactctcacaagcatcagtgtgtaagttctgggcacactcactctcataagcatcagtgtgtaagttctgggcacactcactctcacaagcatcagtgtgtaagttctgggcacact

SEQ ID NO: 91457 - DNA, 111 bp, Mus musculus
tggtatatattgactaagaagtaaactgcttataattttgaatttttgtctaaatatatgtgtgactatttacaaattaatgtagtttatttaatagttggttgaagatta

SEQ ID NO: 91458 - DNA, 88 bp, Mus musculus
atatgtatatatatatgtgtgtgtgtatatatacatatgtatatgtgtatatatatatatatatatatatatatatatatataaatgt

SEQ ID NO: 91459 - DNA, 103 bp, Mus musculus
atgtgtatgtatatgatgtatatgtatgtatatatgtatgtgtatgcatatgatgtatatgtatatgatgtatattatgtatatgatgtatatgatgtatatg

SEQ ID NO: 91460 - DNA, 101 bp, Mus musculus
gacacagagacagagacaatatatatatatatatatatacatacatatgtgtgtacgtatatgtgtatatgtatatatatatatatatatgtatatgtgtc

SEQ ID NO: 91461 - DNA, 109 bp, Mus musculus
gtattgagaaattagacagctttcattaattatgtcatgtaatttattattttgttcaagaaagtagaatacggtaattcagtaaatgtggaggactgtttctcatgac

SEQ ID NO: 91462 - DNA, 170 bp, Mus musculus
tatgtattatatatacatatatatacacacatatatatacacaaatatatatatatcttgtgtttatatacatatatatgtataatttcatatatatatgtgtgtgtgtgtgtatacatatatgtatacatagtgtgtgtgtgtgtgtgtgtgtgtgcctatatgtatat

SEQ ID NO: 91463 - DNA, 111 bp, Mus musculus
atgtatacacacacacacacatatatatatgaaattatacatatatatgtatataaacacaagatatatatatatttgtgtatatatatgtgtgtatatatatgtatatat

SEQ ID NO: 91464 - DNA, 96 bp, Mus musculus
gaggcatagacttcagtattttattctgaaatggaaagttagatctatttttataattccagtactatagggaatgaaatttttagctgtgatttc

SEQ ID NO: 91465 - DNA, 107 bp, Mus musculus
cttttggacataagtgttaggagagagtttcatgactacatcacagattactagtgttattgatgttgtatgtcctattaactctcttggatagaaaatggtagaga

SEQ ID NO: 91466 - DNA, 118 bp, Mus musculus
caatatgtggaagatgaaggcagaaaggtcaggagttaaagacatccttggatactgagcaagtcacagaagagtctgtgctccaggagacccggtctcaaaaaaattccccatattg

SEQ ID NO: 91467 - DNA, 82 bp, Mus musculus
tgtcaagcttcagaattacagctgagcctggaagctgattcagcatcaatgactcactctctgtatcttctggtccttggta

SEQ ID NO: 91468 - DNA, 87 bp, Mus musculus
atacaaatataagtaaatatatatagtatatatgtgcaatacatttattacatatatgtatatatgtgtatatatgtatatatgtgt

SEQ ID NO: 91469 - DNA, 85 bp, Mus musculus
ggccatggtggtctgataggatacatgggacaatttcaatatttttgtatctgtcgaggcctgttttgtgaccaattatatggtc

SEQ ID NO: 91470 - DNA, 107 bp, Mus musculus
tgattttgtgtgtgcatgtggccatgtgggcatgtgtgggtgtgtgtgcgcgagcgtgcgcgcgcaagcacacataaacatttgccaaagcattccagtagagctca

SEQ ID NO: 91471 - DNA, 85 bp, Mus musculus; identical to SEQ ID NO: 57439

SEQ ID NO: 91472 - DNA, 106 bp, Mus musculus
gtagcagggattttgtccttctttattaatgtttgcaatacttgtgagtactctcccagtctctcttacatattggagacagtgtattatcagattcatccattac

SEQ ID NO: 91473 - DNA, 107 bp, Mus musculus
ttaaattttatagcatgactttcattttaaaaattaattatacttatttcaactgtgattaaaaaattacttgtatataaataaaaagtctatgcagtgaaatttaa

SEQ ID NO: 91474 - DNA, 117 bp, Mus musculus
gaaatgtatataaagaaaataactaaatatatgtatgtgtatgtatatatatatatatatatatatatatatatatatatatatatatatattccctatctttttaaatgtctgttc

SEQ ID NO: 91475 - DNA, 105 bp, Mus musculus
ctggaactctgatgagagggatgtgatgaggtcctctcatatagagctgtgtctctatctctctgcataatttctggtctttgtaattgttcccgtctcagcaga

SEQ ID NO: 91476 - DNA, 92 bp, Mus musculus
gtatgtgatatgcttctgtaagttttgccatattgcttcaggtgacaatctcgctgaagtgtgtgagcactcaacctgagcatgggacctgc

SEQ ID NO: 91477 - DNA, 84 bp, Mus musculus
gcagttatgtctgtattattaggctttgacttttctatttgttctttagaattgtctttttttggtggacagaaaataaaaggc

SEQ ID NO: 91478 - DNA, 114 bp, Mus musculus
ggctcggtaccccagaaggcaactcttatggatgaaaggatttaattgtggatgttttctgtttcagaagatcacacattctctaattggtgggaagcctggtggttctgagac

SEQ ID NO: 91479 - DNA, 72 bp, Mus musculus
agagagacacggactctcacacacgtcaagctttgctaactaaaaggatatgacactgtagcctgtctctct

SEQ ID NO: 91480 - DNA, 85 bp, Mus musculus; identical to SEQ ID NO: 57439

SEQ ID NO: 91481 - DNA, 87 bp, Mus musculus
gtgaggattcagtgacagaaaagtgagatcagaggggattcgaagctgaaactttggtttcactaaggattcagcacaagtcctcac

SEQ ID NO: 91482 - DNA, 85 bp, Mus musculus; identical to SEQ ID NO: 57439

SEQ ID NO: 91483 - DNA, 113 bp, Mus musculus
gtaactatggtgaagggggttatttccctaatttctttctcagcctgtttatcattttttatcaaagaaggctactgatttatttgagttaatttcctatccggccactttgc

SEQ ID NO: 91484 - DNA, 77 bp, Mus musculus
ttcttaccatgtccatttaaagttgtgtgtcaaatgtgtgtgtgcacacactcacacgcacttgggtatgttgggga

SEQ ID NO: 91485 - DNA, 104 bp, Mus musculus
gagctctttgtgttacttattctctctcgctttgtggattgttaacatgattgttctatactgaacagctaatgtccacttataagtgagtaaatactatgttt

SEQ ID NO: 91486 - DNA, 74 bp, Mus musculus
gtgtgtgcgtgtatgtgtctctgtgtgtgtaaattaagtaaaaaattgcatagacttagtacatatgtatatat

SEQ ID NO: 91487 - DNA, 109 bp, Mus musculus
gtattgcatgctcactagaggaagtaagtcatggggatggctccacatattctctctgtgcttcttgaatgtggatgcaatatgaccaatctgtttactcgtcctgtgg

SEQ ID NO: 91488 - DNA, 77 bp, Mus musculus
caggcattaatatcagaactctgtcactagagacatgttgttatgtcattagtgtctctgctttgacagtgtgcttg

SEQ ID NO: 91489 - DNA, 110 bp, Mus musculus
gtgagaaggtgcatgtgcatatatgtatgtgcatgtgtatatgtgtgtacatgtgtgtatatatatgtctatgtgtgtatgtgtacatgtgtgtgaatgtacttgtgtac

SEQ ID NO: 91490 - DNA, 162 bp, Mus musculus
tatacatatacatatatatacacataaatgtatatacacacatatatacatatatatgtatatatacacatatatgtatatacacacatatatacatatatatgtacatatatatacatatgtacatatatatacatatgtacatatatatgtatatatatg

SEQ ID NO: 91491 - DNA, 114 bp, Mus musculus
tatatatgtacatatatatgtatatatgtgtgtatatacatatatgtgtatatatacatatatatgtatatatgtgtgtatatacatttatgtgtatatatatgtatatgtata

SEQ ID NO: 91492 - DNA, 102 bp, Mus musculus
ctattgtgttgtttacttgaaccctacttccttaagacaaacttttaaagatatgtatctatttttatagcagttccagggggaaggcagttacacaatcag

SEQ ID NO: 91493 - DNA, 115 bp, Mus musculus
tcactgtccttcatgctgataccttgtaagcccccaccctcactcactgacgctgtagcttcctccacagtgagacggtttcggatggtctcataggtcttgctgtttaaggtgg

SEQ ID NO: 91494 - DNA, 83 bp, Mus musculus
tcatcttgttgagttactggctaaaggtacctcattgacctctagtcaaaactcaggcagctatgaggaaatgtaggcagtaa

SEQ ID NO: 91495 - DNA, 125 bp, Mus musculus
atgtgtgtgtatgttatatgtttgtatgtatgtgtgtgtgtatatatatatatacataatatatataatatatataaatataaatatatatatatatatacacattcctacttagtgtttataat

SEQ ID NO: 91496 - DNA, 66 bp, Mus musculus
gtgtctgcctcagtccctgagactcgggacctgcagcttccgttttcagctaggctggcagccagc

SEQ ID NO: 91497 - DNA, 106 bp, Mus musculus
ttccttcagtgtgtttaaaataaaattctatgaattctgattatgttgttcacttgtagcatcctgatgcatggttcgtaatatattttattgctgactgaatgag

SEQ ID NO: 91498 - DNA, 106 bp, Mus musculus
ctgaaaagggtaagcatgaaagtggcacatttatgtcctatatttaattatttttgcacataagacattttgtgcaaattttttcacctcttgcaactcaactcag

SEQ ID NO: 91499 - DNA, 71 bp, Mus musculus
taagcctgaaggatgcttgaatgcttagtctatcctagttgaggctgagcacagtgccactgctgagcttg

SEQ ID NO: 91500 - DNA, 133 bp, Mus musculus
ttgaccactatgtttttctgggaagcctaggatggattctttagcctgattaaatgcttgtagattctatattgttaaaggttttgtgattacatgctggttagactatttagatcataactgggttgagctt

SEQ ID NO: 91501 - DNA, 114 bp, Mus musculus
taaagtattttttaattaagtagttacaggctagaacccaggcactgtttcaatttatattttatgactaagtctgagagcatttctatctgttttacccattttaatactttg

SEQ ID NO: 91502 - DNA, 113 bp, Mus musculus
tacagacatgtatatacatataagtatatatgtatatgtgtatataatgtacatatgatggatatataatgtatatatgaatgtgtataatatatgcatttatatgtgtatat

SEQ ID NO: 91503 - DNA, 113 bp, Mus musculus
tcacatttttctgtctcccagttttttttttttaaggatgtattacatttatcaatttatgtatgttgaaccatccttgcattttggaaatgaagcttacttgattaatgtgg

SEQ ID NO: 91504 - DNA, 80 bp, Mus musculus
tagtgtgtgtgtatgtctgtgtttgtgtgtgcatgtgcatgcataggtacaggtgcacgtggaggccagaagcaccactg

SEQ ID NO: 91505 - DNA, 71 bp, Mus musculus
gctatgctctcagccacactgtaagactagtttgcttgcttgtttgctgcctgtctggctggctggctggc

SEQ ID NO: 91506 - DNA, 64 bp, Mus musculus
gtatgtatgtatgtatgtatgtatgtatgtatgtatgtaggtaggtatgtatatatgtatgtat

SEQ ID NO: 91507 - DNA, 88 bp, Mus musculus
gtgtttgctggtggtttcagctatttttataagtatatattcatacttcataaacacatgcacagatacacacatatgcagcatacac

SEQ ID NO: 91508 - DNA, 91 bp, Mus musculus
cttttcaggacatttgcaccataggtataaaacatgggcacatttgttttttaatgtctgttcttatgtattggttggtcatccttgaaag

SEQ ID NO: 91509 - DNA, 108 bp, Mus musculus
agaatcagagagacaccaactgttcactataagattttttacttttctaaatagatggggaggtttccatactattcaaaagtcttgggctaaagggatttctgctct

SEQ ID NO: 91510 - DNA, 110 bp, Mus musculus
cagaaggtaattttatggttacgaagaatgagtttgcatttgtttgtgtagttactatataaatttatagatgcattttgtttgtaccacattttaaattttactggttg

SEQ ID NO: 91511 - DNA, 85 bp, Mus musculus; identical to SEQ ID NO: 57439

SEQ ID NO: 91512 - DNA, 89 bp, Mus musculus
tggactgtgcttctctctgcctgtgtgaattatagccaccattcaagtctcacttgctttatataatcctccaggttctgtatagtcca

SEQ ID NO: 91513 - DNA, 62 bp, Mus musculus
ggtatgtgtgatcaatgtgacatgcatgtgtatgtatgcatgtttgtatgagtgtgggtacc

SEQ ID NO: 91514 - DNA, 117 bp, Mus musculus
gaatacaggaggctttgtttatctcaaaggtatgccaaaggacacagaagagagtaagcaggaaggtgattttgagggcagaaaacacctgggagagacaggtcttgcctttgattc

SEQ ID NO: 91515 - DNA, 117 bp, Mus musculus
agtcttttcttggtcaagggtgctgtgtcagcaaagtgtctcattgtctctctttttaaaaaaatggggataataaaccttgccacctgcctgcctcacagcgatattaagaatact

SEQ ID NO: 91516 - DNA, 91 bp, Mus musculus
aagtgatattaagggttttagtggccacgcatccctccagcagtggcttcgcagtggagggagatctcactgttgactttttatatgactt

SEQ ID NO: 91517 - DNA, 83 bp, Mus musculus
tgttcttggaagggctggagagatgactcagtgctcaagggcactgactgctcttccagaggtcctgagttcaattcccagcc

SEQ ID NO: 91518 - DNA, 74 bp, Mus musculus
ggacagcctcgggtttgaggccaacctgggctatgagttaccttgcctgcctgcctgcatgcctgtctctgtct

SEQ ID NO: 91519 - DNA, 90 bp, Mus musculus
tggctgctgtcttttttcaccgaaaattattattttccttttgtagtaactgggccgtatagggaaatgttgagtgtatggcttcagtca

SEQ ID NO: 91520 - DNA, 83 bp, Mus musculus
caggtgcccagggtttacctctggcacacagtctgtgtctggtcttacagacaactgaggactagagggtggttgggtggttg

SEQ ID NO: 91521 - DNA, 76 bp, Mus musculus
acacacatatatgtgtatagatgtatgtatatatatatacatatgtgcatatatgtatatatatatatatgtgtgt

SEQ ID NO: 91522 - DNA, 104 bp, Mus musculus
cagttctgttgtagtgtgagaatcacagagttcactagccaaccctgtcacatgacagtgaggaccatgagtgactctgcttcactgaatacactgatgcactg

SEQ ID NO: 91523 - DNA, 86 bp, Mus musculus
ttgaactgctcactttgtgagcttttccagaggctgtggatgaaccatgggctctggtagtaggtagtggagggttggcagtccgg

SEQ ID NO: 91524 - DNA, 72 bp, Mus musculus
catgtgtacttgtgtgtctctgtgtgtgtacgtgcgtgtgctctcatgtgcacaaaagagaaagtgtgtgtg

SEQ ID NO: 91525 - DNA, 112 bp, Mus musculus
caatctttgcagtataatttgaaatcaggatgctgatagctctagaatttttttttattcagaaatgttttggttctcctgggtgtcttgtatttccgcatgcatttggcga

SEQ ID NO: 91526 - DNA, 96 bp, Mus musculus
gatcagccttagtccatggtgatctgataggatgcatgggataatttcaatatttttgtatctgttgaggcttgttttgtgactaattatttgatc

SEQ ID NO: 91527 - DNA, 98 bp, Mus musculus
tgactgattggaatcgctagagtggccagtgtttcagaattgcttgctgatttacataattgtaagaagaaacagtggatagatggtttgagaagtca

SEQ ID NO: 91528 - DNA, 74 bp, Mus musculus
gagagtgcttgcagtagtgcacaaggctctgggtttagtacccaggactgccaatcactcactcactcactctc

SEQ ID NO: 91529 - DNA, 93 bp, Mus musculus
acgtggtcttcatctgggtcctcaaacaagtagggcaggggctgtctctgtctctgtcccttccattgattggacttcagtgggagagaatgt

SEQ ID NO: 91530 - DNA, 112 bp, Mus musculus
atattcagtgggagtcagaaagctcatgggaagatgagaggcttgttgtctgttctcacttaaaattcctatgtgtttataacctttaccttctaagactcctaaaaaatat

SEQ ID NO: 91531 - DNA, 87 bp, Mus musculus
gggcagcatttcacagaactgactctgctggtatgggtgtgagtgagccagtcccatgacatgagagttggaaatctgggtttgcct

SEQ ID NO: 91532 - DNA, 115 bp, Mus musculus
tcctttgcccagagagctgactgttcacacaactctggaagacttctgatatagaactgcacatttgaccctgggaagtgtctagaaagttgagctcagccaatttgacaaaaga

SEQ ID NO: 91533 - DNA, 82 bp, Mus musculus
tatatatatatatatatatatatatatatatatatataaatatgcatatatatgtatgtgtacatatatatgtatatatatg

SEQ ID NO: 91534 - DNA, 85 bp, Mus musculus; identical to SEQ ID NO: 57439

SEQ ID NO: 91535 - DNA, 114 bp, Mus musculus
gaatacattgaaagcagttctcttcatcacttctggagagcagaaagacaagatagagtcctcagagacgctacgctcatcttctgcctccactggggctcctctcttagattc

SEQ ID NO: 91536 - DNA, 86 bp, Mus musculus
gcatgtgtccttattacatattggagtatcttctgggtattgctggagtctctggtagtactatgtccaattttctgagaaactgc

SEQ ID NO: 91537 - DNA, 111 bp, Mus musculus
ctccactaggatctgcttagaccccggaaatggaggcagagagtaaagagagtccacaataggtagtctgttacaaatgctgggaatgagactggggaactgggcttggag

SEQ ID NO: 91538 - DNA, 84 bp, Mus musculus
agcatacatattttattgcatgtatatatgtatgtatgttttatatacattatacatatatacatgtatataaatatgcatgtt

SEQ ID NO: 91539 - DNA, 89 bp, Mus musculus
gcatttgatagagatatctcatttctggctgagtgttccaaggtctatcactgtctccaaactgtcaggctgtgtgtctctgttcttgt

SEQ ID NO: 91540 - DNA, 109 bp, Mus musculus
ctctgcagcatggatgtggctgttgggggaaagctctgttcataatatacatacatataagtgtatatatttatctactgagagctcttataaaatttagctgatagag

SEQ ID NO: 91541 - DNA, 115 bp, Mus musculus
tcggtagcaagtgtcttctgctatcacatctgctgtatggatgtcaagtgtttatgtccaagttacccttacttattccccaatgcaaggatcatgatgctagaaacttgaatga

SEQ ID NO: 91542 - DNA, 115 bp, Mus musculus
gaagactggctacctttgaagttacaggcctggactcttctcagctacagctcagaagacagagagctctagcagtgacagagccacaccccatcagcttttgagactaatctcc

SEQ ID NO: 91543 - DNA, 79 bp, Mus musculus
caggccaccatgtgataatgggaaatgcactttagattcaggttctcctgtgtatgtgtgtgtgtgtcagtggggcagg

SEQ ID NO: 91544 - DNA, 100 bp, Mus musculus
tgttgccccatgggacccaataacatgggaagtcaagaaagtagatgtgtgtacccactgtccctctcactgccatgttgtccagtgccatctgtcaata

SEQ ID NO: 91545 - DNA, 112 bp, Mus musculus
taatgacttggtggaaggccagccccattctaagattacttgccacttttaatgtttatttatccaacaaataaatgtaggtgccagtagttgagctgggcactgaggattg

SEQ ID NO: 91546 - DNA, 99 bp, Mus musculus
gtgataactacagcacagaatgtcctgaagtagagaagaagtcctgccctgatttatatttgtatttcaacccttgggcctctgtgtacttgatattgc

SEQ ID NO: 91547 - DNA, 102 bp, Mus musculus
ggtggaaggaatgagtaccttatttgttcaccacacttaccatgcatatttatttttaaatggtcaagtttctgaaccaaactaaattactttccctcctcc

SEQ ID NO: 91548 - DNA, 88 bp, Mus musculus
aagcatcacaggcagagtcaagcgaggacagagatggatgctgcctgcctgcctgcctgcctgcttgctgtcaagtagcatccctctc

SEQ ID NO: 91549 - DNA, 111 bp, Mus musculus
ctgacgtttttgtcttcagacggttttatttatgtctctgactaacatggacagtcaatctctctgtccacatgaaagacatggagagaaaaggggggagaaagacagcag

SEQ ID NO: 91550 - DNA, 91 bp, Mus musculus
gggtggggtaagtagatagctggaggcatgtcctttgagggttttatcttgccatgactcctgactgtctgtctttctctacttcttgcct

SEQ ID NO: 91551 - DNA, 116 bp, Mus musculus
gtgtctgtccactggaaggggatacgtaacagatcttcctacttctgagtctcactctttccctggtacccagactacagaatcgggagctctatgtctcatttggtaggcgatgt

SEQ ID NO: 91552 - DNA, 138 bp, Mus musculus
cccagtgtctctctacctgcatgcctccagatcaggatataagctctcaatcccatgcctgcctgcctgcctgcctgcctgcctcctgtctttttgttttttgtgggttttttttgggggggggggttgtttttgttt

SEQ ID NO: 91553 - DNA, 112 bp, Mus musculus
atggaggacactggggctgttgagatggctcagcggttaagagcactgactgctcttccaaaagttctgagttcaaatcccaacaaccacacggtggctcacaaccatccat

SEQ ID NO: 91554 - DNA, 108 bp, Mus musculus
tctgtgatgcggagcaggggcagggccaagaggacgtgttgaatgaatccacaacttacacacacagacactcaaatggcatccaggcctacagtgagtcctcacaga

SEQ ID NO: 91555 - DNA, 79 bp, Mus musculus
aggctaagcaccgttgtcctttcagagggaagggtcataaacccctgcctcacccactgagtcactggtgacctggtct

SEQ ID NO: 91556 - DNA, 96 bp, Mus musculus
gtatggagttatacctagtaaattatacatatatagattgacatgtttttgtatagctatagtctatatgtaattgattccctactaagtctgtac

SEQ ID NO: 91557 - DNA, 124 bp, Mus musculus
tgacacacaaaatagcactcaatgacctccccccactcccagactctctcagcctctctctctctctaagggagggggccctacaaatgagacctttgcgtcacagggaagaggaagcgatggg

SEQ ID NO: 91558 - DNA, 83 bp, Mus musculus
gaacacagtacgtgaaatactgagagctggggtcactgaaggagtagagatgtctcagtggcagttgttacttgattttgttc

SEQ ID NO: 91559 - DNA, 65 bp, Mus musculus
gcttgatgactgcagtacagcctctctgttgctctgtgactccagagctgactgtcctcacttgc

SEQ ID NO: 91560 - DNA, 85 bp, Mus musculus
atatatatatatatatatatacacaaatatatgtgtatatagatgtatgtttatgtttctgcagtatgtgtatatatatttgtgt

SEQ ID NO: 91561 - DNA, 114 bp, Mus musculus
gctatagactttgttatttataagggaaaatatttgtacttagaaactctcattttattacaatcagatgcaagttgaccaactttattggccttcgtagatgtcatctatagc

SEQ ID NO: 91562 - DNA, 76 bp, Mus musculus
attcatgaatttatgtacacgagagcagcgctgtttacctcagtggactgtgatatgtatgtatgtatgtatgaat

SEQ ID NO: 91563 - DNA, 85 bp, Mus musculus; identical to SEQ ID NO: 57439

SEQ ID NO: 91564 - DNA, 83 bp, Mus musculus
gttttgttttgttttaattgtccttctggtggacactgctcttacagtcttcctggaagttcagaaaaaaacccaagctcagc

SEQ ID NO: 91565 - DNA, 154 bp, Mus musculus
gtatacagatacatatatatgtatatctatatatacatatatagatatatatagagatacatatatatgtatatatagagagtatatgtatatatacatgtatatatgtatatatatatatatatatatatatatgcatgtgtgtgtgtgtatg

SEQ ID NO: 91566 - DNA, 85 bp, Mus musculus; identical to SEQ ID NO: 91469

SEQ ID NO: 91567 - DNA, 122 bp, Mus musculus
tggctgtggcatttattacagcaacagataccagattagtacagaaatagaacttacttctctatgtgtgtgcagatgctgctggagtgctcagtcacttatatatgcatgtatgtagagaa

SEQ ID NO: 91568 - DNA, 85 bp, Mus musculus; identical to SEQ ID NO: 57470

SEQ ID NO: 91569 - DNA, 79 bp, Mus musculus
gacaagatgttatcagagtgtggtcagctgtggtgggcttcttgcaagaacatcatgctaagaaaacaagtctcttgtc

SEQ ID NO: 91570 - DNA, 109 bp, Mus musculus
atgcatatagctacatattcacatatgtatatattatgtatatatgtgtatgccacacaaatacatatatatgcatatatatgtgtgtatatatatgtgtgtatacata

SEQ ID NO: 91571 - DNA, 85 bp, Mus musculus; identical to SEQ ID NO: 57470

SEQ ID NO: 91572 - DNA, 82 bp, Mus musculus
attttaaaagtctccagggtgggggattttaattctttattttagaagataatgttttactcttgctggtgactttttgaat

SEQ ID NO: 91573 - DNA, 72 bp, Mus musculus
cagaaggatccggtttctcatgcgtgtgttcttgctggcgagacaatagtgcgtgtgagagggggtcatctg

SEQ ID NO: 91574 - DNA, 158 bp, Mus musculus
catatatatgtgtttgtatgtatgtttgcatgtgtatgtatgtatgtatgtatgtatataaacatatatgtatagacacacacacacacacacacacacacatatatatatgtatatatatatatatatatatatatatatatatatatatatatatg

SEQ ID NO: 91575 - DNA, 74 bp, Mus musculus
gtagcagatgtgcagtttggtcttcctgtgggtcccctgacaattgaagcagggactgtctctgactctgttac

SEQ ID NO: 91576 - DNA, 105 bp, Mus musculus
ccattgattagcttctcttcttaactgttgaactttgtatgtatatatgtataggcatacataaatatgcatgaaggacccactaggagacaggttctcttttgg

SEQ ID NO: 91577 - DNA, 79 bp, Mus musculus
ggtggtggtggtggtgggagaccatagtgttctcggtatagtgttctggaacactctctctctgtagaccagactggcc

SEQ ID NO: 91578 - DNA, 91 bp, Mus musculus
gttatttcttgttaatattctcattgtgtagttgtcatttcatgaagtgagcactatatttaagcaatgggaacatttacttatttataac

SEQ ID NO: 91579 - DNA, 122 bp, Mus musculus
gagtgccttgagaaataattaagcttatatatatatgtgtgtatatatatatatatacatgtgtgtacatatatatatatatgcacatttatgttaatttgaagatttataactccaagaca

SEQ ID NO: 91580 - DNA, 62 bp, Mus musculus
ataaatgtgcatatatatatatatgtacacacatgtatatatatatatatacacacatatat

SEQ ID NO: 91581 - DNA, 97 bp, Mus musculus
caaagaaaggaaagaggtaaagacacgctagtatagagaaaatgttgttgtaagggtgggttctcactagagtggctgtgacacaggcctggctgtg

SEQ ID NO: 91582 - DNA, 91 bp, Mus musculus
tatgcctcactatgtgtgtatatatgtagaagccagagattgatattagctgtctatctcagtccttctcaaccatatttattgagacatg

SEQ ID NO: 91583 - DNA, 90 bp, Mus musculus
ttgtctggttgtaccactgattattgcaacatgagaactgatgtctccacccatcagtctcagcgtctgtctgtcttatagctctgtcaa

SEQ ID NO: 91584 - DNA, 95 bp, Mus musculus
catgccagagccaggttcactctcagtctgtggatcaggatgtgactttccgctactgctccagcattgagtgtgccactatgctacatgccatg

SEQ ID NO: 91585 - DNA, 98 bp, Mus musculus
agaagtatatttccatggtgactataaattcagagaatggtgaaggataattaacactaaaacttttttttttgaaaaaccatgtggaaatatactct

SEQ ID NO: 91586 - DNA, 95 bp, Mus musculus
catatacatgcatacacatgtgtgacacatatatgtacatatatgtgtgtgtatatatatgtatatatgtgtacatatatatatgtacatatata

SEQ ID NO: 91587 - DNA, 138 bp, Mus musculus
gccccgaatctaatgagttatgatactgcaaagcctcaaacgttcaggcactgtggatgcctgcctgtctgtctgtctgtctgcctcttaagtagattctgtggcgcagaacccaggattgatttttctgatttttgg

SEQ ID NO: 91588 - DNA, 80 bp, Mus musculus
tcagactgactcacacactgtagaatgctgggtggccacatgctacacagttccaattaaacagatggagtgagttctgg

SEQ ID NO: 91589 - DNA, 80 bp, Mus musculus
tctatctctgtgtgtgtgtgtgtgtgtgtgcgcgcgcgcgtgtgtgtgcccatgctttatatgtttactgctttgataga

SEQ ID NO: 91590 - DNA, 64 bp, Mus musculus
cttcagcagggtgtcctgtcagtctgtctctcttatgggagttagtcctagatataccatgaag

SEQ ID NO: 91591 - DNA, 74 bp, Mus musculus
tataatgaaccagcatgcctgtgtgcctctcactgagagaagttcccatcatacagactatgctgtgtgttata

SEQ ID NO: 91592 - DNA, 92 bp, Mus musculus
gagttaggtaaatctccaagattttgttgtgctgtatataaatatgtttagatacaatcacaatacagtcttcaaaccgaataacaggactc

SEQ ID NO: 91593 - DNA, 86 bp, Mus musculus
gtagagtatttaataagctgggtgtctgctgggtaccaagcttcacttgggtgctgagagaggagagtgattaaagagtatttggc

SEQ ID NO: 91594 - DNA, 105 bp, Mus musculus
gcagaggacctagctcagaccatgcagaatccatgtttgtcacttcagtctctgtgagctcctctgagacctgtttagttgactctgtggtctgtgttcttatgc

SEQ ID NO: 91595 - DNA, 96 bp, Mus musculus
atacacgtatatgtatatacacaaaacacatacatacacacatatatatatgtatgtatatgtgtatatatgtgtttatatatatgtgtatatata

SEQ ID NO: 91596 - DNA, 71 bp, Mus musculus
cagtgagcatagctcagttgtgagtgtgtgacactcagtcacacaggatcagctgagcagatacatcaggg

SEQ ID NO: 91597 - DNA, 98 bp, Mus musculus
ggatgctgtgggtctttaacactgaactgagtctgctgagacatacatcttcttggactgagcagctctcactcatgttcctggcctctccagcatgc

SEQ ID NO: 91598 - DNA, 110 bp, Mus musculus
gatatctgttacatccatttttttaataacttctgttagtttcactgtgtctctgtttagtttctgtttccaggatgtgtctattgatgagagtggggtgttgtagtctc

SEQ ID NO: 91599 - DNA, 78 bp, Mus musculus
gtatgtgtatatatatatacacatatacatgtatttgtgtgtgtatgtatgtatgtgtgtatgtatgtatgtatgtat

SEQ ID NO: 91600 - DNA, 85 bp, Mus musculus; identical to SEQ ID NO: 57470

SEQ ID NO: 91601 - DNA, 103 bp, Mus musculus
cttgtctttatactcatttgtaaatgtaacctctactcctcaccatgaatttttttttttcatagaagaaggaggccattacagaaattcacaactggacaag

SEQ ID NO: 91602 - DNA, 75 bp, Mus musculus
tcagagacactggcaatgacacttggtctttaaacaaggggaaactctccaaaggatgtctgtctgtctgtctga

SEQ ID NO: 91603 - DNA, 64 bp, Mus musculus
tggtttgcctcactcagtgactccaaaaagtccctcagggactcactgagaggagtgcttctca

SEQ ID NO: 91604 - DNA, 104 bp, Mus musculus
cagatgtggatatgctctagctctgggtcctcaggctttccacttgctgacttaaaacttcactctgtctgcctgtctgcctgcctgtctgtctgcctgtctgc

SEQ ID NO: 91605 - DNA, 79 bp, Mus musculus
acttctgttagtttcactgtgtctctgtttagtttctgtttccaggatctgtccattgatgagagtgtgctgttgaagt

SEQ ID NO: 91606 - DNA, 114 bp, Mus musculus
tatacatgtatatatgaatatatgtacatacgtatatatgtatatatgtatgtatatatgtacatatgtatgtgtgtgtgtatatatatatatatatatatatatatatatata

SEQ ID NO: 91607 - DNA, 100 bp, Mus musculus
agagcagagcagtatggccatatgaggatgcatatgtatgaatttatgggtctcggctctatctatctatctatctatctatctatctatctctctctct

SEQ ID NO: 91608 - DNA, 111 bp, Mus musculus
catgaggaaagtctgggtgtgtgatcaaaatataaccaccccttcgactcagaagagtgtcaggaatgcatgtgtgtttacagattgtagattagtagaattttagttatg

SEQ ID NO: 91609 - DNA, 117 bp, Mus musculus
atgcttcatgacccaatatgtagcttattgtaatgaaggccccatggcatgcttagaagagtgtgtgctctctacacatggatggaatgctctgtagctatgtgtgatggtttgtat

SEQ ID NO: 91610 - DNA, 71 bp, Mus musculus
tatgtgtgtgtgtgcatgtggatgtgtgtatgcatgctgtgtacatgtttctgtgtgtgtgtgtgtgtgtg

SEQ ID NO: 91611 - DNA, 100 bp, Mus musculus
tatctgagcatgatattgtcattatatatagactcttgaagtatgtttatatttcaatgtagtcatttcaaaaatgaccttgtcttagttataacagatg

SEQ ID NO: 91612 - DNA, 80 bp, Mus musculus
tccccccgcccccttcttttgtcctgtcttgtttgttgtggctctaatttagcaaacaagagagcaaagatgtgagggga

SEQ ID NO: 91613 - DNA, 96 bp, Mus musculus
gacttaattaaagttttctattatacaggctttctgaatctgcaactctatgagtatatattagagaatctgtatgtttgatgaatatcattagtc

SEQ ID NO: 91614 - DNA, 81 bp, Mus musculus
aggacagaagagaatgaggtcagtggttagcaaggtcagctttagggtggcatttggctggatttcactcttgatggtcct

SEQ ID NO: 91615 - DNA, 112 bp, Mus musculus
tgtacctgtatgttaccaacacaaatgggaaaataatgctatagtgccattcattctatatttatgtaatgcaataaggtataactcctgagcctttggaagagaaggtgca

SEQ ID NO: 91616 - DNA, 90 bp, Mus musculus
ctttctgcacccatcactgtggctctctgggtggctgcctgtgcctcagcagttggccacaatcaggcgaaccagtttggaagctgaaag

SEQ ID NO: 91617 - DNA, 76 bp, Mus musculus
agacctggaaggatgatgacgaggcttgtcttggcgtgattgatgtcaggcacgagtttaacctcccttcttgtct

SEQ ID NO: 91618 - DNA, 67 bp, Mus musculus
ggcagtagaagggacctttttttctcatctgtaaaacacagatgtggcagctgggttcattgactcc

SEQ ID NO: 91619 - DNA, 68 bp, Mus musculus
agggtgctgcctcagtccctctgtgcttctgcctgttccagaggctgtcagggtctctggcgctccct

SEQ ID NO: 91620 - DNA, 81 bp, Mus musculus
gtacacacacacacatatatatgtatatatatacacacatatatacggatatacatatatatgtataagtcttgtgtttac

SEQ ID NO: 91621 - DNA, 84 bp, Mus musculus
tatatatgtatatccgtatatatgtgtgtatatatatacatatatatgtgtgtgtgtgtacatgtatatgtgtgtgcatatata

SEQ ID NO: 91622 - DNA, 75 bp, Mus musculus
gctttcaatggaactgcatacaatggaggctcagttgctcacagtcactgagactgctatgcatcatgtaagagt

SEQ ID NO: 91623 - DNA, 120 bp, Mus musculus
aggctgtccttgccacctccgtactgctgtgcagtcatgtgtctctcttttagtctctggtttcccctggaagagaggcacagacaaagcgcagcagctataaggactcctatggtatgg

SEQ ID NO: 91624 - DNA, 79 bp, Mus musculus
tcatttttttgtgtttaatcttgaagatgcttcaaattctacctgagaaggatatcatggttgagtacataaaaagtga

SEQ ID NO: 91625 - DNA, 85 bp, Mus musculus; identical to SEQ ID NO: 57470

SEQ ID NO: 91626 - DNA, 73 bp, Mus musculus
ctggggttggccgtgaggtttcagaagctaaaagccagggctagtggctcactgtctctctttctgcctgtag

SEQ ID NO: 91627 - DNA, 117 bp, Mus musculus
gaggttccttattcccagatgactacagcttgtgtcaaggtggcataaaactatccaacaaagtggatgtcaattgcatatagcttcttgatcaaggtgggatcccctgtacacttc

SEQ ID NO: 91628 - DNA, 72 bp, Mus musculus
agggcttatgttgcagcgttcaaagggtaaatgtgcgtgtgtgtctctttgactctctgtgatttaggtttt

SEQ ID NO: 91629 - DNA, 98 bp, Mus musculus
gacgtagaagtttgcgtgtgagagtttgagtgtttggtatggcagtgaggacattcaagactaggcactgctcctcacatttaacacaattctgcgtt

SEQ ID NO: 91630 - DNA, 88 bp, Mus musculus; identical to SEQ ID NO: 81708

SEQ ID NO: 91631 - DNA, 74 bp, Mus musculus
gcttgagtgagctcttcatgatgttgatgctgctggcccacagagctcaactggtatagaacagctcattcagt

SEQ ID NO: 91632 - DNA, 70 bp, Mus musculus
cagtgaccacactgtggaacttgaattgcagacatatgcaaacccttgtttctctctgtcttagtcactg

SEQ ID NO: 91633 - DNA, 68 bp, Mus musculus
ttgtctatcgtctctgcccttctgttcattttaattgggtgaagagaggcagcagagtgcacagagaa

SEQ ID NO: 91634 - DNA, 108 bp, Mus musculus
tgctgcctgcagatctatatgtagctatatgtatctatattctgtatctatatgtatctatattttgtatctatatgttgctgtatattctccgctacttctccagca

SEQ ID NO: 91635 - DNA, 109 bp, Mus musculus
ccagcatagtagatgacagtagagatctcaaatgacagggagctatcaagcgtggatatcctagactatggttggctttgactcagtgagaactgttaaagtattttgg

SEQ ID NO: 91636 - DNA, 72 bp, Mus musculus
ccaactccttctcttgtcttttgaggcagtgtctctcactgaatctgaagcacacagttttgactgagctgg

SEQ ID NO: 91637 - DNA, 86 bp, Mus musculus
taggtgaatggaaactctttaagcatgtctgtgagagaaaacaactattcaaactacagacatgaggagatattaatattcattta

SEQ ID NO: 91638 - DNA, 114 bp, Mus musculus
agtgtgaggttcaaaaatatttattgaagactagagagatggctcagaagttaagagcactgactgctcttccagaagacctgggttggattcctagcgtttgtgtccataact

SEQ ID NO: 91639 - DNA, 73 bp, Mus musculus
agagaagatctattgttgagacttagttgagagtataaagagtgtactctagtgtgacagtcaggtaatctct

SEQ ID NO: 91640 - DNA, 96 bp, Mus musculus
gatcagccttaggacatggtggtctgataggatgcatgggacaatttcaatatttttgtatctgttgcggcctgttttgtcaccaattatatggtc

SEQ ID NO: 91641 - DNA, 118 bp, Mus musculus
ctggttggccatggtgtagaaggtgtgcaccatggcagtcagagactctgagagctgtgtgagctgagagagctgctcagggctgagccgggagccatgttgctgcgcctgcatctgg

SEQ ID NO: 91642 - DNA, 131 bp, Mus musculus
gcagcagacatgcagctttgtcttcatgtgggtcccctaacgattgaagcagggactgtctctgactctgttgcctgcccgtggatccccttctcctacctggacttcccggttgggcctcagtgggagag

SEQ ID NO: 91643 - DNA, 82 bp, Mus musculus
ttactatttaaggtctgtagtcacagtagggctaagtaactgacagacactctgcttaagaactgtgattttcttgaagtga

SEQ ID NO: 91644 - DNA, 117 bp, Mus musculus
gatagtaactacaagctttgtacactgtgataacaattataaggaaagttggacacagggtctctgtgtgtaacatgacttataacatcttaaaacaggtactgtaggagcggtgtc

SEQ ID NO: 91645 - DNA, 69 bp, Mus musculus
ttcacttttatactcacacatacacgcacacacacacagtgtatgtgtgtgtgtgaaaaagagagtgaa

SEQ ID NO: 91646 - DNA, 83 bp, Mus musculus
ccctcgttgaggatactgtgttggagtggtggatggaattatctcatcaaggatgccaaagaagacagtgatctctctgtggg

SEQ ID NO: 91647 - DNA, 85 bp, Mus musculus
catgcccctttctctcttctgactctctcagatccaagaacaagcatggcgttcactgatagaaagaagggattaggacttcatg

SEQ ID NO: 91648 - DNA, 118 bp, Mus musculus; identical to SEQ ID NO: 91641

SEQ ID NO: 91649 - DNA, 118 bp, Mus musculus; identical to SEQ ID NO: 91641

SEQ ID NO: 91650 - DNA, 95 bp, Mus musculus
acattttggaatattataccagcatatcttacaaggaggtctcttttgtagactactgtgtttgtagctgtattgtgatatgttttccatctagt

SEQ ID NO: 91651 - DNA, 99 bp, Mus musculus
ttctttcccctgtctatgctgaggacatatacaatttttttgtataattgcattataaattgttgtgtgatggctgggtacattagtcagagaggagaa

SEQ ID NO: 91652 - DNA, 99 bp, Mus musculus
atatatatatatatatgtgtgtgtatatatatatatatatatatatgtatatacacaaacatatatatgtgtgtatacacacacacatatatatatgta

SEQ ID NO: 91653 - DNA, 85 bp, Mus musculus; identical to SEQ ID NO: 67887

SEQ ID NO: 91654 - DNA, 78 bp, Mus musculus
agggctctctcttattctcactgaaataacactttagttttacactctagtggttaggggcttgatgatatgagtcct

SEQ ID NO: 91655 - DNA, 73 bp, Mus musculus
tatatgggtgtgaatatgtatatatgtgtatacatgcatatatatatatatatatatatgatacaaacatatg

SEQ ID NO: 91656 - DNA, 109 bp, Mus musculus
gaagctgtttgggttacatgtaaagctctcttagttgacttgatcctctgggagtctctctctcagggccaggaaactgcagtgtccccctgtgacttcaattagcctc

SEQ ID NO: 91657 - DNA, 85 bp, Mus musculus; identical to SEQ ID NO: 57439

SEQ ID NO: 91658 - DNA, 96 bp, Mus musculus
agtaccctgtgcccctccttgtcaaatagtggcagctacataggttagaaaaagaacacagtgagctttcatttgttacaagtatgcaattgtact

SEQ ID NO: 91659 - DNA, 99 bp, Mus musculus
gcagaagcacaatgcatattttaatgaatgtatgtatgaatcgggaacagttgcaactattctttaattatttacaagtggaatatgaagtgtttttgt

SEQ ID NO: 91660 - DNA, 59 bp, Mus musculus
tgtgtgctgacaggagcctgagatagctgactcttgagaggctctgtcagtgcctgaca

SEQ ID NO: 91661 - DNA, 97 bp, Mus musculus
gcaaagcaatatgtgaacctgtttggaaagagttctttgcattaattcaaatctgcattctcagtactgtttctgtgagttcatatgtgccactgct

SEQ ID NO: 91662 - DNA, 82 bp, Mus musculus
gaagcaggtgtgttggtgagcagggggaggagggaattgccacagaccctctgagtctctttgtctgcatggaaagggtttc

SEQ ID NO: 91663 - DNA, 80 bp, Mus musculus
gacatctatcctctcctggtgtcattgggaggtagtcattatttttgttcttgtaaagaaagtccaggcagtggtggtgc

SEQ ID NO: 91664 - DNA, 115 bp, Mus musculus
attcagaatgaaatcctgtgaagtcatttcctgctgccacactggtgagtacatgtgaatatgtatatgtgtgtgtctctgtatgagtgtgtccatatgaatgtgtgttgtgaat

SEQ ID NO: 91665 - DNA, 74 bp, Mus musculus
gtgcaggctattacagtcaactaagctgggctcataatgactgacaagagagtgaactgacaggtagcctgcat

SEQ ID NO: 91666 - DNA, 101 bp, Mus musculus
tagaatttcttatagagttgaatgtaaagtgaatactgattatatataataatatactgttagatacaaaatattatcatcatttttataaggttgttcta

SEQ ID NO: 91667 - DNA, 89 bp, Mus musculus
gctagctctttcagcgatctgtcccctgagcaagatatactgtcccactgtatcttgtaatagagaggacagagagagctgaggtcagc

SEQ ID NO: 91668 - DNA, 88 bp, Mus musculus
atgccaccctccctgtctcccacacttctctccagcgcagttggtggcacccaagaagtgtctttgacccctttccagaggaaggcat

SEQ ID NO: 91669 - DNA, 74 bp, Mus musculus
ctaagaagacctaaaccaccacagccataggatttagtgggagacactctgtgcctgtgatggagacttctaag

SEQ ID NO: 91670 - DNA, 63 bp, Mus musculus
agaaggtctcactgacagcctgagtcctagcggggcccaggacaccttcagtttagcccttct

SEQ ID NO: 91671 - DNA, 73 bp, Mus musculus
ttagaaagactgcaggctgccggactgcactaacttactgtctgtctgcctgcctgcctgcctgcctgcctga

SEQ ID NO: 91672 - DNA, 84 bp, Mus musculus
gagcagtttgccctaagtgtttatatttatttactgagtcacacattaccaggccagggataaaatatggaggcagacaagctc

SEQ ID NO: 91673 - DNA, 78 bp, Mus musculus
acagatgttctgggactgcaggcatgtactaccacctggctcaaaagctgtctgtctgtctgtctaccacctgtctgt

SEQ ID NO: 91674 - DNA, 66 bp, Mus musculus
gtgcggtgagtcagtgggtcagtgtgtctcttctagagcaccccggcagctcacatcctcctgtac

SEQ ID NO: 91675 - DNA, 121 bp, Mus musculus
tttgtaaaatctgaggcaagaggaattactgtttaatgggttcagattttcttgttatttataacaagaaagattaacttttatttatatgtatgtttaagtgccctaagaagccagcaga

SEQ ID NO: 91676 - DNA, 81 bp, Mus musculus
gtgtatgtatgtatgtatgtatgtgtgtgtgtgtatatatatatacatatatatatacacatatatgtatgtatgtatgta

SEQ ID NO: 91677 - DNA, 80 bp, Mus musculus
gtcatgtgtgaaatgatgagtggaatcgatttttagagatatcttaaagtggacatcactctgtcgtcagttctgttgac

SEQ ID NO: 91678 - DNA, 82 bp, Mus musculus
gaggcagctctctgtgactctgaggctaacctggtctatccagtgaattccaggccaggcagagctacagaaaccctgtctt

SEQ ID NO: 91679 - DNA, 77 bp, Mus musculus
ggatagactcttatttagggagttatataagtattagatcattctttctgtgtgtctgtgtatctgtctgtctgtct

SEQ ID NO: 91680 - DNA, 115 bp, Mus musculus
ctagtatgatatattataattatatgttacatatatttatgcactaacattatatatgtatgtgtgtatatatgtatatgtatacacttaatttttaagattcttaactttctgg

SEQ ID NO: 91681 - DNA, 74 bp, Mus musculus
agacagagttccaacagcagtctagtttaggaacaagcactctgcgtgtgttcacatgctgtgggactcattct

SEQ ID NO: 91682 - DNA, 89 bp, Mus musculus
gaaggtactgttttcgatcagggttctcttgatagtctgtcacagcctgggtgagatgtgagagaggacttaactggttttctgctttc

SEQ ID NO: 91683 - DNA, 77 bp, Mus musculus
agctgtgctaagtgtgttgatctggaactggtgcctaaaaagctactgggtcactctcaggcacactgtttacggtt

SEQ ID NO: 91684 - DNA, 107 bp, Mus musculus
tcctccctccctcccccctgcttgtgggtgagatgtgagtgagctcttagctcctgctccagcaccatgtctgtctcctccctccatctccctgctgtgaggatggg

SEQ ID NO: 91685 - DNA, 88 bp, Mus musculus
gctgattcaggagtctcaggctcaggagcagatgcacgcatattgcgggtcatctgtctttctgtgtctgccatttcctctctccagc

SEQ ID NO: 91686 - DNA, 106 bp, Mus musculus
gttgagtggagaagatggggctggagagatggctcagtggttaagagcactgactgctcttacagaggtactgagttcaattcccagcaaccacatggtggctcac

SEQ ID NO: 91687 - DNA, 95 bp, Mus musculus
cagacaatcatgagacagactgtaaagctgtgtttccttaggacagtctcagagactcacagtctatagtgctgggggcagggagggggtatctg

SEQ ID NO: 91688 - DNA, 89 bp, Mus musculus
cccatggattgaactcgagaccatcaggttgggcagcaagcacttcatgccagccaatcagactgtttttgttttttaatagctgtggg

SEQ ID NO: 91689 - DNA, 136 bp, Mus musculus
aggcccaggttcaaccccagcaccccaagaaaacttctaggtgtgtgtagggggtctgtgtatctgtgtgtctgtgagtgtgcgtgcacacatatttgcatatgcacacttactgttcatggtgagacagtcctgc

SEQ ID NO: 91690 - DNA, 67 bp, Mus musculus
tgtgcatatgtgagtgtgtgtacacttgtgtgtgactgtgtgtgcatgtgttcaggtgccaggtgca

SEQ ID NO: 91691 - DNA, 79 bp, Mus musculus
gggagagtgacagtcagttagacagacatacacagagacagacttactgactgactgatgactgactgaccaaccaacc

SEQ ID NO: 91692 - DNA, 75 bp, Mus musculus
tgtgtgtatatatatatatatatatacacgtgtgtatgtatttgtgtatatatatgtatgtgtgtaaatatatat

SEQ ID NO: 91693 - DNA, 113 bp, Mus musculus
ggttgcaagcacctttgccctctgagccatcttgcaggcccttctttgtttttaaattagtatacaaagtgatggcctttattgtggtagttcatactgtgtttctggtgatc

SEQ ID NO: 91694 - DNA, 75 bp, Mus musculus
tctgtctctctctgtccagcccacagtgcgtacatttataatcccagcactgcagtggggaaggtgagaggtaga

SEQ ID NO: 91695 - DNA, 113 bp, Mus musculus
gacctaggttcagttcccagcacccatgcggaggctaacaacagttctgaactccacttctgactgcctcagtccctgcttgtacctggtgcacattacatatacacttaggc

SEQ ID NO: 91696 - DNA, 68 bp, Mus musculus
gtgtgtgtgtgtgtgcatgtgcactgggagaagggcattcctctgtgtgtgtgtgtgtgcatgtgcac

SEQ ID NO: 91697 - DNA, 67 bp, Mus musculus
agcaatttctcccagtcagcctctttgcctgcaaccatagggatttggattggtggtgctgggtgct

SEQ ID NO: 91698 - DNA, 148 bp, Mus musculus
ggcacgttgagtgcagagagagagagaaggggggatgtaaacgtctgtgtctctgtgtgtctgtgtatgtatgtggtatgtgtctgtgtgtgtgatgcagcatcatggtgtatccagtacattttgcagcgttctacatactctaaca

SEQ ID NO: 91699 - DNA, 162 bp, Mus musculus
tatgtgtgcatatgtatatatgtatatatgtgtgtatttctatgtatgtatatatgtatatgtgagcatatatgtagatatgtatgtgtgtgtatatatatatatatatatatacatatatatacacatgtgtatatatgtatatgtgtgtgtgtatatgtg

SEQ ID NO: 91700 - DNA, 82 bp, Mus musculus
agcctaccctggagcagtctgaggtccctcaggtcaagttgggacctgactaagatcacacagtgctgaaggtcgaagagct

SEQ ID NO: 91701 - DNA, 73 bp, Mus musculus
gatgttctggtaaggctggagagatggctcggcggttaagagcactgactcctcttccagaggtccagagttc

SEQ ID NO: 91702 - DNA, 108 bp, Mus musculus
tggcatcgcctgtgtcacatagctcctgtctgacattcacagactcgcctccatgaagaggctgagcactgtggtagcatcacaggagcctcagtgaggcaggtgtca

SEQ ID NO: 91703 - DNA, 82 bp, Mus musculus
gctactgctgtgccttctcatgtttgtcactgctatatccctcatgtacttgacatagtgagacactcactgcctccgtagc

SEQ ID NO: 91704 - DNA, 110 bp, Mus musculus
gtatgtatatacacatgtatgtgtgtatatgtatgtatatgtgtgtgtgtatatatatatgtgtatatatatatatatatatatacaaacatgatatatatacatatata

SEQ ID NO: 91705 - DNA, 88 bp, Mus musculus
ggcatggtgccatcttcaggggacatgtcttgccacctcattaaagcaatccagacactctccctcagacaggcccagaagccatgcc

SEQ ID NO: 91706 - DNA, 159 bp, Mus musculus
tatatctgcatgtgtatatgtgtgtctatgtatatgtatgttattacatgtgtatatgtgtgtgtatatatatatatatgtgtgtgtgtgtctgtgtgtgtgtgtgtattgctgaggactaaatccaaggtctgcacatgcagaacaagcacttcatat

SEQ ID NO: 91707 - DNA, 77 bp, Mus musculus
gtctaggatggataaccatggttaccctctctgtctaggatgaataaccatggttaccctctctctctgtctaggat

SEQ ID NO: 91708 - DNA, 90 bp, Mus musculus
ctgtctgtctgtctgtctgtctgtctgtcagcctgttccgctggaccctcagaccgggttgaaagaatgcacagaacacaaagaaagcag

SEQ ID NO: 91709 - DNA, 68 bp, Mus musculus
agagtagccatgtgtatttatgtatttatgcattatgtatgtatgtacatatgtatgtatgtctgtct

SEQ ID NO: 91710 - DNA, 89 bp, Mus musculus
tcacagcccaggatcttctcggcccttttctgttcctgtctattgagagagatgaaagtcagcaggagtcactcacactgaagttgtgg

SEQ ID NO: 91711 - DNA, 83 bp, Mus musculus
gtgtgttttgcctgcctgtctgtctgtctgtgtgctatatgcatgcctggtgttcatggagggcagaaggtggcattggatcc

SEQ ID NO: 91712 - DNA, 74 bp, Mus musculus
gcctgatagcactgtttttacttcagaccgtcctcactggaaaacacggctgagaagacactgtgctgtcctgt

SEQ ID NO: 91713 - DNA, 76 bp, Mus musculus
ttcctgctcccaccctctgccctgtgactcccagcctctcaccctaagccacagggaagttaaggaagaagggagt

SEQ ID NO: 91714 - DNA, 95 bp, Mus musculus
cagctttagaattcacctgtgagctggaggtgggcaggagttcacagtgaagagctgagctcacactcactgtttgtttctgttacttattacag

SEQ ID NO: 91715 - DNA, 114 bp, Mus musculus
gttactggcctggagattccccagcatcgtgacggggcagtgacaggagactgaggccatttcggtccctgcgcccctaacgcacacgcccttcgtttctcctcaggctgggac

SEQ ID NO: 91716 - DNA, 112 bp, Mus musculus
gccaggccattggaactgctgaaaggcatggccattcactctcagtctgtcctacaggggcttcgggtgtggctggcttttaattagcctttgacttttccattccccaggc

SEQ ID NO: 91717 - DNA, 81 bp, Mus musculus
ggagaggaggtcccagtacagactgtggacagaagctggcttctcactgtccactgcctgtgtggctagggacaaggctcc

SEQ ID NO: 91718 - DNA, 74 bp, Mus musculus
tctttgtatatgtgtatatctgtatgtatatatgtgctgggtatgtatataaatgtatatatatgtatatagag

SEQ ID NO: 91719 - DNA, 110 bp, Mus musculus
cagatccctgagcctagaggggaggggtttgatggagacatgccatttaagactgactcccaagtctctcactctctgtccactgtccacttgtgggtcctggtggtttg

SEQ ID NO: 91720 - DNA, 100 bp, Mus musculus
gacggatactagacggcagagaagaggttgtgcttttggcagccaccctgtttcccacgcagagccctgggatctgctgtctctccacttgtacccagtc

SEQ ID NO: 91721 - DNA, 87 bp, Mus musculus
atggtacctgtttcataaggtttgtaatgatgtatgtaaagagcacgcgtggtgtctcatgtccgaatgtggagccccaggctccgt

SEQ ID NO: 91722 - DNA, 82 bp, Mus musculus
gctagtcctgtgcctctctctctctagatagcagctggcaggggttttaggatggagagggggtttctgtagcaggaagagc

SEQ ID NO: 91723 - DNA, 79 bp, Mus musculus
gtcagggtctctggctcactgttttagttggtggcttctctatgggaaggaatcctggaggcatgagtcatgcccttac

SEQ ID NO: 91724 - DNA, 63 bp, Mus musculus
cttctttttgcaatgatcagccatagttgtgaagattgatgcctggtcaagaacagagagaag

SEQ ID NO: 91725 - DNA, 108 bp, Mus musculus
ctcaggtctgtgtgtgtatgatgtgtatgatgtgtatgtgtgtatgacagacagacagacagacagacagacagacagacagacagacagatagacagagacagagag

SEQ ID NO: 91726 - DNA, 67 bp, Mus musculus
aggcaggagctgacagtgaaggctgtgagctgacgaccagccagagctgcacagcaagattctgtct

SEQ ID NO: 91727 - DNA, 213 bp, Mus musculus
tgtgtatgtatatgtgtgtatgtgtatatatatatgtgtgtgtgtatatatatgtgtgtatatatatgtgtgtatgtatatgtgtgtatgtgtacgtgtgtatatatatgtgtatatgtatatgtgtgtatgtgtacatgtgtatgtatgtatatatatgtgtatatgtatatgtgtatatgtatgtgtatatgtgtgtatgcatgtgtacat

SEQ ID NO: 91728 - DNA, 84 bp, Mus musculus
taggtctcactaaggacctgagatgtgagctgcacccacctgggcccaggcctcccagactcactctgaccctgacctgacctg

SEQ ID NO: 91729 - DNA, 104 bp, Mus musculus
gtatgtatgtatatgtgtgtgtgtgtatgtatgtatgtatgtacgtatgtatgtatatatgtatgtgtgtatatgtgtatgtatacgtatgtgtgtgtatgtat

SEQ ID NO: 91730 - DNA, 58 bp, Mus musculus
gcatgtgtgtatatgtgtatgtatacatatgtgtatatatgtgtatgtatatgtatgt

SEQ ID NO: 91731 - DNA, 93 bp, Mus musculus
cagtgtgtccaccacatagaaggagagaggcagaggaccacagtatctgttgagtttgtcagtctcagtctttgtgtgttctggccaagtctg

SEQ ID NO: 91732 - DNA, 89 bp, Mus musculus
gccacgacacagtccatgttcaggtcccggctgttgtccatcttgacgatgacagatgtgtctgagatgtgggaatggaggatgcgggt

SEQ ID NO: 91733 - DNA, 94 bp, Mus musculus
ggggctgggcactgtgggcatcgggcgggaccctcgtgtcgcgctattgggactcactgggtcactgtctccatcccaggctggctcacatccc

SEQ ID NO: 91734 - DNA, 81 bp, Mus musculus
atagtctgtccatcagtgagcaccatgcatcgttgcacttcggagtgtgtcgtctgtctgtgtgtctgtgtgtctgtctgt

SEQ ID NO: 91735 - DNA, 98 bp, Mus musculus
gccccagagtacaatgcacagctccacacaacaggcttatttaaggggacttggtaaaatttctgtcagatgtttgcagctgtcattatttccctggc

SEQ ID NO: 91736 - DNA, 111 bp, Mus musculus
tgtgtatatgcatatataatgtgaatgtgtgtgtatatatatatgtgtgtgtatacacacacacacacacatatatatatacatatatatatatatatatgtatatatata

SEQ ID NO: 91737 - DNA, 118 bp, Mus musculus
cggcatatgctattgatctctggtaagttccctggtctggtgagggtcaggctctgtctgtctgtctgtctaattccatgtcttgtacttgccccagagtgagtggttctgagagctg

SEQ ID NO: 91738 - DNA, 109 bp, Mus musculus
gggagtggctttgccaacagcatgtttggcagcatggccctgggggccaattgtccatctgtgtgtctgtctgggggcatctaccaggtcacagtcaacaagagcctcc

SEQ ID NO: 91739 - DNA, 92 bp, Mus musculus
gtctgcgtctgtggggatagggctcgggcaggacatttcctgaagtcagcaggtggcctgtccctcagtctctggctgggcagcatgcggat

SEQ ID NO: 91740 - DNA, 101 bp, Mus musculus
gggtcaggctgctggagggcatgagagacaggacactcagcacaggaaaccagaatcgttggcccaggaagtctcagatactctcctccccctctggagct

SEQ ID NO: 91741 - DNA, 84 bp, Mus musculus
ggctaagcatggtgacgcacgtgtatgctccagcactcaggaggctgaggtaggaggatgatgagtctgaagccgatatgagct

SEQ ID NO: 91742 - DNA, 77 bp, Mus musculus
gccttagccgactgacacattcctgttccccgcccccctcggggacagactggagtcacacacagcttgcggtaggt

SEQ ID NO: 91743 - DNA, 72 bp, Mus musculus
gtgtgtcacacactcacaggtaaaaacaatatttaagatttatttttatttatgtgtatgtgtgtgacaaac

SEQ ID NO: 91744 - DNA, 86 bp, Mus musculus
atatgtgaatgtgtgcatgtgtgaatgtgtatgcatgtgtgtgagtatgtgtatatatatatgtgtgtgtgtatatatgttagtat

SEQ ID NO: 91745 - DNA, 83 bp, Mus musculus
gggagaggtttagggtaggggtggctggggtggggtggccagaggcgttgttgtagcacctctcactctgtcagtcctttatc

SEQ ID NO: 91746 - DNA, 115 bp, Mus musculus
gagaccgagtcagaaccatgcgggggagctcctttcagtgggaagtcagtaggagtcacagggtcactgtttctcattgaggtccaccaatcaatgatgctaactaccagggctc

SEQ ID NO: 91747 - DNA, 66 bp, Mus musculus
gtgtatgtgtatacatgcgtgtctgtacatgagtgagtgtgcgtgtctgtatgtgtgtctgtgtgt

SEQ ID NO: 91748 - DNA, 116 bp, Mus musculus
ccctgaattccatgacctttctgttgaggagagcgtggagagaggcagactgactgagagactcaggtatttccctccgaggctgtttctgatattttgtacgtgagcgttctggg

SEQ ID NO: 91749 - DNA, 85 bp, Mus musculus; identical to SEQ ID NO: 58391

SEQ ID NO: 91750 - DNA, 92 bp, Mus musculus
tgtacaacagagggcaaggcctcgccaggactcagtctctgagtgggtgccaaggagggagacctggtggtgtcttgccgtcggttgctgca

SEQ ID NO: 91751 - DNA, 92 bp, Mus musculus
gtgtgtgcatgtgtgtgagagagtgtgtattagtgtatatatatatgtgtgtgtgtgagagagaataagtgtgtgtatatatgtgtgtgtat

SEQ ID NO: 91752 - DNA, 115 bp, Mus musculus
gtttgattgcatatgggttgttcttgtcattgcatgatgtagagattgggggggggtcactcactctgtttcacattttgtgcagaggtcagaaggcaactatgtacagttgaat

SEQ ID NO: 91753 - DNA, 62 bp, Mus musculus
gagccgccactcagcttccattctgtgtttttaagacagagtctctcagtggctgagagctc

SEQ ID NO: 91754 - DNA, 83 bp, Mus musculus
acatatgtgtatatatatatgtgtgtgtgtatgtatgtgtatatatatacacacacacacatatatatatatatacatgatgt

SEQ ID NO: 91755 - DNA, 110 bp, Mus musculus
ccattttttttaaattttatatatgggggctaaagagatggctcaacggataagagcactgactgctcttccagaggtcctgggttcaagtctcagcatccacatggtgg

SEQ ID NO: 91756 - DNA, 90 bp, Mus musculus
cttaccctgtgaagtccgttctgactgtcctctaaagtcttttttgttttttttttggaggtgggggggcggggaaagctcactggtagg

SEQ ID NO: 91757 - DNA, 100 bp, Mus musculus
gcatgaaagggggtcttagagcccgacagttctgtgtctgtcagccatttagtatggtgcaagcttgggcaaactgtttaacctaggattcctcttctgt

SEQ ID NO: 91758 - DNA, 62 bp, Mus musculus
tgcccatgagtgtatgactgtggcatgtggtgtgtgcctatgtcagtctgtgtgtcagggca

SEQ ID NO: 91759 - DNA, 103 bp, Mus musculus
tcatgtgtaaagataaaacctcgggctggagagatggttcagcggttaagagcactgactgctcttccagaggtcctgagttcaaatcccagcaactacatga

SEQ ID NO: 91760 - DNA, 91 bp, Mus musculus
gtactaatatacattatataaatacatatatttgcatatataaaaatctatatacataaagatgtgtgtatgtatatatgtgtatacatac

SEQ ID NO: 91761 - DNA, 70 bp, Mus musculus
gtaacagaagggctggagagatggctcaatgtttaagagcactgactgctcttccagaggtcctgagttc

SEQ ID NO: 91762 - DNA, 117 bp, Mus musculus
ctcggattatcagtacttttctggcagttcccttaataataatctatttgcttcccttgtgaatatgttgaagttattaaaagaatatgatttgggggatagagagatgactccgag

SEQ ID NO: 91763 - DNA, 90 bp, Mus musculus
ttaagacaagatctcattgtgtagttctgaataccctggaactctctatgtagaccaggctggcctcaaattcacaaagatccaccttaa

SEQ ID NO: 91764 - DNA, 114 bp, Mus musculus
ataaaggctcaatctacagaatggggctatttggaaggggtaaaatttgagggtggagtctctctctgtcttatatattgtatagatgcctcacttgtcagttgaaaactttat

SEQ ID NO: 91765 - DNA, 117 bp, Mus musculus
agttagggcttatggagctcaggaggccaatggaggagtttaagtatctgtctcactgtgtatctagtgggtctgtatgatagtcttctggttattttctctccattttgaataact

SEQ ID NO: 91766 - DNA, 110 bp, Mus musculus
atgtctaaatcgtacagttataaaggtaacgtgtgtctgtgagtgtctgcctcctcagctctgggattgcaggagtgaactactacatgtctggctttttgcaggggcat

SEQ ID NO: 91767 - DNA, 78 bp, Mus musculus
caaaagggaggagtttgttacagggtcgcactgtgtagccaagaattcacagagctctgtctgcctctctgccttctg

SEQ ID NO: 91768 - DNA, 68 bp, Mus musculus
ggagtaactcagtagtcactcagctcagtagtagtagtagagctggaactgggctcctgagcggcttc

SEQ ID NO: 91769 - DNA, 115 bp, Mus musculus
cagaagagagcatcatctggggctggagagatggctcagcggttaagagcactgactgctcttccgaaggtcctgagttcaaatcccagcatccatatggtgagagcatcatctg

SEQ ID NO: 91770 - DNA, 61 bp, Mus musculus
ccaagatcagtgtgtctcagaccctctcaggatggaggctctggggtaccctagattctgg

SEQ ID NO: 91771 - DNA, 87 bp, Mus musculus
gactctctctctctgtgtacacacacacacacacacacacacacacacacggatggatgggtgtgctgggcagataggtcagaggtc

SEQ ID NO: 91772 - DNA, 114 bp, Mus musculus
ctgtgctttctgctcattatctaattttactgccatatcagctcttgatttttttttcatgtaaagataaggaaactgaagcatgtaatagtgagataatcagtctgactacgg

SEQ ID NO: 91773 - DNA, 141 bp, Mus musculus
gcacatggactcataacagagattaaaaaaagatttattttttatttttatttactttgtgtgcagtgtgtgtgtgtgcgtgtatgtgcatgtgcaagtgtgtgtatacatgtgtgtgtatgtgtacatgtcacaacacat

SEQ ID NO: 91774 - DNA, 139 bp, Mus musculus
ctccggccctgcttgctcagctgatctgtggcttaggtagtttcatgttgttgggattgagttttgaactcggcaacaagaaactgcctgagttacatcagtcggttttcgtcgagggccccaatccacctcccctaac

SEQ ID NO: 91775 - DNA, 58 bp, Mus musculus
ccccgaagtcggtgtggctagagcaggagtgattctgtcacaccctctgtcgctgggg

SEQ ID NO: 91776 - DNA, 82 bp, Mus musculus
ggatagctggcactacacagagaaaccctgtctcgaaagacttaaaaataaaaatagtctctctctgtctgtgtatctgtct

SEQ ID NO: 91777 - DNA, 61 bp, Mus musculus
gaagagggtgaggcggaggtcggggagaaggggttacagtcagtctgtctcaccttaactc

SEQ ID NO: 91778 - DNA, 71 bp, Mus musculus
ttctgtgtcactttattgggaggacaacactgtcactcactctgaacctcctccaaggtgcagcaacagaa

SEQ ID NO: 91779 - DNA, 58 bp, Mus musculus
gtgtgtatatatatgtgtgtatgtatgtatgcatgcatgtatgtatgtatgtatgtat

SEQ ID NO: 91780 - DNA, 108 bp, Mus musculus
gagttaagagtacttgttgcagggctggagagatggctcagcagttaagagctctgagtgctcttccagaggtcctgagttcaaatcccagcaatcacatggtggctc

SEQ ID NO: 91781 - DNA, 107 bp, Mus musculus
ctgtgatcaacagcaaggatttagcttactgtcatcactatacaaattctagattttttttcttgagatgtgaggcagagaacctttgttgtggaactggaaggcag

SEQ ID NO: 91782 - DNA, 66 bp, Mus musculus
tctgctggagggccaagtgacacttgatgagatttttactgactgtctctgggtccctcacaaaga

SEQ ID NO: 91783 - DNA, 138 bp, Mus musculus
ggaaagaaagggtgtaagacttaggagacatgaaactgaggcaatctgtcagtgtcactgtctgaggttagctggttcgatctcaaagtagaaagggtctttacagggctggaggtgtaactcagtggtacatcttct

SEQ ID NO: 91784 - DNA, 65 bp, Mus musculus
ggtcttcctatgtatgtatgtatgtatgtatgtatgtatgtatgtatgtatgtatgtgtgaggct

SEQ ID NO: 91785 - DNA, 104 bp, Mus musculus
ggcacccttagcatttgaggtgaagttctgttatacactcaggctgtggctctgaaagtcagtgcatcacagaactttgtctcgaaagctttctagcagctgcc

SEQ ID NO: 91786 - DNA, 71 bp, Mus musculus
atatacatatatgtgtgtgtgcatatatagtatatcttcatatatacatgtatatatatatgtgtgtgtat

SEQ ID NO: 91787 - DNA, 89 bp, Mus musculus
taaagctacagtcctgtgagtctgtgactctgacttgtttggttagatcttttaactcaagggtcctagaccactagttttactgtgtc

SEQ ID NO: 91788 - DNA, 70 bp, Mus musculus
actttctcaacccttgcaaccatgtgatatatatatatatgtgtgtgtgcgtgtgtgagagagagagagt

SEQ ID NO: 91789 - DNA, 85 bp, Mus musculus
tatttacatatatatatatatatagtacacacatataatatatcatacatgtatgtatgtatatgtatgtatgtatgtaagtata

SEQ ID NO: 91790 - DNA, 81 bp, Mus musculus
ttctgtctctgactctgtggtgcatgtttacctccacacaggagggaggggtgagcaggaaatggaggtagaggaaaggga

SEQ ID NO: 91791 - DNA, 79 bp, Mus musculus
aagactctggctcacactgtcaccatggcttgtatctcttcaaaccaagccatgaccacagctgttggtctgatagctt

SEQ ID NO: 91792 - DNA, 91 bp, Mus musculus
tgaggaagatactcagtgtgttaggggttgagttgggtcaggatctcctcagaagctagtgacctctctctttctctcaagttctttctca

SEQ ID NO: 91793 - DNA, 74 bp, Mus musculus
gggatttgttggtagtgacctgtgcagatactcggaggccctatgtgtgtgtgtctgtcactgtccccagaacc

SEQ ID NO: 91794 - DNA, 110 bp, Mus musculus
taggtgatgctctctgagtccctctcttctcatgtctggtactaggtgatgctctctgagtccctctcttctcatgtctgatactaggtgatgctctctgagtccctcta

SEQ ID NO: 91795 - DNA, 274 bp, Mus musculus
aggtgatgctctctgagtccctcaattctcatgtctggtactaggtgatgctctctgagtccctctcttctcatgtctggtactaggagatgctctctgagtccctctcttctcatgtctgatactaggtgatgctctctgagtccctctcttctcatgtctggtactaggtgatgctctctgagtccctctcttctcatgtctgatactaggtgatgctctctgagtccctctcttctcatgtctgatactaggtgatgctctctgagtccct

SEQ ID NO: 91796 - DNA, 439 bp, Mus musculus
tgatgctctctgagtccctctcttctcatgtctgatactaggtgatgctctctgagtccctctcttctcatgtctgatactaggtgatgctctctgagtccctcaattctcatgtctgatactaggtgatgctctctgagtccctctcttctcatgtctgatactaggtgatgctctctgagtccctctcttctcatgtctgatactaggagatgctctctgagtccctctcttctcatgtctggtactaggtgatgctctctgagtccctctcttctcatgtctggtactaggtgatgctctctgagtccctctcttctcatgtctgatactaggtgatgctctctgagttcctctcttctcatgtctgatactaggtgatgctctctgagtccctctcttctcatgtctgatactaggtgatgctctctgagtccct

SEQ ID NO: 91797 - DNA, 102 bp, Mus musculus
gtccttgagtggtctgaaagtgatgttattattttatttttttatagtgtgtaatatgtatgcattgtttgtatgtatgtcgctgtctgtctgtctgaggac

SEQ ID NO: 91798 - DNA, 57 bp, Mus musculus
caagtcttgtgattctcttgtccagggaggccttgtggataagagacctcaagaatg

SEQ ID NO: 91799 - DNA, 98 bp, Mus musculus
gagtgacatctttcctgctgtcatgtctagactgtctctctctctgaactcttgctacctcacaagagagagataaagtgacacacacaatgtcatcc

SEQ ID NO: 91800 - DNA, 77 bp, Mus musculus
ctgcctgcctgcctgcctgcttgcctgcctgtggatcctgttcccctaaatgggctgcctggtctggcctcaggggg

SEQ ID NO: 91801 - DNA, 90 bp, Mus musculus
agttgtcaccatctattggatctagccattggtaaaagggtatattagagactttatatatctttttgtcgtttgatctttatagcaact

SEQ ID NO: 91802 - DNA, 110 bp, Mus musculus
ttatgtgtgtgtgtgtgtgtgtgtgcactcatgtgtgtggaaaagagagagacacagagagacatagacacagacagagagatagcaagacagagacacagagagacaca

SEQ ID NO: 91803 - DNA, 84 bp, Mus musculus
ccttccatgggagcaacacctctgcttctgtctgtctgtctgctcggcttggatggacagagttaccgaccattgtccctgagg

SEQ ID NO: 91804 - DNA, 74 bp, Mus musculus
tgaccactctcccactgtgtgacccttctgatttttctgtaaaacagaaaagagaggtttgctgagagaagtca

SEQ ID NO: 91805 - DNA, 80 bp, Mus musculus
gatgaatacttggagctggagagatggctcagcggttaaaagcactgactgctcttccagaggtcctgagttcaattctc

SEQ ID NO: 91806 - DNA, 89 bp, Mus musculus
atcagcagcccctatgctcagtgtctgtctcagtgtctgcctcctgacagtctcaggaagttcaaacttcattagacatggtttatgat

SEQ ID NO: 91807 - DNA, 93 bp, Mus musculus
ttgtgaatatttaaagttgacgtgacgttaagggacataaatgtgtgtatgtacatctatgtctgtctgtctatctgtccaaatatgaagcga

SEQ ID NO: 91808 - DNA, 78 bp, Mus musculus
gaacacagagcagagtcaagagacacaagccaaatccaggacagggatgaacttttgttgttgatgttgttgttgttc

SEQ ID NO: 91809 - DNA, 127 bp, Mus musculus
gcgtgtgcctgtgcctgtatgtgtgcctgtgctgtgcctgtgcctgtgcctgtgcgtgtgtctgtgcctgtgctgtgcctgtgctctgcctgtgcctgtgtgtgtgcgcgtgtgcgtgtgcgtgtgc

SEQ ID NO: 91810 - DNA, 66 bp, Mus musculus
gtgggtttatgtacatgtatatgtgtgtatatatatatgtatacacatgcatgtacacacacacac

SEQ ID NO: 91811 - DNA, 67 bp, Mus musculus
aaatatatatgaatcatacatacatacatatatgtatgtatgtatatatgatataaatggtatattt

SEQ ID NO: 91812 - DNA, 81 bp, Mus musculus
gaagggattcatttctggggaaaaaaatcagtgaggcacaaaccacacatttttttttctttaagaaagtgaaattatttc

SEQ ID NO: 91813 - DNA, 119 bp, Mus musculus
cctggatctgggcctgagaggtatctgagctggtcaacccactggctcccacactctcacactgagagtttccacaaccagggccagctctaccctaatatccaggcaagtgcagggcc

SEQ ID NO: 91814 - DNA, 104 bp, Mus musculus
gggcttgctatacagctctacagcatcctggggcagctgagtggcagtacctctctcccacccacactgccacacagcagacaggttatggagccagctccccc

SEQ ID NO: 91815 - DNA, 98 bp, Mus musculus
tatatgtgtgtgtgtgtatatataaatatgcatgtgtatatatacatgtgtatgtatatatacatatgtatgtatatatgtacatgtacttatgtata

SEQ ID NO: 91816 - DNA, 71 bp, Mus musculus
atctccctaggacacagaagcctgagagctctttgcaaattaggactgaatttctctgtactgtgggtgat

SEQ ID NO: 91817 - DNA, 115 bp, Mus musculus
ggactcatgactgtggataaagccctgttttgtataatatatatatatatatatatatattttttttttctggtgcaaaattggtcatttaagcaatctacttcatttggtgttt

SEQ ID NO: 91818 - DNA, 102 bp, Mus musculus
ggttggggcaggtgtgtttcggtttaaaaggactacagcctgcgttctttatttttaaatagtcaggcttattttagatctcctagcgctcatttctcgttc

SEQ ID NO: 91819 - DNA, 60 bp, Mus musculus
ggaggaagtgagagtgaactttgaggtttcagaagctcaagccacactcagtgtctctcc

SEQ ID NO: 91820 - DNA, 98 bp, Mus musculus
tcagaacttgtagagtgtagcctctaagagtgagtgtcactgacactgaggttacttgctgcgtgcaccactcagaggattgtgttttgcttagctga

SEQ ID NO: 91821 - DNA, 119 bp, Mus musculus
agagaaacgggtagggtgcttaagatttgttagtggcaaatataatgtctggctccctgctagccatctttctgttatgcttgcttatcttggctgttggaccccaacctgtgacctct

SEQ ID NO: 91822 - DNA, 68 bp, Mus musculus
gtatgtatgtgcatgtgtatgtgcatgtgcatgtgtgtgtgtatgtatgtgtgtgtgcatgtgcttgc

SEQ ID NO: 91823 - DNA, 63 bp, Mus musculus
gtgagaccctgtgtctgtctgtcttctgtctcaaaagggggtggagagatatactggtagaat

SEQ ID NO: 91824 - DNA, 88 bp, Mus musculus
gagacagggtttctctgtgtatctctggctgtcctggaacttactttgcagaccaggctggcctcgaactcagaaatccacctgcctc

SEQ ID NO: 91825 - DNA, 68 bp, Mus musculus
gagtccaggactggagagatggctcagcggttaagagcactgactgctcttctagaggtcctgagttc

SEQ ID NO: 91826 - DNA, 100 bp, Mus musculus
agacacccagtggggctggagagatggctcagcggttaagagcactgactgctcttccaagaggtcctgagttcaattcccagcaaccacatggtagctc

SEQ ID NO: 91827 - DNA, 109 bp, Mus musculus
ggttttgtaatcaactgtaaccacaggtatatagatatcacttttttggattctaaaaatgtatgtgcatgtatacagcgtgcaagtgcagttgcccagagagcccaga

SEQ ID NO: 91828 - DNA, 76 bp, Mus musculus
gtgcatatgtgtggtgtgtgcatatgtgtatgtgcatgttgatgtacatacatgtggtatgtatacatgtgtgtat

SEQ ID NO: 91829 - DNA, 72 bp, Mus musculus
gcaatatatatgtatatatgtgtgtgtgtgcgcgcgcccgcgcgcctgtattatgcatgtgtgtgtgtttgt

SEQ ID NO: 91830 - DNA, 103 bp, Mus musculus
cattttctttgaagatgggctctgagagaacagattgagcagtagtgagaagtttgacggaggggctgggtgtactccagtgccaatctgagggaagaggatg

SEQ ID NO: 91831 - DNA, 66 bp, Mus musculus
catgtgcgtgcgtgtgtgcgtgcgtgcgtgtgtgcgtgcgcacgcgcgcatccactcactcacgtg

SEQ ID NO: 91832 - DNA, 94 bp, Mus musculus
tgtttatatatacatatatatatgcatatgtatatatgtatgtgtgtgtgtatatatatatatacacacacatatatatacatacatgtatata

SEQ ID NO: 91833 - DNA, 56 bp, Mus musculus
gtatgtatatatatgtgtgtgtatatatatatatacacacacacatacatatatac

SEQ ID NO: 91834 - DNA, 88 bp, Mus musculus
gcagtgttaaaggactcagaagtcagtgttgagcagttcccagaggggctgccagctctaatcaggccactgggtacttgacgagggc

SEQ ID NO: 91835 - DNA, 85 bp, Mus musculus
cagagcaacagaaacctaaacacagtgccctccccagactctgcgggtacctccgtctctggcgctgtgagaaatgtctgctctg

SEQ ID NO: 91836 - DNA, 126 bp, Mus musculus
ctcctcatcgcccagggtgtcctttccttcatctgactctgggttgtagaatgaggtgcctgacagaagaggctgagtgcctgagggaaaagcactcccaggtccacacagcttccttttttcacc

SEQ ID NO: 91837 - DNA, 101 bp, Mus musculus
tcatgccatccacctgggatattctcaaaatcaccggcagagcactgtccctgtgtgtgtgtgtccaacacttgggaggcagaggcaggctgatttctgag

SEQ ID NO: 91838 - DNA, 118 bp, Mus musculus
tgaggtgaggtaagtagggccaaatctagacagacagacagacagacagacagacagacagacagacagacaggatatgtgtctagatgagagaccagggctgcggctatccactcca

SEQ ID NO: 91839 - DNA, 112 bp, Mus musculus
ccttaggtgttgttcctcaatagctatctacctcagtttttgaaacacagtctctcactgggacctggagctcactgtcttgatgaggctacatgagcagctaactctaagg

SEQ ID NO: 91840 - DNA, 77 bp, Mus musculus
gcctgagatgtgcccttggctagtgtgcaccgacagtgcctgagagtgtacactgaacactgagcgcactcctctgc

SEQ ID NO: 91841 - DNA, 108 bp, Mus musculus
gcagtgcagagccctgcaggcctcgtgcatcgtgtcccgtgctcacgtctctgtgagttcacaagtgtcaccctctgcataatgtctgctatgggtctctgtacttgt

SEQ ID NO: 91842 - DNA, 90 bp, Mus musculus
atctccaattaaagttctaaaggagctattagaatagtctatttttgtcttttctatggaagctctcctaatggtccttttttaagaggt

SEQ ID NO: 91843 - DNA, 62 bp, Mus musculus
ctcagaggctgtcacagtcacacacagcagccaccacttgctcgttgtctcagcctcctggg

SEQ ID NO: 91844 - DNA, 77 bp, Mus musculus
tcttcattcctgcggtagttaagcgcacacgaaggcttctttgaagtcagtgagcactgtctactggcttctgagga

SEQ ID NO: 91845 - DNA, 119 bp, Mus musculus
gaggatgcaagaaccttagactattctaaatatctcttctacctttcaggcacctgccttctaagggctagactaggatacatgtagactggcaagggattctgggaagtgtagttttc

SEQ ID NO: 91846 - DNA, 79 bp, Mus musculus
gtgtgtagtcttcagtagtgagtggaatgatgtgtgtgagtgacgtcactgtcagaccagcaagaccgcatttatgcac

SEQ ID NO: 91847 - DNA, 82 bp, Mus musculus
tctgtatatatgtatatgtacatatatacatatatgtatatatatacatatatgtatatgtatacacatatacatattcagg

SEQ ID NO: 91848 - DNA, 70 bp, Mus musculus
tatgtatatgtgtatacatatacatatatgtatatatatacatatatgtatatatgtacatatacatata

SEQ ID NO: 91849 - DNA, 96 bp, Mus musculus
gatcagccttagtccatggtgatctgataggatgcatgggacaatttcaatatttttgtatctgttgaggcctgttttgttaccaattatatggtc

SEQ ID NO: 91850 - DNA, 86 bp, Mus musculus
tttagggaagacgtaatctgtgtgtgtgtgtgtgtgtgtgtgttcttttgtgcctatgtgtgcatgtgcatgtgtgtgtttctgaa

SEQ ID NO: 91851 - DNA, 85 bp, Mus musculus; identical to SEQ ID NO: 57470

SEQ ID NO: 91852 - DNA, 75 bp, Mus musculus
taacctctcagtttcactgtatctctgtttagtttctgtttcaatgacctgtccattggtgagactggggtgtta

SEQ ID NO: 91853 - DNA, 89 bp, Mus musculus
tagtttgtgattagggtgatattgttcccctgaagcctaatgccaaggtcgggatgcatcagagagaacagtgtgaactgtttaagctg

SEQ ID NO: 91854 - DNA, 107 bp, Mus musculus
ttctaaatggatacacttattggatgtgaggcaaaaaagctcatcatactttctttatgaataagtttcatttttattacaactagtaaatgtttgaacagttggga

SEQ ID NO: 91855 - DNA, 117 bp, Mus musculus
tagcatgttgtttagttatcagttaaatccatttatttcagaatttctgttagtttcactgtgtctctgtttagtttctgtttccaggatctgtccattgatgagaatggggtgttg

SEQ ID NO: 91856 - DNA, 87 bp, Mus musculus
tttccacatatatagtttccatcatatatatatatatatatatatatatatatatatatatattgtatgagtggtttaggaaggaag

SEQ ID NO: 91857 - DNA, 107 bp, Mus musculus
gccttagtgcatggtgatctgataggatgcatgggacaatttcaatatttttgtatctgttgaggcctgttttgtgacctattatgtggtcaattttgtgagaaggt

SEQ ID NO: 91858 - DNA, 100 bp, Mus musculus
tgttatacatatttacatacatatataactacttatatatgcatgtatatatatatgcatgtatatgtatatatacatatgtgtgtgtgtgtgcatgtgt

SEQ ID NO: 91859 - DNA, 84 bp, Mus musculus
tttgggtgactgtccaggctgcctgcaactctgtcatttctatagtttagaagttacttgttctgcacttcctgctcactcaga

SEQ ID NO: 91860 - DNA, 70 bp, Mus musculus
tacatatatgtgtgtgtgtatatatatatatgcatttgtgtgtgtgtttgtgcatgtgtgtgtgtgtgtg

SEQ ID NO: 91861 - DNA, 105 bp, Mus musculus
ttcatgggtcacttacaacttgagaaatctgacaaagttgataaaaaatggtaaatgacagaactgtgtcagaatttaatatcaaaaggaaagtgtgcatatgaa

SEQ ID NO: 91862 - DNA, 85 bp, Mus musculus; identical to SEQ ID NO: 57439

SEQ ID NO: 91863 - DNA, 87 bp, Mus musculus
ctgtctgtctgtctgtctgtctatctatctatctatggacaaccccaaatagataatagatagatagatagatagatagatagatag

SEQ ID NO: 91864 - DNA, 81 bp, Mus musculus
gtttgttgactgcacagaccaaaaagaattgagcagatctctctccctttctctgactcattctgtactgcattaacaaac

SEQ ID NO: 91865 - DNA, 112 bp, Mus musculus
ggttcccaggtttgctagtgagttctgctatatatgttgtgatgagaaatatttgttttttcttactaaaagggagaagatggtcagtagcttcattattttcctatgagtc

SEQ ID NO: 91866 - DNA, 90 bp, Mus musculus
tgcaatggttgggtataaatatctgtctctgtctctgtcagctgatggtgggacctctcagagaatagccattcaatactcctgtttgta

SEQ ID NO: 91867 - DNA, 113 bp, Mus musculus
ggtgacatattctataaatttctaaatagaatacattttttcagaagcatttggaatgaaatttagtgtttaaaaagaggtattatttctgttctatggaatcttaggtctcc

SEQ ID NO: 91868 - DNA, 90 bp, Mus musculus
ctatccaaatgcaaggacatgaaacagcagtagtgatattgctactatgtttatttttctactgtgtaaatgtcatgtgaacagtgatgg

SEQ ID NO: 91869 - DNA, 72 bp, Mus musculus
tatatatgtgtgtgtgttttatatgtatatgatgtatatgcacatgtacatatatatatatatgcatatata

SEQ ID NO: 91870 - DNA, 80 bp, Mus musculus
ccaaatagaaatgcagtgaaaatatgtctggcttctaagtcactcattgtctgacagtttttctttactgcattcactgg

SEQ ID NO: 91871 - DNA, 85 bp, Mus musculus; identical to SEQ ID NO: 57439

SEQ ID NO: 91872 - DNA, 85 bp, Mus musculus; identical to SEQ ID NO: 57439

SEQ ID NO: 91873 - DNA, 79 bp, Mus musculus
acttctgttagtttcactgtgtctctgtttagtttctgtttccaggttctgtcctttgatgagagtgaggtgttgaagt

SEQ ID NO: 91874 - DNA, 109 bp, Mus musculus
gatatatatacatatatatatacatatatatatatatatatatatatatatatatatatatatatatatatatatatatatatagtgtgtgtgtgttcatgttcatata

SEQ ID NO: 91875 - DNA, 111 bp, Mus musculus
agatcaggttccattctgagtagaaccttttactaactaggttatatcttgggaatctcattatttaattttgtgtaggaggtttgagcctggctgctgagtggatatatg

SEQ ID NO: 91876 - DNA, 110 bp, Mus musculus
ttgaagatcagccttagtgcatggtgatctgataggatacattggacaatttaaatatttttgaatctgttgaggcctgttttgtgacctattatgtggtcaattttgga

SEQ ID NO: 91877 - DNA, 110 bp, Mus musculus
gatatgcgtagttatttcaaatttcttgtatttgttgagacttactctgtgactgactatattgttaattttgtagaagtttctgaaaggtgatatgaagaagctatatt

SEQ ID NO: 91878 - DNA, 68 bp, Mus musculus
ctgagaatagaatgcacttgaggtaaaaggccctctgtcatttttcctggagtctctctctctctcag

SEQ ID NO: 91879 - DNA, 94 bp, Mus musculus
ggatacgttttcctctttttctttaaggacttgtaactctttagcagtgttcttctgtatttctttaagtgagttattaaagtccttgatgtcc

SEQ ID NO: 91880 - DNA, 109 bp, Mus musculus
ggtgagtatatgtgagcttcttttaggattagattatatatgaacttatatatttctttgtaatgtttaatatccctctattttagaagccattacaatgtgataaact

SEQ ID NO: 91881 - DNA, 85 bp, Mus musculus; identical to SEQ ID NO: 57470

SEQ ID NO: 91882 - DNA, 85 bp, Mus musculus; identical to SEQ ID NO: 57470

SEQ ID NO: 91883 - DNA, 91 bp, Mus musculus
ccagacagccctgttgacagaagagtgacagactgagccccatgagaagcatgtggttttcacacactttgaaggcagttcagcgacttgg

SEQ ID NO: 91884 - DNA, 185 bp, Mus musculus
atatatatatatatatatatatatgtgtgtgtgtgtgtgtgtgtgtgtgtgcgtgtatacatacatcattatatatatatatatatatatatatatatatatatatatatatatatgtatattcatgtatatatatgtatgtgtatatatctatatctatatgtgtgtgtgtatgtatatatata

SEQ ID NO: 91885 - DNA, 74 bp, Mus musculus
gttttgtgactgtgttgttgtgaacatttttcttttggtagcccatgaagtgcccacagcaagggcactagaac

SEQ ID NO: 91886 - DNA, 89 bp, Mus musculus
tactgcaattgtttatatatatatacttgctattgtttacatatatatgtgtgtatatttgtgagtgtgtgtgtgtgaatgtgtgtgtg

SEQ ID NO: 91887 - DNA, 100 bp, Mus musculus
gtttgattttctggctcttagaatattcctgttatcattagaagtatgttttagtgttgaattcagatgtgtaagagtacagtaataaagaatcattagc

SEQ ID NO: 91888 - DNA, 90 bp, Mus musculus
tggatatgtatgaaactgaatgttgaagccaggggtggatatatataaatatatcaatgggtggttctgcattttattttctgtgctcca

SEQ ID NO: 91889 - DNA, 85 bp, Mus musculus; identical to SEQ ID NO: 57470

SEQ ID NO: 91890 - DNA, 110 bp, Mus musculus
tgaatgccaactggtgattcattcaagtgatttagagaaaaagttctttatatataaaattctgtaaggaattttctctttgatcatttcttatgttgctcttacattca

SEQ ID NO: 91891 - DNA, 85 bp, Mus musculus; identical to SEQ ID NO: 57470

SEQ ID NO: 91892 - DNA, 80 bp, Mus musculus
tgccttatttgtcatgtgttgggtcatgaggacataaactatgtgacttcactgtccttattctctcacactcagtggta

SEQ ID NO: 91893 - DNA, 75 bp, Mus musculus
tgatattcttgtgtgggtgggtgcctctttgctagtgcaggagcaactagaggcaggacatttagtagaatctca

SEQ ID NO: 91894 - DNA, 122 bp, Mus musculus
tacacatatatgtatatgtgtatatatgtatatatgtttacatatatatgtgcatatgtatatgtgtatatgtatatatgtgaatatgtatgtatgtatgtatgtatatggtttgtgtatat

SEQ ID NO: 91895 - DNA, 111 bp, Mus musculus
gcattcttctgtggatgaaaatctagtcttgtatatatatatatttctgttgtctgtagtacaagagtgttataagatatacaggacacgtgatagagtcccaggagaggt

SEQ ID NO: 91896 - DNA, 70 bp, Mus musculus
accattagtaatagtgtctggtttagtgcctgtcaatgagacatccaagtttggccagccactggatggt

SEQ ID NO: 91897 - DNA, 85 bp, Mus musculus; identical to SEQ ID NO: 57470

SEQ ID NO: 91898 - DNA, 111 bp, Mus musculus; identical to SEQ ID NO: 91895

SEQ ID NO: 91899 - DNA, 70 bp, Mus musculus; identical to SEQ ID NO: 91896

SEQ ID NO: 91900 - DNA, 72 bp, Mus musculus
gtgtgtgtgtgtgtgtgtgcctataggatgtgtgtctgtctttctgtatgtaggatgcatatatgtgtgtgc

SEQ ID NO: 91901 - DNA, 85 bp, Mus musculus
ggctatggtggtcggataggatacatgggataatttcaatatttttgtatctgttgaggcctgttttgtgaccaattatatggtc

SEQ ID NO: 91902 - DNA, 64 bp, Mus musculus
gtgtgcgagtgtgcatgtgtgtgtgtgtatgtgtgtgtgcatgtgtgcgtgtgtgagtgtgtgt

SEQ ID NO: 91903 - DNA, 117 bp, Mus musculus
ttggagaagagttttgagcagaaactgctgagctgaactaacaagtgagagttcagagagaactagaaagggtgaggtcattcagcagtaggcttccaaaagaacaatcacctctga

SEQ ID NO: 91904 - DNA, 85 bp, Mus musculus; identical to SEQ ID NO: 57439

SEQ ID NO: 91905 - DNA, 96 bp, Mus musculus
cttcctcccttaactgttttgtaaggttatcttcttatcacaatgatatggaaagtaaccaagaattatggacattcagtttaagaacggcgtgag

SEQ ID NO: 91906 - DNA, 102 bp, Mus musculus
agagacatcccactggttgtataaacctgttgaattcatgtgcttgatattatatcatgtatattttaataatatgcaaatacctacaagataaatgtttct

SEQ ID NO: 91907 - DNA, 86 bp, Mus musculus
gtgagtttgtgtgtatagattatatgtatgtatatatacacatatgtgtatatatatatatgtacatatgtataatatatactcat

SEQ ID NO: 91908 - DNA, 80 bp, Mus musculus
tactttcccttagaaattgtgactgtctcatagtctctgagagagacactgagaggccacgttgtgaatatatgaaggtg

SEQ ID NO: 91909 - DNA, 112 bp, Mus musculus
cattacaaattatatatatatatatatatatatatatatatatatatatatacatatatatgtatatatatatgcatatatatatatgtatgtgtatatgtatatgtatatg

SEQ ID NO: 91910 - DNA, 86 bp, Mus musculus
atatgtatatgtatgtgtgtgtatgtatatatgaatatatgaatatacatatatgtgtatacatgtatatatgtatatgtctatat

SEQ ID NO: 91911 - DNA, 105 bp, Mus musculus
tctctctgacagtagatgttctgtgagcattttttatttttacaaatgttttgagtttttttaaatctaggaaaggccaacaatgaacaagaggcatcatggaga

SEQ ID NO: 91912 - DNA, 113 bp, Mus musculus
tcatgatggcaggacagctcattgacacagttcaagcaaaactgagctgaaggctgtgcttactgacactgtctctcagttttaactttggtgtctgctggttgcatgtatgg

SEQ ID NO: 91913 - DNA, 71 bp, Mus musculus
tcattaattgctactgcatgtacttatgtgcatgtatgcatgtatgtaagtatgcatatgcatgcatgtga

SEQ ID NO: 91914 - DNA, 68 bp, Mus musculus
cacactctccaacaatcaaaagaatatatatatgtatgtgtatgtgtgtatattcttatgtgtgtgtg

SEQ ID NO: 91915 - DNA, 75 bp, Mus musculus
gagaacttctgctgtagggatcagagagaataaagtagggtgtccacgattctctctgtctctgggagagttttc

SEQ ID NO: 91916 - DNA, 85 bp, Mus musculus; identical to SEQ ID NO: 57439

SEQ ID NO: 91917 - DNA, 85 bp, Mus musculus
ggccatggtggtctgataggatacatgggacaatttcaatatttttgtatctgttgaggcctgttttgtgaccaattgtatggtc

SEQ ID NO: 91918 - DNA, 107 bp, Mus musculus
gccttagtgcatggtgatctgataggatgcatgggacaatttcaatatttttgttatctgttgagacctgttttgtgacctattatgtggtcaattttggagaaggt

SEQ ID NO: 91919 - DNA, 102 bp, Mus musculus
gtattttagagaaattactcaatagtttctgatatttgaagttagtgcgtgcacacttgcacacacacacacttacatatacacaaacattgagggagatgc

SEQ ID NO: 91920 - DNA, 70 bp, Mus musculus
tattgcatatgataatatattttaatcatatgcattatatatgcatatatatgatatagtatatgcaata

SEQ ID NO: 91921 - DNA, 63 bp, Mus musculus
ctggttttgaattgtaaagaagaaggcatattccctcactttggtcttatttttcagaaccag

SEQ ID NO: 91922 - DNA, 118 bp, Mus musculus
ctggaaagagatcattccgagaatcaagaagatgaggactctcagagtttcacagaagtttgtgatcttaattggctcttaattgtttttaatctttttttcagtgaacactaaacag

SEQ ID NO: 91923 - DNA, 76 bp, Mus musculus
cttacttcatcctatttgtatgttaattattcagagaacttgacatggttctctttatgcctgaagggtttgtgag

SEQ ID NO: 91924 - DNA, 110 bp, Mus musculus
tgtgactgcattggaggaaggagactgttacaagtagatactgctgctataaatcaatttgttgttctgtagaatttattgtttacttattcgtcagataataagtcaca

SEQ ID NO: 91925 - DNA, 93 bp, Mus musculus
gtgtgtatatgtgtatgatatatatacatttatatgtacatctttttattgatatatacatatgaggtagaatatttatatataatatacata

SEQ ID NO: 91926 - DNA, 78 bp, Mus musculus
gctctgtgcatgtataattgaagtatacaatggatatacagtacacagtgtgctcaatggacacatgcatacatcagt

SEQ ID NO: 91927 - DNA, 85 bp, Mus musculus; identical to SEQ ID NO: 57470

SEQ ID NO: 91928 - DNA, 85 bp, Mus musculus; identical to SEQ ID NO: 57439

SEQ ID NO: 91929 - DNA, 115 bp, Mus musculus
gtgtacgtgtacgtgtacgtgtacgtgtacgtgtacgtgtacatgtatatgtatatgtatatgtatatgtatatgcatatgcatatgcatatgcatatgtatatgtatatgtata

SEQ ID NO: 91930 - DNA, 72 bp, Mus musculus
gtttgggcattgatgtcatcttgcagcctatcagctgtaaaaaggatgggctgtgtactgtctctctcacac

SEQ ID NO: 91931 - DNA, 102 bp, Mus musculus
gacagacagagacagagacagagagacagagagtcatagaaatacttattgtaatatatttatttctgtggctgatttatttcattttacgtaaaaattgtc

SEQ ID NO: 91932 - DNA, 77 bp, Mus musculus
ctgtgtgtgtctgtctatgtgcatgcgtgtgtatctgtgagaacagagtgcaagaatacacaggtagaatcatacag

SEQ ID NO: 91933 - DNA, 85 bp, Mus musculus
gtccatggtggtctgataggatgcatgacacaatttcaatatttttgtatctgttgaggcctgttttgtgaccaattatatggtc

SEQ ID NO: 91934 - DNA, 101 bp, Mus musculus
agctttttctatctatatcatcagacataggcatagcatgtctttgaatgttacttttttatgttaaatgtggtgttttgtaatctatcatagagaaagtt

SEQ ID NO: 91935 - DNA, 80 bp, Mus musculus
tctgtgtttttattttacattaactgaggggaagtcaactcttgcccttgcagttgcacagtaagaactttatacactga

SEQ ID NO: 91936 - DNA, 116 bp, Mus musculus
tatattaactacatgtaatttatatcttatatataatgtttgcatatatgtgtatatatataaatacacacatatatgtatacatatatgtatatataaatacacacacatatata

SEQ ID NO: 91937 - DNA, 88 bp, Mus musculus
gtgtgtgtatatatgtgtgtgtatttatatatacatatatgtatacatatatgtgtgtatttatatatatacacatatatgcaaacat

SEQ ID NO: 91938 - DNA, 85 bp, Mus musculus
ggccatggtggtctgataggatacatgggacaatttcaatatttttgtatctgtcgaggctttttttgttaccaattatatggtc

SEQ ID NO: 91939 - DNA, 86 bp, Mus musculus
catagctctcatcatgtgtgtatgtgttgtatatatgtatttgtacatatatgtatatgcacatacatgtatgtataaaatatatg

SEQ ID NO: 91940 - DNA, 113 bp, Mus musculus
actttgtggatggtgccatccctagaacagtggtactgagttctgtaagaaagtgtttggttatggagctctatgacagtaattgtaaccctgggtaaatcatctcctatagt

SEQ ID NO: 91941 - DNA, 85 bp, Mus musculus; identical to SEQ ID NO: 57439

SEQ ID NO: 91942 - DNA, 96 bp, Mus musculus
gtgtgtatgtatacatatacatatgtatatgtgtatgtatatgtgtgtatacatattcatatatgtatgtatatacatacatatacatatgtgtgt

SEQ ID NO: 91943 - DNA, 85 bp, Mus musculus; identical to SEQ ID NO: 57439

SEQ ID NO: 91944 - DNA, 78 bp, Mus musculus
aggtctctcactctctgtgtaatgggtggctgttggtcccagtatttgttcccatctgctgcaggaggaagcttatct

SEQ ID NO: 91945 - DNA, 91 bp, Mus musculus
gtgtatgtgtatgtgtatatgtgtgtgtatgtgtatatgtatatgtaatgtatatgtatataatgtatatgtatatgatgtatatgtattc

SEQ ID NO: 91946 - DNA, 131 bp, Mus musculus
tgaaaggcacataatattactttcttggctatatttttatatctatgataaagcttagcaaagagagcttatgttcttttaaaattttgttatattgttctgaaaatacaagaccatttttttacagaagg

SEQ ID NO: 91947 - DNA, 91 bp, Mus musculus
catacagcaaagtacatatatgtgaaaattatagatgtgtgagaagatatgcattaagtgattttatgtgtgtacattttaaatgctgatg

SEQ ID NO: 91948 - DNA, 86 bp, Mus musculus
ctgcagaaagatgaactgaggtctagtgaggtctaggaaactgtacacctcttgttttgtctgtctctgtcagtcttctttctcag

SEQ ID NO: 91949 - DNA, 105 bp, Mus musculus
gtataagtgtatgtatatgtatgtatgttacagccacagccacacacacacacacacacacacacacacacacacatatatatatatatatattctcacatatac

SEQ ID NO: 91950 - DNA, 98 bp, Mus musculus
gtgggtgtgtgtgtgtattgtgtgtccatgtgtttgcatatatatgaatgtttatatgtgtctttgtatggacacatataatataggagtatagtcat

SEQ ID NO: 91951 - DNA, 113 bp, Mus musculus
tgtttaatcttcacagattaaagctgcacagattgctttttgaatgtataatatcaatgagttgtgtaaacaaaagcaatcactgctagctcttattttatgatattttcaca

SEQ ID NO: 91952 - DNA, 70 bp, Mus musculus
tttcttgtgtgtactgggtgtgtgtgaaagaactaaagctttacttacacacactctgtgcctcatggag

SEQ ID NO: 91953 - DNA, 85 bp, Mus musculus; identical to SEQ ID NO: 57439

SEQ ID NO: 91954 - DNA, 85 bp, Mus musculus; identical to SEQ ID NO: 57470

SEQ ID NO: 91955 - DNA, 98 bp, Mus musculus
tatttatatacacagcaattatatatatgaaattatatatattgaatttccatataaaattatattttcatatatatacttatgtatgtatatacata

SEQ ID NO: 91956 - DNA, 114 bp, Mus musculus
gatcagccttagtccatgatgatctgataggatgcatgggacaatttcaatatttttgtatctgttgaggcttgttttgtgaccaattatgtggtcagttttggagaaggtatc

SEQ ID NO: 91957 - DNA, 72 bp, Mus musculus
tgtatgtatgcatgtttgtatatgtacgtatatgtgtatgtatgtatgcatgtttgtacatgtatgtgttca

SEQ ID NO: 91958 - DNA, 86 bp, Mus musculus
gttctctatataagtgtgtatatatatatatatatatacttgagtgtgtacatatatatatatgtacatatatatacttgagtgac

SEQ ID NO: 91959 - DNA, 100 bp, Mus musculus
tatatatatatatatatacacacacacacatatgtgtgtgtatatatatatatatatacacacacatatgtgtgtatgtatatgtatgtatatatacata

SEQ ID NO: 91960 - DNA, 107 bp, Mus musculus
gctcatgggttgggtctcaagttgggctttttattggtacatcatacactcagtctctgtatcatctgctgtttctgcctttctttaagataggatacgttttgggt

SEQ ID NO: 91961 - DNA, 100 bp, Mus musculus
ttgtgccagagaccctatattgaaagtttataaatataatttcattgctacatagcatgttatgacatgagagtttttcagtaccacatatttggggcaa

SEQ ID NO: 91962 - DNA, 85 bp, Mus musculus; identical to SEQ ID NO: 57470

SEQ ID NO: 91963 - DNA, 132 bp, Mus musculus
gaatacctgtacatggttctttccctgattacagaaacgttcataaaatgtagccttaatatacatagtttttgtaatgtgggatagaggtagcatctttttttctcatcttgcacacattgtcgtattaag

SEQ ID NO: 91964 - DNA, 82 bp, Mus musculus
tacatacatgaatatttatgtatgtatgtacgtttacatatgtgtgtgtatgtatgtatgtatgtatgtatgtatgtatgtc

SEQ ID NO: 91965 - DNA, 85 bp, Mus musculus; identical to SEQ ID NO: 57470

SEQ ID NO: 91966 - DNA, 95 bp, Mus musculus
gtatagtagagatcattttcttaatatttaacaccatgtgctatataaaatacagatggaatttttgttcttcagttgagagaactctgctctgc

SEQ ID NO: 91967 - DNA, 85 bp, Mus musculus; identical to SEQ ID NO: 64086

SEQ ID NO: 91968 - DNA, 84 bp, Mus musculus
gactgtctctgtctgtctctgagtgcctgtgtgtgtgcgtgtgtgagtgtatgaaacatatagccacttgcagacggagaagtt

SEQ ID NO: 91969 - DNA, 75 bp, Mus musculus
gaaaagggtgctgcctcagtggctctgtggctctgcctgtcccagaagctgtccggttctgtggtgcaccctctc

SEQ ID NO: 91970 - DNA, 77 bp, Mus musculus
acttttattaagttaaattttaccagtgtggaactgcaagcatgtagtttctttggtattgtgatgtggatatctgt

SEQ ID NO: 91971 - DNA, 82 bp, Mus musculus
attatatgtttatataccatgtatatcatatgttacacaaatatatgcataatatatgtatatatgtgtatatatatatgat

SEQ ID NO: 91972 - DNA, 69 bp, Mus musculus
tgtgcaaggcaaagcttgtggtacaattcacagaaatctgtcatgacacaggcacttgtttctgacaca

SEQ ID NO: 91973 - DNA, 100 bp, Mus musculus
gtcttatacatcttatataaagcaactgtaccttaaatgtatatctatataagaatgtcatttatttaggaattgcttttatttggggatatatgaagac

SEQ ID NO: 91974 - DNA, 62 bp, Mus musculus
tatatgtgtatatatatatatatacatatatttgtatgtatgtgtatgatatatcatctata

SEQ ID NO: 91975 - DNA, 76 bp, Mus musculus
gtccctggagcccatctcacctagacctgtgcaggacctgtgcatactgccacagtctctgagtgtatctgtggac

SEQ ID NO: 91976 - DNA, 100 bp, Mus musculus
actccatccactgtttggctataggtgtctgtgtctctgtcagctggtaggtgaaacctttcagaggacaacatgctcctgtctgcaagcataacagagt

SEQ ID NO: 91977 - DNA, 75 bp, Mus musculus
tatatatcttaaaactgcacccaatgtgtgtgtggggggggtgtgtgtgtgggtgtgtgggtgtgtgggtgtgtg

SEQ ID NO: 91978 - DNA, 61 bp, Mus musculus
aagtctgtctctgtgtgactgggcttttagatcttcctcctagccatgtggagccagtctt

SEQ ID NO: 91979 - DNA, 76 bp, Mus musculus
tgtatgtgcatgtggatgtgtatgggtgtgtgcacgtgtgcatatggctgtgcacatgtgtgagtgtgtgtgtata

SEQ ID NO: 91980 - DNA, 80 bp, Mus musculus
gtatgtatgtatgtatgtatgtatgtatgcatgtatgtatgtatgcatgtatgtatatatgtttgtatgtatgtatttac

SEQ ID NO: 91981 - DNA, 85 bp, Mus musculus
gtccatggtggtctgatagaatgcatgggacaatttcaatatttttgtatctgatgaggtctgttttgtgaccaattatatggtc

SEQ ID NO: 91982 - DNA, 134 bp, Mus musculus
gtgtatgtgtatggtatgcatgtgttcatatgtatgtgctgtgtatgtgtgtaatatgcatgtatgtatatatgtatgtatatacatatgcatgtatatacatactatgtgtatgtatgcatgtgtgtatgtat

SEQ ID NO: 91983 - DNA, 79 bp, Mus musculus
agaaagcaagctgagcaagccgtagagactaagctagtaagcagcagtccttccgatttctgcatcagcatctgcttct

SEQ ID NO: 91984 - DNA, 90 bp, Mus musculus
catatataaacatatatatgtttatatataaatatacacatatgtatctatgtgcatatatatgtatatgtatatgtatgtatatgtatg

SEQ ID NO: 91985 - DNA, 69 bp, Mus musculus
gctctcgaagatcaagtcagaatttgagctcacatgggtcttaaggatgctgtctcaatctctgtgagt

SEQ ID NO: 91986 - DNA, 81 bp, Mus musculus
gagcttgatcacaccaggatctcggggtcgcagaggcaccttgactcggaggaactctgacacacccagactctcaggttc

SEQ ID NO: 91987 - DNA, 85 bp, Mus musculus; identical to SEQ ID NO: 60894

SEQ ID NO: 91988 - DNA, 85 bp, Mus musculus; identical to SEQ ID NO: 60894

SEQ ID NO: 91989 - DNA, 101 bp, Mus musculus
ctgaagtggagaaaattatcttgctattaatttgcctaaggaaagatacttagttttattattttcataggcaagataatctattctgcatatatatttag

SEQ ID NO: 91990 - DNA, 77 bp, Mus musculus
atatgcatatgcatatgcatatgtatatgtatatgtatatgtatatgtatatgtatatgtatatgtatatgtgtgtg

SEQ ID NO: 91991 - DNA, 114 bp, Mus musculus
ttattttatcttacaatattttatgctgcttttagatgtctgtggttatttttttttaataagagagagaacagagtgtggatttaggtagatggggatgttgggatgatctgg

SEQ ID NO: 91992 - DNA, 108 bp, Mus musculus
ggtgaaatatcttatgtggctatctgcatgccctagggatggagatatatatatatatatactcgattcctcttctcctctgttgtgcagtttctccatgtaggcacc

SEQ ID NO: 91993 - DNA, 67 bp, Mus musculus
tacagaagagagaacagtctgaggcacctggagaagtccagacctgtaagctgtaagtctatctgta

SEQ ID NO: 91994 - DNA, 125 bp, Mus musculus
gtacatatatacacatacatgtatgtatatatgtgtgtatgcatatatgtctgtttgtatgtgtgcatgtgtatgtatatatgtatgtatataggtatatatgtatgtatacagtacatttgtat

SEQ ID NO: 91995 - DNA, 106 bp, Mus musculus
gaactcatttctttaaagtgatgaatttgaaaattctctttttgattttgagttgaatcaaagacaggatcttcaacatccatattgcaaaagaagaggtggcttc

SEQ ID NO: 91996 - DNA, 73 bp, Mus musculus
gccttgcagggggagtgtgacatagacatcccactggggactgaacactaagtctctctctctcaactgtggc

SEQ ID NO: 91997 - DNA, 74 bp, Mus musculus
tgcatgcctgggtcacaggcagaagctgttaatcatcttagtgttgattcagagtctctctgtgcctgcatcca

SEQ ID NO: 91998 - DNA, 136 bp, Mus musculus
tccttcttaccggttgggacatattctggatatatgcccaggagaggtattgagggagactctggtagtactatgtccaattttctgaggaatcgccagactgatttccagagtggttgtacaagcttccaatccc

SEQ ID NO: 91999 - DNA, 60 bp, Mus musculus
gctgactgtctccctctttggcagtgctaatacagggttatcagagggagactgtaaggc

SEQ ID NO: 92000 - DNA, 117 bp, Mus musculus
cagggagatcttgtctcatagcaacagcatatccagcagaataatttctatatttatgaagtttcctcctactgtctgcagtttatttatgtgaatgtctaagaagtggtttccttg

SEQ ID NO: 92001 - DNA, 69 bp, Mus musculus
gctcagggtcaaatttcatgattgcattccttttcaaatgtgggaatgttgtctggcttgagtctgtgt

SEQ ID NO: 92002 - DNA, 83 bp, Mus musculus
gtgggagccttgggatattagtcactctgtcacactctccatccatttatggaagtctacagtagaactgtgccgagcaacac

SEQ ID NO: 92003 - DNA, 107 bp, Mus musculus
tgatattctcaagttccaagcatttgcctgcaaagtgtatgatgttcttctttttaaataactgaatagtatcccattgtgtgtgtactggctggttttgtgtgtca

SEQ ID NO: 92004 - DNA, 117 bp, Mus musculus
gtatttatgttttacttcttttatcaagggcaatttacttctgcatcgatggaaaaagaagagagattttgttgtagtcgtatctgctcttgttctatcttgtccttcatttacgta

SEQ ID NO: 92005 - DNA, 100 bp, Mus musculus
ggcagtcttgttttctcctttcctttcataagtctagacagtcagcacaatagtaaaccaaacactgtccagtcttcaaatgtgaaaggaagtatttgcc

SEQ ID NO: 92006 - DNA, 104 bp, Mus musculus
attaaatgttgtcaagtgctacagggtattatagtatatattaacacacatatatatgtacatatatatgtatattttggacctagcatatatcaatatataat

SEQ ID NO: 92007 - DNA, 73 bp, Mus musculus
gtctctctatctctctgtctgtctctgttgacttatgagccaacagtactattcaaagacctgatggagaagc

SEQ ID NO: 92008 - DNA, 112 bp, Mus musculus
gcatttaaatgtacagagacctttacatgtgctccatgtatgtatataagtatgtatgtatgtatgtatgtatgtatgtatgtatgtatgtatgaagtgaatgaacatatgc

SEQ ID NO: 92009 - DNA, 82 bp, Mus musculus
ttatgtgtatgtgtgtgcatgtatgtgtatatatgtatgtatatatacatgtgtgtatatgtatgtatgcatgtatatgtag

SEQ ID NO: 92010 - DNA, 113 bp, Mus musculus
tctgctgttaatgttgttagactgttttccatgagtatatgtatatatatatatatatatatatatatatatatatatattccctaaattgttagagctttattcatgtatga

SEQ ID NO: 92011 - DNA, 85 bp, Mus musculus
caggtagtctttgggactgtgtcagtggcttgtgaatacttaaatccttagtgtgagtcactctcgcagatattgatgacatttg

SEQ ID NO: 92012 - DNA, 80 bp, Mus musculus
ggatgctggacactcaaacttcagtccttctgcgtatgtggcaggtatttgactgaagactgactgatctccctagctct

SEQ ID NO: 92013 - DNA, 102 bp, Mus musculus
gtgatggcattgaccattgacctctgttggtatgaatgaaaaagttctcacagtgaaaagtgagtgcttttgatatctaacagaaagaggacagaccaacac

SEQ ID NO: 92014 - DNA, 77 bp, Mus musculus
gctaagacctttggacatgggcaggagagatggctcagtggttaagagcactgactgctcttccagaggtcctgagt

SEQ ID NO: 92015 - DNA, 88 bp, Mus musculus
cagactgactgcagctgctgatggaagctctcagacacacactaacccagttgctgtagcattcagacagagaaacgcagtcagtgtg

SEQ ID NO: 92016 - DNA, 117 bp, Mus musculus
ggatttaactaatcactttacctcagcttgtctgtcttcttaccttgttctgtgcaatgttctcaggctgcgcaattgatccaaatgagtacaagtaaatgaggtgtgtcgttatcc

SEQ ID NO: 92017 - DNA, 90 bp, Mus musculus
gggcacagacagggcctttgaaagggaatggagctcccctaactcacctggaaacacctctgtctctcactctgtggcatgcctgtcccc

SEQ ID NO: 92018 - DNA, 94 bp, Mus musculus
ttgatctagctgtctgtctgtctatctatctatctatctatctatctatctatctatcctgagagagaggaagatttgcagattctggagccaa

SEQ ID NO: 92019 - DNA, 75 bp, Mus musculus
tgtctgtctgtctgtctgtctcgctctgtgtgtgctcacacgtgtatgcaattgacatgtatagatacacatgca

SEQ ID NO: 92020 - DNA, 115 bp, Mus musculus
cagatttaaactggcaaatgggcgtgccttaaggctactgtagtgtgatgattggtatatatttggtccagggagtggcactattcgaagctgtggccccgttggagtaggtatg

SEQ ID NO: 92021 - DNA, 88 bp, Mus musculus
ccacctattccagtctgttgtgatattgggagaacatttttatttcattgtaaaactcacaagctttcactgagggaaaacgaggtgg

SEQ ID NO: 92022 - DNA, 110 bp, Mus musculus
gggagataagaatgttgagacaaatgcagaggctgaagagttgtgacgtttcagagggatgtttaaagatcagtgccatttgttattttaagttaagattctatggtcct

SEQ ID NO: 92023 - DNA, 66 bp, Mus musculus
gcacacacacacacatacatatatatatgtgtgtgtgcctatgtgtgtgtatgtgtctgtgtgtgt

SEQ ID NO: 92024 - DNA, 88 bp, Mus musculus
tctctgtgtctcagagtactcaggtttattttggttccgtgttttgttttgatttttagatcctgattattcctctgttgcatatgga

SEQ ID NO: 92025 - DNA, 113 bp, Mus musculus
gcccacggtttcagaggcttcggttcaaggttacttagttctgctggtttgggacctgtgacaagacagtgagccatcaggtgaccatggcaaagaaaagatagttgtgaggc

SEQ ID NO: 92026 - DNA, 90 bp, Mus musculus
ctacaaagctgttcttatctggccatggtcttctctgttactctcacattcttagacgtaactggctcattgtcagtgggtaagctgtgg

SEQ ID NO: 92027 - DNA, 101 bp, Mus musculus
atattaaggcatataaactcatatacttgtatatatacatatatataccccaaagatatatatgtgcatatacaagtatatgagtttatatgccttaatat

SEQ ID NO: 92028 - DNA, 157 bp, Mus musculus
atacactctttttacttgattattgttgttatatacatgtatatatgtatatgttatatagcatatatatgtatatatatacacacacacatatcacagtcccactttaacatgtatatgtatatattacataacacacacatatcctatatgctat

SEQ ID NO: 92029 - DNA, 129 bp, Mus musculus
gtgtgtgtatgtgtacacacacatgcacatgaatgtgtatgtatgcacatgcacacattagtttatatatatgtgtgtgtgtgtgtcctcacaggcacatgcacacacaagtaggttagtttatatgtg

SEQ ID NO: 92030 - DNA, 95 bp, Mus musculus
tccatatttgtttttctctctctgactctctccttatttactagggattagaagaagagtggatacctattttgaagaatactctgaagtgtgga

SEQ ID NO: 92031 - DNA, 110 bp, Mus musculus
ttggtataggaaaatgtcttttaaagaaattcttgagttactctgaatttataaatataaaaaagaacttaattttttctggggaggatcttttttttttatagttccaa

SEQ ID NO: 92032 - DNA, 137 bp, Mus musculus
tgtgtgggggggtgtgtgtgtgcgtgtgcctatgtgtgtgtggccatgtgtatttttacagtgagaacacacacagggcaatggatctatgccccagtgggtggccttgtgtatttaccttgctcctttctcactgt

SEQ ID NO: 92033 - DNA, 98 bp, Mus musculus
tcttatctgtctgtctgtgtctgtctctgtatgtctgtgtatctttctcttcacatatatacacatacatgagacagagatagagaaagaaggaaaga

SEQ ID NO: 92034 - DNA, 66 bp, Mus musculus
ctgggatagcaggctgaccactggtgtatatgtaacactcagggtctctctggaagttaatcctgg

SEQ ID NO: 92035 - DNA, 67 bp, Mus musculus
actgtctgtgactgcctccctgtatgtagtccaggactagtctacagagagctgcagactcagaggt

SEQ ID NO: 92036 - DNA, 83 bp, Mus musculus
gctgggcaaccaacctactggtgagatagatctttagtcctcattgtctgtctgtctgtctgcctgcctgcctgcctgcctgc

SEQ ID NO: 92037 - DNA, 87 bp, Mus musculus
gggctttctggagcttctgaagtgtgggtgcacactccaggatgcttagggggtgcagccattcacagatggggagctgaagaagcc

SEQ ID NO: 92038 - DNA, 115 bp, Mus musculus
atctcaagaagaaattgtggagttttgaggggtattttgatgtcatggcactgatgagaaagacagtggtactactttttaaaaaaatgcctttcaagcattttgtatgtgggat

SEQ ID NO: 92039 - DNA, 85 bp, Mus musculus
agcctgtgagtggagtgtgtgcactgctgatggtttttttccaccttggacataaattttccccatctgtggctctgctccagct

SEQ ID NO: 92040 - DNA, 105 bp, Mus musculus
tatgcatgcatgtatgtatgtatgtttgtatatccgtgtatgtatatatatatatatatatatatatatatatatatatatatatgcatgtatgtgtcaatagca

SEQ ID NO: 92041 - DNA, 112 bp, Mus musculus
aaggtcctgtgtgcttaagccttatgtaagcattgtttattttctttaaacaattgaaaaatgtttctttataatagggatgctgacatttggtggtggtggcacatgcctt

SEQ ID NO: 92042 - DNA, 70 bp, Mus musculus
tcatagcacctgcctgcctgcctgtctgccagtagccttggtgtggagacagacaggataaggtgaatgg

SEQ ID NO: 92043 - DNA, 152 bp, Mus musculus
aaattgtgtttctgcgggctcacctccatatttactctcagcctgactctcattttccagtgtctcatagtctggagaggaagtgtggtctagtggtcaggaaaaaaacaatttaggagactagagttgtgttttctattcctgtctcacta

SEQ ID NO: 92044 - DNA, 85 bp, Mus musculus
cattcttaacaaaacggactgttgcatacaaggttggaattattttctttttaaagacctcgtgaaacagcagtgtgtaggaatg

SEQ ID NO: 92045 - DNA, 90 bp, Mus musculus
cttctcattaggtgtcaggagtgtgtgtctgcgtgtgcatgtgcatgtgtgtgcacgcgtgcatacccgctcttgtgcactttgtgttag

SEQ ID NO: 92046 - DNA, 125 bp, Mus musculus
gccagacctccccattgctgatcacgtggcccagtgatgatgtttggcagctctctccctctctgtgtgccatgacatgattggtccttggtcagcccacacggagagaactggtaaggggctgt

SEQ ID NO: 92047 - DNA, 74 bp, Mus musculus
gggtctcaggacaacacaggcctacaatgggatgctacaaagttaacatgtgggtctcagtctgtcacagtcct

SEQ ID NO: 92048 - DNA, 123 bp, Mus musculus
ggaacattcccggtgtccaacaaccccatttacacactgaaagcaagaacacacacagcttagattcactactaggctcacattccttgagtggtagatggtgaaacacaggatccagcgtgt

SEQ ID NO: 92049 - DNA, 58 bp, Mus musculus
ggcagctgcagttctattagacacagagtctcactgtgtacagatgctgctgagtgcc

SEQ ID NO: 92050 - DNA, 76 bp, Mus musculus
tgtatttatatgtgtatgtgcatgcatgcatatatacatatatatatgcatgtatatatatatacacatacataca

SEQ ID NO: 92051 - DNA, 90 bp, Mus musculus
actaacagtaactctgcacggtgctggctcaggctctgagctatggagagacacagaacccagtcagcagaggagaaagaggcttatggt

SEQ ID NO: 92052 - DNA, 71 bp, Mus musculus
gctgcacctgcaccaacaagccccagtcgccaaacccctgccctctgactgggtctgtggctctgaccagc

SEQ ID NO: 92053 - DNA, 110 bp, Mus musculus
gcttcaatatttcctttggaagcaaacacagaatatgggatatttatttccattgtaactttattttgtaaataaccctcctttgtgaatgctttcctttagagcctagc

SEQ ID NO: 92054 - DNA, 75 bp, Mus musculus
tgtcagtccttgctctccaaggctcctgtttgtcacactcacactcaccaggctgccagggctgcaggggctgca

SEQ ID NO: 92055 - DNA, 75 bp, Mus musculus
ccaggcctgggggagctgtcttgtgtttctctgagagtatgttagtgatggcagatgcagctctggttgtaatgg

SEQ ID NO: 92056 - DNA, 105 bp, Mus musculus
gcggtgctgtgtggacaggagaggttcatgtactttctcaaaacagattttctttttgaaaaattaatgtgtgtgtgtgtgtctcctgcataaatgtctgcccag

SEQ ID NO: 92057 - DNA, 92 bp, Mus musculus
gtgtgtgtgtgtatgtatatgtatatatatatctcatatacatatatgcatatatatatatatatatgcgtatctgataaatgtgtatgtgg

SEQ ID NO: 92058 - DNA, 90 bp, Mus musculus
ggatccacccatgcctgtacattgtgagcactcactctctgggttcacacccttggtgaactaggcaagtctagaggcccatggtggtct

SEQ ID NO: 92059 - DNA, 91 bp, Mus musculus
cagtgtgtgtatgcagtatgtgcagtgtgtgtacagtgtgtacaatgtgtatatgtgcagtgtatgtgtgtgcacaagtgtgtttgcagtg

SEQ ID NO: 92060 - DNA, 104 bp, Mus musculus
actagcaatttagagaactaacctgctgcctggattatgatggtgtcactgaagtgagagtcctgagttttgtagttaaggctggctttgatcttgcatctggt

SEQ ID NO: 92061 - DNA, 96 bp, Mus musculus
aggttagctttgaatttatggtatagtccaggcaagcctcaaattttcagtcctcctgcctcagcttcttggttctatacaatatattcttgatct

SEQ ID NO: 92062 - DNA, 115 bp, Mus musculus
gttaattgtctgagatctggacttgctgtgtaacaaaggctagaatcacaggctggtttcaagtctggaattctcctaccctatccctccaagtgctaggattacagacatttgc

SEQ ID NO: 92063 - DNA, 101 bp, Mus musculus
tatgtatatatgtatgaatgcattatgtatgtatgcatgaatgtattatgttcatatatattatgtgtatatgcatgcatgtatgaatgcatgtgtgtatg

SEQ ID NO: 92064 - DNA, 98 bp, Mus musculus
tttcaaagtagaggttcattttcctgggtatatatttataactatctgaatatacaggttgatatacatccctaggagaatatatacagaatttggaa

SEQ ID NO: 92065 - DNA, 65 bp, Mus musculus
agtattggttctcttgcatatgtgccctcatgtgagtgagcacacgtgggtcagattactatgct

SEQ ID NO: 92066 - DNA, 110 bp, Mus musculus
tctgcctccatgtgtagggattaaaggctcataccaccacaggcctccataagtatatattttcttaataactcctgtgaagtgggtattatttctccaaattttacaga

SEQ ID NO: 92067 - DNA, 106 bp, Mus musculus
gccttaggccatggtggtctgataggatgcatgggacaatttcaatatttttgtatctgttgaggcctgttttgtgtccaattatatagtcaattttggagaaggt

SEQ ID NO: 92068 - DNA, 119 bp, Mus musculus
tctcagtgacagaactttctttaaaatttgtggtcctccattccaacttgatgaaattgtttttctttctttgtgcaagttttctgtgctggaatatacattttaaactggtactgaga

SEQ ID NO: 92069 - DNA, 56 bp, Mus musculus
agctagagctgtgagcaatgatctgaatgtcaggtctgtgaacatggtgaatggct

SEQ ID NO: 92070 - DNA, 75 bp, Mus musculus
cactcactctctctctttctctgtgtgtgtgggtgtgcacacacgcacgcatacatgtgattgtgtatgtgtttg

SEQ ID NO: 92071 - DNA, 91 bp, Mus musculus
gaatgttttttttcttgtcataaatctatccattttaacttgtacactaaagaccaaacaagtggatgaagttggaaggaggaaaacattt

SEQ ID NO: 92072 - DNA, 88 bp, Mus musculus
ttttagactttcttcatatctctccgtgcttgttacttgtcgacttgtcgggcgctcaaagcacctagggatgtgtgactgtggggga

SEQ ID NO: 92073 - DNA, 106 bp, Mus musculus
ctcaaaattacatgattaggcatggcttatcttttttttttcatggaaagggagatcaaattaagctccatgaagaaaggaccattttatcctatgttatattgag

SEQ ID NO: 92074 - DNA, 75 bp, Mus musculus
gaagaggttgtgaatgtatatttttagctgtgggaagagctatttcctagagttgtgtgcaaaattaattttttc

SEQ ID NO: 92075 - DNA, 81 bp, Mus musculus
tgatgggtaattcattacatttggataggagaaaactatctggctctctgtctcactgtgtaatgactatggatacctaca

SEQ ID NO: 92076 - DNA, 75 bp, Mus musculus
atgtgtgtgtgtgagtgtgtgtgcatgtaagttatctatgactatatatatgtatgtatatgtatgtataggcat

SEQ ID NO: 92077 - DNA, 88 bp, Mus musculus
agtagaaatcacaagaaatgagtgcattgatgacagccatgacaattaattcattgcagaataattatgcattcagtgatattttatt

SEQ ID NO: 92078 - DNA, 85 bp, Mus musculus; identical to SEQ ID NO: 57470

SEQ ID NO: 92079 - DNA, 85 bp, Mus musculus; identical to SEQ ID NO: 57470

SEQ ID NO: 92080 - DNA, 112 bp, Mus musculus
gtattatatttgactgatagtagctgtatatatgtatgcatgtatgtaatgtatgtatgtatgtatgtatgtatgcatgcatgtatgtggcacaatgtgaatttctagtata

SEQ ID NO: 92081 - DNA, 85 bp, Mus musculus; identical to SEQ ID NO: 57439

SEQ ID NO: 92082 - DNA, 99 bp, Mus musculus
ctggggagagtattatgaatctgtaactttcattaatttttggaatcttgtatatttcattagttttcagggtctcatgagctcatgtcttccttccag

SEQ ID NO: 92083 - DNA, 137 bp, Mus musculus
gcatatacatacatatatatatatatatgtatatatgtatatacatatatatatatatatatatatatatatatagtgtgtgcatgtataaatgtgtatgtatatatgtgtgtatatacatatatgtgatatatgta

SEQ ID NO: 92084 - DNA, 115 bp, Mus musculus
gaacgtctcactggcccacatgtactccttatgcttttgttttcactgtaatttttatattttcatgcaagtgaaaaaagaaagcaagttcaaccagaataaaaatgagatgctc

SEQ ID NO: 92085 - DNA, 65 bp, Mus musculus
atgtatgtatgtatgtatgtatgtatgtatgtatgtatgtatgtggtatgtattcatgcatgcat

SEQ ID NO: 92086 - DNA, 83 bp, Mus musculus
ccctcagtctctactcagactttatctctgtgtatcttgtagacaagacaaactttgggtttaaggttttgtgggcaggttga

SEQ ID NO: 92087 - DNA, 60 bp, Mus musculus
ctggtgcagactagtacagaccctgtgcatactgcctcagtctctgtaagtttacatgag

SEQ ID NO: 92088 - DNA, 101 bp, Mus musculus
gcattcatatatacatatatgtatatattcatatgtcatatatatgtatatatatgcatatatatgcatatatgtatatatgtgtatatgtgtgtatatgt

SEQ ID NO: 92089 - DNA, 226 bp, Mus musculus
gtatatgtgtatatgtgtatatatgtatatgtgtatatgtgtatatgtgtatatatgtatgtatgtatgtatatatgtatatatgtgtgtatttatgtatgtatatatgtatatatgcatatatgcatatgtgtatgtatgtatgtatatacgtatatatgtatgtatatatgtatatatgcagtatgtatatacgtatatacttatatatgtatatatgtatata

SEQ ID NO: 92090 - DNA, 94 bp, Mus musculus
tggaacatcaggggctggagagatggctcagcggttaagagcactgactgctcttccaaaggtcctgagttcaaatcccagtcatggtgggtca

SEQ ID NO: 92091 - DNA, 115 bp, Mus musculus
gtatgtttattaatgtacttggaaatacataaactatattctaactatatatatgtaaatacacatatatatgtgtgtgtgtgtgtgtattcacatttacacagaatggacatat

SEQ ID NO: 92092 - DNA, 65 bp, Mus musculus
gccattagtgaagagagtgtgctgtaactgtgtttgtaacggagctcacattctgctctacaggc

SEQ ID NO: 92093 - DNA, 71 bp, Mus musculus
acttttgcataagattatgtatgtatgtatgtatgtatgtatgtatgtatgtatgttctgtgtgtatgggt

SEQ ID NO: 92094 - DNA, 75 bp, Mus musculus
acatgcctgatgtgtcttcagtaccacaccaggtgggacctgactgacactcactccttctcatcaggttcatgt

SEQ ID NO: 92095 - DNA, 118 bp, Mus musculus
gtgaattgaatgctgggaacaggattttccaggttgtggatgccttttattttgtatatgatactttgataattgaaactattcctgcaaacaagtcctaagtctctctctctgtctc

SEQ ID NO: 92096 - DNA, 72 bp, Mus musculus
gacagtgaaattagattcatgccaggatggagaggggtagctaaagtcgtctggtctcagtctgtcactgcc

SEQ ID NO: 92097 - DNA, 75 bp, Mus musculus
gtctgtctctgtatctctatctctacattatcaagtttgcaaaccactgatgtagagggagaatataccactgac

SEQ ID NO: 92098 - DNA, 92 bp, Mus musculus
gttacactaatcgtaaataatgcctgttaaatgtccctctgtctctcagtaggggcgggtactcaatgctttgtcagtgcgactgggtttac

SEQ ID NO: 92099 - DNA, 85 bp, Mus musculus
atatatatatatatatatatacacacacatacatatacatatatatttgtatgtatatatgtgtgtatatatgtaatgtatatgt

SEQ ID NO: 92100 - DNA, 76 bp, Mus musculus
tgtgtgttcaagtcaggtacacatgtgtttttgttcatgtggagtatgcatgtgtgtaggtgtgcatgtatgtaca

SEQ ID NO: 92101 - DNA, 103 bp, Mus musculus
gtttatgtgtggatttttttgtatgtaatacttatgtatatatgtgtattcatgtatacgtgtttctatatgtgtgttatacatatattcatccccataatac

SEQ ID NO: 92102 - DNA, 86 bp, Mus musculus
tactaatatacatgtgtatatatgtaaatatgcatatgtatacatatatatgaatgtgtgtatgtatgtatgtatgtattacagtg

SEQ ID NO: 92103 - DNA, 66 bp, Mus musculus
cccatgggtgtttgtgtcgacgtctccccatagctgtgattattgacacacactgacactcttggg

SEQ ID NO: 92104 - DNA, 84 bp, Mus musculus
cagtcagacttatcatactgccagtgaagccagagtatatatttatttccttacaggtttctgttgtagatgtgtggtctcctg

SEQ ID NO: 92105 - DNA, 78 bp, Mus musculus
tatgtgtgcatgcatgtgtgtgtgcatgtgtatgtacatgtgtgtatgtgtgtgcatgcatgcatgtatgtatgtatg

SEQ ID NO: 92106 - DNA, 91 bp, Mus musculus
ctggctgtgtggtggagcttgctctatccattaaatgtatgtatataagtatgtatgtgtatgtgtgaaatgcctggagtctgcttgctgg

SEQ ID NO: 92107 - DNA, 75 bp, Mus musculus
gcttccagagtgcagcttgatagttctggcctgctgggcagaggacagatgatagtgagctgtgtttctatgaac

SEQ ID NO: 92108 - DNA, 76 bp, Mus musculus
ccaaaaatactcatatgagttgagtctgtgcagtgaagtttcttttcctggaatctcagcttgctgagctcgctgg

SEQ ID NO: 92109 - DNA, 56 bp, Mus musculus
aactctgtcagtctgtctgttgtctctctgcaagagacacataaggaagcagagtt

SEQ ID NO: 92110 - DNA, 68 bp, Mus musculus
cagacccacagactgcacttgaaggggagctctccaggcctcgctctacttgtctgtctgtctgtctg

SEQ ID NO: 92111 - DNA, 123 bp, Mus musculus
cccgggcctgagagctcagagtatagggccccagcgcttctgccccctttgtcgtctctgtctgcctgtcagttttggggctggttatggaacctacagcaggtgacagtctcagcagtttgg

SEQ ID NO: 92112 - DNA, 87 bp, Mus musculus
ttgtggttaactctaccctcactctgatgatcccaggtctccttttgttatctatatgactttgttggttttaagagtctaccatgg

SEQ ID NO: 92113 - DNA, 90 bp, Mus musculus
tgaggtggtatgtggcagaagacattctggtcaggcaggtggggaaccaagggatggtggcaggtggggaatggtttgattgtgacctgg

SEQ ID NO: 92114 - DNA, 76 bp, Mus musculus
ctcagtggctcagagtctctctggaagttagtatcactacatatccagggttacaatcatctgatgctttactgag

SEQ ID NO: 92115 - DNA, 88 bp, Mus musculus
gatggcactattgggagtggtagaaaacagaaggtgggctggctggaggaagcaggacactgagggtgtgaatttggatagtgttatc

SEQ ID NO: 92116 - DNA, 95 bp, Mus musculus
ggagacagtgactagagtttctcctgtcaacattctttagtgacacacaatctctgacatttggacttgcatgagattttctgaaacactgttcc

SEQ ID NO: 92117 - DNA, 114 bp, Mus musculus
gtagatgtaggtgtaggtgtaggtgtaggtgtagatatatacatacatatacacacacacatatatatgtatatatacatacacacctatctatctatctatctatctatctat

SEQ ID NO: 92118 - DNA, 97 bp, Mus musculus
agtctgagaggctgcagtcaaggtactggcaagaccatgctctcttctgacactctgagagagcatccatgctttcttgctttagcttcttatggct

SEQ ID NO: 92119 - DNA, 107 bp, Mus musculus
tatatatacatactttttgcgtgtgcacatggatgctcatgtggaggtgtacgtgtgtgtgtgtgtgtgtgtgtagatgtctgttcatgtctgtgcatgtgcatgtg

SEQ ID NO: 92120 - DNA, 85 bp, Mus musculus
ctggatcaccagtctgtgggatgtgcaatagtgtatttgtacatgtgggcaggtgcacatgcccgtgcactcatgctgtggccgg

SEQ ID NO: 92121 - DNA, 82 bp, Mus musculus
tttacactttagcacacatttatttatgttttaatgctgggagctgggaacaggtgtactaagaatgtgccctaaaggtgga

SEQ ID NO: 92122 - DNA, 98 bp, Mus musculus
ggaagcaagaaaacaaatgtgtccaaactccactgtgaaccctctcactcactgcctgaggaggttttcatgagagcagcacatgagttcttgactct

SEQ ID NO: 92123 - DNA, 102 bp, Mus musculus
tatgtatatgtaatgtatatgtatacacacacatatatatgtgtgtatatatatatatatatgtgtgtgtgtgtatgtgtgtgtatgtggtgtgtgtgtgtg

SEQ ID NO: 92124 - DNA, 80 bp, Mus musculus
cagacgagaactgtggagtctggggtcagcctgcagctggaaacacacaggctgtgcctctctcacctcttttgcttctg

SEQ ID NO: 92125 - DNA, 83 bp, Mus musculus
ttaggttaaaacaacagtggctctgtctccctcggctgcctgcagctgcttcagtgagctaaagtctgaagtcttatatctgg

SEQ ID NO: 92126 - DNA, 141 bp, Mus musculus
gcctgcatgtgtgattttgatgtgtgtgtgtgtgtgtgtgtgtgtgtgtgtgtgtgtgcacagaagcgtcttactgttttgtcagtgcctatcttcagctgtactgtggcacatagagcagagcacaaactgtaggcaaca

SEQ ID NO: 92127 - DNA, 84 bp, Mus musculus
cacacgtaatcaggtaggatgttgcttccattctgatttcacagatgaatgagagctatatgcttctgcactggtattcctgtg

SEQ ID NO: 92128 - DNA, 69 bp, Mus musculus
tgtctgcagtgacctgcaggagtctccgagactgtaccctcagctctctctcagtgtctctgccttgca

SEQ ID NO: 92129 - DNA, 120 bp, Mus musculus
aagtagtaagaatgaatggatgaactgggcatgcgaatctttagactctagaaagacaccagagaacttgaaaaggagtctaagtgcactgttttgatatctccatggaaactgatattt

SEQ ID NO: 92130 - DNA, 69 bp, Mus musculus
tttatttgatacatataaaagatatgcatatatttatatatatgtgcacatatgatatgtatctataaa

SEQ ID NO: 92131 - DNA, 90 bp, Mus musculus
aatagatgtggatgtgaaagtatcttagtcgggatttaagtgatgtgaagagacacattgaccacaggaactctcataaagacatgtgtt

SEQ ID NO: 92132 - DNA, 64 bp, Mus musculus
gagaagtggaagctagagtctcttggcaggtctgtccatcatgaccacagactctgtcactctc

SEQ ID NO: 92133 - DNA, 85 bp, Mus musculus; identical to SEQ ID NO: 57439

SEQ ID NO: 92134 - DNA, 66 bp, Mus musculus
gcatttggtggtatcagtattttaatctttatagtaggagtgtaatgatattgcaccactgtttgc

SEQ ID NO: 92135 - DNA, 83 bp, Mus musculus
ttttgaaatgtcaacttgagaatcctacatacagcctttgttgggcagtgagtcagtctttctcagtcaaagctgtttcaaaa

SEQ ID NO: 92136 - DNA, 85 bp, Mus musculus
gtccatggtggtctgataggatgcatgggataatttcaatatttttgtatctgttgaggcctgttttgtgacctattatatggac

SEQ ID NO: 92137 - DNA, 85 bp, Mus musculus; identical to SEQ ID NO: 57470

SEQ ID NO: 92138 - DNA, 100 bp, Mus musculus
ggggaccttgtgctcagttcaagggttgtctgagagcatctacttttgtatttgtcaggcactagcagagcctctcaggagacagctgtatcaggtttct

SEQ ID NO: 92139 - DNA, 85 bp, Mus musculus; identical to SEQ ID NO: 57439

SEQ ID NO: 92140 - DNA, 79 bp, Mus musculus
acttctgttactttcactgtgtctctgttcagtttctgtttacatgacctgtccattgatgagagtggggtgttgaagt

SEQ ID NO: 92141 - DNA, 114 bp, Mus musculus
ggaggtcttacaaatctgtacattgtatgtacatctatatgtgtaaaaatacatatgtatgtatgtatgcatgtgtgtgtgtatgcatgtattatttgatagaagatgttttac

SEQ ID NO: 92142 - DNA, 93 bp, Mus musculus
catatttatatgcacatatatgaacaggtatatgtaattgattttaatgaaattacatatatatattatatatgctatgcatagaattatatg

SEQ ID NO: 92143 - DNA, 108 bp, Mus musculus
ggagcactgggtagtcggactgcgcaagacctggggagggtgaggggtggctacagctgtgctctgtctgactctctggttgctgcagcagcagagcaagctaagtcc

SEQ ID NO: 92144 - DNA, 85 bp, Mus musculus; identical to SEQ ID NO: 57470

SEQ ID NO: 92145 - DNA, 85 bp, Mus musculus
ggccatggtggtctgataggatgcatgggataatttcaatatttttgtatctgttgaggcctgttttgtgaccaattatatggtc

SEQ ID NO: 92146 - DNA, 117 bp, Mus musculus
ggaatactttggtttctccatctatggtaattgagagtttggctgggtattctatctttatttagtgcatttgttgttctgattattatgtgtctggaggaatttcttttctggtcc

SEQ ID NO: 92147 - DNA, 85 bp, Mus musculus; identical to SEQ ID NO: 57439

SEQ ID NO: 92148 - DNA, 100 bp, Mus musculus
ggacctgtagttccagtgtttcctctaggctgtgttgccaagtcttaagtttatgtctctgtggctcagtctcatctgtgaatttctgcagcctctgttc

SEQ ID NO: 92149 - DNA, 101 bp, Mus musculus
gtgtattcaggggggctggagagatggctcagtggctaagagcactggctgctcttccagaggtcctgagttcaagtcccagcaaccacatagtgactcac

SEQ ID NO: 92150 - DNA, 92 bp, Mus musculus
atatatatatagatacatatacatacatatatatgtatatgtatctatctatacatatatatatatatgtatgtatgtatgtatgtatgtat

SEQ ID NO: 92151 - DNA, 97 bp, Mus musculus
ctccaggtaaagggacagtacactgttgactgtcagcaccgtcttggtgacgaatgctccccgtggcagcagcagttgggtgctgggagcctcggag

SEQ ID NO: 92152 - DNA, 78 bp, Mus musculus
tatatgtatatgtatatgtatatatatacacacacacaagtatgtatgtgtatgtatgtatgtatgtatgtatgtatg

SEQ ID NO: 92153 - DNA, 79 bp, Mus musculus
gacagagggctggttgttaagtctctctgtttctcagtctcttcccccagaaacatggagaaatgacagtgttcctgtc

SEQ ID NO: 92154 - DNA, 121 bp, Mus musculus
atgtgtctatgtgagcacattggcatgtatgaacgtacatgtgtgtgtgtgcatgtgttgtgtatgtgtgtgcattgatgtgtgtgcgtacatgtgtgtgtttgtgtgtgcatatgtgtgc

SEQ ID NO: 92155 - DNA, 76 bp, Mus musculus
ccaaacaactgtgagtttggggcatactagaaatggaaataacctgcattctctgtgcctctgagactctggatgg

SEQ ID NO: 92156 - DNA, 85 bp, Mus musculus; identical to SEQ ID NO: 57470

SEQ ID NO: 92157 - DNA, 83 bp, Mus musculus
ctggtatttaagaacagtagtaattttgttcatgcttaaataatttggattaagcagattagcctgctgctggccttttctag

SEQ ID NO: 92158 - DNA, 82 bp, Mus musculus
ggctttatgcaaggctagagagataaagggcactgcaataaatcatatcagagccatatttccccatgcctgcaaaagagct

SEQ ID NO: 92159 - DNA, 85 bp, Mus musculus; identical to SEQ ID NO: 57439

SEQ ID NO: 92160 - DNA, 85 bp, Mus musculus; identical to SEQ ID NO: 58391

SEQ ID NO: 92161 - DNA, 111 bp, Mus musculus
ctgtaaccatctctgtaaagcctacctcaaactgcagatccatgaatgaaaatgctcagtttgtaggttctttgctgtgatgcacagacaccaaacagaaatcgagcattt

SEQ ID NO: 92162 - DNA, 60 bp, Mus musculus
tatatgtgtgtgtgtgtgtgtatacatatatatgtatatatttttatatatgtatatata

SEQ ID NO: 92163 - DNA, 60 bp, Mus musculus
atatacacacacacacacacgcatatatgtgtgtgtgtgtgtgtgtgtgtgtgtgtgtgt

SEQ ID NO: 92164 - DNA, 137 bp, Mus musculus
catgtgcatgtgtgtgcatgtgcaagtgtgtgtgcatgtgtgtatatatgtgtgtatgtgtgtgtgcatgtgcatgtgtgtatgtgtgtgttcacatgagtgtatgcatgtgtgtatgtgcatatgtatatgtgtat

SEQ ID NO: 92165 - DNA, 94 bp, Mus musculus
gaggcgggaggttggcattcaaggtctttgttatggagttccaccttatttttgttgagactgggtctctcactgaattggaactttctgtttc

SEQ ID NO: 92166 - DNA, 114 bp, Mus musculus
aacctttatgaaatgtgtgtgggggggggctacatttttcttttacaacttggttgtttagttttcaaacatgacctttgtagatgacaacattgcattgcgacacaaaaggtt

SEQ ID NO: 92167 - DNA, 114 bp, Mus musculus
ctttggcccaagtgtgaaatggctggctgttgatttcagaagtgtgagtgtacatttttatatctcacacaaatgaatacattttttgtaccttacacatttgcggaaacactg

SEQ ID NO: 92168 - DNA, 85 bp, Mus musculus; identical to SEQ ID NO: 60314

SEQ ID NO: 92169 - DNA, 112 bp, Mus musculus
tggaacacactcaagcatggagccttttattattctataataataaagttattattatagaattaaaattattattattctataataaaaggcactgtgtgtgtgtatttca

SEQ ID NO: 92170 - DNA, 118 bp, Mus musculus
gtattttgttttagatgttggagtagttgtgtcatgatgttgttattattttaatttctctttacctgaatgtaataagatgatgatacatattttttattcatgaaaaatttataca

SEQ ID NO: 92171 - DNA, 108 bp, Mus musculus
ctttccctttcccttctccctaaacctccatctcttgtctctgtctctcattccctgcgtttgtccctctggggtgagaacttggttttggggtgtcttgtgggatag

SEQ ID NO: 92172 - DNA, 69 bp, Mus musculus
gcctttgcccctgcctctgtctctgcctcccaagtcctgggattgtagacatgagacgtggtgctcagc

SEQ ID NO: 92173 - DNA, 83 bp, Mus musculus
gctcagtgttgggggctgagttgggatagggactcctcagcaaccgagggcctctctcttgctctcagtgtccttgttggggt

SEQ ID NO: 92174 - DNA, 79 bp, Mus musculus
gtgctgcagtaccctgagagaagactgtctgctttggatgcttcagagatgcatgttagcctggtgggaagtaaagcat

SEQ ID NO: 92175 - DNA, 60 bp, Mus musculus
gtatgtatatatatatatacacacatatatatgtatgtgtgtgtgtatgtgtccatttac

SEQ ID NO: 92176 - DNA, 90 bp, Mus musculus
ggaatctggaaaaaggaacattttgctcactgtgtatctgtgacgagttccaggtgcagcctggagttaagtggttgttttttctgatcc

SEQ ID NO: 92177 - DNA, 119 bp, Mus musculus
cctaaatgtccaatatagcagtctctggtttttgcaccaatcaatctccctatgacagctaagaatagtgattatgttgaggtttggtcttttgctagtgttgtaatgttaaatactgg

SEQ ID NO: 92178 - DNA, 84 bp, Mus musculus
tgctgtgactctaactctctgactatgaggccaattaagtcctttctttataagctgttttggtcatggagtgttgtcatagca

SEQ ID NO: 92179 - DNA, 83 bp, Mus musculus
agcttagcttgaaagcaactacagcaactgtgattttgtagatgattaaaatcgctgtaatgggatgcttttgtataatggct

SEQ ID NO: 92180 - DNA, 91 bp, Mus musculus
gggaattgaactcagaactgagagagcagccagtgttcttaactgctgagccatctcactgctttgatgtttttggttttaatcaactccc

SEQ ID NO: 92181 - DNA, 78 bp, Mus musculus
gcttccattcaagaggatgtggtaccttcttctgaccagctcagaagaaggggtgattatatttcattgtatacaagt

SEQ ID NO: 92182 - DNA, 116 bp, Mus musculus
ttgaagatcagccttagtgcatggtgatctgataggatgcatgggacaatttcaatatttttgtatctcttgaggcctgttttgtgacctattatgtggtcaattttggagaaggt

SEQ ID NO: 92183 - DNA, 96 bp, Mus musculus
ctgggaaggacagaagatgagagttcagactcaggtcaggtgtccacccttgctggtaagcgccttacctcactgagccgtcttactgggccccag

SEQ ID NO: 92184 - DNA, 67 bp, Mus musculus
acatatgcacgcacagtatatatgtatgtatatatacatatatatgtacacatgtgtgtgtgtgtgt

SEQ ID NO: 92185 - DNA, 78 bp, Mus musculus
ccgggacagtctgtttctcagattcttgggcacccagacaccgctgggagccgtgtggaagagttcagaatggagtgg

SEQ ID NO: 92186 - DNA, 80 bp, Mus musculus
gttgtagtgatggagcctggctggctgcctctgtgccatcctcacaaggaggcttgctgtcgtgtgtactgtctcacagc

SEQ ID NO: 92187 - DNA, 105 bp, Mus musculus
tagttcagggtgtgcagctcaatttgatactggccttaaattgaagatgtcattttcttattttgttggctaattccagaagttgtaggaattttaaatgaacta

SEQ ID NO: 92188 - DNA, 87 bp, Mus musculus
gctgtttacaacttaaaaattagtaaggctcacattagtattttaataattcaagctattttgagcaaactaatggctctaagcagc

SEQ ID NO: 92189 - DNA, 105 bp, Mus musculus
agaggtctgggattataggtgtatactacaacacatgactgaggttgaacttttaatgtgtttattaaacatgtgtatttctcacttactattcagttttccttt

SEQ ID NO: 92190 - DNA, 111 bp, Mus musculus
aacaaaacaaaagagtttaaggcaggtgcggtgctgtggcagctatgtaacaatgtaactatgtaacttgaggctctgcactagtcattaaaatagagctcttcttttgtt

SEQ ID NO: 92191 - DNA, 71 bp, Mus musculus
gggtttgctaatttctcactttctcacctggtgtgccctctcacatcagagtgatcagagagatgtgactc

SEQ ID NO: 92192 - DNA, 73 bp, Mus musculus
ccgggcaagtccaggcaagcccaggcaagtcagttactaatagaaaaatccaggctccagccttcatgcccgg

SEQ ID NO: 92193 - DNA, 85 bp, Mus musculus
actcagtggtgtgtgtgtgtgtatgtgtatatatgtggtgtctatgttcatgtatgtatgtatgtatgtatacatgcaggtgtgt

SEQ ID NO: 92194 - DNA, 113 bp, Mus musculus
agtgcagtgcaggaaagaggagctgtcccagagctctctcccactccctgtcacaggacacagggcttgggtgtgaaaactggtagcctcttcagacagtctcacgatgcatt

SEQ ID NO: 92195 - DNA, 67 bp, Mus musculus
gaggctgtgcctctcactgtgtacctctgtctggcctagaatttgctacatagaccaggctagcctt

SEQ ID NO: 92196 - DNA, 98 bp, Mus musculus
gttctgagactgcaccacccctcacacctgaccgcatacttctatggcagtgcccacaagtctgcctgtgtgcctgtctgtgggcaggcctcatgcac

SEQ ID NO: 92197 - DNA, 84 bp, Mus musculus
tgtgagaaggtaaaaagactgctatgtgtctctcttgctctgtcagggagtctgtactgaccataggcatgtcctaccaccaca

SEQ ID NO: 92198 - DNA, 100 bp, Mus musculus
agtgtactgttcaggggctggagagatggctcagcggttaagagcactgactgctctttcagaggtcctgagttcaatttgcagccaccacacggtgcct

SEQ ID NO: 92199 - DNA, 69 bp, Mus musculus
ggaagtaggtttggagaggctagggctagagttcatgctgtgtgctctatgaatctctcactctcttct

SEQ ID NO: 92200 - DNA, 85 bp, Mus musculus; identical to SEQ ID NO: 57470

SEQ ID NO: 92201 - DNA, 147 bp, Mus musculus
atatgtaataggtatgtatgtatgtatgtatgtatgtatatgtacgtgtatgtattatatgtatgtatgtatagtgtgtgtgtgtgtgtgtgtgtgtgtgtgtgtgcgtgcatgcacatgggtgcttacataccacatcatgtgtat

SEQ ID NO: 92202 - DNA, 84 bp, Mus musculus
agcaaaagctggagctagaagacagacagcagaggccacaggcctccgactgctgactccagttccccacacaatgcctttgct

SEQ ID NO: 92203 - DNA, 62 bp, Mus musculus
gaggggtgtctggctctgtgtgtggcagccttgccttcatctgcccactgctactgtccctc

SEQ ID NO: 92204 - DNA, 102 bp, Mus musculus
cactggtgactgtggtgacatcacagactcacactgtgtgattatggtgacatcataggctcacactggtgactgtggtgacatcataggctcacactggtg

SEQ ID NO: 92205 - DNA, 78 bp, Mus musculus
ctctagactcactctatctgtctgtctgatacacgcacacacacacacacacagagagagagagagagagagagagag

SEQ ID NO: 92206 - DNA, 68 bp, Mus musculus
tgatgtgatggcacagaggcagaggctcggtcaggtttggaggctcactctcactctgagtcacatta

SEQ ID NO: 92207 - DNA, 85 bp, Mus musculus
tgctgcacatgtactatgtatgtatatatgtgtatatgtgtgtatgtatgtgtgtatatgtgtatgtgtgtatgtatgtgtatat

SEQ ID NO: 92208 - DNA, 74 bp, Mus musculus
ccatacactagcttcatgatgttgagtaaagggaggagcctctctcaatctcagaatctttgaactgtgaatgg

SEQ ID NO: 92209 - DNA, 70 bp, Mus musculus
ggcaggaggagagagggaagaactcatatgcatctatgtgtgtctgtttgtatgtctctgtgagtgtgtc

SEQ ID NO: 92210 - DNA, 78 bp, Mus musculus
cactatgctgtgacgaataggaagccatgtccgacttctgaatctcagaagcaatctgtgtctgtctgtctcgtggtg

SEQ ID NO: 92211 - DNA, 91 bp, Mus musculus
agctttgggctggagtgagcgaacagagtgagtagaggttaaaattcaattcctgacaaccacatgaaggctcacaaccatctgtaaagct

SEQ ID NO: 92212 - DNA, 102 bp, Mus musculus
gaggcagaatatttaggcccaaaaggcagaagggacttccagcaactctaaaagcacactgactgtcactttctgctcataaactaaattggactgggcctc

SEQ ID NO: 92213 - DNA, 120 bp, Mus musculus
ctggaactcttggttgctgagtggctttatagtgtacgaatggagcagagcacatttgtgtgtctctgtgcaattcctggtggacatgtgcctactccaggctttggctcttgtctccag

SEQ ID NO: 92214 - DNA, 80 bp, Mus musculus
ggccctgccatggaggcagaggagcagtgggttcttcagctcacactgtctgattgtctgccatgctcaggtttgctttc

SEQ ID NO: 92215 - DNA, 133 bp, Mus musculus
tcactgttgcagtgaagacacagagaatgacagactcactgtcaatcactgctgcagtgaggacagagagaatgacagactcactgtcaatcactgttgtagtgagacacagagaatgacagactcactgtca

SEQ ID NO: 92216 - DNA, 75 bp, Mus musculus
ggactggagagatggctcatcggttaagagcactgactgctcttccaaaggtcctgagttcaaattccagcaacc

SEQ ID NO: 92217 - DNA, 94 bp, Mus musculus
gctaagtggtgcttgtatagtggtaacctggttagtgtgacagtcccactgtctccaagacatactgccaactgtgtgcaggcttcaattttgc

SEQ ID NO: 92218 - DNA, 66 bp, Mus musculus
gctcccaggacagaaagctcctggctctgagctgatggagtctggcagtctgtgtgcctgtggagc

SEQ ID NO: 92219 - DNA, 90 bp, Mus musculus
gactatgcatttaggtattctgtggaggtgtccgtgctcaggctgtgtctgacaggcagacttctggtgttctctgagacatgtttagtt

SEQ ID NO: 92220 - DNA, 78 bp, Mus musculus
cagggatttcttgagtgaggggctcagaaccagttcaatatcagagaccctgggacactctgtaactctaatcacctg

SEQ ID NO: 92221 - DNA, 113 bp, Mus musculus
tgattttcttcctgatgttttcctagttgtgtttttgtaactgaaacagaagagtcaaagcagtgtttagaggagaggactaggctccccacacgaggaaggcattttaatca

SEQ ID NO: 92222 - DNA, 73 bp, Mus musculus
gatctgaagtgacagagactctcgctcactgctggtggcagtgcacactgacagtcatttgggacagaggatt

SEQ ID NO: 92223 - DNA, 92 bp, Mus musculus
acagaacacataaatgacaggcagcattgttgggcatatcatagttaatacagtgcctaaccatgttctctctgatgataacccggttctgt

SEQ ID NO: 92224 - DNA, 76 bp, Mus musculus
cacaaaaatgggggagactaacggtctgtgttcatgttctctgagggctgtggagaggtgtctcactgtgtgtgtg

SEQ ID NO: 92225 - DNA, 91 bp, Mus musculus
gagttaataatgagtctgtttcactctgccacttctgccaaatgcccagtgctaggccagagggatgaacaaagacagcgtcactatgctc

SEQ ID NO: 92226 - DNA, 82 bp, Mus musculus
gagccagtgagtagtgagtgtgcccagaaactgcctccgccttcaccggagcaagatggacagacagacatactgctgattc

SEQ ID NO: 92227 - DNA, 64 bp, Mus musculus
ttaaatgtatgtatgtatgtatatatgtatgtatgtacatatgtatgtgtgtgcatgtatttga

SEQ ID NO: 92228 - DNA, 117 bp, Mus musculus
gagtctttcattgaatctggaactcattggttggctagcctacgatatgccgagcccctgtctctgtctcactggggttcccggtgcttgctacaatgtctgactttttgacagatc

SEQ ID NO: 92229 - DNA, 64 bp, Mus musculus
gcacgtgaggtcttagctgtgtacattagggtgagtgtgagcacagagggaggctttaatgtgt

SEQ ID NO: 92230 - DNA, 66 bp, Mus musculus
gtgtctgtgtatatgcatatatatatgtgtttgtgtgcatatatatatatgtatatatatatatat

SEQ ID NO: 92231 - DNA, 60 bp, Mus musculus
tctgtgtactctctgtctcagcatcctgctactacaaagtgctgcttgtcagagaacagg

SEQ ID NO: 92232 - DNA, 75 bp, Mus musculus
gggctttaaaatttgggagtagttgttgctctagaaaagattcaaaggcaatatttttttcaatatttggggcct

SEQ ID NO: 92233 - DNA, 97 bp, Mus musculus
cctatgagttctaattagtcatgtgatgtcatttactagttgtcttagctgagatttctattgctgtgatgaaacaccatgacctaaagaaaaaggg

SEQ ID NO: 92234 - DNA, 119 bp, Mus musculus
catcaggtagaggtagagctcagggagtcttgtggaagagtgggtgacagaagtgagtgagctggaagggtcaagaataccacaggaagacctacagagtcaactaacataagcctatg

SEQ ID NO: 92235 - DNA, 95 bp, Mus musculus
tgagctgcagaactatagcagatgcagaggacctaggccagtctctgtgagtcacagtgagccctggttagttgattatataggccatgttctta

SEQ ID NO: 92236 - DNA, 75 bp, Mus musculus
gcctgtatgtatgtatgtatgtatgtatgtatgtacgtatgttatatgtatgtctgtactgcatgtatgcagtgc

SEQ ID NO: 92237 - DNA, 119 bp, Mus musculus
ccacctgcttctgccttctcagtgctaggttaaaggctgcaccatcatgtcctcagggcctgcctgcctgcctgcctgcctgcctgctgacccgcctacctacctatagagcaatctgg

SEQ ID NO: 92238 - DNA, 80 bp, Mus musculus
aagcatggtgaggaaatactggaccagagtaaacctgaaaatcagctgggcaaactccagattctccatctccatgtctt

SEQ ID NO: 92239 - DNA, 104 bp, Mus musculus
atgacattttcaggaagtgccagggtccagtccaggggtttgtccatgacaggaaagttctctgccactgagacatatctcccaccagccatgacaaaggttat

SEQ ID NO: 92240 - DNA, 104 bp, Mus musculus
gtgcgtgtgcgtgcgcgtccgtgcgcgtccgtgcgtgtgtgtgtgtgtgtgtatgcgtgtgtatgtgtgtgtgcacacatgtgcgtgcgtgcgtgcgtgcgtgc

SEQ ID NO: 92241 - DNA, 73 bp, Mus musculus
agagacccacaagtgttgcacagctagctgcattagcaagtcaagctctgtctctgtcttttagtggagtcct

SEQ ID NO: 92242 - DNA, 64 bp, Mus musculus
accaccagcaaacgtgacagactctttctctgtagtttctaagagtctgaacacagcagggggt

SEQ ID NO: 92243 - DNA, 79 bp, Mus musculus
ctgaacacaaggcaagtttgctctacatggtgggttccaagctggtcaggggtatgaagagagactctgtctcactcag

SEQ ID NO: 92244 - DNA, 77 bp, Mus musculus
gcagctcttcaagctgcacttggttcattggctttcctggtcttgactgagctgactgtgtatctgtgaccagctgt

SEQ ID NO: 92245 - DNA, 71 bp, Mus musculus
ggagaaactgtgtcactatgtctgtgggctttaaaaccctcatcctaacggcctggaagccagtcttctcc

SEQ ID NO: 92246 - DNA, 98 bp, Mus musculus
tggactactgaagtcactgcatgggtcactcagagaggactggatcgagtatctgcctccctgaatgccatcatgccctgcagagagctggtagtcta

SEQ ID NO: 92247 - DNA, 103 bp, Mus musculus
cctcaactctctcttggattcatggtctcttcttctgtaactgttgcagatagatgatagacagacagacagacagacagatgatagatagatgataggtagg

SEQ ID NO: 92248 - DNA, 68 bp, Mus musculus
tatgtatgtgtatgtctgtgtgtgtatatgtatgtatgtatatatgtatgtaagcatgtgtgtatgtg

SEQ ID NO: 92249 - DNA, 68 bp, Mus musculus
gctctgtctctgtgtgactgagcctttaccccagctctgtggctctgtctgtctctgtgtgactgggc

SEQ ID NO: 92250 - DNA, 83 bp, Mus musculus
gctcagttctctgccagcagatccagggaagaggagagaggtcctggtccagagtctctctgggtctgagcatgatggtgagt

SEQ ID NO: 92251 - DNA, 95 bp, Mus musculus
tggtcgggttggataatgatgagcctgtcagatgactgagatgaccctggatgacagtcattcctgtcatggaaaggagaagccagcagttacca

SEQ ID NO: 92252 - DNA, 76 bp, Mus musculus
tactggcaacaagcagccagggaaggcctgtcacaacatactccactcttgttactggcttctgtctgagtcagtg

SEQ ID NO: 92253 - DNA, 70 bp, Mus musculus
gttggggactgagttgggataaggactcctcagcaaccgagggcctctctcttcctctcagtgtccttgc

SEQ ID NO: 92254 - DNA, 115 bp, Mus musculus
gaactgcaagtaaaaaaataaacctgctttctttctgactcaccctctttctgactcacccagaatgtggtattgtgttgttagcagcgtaaaagagagcaggtctaggggattc

SEQ ID NO: 92255 - DNA, 78 bp, Mus musculus
ctctcaggccattccaggtgatagaaggttggagctgagccgtctcactctgtctcttaagtcggagtttcctgtgag

SEQ ID NO: 92256 - DNA, 72 bp, Mus musculus
agatgtatagatacagatatagatatagatttaaatatcattcaagcctgtgtgtctgtgtctgtgagtctg

SEQ ID NO: 92257 - DNA, 75 bp, Mus musculus
tctgtctgtctgtctctctctccatccatcagagacagacagacagagatagagagacagagacagagagacaga

SEQ ID NO: 92258 - DNA, 88 bp, Mus musculus
catctacccacttactctctctcaaactcatggcctcttttcccttgagagagagagaagagagagtggtggtgtgtgtctgtgtgtg

SEQ ID NO: 92259 - DNA, 56 bp, Mus musculus
ctgtgtgtgtgtgtgtgtgtacgtatgtacgtatgtatgtatgtatgtatgtatgg

SEQ ID NO: 92260 - DNA, 86 bp, Mus musculus
tcagccaaacattgtattgccttgtgattttgatgtagaaataaaggtttttatggccaaaacatatcatgtatcaggtttgctga

SEQ ID NO: 92261 - DNA, 60 bp, Mus musculus
tgggtctcagtgagagcactggctcttggtcttcctgcctgtgtgactcactgtctctca

SEQ ID NO: 92262 - DNA, 64 bp, Mus musculus
tttgtgtctgtctgtctgtccatgtgatccactgtatttactaaggatagactgcaggaataaa

SEQ ID NO: 92263 - DNA, 110 bp, Mus musculus
gtttaaggatttattggtgtcttgcttaatattacaactcatatattatgtatatatatgcatgtgtataggtattcactttttaagagcacacttagcaattctgtaac

SEQ ID NO: 92264 - DNA, 126 bp, Mus musculus
cacatacatgcacccctgcactatatatatatatatatgtgtgtgtgtgtgtgtgtgtgtgtgtatatacatatatatatacatacacatatatgtacatacacacatatatacatatgcgtgtgt

SEQ ID NO: 92265 - DNA, 127 bp, Mus musculus
tatacacacaacaaaagtggattcagcaggttgtatttatatatttgtgcatatatatatgtatgtgtatatgtatatttacgtgtctatatgtgtgtataggtacatatacatatgtgtgtgtata

SEQ ID NO: 92266 - DNA, 116 bp, Mus musculus
ggagcagtagtaggtcttcaggcttacaggccagagtttgcaaaccacatctgtctgtagacagtctgtagaggcagtgtcggcttagcttagcccaggatgttccactctgtccc

SEQ ID NO: 92267 - DNA, 82 bp, Mus musculus
tgcatgagtgtatgtttgtgtgtacatttttaagttttctattaggcttatatatttgagacacaaacactctctctaggta

SEQ ID NO: 92268 - DNA, 85 bp, Mus musculus; identical to SEQ ID NO: 57439

SEQ ID NO: 92269 - DNA, 85 bp, Mus musculus; identical to SEQ ID NO: 57470

SEQ ID NO: 92270 - DNA, 105 bp, Mus musculus
atatatatatatatatgtatatatatatacatatatatatacacacacacatatgtatatatggatatatatgtatgtatatatgtgtatgtgtatacatatgta

SEQ ID NO: 92271 - DNA, 116 bp, Mus musculus
attgtgaattttgaccagtccttttgtgtgtgtattttcacgtctgtctcattctctctcgactgttttaggacacgagatgcatgtgcctagccctcgtgagacccctcagcaat

SEQ ID NO: 92272 - DNA, 104 bp, Mus musculus
ggcatagagtatcttaggagatgagatctgacattatttattttatagtcatgtggtttgtacaacttaattgtgatgaagtctcagcgactcttctcagtgtc

SEQ ID NO: 92273 - DNA, 118 bp, Mus musculus
agtctgtgtcaacagctttccctggagttgtaaaggcggtctcttcgagtcctgccaggacagagggaagacagtgagcctaagcacaaagccacgggctggcttccatgtcaccact

SEQ ID NO: 92274 - DNA, 116 bp, Mus musculus
ggattgaagtcttctactatcaatgtatgtaagccaacatgtgattaaagctatctatagtagtgtgtacatgaacttgagtgcccttgttttggtacatagatgttaagaattcc

SEQ ID NO: 92275 - DNA, 81 bp, Mus musculus
tatctatctatctatgtgtgtgtataaaatagtatctattttaaatatattatattgtgcatatcatatattaaatagata

SEQ ID NO: 92276 - DNA, 92 bp, Mus musculus
atgaataacagtatagacataggttaggggtgatgcttaagtcatctaaaatcctccttactctgtctctatctcatttctcagttattgat

SEQ ID NO: 92277 - DNA, 117 bp, Mus musculus
atgttgtggaaaggggtgtaatacagatgtctcatttaccagtatagatttcacattttcttattctgtgaatgttgactgtttgtaggcatctatattgatcaccatctactgcat

SEQ ID NO: 92278 - DNA, 85 bp, Mus musculus; identical to SEQ ID NO: 57470

SEQ ID NO: 92279 - DNA, 116 bp, Mus musculus
ctccaagtttgtaatagggacatgttctttctattagactttattttaaatattattgacagaagatatccggtagttaagaatgcatgagaaaataatgtcccaaattgatggag

SEQ ID NO: 92280 - DNA, 84 bp, Mus musculus
gccacacattcaacaaagtatgtatatttgtatttgcatatatgcaaaatatataaatacaaaatgctgagtcagttttgtggt

SEQ ID NO: 92281 - DNA, 117 bp, Mus musculus
tcaatgcctagggggagaggtgacatgacgtgtaatttggttctgattttgttctatactttgaaagtataggctaagtcattggtattgttgagacatctttctgctagaaattga

SEQ ID NO: 92282 - DNA, 61 bp, Mus musculus
tgcctagaggcttgcctgagagggtgttgcaccaccactgtcagcctgtctgcttgaggta

SEQ ID NO: 92283 - DNA, 109 bp, Mus musculus
aaacaacatgcctacagtactgcccaggagaaagaaatttttgttcctgtcttcatgaacaaggttgtttagtctctaccggtcattagggctatgggaagtcaagttt

SEQ ID NO: 92284 - DNA, 76 bp, Mus musculus
ctggagtttagacagtgttggtgaagctccaggggacaagcccacttgaggagagaaatcacagtgctcgctccag

SEQ ID NO: 92285 - DNA, 119 bp, Mus musculus
gcacatctctgaggacttatcacattctctgcgagcattaatttatatgtatttaacaaccactcctctgctgtttagaagtgtattgttgatgttggagatagtgtggcgtgtagctc

SEQ ID NO: 92286 - DNA, 70 bp, Mus musculus
catgtatatatgtgtatatgtatgtatgtatgtgcccatgtatagtatatatgtatatatgtatgtatgt

SEQ ID NO: 92287 - DNA, 75 bp, Mus musculus
cacaaatatatatatatatataaatatatatatatatatatatatatatatatatgcatgtatgtgtgtgtgtgt

SEQ ID NO: 92288 - DNA, 115 bp, Mus musculus
gggccatacaaacaacactaaatgaattttgtaacataccctgtctgtgtgtgtgtgtaacaataacaactaaggaagaggacataaattacaagagagtgaatgtagtaggctc

SEQ ID NO: 92289 - DNA, 84 bp, Mus musculus
agacactgagagcatgaacaaaggaagtagcttgaattctaaaaatagatctaccaggtacctttctgtgtctctgcttcgtct

SEQ ID NO: 92290 - DNA, 87 bp, Mus musculus
tatttatatatggatatggatatgtgtgtatttgatatatatttaaatttatatctagtgcatatatttatgtatactttgtaagtg

SEQ ID NO: 92291 - DNA, 94 bp, Mus musculus
tctccgtatctcatgtttctactgtgtgagtgacactgtgtcaggaagtatgtgaacagatgtttatttaccctagtataccatggataacaga

SEQ ID NO: 92292 - DNA, 84 bp, Mus musculus
tcgcttcagtatgtttgtgtgtcagtgtgtcagagtataaaaatgtctccagcagctagaagcatcagatcccattgaaggtgg

SEQ ID NO: 92293 - DNA, 92 bp, Mus musculus
tgccactccctggtccaaggatatacaaaccatcacagtgtgtacatgtgttcatgtatgtgtgcaagtgtatgtgcctatgtggggaggca

SEQ ID NO: 92294 - DNA, 103 bp, Mus musculus
gtgaagatctggaatctgtgtgattctctgagattatgtaaacagtaggaatctaattttattttaatgatattagtaaggttatacatgattcactctccac

SEQ ID NO: 92295 - DNA, 85 bp, Mus musculus
ggtttaaaagtcccagttgctttttgtgtttgtgagttctttagcaatttgacacaagacagagtcatctgggaagaaaagaact

SEQ ID NO: 92296 - DNA, 101 bp, Mus musculus
gtgcacctgctgtgtgtctttatcagtcttgtgtggagacagcagagtgagacctcccttcccactgagtgctgctccttctactgtgaacttagccccac

SEQ ID NO: 92297 - DNA, 89 bp, Mus musculus
ctcaaaaataattctaggtattttcagggactccggagtgtgtgaaagactgactgggtctctgagtcttgtgcattttcttgagctct

SEQ ID NO: 92298 - DNA, 87 bp, Mus musculus
gaacccaaaacacgagtgtctgaggggatggatgtcacagctgagagagcaaacacaccattcctgttgttgctgggttattggttc

SEQ ID NO: 92299 - DNA, 59 bp, Mus musculus
tgtgcatatgtatattcgctgtacttacttgtgtgtgtatgtgcttgtgcatgtgtgta

SEQ ID NO: 92300 - DNA, 103 bp, Mus musculus
cggctgggttctagttggattccactcatcccccggaaggtcatggttaggacaggtccctctgacactctcagccgctcagcccgggatcaggtccttttcc

SEQ ID NO: 92301 - DNA, 100 bp, Mus musculus
tattgaggaaaaacggaggcctgtcttactagagtttctaggtagataagttgtatatttgctaagaaaagtaatatagggctagagagatagctcagta

SEQ ID NO: 92302 - DNA, 88 bp, Mus musculus
ggttctcccaagagcccatgatttgtctgcttacagtcctctgcactgataacagtgccaggtatgagctgcaacttgtggagatgac

SEQ ID NO: 92303 - DNA, 59 bp, Mus musculus
gcaaatgtctgactctgactctttcagctgcttgttgggtctttcggaggcagtcatgc

SEQ ID NO: 92304 - DNA, 116 bp, Mus musculus
ctaacaaggttaatgaggactcttgggatatataagaaggtatgtgtgcatgtacatgtgcatacactcataccccaatatttctgaaagagaggtatatcttagcctatgtgtag

SEQ ID NO: 92305 - DNA, 105 bp, Mus musculus
gaatggacgattccctgttactaaccacagtgactgaattgggaagtagaactcttgtgattttgacttcaccagaagcacattctctgagcagcgatgtccctc

SEQ ID NO: 92306 - DNA, 74 bp, Mus musculus
ggccaggagggttgctggccgtctgcggcccgaaaatggtgctgcctcagtggctctgtgactcccgcctgtcc

SEQ ID NO: 92307 - DNA, 72 bp, Mus musculus
gaatttgggcacagagactagagagagggctgagtgttgagcacctactggtcttatagagaccttaggttc

SEQ ID NO: 92308 - DNA, 115 bp, Mus musculus
gcccaacaagcaattacaagtcagatgcagatacttacacccaaccaatggacagaagtcagcgaccactgtggttgaattagtgaaatgctgaaagaagttgtggagatgggtg

SEQ ID NO: 92309 - DNA, 85 bp, Mus musculus; identical to SEQ ID NO: 57470

SEQ ID NO: 92310 - DNA, 109 bp, Mus musculus
ctgctgcataaaatcaggtatacattttttttgtctaacagcatttcaatacatttaaaagcactgttattaaattagtttgtaccatattgtgattggtgcagatcag

SEQ ID NO: 92311 - DNA, 73 bp, Mus musculus
tgcttctcattcactgactctgacaaactagttctttttatgaagtgatttatctcagtgcaaatgagatgca

SEQ ID NO: 92312 - DNA, 100 bp, Mus musculus
gatgtaaacttttagaaccattttaagggtagaagtttttcattattttacattgaaatttcttcatagttcttgatttggttttctatctccagtaatc

SEQ ID NO: 92313 - DNA, 116 bp, Mus musculus
gcttgttcaatattacccaggggacaaaatttggtgaatggattgttagaaataaattgtttcaattttagtcatgaacaatatggctgagtgtatgcctcttaactgtgtcaagc

SEQ ID NO: 92314 - DNA, 81 bp, Mus musculus
tagtgataggtttgatatatatatatatatatatatatatatatatatatatatatttgtatgtgtctgcctatctatcta

SEQ ID NO: 92315 - DNA, 67 bp, Mus musculus
tatatatatgtatgttgtatacatatatgtatatgagtatatatgtgtgttgtatatatgtatatgt

SEQ ID NO: 92316 - DNA, 58 bp, Mus musculus
tggtgatttgaataagaatggccctcctagggctatttatatgaatatttagtcatca

SEQ ID NO: 92317 - DNA, 76 bp, Mus musculus
agaggactgttatggtgtggctctcttgtcatgaggggcttaattcaaggaggtccatttccatgattattccttt

SEQ ID NO: 92318 - DNA, 77 bp, Mus musculus
ggtgtcctctctcactgcctctcccactggttattaaatcatgtaacttctgcaagactgcatctagagcgaatacc

SEQ ID NO: 92319 - DNA, 116 bp, Mus musculus
tgcctctcaccatatggctatctctggtgttagctggtcttgctgtctctgactgtgatttttccctcctgcaagcctctgtgtcagtactctgggatgaatttgtgtatggagca

SEQ ID NO: 92320 - DNA, 72 bp, Mus musculus
ctgatttctgtgtgtgtgattctctggatcaatcatagtccaaaacatcacataaaatttttcggaagtcag

SEQ ID NO: 92321 - DNA, 114 bp, Mus musculus
ttgagatcactatgtagcttccagctttcaatttgagtgaaaatttcttctaaagtagaatgttgttcagttgaggataaaggtggcaaggagaattgtacttaagtattttaa

SEQ ID NO: 92322 - DNA, 66 bp, Mus musculus
tggcaagaattgaaaatctgatatgaaatattaatttgccttataattcagattttcttcttgtcg

SEQ ID NO: 92323 - DNA, 74 bp, Mus musculus
gtatatgtgtatatatgtatgtatatgtatgtgtatatatatacatacatatatatacatacatacacacatat

SEQ ID NO: 92324 - DNA, 77 bp, Mus musculus
cacacacagcattgtgtctgatgagtgagaggatggtaagacatctcctatgtgggctaaggcaggagctgggtgtg

SEQ ID NO: 92325 - DNA, 84 bp, Mus musculus
ggctggttttgttttggccagatcacatatcaaggtcaggtgtaccctgccaagaagggcacactgtgtgactgacagccagtt

SEQ ID NO: 92326 - DNA, 109 bp, Mus musculus
tactttgctgtgaatttcctggtcatcgatagatatttatttcataggaatgtagcgtactttgtcagatgagagtgaggaccaagaataacccacaagctgcaatgta

SEQ ID NO: 92327 - DNA, 81 bp, Mus musculus
gctttctctagtttgaccttctgtctctgtctgagtattttctctaattgagagatggaaaatgtgcagtttggagagggc

SEQ ID NO: 92328 - DNA, 79 bp, Mus musculus
gacctcaaacactgcctctgactgcctctgcttctcaagtgctggggttaaaggtttgaggcactgttgcccttgggtc

SEQ ID NO: 92329 - DNA, 86 bp, Mus musculus
tcattgagtagagtgtggttcagcttccacgtgaatgttggctttctattatttgtgtgatagtccatcatgatctgataggatga

SEQ ID NO: 92330 - DNA, 115 bp, Mus musculus
gcctttatatgttacttgaccttttccccaactccttttaatattctatcctcatttagtgcatttgttgttctgattattgtgtgttgggaagaatgtcttttctggtccaggc

SEQ ID NO: 92331 - DNA, 100 bp, Mus musculus
ctaagagaatcaacgcttccagagcagaagcgttctgttgcctgggttaaaaatgaagtgtaatcaagaatgttgaatgctgtaggaacttggttattgg

SEQ ID NO: 92332 - DNA, 88 bp, Mus musculus
gcaggcttagtctatgattactgagtttgctgatgttaactaacatggcatgagtcattctctgttttctataattaactaagtctac

SEQ ID NO: 92333 - DNA, 133 bp, Mus musculus
atatgtgtgtgaatatgtgtgtgtatatgaatgtgtgtgtatacgtatgtgtgtgtatatatatatatatatattcataatatattcatatatttacatacacatatatattacacacacacacacacacaca

SEQ ID NO: 92334 - DNA, 93 bp, Mus musculus
acatgcccatgtatacaaacatactcacataatatagataatgcaaaatataatacatatgtatgtatgtatgtgtatatatgttatacatgt

SEQ ID NO: 92335 - DNA, 141 bp, Mus musculus
tcattatgtaagtaatatatatgtatatatgtgtatgtatgtatgtgtgtgaatattagtatattcatatatatacatatgtgttcatatatattagtatattcatattattatgaatatattcatattatatatgaatat

SEQ ID NO: 92336 - DNA, 94 bp, Mus musculus
cttcatatgtaccttgttgacaatatttttatatacatgtatgaatatacatatatgtatatgtgtatatgaagaggttcacatacatatgaag

SEQ ID NO: 92337 - DNA, 126 bp, Mus musculus
ggggttgagctggcaagctgtcctggggcctgcacatatgtctaaatccttgtgggacagtctctgactctggcagctgcactttctgcacactacagaaggctgctgatgctggcattggcagag

SEQ ID NO: 92338 - DNA, 99 bp, Mus musculus
ggacagaataaacatgctgaggttctaggttgtttggtagtcagtgtcacctcatcaaagcccacctgaccactagctgttctgtgtgtatgtctgtct

SEQ ID NO: 92339 - DNA, 120 bp, Mus musculus
agggatattgtttgtttatattctcctagttttagttgagggattagttaggttttttttttttttttttttttcctttgttgaaattttggatctgttgtggtaggacagttgggctct

SEQ ID NO: 92340 - DNA, 112 bp, Mus musculus
ttttttgaggggcggggagaggtagttgtttctccagaaaagattcaaagacaatatctttttcaatattttggacatcagttatatcctaaacaaatagtgccacagaaaa

SEQ ID NO: 92341 - DNA, 88 bp, Mus musculus
agttctggtgtattctgatgacctttgatctgtatctttaagattgttttgggctacacaggagtagggcataggatccatttgagct

SEQ ID NO: 92342 - DNA, 85 bp, Mus musculus; identical to SEQ ID NO: 57439

SEQ ID NO: 92343 - DNA, 85 bp, Mus musculus; identical to SEQ ID NO: 57470

SEQ ID NO: 92344 - DNA, 85 bp, Mus musculus; identical to SEQ ID NO: 57439

SEQ ID NO: 92345 - DNA, 77 bp, Mus musculus
tacctgtaaatttatatatatgtgtgtgtatataatacatattatacacatacatatatacagaatatatacatgta

SEQ ID NO: 92346 - DNA, 84 bp, Mus musculus
ggaaacgggttactgggaggtgggctttgaggtttgagaagctcaaaccaggctcagtgtcagtctctcttgctcctgcctgcc

SEQ ID NO: 92347 - DNA, 118 bp, Mus musculus
gaatgtttgcttggaaaattgttttccagccttttactctgagttagtgtctgtctttttctctgaggtgggtttcctctaagcagcaaaatgttgggtcctgtttgtgtagacagtc

SEQ ID NO: 92348 - DNA, 85 bp, Mus musculus; identical to SEQ ID NO: 57439

SEQ ID NO: 92349 - DNA, 93 bp, Mus musculus
ccatgtgcccatgtgcatgtatgtatgtatgtatgtatgtatgtatgtatatgtatgtatgtatgtatatgtatgtatgtatattcctatagg

SEQ ID NO: 92350 - DNA, 117 bp, Mus musculus
cttttctgtttttcttctctttttccctcctggtcctttcaaattatatactacacacagaaagaacagagagtggaggtgcgagtggggaaagagagaacgagagtaacagaaggg

SEQ ID NO: 92351 - DNA, 104 bp, Mus musculus
cacttcatctaatacagaagtccaacttcatttcatcaaagaaaacaagattgttgtttgccttttgcaatgagaaaaatgaggtatttctagtgtgtatagtg

SEQ ID NO: 92352 - DNA, 121 bp, Mus musculus
ccatttttaatctggacttcttgatgtgcacgatacaaaatcagtattgctttttatatttaaaaatgctctgttgatggtataatgtgttcaacatatgtatgggggtggtggctgagaa

SEQ ID NO: 92353 - DNA, 119 bp, Mus musculus
ggtgctggcctccgctgtgcctaactaataaacaagccttgtacgcaggcatgagagtgaactcactcttagtcactgcccattctcggggtgtaatagtggggtgatgggcgagcaac

SEQ ID NO: 92354 - DNA, 104 bp, Mus musculus
tggcaaattagttttctattggccatgcactgctggacatgcagagtgccctgagtgtagtttgtgtccccagtgagacacccttggaaaaaactaagttttca

SEQ ID NO: 92355 - DNA, 96 bp, Mus musculus
gatcagcattagtccgtggtcatcagataggatgcatgggataatttcaatatttttgtatctgttgaggcctgttttgtgaccaattatatggtc

SEQ ID NO: 92356 - DNA, 169 bp, Mus musculus
tatatgatgtataactgatagatatgtatatatgtataactgatatatgtatatatgtataactgatatatatgtatatatatctgtattatatatatatatatatatatacatatatatacatatatatatatatatatatatatatatatatatatatatatactca

SEQ ID NO: 92357 - DNA, 118 bp, Mus musculus
ttctgactggtatgaggtggaatctcagagttggttagatttgcatttccctgatgacgaagtatgttgaatatttctttaggtgcttctcagtcattcgatattccccagttaagaa

SEQ ID NO: 92358 - DNA, 118 bp, Mus musculus
aagatcaaccttagtccatgatgacctgattggatgcatgggacaatttcaatatttttgtatatgttgaggcttgttttgttaccaattgtgtggtcaattttggagagggttcctt

SEQ ID NO: 92359 - DNA, 66 bp, Mus musculus
atcgatctatctatctatctatctatctatctatctagatagatagatttagatttagatttagat

SEQ ID NO: 92360 - DNA, 82 bp, Mus musculus
cactgattttctggaagcatatgagagaaccccagaagacatctgtctcagtcagggtttctattcctgcacaaaaatcatg

SEQ ID NO: 92361 - DNA, 85 bp, Mus musculus; identical to SEQ ID NO: 57439

SEQ ID NO: 92362 - DNA, 87 bp, Mus musculus
aggttcagagtttgcagtttgcccatctggtttcatgtcttacttaagtgattgaaagaatctcagaagagactgacctttgaactt

SEQ ID NO: 92363 - DNA, 100 bp, Mus musculus
gaagggaactttttgtatctgggtggaggtgatggatgtatgctattgtaaatatactagacaattcattttcttcatgttaaaatgattagttctcttt

SEQ ID NO: 92364 - DNA, 81 bp, Mus musculus
tccatggtgatcagataggatgcatgggataatttcaatatttttgtatctgtggaggcctgttttgtgaccaattatgga

SEQ ID NO: 92365 - DNA, 85 bp, Mus musculus; identical to SEQ ID NO: 57470

SEQ ID NO: 92366 - DNA, 110 bp, Mus musculus
ctttagatgcttcactgcagttcaagtctcctcagttgagaatttgttgtttagctctgtaccccattttaaataaggttatttggttttctgcagtctagctccttgag

SEQ ID NO: 92367 - DNA, 116 bp, Mus musculus
gaagcagcagataaggatcgattttcttccctcctgagctagtacgttgattataaatgatgaaaaatctagagaagatatcttagtaggaagcaattctagttatctaaagtttc

SEQ ID NO: 92368 - DNA, 179 bp, Mus musculus
atatatatgtatatatatgtatatatatatatatgcatgtatatatgcttgtatgcacatatttatgtgtatatatatgtgtgtgtatgtgtatatgtatacatttatatgtatatatttcagtcatatatatatatatatatatatatatatatatatatatatatatatatatatat

SEQ ID NO: 92369 - DNA, 100 bp, Mus musculus
agttgaaagcaatcatctgttattttatgtcagcttttcctctctgactctcagaggattctctgcatcattaggatataatcaggttttgttttgaatt

SEQ ID NO: 92370 - DNA, 73 bp, Mus musculus
tatgtactgtttctcagtgattacatatatatatagatgttgatatatatatgtatatagagagagatatata

SEQ ID NO: 92371 - DNA, 101 bp, Mus musculus
catttagaatctgtctctctctcaattatgtgtgtgtgtgtgtgtagagagaaagagagagagagagagagagagagagagagagagagagagaatgagtg

SEQ ID NO: 92372 - DNA, 110 bp, Mus musculus
ggttgaggaattcaaggtggtggggtgctccttgccaactccaaagtgacacacactgttactgtaaccagtgcacatcatttgcacccaaccatgtgttggccaagacc

SEQ ID NO: 92373 - DNA, 110 bp, Mus musculus
ttgaagatcagccttaatccatggtgatctgataggatgcatgggataatttcaatatttttgtatctgctgttgcccttttgatgactgattatatggtcaattttgga

SEQ ID NO: 92374 - DNA, 84 bp, Mus musculus
attgctgtgacaaaacactgtgaccaaataaaacttgggaagaaaaatgtttatttggtttacatattccacgtcacagtcaat

SEQ ID NO: 92375 - DNA, 85 bp, Mus musculus; identical to SEQ ID NO: 57439

SEQ ID NO: 92376 - DNA, 85 bp, Mus musculus; identical to SEQ ID NO: 57439

SEQ ID NO: 92377 - DNA, 85 bp, Mus musculus; identical to SEQ ID NO: 57439

SEQ ID NO: 92378 - DNA, 112 bp, Mus musculus
atactatggtaaatggattccctgtcagtgattctactcacataaaagattaattttttaatttaattattttaatgtgtgtcacttttattgtgatgtttttactatgtat

SEQ ID NO: 92379 - DNA, 140 bp, Mus musculus
atatatatatatatatatatatatatatatatatatatatatatatatacatatgtgtgtgtgtgtgtatacatatatatagatatattctaaatgcataggtgcaactttggtttgcatgagtgtgtgtgtgtgtgtgt

SEQ ID NO: 92380 - DNA, 82 bp, Mus musculus
atatgtgtgtgtatgtgtatgtatttgggtgtgtttcaatgtttgtatgcatgtataagtgtgtgtgtgtgtgtgtgtgtgt

SEQ ID NO: 92381 - DNA, 80 bp, Mus musculus
cagacactaggcagatgccaacaagagtctgctgacatgagcctaataaagctgtctctgtgagtctctgccagtgcctg

SEQ ID NO: 92382 - DNA, 83 bp, Mus musculus
ggcaaggaagtgggctcaagtattttggtcattatgacaatcatgggagtaatcactcaagagactttgcttactgccttgtt

SEQ ID NO: 92383 - DNA, 85 bp, Mus musculus; identical to SEQ ID NO: 57439

SEQ ID NO: 92384 - DNA, 72 bp, Mus musculus
gataacaatgaaaccatgagtagcaatgtcagtttatatattgataaatacttatgggcttgcctgtttttc

SEQ ID NO: 92385 - DNA, 86 bp, Mus musculus
tctatgtgagtataatggttacagaggctagaagagggagttagatttcctggaactaggatctatagtaactagggcttatagga

SEQ ID NO: 92386 - DNA, 71 bp, Mus musculus
tatgacaaatgatgtatattttatttactttgacttagtcaaaaatagtatgtatatatcaaaatgtcatg

SEQ ID NO: 92387 - DNA, 118 bp, Mus musculus
gcttgctgtagatggataactgtgctttgaaggtgttatattgacctgtgttcctttgagtgtgtgcttttcagggcctttagccttttggtgcctggatgttctttttgtagtaggt

SEQ ID NO: 92388 - DNA, 91 bp, Mus musculus
ggatcttggttatacctggatatcagagtctcagaggaagctaaacttccaagaactctgatacactcagaatctcagcaccccagaatcc

SEQ ID NO: 92389 - DNA, 101 bp, Mus musculus
tatacaggtcattgttttctgtcttgagaggtatagttgacaaatatatgtttctattttgcttttgaaaacactctttgaggggatggagtgacattata

SEQ ID NO: 92390 - DNA, 125 bp, Mus musculus
cagaattcagtctctctctctctgtatatatatatatatatatatatatatatatatatatatatatatatatatatatatatatatatatacagtgtgtgtgtgtgtgtgtgtttgtgtgtatg

SEQ ID NO: 92391 - DNA, 117 bp, Mus musculus
tggaatctcagagtcattttgatttcagtttctgtgatcacaaaagatgttgaatatttctttaaatgtttcttggccattaaagatcctctattaataattctctggttagttcta

SEQ ID NO: 92392 - DNA, 73 bp, Mus musculus
ctgtgtgactagtgcctgaggctctgttcagcagaaatgcagtgacagagagtcagtcacatcagttagacag

SEQ ID NO: 92393 - DNA, 109 bp, Mus musculus
tggatgtgttttcttgattttctttaaggacttgtaactctttagcagtgttctgtatttctttaagtgagttactaaagttcttcttgatgtcttctaacatcatcta

SEQ ID NO: 92394 - DNA, 90 bp, Mus musculus
acacacatatgtatatgtatatgtatatgtatacgtatacgtatacgtgtacgtgtacgtgtacgtgtacgtgtacgtgtacgtgtacat

SEQ ID NO: 92395 - DNA, 85 bp, Mus musculus
agaagcaataacagaagtttgactccagttagaaaaactgcttagtagtaaacctgataggggatgaagtatccttgttgtctct

SEQ ID NO: 92396 - DNA, 88 bp, Mus musculus
gtccccaattcactgctgactgctgaaactgactcttccttagcttcctatgtccgttcaccagggagacaatgaagtttggaaagac

SEQ ID NO: 92397 - DNA, 113 bp, Mus musculus
ttatttgcctatatgagagtgcaacagctgtgtctgaagccatgtggctgtgaaactttatatatttagtatcttctagcttcagccaaaatttgttcatttatggtctataa

SEQ ID NO: 92398 - DNA, 69 bp, Mus musculus
ccaacagctgaatgagaaatgaaattgttgtactctatacactgtagtatttattattcagcttgtagg

SEQ ID NO: 92399 - DNA, 110 bp, Mus musculus
gacttttgaaaagaaagcagtgaacacttagctgtgatcactcagaactgattctcacactctgagttccagcttgttttaacattcttcatactattatatcaactgtc

SEQ ID NO: 92400 - DNA, 82 bp, Mus musculus
gttgaattagggaaagctggactggacagatagctcagcagttaagagcactgtctgctcttccagaggtcctgagttcaat

SEQ ID NO: 92401 - DNA, 85 bp, Mus musculus; identical to SEQ ID NO: 57470

SEQ ID NO: 92402 - DNA, 83 bp, Mus musculus
tcttttgagacagggtctctctgtgtatctctcactgtcctggaaattatatatagagcagacttcccttgaactcatagaga

SEQ ID NO: 92403 - DNA, 110 bp, Mus musculus
ttgaagatcagccttagtccatggtgatctgataggatgcatgggataatttcaatatttttgtatctattgaggcctgttttttgaccaattatatggtcgattttgga

SEQ ID NO: 92404 - DNA, 108 bp, Mus musculus
ttgtgtgttcattttttatataaatgtaggtatgaatatctaagtctatatgttaatttatatagagaggtgtttatgtacttgtacttaatatataataatatataa

SEQ ID NO: 92405 - DNA, 85 bp, Mus musculus; identical to SEQ ID NO: 57439

SEQ ID NO: 92406 - DNA, 120 bp, Mus musculus
ccattaagaattaatttggttggggtaggggaggatgctggagagatggctcagcggttaagagcactgactgctcttccagaggtcctgagttaaagtcccatcaaccgtgtggtggct

SEQ ID NO: 92407 - DNA, 112 bp, Mus musculus
tacaaatattaaaattattatcactagatttaatatacatatgtatatatatatataattatgtatatatgtgtgggtatattgtgtctgtgtgtataaatgggtatgtgta

SEQ ID NO: 92408 - DNA, 127 bp, Mus musculus
tgtgtatgtgtgtgtgcgtatgtatgtatattatatgtatatgtgtatgtgtatgtgtatgtgtatatgtatatgtgtatatatatatatatatatatatacacacacacacacacacacaaacaca

SEQ ID NO: 92409 - DNA, 93 bp, Mus musculus
gcacatgtgtgtgttcatgtgcatgtgtgtgttatgtatctatatatatcatatacatcacatatatacatacatacatgtacacacatgttc

SEQ ID NO: 92410 - DNA, 68 bp, Mus musculus
gtatatttgtatgttatgtatatattcatatatattatgtaagtgtatataatatgcatattatatac

SEQ ID NO: 92411 - DNA, 68 bp, Mus musculus
ttgtccttgtcttctgattatctgctttggacaataaaaggtctaagaaacacagaagacaaggacag

SEQ ID NO: 92412 - DNA, 98 bp, Mus musculus
gaagagagaataactgcaataaagttaagtgtcgtattaaattgtcattatattttaatagtctagtatgtcataaattatgcagtactctggtcttc

SEQ ID NO: 92413 - DNA, 89 bp, Mus musculus
tatgtatatgtatatgtatatgtatatgtatatgtatatgtaatgtgtatatgtatatgtacatatatatatatgcatttccttacata

SEQ ID NO: 92414 - DNA, 69 bp, Mus musculus
gtgtctgtctgtctgtctgtctgtctaacacatgtggctgtatctacaggctagaataggtcagatcgc

SEQ ID NO: 92415 - DNA, 111 bp, Mus musculus
tgtatgtagctctagtgccttggttggttggtttgttttcctagtttactggagttgttttctataaatttttgaaagcattaaaatgaactacttagcatgctgaaaaca

SEQ ID NO: 92416 - DNA, 77 bp, Mus musculus
acacatacatacatacatacatacctttaaaaatcatttattttatttttagatgttttgtgtgtatgtctatgtgt

SEQ ID NO: 92417 - DNA, 85 bp, Mus musculus
ctgacaggttaaggagaaccaaggaaatagatttttttttaatctctgacctgtgtaatcatttggcctttctataacctgccag

SEQ ID NO: 92418 - DNA, 92 bp, Mus musculus
gagagagagagagagagagagagagagagagagagaaggaaaccggaagacttaacttctctctgtctcagttttagccctttaaatttgtt

SEQ ID NO: 92419 - DNA, 113 bp, Mus musculus
atgcatgcatgtacatgtgtatgtgtctctatataacatatatacatatatattcatgtatgtatgtatgtatgtatgtatgtatatatacatgttattcttcatgtatgcat

SEQ ID NO: 92420 - DNA, 81 bp, Mus musculus
cagtctggattataagttcctggccagtcagggcacagagttagactctgtgcctctgtctctcctctatctatccatctg

SEQ ID NO: 92421 - DNA, 85 bp, Mus musculus; identical to SEQ ID NO: 60912

SEQ ID NO: 92422 - DNA, 59 bp, Mus musculus
tttgagacaggctttcagtcttagccctggctggcctggaactcagtctgtgtctcaga

SEQ ID NO: 92423 - DNA, 85 bp, Mus musculus; identical to SEQ ID NO: 57439

SEQ ID NO: 92424 - DNA, 85 bp, Mus musculus; identical to SEQ ID NO: 57439

SEQ ID NO: 92425 - DNA, 86 bp, Mus musculus
ccttcccctaactcttccattggtgtctgcatgctcagtctgatggttgtctatgagcatctgcatttgaattggttaggttctgg

SEQ ID NO: 92426 - DNA, 74 bp, Mus musculus
agagaggttgacacacaggagagagtctgcacagggggccttgatgaacagactgtctatggttttagagcttt

SEQ ID NO: 92427 - DNA, 85 bp, Mus musculus; identical to SEQ ID NO: 57439

SEQ ID NO: 92428 - DNA, 87 bp, Mus musculus
attgtagacttctgacatctgtatttgttattgtgcttataaagaatatcaacaataaccaataacaatgaaaaggagttctacagt

SEQ ID NO: 92429 - DNA, 93 bp, Mus musculus
tccatggtgatctgataggatgcatgggacaatttcaatatttttgtatatgttgagccttgttttttgaccaattatgtgatgaattttgga

SEQ ID NO: 92430 - DNA, 74 bp, Mus musculus
gtatgtatgtatgtgtgtgtgtatatatatatatgtatagatacatgtatacatatatgcacatacatacatca

SEQ ID NO: 92431 - DNA, 115 bp, Mus musculus
tccttgaccaagttatcattgtgtagaatgttgtttagtttccacatgaatgttggttttttattatttatgttgttattgaagatcagccttagtccatggttatctgagagga

SEQ ID NO: 92432 - DNA, 97 bp, Mus musculus
agggatgcatgtaggtatatgagtatgtgtgaatgaatgtgtatatgaatatatatgagtctatatatttgcttatgtaacagtttttccttccatg

SEQ ID NO: 92433 - DNA, 76 bp, Mus musculus
atgtgcatatgtatatgtatgtgtatatgtatatgcatatgcatatgcatatgcatgtgcatgtgcatgtgtatat

SEQ ID NO: 92434 - DNA, 73 bp, Mus musculus
tatgtatggatgtgttatgtatatatgtgtgtatatgggggtgcacattgtatgtgtatgatcattgtgcatg

SEQ ID NO: 92435 - DNA, 73 bp, Mus musculus
tgtgtatacgtgtgtacgtgtatacgtgtgtacgtgtgtatgtatgtatatatgtatcaagataaatacacac

SEQ ID NO: 92436 - DNA, 201 bp, Mus musculus
atatatgcatgtatatgtgtatcatgtacatatgtatatatataatataacatgtgtatgtatgcatgtatatatgtatgtatatatgcatgtaagcatgcatatatgtatatatgtatgtaattatgtatatatgtatgtgtgtgtatttgtgtatttatgcatatatgcatatgtgcatatgtgcatatgtgcatatat

SEQ ID NO: 92437 - DNA, 99 bp, Mus musculus
acatgtatacatgtataggtgtttgtatgtacaatgtaaatatgtatgtatgtatatatgtatgtaattatgtatatatgtatatatgtatgtgtgcat

SEQ ID NO: 92438 - DNA, 85 bp, Mus musculus; identical to SEQ ID NO: 57470

SEQ ID NO: 92439 - DNA, 110 bp, Mus musculus
gtgcaccccaccccaaaccttgatgaaataagaaatactgtgtaacaaatgaaaaacgaacttttttctttattatgccatctttctaaatcaggttactctgggcaaac

SEQ ID NO: 92440 - DNA, 98 bp, Mus musculus
tgtatatgtatatgcatatgtatatgtatatgtatacatatatatatgcatgtatatatgcatatatatatatatatatgcatgtatatatgcatatg

SEQ ID NO: 92441 - DNA, 110 bp, Mus musculus
taaaggaagatagatcaactattcagagcaggtttaatataacttttctttttataaagaaacataagggtgatataggaaatgaatgagaagtgaattacttcatttta

SEQ ID NO: 92442 - DNA, 168 bp, Mus musculus
gtatatgtatatgtatatgtatatacacacatacacatatatgtgtgtgtatttatatatgtgtatatgtattttatatatatatatatgtattatatatatatatatatatatatatatatatatatatatatatatatatatatacatatgatatacacattatat

SEQ ID NO: 92443 - DNA, 66 bp, Mus musculus
ctggcaagagagtgagcagagggagaaaacagacagttttatagcctctgtcactcttcttggcag

SEQ ID NO: 92444 - DNA, 85 bp, Mus musculus
ggccatggtggtctgaaagaatgcatgggacaatttcaatatttttgtatctgttgtagcctgttttgtgaccaattatatggtc

SEQ ID NO: 92445 - DNA, 111 bp, Mus musculus
tatatatgtgtgtgtctacatatatgtatatgtgtacatgtgtatatttgtgtatatctctgtatatgtatatatgtgtacatatgtattatatgaatatatgtatatatg

SEQ ID NO: 92446 - DNA, 111 bp, Mus musculus
atgacttgtattattgatcttagccatcctgacaggtgtaagatggaatctcaaagtcgttgtgatttgcatttccctggtggctaacgatgttgagcagttcattaagtc

SEQ ID NO: 92447 - DNA, 77 bp, Mus musculus
agtgccaagggacacacactcacagtaactcattcatccaaagatatttattgagctcttgagatgtgccaggcact

SEQ ID NO: 92448 - DNA, 113 bp, Mus musculus
gtatgcctctactgttatttatgggggctggagagatggctcggcagttaagagcactgactgctcttccagaggtcctgagttcaattctcagcaaccacatggtggctcac

SEQ ID NO: 92449 - DNA, 70 bp, Mus musculus
gtgtgtgtctgtgtgtctgtgtgtctgtgtaatacacacatatatgtttatatatgattcaatcatacac

SEQ ID NO: 92450 - DNA, 91 bp, Mus musculus
actttcagaaagttcttcaggatggcagtgaggggagacagaccagagagtgggctttctaacttctgtgttataggaagacatttgtagt

SEQ ID NO: 92451 - DNA, 134 bp, Mus musculus
atatatacgtgtgtgtatatatgtgtgtgtgcgcgtgtgtatatgtatgtatgtatgtatgtatatgcatatatatacgtgtgtgtgtatatatgtgtgtgtgcgcgtgtgtgtatgtatgtatgtatgtatgt

SEQ ID NO: 92452 - DNA, 79 bp, Mus musculus
gtgtattaggttgaaatgtttaagagagtggagccatgctagcacagctttatcctaggaggttgcaaacctgccacac

SEQ ID NO: 92453 - DNA, 82 bp, Mus musculus
tacatatatatatgtatatatatgctttatatattcatacgtatgatatatatcatgtgtgtgtatatatatatatatgtgc

SEQ ID NO: 92454 - DNA, 86 bp, Mus musculus
ctgtgtttaagagcttaaaggttgttaagcgaagccggttctgtgatcgggctttcagttactcagcgaagcttggcaagccacgg

SEQ ID NO: 92455 - DNA, 81 bp, Mus musculus
ctgtagctgactctcagactctcattacgggtggttgtgagccaccatgtggttgctgggaattgaactcaggaccttcag

SEQ ID NO: 92456 - DNA, 82 bp, Mus musculus
agtctggataatctaagatatcacatgagaactgggagtattttgtcactctttgtcactgtgaactttaagagtttggatt

SEQ ID NO: 92457 - DNA, 77 bp, Mus musculus
tcttttgaggatcagaatatttagaaaagcaacgaagcaattgcaatccaagtgttttgattttctacttgaaaaga

SEQ ID NO: 92458 - DNA, 85 bp, Mus musculus; identical to SEQ ID NO: 57439

SEQ ID NO: 92459 - DNA, 85 bp, Mus musculus; identical to SEQ ID NO: 57439

SEQ ID NO: 92460 - DNA, 85 bp, Mus musculus; identical to SEQ ID NO: 57439

SEQ ID NO: 92461 - DNA, 85 bp, Mus musculus
cttcagaacacagcttgaagccagactccctgattgccacccaggcaggagacaggaaaatgggtagggactaggctgtgtgaag

SEQ ID NO: 92462 - DNA, 85 bp, Mus musculus
tgtatgtaatgtatgtatgtatgtatgtacatatatatgtccgtatgtatatatgaacatacatacatacacacacacacacaca

SEQ ID NO: 92463 - DNA, 63 bp, Mus musculus
cactcaggcaggcaggcaggaagaaaggaaggatgaatggctggctggctggctgcctggatg

SEQ ID NO: 92464 - DNA, 100 bp, Mus musculus
tcctctattgtatgagtgttgggggcctcatataagctggtggatgctgcctgtttggtgagagatcaaacagagatcatacagtggtgagagatcttgg

SEQ ID NO: 92465 - DNA, 91 bp, Mus musculus
tttggctgattagcttagggaacatgtcagaggcatgtttgatgaatgtacatctctgacagactcagacactccatagcaggtggttgga

SEQ ID NO: 92466 - DNA, 108 bp, Mus musculus
gtgtgtgtgtgtgtgtgtacgcatgtgtatatatgtctatatatgcatgtctatatatatgtatgtgtatatatagacaaatgcacatattcatatatacacatccac

SEQ ID NO: 92467 - DNA, 73 bp, Mus musculus
gacgattgatgtctgggtccagggaaggctatgacatcaagaaatcttttccttcccagaaagagtgatagtc

SEQ ID NO: 92468 - DNA, 112 bp, Mus musculus
tatgtatatatgattgcatgtatatatgtatgtatatgtgtgtatattcatatatgtgcgtgtatatatatatatatatatatatatatatatatatatatatattgttctc

SEQ ID NO: 92469 - DNA, 71 bp, Mus musculus
ccacagctgacgaggggtccaggcaataacatggctgagtttgtgctttgtgtctctctgagtgtgtgtgg

SEQ ID NO: 92470 - DNA, 106 bp, Mus musculus
tgaaaatgttatgctgaggggctggagagatggctcagtggttaagagcactgactgctcttccaaaggtcctgagttcaaatcccagcaaccacatggtggctca

SEQ ID NO: 92471 - DNA, 85 bp, Mus musculus; identical to SEQ ID NO: 57439

SEQ ID NO: 92472 - DNA, 113 bp, Mus musculus
agaggcagtcactgtggtggctggagagatggctcagcggttaagagcactgactgctcttccagaggtactgagttcaattcccagcaaccacatggtggctcacaccatct

SEQ ID NO: 92473 - DNA, 103 bp, Mus musculus
tgcattaccatccaagttatgatttgaattgatgttgtaggtagaaaaggcgacatttctggtgacagtaacagaatacatttccagacttagagctagtgca

SEQ ID NO: 92474 - DNA, 92 bp, Mus musculus
catctgaaggctgtgacaatgttctgaaataatagtgatatctgcacaatggtatgaaatagtcatttaattcacgtggcagggcacagatg

SEQ ID NO: 92475 - DNA, 105 bp, Mus musculus
ccttttcctcctaccagccttgatatgagggtctgtggctcgtcttactgcatcttgttatgctttatttggtcgatatagctcttttctgaaaggagacaaagg

SEQ ID NO: 92476 - DNA, 111 bp, Mus musculus
agcaatggatgagtattccccttactctatacccttgccagcatgaattgtcattgtgttgttgatattggccattctgataggtgtaagatgaaatctcaaaatagtgtt

SEQ ID NO: 92477 - DNA, 108 bp, Mus musculus
gtcttaatccatgttgatctgataggatgcatgggactatttcaatatttttgtacatgttgaggcttgttttgtgaccaattatgtggtcaattttggagaaggtac

SEQ ID NO: 92478 - DNA, 104 bp, Mus musculus
gaaaatgctctaaaccacaagttagcctgtacaatggaaggaggatgacatgtgaatttgttccattttttaaggttaacctcattttcagaaaggggctttgc

SEQ ID NO: 92479 - DNA, 131 bp, Mus musculus
tatgtatacatgtatgtatatgtatgtatacacagatacatacatatatgtaatgtattttatatatatatatatatatatatatatatatatatatatatatatatgtatatatatgtgtgtgtgtgtag

SEQ ID NO: 92480 - DNA, 67 bp, Mus musculus
ggtcttcctgtctctgactgtgacttgtccctcctgtaagcctgtatgtcagtactcctggaagacc

SEQ ID NO: 92481 - DNA, 79 bp, Mus musculus
cttcttttagtttcactctgtctctgtttagtttctgttttcatgatctgtccattgataagagtggggtgttgaagaa

SEQ ID NO: 92482 - DNA, 85 bp, Mus musculus; identical to SEQ ID NO: 57439

SEQ ID NO: 92483 - DNA, 85 bp, Mus musculus; identical to SEQ ID NO: 57439

SEQ ID NO: 92484 - DNA, 85 bp, Mus musculus; identical to SEQ ID NO: 57470

SEQ ID NO: 92485 - DNA, 102 bp, Mus musculus
agagcaggtgaagttatatgtgtggggtagaaggttgcttagaattccatttttatcctcctgtgtcttatctccacccaactgaagcttcagggtagttct

SEQ ID NO: 92486 - DNA, 96 bp, Mus musculus
ggaagagagaatgtgatggcagagtgtctatcaagttttaaatatacagttctatatttatatatgcaacatgacaagttgacagagtcctcttcc

SEQ ID NO: 92487 - DNA, 102 bp, Mus musculus
gaaaggcgagtctgtggctccagggtttgaagtacagtagtctgcaggaagaaactctgatgtggcaactctatagttggtccctggaaatcttttgccttc

SEQ ID NO: 92488 - DNA, 113 bp, Mus musculus
tctccagaagcacgttggtcatggttttacagctttgcagtgatgggtgcgatagttgctttttttttattgaaccatagattgcagcattgtaaagcttactcattcggagg

SEQ ID NO: 92489 - DNA, 83 bp, Mus musculus
aggcaggcgcagaggcaggcttaatgtccatcttctgagcgtttgctactgcctgggcagtctgtctgtctgtctgtctgtct

SEQ ID NO: 92490 - DNA, 87 bp, Mus musculus
ctcactggacagctttaaaaacacatgagtctgagcacacccccagaggggtacactcagttggtctgatattgtccttggcatggg

SEQ ID NO: 92491 - DNA, 117 bp, Mus musculus
gcaccgttgatgttgagttattaatttctgtactggaagcaggaagtgagcaaagcccattggcagtggtagaactcactgctctcattgtgttggtttagtggaaatagctggttc

SEQ ID NO: 92492 - DNA, 72 bp, Mus musculus
gtgtgtgtgtgtgtgtgtgtgtgtgtgcgcgcgcgcgcgtgtgtgtatacacatgtgtgtgtacacatgtgt

SEQ ID NO: 92493 - DNA, 97 bp, Mus musculus
gctttgaggtccgctgcgaggtctggcaccgggctcagcctctctcggtcgctgagtgctcctcccagttgtgctctgcctccaactcctcagccgc

SEQ ID NO: 92494 - DNA, 99 bp, Mus musculus
agctaaagtgttcaggctggagagatggcttagggcttaagagcactgactgctcttccagaggtcctgagttcaattcccagcaaccacatggtggct

SEQ ID NO: 92495 - DNA, 88 bp, Mus musculus
tttttatgtgtatgggcatttttagtgcatgtatgtaagtgcatgtatgtatgtatgtatgcatgctttatgctcattcaggtgagaa

SEQ ID NO: 92496 - DNA, 67 bp, Mus musculus
ctctgtgtctcactctgtgaagggccaggctaggcagtgggctatgctctgttagaagtgagaggag

SEQ ID NO: 92497 - DNA, 63 bp, Mus musculus
ttggagcttggaaccacaaataagagacaaacttccgtttgtctctctgtgtctgggtgccaa

SEQ ID NO: 92498 - DNA, 85 bp, Mus musculus
ggccatggtggtctaataggatacatgggacaatttcaatatttttgtatctgttgaggcctgttttgtgaccaattatatggtc

SEQ ID NO: 92499 - DNA, 74 bp, Mus musculus
tggtagattggaggcagccagcatacggcacgttgtaattgaggaatgtgtgtgtctgtgtttctcatctgttg

SEQ ID NO: 92500 - DNA, 92 bp, Mus musculus
acacacacacacacatatatatataatgtatatatatgtatatatatattgtgcatatatatattgtgtgtgtgtatatatatatgtatatg

SEQ ID NO: 92501 - DNA, 106 bp, Mus musculus
taaatgaagtgatatgtgtcatttcagattctttttgttcacatgtatgtatgtatgtatgtatgttcagttgacacatttgaattgaaccgtctcttagcgttta

SEQ ID NO: 92502 - DNA, 132 bp, Mus musculus
atatagatgtatgaatgcttatgcatgtgtgtatgtgtgtatgtatgtatgcatgtatgtgtgcatgtgtgtgtatgtatgtatgtatgtatgtatgtatgtatgtatgtgtatatgtgtgtatgtgtgcat

SEQ ID NO: 92503 - DNA, 70 bp, Mus musculus
tcagagagaaatatgcaaataggttgtataattgccaagcttgtatgcataacctgcaacttctctctga

SEQ ID NO: 92504 - DNA, 104 bp, Mus musculus
aagtaagctatgtaatgtgatgaagacaaggtgaattttatgtggtgacaataaatttaatttatttgtcatggttatattatttatattttgtttacttcata

SEQ ID NO: 92505 - DNA, 91 bp, Mus musculus
tagattaatatgtattctatgtggagagaattctatatagaatgtagaataatttttctatatagtattcaacatattctccctaagatac

SEQ ID NO: 92506 - DNA, 76 bp, Mus musculus
agtggtccatgatttcagtctagtggttgggtataagaatctgtgtctgtctcagtcagctgctggttgggcctct

SEQ ID NO: 92507 - DNA, 70 bp, Mus musculus
tgtgtcagtctgtctgtctgcctgtcaaacacattggtgacaggttctctaaatggcttccagctggcca

SEQ ID NO: 92508 - DNA, 89 bp, Mus musculus
ccatgtgggcatagtgtttactgactgatctctgtgtgctcatatgagccttgctcagttgattcagaggtattctctattctctctgg

SEQ ID NO: 92509 - DNA, 101 bp, Mus musculus
tggacagctttgcagaggtggttctcttcttgcaccatgattgtatatttctataatatatgaccaaggacagttaacacacagtgacgtatacttgttca

SEQ ID NO: 92510 - DNA, 78 bp, Mus musculus
tctccaagctccacccattgtttggctgtgtgtgtctctatctgtttgagtcagctactgggtagaggctctgagaga

SEQ ID NO: 92511 - DNA, 88 bp, Mus musculus
gagaaaaccttttatcagctgagacatgaatgtcaccaccaagcaaatagccctgactctcacagactgtctcagttactgatttctc

SEQ ID NO: 92512 - DNA, 94 bp, Mus musculus
ttggaggaagtgggggtgagggagctttgtggtttcagaatacgggtttcgaatccagtgtctcactctgtcttcccactgcctacccatccgg

SEQ ID NO: 92513 - DNA, 81 bp, Mus musculus
tgtctgtctgtgtgtctgtcggtgtaggtatgtgggaaaggagcattcttcccactatctgcatatggaaatcagaggaca

SEQ ID NO: 92514 - DNA, 94 bp, Mus musculus
gatgttgcgtgtactcatgttgcccaaatgtgcttttgttttaatttcttttaaaagcagaatgaagctgagcacataataatgaacgcacatt

SEQ ID NO: 92515 - DNA, 115 bp, Mus musculus
gggtgactattagtctagctcttctttcctattgaattcactgatagtctctctgtctccccagagacttgatattgtgtccctttagccaaagaaaagtcacttgaatagcctc

SEQ ID NO: 92516 - DNA, 101 bp, Mus musculus
ctcctaattcttaggtcctccataaagagctgctgagggagtctgtgtctgtgtccctgcagtcctaggaagagatgggaagtggagacagggaaactggc

SEQ ID NO: 92517 - DNA, 73 bp, Mus musculus
ctctctgtgaaggagagccattctgaagactcggtgtagtagatagtgtgcacactccctctgggaaagagag

SEQ ID NO: 92518 - DNA, 106 bp, Mus musculus
tatgttgcttagttgtctcagtctcagaacatataagaaatttagtcaaaagggcagagttaattttattctttatttcagagtctgtcactgtataagctccatg

SEQ ID NO: 92519 - DNA, 96 bp, Mus musculus
gacctgtgcagtaaactgtgagctgtggttgcgggctcacaaatcagagtgagctttgtttgctgtgctgcagtgacatttataaatcaagtggtc

SEQ ID NO: 92520 - DNA, 58 bp, Mus musculus
ggttttgcactgaggtcagtggggtcacatgacatgtctctgtctgaggtgaaaggcc

SEQ ID NO: 92521 - DNA, 58 bp, Mus musculus
tacatatatatatatgtatgtgtgtgcgcatgcatgcatgcacctgtgtgtatgtgtg

SEQ ID NO: 92522 - DNA, 88 bp, Mus musculus
gtcctaaagaatcttaacaagtaactgatagcagttcaatggttaggccactgccaatgacagtcacagagcttagggttttctggac

SEQ ID NO: 92523 - DNA, 129 bp, Mus musculus
gaagcgagcctcagtctgtcagtgctcgggaccttgtaaacagctgtacacacccatagagatgtaagtgagcagagcagcagcagatagaggcggagtgtcaggttgggtcatggggagcatagcaga

SEQ ID NO: 92524 - DNA, 116 bp, Mus musculus
ccaccctggctcattcattccctgcaggactagtccattctctctcactgagacacaaccaggcagtcagcgaaggagaaaggggatccaatgacagggaacagagtcagagacgg

SEQ ID NO: 92525 - DNA, 118 bp, Mus musculus
gtgcatgcttatgtgtgtgcatgcatgcgtgtgcatgtttgtgtatgtgcatgtgcttgagtgtatgggtgtatgcatgtgtgtgcatatttgtgcatgtgcgcgcgtgcgtgtgtgt

SEQ ID NO: 92526 - DNA, 85 bp, Mus musculus; identical to SEQ ID NO: 57470

SEQ ID NO: 92527 - DNA, 146 bp, Mus musculus
tgtgtaaatatagatttgtctatgatgtatataatatatgtatatgtgtatgcatatatgtgtgtatttgatgtatatatttatatgattatgtgtatatttatgcaagcacatatatacatgtatatatatatgcatatatatat

SEQ ID NO: 92528 - DNA, 100 bp, Mus musculus
ggacacctgtcctctggtctggatggtggcaggctgtctgcggcccgcaaagggtgctgcctcagtggctctgtgcctccatctgtcccagaagctgtcc

SEQ ID NO: 92529 - DNA, 78 bp, Mus musculus
tacatatatgtatacatatatatatacacacatatatacatatatatgtgtgtgtgtatgtatgtatgtatgtatgta

SEQ ID NO: 92530 - DNA, 107 bp, Mus musculus
tctgttttgagttgctggctagttcccatcaatcacaaaacattataggttatgagcttgatggttgtattgcattgtggaattatactgcatacataagtcacaga

SEQ ID NO: 92531 - DNA, 118 bp, Mus musculus
gttgactggtagagggagtgtgcagctcagagtgcttcagcctgcttcccatctgctccacagaagtttgttagcacagctggaaaaaaaggagctttcatagccagccacctttgac

SEQ ID NO: 92532 - DNA, 111 bp, Mus musculus
taggtgttggagggtagacaccagaggccggcaatgctgcttcttcttgcatcaggcaagagagagaacagtcagagccttctggacaaagtacttgacatccacatcctg

SEQ ID NO: 92533 - DNA, 83 bp, Mus musculus
atatgactatatatatatataatatatgtatatatatatgtatatatatacatgtatatatgtatgtatatgtgtatgtatat

SEQ ID NO: 92534 - DNA, 94 bp, Mus musculus
ctccgcccagcccacccaccttgaagaacaaagagtcctggttagcagaaggatgagagcagaggaatgttctgtggagggctcctatatggag

SEQ ID NO: 92535 - DNA, 91 bp, Mus musculus
cttcgttttctttggttttggcttttatgaacatgttttttactttaaaaatgaacagtctgaaatgccaactttgcaggaaaacttgaag

SEQ ID NO: 92536 - DNA, 99 bp, Mus musculus
tatatattcatatgaatatattcatatatattctgtatatatattaatctactcacatatataaatagattcatatgaatatattcatatatatatata

SEQ ID NO: 92537 - DNA, 83 bp, Mus musculus
atatattcatatgaatctatttatatatgtgagtagattaatatatatacagaatatatatgaatatattcatatgaatatat

SEQ ID NO: 92538 - DNA, 174 bp, Mus musculus
atgtgcatatgtatgtgtatatataaataattttatattatatacacatatatgtgtatatttatgtatgctatacatatggctacatatatctataagtatatatatataagcatatattacatatatgtattgagatagatgcttgatagatgatagatagatagatagata

SEQ ID NO: 92539 - DNA, 112 bp, Mus musculus
tttatactaacagagcaatatatatgtatatatgtgtgtgtatacatatatatgtattatatatgtgtatatatatgtacatatatatgtatatatatatatgatgtatgag

SEQ ID NO: 92540 - DNA, 109 bp, Mus musculus
atgaagccagaaaggaggttccctgggatttttgcaaatggaaaggaatgatttatgttctcacatgagcacttgcaaacaaggactggggaactactttccaagtcgt

SEQ ID NO: 92541 - DNA, 117 bp, Mus musculus
taccaagtaaccattctctccgggctctgctctgcccaggttatactctctgactgtggcacagattcccagatgtaacttcagcagcaaattgttctggggcatgtaaactaagtg

SEQ ID NO: 92542 - DNA, 115 bp, Mus musculus
tcggcttcattttgtactcaggtaagcattgccataaagctctgaggtggtaggtagtattcttttccaaccagtgcaagtcccagtgcaaggccaatgtgacaggatgggcaga

SEQ ID NO: 92543 - DNA, 70 bp, Mus musculus
atatgtatgtatgtatgtatgtatgtatgtagtgtgtaatatgtatgtatgtatgtatttatgtatgtat

SEQ ID NO: 92544 - DNA, 85 bp, Mus musculus
aagggctaagtactaaacagtttggaactggaggccatattccttttctcttatattgtctttgtccctctgtcgctctgtcctt

SEQ ID NO: 92545 - DNA, 98 bp, Mus musculus
tgtatttactctgtgtgttttgtctgcctgtctgcatgagcaccacatgtcttcctgatgaagacagaagtcagagggcacctggaactagaattaca

SEQ ID NO: 92546 - DNA, 85 bp, Mus musculus; identical to SEQ ID NO: 57439

SEQ ID NO: 92547 - DNA, 100 bp, Mus musculus
cacaatctctcatgttgattctgtctgtcattcactgtctccttgtccacctgcaaccagagacccgttctacgcagacagggacgaaaaagggtctgtg

SEQ ID NO: 92548 - DNA, 105 bp, Mus musculus
agccaggcaaaatcccagcatggatgtcactgggtatatatatatatatcactgggtatatcaaatatatttcagggcaggccccatgctcaggagatattggct

SEQ ID NO: 92549 - DNA, 96 bp, Mus musculus
gatcagtcttagtccgtgatgatctaataggatgcattggataatttcaatatttttgtatctgttgaggtctcttttgtgagcaattatatggtc

SEQ ID NO: 92550 - DNA, 103 bp, Mus musculus
gtgtgtatgtatatatatatgtgtgtgtgtatatcatatatacatatataaatcataaatatacatatatatatatatacacatacacatacatccttacata

SEQ ID NO: 92551 - DNA, 100 bp, Mus musculus
atgtgtttgtatatgtgtttgtgtgcatgtatctgtctgcatatatacatatatatatatgcacacacacacacacacacatatatatatacatatatat

SEQ ID NO: 92552 - DNA, 83 bp, Mus musculus
ctgggttaacaattttgagatgggtgggtggcactatccctcaactgggagccatgtctatctactggaggcgatctctacag

SEQ ID NO: 92553 - DNA, 81 bp, Mus musculus
tcctcagtctaagggcattgatagttcaggtgtagacaggcctgtctgaatctctctgtctatgttgatggctgggagact

SEQ ID NO: 92554 - DNA, 116 bp, Mus musculus
gtctgtctgtctatccatccatctacctatctatttatttatatttttgtttcctttttgggggaggttggaggggtgaatattgagggctagggagatgagtgggattggtgtgc

SEQ ID NO: 92555 - DNA, 109 bp, Mus musculus
acatgatgtgtatgcttatgtgtgtatgtatgtaagcatgttgtatgtatgtatgtatatgcacacatgtatacatatatacttatatttgtcaggaaaacatattagt

SEQ ID NO: 92556 - DNA, 86 bp, Mus musculus
atgtttatctgatgtttatgagtcgggtcttcagagctggcaagaatggcctgtgttggagatctgcagaaataacagccacacat

SEQ ID NO: 92557 - DNA, 134 bp, Mus musculus
gtgcacatatgtatatgtgtgagtatgtgtatgtgaatatgtatgaatgtgtatgagtgtgtgtgcatgtgcatgtatgagtgagtgagtgaatatgtgtatgtgagtgtgcatgagtgtgtgagtgtgtgttt

SEQ ID NO: 92558 - DNA, 65 bp, Mus musculus
gagggggctggagagatggtttagtggttaagagcactgactgctcttccaggggtcctgacttc

SEQ ID NO: 92559 - DNA, 85 bp, Mus musculus
ggacacaggagctctcactaagtctgtcgctcactaatttgtctatgctggctagtcagtgagctctcaggggtcacctgtctcc

SEQ ID NO: 92560 - DNA, 105 bp, Mus musculus
cgctttgtctccattttttctgtatttcttcctaaggcggtacagcagggaccagccatgtctctgctgtatatgtggaatgtgagctaaaaatgtttgcctgtg

SEQ ID NO: 92561 - DNA, 90 bp, Mus musculus
atatgtgtttgtgtgcatatatatatatatatatatatatatatatatatacactatgtatatgtatatatatgcacatatatgtatata

SEQ ID NO: 92562 - DNA, 94 bp, Mus musculus
agacaatgattttcttagttctggaagccagaagtcagagagcaaagtttcagaggactaccttttccttcacagtgctaagaattcagtttct

SEQ ID NO: 92563 - DNA, 85 bp, Mus musculus
agtgccaagtttgatagtctgagttgggtatctgcaactccatatgctggaaagagagaacacccacaggttgtcttttgtcact

SEQ ID NO: 92564 - DNA, 66 bp, Mus musculus
gtgtgtgtgtgtgtgcatgtgcatgtgtatgtgtgtgtgcatgtgtatgtgtatgtatgtatgtat

SEQ ID NO: 92565 - DNA, 77 bp, Mus musculus
gatttatcttttgactgagcagtctgtgcactgtgccaggcctggtgcctgcagatgctaggaaagggtcttagatt

SEQ ID NO: 92566 - DNA, 110 bp, Mus musculus
atatatgtatatgtgtatgtatatatatgtgtgtctatgtatatatacgtacacatatatacatatgtatatatatataaatacatatatacatacatacatacatatgt

SEQ ID NO: 92567 - DNA, 88 bp, Mus musculus
cagagtctaagtaaaacatgggctgtccggggagaggggaattttctctgaccctctccctgcctcactttctgcttcgatagagctg

SEQ ID NO: 92568 - DNA, 79 bp, Mus musculus
ggtggtctgcctctctgtcagtcaggtggtctgcccctctgtcaggtggtctgcccctctgtcagtcaggtggtctgcc

SEQ ID NO: 92569 - DNA, 91 bp, Mus musculus
gatggaatctcagtgcttatatttattggatgagtaaggatgttgtatgtttcatttttagaatctatagattctaggtactgactctgtc

SEQ ID NO: 92570 - DNA, 80 bp, Mus musculus
gccagtctggtctacacagtgagtttcaggtcagccaaggtctacactttgacacactgtctcaaaaagaaaggaagggt

SEQ ID NO: 92571 - DNA, 74 bp, Mus musculus
ccacagagcaggctgaggacatgtgaaaggccacgatcccctaacctcaacactgtcactcagaatcactgtgg

SEQ ID NO: 92572 - DNA, 79 bp, Mus musculus
ttggtttagcttttgttttctttttctgggtcgtgcagcttctcggtgcacagtcagatgactgaagagactcagccaa

SEQ ID NO: 92573 - DNA, 80 bp, Mus musculus
agccaagggtgagggtttcggtcaggctttgtacaactccggaggagtgtgtgtctgtcagtctgtctgcttgcatggct

SEQ ID NO: 92574 - DNA, 80 bp, Mus musculus
ggggtatggcagacagacaagctacatgagtcaaacaagttaatttactcagactctttctgtctgtgctgtgatatccc

SEQ ID NO: 92575 - DNA, 84 bp, Mus musculus
gaacatctgtctgtctgtccgtccgtctgtctagaggagcccagggcaggcacgtgggagatcagtcagagatgggctgaagac

SEQ ID NO: 92576 - DNA, 110 bp, Mus musculus
gcatgtatgtatatgtctgcatatgtatgccattatatatttataaatacatatatgagtatgtcatgtaattgttgtgtgcatgtgtgtgtatgtatgtatatttatgc

SEQ ID NO: 92577 - DNA, 121 bp, Mus musculus
cacatgactgaattcatgcacacatatatatgcttgtatgtatatactatatatatgtatatatgcatgtgagtgagtatatctgtatataattctatatgtgcatatatgtatatgtgtg

SEQ ID NO: 92578 - DNA, 72 bp, Mus musculus
gaggaagtgtgtcattgggtgtggactttgaggtttcaaaagcccaagccaggctcagtctctctgtttctc

SEQ ID NO: 92579 - DNA, 91 bp, Mus musculus
ggagacaggtcagtccttccacaagcatcttgtatttttataaatcaatctgatacaggttcccactctgaaggaattgctatctgtcttc

SEQ ID NO: 92580 - DNA, 109 bp, Mus musculus
tgtatatatgtatatatacatgtgtgtatatacatgtatatatgtatatacatatacactgtatatacacatacacatgtatatatatatatgtatatacacacataca

SEQ ID NO: 92581 - DNA, 77 bp, Mus musculus
ggtatttgattctatttatttgcacacattggattcaccaggaggtgagttaccaggagataggtgtttttagtgcc

SEQ ID NO: 92582 - DNA, 91 bp, Mus musculus
gtgggtatctgtgtgtgtgtatgtgcatgtgtatatgtgtctgtgcatgtgtgtgtatgtgtatttgaacacatggtcaccagatacctgc

SEQ ID NO: 92583 - DNA, 124 bp, Mus musculus
tgtacatatatacatatatacatatacatatacacatacacatatacatgtgtgtgtatgtatgcatgtatatatgtatgtatatatacatatgcatgtatttatatatatatgcatgtaagca

SEQ ID NO: 92584 - DNA, 126 bp, Mus musculus
ttggtatgtgtttatgtgtgtctgccagtgacaggtggctgtgtaccccagacagacaacagtgagaccagccctgtcctcctccgaggccaggtgaaagtgcggagacaggggagaggcgctagt

SEQ ID NO: 92585 - DNA, 102 bp, Mus musculus
gtgggactaggccagccctcacttgtcacagctgtcacctctttgtgtctgtgtatggcttgctttacttccatgtttcccatgctgagacactcccctgac

SEQ ID NO: 92586 - DNA, 103 bp, Mus musculus
tgtgcactgtttgtgtgtatgtatgtgagtatgtatgtatgtgtgtatgtatgtatgtatgtatgtatgtatgtatgtacgtgcactgtgtgtatacctactt

SEQ ID NO: 92587 - DNA, 71 bp, Mus musculus
tatttggttgcctgtgtctgtatctgtctgagtcagctgctgggtagacattctcagacgacagccatgta

SEQ ID NO: 92588 - DNA, 74 bp, Mus musculus
gccaactctcaggctcactctcagtctggatatgcaacctggttccagaaagatggtgatcttggggcctctgc

SEQ ID NO: 92589 - DNA, 60 bp, Mus musculus
agagctgctgggggtgggaggtggatgctgtgagcaacgtctcagactctcagcatctct

SEQ ID NO: 92590 - DNA, 65 bp, Mus musculus
gtagcaagaaatgagaaggatgtctgaggaggcagctgtctctcacaatctgtcactttggctac

SEQ ID NO: 92591 - DNA, 71 bp, Mus musculus
ttggatgattctctgctttctcaggcagattggcactgtactgtctgtctgtctgacagtgattgacccaa

SEQ ID NO: 92592 - DNA, 84 bp, Mus musculus
gatttcatgctgtgctgtggcatgtatgtatgcatgtgtgtttatatatatgttaggacataagttatgcagtagtcagttatc

SEQ ID NO: 92593 - DNA, 100 bp, Mus musculus
gcaggaaatggtggtgacgctgaattttaaaggcaggatgtctgcaatagatgtgtctgtgcacactgcctgggaacagtgcctatgttctatgacatgc

SEQ ID NO: 92594 - DNA, 60 bp, Mus musculus
gaaacagagacagcgtgggcctgaggacacatttaggtcctttgtcagtctctgtgtatc

SEQ ID NO: 92595 - DNA, 113 bp, Mus musculus
cttggttccttttccccctaagctccaaccgggttcagtactgacttagttgtcctctcttaagaccaacactaagttctttgaaaggggctgtgtggaaggcttcccccgag

SEQ ID NO: 92596 - DNA, 70 bp, Mus musculus
ggagagttggtgcgatggctttttggaggcgacatagctgtgtcactgagtgactgcactcttcctttcc

SEQ ID NO: 92597 - DNA, 72 bp, Mus musculus
tcctggaactggaactgcatgtgtttgtgagccctcagatgggggctggacatcaaacccaggtcctctgga

SEQ ID NO: 92598 - DNA, 88 bp, Mus musculus
caccatggttttgtctctaatagttctgtatggaagacgctattgtttctttttttaacagaaaacacaactgagaagggctagggtg

SEQ ID NO: 92599 - DNA, 92 bp, Mus musculus
tcttgtacacatctggctactgtccctctgtctctgcatgtctgggtaaagatggcacagcaggcacagatgttcaggtctgatgatcagga

SEQ ID NO: 92600 - DNA, 117 bp, Mus musculus
ctccttgccactgcttacatgagggcttctggtatgtggggtctttgacagttttcactttctgtctcacactccatatgccagtcttagctctataacctcagacaagttatgagt

SEQ ID NO: 92601 - DNA, 74 bp, Mus musculus
cctagcccagagctgatcacacagaagcaccgggaatgcatgagtggtgtgtgtgtgcacagttctgtggaagg

SEQ ID NO: 92602 - DNA, 110 bp, Mus musculus
tcctccacctcctccgcctcccggtgactcacgctgtatacacacacacactcacagcccgggctgtgtaaacagttgggaagccgggttgtgcaatgaggtggctgcga

SEQ ID NO: 92603 - DNA, 115 bp, Mus musculus
tagatgtttttaaaagtctgttgtggggctggagaaatgtcttagcagttaagagcactgactgctcttcctgagttcagatcccagcaaccacatggtggctcacaaccatctg

SEQ ID NO: 92604 - DNA, 128 bp, Mus musculus
aaagctgtgtgtcagtaggttagaagcccttggttggtacattgtttttctgatagaagagagtgcacacacctccctgcttcagcccatagatatcacccctttcaggattcccttctcctgctgac

SEQ ID NO: 92605 - DNA, 84 bp, Mus musculus
cattttcaaaactctgtgtgtcagtggctctaatgcaatgtccagctatatcttgagcaagtgaccggcaggggacataggatg

SEQ ID NO: 92606 - DNA, 73 bp, Mus musculus
cttttgcggcatgtgtgtgcatgtgcatgtgcgtgtacacacacacacacacacacacacgagagagagagag

SEQ ID NO: 92607 - DNA, 71 bp, Mus musculus
gtatcctgtgcctttcagcattctcctggtcagccttgggtgacagtgatgagtgtggacacatagaatat

SEQ ID NO: 92608 - DNA, 75 bp, Mus musculus
cttgggaagaggctcttgaaggctgtgtttcacacatggtctcagtgtcctgacagagcagatccgtttcccaag

SEQ ID NO: 92609 - DNA, 93 bp, Mus musculus
ctgcagagagcatgacacatgactttttttttttcaaggatgctaacaaagagttcaaacagagaaggcatgtgatacagaggtcgggggcag

SEQ ID NO: 92610 - DNA, 118 bp, Mus musculus
tagacggttccacaaagctgtatctgcgaagtttaatgatacagagaaaaaagtttcattttatgtaaaacttcaagaactctgtatgccattctagaccagcttgttcttgctccta

SEQ ID NO: 92611 - DNA, 81 bp, Mus musculus
ggttccacggcatcatgaaatggccctgtgtttatatctttgtgtgtctatgggtctcttgtgtgtctatgtctgtgtgcc

SEQ ID NO: 92612 - DNA, 85 bp, Mus musculus; identical to SEQ ID NO: 57439

SEQ ID NO: 92613 - DNA, 74 bp, Mus musculus
tccagccttttactctgaggtaatgtctgtctttgtgactgaggtgggtttcctgtaagcagcaaaaggttggg

SEQ ID NO: 92614 - DNA, 85 bp, Mus musculus; identical to SEQ ID NO: 57439

SEQ ID NO: 92615 - DNA, 77 bp, Mus musculus
agtggcagtaggcttgaggtggaagctggggggtgtttcctataatctgctgtctgcctgcgtgcctgcctgttgct

SEQ ID NO: 92616 - DNA, 193 bp, Mus musculus
tatgtatgtgtgcacatgggtttatgcacatgtatggggtgcatatgtgtgtatgtatgtatgtatatatatgtgcatgagttttcatgtgtgtggtatgcgtggtgtgtatgcgtgtgtgtgtgtgtgtgtatatatatatatatatatatatatatatatatatatacatatatagtgtgtgtgtgtgtgc

SEQ ID NO: 92617 - DNA, 85 bp, Mus musculus
gcatgtgtgtgtccatgtgtgtgtgtatatatatatatatatatatgtatacgtgtgtatatatatatattgtgtatgcatgtgt

SEQ ID NO: 92618 - DNA, 116 bp, Mus musculus
ttctgaaagttgttcattattattgaatgaagtaatagtttatgataaagttgaaaaatcaatttaaatatattaaatattttatctcaaggattgtatgttacaaattttcagga

SEQ ID NO: 92619 - DNA, 86 bp, Mus musculus
gacttaaattaggatatctgatgctatctcatgtggatcctggccatcgagactagggtcacattcagcttttcctaagtgtccta

SEQ ID NO: 92620 - DNA, 61 bp, Mus musculus
ctctgcagctgtggggaaggggaaacaaagacactctcagtctctctgtccctttgcatag

SEQ ID NO: 92621 - DNA, 102 bp, Mus musculus
tgttacaattgaattggacctctgcccgcttctgtctctcttactgtaacctacttacttctgtagagagattagcccaaagggaggaccaaatggaagaca

SEQ ID NO: 92622 - DNA, 117 bp, Mus musculus
cttgagaagagtagactatatattacatatatacacacacatatgtatatatatatatgcacatacgtgtggttatgtatatatgtatattaataattgctttctgtgattctggag

SEQ ID NO: 92623 - DNA, 81 bp, Mus musculus
atgtgtgtgtagtgtgcgtatgtatatgaatatgaatgtatatgtgtatgtgcatttatatgtgtatttctatacatgcat

SEQ ID NO: 92624 - DNA, 104 bp, Mus musculus
atacatacatacacacatacatatgaatatatatacatatatatacacatagtatatatacatatgtacatatgtatacatatgtatatatacatatatagttg

SEQ ID NO: 92625 - DNA, 85 bp, Mus musculus; identical to SEQ ID NO: 57439

SEQ ID NO: 92626 - DNA, 115 bp, Mus musculus
gttttctagttttttccctttcttttaaattcttaataattttctttactttaggtgagagagacagagacagagacagatagaatcagatatagatagagagaagaaagagagc

SEQ ID NO: 92627 - DNA, 66 bp, Mus musculus
gtgagctggccatgtaaaactctttgttctagccaacagctggagagagaagacagactggcaaac

SEQ ID NO: 92628 - DNA, 77 bp, Mus musculus
ggcataagatctcatgtatcccagattgggttgatgcttgataagtgtttgatggtgactctgcatgagcatctgct

SEQ ID NO: 92629 - DNA, 87 bp, Mus musculus
tagagtgcagggtatataagcttgaaaagtattgagtttttgcagatggcatggcattaagctttcaacttaacccactgcatttta

SEQ ID NO: 92630 - DNA, 78 bp, Mus musculus
tgcagtacctggcagccaaagatgtgatcttgagagatgaaatagaggacatcaatgaagtggtgccgtggacaagca

SEQ ID NO: 92631 - DNA, 120 bp, Mus musculus
gccttaacagttttcactctgttgagtcattgactaacccagagtagcttgtataatattactgtagtgactgagcagacagggggaaatggtggagatgcattggataggcgggaaggg

SEQ ID NO: 92632 - DNA, 99 bp, Mus musculus
ggaagagaaatgtatgtatgtatgtgtgtgtgttatatatatatatatatatatatatatatatatatatatatatatatatatattctgcttgcattt

SEQ ID NO: 92633 - DNA, 92 bp, Mus musculus
aggaaggaagagcaagaaaagtagatgaaattagagtggtatgaagtcaaagtttacacactcattctggttgatttctgttaatccttgct

SEQ ID NO: 92634 - DNA, 96 bp, Mus musculus
attctagattgttcaaggatgtgggttatatcctggctctgtctttatctctgtgaaaagaagtaagccaagatgtttgtgcttaggaacaagaat

SEQ ID NO: 92635 - DNA, 82 bp, Mus musculus
gtgtgtctgtctgtctgtgtcccatctctttgtgtatgtatgtctatataaccctggtgtgcacagatgtacgtagaggtac

SEQ ID NO: 92636 - DNA, 93 bp, Mus musculus
gctgggcaccgtgactaacccagagccatgtgactgatgtgggtgcttccatgggctctctgccagtctcactatctgggtttgaatcccatc

SEQ ID NO: 92637 - DNA, 81 bp, Mus musculus
gacgtcactgactgtctcacttgtagcctcttcccaacagtgctgagaaggaggcctcagtgggccagttaatgggaagtc

SEQ ID NO: 92638 - DNA, 71 bp, Mus musculus
cacagtctcagtgtgtgtgttcgtctataaaatgaggctaataaatacactagcatcacactgttactgtg

SEQ ID NO: 92639 - DNA, 90 bp, Mus musculus
gaatatagagatggctgcctggctgcctccaggagtttgacacacactgtgccacacacagtaggcagctatgcccctgtttctgtgtcc

SEQ ID NO: 92640 - DNA, 115 bp, Mus musculus
tcaggcgactccccttagaggagaaagttcctgcaagagaatggactgaaggacccaagagatgtctccactttggttttctctcactttcacactcaaacacaaaagtacctga

SEQ ID NO: 92641 - DNA, 77 bp, Mus musculus
tgatatgtacatatatatatatacacacacatatatacatatatgtgtacatatatacatgtgtgtgtacatgtaca

SEQ ID NO: 92642 - DNA, 105 bp, Mus musculus
tagattagcatgcggaggatgtaatgacagggtctgtgaacattcctagattgaagagtctgtgcctgtctccctgcttcaccagctctccttgcctctgattta

SEQ ID NO: 92643 - DNA, 82 bp, Mus musculus
ctctctctgcctgtctccctgtcaagaaaatgggtgtgctaattgccaagtcatggggtcagggatgtagcacagtggatag

SEQ ID NO: 92644 - DNA, 118 bp, Mus musculus
cctccatttactgactcttcaaagctgaaatgtcatataaagcattaacaagtatatttgatttttctcttgttgatttgccttatgtatcagctgtgaccttggcaatgagaagggg

SEQ ID NO: 92645 - DNA, 86 bp, Mus musculus
tgcacatattcatgtatatgtatatatgtacatgtaccataatactatgattgtgtaggatacacatacatatacatgagtaggca

SEQ ID NO: 92646 - DNA, 114 bp, Mus musculus
ggcctgtgtgcagatgaaaaagcaagactagctggagagacggcttagtggttaagagcactgactgctcttccagaggtcctgagctcaattcctagcaaccacgtggaggct

SEQ ID NO: 92647 - DNA, 118 bp, Mus musculus
tttctctctggctgctttctcaccttgctctttttcactgtttatatatatatatatatatatatatatatatatatacagagagagagagagagagagagagagagagagggaggga

SEQ ID NO: 92648 - DNA, 73 bp, Mus musculus
ctgtagacactgaacaatgaatggactctgtttctcatggctcacgttctatgttgtatctcagtgtgtacag

SEQ ID NO: 92649 - DNA, 85 bp, Mus musculus; identical to SEQ ID NO: 57439

SEQ ID NO: 92650 - DNA, 99 bp, Mus musculus
gcccaccacattttatcataattgcttaactaagtgcatattttatgtaattatctgtatgttcttcattgggttgtgagcttctgaatgcaggtgagt

SEQ ID NO: 92651 - DNA, 72 bp, Mus musculus
ggttcatatttacaaagtatgtattcatatgtgacaatatatgtctgtacatgtggatctttgtggatttcc

SEQ ID NO: 92652 - DNA, 82 bp, Mus musculus
ttacagagaaatgacagagatctgatctgcatattctccagaggattctggtgcatgagtctaagttgtttaatatctgtaa

SEQ ID NO: 92653 - DNA, 105 bp, Mus musculus
tcaaagtaaaatcactttggatggattttagtgcttctgaaatgattttaatgagctgaacttcctacttagaagcattatagccaacttctgacattacttgga

SEQ ID NO: 92654 - DNA, 96 bp, Mus musculus
agctcttgggggactggagagatggctcaagggttaagagcattgactgctcttcctgagagcccaggtttgatcctcagtgctcacctgacagct

SEQ ID NO: 92655 - DNA, 115 bp, Mus musculus
gggaatgacccttgaagtaaagcttaccaatccatgcaaagtcagccagctatgttcaggtgaagagtggatattggctgcttatgggagcttctgtagcaaggaaaaaccaccc

SEQ ID NO: 92656 - DNA, 108 bp, Mus musculus
ggttcccgggtagacagaaagacagggagaggctaaggaagaagccggccatcctgctgtgtctcttagtctctgtcctagtctctcagagctacagctaaaggaact

SEQ ID NO: 92657 - DNA, 80 bp, Mus musculus
gtgtgtgtatatgcacacatgtgtgtgtgtatctatgtgtatctatgtgtatgcatgtgtgtgtgtgtgtgtgtgtgtgt

SEQ ID NO: 92658 - DNA, 109 bp, Mus musculus
gtgttctctgtctaggggttgggtcgctgtgagatttcccccttccatgttaacatgtctggtgatattgttgttcgggtctaactcagcaaccctttctaagagtcac

SEQ ID NO: 92659 - DNA, 80 bp, Mus musculus
ctgagtgcatttgaatcgggcttaggtgagcaaggtttgtccattgcaacacactgaggacacaggcagtgtgcactggg

SEQ ID NO: 92660 - DNA, 74 bp, Mus musculus
ccccaaacccacactctcagtgcctctggaactagaaatggatggcgggggtggagggtggggtggcagtgggg

SEQ ID NO: 92661 - DNA, 87 bp, Mus musculus
gagacagggtctcactgtgtggctctggctggcctggaactcactatgtagaccagactgtcaaactcacagagatcctcctgcctc

SEQ ID NO: 92662 - DNA, 164 bp, Mus musculus
atatgtgtataaatatgtgtgtgtatatatgtgtatgtgtgtatatacatatatacgggtgtgtgtatatatatgtatatattggtgtatatatatacatatatgtatgtatgtatatatacgtgtatgtatatatatatacatagatatgtgtgtatgagtat

SEQ ID NO: 92663 - DNA, 110 bp, Mus musculus
cagcactcagtggattctgtaatttctcacttgtcactgaggacagtgaggggaatccttcccacttcctgtcttcatttaggaaccacagttcagttcgaaggctgctg

SEQ ID NO: 92664 - DNA, 75 bp, Mus musculus
gtgcttgagacagaagagaatgagatcaagtgggttccttcctggcttcacccagatttctcatttgtctcccac

SEQ ID NO: 92665 - DNA, 61 bp, Mus musculus
tgcctgatgctaagttagagcacccaggctgaagtctgggctctctctcactgtcggtgca

SEQ ID NO: 92666 - DNA, 118 bp, Mus musculus
acgtcctacacaggggatcctggatagcacaagagtagggaacgtgagctgagcacgagaacacactcattaactcactgctctctgctcctgactgctccagctctctgactgacgt

SEQ ID NO: 92667 - DNA, 94 bp, Mus musculus
tggtggaagttgttggctcacactgctagagcagagccagagtgctgtctctgtctcggctgtctctaccactctgtgtgtattgcttctgcca

SEQ ID NO: 92668 - DNA, 63 bp, Mus musculus
ttctctctgtgacactctgtatttcctcctcaccagatctctgcagagtgtgatagatgagag

SEQ ID NO: 92669 - DNA, 78 bp, Mus musculus
cagaagcaaatggtagaattgactctctttctcactgcacatatacccaggatgagagggttaaagaccatggttctg

SEQ ID NO: 92670 - DNA, 74 bp, Mus musculus
ctgcttgttccctttgtgctctgaggccattgacctctctgtctcttggtctctggagtaaaaattgtaggtag

SEQ ID NO: 92671 - DNA, 71 bp, Mus musculus
gtaaagcagcttcctcctgtacagttgtctccactttctggagtaaaactgaggaaacggttacattttac

SEQ ID NO: 92672 - DNA, 89 bp, Mus musculus
aagaaagtctttgtgtcgagccatgtgtgtggaagatctgtcaggagtccaaatccttccataactcagttagtccaaggaaaattctt

SEQ ID NO: 92673 - DNA, 86 bp, Mus musculus
tgactactgagtgagcaagcattaaggaaaacgaaggattcattctttgaatatattatagtcttgatgtttcaaattctaagtca

SEQ ID NO: 92674 - DNA, 100 bp, Mus musculus
gatgaggattgcattgaattcctagattgcttttggtaggatgacaatttttacttattaatcctactgatccatgagtataggaaatcttttcatcttc

SEQ ID NO: 92675 - DNA, 118 bp, Mus musculus
taggggtcagtaggtctcttcccagtgtagccacattgaataattttctacatttcattgttaatgtagctgttttgattggcttatggagaaggggtagcttatttgaacactgact

SEQ ID NO: 92676 - DNA, 76 bp, Mus musculus
gggatatttggtgtgatagttactgaagaggcacaagtgacctctgagtgtcagtcactgtatgagggccattcct

SEQ ID NO: 92677 - DNA, 59 bp, Mus musculus
ttgcaggtgaagatgtgtggacagagggatatactatgggacacactgtcacactgtaa

SEQ ID NO: 92678 - DNA, 96 bp, Mus musculus
ccacatattcacaccctagcactaaccgaacttagtgaattatacattttttaaagatttggacttgtgagggacagtgttgggagaataatgggg

SEQ ID NO: 92679 - DNA, 63 bp, Mus musculus
ggggactaggggaaggaagttggcattttaaacaagtgtctctttctgtctctcctagtcttc

SEQ ID NO: 92680 - DNA, 110 bp, Mus musculus
agatgtctgttaaaaccatttgtttcataacttctgtcagtttcactgtgtctctgtttaatttcagtttccaggatctgtctgttgatgaaagtggggtgttgaagtct

SEQ ID NO: 92681 - DNA, 79 bp, Mus musculus
gggatctaagaatagaaaggaggtatgtgaaagaggctacatcagtgtgtgtgcatatctctctctctctctctctctc

SEQ ID NO: 92682 - DNA, 87 bp, Mus musculus
gtatgtgtatacatgtatatgtgtatatgtatgtatgtttgtatagtatgtgagcatgtgcatatttgtgtatatgtgtgcacacac

SEQ ID NO: 92683 - DNA, 85 bp, Mus musculus; identical to SEQ ID NO: 57439

SEQ ID NO: 92684 - DNA, 93 bp, Mus musculus
ggtccatggacaactggctctgtctctgggtctcggactgggagactgtagaacttcctagcagaggagcatggcagaggaaagttgttctcc

SEQ ID NO: 92685 - DNA, 85 bp, Mus musculus; identical to SEQ ID NO: 57439

SEQ ID NO: 92686 - DNA, 83 bp, Mus musculus
ccactttctccagctgacactgcttgttgtttgtactttattgactatgtggaccaatgggctacagtgtgctgtacatgtgg

SEQ ID NO: 92687 - DNA, 79 bp, Mus musculus
ctcttctgtatgtcccactgtgttctgtcatcctttagaaaaccccagggctcagacactcagtagatagatagcagag

SEQ ID NO: 92688 - DNA, 70 bp, Mus musculus
catggaatgggtctcaagttggactggttattggttggccactccctcagtctctgcttcctcccctgtg

SEQ ID NO: 92689 - DNA, 78 bp, Mus musculus
gccacattaccctctctgtctatgtctctgcaggacctcacccttccttagaacacttactctgtagtggtctgtggc

SEQ ID NO: 92690 - DNA, 117 bp, Mus musculus
tctatctatctacctatctatcatctatctacctacctctcatgtatatgtatatacatatatacataaacatacatgagagaggggggagggtgaggagggaggaagtatttcagg

SEQ ID NO: 92691 - DNA, 68 bp, Mus musculus
gctgggtggctctgggtgaaagttggccttcctgggcatttttctcacctacactctgtgactaatgc

SEQ ID NO: 92692 - DNA, 96 bp, Mus musculus
caaagtatgcgcttgccccacatttcagttacttttctgttgctgtggccatagccacagaactgagtgtgaagttataaaggaaagaatattttg

SEQ ID NO: 92693 - DNA, 64 bp, Mus musculus
gcagggcccctgagcttgctaccccaaaggcctaggtcagtgtgtgtctctctctcagccttgc

SEQ ID NO: 92694 - DNA, 78 bp, Mus musculus
ttggtgtgtctgaagacagctactcttacaaataaaaataaatctttttttttaagggagtactctgtgacacactga

SEQ ID NO: 92695 - DNA, 81 bp, Mus musculus
tatatactatgcttatgtgtatatataatattattctagtatactagtatatatgtatgtgtgtatatgtatatgtatatg

SEQ ID NO: 92696 - DNA, 77 bp, Mus musculus
atagaaacctatatacattatacatatacatacatatatatgtgtgtgtattgtatatatgtatctatatatagtgt

SEQ ID NO: 92697 - DNA, 79 bp, Mus musculus
gctagcatggacaatttgttgtctggggtttgccaacttactttgtagttgtgacttctgatccatctgtgctgagagc

SEQ ID NO: 92698 - DNA, 91 bp, Mus musculus
agccacacaagcctcactgaggttgctctgagctttccattaactcaatttcttaatctgagccgatttcctgaggtttggcccagtgact

SEQ ID NO: 92699 - DNA, 106 bp, Mus musculus
gaatgaatagcaagagacttggcttggagtttctataactgcatttatatacatatatttgaatagaggagtacataagcacatatctatcttagctatgtcattt

SEQ ID NO: 92700 - DNA, 133 bp, Mus musculus
ctaagttctccttgtacatcacactggtttgggaggggttcagtgtgatgtggccatctgggtcacagaagaaactgtcctcagtccaaatgtagtagccattggtgaggagtcgggggcttctgcggcagat

SEQ ID NO: 92701 - DNA, 63 bp, Mus musculus
ggacccacaggtggggcagtctccagatggtcattcatcctgtctctgcttcacactgtctct

SEQ ID NO: 92702 - DNA, 59 bp, Mus musculus
ctgtctgtctatgtctctctctttacgtgtgtgtgtggggggggggggggtagaaagtc

SEQ ID NO: 92703 - DNA, 130 bp, Mus musculus
ccaaaagtcatgcaactgcctctgtgacatttttcctgtccatcaaaggccaggcactctgtgtctgtgaggcatgtgatttgtggggtgtcaaactgtagcccacccagagattctagtgcctatgaca

SEQ ID NO: 92704 - DNA, 88 bp, Mus musculus
gttggaggaagtggatcactggaagtgggctttggggatttaaaagcctctgccaagcccagactctcagtctctcagtctctctctc

SEQ ID NO: 92705 - DNA, 89 bp, Mus musculus
ctctgtgtttaaggatcagctcatgcaagtgtctatctcacagtctgtttcttggaagacagtcattacatctgtttttaaacataaag

SEQ ID NO: 92706 - DNA, 99 bp, Mus musculus
ctggcatctccagcccccagatatggctgcagaggctcagtctgacactcaccagacttccggtagatgtaggtagcctcttcatggagcagaagccag

SEQ ID NO: 92707 - DNA, 99 bp, Mus musculus
ctgggccatgagatctattgactggagtctgtgagcacagcttctttggggctacctaagatactactcaacttctccagcacccccttctctgctcag

SEQ ID NO: 92708 - DNA, 107 bp, Mus musculus
ctcacaggcaggaataaatcttccattatctctgaaattacacatgacttgtgagtgaactcacagtggtaaggcatgggagggacacaagatctgcacgttgtgag

SEQ ID NO: 92709 - DNA, 69 bp, Mus musculus
ggacagaatgtgcattgggggtcactcaagaagcaaggccacagtgacaggacacagagcacaatgtcc

SEQ ID NO: 92710 - DNA, 76 bp, Mus musculus
gtatttatttgtgtatgtgtataggcttacatatgtgtatgacatatgtatatgtataaaagtatgtagtatttgc

SEQ ID NO: 92711 - DNA, 66 bp, Mus musculus
caagagacgcatggaacgagctgtgagccatcacccatgcgatggacagactctgtgtgtctttag

SEQ ID NO: 92712 - DNA, 85 bp, Mus musculus; identical to SEQ ID NO: 57439

SEQ ID NO: 92713 - DNA, 119 bp, Mus musculus
tctccatctatggtaattgagagtttggctgggtatagtagcctgggctggcatttgtgttctctcagtgtctgtataacatctgtccaggctcttctggctttcatagtctctggtga

SEQ ID NO: 92714 - DNA, 84 bp, Mus musculus
cagccctagtgacagtgagtgactgtctctctaggaacaggcaaccacggaggattagagggctgcaatcactgttacagactg

SEQ ID NO: 92715 - DNA, 83 bp, Mus musculus
cttgttcttcctgtggtttcttgcagatcttcaaacagtccttaactgtctgtgcctctctctctggggacctgggacacaag

SEQ ID NO: 92716 - DNA, 122 bp, Mus musculus
gtgtatggtctatgatagcgtgctctgggtggtgttgggatatggtgtggtacatgtggaaagtgtgtgaacagagtgtgcacagtgctatatgttgcatcctgtgagaaatgtatgttatc

SEQ ID NO: 92717 - DNA, 75 bp, Mus musculus
gtgtctatgtgtgcatgatacatgtgtgtgcatatggttgtgtgtacatatttgtatgtatgcatgtgtgtgcat

SEQ ID NO: 92718 - DNA, 102 bp, Mus musculus
gttgtagagcattgcatttcacaaggtctttttggctcttcaccagctccaatctgtcacagtctcacaacgccatggaaggagatgctgtgctcaagcagc

SEQ ID NO: 92719 - DNA, 115 bp, Mus musculus
acagacaggatgaccgttacttttctgaagcagagctgtgtggtcacttctctttgttctctgggtcctggcctaccagcctcacatactgccccagcgtgacttatcaagatgt

SEQ ID NO: 92720 - DNA, 120 bp, Mus musculus
acctcccctgatgtggcacttctggtaagcactccgttctccttgactctagagcctctgctctgattgtttgggatggtgtcaggctgaatgtatcctccaccaaaggccgggctgtgg

SEQ ID NO: 92721 - DNA, 111 bp, Mus musculus
gatgttcgctcttcagtcgcctcagggcgagggcagagagtagaaagagaccgcaattccgcagcctgtgcggctcagctgctttgtcctcttcctcgctggagtgacgtc

SEQ ID NO: 92722 - DNA, 101 bp, Mus musculus
cacctgaatgttggtttaatgtactcagactgtctgtctttctgggccacaggatcacgtaagcagtagggacttcagactgggagcataagaagtgggtg

SEQ ID NO: 92723 - DNA, 117 bp, Mus musculus
tgtctgcctcaaggaaagaattttaggaacaactactgagtcttaagtgatctggtccaggctgctctttctctcagggcttctgattgctctcagcttcctgtttgtccttggaca

SEQ ID NO: 92724 - DNA, 85 bp, Mus musculus; identical to SEQ ID NO: 58391

SEQ ID NO: 92725 - DNA, 74 bp, Mus musculus
actttctgagtctctgacagtttccttagtttcctgggcttcctagcaggagggaatgcttcagtttgggaagt

SEQ ID NO: 92726 - DNA, 109 bp, Mus musculus
ctcaatttgcaggcagctcctccagaaagaggctacctcctagctgttattttttgtatattaaatgtgtcggtcagtgagtctgtctgtctgactgtctgcctcagag

SEQ ID NO: 92727 - DNA, 111 bp, Mus musculus
tgaggccaggcctattgaactgggaactgagctgaatctctcaggctgctttcaagagctgtgcttctgagagatcctgctgtgcagtaaatttgagaggtgctggactga

SEQ ID NO: 92728 - DNA, 90 bp, Mus musculus
gcattgtccttcaactaaagtagtagctctaggcatgagtttctcaatctctctcacacactctgccttattacttttgataacacttgc

SEQ ID NO: 92729 - DNA, 94 bp, Mus musculus
tctctctctctctctgtctgtctgtctgtatatgttgggaggagtacatgctcacacacatgctcacacacacgcacacttagggagacaaaga

SEQ ID NO: 92730 - DNA, 127 bp, Mus musculus
agggtggcgtcctctcagtctccggctttcccatatgaccaagggaagacagaagggactgacctcacaacaaagggagctctatagctgtatggctgtatggctgtgtggctgtgtggctgtgtgg

SEQ ID NO: 92731 - DNA, 83 bp, Mus musculus
tgtcagagtttggtgtttgctcatggaatggccatttataccaatgacaggtggacattcagtgtgtcactgagactctgata

SEQ ID NO: 92732 - DNA, 132 bp, Mus musculus
tatatatatatatatatacatatacatatatatatatatattatacatatatatgtgtacatatatgtatgtatatatgtgtgtatacacacacacacacatatatatatatgtgtgtgtacatatacatat

SEQ ID NO: 92733 - DNA, 56 bp, Mus musculus
tgcagagtgaagtaacacagcaccagaaagccaggtgttgtatgtactcacttgta

SEQ ID NO: 92734 - DNA, 91 bp, Mus musculus
atgcgtatgcgtatgcgtatgcgtatgcgtatgcgtatgcgtatgcgtatgcgtatatgtatatgtatatgtatatgtatatgtatacaca

SEQ ID NO: 92735 - DNA, 105 bp, Mus musculus
tgtgaacctggaggaaatggattttagcagactggctgttctttattattagaaggatcttggagaaagccattcattttctgtgctttggtttctttatccaca

SEQ ID NO: 92736 - DNA, 87 bp, Mus musculus
ctgccctcttgaaatcagagcaattatgattgcacctatgaaattgtaacaaaattgtagccatgaagattctttctggatgggcag

SEQ ID NO: 92737 - DNA, 102 bp, Mus musculus
gctttgtggatgcggtatgatgcctctgcctggagtcagtgggtcagcactgaactcattttgaacttctttattcatagggtatattgtcttccattttgc

SEQ ID NO: 92738 - DNA, 103 bp, Mus musculus
caggagctcattacagtaagttagaaaggataggctgaacagagtgaggactttacttacaaaggtttccctgtcagtatcaaattgatctgttaggggcctg

SEQ ID NO: 92739 - DNA, 72 bp, Mus musculus
tgtcgctcactctcaggctctgaatgtgttaatatagcgttgctccttgaccttgggccttggagagcagca

SEQ ID NO: 92740 - DNA, 102 bp, Mus musculus
gtgttactgtctgtgtttgatgagccatttgaaagagctgacccaatcccattgccacacagtgtgactctgactgttcagtgctacgtggaaatgtaacac

SEQ ID NO: 92741 - DNA, 94 bp, Mus musculus
taagccaagtttcagttcatgtaaacatcctacactcagctgtcatacatgcgttggctgggatgtggatgtttacgtcagctgtcttggagta

SEQ ID NO: 92742 - DNA, 102 bp, Mus musculus
tgctgtcagaaagtctgtgtctgtaaacatccccgactggaagctgtaagccacagccaagctttcagtcagatgtttgctgctactggctcttcgaatgca

SEQ ID NO: 92743 - DNA, 103 bp, Mus musculus
ctttgatgtgagcacgaaagcacatacacgtgcctgctgtgtgagtgcacacagagatgtgcatgtcccggggtgtgactttgtaggtgttcacagtgtgaag

SEQ ID NO: 92744 - DNA, 83 bp, Mus musculus
tgacatgcaaaaattctatatatgtatatatacatgtgtgtgtgtgtatatatatatatatatatatatatattaccatgtga

SEQ ID NO: 92745 - DNA, 100 bp, Mus musculus
tatagccaggttgttcttcagaattgcagaggatttgacctcctctttatgaggcaaggaggtctctgtatggcactggaagaaatttcttgcttctata

SEQ ID NO: 92746 - DNA, 93 bp, Mus musculus
gatcttctttgtaggatggctccaatagaactcttctatatgaatatataaatacatgagttcaaggtcagcctacattacaaagtgagtttc

SEQ ID NO: 92747 - DNA, 79 bp, Mus musculus
ctttgtaatgtaggctgaccttgaactcatgtatttatatattcatatagaagagttctattggagccatcctacaaag

SEQ ID NO: 92748 - DNA, 91 bp, Mus musculus
tatgtataatatatatattatgtgtgtgcatgtatgtatgtatgtatgtatgtatgtatatatgtatataacatagacattagacatatgg

SEQ ID NO: 92749 - DNA, 79 bp, Mus musculus
ggtcagcatttgccatgatttcttttcttgatgtcagtcattctgactgagtgagatggaatctcaacaaacgctctcc

SEQ ID NO: 92750 - DNA, 60 bp, Mus musculus
gacctggtggttttcctctctgtccctaaagtggatgatagagactgaacacactgagtc

SEQ ID NO: 92751 - DNA, 96 bp, Mus musculus
gggataccacccttggaaggaattaaagtacttctctttggaaccgaggccccatgaaagagtagattgttataaaaggataaagattggtctccc

SEQ ID NO: 92752 - DNA, 85 bp, Mus musculus
cctcgtgttctcactgaagacagtgtctagattcaaaatgagcaaagaaaacattgtcttcttcccttcagcgtgacacatgagg

SEQ ID NO: 92753 - DNA, 85 bp, Mus musculus
ctcaaaatggatctctccactctctctctgagcctgaggcaaacacatgcatgcatgcgcgcgattagaaaggaatccaaatgag

SEQ ID NO: 92754 - DNA, 117 bp, Mus musculus
ggtgatgggcagaggcctggctggctgtgtctgtcctttgttctccccagcagtcactggctctgttcacttgcttctccttctatatcgtccccctggtgattctggttggagaat

SEQ ID NO: 92755 - DNA, 61 bp, Mus musculus
gggtgtgaggtgagtgtggccacacaaggtctgtgttgtgctacaatctatcacacagccc

SEQ ID NO: 92756 - DNA, 91 bp, Mus musculus
ttagagatatgcctgccagccactacagaatgtcttcttctgactttgcgcctaacgaaaatagaaggacactggttggattttctaggta

SEQ ID NO: 92757 - DNA, 74 bp, Mus musculus
gatgacagaacactgagagaagacagacttgttgactatccaaagctctactcttaactcccgggtctgtcatt

SEQ ID NO: 92758 - DNA, 96 bp, Mus musculus
tgtatgtatgtatgtatgtatgtacgtgtgtgtgtgtatatatatatatatatatatatatatatatatatgtatgtatgtatatatatacgtgca

SEQ ID NO: 92759 - DNA, 59 bp, Mus musculus
gaacagcttgcagtgtaagtggggtctctccctctgtcttacttactgtcaggcagatc

SEQ ID NO: 92760 - DNA, 93 bp, Mus musculus
agtgctacaagtagataaatgccatactggagttgttcccctgctatgtaatgtagtaagatgactacagatgtcaagaatgcattgtgtatt

SEQ ID NO: 92761 - DNA, 115 bp, Mus musculus
tatatgtgcatacctgtgtctttgtatgtattatatataaatatatatgtctatggatatacatatatatgtatatatgtagataggtatatacattgaatatgtagatgtgtac

SEQ ID NO: 92762 - DNA, 78 bp, Mus musculus
gtcagtcacagaaattcagcattcccctccaagcatatttgttcttgagataggtgaagctgtctttcctaaactgat

SEQ ID NO: 92763 - DNA, 85 bp, Mus musculus; identical to SEQ ID NO: 57439

SEQ ID NO: 92764 - DNA, 115 bp, Mus musculus
ggggttgtttggttttctggagtccatctttttgagttctttatatatattagatattactcccctatctgatttaatattggtaaagatcctttccaaatctgttggtggcctt

SEQ ID NO: 92765 - DNA, 95 bp, Mus musculus
agttacatgaggctgtgagatgcctatacaattgctgagaactgaactaaaatcttctgaaagaacagtctctgctctcaatggcctaagtacct

SEQ ID NO: 92766 - DNA, 113 bp, Mus musculus
agttcttcagttcagagtagggtagactagtgtgttcacatatttgtatttatatatcacagctatgcataggacattataggagtagaattgcattttgaaagtgaagagct

SEQ ID NO: 92767 - DNA, 85 bp, Mus musculus; identical to SEQ ID NO: 57439

SEQ ID NO: 92768 - DNA, 85 bp, Mus musculus; identical to SEQ ID NO: 57439

SEQ ID NO: 92769 - DNA, 126 bp, Mus musculus
cattcatataatatatatgtatatatatatgtgtgtgtgtgtgtatatatgtatgtatatatatatatgtgtgtgtatgtatgtatatgcatatatatatgtatatacatacatatatatcagtgt

SEQ ID NO: 92770 - DNA, 135 bp, Mus musculus
gcagcagatgtacacagcttcatcttcatgtaggtctacaacaattggaatgggagctgcctctgtctctgtctctgttgcctgacattggatcccctggtctcatttccttggttaggcataagtggaggaaga

SEQ ID NO: 92771 - DNA, 93 bp, Mus musculus
tgaatgtattgtttggaccaatgtgttaactgtttttgtagatgtcctaatttgaaaaagtagtgctacattggagtcacaaaattattttca

SEQ ID NO: 92772 - DNA, 58 bp, Mus musculus
tgcatatgtatatgtatatgtatatgtatatgtatatgtacatgtacatgtacatgca

SEQ ID NO: 92773 - DNA, 105 bp, Mus musculus
cagttaattattccacacattttgaaacaaaattggatttattatctatttataggtagtatattcattttagtataatgtgttgcattggaactattattactg

SEQ ID NO: 92774 - DNA, 77 bp, Mus musculus
tacatatatgtgtgtatatatgtatatatacatatatgtgtgtatatatatgtatatatacatatatgtaattgtat

SEQ ID NO: 92775 - DNA, 121 bp, Mus musculus
tcttaagccattcttgatttgatgtctaagaagagttttaagagagaagaatgattgcacataaatacatgttagaagtttttcctagttcgtagatatattttgcacagagggcttctga

SEQ ID NO: 92776 - DNA, 85 bp, Mus musculus; identical to SEQ ID NO: 57439

SEQ ID NO: 92777 - DNA, 87 bp, Mus musculus
cagcaggtactctaggatgtactggggtatgaagtcttcatgggagctgaacaactagggatctgccccagcatcaaggaccaggtg

SEQ ID NO: 92778 - DNA, 78 bp, Mus musculus
ctcaggcttgatatctctctggctgtacatagtgatataatcggtgttatcttctgtgcctcaggaagagggtttgag

SEQ ID NO: 92779 - DNA, 60 bp, Mus musculus
tacttctatgtatatatgtatgtatgtatgtatgcatgtatgcatgtatgtatgaatgta

SEQ ID NO: 92780 - DNA, 90 bp, Mus musculus
ggaccaccaaagaacatacaaaggttgaagctggtccttcttgtatattaatatatatacagatgtgcagcttggttttcatatgtgtcc

SEQ ID NO: 92781 - DNA, 85 bp, Mus musculus; identical to SEQ ID NO: 63901

SEQ ID NO: 92782 - DNA, 122 bp, Mus musculus
tattctgacatcattacacattctccctacaaattagttaaattgtatctggatgtggatgtggattggatgtagatgtggatgcggatgtagtaaggaaggcagaatgttgtgtaaatcag

SEQ ID NO: 92783 - DNA, 69 bp, Mus musculus
agtgtgagtgtgttcatgtctgtgtgtgtgtgtgtacctgcacacacatgcgctcatggtgtttgcact

SEQ ID NO: 92784 - DNA, 94 bp, Mus musculus
gttatgcttttaaggtgtctcattgtctgtgtttgagatgtgtgatagtttgtatatgtttgggccagggagtgacattattaggaagtgtggc

SEQ ID NO: 92785 - DNA, 85 bp, Mus musculus
ggccatggtggtctgataggatacacgggataatttcaatatttttgtatctgttgaggcctgttttgtgaccaattatatggtc

SEQ ID NO: 92786 - DNA, 114 bp, Mus musculus
agaataatcaaggatgggcactcacagctctttgaacattgactgaaacactctctggaaaacaggagtgctgacacaaggacatagatgactgtggtactcagaactgattct

SEQ ID NO: 92787 - DNA, 91 bp, Mus musculus
aatcacagatgtcattctcttccacacaggcacacaaaatatatgattataaacataatagaaatgggactgaagagattgctctgtggtt

SEQ ID NO: 92788 - DNA, 69 bp, Mus musculus
gctaggaacagtgtctctctgactgctgcctatggatccagatgtagaactctcagggaattgtctagc

SEQ ID NO: 92789 - DNA, 113 bp, Mus musculus
atatatatatatatatatatacacatatatatatacacacacacatatatatgaattgaatttatatatatatatgtgtatatgtatatgtatatctatatgtatatatgtgt

SEQ ID NO: 92790 - DNA, 85 bp, Mus musculus; identical to SEQ ID NO: 57470

SEQ ID NO: 92791 - DNA, 80 bp, Mus musculus
tagagtaaactgcagaggttctgaggatatattgctcttatagtgagaacaattttgtcctctctgtctctgtctctctg

SEQ ID NO: 92792 - DNA, 82 bp, Mus musculus
gtgtgagagagagagagagagagagagagagagagagagagagtctgtctgtctgtctgtttctggtgtctgtgtctctttt

SEQ ID NO: 92793 - DNA, 80 bp, Mus musculus
ggtgacaactctctgtgacactgcttctgagaacattgaatgctaccatatgaggagctcaggacaggttggaggacacc

SEQ ID NO: 92794 - DNA, 110 bp, Mus musculus
tctctcttgatatatatgtgtgtatatatatatatatattcatatatacatgtatatatattcatatatgtatatgaatatatataatacaaaatatgtattaaaagaga

SEQ ID NO: 92795 - DNA, 85 bp, Mus musculus; identical to SEQ ID NO: 57470

SEQ ID NO: 92796 - DNA, 70 bp, Mus musculus
ctccttatgcaggccaggctagccttgaactcacagagtctctcattgtgcctgtgtctgcctcctggag

SEQ ID NO: 92797 - DNA, 91 bp, Mus musculus
gaaaataagagacagcatctgaacagaagtatttttgtatttgagaatcagatattcccacttgcaccttgagatgctgtgttcatttttc

SEQ ID NO: 92798 - DNA, 85 bp, Mus musculus
ggccatggtggtctgataggaaacatgggacaatttcaatatttttgtatctattgaggcctgttttgtgaccaattatatggtc

SEQ ID NO: 92799 - DNA, 85 bp, Mus musculus; identical to SEQ ID NO: 57439

SEQ ID NO: 92800 - DNA, 80 bp, Mus musculus
gaggcattctgcttttctttgattccaccagggggtaattgggccctctgggtggctctgagctcacaggcagctttctc

SEQ ID NO: 92801 - DNA, 85 bp, Mus musculus; identical to SEQ ID NO: 57439

SEQ ID NO: 92802 - DNA, 87 bp, Mus musculus
ttacttgtctgatgtcacagagctgaaagtggagaggggtgggctcttttctaaaatattatttaattcccgtggattcagaagtaa

SEQ ID NO: 92803 - DNA, 85 bp, Mus musculus; identical to SEQ ID NO: 57439

SEQ ID NO: 92804 - DNA, 66 bp, Mus musculus
tctctgtatgtcttagtcaaagggggtgctctgtgccacacagagtctctgtgacacatacacagg

SEQ ID NO: 92805 - DNA, 63 bp, Mus musculus
gtgcatgcctgtgtgtgtgcatgtatgtataactatgtgtgtgcttgtgcatgtggtgtgtgt

SEQ ID NO: 92806 - DNA, 75 bp, Mus musculus
agtcttgctcacagatgagacacagtaccaatttgcatcttggttacagcattgggaatctctgagcaaaggact

SEQ ID NO: 92807 - DNA, 107 bp, Mus musculus
tggacttaggcggcagactctggattggttatttttttcaagcagaaaactttttttttttaatgagtcacttttaaagaattatctcctgtgtcttcctagggtca

SEQ ID NO: 92808 - DNA, 83 bp, Mus musculus
tgaacagaggagtgtcaccatgacaactgaaggtaaaatgctgtcatcggtacttggtaacttacagactctcagtctgttta

SEQ ID NO: 92809 - DNA, 63 bp, Mus musculus
tggcttcctgagctgtctgtccctctctgaagcatcagaagacagactgctcagtggaagtga

SEQ ID NO: 92810 - DNA, 85 bp, Mus musculus; identical to SEQ ID NO: 57439

SEQ ID NO: 92811 - DNA, 90 bp, Mus musculus
gtccctatgtgtgtgtcacagtcacacaaaattacacaataggtatgtgctatactatagttttatgttaactttatacacgctagagat

SEQ ID NO: 92812 - DNA, 89 bp, Mus musculus
aggaagctgctgagagccagaggcctgagaatagagagatcggcagactgggactctgtctctctcaggttcacccttcttcctactta

SEQ ID NO: 92813 - DNA, 103 bp, Mus musculus
gtgaatgtaggaaggtgtgtgatatctgtctgtctgtctatctatcatctgtctaggtgtgggtatggagtatgggtgtgggagtgcatttgtgtactattat

SEQ ID NO: 92814 - DNA, 92 bp, Mus musculus
gtgtagacccgaggagtagcctgtggatttcagagtgtccttctttggaatctgtcactctgtgcgtctgcatacaatggttgtttgggatc

SEQ ID NO: 92815 - DNA, 77 bp, Mus musculus
acatggctttagtgctccatacaaacggatccaggagagctctgttgtctctgtttcagcacttacttggtctctgt

SEQ ID NO: 92816 - DNA, 67 bp, Mus musculus
gtgtgtatgtctctgtctgttagaactgtgttacgagatgctagcagaattgagaggtttttcatgc

SEQ ID NO: 92817 - DNA, 74 bp, Mus musculus
gtagcagatatacagtttgcccttcatgtgggttccctaaccattaaagtggggactgtctctgactctgttgc

SEQ ID NO: 92818 - DNA, 93 bp, Mus musculus
ggacaagatggttaattgttctgaaagctggcatggagtaggacctgcctacataccccacagccatgtctaagacagttacccatttctgcc

SEQ ID NO: 92819 - DNA, 86 bp, Mus musculus
gacataaacgaattgcagagtgaagagacacagctgaaaatcagcacacaggttgatctgcatatctgcaaagtgtgcaagaggtc

SEQ ID NO: 92820 - DNA, 96 bp, Mus musculus
gcagagtggcaaaacagaagcaaggcccagaacaggcctggacaagagaacagctgccaggcactcactgcctgtgtatgtgtgcccccacactgt

SEQ ID NO: 92821 - DNA, 70 bp, Mus musculus
gtgtgtgtctgtcactgtgtgtctgtgtgcatgtgccaatgcatgcgagccagtggtgggagaagaacat

SEQ ID NO: 92822 - DNA, 95 bp, Mus musculus
tatatatatatctgtgtgtgtatatatatatgtgtgtgtgtgtgtgtgtacatatatatgtacatatatatatatatatgtacatatatatatat

SEQ ID NO: 92823 - DNA, 111 bp, Mus musculus
tgttagctagaggcttgggtcctgcggactgtgtctcactggctcacaatcatgttaggtgtgggctgtcaagacaatagacattaggaaagatcaggtcttctgtgtgca

SEQ ID NO: 92824 - DNA, 112 bp, Mus musculus
tttcctgctgtggtggtgtgaggccttacttgcaatttaatttaatttaatttaatttaatttaatttaatttacacgtgttgagaccttcttgtggcccagcatttgggaa

SEQ ID NO: 92825 - DNA, 120 bp, Mus musculus
atatgtatatatgtgtgtgtgtacatatgtgtgtatatatatgtgtatacatatgtgtgtgtatatatatatatatatatatatatatattcaggtatcgatgtatatgaaggcatatat

SEQ ID NO: 92826 - DNA, 86 bp, Mus musculus
gcagaaacagtagtcacagggcactggaaggaaaaaaaaacttgttcactcttccctccctccctctgtgccccttggctgttcgc

SEQ ID NO: 92827 - DNA, 80 bp, Mus musculus
gtgggccgctctgccatcctctctgcctctgtcagtcggctgctcagagtgggaaggcggatggtggtggtgtggtctgt

SEQ ID NO: 92828 - DNA, 74 bp, Mus musculus
ttgtgctaagagacaaaatacagagaagacaggaaccaattcgggtcctattttctttgaagtctgtggcagga

SEQ ID NO: 92829 - DNA, 118 bp, Mus musculus
gcatggagcacagatgatggagcgctttcctgccctcgaggagctcacagtctagtatgtctcctccctactagactgaggctccttgaggacagggatcgtcatactcacctcctgc

SEQ ID NO: 92830 - DNA, 90 bp, Mus musculus
gtacattcatttgtgtgcttatgtatgtatatatatgcatacacacatatacatacatacatatctgtaagtacacacattccccagtgc

SEQ ID NO: 92831 - DNA, 77 bp, Mus musculus
gtcctggaactcactctgtagaccaggctggccttgaactcagaaatccgcctctctctgcctctgagtgctgggat

SEQ ID NO: 92832 - DNA, 97 bp, Mus musculus
gtctgttaaatgcattaaagagggcctggagagatggcttagtggttaagagcactgactgctctaccagaggtcctaagttcaattcccagcaacc

SEQ ID NO: 92833 - DNA, 96 bp, Mus musculus
gtgtgtgcactgcttgtgtgtctagggtcctgagtgaaggaggaggctctgactcatcctctctcaggcactgatgtgctgtttgtatggtactgc

SEQ ID NO: 92834 - DNA, 113 bp, Mus musculus
tggccacagtctcacatgtctctagtcacttggccccctcagcactatcagccctatctgtgcctctgtccctgaatgcccaggtgactgggatctgtcaggttgtcaagtca

SEQ ID NO: 92835 - DNA, 71 bp, Mus musculus
ctacgagctcattttgtcactcaggggacattacaaaggcagtgacctcagagtggccagactgagtctag

SEQ ID NO: 92836 - DNA, 83 bp, Mus musculus
gagtatgtttatgtatatgcatgtgtgtatgtatgtgcatatatgtgtatttatatatatgcttatacacatgtgtatgcatg

SEQ ID NO: 92837 - DNA, 59 bp, Mus musculus
agggtggggatcagggccacagcaggagtggcatcttctgagtgtccctgtctctctct

SEQ ID NO: 92838 - DNA, 112 bp, Mus musculus
ggtgtctgacctcagacagaccagttccttttctgggcttggcaggtgtgtgcacactcactctgggacacagtctgcctgccttttctgtgttcatctgagctccctgacc

SEQ ID NO: 92839 - DNA, 74 bp, Mus musculus
agccagcacagctgtatgacacggttccagcaaagctgagccgaatgctgtgaccactgtctgtctgtctgtct

SEQ ID NO: 92840 - DNA, 93 bp, Mus musculus
gactgctgtggtgtgggtgctcagagggtctgtcctcagggacgcacatgaagggtccctggctctttcactctctcgggcactggcgtggtc

SEQ ID NO: 92841 - DNA, 112 bp, Mus musculus
agcccaggtctgctgccacctctcggctgaggttacacagatagggtgtttgagccacaagtcactcactgtgtgactgctgctaaaggcctggaaggtgtggattctggct

SEQ ID NO: 92842 - DNA, 115 bp, Mus musculus
gtgagagaccctattcagagaacagggtgaggagtggcagaggaagacagacacctgtgctgacatctgtctccctatgtacacagatttttttgccttgatttctattctgcac

SEQ ID NO: 92843 - DNA, 74 bp, Mus musculus
ggaaatactcactgtgtcactgtgtgtacatgggacagcccactgcaacacttgggtcacatgcagaggtttct

SEQ ID NO: 92844 - DNA, 91 bp, Mus musculus
ctgtgttttcaggttggagacatggctcagaggttaagagcactgactgctcttccaaaggttctgagttcaaatcccagcaaccacatgg

SEQ ID NO: 92845 - DNA, 104 bp, Mus musculus
tggcaggaggacctctggcgggggcagcgggggcaggggggggggagctggctctcactgactcggactcttggctagttcctgggggtgtgtaagggctgcca

SEQ ID NO: 92846 - DNA, 76 bp, Mus musculus
ctcagtctccatcctgctcagccctgtgactggcaccaggaggtgctcagcatgcctgtctcactgagtgactgag

SEQ ID NO: 92847 - DNA, 74 bp, Mus musculus
acaggtgtatatatgtatgtatgtatatatgtatgtatgtatgtatgtgcatatgtatgtgagtatgtatgtat

SEQ ID NO: 92848 - DNA, 116 bp, Mus musculus
tccatgattccccgacctgtgcaccagtctaagcatctccttcattctcagtctgtaggtcactgtctgtctagggtgtggggaggcagctgtgtgctctgggctatgactcagga

SEQ ID NO: 92849 - DNA, 75 bp, Mus musculus
ggtatgttgcagggggtgggctctgcagtttcaaaagcccattccagggtcagtctctctctctgcctgccgcct

SEQ ID NO: 92850 - DNA, 62 bp, Mus musculus
tgtgtatgtatatatacatgtgtgtatatgtgtgtgtatatatgtgtatgtatatgtataca

SEQ ID NO: 92851 - DNA, 102 bp, Mus musculus
ggagcagagaaatcaggcagtcgctacaagggaagtgaggttgagagagaggacagagagcctcccgcctctgtggtaatggctgtggaaagcgaatgcttc

SEQ ID NO: 92852 - DNA, 89 bp, Mus musculus
gctgagtagcccatctcatccgtcccatcctccctgaggttcttgtttctctaccaaagctcagagagaaaggacacagggttgtcagc

SEQ ID NO: 92853 - DNA, 102 bp, Mus musculus
actgaacaagctcagatagggcgcactgggacacagagcctgggtctctgtttgtgaggtgtaactgggaccaaaccaggtgcatctccacagaaacgcagg

SEQ ID NO: 92854 - DNA, 79 bp, Mus musculus
agagaaggtgcagcattctgggagccccaggtgcaaaggatgctaccctgcagctgtgtcccactctgagcctctctct

SEQ ID NO: 92855 - DNA, 79 bp, Mus musculus
cactggatgaggcattcacagttcaggatgccgctggccagccagtttgctcttcagatctgtctgtctctgtcctctg

SEQ ID NO: 92856 - DNA, 96 bp, Mus musculus
ctttccttcatgatatatgatggtgggtgagatatttttttcttgaaaaatattatcccttcttgctaacggcatctgagatttgtgatgggagag

SEQ ID NO: 92857 - DNA, 102 bp, Mus musculus
tggtttctaagagttttgttgtagattatttctgagagttgagtgtgaggcctctgagcagcacacgatactcagaggtctggatgcagactctggatacca

SEQ ID NO: 92858 - DNA, 70 bp, Mus musculus
aggtgtgggtctgaggaaacaggaaagttggcatggagccagacactctgtgaccctgtgacttccactt

SEQ ID NO: 92859 - DNA, 74 bp, Mus musculus
ctaagtgctagaattactggcatgggggtgtggcaatatcatgcatcattatatgcagaattctggacccttgg

SEQ ID NO: 92860 - DNA, 91 bp, Mus musculus
tctgtgaagtctgagtcagtcagaggacagtgacatcacgtgaaatgaagacctctgggaactccagacttccaggtcaggtggatggtcc

SEQ ID NO: 92861 - DNA, 89 bp, Mus musculus
actaatccggcagcagattctgagcagagagtcacagaatcctcctggaggcagggtcaatgtctctgaacagactgaggttggagagt

SEQ ID NO: 92862 - DNA, 79 bp, Mus musculus
ttggaggcagtctttgcctggaggacagaggcaggctgctactggcctctctctgtcactctaagagatagcaagctaa

SEQ ID NO: 92863 - DNA, 81 bp, Mus musculus
tccaacttgttcatgagtcatggggaaactgaggcaatgctgagatgcattgctcactctgtctccctcagaaactggaat

SEQ ID NO: 92864 - DNA, 136 bp, Mus musculus
cactgacttacttgactgagagctctggaaagccctttctcagcctcctgctttggtgtctgtgacactcagtgcctttcctctggttgtttgctctgggccctacccatcacctggaactcccagaaggtttctg

SEQ ID NO: 92865 - DNA, 93 bp, Mus musculus
tgtgacagacttcagggtgtgtaatctttccacagaggagaagggaagacccactctgaagaaagacagctccatcctgtgtgctcaggtccg

SEQ ID NO: 92866 - DNA, 69 bp, Mus musculus
caagtgcaatggtaactatacaagtgtgaatggtgtaatgcaccaatcacagggcatggtcggcgcttg

SEQ ID NO: 92867 - DNA, 143 bp, Mus musculus
tgtgcatgcatataggtgtgtgtgtgaatgtgtgcatgtgcatgcatataggtgtgtgtgtgaatgtgtgcatgtgcatgtatataggtgtgtgtgtgaatgtgtgcatgtgcatgcatataggtgtgtgtgtgtgtgaatgt

SEQ ID NO: 92868 - DNA, 92 bp, Mus musculus
tccctctacgtctttagtctctcactctcacccaagacttttagcaagagtttcagcacgtgaacttgaggacagagtcttcgagctctgga

SEQ ID NO: 92869 - DNA, 90 bp, Mus musculus
gctgggaaatgatctggccaatgtgggtctggatttctttggaaaggtcttttcacagagacccacactgggtctgaggtccccttgagc

SEQ ID NO: 92870 - DNA, 68 bp, Mus musculus
gcatgccagagcatgtgtgcccttgtgtacaatggcacagtctcacacacccacacatgccctgcagc

SEQ ID NO: 92871 - DNA, 104 bp, Mus musculus
tgaagaagttacagtgatcaggcacagacctgcatccaaggcacgaagctgtgtgaagagccagtgcacagtgctatctggccaattccagttgtaacccttca

SEQ ID NO: 92872 - DNA, 117 bp, Mus musculus
agctggacattgcctgacttaggaggggatgggtgcccaagcttgcccgctcccagaagacagtgagggcaaaggccctgggcacagagctcagcagtcaagagcggagagtcagct

SEQ ID NO: 92873 - DNA, 70 bp, Mus musculus
gaaaaagcaggattctggggggtggggcctgggagttcctgggagtctgtgagtgtgtctctgtgtgttc

SEQ ID NO: 92874 - DNA, 86 bp, Mus musculus
gttcaggtcacaaggacttcttgctcctgtccaagcaggtgcagttctgggacagagctgagacaggtgacacagtatgagctaag

SEQ ID NO: 92875 - DNA, 78 bp, Mus musculus
tgggcaacttacagaggctagctctgccctctttccatgccaagcccggctggctggctggctgggtctctgggccca

SEQ ID NO: 92876 - DNA, 91 bp, Mus musculus
gggcgctgaggcccaggagagcagctgcagcctcggaagaggaagaacacccttctgtctgctctgtctgtcttggtctctcctttgaccc

SEQ ID NO: 92877 - DNA, 104 bp, Mus musculus
gtgattgacttctttattcattaggggtttggttcacgagaagtcacctgagtttgtgactcactctttgtcctcaacccctcccaggtgagcagaattagcat

SEQ ID NO: 92878 - DNA, 77 bp, Mus musculus
ttgcaaggaagtctccaggatagggggtgaagggtctcatctcagtctctctgctctggggcactcttggcctgcag

SEQ ID NO: 92879 - DNA, 84 bp, Mus musculus
gggttctgtaagctgaggaactgttctgaggccaggtgccaggatggggtgtctctgacagtaaagtgtgcccagatagagcct

SEQ ID NO: 92880 - DNA, 79 bp, Mus musculus
gcatgggggtgggggagagaattgaggctgagctctcagctcttcctgcctccgtgcctttgctcctccactcctgggc

SEQ ID NO: 92881 - DNA, 79 bp, Mus musculus
accactgagccatctctccagtcattttgatccttgcccatgcatgtattgagatttacttgatggctcagaatatggt

SEQ ID NO: 92882 - DNA, 81 bp, Mus musculus
ccctaatgctagctctttttctgcaaggccttgtaaattctcggtgagtcagacaacagaatgaggagtgtttccctgggg

SEQ ID NO: 92883 - DNA, 117 bp, Mus musculus
tggatgctattctcagtaaggcatttgacatcattacaggttcacttatatatatataataatatatatatataagtgaacctgtaatgatgtcaaatatatatattgacaaatcta

SEQ ID NO: 92884 - DNA, 110 bp, Mus musculus
gatttgtcaatatatatatttgacatcattacaggttcacttatatatatatattattatatatatataagtgaacctgtaatgatgtcaaatgccttactgagaatagc

SEQ ID NO: 92885 - DNA, 93 bp, Mus musculus
gggctgcccttaaagagaccttgaggtaggtgatgactgcttttccctccctgctggtcagtgctctctctctctcttttggggtccatgttc

SEQ ID NO: 92886 - DNA, 79 bp, Mus musculus
gagaaaagtccattttgtgcagctgtctgtctcactgtcccctctgaggtaccagcagtgcgcagctcagactgttctt

SEQ ID NO: 92887 - DNA, 63 bp, Mus musculus
tctgtctgtctacctgtctgtctgtctgtgtatcacatgcatgcagtgcccctagaggataga

SEQ ID NO: 92888 - DNA, 85 bp, Mus musculus
tcctgctctgtcaccagtgcagtcatgtgatgctcctgcctgtactttatgtctagggtctcactggctcactgacagaccagga

SEQ ID NO: 92889 - DNA, 85 bp, Mus musculus; identical to SEQ ID NO: 92888

SEQ ID NO: 92890 - DNA, 84 bp, Mus musculus
ctcctcagttgccagtgcagtcatgtgatgctcctgcctatactttaggtctagggtctcactggctcactgacagactaggag

SEQ ID NO: 92891 - DNA, 95 bp, Mus musculus
ttgccagtgtagtcatgtgatgctcctgcctatatgttatgtctagggtctcactggctcactgacagaccaggagagctggaagtatctagtga

SEQ ID NO: 92892 - DNA, 78 bp, Mus musculus
tgtgatgtcccaagtgaatgagtggccttgtaaaaagcatctctgactcactggctcccttgggaattcaatgtcaca

SEQ ID NO: 92893 - DNA, 65 bp, Mus musculus
cctggaggccagggaaggctgagggttttcagacagtggctgcctggctccttctctgggacttc

SEQ ID NO: 92894 - DNA, 80 bp, Mus musculus
aggaggtgcctgatgtacctgtggaacttaaacaggctccagcgagccagtgagagacagagacagagcagggagctctt

SEQ ID NO: 92895 - DNA, 66 bp, Mus musculus
ccctctgtctgtctgtctgtctgcatggcttgcagctgatgtgcacggccacagatcagtagtggg

SEQ ID NO: 92896 - DNA, 92 bp, Mus musculus
gggcaccgtgtagtttcggctctgtgtaatctgacactcactgtctcccccagtggccaggtccccatgaatgaaataaaacatgacagctc

SEQ ID NO: 92897 - DNA, 99 bp, Mus musculus
tgtactttcttgttgaagtcaaaggtttgctgacactagggaaggaaatttatttctttaattatgactactgtaagtgggccagtcagcggtagtgca

SEQ ID NO: 92898 - DNA, 106 bp, Mus musculus
gatgaatggctaggtagaactcatgtctttcctgggctaggagtgtctcaccctcactgagtattgaggaaagcttccccaagggcataatacctgagcttggatc

SEQ ID NO: 92899 - DNA, 69 bp, Mus musculus
ctctgagactcactctgtgcctgatactcctgcatgagtgctcagtccgtatagcatgggtgttaagag

SEQ ID NO: 92900 - DNA, 87 bp, Mus musculus
gctcagtgttgggggccgagttgggatagggactcttcagcaaccgagggcctctctcttgctctcagtgtccttgctgggttgggt

SEQ ID NO: 92901 - DNA, 81 bp, Mus musculus
tggtggtttgcctgtctgtttgtctgtctgaaggtgttggatccccctggagctggaactacagacagttgtgagctgcca

SEQ ID NO: 92902 - DNA, 111 bp, Mus musculus
gactctgcctctcaagtgctggaattaaaggtagagtgtgctctcccacactctgtgtgtgtattcttaagcctgtgtctctatttttaaattaacactactatcacagtt

SEQ ID NO: 92903 - DNA, 90 bp, Mus musculus
ggctgcatgtctgccgctcaaggaaggcagaacacagttcagtgcctgtgttctcctgggtgagaaacagcaggagctgggatggatgcc

SEQ ID NO: 92904 - DNA, 110 bp, Mus musculus
ccagctatacctcccttaaggtcatcgacttcacagccaggtttgttgacatcagatggactgataacaatgagatggggctctgaagtaaagtctcttggggccactgg

SEQ ID NO: 92905 - DNA, 78 bp, Mus musculus
gcttagttagtggcagaagtggagcacccactctcgcactgtctgagagtgggaagagctcatctcgcttacctgggc

SEQ ID NO: 92906 - DNA, 98 bp, Mus musculus
gctctagctggggcagggctggtgaagcagtttctacagtggataacactgctgcaaccactgtcacactgtcacaaagccctgagtgccagcactgc

SEQ ID NO: 92907 - DNA, 92 bp, Mus musculus
tgctgccatctgaaagacagtaaagacagagttcagtctgttggagccgagcagtctcccgctcttgtcaacacctcacgcagacagcagca

SEQ ID NO: 92908 - DNA, 78 bp, Mus musculus
ttgagacagtgtctgagttagtctgtcacttcctgtgtcacacaggctgacttcaaccttgttatcctcctgcctcag

SEQ ID NO: 92909 - DNA, 85 bp, Mus musculus
gagagctgcaccagaagaagaagagaggctctggtccttacctggaagtaggctgtattctctttcaagtgtgcttcaatgcagc

SEQ ID NO: 92910 - DNA, 132 bp, Mus musculus
ctttgtaaccctggctgactataactcctgtgtagactagactcactgaaccacctgcctctgtgtctgcctctggagcactagggttaaaggcacgcactaccacacccagcaacgggggcccacagagcc

SEQ ID NO: 92911 - DNA, 62 bp, Mus musculus
aggattctgggtgagggtgtggctcagtggtgaagagcactgactgctcttgcagaggacct

SEQ ID NO: 92912 - DNA, 123 bp, Mus musculus
atgttttatatatatatgcatgtgtgtgtatgtgtatatatatatatgcatgtgtgtgtatgtatatatatatatgcatgtgtgtatatatatacatatatatatacatacatatatatatat

SEQ ID NO: 92913 - DNA, 89 bp, Mus musculus
gctaagaatcagcctgtggagctggtgagataactcagtggttaagagcactgactgctcttccagaggtcatgagctcaattcccagc

SEQ ID NO: 92914 - DNA, 70 bp, Mus musculus
aagaatcagaactgttagcatgtacgcatgcatgcatgcatgcatgcatgtgtgtgtgtctgtctgtctt

SEQ ID NO: 92915 - DNA, 88 bp, Mus musculus
tagatgtaagtgtcctggagtagtaggttgtaatcttgtgtacggacaagagtgaatatgagctcaggctgcccagactcagaccctg

SEQ ID NO: 92916 - DNA, 108 bp, Mus musculus
acctactaaagagcctgcctgtgtcctgtgccttccaactgtcttacactcactccgagactaaaaggacacaggatagctggccctccttcctgtcttatggtaggt

SEQ ID NO: 92917 - DNA, 67 bp, Mus musculus
gctgggggctgactttgattctcagaagagtcgttgagactctcagagactcaatggggccttgggt

SEQ ID NO: 92918 - DNA, 79 bp, Mus musculus
tcctggaactcactttgtagaccaggctggacctgacctcacagagatctgtctgcctctgtctcccaaattgctggga

SEQ ID NO: 92919 - DNA, 78 bp, Mus musculus
actaaatatgtagaatttatatgtatatatgtggagtttgctccatccaccagatgtacgtgtacatgcatgtcctgt

SEQ ID NO: 92920 - DNA, 79 bp, Mus musculus
acatacacacacacacacacacaaagtggttggagctctgccccatccaaccaaagtgtatatgtatatatgtctatgt

SEQ ID NO: 92921 - DNA, 82 bp, Mus musculus
ggtggggcatagggccatccttgggagaggatcatgtttggtcttcccacctgcctctctctctcaggctctctacctcccc

SEQ ID NO: 92922 - DNA, 67 bp, Mus musculus
ggtggtggtggtggtggtgaagcggggagggctagaggactctcagtcactgccacggtggcgcacc

SEQ ID NO: 92923 - DNA, 91 bp, Mus musculus
tgtgtagggtctgggccagtggcctaaacagagaaaaacgtggtgacctgagtgtgtcactcactaggttccagtccacaggcccagcaca

SEQ ID NO: 92924 - DNA, 78 bp, Mus musculus
acagtgtcccggagctgatggtacggtctatgcaagtgtgctcattagctggtccttacagtctgcctgagtcactgt

SEQ ID NO: 92925 - DNA, 84 bp, Mus musculus
gctccaccagcgtgctaatggggagtgtagagtttgaactccatagatgttctcatctctgtgtgtgtcagggtgtgtgtgggt

SEQ ID NO: 92926 - DNA, 86 bp, Mus musculus
tatgtgcatgtgtgtgagtgttcatgagtgtgcacatgtgtgtgagcatgtgcatgggtatgtgcacatgtgtgtgtgtgtacgtg

SEQ ID NO: 92927 - DNA, 114 bp, Mus musculus
gggggtgggctttgaggttttagaagcccaagccaggccccgtcactccctctctccaagttacagattagatgtaagctctcagctagtgcttctgccccacgcctgcctacc

SEQ ID NO: 92928 - DNA, 113 bp, Mus musculus
ggcagttctctatctgccgtgttcctgtgcactttgtggtatactaaacaaatctatttttgttttaaagactgggtgagggctggcgagatggctcagtggttaagagcgcc

SEQ ID NO: 92929 - DNA, 76 bp, Mus musculus
agacagacagaaccgagtatgctagattttattcattattttaaataggatcccggtatgtgggttttggctagct

SEQ ID NO: 92930 - DNA, 104 bp, Mus musculus
tatgtacacatgtgtatatttgtatctctatgtgtttatatgtgcatattttgtgtgtgtatatgtatatatttcttacatgtctatagttatgtgtgtgcata

SEQ ID NO: 92931 - DNA, 69 bp, Mus musculus
agctgtgcatcagatgggcaagacagaaaggggctccccaggcatctgtctctctctgctgctgctgct

SEQ ID NO: 92932 - DNA, 101 bp, Mus musculus
actgttcattaacatttcacccaccgaatgattccttaacacaggtagacagaacactgaatggagagggggttccagaggtcagatgatgcaaacgcagt

SEQ ID NO: 92933 - DNA, 101 bp, Mus musculus
cagggagggggcttatgtggcttgccaagtgtcttggtctgtctgcgctgctgtgacagaagactgttggctgagtagtttgttaagaacaattatctctg

SEQ ID NO: 92934 - DNA, 108 bp, Mus musculus
tacacctcaataccaggacgcagaggctgaggtagaagaatctttagtttaaggcctatctgggctacaaagtcagccttgcctcaaaaatcccaggctggggatgta

SEQ ID NO: 92935 - DNA, 70 bp, Mus musculus
gggagtgcctttgagttgtcagtgaggtcagagagagtgggagcactgactgacatacaggggcaaattc

SEQ ID NO: 92936 - DNA, 83 bp, Mus musculus
gcatactgctcagcctctccctctgagtgtggtcacagacagacagatagacagcaggactcagggaagtaagatcagtaggt

SEQ ID NO: 92937 - DNA, 68 bp, Mus musculus
cacacaatgactgcagaggcagaggagggcgtcagatctctttgtgtatgtgtctctgtgtctgtgtg

SEQ ID NO: 92938 - DNA, 73 bp, Mus musculus
gggaggggggctggtgcgatggctcagcatgtaagagcactgctcagcggttaagagcactgactgctcttcc

SEQ ID NO: 92939 - DNA, 84 bp, Mus musculus
gatcgtggtgatggagcaagtgcagatagttcttaagagtggccagggctttatcagatctgtctgtctgtctgtctgtctgtc

SEQ ID NO: 92940 - DNA, 63 bp, Mus musculus
gggtgaccattgaaagaactcagtggggaaacccccactcagctcccgattcggcgtgtaccc

SEQ ID NO: 92941 - DNA, 85 bp, Mus musculus; identical to SEQ ID NO: 57439

SEQ ID NO: 92942 - DNA, 69 bp, Mus musculus
ataaggtgtgtatgagaagctctgtgtgtcacagacacacagaaattgtttactattttcataaattgt

SEQ ID NO: 92943 - DNA, 70 bp, Mus musculus
gttgtgtcagtctgacagtctgacattgctccagaaggtgggactttaactttcagtagctgagtataac

SEQ ID NO: 92944 - DNA, 98 bp, Mus musculus
tcccactcaggaatctgctgaacacaatgctgcattctctctctggctgaactttgttggctacttctgcaatcatcagcagaaagtcttcagtgtga

SEQ ID NO: 92945 - DNA, 58 bp, Mus musculus
tccattccagggtcactcactgtctctcctgacccctggctgtgaccctggtcctgga

SEQ ID NO: 92946 - DNA, 61 bp, Mus musculus
atggttagtcaggcttctctaccggacccacatctgtgtctctgcctgcctgactacctat

SEQ ID NO: 92947 - DNA, 81 bp, Mus musculus
gataatgggtgacctgtctgtcagtcagtctagccaggaagtggcctagggtgtggcctggaggagagggaattagtgagc

SEQ ID NO: 92948 - DNA, 79 bp, Mus musculus
gaggggatccagctgtggacacatggacatagacctcacccagggtcactgtcactgtggataacttctgaattccttc

SEQ ID NO: 92949 - DNA, 113 bp, Mus musculus
ggttaaagaagaactagtgggggctggagatatggctcagcggataagagcactgactgctcttccaaaggtcctgagttcaaatcccagcaaccacatggtgactcacaacc

SEQ ID NO: 92950 - DNA, 88 bp, Mus musculus
tgtgcatatgtgtatataagtatgtgtgcatatgcatgtgcacatgtgtgtgcatgtgtgtatatatgtctgtgtgcatatgtgtgca

SEQ ID NO: 92951 - DNA, 95 bp, Mus musculus
catgtgtgtgcatatgtgtgtgtgtgtgtatatatgtgtgtacatgtatgtgtgtgcacatgtgtatgtgcttgtacatgcatgcctgtacatat

SEQ ID NO: 92952 - DNA, 65 bp, Mus musculus
gtacatccaacatagaatgtctcccgtagcaccctgcgggtgtgtcagtttctctgtgggtctgc

SEQ ID NO: 92953 - DNA, 82 bp, Mus musculus
gctctcccactcacttgctgtgtgactctgggggaagctccacccccattctggatcacattttaaatgaggacatgagggt

SEQ ID NO: 92954 - DNA, 64 bp, Mus musculus
acagagagcagagactgaggtgtagcttctccgtcacgctggcctccgtttccctcttccctgt

SEQ ID NO: 92955 - DNA, 100 bp, Mus musculus
ttccttacttgggcatagtcaacaaaccgatctcttggctgggggatgtgggctgctctctgtctgtcagcctcatggtactatgacaaaatactggagt

SEQ ID NO: 92956 - DNA, 108 bp, Mus musculus
gacagagctgggtctctctcctttgctagcattggccgggggctggggcagcccaagtcctctctggctctgacactggcatggggatcagggggacaaactcaggtc

SEQ ID NO: 92957 - DNA, 73 bp, Mus musculus
gacccactcatagtctactttagtgtgtcgcgtctgtacacacagacccactcacggtctactttagtgtgtc

SEQ ID NO: 92958 - DNA, 74 bp, Mus musculus
ggtatttcattgtatgtacacagacagacagacagacagacacacatgtgcatgtatgtgtgcatgaagatacc

SEQ ID NO: 92959 - DNA, 95 bp, Mus musculus
taagagtatggcactggtataattgagtcctcagtgcagaatctgtctaaagtagggaggatatatattatggagtttgtgcctcaatactctta

SEQ ID NO: 92960 - DNA, 94 bp, Mus musculus
ctgagttctaaggtccctctcttctctctgactcttcctaccttttctgattgccctgaagtgccagggagactgggttctcattccagctcag

SEQ ID NO: 92961 - DNA, 91 bp, Mus musculus
catcagctcctgcaaagacagggaaacaggtagaggtctctcacacactcatattgggatctagatggcccagatttgtcggacagctatg

SEQ ID NO: 92962 - DNA, 68 bp, Mus musculus
acggtgtaagagtggagacagtgagctgagtacaagcatacatttgttctctctctgctcttgattgt

SEQ ID NO: 92963 - DNA, 73 bp, Mus musculus
cctggcctgtgacattctgtgtgtctgtctcccagtggggatcagagctcacagtgtgtgtgtggaggtgggg

SEQ ID NO: 92964 - DNA, 59 bp, Mus musculus
tttctcccttctgtcgctgtggtcggagtatttttttttcatagtgataggaatagaaa

SEQ ID NO: 92965 - DNA, 81 bp, Mus musculus
gagagggagggagagatgacatcttcccagcccagttatatagtgggggcacacctctgtctctgtctctcccgctgtctc

SEQ ID NO: 92966 - DNA, 62 bp, Mus musculus
agagggcccagcacagacccatgcaggcgctgtggtggcctcttcagtctctgtgagcccct

SEQ ID NO: 92967 - DNA, 60 bp, Mus musculus
ctcgctcgctcgctcgttcgctcagtgtatccatcagagcccttgggtctgcgcaccgag

SEQ ID NO: 92968 - DNA, 76 bp, Mus musculus
gatgcgcatatgtatatgcatgccacatacacatgtgctcacacatgtatgcatgtatgtatgtatgtataccatc

SEQ ID NO: 92969 - DNA, 57 bp, Mus musculus
gccaccaagcacagttaggctggactggtgccgcctgcctgcctgcctgcctgcggc

SEQ ID NO: 92970 - DNA, 95 bp, Mus musculus
tccttaaagggatctcggggcaggtgagaggtgagagggctcagcagaaaaggcagcttgctgacacgctgactgcctgagtttgattcccagga

SEQ ID NO: 92971 - DNA, 95 bp, Mus musculus
ggtcaccggcagataagaggcctagctgggaacaggatgcaaatgaatgcaaagctgagacacacacagagagagactcacagctgaccggggct

SEQ ID NO: 92972 - DNA, 89 bp, Mus musculus
gttttatatacatatacatatatagatatgtgtgtgtatgtgtatatatatgcatacacatatatctatatatctatatgtatgtaagc

SEQ ID NO: 92973 - DNA, 75 bp, Mus musculus
ctggttgctgtgttgtcaaagagcacccatgtttggggagccctctctgtgtgtgactcattgccaggcatttgc

SEQ ID NO: 92974 - DNA, 74 bp, Mus musculus
ctcagcacgttacagacactctctcaggtgtgtcacacccctgtgaagacagcattgtccgtaccctgctagag

SEQ ID NO: 92975 - DNA, 82 bp, Mus musculus
gcctgcctgcctgcctgcctgcctgggcaacttcacaaaaagaaatgaagaactgggccaggaagatggcagagtgcagagt

SEQ ID NO: 92976 - DNA, 115 bp, Mus musculus
ggattgtgcagatgtggatctcaggggaaaaagggagactgggtatagtgagtgacctgactccgtgcacggatcgactggagcccttgatggttgcgcacctgatcagtgaccc

SEQ ID NO: 92977 - DNA, 61 bp, Mus musculus
gaggtgactctgcctatcaccagtgagcttcgaatctgactggaagatttcaggtcccctc

SEQ ID NO: 92978 - DNA, 75 bp, Mus musculus
ggcccctcctccctcagattctctgtgcctcagtttccctggagaataaggataccagattcagacagaggggtt

SEQ ID NO: 92979 - DNA, 82 bp, Mus musculus
tggtctctctgtctctctcattttaattatgtatgtatgtgtgtgtgcgcacacatatgcacaaagatgcccacagcggcca

SEQ ID NO: 92980 - DNA, 78 bp, Mus musculus
agcccttgaacttccagggcttgtcctgtctctgcccctgtctctcagtagaagccctggatctcggcttcaaggtct

SEQ ID NO: 92981 - DNA, 56 bp, Mus musculus
tagtgacaggcgacagggccaaggtcagctcacttgtctctgtgtgtcttttactg

SEQ ID NO: 92982 - DNA, 85 bp, Mus musculus
aggttgaggcgtgggtggcctggagtctgcgtggagagtctcttgtggctctccctgtcactgacagccatcaagcacctcacct

SEQ ID NO: 92983 - DNA, 105 bp, Mus musculus
caacttgctccttggtcatgttttgtgcaggaatagaaaccctgactgagactgtctctgacagtgaagtgagctgcagaaaggtgagcagaggggaggtggttg

SEQ ID NO: 92984 - DNA, 86 bp, Mus musculus
gaccacatcaatggctggcaggtgtgtgtctctgagtctcattgggtcatggtggggcacggacctctgtcggtgacatgagggtt

SEQ ID NO: 92985 - DNA, 70 bp, Mus musculus
ccctgctcttctgagtgtctgctcctagggggctgggcagcaacatagagctctcagaagagtgtgaggg

SEQ ID NO: 92986 - DNA, 118 bp, Mus musculus
tggaggcatgggaggaaaggaaaggaaaccagggagggcctcctggaggcagaagcatgagagcacaagcagccagtctatgagccctgacctcctttctcctccacctgcacagcta

SEQ ID NO: 92987 - DNA, 127 bp, Mus musculus
gccaaaggcccgtctttcaaactatcagagtgggtgtgagcaccccagtcaggttttgacaccctcagtggctctgtctgggcctccttggcctcagcaataaagcaaggatctagaacatggctac

SEQ ID NO: 92988 - DNA, 91 bp, Mus musculus
caggggctgcctcagtggtagaaggaaggctcagccactcacaatcctctgtgaccttcactgggtcactgtcaccctgagggggcttctg

SEQ ID NO: 92989 - DNA, 78 bp, Mus musculus
gcatttactttgtacatgtatgtatatatatatgtatgtatgtacttcctatgtgtgtgtacatatatgtccacatgc

SEQ ID NO: 92990 - DNA, 120 bp, Mus musculus
tctcagtagagcacactgacacactccctggaatgagtctgtgcaagtgcatcttcatgtgagggggggagcactcagtatgaaccctccagtcagactgtcagtccaaaactccagaga

SEQ ID NO: 92991 - DNA, 102 bp, Mus musculus
ttataaatatacactgaagaggaggagaatgaattaaaaccaagtatgattacatatgtaaaaatgtatggtgggattctctgaactgtcaagtagttgtaa

SEQ ID NO: 92992 - DNA, 115 bp, Mus musculus
gttgctgatcttctgatactccttcagtgactcccgtaacatcctctctctctcagtcttactctgaacttgtcgggaacgctgaaggagctcatttgcctaaagagaggacaac

SEQ ID NO: 92993 - DNA, 120 bp, Mus musculus
gccagagtaagaaacaacttgggggctggagatggctcagaggttaagagcactgagtgctcttccagaggtcctgagttcaatttgcagctgccacatggtgtttggtgccttcttctg

SEQ ID NO: 92994 - DNA, 73 bp, Mus musculus
gacagggaggagtcagggaggaccacctccctcgtacatcatggtctctccctggctctcttttaaacctctc

SEQ ID NO: 92995 - DNA, 80 bp, Mus musculus
attaggtagctagtagtcatttatcattgtcattgtcacatcaaggtgtcacagcacagtgtgctgaggggctgcagaat

SEQ ID NO: 92996 - DNA, 81 bp, Mus musculus
gatgggatcctgggatgagactgagctgagagacacctctaaaccctccatccctcaagctctgccttcttcccctctcct

SEQ ID NO: 92997 - DNA, 73 bp, Mus musculus
gtatgtatatatatgtatgtgtatgtatatatgtatatacatgtgtgtttatatatacatatatacacataca

SEQ ID NO: 92998 - DNA, 74 bp, Mus musculus
tgaaactaagacgggctggagagatggttcggtggttaagagcactgactgctcttccagaggtcctgagttca

SEQ ID NO: 92999 - DNA, 94 bp, Mus musculus
gggctatacagagaaaccttgtcttgaaaaaccaaaaaaaaaaaaaaaaaaaaaaaattgaggggtatcttctcgggatacaggtttctggtcc

SEQ ID NO: 93000 - DNA, 97 bp, Mus musculus
acatgggtaagattcctactatgtcactcactatgtcactcgcagataatgtggccttgggctagtcatttctgtgcctgtgttttctcagtggtga

SEQ ID NO: 93001 - DNA, 112 bp, Mus musculus
agtggtaagattacagatgtggggggctggagagatggctcagtggttaagagcactgactgctcttccagttcaattcccagcaatcacctgtaatggggtttgatgcact

SEQ ID NO: 93002 - DNA, 69 bp, Mus musculus
gggtggggcttcatgagtccagacattttttttttttctgagacagtgtttctctgtgtagccctggct

SEQ ID NO: 93003 - DNA, 69 bp, Mus musculus
caggacatgtcatctcagaaggcagaagatggggctcccaatctctcactctgtgcatgaccgtggatg

SEQ ID NO: 93004 - DNA, 107 bp, Mus musculus
cctggataccttgcaataatggatccctgtctatccactgcctcaggcttgatcagagtagaaactgaggcatgcagagagaagagacttgtttagggtcacccagg

SEQ ID NO: 93005 - DNA, 80 bp, Mus musculus
ttcccatgcagagaccagaggcctgctctattgatccctaacttattcactcgagtcagagtctctcactgaacctggag

SEQ ID NO: 93006 - DNA, 100 bp, Mus musculus
gatgttctttctttcacatgcatgtgtgtatgtgcatttgcatgtgcgtgtttgcatatgttcccagttgcatagaggcatgaggttgatgtaagaaatc

SEQ ID NO: 93007 - DNA, 86 bp, Mus musculus
gtgagccttgcgtgcagacttgtctgggtcagaagctacatttaggatagtggagccctgaacctacaagagtccttcagggtcat

SEQ ID NO: 93008 - DNA, 122 bp, Mus musculus
ccagctgttctgcggcctgctctgagctaggtctgttgagttgaggtctgaccctgcctccctctatggggggttgcaggcctgggataaccttggccttgctccctgccggagcctggaat

SEQ ID NO: 93009 - DNA, 75 bp, Mus musculus
tcacagggtacatgttgggcatccctgttagacttcttactgtctgtcatctgtctgactgtttgtctgctgtga

SEQ ID NO: 93010 - DNA, 76 bp, Mus musculus
ggttggatttaacacggtcagtgaatctctctgtggccagccattgagatttcctatgtggtcgtagaactcagcc

SEQ ID NO: 93011 - DNA, 58 bp, Mus musculus
cacaaggagtcactgtcttcagttgtgtgcccactgatgaccccaagagactccagtg

SEQ ID NO: 93012 - DNA, 65 bp, Mus musculus
gggaagtgaggtaggacagtggagaggcatgttctgtctgtctgtctgcctgttttattcttctc

SEQ ID NO: 93013 - DNA, 84 bp, Mus musculus
tccttgttaagaaaattctgaggggttggagagatggctcagtggttaagagcacagactgctctagccagacagtggtaggga

SEQ ID NO: 93014 - DNA, 87 bp, Mus musculus
gttatccttttactgatgtctagaagaattctgctgtggtctgaaaacagatactgtatgattttatattcttgtaaatggattgac

SEQ ID NO: 93015 - DNA, 104 bp, Mus musculus
agttcactcagcaaatggtgggctgggctctgccgatttagttgtctggctccacgacgagtatccagtcagtgtaacttcttattattactgccacgtgaact

SEQ ID NO: 93016 - DNA, 82 bp, Mus musculus
gcccactgccactgtccctctgtcaccttaaactagaattgtgtgtcctggggaatggagcacagagaagcctggctgggtg

SEQ ID NO: 93017 - DNA, 88 bp, Mus musculus
gctcacaaccatctgtaatgggatctgacgccctcttctggtgcatctgaagacagcctcagtgtatttatttatttatggagtgagc

SEQ ID NO: 93018 - DNA, 88 bp, Mus musculus
gtcaagacaatctcccacagacagtctcagacacaaatgtgatataggtgtgtcttagggttttactgctgtgaacagacacaatgac

SEQ ID NO: 93019 - DNA, 71 bp, Mus musculus
gtctgttcacagcagtaaaaccctaagacacacctatatcacatttgtgtctgagactgtctgtgggagat

SEQ ID NO: 93020 - DNA, 112 bp, Mus musculus
gcttttattcttaaatttgtttgttatccctctgtgtgtgtgtgtgtgttagagagagagagatagacagacagacagacagacagacagacagacagacatagagtcttag

SEQ ID NO: 93021 - DNA, 135 bp, Mus musculus
gaggtcatgtgtgagctctctgtaaggtgtgacatgtgtgtgagctctctaaggtgtgacatgtgtgtgagctctctgtaaggtgtgacatgaacttgggctccttctttgcttctgtcttcacctccatatgga

SEQ ID NO: 93022 - DNA, 103 bp, Mus musculus
gctattttctaacccaggtttagtggcacgagccttcattccgcactccacctttgactccaggactccgggaagaggcaggtggaactgttgagttagatgc

SEQ ID NO: 93023 - DNA, 97 bp, Mus musculus
ctgggacgtttaaaaaatctggataaagggctggagagatggctcagtggttaagagcactgactgctcttccgaaggtcctgagttcaaatcccag

SEQ ID NO: 93024 - DNA, 115 bp, Mus musculus
tggtctaaggacttccttgaggtgctgatgagatggctcagcggttaagagcactgactgctcttccaaaggtcctgagttcaaatcccagcaaccacatggtggctcacaacca

SEQ ID NO: 93025 - DNA, 76 bp, Mus musculus
gtctctgcaggtatcaggagggaccaggaggaacatcagaagttctaggctgtgtctctctcagtgaagcgaagat

SEQ ID NO: 93026 - DNA, 81 bp, Mus musculus
tgtgcatgctcctagtgaggcaggcagcgtgtttctctgcgctgtgctggatatgtgcctgcctgtctgcctgcctgccca

SEQ ID NO: 93027 - DNA, 57 bp, Mus musculus
gggtgcctgtgtgggtcttggggtgctgctcactgcctgactgtcacactggcactt

SEQ ID NO: 93028 - DNA, 57 bp, Mus musculus
ggctggagtcttgctgtccagctggcctggagtacagcagacacaagagagtcagcc

SEQ ID NO: 93029 - DNA, 94 bp, Mus musculus
aaagaaaataaaagggccggagagatggctcagtggttaagagcattgactgctcttccagagggcctgagttcttttttcttttcttttcttt

SEQ ID NO: 93030 - DNA, 98 bp, Mus musculus
gcagtatctcagtggaggattggtctctctctttcaggcagggtctctcactgaattaggagctctcccaggcggctttccctccactttgtctctgt

SEQ ID NO: 93031 - DNA, 88 bp, Mus musculus
atgtgtacacacatgaaatgtgaagaagttactgccaactccaccacaggacattagtggtagacttttattttatggaaatacagat

SEQ ID NO: 93032 - DNA, 86 bp, Mus musculus
agtaatctcatgccctctggcttctgtgtgggttcagctagtaggctgccctgctagatcagagaggagagtgacgccaggctact

SEQ ID NO: 93033 - DNA, 115 bp, Mus musculus
acaacattcctcaatggcctttgaaaacaagtagtggtatgagaactgttagtgcatctgcttttgggtcttattgagagtaaacatttgtgtccttgtctttttgccttgttgt

SEQ ID NO: 93034 - DNA, 93 bp, Mus musculus
gcaggaagataaacactgggctggagagatggctcagccgttaagggcgctgactgctcttccagaggtcctgagttcacttcccagcaacca

SEQ ID NO: 93035 - DNA, 69 bp, Mus musculus
gctggagagatggctcagtggttaagagtgctgcctgctcttccagaggtcctgagttcaaattccagc

SEQ ID NO: 93036 - DNA, 77 bp, Mus musculus
gtgtgtgggaatcagagaacagcacgggtgctagttcctgccttctaccttaagactgtctctgcctgtctcaccac

SEQ ID NO: 93037 - DNA, 110 bp, Mus musculus
cctcccagatgaaagaagacgactgtgagaggccagattcttgagggtggtcttgaactcactctcactcagtcattcaagtgcccgtcttgctatgttgtccagggtgg

SEQ ID NO: 93038 - DNA, 75 bp, Mus musculus
tgtgccgctcaatcacagagaagacagagctcaggagctcctgtcttatggctgtgagctatgacccccgagcca

SEQ ID NO: 93039 - DNA, 110 bp, Mus musculus
tctatgcagcaagttccaagacagccatgattacatacaaagactattttttttcttcaagacagggtttctctgtgtagccctagctgtcctagaactagctctgtaga

SEQ ID NO: 93040 - DNA, 76 bp, Mus musculus
tgacagtccttgacctcctgtgttaacctcaatctgaacaacagggtgaggacacaggctgagtgagaggctgaca

SEQ ID NO: 93041 - DNA, 90 bp, Mus musculus
ggctcagagggtaaaacagtctacacagtgagactctgtctcaaaaacaaacaaggacagtcagtgctgaatgtgactgtactctgagtc

SEQ ID NO: 93042 - DNA, 66 bp, Mus musculus
gtgtgtgtgtgtgtgtgtgtggtgtgcaggaggcacctcgggcccctcactcactcactcactcac

SEQ ID NO: 93043 - DNA, 68 bp, Mus musculus
gggtttctctgtgtggccctggctgttctgcagctcactgtagagagtgagttcctacagatttgcct

SEQ ID NO: 93044 - DNA, 67 bp, Mus musculus
tgagggtggcagtctgcagcatccaggcctgggctggcctgggctgcctgcctggctgtgtgactca

SEQ ID NO: 93045 - DNA, 59 bp, Mus musculus
gcacacacacacactttctctctctctgaaagagagggagagaaagtgtgtgtgtgtgt

SEQ ID NO: 93046 - DNA, 77 bp, Mus musculus
ggaagttcttgggctggagagatggctcagtggttaagagcactgacagctcttccagaggtcctgagttcaaatcc

SEQ ID NO: 93047 - DNA, 73 bp, Mus musculus
gtctgtctgtctgtctgtctgtgtgaaggtatatgcacatgagtgcaggtgcccttggaggccagaagagggc

SEQ ID NO: 93048 - DNA, 79 bp, Mus musculus
gggagaaagctgactggcctatagacacactcactggcagtgtcatggcagcctataggaccaggacagcatttcactt

SEQ ID NO: 93049 - DNA, 122 bp, Mus musculus
tggggtccagctggagtggaggcctggtggtgaggagacctcttgtgttttgagtgtgtgtctctctctgccttgtgctttagtgggatgtcagatggagactggatggagaggcaaggagg

SEQ ID NO: 93050 - DNA, 61 bp, Mus musculus
tgtgcctgcctgcgtgcgtgcgtgcgtgcgcgagcatgtgtgtagctcatgttccaggaca

SEQ ID NO: 93051 - DNA, 72 bp, Mus musculus
tctgtctcttattcactctttgttcttggtgggtcaatctcacctggcaagagtcttcaaccaggagatagg

SEQ ID NO: 93052 - DNA, 111 bp, Mus musculus
gagaacagaaatgaaggctatgttcaggagtgacagctggcactgtgtcacacacacagacccagtgtggtgaccaggttggtgacaaactgcacgcagatgtaagttctc

SEQ ID NO: 93053 - DNA, 115 bp, Mus musculus
agatgaggtcttaccattatgcaaggtatagttagcatgtcagtcaggacactgagtgcagagagcaatgtggctgcctgaatcttttgctgctgctgtgttctgcagcctcact

SEQ ID NO: 93054 - DNA, 71 bp, Mus musculus
tgttgtgtattacataacctctgacctacactgacacagacagagacagaggttgaggataggccacaaca

SEQ ID NO: 93055 - DNA, 82 bp, Mus musculus
tctctgcccatggtgcctactgggtgttcctggatgaacaacagtctctgacactcagtttcctccgttctaaaagcaaaga

SEQ ID NO: 93056 - DNA, 122 bp, Mus musculus
gcctttgggatccattccccctcctgcatcgtccaacattagtagaagaggaggtgcctagtcttactgcaacttgatatgccatggctggttgatatccatcaaggcctgcccttctctga

SEQ ID NO: 93057 - DNA, 68 bp, Mus musculus
ggcaccaggagatgcctgagtgccaggctgcctgaaacacagatcctggcttccccaacactggtgct

SEQ ID NO: 93058 - DNA, 72 bp, Mus musculus
tgggctgtttatctggacagaatagacagtgggcacaggccccatcaggctacctagatgacagactcccca

SEQ ID NO: 93059 - DNA, 65 bp, Mus musculus
cagagcatcacagaagagggtctggactgaaggcaagagtccgagagctgtccatggatgctgtg

SEQ ID NO: 93060 - DNA, 124 bp, Mus musculus
catatattatattacatatacatatacattatattatatatacatatatattttatacacacatatatgtagtatatatgtatatgatgtatatttatatgtatatggtggtggtttgaatatg

SEQ ID NO: 93061 - DNA, 78 bp, Mus musculus
ggcatggggcaggtggaggagctagggcaagaaatggagggttctggttacagatgtgtctgtctctgtcaggggttc

SEQ ID NO: 93062 - DNA, 116 bp, Mus musculus
ttgcgtctgtatgtgtggtcctgggcatatatgtataatatatacatgtgggccagggagctgtgtctgtgtgtgtgatcctgggcatatatgtataatatacacatgtgggccag

SEQ ID NO: 93063 - DNA, 126 bp, Mus musculus
gttcttcagggctggggacctgttggatttttgtcaccattgtccttcggtggcagcctgtttcccagtccagtagagctaaggttctcttccctggttgccagctctctgggttcctgaggaagc

SEQ ID NO: 93064 - DNA, 109 bp, Mus musculus
ctatgggaagctctccctgtaccctcagagctgcgttttgttaagtctgtatcactctctaaatctaccaggtagtctctgtcagtacttggcctggagttgtacacag

SEQ ID NO: 93065 - DNA, 107 bp, Mus musculus
atacatatgtaggtatacgtgtatggatataagtattcatgtacacttgtgatattgatgaatcaggtagttggaactggccagtgtgtgtgtgtgtgtgtgtgtgt

SEQ ID NO: 93066 - DNA, 144 bp, Mus musculus
gtgtatgtatatatgtatgtgtgtgcaaatgagtgtatatgcacgcacttgtgtgtatgtgtgtgcacatgtgtatgtgtgcaaatttgtgtacatgcacacacttgtgtgtgtgcacatatgtgtgtgtgcaaatgtgtgtat

SEQ ID NO: 93067 - DNA, 79 bp, Mus musculus
tgtgggtgtgcctctgtgtgtgtctctgtatatgtgtgtctgtctctgtgtgtgtgatgcacatgttggtgtactggca

SEQ ID NO: 93068 - DNA, 87 bp, Mus musculus
ctccttctcagtgggcaatgatgctactctgtctgtgagtcaaagcccagcctgattccaggggcaacagagcacagcacggtggca

SEQ ID NO: 93069 - DNA, 58 bp, Mus musculus
ttcttaggaagtcccagggccctgaaagcctacctcagggtctctgtgtccctgagaa

SEQ ID NO: 93070 - DNA, 77 bp, Mus musculus
ggtcccaagtgtctgtctgaagactgtgaggggagagggttcctgagttccctcgctgtggaatgataaaagagacc

SEQ ID NO: 93071 - DNA, 59 bp, Mus musculus
tgcacttgagaaagatgtgtgtgtgtacatgtgtatacatacatatacagttcatgtca

SEQ ID NO: 93072 - DNA, 112 bp, Mus musculus
gcatcatgacagagtatgttaatgggagaccctcttttagtttattttttaaaaattaaattacatttatttgggggagggaacatgtgcatgtcactctgtgtgtgtatgt

SEQ ID NO: 93073 - DNA, 82 bp, Mus musculus
gtggctcctaaggtgctgtgtctgtgtgtctgatctccttgcttccctgtcccaccccatcactgctgtttcctggggctac

SEQ ID NO: 93074 - DNA, 73 bp, Mus musculus
gcccatcagtcactctctcacaagctggtgacagcgaccccatcagaagccttgcctgacagagtctgacggc

SEQ ID NO: 93075 - DNA, 60 bp, Mus musculus
gcatatgtatgtatgtatgtgtgtgtgttcctgtatatgtgtgtatgtatgtatgtgtgt

SEQ ID NO: 93076 - DNA, 76 bp, Mus musculus
tgtatatgtgtgtatgtatgtatgtatgtgtgtatgtgtatatatatatgtatatacatatatgtacatatatata

SEQ ID NO: 93077 - DNA, 87 bp, Mus musculus
ctgggcagctctgttagaagtcagagtcccgtttggtgcatagcccagtgtagggggttgcctgcctcagtctgtgagtgtgcccag

SEQ ID NO: 93078 - DNA, 83 bp, Mus musculus
ggtctgcaccaccctgacgtgtgtgtgtgtgtgtgtgtgcgagcgtgcacacacacacactctcaggcaggcaggcagctgcc

SEQ ID NO: 93079 - DNA, 82 bp, Mus musculus
atatatatatatacatttgtatgtatacatgtgtgtgtatttgtacatatacatatgtatgtatatgtgtatgtatacatat

SEQ ID NO: 93080 - DNA, 84 bp, Mus musculus
gtgtatgtgtatatatgtgtgtctgtgtgtatatgtgtatatatgtgtatatatatgtatatatgtgtatatatacacgttgta

SEQ ID NO: 93081 - DNA, 64 bp, Mus musculus
gtgtgcatgcgtgtgtgtgcatgcatatgtgtgtgcatgtgtgtgtgtgcatgtgtatgtgcat

SEQ ID NO: 93082 - DNA, 93 bp, Mus musculus
gagcccccttagctagatcagagcctagcccagtctgttctgagacactgtgagactcatttagaaaggctgtctctgtctctaatgtagctc

SEQ ID NO: 93083 - DNA, 70 bp, Mus musculus
tctgggaggcttcctgtaggaggtggcactgagccagcaggagtgactgactacagagggcactgccagg

SEQ ID NO: 93084 - DNA, 132 bp, Mus musculus
acacacatgtaacattatacagatggagcaaattgtacttatgcatttggaaatctaagtatatgtatatatgtatatgtgtatatgtgtgtatgtgtatatgtgtgtatgtgtatatgtgtatatgtgtat

SEQ ID NO: 93085 - DNA, 67 bp, Mus musculus
gcccatggatcagggttaggctgtcagccactgctccagtgctgtgctcccttctgactctgtgagc

SEQ ID NO: 93086 - DNA, 95 bp, Mus musculus
aggttatacatctctccccttgaagagacaactgtgtgtgctcagcactcatgagtctactagtgcttatctgtgagctaagagcccccatgcct

SEQ ID NO: 93087 - DNA, 212 bp, Mus musculus
gggcttttacagaggaacagcaaggagtaagggggaaaagtctctctatttctgtctgtctgtctgtctgcctgtctctctcttacacacacacacacacacacacacacacacacacacacacagagagagagagagagagagagagagagagagagagagagagagttaaggctttgtaaagtcttgcttttttgtttttttgttttttc

SEQ ID NO: 93088 - DNA, 71 bp, Mus musculus
gaactctcagggcttggagagatggctcagcggttaagagcactgactgctcttccagaggtcctgagttc

SEQ ID NO: 93089 - DNA, 98 bp, Mus musculus
gtcctcttcttccacgactctgtctcaacacttaataaactcactaatccggttcattctatctggttctgaaatgcttgttgtggtgaaatcaggac

SEQ ID NO: 93090 - DNA, 85 bp, Mus musculus
gaaggagaaagagatggatgctggtgcttaggaggagagatggatgctggtgctcagatcactgtctctgtcttattcaaggcat

SEQ ID NO: 93091 - DNA, 71 bp, Mus musculus
cgtgggatgcagggagtttgtatttctgagatttccgggatcctggggtctcaggctccctgacagttatg

SEQ ID NO: 93092 - DNA, 57 bp, Mus musculus
gatggtctctgcttttccaccagcttcctgactcatgtgagagagcagggagtcctc

SEQ ID NO: 93093 - DNA, 79 bp, Mus musculus
gggcatgtgtgcagtggacagactccctctgtgtgtgcagtagactgacactctgtgtgtgtgtgcagtggacagaccc

SEQ ID NO: 93094 - DNA, 103 bp, Mus musculus
tcagactgggtgactataggccagcacgctctctctttgactctgatgcaactctacagggagaagctagaccctgtgtccagccaagtacacatagacctga

SEQ ID NO: 93095 - DNA, 86 bp, Mus musculus
gtatatgtgtgtatgtgtgtatatatgtatatatgtgtgtgtgtatatatgtatgtatgcatgtgtatatatgtacatgcatgtgc

SEQ ID NO: 93096 - DNA, 82 bp, Mus musculus
tcactcttgccgtgaggtgtatgtgggagagatggtgtgggcaggcgcctcactcactcactccttggcacgagcgacctcc

SEQ ID NO: 93097 - DNA, 70 bp, Mus musculus
tctgtcatggaagccacttctgagtttctgtaagagaacagagcaagctcagagaggctaattgcataga

SEQ ID NO: 93098 - DNA, 57 bp, Mus musculus
tgagagctttgggaagagcctttatgggaccagactagactctgactctggctctca

SEQ ID NO: 93099 - DNA, 94 bp, Mus musculus
gcataagataggaggagactgaagttagtgtgcaggagaggaaacctatctcttgctttactaaagataacccagcactttctgtgatgtgtgc

SEQ ID NO: 93100 - DNA, 78 bp, Mus musculus
gaaaagcatttagggctggagagatggctcagaggttgatagcactgactgctcttccagaggtcctgagttcaattc

SEQ ID NO: 93101 - DNA, 72 bp, Mus musculus
gagctgcattcccaaccctggccaaagcaatctataaaagaaagtgtttatctaggcatggtggtgcacatc

SEQ ID NO: 93102 - DNA, 64 bp, Mus musculus
gagccagggagagacaacagacacagcaggctgcagtgggaggatggtttgagtctctcagttc

SEQ ID NO: 93103 - DNA, 138 bp, Mus musculus
gaagacagggaatgtgggtgtcaggtgtccagtgaaggcaccgaggaacacaatgaacccttgtctgtctctctgtctgtctgtgcagagctcagcaaatagcctctgtttgcctggctttcaaaggtggtggaagat

SEQ ID NO: 93104 - DNA, 86 bp, Mus musculus
ggtcccggacacccaggaaagggccagtgagaagctaaggcatgtgcctggctctgtctctctggcctgtgcccccgggctaggcc

SEQ ID NO: 93105 - DNA, 76 bp, Mus musculus
tggaggtgtgcttcagacgtgctcccttagtgctccctccagggggagagctagtagctagtctcctttagctcca

SEQ ID NO: 93106 - DNA, 117 bp, Mus musculus
ggccatttctgagaccgtgaccccgggctgcgtgctggactctgaccgtttcacactctgtctttcaggctttgggatccaccactgcagtgcctgtcacaggtcctcaggtcagct

SEQ ID NO: 93107 - DNA, 78 bp, Mus musculus
cgtgatccttatgaggccagcaccacggacagcaccagatatgggctcgcgtgcagtgtggctctgttcaggaccacg

SEQ ID NO: 93108 - DNA, 109 bp, Mus musculus
ggtttaacccctccattcaacactatgaatctgagatcatagagtgggcacaccagcaggcgatgctgcaggcctgggagatggctcagttgactgtgtgtttggcacc

SEQ ID NO: 93109 - DNA, 114 bp, Mus musculus
ggcttagcagttaaaagcactggggctggacacacggctcagcagttagcgcactggctgctcttgcagaggacctggattcggttcccagtggccacctagcagctcataacc

SEQ ID NO: 93110 - DNA, 72 bp, Mus musculus
ctcagtatgaaggagaccaggcttacctcgaactctcggagctctgtctgcctctgtctcccgagtgctggg

SEQ ID NO: 93111 - DNA, 97 bp, Mus musculus
tatgtgtatatgtttctgtgtgtatctctctgtgtgtatatgtccacatgtctctgtgtgtgtatctctgtgtatatatatatatatatatatatat

SEQ ID NO: 93112 - DNA, 91 bp, Mus musculus
ctaggaggctggctctggagactagctgtcatcctgtcctgtttcaggttcaaggatgattagctagagtcctccaaagcctttcatctgg

SEQ ID NO: 93113 - DNA, 85 bp, Mus musculus; identical to SEQ ID NO: 57439

SEQ ID NO: 93114 - DNA, 72 bp, Mus musculus
tatgcagagctcctcatgggcttggctgggactcttgtgtccctggatcccatctcagtctgtctctgtgta

SEQ ID NO: 93115 - DNA, 63 bp, Mus musculus
tttgctctagcagctggtcagctggtggtatcggtcacagaagttagtcagctatggggtgag

SEQ ID NO: 93116 - DNA, 74 bp, Mus musculus
ctatatgtatatgtgtgtgcatgtatatgtgtatgtctctgtgtgtgtgtctttgtgtatatgtatgtgtgtgg

SEQ ID NO: 93117 - DNA, 71 bp, Mus musculus
ggacttcccttctgtcactctgactctctagtactcttactacgacatgagtctggacctgaaggagagct

SEQ ID NO: 93118 - DNA, 69 bp, Mus musculus
gtttgtttgagactgggcttttctatgtagccctggctgtcccaggactctctcagtctctctgtagac

SEQ ID NO: 93119 - DNA, 82 bp, Mus musculus
gcatgtgtgtgcatgtgcatgttcgtgcatgtatatgtgtgtgactgtgtgtgtgtgatcacatgcatgtgtattcatgtgc

SEQ ID NO: 93120 - DNA, 69 bp, Mus musculus
gctggagagatgactctgaggttaagagcactgactgctcttccagaggtcctgagttcaattcccagc

SEQ ID NO: 93121 - DNA, 78 bp, Mus musculus
ggcagatctctgtgagctcaaggccagcctgatctacatatgaagttccatgccggtggggttaacagagaccctgtc

SEQ ID NO: 93122 - DNA, 79 bp, Mus musculus
ggacactgcctgtttatccagacacagtggaaggttttgggatctgccacacactgtgcctgtgaccatctcagggtcc

SEQ ID NO: 93123 - DNA, 64 bp, Mus musculus
ggctctcagagtcaggtctctcttattctctcttagagggaacaggctagagctttgggcagcc

SEQ ID NO: 93124 - DNA, 98 bp, Mus musculus
gcgtgtggacacatgacatgcacacacaccgcacggggttgctttagcatttgcaaaccactgagactctgagtgtgtaacatatgtgggtacgaagc

SEQ ID NO: 93125 - DNA, 127 bp, Mus musculus
tcaggaattctaaggaagggcttgggtggaccagggaatgcagtgctctggggctcagtgtaagcctctaggtgggtggctgaggtgtgtatattggtgcagatgtgcaataaccatggctgacact

SEQ ID NO: 93126 - DNA, 70 bp, Mus musculus
ggcacttaaggaacatgagagacacacaaggatgctcactacagtctgtgtgtcaatcacccatatggcc

SEQ ID NO: 93127 - DNA, 79 bp, Mus musculus
gtccgacacagctggctgggagtggtgagtctgggtttttaacctcttgatactttccctgtgggtctgtcagtctgtc

SEQ ID NO: 93128 - DNA, 97 bp, Mus musculus
ggagggacctcaagaagccacaacatccagctctacgccaagactgactgacggcctttggggtgaggtagtaggttgtatggttttgggctctgcc

SEQ ID NO: 93129 - DNA, 75 bp, Mus musculus
tctactgtctttcctgaagtggccgcaatatctgcagtggatacaacggcggccctggctggggagactgaggga

SEQ ID NO: 93130 - DNA, 151 bp, Mus musculus
cctgtggccagggtgggtggggagcggctgggcctcctccagaacacggacaccgcagggtgaggtagtaggttgtgtggtttcagggcagtgatgttgcccctccgaagataactatacaacctactgccttccctgaggcgcccaggga

SEQ ID NO: 93131 - DNA, 84 bp, Mus musculus
aggctacagtgtcttggggataaaagaggccactggctcagccttacaaggcccacaggcccctgtctctgtctctcatagtct

SEQ ID NO: 93132 - DNA, 126 bp, Mus musculus
tatgtgtgcatatgtgtgtctgtatatatatatgtgtgtacatatatctatgtatgtatatgtgtgtatatatatatagttgtgtatacgtatatatatgtgtgtatatagatatatgtttatatg

SEQ ID NO: 93133 - DNA, 83 bp, Mus musculus
catgctcagagtcggagtcagggcctgagctccctcccaaccctaccctgcccctgcaggccctgactctgactctgacagtg

SEQ ID NO: 93134 - DNA, 76 bp, Mus musculus
cactggccatttcctttccacttgggagcgcatgtgcatgtgcatgtgtgcctccatctgtgtcttggtctctgtg

SEQ ID NO: 93135 - DNA, 75 bp, Mus musculus
gtgtgtgtgtgtatgcatgtgcatgcatgtgtgtgttctctctgtgtgtgcatgtgcatgcatatgtgtatgttc

SEQ ID NO: 93136 - DNA, 69 bp, Mus musculus
gtgagagtctgacactgtctgctaggaggctcccaggggaggggaggggaaagaggttcagacagacac

SEQ ID NO: 93137 - DNA, 73 bp, Mus musculus
ctgggctgtcactgtctgtccctcaggctagggacactcttctccctcctgagtctagcattcacagctccag

SEQ ID NO: 93138 - DNA, 70 bp, Mus musculus
gagaggagagatgactcggaggttaagagcactggctgctcttccagaggtcctgagttcaagtcctggc

SEQ ID NO: 93139 - DNA, 83 bp, Mus musculus
taagctggtctcagactcacagagacccaggctctgcctccagagggctgggattaaaggcctgtgcaactgtatccagctta

SEQ ID NO: 93140 - DNA, 99 bp, Mus musculus
tctctctctctctctctctatatctgtgtgttaaatattttttttatatgtatatataagagagagagagagagagagagagagagagagagagagaga

SEQ ID NO: 93141 - DNA, 67 bp, Mus musculus
agtgtggctctcactgacagacttcaccaggcgaaggtcaccactgggaggtacaggaggctctgct

SEQ ID NO: 93142 - DNA, 144 bp, Mus musculus
gtggccgtggaggaagtgtgtcactggggatgggctttggggtttcaaatgctcaaggcaggtctgtgtgtgtctctctctccctgttgcctacggatctggatatagaattctcagctaggggccaggcgtggtggcgcacgc

SEQ ID NO: 93143 - DNA, 89 bp, Mus musculus
gatggatggctctcaggccagaactggccagctagctccctgtctgctcactgggtacttctcagtctctctgcctctgagcttctctc

SEQ ID NO: 93144 - DNA, 93 bp, Mus musculus
gctgctgctgctgtgtgtgtgtgtgtgtgtgtgtgtgtgtgtcacaggaatgtgagtatgggagagaatactaactgctgctgctgctgctgt

SEQ ID NO: 93145 - DNA, 89 bp, Mus musculus
ggcagtagcctgctctgagcctcttccatccattctgcttccagttgcctgcctgggtgtgtggctcttattcccatgtctctgctgtc

SEQ ID NO: 93146 - DNA, 78 bp, Mus musculus
gtatgcgtatgctagtgtgttatacacaggtgtgtttacatttattgtgtatataaacaggtaaaaagatatgtatat

SEQ ID NO: 93147 - DNA, 81 bp, Mus musculus
agttaaatcagccatgcattcgagaatacagcacatgtcacaatgatatattattcttttaatgctgtgtttgatttgatt

SEQ ID NO: 93148 - DNA, 106 bp, Mus musculus
tcctggccaggtactcagcatctaggtgccctttacctctcagtctctgtcaccttgcccaggagttgggtactaagtgccaagctcagaggaggaaccaaggact

SEQ ID NO: 93149 - DNA, 108 bp, Mus musculus
ctgtctgtctgtctgtctgcatgtgcgtttctgtgtgtctgtgtgtatgttgtacaggtacacacgcacactcacatgtacacacatgcaagcaaatgtcaacctcgg

SEQ ID NO: 93150 - DNA, 99 bp, Mus musculus
ggtttattcagcttacactttccatattgctgttcatgactgaagaaagtcaggactggaactcaagcaggtcagtgagcaggagctgatgcagaggcc

SEQ ID NO: 93151 - DNA, 97 bp, Mus musculus
ctgtcactgtctgtctgtctcatatatatatatatatatatatatatatatatatatatatatagatatatagatatatagatatatagatatatag

SEQ ID NO: 93152 - DNA, 72 bp, Mus musculus
gtatatgtttgtgcatgtttgtatatatgtctctctgtgagtatgtgtgcatgttcatgtgctcaaatgtgc

SEQ ID NO: 93153 - DNA, 118 bp, Mus musculus
tagggttcaatcacaatgacaacctcatggttttcctgccacaagtgagccacaggtataatggcactgcttgaaaacaggaagaaagagacttgttgtgtggagtgactgtcttcta

SEQ ID NO: 93154 - DNA, 116 bp, Mus musculus
tatgtgtttatgaaggccagagatagatgtcaaatgtcactttattttttgagacaggctctctcactgaatttgaagtttacgaattctcctgtctctgctttccttggtctatg

SEQ ID NO: 93155 - DNA, 110 bp, Mus musculus
gtgtgtgttcatatctggtgtgtatcagatgtacatgtatatatatatatgaatctggtgtgtgtgtgtggtgtatcttgtgtatagctgtatctggtatgtgtgtgtat

SEQ ID NO: 93156 - DNA, 76 bp, Mus musculus
ggcaatctgacagaggcatttttctccgttgaggttcctcttccccgaggtcagtctcagtttctgttaggttggc

SEQ ID NO: 93157 - DNA, 83 bp, Mus musculus
ggtgctctgggtatcaggggttgaggccttgggaacgcagcaaatgagcctgggtccctctgtgtcagttcctctagggcagc

SEQ ID NO: 93158 - DNA, 62 bp, Mus musculus
acagggagatacacaggcagctgtgcctggggactggtctgtctgtctgtctatctgtctgt

SEQ ID NO: 93159 - DNA, 74 bp, Mus musculus
tatgtgtgtatatgatgtatatgtatatgtatatgatgtatgtgtatgtatatatgtgtgtatatatacatatg

SEQ ID NO: 93160 - DNA, 96 bp, Mus musculus
gtctgccctcagaacatgcatgccaaactcctaactctttctgtctctctaattaatttgtgccaggtttcagttaagtgtttggtagagggagcc

SEQ ID NO: 93161 - DNA, 117 bp, Mus musculus
atacatagatgtttgatgtatagtatatgcatgatatatatatatacatatatatatatatgtgtgtgtatgtatatatatatacatacatatacacacatacacacacatacgtat

SEQ ID NO: 93162 - DNA, 85 bp, Mus musculus; identical to SEQ ID NO: 57439

SEQ ID NO: 93163 - DNA, 85 bp, Mus musculus
ccctacttggctgtgtgtctctgggtgtgtcagcacccatgctctggtggacgtttgacaactctggcccagcctcatggtgggg

SEQ ID NO: 93164 - DNA, 86 bp, Mus musculus
ggttgctaagtctcaggttctctctcagtgtgaccgagtaggatgtcacctgccatgctgggtgttcagagaagctgggaggcacc

SEQ ID NO: 93165 - DNA, 69 bp, Mus musculus
cccccttggctctggctccatgcttgtgtctgaaaggagagaggagactggatggtgaggttccctggg

SEQ ID NO: 93166 - DNA, 91 bp, Mus musculus
tcctacctatatgcgtgtgtctatctgtctgtgtgtcatatcccatatgtgcccagttgtctgcagaggtcagaagagtgtgtcaggggga

SEQ ID NO: 93167 - DNA, 72 bp, Mus musculus
ctggaatcttctcagtctgtcacccttttctgactacttggcaggtctgggtcgtcatgctaaagaggccag

SEQ ID NO: 93168 - DNA, 84 bp, Mus musculus
cttggttgaaacactcaggacactagtgagccgtgtgcatgtgtgtgtgcatgcatgtgtgcttccagagagaattgactgagt

SEQ ID NO: 93169 - DNA, 87 bp, Mus musculus
tgtatctgtctgtctgtctgtctatctaactatgagccttctggcctggaaagggttgtggcgggagcacagagcaggactgatgca

SEQ ID NO: 93170 - DNA, 102 bp, Mus musculus
atcatatatatatatgtctgcctatgtttatatcaatatattgatagttatctctaaattcctaatatattggtatctacatactgatatatatgtagagat

SEQ ID NO: 93171 - DNA, 114 bp, Mus musculus
agttcaaaggtgtggccatcttaagtgggtcagaaattgtggtctgctggagtccatctctctggctctcagagaaactcttatttaactgccctctgaagatgtcatcggact

SEQ ID NO: 93172 - DNA, 107 bp, Mus musculus
ggggaacgggcaggtggggcttccatgcctgagggtctctctcactgcccaaggacccagaggacctcagtgccttggaacatccctgtcaccttcctcccttcctc

SEQ ID NO: 93173 - DNA, 67 bp, Mus musculus
acagtctctgtctctgagcatagtcttgcacatgtgtaaggagcagggccagatactcaggggctgt

SEQ ID NO: 93174 - DNA, 109 bp, Mus musculus
cttatgctaaacttagaaatatgagattccacagtgctgtctgtctgtctgtctgtctggagccccacagccagcacagtgtcttttcagtcttggtaggagacaagag

SEQ ID NO: 93175 - DNA, 75 bp, Mus musculus
gctcaaggtctcagctgaagtggaatcaggagcccgccaagctggcttactgactcacttactctcagcacctgc

SEQ ID NO: 93176 - DNA, 97 bp, Mus musculus
caagggaacaagcatggttcaggaaggtggcttcattgctgttgggctcagcaaactgagatgtgtggcatacttttctggacatctcctctccttg

SEQ ID NO: 93177 - DNA, 103 bp, Mus musculus
gggaacacatattggggagctgtaggtctctagagagttagctgacaaggatacctgagaaggaacacaatcagatagaccagcaacttccaccccgaatccc

SEQ ID NO: 93178 - DNA, 107 bp, Mus musculus
ggccagactcccggacctccagagatgaagcactcacataatcagggaggtggcgttcggttactgatgtgagagaggtcattctggaagtgtgggaaccccttgcc

SEQ ID NO: 93179 - DNA, 80 bp, Mus musculus
gggtttgttcagcttccatgtgttcctccatctccggaatgaagtgtggaagggagctacacgagacggtgatgcctccc

SEQ ID NO: 93180 - DNA, 121 bp, Mus musculus
gagaggtgttcattggttccttatctgtacaaggcctggacctctgagagactcagtctgtgctgcagagtggctaagctgatgtatcctttccacctctgggcagtgccacttggggacc

SEQ ID NO: 93181 - DNA, 72 bp, Mus musculus
ttggaatcagaaatgcctgtggggaagcgggatacaaatgtcaggctgctttcttttgcaatttgatttgaa

SEQ ID NO: 93182 - DNA, 81 bp, Mus musculus
tggctgtgtatgtgctatatatgcagctgtgtgaatgtgtatgtcattttgtacatgtgtatttatagtatatgcatgtga

SEQ ID NO: 93183 - DNA, 77 bp, Mus musculus
cttcagactgcttttgtcccagaagagagtctcctcagagaaaagcttaaggaagagaggcagaacttcatctgagg

SEQ ID NO: 93184 - DNA, 62 bp, Mus musculus
gtgtgcttgtatgtatttatgtatgtacacatatttgtgggtcgttgtgcatatttgcgcac

SEQ ID NO: 93185 - DNA, 146 bp, Mus musculus
tatatatgtgtgtgtgtgtatatatatgtgtgtatgtgtatatatgtatatatatgtgtgtatatatatgtatatgcgtgtatgtatatatatgtatatatatatatatatatatatatatatatatatatatatatgtacacaga

SEQ ID NO: 93186 - DNA, 71 bp, Mus musculus
ggagcaaagtcagggttttcatgaacctggagcccatgcactgcattcatgaaagcagtcaatgtgtctct

SEQ ID NO: 93187 - DNA, 89 bp, Mus musculus
gtgagtctctgtgcatattgctacttacacaaagggtggacccacatactctgtgtatatctctgtagcccagttagggagatggtcac

SEQ ID NO: 93188 - DNA, 91 bp, Mus musculus
gcagtggcttcagtcagggctctggttcttttttgtacatttgcatgggcatccttaaagtttaccagcatagcttctgtaagcttctcgt

SEQ ID NO: 93189 - DNA, 117 bp, Mus musculus
gcatatttgagggaaaattggagtttaatataattacacttagagatgagacagatcacaattatgcttcagaggtggaatttttaattgtattatttaaaaccaagcccgggttgc

SEQ ID NO: 93190 - DNA, 65 bp, Mus musculus
gtaagttgtatgtgtgtgtgtatatctgtgtatgcacagagatacatgcatacatacatacatac

SEQ ID NO: 93191 - DNA, 85 bp, Mus musculus
tgcctagtgtcagacaccaagggtgtgagctgcttcctcaggatctgtctgtctgtctgtcttactggtgtctgactgactggca

SEQ ID NO: 93192 - DNA, 65 bp, Mus musculus
tggatctttctgtcctgttctctcactcactctgagtcacagtgacaggattggaaggacaccca

SEQ ID NO: 93193 - DNA, 74 bp, Mus musculus
gttcacttatgatgataaggggtctctgtatctctctatgatgagagtgttctctgtgtctccagatggtgaat

SEQ ID NO: 93194 - DNA, 79 bp, Mus musculus
gcttagcagagaatcagaacagagaccatgagacggagtccagagagagccatggtcactgtagagtgactgcataggc

SEQ ID NO: 93195 - DNA, 69 bp, Mus musculus
ggtccttgcctcccttctgttttctgtccacgctatgaagcatgacagagagcacacccggtgttgacc

SEQ ID NO: 93196 - DNA, 76 bp, Mus musculus
gtgtgtgtgtatgtatgtatatatattatatatatatgctatatatatgcatatgtatatatatatatatacaggc

SEQ ID NO: 93197 - DNA, 73 bp, Mus musculus
tagctggtttgattccgcaccttgggtctgatgtgcctgtcactgtcactgggtcaaatcaatgtgccggctg

SEQ ID NO: 93198 - DNA, 85 bp, Mus musculus
gcagccaccccgctcgctctctgtctgtgaaagaatatgattccacatccatgttctggaaaagccagttgctggagctgtctgt

SEQ ID NO: 93199 - DNA, 85 bp, Mus musculus
gaggtcagaggagataaggaaatgatcagagagagctctctggatgcagagctcctttctagacggctcagtgctaaatctcatc

SEQ ID NO: 93200 - DNA, 97 bp, Mus musculus
ctagagttataggtggttgtgagtcactgtgtgagtgctaggagccgaaccctggaaagagcaaccagtgctcttgactgctgagctgtctctctag

SEQ ID NO: 93201 - DNA, 81 bp, Mus musculus
tccaagctgtccatgggtccctggcctgctcagttctctctcactaacatgaagtgagctggctgtggatcaggacttggg

SEQ ID NO: 93202 - DNA, 111 bp, Mus musculus
catctactccatctgcaggctgctggggtgtgtggaggaactggtcctgccaaaccagctcagagaacacactgaagatgaaagcctgaagcatggctgtaatggaagatg

SEQ ID NO: 93203 - DNA, 106 bp, Mus musculus
ccatccacagagacacctggtggtgggtatccagggagtctagaactcctcactctgagtctttctctccctgggtctcctctgccctgggttttctctccttagg

SEQ ID NO: 93204 - DNA, 119 bp, Mus musculus
tctctgggtggtgattgtggatgaagtggccccaggacctagactcatagctcagtggttaagagcactgactgctctttcagaggtcctgagttcaaatcccagcaaccacatagtgg

SEQ ID NO: 93205 - DNA, 108 bp, Mus musculus
catatgtgtgtactgtgaatgtgttcatacatgtgcatatatctatatctatgtctatgtctatatctatatatgtatctgtgtggcataggtgggtacaccggtatg

SEQ ID NO: 93206 - DNA, 72 bp, Mus musculus
gtggtcacgtgtaatggtgggaggggcaacgggtgcatggagacaagtgtctgtctgtctgtatgtggcttc

SEQ ID NO: 93207 - DNA, 82 bp, Mus musculus
tattcttttatatgcggaattgagataaatatatgcatgtatatttatatgtatgcatgtatgtatgcatatatatggagtg

SEQ ID NO: 93208 - DNA, 93 bp, Mus musculus
ctctgacctctatatgcacgctatgactgatgttccaccccagtgaatatgaatatgtgtgtgtgtatatatatatgtaaatggtttcttgag

SEQ ID NO: 93209 - DNA, 112 bp, Mus musculus
agatctggtgacatgtggctgtagagatggctcagcacttaagagcactgactgctcttccagaggtcctgagttaaattcccagcaaccacatggtgacgcacaaccatct

SEQ ID NO: 93210 - DNA, 102 bp, Mus musculus
ggacttgtgagaccctttatgcctgtcacaggcagattttccttggaatctggacctctgtgactccctctgactatataggagcctctgagccaacagtcc

SEQ ID NO: 93211 - DNA, 64 bp, Mus musculus
gaggaggaggcttgtcactgggggtgagcttagaaaagcccttgtcagtctcagtctctctctc

SEQ ID NO: 93212 - DNA, 115 bp, Mus musculus
agttttatttattttctgtatgtgagtgttttacctgtatatatgtctgtactattcgtattcctggtgccttcagatgtcagaaaaagacaaggatagaagataccccagagct

SEQ ID NO: 93213 - DNA, 100 bp, Mus musculus
aatactgggaaggaaggcatccaagtattaacatttaatcatgcctaagaagtaagacatttgattttgttttacttaaaatgccttttacattagtgtt

SEQ ID NO: 93214 - DNA, 78 bp, Mus musculus
cacacacacactcacacacacacacattcaagtgtgcgcacagcaccttttgggttttgtttggtggtggtggtggtg

SEQ ID NO: 93215 - DNA, 120 bp, Mus musculus
ggaatgtggtgctacttctcattggggaacccgtctcttcttatttatttatttatttatttatttagttatttatttatttcgagacagtgtttctctgtcagaaatttgcctgcttct

SEQ ID NO: 93216 - DNA, 91 bp, Mus musculus
ggcatcggatcccattacatacagactgttgtgagccaccacatggttggcgggaattgaactcaggacctctggaagagggatcagtgct

SEQ ID NO: 93217 - DNA, 77 bp, Mus musculus
ctgacttcagacacaccagacacaccagaagagagcatcagatctcattacagatggttgctgggatttgaactcag

SEQ ID NO: 93218 - DNA, 110 bp, Mus musculus
ttttgctccatgtagtcatttaggaacctagataaaggaactatatcattaaaaatattttttaaaatttattttagggggctggagagatggctcagtggttaagagca

SEQ ID NO: 93219 - DNA, 78 bp, Mus musculus
gccatagtttctcactgcctctctgtcttaacaactgtaaaatccagggttcaggtaggttatagacccatgtatggc

SEQ ID NO: 93220 - DNA, 76 bp, Mus musculus
tcgcttctgtggttgtagcttttaatgcttctgaccttagtcagagtctgtgttactctggctaacacagaggagg

SEQ ID NO: 93221 - DNA, 82 bp, Mus musculus
cagcaacagagtaaacgagagaaaagagagccaccttctaagggggggggttcctctgggtcacttctctgtctctgtgctg

SEQ ID NO: 93222 - DNA, 83 bp, Mus musculus
gtgagccttgtggtagtaggaagcatgcatgctctggaaccgctcctggcctgctgtatcccagaagtctgcaacaagaacac

SEQ ID NO: 93223 - DNA, 65 bp, Mus musculus
ctcacaatggaagccctcagtgactgtcagtgtcttcgcgatttacgagggctttctttcgtggg

SEQ ID NO: 93224 - DNA, 85 bp, Mus musculus; identical to SEQ ID NO: 57470

SEQ ID NO: 93225 - DNA, 76 bp, Mus musculus
cctttttatttgtttgttttatttgcctgtttgttttctagagaggaaaaggtgtggagttggatgggtagagagg

SEQ ID NO: 93226 - DNA, 85 bp, Mus musculus; identical to SEQ ID NO: 57439

SEQ ID NO: 93227 - DNA, 111 bp, Mus musculus
gtttttgaagttttattgcattttggccagataggatacacagagtagcttcaatacttttgaattagtaaagacttatgttttgtctcaggatgtgattgcttttagaac

SEQ ID NO: 93228 - DNA, 69 bp, Mus musculus
ggagggagcaacgttcctgattttgttgttcactttcatggtgtaagtggtaggaaatgtactctctct

SEQ ID NO: 93229 - DNA, 85 bp, Mus musculus; identical to SEQ ID NO: 57470

SEQ ID NO: 93230 - DNA, 90 bp, Mus musculus
ttttgttcctgtgtctgtatgtgtctgttttagtcagggtttctattcctggacaaaacatcatgaccaagaagcaagttggggaggaaa

SEQ ID NO: 93231 - DNA, 90 bp, Mus musculus
gtgttgcacacagacagcacagaactagcccacacagacttctatcagaagtctttatgttgttatttcagttggtttgcttgtggatac

SEQ ID NO: 93232 - DNA, 97 bp, Mus musculus
aagtccatgttaccaccccttgtcatatgtgagaaggcagtgtgcatacgtgcagtatgctcctccttcacatgtgggaagctctctgttacagctt

SEQ ID NO: 93233 - DNA, 118 bp, Mus musculus
aggaagagaagagggctcctgtctagcagttctccaggatgtgcttccactaaaattcctttcttgtctggatggaggctttcctgagctgagacatggagatgagtttgtcaatcct

SEQ ID NO: 93234 - DNA, 85 bp, Mus musculus; identical to SEQ ID NO: 57439

SEQ ID NO: 93235 - DNA, 112 bp, Mus musculus
ggaaaaatgttgaagatgaatattgttcagaatttctgaaatacatgtgaatttgttctcataagttggcacaagttttatgtgaataataggaatctaagagatcatatcc

SEQ ID NO: 93236 - DNA, 86 bp, Mus musculus
gtgtgcatgtgtgcacaagtgtgtgtgtatatatatatgtacatatgtacatatgtgtatacacacacacacatacatatgtatat

SEQ ID NO: 93237 - DNA, 110 bp, Mus musculus
ggtattttactgtcatgtctgtctgactgcccgtctgtacatccacgtgtctgtctgtgtctatgtgaaggtgtcagacctcccggtatctgaaataacagttatgagct

SEQ ID NO: 93238 - DNA, 71 bp, Mus musculus
acatgctatcatatatacattatatatatatgtatatatatatgcacatatatgtatgtatatatacatgt

SEQ ID NO: 93239 - DNA, 76 bp, Mus musculus
ttatatacatgtatatatattgagagatatatgtatatatgtatgcatgtatgtatgtatgtatgcatgtatataa

SEQ ID NO: 93240 - DNA, 116 bp, Mus musculus
tctttttaatccaatgtgtatgtctggcttctttatcaaatatcaagtgtccatagacttgtgaatttctagatggatcttaagtccactcatcaacacgtctgtttttttgagga

SEQ ID NO: 93241 - DNA, 98 bp, Mus musculus
tcaatcacatcttctaacactgccactctctctatgccagtcgactcaaaagttatcaggagccagaggggggaaaaaggccagaaggggagtgttga

SEQ ID NO: 93242 - DNA, 70 bp, Mus musculus
tgagtgagagactgtacacactcagtgctaccccatcatgtagacacgagtgagtatcagtacacattca

SEQ ID NO: 93243 - DNA, 85 bp, Mus musculus
gcttttcaaacccttgagttccattgttgatggtagaatagtcctcctgtatcaagagtgtctgcacactgggtgctgtctgagt

SEQ ID NO: 93244 - DNA, 70 bp, Mus musculus
ccacattcctttaggtggagggcttgagttgtctgcagtcttaactctgtctctcactggtaggacttgg

SEQ ID NO: 93245 - DNA, 57 bp, Mus musculus
atatacattatatacatatgtgtatatgtatgtacatatatatatgtaaatgtatat

SEQ ID NO: 93246 - DNA, 61 bp, Mus musculus
tatgtgtgcatatatatatatgtgtgtatatattcacacatgtatataatatgtatacata

SEQ ID NO: 93247 - DNA, 117 bp, Mus musculus
cacggtattttgatgcaccttagttctcaaaaacgctgttgtattatataaatagatgcataagtatgtatgatgtacacatgctttggagagatcattaaattaagacaatttgtg

SEQ ID NO: 93248 - DNA, 173 bp, Mus musculus
atatgtatgtatgtgtgtgtgtgtatgtatgtatatgtatatatgtatgtatgtgtgtatacatatgtatgcatgtatatatgtgtatatatgtatatatgtgtgtatatatgtatgtatatatatgtgtgtatatgtgtatgtgtatatatatatatatatatataaaacac

SEQ ID NO: 93249 - DNA, 94 bp, Mus musculus
ggcagagactgctattggttgtggttgtaaacggctcattccgtctgatgaggctgtgatagaacagagagaacaccatggcggctaagaagcc

SEQ ID NO: 93250 - DNA, 110 bp, Mus musculus
tctcagaagataaccttgctaaatgtttctgtgtggaacataaaatatttcatttgttttctacctgtatttctctaatgttcccgcaaatataggttagctccctgtgg

SEQ ID NO: 93251 - DNA, 57 bp, Mus musculus
ggtcctgagtagatagtgagcaccctgtggcagctgctcagtagccctaccagtgct

SEQ ID NO: 93252 - DNA, 67 bp, Mus musculus
ctcaaaggtcacagtctgtcactgagggaagtcaaggaagaaactcaaggcaggaagtgaagcggag

SEQ ID NO: 93253 - DNA, 98 bp, Mus musculus
tggtgtatatatatacatatatatgtgcatatatatatacatacatacatacatacatacatacatatatatatatatatatatatatatatatacca

SEQ ID NO: 93254 - DNA, 87 bp, Mus musculus
ttgtttttttataaacttatcatgtgtatgttgttatatgagtatgctcagatgtgtcagagcacacgtgtggaagtcagaggacaa

SEQ ID NO: 93255 - DNA, 104 bp, Mus musculus
taggctgtcactttgcctttttagttttatgacaccttatttattgtttttcttagtgtctgtgctttaggtgtcctgtttagaaaggtcagtctgtctgtctg

SEQ ID NO: 93256 - DNA, 98 bp, Mus musculus
gtggagttttcagtctctcccactggcttcttttatggcatgatgtgacatcactctgcctcactgactgggatcagaatgactgagccaactatcac

SEQ ID NO: 93257 - DNA, 68 bp, Mus musculus
ctgagatgcctgacacctagacacacttattcagagtgactgccactctgactgacagccaggctcag

SEQ ID NO: 93258 - DNA, 115 bp, Mus musculus
tatgtgtgtatatgtatatgtgtgagtgtgtgaatacgtatgtgtatgtgtatatatgtatgtatgtgtatatatgtatgtgtatatgtatttaagtgtgtatgtgtgtaatgtg

SEQ ID NO: 93259 - DNA, 60 bp, Mus musculus
gggtaaaacgtcacctagcccttgttgctttgcaagactgaagtgggtgaccacacaccc

SEQ ID NO: 93260 - DNA, 75 bp, Mus musculus
tgaggtgctgggctgttagtagtcagagtggacataaagtcatgtcagtcaagatgagaatggctcacaagatca

SEQ ID NO: 93261 - DNA, 98 bp, Mus musculus
agcctgtgcaggtgttgtgtacgctgtcacaatctctgtgagtttatatgtttatatgactgatgatgttgtctcagagtcatccaccacctcaggct

SEQ ID NO: 93262 - DNA, 122 bp, Mus musculus
atcctggaactgttctgaagaccaggctggccttgaactcatggatctgcctgtctctctgccagtgctgggattaagaggtgcatcacatggccaggccaagacaaatgatttaagacagc

SEQ ID NO: 93263 - DNA, 83 bp, Mus musculus
gtgtatgtatgcatgtatatttgtgtgtgtgtctgtctcttgtgtgtataagtatgtatgcatgtatatgtgtgtgtgtgtgt

SEQ ID NO: 93264 - DNA, 83 bp, Mus musculus; identical to SEQ ID NO: 93263

SEQ ID NO: 93265 - DNA, 115 bp, Mus musculus
acacaagtatgcatatatacacaaacatatatgtgtgtacatatatatacatacaatgtatatgtgtgtatatatatacatatacacttctttgtgtatatatgcatacatgtgt

SEQ ID NO: 93266 - DNA, 89 bp, Mus musculus
tatacatactgtgtatatacatatatgtatatatgtatgtatacgaataaatgtgtatatacatgtgtatgtatgtatacatatgtgta

SEQ ID NO: 93267 - DNA, 117 bp, Mus musculus
ttgttgacacagtgtgaattctgcgagtaacagagaacaccaacccctcacagctctcagtgtcctcaggccagcgctctctgtttcattccctctctcctttcactacttaataac

SEQ ID NO: 93268 - DNA, 116 bp, Mus musculus
attcagcatattatacatatatatgtatatattaacagtgttgtatatttgattatttatatatatataacattgtatgctactaatatatgtttgatatttccaaggcctagaat

SEQ ID NO: 93269 - DNA, 79 bp, Mus musculus
acttctgttagtttcactgtgtctctgtttaatttctgtttccaggatctgttcattgatgagagtggggtgctgaagt

SEQ ID NO: 93270 - DNA, 100 bp, Mus musculus
atatatatgcaatgtatgcatacgtacacacatatatgtatatatatttctaactaatatacatgtatgtgtgcatgtgtttgtttacaaaaatatatat

SEQ ID NO: 93271 - DNA, 76 bp, Mus musculus
tctgtgtatatgttcatgttcatgtgcatgtgttatcatgtaggtacatgtgtacatatatgaacatacatgcaga

SEQ ID NO: 93272 - DNA, 166 bp, Mus musculus
gatgctatatacatacatatatgagactatatacatatatatgtatatatgtgtatatatgactatatagtctcatgtatgtatgtatatatactcatacacacacacacacacacacatatgtgtgtgtgtgtatgtgtgtattaaattttgtgagtggtacatg

SEQ ID NO: 93273 - DNA, 119 bp, Mus musculus
ctgcctttctgagagatgtttgctggatgtagaattacacattgtttttttctttttctctctaaccttaaagatgaaagcaattctttgaagaagcaggttttatgaggaagacgcag

SEQ ID NO: 93274 - DNA, 86 bp, Mus musculus
ggagttcagtaggagctgtgggatgcttctggggctgctgaaagactttccaggcacgctcgcacacacactctgagctggaagcc

SEQ ID NO: 93275 - DNA, 74 bp, Mus musculus
tgtatgcgctcttccacacacatctgtatctgtgagctcgtccacacacatctgtgtgtgaggtgtcccatgca

SEQ ID NO: 93276 - DNA, 96 bp, Mus musculus
gtcacaacttgtctcagggatcttgaacttcatgatttttaattttagcttgaacacaagagggagattttattaatagttccctgtacctgtgat

SEQ ID NO: 93277 - DNA, 125 bp, Mus musculus
agacatcccatttagtactgaacaatccaaaatctctcactttctccacattgtccgactgtgggtctctgagttagttcaggtctactgcgagaggatgctgagctatgcactgatcaatagtt

SEQ ID NO: 93278 - DNA, 115 bp, Mus musculus
tagagtcctagagaaatctgtatgttcataaatcagattttaaggaagctgacatctactgatttttatttttaaagtaccatatggacataggacattatctagaaataatctg

SEQ ID NO: 93279 - DNA, 74 bp, Mus musculus
ggctgggtatgcttacatacagctgcacccagcattctagatactgaggtagagttgtgagtttgaagccagcc

SEQ ID NO: 93280 - DNA, 59 bp, Mus musculus
gacaagattggccatggcatcaaacactctgttcgatgtggtggctctgtctctctgtc

SEQ ID NO: 93281 - DNA, 100 bp, Mus musculus
gcccagttctacttttggaggtagcaggatgtttactgatggagtgaagcgctgttttatgctcatagcctttgtggattttgccttcctacagatgggc

SEQ ID NO: 93282 - DNA, 91 bp, Mus musculus
gcactacagaaattttgcactaatcatatatgtatacatatatatgtacatatatatgtatatattgatgatgatgatgatgatgtaatgt

SEQ ID NO: 93283 - DNA, 85 bp, Mus musculus; identical to SEQ ID NO: 57439

SEQ ID NO: 93284 - DNA, 83 bp, Mus musculus
gctacgggctacaatcattgtctttagtgtttatgatgttgtcatacttcagttgcttagagaactttgaaaatcggccttgc

SEQ ID NO: 93285 - DNA, 106 bp, Mus musculus
gcaatcaaaactcttctggtagggggtctctatcacagctccacaggactgtgtatgcctgaagtcagtgaagagactacctctctgggcatggtgctgatgatgc

SEQ ID NO: 93286 - DNA, 93 bp, Mus musculus
acaagatatatactattatatatatatatatgtgtgtgtgtgtgtatgtatagatatatgtgtatatgtgtgcatgcatatatatatatatat

SEQ ID NO: 93287 - DNA, 156 bp, Mus musculus
gcatgtgtctgtgtgtgagtacctgtacatgtgtgtacatgcctgtgtctctgtgtgtgagtgcctgcacatgtgtacatgcatgtgtctgtctgtgtatgtgagtgcctgcacatgtgcatacatgtatgtgtgtatatgtggatgcctgcacat

SEQ ID NO: 93288 - DNA, 82 bp, Mus musculus
gtggcctgctttaggaatgcaatctaatgatttttagcaagacagaaggaatcagggagaagagcaagcctgccagagccac

SEQ ID NO: 93289 - DNA, 81 bp, Mus musculus
agagaagagtgacagctctctgatactgagttcctaattcctgaaggagttgagaggaatcggggaagttacctgtgatct

SEQ ID NO: 93290 - DNA, 112 bp, Mus musculus
gtgcctatgcttgcctgtgtttggtcctgtgtcccagtgtgcctgagtgcctgcctgtgtctgcctgtctcggctactttctcctggatggagtaaaggttgtcttactcac

SEQ ID NO: 93291 - DNA, 67 bp, Mus musculus
gtgcacatgtgcatgtgtgtgtgtctaacatatatatgtgtatatatgtatgtatgtatgtgtgtat

SEQ ID NO: 93292 - DNA, 105 bp, Mus musculus
ctgtcttaggaaccggtgctcctgttgctaccctaggtttccaggcaatggggtccatgagaagcttgagagcacacaggcaggcagtgctgacacctgagttag

SEQ ID NO: 93293 - DNA, 83 bp, Mus musculus
gctggtgtgaggcagaactgtttctccgtctgtctctgcctccctatctgaggcacacagaaatagtattgcccaggaacagc

SEQ ID NO: 93294 - DNA, 114 bp, Mus musculus
gttcttttaatctaggtgtggtggcatgtttgtgttatctcagtacttgagggtagaggtagaaggaacttgagttaaacctgagtgacagagcaaaaccttaaactctgtggt

SEQ ID NO: 93295 - DNA, 90 bp, Mus musculus
tgcagaggactggcactcgattcccagagtccatgaggcagctaataattgtctgtaactctgtgtctcaggtattcatcatcctcttca

SEQ ID NO: 93296 - DNA, 84 bp, Mus musculus
ttgtcgccaccactgaagagactgagctgaaacattttaacccctttgttttttcttcttgtttcttttggggatggagatcaa

SEQ ID NO: 93297 - DNA, 79 bp, Mus musculus
gcttaataggtagtttagagattaagagtatggctagtatgtctcaggctctgagactgtttctcagcactgtaaaagc

SEQ ID NO: 93298 - DNA, 79 bp, Mus musculus
attatgctctggccttccctgggctccttatccttgtgaccttgaaaacagatgagccacacagaagacagtgtgtagt

SEQ ID NO: 93299 - DNA, 79 bp, Mus musculus
cgtctgtctgtctgtctgcctgcctgcttattcagttgtgagctgatacccaaggcatgtggctgtgctgatacagggg

SEQ ID NO: 93300 - DNA, 88 bp, Mus musculus
tgtgtatgtgtgtatatatatatgtgtgtgtgtgtctgtatgtatacatacacacatacacatacatacgtacatatatatatatata

SEQ ID NO: 93301 - DNA, 85 bp, Mus musculus
gctgtgttttcaggctggagagatggctcagcagttaagaagaacactgactgctcttccagaggtcctgagttcaattcgaagc

SEQ ID NO: 93302 - DNA, 90 bp, Mus musculus
ggtctccaacaggactctgcttgcctgggtccctggctggcttcaccctgggccagcagatgccagccgtaagtgggtactggacagacc

SEQ ID NO: 93303 - DNA, 113 bp, Mus musculus
gtgagaaccaaactgcctccctctgtatggtgcttacttgtgaggtcacaactgtctctgtcttagaagccctgctcaagagtaaagaggacaactggtcaacatattctggc

SEQ ID NO: 93304 - DNA, 112 bp, Mus musculus
gtctctgagaatctcactcatacccagggccaggcgagagtattattatcatttaaatatttatttacctttgtgtgtgtgtgtgtgtgtgcctgtgagtgttcctcagcac

SEQ ID NO: 93305 - DNA, 121 bp, Mus musculus
gagctaggaagtggggttcagcctctgcaataaaaacaggtcagctttcattttatatatattgtggttctaagtaggactcttttttttagagcaagaacattctgtcatcaccccaccc

SEQ ID NO: 93306 - DNA, 76 bp, Mus musculus
tatatattgtgttatatgttatatataatatattatatatagtgtgatatatatgtgtgcatatatatagtgtgtg

SEQ ID NO: 93307 - DNA, 125 bp, Mus musculus
tatatgtgtgtgtgtaaatatatatatgtatatatatatatttatatgtgtgtgtatatatatatttatatgtgtgtatatgtgtgcgtatgtgtgtatatgtatatatgtgtgtgtatatgtgt

SEQ ID NO: 93308 - DNA, 79 bp, Mus musculus
atgtctgtctgtctgtctgtccattgtcctcatctatgaaatggaaataaagactcagatagaagaatagtacagatat

SEQ ID NO: 93309 - DNA, 85 bp, Mus musculus; identical to SEQ ID NO: 57470

SEQ ID NO: 93310 - DNA, 65 bp, Mus musculus
gctcactgctctgtgacactgagtctccccagttggactgaacggtgctcacagaggggctaagt

SEQ ID NO: 93311 - DNA, 114 bp, Mus musculus
agttcatcatctctgtccactcctttagatttttgcgggacaggattcagacggaacctgtgtcactcactgtcttgggtctcaaggctgccagtggattgacaggtgtgaatt

SEQ ID NO: 93312 - DNA, 163 bp, Mus musculus
gaatatatatatatatgtatatatatacatatatatgaatatatacatatatatatgtatatatacacatatacatatatatatatatacatgcacacatacaaatatctatatatgtatgtgtgtgttatgtgtatgtatacctgtgtatatgcatgcatat

SEQ ID NO: 93313 - DNA, 116 bp, Mus musculus
tgtgtataatatatatgcatatataatatatgtatatacatatatgtatacatgcatatattattatatgtatatatatatgtgtatatatatgtatatacatacatataataata

SEQ ID NO: 93314 - DNA, 64 bp, Mus musculus
tataataatatatgcatgtatacatatatgtatatacatatattatatatgcatatatattata

SEQ ID NO: 93315 - DNA, 94 bp, Mus musculus
ggtttatttggcttactcttccataccactgttcatcactgaaggaagtcaggacaggaacttacaatgggggaggaagctagaggcaggagct

SEQ ID NO: 93316 - DNA, 105 bp, Mus musculus
tatatatatgcatgtgtatatgtatgtgaatatatgtatatacatacatctatataagtacatacatatacacacacacatatatatatacatgtgtaatatata

SEQ ID NO: 93317 - DNA, 61 bp, Mus musculus
atatatgtgtgtgtgtgtgtgtgtgtgtgtgtgtataatatatatgtacatatacatgtgt

SEQ ID NO: 93318 - DNA, 84 bp, Mus musculus
gttttctatgatttacactcccaagtcacagtctgtcactgaaagaagccaggacagaaacttgaagctgaaatcatggaggac

SEQ ID NO: 93319 - DNA, 123 bp, Mus musculus
gtatgtatatatggatggatggatggatggaaggatggatctatctatctatgtatctatgtatctatatctatgtagccatgtatttctagatctatctgtctgtctatttttctatctata

SEQ ID NO: 93320 - DNA, 115 bp, Mus musculus
gaagctgaaacccagggcaaagtagtgaaagatgccaacgcatgcctcctgagagaagggagtgtggagctttgtgttgtgcaatcttctcccacttcacctgatgattcacgtc

SEQ ID NO: 93321 - DNA, 90 bp, Mus musculus
ggcctgtcttagttagggttttattgctgaaaatggggctgagagttcttggtccactggcagtgagaagactgtgagcaacactgagct

SEQ ID NO: 93322 - DNA, 85 bp, Mus musculus; identical to SEQ ID NO: 57439

SEQ ID NO: 93323 - DNA, 98 bp, Mus musculus
tatatagacatatatatgtgtatctatgtatgtatatacatatatatggttatatatgtgtgtatgtatatatgtgtacatgtatatatgtatgtgta

SEQ ID NO: 93324 - DNA, 89 bp, Mus musculus
ggtttgtccagtttctcctgtctctgtgtgtctttcctgtttcatgcctctggagaggttctgggatgcggcagggtgggatgaatctg

SEQ ID NO: 93325 - DNA, 85 bp, Mus musculus; identical to SEQ ID NO: 57439

SEQ ID NO: 93326 - DNA, 74 bp, Mus musculus
actgggaaatgggcagatgggcagatggtgcagtgctgagcttagaaccatctctctgtcacagactctccagt

SEQ ID NO: 93327 - DNA, 79 bp, Mus musculus
tctgtacctctctctgactgtttctttgcttagtaacatgggttgattctcagtggtcagaaggagtcaagcaaacaga

SEQ ID NO: 93328 - DNA, 68 bp, Mus musculus
acaaacacactcacatacacacacacacacgtgcagacacatgtgtctctgtgtatctctgtgtctgt

SEQ ID NO: 93329 - DNA, 88 bp, Mus musculus
tatgtgtatatgcatatatatttatgtgtatttgtgcatatatcttcacttatgtgcgtatacatacatatatgtgtatgtatatata

SEQ ID NO: 93330 - DNA, 63 bp, Mus musculus
gctgctctcttcagatgctaggtctcttcctggggagactgaggacagagaggtgagacaggc

SEQ ID NO: 93331 - DNA, 77 bp, Mus musculus
agctgtcagtctgtcagtgagggccaccatcgaaggcttgtgtggtcaatcattctctctggtcactcgaagaagct

SEQ ID NO: 93332 - DNA, 167 bp, Mus musculus
catttatgctatataatatatacatatgtatatgtgtgtatatatatgtatgtgtgtatatatatgcatatgtgagtttgttactgtgtaaaatattttatatatttatatgttatatataattgcataatatactttacatatttatgttatatattatatataca

SEQ ID NO: 93333 - DNA, 83 bp, Mus musculus
ggaaggtgtccctaagacaattgtctttcactggtatatattatagcagtgaataatcattctgtctgtctgtctatctatct

SEQ ID NO: 93334 - DNA, 113 bp, Mus musculus
gctccagcaagggagagatcaaggagctagggaacagggatggtcacagatgactggctgcaccgtcagcccctaaggaagctccagcttgaagctctgaggttctttggagc

SEQ ID NO: 93335 - DNA, 79 bp, Mus musculus
gtatgtatctatctatctatctatctatctatctatctccacatatatatggatatatatgatgtatatagatacatat

SEQ ID NO: 93336 - DNA, 107 bp, Mus musculus
taaacaatacatagttggctggatggatattggtccctgttactctgactcagtttcactctcttagaacaaaagcagccacgttccaatcaaagtgtgtgtgttta

SEQ ID NO: 93337 - DNA, 107 bp, Mus musculus
atgcaaaattaaaccaatagcttaaaaaaccctttaaaatctcaatttgaaattatgatgagtcaaaaatatttctaaaggtgtttatggcgattatagttttgcat

SEQ ID NO: 93338 - DNA, 66 bp, Mus musculus
gcctacttactcagtcaggtaatgaagaccaaccacaatctacatgccatgttcagagtaggtggc

SEQ ID NO: 93339 - DNA, 72 bp, Mus musculus
ggatacagacaccgtacatcagagataaagtggaatccctccctgcctgtctgtctgtatgtctgtgtctgt

SEQ ID NO: 93340 - DNA, 86 bp, Mus musculus
ggtttggtggttgaataagggatggaccccaggtggggcagtctctggatggtctctgctccacacttgtctctgtaactccttcc

SEQ ID NO: 93341 - DNA, 103 bp, Mus musculus
gattatgttctaggcagaggaagtactatcgttctcctcttctgaaggaagaacacagacaggagagtttaagtaattctttccaaggctgttgagaggtgtc

SEQ ID NO: 93342 - DNA, 104 bp, Mus musculus
gatgttccttctatggggcttcagtccccttcagctctctgagtatttctctggctccttcactggggaccttgtgctctgtcccatggatgactgtgagcatc

SEQ ID NO: 93343 - DNA, 69 bp, Mus musculus
gctgtaagtgctctcaggatgctgcacgctgatttgtcaggcgtggtagcaggttctttagaagcaggc

SEQ ID NO: 93344 - DNA, 62 bp, Mus musculus
gaggtgagcactttagatgctgggctgtcttcccagctctcagtgtctgtgtgttaactctc

SEQ ID NO: 93345 - DNA, 90 bp, Mus musculus
tcctggtgactaatgctgtggctgactcactcttacagatggccaatgtaccatgtgcaaagggccttcttggtttcagtgttgacagga

SEQ ID NO: 93346 - DNA, 102 bp, Mus musculus
tttccagcctttcactcttaggtagtgtctgtctttttctctgagatgggtttcctgtaagcagcagaatgttgggtcctgtttgactgagattgttggaga

SEQ ID NO: 93347 - DNA, 81 bp, Mus musculus
ctctaaggtggtgctggtaatggtaggtggtgaaaatacaattatactttgttttcccacaagatactgtgctgtttagag

SEQ ID NO: 93348 - DNA, 56 bp, Mus musculus
gacaacggtgaggaggtgaggaaggctcttccgagaggtctcagtctcactgagtc

SEQ ID NO: 93349 - DNA, 113 bp, Mus musculus
tgtatgtgcataatgactacgtgtctgcgcatgtatgactgtctgtgtgtgtatctgtatgtgtgtgtatgtgtctatgtatgtgtccatgtgtgtccatctgcatgtgtaca

SEQ ID NO: 93350 - DNA, 120 bp, Mus musculus
gcatcgctctaagaactttggaggtaactggttgtgatatgtttatgtatacatatttatatatgtgtgtgtgtatatatatatatttgtatattgtccttgtctccactccgggccggc

SEQ ID NO: 93351 - DNA, 62 bp, Mus musculus
cagggtgtcaatggtgggggttgggtctgagaaatggaactcacagccactgtggctctctg

SEQ ID NO: 93352 - DNA, 80 bp, Mus musculus
gtgatgatgccactcaggttgttgatttgaagccatacttggcccagatctatctttctcactcagtggctggtggttgt

SEQ ID NO: 93353 - DNA, 85 bp, Mus musculus
tcctcaggcacaaccagactgtacacactgaccactttgtagtcatatgtcagagatgataggaagggcatgggcactgtgagga

SEQ ID NO: 93354 - DNA, 85 bp, Mus musculus; identical to SEQ ID NO: 68752

SEQ ID NO: 93355 - DNA, 58 bp, Mus musculus
tgcttgtctctctgactcacgccttattaaggcagcagagactcagggaagcatggca

SEQ ID NO: 93356 - DNA, 94 bp, Mus musculus
gtgcctgcatgtatgcctgtgtgtgtgtctgtatgtctgtatgtgaatgcatgtgcatatttcacatgtgcatacttcagcatgtgctcacagg

SEQ ID NO: 93357 - DNA, 64 bp, Mus musculus
gaatgtgtgtgtatatgtatatatgaatatgcatatatatgtgtgtatataaacatacatattc

SEQ ID NO: 93358 - DNA, 89 bp, Mus musculus
gtatgtgtgcattcatgtgtgtgtgtgtgtgtatatatatatatatatatatataatacatgcatatatacacatatatgtatgcatat

SEQ ID NO: 93359 - DNA, 170 bp, Mus musculus
atgtgtgtatgtgtgtatatatgtatgtgtatatatatgtatgtgtatatatgtgtgtatatatgtatgtatatatatgtatgtgtatatatgcatgtatatatgtatatgtatgtgtatatatatatacatacacacacacacacatatatatatatgtatatatatat

SEQ ID NO: 93360 - DNA, 68 bp, Mus musculus
gtgtatatatatgtgtatatatgtgtgtgtacatatgtatatatatatatatatatatatatatatcc

SEQ ID NO: 93361 - DNA, 106 bp, Mus musculus
ggctcccttacataaatatagcaggcatgcagctgagtctctgtgtgggtcccccaacaactggaatgggccctgtccctggagctgttgcctgcctgtagaagcc

SEQ ID NO: 93362 - DNA, 71 bp, Mus musculus
gtataggcatatatgtctatgtgggtgctgactctgtgtgtgtatgaatgtgtgcatatgtgtgtgtgtac

SEQ ID NO: 93363 - DNA, 65 bp, Mus musculus
gcccggctctatctctctctctgtctgtggaacgatcctgagagtcagagagaagctgcccaggc

SEQ ID NO: 93364 - DNA, 78 bp, Mus musculus
gttcctcatctttgcaatctgtggcctgggcagcttctctctgactctcaggatcgttccacagacagagagagagat

SEQ ID NO: 93365 - DNA, 68 bp, Mus musculus
ggtgaacatccttgctcttattaaaagaaagtaacttttttctttttgtagtagcaatgggcagagcc

SEQ ID NO: 93366 - DNA, 118 bp, Mus musculus
aatgtaacattgtttctatttatccatagttaagctaaaaaaataaatatgtattattatataaacagtgtaacattgtatttattcgtagtttagctaaaatattggcaatttcatt

SEQ ID NO: 93367 - DNA, 80 bp, Mus musculus
cctaccactacttggcatgtgtccaaagggctcagacacttgtcccccatgctcactgccactcagtcacagtggctagg

SEQ ID NO: 93368 - DNA, 73 bp, Mus musculus
agctctcagtcagatagatgcgggacacacagtaaggcaaccgagccctaactgtctctcgctctctggggct

SEQ ID NO: 93369 - DNA, 81 bp, Mus musculus
ttgaaaaacccacttcaggagctggagagatggctcagcggttaagaccactgactgctcttccagagggcctgagttcaa

SEQ ID NO: 93370 - DNA, 82 bp, Mus musculus
gtgggaaacaaagcagggccagttgtgtcctgaggctcttagaccctgagccacacccactcgctggctctctcactcccac

SEQ ID NO: 93371 - DNA, 98 bp, Mus musculus
ggcgtggtgactgtctcagagagtagtgagtgctgagagccgaatgaattcacacttgtctagcaactgaactcctatctaatatttgccaccatgct

SEQ ID NO: 93372 - DNA, 106 bp, Mus musculus
tgtgtgcgtgtgcttgtgaacatgtatgtgtatgtgcatgtgcacacatgtgtgtgtgagtgcgcacgtgtgcttgtctgtatgtgtttgagagcacacacacata

SEQ ID NO: 93373 - DNA, 80 bp, Mus musculus
gcagggaagcaaagcgatgacataaggaagaagcaaaagttgagagagaaagtgcttcctgttcgtgccgcaggccctgt

SEQ ID NO: 93374 - DNA, 74 bp, Mus musculus
ttgcctcggcttccccatctaggaaatggaccttgctcagacagtcagtgtcttagttggggatattgttgtga

SEQ ID NO: 93375 - DNA, 129 bp, Mus musculus
gagaaaaatttgtggagacttaccagtattctgctgcttaggtgagaaactccctgaatttctctatttatattatgtatgagaaattggactgtgagcctctccatctgaatacagtaagcaacttgg

SEQ ID NO: 93376 - DNA, 91 bp, Mus musculus
gatttatgtgtatatatgcatgtgtgtacatgtatgtgtatatatgtatatatacacacatatacatgtgcatacacagatgtcacatttc

SEQ ID NO: 93377 - DNA, 140 bp, Mus musculus
gtgggttcatgtgggtgagatggtggccggcagctctagcccagtttcatcgggagtggccccactctgcgtgtgtctcagcttcttcagaacaatgagccaaagaacgttctcgtggtggcaggggtgcccgagaagac

SEQ ID NO: 93378 - DNA, 115 bp, Mus musculus
tgtatataatgctgtaattacgcaccttttagtcatactgattcatctagtaggtatttttatgtatctaatctatgtatgtgaagtatattatttatgtgtgtgcttatgtata

SEQ ID NO: 93379 - DNA, 71 bp, Mus musculus
tctgtctctgtctctatcactctctatctcttactgggttggctccagagaggtatgggcctgaggtcaga

SEQ ID NO: 93380 - DNA, 88 bp, Mus musculus
actgagcatcgtcagagcagcaacttaagcagaagccatggaagctactgtgtgctggcttgattggccacgcttggccatgtttagt

SEQ ID NO: 93381 - DNA, 100 bp, Mus musculus
ggccgctgcgcacgattttgtggttttgtcctcgcatacagccgctgtgccttccctcatacactgtctgtgaaagaccacggagctgcggaaggaagcc

SEQ ID NO: 93382 - DNA, 100 bp, Mus musculus
tgactggtcaatgtatgtgtaatgcttcctcctcctgtgtccaagtcagtgtgtcccctcaaggtcactgaacagagttagacacacatgtttgctgtca

SEQ ID NO: 93383 - DNA, 112 bp, Mus musculus
gcactaaatatctatgtgtttatctatgtatctatacatgtatctatgtatctatctatgtatatatgcatgtatgtattatgtacctatttatctatatctatctgtgtgc

SEQ ID NO: 93384 - DNA, 77 bp, Mus musculus
aagggaaagagtcagaatatagcaccagagagctgcaggatgctctctgtctgtctgtctgtctgtctgtctgtctt

SEQ ID NO: 93385 - DNA, 65 bp, Mus musculus
gctctgtctctgtcactccatggagtcctattaatactctcctcagtgtggcacgggcagccagt

SEQ ID NO: 93386 - DNA, 89 bp, Mus musculus
ggtgccctcagtggaggtgtgagttgtctatgtgttcttatgtgccagaccaagctagcctgcatacggtagctcattcattgttcacc

SEQ ID NO: 93387 - DNA, 93 bp, Mus musculus
gctttcctttcaggaaaaaggctcctccagggcttcgtagctcactttaattcttggtgactgactctgtgacttatttgatgaaagatgggc

SEQ ID NO: 93388 - DNA, 72 bp, Mus musculus
attctgttataatctgtgtctttttattggggggttgagaccttgatgttgagagatatcagtgagcagagt

SEQ ID NO: 93389 - DNA, 73 bp, Mus musculus
cagtatctgtgcttctgccagccaccctgttagcttgacatcaaggtagaacttaggtcctgggcagatactg

SEQ ID NO: 93390 - DNA, 94 bp, Mus musculus
gtaacttagggagccctttgtgtccgtcagtccgtcagtttgtctgttgttgtggggagaccgaggaggaaggatttatggggttcacagttgc

SEQ ID NO: 93391 - DNA, 57 bp, Mus musculus
gctcagagaaatgagtttccagactgagaccagtatggcactgctgtttcttggagc

SEQ ID NO: 93392 - DNA, 77 bp, Mus musculus
ctcagccccttgaaggcaatgttgtcaggagtctgcagggagccccagcgtgacagtgtggcaggatggggcaggag

SEQ ID NO: 93393 - DNA, 76 bp, Mus musculus
gtcctctgaaagctaatcagtctgtcacagtctgtgaccctcgtccttggcagtgctgacagagcagaatgagctc

SEQ ID NO: 93394 - DNA, 113 bp, Mus musculus
gggaagattgtgttgaggtttggtctgttgctaagtgaggcccccgagacctggctgccccagagatgagagagtccacacatagacccaagtgacactatttgatcttgccc

SEQ ID NO: 93395 - DNA, 118 bp, Mus musculus
ggggctgtctttaagtgagtaaggagatacacaagcatagtttctagttgtggagacagaagagagagacttgggtgggacgggctttctgtagctccgctgtatagtatgggaaccc

SEQ ID NO: 93396 - DNA, 93 bp, Mus musculus
tccatggtgatttgataggatgcatgggacaatttcaatatttttgtatctgttgaggcctgttttgtgaccaattatatagtcaattttgga

SEQ ID NO: 93397 - DNA, 78 bp, Mus musculus
ctcccaccaaaaagctaattctggaagtagttggatgaattctattgtcttccagatgtttagtttgacagatggtag

SEQ ID NO: 93398 - DNA, 81 bp, Mus musculus
cttttcagagtgtctgtgtgagtgcccgaatgtatatctgtctaccatatgagtgcctggcacctgtggacaccagaagag

SEQ ID NO: 93399 - DNA, 113 bp, Mus musculus
gtgtcctcttgcatgagttttgtgacttttgtccacctcagtttctgcatctccaagttcaggctgacaagtatcattagttatgtgaagattcagtgttgctacagattcac

SEQ ID NO: 93400 - DNA, 73 bp, Mus musculus
atatatctatgtgtatgtgtgtatgcgtatgtttattatgtatgtatgtatacatgtatgtatgtatgtgtat

SEQ ID NO: 93401 - DNA, 74 bp, Mus musculus
ggatcagcatggtagagtaggctggcctgggggcattttatattcctggggccagtctctctctctctctctct

SEQ ID NO: 93402 - DNA, 67 bp, Mus musculus
gtatgtgtgtgtgtgtgcagtaacaataatcattaatatacagtattttcacacacacacacactgc

SEQ ID NO: 93403 - DNA, 86 bp, Mus musculus
ggagtgtgaaggagagtgaagactgtcagtttcacccgtttcctcgagaccctggaagctgacgtcatgcccctcgctcacatttt

SEQ ID NO: 93404 - DNA, 82 bp, Mus musculus
tcagatgaagccctgtactcacgctagaacctcccttcagggttctgagggtgactgagttgtgagtgtgcagatgacctga

SEQ ID NO: 93405 - DNA, 79 bp, Mus musculus
ctggccccaccctgctcccactgactctctgaggctcctgacccccgagagctttcgtgcctggagaaatggactccag

SEQ ID NO: 93406 - DNA, 93 bp, Mus musculus
ctttggctgtccgtgtctgtggctctgtcattgcctgcacacaagcttagaaccatttgagaatcctggcagactctccacaggcatctgaag

SEQ ID NO: 93407 - DNA, 88 bp, Mus musculus
tatatatatatatatattcaggtttacaaagggagatggccacataattatctaaacaggtgtgtgtgtgtgtgtgtgtgtgtgtgtg

SEQ ID NO: 93408 - DNA, 63 bp, Mus musculus
gaagcaggaggagcaaggtggatggttgcttgctcgctcgctctcttgctcgctctctgcatc

SEQ ID NO: 93409 - DNA, 110 bp, Mus musculus
cttctgatccaggtccttggctgctcaggaagtctgcctctgagaagtgactgaggtctcctcagacaaccccagagttcagggctgcagtggagagcagggtaaagagg

SEQ ID NO: 93410 - DNA, 97 bp, Mus musculus
tttctgtctttctcatttgcctaagatgttgcttaatttttgattatattcaactgatggagtgatttaagcaacacagaaagtaacaaaacagaaa

SEQ ID NO: 93411 - DNA, 77 bp, Mus musculus
aggagggaatcacacagtaagccagatggggtcagggcggggcgcagtctgtatgtctgtcttataacggccttctt

SEQ ID NO: 93412 - DNA, 66 bp, Mus musculus
tgtacgtacgtatgtatgtacgtatgtacatatgtatgtacatatgtatgtacatatgtatacaca

SEQ ID NO: 93413 - DNA, 85 bp, Mus musculus
ggggctttgcgtctgctcccatcagttgctggatgaagtctctatgatctctctgatgacgatgatgatgatgatgctaggctct

SEQ ID NO: 93414 - DNA, 81 bp, Mus musculus
tttgtctgtcaatcatgtatgtatatatgtatgcatgtatgtatgtatgtatgtatgtatgtatgtggtttcggagacagg

SEQ ID NO: 93415 - DNA, 90 bp, Mus musculus
atgcatctgtgcagacacagtaaggagtatggaacaatgagtagtccttaatacttgctgaaaatatttttgtctttataaaccatgcat

SEQ ID NO: 93416 - DNA, 68 bp, Mus musculus
ggtgcctgtcacacacttcagcccacagggatgcttattccctgtcacactgtatgagtgacgccacc

SEQ ID NO: 93417 - DNA, 75 bp, Mus musculus
gctagagaacaagggttgtttctctgtccctctggggaaagttctgttgagatactcacagtctctgtctctagc

SEQ ID NO: 93418 - DNA, 99 bp, Mus musculus
actcatttaagcactgtagatccatgtgtgtgtgtacaatagtatgtgtctgtatgtgtctctgtgtgtacatgtgtgtgtttgtatgtgtctgtgggt

SEQ ID NO: 93419 - DNA, 65 bp, Mus musculus
agaggtttgttgattgctattcaagatgacgtcctcacatctgagtgtgatagtgcagctcctct

SEQ ID NO: 93420 - DNA, 86 bp, Mus musculus
ctgagcctctggttaagtcagggtgattatggtctctgtcagtttcactcaagatcctggttactttggccctaaatcaaggccag

SEQ ID NO: 93421 - DNA, 82 bp, Mus musculus
ctttgttctctgtcagtcagcctgtgcctgagtaggaagctttgcagaactcagtattcaaattgaagggcttagggcattg

SEQ ID NO: 93422 - DNA, 116 bp, Mus musculus
ttctgtttggttttgatttgtttggctttgtttttcaagagagtttatatgtagagagtcattcagaccaggctagccttgaactcagagatccacctacctctaagcctccggag

SEQ ID NO: 93423 - DNA, 111 bp, Mus musculus
tctatgtgtgtgctgcaaagaaattaagggagctggagagatggctcagcaggtaagagcactgactgctcttccagaggtcctgagttcaagtcccagcaaccacatgga

SEQ ID NO: 93424 - DNA, 132 bp, Mus musculus
gcttttaggtatgctcttaagattgaatctcaggggggctggagagatggctcagcggttaagagcactgactgctcttccagaggtcctgagttcaaatcccagcaaccacatggtggctcacaaccatct

SEQ ID NO: 93425 - DNA, 131 bp, Mus musculus
catgtgtgtgtatatatacatgtgtgtacatatacacacatgtatgtgcatatacacacatgtatatatgtatatatgcacacctgtatgtatatgtgtgtatgtgtatatatacacacatgtatgtatat

SEQ ID NO: 93426 - DNA, 74 bp, Mus musculus
gagtgatgtggatgcggctgtaaggggccaggaggttaagactctggctctctcacccagcctcccagccactc

SEQ ID NO: 93427 - DNA, 81 bp, Mus musculus
gacttgtatcagtgagcattgacgaggaacaggtctgtagtgtgtcaccacaggccagtcttcagctctttggcttaggtc

SEQ ID NO: 93428 - DNA, 65 bp, Mus musculus
ggccccatgtcccctgctgtcagtctccagagctgctggagacagaacacagaatgcagattccc

SEQ ID NO: 93429 - DNA, 69 bp, Mus musculus
tctctctgtctgtctgtctgtctgtctgtcatggtaggatagatgccaaccaggaagggagcagaagga

SEQ ID NO: 93430 - DNA, 91 bp, Mus musculus
cagagaggtctgactggggagctgaggaaggggcgctattgaaaggagggccgtgccaggctccctcagtgaccctctctgagttcccggg

SEQ ID NO: 93431 - DNA, 97 bp, Mus musculus
atgtgacctgaattactttgcttgctgggttgtgtgcgtgcgtgcgtgcgtgcgtgcgtgtacacatgtgtgcagaggcctcaggaaggcatcacat

SEQ ID NO: 93432 - DNA, 71 bp, Mus musculus
ctttcacgtgagtgtctgtatgtctgtgtggctcacgccacagcatccacgggcagatcatctacggacag

SEQ ID NO: 93433 - DNA, 83 bp, Mus musculus
ggggtgagcagagggtggagtcactctgaccgtgtctgggtttcctacagtgggtttaagatgtattcataccagagcatccc

SEQ ID NO: 93434 - DNA, 75 bp, Mus musculus
cagaaccagaaaaaaaataaagataagggcagttgtgaggcggtgtctctctctgtctccctatctctgtctctg

SEQ ID NO: 93435 - DNA, 72 bp, Mus musculus
ggcagacagacagacagataggtgtatatataatgtatatctatattgagccactgtctcactctgtaaacc

SEQ ID NO: 93436 - DNA, 80 bp, Mus musculus
agaaaagactggatgttcggcttccagagtctcctctgctttgcagagagtctcttcctctgtgtgtctattgcagttct

SEQ ID NO: 93437 - DNA, 115 bp, Mus musculus
atacatacctcataatatataatagaacacacacttttaagtgtgtttatgttttgcatgtatgaatgtatgtatgtatgtatgtaccacaggcatgcatgtgtagtgaacatgg

SEQ ID NO: 93438 - DNA, 121 bp, Mus musculus
attgctggcatagcaagggccctacatgcctcctgcttgcctctgctctcagacattcagtctgggtgtgagtgggccttggtattcatagtcccttctggtgtttacccagtagtgagtg

SEQ ID NO: 93439 - DNA, 87 bp, Mus musculus
cacgtgtgtgcctgtctgtgcgtgtgtgagtgtgtgctagcgcgcgagcgcgcgcgcatgtgacacgccgccgtggacggctccgcg

SEQ ID NO: 93440 - DNA, 76 bp, Mus musculus
tgtggtcccagtgatgtgtgttccgatacagtcctgaccccaggagtgacacactgacttactgtcttcagccaca

SEQ ID NO: 93441 - DNA, 73 bp, Mus musculus
gggatgtagctcagcctcagtagcacagagttgtctagactgtgtgactgtgtgggtcccacatacaattccc

SEQ ID NO: 93442 - DNA, 89 bp, Mus musculus
gattggttttctagggactggagagatggctcagctgttaagagcactgactgctcttccagaggtcctgagttcaattcccagcaacc

SEQ ID NO: 93443 - DNA, 116 bp, Mus musculus
gccttaatattttaaaaccagccagatggactggagagatggctcagtggttaagagcactgactgctcttccaaaggtcctgagttcaattcccagcaaccatctgcagtagggt

SEQ ID NO: 93444 - DNA, 92 bp, Mus musculus
cattgcactgttcgcggcactgaggcgtcagccacagacagacacacactagtccaggattggcgctccagagtgagtgctggctttgcatg

SEQ ID NO: 93445 - DNA, 112 bp, Mus musculus
gcctgtgctgtgtgtaactctgcttcgttcagttgctcttggccagtgtgggattgagaggcacagagaactcacagtgctccgcagaggacaagtgattgtagaaaaaggg

SEQ ID NO: 93446 - DNA, 102 bp, Mus musculus
gactggctggggcagtgcaggggtggagatgaaacccatggataggcagactcactgtggctctcactgacccagaatccagtcttctctgccaagcctggg

SEQ ID NO: 93447 - DNA, 67 bp, Mus musculus
aggccagacagtcatcacacacaggcctgctgaggctgaggattgtgctctgaatggactctggctt

SEQ ID NO: 93448 - DNA, 73 bp, Mus musculus
ctagactgtcactcagtgtctgcggcatgctcatgtgagtaactcctgcattcaccttcgttccacaggatgg

SEQ ID NO: 93449 - DNA, 89 bp, Mus musculus
ctaagattttctacatcaggggctggagagatggctcagtggttaagtgcactgactgctcttccagaggtcctgagttcaaatcccag

SEQ ID NO: 93450 - DNA, 87 bp, Mus musculus
gggcggggacctagtttgtcacgcagctttgaagtacagggcaggatctgctttggcttatgctctgaccaccacatctaactgcct

SEQ ID NO: 93451 - DNA, 70 bp, Mus musculus
tatgtatgtgtgtatgtgcgtgtgcatgtgcatgtgcatgtgcgtgcatgcgtgcgtgcgtgcgtgtgtg

SEQ ID NO: 93452 - DNA, 61 bp, Mus musculus
ctgtttctctgctggctgtgaactgtatgtagtcaggagacacggagcagacaggagacag

SEQ ID NO: 93453 - DNA, 113 bp, Mus musculus
gagctagtgtctaaaggactgtgctcgggctggagagatggctcagtggttaagagcactgactgctcttccagaggtcctgagttcaattcctaggaaccacatggtggctc

SEQ ID NO: 93454 - DNA, 70 bp, Mus musculus
ggcttgtggttctgcttggatggacatatgtgtcccagctgtcatccgaccctcagtcacactctctgcc

SEQ ID NO: 93455 - DNA, 87 bp, Mus musculus
cttttgtctgtgtaggatgtgagctctagggaagcaagggatctgtctgctttgatcatccctggtcgctctacacccagtcaggag

SEQ ID NO: 93456 - DNA, 106 bp, Mus musculus
ctctgcatgtgagtgtgtgcacacggccacactgcagagtgcacgtggcagtggaagagatgtgagtgtgtgcacacggccacactgcagagtgcacgtggcagtg

SEQ ID NO: 93457 - DNA, 118 bp, Mus musculus
gagtggcctctctgggtgcttgcagttcttaacaagatgtttgagttactctagtgtggttcaatgtatttatcatttttttcagaaagtaactgtaggtgtctcctctgtgtcaggc

SEQ ID NO: 93458 - DNA, 78 bp, Mus musculus
tcccaggtgatgcacacaggcaagtgtgactctaaatttgattatatttgatggaagtgtgcctctctcttcttggga

SEQ ID NO: 93459 - DNA, 83 bp, Mus musculus
cactcagacacacacacacacagagggcagggacaggcagtgacctgcagtgtttgcaactctcttgtaatgagtgctgggtg

SEQ ID NO: 93460 - DNA, 81 bp, Mus musculus
acccagcactcattacaagagagttgcaaacactgcaggtcactgcctgtccctgccctctgtgtgtgtgtgtgtctgagt

SEQ ID NO: 93461 - DNA, 95 bp, Mus musculus
aagcccttcagaactggagggctctggagagtccctgcctgcctcaaagtgccttggaagcttcatctctagctgcttttctctgacacgggctt

SEQ ID NO: 93462 - DNA, 70 bp, Mus musculus
gcagaaggggtaccctgacattcatggttactctcagtgagcacagccagcctcactctgcctctcctgc

SEQ ID NO: 93463 - DNA, 69 bp, Mus musculus
cctaagtggcatcacttctgtgagtgtcacctggaggggtctctcacagaggattgtgtgaagcctggg

SEQ ID NO: 93464 - DNA, 61 bp, Mus musculus
gggtcttgcagggacttgagtggtctgctccagcacccagtcacactcagtctgtttgccc

SEQ ID NO: 93465 - DNA, 56 bp, Mus musculus
ctacaggtggtacaggttgacagcagtggtctgtctgtctacctgtctgtgagtag

SEQ ID NO: 93466 - DNA, 190 bp, Mus musculus
tataagcatatatgtgtatatatacatatatacacatttatatgtatatatacatacatatatgtatatatacatatatgtatgtgtatgtttgtatagatacatatgtgtatatgtacatatatgcatatatatgtatgtatgtgtatacgtgtgtgtatgtgtgtatatgtatgtatgtatgtatgca

SEQ ID NO: 93467 - DNA, 66 bp, Mus musculus
agtcctcttctcagaagtgagtgtgaaccagacatgctgaagcacacccattgatgcttgaggact

SEQ ID NO: 93468 - DNA, 81 bp, Mus musculus
cagaacaggactgatctctgggtggaggtactaggactgcccgggcctggtaccatggcccactgccctcagtcctggctg

SEQ ID NO: 93469 - DNA, 98 bp, Mus musculus
tgatcaccttgagctagagagatggctcagcagttaagagcactgactgctcttccaggggtcctgagttcaattcctagcaacagcatggtggctca

SEQ ID NO: 93470 - DNA, 88 bp, Mus musculus
tgcggatttccatcctctgtcacttgagtattactagtagtaattaatactagtaattttcttcttaactgaaagaaatggttctgta

SEQ ID NO: 93471 - DNA, 113 bp, Mus musculus
tatatatgtctgccctctagttgtaagcctgagatgtgatcggaaagaacgtaatattatttctgaaattgttcttctgtgaacataagtatgtttacatcagtatatgtatg

SEQ ID NO: 93472 - DNA, 105 bp, Mus musculus
caatgctggctccctgtttggctcttaagattaaaaccaggacttaggctggagagatggctcagtgttgaagagcactgactgctcttccagcggtcctgagtt

SEQ ID NO: 93473 - DNA, 110 bp, Mus musculus
ggcaaagtgggttactggttgtttgctgttggctatggttttaaagtcattgtttgcaaagaagaatgaagacgttagatatcctgacagcaaacatcaaacttgccccc

SEQ ID NO: 93474 - DNA, 105 bp, Mus musculus
cctcaattaagagctgaagaataaaaatagtctggttctggactttttgttgttgttattccaggagacatttagattagttatcttttctggttttgattcagg

SEQ ID NO: 93475 - DNA, 102 bp, Mus musculus
gcatgtatgtactcatgtatgtatgtatgcatgtatgtatgtgtgcaagtgtgtgcttgtatatgtatatttgtatatatgtatatgtttgtgtatttcagc

SEQ ID NO: 93476 - DNA, 61 bp, Mus musculus
ggaagactaactgcatgtgaaatcctcacggataattaggatgccacgttgcacagcttcc

SEQ ID NO: 93477 - DNA, 81 bp, Mus musculus
gttctctgtccctctgtgtcttttctgtgtgtaatctcaggagtgggatgccatagtcaaggcatatggttgtagtggaac

SEQ ID NO: 93478 - DNA, 117 bp, Mus musculus
ggttttgttttgagtaattattctttgaatggtgctgtctgaggtttctggttgtttactctgacattcagcaggcgtaattgctttgacttgcacacattaattactgcagtcact

SEQ ID NO: 93479 - DNA, 70 bp, Mus musculus
ctttctttatgggtgtgagccatggctggtggaccacacttcactgggtcactcacactcaggagttaag

SEQ ID NO: 93480 - DNA, 74 bp, Mus musculus
tagggcactagcatccctgagcatatcagaagcatgtatatattttctttgtataggggtgtctgggagctgtg

SEQ ID NO: 93481 - DNA, 77 bp, Mus musculus
accaaaaagtgtctgttttgcacttgaaggagggtaaggcatttccttgaatgtgaggagacagagaacattgtggt

SEQ ID NO: 93482 - DNA, 107 bp, Mus musculus
gagtagcaaaaccagtgagtgaccttctcagctacaacaaaaggatctttgcagagagtagctctctgcctgtctgtctgtctggtcaaagttcaacctggaaactc

SEQ ID NO: 93483 - DNA, 75 bp, Mus musculus
tggataccggaagcgcggcatatgagacgggctggtgcaggcagtggctctctcatcctctgtcacttctgtcca

SEQ ID NO: 93484 - DNA, 64 bp, Mus musculus
agtcttggtattgtgagtggctgtgacagcagagcacagactatttctcactcttatcaagtct

SEQ ID NO: 93485 - DNA, 83 bp, Mus musculus
atggatcccggggtggggcagtctctggatggtccatcctttcatctcagctctccaaactctgtctctgtaactccttccat

SEQ ID NO: 93486 - DNA, 83 bp, Mus musculus
ccacacacacacaaacacacaaattctgtatgtgtgcacatgtattcatgtatgtaggtgcacatgtatgagtgtgtatgtgg

SEQ ID NO: 93487 - DNA, 68 bp, Mus musculus
gtgtgtgtgcatgtgtatgtgcacatggaaatttgtgtgtgccagtgtgtgtgcacatgtgtacatgt

SEQ ID NO: 93488 - DNA, 93 bp, Mus musculus
gtgtatgtgtgtgcacatgagtgtatgtgcatgtacatgtgtgtggcatgtgtgtgcatgtgtatatgtgtgtattcatgactgtgtatatgt

SEQ ID NO: 93489 - DNA, 78 bp, Mus musculus
gtgatgatgcacctgtgttgagtctggctctgacagtgggtgtctagggctctgagcttgcagatagtatctatgcac

SEQ ID NO: 93490 - DNA, 106 bp, Mus musculus
caaggttggccaccctgtcagcagttccctcctctcttcagtctctctgatcctcacttggaccagagagctaggcttccaggaaatgttactaggatcgctcttg

SEQ ID NO: 93491 - DNA, 109 bp, Mus musculus
gtgtgaatgtgtgtgtatgcatgagtgtgcatgtgtgtgtatgcgtgtatgtgtatgtgcatgtgcacgtgttgtattcattttctgtatccattcattcgttgatcac

SEQ ID NO: 93492 - DNA, 60 bp, Mus musculus
tatgtatgtatgtgtgtgtgtatgtatatatgtgtatatgcatgtatatatgtatgtgtg

SEQ ID NO: 93493 - DNA, 92 bp, Mus musculus
aggcctggctcccgggagtgtttttgagcagtgtctcttagtcagtcttcttacagtcatcttgcaacactcttctgggcagtactgggtct

SEQ ID NO: 93494 - DNA, 87 bp, Mus musculus
gttctacccttagtgactgaatttctttaggtgagtgtgactcttcctcactctgacatccatgacctagttctgaatgggtatgac

SEQ ID NO: 93495 - DNA, 76 bp, Mus musculus
gtcctagtcattgacacactgtctcagaaacaaagtggcaaggaaaacggtggagagggtgcccagtgtgttggat

SEQ ID NO: 93496 - DNA, 115 bp, Mus musculus
gaatttgaagtggtgcagctgtggctgaggttggaagggagcctaacatcaagggagtctgtgtttgtctctctcattcatcctgagacagaggtgccaggggtcactcagaatc

SEQ ID NO: 93497 - DNA, 77 bp, Mus musculus
cagttgcttctctctgtctctctgagggaatgctcagctgctgtggtgtctctgaggaggcagtagaggttcgtctg

SEQ ID NO: 93498 - DNA, 75 bp, Mus musculus
gcttggtttctctgcaggttggactaggactaaagtgacaaatgtctgtgtccctgtatctcagacaacccaggt

SEQ ID NO: 93499 - DNA, 85 bp, Mus musculus; identical to SEQ ID NO: 57439

SEQ ID NO: 93500 - DNA, 100 bp, Mus musculus
cacctatatgtgtacatgtacaggcagacagacagacgcacacacattttaagagatgggcatgctaaggactgcttgttatcttgttgctcagaaggtg

SEQ ID NO: 93501 - DNA, 71 bp, Mus musculus
gaagctactctgtctgtctctggctcagaagtaaaccaagcacctgctgatgagatggacagccctgtttc

SEQ ID NO: 93502 - DNA, 105 bp, Mus musculus
tctccattttgccatcctgttcctagtgagtcttcactgagttcctgactctgccactcagagtctttgagatttgtctgggctcaggttttgtgttgttgttga

SEQ ID NO: 93503 - DNA, 79 bp, Mus musculus
ctgcagaggtgtgctgagaatggatgatgtctgactggagctaggccagactctcttctctctgtgtgatttgaagcag

SEQ ID NO: 93504 - DNA, 129 bp, Mus musculus
gctgggggattctggagcctaccttgaacagcagctcagcagctctgtgatgtgggtcactgtgtgccagtgataacttatttttctacatacaaaaatcacaagatggtacctctccctcacagagct

SEQ ID NO: 93505 - DNA, 106 bp, Mus musculus
gagccaggactcagatcagctgggtgatactgaagaagtaatttttttcatttttgaactaatgcctcctcagtattcaaaaagacagttatcccagtgtcccctc

SEQ ID NO: 93506 - DNA, 67 bp, Mus musculus
tctctgtgtctctgtctgtctgtctgtccgcctgttgggtatgaggtacatatgtgggaaacaggga

SEQ ID NO: 93507 - DNA, 80 bp, Mus musculus
tgagtcgagggtggagagaggaagatacccagccaggaaagaaaatcattccttcattctctgaatcactctttcattca

SEQ ID NO: 93508 - DNA, 78 bp, Mus musculus
gggacgcaaagactgttcagctcaggcggcctctggcagcagcttctccagtgtctgtctgtctgtctgtcctcaccc

SEQ ID NO: 93509 - DNA, 88 bp, Mus musculus
atggcaattgtcccgcagagaagagagtgaccagtgggatatggcgtgaatcctagtcttgttgcttactggggagaaactttgctat

SEQ ID NO: 93510 - DNA, 80 bp, Mus musculus
gtgctgttattttggcatggcagataaagctatcctgtgtattgtcagtatcggtgtctcacagtctcattagtcagcac

SEQ ID NO: 93511 - DNA, 118 bp, Mus musculus
cctatctgttcctatggctgtcttttaacatatatgcacatttagaaaaaagactcaatttatttttaatcatgcatatgtgtatctatgtggggatatgtgagtataggtgcctagg

SEQ ID NO: 93512 - DNA, 77 bp, Mus musculus
acatacacacacacacacaggaggaagcatcaatttctattaaagtgtatctatttttttgtgtgtgtgtgttttgt

SEQ ID NO: 93513 - DNA, 120 bp, Mus musculus
tatatctctagaaagtgcctctctctgtgtgtctgtctgcctatcatctatcaatcaatctatctacctgtgatggtttgtatatgctcagtccagggaatgacactattagaaggtgtg

SEQ ID NO: 93514 - DNA, 78 bp, Mus musculus
ttgcagtagtcagaggagagagtgctgtttgactcgttctaccagtcagaggttgcagattttctcctcatgaggcag

SEQ ID NO: 93515 - DNA, 93 bp, Mus musculus
cactattgtggatgccaacaagtgcttgctgataggagcctgatatagctgtctcctgagaggctctgtcagtgcctgacaaatacagaagtg

SEQ ID NO: 93516 - DNA, 64 bp, Mus musculus
aaggcacacagcctgtgataatgccattaatctttaaaaatgtatctctatgtctgtgtgcctt

SEQ ID NO: 93517 - DNA, 70 bp, Mus musculus
cagccaccggaagcctcaggcctcaggccagaatctcacctgtctgtctgtctgtctgtctgtctgtctg

SEQ ID NO: 93518 - DNA, 119 bp, Mus musculus
gcctgggctatctagcaatcccccccatctatctatctatatgtatgtatatatacatatacatgtgtgtgtgtgtacatatggtacattgggctggtgaaacagcttatagtgcatgc

SEQ ID NO: 93519 - DNA, 72 bp, Mus musculus
ggctggtgcctggatcctgtaaggcttttttctttttttaaaagacagggtcttatgtattcctggttggct

SEQ ID NO: 93520 - DNA, 115 bp, Mus musculus
ggaaccgggttcaacaggtcacatgactccatctgtatgagacagtcaatctctgcagacacaagagactcaggatcagcagggggaacatgaggagtggctggttaaggtgcac

SEQ ID NO: 93521 - DNA, 101 bp, Mus musculus
tgaaaagcagaaagaggattgctcattttattatatattatgcatgatttttggtatgtttttatttgtttgtttttgagacaaggtcttgctgcttagca

SEQ ID NO: 93522 - DNA, 98 bp, Mus musculus
tggcagcaagatcctacccactgagcagtctcgccggtcctatttatttatttttgaaacaaggtgttgctgtgtagctcaggctggacttgaagtca

SEQ ID NO: 93523 - DNA, 162 bp, Mus musculus
gcatgtatgtgcacacatgtgtgcacatgcatgtctgtgtgtctgcatgtgtttacatgtgtgtctttgtgtgtctgtgtctgtgcatgtgcatgcatgcatgcatgtatgtatctgtgtatgcatgcaggtgtgtatgtgtgtctattcagtgcaggtaca

SEQ ID NO: 93524 - DNA, 70 bp, Mus musculus
atgtatgtaggtatgtgtatatgtatgtaggtatgtgtatatatatacatatatatatgaatgcatgtat

SEQ ID NO: 93525 - DNA, 104 bp, Mus musculus
ctcagtagggtgggcagatgcaggcaggatcttggtcagtggtgagtgagcagaaagaacacacaccccagaatagcttctgagaactggttcatctattggag

SEQ ID NO: 93526 - DNA, 73 bp, Mus musculus
ggagtctgaggcaggaggctcaagaattcaagaccggtctgaattacagtgttgagtctcaatctctctctct

SEQ ID NO: 93527 - DNA, 112 bp, Mus musculus
acataattgtaacagtgtattataataaaagtcacacaaaggtggctgttctctgtcatactctctccttgtgttgacttgtacttttagaccacagctgactgccatgtgt

SEQ ID NO: 93528 - DNA, 96 bp, Mus musculus
tctaaccagggagaagtgtggtggggattatgggataacactaggacggatggtggagatcatagtactgacagagcacataggcacaagggagga

SEQ ID NO: 93529 - DNA, 116 bp, Mus musculus
tgtagcatcagaaacattgaatgtgggggctggcgagatggctcgggggttaagagcactgactgctcttccaaaggtcctgagttcaattcccagcaactacatggtggcttaca

SEQ ID NO: 93530 - DNA, 71 bp, Mus musculus
ctgtgtgtgtctgagtgtctgtgtctgtgtgcgtacgcacacatgcatttgaggccagaggagaatgtcag

SEQ ID NO: 93531 - DNA, 84 bp, Mus musculus
cagggcctgtgggaggagagtgagggcactcagtgctccccacttctgttagtcgggcaactgaaagttctctctctctctctc

SEQ ID NO: 93532 - DNA, 74 bp, Mus musculus
cagcaccaacatggcagctcacaggtttcggcaagcccagttccagggaatctgtctgtctgtctgtctgtctg

SEQ ID NO: 93533 - DNA, 136 bp, Mus musculus
gtccctgcagaccttgttgctgggggacttaggaagcaaatgccgggctccagcagcctgggtccctccgtcagtggctggtgagttagggaccattatgcagccttctcaggtagcctcttattctattagtcac

SEQ ID NO: 93534 - DNA, 86 bp, Mus musculus
gtccatggtggtctgataggatgcatgggacaatttcaatatttttgtatctgttgaggcctgtttttgtgaccaattatatggtc

SEQ ID NO: 93535 - DNA, 85 bp, Mus musculus; identical to SEQ ID NO: 57439

SEQ ID NO: 93536 - DNA, 109 bp, Mus musculus
ctaaacctggatgtcctgagttcttctatccaaaaagtagcaggaatagaattctgtaattgatattgagatgacagctgctctcatttgggaaggggaaatgacacag

SEQ ID NO: 93537 - DNA, 66 bp, Mus musculus
atgcagctcctagctatagatgcctcaggatccacaaacttgtagacagaagataggaagctgcat

SEQ ID NO: 93538 - DNA, 66 bp, Mus musculus; identical to SEQ ID NO: 93537

SEQ ID NO: 93539 - DNA, 93 bp, Mus musculus; identical to SEQ ID NO: 70643

SEQ ID NO: 93540 - DNA, 73 bp, Mus musculus
gatgtctgtctgtttctgtctatttgtatgtctaacccagagaaagatacaagtgccaagaagctggggcatt

SEQ ID NO: 93541 - DNA, 71 bp, Mus musculus
agcaactccttctctgaacacagatctcctgacttttggaggactgtgtcagtgtctcagagatatgtgct

SEQ ID NO: 93542 - DNA, 85 bp, Mus musculus; identical to SEQ ID NO: 57439

SEQ ID NO: 93543 - DNA, 90 bp, Mus musculus
gatgttctgattattatgtgtcgggaggaatttcttttctggtcttgtctatttgaagttctgtaggcttcttgtatgttcatgggcatc

SEQ ID NO: 93544 - DNA, 119 bp, Mus musculus
tatgttcatatgtatgtatatatgtatgtgtgggcataaatacatacatacatatataagtaggtagatatgtatgtacatatgtatatatacatatgtatgtatatatgtattgtgta

SEQ ID NO: 93545 - DNA, 105 bp, Mus musculus
tcctggcccagtccatttgatgcttcttgcactgtgataggcatttttttctttaattagagaaattttctatgattttgttgaaaatattttctgggactttga

SEQ ID NO: 93546 - DNA, 79 bp, Mus musculus
acacacacacatatgtatgtatatacatgcacatatatatgtatttatacatacatatatgtatatgtatacacacaca

SEQ ID NO: 93547 - DNA, 84 bp, Mus musculus
tatctggtgttgcagagactcaagactgtctgcagtgaatgccattgcctgttcaagtttgtcctggaagtcactggctagatg

SEQ ID NO: 93548 - DNA, 71 bp, Mus musculus
catagctgtatgagcatcacctgtataactgatgcctgaggaagtcaggagagagtgctgagtcagttgtg

SEQ ID NO: 93549 - DNA, 110 bp, Mus musculus
cacaaggcattagatcattgcacagtgcccaaggtatggctttacacactcactgtcacagttgaggcctgggaaccttgtgactgtgtggtggctactacaaactggtg

SEQ ID NO: 93550 - DNA, 106 bp, Mus musculus
aggcttacatgtgtgcctcgtaattgccatctccctctctatgtgtgtgtgtgtgtcacaaaatgtcaatcacacatctgaagctgtgggaggtataatgaagcct

SEQ ID NO: 93551 - DNA, 86 bp, Mus musculus
ttggtcattgtgcatatggatgctaagatacacagaagtcagtgatctctatgcctcacttggtagcctatgagctacaggtccag

SEQ ID NO: 93552 - DNA, 80 bp, Mus musculus
ttgtttggtatatatgtatgtaagtatgtatgtatgtaagcatgtatgtatatacacacatatataattgtctaatacaa

SEQ ID NO: 93553 - DNA, 83 bp, Mus musculus
gctgagtgattacagtgaggtcagtattgagctgtataacaaggagtgggtacaaatttctgtctgtctgtctgtctgccagc

SEQ ID NO: 93554 - DNA, 112 bp, Mus musculus
gtgtccatgtgtatatttatatgcgtgtgtatgggtatgtgtttagacatgtatatttatttgtgtgtacttgtatatatgtgttggtgaatgcttatgcatatgtacataa

SEQ ID NO: 93555 - DNA, 78 bp, Mus musculus
atgcttatgtatttgtgtacatgtatacttatgggtacacatgaatatttgtttatatgtgtgcatgtatatgagcat

SEQ ID NO: 93556 - DNA, 85 bp, Mus musculus; identical to SEQ ID NO: 57470

SEQ ID NO: 93557 - DNA, 79 bp, Mus musculus; identical to SEQ ID NO: 72631

SEQ ID NO: 93558 - DNA, 85 bp, Mus musculus; identical to SEQ ID NO: 71082

SEQ ID NO: 93559 - DNA, 60 bp, Mus musculus
ttgtctctccctgtctcagaattcggtatgagccctgtctctgagacacagaattgataa

SEQ ID NO: 93560 - DNA, 65 bp, Mus musculus
ttgtatatgtgtgtatatatatgtgtgtgtgtgtctatatatatatgtattttatatatatataa

SEQ ID NO: 93561 - DNA, 119 bp, Mus musculus
gcttgccggttgttgcacccgcctggggtggggagggtgtctcttgggcagaagactgtcaggagacaaggtcctctacacaccaacccaccagagtggctggtgcgacgcctacaggt

SEQ ID NO: 93562 - DNA, 92 bp, Mus musculus
ggggtgtcaaattccctggaactggggatagttgtgagctgccatatgggtactgggaattgaacccaggtccttaaccacttaaccagccc

SEQ ID NO: 93563 - DNA, 107 bp, Mus musculus
ggaaaggtgaaccaagttcccagaatcaggtgcctgtccataattctgtgactcagtcacacagacaatgtcccaagcttctggcattctggctagactccacctcc

SEQ ID NO: 93564 - DNA, 81 bp, Mus musculus
tttaaatgtgtgtctaggaccttttgaattcatggtctattccaggaccgagatgggttggaacagatttagaagcacatt

SEQ ID NO: 93565 - DNA, 116 bp, Mus musculus
tccccatgccccgccccaccccgtgagactgacaggcttgttggacactctttccctgttgcactactgtgggcctctgggaagcagtgcaatgatgaaagggcatctgtcgggcc

SEQ ID NO: 93566 - DNA, 121 bp, Mus musculus
tatatacatacataaatacacacacacacatatatgtgtttatacttatgtatatatacatgtatatatacatatgtatgtatatacgtgtatacacgtgtgtgtgtatatatagtatata

SEQ ID NO: 93567 - DNA, 72 bp, Mus musculus
aggtgggtgcatacttaggcagaggaggggcccctggcaccaagttcccttactgtctctctgtgtttgcct

SEQ ID NO: 93568 - DNA, 112 bp, Mus musculus
gctttcaagcagacatttttaggatcgtagtctgtgtaaccactctgtagctctgtctctcgaaaaagtatgctgggtggagcagagctcctggagtagtctgaaagaaagc

SEQ ID NO: 93569 - DNA, 64 bp, Mus musculus
gtgtgccaaggtacacgcatgtgctcccctgggtgtgggtgactgtgtgtgtcagtgtgtgcat

SEQ ID NO: 93570 - DNA, 84 bp, Mus musculus
cctttaatcccagcactcaggaagcagacacagtcaaactctgtgagtttgaggccagctgctctatggtactgtctctgaagg

SEQ ID NO: 93571 - DNA, 70 bp, Mus musculus
gtgtgtgagtactcactcagcacacggaggctaaaggacaactctgtgggggtgggctctctgttcacat

SEQ ID NO: 93572 - DNA, 71 bp, Mus musculus
gatgagctttcacagcagccccttgtagctccactgaggccagggagagctctgctgtctctctgtctgtc

SEQ ID NO: 93573 - DNA, 110 bp, Mus musculus
gctgtcctgaacgaacttttatacttgaactcagacactgcatgtggatgtcagcactggcattttgtggtgtgcagaagtcaggctggaggctagctggtcaggacagc

SEQ ID NO: 93574 - DNA, 84 bp, Mus musculus
ttcggggtctgtctctatctctgtaaaatagggttgcaataggcctcagctcttggtgctggagatgagggtggatgccctgag

SEQ ID NO: 93575 - DNA, 81 bp, Mus musculus
gagaccagagagtctcactgtgtttccctcactgttcagtgggtggggggtgagtgggtgcagggggagcatttctgtttc

SEQ ID NO: 93576 - DNA, 118 bp, Mus musculus
acatatatatacacacacatatatattagatatatacatatatatgtctatatatgcatatatatctatatatgtatatattagacatataagtatatctatatatgtgtatatatgt

SEQ ID NO: 93577 - DNA, 91 bp, Mus musculus
ggctggaaagtggctcagtggttaagagctctgactgctcttccagaggtcctgagttcaattcccagcaactacatgatgactcacagcc

SEQ ID NO: 93578 - DNA, 89 bp, Mus musculus
agtagacacaggtaaaaggatgttttgataaatccatcatgagaggacgtgtgatgaaggattcttcactaacaacaggttgtgctgct

SEQ ID NO: 93579 - DNA, 102 bp, Mus musculus
tgtattcatgtggaactggagagatgcctcggcagttaagagcactgactgctcttccagaggacccagattcaattcccagcacctacatggcagcttaca

SEQ ID NO: 93580 - DNA, 70 bp, Mus musculus
caggctgaggggaggctacacatggatcctttctgctccctccatccctgtctgtctgtctgtctgtctg

SEQ ID NO: 93581 - DNA, 112 bp, Mus musculus
ttactttctgggtctggagagatgccgctggttaagagcacagacagctcatgcagaggacgtgagttcagctcttagtgagcattagtgagcagttctcaaccacctgtga

SEQ ID NO: 93582 - DNA, 70 bp, Mus musculus
tcagtttgtgacatacattcagattctatacaatctcctgtgttgagtctgtctgtcagtcattctccga

SEQ ID NO: 93583 - DNA, 101 bp, Mus musculus
acaagggctactgccagaggcagccagtgattagagtagttactcagcagacttttctctgaggtaacaaagcttaatttactggggctggcactctctgt

SEQ ID NO: 93584 - DNA, 83 bp, Mus musculus
gtgtgtgcacgtgtgtgagtgcatgtgtgtgcacacgtgtgtgagacatgtgtgtgtacatatgtgtgtgtatgtgcatgcac

SEQ ID NO: 93585 - DNA, 79 bp, Mus musculus
agccaaagcaaaaacagggaagcagagcaactgccaaaagatgtgacagtctggttacctgcttgaccattttgctgct

SEQ ID NO: 93586 - DNA, 83 bp, Mus musculus
tgctaaggagagaggcttctggagctgaagagatggctcagcactgactgctcttccagaggtcctgagttcaaatcccagca

SEQ ID NO: 93587 - DNA, 97 bp, Mus musculus
ttaaacacttgtgcccccattctgactctctcagtggttaaaaacaaggcacccgggagctggtgagatggctcagtggttaagagtgccgaccgct

SEQ ID NO: 93588 - DNA, 69 bp, Mus musculus
gctcacagaggctcctccaccagggacaatagtggctctgcagaactgtcccagtctctgacagacagc

SEQ ID NO: 93589 - DNA, 117 bp, Mus musculus
gcacaaggtaggtggggttaaggagataggacagactcctgacagaagacactgagcactgttctgtggcgagcatgtcagcatgtctgtcctgccctccccatgcctgcacactgc

SEQ ID NO: 93590 - DNA, 113 bp, Mus musculus
ggcctggagctctcagagtaggcccagctgactgcctagtcagaggatcgtcctgtggctacctccctctgtgcctggctttttacatggattctgggaaataaactcaagcc

SEQ ID NO: 93591 - DNA, 79 bp, Mus musculus
ccggcttctgggggactcttgtatcatgctttgctgtgtcctttgcaactcgatggagcctggctccctctgtggttgg

SEQ ID NO: 93592 - DNA, 111 bp, Mus musculus
gttctgagggttagggacttctctgaaggttggaggcccctcccttcacagcaaggaacctgtgggtctctcagaccctgagagaaggatggatggactgacatatagagc

SEQ ID NO: 93593 - DNA, 105 bp, Mus musculus
gggagtatggtccaagagttgtatatccagccaaagtgtcactcaactgtgaaaacagtagacagacattttcgaacatgtaagagctgaaagatcattgctccc

SEQ ID NO: 93594 - DNA, 118 bp, Mus musculus
actcgaagcgcctgttctgtgagcatgactgcactgggtcagccggcagccttgagtgtgtcactctctgcctgtgccatcgcagctgtgctcaggactccagagcctgctggtgggt

SEQ ID NO: 93595 - DNA, 71 bp, Mus musculus
aagactgacattacaacttgatatgccctgtttctggggtgagaaatgtcagagaggtcagagtgagtctt

SEQ ID NO: 93596 - DNA, 61 bp, Mus musculus
gagctcaacacacagggtctctccctctcattgggaggggaaggtttctggtccctggttc

SEQ ID NO: 93597 - DNA, 121 bp, Mus musculus
taccttgaagtatcttgcaagaattgaactctaggggctggagagatggttcagcggttaagagcactgactgctcttccaaggtcctgagttcaaatcccagcaacgtcatggtggctca

SEQ ID NO: 93598 - DNA, 74 bp, Mus musculus
gggaaaggatgggggggggggattggcaaaggacttgtaaaggccagtgacagtgtctgcctctctctgttcct

SEQ ID NO: 93599 - DNA, 88 bp, Mus musculus
gatggcagctgtgtgcctgcctggctgcgtgttgactagattgaatagcagtggaacacaagctcaggcttacccacaggctagcctc

SEQ ID NO: 93600 - DNA, 93 bp, Mus musculus
cgctgagagcccaagagggtgccactaggtctggctgtaatcactttttatatttctgaattcacttttggttttcatttgttggcttttgtg

SEQ ID NO: 93601 - DNA, 113 bp, Mus musculus
agaaacattatcagggcttcttaatgaatttgagtgtgtctgtctgtctgtgtatgttggggggccgagttacaggcacaggataacttttttttttcctagcccgggtttct

SEQ ID NO: 93602 - DNA, 109 bp, Mus musculus
agtgggtgctataagtggtgatgatgttacctgtattcttgaatgtttcaatttatatttacctggaaaactggttcatttttgttaaggattctatgttgcattccct

SEQ ID NO: 93603 - DNA, 85 bp, Mus musculus; identical to SEQ ID NO: 70941

SEQ ID NO: 93604 - DNA, 85 bp, Mus musculus; identical to SEQ ID NO: 57470

SEQ ID NO: 93605 - DNA, 96 bp, Mus musculus
gatcagccttagtccatggtgatctgataggatgcatgggacaatttcaatatttttgtatctgttgaggcctgttttgttgccaattatatggtc

SEQ ID NO: 93606 - DNA, 71 bp, Mus musculus
atatgtgtgtgtatatatatatgtatacatatgtgtatatatataaatatatatatatatatatacgcgca

SEQ ID NO: 93607 - DNA, 85 bp, Mus musculus; identical to SEQ ID NO: 57470

SEQ ID NO: 93608 - DNA, 85 bp, Mus musculus; identical to SEQ ID NO: 57470

SEQ ID NO: 93609 - DNA, 96 bp, Mus musculus
acaagaagagatttaattaagacataccttatagggatgcatgttccaagatctctcactctctgtgtattgtctggctgtgatctctgtatttgt

SEQ ID NO: 93610 - DNA, 107 bp, Mus musculus
agcatgccatttctctccctgcttcctacaaccgatttcatctctcctcctcaggggctcagagatcagagtggtcatgcaatgggcttggagcaacagagcatgtt

SEQ ID NO: 93611 - DNA, 85 bp, Mus musculus; identical to SEQ ID NO: 57470

SEQ ID NO: 93612 - DNA, 128 bp, Mus musculus
cggtgagtgggaagggtagcacttctcctgcgtgggctctgaggagtcctctctgtctctctcaaggacttggaagctagcaaggcagatgctgttaactgtagtacttgcttgctttcaggggttct

SEQ ID NO: 93613 - DNA, 80 bp, Mus musculus
acttaatctctgttagggttcccttctgcttctaatattttcatagtaagagcacagagagagcacatagagggaagagt

SEQ ID NO: 93614 - DNA, 72 bp, Mus musculus
taagacttcagagaggaactgcatagggggacttctctgtctcccactatctgagacccctttggagcctta

SEQ ID NO: 93615 - DNA, 80 bp, Mus musculus
tgtgtgtgtatgtgtgtatatatatgtgtatatatacatgtatatatgtatatatacacatatacatacatacacacata

SEQ ID NO: 93616 - DNA, 80 bp, Mus musculus
tgtatgtgtgtatgtatgtatatgtgtatatatacatatatacatgtatatatacacatatatatacacacatacacaca

SEQ ID NO: 93617 - DNA, 66 bp, Mus musculus
gctgaagttccaagactagttgccaactcccatgttagggtgctcacaactgtctgtaactccagc

SEQ ID NO: 93618 - DNA, 104 bp, Mus musculus
gacaccaacgcagacacatagttaaaaacagtcaatctttttttttaaagtgtaccttactataattttaaaatactgttcttcaagactaggtgtggtggtgc

SEQ ID NO: 93619 - DNA, 74 bp, Mus musculus
gagagcaggacatgtcccactggttaggagtgctcactgctcttacagataactgggatcagctcccagctctc

SEQ ID NO: 93620 - DNA, 114 bp, Mus musculus
ggcagaaacatggtaaaagtaagacagtgtattaattcaagaaaactttttctgtgcacatagagaatttctatttgtgaattataaacacttgttacaatatatgtaaatccc

SEQ ID NO: 93621 - DNA, 73 bp, Mus musculus
gtgctggtggcacagacctttacagaggcagaggcagacagatctctctctctctgtgagtgccaggccagcc

SEQ ID NO: 93622 - DNA, 126 bp, Mus musculus
ttctccagtctgttagtcccaagttctatgggcatgagggaggacctgttctcatctctgtggctcagggatcagtggcaaatttgagtcagacaggagagatttcagctcccagcctgcgacttg

SEQ ID NO: 93623 - DNA, 77 bp, Mus musculus
agaatggtgactaagtcagcaagcgtgtaagcacactttagtatgtatgcatgtatgatgctgcacaccacctatct

SEQ ID NO: 93624 - DNA, 126 bp, Mus musculus
gagaagtcaggaaatactgtttaaggaacaattctgagctctcttctggatatgacagcctggtttcttgagagcttgtttgggatgtctagcaggggaacgtggctacttataaacacttgaccg

SEQ ID NO: 93625 - DNA, 68 bp, Mus musculus
tatacatatatatgtatatacacatatatacatgtatgtatatgtatatacatatgtatatatgtgtg

SEQ ID NO: 93626 - DNA, 118 bp, Mus musculus
atgtattataaattttatatatgtatatatgtgtgtgtgtatatatatataaataaatacattttatatgtgtgtatatacatatacatacacatatatatgtattatacattttata

SEQ ID NO: 93627 - DNA, 66 bp, Mus musculus
cctatgggctgtggaatatataggcagctgaatgtgtgtgaggtgagtgtgcatacagttcatggg

SEQ ID NO: 93628 - DNA, 115 bp, Mus musculus
agagagagagagatatggaagctggagagatggctcagcggttaagagcactggctgctcttccagaggtcctgagttcaattcccagcaactacacagttgctcactaccatct

SEQ ID NO: 93629 - DNA, 86 bp, Mus musculus
ccaagctgcagtgtcccaccaggcttgagtgggcctcttggaaactgagaggcagctgagcatcgtggttagaagctctggcttgg

SEQ ID NO: 93630 - DNA, 70 bp, Mus musculus
ttggagaaagtgtgtcattaggggtgggctttgaggcccagtctctgtctctgcctctaacttgcagatt

SEQ ID NO: 93631 - DNA, 77 bp, Mus musculus
agggtagttataagagttgatgtacaggtcctggagagatggctcaaaagtgcactgactgctcttccagagatcct

SEQ ID NO: 93632 - DNA, 116 bp, Mus musculus
ggtaccctctcgtgggaggccgtggcgggatcttggcccccagagcgcatgcacctcagtggtctctgtgtcactgctgctggtggcactgtcccggaaactggcgaggggtggcc

SEQ ID NO: 93633 - DNA, 84 bp, Mus musculus
ctctctaggtagtcctgggtgtccagagactctctatatagactatactggtctcaaacactcattgtctctgcctctcaagag

SEQ ID NO: 93634 - DNA, 102 bp, Mus musculus
atgttaatatatatatatatgtatatatatatatatacatatgtgcatatatatgtgtgtatatacatatgtatatatgtatgtatgtatgtatgtgtgtgt

SEQ ID NO: 93635 - DNA, 106 bp, Mus musculus
gccttagtccatggtgatctgataggatgcatgggataatttcaatatttttgtatatgttgaggcttgttttatgaccaattatgtggtcaattttggagaaggt

SEQ ID NO: 93636 - DNA, 71 bp, Mus musculus
gtgcatacagtgtgtctctctgactggtctggggtccctctggttgctatctgagatactctgtcatgctc

SEQ ID NO: 93637 - DNA, 61 bp, Mus musculus
cctagtgtgcctgcctcccagaaggccatctggaccaactggaatctgcaggttagacagg

SEQ ID NO: 93638 - DNA, 86 bp, Mus musculus
atacacacttgcgtgcacacacacacacacacagtggttctgcatgtggaagcaagcatgcagtgtttgtccttctgagtgtgtgt

SEQ ID NO: 93639 - DNA, 78 bp, Mus musculus
tgtatatatgtgtacatctatgtatgcatacatatacacacacatcaatgcacacatatctatttatatatgtataca

SEQ ID NO: 93640 - DNA, 60 bp, Mus musculus
cctggtgaacacagtgagctctgggggaggcagggcatagctgtaaatgtgaaaactggg

SEQ ID NO: 93641 - DNA, 111 bp, Mus musculus
ctcattatcccctcaccagttggcgacatccagcttgattccatttcacagctattttgagcagagcagcaatgatcaagatgggtgagcgtctctagagtcggaagtggg

SEQ ID NO: 93642 - DNA, 107 bp, Mus musculus
attaaaatggtataaaaagcaggttgggaaaattaaatttgccttcagtctcagaattgactgaggtcacgttacaatgttgtctaactgtcttttttccttttaat

SEQ ID NO: 93643 - DNA, 92 bp, Mus musculus
gttgggaatcgaaccctagtcctctggaagagcagctggtgctcttaactgatgagccatctctctctgtctccaattagttggttttgaat

SEQ ID NO: 93644 - DNA, 120 bp, Mus musculus
caggactggggacgtgagcgatgtctgccaccttacactgtccctctcttacactgtaactctgtgtgtgttggccatcttaacagtgtctcaggccctcgactgtcacgtttccttctg

SEQ ID NO: 93645 - DNA, 115 bp, Mus musculus
taggtgtatttttggctgcattgtgaatgggtttgcatgatctcttcctcagtgtgtctgtgaccagtgtgaggaaaggatgctgacttttgtaagctgattttgtgtcctgcta

SEQ ID NO: 93646 - DNA, 87 bp, Mus musculus
accagggcactcgatgacaggattatgacagtggctgttctctgcacaggtcgccgcctcagcctctgtattccagcggatgcaggt

SEQ ID NO: 93647 - DNA, 99 bp, Mus musculus
gcacatcctgctggtgttgtacatgtctctgttagtctctctgcttctcccaatccgtgggactcagcaagaaggagatgatgacccggtttgctgtcc

SEQ ID NO: 93648 - DNA, 83 bp, Mus musculus
gccctccatttgctctggtctctcagtctctcaattcaccaggaagctgtgagattctctggagagactaggtttggaaaagc

SEQ ID NO: 93649 - DNA, 112 bp, Mus musculus
ggactgctctagaggtaaagacgttggagtttctgtgtttggtgcaggggtagccgtggctgcaagaagtgactaagcacacatgattcagcttgcctgtctgtgggactcc

SEQ ID NO: 93650 - DNA, 115 bp, Mus musculus
ggttttgagagttttttatttggggctggagagatggctcagcggttaagagcactgactgctcttccagaggtcctgagttcaattctcagcaactacatgatggctcacaacc

SEQ ID NO: 93651 - DNA, 105 bp, Mus musculus
gtcatgttggccaggtacctagaaagttcctactccactaacgccactgacacatcagtgaagtgagactgcagatgtactgtgggtatgggctagttatatagc

SEQ ID NO: 93652 - DNA, 62 bp, Mus musculus
tctgttgagtctgtctgtgcctgtgtaattgtccatacttcaggaggcagtaagaccacaga

SEQ ID NO: 93653 - DNA, 115 bp, Mus musculus
tccgagggaaatgtgtcactgtatgggctacagacccataggactgggcgcagacactagttagtcagctccctgaggcagctgttggaccatggagaaagagcatccttcagga

SEQ ID NO: 93654 - DNA, 70 bp, Mus musculus
ggttgcctcacagtgaacttactctcaacacagacatgtgttcctgtgtggttgacttcaggtatagacc

SEQ ID NO: 93655 - DNA, 67 bp, Mus musculus
ggataggtagagagaagggaactcactggttagtactgcagccagccactgttctctctgagtctcc

SEQ ID NO: 93656 - DNA, 76 bp, Mus musculus
gagacaggctctctcactgaacctctagctcatcattttagctagacaggttcgtcagtcagtgaacccgcctctc

SEQ ID NO: 93657 - DNA, 86 bp, Mus musculus
tatatatgtatatgtatgcacatatatgtgtgttatactatataatgtatataatatatatacatatatatacatacatacataca

SEQ ID NO: 93658 - DNA, 69 bp, Mus musculus
acttgagaacccagatcacctgatcccacagtctctgtgactgtgtctgtgtgactgtctttcttcagt

SEQ ID NO: 93659 - DNA, 74 bp, Mus musculus
gtttatgtgcatggatattctgcttgtatgtatgtatgtatgcatatatatatatgcactacatgtacatgtac

SEQ ID NO: 93660 - DNA, 78 bp, Mus musculus
ccctgacagacaggctgactgactggttcatctataagaatatctagaataagcaaggggaatgtttgtctgccaggg

SEQ ID NO: 93661 - DNA, 60 bp, Mus musculus
actctgtctgtcacagtcacagtgtataagagagcacactctgtctgtcacagtcacagt

SEQ ID NO: 93662 - DNA, 85 bp, Mus musculus
tgtttttgtgagacaagctctctgcattatgtagctctggccatcccagaacttactgtgcagaccagattggcctccgaattca

SEQ ID NO: 93663 - DNA, 77 bp, Mus musculus
tgtcctgaaactctgtagaccaggctggcctcaaactcaaagatctgtctgcctctgtctcccaagtgccggggtca

SEQ ID NO: 93664 - DNA, 76 bp, Mus musculus
gatctgtagagcatggcaccaagagggacgacatctggcaagagattaaatctctgtgtctcactttgtgcaggtc

SEQ ID NO: 93665 - DNA, 56 bp, Mus musculus
tcaccctccctctgactctctctggtcccagggcaagctttctttgggagcggtgg

SEQ ID NO: 93666 - DNA, 67 bp, Mus musculus
tatatgctgttcctcccacagtctgtctgtttgcctgcaggcctggagagcaaaccctgggcatgtg

SEQ ID NO: 93667 - DNA, 76 bp, Mus musculus
cttcagactcactcactgggtgagcaaagccccaggggcagttgctttgagtcatcctggtgagtaaactcgggag

SEQ ID NO: 93668 - DNA, 81 bp, Mus musculus
catagaattattttcattgctacttcttaactgagattttactactgttatgaatggtaatgtaaatatctatgttctatg

SEQ ID NO: 93669 - DNA, 94 bp, Mus musculus
ggggtggactggggataagggtactgaatgctggtcaaagtctctcttcttaagctctctccctgtccctcagatcttaatgcccatccatcct

SEQ ID NO: 93670 - DNA, 85 bp, Mus musculus
gagaacaaaggaggtgggggctggagagatggctcagaggttacgcacactgactgctcttccagaggtcctgagttcaattctc

SEQ ID NO: 93671 - DNA, 95 bp, Mus musculus
aacaagtaaaccagagctttaaaaatgttgcacaggaataaagatgagtcatcgtcttatttatttgtttttatttagaaagctgttaatttgtt

SEQ ID NO: 93672 - DNA, 127 bp, Mus musculus
gagcacaaagggcctgttgctccacatctgcgctcttagtctgtaggcgagtgtggaagacaagtgaattcgtgctcctgtcaacttctcagatggtagagtctgtctgagcccacaggacaagtac

SEQ ID NO: 93673 - DNA, 130 bp, Mus musculus
tagtcacagagaggactgactggtagtcacagaggggactgactggtagtcacagagaggactcagagaggactgactggtagcacaggggccatcacaactccagccctgagctccttcccactttgag

SEQ ID NO: 93674 - DNA, 86 bp, Mus musculus
gctctgacttgactgcacagctacccatttcttggcgctgaagagacaaaagatgagttctgtgcacattgcatccatcaggcaga

SEQ ID NO: 93675 - DNA, 109 bp, Mus musculus
gggaagtatggccttgttggagaaggtgtcacttggtgcaggcttctctgccgcctattagcaggtcgagatgtgagctctcagctcctgctccagcaccatgccttgc

SEQ ID NO: 93676 - DNA, 116 bp, Mus musculus
tgttgtgtagtaatttcctctgaggaaaaaacatttcatcttaagagaaggcttaagactctgggtgttctaaatggaggtgcaacatttcatcctgggcagaaagctccttgaca

SEQ ID NO: 93677 - DNA, 103 bp, Mus musculus
tgttagccttcttagaaagatagtgttccttctgtttctatttcattatttaatggaatagtttgaggaatcgtggcattaggtcttctttgaaggtctggta

SEQ ID NO: 93678 - DNA, 77 bp, Mus musculus
cactgccttaatgtgtgcccatcctggagattcctaacctagccgctcaggaatctgtcagaacacacacagcagtg

SEQ ID NO: 93679 - DNA, 80 bp, Mus musculus
cttctatcagtctgtctcagtgtggaggactccaaatcacggtgaggatgttgtctggcaactgtgcggaggaggaggag

SEQ ID NO: 93680 - DNA, 108 bp, Mus musculus
ctgtgggcatttcatccttcttatatatcatgtatgtatacatatatatgtatatatatcatatatgtgtgtgtatatataggtatatatatatttatgtctttgcag

SEQ ID NO: 93681 - DNA, 101 bp, Mus musculus
attctctttgctcagatgcttagaggcagagagaagtctcagaggatacaaaagtcaatcggacttctgtccaatctcatgggcagaaaagcagaggggat

SEQ ID NO: 93682 - DNA, 102 bp, Mus musculus
tcaatacatttacattttttatataaaattaggttttttgccaacaaaaatatgtttgtatttatggatattatctagaattgtgagaaatgtgaactttgg

SEQ ID NO: 93683 - DNA, 66 bp, Mus musculus
atctggatacatctttgttgggtgatggttaacgttgattgtcaacctgacaggatgatgtaagat

SEQ ID NO: 93684 - DNA, 119 bp, Mus musculus
tcccttacaaattctgtttcagtaatgcaggctactgtgccctcagtacaaatgatagctcctccctccctgtttggcacatggagcctgccttgccctgatgatttcttgtgctggga

SEQ ID NO: 93685 - DNA, 103 bp, Mus musculus
attctggtggatgtaaatgaaattgcaaagtagttttgattttcattcccctgatgactgaagatactgaacacttctttaaacatttctcagccatttgagt

SEQ ID NO: 93686 - DNA, 68 bp, Mus musculus
acacactagacagggagcagagaagttgagaccttgccagctttctctcactctttatcctggtctgt

SEQ ID NO: 93687 - DNA, 134 bp, Mus musculus
cagtaaacccatgtgtgtgtgtgtgtatatatatgtgtgtgttcgtatatatatatacatatatatacatacatacatacatatatagttattgagatggtctttctatatatgtgtatatgtataaatgtata

SEQ ID NO: 93688 - DNA, 59 bp, Mus musculus
ttgcatttgtgaaagtccaggacttgaaatgaggtctctgggtctgtcactgaatgtga

SEQ ID NO: 93689 - DNA, 98 bp, Mus musculus
gcattatatatgactatatatatgtgtgtgtgtcaaatacacatatatgtatgtatattatacatatttatatacacatatatgtgaatacgtgatgt

SEQ ID NO: 93690 - DNA, 145 bp, Mus musculus
gttgtatatatatgaatgtgtatatctatatatgtatgaacatatgcatatatatattgaattcatatatatgagtacatatatatgaacatgtatatatatatgcatatatatatatatacacacatatatatatgaacatata

SEQ ID NO: 93691 - DNA, 98 bp, Mus musculus
ccaggccccatttagtgcatgcaaagtctttgttatccatgattttatttgtattgaaagtacatagtaacacatagacttagttctgtgggtgaagg

SEQ ID NO: 93692 - DNA, 84 bp, Mus musculus
agggtcctttacaaggttgaattgttctaaggtttgaagcagagagctgacagacatgcacagctcaggattttgaagcattct

SEQ ID NO: 93693 - DNA, 72 bp, Mus musculus
tcctctgtctgtatcagtcacttgtaatgttcctatcatagttacacagcatcgggacttgtgtatagagga

SEQ ID NO: 93694 - DNA, 98 bp, Mus musculus
gaggtggtccctaccttcaaggagctcacagtctattgagttgcctttctgattctcccactagattgtgagctgctggagggcaggcacttgaattc

SEQ ID NO: 93695 - DNA, 79 bp, Mus musculus
tatgtgtatgcaggagtgctcacatatatgtatgtatatatgtatgcatgcatgcatgtatgtgcaccatgtgcagtcc

SEQ ID NO: 93696 - DNA, 111 bp, Mus musculus
cctattcgagatccctcagacattttgttgcactgagctggtgattatttttttttccttgggaaaggcatataagtgcttctgtgagcgagagcaagaggtgattagagg

SEQ ID NO: 93697 - DNA, 107 bp, Mus musculus
ggctaagttagttggccaatgaccttcatggatctatctatctatctatctccacctacctcacatggctgggttatagatacccatgaccatggccagctttagac

SEQ ID NO: 93698 - DNA, 90 bp, Mus musculus
gttgccctgttgctgctgctgctgctgctgatcatgatgatgatcatgatgatgattcctttgctaattgcagaaccagtattttccagc

SEQ ID NO: 93699 - DNA, 70 bp, Mus musculus
ctctgccaggctgcgtgtttgagcttgcctgtttctgcagatgaggtcgagggcactgtgctgtgtgggg

SEQ ID NO: 93700 - DNA, 115 bp, Mus musculus
gcaggttgctgccgtgtgaaatgcaggccttcatttatgtctgaagagtgtgtccaagtattcctgaattgtggacatctggagagagagagctctgcaatgagagccaatctgc

SEQ ID NO: 93701 - DNA, 83 bp, Mus musculus
ccattttgctttctgaagattcagtgcacattgccaggaagtggtatgttgcacttttaatccccaaagagcttgagccctgg

SEQ ID NO: 93702 - DNA, 66 bp, Mus musculus
aggtttgctttgcagtacagacttctgtctgatgtcagatcagacagagaactgcctcggctttct

SEQ ID NO: 93703 - DNA, 115 bp, Mus musculus
tcagtttccttcctttatatacatatggctgccttccttaaaagtagagactgagcactaagcattcttttgacagtagagcatcgtacattctaaccgcaggatggaaaactga

SEQ ID NO: 93704 - DNA, 64 bp, Mus musculus
agacagggactctctctggctgactgtccaatggactatcagagcccctcagatctgcctgtct

SEQ ID NO: 93705 - DNA, 106 bp, Mus musculus
taatacacatatattatacatatatgtaagtatacataagtacatacgtatatatgtatgtatgtatgtggtgcacatatacaagtaatatgttccacatgtatta

SEQ ID NO: 93706 - DNA, 113 bp, Mus musculus
tttatatacagataaaaaggtaagtatttagaagggagtttgatactatatttatttcagaaaataagagttagtaggttctcactaaggcctatgatcctctgtgctataga

SEQ ID NO: 93707 - DNA, 105 bp, Mus musculus
catatatactgttatttcatattgggttaaaatgaagaatactgtttttgtttatcatcctgtggtagatcattgttgcttaattgtagggtaagagtgtgtgtg

SEQ ID NO: 93708 - DNA, 103 bp, Mus musculus
gttgtgccttgaacttgaggtctccttgccttggcatccgcaatactgagagatcagtgtgagccaccatgcccaggtgcaggggaaatcttctcaatgctgc

SEQ ID NO: 93709 - DNA, 118 bp, Mus musculus
acaatcataacatctgtggattatatatgtatacaagtaacattgtttttgaactctccatattttttaatttatcgattttgctgtatgttcatattttttctgcaagagtgactgt

SEQ ID NO: 93710 - DNA, 110 bp, Mus musculus
gaatgagactttattttataataactagcaaagtctagtactagagttttgatttttatgtagtcttctagacaggtggtggttgctctttgttacttgaagttttgatc

SEQ ID NO: 93711 - DNA, 74 bp, Mus musculus
gcaatgaagacatctctgaagtcactgagcacagtcaaacgctcattgaggtggctgtgtgcttccttgttttc

SEQ ID NO: 93712 - DNA, 115 bp, Mus musculus
agtgctatggtttctgataaggagaatctgcttggcttgcaaatggtctctttctctctgagatagagacaatgcacagtgagaaggaatctctgatgtgtcctcttacagtatt

SEQ ID NO: 93713 - DNA, 114 bp, Mus musculus
tctcccttacttttgtttaaaatgccacaaatgctcataaaataggtacagtggatagagtgcagcttcaagtgagaaaaacaaaaggtaaatttttaaagagagagagagaga

SEQ ID NO: 93714 - DNA, 85 bp, Mus musculus; identical to SEQ ID NO: 57439

SEQ ID NO: 93715 - DNA, 85 bp, Mus musculus; identical to SEQ ID NO: 57470

SEQ ID NO: 93716 - DNA, 97 bp, Mus musculus
tctatatatttggtggtggtgttcagaaaatctattcttttcaagctgattctaaaattgttaatcattttttgaacttttctcccagatgtttggg

SEQ ID NO: 93717 - DNA, 81 bp, Mus musculus
ggtacatgtatatacacacatatatgtatatacaaacataaacatgtgcatatatacatatattttgtatatgtggtgtat

SEQ ID NO: 93718 - DNA, 60 bp, Mus musculus
tatatgtatatatgcacatgtttatgtttgtatatacatatatgtgtgtatatacatgta

SEQ ID NO: 93719 - DNA, 158 bp, Mus musculus
ccatgcccggcctgttttaaattttatatgtttattttatctatatgtatgagtattttgccagcatgtaagtgtatgagccatatgagtgcacagtgtctgcagagaccagaagaggggggtcagagtccctgggattggagctgcagattgctgtg

SEQ ID NO: 93720 - DNA, 96 bp, Mus musculus
tctgtgtgtgcatgtgtgggaatatgtgtgctcatgcatgtgttgagtgtgtgcatgtgcttgtgtgtttatttataggtacacatgtgccacagg

SEQ ID NO: 93721 - DNA, 114 bp, Mus musculus
gttctgaaagatataaacgatggaggctggagagatggctcagcagttaagagcactgactgctcttccagcggtcctgagttcaactccagcaaccacgtggtaactcacaac

SEQ ID NO: 93722 - DNA, 116 bp, Mus musculus
tgctgttacaaagttcactgacagccaagtgtatttatttttgtatcatgatcttttattctttttttaaaaatagatttcctcctttcatccttgtgagcatttgaaatgtagca

SEQ ID NO: 93723 - DNA, 85 bp, Mus musculus; identical to SEQ ID NO: 57439

SEQ ID NO: 93724 - DNA, 68 bp, Mus musculus
atgtatgtatgtatgtatgtatgcatgcatgcatgcatgtatgtatccatgcatgcatgtatgtacat

SEQ ID NO: 93725 - DNA, 80 bp, Mus musculus
acatactataatatgtatgtatgtatgtatatatgtatgtatgtatgtatgcatgcatgcatgcatgcatgtatgtatgt

SEQ ID NO: 93726 - DNA, 102 bp, Mus musculus
ttctttcaatttgttattatcatattttcttggcacttatgatttagtgaatggtctgtcattcactcagtaactgctaactgtatgtcaagtagaaaagga

SEQ ID NO: 93727 - DNA, 97 bp, Mus musculus
gaggtctgtgactgtgtgtctctccacaaatacacatttttaaaatttttttaagctttattttattcatgtgtatgagtacactgtagctgtcttc

SEQ ID NO: 93728 - DNA, 116 bp, Mus musculus
cacttcttctttgcaacatggatttggaatattttgctctagatttaaaaaataatactctttttctattttttaataacatgtagtgtaaaatgtctctgtgtgtgatgtgtgtg

SEQ ID NO: 93729 - DNA, 109 bp, Mus musculus
ttgattagggttggcacaaccccgtgtttatttgcatttgcttatcaataactgaagacagattgctcagataaattcacatgtccttgtgctaggttatccttttcag

SEQ ID NO: 93730 - DNA, 85 bp, Mus musculus; identical to SEQ ID NO: 78067

SEQ ID NO: 93731 - DNA, 65 bp, Mus musculus
atacatatatgtatacactagcataatatatatgtatgtatgtatgtatgtatgtatgtatgtgt

SEQ ID NO: 93732 - DNA, 112 bp, Mus musculus
attggtgtctgttattccaatgctttccccaaacaaacttacagtcagaagacaagagattattttcttcatgacatgggtacaaagactaaattgaaagagacaaaccaat

SEQ ID NO: 93733 - DNA, 119 bp, Mus musculus
gcatatgtcggcccttgccattgtattttggaagtatgttatttattcaatgctatggattgaattgatactgaaaatagttaagatgtatggtgctacagggacttaaagaagtgtgt

SEQ ID NO: 93734 - DNA, 80 bp, Mus musculus
gctttgaatggcctgtgactcactatgtagaacaggttggcttgaatcctcagtgatctcagagtgcacagataagaagc

SEQ ID NO: 93735 - DNA, 85 bp, Mus musculus; identical to SEQ ID NO: 57470

SEQ ID NO: 93736 - DNA, 84 bp, Mus musculus
tatgcatgtatatgtacatatatatacatgcatacatatatgtatgtatgtatatatgatatgtatgtatgtgtgtgtatgtat

SEQ ID NO: 93737 - DNA, 110 bp, Mus musculus
ggttagagcttgttctttccgtgattatgttagcctctatcagcagacctgggagactagctctcttctgattttcagtggtcagtgtactctctgtaggcaaactctcc

SEQ ID NO: 93738 - DNA, 73 bp, Mus musculus
gttatctatttatagcagtgatatatatactatatgtatgtatgtatatatcactatatatgcgtgtgataat

SEQ ID NO: 93739 - DNA, 81 bp, Mus musculus
tagagacagagagagacacagaacaagcagctattatccagggtatctgtttcaagttcttgtctggagttcttgtctttg

SEQ ID NO: 93740 - DNA, 92 bp, Mus musculus
gatttaacccagctataggaagttggtttcttacactgtgtttaaatatttatttacactgagctgatggtcaatggatacatgggtttctc

SEQ ID NO: 93741 - DNA, 109 bp, Mus musculus
cctatattgtttgggattaaatactaaggatgtgcagtgtgtctgtatttcactcatattacacaaatctggaaggtctttggatgtgctcccccctacttaccatagg

SEQ ID NO: 93742 - DNA, 112 bp, Mus musculus
ccatttctcagagcttcttgtagttaagttaggcgtgtagatgcttatgtaatgtttataacattgcattgtccacatgaaccacttcccaggcaaactctaacctaggtgg

SEQ ID NO: 93743 - DNA, 85 bp, Mus musculus
catgtgggaatcagccaggatgtctggaaacctgtgggccgaacatcccactgtgcacacttcctgttctgaacttgctatcgtg

SEQ ID NO: 93744 - DNA, 108 bp, Mus musculus
cattcattctactgcaggtcctgggataggcttggaggctctggaggagagagaagagtgtgttctggggatggcatagggcacaagagactaactgtcactccagag

SEQ ID NO: 93745 - DNA, 84 bp, Mus musculus
atgttgaaatggaaggtaatctagtaagtaagaatgttaattcttgcttagaatcccaagagactgcttgaccagaaaagacat

SEQ ID NO: 93746 - DNA, 87 bp, Mus musculus
ctgtggggtgagagggcaggctttgaggtctcctaagctcaagttatgctcagtgtggctcacagtctctccttctgctgcctgtag

SEQ ID NO: 93747 - DNA, 80 bp, Mus musculus
tgaggtgtcagaggtgggagaagttagataatagctctcttgcactgtttgtctttgtctcccagtctctgtctctcact

SEQ ID NO: 93748 - DNA, 62 bp, Mus musculus
ggtgcatctgtgaagatcagaagacatcttgagggatttgttctctccttccactgtgtacc

SEQ ID NO: 93749 - DNA, 84 bp, Mus musculus
acatacatatgtatagctatgtatatgaatgtatttgcatatgtatagtataattgtatgtatgtatatgtatatatatatgct

SEQ ID NO: 93750 - DNA, 79 bp, Mus musculus
cacagtgaagagtggcagctgcttttcatttcctttaaatgagaacaacttaaatgtgactctgagtctctcactgatg

SEQ ID NO: 93751 - DNA, 111 bp, Mus musculus
gttagttgtacatttctcaccactcaaccgtaagcttttagaaagagatgactctattgtccctgtgtctgtctcagtgtctatgatctctcaagaaatgtgacaagttgc

SEQ ID NO: 93752 - DNA, 114 bp, Mus musculus
tttgggaggcagagacaggtggatctgtgtgttcaaggctcacttggtttgtatagaagttagttataggacagccaaggctacacaggaagaccctgtctcaaaacaaccaaa

SEQ ID NO: 93753 - DNA, 78 bp, Mus musculus
tatatatgtatatatgcacatgcatatgtgtataaatatgtatatatacatatatgtatgtgtaataatacataaata

SEQ ID NO: 93754 - DNA, 100 bp, Mus musculus
gagccatgttctggggctggagagatggctcagtggttaagagcactgactgctcttccagaggtcctgagttcaagtcccagcaaccacatggtggctc

SEQ ID NO: 93755 - DNA, 70 bp, Mus musculus
gtatgtgtgacttgtgtgtatgtatatgtgtatgcatgtatgtatgcgagtgtataacacgagagcctgc

SEQ ID NO: 93756 - DNA, 79 bp, Mus musculus
ggttttttttttttttgtttgttttttttaactgcttaaaatcctcaggtgcagttcagacaagagacagaacaaagcc

SEQ ID NO: 93757 - DNA, 91 bp, Mus musculus
cagacaagacaaagcctgaaggtaccgatgatccactctaacatccaagctgggatgggtgactctctgcctggctctcagttgtgtgctg

SEQ ID NO: 93758 - DNA, 64 bp, Mus musculus
atgtgtgtgtgtgtgtgtgtgcatgtgcactagattgcaggagtatgtatgtatgtatgtatgt

SEQ ID NO: 93759 - DNA, 81 bp, Mus musculus
ctctggctgaacagaagagtgttccctttggccagaaaatgtgctactctagcagtttctccatgagcacctgcagcagag

SEQ ID NO: 93760 - DNA, 75 bp, Mus musculus
ttgcatatgtgtgtagtatacatgtatttttgtgtattcaaatgtatatgggcatatgtattcatgtatgtgtag

SEQ ID NO: 93761 - DNA, 85 bp, Mus musculus; identical to SEQ ID NO: 57439

SEQ ID NO: 93762 - DNA, 82 bp, Mus musculus
tgagcattcagtggctctctctgtcttggtggattctggcttgagagcaggagtcaaggatgagggcagagctgaactctcg

SEQ ID NO: 93763 - DNA, 129 bp, Mus musculus
tacatgtatatgtatacatatatgtatacgtatatgtgttcatgtgtacttgtgtatgtgtatatgtatatgtatatgcatatatgtatgtatatttcatgtgcgtatatagcataatggtatattttg

SEQ ID NO: 93764 - DNA, 85 bp, Mus musculus; identical to SEQ ID NO: 57439

SEQ ID NO: 93765 - DNA, 110 bp, Mus musculus
gactgggagttttgatatttgttgttttctgagcagacagtggagagtgagtaaattggctaatcacccgtagtctctggagctggaggtagtgagagttaacccctgtc

SEQ ID NO: 93766 - DNA, 110 bp, Mus musculus
gtacatgagattgccctgtctcatttcttacagctgagtgtgtctctctgagtgtctttatgctacatccactccagtagtgacctgtatgacaggccaaaaacctgtac

SEQ ID NO: 93767 - DNA, 114 bp, Mus musculus
gaattttcagctttaagtgggagtgggtcaacatttttcccttgttagaataatttttctttaaaatagtgtttgagggctattgtgaaacctttccctgacgcctagttcaga

SEQ ID NO: 93768 - DNA, 128 bp, Mus musculus
gcatctccaaccaagatggctagaagtcctgctgtcagagctgtaggggcacccacgtgcacagacagacagacagacagactgtgactcatgggtgggcagcatgctgtgtgtagacactgtgacac

SEQ ID NO: 93769 - DNA, 100 bp, Mus musculus
tctgtactgaaaatcattgtagttttgtgggtttttgtttttgttttgctctaggatgaaaacaaaagtagtttggagaagaggcaggtggtagaacagg

SEQ ID NO: 93770 - DNA, 115 bp, Mus musculus
tgagagtctaaggtttaggactatatctagggatagttctcttgctggtagtgactctatgtcacaacacagtcaagagacagggccaatattggcttagacaaaagacctttca

SEQ ID NO: 93771 - DNA, 77 bp, Mus musculus
actgagatagagggtgtgtgcatgtgcatgtgcatgttcatgtgggtgtgcgtgagcactgggacttgtgtgtctgt

SEQ ID NO: 93772 - DNA, 74 bp, Mus musculus
ggtgcatacctgagggactgtcatggcgaggacctgggtttgctccctgtgactctgactcttaaatgtggact

SEQ ID NO: 93773 - DNA, 66 bp, Mus musculus
gtcactctctcagtgtgacttggagtggggcagagcactctcactctcgggctgattcagagggac

SEQ ID NO: 93774 - DNA, 99 bp, Mus musculus
catgcccatgcgaggtcatgtggttactgaatacaggagctggcattccgagcagtgtgcctgcctctctgagtttctaaccatgcccctcctgggctg

SEQ ID NO: 93775 - DNA, 84 bp, Mus musculus
aatgagaacaatgtcttgcactggatgagagtatggaaaggatttttttttcttttaaagcaccagagtagacagtcctccatt

SEQ ID NO: 93776 - DNA, 93 bp, Mus musculus
gtatatattatatatatgcgtgtgttatatgtgacatatatgtaatatatatgtgtatatatgtatatacacatatatgtgtgtgatatatat

SEQ ID NO: 93777 - DNA, 68 bp, Mus musculus
tgctcagtctagatagagagctgttccctgggtgttttagggaacgccttctctatgaggccagagca

SEQ ID NO: 93778 - DNA, 116 bp, Mus musculus
atttggacaggacgctcagcctcgtctccgacgtttttctgagccttgaggagaatcttctctctctcctcggctgtgaatagagtctgcagaagctgctggcagtcatcccaggt

SEQ ID NO: 93779 - DNA, 121 bp, Mus musculus
tattagggttatgctattattaaacgagtcacaggagctggagagatggctcagtggttaagagcactgactgctcttccagaggtcctgagttcaactcccagcaaccacatggtggctc

SEQ ID NO: 93780 - DNA, 79 bp, Mus musculus
tcagactatatttatttatgttccagccactctgtcacaggagtgtaagctgtcagcttaggtggcagttgtagcctga

SEQ ID NO: 93781 - DNA, 69 bp, Mus musculus
gtggccaacacctacaagtgtaaaagtgagagtgttcccgctctcactgtctctgaggtttccatccat

SEQ ID NO: 93782 - DNA, 102 bp, Mus musculus
gaaacatctgtactagtcaagttctcttactcacagagtcattggacagaagcccctggctcattctgtcactctgaagccagcaagctagtcagaaccttc

SEQ ID NO: 93783 - DNA, 95 bp, Mus musculus
catatatgtatgtgtgtgtgcatgtatatatgtatatacttatgtatatgtgtgttaatgtatatatacatgtgtgtgtgtgtgtgtgtgtgtgt

SEQ ID NO: 93784 - DNA, 135 bp, Mus musculus
gtgagagagaaacaagatgtagacactgaggtctgaattccatctgtgtttagcctctctgacctcacttctctttgactgtgccccaaggagcagccaagatggggacagtcctaggtgggagtggggaggcag

SEQ ID NO: 93785 - DNA, 103 bp, Mus musculus
cctgcttctatctctctctagctaatggcgctttcctcttcctctcagggcctctcactgagaacagttgaaagggctgggggatggctcaggagttaagcgc

SEQ ID NO: 93786 - DNA, 66 bp, Mus musculus
gtgaatcagtcagtcagtgactgcagtgtattgatagtacaggaacactgattttgacagaagcac

SEQ ID NO: 93787 - DNA, 84 bp, Mus musculus
tagagggctggagagatggctcagtggttaagagcactgactgctcttccaaaggtcctgagttcaaatcttatcagtctggta

SEQ ID NO: 93788 - DNA, 92 bp, Mus musculus; identical to SEQ ID NO: 57641

SEQ ID NO: 93789 - DNA, 93 bp, Mus musculus
ctccaatgtccccaagctgagcaaggctgagtgaggtcagtgggaactcacgctcgcgctcgctcgctcgctcgctctcaccagacccaggag

SEQ ID NO: 93790 - DNA, 70 bp, Mus musculus
tgctgtgtgttactgcacggtggcagcggtgtctcacactcacacccgcacactttgttttcaaacagca

SEQ ID NO: 93791 - DNA, 78 bp, Mus musculus
gagctgactcagtgagcagcaaatgtggaagagggaggcagaccctctgtcactgtctgtcactgtccccacagctca

SEQ ID NO: 93792 - DNA, 68 bp, Mus musculus
atacatatatacatatatatacatacatatatatatgtatgtgtgtgtatatgtatgtatatatgtat

SEQ ID NO: 93793 - DNA, 96 bp, Mus musculus
ctcatagcgtgtggtgaaaagtgaggaaatttgcctggaattttggaatctgctccaggaattcatttttttgttttaacagcaaatagcttctag

SEQ ID NO: 93794 - DNA, 75 bp, Mus musculus
tgtgtgtgtgtgtgtgtgtgtgtgtgtataatcaaattaagaatgtgtatacacacacactcacatagacacata

SEQ ID NO: 93795 - DNA, 92 bp, Mus musculus
gtgtccagaaaaatatttatttaggatgaatgaatgaatgaatgaatgaatacatttagtcaatcctcacagttttgggttttcggggacac

SEQ ID NO: 93796 - DNA, 116 bp, Mus musculus
acgcgaggttattcctgcacagagagagagggagacagacagtgcgagacagagacacacacagatataataagtacctactgaagatctcctttgactgagggaacaggctctgt

SEQ ID NO: 93797 - DNA, 93 bp, Mus musculus
aggggcccaggaagctccctgtgtcactctttctgcctccctaggataccccggaaagagccttagcgtgggcattgcttcctagggcacact

SEQ ID NO: 93798 - DNA, 142 bp, Mus musculus
ggatgataagccatctgacttaaggctatgagagtgtaggaggtttcccagaagaggtgacagacagagctcacagtggtgaattactcggttggcactgttcccagtactttacaactgtaaactcacttcatgtctcctc

SEQ ID NO: 93799 - DNA, 78 bp, Mus musculus
gtcactgccctggaaattatgtcccacgagacacaagccatttattctgtgtgtctctgtgaggctcagacaggtgac

SEQ ID NO: 93800 - DNA, 84 bp, Mus musculus
tggcagcctcacaagtgtccttcacagtgtcctggtttgggagacataacagacacaagactgagggcatcatgagagcagcca

SEQ ID NO: 93801 - DNA, 106 bp, Mus musculus
cctctgaaaccttatgagctagagaccccagtgtctgtttctctcagggtccttccaagttccctactagaacagctcactaagatctgctcccagcttccagtgg

SEQ ID NO: 93802 - DNA, 139 bp, Mus musculus
aatatatatatatgtgtgtgtgtgtatatacatatatatattatatatacatatatatgtatgtataaatatatattatatatattatatattatatatataaatatatataaatgtgtatatatatatatatatatat

SEQ ID NO: 93803 - DNA, 92 bp, Mus musculus
gtattgcacaaagtttaaagctcactatttagtgctgctgcaggtaagagtgagaacagtgtgagtgcactaaaactgagcgtgctgggtag

SEQ ID NO: 93804 - DNA, 82 bp, Mus musculus
gtgtgtatgtatgtatgtatgtatgtggggggggcatgtgcatgcatgtgttttgttgatgtgtgtgtgcgagcatgtgcat

SEQ ID NO: 93805 - DNA, 95 bp, Mus musculus
cagtccagaagcatctgaagtgagctcaagtagaaggttctatagatgggttccataagtctcttactgggtgcacagctcttcttctggcactg

SEQ ID NO: 93806 - DNA, 73 bp, Mus musculus
tggaagctgatctggctcctggttctgcaggctggaagtcagtagattgagaggccacgtctagtgcttcaca

SEQ ID NO: 93807 - DNA, 74 bp, Mus musculus
ggaatgacgccagacactgccaacagacaggagctaagcagcggctgtctctgtgactctctggtacttatttc

SEQ ID NO: 93808 - DNA, 81 bp, Mus musculus
ggaggagacacagtccacactgggtggagactgagcactaggaaacctcaaagcccacctacttagtgacacacttccttc

SEQ ID NO: 93809 - DNA, 75 bp, Mus musculus
gagagagaacatgtgtctgtgcatgtgcacatgagtgtgagtgtgtgtgtgagagagagagaacatgtgtctgtt

SEQ ID NO: 93810 - DNA, 91 bp, Mus musculus
ccaagtaagtggctctcacacacacaagacgaggtgaagaagtctgtccctctctgtctcggtattgtgtgcagtggggacttcttgctgg

SEQ ID NO: 93811 - DNA, 64 bp, Mus musculus
atgtgagagtcaagggacagctttcaggagtcatcctcctctgttctgaggattgaactcaggt

SEQ ID NO: 93812 - DNA, 118 bp, Mus musculus
ctgatgaggattctgctgataatcttcctggaagatctcttgtatgtgagatgagtcactgctcatactgtgtacaccgatatcttccaacagtctgacagtaacgtgcctcagtcag

SEQ ID NO: 93813 - DNA, 87 bp, Mus musculus
tgggctggaaggctggtgaggtggatcagttgggtaagaacactgactgctcttccagaggtcctgagttcaaatcctagcaaccac

SEQ ID NO: 93814 - DNA, 81 bp, Mus musculus
tgtttgggacacacaacactttgtacacagaactatgacagcagcctgatgtggtgttggtgcacaactttagtcccagca

SEQ ID NO: 93815 - DNA, 61 bp, Mus musculus
atgtgggcggcacagtttcctgggctgggcgccagacagtaaagactgggctgagacgcgt

SEQ ID NO: 93816 - DNA, 64 bp, Mus musculus
tctgggatgtcagtggggtaggaaggtcagctgggtgccttctctgcctctctgagtcagcagg

SEQ ID NO: 93817 - DNA, 56 bp, Mus musculus
tatgtatatgtgtatgtatatgtgtatgtatatatatatacatatatatatatata

SEQ ID NO: 93818 - DNA, 64 bp, Mus musculus
ctggagactcgggctctcactctgacccgctgtaacagcgatggagagagagaccttactcggg

SEQ ID NO: 93819 - DNA, 115 bp, Mus musculus
agcaactgatttggactgatgagctatctgtctctctcccacctgattttgtatttttaattgttttgcttttagggctagagagatggttcagtggtttggagcactgactgct

SEQ ID NO: 93820 - DNA, 116 bp, Mus musculus
tgctaataatgcctcatgttccattgagtgtagactacagaagaaatgtaactttatatttatcatgtgagtcttaatatactaaagatactaagaatatcagtcattttcatgta

SEQ ID NO: 93821 - DNA, 73 bp, Mus musculus
gctataggagcacttcatgagagtctatgggagcacttcacagctactggattctctctgtgtctgagagggc

SEQ ID NO: 93822 - DNA, 287 bp, Mus musculus
gcatgtgtgtacatgtgcatatgggtatatgtatatatatatgtgtgtgtgtatatatgtatatacatatatctgtatgtatgtatatacatatatgtgtatatatgtatatgtaggtgtatatgtatatgtgtatatgtttatatatgtatatatgtgtatatgtacatgtgcatatatatatgtatataatgtacatttctatatatgggtatatatgtgtatatgtatacatgtatatatatgtgcatatatgtgtatgcatatgtatatgtgtatatatgtgt

SEQ ID NO: 93823 - DNA, 100 bp, Mus musculus
gcttttcagtttcatcctttgttccctgcagtgcagtctctcggactgtcaccatctgaatgtcagccgtgtcatctgtgttgttaggatagggctcagc

SEQ ID NO: 93824 - DNA, 82 bp, Mus musculus
gttgttgctttgagacagggtctctgtctctctatagccctggctatcctggaattagctatgtaggcccttcttgcccagc

SEQ ID NO: 93825 - DNA, 96 bp, Mus musculus
gaggatctctgagtaggaggtcaacttggtctacagagtgagttccaggacaccaactcccagtgatctgtctacctcttcctccagtgtgcttcc

SEQ ID NO: 93826 - DNA, 68 bp, Mus musculus
gatcccagaggtgccagctctgtcacctgaggccacacagaagacagacaggataaatccggtagatc

SEQ ID NO: 93827 - DNA, 64 bp, Mus musculus
tctggcttgtggcttcatcctggcatcatcactgaagagagaaatgaagtcagcaagcagaaga

SEQ ID NO: 93828 - DNA, 93 bp, Mus musculus
agtgagtgagtgagtgagtgagtgagtgagtgcctgagtgcctgggtgaatgggtgaatgggtgaatgcttgcctgcctaggtttccctggct

SEQ ID NO: 93829 - DNA, 91 bp, Mus musculus
gaactgctagcaactggggaagctagattgtaaagaagagtgtggatgaggccaggcacctttggacttagtactgagaggcaggcagatc

SEQ ID NO: 93830 - DNA, 114 bp, Mus musculus
cacaagactgagctctgattggccaagcagcagcagcagccacacacactcactattttcagggcaaagggcatgctgctatcttgttggcatcaacagatcctctgtgcctgt

SEQ ID NO: 93831 - DNA, 79 bp, Mus musculus
gccaaactatgacaatactgcttccttttccagcgtcagtctcagtctgtgacaggggtcagcagtggacctgcctggc

SEQ ID NO: 93832 - DNA, 112 bp, Mus musculus
tgtacatgcaagaacatcgtgagggagaaaggttaacagtagagtgttaccactgcagagtagacttgaggtagcagtgttctttatgttgatgcgggttactgacatgaca

SEQ ID NO: 93833 - DNA, 99 bp, Mus musculus
ccatcagaagtctattctcatgttcactgactcactgtggcagagttttgtcgactcgacacaggctagagtcacctgggaagagagaacttcagttgg

SEQ ID NO: 93834 - DNA, 80 bp, Mus musculus
gttcaatttccagacaccacatggtggctctcctgtaatgggatcagatgcccttgctgatgtgtctgaagagagagagc

SEQ ID NO: 93835 - DNA, 60 bp, Mus musculus
tctgtgtctctgtgtgtatgtctgcatgccacatgtgtagggttgcctacaggggccaga

SEQ ID NO: 93836 - DNA, 65 bp, Mus musculus
gtgcacatatctgtgtgcgcatgtgaccctctatggtatgtgtgtgtctgtctctgtgtgtgcat

SEQ ID NO: 93837 - DNA, 94 bp, Mus musculus
tttttttatgggtgtgaatgtttgcctgcatgtatgtatgtatgtatgtatgtttgcatatgtgtgcactggctctattgaatctagaagaagg

SEQ ID NO: 93838 - DNA, 114 bp, Mus musculus; identical to SEQ ID NO: 93830

SEQ ID NO: 93839 - DNA, 114 bp, Mus musculus
tttgtgagtgttaccttaggggctggagagagggctcagcggttaagagcactgactgctcttccagagggcctgagttcaatttccagcatatagttgctggatacatacaga

SEQ ID NO: 93840 - DNA, 83 bp, Mus musculus
caggtggatctctgttgagtctgaggactgcctggtctacaacttgagttccaggtcagccaaggctacacagagaaatcctg

SEQ ID NO: 93841 - DNA, 111 bp, Mus musculus
cgaggaggttttctagcaatgcataatttcagttttttatcttttgagagctatttatttttatttctgaaggatagttttattaaatattattcattagtatctcccttg

SEQ ID NO: 93842 - DNA, 82 bp, Mus musculus
ggaagcaagagcttgaagcagcgttggtgtgacatcacggtcaggggacagatctctgcacattgctgttgagttctctttc

SEQ ID NO: 93843 - DNA, 119 bp, Mus musculus
gtccagtcatcatcagaaggagcgaatgctaggcgctgccctcatctggaagactgaagggagtgtgcattgctgggagccagtgatactgtctgagctgctggggccccagtctacca

SEQ ID NO: 93844 - DNA, 81 bp, Mus musculus
tgagtgtatgtgtctctgtatgtatttttgtgtttgtgtgtgaatgtgggggttgtctgtggggggacatttgtgtgttca

SEQ ID NO: 93845 - DNA, 62 bp, Mus musculus
tcctcagtgctctcgttggagcttggggtattattgccactgactctgagtgagactgaggg

SEQ ID NO: 93846 - DNA, 77 bp, Mus musculus
cctaaaactcactaacatagactaggctggcccttgaactcacagcaatctacctgtgtctgtctctgggtgttggg

SEQ ID NO: 93847 - DNA, 63 bp, Mus musculus
ggttcttttagcctgtggattgccacctacggaagagaggcagaacacagagctcacaggtcc

SEQ ID NO: 93848 - DNA, 70 bp, Mus musculus
tcacatggccagctcagtctgccatgttcactctggactctcccagatggctctgcctctgtctgtgtga

SEQ ID NO: 93849 - DNA, 107 bp, Mus musculus
gagaaagtatagagaaatgggagctagagagatggctcagtggttaagggcactgactgctcttccagaggccctgagttcaaatcccagcaaccacatgctggctc

SEQ ID NO: 93850 - DNA, 117 bp, Mus musculus
tctgaccaaaagtaacataggggaagaaataggtattgggtttacatgtctgagtcacagtctgtcattgagggctgctaaggcaggaactcacgctctaagtacttgggaggcaga

SEQ ID NO: 93851 - DNA, 114 bp, Mus musculus
tcgtttaaaccgttggttcttgggctggagagatggctcagtggttaagagcactgactgctcttccatgggtcctgagttcaattctcagcatccacatggtggctgtaatga

SEQ ID NO: 93852 - DNA, 102 bp, Mus musculus
cctcaggtctctgagccccagggtctaatgaataaatgtttgaacttgttgagttgtatgagttcacacagtaaaggcttgagggggcccgatcctttgagg

SEQ ID NO: 93853 - DNA, 104 bp, Mus musculus
atatgtatgtatgtatgtatgtatgtatgtatgtgtatatatatgtgtgtgtatacatacacatatacatacatacatatatacacacatacatatatacatat

SEQ ID NO: 93854 - DNA, 118 bp, Mus musculus
aagctccagttgaccatgaccgtgacctctcccgcacacactcagtttatttgctaagcacagcttgctttgaactggtgtctcttcggctccctctgtgcatgcctctggttggttt

SEQ ID NO: 93855 - DNA, 109 bp, Mus musculus
ctggttttgatggactgcttggcccggtcacatagcattgatgtctgctgagtctgtttatctcacgaacattcagtgagcgtttaccatgtggccagcctcctgccag

SEQ ID NO: 93856 - DNA, 93 bp, Mus musculus
acccacccatgcaaattatcactcagtctgagcactccatgactgggttagtgcaggtcatgacagagaaaacacagtgcacaggttaagggt

SEQ ID NO: 93857 - DNA, 67 bp, Mus musculus
ggtacactgtatccttgcagtacactgtatccctgcggcacactgtatccctgtggtacactgtatc

SEQ ID NO: 93858 - DNA, 65 bp, Mus musculus
cagagccgaagggcagcagatactgcagtgcacaccatgcattgttgtctgtctgtctgtctttg

SEQ ID NO: 93859 - DNA, 112 bp, Mus musculus
tctgcctctcaaatgctggaattgaagccatgcaccaccaccgcccaggtttaatatttatttatcgtagtggtgggtgggtacgtaacacagcttgcatgtgaaggtcaga

SEQ ID NO: 93860 - DNA, 93 bp, Mus musculus
gggagaaagaagaggggggggggggctggagaaatggctcagtgtttaatagcactgactgctcttccagaggtcctgagtttaattcccagc

SEQ ID NO: 93861 - DNA, 113 bp, Mus musculus
tcctccagcacctccttctgaaggtcctccatccatgtccacagctgtgtgggagagagcagagactgtactggggctgcagagaggggccagcacgaggcagggcaacagga

SEQ ID NO: 93862 - DNA, 65 bp, Mus musculus
gagatggcagcaaactgggagtttcccaagagagggaatgtgactctcagtctgactgaactctt

SEQ ID NO: 93863 - DNA, 82 bp, Mus musculus
tcacagagccagagtaatgaaaatctcaactgagtgaggacacacgtccttggctcgtggcttcagagggtttggtctgtga

SEQ ID NO: 93864 - DNA, 72 bp, Mus musculus
gtatgcatatgtgtgtgtatatatatgtatgtgtgtgtatgcatatgtatgtgtatacatgtatatgtgtat

SEQ ID NO: 93865 - DNA, 82 bp, Mus musculus
tgtatatgtagggtgggggcagcactggccttagagaaaaatgccattttctggtgctgtctaccactctctctcccagaca

SEQ ID NO: 93866 - DNA, 72 bp, Mus musculus
tgctactcagcctctctgagtctgtggactgtagcacaattatccttcacctcacagctaagagagagtgca

SEQ ID NO: 93867 - DNA, 69 bp, Mus musculus
agaggaggaatctctgacactctctttgcctcacaatgtgtaattagagtcacctggggttctgtttct

SEQ ID NO: 93868 - DNA, 79 bp, Mus musculus
gctttacaacatctccatctgtctctctctgaaccttgacattcgggtttagggtgcagcttgagaaaggtcttgaggt

SEQ ID NO: 93869 - DNA, 81 bp, Mus musculus
cagttaggaagtgacagatctgtgtgagttttgaaccaagcagttgtatgtcctcttccatagtccatgttatttctgctg

SEQ ID NO: 93870 - DNA, 118 bp, Mus musculus
atatgtatcatgtagaatataacttaacctcatatgatatgtatatatgtatgtgtatatgtatatgttgcttgtacacacacacatatatacatattatatatacatgtgttttata

SEQ ID NO: 93871 - DNA, 101 bp, Mus musculus
catctatgtgtctatatatgtatgtgtatatatacatgtatatatgcatattatataattatgtatacatatgtgtgtacacatagatatgtatgtatata

SEQ ID NO: 93872 - DNA, 64 bp, Mus musculus
gtgcacgcgtgtgtgcacgtgtgcgcgcgcgcgagtgtgtgtgtatgtgtctgtgtgtgtgcat

SEQ ID NO: 93873 - DNA, 71 bp, Mus musculus
actatggggaggcctttgtgggggcagcacactttcacagagtctgtctggctctatggctgcctcattgt

SEQ ID NO: 93874 - DNA, 85 bp, Mus musculus; identical to SEQ ID NO: 57439

SEQ ID NO: 93875 - DNA, 88 bp, Mus musculus
tgcaatggggagagggtactgactgagcaaggaggggggaactgagcaccggcattcactcactctctgcttcctgacctcagatgcg

SEQ ID NO: 93876 - DNA, 74 bp, Mus musculus
ggtggaggtgtgtcactgggagtggggctttgaggtttcaaaagcccttgccagccccagtctcactctctgtc

SEQ ID NO: 93877 - DNA, 74 bp, Mus musculus
gtgatgtcaggagagtagagagtgtggaaatgtcccttggactacgcttgctccatcactgtctttaaagtcac

SEQ ID NO: 93878 - DNA, 81 bp, Mus musculus
ctccttctgtaatctcttgtgtagtgtctctgctccacggggcagtgcagccacatagtagtgagtgagcagaacacagag

SEQ ID NO: 93879 - DNA, 73 bp, Mus musculus
cccacacctatgcatctggagggctacatacaggtactaagtctgtgactctcacacctatgcatctggaggg

SEQ ID NO: 93880 - DNA, 95 bp, Mus musculus
tccttaatgtgcccagctcagagttaaatctaaggcttcaatgaggcaatgccatgaagccagaacagagtctgcaaaccctgagcactcagtga

SEQ ID NO: 93881 - DNA, 77 bp, Mus musculus
ctgctgctgttggacagagtaaaggaaaggaactagacttaatatctcccagtctcactcagtcacacatgcaggag

SEQ ID NO: 93882 - DNA, 80 bp, Mus musculus
tatatatgtatatatgtatgtgtgtatatatggatatatatgtatatgtgtgtatgcatatatatgtatgtgtgtatata

SEQ ID NO: 93883 - DNA, 81 bp, Mus musculus
ggagcagagggagcagaaagacaggcagtgtataggggagcgtcacccacactctgtccctggatgctttccccatgtttc

SEQ ID NO: 93884 - DNA, 108 bp, Mus musculus
agggtagtatatatgggctggagagatgactcagtggttaagagcactggctgctcttccagaggtcctgagttcaattcccagcaaccacatggtggctcatgccct

SEQ ID NO: 93885 - DNA, 73 bp, Mus musculus
ggacatggtcactctctgagtgactggggctgacagaccacataacaggtacactcttggagtgagcttgtct

SEQ ID NO: 93886 - DNA, 77 bp, Mus musculus
ggcttttctcacaagcttcatttttgcagatgggaaagagactcccagagaagagtgtgagttgtgagcttgaagtt

SEQ ID NO: 93887 - DNA, 87 bp, Mus musculus
ccagggaggctatgagcagctagagtagtgaagttgtacatgtatctcagaaagtagaatggttgcctagctcacatgaggccctgg

SEQ ID NO: 93888 - DNA, 100 bp, Mus musculus
gtatcactttatatatatatatatatatatatatatatatatatatatatatatgtatatgtatatgtatatgtatatatatatatactcacacacatac

SEQ ID NO: 93889 - DNA, 88 bp, Mus musculus
gtctgggagatgacggtgtgtctgtgtctctcttacacgcgttcgcaaccggccaggaaagacgcaacaaaccggaatcttctgcggc

SEQ ID NO: 93890 - DNA, 91 bp, Mus musculus
ccagaggatctacattcagttcctagcacccatctcagacagctcacaaccacctgtaactccggctccaaaggatctgactagcctctgg

SEQ ID NO: 93891 - DNA, 59 bp, Mus musculus
ctgcatgcttccgacgagagcccacgcgagtgtggctctctgtctgtgggagagtgcgg

SEQ ID NO: 93892 - DNA, 112 bp, Mus musculus
gcatcggccggggcctgactctccagattgtccaaggctgtattgaaatgcaaacagtaagtttttgtttttattccctggcagaggggagtcctggaattaatggttaatc

SEQ ID NO: 93893 - DNA, 85 bp, Mus musculus
tttggtgagcctgagtgtgtgcctatagtatgtatgtatgtatgtatgtatgtatgtatgttagttaaacgcagagctcattgaa

SEQ ID NO: 93894 - DNA, 111 bp, Mus musculus
gtaagtctgagagcatagttgggtttctgcggctcttcctcgcgccggggggcagagagaagtgactgtgctctctctgctggcagatgctcggtcgccatagatccggct

SEQ ID NO: 93895 - DNA, 134 bp, Mus musculus
ggctttcctcatcgcctgccagagacttcagcagtcactcgaccacactttaattgtcttgtcattttctagtgctgctgatgcgatgatgttttttgtagggtgacaggctgctgagatcaccacatctgtgt

SEQ ID NO: 93896 - DNA, 93 bp, Mus musculus
gagagttacagcagattttcatgatttttaatagttgatcatttggttatccagaatagctgctcttttgaaacgtgggttttgctatttctc

SEQ ID NO: 93897 - DNA, 102 bp, Mus musculus
gttcaaggacttttagtatattcacaagtgtgtataagcatcaccatgtcatttcacaatattttccttccacacacaagaaagagctgtcagtcctctaac

SEQ ID NO: 93898 - DNA, 116 bp, Mus musculus
tgattgagttgataccaggctaacagaatatgtaaatgtttgtcactttctcactggttcaaaaatgaaaggcaaacctccaatgtgtcatgtagcctccaaagccaactggttca

SEQ ID NO: 93899 - DNA, 77 bp, Mus musculus
gaatgatttggggactggagagatggctcagtagttaagagtactgactgctcttccagaggtcctgagttcaattc

SEQ ID NO: 93900 - DNA, 108 bp, Mus musculus
tccataggcttcctgcaaatacttttcatcctttgctgcaagtaggatgtaatgaacacagcgaagtttgggatattctttcctaattcgttccaatgcttttcctac

SEQ ID NO: 93901 - DNA, 88 bp, Mus musculus
ggcatcattctgacattggtagtgtaacatattttttccagacatacaggaagaaatcagtgtgatcacacacattttgtatgatgct

SEQ ID NO: 93902 - DNA, 74 bp, Mus musculus
ctaagttgagagtgatgagagacagcacaggcagtgtggacctgtgtggggttgatgagcacctcataagatag

SEQ ID NO: 93903 - DNA, 111 bp, Mus musculus
aattgtaaccaagctgtagttattatatgtgcttccctgacagtgaggaagaggtagtaagatcttttatctaattgtaaccaagctgtagttattatatggtttctagtt

SEQ ID NO: 93904 - DNA, 68 bp, Mus musculus
ctctgttctgttcctgtcaacagcccagctccaggtgcctggagtcagatgacagccagcagaaagag

SEQ ID NO: 93905 - DNA, 89 bp, Mus musculus
gggcccttttgtcaggatgaagactgtctggcccactctgactctatcttcccaggctcaggggtcttcctaatcctgactttctgctc

SEQ ID NO: 93906 - DNA, 73 bp, Mus musculus
gggtgctgcgcaagtggagtcccaagtgaagaatagaatgtctctcactgtgacagctgcttgtgctttcccc

SEQ ID NO: 93907 - DNA, 80 bp, Mus musculus
atacacatgcatatatatatacatacacacacatatagatgtatatatatgtatgtgtgtatatgtatgtatatgtgtgt

SEQ ID NO: 93908 - DNA, 119 bp, Mus musculus
gatggactgtctctgattagtaacatgtaactgtatattctctctctatatatatatttcctttgtcaagtgtatatgtagaaatatttatattttctccaagtttgtgactttctgtt

SEQ ID NO: 93909 - DNA, 89 bp, Mus musculus
ctctgccagcaccatctctctggcaccctgtttccccttcacctctgatggcacggatgagagtcagagaggacttttaattgactgag

SEQ ID NO: 93910 - DNA, 85 bp, Mus musculus
ttccacttacctgctattgtaacagagacagggaccagactggtggttgccatgggtatgatgaggtagaaggtagaagtgaggg

SEQ ID NO: 93911 - DNA, 84 bp, Mus musculus
catatatgtgtatatgtatatacatatgtatatatgtgtatatacacacatgtatgtatatgtgtatatatgtatatgtatgtg

SEQ ID NO: 93912 - DNA, 99 bp, Mus musculus
tgggggaagggcgatgggggtggggtgggggtgggggggggagtcaggaaaacttcccagaattcacagtccactaacacacccagcaccagtccaaca

SEQ ID NO: 93913 - DNA, 80 bp, Mus musculus
gtgccctaaggggaggcttgggtgtgattgtttctagtcattgacctggaaacgtgtctcactctgagcctctgggtgac

SEQ ID NO: 93914 - DNA, 78 bp, Mus musculus
cctctcaggtctgtcagtctcacttaaacccttccagggttctcctacactgtgggacgccaggtgcctgcacagagg

SEQ ID NO: 93915 - DNA, 94 bp, Mus musculus
ctggttgggtttcttatttgtttctgagacagtctctcactggcctgatgtttgtctgcataggctaggctagctgaccagtgagccccaccag

SEQ ID NO: 93916 - DNA, 90 bp, Mus musculus
gtctgacctcctggagactgctgaaggactctacagccctgcccaggcatgctggccattcagtctctctctctgcagccggtgaaaggc

SEQ ID NO: 93917 - DNA, 92 bp, Mus musculus
tgattattttggtgcgtgagagatgattctgaggttaagagtgcttgctgctcttgtagaggacccgagttcaattcccagcacccacatca

SEQ ID NO: 93918 - DNA, 79 bp, Mus musculus
ctatgtctgtctgtctgtctgtctctaacaaaaggctttgctttcttgtttactgaaacacacagaaagcatcacatgg

SEQ ID NO: 93919 - DNA, 129 bp, Mus musculus
acacaaatggtcctggccctattcttgatagagttcttgtctcatgagctgggcctccactgtctgtgtttctctcatcactcctgtcttccagcataaagaaaaaggtgatagggagaaataggaaca

SEQ ID NO: 93920 - DNA, 88 bp, Mus musculus
caagatgggggaagtggcatgtgctgaaaactatgaattcaggttagttcagtagttaagagcactgactgctcttccagaggtcttg

SEQ ID NO: 93921 - DNA, 73 bp, Mus musculus
gtcactggggttgtcactttgaggttgccaaaggtcatgccagacccaggctccctcttagcctgatcaggat

SEQ ID NO: 93922 - DNA, 88 bp, Mus musculus
gcacagttctgctttttaatgtgtgtgctttctgtggctatttttgtactactgtataaaagttgagaagctgtaagacaaactgtgt

SEQ ID NO: 93923 - DNA, 85 bp, Mus musculus; identical to SEQ ID NO: 57470

SEQ ID NO: 93924 - DNA, 95 bp, Mus musculus
cttcatttgggctgtggctgtgtctgtgtgtctgtatgtattttcaaaagcttgaacagctcacggagacactccgttccataaaccattctaag

SEQ ID NO: 93925 - DNA, 86 bp, Mus musculus
gtgtatgtatatatatatgtatgtgtgtatatatatacatatatatatgtatatatatacatacatatatatatatatgtgtgtgt

SEQ ID NO: 93926 - DNA, 66 bp, Mus musculus
tgacacactcagtgtctatatagcaagtgctatatagacatgccattgagtgttaacataaagtca

SEQ ID NO: 93927 - DNA, 88 bp, Mus musculus
tttgaatagtttgtgtgaggttctgggttcaattcttagcactggaaaggtggaatatgatatttagcatcttgaataaacttgtaga

SEQ ID NO: 93928 - DNA, 81 bp, Mus musculus
aagcggcatcagtcaaaactcacagatgtgcctgagcaaaatgttaaaagaaacaccttctgagagagggagtggtggctt

SEQ ID NO: 93929 - DNA, 81 bp, Mus musculus
cccataagaaagcaagcaaccactgcccagagactttatttacttgtgtgtctctgtgtgtgcttgcacgctcatgttggg

SEQ ID NO: 93930 - DNA, 79 bp, Mus musculus
tgtgtgtgtgtgtgtgtgtgtgtgtgatttttaaatcaaggaatcaccagatgctccagattaaaagaaataatacaca

SEQ ID NO: 93931 - DNA, 114 bp, Mus musculus
gtactgcaggcacatgtgtgtgttcttgtgtgtgtgtgcgcacgtgtgcatgtgcatgtgtgtgtctgtgtatgtctttctgtgtgaatgtgtgtgtatgtgcatgtgtgtaca

SEQ ID NO: 93932 - DNA, 85 bp, Mus musculus
cccagggcacagttctttttctacctcagggagactccacctcactactctctctgacccaggctacaagctcgtgttcctgagg

SEQ ID NO: 93933 - DNA, 101 bp, Mus musculus
ggtttaaatggaaaaggaaagttgtacatgatgtcatgagaactctaaaaatgttcttaaaatgtcattatttatatgtattttcccttcatataaagacc

SEQ ID NO: 93934 - DNA, 111 bp, Mus musculus
caagtattggagatggttagtatgtttagtctaacttaagagtacacagtgtgcacaagtgtcagataccatgtactatactattcatatgtccaacttagaaagtttttg

SEQ ID NO: 93935 - DNA, 95 bp, Mus musculus
ccttagctacttcctagcaacagtcaatcaaagatcagtctgattgtttcagatgtactctcagactgtggttgttcatagttttgcttcagagg

SEQ ID NO: 93936 - DNA, 92 bp, Mus musculus
gtgctccagggactctaaacaagcgccgatgaatggaggagtgaccaagctggtgattctctgtctggctctcttaagagcccaggtctcat

SEQ ID NO: 93937 - DNA, 80 bp, Mus musculus
gtcgtcaaggggaagctggcctgggttacaaaggtctcatagacacctgttctctgtgactctgtctttctcaagatgat

SEQ ID NO: 93938 - DNA, 80 bp, Mus musculus
tgtacaccaccggaggcagaggcagtctgaggtttgacagcccagtcccactttctgtctctctctggtccctgtgtgca

SEQ ID NO: 93939 - DNA, 87 bp, Mus musculus
gtcccagctaaggagagatcgtgactcagtggctgtgtcagacccaggtgtcatttcacagcccttcccctatcttctagctcttac

SEQ ID NO: 93940 - DNA, 119 bp, Mus musculus
ggtggagtgcatgatttctgggttttgctctatgtatgtatgtatgtatgtatgtatgtatgcatgtatgtataaacacatgtactttttttttaacctaaagatgggctaattttgct

SEQ ID NO: 93941 - DNA, 60 bp, Mus musculus
gtatatatgtgtatatgtatatgtatatatgtgtgtgtatacataaaatgacatatgtac

SEQ ID NO: 93942 - DNA, 97 bp, Mus musculus
ccatcttctccatcacctgatattcgctttggaagatctctctctcttttgtgcggagagtgacactacagctaactgtttacagatgaggaaatgg

SEQ ID NO: 93943 - DNA, 115 bp, Mus musculus
gtggggtccccgtcacactatgctatctatctactgagcctctcacagtcacttttagatgtcagcttgtgtttcagcagatttgttgttctgtgtaaaagacagggtttcttgt

SEQ ID NO: 93944 - DNA, 81 bp, Mus musculus
cccatgaccttctcacagtatgtggtggtttaaataggaatggccccgtagactcatgtgtgtgagcacttggcccatggg

SEQ ID NO: 93945 - DNA, 131 bp, Mus musculus
tgagaatgaatacatattcacacacatattatatataacatatgtaatatattacatataataatatatattaactatgtgtgtatatatatgtatgtatgcatatgcttattttacttcatgtgtatggg

SEQ ID NO: 93946 - DNA, 80 bp, Mus musculus
ccaaaggtgcctgagacagaatggagagagcactgaggggcccataggtggcagattccattcttttgggtcacttttgg

SEQ ID NO: 93947 - DNA, 76 bp, Mus musculus
gtgtacatatgcacgttaatttgcatatatgtgtacaggtgtgtgtgtgtgtgcatgtgcaagtgtatgtgtaagc

SEQ ID NO: 93948 - DNA, 114 bp, Mus musculus
agaaaggatgaacagagagtacaagagaaagctagagtcagaggctgtctattacaccatctgcatctgtcaaatgtctttttcttttaaaatgaaaattttcttagccttttt

SEQ ID NO: 93949 - DNA, 67 bp, Mus musculus
gccacactgcgtggtgcgttcaggtgaagtctcagactagagctttgactcacagtcagtgtcaggc

SEQ ID NO: 93950 - DNA, 72 bp, Mus musculus
gtacttactggcaggagcctgatatagctgtctcctgagaggctctgtcagtgcctgacaaatacagaggtg

SEQ ID NO: 93951 - DNA, 88 bp, Mus musculus
tgtgtgtatgcctgtatttgtgtctgtttgtagttttttttcatataaaaagactacagcacatatgtaattaattacacgtacaaca

SEQ ID NO: 93952 - DNA, 119 bp, Mus musculus
ctttgttccgagtctgtaaatgtgaagtgtgcagctcaggtttccttagtttcattatttaaaaatgtctgaggcaaagcatttctgtgtgtagtatacttgactgaagtggagcgagg

SEQ ID NO: 93953 - DNA, 117 bp, Mus musculus
gttccattttttctatttaattcttacctattctttctgtcttttcttctttttcccccaaggaatgaaaagatgtgtgtgggtgttatagcaagaggaagagaggaaaaattgagc

SEQ ID NO: 93954 - DNA, 115 bp, Mus musculus
ttatgtgtatgcaaggaaataaacttcaggtgtgacagagagaagagatggaggacataggaccaattctaatccatgggccctcggctggtagtttccaggtagttcaatgtag

SEQ ID NO: 93955 - DNA, 91 bp, Mus musculus
ggccgtgcagctgcaaaggcaactcctgcaggaggacctaatcgaagactgcctgagagatcaaagattgctgatgcagacaatgccagcc

SEQ ID NO: 93956 - DNA, 75 bp, Mus musculus
gtaaagataggtatatattatgtgcatgtatacatatatatatgtatacataaatatgcatatacttatatttac

SEQ ID NO: 93957 - DNA, 74 bp, Mus musculus
ccttgactgtgcctctgtctctgccatccctatcttactttttataaggtgacagagaaagtggcaaagtccgg

SEQ ID NO: 93958 - DNA, 88 bp, Mus musculus
ggaccatctgctgtgcagctgttgagtctgtctgtctcagtcagtcatttactgctatggggaggcacaaagacatagtgaatgttct

SEQ ID NO: 93959 - DNA, 104 bp, Mus musculus
atatatatgtatatatatacacatatatgtgtgtgtatatgtgtgtgtatatatatatatataaacacaaccatatatatgtgtgtatatatgtatatatatat

SEQ ID NO: 93960 - DNA, 85 bp, Mus musculus; identical to SEQ ID NO: 57470

SEQ ID NO: 93961 - DNA, 117 bp, Mus musculus
atatatatatatatatatatgtatatatatatataatgtgtgtatacatatatatgtatatacatatgtgtgtatacatctatacatctatgtatatgcatatatacctttatgcac

SEQ ID NO: 93962 - DNA, 57 bp, Mus musculus
gctcactgaacagagtctgtagtctgtgtggcaggttgctcatggattttgttctgc

SEQ ID NO: 93963 - DNA, 85 bp, Mus musculus; identical to SEQ ID NO: 57470

SEQ ID NO: 93964 - DNA, 91 bp, Mus musculus
ttagctctagaaccccatcttctgcagacctgtgcaggccctgtgcctgttgcttcagattctgcaagttcatgtgtgtcaatcctgctaa

SEQ ID NO: 93965 - DNA, 106 bp, Mus musculus
gagttttattactatgagcatggttgttgtgtatctctctgccacactcatttcagtcctttgaatatatacacagaaacagcaatactggatcataatggaattc

SEQ ID NO: 93966 - DNA, 83 bp, Mus musculus
agcactgaaaacaaatatacaagtaacattatatgactgaaccatgtgtatttaggaaatatatatttgtatatgtgagtgct

SEQ ID NO: 93967 - DNA, 159 bp, Mus musculus
tatatgtgtatacatatatgtatacatatatgtttgtatatgtacatataatatgtgcatatgtatatgtatatttgactacatatttgaaatatatacatatgtgtatacatatatgtatatatacatatatatatgtgtgtgtgtgtgtgtgtgtgt

SEQ ID NO: 93968 - DNA, 56 bp, Mus musculus
atgtatgtatgtatgtatgtatgtatgtatgtacgtacgtatatatgtatgtatgt

SEQ ID NO: 93969 - DNA, 81 bp, Mus musculus
ttcactgtctttcactgtctctggttttatgtggagttccttgatccacttagatttgaccttagtacaaggagataggaa

SEQ ID NO: 93970 - DNA, 85 bp, Mus musculus; identical to SEQ ID NO: 57439

SEQ ID NO: 93971 - DNA, 106 bp, Mus musculus
aacatatatgtcacatgtacatatgtcataatatataatatatatgtcatatgtatatatgtcaatatatatatattatggcataaactgcccaggcatcaatgtt

SEQ ID NO: 93972 - DNA, 101 bp, Mus musculus
aatctgctatgcagacaggtttggaaatctctgatctaaggtgtcattcactcgtcaccagactctctccctgtgcctgtaacctccatgcatgacagatt

SEQ ID NO: 93973 - DNA, 84 bp, Mus musculus
acacattccaaatgtatgtatgtatgtatgtatgtatgtatgtatgtataatacatgtataatacatgtacatttggaatgtgt

SEQ ID NO: 93974 - DNA, 105 bp, Mus musculus
tggaaattctgtgtcagttcacttggaaggcaaacatctgtttcttgctttgacagtcagtacatagtgagctttcaaagaatcttgctggttattttatttcca

SEQ ID NO: 93975 - DNA, 75 bp, Mus musculus
gtgtgtgtgtgtgtgtgtgtgttaatataaatgtgtttaatttttattctttgatgcacatacacacacacacac

SEQ ID NO: 93976 - DNA, 79 bp, Mus musculus
gtgtctgtaatcccagcactcagggttcggaagcaggatgattgtaactttaaagactgtgtgatgagtttgaggacac

SEQ ID NO: 93977 - DNA, 112 bp, Mus musculus
atttgaagcattttgctggaggggtgatctgaaaacaaaattatatattagtatctctttttgatacattctctgtttggccttctgaatactcaggtaaagtgaaagagat

SEQ ID NO: 93978 - DNA, 92 bp, Mus musculus
gtgactcaatgtaaatggtttcaaatctgtctcactcacaattttctgaacttaagagacacaagataggagtgagacttgaaatgactcat

SEQ ID NO: 93979 - DNA, 72 bp, Mus musculus
gtatgtatatatgtatgtatgtatgtatgtatgtatttacatatgtatgtatgtatgtatgtgtgtgtgtat

SEQ ID NO: 93980 - DNA, 80 bp, Mus musculus
ggaaaacaacctggagttctagggaacaaacaggactcaagagccctccctgtctctgtgactctactcatagtctttcc

SEQ ID NO: 93981 - DNA, 77 bp, Mus musculus
gcagttagagggacaggctgctgcaaattccccactttaaaaatcatcagggtctgtctccctgtctctgtctctgt

SEQ ID NO: 93982 - DNA, 89 bp, Mus musculus
tcatgtcacctactgttacatgactttcctggggagatgtgaagaatcatctattcacaccagagagagcactgagggtagtccacaga

SEQ ID NO: 93983 - DNA, 96 bp, Mus musculus
gtgtgaaattctatactttacagaggagacgatgggggtcatacaatactgctaagtcattgtcagtgtgtctgtggttgttaatagaaaacacac

SEQ ID NO: 93984 - DNA, 126 bp, Mus musculus
cacatagataagcatatgtatatctatgtgtgtgtatatatgtatatatgtgtctgttatgtgtgtgtttctaaatatatttatacaacttgcttagtccacaaatgttactcatgtgcatatgac

SEQ ID NO: 93985 - DNA, 109 bp, Mus musculus
atggctatttgttttcttttgttggttttctattctatttttgtgatatacatgagctgagatttcacagagataatgttgaatgtgacaaggaagcactccatgaagc

SEQ ID NO: 93986 - DNA, 85 bp, Mus musculus; identical to SEQ ID NO: 57439

SEQ ID NO: 93987 - DNA, 65 bp, Mus musculus
atatacatatatgtatatatacatatatgtatgtgtgtgtatatatatgtgtgtgtgtctatgta

SEQ ID NO: 93988 - DNA, 87 bp, Mus musculus
cagaccacgaacatttatgtttttaaatatcaaatgtggtttatggttatttgatatttaaatgttgattgaaaatgtatgtgtttg

SEQ ID NO: 93989 - DNA, 92 bp, Mus musculus
gtagtcctaaacccatgtgcatatgggtaacactgactcagtctcacagattgtgttcatttatgtttgtatgcatctgtgtgtattgctat

SEQ ID NO: 93990 - DNA, 78 bp, Mus musculus
atgcatgtatacatgtatgtatgtatgcatgcatatatgtatgtatgtatgtatgcatgtatgtatgtatgtatttat

SEQ ID NO: 93991 - DNA, 98 bp, Mus musculus
gtagaatctatgaatgcctgtgcatgtgtgggggatatgtatgtaaatgtatgtgtatataaacatgtgtgcgtgttgtgttgttattgtagtgctat

SEQ ID NO: 93992 - DNA, 90 bp, Mus musculus
ccttgtgtagatgggtttgtgtcactggttgatcttattttagagttgtgaataagggaccactggggactcccaaagtttacattgagg

SEQ ID NO: 93993 - DNA, 128 bp, Mus musculus
atgtacatatatgtttgtgtgtgtttgtatatataaatgtatatatatatatatatgtatatatatatatatacacacatacatatatatatgtgtgtatatatgtatatatatgtgtgtgtgtatat

SEQ ID NO: 93994 - DNA, 82 bp, Mus musculus
gcactctgtcagtttgcatggctcagtctctctttgtctaagagaacagcagctgtgacctctgcactggatttcagtgtgc

SEQ ID NO: 93995 - DNA, 113 bp, Mus musculus
gtcttagagtaataattccctctgttaagagaaatttagatgagaatgtctgcatgtgcatgtagatgaaaatttaatctgtcttttcttgcattggatattcatcgtaaagc

SEQ ID NO: 93996 - DNA, 74 bp, Mus musculus
tctctatatatgtgtgtatatatctctgtgtgtgtatatatatatatatatatatatatatatgcttatagaga

SEQ ID NO: 93997 - DNA, 85 bp, Mus musculus; identical to SEQ ID NO: 57470

SEQ ID NO: 93998 - DNA, 86 bp, Mus musculus
tcttgtcttgaagggaatgttgttaggaatcctgaaagttcttcaggagaccaaatcctatctctcattatctctgtcataaggat

SEQ ID NO: 93999 - DNA, 85 bp, Mus musculus; identical to SEQ ID NO: 57470

SEQ ID NO: 94000 - DNA, 113 bp, Mus musculus
tatcttgtgctagctgatactttctatgaaaagacaggtgaagaatattggtgtttatttcaatttttagagcctgtaagtgctctgggttatgtctacatagacattagata

SEQ ID NO: 94001 - DNA, 85 bp, Mus musculus; identical to SEQ ID NO: 57439

SEQ ID NO: 94002 - DNA, 97 bp, Mus musculus
cctagaatgctgggagttgtagttcttaaaaaataaaaactgcttcatggtggtctatgtatttatctttataatcccctgcaaaaatgtttctggg

SEQ ID NO: 94003 - DNA, 118 bp, Mus musculus
tgtaaagtcactgtttcatgacacttatatgctagtaagaggcgattataaatgttatgtggctttttatatatatatgtaaggtcatgtgattctgagtggctataaagacattgca

SEQ ID NO: 94004 - DNA, 117 bp, Mus musculus
atgtatttccatatatgtacatatatgcatatattatgtattacacatatattgtatatatacatatatgtatataatatatacaatgtatatgatatttattagcatgattgtaca

SEQ ID NO: 94005 - DNA, 97 bp, Mus musculus
gcttttctaataattaccattttttgaaactattttggctgttaaaaatgtttctttttaataagctgattaaaagagcctgcttattagcataagc

SEQ ID NO: 94006 - DNA, 83 bp, Mus musculus
ccactgactggctcacacactctcccctgaaaggactgggcttacaatctggcgcaggcaaggaagtgctgactggcctttgg

SEQ ID NO: 94007 - DNA, 85 bp, Mus musculus; identical to SEQ ID NO: 57439

SEQ ID NO: 94008 - DNA, 107 bp, Mus musculus
atatatatatatatatacatacatatgtatatatacacacacatatacgtatatatatgtatatatacgtatatatgtgtatatatatgtatatatatctatgtata

SEQ ID NO: 94009 - DNA, 104 bp, Mus musculus
gaagagtcaaaatttaccagaacaaataaggtttctacatggtttgtatatatttatctttcccatagtgaaacagttctacctggagcattttgcagttcttc

SEQ ID NO: 94010 - DNA, 122 bp, Mus musculus
ggggtagaagagatggctaagtgattacaactgaatattgtgcttgcagatgacctgagtctgacactcagtatcaatgttgggagatacaaaattacctgtaactctagctccaatggatc

SEQ ID NO: 94011 - DNA, 109 bp, Mus musculus
gaaacataaccaacatggttccccatgatggcagctcacttgaagtttatttttatactttcacaggtttctgttgtttcattctttcatgtttaatggttaacgtatc

SEQ ID NO: 94012 - DNA, 104 bp, Mus musculus
acacacacacacacacacacacacacacacacacacacatctatatgtatgtatgtatgtatgtatgtatgtatgtgtatatgtatatgtgtatgtgtatgtgt

SEQ ID NO: 94013 - DNA, 79 bp, Mus musculus
gtgagtgtgcatgtctctctctctctctatcacacacacacacacacacagacacagagaaataggcatgcatacacac

SEQ ID NO: 94014 - DNA, 104 bp, Mus musculus
cattctagatgatggagtcagggcaagttcagtcactctgactgaaggtggcagcccccgacattcactctaatgaaaatgctggtttactgtttcaccttcag

SEQ ID NO: 94015 - DNA, 70 bp, Mus musculus
atatatatatatatatatatatatatatatatatgcatgtgtatgtgtatgtgtatgtgtatgtgtatgt

SEQ ID NO: 94016 - DNA, 85 bp, Mus musculus
ggtatgtgtgtttgttaagagtgaagacagagagaaagattgaggatccactatttctctttaatcacttttcactgattatgcc

SEQ ID NO: 94017 - DNA, 114 bp, Mus musculus
gtgtaaatgtgcatatgtatacatgcatgtgtgtgcatatgtatatgtatatatgcatgtttctgtatatgtgtgtacatgtgcttgcatgtatgtgtgcacgtacttgtatat

SEQ ID NO: 94018 - DNA, 85 bp, Mus musculus
tatatgactgctctatctgcatgtacatctgaatgccagaagagggcatcagattatattacagatggttgtgagccaccatgtg

SEQ ID NO: 94019 - DNA, 81 bp, Mus musculus
ttcctcctcaacttgcttcttggtcatgatgtttgtgcaggaatagaaaccctgactaagacagccaggtttgatgatgag

SEQ ID NO: 94020 - DNA, 133 bp, Mus musculus
gagtggaagagctgggccttggctgcctcagatgcctgactctggggttcagcccttctgactttcacactcagattatgatttgggacttatatcctgagagtatgttataataagaggcactgaaagtgag

SEQ ID NO: 94021 - DNA, 90 bp, Mus musculus
gggtatttttttggacttccaaatccagagaggactgtgtgcacacggtggcacctctgaattgtgtgtgaagttgcaatgaggagatcc

SEQ ID NO: 94022 - DNA, 93 bp, Mus musculus
gagctgtgagctgacagagtgcctggagtgacctttagttgttcagggctttgatctctggcttttgttctcactctcactctctccagtctt

SEQ ID NO: 94023 - DNA, 114 bp, Mus musculus
accttctaactttctgctgtgttttatgctcattaagttgtgattattatatacatatatagatgtatagatgtataaacatataggtatatagatatatagacgtatagatgt

SEQ ID NO: 94024 - DNA, 76 bp, Mus musculus
gagcaagaaatgaatatttgcatgtgtgtgtatgtatgtatgtatgcatgtatgtatacaaatatgaatattgttc

SEQ ID NO: 94025 - DNA, 85 bp, Mus musculus; identical to SEQ ID NO: 57439

SEQ ID NO: 94026 - DNA, 110 bp, Mus musculus
ttaaactttatttattatgactctgttcttacatgtatgtacatgtgcatgtgtatgtatcagcaagcatgtgccatggcctgtgtatgagatagtttgaataggtttgg

SEQ ID NO: 94027 - DNA, 91 bp, Mus musculus
tggtccacaggtggggagtgaggcttagatatctatgtatctatgtatctatgtatctatctatctgtctgtctgtctgtctgtctgtcta

SEQ ID NO: 94028 - DNA, 73 bp, Mus musculus
aacctgagagtcagtcccaattaaattttgtttttcataagagttgccttggttaggacatgaatgttaggtt

SEQ ID NO: 94029 - DNA, 110 bp, Mus musculus
atatatatatatgtgtgtgtgtgtgtatatatatacatacatatacatatatatatgtgtgtgtgtatatatatatgtgtgtatatatatatatgtgctgtgtctgtata

SEQ ID NO: 94030 - DNA, 119 bp, Mus musculus
ttgaattttaatgtctttcaagtctggaaatcatgtattacttcagatattgtcattttgtttttgacttctcattctgagttattagatacatgattggaagatggttttttagtcat

SEQ ID NO: 94031 - DNA, 76 bp, Mus musculus
tccactcagactcagtaactgtattcttcccactgtctaagctaaacccaaagaagctacagttgctgggagtgga

SEQ ID NO: 94032 - DNA, 77 bp, Mus musculus
gggtcttacagaaaacgaagatagacaccaggaatccccagctttctcttgattgtctctgactttctgtgattcct

SEQ ID NO: 94033 - DNA, 88 bp, Mus musculus
tactatgtggatgtatgtatgtatgtatgtatgtatgtatgtatgtatatatgtatatgtatatgtgaatatatatatccagtgtagt

SEQ ID NO: 94034 - DNA, 62 bp, Mus musculus
gttttctgtggactgtatagaactttgttttaaaatcaatgttctatagagtttctgaaaac

SEQ ID NO: 94035 - DNA, 80 bp, Mus musculus
gtgtgtgctttttctctctgtctgtgtaccagttatgcgacattgcgtaactgagtacagagtaggcggttagcgtttac

SEQ ID NO: 94036 - DNA, 100 bp, Mus musculus
tgatcacagaaagcactgagtagagcttagagccctgggtttgctctcgttttaacagtgactcactgtgtcaaatctagagtccatgacctccttgggt

SEQ ID NO: 94037 - DNA, 69 bp, Mus musculus
gataagtacaagaatgcccggtagacagcagaggctcaaaaagcctctctgtccatctgtctgtctgtc

SEQ ID NO: 94038 - DNA, 128 bp, Mus musculus
gatcctgacagggagagtgatatgaaacaggcacgcccagagaaaactcttgctctcccgtctcagacacacagcctctccctgctcatggattgaaaagagttttcttggtccttacatgatattat

SEQ ID NO: 94039 - DNA, 68 bp, Mus musculus
gtcactccctgtgagtctgtgggggccattttcattcaaattaccatagcattcctcttggagttgac

SEQ ID NO: 94040 - DNA, 67 bp, Mus musculus
gagagcagagaggcgggaagcaaagggactgatcagtcggactcagtggctcatttctgtgatgctc

SEQ ID NO: 94041 - DNA, 76 bp, Mus musculus
gaattaagacaaatccttacagtgtgcttcagggtcctggacccctaacccctctgtgagctctgttgtctcactc

SEQ ID NO: 94042 - DNA, 101 bp, Mus musculus
tcaggcaagctaatgctcccgtgcctccctgagtgcctgtctctccagtctgggaatgattacacgtctcaggtcaactcacaaaaagacattagttctga

SEQ ID NO: 94043 - DNA, 60 bp, Mus musculus
ttctgtgtgcctcagttgtctgtctctctcagcctgaggattcacttggggcttccagaa

SEQ ID NO: 94044 - DNA, 66 bp, Mus musculus
cttgtgtttgacttgtctctctgtcaccctgtgcccaggcaggacaggagagcgaaagaggccaag

SEQ ID NO: 94045 - DNA, 108 bp, Mus musculus
gtggtacaatctgagattatatatatatatatatatatatatatatatatatatatatatatatatatccttgtgtgtatgtgtatatatatttatagaatatatcat

SEQ ID NO: 94046 - DNA, 82 bp, Mus musculus
gccactaatttccatcttctaagtgttcaaatattttttctttagaagttaatttattggactggcaggatgggttagtggt

SEQ ID NO: 94047 - DNA, 116 bp, Mus musculus
tcatgtattcatttattggtttttcgagacagggtttctctgtgtaacattgactatcctagaactcactctgtagactcacagagatccacctgcctctgcctctcaagtgctgg

SEQ ID NO: 94048 - DNA, 104 bp, Mus musculus
agtcatcagccccttttgcctgttttaattggaatgccttttgcattaaatttttagattgtgtgcatgtgcatgtcccagtatgtgtctaaaggcttaggact

SEQ ID NO: 94049 - DNA, 89 bp, Mus musculus
aggctggttcaaacagtttgtattggaccttttgatttcacgagtctcagtgaattcaagatgaccttacaaagatgtgcacctaggct

SEQ ID NO: 94050 - DNA, 89 bp, Mus musculus
ccaccacacccagtttattaatttattctaaaggcttatttttattctctgtgtaagcgtttttgcctgaatgtgcactgtgtgtgtgg

SEQ ID NO: 94051 - DNA, 105 bp, Mus musculus
gagctagagatgagcttttggccttcttttcttccctcccaagtatccctcggtgcctcttaccctggatggagaatgatccgccacaggcataatcttcaggtt

SEQ ID NO: 94052 - DNA, 81 bp, Mus musculus
ggtctgtaagatatcagaactgtttttgtaggtttccacaaaaaccttaatcactaatttgatgtttcttacacagttgcc

SEQ ID NO: 94053 - DNA, 103 bp, Mus musculus
tcaatagtgtctgtgtgcctttctctctgcactaggtttctttttaacttaagttcagacagactcactcatacagagagaataaggtgagaagtaagcttga

SEQ ID NO: 94054 - DNA, 122 bp, Mus musculus
atatatgtatgtatgtatatatgtatgtgtgtatgtatgtatgtgtgtatgtatgtgtgtatatatatgtaagtgtgcatatgtatgtatgtatgtatgtatgtatgtgtatttatgtcata

SEQ ID NO: 94055 - DNA, 84 bp, Mus musculus
gaatctggctggtgtcagggtccactttcaatatgtttatttttacttgacaggaagtgggcatcttgaatgcttgctagattc

SEQ ID NO: 94056 - DNA, 114 bp, Mus musculus
ggaggcgggggtgtggggctaaggcagagccacaaattccatacccatgagtacttgtggggaatgaagggaggactgaattaagaccgtccactgttcctcctcctccacggg

SEQ ID NO: 94057 - DNA, 115 bp, Mus musculus
tccactgggacccagaaatgaaaataagaaatgcaagggtaattagtcactgtcacacacactgggagggtgaacgcaggcatcagtttggcatttccggattaccccagtgcgg

SEQ ID NO: 94058 - DNA, 71 bp, Mus musculus
gagtaaaggagggctggagagatggctcagcggttaagggcactgactgctcttccagaggtcctaatttc

SEQ ID NO: 94059 - DNA, 83 bp, Mus musculus
catgtctttggtctgaaatgacattagttgaaaggcccaccaggcgacaatgccagtgcatgaaatcagatctccagtgactg

SEQ ID NO: 94060 - DNA, 102 bp, Mus musculus
catttctggaaaaggcagatactgctggcccgcctctcagcactgagactggctgcctccctgagtggcggagctgagtggggtttgcttctctgagaagtg

SEQ ID NO: 94061 - DNA, 72 bp, Mus musculus
ggaggaagtgtgtcactggaggtgggctttgaggtttcagaagctcatgccagtctctgtgtcactctctct

SEQ ID NO: 94062 - DNA, 62 bp, Mus musculus
tttggattacacaagcattgggagcatcctgactccctgactcacagtgcttggtttctgga

SEQ ID NO: 94063 - DNA, 82 bp, Mus musculus
atctacctgtctgtctctgtgacagtgccatgcagtttttatcacaattattgtagtacagcttgaggtcaggcatggtgat

SEQ ID NO: 94064 - DNA, 98 bp, Mus musculus
atcagccttagtctgtggtgatctgataggatgcatgggataatttcaatatttttgtatgtgttgcagcctgttttgtgaccaattatttggttgat

SEQ ID NO: 94065 - DNA, 85 bp, Mus musculus; identical to SEQ ID NO: 57439

SEQ ID NO: 94066 - DNA, 86 bp, Mus musculus
gaacaaaacaggggctggagagatggcttagtggttaagagcattgactgctcttccagaggtcctgagttcaattcccagcaacc

SEQ ID NO: 94067 - DNA, 85 bp, Mus musculus; identical to SEQ ID NO: 57470

SEQ ID NO: 94068 - DNA, 80 bp, Mus musculus
gtagctgtgtgagcatgtgcatgtgcaggcctgtgtactcacgtgcacatgtgtgcgtgcatgcatgcatgcagtgcagc

SEQ ID NO: 94069 - DNA, 68 bp, Mus musculus
ctatctatctatctatctatctatctatctatctaggtagatagatagatagatagatagatagatag

SEQ ID NO: 94070 - DNA, 68 bp, Mus musculus
cactgtgataggtgacagtagatagtatggatactgtacctttttactgtccataacctaaagatgtg

SEQ ID NO: 94071 - DNA, 63 bp, Mus musculus
caactaggctggatggtcagtgagccctggttcaactggtgttcactgtctctctcactgttg

SEQ ID NO: 94072 - DNA, 109 bp, Mus musculus
gagaacatcatgaaaaacaagagtagaaaaggcactcttctggatgtgagagatgacagagatgttccaagggtcaggatttttttttttctttttgaagtatgttctc

SEQ ID NO: 94073 - DNA, 94 bp, Mus musculus
taccagacctcacaaaggagtagcttagatggtttctggcaccatagtaattagcactctgtcttgctgtgtctctggtacctcggctgaatcc

SEQ ID NO: 94074 - DNA, 68 bp, Mus musculus
tcctggaactcactgactcactgagaagcccagaatggctttgaagtagcaatgatctagttcaagga

SEQ ID NO: 94075 - DNA, 85 bp, Mus musculus; identical to SEQ ID NO: 57439

SEQ ID NO: 94076 - DNA, 116 bp, Mus musculus
acatgctccgtggttaacagttcagtctctgtgagtcaaagttcattaattttgtttttgtttttgtttttttttttgttttttgagacagggtttctctgtatagccctagttgt

SEQ ID NO: 94077 - DNA, 71 bp, Mus musculus
tttcattgttggacgatgtgattgtcttcttttcctgaaggcaattcctcattgtatatttttacatgaaa

SEQ ID NO: 94078 - DNA, 119 bp, Mus musculus
gtgggggctacgagaacacgtctcctgtctgccttgattactgcagaagagagaaaactcagagcttacacactgcccatttcccaagcagggtgagagggcagaaaaaaaggtttaga

SEQ ID NO: 94079 - DNA, 85 bp, Mus musculus; identical to SEQ ID NO: 57439

SEQ ID NO: 94080 - DNA, 75 bp, Mus musculus
gtgccaccacgcccgcccggctgcattcattttttgttttacatgtgaatgttttgtctgtgtgtgtgtgtgtat

SEQ ID NO: 94081 - DNA, 88 bp, Mus musculus
atatgtgtatatatctacatatgtatgtatgtatatatacatatgtacatatactatatgtgtatatacatgtatgtttatattgata

SEQ ID NO: 94082 - DNA, 98 bp, Mus musculus
tgagtatagttactttcatatacacatgcatatatatatatatatatatatatatatatatatatacatacatgtgcatatatatatatgtatacaca

SEQ ID NO: 94083 - DNA, 77 bp, Mus musculus
gagtgcatacagtcttcccaagatcactcagtgagggctcagcccacagctcctgactcagtctctctgtctgcacc

SEQ ID NO: 94084 - DNA, 81 bp, Mus musculus
gtgcaagtgtgtgtgtatgtgcatatgttatatttatatcattgtgtatatatgcatatgtgtgtatatgtatgtttgtat

SEQ ID NO: 94085 - DNA, 103 bp, Mus musculus
gtgtgtgtgtgcatgttatgtgtgtatgtgtttgtatacatattaatatatgtacatgttaatatacatacatgtgtgtgtatatgtgagtttgtatatgtgt

SEQ ID NO: 94086 - DNA, 67 bp, Mus musculus
acatatatatatacatatatatcatatatatgtttatatgtacttatgtgtatgtatatatgtatat

SEQ ID NO: 94087 - DNA, 85 bp, Mus musculus
gtccatggtggtctgataggatacatgggacaatttcaatatttttgtatctgttgacgcctgttttgtgaccaattatatggtc

SEQ ID NO: 94088 - DNA, 81 bp, Mus musculus
ggacacagataataataatgatggcaagaactgggccacttaatgggtctttctttagtctctgtctctgtctgtctgtct

SEQ ID NO: 94089 - DNA, 81 bp, Mus musculus
gccagcaagttcactgttgtctgtgtgtctgttagctatgaaaagtccttgggcaaactgctatatttgatagttgttggc

SEQ ID NO: 94090 - DNA, 85 bp, Mus musculus
gaacactgctgtgtgtgttagtcactcatctattttattaattgatatattggatagtatgactaactttttctacagtaagttt

SEQ ID NO: 94091 - DNA, 116 bp, Mus musculus
aatggggtatagctcacagagaactgataatatgtgtcattggtttcaaagatttttataagtgtgaggaattgctttggctgttgtcattttcattagtggaatgctttgttcta

SEQ ID NO: 94092 - DNA, 87 bp, Mus musculus
ttttttagtgattcatgattcattgctctgggaaaacgtgtggcaaagacgcaccatggagcagagtccttcatggtagctgaaaaa

SEQ ID NO: 94093 - DNA, 111 bp, Mus musculus
gaagagcctatggaacgagaacccagcagagggaattcaagcaagctgagagaagatacacatcacttgcttctaaggaaatttctcaattgttttgtaccttattttttt

SEQ ID NO: 94094 - DNA, 113 bp, Mus musculus
ggttgttttgatttgcatttccctgatgactacagatgttgaacattttttttaaatgcttctcagcccttctgtattcctcagttgagaaatctttgtttagctctgcaacc

SEQ ID NO: 94095 - DNA, 87 bp, Mus musculus
ggggctgcccacccagggactcaccacttgtcattgttgatctggtctccaaagccaggtgtgtctgtcactgtcagcttcagcttc

SEQ ID NO: 94096 - DNA, 81 bp, Mus musculus
tcaatttcaactctacttatctatatatgacatgcatatacatatatatgtatatatagatggggcagaagtgaaaattga

SEQ ID NO: 94097 - DNA, 71 bp, Mus musculus
gtgtgtgtgtgtgtgtgtacatgtgtgatgtatgtctgcatgttcatgtgtgtgggtgcattcaggtatgc

SEQ ID NO: 94098 - DNA, 101 bp, Mus musculus
tgaatctgtatatgaatttatgtgagtttatacatattcatttgtataaaagtttttctttttgcaagtgtgactctcttctccagttcaatacaagttta

SEQ ID NO: 94099 - DNA, 85 bp, Mus musculus
gtccatggtggtcagataggatgcatgggacaatttcaatatttttgtatctgttgaggcctgttttgtgaccaattatatggtc

SEQ ID NO: 94100 - DNA, 101 bp, Mus musculus
cattgatgacctactagtccatcctcagctctatatgcagctagagacatgagtctctctgtgtgtttagtcccagggagttctaggattagttcatattg

SEQ ID NO: 94101 - DNA, 84 bp, Mus musculus
ggtctttagtcagtcagtctcagggagtcaccaagggtcaaagttagttaactctgttgatcttcctgtggagtttctatcacc

SEQ ID NO: 94102 - DNA, 79 bp, Mus musculus
atgctccaatgcattgttatacatatatatatatacgggtcatctctatgtctatatatgtatgtatatatgtatgtat

SEQ ID NO: 94103 - DNA, 94 bp, Mus musculus
gtgtttcaataattgtagggaagcagaaccaatggcatggaatgtttctttctatttgtattgcattcattatattacaaaactatagagatac

SEQ ID NO: 94104 - DNA, 95 bp, Mus musculus
tctgggatgttgatgtagtaggaagggtcagctgggtgttttctctgtctctgagttacctcctgagtcttcgtttggtaaattgaacatttgga

SEQ ID NO: 94105 - DNA, 119 bp, Mus musculus
gcctcacaagacacagctatatcatggtcttttcagcaaaatcttgctggcatatgtaatagtgtctgcttttggtggctgattatggaatggattatggaatggtggggcagtctctg

SEQ ID NO: 94106 - DNA, 115 bp, Mus musculus
gtcaaaaagataaatgagttgataatgattggaggagagatgtatatgcataaagcattatgttattatgttattctcataagaatagtaaaaaccttgtttctctgtggaggac

SEQ ID NO: 94107 - DNA, 118 bp, Mus musculus
tgagcaatgagtttaaatattttatgtagttacagtaattagttgactgtagagtctgactctaggccatttgagttcacagtcactgcatttatgggtatatttaaataatgactta

SEQ ID NO: 94108 - DNA, 74 bp, Mus musculus
ttcttgtcaagggccagcagagtggaacagagccgcctaatactgatggggccactctctgactcagagaggaa

SEQ ID NO: 94109 - DNA, 90 bp, Mus musculus
tggcttgggcagaatattaccctctcagtcactggctgacccaaggccgcctgggccccacagtgtcaaagatgaatgtttcagaagcca

SEQ ID NO: 94110 - DNA, 85 bp, Mus musculus; identical to SEQ ID NO: 57439

SEQ ID NO: 94111 - DNA, 84 bp, Mus musculus
caccccacccagcgatgacacaggctccctctctgaccctcaggccacctgacaagatggatgtcactggctcacactggggtg

SEQ ID NO: 94112 - DNA, 76 bp, Mus musculus
gtctctctgtgtgtctgtgtgtctccaaaccacgtcggtaggggacaaaccatttcactttaccttagtttgaggc

SEQ ID NO: 94113 - DNA, 85 bp, Mus musculus; identical to SEQ ID NO: 57439

SEQ ID NO: 94114 - DNA, 94 bp, Mus musculus
ctttctgaatgggtctctctctctctctcaaacacacacacacacacacacacacacacacacacagagagagagagagagagagagaagagag

SEQ ID NO: 94115 - DNA, 108 bp, Mus musculus
gatgtgtgctcaagggggctggagaaatggctcatcagttaagagcactgactgctcttccagaggtcttgagtttaattctcagcaaccacatgatggctcacaatc

SEQ ID NO: 94116 - DNA, 56 bp, Mus musculus
cacccatgtgtatgtgcattcatgcacacatgtgtgtgtgcatgtgcatgtgggtg

SEQ ID NO: 94117 - DNA, 71 bp, Mus musculus
ggaggcagaggtagatggatctctgagttcaaggccagcctagtctacagatcaatttctctctctctctc

SEQ ID NO: 94118 - DNA, 93 bp, Mus musculus
ggctggctgactgagtgctggatgcggtatattaggtgtagtactcactctccccctctgactcttgcatctgcactgagctgatgcagcccc

SEQ ID NO: 94119 - DNA, 70 bp, Mus musculus
ctgtctctctcactgtgtggtcctctcagctttgtctgattggggtgtcatcagatggtttggggcacag

SEQ ID NO: 94120 - DNA, 113 bp, Mus musculus
gcttcacactttccaaaataaaggcttacttactttttgtaactttgaagagatttgttcatggttgtaaagtacacaaggctgggagccaggatgaatgcaaagtactgggc

SEQ ID NO: 94121 - DNA, 116 bp, Mus musculus
cactgcaaggatggagccacctcacatacacagaagaaactgaggaatctagagctaaatggttgatttctgtttaaggattctgtcagtttggggcagctttagaaggctaggtg

SEQ ID NO: 94122 - DNA, 85 bp, Mus musculus; identical to SEQ ID NO: 57470

SEQ ID NO: 94123 - DNA, 85 bp, Mus musculus; identical to SEQ ID NO: 57439

SEQ ID NO: 94124 - DNA, 67 bp, Mus musculus
gctgaggcctgagagaaatcacagagaacacaagcattcacctctgcacgctctcactgcctccagc

SEQ ID NO: 94125 - DNA, 69 bp, Mus musculus
gactcacccactctgggtgacatcattccctaggcaggaaattatggattatagaagagtggaggaatc

SEQ ID NO: 94126 - DNA, 102 bp, Mus musculus
tggacattaagccctgcttaactgttccctagggtctgaaatgtatgtgtgacactgtgactctgacaggtaaaacagtggcagcatgatggcttcctgcca

SEQ ID NO: 94127 - DNA, 102 bp, Mus musculus
tggcaggaagccatcatgctgccactgttttacctgtcagagtcacagtgtcacacatacatttcagaccctagggaacagttaagcagggcttaatgtcca

SEQ ID NO: 94128 - DNA, 143 bp, Mus musculus
cacacatatatatatatatatgtatatgtatatatatgtgtatatatacatatatgtgtgtatgtgtatatatatacatatatgtgtgtatgtatatatatacatatatgtgtatgtatgtatatgtgtgtatagacatatat

SEQ ID NO: 94129 - DNA, 84 bp, Mus musculus
atgcatgtatgtatgtatgtgtatatatgtatatacacatatataaatgtgtatatatatgtataactatgtgtgtatatatgt

SEQ ID NO: 94130 - DNA, 76 bp, Mus musculus
gctgtgtgtgtgcctgagactctcacactttgagagcagagagacaggtggattacaagtttcaggtcaatccagc

SEQ ID NO: 94131 - DNA, 72 bp, Mus musculus
ggcccctgtgtgaaaataagaggaaaatttgcaggagtcagttccactcactctttgagtcacacaggtttc

SEQ ID NO: 94132 - DNA, 85 bp, Mus musculus
gaccacatactatttacatgtttgtatctggtttattttactaagcaccctatcttcaaggttgatatgtattgtagtatgtatc

SEQ ID NO: 94133 - DNA, 86 bp, Mus musculus
atatatatacagcatatatatgacatatatgtatacatatatatatatatgtgtgtgtgtgtgtgtgtgtgtgtgtatacatatat

SEQ ID NO: 94134 - DNA, 100 bp, Mus musculus
gtataagaattcacagttaagatatggtcttgaatctcagaagagagtttgcacttttggatactgttaggatgattagagactatgaagaattttatat

SEQ ID NO: 94135 - DNA, 96 bp, Mus musculus
ggtgcagcaattaggataatatgtggggtgagggctgaggcatggagtcagtgtatctctctctttcaaatgtaatggatcctttcttgtttctcc

SEQ ID NO: 94136 - DNA, 75 bp, Mus musculus
gggtggaagtgtgtcactgggggtgtgtttggggcttttgaaagcccaagtcagtcccagtgtctgtctttcctc

SEQ ID NO: 94137 - DNA, 85 bp, Mus musculus; identical to SEQ ID NO: 57439

SEQ ID NO: 94138 - DNA, 71 bp, Mus musculus
gtccatggtggtctgataggatgcatgggacaatttcaatatttttgtatctgttaggcctgttttgtgac

SEQ ID NO: 94139 - DNA, 71 bp, Mus musculus
gaccagcacacactcacacactgtggtggctcctgctgcaggctggccaggtggctgggtgtgtgtgtgtc

SEQ ID NO: 94140 - DNA, 106 bp, Mus musculus
atatataatatatatgaatgtatgtgcatgtattgggtacatacatgtatataagtgtatattatatgtatgtatgtatgtatacacatgtgtatagacacatata

SEQ ID NO: 94141 - DNA, 79 bp, Mus musculus
cacactcttcctcactgtgacacttcaaggctgcatgaccattcccttgtcctttgttacgaaatgagagaaaggggtg

SEQ ID NO: 94142 - DNA, 73 bp, Mus musculus
cttctttatcctctgtctctctgtctgtgtgtgtgagaaagagagagggagggggagggagagggagagggag

SEQ ID NO: 94143 - DNA, 77 bp, Mus musculus
gggtgtgtgtgcatgtgcatgtgcacatatgtgtggtgtgtgtgtgtgtgtgtgtacctgtgcatgcatgcatgctt

SEQ ID NO: 94144 - DNA, 56 bp, Mus musculus
tatatgtatatgtgtatatgtatatatgcatatatataaatacatatgtgcatgta

SEQ ID NO: 94145 - DNA, 76 bp, Mus musculus
ggagtttctgtcactcagccagactcagtccctagagaagattttgaaaggtgctgtctggctccagtgaaaaccc

SEQ ID NO: 94146 - DNA, 84 bp, Mus musculus
tatgtgtgtgtgtgcgcgcgcacatgtgtacgtgcatgtagtttattctgcatgtgcaagtgtatgcacttatgcacactcata

SEQ ID NO: 94147 - DNA, 78 bp, Mus musculus
gctttccattgtggttacttgcattattacattggttatttaattctatttaatgctggcaagttttcagagtgtagc

SEQ ID NO: 94148 - DNA, 85 bp, Mus musculus
gtccgtggtggtctgataggatgcatgggacaatttcaatatttttgtatctgttgaggcctgttttgtgaccaattatatggtc

SEQ ID NO: 94149 - DNA, 163 bp, Mus musculus
atatatatacatacatatatatatatatatatatatatatatacacacatacacacacacacacacacacacacacatatatatatatatatatgtatatatatatatgtatatatatgtatatatatatatacatatatatatatatatatatatatatata

SEQ ID NO: 94150 - DNA, 109 bp, Mus musculus
gaaacagtttcacgacctaaaagctggaatctgctgtttgaagttgaggacactttcagtcactgacacagggtagccaggataacctcttttaggaagttgtcgttcc

SEQ ID NO: 94151 - DNA, 129 bp, Mus musculus
ttgccatagttaaagactggggtttaatatagctgtttgaaaatactcacatctaactgatctcagtactttggtatgtcaggggatagaaaaataaggtttgaaccattataaaaaagactcaacagt

SEQ ID NO: 94152 - DNA, 98 bp, Mus musculus
agcactctcatgctgtgcagagagaaaacagagggaccaggctcccagggatgctcagctccagtcctttacattcccacttttcagttgagggtgtt

SEQ ID NO: 94153 - DNA, 111 bp, Mus musculus
gcatctttttcctgagtattaataactggtagaacatttctactatatatatagatgattattgtagaggctgtggttagttttaataaagggtatcactttaattggtgc

SEQ ID NO: 94154 - DNA, 74 bp, Mus musculus
ccagtgagaccctgtgtctccctccctctaagactgcatggtgggtgggacaacgcaacccctgtaatcactgg

SEQ ID NO: 94155 - DNA, 115 bp, Mus musculus
atatagggagctatttcaattttcttgtatctatggagactctctttgtctctgagtatgtgttcaatttggagaaagttccgtgaggtgcagagaagatagtatactcttgtat

SEQ ID NO: 94156 - DNA, 77 bp, Mus musculus
gggttcatcctgcagaacacagaggctgagacctgctcccccactctcagactctatttgaccaggaaagaaaaccc

SEQ ID NO: 94157 - DNA, 65 bp, Mus musculus
acacagagatagctgctgatagagaagaaaactcctccttgctgtctgtctgcctgtctctgtgt

SEQ ID NO: 94158 - DNA, 102 bp, Mus musculus
ggcactgcaaaatttcactcggtgactcacagggacaggtgaggttaaatgttgtaaagaactttgtctctgtaactccttccatgggtattttgttccccc

SEQ ID NO: 94159 - DNA, 96 bp, Mus musculus
atcttcttaaatctgtctcagttagcttgaaatgacagtgtgcactgagggatgggcactgtgaattctaagccagcctggcatacctaggaagat

SEQ ID NO: 94160 - DNA, 91 bp, Mus musculus
tctaaaatgtatatgtacacacacacacacacacacacacacacacacacacacacacacgtgtgtgtgtgtgtatatggctgctcgggga

SEQ ID NO: 94161 - DNA, 74 bp, Mus musculus
caagagtcacaggttcataggtagaagagctgtgagccctgctctgccacactcactctgagcctgtgttcttg

SEQ ID NO: 94162 - DNA, 85 bp, Mus musculus; identical to SEQ ID NO: 57470

SEQ ID NO: 94163 - DNA, 85 bp, Mus musculus
gcactgaccacttttgtcctttgtatttgtaagtcacagtctctcaaagacctgggatttgtcaagaagatcaagatgttcagtc

SEQ ID NO: 94164 - DNA, 64 bp, Mus musculus
gtatgtatgtgtatgcttgtgtgtgtgttcgagagagaatgtatgtatgtatgtgtgtgtatgc

SEQ ID NO: 94165 - DNA, 105 bp, Mus musculus
gcaatagtgtctgggtttggtggctgattatgggatgtctctctctctctccaagagaaacttttcaagacatatatagtattctaaacatgcctgggtccttgc

SEQ ID NO: 94166 - DNA, 142 bp, Mus musculus
atacactatatgtatgtatgtatgtatgtatgtatgtatgtatgtatgcatgcatgcatgtatatatatgtttatatgtgtatacatatatgtatatatgtatatgtgtatatgtgtatatgtgtatatgtgtatatgtgta

SEQ ID NO: 94167 - DNA, 85 bp, Mus musculus; identical to SEQ ID NO: 57439

SEQ ID NO: 94168 - DNA, 71 bp, Mus musculus
atagcagccttgtgtatgtatgatgtatgtatgtatgtatgtatgtatgtatgtatgtattgggtttctgt

SEQ ID NO: 94169 - DNA, 87 bp, Mus musculus
tatctatgtatctatgtatctatgtatttatgtacctatcttcctgtagatagatgatagatagatagatagatagatagatagata

SEQ ID NO: 94170 - DNA, 64 bp, Mus musculus
tccgaatcagaagagggctaaggggaagacacttctttgactctttggttatgattctgtagga

SEQ ID NO: 94171 - DNA, 69 bp, Mus musculus
tctgtctgagtcagatgctgagtggagcctctcagaggacagccatgccagactactgtctcagtcagg

SEQ ID NO: 94172 - DNA, 85 bp, Mus musculus; identical to SEQ ID NO: 57439

SEQ ID NO: 94173 - DNA, 112 bp, Mus musculus
tttggtctcttctggtagatttgagtataagagattagttcaaagcaatgcactctcagagtctctgtttagaattcttatctcttaagtcactatgatctctgatatcaaa

SEQ ID NO: 94174 - DNA, 106 bp, Mus musculus
cagtgaagtatctctgtcttttccccacctctctcagtctcttccactctgtctcatttgagagaaaatactagaggctattgaaaaacaaagctatttcctcctg

SEQ ID NO: 94175 - DNA, 83 bp, Mus musculus
atatagctgggagagagcaacagtgtgcacatcacccccctctctgtgtatctatctattactgcctctctctgtgtctgtgt

SEQ ID NO: 94176 - DNA, 74 bp, Mus musculus
gtagcaggtatgaaacttggtctccatgtggatcccctgacaactggagctaggactgtctctgactctgttgc

SEQ ID NO: 94177 - DNA, 73 bp, Mus musculus
gtcttggaggttcagtgtttatgtatttatttccttgttttatgggacagtgagtaggcacgtattccgagac

SEQ ID NO: 94178 - DNA, 116 bp, Mus musculus
tgttccaaatacacagaagaataagttgtgactgaaagtgtcttgctgatttgtacctgataaagctagattagaaaacatcttgcccctgagactgttcttcatgtggctagaca

SEQ ID NO: 94179 - DNA, 114 bp, Mus musculus
tacacacatgtgtatctgtatgtttgtaggattgtctagaaatcaagtactatatttgaatatatttttaaagaattttaaattttattttatacatatgcatatgtgcctgtg

SEQ ID NO: 94180 - DNA, 115 bp, Mus musculus
aggcagggggagagagagaataggattagagaagaagaatatcatcatggttactttagacagaagaatgaatgctctttatttttttattttattttatttttttgttttgttt

SEQ ID NO: 94181 - DNA, 117 bp, Mus musculus
agcttctcgtgttactaggagacacaagtgcccaaccaagtcccgggttctctgactctcacagtgtttctgcccttgattgtgcattgtttcctaagtcctaggtatgggaatgtt

SEQ ID NO: 94182 - DNA, 82 bp, Mus musculus
aagatggtgataacaccttgggctgaacgtcttcaaggcagaacacctgctctgtgtgcctctctctgtgtgttactgtttt

SEQ ID NO: 94183 - DNA, 112 bp, Mus musculus
tccgtgtctaagctttatgaactggggttcactgctttgtgtctgtgcatttcagcagagtgtgtgctgtgtgctttcatgaacattggatttcatctcagaaggatagggg

SEQ ID NO: 94184 - DNA, 102 bp, Mus musculus
atgctcagctgtgtgttcacctgtgtgtgtgttcacctgtgtgcatgctcagctgtgtgttcacttgtgtgtgtgtccacatgtgcattctcagctgtgtgt

SEQ ID NO: 94185 - DNA, 112 bp, Mus musculus
ttattgggcttacagcacctgattaggctcagtgagggaagacagtgatgagagctgcttgtcagtccgtcagcctcctgagagaacaggggagtcagggctagctggatgg

SEQ ID NO: 94186 - DNA, 85 bp, Mus musculus; identical to SEQ ID NO: 57439

SEQ ID NO: 94187 - DNA, 116 bp, Mus musculus; identical to SEQ ID NO: 94076

SEQ ID NO: 94188 - DNA, 85 bp, Mus musculus; identical to SEQ ID NO: 57439

SEQ ID NO: 94189 - DNA, 79 bp, Mus musculus
tgcatttctcagtcggttgctgttagagcctctcagagtctcagagtctgaataatagtgtcaggatttagtgtgtgca

SEQ ID NO: 94190 - DNA, 117 bp, Mus musculus
ctaagataagagagtacttccttggggtctatctgcatatgttctgatccttttgtgtctgggtcactcattgtcaagaatacaagtagaattcaggaggctgcctttgtatttaag

SEQ ID NO: 94191 - DNA, 83 bp, Mus musculus
tgctgtgtggtacactggggggcaggtctattggtggtgtggttctctgcagatctctgtctgtctgactccctcacactgca

SEQ ID NO: 94192 - DNA, 108 bp, Mus musculus
tccatgacaagctgttctctatgctttgctttgtttatttttttatgatttttaattttgggggaatgttgcaagggctgaagatggatgcaaggacagatgagtggg

SEQ ID NO: 94193 - DNA, 84 bp, Mus musculus
ttaagcttcttgatgtgtccgttttcataatggggatgaatattttttaatattctcccagctggactatagaaagaagtatga

SEQ ID NO: 94194 - DNA, 75 bp, Mus musculus
gtaggcaggagaagttataggtcatagattttgtggctatgactctgtgtctcattctctctactgtgtgtctat

SEQ ID NO: 94195 - DNA, 114 bp, Mus musculus
gagatgagtacttggtactggataggaaactgagggtggttttcatgaagataattatttcttttttctgaatggtccttaatttcttgtgattctttgtctgaggttcatgtc

SEQ ID NO: 94196 - DNA, 97 bp, Mus musculus
tatatatatatatatatatatatatacacacacacacacacatatatattatgtgtatagtgtatgtatttatatacatatagtgtatgtatgtatg

SEQ ID NO: 94197 - DNA, 139 bp, Mus musculus
tatatgtatataaatacatacactatacacataatatatatgtgtgtgtgtgtgtgtatatatatatatatatatatatatatatatatatatatatatatatgtgtgtgtgtgtgtgtgtgtgtgtgtgtgtgtgtgt

SEQ ID NO: 94198 - DNA, 82 bp, Mus musculus
tgtgcaagtgttctctcagagctggacatgaggaaattaaaagaatccatgccatgtccatgtcaagagattttcttcaaca

SEQ ID NO: 94199 - DNA, 66 bp, Mus musculus
ggccaatcactctctcagcctctgtgatgtcatatggcagaccaggataagagagggcaggatgcc

SEQ ID NO: 94200 - DNA, 76 bp, Mus musculus
acactaataacatattttctatatatgtaaaggtatgtatatatgattttacatatatacagatgtgtgtttgtgt

SEQ ID NO: 94201 - DNA, 86 bp, Mus musculus
atgggatggatctccaggtgaggcagtctctggatggtctttccttcattctctctgccacacttagtctctatatttcctcccat

SEQ ID NO: 94202 - DNA, 119 bp, Mus musculus
ccatatgttactcagtctacctgagataaacaacttatcaccacattacatgatatttttacatatattatccatctgttagatgagtaaagttcaagtagcatgcagcaatatattgg

SEQ ID NO: 94203 - DNA, 109 bp, Mus musculus
gcagtcactggtatctggagactcttatcatgtttggtaataatgtttgctttcttttttttttttctttttattttgagacatagtctctctatgtatcactgtctgt

SEQ ID NO: 94204 - DNA, 67 bp, Mus musculus
tatgtactatatacatataaatgtgtgtatatatatatatgcataaatgtatatgaatatgtatata

SEQ ID NO: 94205 - DNA, 76 bp, Mus musculus
tacgtgtgtgtatgtgtgtgtgtgtgtgtgtgtgtgtgcgcgcacacatgtatgtttactcacagacacacacgtg

SEQ ID NO: 94206 - DNA, 90 bp, Mus musculus
tggtgatccaattttatgcgttttcaaatggatagcccatgttactttatttttaagtaagctatcctttaccactgaatggaaacacca

SEQ ID NO: 94207 - DNA, 141 bp, Mus musculus
catatgtatgtatatatatatatacacatatatacatatatgtgtgtatatatacatatatacatatatgtgtgtatatatacatatatatgtatgtacatatatatgtgtgtgtgtgtgtgtatatgatgtatatatatg

SEQ ID NO: 94208 - DNA, 87 bp, Mus musculus
tcatacactacataaaattaagattaaagatgaaaaataccatgtatatgtatgtatgtatgtatgtctttgtgtatgtgtgtgtga

SEQ ID NO: 94209 - DNA, 85 bp, Mus musculus; identical to SEQ ID NO: 57439

SEQ ID NO: 94210 - DNA, 89 bp, Mus musculus
catatgagtttgtgtgtataagtgtatatgtatatgtgtctataatagtcatatatatatatgtgtgtcatatatatcaaaagcagatg

SEQ ID NO: 94211 - DNA, 99 bp, Mus musculus
cttagtcagaagtgcttgactattgcattgtgagggctaaagctacgtgctcttaacactgtgactccttcactcagtgtctgcataatactggctgtg

SEQ ID NO: 94212 - DNA, 123 bp, Mus musculus
gtagagcttccagagtacatctatcataggcttctgtctccaagcacaatatagcacaagtaatagtgtctggttttggtgcctgcccatgggatggatcataagttaggctggtcattggtt

SEQ ID NO: 94213 - DNA, 112 bp, Mus musculus
tacctattgctcagaccaacttctacacaggtcactgaacatagagaggtcaagttagtgtctgcacagaggttttactcctgtgttctagtctctttggtttggataggta

SEQ ID NO: 94214 - DNA, 62 bp, Mus musculus
gcatatatacacacacacatatatgtatatatgtatacatatatgtgtgtgtgtgtgtgtgt

SEQ ID NO: 94215 - DNA, 113 bp, Mus musculus
ttttttttttgttatcacaactctgcatatatatacatatatgcatatatgtatatatatgcatatatatgcataaatgtatatatatgcagctgatttttccagagactgag

SEQ ID NO: 94216 - DNA, 75 bp, Mus musculus
ggatgctagccctctatcagatgtggggttagtgaagtttttttttttttttcccaatctgtaggttgcctatcc

SEQ ID NO: 94217 - DNA, 102 bp, Mus musculus
tttagttgaacttatttacagtttcagatgtttatttcattatcatcatggtagggagcatggaagtaggaaggagcagatgatcctgtacaagtgactgag

SEQ ID NO: 94218 - DNA, 74 bp, Mus musculus
tatatatgtgtgtgcacaagtgtatatatgtatatatgtatatacatgtatatatgagtgtatatacatgtata

SEQ ID NO: 94219 - DNA, 75 bp, Mus musculus
gtccttgctgacaggagtctgatatagctgtctcctgagaggctctgtcagtgcctgacaaatacagaggtggat

SEQ ID NO: 94220 - DNA, 104 bp, Mus musculus
tttggaagtcacatcctggtgcctaagaatccagatgcagaacgttcagcaccatgtctgtctgtatgtctctgtgcctcctgccatgatgataatgaactaaa

SEQ ID NO: 94221 - DNA, 111 bp, Mus musculus
gggtgacttacatcctgaatatatgatgatgtgagtggatgtgaattgtttaacaagaattgaccatgttcagtatcaagaattaaggcatgtgggaaataagtacaacct

SEQ ID NO: 94222 - DNA, 71 bp, Mus musculus
tctgttgtcacttgagattttgatcttaaccattctgattggtgtaaggtggaatctcagtgttgttttga

SEQ ID NO: 94223 - DNA, 78 bp, Mus musculus
ctctctgtctgtctgtgtattggaatgtcttaggctgcacagcagtcaatccaacaatggctagatgtgaacagaaag

SEQ ID NO: 94224 - DNA, 124 bp, Mus musculus
tatatatccatatatacatacatgcatatatacatatatatgtacatatacatatgtatatatgaatgtatgtatgcatatatatatgcatgtatgtatgtgtgtatgtatgcatgtatgtatg

SEQ ID NO: 94225 - DNA, 95 bp, Mus musculus
gtccccattcttctctctgtattattctgtatatatgtatattcatatataacatacatatatactgaggaagaggatccagggatcaagaaagg

SEQ ID NO: 94226 - DNA, 60 bp, Mus musculus
gtgcatatatgtacgtatgtatgtatgtatgcatgcatgcatgtatgtatgtgtgtgtgt

SEQ ID NO: 94227 - DNA, 93 bp, Mus musculus
gcatgagctttgctcaggctgatttagagatccttgttttcatggtgtcttctatgcactttggtttttatgctctttgagcccctttcctgt

SEQ ID NO: 94228 - DNA, 83 bp, Mus musculus
tgtgtgtctgtatgtgcatgtatatgtgcatgtgcatgaatatctgtgtgtgtgtgtgtgtgtgtgtgtgtgagagagagaga

SEQ ID NO: 94229 - DNA, 101 bp, Mus musculus
gagatccttctaccaaatggccagagaattctgagtgataatattacaggatgatgctttgtcactgcaagagttctctcaaacatctggaggagagtctt

SEQ ID NO: 94230 - DNA, 93 bp, Mus musculus
cctaggactcttatatttggggtcttattatttgtatttcttgtctatcgttagttggaatgtggatatgttttcagataatgggggctttgg

SEQ ID NO: 94231 - DNA, 140 bp, Mus musculus
tatatgtatatatacatctatatatgtgtgttttatatatatatatatgtgtatatatatatatatatatatatatatatgttttatatatatggaggggggtttgtgtgtgtgtgtgtgtgtctgtatatgctcatgtg

SEQ ID NO: 94232 - DNA, 79 bp, Mus musculus
tatgtatatatgtatatgtgtgtatatgtatgtgtatatgtgtatatatgtcatatacacatatatgcatatatatatg

SEQ ID NO: 94233 - DNA, 85 bp, Mus musculus; identical to SEQ ID NO: 57439

SEQ ID NO: 94234 - DNA, 103 bp, Mus musculus
tgcatgtatatatgtctatctacatgtgcatggtatgtacacacacacacacacacacacacacacacacacacacacacacatatatatatatatatatgca

SEQ ID NO: 94235 - DNA, 77 bp, Mus musculus
ggtgtggccttgttggaataagtgtgacctgcttggaatgagtgtgtcactgtgtgtgtcggtataagatcctcacc

SEQ ID NO: 94236 - DNA, 118 bp, Mus musculus
ggttatgcatctgtaaatatatatctttatattgagtgcatgtgtgtgtgtgtgtatatatatatatatatatatatatatgcactgtatatttatatgtatatattagagtttaact

SEQ ID NO: 94237 - DNA, 84 bp, Mus musculus
ctagacattaggcagacgccaacaagagcctgctgacaggaacctgatatagttatctcctgtgagtctctgtcagtgcctggc

SEQ ID NO: 94238 - DNA, 73 bp, Mus musculus
tctctgtgtgtgtgtgtgtgcatgtacatgttcatatatgtgcaggtacacatgccttcatacatacctgaga

SEQ ID NO: 94239 - DNA, 66 bp, Mus musculus
gctatgacagtcagtgttgatgttcaagatctgtactgccacagagaaaacactgaggtctgtggc

SEQ ID NO: 94240 - DNA, 70 bp, Mus musculus
ctgtctctgtcactctgtgtcttagttttgagacagagtctctgactgaaccttgagcttgtagatgcag

SEQ ID NO: 94241 - DNA, 61 bp, Mus musculus
atgtatatgtgtatgtatatgtatatatacatgggtgagatgtgtatatgcacatgtatgt

SEQ ID NO: 94242 - DNA, 111 bp, Mus musculus
ttcatggtttccctccattccctctggttatctttatttctcagacacacacacacatggtgggggggggggggacagaggtgggggtgggagatataaatctaatatgaa

SEQ ID NO: 94243 - DNA, 75 bp, Mus musculus
ttctcatttagtttaagagttcacggagatgccatggaggcagtcaacacagtcagcactcttaagccctgagaa

SEQ ID NO: 94244 - DNA, 72 bp, Mus musculus
ggcagagagaactgagagaggacaaataggagatagcaattaggttttgatgttctctaggtttgttgtgct

SEQ ID NO: 94245 - DNA, 93 bp, Mus musculus
agcttatctatctatctatctatctatctatctatctatctatctatctatctagatggatggataaatatggatggatagatgatagtggtt

SEQ ID NO: 94246 - DNA, 78 bp, Mus musculus
agctggacttttcccagagttaatatatatatgtgtacatatatatattatgtatacatatactatggttagttagtt

SEQ ID NO: 94247 - DNA, 61 bp, Mus musculus
ccagaatactatgtatgtatgtatgtatgtatgtatgtatgtatttacatcaggttgctgg

SEQ ID NO: 94248 - DNA, 106 bp, Mus musculus
gctctaaaaggtggattattggagctgaagagatggctcggcggttaagagcactgactgctcttccagatgtccccagttcaattcccagtaaccacatggtggc

SEQ ID NO: 94249 - DNA, 85 bp, Mus musculus; identical to SEQ ID NO: 65796

SEQ ID NO: 94250 - DNA, 85 bp, Mus musculus; identical to SEQ ID NO: 60912

SEQ ID NO: 94251 - DNA, 77 bp, Mus musculus
ggatttgctgaggtcatttggtatacaccaggtctgccagtgtatcctggatatgtcattggtgatcaagctgaacc

SEQ ID NO: 94252 - DNA, 71 bp, Mus musculus
cttttaaagctgtcagaactgagataggcaaagcgatgactgactgtttcactctgacagttcctttggaa

SEQ ID NO: 94253 - DNA, 79 bp, Mus musculus
gaagcatctttgttcatttaggaaagctcgggcagatgtacagtaaggcctttgagtcagatgttaccagagatgtttc

SEQ ID NO: 94254 - DNA, 91 bp, Mus musculus
agttggttgtggatgagtttaccaccaggttgccagcagtctgcatgtctgtatgtctgtctgtttttatgctggtttgttcactccagct

SEQ ID NO: 94255 - DNA, 71 bp, Mus musculus
gcctgcctgcctgcctgcctgcctgcctgccccagagctactggggaagcagggtgggaggattaggtcgc

SEQ ID NO: 94256 - DNA, 56 bp, Mus musculus
tatatatgtatatatgtgtgtatataaatgtatataaacatatataaacgtatata

SEQ ID NO: 94257 - DNA, 76 bp, Mus musculus
ttggtgagcttttgtcacttgtctttctctgtctgaaacatacacgatattaaggtgagtggctgaaaacagccaa

SEQ ID NO: 94258 - DNA, 78 bp, Mus musculus
ggaaggaagtgcgaacaggactgcagtatcaacatttactgtgtttgtatgcatgtctgtctgtctgtatgtctgtct

SEQ ID NO: 94259 - DNA, 62 bp, Mus musculus
tgggtcttgattggagtcggtcagcagagtgactccacactcgttcactgtcctcgagccta

SEQ ID NO: 94260 - DNA, 70 bp, Mus musculus
gccgacttggctggactggctggccagcaaaccccaggggacctcctgtctcagcctctccctctctggc

SEQ ID NO: 94261 - DNA, 71 bp, Mus musculus
tgcagggctcatgtggaggtcggaagacaatgctcagttgtctctctctcaccaccaagtgaattcttgta

SEQ ID NO: 94262 - DNA, 107 bp, Mus musculus
ggcttatgtatggcaaggtaggaggtggagagatggtttagcagttaagagcactgactgctcttccagatgtcctgagttcaattcccagccactgcatggtggct

SEQ ID NO: 94263 - DNA, 95 bp, Mus musculus
gcttacgggagactgaagagtcattttcttcttctttctgaacgatgttttaaaagtaaagaaattacattttttccatttggttttcctatggc

SEQ ID NO: 94264 - DNA, 85 bp, Mus musculus; identical to SEQ ID NO: 57439

SEQ ID NO: 94265 - DNA, 81 bp, Mus musculus
tttggttttatttactctgtgcctctcccgtctgtatgtctctcagatcaggaagggtgaagacagaaaatagatagcaaa

SEQ ID NO: 94266 - DNA, 62 bp, Mus musculus
gtatgtacgtgtatacgtatgtacgtacgtatgtatgtatgtatgtgtatatatgtgtgtat

SEQ ID NO: 94267 - DNA, 60 bp, Mus musculus
catacacatggaggacactaacatatatatgtatgtatgttagtgtcctccatgtgtatg

SEQ ID NO: 94268 - DNA, 91 bp, Mus musculus
gtgacagatgcttgcttgtgttggccacaaagactggatgctgttagccacagctttgcagggtagatagactgaaagaagccatccctcc

SEQ ID NO: 94269 - DNA, 114 bp, Mus musculus
acttactcttgttatgtgcattggttatatgatcacatgtgtgcacatgcatgaatatatgtatgtatgcatgtgtttgcatttgctatgaacctctgtacctttaaagtatgt

SEQ ID NO: 94270 - DNA, 85 bp, Mus musculus; identical to SEQ ID NO: 60894

SEQ ID NO: 94271 - DNA, 85 bp, Mus musculus; identical to SEQ ID NO: 57470

SEQ ID NO: 94272 - DNA, 116 bp, Mus musculus
gggtcatataggtagagggaggcttacatgagtcagaataattgatttttctttacaactgcagaagagagacaagatcctggctttctggttctagcaaccctgctgcctttctc

SEQ ID NO: 94273 - DNA, 110 bp, Mus musculus
cagggcatctttaactcttgtcaggtgttttttgcaggacttccgatttattgtctctctttctctgaattaaatagagccaggtaaagtctgtatggagtagtgatctg

SEQ ID NO: 94274 - DNA, 100 bp, Mus musculus
ttggattagggggactgtgggatttatcaaacttggcctgtgtcactgtcacaccatgaagtcaaaatttaagttcctatagtttaaaaactactcttaa

SEQ ID NO: 94275 - DNA, 112 bp, Mus musculus
tgcgtgtgcatgcatgtgtgtgtgtgcacgtatatatactacaaatatacgtgtatgtatgtatgtatgtatgtgtgtatgtaaatatacatatatatctaatgcaatagca

SEQ ID NO: 94276 - DNA, 81 bp, Mus musculus
tctcttttcagctgtcagcattacaggagtgtgtcagcacacttggcgtaacttctgaaggtggttcgtagaagaaagagg

SEQ ID NO: 94277 - DNA, 86 bp, Mus musculus
gctccttgctttgaaatgaagaatgtttatctctcagcagtatttttattgctattgaacatgtgattatttactggataaggagc

SEQ ID NO: 94278 - DNA, 63 bp, Mus musculus
gggcataagcagaatgccaggtggggctaatgtaagggtctgttctgtgtgtctgaggggccc

SEQ ID NO: 94279 - DNA, 117 bp, Mus musculus
agcctaccctcattactcagctgaagaagccctttcacaaagcaagtgaaacagcatctcgttgtcccttgctctcttctgaaatctcttcctctgactgtagcaaggaaatctgct

SEQ ID NO: 94280 - DNA, 66 bp, Mus musculus
gtggtctctagagactgagcactggatttagagtacctagaacagcgcacacgcaccagtgaccac

SEQ ID NO: 94281 - DNA, 118 bp, Mus musculus
ccaggtgttgggatgcagggttagggacaaacacttctgtacaagtttggtatttctcaagttctggcagcaggcatgtttacttccaggttatgcaaagtctcagcttgggttctgg

SEQ ID NO: 94282 - DNA, 89 bp, Mus musculus
tgtgggtctcatttccctccacatatttgttaattttgttctttcccctcccacgttacagaaaagtgagagctcaaatgagttccaca

SEQ ID NO: 94283 - DNA, 94 bp, Mus musculus
ccagaattgtgaaatttagatatatccttgggctgtacatgacgtttgttttcactcagcctcagtgtctgtccctcacttctcattatcctgg

SEQ ID NO: 94284 - DNA, 69 bp, Mus musculus
ccttgtacttctatttatgtatatgtgtgtgtgccttcatggacttatgtgcactgtgtacatgcaggg

SEQ ID NO: 94285 - DNA, 79 bp, Mus musculus
tatatatatatatatatatatatatgtatatatatatatatatatacatatgtgtgtgtatatgtatatatgtatatat

SEQ ID NO: 94286 - DNA, 118 bp, Mus musculus
ggactttgacctgctgacagaaattcctggttgcttcagggtcagtctctttgacattatttatatatacattgtcttcctatggctcatcatttactaggttctttccagaaaatcc

SEQ ID NO: 94287 - DNA, 107 bp, Mus musculus
gccttagtgcatggtgatctgataggatgcatgggacaatttcaatatttttgtatctgttgagggcctgttttgtgacctattatgtggtcagttttggagaaggt

SEQ ID NO: 94288 - DNA, 63 bp, Mus musculus
ctgctgccatgctcccagaggtgatggttatggcctctaacactctgtgactgtgagctccag

SEQ ID NO: 94289 - DNA, 59 bp, Mus musculus
atatgtatgtatgtatgtaaatatgtatgtattatatgtatacatatatatgtatatat

SEQ ID NO: 94290 - DNA, 66 bp, Mus musculus
gttgtagggatgctggtgagggctcagcagttgagaatgctcactgctcttccagagaactagaat

SEQ ID NO: 94291 - DNA, 115 bp, Mus musculus
gtgtgtgtgtgtatggaatgtgtgtatctatctatatatagtgtgtgtgtgtatgtatatatatatatatatatatatatatatatgtatatatatatattgtagacatatttgc

SEQ ID NO: 94292 - DNA, 85 bp, Mus musculus; identical to SEQ ID NO: 57470

SEQ ID NO: 94293 - DNA, 102 bp, Mus musculus
gacattcttggtagatatttgtgaatttgtatatgaatttatctgaacctcagtacctgagtttggcaaacactatttacaaagagctatgtggagagtgtt

SEQ ID NO: 94294 - DNA, 85 bp, Mus musculus; identical to SEQ ID NO: 57439

SEQ ID NO: 94295 - DNA, 116 bp, Mus musculus
gcatgtcaagtgactttcttgatcacttccatctcatttattactattattttgttgttgttattattacatgtgtataatgtgtatatgtggatgtgccatgtcaaagcatatgc

SEQ ID NO: 94296 - DNA, 78 bp, Mus musculus
tggtctgagtttttgcctgtggtacacactggtcttaaaagtggctcagttttattatatgtaaagaacaatcttcca

SEQ ID NO: 94297 - DNA, 119 bp, Mus musculus; identical to SEQ ID NO: 84345

SEQ ID NO: 94298 - DNA, 67 bp, Mus musculus
gcagccacttcactacacaaagcatagtctccaagcttgactgtgtctgtgtgtgtgtcccaaaagc

SEQ ID NO: 94299 - DNA, 102 bp, Mus musculus
gggttctaattaacaactgtttgtgtaagctttctggttttaagttaaaaaaaaactatctttggaaatctaggtattaataagcagtttggttagagaact

SEQ ID NO: 94300 - DNA, 67 bp, Mus musculus
accaggagagagtagagtgagacaacatggcatttaacattacaggatcgccttaccttgtcctggt

SEQ ID NO: 94301 - DNA, 132 bp, Mus musculus
tactatgtgtgatgctgtgtatatatatatatgtgtgtgtgtgtgtgtatacatgtatatgtgtatatatgtatatgtgtatacatgtatctgtatatacatgtatatgtgtatacgtgtatctgtgtatac

SEQ ID NO: 94302 - DNA, 108 bp, Mus musculus
tgttctcctagcatgatatttatatttatagcatgataagacaatttatatactcgaaaattgttttatttttcaatatcattgaataatatggtttaagggaaaata

SEQ ID NO: 94303 - DNA, 73 bp, Mus musculus
ctctgtgtggtggtaggttgtatcctagaagaaaatctccctgtgtttacaacactactccctgcaacaggag

SEQ ID NO: 94304 - DNA, 73 bp, Mus musculus
ctgccatgtggcagaggctggtgcaagaaggttcaatttcagtctgactcactcagaggctgccaagttgcag

SEQ ID NO: 94305 - DNA, 90 bp, Mus musculus
cattcagtcggcgacagagaagacaggcagcaccagagggagagtggcagctgacagtcattgtcaactctgtgggatccaggctgggtg

SEQ ID NO: 94306 - DNA, 90 bp, Mus musculus
gtatgtatgtgtgtatgtatgtgtgtatgtatgtatgtgtgtgtatatatatatgtatgtatgtatgtatgtatgtatgtatgtatgtat

SEQ ID NO: 94307 - DNA, 126 bp, Mus musculus
gggaaagcagtgtccccacactacacctgggccctatggtaaagatgtggtgagagacaagacagagctggccccaccctgtgcctgtgcaaagcagagagctggctgtagtggtgagggtatagg

SEQ ID NO: 94308 - DNA, 79 bp, Mus musculus
tgtgagtttcactgtctctgtttagtttctgtttccattatctgcccattgctgggagtggggtggtgaagtctctcac

SEQ ID NO: 94309 - DNA, 89 bp, Mus musculus
aagtcagaggtcaaccttgactgccattcctcaggtgccatctcggttttggaggcacagtctctttctctctcattggcttgtgactt

SEQ ID NO: 94310 - DNA, 79 bp, Mus musculus
aggctgctgttgtaggattactgggttcaggtggtgccctattgccctagcttttgtagttttattttcatgcttgcct

SEQ ID NO: 94311 - DNA, 112 bp, Mus musculus
tgtgtggttttctttcactttcttggtttgggggaggcttttgtaactatatataatagttacataagtgagcctaaagacacaaatggttggtgatggctcagtcggtaca

SEQ ID NO: 94312 - DNA, 91 bp, Mus musculus
cattgtcatacatcatagacacaggattcaggacacttgagtactttcactcagtctgtgaatgatgactgtggtttgatgaatgagtgac

SEQ ID NO: 94313 - DNA, 57 bp, Mus musculus
aatgtgtatgcatgtatatatgtatttacgtatgtatgtatgtatatgcgtgaagtt

SEQ ID NO: 94314 - DNA, 88 bp, Mus musculus
ggccatggtggtctgataggatacatgggacaagattttcaatatttttgtatctattgaggcctgttttgtgaccaattatatggtc

SEQ ID NO: 94315 - DNA, 106 bp, Mus musculus
gccttagtccatggtgatctgataggatgcatgggacaatttcaatatttttgtatctattcatgcttgttttgtgtccaaatatgtggtcagttttggagaaggt

SEQ ID NO: 94316 - DNA, 107 bp, Mus musculus
tctatctatctatctatctatctatctatctatctatctatctatctatcttatatagcaatttgaggatggtggttatagtttgtagctgtgatgataggaatagg

SEQ ID NO: 94317 - DNA, 108 bp, Mus musculus
taaattccctccatatatatgtatatatgtgtacatatacataaacatgtatatgaagggaatttatatatttgtgtatacatatgtgcatttatatatatgcatgtg

SEQ ID NO: 94318 - DNA, 77 bp, Mus musculus
gccagcatgagctatgacttgtgtttttgatcttagccattctgataggtggaatctcaaaggtctgccctgatggc

SEQ ID NO: 94319 - DNA, 154 bp, Mus musculus
tgggtgttttcataggctttttttttctaactatgtcaatatatatttttgacatatatatctatgtcaatatgtatttttgacatatatgtatatatctatgtcaatatatatttttgacatatatatatctatgtcaatatatattttcatg

SEQ ID NO: 94320 - DNA, 62 bp, Mus musculus
tcacatttgggatgcagatacctggcattactttcaaccaggttctgaatttctaaatctga

SEQ ID NO: 94321 - DNA, 100 bp, Mus musculus
gtggtagggaggtaatggagatgtgctagcaaagcaaaagaagacactactgtcacacagtgtcactggcttgtctatgagcaacttggttgcatattat

SEQ ID NO: 94322 - DNA, 85 bp, Mus musculus
tacacacacacatatacacacatatgtttctgtatatatatgtatattgcatatatgttacatatgtatatatatttcagtggta

SEQ ID NO: 94323 - DNA, 70 bp, Mus musculus
tacagtcatgtcattttttatatataattacatgactgtaattatatatgtgtatgtatatgtttatgtg

SEQ ID NO: 94324 - DNA, 96 bp, Mus musculus
atggtctcatgcatgtattttttatgtatgcatatatgtatgtatgtatgcatgcatgcatatatctatgtatttatgtattatgtatgtgtctat

SEQ ID NO: 94325 - DNA, 78 bp, Mus musculus
tggttatgtgaatctcactctcagagattttagcatcactgctccaaaacacagcctgaagattgagagcacgttcca

SEQ ID NO: 94326 - DNA, 66 bp, Mus musculus
tgtatgtatgtatgtatgtatgtatgtatatacatatatatatatatatatacacacatatatata

SEQ ID NO: 94327 - DNA, 69 bp, Mus musculus
ttgacatatatgtatacatatattgactaaattatgattattcaatatatgtgtatatgaatatgacaa

SEQ ID NO: 94328 - DNA, 72 bp, Mus musculus
actttagaatgtatacatgtatgtatacttggtaaggaacctttagaatgtatatatgtatatattcttggt

SEQ ID NO: 94329 - DNA, 85 bp, Mus musculus; identical to SEQ ID NO: 57439

SEQ ID NO: 94330 - DNA, 85 bp, Mus musculus
actgaagtaactgatttttaatatttccattgagagatgaataataacagaatttaaggaaatgtcaaatttagtggctgtcagt

SEQ ID NO: 94331 - DNA, 100 bp, Mus musculus
aaatgaaaaactcaatttgaattaacagaaatatctacatataaatgttttttttaaacatggttgtagttttttgtttttcctttttctattttcattt

SEQ ID NO: 94332 - DNA, 81 bp, Mus musculus
gactgtctgtaggtctatgtatgtgtgcatgtgcatgtgggtctgagcacacatgtgaatgtggaggctgacatggctctc

SEQ ID NO: 94333 - DNA, 96 bp, Mus musculus
atgcacacccatgtttatctctcctgtcagtcactatctcagcctctttattttaccgagcctgaaaaagtgactaattaatcatgaagtgtgtgt

SEQ ID NO: 94334 - DNA, 90 bp, Mus musculus
ccatatattgagagtggagagagaggtcaaatccccagtgtgaaaaagtaggggcattacacaaaacctcctcccaggctcatcacctgg

SEQ ID NO: 94335 - DNA, 56 bp, Mus musculus
ttttatcattgttatacacatacatatatatatatatgtgtgtaacaatgacgaaa

SEQ ID NO: 94336 - DNA, 92 bp, Mus musculus; identical to SEQ ID NO: 82480

SEQ ID NO: 94337 - DNA, 78 bp, Mus musculus
tgctctcaagatttcaaagggctgtggttcttgaatgtaaatatattgctatccacagactttttgttttcggaggta

SEQ ID NO: 94338 - DNA, 83 bp, Mus musculus
gagccaatgtcagtgaaacattttattaattgctaaaaatataagatattacagttcagtgagagcagtgctgaccttgggtc

SEQ ID NO: 94339 - DNA, 114 bp, Mus musculus
aaggttttcatacataaggaagtatatgcaatcatatatatatgtatatatatcatatgcaatatcatatatatatatatgaacaggcaaagtgctctgctaagagagaatttt

SEQ ID NO: 94340 - DNA, 84 bp, Mus musculus
attctttaatatgcattagaacacttaatgcatgtatactatagaatatatgtgctcacggtgtttatatgtatactatagaat

SEQ ID NO: 94341 - DNA, 103 bp, Mus musculus
tcaataacctttaagatactttagggctgcaaaagtattttttttcttaactacagtgcttctgttgcagtttgatattcttctggtattttattgtttttga

SEQ ID NO: 94342 - DNA, 93 bp, Mus musculus
gaagtctctcacaatcagtgtttaatggttaatatgtgattaaaggtatagaacttttattattattattttttacaaatgtgagtgtacttc

SEQ ID NO: 94343 - DNA, 93 bp, Mus musculus
tatgtaaggtgtgcatgagagagacagatgtgtgtgagcatgctgtggtgtgtatatatgtttttctgtttgtatgtggtatattgtgaggta

SEQ ID NO: 94344 - DNA, 85 bp, Mus musculus; identical to SEQ ID NO: 57470

SEQ ID NO: 94345 - DNA, 66 bp, Mus musculus
acatatatgtatgtatatatatgtgtgtatgtgtatatttatacatatgtatacatacatttttgt

SEQ ID NO: 94346 - DNA, 96 bp, Mus musculus
atatatttatatatatatgtatacacacacacatatatatatatgtatacatatatatatatatgtgtgtgtgtgtgtgtgtgtgtgtgtgtgtat

SEQ ID NO: 94347 - DNA, 130 bp, Mus musculus
acctagaggcacaggcaacatgggaacagttaactgggatgacttgtctagcctcagtctgtcagtgggacaatataggcataggccctcagtgactatatgtgctagtgtgggttggtttggaggcagg

SEQ ID NO: 94348 - DNA, 85 bp, Mus musculus
gtccatggtgttctgattggatgcatgggacaatttcaatatttttgtatctgttgaggcttgttttgtgaccaattatatggac

SEQ ID NO: 94349 - DNA, 82 bp, Mus musculus
agtgtataaacttatttttcagtttttaatcctacatatatgggtgttttgcatccatgtatgtctgagctggacatacact

SEQ ID NO: 94350 - DNA, 85 bp, Mus musculus; identical to SEQ ID NO: 57439

SEQ ID NO: 94351 - DNA, 105 bp, Mus musculus
tataatttgagttagcttgatctagtgcaggtcttacacaggcagtcagtctctgagttcacctgtgtgaagactcttctgtctataaagttcacttaaattata

SEQ ID NO: 94352 - DNA, 87 bp, Mus musculus
aggcttttaattttctttcatgcattgaaagtatttcaaaataggaaatactttctaggataatagaaaggaaatgaacagaggcct

SEQ ID NO: 94353 - DNA, 98 bp, Mus musculus
tagttgttcagacactgtaagtagcctgactatatttctgtttttaaaaatggttctgaagtgggagtttagttacagatgcggtattctggcattta

SEQ ID NO: 94354 - DNA, 85 bp, Mus musculus; identical to SEQ ID NO: 57470

SEQ ID NO: 94355 - DNA, 90 bp, Mus musculus
gaggctccactatgtttcccagactgaagtacagaggctaatcacaggtatggccccactgtcaatcagcatgtccaactgcaaagtctc

SEQ ID NO: 94356 - DNA, 79 bp, Mus musculus
acttctgttagtttcactgtgtctctgtttagtttctgtttccaggatctgtccattggtgagagtgggatgttgaagt

SEQ ID NO: 94357 - DNA, 81 bp, Mus musculus
ctatgaatgtgtgggacatctgaagtctacattgggtagatatatttatgtattctatgtggaagatgtcaagtcaaatag

SEQ ID NO: 94358 - DNA, 83 bp, Mus musculus
ctgttttctggattctaaacatgtatgactagcatgtgctgacaaacatgcaaagtgaaccaataggaactcatagaggacag

SEQ ID NO: 94359 - DNA, 125 bp, Mus musculus
gcataggtgtacaggtgcatgtgtatgcatgtatttgtgtgtgcaagtacgtgtatgtgcaaatgcatgtgtgatcatgtgcaggtgcatgtgagtgcagggatgtgtgcatgcaggtgtatgtg

SEQ ID NO: 94360 - DNA, 83 bp, Mus musculus
cagactttgacttgtgactttgatttagataaatctatttatataagtttattctgatcaggatttgtgtgagtccaagtctg

SEQ ID NO: 94361 - DNA, 64 bp, Mus musculus
tatatatatatttgtatatatttatgtatgtatgcgcacatgcatgtatgtatgtatgtatgta

SEQ ID NO: 94362 - DNA, 73 bp, Mus musculus
gaagagctgtcattttgttgtcttttgataaatgtaatattacgtatgctggatcccagaagaaacagccttc

SEQ ID NO: 94363 - DNA, 74 bp, Mus musculus
ggtctttctctggctcactctgatctgtgtgtgtcttcgtgtctgccttctcagggtgacctcagagcgaatcc

SEQ ID NO: 94364 - DNA, 101 bp, Mus musculus
gtgtcctgcagtaggcttaagacatatatcttttatatttaaaggtcatatatatatatatatatgactttaaatataaaagagataagaaactgggacat

SEQ ID NO: 94365 - DNA, 99 bp, Mus musculus
tgtcccagtttcttatctcttttatatttaaagtcatatatatatatatatatgacctttaaatataaaagatatatgtcttaagcctactgcaggaca

SEQ ID NO: 94366 - DNA, 67 bp, Mus musculus
cctccattggggtagatgtgcagagtccgattgttggctgtgagcatctgcatctgtattggtcagg

SEQ ID NO: 94367 - DNA, 92 bp, Mus musculus
tcacctgccatcagctgaagacatagtgaggctcaacttccatgctgcctacacaaaggtcagtcccactgtgactcggtcctggtatttga

SEQ ID NO: 94368 - DNA, 65 bp, Mus musculus
atacaaagatagcaggtatatctgaagcataattctgctctgtgtgtgtctgtctgtctgtgtgt

SEQ ID NO: 94369 - DNA, 119 bp, Mus musculus
cttcttttttgctgggaaattttttcaggtttgagcttttcatgcatacgctgtcataatctctctgtttatgtgtatcgtcagctctgctggatgtgagtggcaaacttcccttgaag

SEQ ID NO: 94370 - DNA, 108 bp, Mus musculus
ccccaaaatagttgataagctccccaaatatcaccatgtggagcagaatgattaaatatttatgtgtgttcactggggtaataaaattgcattcaattatgtctcagg

SEQ ID NO: 94371 - DNA, 74 bp, Mus musculus
gtttaacagcagcagacagtgagaacagggggtccctgcactgcgaccgttctcatttaatgaagttagtaaac

SEQ ID NO: 94372 - DNA, 125 bp, Mus musculus
gttataattatatttacatatgtaatgtattcgttatattatatttatatataatatatttattatattatatttacatatataatagtatatattatattatgtgtgacagatttataataaac

SEQ ID NO: 94373 - DNA, 84 bp, Mus musculus
ttttccaaagtgatcatgatcatcagagctaatgaactaactagtccatggttctaaagattgtgtagtctggagattggaaag

SEQ ID NO: 94374 - DNA, 75 bp, Mus musculus
gaatgtttgtctttttgagtttatggaggttttgtgtgtactgtcacaatctctgtgagttcatatgttgcattt

SEQ ID NO: 94375 - DNA, 85 bp, Mus musculus; identical to SEQ ID NO: 57439

SEQ ID NO: 94376 - DNA, 85 bp, Mus musculus; identical to SEQ ID NO: 57439

SEQ ID NO: 94377 - DNA, 63 bp, Mus musculus
ggttggtcttcaggaaaatgatgagtagagtctctatgtgtcatttacttgggtgaacagacc

SEQ ID NO: 94378 - DNA, 83 bp, Mus musculus
caggaactctgtgtcattgttggaagccgtgaagaaatagacactcactctgaaagtcactgaaccaatttcatagaggcctg

SEQ ID NO: 94379 - DNA, 79 bp, Mus musculus
acttctgttagtttcactgtgtctctgtttagtttctgtttccagggtctgtccattgatgagagtggggtgttgaagt

SEQ ID NO: 94380 - DNA, 85 bp, Mus musculus
ttcataaggaaaattggtctgaagttctttacctttgctgggtctttctgtggtttagatatcagagtaattgtggcttcatgga

SEQ ID NO: 94381 - DNA, 97 bp, Mus musculus
cttgtgcatgcatattcacacacacagacacatacacacatgtgcacatgtgtccctgtgtatgtatgtgtgtgtgtttgtgcctgtcatgcatttg

SEQ ID NO: 94382 - DNA, 90 bp, Mus musculus
ctgacaaaacagagcacctaagtgctggggaaaatgagattttgttcttctctttaactgagctggaagcttgctctaaagaatggtcag

SEQ ID NO: 94383 - DNA, 78 bp, Mus musculus
cattacagtgagaaggcagctccttgagagcattgttgtgtgcaaaagggacaaatgatatctccttaactgttagtg

SEQ ID NO: 94384 - DNA, 106 bp, Mus musculus
gccttagtgcatggtgatctgataggatgcatgggacaatttcaatatttttgtatctgttgaggcctgttttgtgacctattatgtggtcaattatggagaaggt

SEQ ID NO: 94385 - DNA, 104 bp, Mus musculus
taaaagtcttggcttttgtgaatggtttgccatggccatgaagagatgcaactaatctttgtatatttatttcacatgctgaaacttcacatagtttactttta

SEQ ID NO: 94386 - DNA, 102 bp, Mus musculus
attaagtacacccatggcagtggctgaatcggaggtagagggtagactaatacaattttatttttgtaactagctattgttgatgatgtggtagcacttggt

SEQ ID NO: 94387 - DNA, 85 bp, Mus musculus; identical to SEQ ID NO: 57439

SEQ ID NO: 94388 - DNA, 64 bp, Mus musculus
aggagagagaactcagtcagcagaaagcctgctacacaagcttgaggactgagttcagatccct

SEQ ID NO: 94389 - DNA, 98 bp, Mus musculus
gagtcatgaattgggctgaagagatggctcagtggttaagagcactgcctgctcttccagaggtcctgagttcaattccagcaaacccacggtggctc

SEQ ID NO: 94390 - DNA, 84 bp, Mus musculus
atttgaaaagactctggtggggctggtgagatggctcagcagttaagagcactgactgctctttcagaggtcataagttcaaat

SEQ ID NO: 94391 - DNA, 100 bp, Mus musculus
gagtctctcaaataattttccacattagacagtgaacagtgagttctttaatgaagacttttcatgaagttcaaattttggtgccaattgtgtaggattc

SEQ ID NO: 94392 - DNA, 109 bp, Mus musculus
gaactaataagtattttaagggactaaatgattggttaattaaaattaaatgcaaaaatatatgtttatgttcttaacataattattttgtttcttaaacttagtattc

SEQ ID NO: 94393 - DNA, 110 bp, Mus musculus
atgtgtgtgtctgtgtgtctatgtatactgaggtatatatatatatatatatatatatatatatatatatatatattgcatatatatgatagttattttctgacaagtat

SEQ ID NO: 94394 - DNA, 95 bp, Mus musculus
agcaatgcttatttatctaagtctctatgtctgtggatgtatacttttacagtttagatgtcatagaacttctcggtggaatatgatgtaatgct

SEQ ID NO: 94395 - DNA, 92 bp, Mus musculus
gtattaacatcaccagagtctctgtcagtgagttcactcgtttctttcattaatgtgtgtacactgaatagagcaatggggtttaaaatggc

SEQ ID NO: 94396 - DNA, 94 bp, Mus musculus
cccaaggaacactttcccactgtctgcattccttagttacatgtagttctttgtatagaattgaggctttgtgggatttctcagttcactttgg

SEQ ID NO: 94397 - DNA, 81 bp, Mus musculus
cccaccccttgttctggtcattgctatatttgaatttattaaacattctaaagtaatgtgctaggacatatctggggtagg

SEQ ID NO: 94398 - DNA, 113 bp, Mus musculus
tgtgggattccaggcacttcagcacttcctagagatgtgtaaacaaatatcctgtatagagtctatagagtgagcacacagactaggcccagcagaacaatgtatttcctata

SEQ ID NO: 94399 - DNA, 58 bp, Mus musculus
tatgtatgtacatacgtatgtacgtatgtatgtatgtatgtatgtatgtatgtatgta

SEQ ID NO: 94400 - DNA, 78 bp, Mus musculus
tggtgtgtgtgtgtacgtgtatatggtgtagatcctgcaagtatgtatctatacaagtatgtgtaagtatatgtgtga

SEQ ID NO: 94401 - DNA, 107 bp, Mus musculus
ttcttagcaattcatcacagcagttaccaataccatttagtcagaatttggttcctactgtctgactcagtgactgtggagcatggagagtgatgggacagtatgaa

SEQ ID NO: 94402 - DNA, 81 bp, Mus musculus
aatccagaatatatgtgtgttgtaaagaagtcctacacttcatgggtaggggttcgatatcaacatcacataccatcgatt

SEQ ID NO: 94403 - DNA, 116 bp, Mus musculus
caaacccagttggccattatcaaataaaatgtgttttaaagtctatagtaagttgtattgttctttattcgaacgaacaagcttgctttatttacattttactaatgaaatgtttg

SEQ ID NO: 94404 - DNA, 83 bp, Mus musculus
tgagtatattgcctgccttgagatccctggtctatcctcagtagaggaagatgcccctagtcttactgcatgttgatgtgcca

SEQ ID NO: 94405 - DNA, 66 bp, Mus musculus
gggcaccagactctgtcactgactgccagacctcaggctgggccggccttgtcagagaaagtgctt

SEQ ID NO: 94406 - DNA, 113 bp, Mus musculus
cttgggacttttaacattgttgacactgctataaatgatggggactttggaagttgtactaaatgtattttttattatgctgtggctaggtagggacgcaaaagtttcctgag

SEQ ID NO: 94407 - DNA, 111 bp, Mus musculus
tgaaaaggggacatttcaaatggacccagaaacatctgagaacacagacagcactttatgccatttttttttaggttggggtttataaataacatgacaattctcttttta

SEQ ID NO: 94408 - DNA, 68 bp, Mus musculus
gaatatagcatacatgtcattttgggtctgggttacctcactcagtatgatattttgtagttctattc

SEQ ID NO: 94409 - DNA, 84 bp, Mus musculus
ggctctctctggatctctgtcacttttctggtcatgtctggttgtctcgtaggacacatatgttgaaagacatagatcctggcc

SEQ ID NO: 94410 - DNA, 76 bp, Mus musculus
gaggatgtgagttttcctcatctgcaggtggctgagggtctgtccccactgtggtctgaggaatgtagtcagcctc

SEQ ID NO: 94411 - DNA, 80 bp, Mus musculus
tggttggcactggaaacagatgtgtttaaggtaacgaagaccaatccttacccaaatatatttctatttaagtgaaacca

SEQ ID NO: 94412 - DNA, 109 bp, Mus musculus
agaggtgacaacagtgcagattgggaggagcaggtttatctatctatctatctatctatctatctatctatccatccatccatccatccatctatctggtttcccctct

SEQ ID NO: 94413 - DNA, 56 bp, Mus musculus
gtcttcttaggttaccatcagcacgtggacacgtccagactgaagactgagaggac

SEQ ID NO: 94414 - DNA, 80 bp, Mus musculus
agatttatttatataggtaggcatatatgtgtatatgtccacatacacacctgtctgtctgtctatctatctatctatct

SEQ ID NO: 94415 - DNA, 133 bp, Mus musculus
gtgtgtgtgtgtgtgtgtgtgtgtacatatgtgggtatatatgtatatatacatggatatatatgtgtgtgtgtacatatgtatgtatgtatttatgcatatatgtatatgtgtgtgtgatatggtaatgcac

SEQ ID NO: 94416 - DNA, 85 bp, Mus musculus; identical to SEQ ID NO: 57470

SEQ ID NO: 94417 - DNA, 96 bp, Mus musculus
gatcagctttagtccatggtgaagtgataggaagcattggataatttcaatatttttgtatctgttgaggcctgttttgtgaccaattatatggtc

SEQ ID NO: 94418 - DNA, 89 bp, Mus musculus
caactatgaatgtctggctaacggtgcatggttttatgtatagaagtatgtacattgtttttacactgttaaagctagcacatcatttg

SEQ ID NO: 94419 - DNA, 70 bp, Mus musculus
cctgtatgagagcagagtgagcccaaaatagagtttctgctcttctggaagttctctctcccttgcatgg

SEQ ID NO: 94420 - DNA, 131 bp, Mus musculus
tatgtatatgtgtatatgtgtatatgtgtatatgtgtatatatgtatatgtgtatatatgtatatatgtacatacatatatgtacatatatgtatatatgcatatatgtatgtatgtatatatgtatatat

SEQ ID NO: 94421 - DNA, 85 bp, Mus musculus; identical to SEQ ID NO: 57439

SEQ ID NO: 94422 - DNA, 69 bp, Mus musculus
ctttatgtgacaggagggaaaatttaatctcagaaaactgagttatttttcttttcttagtcacaaagg

SEQ ID NO: 94423 - DNA, 132 bp, Mus musculus
gtatatacagtgaattcatatatatatatatatatatatatatatatatatatatattcatatatgtgtatatgtatatatatacatttatatgtgtatgtgtgtatatacgcatgtgtatttatatatgta

SEQ ID NO: 94424 - DNA, 112 bp, Mus musculus
tttaggattagttgattcaccacatgactcttctctctatttgtaaaactaaattatttgattttcaagaattttatgctgcaagagagaactgaaatcatactaccttaaa

SEQ ID NO: 94425 - DNA, 79 bp, Mus musculus
cacagtcactccctctcatacttgcccactgattctaggtttatagagttcacatggtgtgtgtgtgtgtgtgtgtgtg

SEQ ID NO: 94426 - DNA, 113 bp, Mus musculus
ccttggcactaaggttcactaggcactgagtttcagcatgatgatagttcctaagagactgtatctctctcataaattcagggtttaaaaatatatctggggtccattaaggc

SEQ ID NO: 94427 - DNA, 112 bp, Mus musculus
gtccctcaagggttaggtatatcttctctcattgaggctagaccaggcagtgctctgttgtctatgtgtcagggacctctggtcagcctgtgtatcctgcctgattggcggc

SEQ ID NO: 94428 - DNA, 69 bp, Mus musculus
ggatcccaaggtgaggcagtctctggatggatggtcattctctaagtctctgcttcacactttgtctct

SEQ ID NO: 94429 - DNA, 79 bp, Mus musculus
ctaaattagttatatttttacttaagatctctctatatatatacatatataaatatcttaagtgaaaatgtatctgtag

SEQ ID NO: 94430 - DNA, 90 bp, Mus musculus
gtatatatatatatatatatatatatatatatgtacacataatacatatatgtatgtatatgtatataggtatatatgtgtatatgtatg

SEQ ID NO: 94431 - DNA, 85 bp, Mus musculus; identical to SEQ ID NO: 57439

SEQ ID NO: 94432 - DNA, 84 bp, Mus musculus
acgttctacatatagacatctacatatatacatgtacatatatatgtatatatgtatgtgtgtgaatgtatgtatgtatttatg

SEQ ID NO: 94433 - DNA, 69 bp, Mus musculus
tcacgaaaggaagggggaggcagagcagaggacgtaagacttattctcactttgttcttctctgtgtga

SEQ ID NO: 94434 - DNA, 107 bp, Mus musculus
gtattttattgtggaaatgtggacatgtgatgcttaaacttctgaatatgtttatgagaggcctgtgggaaagtttggcgcttcatgttagataagccataaaatac

SEQ ID NO: 94435 - DNA, 70 bp, Mus musculus
agtgtttgccaattaattgtactctttaagttgtatactatagagtattagttaacgggtatctagcact

SEQ ID NO: 94436 - DNA, 86 bp, Mus musculus
gggacgagaggatagtgctcccaacactgacttagtagccttctcccactttaagacagtgctgagagtgtagaaatttgagttcc

SEQ ID NO: 94437 - DNA, 70 bp, Mus musculus
gtataagtatatgtataaatgtataagtgtatgtatgaatgtacatttatgtatatatatatataagtac

SEQ ID NO: 94438 - DNA, 73 bp, Mus musculus
gctgtctaatatgtaagtgtgtatgtgtacatacaataattatttatatatgcatatatatatactaaaaagc

SEQ ID NO: 94439 - DNA, 82 bp, Mus musculus
agttagactgacagaggtgactgagctggtgtacaagatgtgcctcctggtatgagccttggaaataagagcagatctaact

SEQ ID NO: 94440 - DNA, 112 bp, Mus musculus
gtatatcttctatatctatatctatatatagtgtctgattcatcatatatatatttgtatatatatgtgtgtgtatatgtatgtgtgtatatatatggatgtataaatctac

SEQ ID NO: 94441 - DNA, 108 bp, Mus musculus
taaagctcatcctctatttttacaattagagtgttaaatgagtgaagagactgtctaaagaatgggagaaaatcattgtcaagtattaacctcatgagaggggcttta

SEQ ID NO: 94442 - DNA, 90 bp, Mus musculus
cagctaaaccctggcgtagacatctgtctcgaagctcactcaccctagtgttttcacactgatgtttgcttccagctgtgcctctagctg

SEQ ID NO: 94443 - DNA, 264 bp, Mus musculus
gtgtatatgtgtatatgtgtatatgtgtatatgtgtatatgtatatatgtgtatatgtatatatgtatatatgtatatatatgtatatatatgtatatatgtgtatatgtatatatgtatatacgtatatgtatatacgtatacgtatacgtatatgtatacgtatatatgtatatatgtatatatatacatatatatatatgtatatgcgtgtgtgtatatatatatatatatacatatatatatatatatatatatatatat

SEQ ID NO: 94444 - DNA, 129 bp, Mus musculus
gtacatatgtatatatgcatatatgcatatatgtacatatgcatatatgtaaatatgtatatatgcatatatgtaaatatgcatatatgtaaatatgcatatatgtaaatatgtatgtatgtatatgtg

SEQ ID NO: 94445 - DNA, 73 bp, Mus musculus
ttgaagtttgcttgtctgtctgtctgtctgttttgtctggcagggaggagggagaattgtagaacagctttgg

SEQ ID NO: 94446 - DNA, 108 bp, Mus musculus
tatatataatctacatgtattacatgcatatatatatatatatatatatatatatatatatatatatatatatatatatatgcatgtaaatgtatgtttgtgtgtgta

SEQ ID NO: 94447 - DNA, 85 bp, Mus musculus; identical to SEQ ID NO: 57439

SEQ ID NO: 94448 - DNA, 96 bp, Mus musculus
gatcagccttagtctgtggtgattaaataggatgcatgggataatttcaatatttttgtatctattgagtcctgttctgtgaccaattatatggtc

SEQ ID NO: 94449 - DNA, 134 bp, Mus musculus
tatatatttatatatggatatatatatccacatatatgtaatagatgtatgtatgtatatatatgtgtatatatacatatgtgtgtaatggatatatatatatgtgtatacacacacacacacacacacacaca

SEQ ID NO: 94450 - DNA, 108 bp, Mus musculus
cctctatggagtctccaaggatgtgtggccatcttgttcacactggctgttctttgcagaaaaggcaaacaacagagggaaaaatgatgtctgctcaggagctggggg

SEQ ID NO: 94451 - DNA, 108 bp, Mus musculus
tgcatccaccatctgcctttgactctggtgttgctcagagatgagacacaggtatgggatgtagggtgtttatgtatgtctgtatccctctgttcagtgtctaatttc

SEQ ID NO: 94452 - DNA, 89 bp, Mus musculus
gtaacaatcttaaagtgatgaagaatgttatatgtgtgtatatatatatatatacacacatccacttcatccacaccttagagtaaagc

SEQ ID NO: 94453 - DNA, 75 bp, Mus musculus
tctaaggtgtggatgaagtggatgtgtgtatatatatatatatacacacatataacattcttcatcactttaaga

SEQ ID NO: 94454 - DNA, 85 bp, Mus musculus; identical to SEQ ID NO: 60912

SEQ ID NO: 94455 - DNA, 111 bp, Mus musculus
gaaactcgggtttacctataaccctagaaggacttgctaagttacatttttatttctgtaaatagacataataacctagttcattgtaggtttataggtcagagtgttgtc

SEQ ID NO: 94456 - DNA, 64 bp, Mus musculus
tatatatgcatatatgagtatatatatgtatatatgcatatatatgcaaatatatgtatatata

SEQ ID NO: 94457 - DNA, 98 bp, Mus musculus
gtatatatgttcatatataaaatgcatatgtgtgtgtatacatatatgtatgtatatatacatatatatgtgtgtgtgtttgtatgtgtgtgtgtata

SEQ ID NO: 94458 - DNA, 115 bp, Mus musculus
tatagaataagatagtatctctgctcaccaaggagtctatgaagaaggttgaatagaagacttaccttgaagaatagaccctgtgacacaaaggttctagcttcgaaattcttta

SEQ ID NO: 94459 - DNA, 100 bp, Mus musculus
tattgcatgtatggcttttacatgtgtgattttccacttaatatttttgaatattaacagataattttacatcatatgagccaattttacttttgccata

SEQ ID NO: 94460 - DNA, 100 bp, Mus musculus
agataaatttgtgtgcttgtttagatatatatatgtatgtatgtaaaacatattatatatatttatacatatatacatacatctatatatggagagagag

SEQ ID NO: 94461 - DNA, 115 bp, Mus musculus
gaaacagcattacctcaaatgttgaaatgagggaatgtatcaggattcaatatattttattgttcttctctatgctttgcctacttttaaaaatatttaagcctggtgtggtggc

SEQ ID NO: 94462 - DNA, 117 bp, Mus musculus
gcaaaaatgtctctttatggacaagggtgtgaaaaagaatcttttaatgtgtcttctttattccaattcttaggcatgttctttctaattacaccgaataacttgaggcatactggt

SEQ ID NO: 94463 - DNA, 70 bp, Mus musculus
tatatgtataaatatatgtgcagatatatgtataaatatatgtgtttgtatcttcatgtatatacatgtg

SEQ ID NO: 94464 - DNA, 109 bp, Mus musculus
actcttccacttggctttgttttctagtatgaatgtaggctatttgactttgagaaaactcattttctacatctgtaaaatagggattaaaataacgggttgataaagt

SEQ ID NO: 94465 - DNA, 82 bp, Mus musculus
ggcacagaattgaaaataattgtgctaatgaagaagaatgatttatttacttatttaacacagttattttccattctgtgtt

SEQ ID NO: 94466 - DNA, 85 bp, Mus musculus
gtgtatttctgaaatacactaacataccagctttcagatggggtaaactcctgtctgagagtcaagtgtgtgatcagagatgcat

SEQ ID NO: 94467 - DNA, 85 bp, Mus musculus; identical to SEQ ID NO: 58391

SEQ ID NO: 94468 - DNA, 128 bp, Mus musculus
ctctgtgacacacttcagcttccacaagttttttttcactcttatttattttattttatttattttattttgtgggtgaaagttgcaagagtggaggatagatatggagttatagggagatgactgag

SEQ ID NO: 94469 - DNA, 74 bp, Mus musculus
tgctgatgtgtctctatctgtcagatatcctcatcacctttgggatagaaatagacgatctgggtatgtcagca

SEQ ID NO: 94470 - DNA, 91 bp, Mus musculus
ttctgagggaagggagttggactggcaggagaatgctctacttagattgtttagaagtttcttggtttctgacttaggggttccaatagag

SEQ ID NO: 94471 - DNA, 132 bp, Mus musculus
atatatatgtatatatatatatgtgtgtgtgtatgtatgtatatatatatatgtatatgtatatatacatatatgtatatacatgtatgtatacatatatatacatacatatacgtatgtatatatatatgc

SEQ ID NO: 94472 - DNA, 99 bp, Mus musculus
tatatatatacatacgtatatgtatgtatatatatgtatacatacatgtatatacatatatgtatatatacatatacatatatatatatacatacatac

SEQ ID NO: 94473 - DNA, 112 bp, Mus musculus
tccagacatgtgacttgttagctttgttattcataattctgatctctgtgctagagtagtgtctcagatatgaccagctgaaggctatggtccacctctaaccatgtttgga

SEQ ID NO: 94474 - DNA, 106 bp, Mus musculus
gtgagaaaaatacacacacatgtatatgcacatgtatgtatgtatatgtgtatatatatgcatatgcatgcatatatatatatatgaatgtaattttttaaattat

SEQ ID NO: 94475 - DNA, 94 bp, Mus musculus
ggatatgttttgtagcacatatggtctataatgtatatgctaaatcttttctgtatatatatataccaagatgtaagttatatttaaacatacc

SEQ ID NO: 94476 - DNA, 71 bp, Mus musculus
tgtgttcatcttgaaagtacacatatatatgtctattgtgaatatatgtgtgtagatgtgcttgtggacca

SEQ ID NO: 94477 - DNA, 83 bp, Mus musculus
aggtgacaaacatgcctgtgcatatgtatgcatatgtgtgtgtgtgtgtctgtatgtgcgcacgcgcatgtctatggtaatct

SEQ ID NO: 94478 - DNA, 111 bp, Mus musculus
gtttcagagagtgctaattatttgcattaattaacagacgatttcatagtttttatgttcttttgataaatttgatagcctttatctagctacttataatcatgctgaagc

SEQ ID NO: 94479 - DNA, 75 bp, Mus musculus
ctttcaactcccattctctctctgtttcagtttaaccagggacaaggagagagggagagcaagggagagcgagag

SEQ ID NO: 94480 - DNA, 85 bp, Mus musculus; identical to SEQ ID NO: 57439

SEQ ID NO: 94481 - DNA, 121 bp, Mus musculus
atgcatatatgtatatatacatatgtatatatacatagatatatacatgcatatatatacatacatgtatatgtatatatatatatatatatatatatatatatatacgtagatatttcta

SEQ ID NO: 94482 - DNA, 116 bp, Mus musculus
ctacgtatatatatatatatatatatatatatatatatacatatacatgtatgtatatatatgcatgtatatatctatgtatatatacatatgtatatatacatatatgcatgtag

SEQ ID NO: 94483 - DNA, 93 bp, Mus musculus
agaaattttggagaatcaatttttgtttaagtacaatatgaactcctttgtgtaaaataaaatgtgctttgcagtttgattcctgaataatct

SEQ ID NO: 94484 - DNA, 73 bp, Mus musculus
gtgtgtgtgtctgtgtgtatgtgcatgtttaagaaatgaaaaatcaaaacatatatatacaaggatgccacac

SEQ ID NO: 94485 - DNA, 99 bp, Mus musculus
ttcttgtcaagaatttagtattggggctggagaggtggctcacctgtagagaacactgactgctcttccagaggtcttgagttaaattcccaagaacca

SEQ ID NO: 94486 - DNA, 106 bp, Mus musculus; identical to SEQ ID NO: 65673

SEQ ID NO: 94487 - DNA, 91 bp, Mus musculus
ttgggtttctttgggacttgacagaattcactatatagaccatgtgggcctcatattcaaagatcagtctgtctctgtctctatgttctga

SEQ ID NO: 94488 - DNA, 110 bp, Mus musculus
agatatgtgcatatatacacacacttgtagataattttatgtatatattttttactataccaatatttatttgcttgactcatttagtgtctctgtgtgtgcgtgtgtct

SEQ ID NO: 94489 - DNA, 76 bp, Mus musculus
gtgcttttatcaggagagggagagaagtgaacatgcactctctctgcctctgtctctgcctctctgtctctgtcac

SEQ ID NO: 94490 - DNA, 113 bp, Mus musculus
tacttgcttctagaatttaagatcttctcataccatctgatatagctgaggaaatatttattttctttcatgtgatcatgggaatgaagaagttaagttcttgatccttggta

SEQ ID NO: 94491 - DNA, 111 bp, Mus musculus
tggacctccatttagtatatcttttaattgtctggctgtgtgtctctatacctgttctagagactagagagtctggagacttaaggtaaaagcaaacactgatggtctaaa

SEQ ID NO: 94492 - DNA, 85 bp, Mus musculus; identical to SEQ ID NO: 57470

SEQ ID NO: 94493 - DNA, 85 bp, Mus musculus; identical to SEQ ID NO: 57470

SEQ ID NO: 94494 - DNA, 76 bp, Mus musculus
tatggttgcctgggtaggtgcacttgtgtgcgtgtgtatatacattagtatatatgtatttttctaggtgtacgtg

SEQ ID NO: 94495 - DNA, 85 bp, Mus musculus; identical to SEQ ID NO: 57470

SEQ ID NO: 94496 - DNA, 85 bp, Mus musculus; identical to SEQ ID NO: 57439

SEQ ID NO: 94497 - DNA, 101 bp, Mus musculus
catctccctccccatctttctgactgagggattatgctgtgtgcctcactttcacactcaccatcctccttggtctcaagttctgataggactggagcatg

SEQ ID NO: 94498 - DNA, 105 bp, Mus musculus
tagtattttattcctgagtgattcatgtctgaaattccaatttgcatggattttctttctttgtaaatgtcagccatgtactttaattatggaattcttttattg

SEQ ID NO: 94499 - DNA, 85 bp, Mus musculus; identical to SEQ ID NO: 57439

SEQ ID NO: 94500 - DNA, 72 bp, Mus musculus
gactgggagagaagtgggagaggaaaatcaaccaaaataatcaatctctctctctctctctctctctctctc

SEQ ID NO: 94501 - DNA, 64 bp, Mus musculus
tgtatgtgtacatgtgtgtgcatgtatgtgtacacacacatacacgcacactcacacgcataca

SEQ ID NO: 94502 - DNA, 107 bp, Mus musculus
ttctctcaaagtcaaaacctggtgttaatacagagaaaatgttataatctatcattatacatatttatgaacagtgaattggcattgggtctggggcatgaagagaa

SEQ ID NO: 94503 - DNA, 62 bp, Mus musculus
tggttgtaaggatctgagtctgtctcagtcagttgcttgttgggcctctcagaggacaacca

SEQ ID NO: 94504 - DNA, 81 bp, Mus musculus
atgtgtatatacctgtatgaatatatgcttatataaacatatactatgtttatatatgcatttacacacatgtatacacgt

SEQ ID NO: 94505 - DNA, 77 bp, Mus musculus
gaatgagattgctcagactccgatctgtccggtgacagaacaggctgtcagaagacagacagttgcacatcacattc

SEQ ID NO: 94506 - DNA, 94 bp, Mus musculus
gtggaagaaatgaatctcagaacagtgtcaggattctggtatgtaggagaacagttcctagcagatctgcagtgttagaaggcattgagtccat

SEQ ID NO: 94507 - DNA, 103 bp, Mus musculus
gctgacaaaatgtttgtgtagaaattccagagcaactacaacctgtatttatttttataaaactggtgtaagtacctcaggaggctagcaatggggggtcaac

SEQ ID NO: 94508 - DNA, 81 bp, Mus musculus
tgtgaatcttgaagaaggtgacttcagagtcagtttcactgattgtctgggatccacctctttcctatgtttggatataca

SEQ ID NO: 94509 - DNA, 102 bp, Mus musculus
gaacattttaaaggtgttgagaggatgtactaaaatagaattttttttttctaaaggaaaatgagtacctggtaagttttttgacagcattgctttttgttc

SEQ ID NO: 94510 - DNA, 85 bp, Mus musculus; identical to SEQ ID NO: 57439

SEQ ID NO: 94511 - DNA, 93 bp, Mus musculus
atttcaggctttgaaatcactgcctctgtcactgaaccactgagggacatagggtcaacacacagagacaaattatgatgaaggctttgaggt

SEQ ID NO: 94512 - DNA, 85 bp, Mus musculus
gtccgtggtggtctgataggatgcatgggacaatttcaatatttttgtatctattgaggcctgttttgtgaccaattatatggtc

SEQ ID NO: 94513 - DNA, 113 bp, Mus musculus
tcattgctttggcaatcattcagagggaatttcatatgaaaagtagtaatattcataaattttgaatgtatagaattttcagtttaaaattcatgattttggaggcatattga

SEQ ID NO: 94514 - DNA, 76 bp, Mus musculus
ctattcgaatctatgtgtatgcatatgtatatgtatatatgttcatatgtacatttgtatatacctgttgtaatgg

SEQ ID NO: 94515 - DNA, 70 bp, Mus musculus
gttgcaggaaggtattgttgctccctagataagtcagaagatactctgcagagcttatgattcctgtaac

SEQ ID NO: 94516 - DNA, 110 bp, Mus musculus
ttaacatgcttgtacattttagaattgcttgataaggcaaattaatatattcatattgaaaacagatccaatttgccttcaacgattgtcaatagtacatcccgtgttga

SEQ ID NO: 94517 - DNA, 69 bp, Mus musculus
ctctgtgtgtctctgtgtgtatgtgcgtatttatacgggagcaagtccacatgagcacatgagtcacac

SEQ ID NO: 94518 - DNA, 79 bp, Mus musculus
gctgttgaggctgaggcccctaagtggggtctttatggtttaaaagcccaccccaggctctgtctctgtctctttctgc

SEQ ID NO: 94519 - DNA, 78 bp, Mus musculus
atgtatgtatcatatatatatgtatatatatatagtggatatatatatacacatgtatatatgattttatgcatacat

SEQ ID NO: 94520 - DNA, 114 bp, Mus musculus
gaagcaatcactagacacacacacacacatatatatgtatatatatcatatgtatgtatgtatgtatatatacatatatgtggatatatacatatgtatgtctatagtatattc

SEQ ID NO: 94521 - DNA, 77 bp, Mus musculus
tatatatatatgtatatatatatttgtgtgtgtgtgtgtgtgtacatacatatatatgtatataacatttctgtata

SEQ ID NO: 94522 - DNA, 110 bp, Mus musculus
ctaggcagcaaacccgtgaccagtgcttatgtatgcttaggaacacactctactaatcaagctacagcctcagctctcacgacacaattcatgtctgtttgcatttttag

SEQ ID NO: 94523 - DNA, 86 bp, Mus musculus
tgagagctgaggctgtagcttgattagtagagtgtgttcctaagcatacataagcactggtcacgggtttgctgcctagcgcctta

SEQ ID NO: 94524 - DNA, 92 bp, Mus musculus
gcttggagctggggagacggtcagtgggtcagtgggtcactgggttgtaagcacttgctgctcctacagaggacccaggttcagttcccagc

SEQ ID NO: 94525 - DNA, 109 bp, Mus musculus
ctggaattgtctctcaaagatactcgtgctccctggttgtgcttgttagtagttctcttcaatctctagaagtctgaccacgcagatgctgagtaactgttatttctag

SEQ ID NO: 94526 - DNA, 78 bp, Mus musculus
cttggatatgtttggttgtatcctggctctctgggatatccagcctctggttcttgtttatccaggcagtgtgtcagg

SEQ ID NO: 94527 - DNA, 65 bp, Mus musculus
ttctgagcgcaggagtgatgtagccagcaaacactgtttacattctcgctctctgtctttccgaa

SEQ ID NO: 94528 - DNA, 120 bp, Mus musculus
ggaggcgtggcatggttaggggagatgcatcactggaggttggctttgaggtttcagagtctcttaatctctctgcctccaacttgcaaatcaggatgcaagttctcagctactgctccc

SEQ ID NO: 94529 - DNA, 86 bp, Mus musculus
ggacaaggaagcggttgtagagtcatatggctatcactctggtagaatagacaccattgtcactcatacaatttgcttgataatcc

SEQ ID NO: 94530 - DNA, 94 bp, Mus musculus
acctgcataacaagcgcagtcctattctgttgtatttttgtgactacaaaggagtatatttgaatatttttacccttggaaagcttggtgaggt

SEQ ID NO: 94531 - DNA, 88 bp, Mus musculus
gcatttgtgagtgtgcatgtgtatgtgctagtgcatgtgtgatgtatgtttgtgtgtggtgtgtgtgcatgtgtttgttgtggtatgt

SEQ ID NO: 94532 - DNA, 117 bp, Mus musculus
gagaaagtagacaacacccttcaactcattggcacaggaaaaggtgttgagaacagaacactgttagcacaggcactaagaccaacaattaatgaagaaggaaggcactatgaactt

SEQ ID NO: 94533 - DNA, 107 bp, Mus musculus
ccatactgatggataatgatgctaaagatcagggtgggctctgagaatctgtctttctgatgagcaccagacgagtcatactagtccatgaccatgagtttagatgg

SEQ ID NO: 94534 - DNA, 110 bp, Mus musculus
ggttgtcggaacaatagattcaggacatagttcatggaaattagagtttaaaatcacttctctttttgttcaagactatatattgatgatctatttattatatgacagtc

SEQ ID NO: 94535 - DNA, 82 bp, Mus musculus
tattcagtattgaagtctcccagtgtcagtgtgtgagaattactatgtgattttagctgtactagggtttcttttgggaatg

SEQ ID NO: 94536 - DNA, 74 bp, Mus musculus
gttggtagtgagtatgtgtgtgtgtatatgcacacacatgcatgcacacacacacacacacatgtgctgcttcc

SEQ ID NO: 94537 - DNA, 69 bp, Mus musculus
taggaatatatccattgtgtgtatgtatgtatgtatgtatgtatgtatgcatgtgtgtgtgtgtttgtg

SEQ ID NO: 94538 - DNA, 110 bp, Mus musculus
agtccaagtactgctggcttagctcatgttcttttccatccttttaagagacatttttttttcttacaaaggaaggggatggccgcaatgagcatcacaatacttagatt

SEQ ID NO: 94539 - DNA, 115 bp, Mus musculus
gggttaaggtggaaagcgtcttctagcttgctcttaatagaacacagagtgcacacctcaaatttgcaatggatatattgatgccctgggtaagcaggtagatgccgcctttctc

SEQ ID NO: 94540 - DNA, 133 bp, Mus musculus
tatgtatgtattgatctatgtatatatatgtgtgtgtgtgtgtatatatatacatatatctgtatatatatacatatatatatatgcatatatatatatatatatatatatatatatatatatatatcaatat

SEQ ID NO: 94541 - DNA, 85 bp, Mus musculus; identical to SEQ ID NO: 57439

SEQ ID NO: 94542 - DNA, 95 bp, Mus musculus
ggctgccatgcttcccattatgatgataatggattgaacctataaaactgtcagccaattaaatgtttttctttataagggttgccatggatacc

SEQ ID NO: 94543 - DNA, 68 bp, Mus musculus
gatcacttcaccagctctgttctctgtagcactctggttgactactgttgctgctgttcttagtgatc

SEQ ID NO: 94544 - DNA, 85 bp, Mus musculus
ggccatggttatctgataggatgcatgggacaatttcaatatttttgtatctgttgagacctgttttgtgaccaattatatggtc

SEQ ID NO: 94545 - DNA, 72 bp, Mus musculus
ttatatgtgtgtgtgtgtgtgtgtatatatatatatatatatatatatatatatatatatatatatatataa

SEQ ID NO: 94546 - DNA, 58 bp, Mus musculus
tatgtatgtgtatgtatatgcatatatatatatatgtgtgtgtgtatacacaaatata

SEQ ID NO: 94547 - DNA, 77 bp, Mus musculus
gaggcacaactagggcatccccagagatattctttttatataagaaaactctggatatgactgagagatcatgcttc

SEQ ID NO: 94548 - DNA, 132 bp, Mus musculus
tgtgtctgtgtaggtgtgtgtgtatatacatacatatatacacacaaaaaacatatatataattatattatgtatacacacagtatatatgtgtgtgtgtatatatatatatatgcatatatataatatttg

SEQ ID NO: 94549 - DNA, 89 bp, Mus musculus
atatatatatatatacacacacacatatatactgtgtgtatacataatataattatatatatgttttttgtgtgtatatatgtatgtat

SEQ ID NO: 94550 - DNA, 65 bp, Mus musculus
acacacacacacacatatatatatgtttttcatatatacatatgtatatgtgtgtatatgtgtgt

SEQ ID NO: 94551 - DNA, 85 bp, Mus musculus; identical to SEQ ID NO: 57470

SEQ ID NO: 94552 - DNA, 78 bp, Mus musculus
catttatcatttttagtctgtgtttttctgtgctgggagagagcagagagggtgatggattctctggagatgtggatg

SEQ ID NO: 94553 - DNA, 94 bp, Mus musculus
gcaggtagcatagccccactcccaaaccagatgttactttattaaaaattgaacattttggagggagtaggaggagatttatgctttagattgt

SEQ ID NO: 94554 - DNA, 107 bp, Mus musculus
tcaagtggtttctgtgaatttgggaatggacattttgtgcctggtggaattaaaatacataatgcaatgaaaagtagtttcctcaaacgttcttacaaaattcttga

SEQ ID NO: 94555 - DNA, 67 bp, Mus musculus
ctatgcatgtgtgtgtgtgtgtgtgtgtattatgtgtatatatgtatatggatgtgtatatgtatag

SEQ ID NO: 94556 - DNA, 56 bp, Mus musculus
ttctgtttcagcaagtccttgagagcaggaggtcctcattttttgttggcacagaa

SEQ ID NO: 94557 - DNA, 128 bp, Mus musculus
tgtgtgtggacgttttgaggcaggggttcatttaaatacagacattttctttatgtgaaatatatgtatttatacttagagactgtgttgttcaaatcaaaatccttcatatgcatttaaataagacg

SEQ ID NO: 94558 - DNA, 92 bp, Mus musculus
gctccaagcctttgccatttcagtgggatctttcctggtactgatcagtgctctatattggaaagccgctgagatgacaactgtcttggtgt

SEQ ID NO: 94559 - DNA, 85 bp, Mus musculus; identical to SEQ ID NO: 57439

SEQ ID NO: 94560 - DNA, 76 bp, Mus musculus
gcatatgctttgtataaggtagatttagtatgtattgatataagtattaatgactatcttaaaatgaagtaattgc

SEQ ID NO: 94561 - DNA, 85 bp, Mus musculus; identical to SEQ ID NO: 57439

SEQ ID NO: 94562 - DNA, 60 bp, Mus musculus
gtctgtctgtctgtctgtctgtctaggtggatatgtggatgaatggatggatggacggac

SEQ ID NO: 94563 - DNA, 199 bp, Mus musculus
atataagtgttagctatggatcagatcatagataaactatatatatgcatatatatctatatatgtatatatattatgtacagtcatatgctatacagtacatatatatctttatatgtatatatacatatatgtatatatacactatatatagtgtgcatttgtatgtgtgtgtgtgtatatatatatatatatatat

SEQ ID NO: 94564 - DNA, 118 bp, Mus musculus
aacagacaagcatcaagtgcatcaagtgccagtattcttctgtctcacaacctcacagatcagagattgcagacataaactcccatagctgactttctacttgatttgttgcaatgtt

SEQ ID NO: 94565 - DNA, 80 bp, Mus musculus
cttgtgtgtgtgtgtgtgtgtgtatgcatgtatgtatgtatgtatctatatatgcatatatagctacatataatttcaag

SEQ ID NO: 94566 - DNA, 97 bp, Mus musculus
agaggtagggtttcaggctaacaatagaaaaatgtacaatcagagattaaggtagtaaatatttttttaatggaagacaagctgtaaactgttctct

SEQ ID NO: 94567 - DNA, 79 bp, Mus musculus
agaaagcagagatcggccagagagtgagtagagactgatcataaacttgcaggtttctggttagaatttcactttctcc

SEQ ID NO: 94568 - DNA, 68 bp, Mus musculus
cagagacaaattaagagaggagtcatgctaactttctctcattgtgtgtctctctctgtctgtctctg

SEQ ID NO: 94569 - DNA, 93 bp, Mus musculus
tgacttgcaatcccaactatgcagaggcagatataggtgaatctctgagactcagtccctctctagcctactgactcagtaagttccaggcca

SEQ ID NO: 94570 - DNA, 91 bp, Mus musculus
tcactctttatttaccccaggggaaactcatctgaatagttattatttttatctagatgcaattctctgaaagcggtacagtgttccgtga

SEQ ID NO: 94571 - DNA, 94 bp, Mus musculus
atatatatatatatatatatatattgctgatatatatatgcacatattgctgatgtatatgtatatgtatatgtatatgtatatgtatatgtat

SEQ ID NO: 94572 - DNA, 83 bp, Mus musculus
gagctgaataagcttttgagaaatgtgtgtgagcactgagctggatcgtgataaactcacttccttgtataggcattcagttc

SEQ ID NO: 94573 - DNA, 85 bp, Mus musculus
ggccatggtggtctgataagatacatgggacaatttcaatatttttgtatctgttgaggcgtgttttgtgaccaattatatggtc

SEQ ID NO: 94574 - DNA, 74 bp, Mus musculus
taaatgcccactttcatgatttacgtgtatttatatgaattttcatactatcatgcacataaagagggcattta

SEQ ID NO: 94575 - DNA, 111 bp, Mus musculus
gtcccaaactaactgcactttatcttcagtttcaagtaatggtttatatttattactttcaagtaaaagaatactccataaagtttgtggctggatcagtttcagtgagac

SEQ ID NO: 94576 - DNA, 97 bp, Mus musculus
ggtctcctacttcagttgaatggttgggtgttcgttgggtgtaggtatctgtgtctgtctcagtcaactgctggtagagcctctcagaggacagcca

SEQ ID NO: 94577 - DNA, 117 bp, Mus musculus
gattgttttgtgtttccctcgtctgatctacatatatgtctgtgttaaatgcatttagaatctatagtgctacattacatgtgtgaagtctacctgtattcctgtgttaaaatgatc

SEQ ID NO: 94578 - DNA, 69 bp, Mus musculus
gcaaatgcctgtgcacagaattgtgtgtgcacatacgcacatgcacatacacactctggaggtccatgc

SEQ ID NO: 94579 - DNA, 96 bp, Mus musculus
gatcagtcttaggccatggtggtctgataggatacatgggaaaatttcaatatttttgtatctattgaggcctgttttgtgacctattatgtggtc

SEQ ID NO: 94580 - DNA, 88 bp, Mus musculus
aagttggttgggttctttttttaaagtctctctctctctcattaatgtagaggaaagagggggagttaaaattgatcataagtaactt

SEQ ID NO: 94581 - DNA, 79 bp, Mus musculus
caaacaattcattctgtttagacagacataaatctggaaatatctgaatttatttttgtacttagacagaaagtgtttg

SEQ ID NO: 94582 - DNA, 67 bp, Mus musculus
gcctagtctcactgtgtgacactctccatgaaatctggaagtaggaagccagtatggaactctgggc

SEQ ID NO: 94583 - DNA, 74 bp, Mus musculus
gtctgtctgtttgtctctctgtctgtctataggcagtaggtaggcgtggcagtgaaagctacaagcagatggat

SEQ ID NO: 94584 - DNA, 98 bp, Mus musculus
ccagtggctgagcacatggcggtctcgggaagggtctgaaatcacagtccacatgctgtccttacaaggacccatcagacctaagtgttcacactgtg

SEQ ID NO: 94585 - DNA, 119 bp, Mus musculus
gatattttcctccataaaaattgataatatttttcaaagtggaagagaggcaagcaaatatttagtattggagatctccatttttctgtatctttacatttttttttggagataatatt

SEQ ID NO: 94586 - DNA, 141 bp, Mus musculus
agccaaatatatatatttgtttatatatttatatattatacacatatatatgtgtgtgtgtatatgatgtatatgtgtatatatatgtatatatgtgtgtctgtatatatatgatgtatatgtgtgtacatatatgtatat

SEQ ID NO: 94587 - DNA, 109 bp, Mus musculus
ggactgagttgtactgggtatggttacattttatttctctcttttatgagcaaagtctcagactctcagaggaaatgttggcattttccataaagtccacagcctttcc

SEQ ID NO: 94588 - DNA, 105 bp, Mus musculus
gtgaatgactgtatgtgtaccacatgtgtgtaagagcttgtggatgtgtgtcacatccgctggagctagagctatagatgtatgtgagcttcaaggaactgtcac

SEQ ID NO: 94589 - DNA, 90 bp, Mus musculus
cataagctgcgttgattctaaagatgattgatgtctgctctcatggcaatagacatgccagatcactgatagacagcctcccagcagatg

SEQ ID NO: 94590 - DNA, 107 bp, Mus musculus
ttacagtgactaagacctgctgtttggagggtccatcctacacagtcactttctgtctctatcaaaaaggactcaaatccaccagaaagcacttggctattttgtaa

SEQ ID NO: 94591 - DNA, 100 bp, Mus musculus
tgttattgtgactgtatggtgtgatttgaaagcagatattgtgatgattaaagatattttatcaatatttgtactttaaatatttgtactcacagataca

SEQ ID NO: 94592 - DNA, 102 bp, Mus musculus
tgctgtgtgcatgcagcagcatataaatgctcttgatttttgtcacttttatgatgttcatatctatgtatgtatgtatgtatgtatgtatgtatgtatgta

SEQ ID NO: 94593 - DNA, 88 bp, Mus musculus
aatgtcttcatgtttaattgttcatttaccgtgttcagtgtctgcatagtcgtagactagagttaatgatggattaagtgaggatgtt

SEQ ID NO: 94594 - DNA, 70 bp, Mus musculus
ttgttccaaatgagagcctgagtgcagacttctctgagtgaggaatttctcaggcattgatgtggaccga

SEQ ID NO: 94595 - DNA, 67 bp, Mus musculus
gggtgcagctgcttctgacaaggggacaagaagagtgtgtcagtgttcagagagagctcagcacacc

SEQ ID NO: 94596 - DNA, 114 bp, Mus musculus
tagataaactctgcaaactaggggggaaaaaagggatacatatgtctgtctgtctgtctctctcgactctgactacaagtttatccctaactcatgccctttgcccaggatctg

SEQ ID NO: 94597 - DNA, 71 bp, Mus musculus
actccaaactctgcctctgtgtgtcattgtctgagtattggcaaaaatacagagagagtagaatcacaagt

SEQ ID NO: 94598 - DNA, 109 bp, Mus musculus
gttgaaaggcacagccgggggctggagagacggctcagacgttaagagcactgactgctcttccataggtcctgagttcaattcccagaaacacatggtggctcacaac

SEQ ID NO: 94599 - DNA, 110 bp, Mus musculus
gaagataaatccatttgattttaaatatgccatctctcacctttgattgtccaaaagctattctgtttcaatcagtgcatgaggtattcaaaatataggggttttatttc

SEQ ID NO: 94600 - DNA, 96 bp, Mus musculus
gcttggtttcaggagatcttttgcatgatggctgttcacacccctttctggatgagttgtcttttactgtactggatttttttcttaacccatggt

SEQ ID NO: 94601 - DNA, 89 bp, Mus musculus
gcagaagacctagctcagctgcttaccggaccagtgtttgtcacttcagtatctgtgagcccttatgaaccctgctttgttgattctgt

SEQ ID NO: 94602 - DNA, 74 bp, Mus musculus
gttacaagcatttgtgagcttccttgtgtgggtgctggaagcccagctcagggtctctgcagaagtggcctgac

SEQ ID NO: 94603 - DNA, 83 bp, Mus musculus
acccaaccccaacaatccctctgtaaggagcagttgtttctcacacattctgtgactcctttggatttgttttatgtttgggt

SEQ ID NO: 94604 - DNA, 93 bp, Mus musculus
tatatgaacgtgtgtatatatttatgtatgcatgtatgcatgcacatatgtatgcatatatgtggggtgtatgtatgtgtatttgttcatata

SEQ ID NO: 94605 - DNA, 112 bp, Mus musculus
gtctcgtgtatgaagtgaccaataactttaaaaacttttggatcgtaaatctgtcaagagacagattgaactagagtatgtaaagtatttgtagatcttaacatacaatgac

SEQ ID NO: 94606 - DNA, 108 bp, Mus musculus
ccaagactatatatatttttttttcaattttatcttattttattttgctgggagttgttgcaagggtaaagggtagatagaaagagacaagaagatgagtaagagtgg

SEQ ID NO: 94607 - DNA, 101 bp, Mus musculus
tcctgcagcgagatagtgcatgcttattagaatatatatatcactgaccatactgaagagatatagtactgattatactagcatcaacactgtctgcagga

SEQ ID NO: 94608 - DNA, 117 bp, Mus musculus
ggtccctgtgagacgatgcccattgacataaacccgtagatccgatcttgtggtgaagtggaccgcgcaagctcgtttctatgggtctgtggcagtgtggtgatctgacaaagcact

SEQ ID NO: 94609 - DNA, 108 bp, Mus musculus
tggaagctgtgtgcatccgggttgaggtagtaggttgtatggtttagagttacaccctgggagttaactgtacaaccttctagctttccttggagcacacttgagcca

SEQ ID NO: 94610 - DNA, 103 bp, Mus musculus; identical to SEQ ID NO: 52335

SEQ ID NO: 94611 - DNA, 83 bp, Mus musculus
gaggagggctgacagaagagaggctgcaaagccgagtgagggagagagcaagcgagcggctgcttctcatgcagacccttgtc

SEQ ID NO: 94612 - DNA, 138 bp, Mus musculus
cgccaccccttgcacacagaagcgctctgagtcagcatcagatgctagcccgactctctccgtgtgtctgtgtgcctgtgcgcgcgcgcgtgctcgctcgggcatccgtgtctagccgaggggagggggtggcgtgtg

SEQ ID NO: 94613 - DNA, 79 bp, Mus musculus
ctttgcctagtccctgagaccctaacttgtgaggtattttagtaacatcacaagtcaggttcttgggacctaggcggag

SEQ ID NO: 94614 - DNA, 61 bp, Mus musculus
gggtttggtcatgaagagtgttcctcctctttttgttgggacagtctctcactcagtgccc

SEQ ID NO: 94615 - DNA, 73 bp, Mus musculus
atgtatacactctcacacacaatacatatatttatgtgtgtgtatgtgactgtgtgtgagtgagtgtgtctat

SEQ ID NO: 94616 - DNA, 92 bp, Mus musculus
acatatatatatgtatatatatacatatatatacacacacaaatatatgtacatttgtgtatatgtatacatatgtgtatatatatgtatgt

SEQ ID NO: 94617 - DNA, 66 bp, Mus musculus
tcagtgcagatgtcttatttaatcactttccaccttgggtttttttgagacacagtctgtcactga

SEQ ID NO: 94618 - DNA, 103 bp, Mus musculus
tcaggatctgttgttatgtctcccttttcatttctgattttgttcattagaatgctgtccttgtgccctctagtgagtctgactaagggtttatctatcttga

SEQ ID NO: 94619 - DNA, 59 bp, Mus musculus
ctccatctactgtttggctatgggtgtctgtatctgtctgagtcaactgctgggtggag

SEQ ID NO: 94620 - DNA, 94 bp, Mus musculus
tcttttaagcagtgggtaaggatatcgtcttcacagtgcaagggatggagttgccataagtgcatttgaaatctctgtttcacctctgctagga

SEQ ID NO: 94621 - DNA, 91 bp, Mus musculus
aggacttgagttagatatctgaatgcctctcttctttgatctaccatccacggtttcagaacagactgagcacagagggttcttaagttct

SEQ ID NO: 94622 - DNA, 116 bp, Mus musculus
taggagtggaatggctagttcatatactgtatatatatatatatatatatatatatatatatatatatatatatgtatgtgcatatctatctatctatctatctatctattatcta

SEQ ID NO: 94623 - DNA, 94 bp, Mus musculus
gactttaatttttttggattgggaggctgacagtgagtggaggtatctcactctgtcatgtcagcctctatcactgtcacagagggatccgagc

SEQ ID NO: 94624 - DNA, 79 bp, Mus musculus
aagatatattaaattatggatatagtcatatatatgtacatatatgtatatatgtatgtatgtatatgtatatctttaa

SEQ ID NO: 94625 - DNA, 88 bp, Mus musculus
gtgattgcaggtatgtctctctgtgtgtctcagatccccgggaacaggagttgcagacagttgtgagctgccatgtgggcactgagac

SEQ ID NO: 94626 - DNA, 80 bp, Mus musculus
ctgactaagtctataagttacatcgatttgtgtgtgcatgtgtgtgtgtacatacatgtgtgtgagagagacagagacag

SEQ ID NO: 94627 - DNA, 78 bp, Mus musculus
gtacccttccgggactcgaaatgtccggtgttggacaattacacaacaaagtctggacactgagattatgaacggtac

SEQ ID NO: 94628 - DNA, 71 bp, Mus musculus
gtatacagaggaacgtagtgcagaccagacccatgcaggctctctgactgtcacttcagtctctgtgatac

SEQ ID NO: 94629 - DNA, 70 bp, Mus musculus
gtgtgtgtgtgtgtgagacacagagagagagagcatgtgtctgtatatctgtgtctgcatctgtgtgtgt

SEQ ID NO: 94630 - DNA, 65 bp, Mus musculus
tgatctcacagcctctgtggttgcctgccagttcttggcccgcacacgcctaggcctgccaatca

SEQ ID NO: 94631 - DNA, 85 bp, Mus musculus
ggccatggtggtttgataggatacatgggacaatttcaatatttttgtatctattgaggcctgttttgtgaccaattatatggtc

SEQ ID NO: 94632 - DNA, 77 bp, Mus musculus
gtgcacatgttcctgtgtgtgtgagagtgcatgtacactctagtgtatgagtatgtatatgtgcatgtgcatgggga

SEQ ID NO: 94633 - DNA, 99 bp, Mus musculus
actctcggttatgaggtagatccagttgtgacatctgtcatcccttaatcatcatcagagttgacatctgtctgcctaagctggagtcacctttatccc

SEQ ID NO: 94634 - DNA, 83 bp, Mus musculus
gtgcaccctctctgtttcagtcacttagtcactatggcctccaggcagaagatccccttaggtgacgatggcagacaggagcc

SEQ ID NO: 94635 - DNA, 79 bp, Mus musculus
ttggtgaaaacagagtcaacagttgcttgcacaatggatttggagcaaggcacagtctgaaagtcactgtttcacacag

SEQ ID NO: 94636 - DNA, 99 bp, Mus musculus
ttgtgttggtgttttgatggggatcatattgaatctatatattacgtttaatagtgtagtcattttcataatattgattcgtcctgtccatgagcatgg

SEQ ID NO: 94637 - DNA, 89 bp, Mus musculus
accaatgggactggagagatggctcagctgctaagagcactgactgctcttccagaggtcctgagttcaactccaagcaaccacatggt

SEQ ID NO: 94638 - DNA, 110 bp, Mus musculus
tgtgttcatgcaacacagtaaatacaatacaaatttatataatttatacatatataatttgtgtatatatgtatatattatatatgtattatatgtgtatgcattatata

SEQ ID NO: 94639 - DNA, 134 bp, Mus musculus
catatatatgtgtgtttatgtaaggagagtgtgtaggtttattgtttgtgcacatgtgcatgtgcaagtgcatgtatgtgcacatatgtatgtatgtatgtgcatgtgtgtgtgtgtatgagtgtttatatcta

SEQ ID NO: 94640 - DNA, 76 bp, Mus musculus
tcctggaactcactctgtagaccaagctggcctcaaactcagaagtcagcctgtctctgcctcccaagtgctggga

SEQ ID NO: 94641 - DNA, 75 bp, Mus musculus
ctatctatctatgtatgtgtgtgtgtgtatatatatatatatatatacatacatatatatatatttataaaatag

SEQ ID NO: 94642 - DNA, 78 bp, Mus musculus
atatatgtatatatatcatgttatcatgtataaatcacttcaatgtgtatatatatgtatgtatatatatatgtgtgt

SEQ ID NO: 94643 - DNA, 103 bp, Mus musculus
tatgtatatatgtatatatatatcatgttatcatatatatgtatgtgtatatatgtatatatatcatgttatcatacatatgtatgtgtatatatgtatatat

SEQ ID NO: 94644 - DNA, 85 bp, Mus musculus; identical to SEQ ID NO: 57439

SEQ ID NO: 94645 - DNA, 110 bp, Mus musculus
atatgaatgcaataatttggacatggtggtattggataatagtggtcttatatttattctgtgtgggtcttctatatttatattatgtcacatcttatgcaaaattatat

SEQ ID NO: 94646 - DNA, 85 bp, Mus musculus; identical to SEQ ID NO: 57439

SEQ ID NO: 94647 - DNA, 69 bp, Mus musculus
tatatatgcttgtgtatatatatgtatatatacccctcatatatatatatatatatatatatatatata

SEQ ID NO: 94648 - DNA, 85 bp, Mus musculus; identical to SEQ ID NO: 57470

SEQ ID NO: 94649 - DNA, 123 bp, Mus musculus
gctatttatgcagaggacctagatcaaacccacataggctccgtgattctcttctcagtctctctgagtcactatgagcccagcttgatttggtgggttgtgttcttgtagtatctggctcct

SEQ ID NO: 94650 - DNA, 113 bp, Mus musculus
atcaaggggattcaaattggaaaggaagaagtcaaaatatcactttttgcatatgatatgataggatatataagtgaccctaaaaattccaccagagaactcctaaacttgat

SEQ ID NO: 94651 - DNA, 81 bp, Mus musculus
acacaaacacaatatatatgtgtatatatgtatataaatgtatatatatgtgtgtatatatgtatatacgtgtgtatgtgt

SEQ ID NO: 94652 - DNA, 108 bp, Mus musculus
tgtagatataggtatatgtataagaataggcataggtatagatataggtagatccatacatatatttttattgatgactattttggaatacttttctattcaagtaca

SEQ ID NO: 94653 - DNA, 70 bp, Mus musculus
ggggactgaatatatggctcaggtcttaagagcactgactgctctttcagagaccgtgagttcagttccc

SEQ ID NO: 94654 - DNA, 111 bp, Mus musculus
ctagcaactgaagtttgctattcactttcataatgagctaacactgttatatcattttgtacatgtgtgctgcttggggaagataattctgcatattgagtactctgcaag

SEQ ID NO: 94655 - DNA, 85 bp, Mus musculus; identical to SEQ ID NO: 57470

SEQ ID NO: 94656 - DNA, 90 bp, Mus musculus
ctctccaccttgctattggagacaggatctctctcactgactgggctggacccatagcctaggtgggttggactgtaatattcaatctca

SEQ ID NO: 94657 - DNA, 117 bp, Mus musculus
tcattatttaattagcctcttattactttatttgcttaatataacaatgcatatcttatctatatttgagtatgacattctggatcagataattgaaaggaaataattgagaaatgg

SEQ ID NO: 94658 - DNA, 80 bp, Mus musculus
attatttatctctgtatgtatatctatgtgtatagacatctatattgataattatagatatttttatgtagatagatgat

SEQ ID NO: 94659 - DNA, 88 bp, Mus musculus
ggtcatgcgtctcggtctgtatgtgattctagcttcagagaacagagactggaggaatcaccaaaacaagctggagaccacattagcc

SEQ ID NO: 94660 - DNA, 71 bp, Mus musculus
cagtcaggatcaagcagcattgttagattgtaccaatcggtctacagtagtctgcactcttcttctgattg

SEQ ID NO: 94661 - DNA, 80 bp, Mus musculus
tctctatctgtcagacactctattctctctgatgcttaggtacaagagctgtgttagagatgtgtcatgtaggtctgaga

SEQ ID NO: 94662 - DNA, 132 bp, Mus musculus
aagtatatatatatatatatatatgcatacatacatatatatgtgtgtgtatgtatttatatatgtacatgtgtatatgtatatatacacacatatatccatatgtatatatgaatatgtatatatgtatat

SEQ ID NO: 94663 - DNA, 66 bp, Mus musculus
gctgaatacagttgcactgcaggtggttatcatgtgtttgataatgatcaaagcaattgtagaggc

SEQ ID NO: 94664 - DNA, 62 bp, Mus musculus
tggcctgagcgaggatgaggatgctcggtgtgactgtgtgtcacttagtcactcactagtca

SEQ ID NO: 94665 - DNA, 110 bp, Mus musculus
ctattctccatataggtagagatagatatatgtgtttatgaatatgagtatgtatatataaacatagcacatatatttatatgtatatgttatatatgaaatgggtacat

SEQ ID NO: 94666 - DNA, 150 bp, Mus musculus
tacatcgatataacttgctctgtccataagtatgtatgtatgaatatatgtatttatgtctgtgtatgtctgtgtatatatatatatatatatatatatacatatatatatatatatatataaaatgacatcaagactgacagttgatat

SEQ ID NO: 94667 - DNA, 108 bp, Mus musculus
ccaagcacaaatccatgtttttgtgaattatggattcatgttattgtctcaatttatattactgtctcttataatctactcacattcagctggcttcatttgtcttgg

SEQ ID NO: 94668 - DNA, 106 bp, Mus musculus; identical to SEQ ID NO: 63491

SEQ ID NO: 94669 - DNA, 115 bp, Mus musculus
aaatgcatgcacacacacacacacacacatatatatatatatatatatatatatatatatatatatatatatatatatacacacgtgtgtgtgtgtattctgtatttatgtgtat

SEQ ID NO: 94670 - DNA, 83 bp, Mus musculus
ggatgctgctttaagatgcaggcctagcctctggaatccatgctggtgctgctctggggctgtctctgtgtccctgctagcag

SEQ ID NO: 94671 - DNA, 72 bp, Mus musculus
agacatatatgcgtatgtacatgtatgtatatattctctatgtatatgtgttgtatatatgtatatgtgtgt

SEQ ID NO: 94672 - DNA, 71 bp, Mus musculus
tatgtgtgtatctatttgtctctatatatgtatattttatacagatagatagatagatagatagatagata

SEQ ID NO: 94673 - DNA, 95 bp, Mus musculus
gcatattctatttaacatgtattatatgaatgtatcaatatatgtacatatatatatggatatatatccataatgatattaccaataaataatgc

SEQ ID NO: 94674 - DNA, 96 bp, Mus musculus
gataagtcttagttcatggtggtcagataggatgcatgggataatttcaatatttttgtatctgtggaggcctattttgtgaccaattatattgtc

SEQ ID NO: 94675 - DNA, 65 bp, Mus musculus
ctctctctctcatttttgtgcctatgtgtgcatagttgtctgtggatggtacaagagggtgacag

SEQ ID NO: 94676 - DNA, 243 bp, Mus musculus
atatatatatgtgtgtgtatatgtgtgtgtatgtatatatatatatatatatatatatatatatgtgtgtgtctgtgtgtgtatgtatatatatatatatatatatatatatatacacatacatatatatatatatacacacaatatatatatatatgtgtgtgtgtatgtatatgtgtgtgtgtgtatatatatatatacacacatatccatattttatatatatatatatatatatatata

SEQ ID NO: 94677 - DNA, 85 bp, Mus musculus; identical to SEQ ID NO: 57439

SEQ ID NO: 94678 - DNA, 85 bp, Mus musculus; identical to SEQ ID NO: 57439

SEQ ID NO: 94679 - DNA, 71 bp, Mus musculus
agacttgtcgaggcagaggaaaggaacgacgacgttggtgttgctcactctgtgtctctcacttacagtct

SEQ ID NO: 94680 - DNA, 103 bp, Mus musculus
agaggaatccagagcagtctaagtgttctgtagtgagagagctgatgaacagattcaattcccttacccaatatacacacttaggtctgtctgaagtctatct

SEQ ID NO: 94681 - DNA, 95 bp, Mus musculus
atatatatttgtctatgtccgtgtatgtgtgcatgtgtatgtgcattaatgtgtacaggtgtgcatgcatgtgtgtgacatgtgcatctgtgtgt

SEQ ID NO: 94682 - DNA, 105 bp, Mus musculus
caggataacctcaaccttgcaggaatactgtctcagttgcatgagtcttgcagctttagatatctgtcttaaaatgcacagcttaaggtcaccatgattgtttcc

SEQ ID NO: 94683 - DNA, 85 bp, Mus musculus; identical to SEQ ID NO: 57470

SEQ ID NO: 94684 - DNA, 69 bp, Mus musculus
gcaaatccagagaagagtcagaggagaggattgatgacctttccctctgataggctcagttaggttagc

SEQ ID NO: 94685 - DNA, 134 bp, Mus musculus
gcacgcatgcatgcatatgtgagtgtatgtacttgcacacatgcctacatatgctagtttctgtgtgtgcatgtgcatctatgtatgtatgccccatgtatgtgtgtttgtatgtgtgtgcatgtatgatatgt

SEQ ID NO: 94686 - DNA, 106 bp, Mus musculus
taactatcatcttaggatatgcagaaaaaaattgggattttgttcatgtcagtttatacctccacaacaaaattcttcaggctacatgtcttaaaaacaatagttg

SEQ ID NO: 94687 - DNA, 128 bp, Mus musculus
ggcagatgtacaccttggtcttcatgtgagttccccaacaattggatcagagactgtctatgactcagactgtgttgtctgcctttgaactgtttttccctaggtgggctgtcttgtctggcctcagt

SEQ ID NO: 94688 - DNA, 112 bp, Mus musculus
gatcagtcttaggccatggtggtctgataggatacatgggacaatttcaatatttttgtatctgttgaggcctgttttgtgaccaattatattgtcaatatcggagaaggtc

SEQ ID NO: 94689 - DNA, 58 bp, Mus musculus
tctgcctgtctgcctgtctgcctgactgtctgtcaggtgagtgtttggtcagacaaga

SEQ ID NO: 94690 - DNA, 65 bp, Mus musculus
gagcttcagtctcagtctgtgtggtgagggcaaaagagtaaatcctcccagagagtcttaagctc

SEQ ID NO: 94691 - DNA, 102 bp, Mus musculus
aatgcatgtgctttaactatgtgaatatatatgtatatatacatatgtatgtatatacatatgtgtatataggtgtatgttttatggaataattatagtatt

SEQ ID NO: 94692 - DNA, 114 bp, Mus musculus
ctcttaggcagtaagatagctcagttactgtgacaaattcagcatggatttcttcttttttaattagaagaaatcttatggttcactaattaaggttatctttaaaattgacag

SEQ ID NO: 94693 - DNA, 85 bp, Mus musculus
cagtttatttgggtgcacggtctctctatgtgactcattcttttcttgtccttgagtgcttgctgtttcaccctcatgaaaactg

SEQ ID NO: 94694 - DNA, 91 bp, Mus musculus
cctccttccagtatctctgtttctctcagtatcctgagtttgagcccagaagaggacaaatgcaggagacgggtggtgctccccaaggagg

SEQ ID NO: 94695 - DNA, 102 bp, Mus musculus
atatgtgtgtgtatatgtatatatgatatatgtacatgtgtaatatatacctatgtgtatatacatgtatatatatatatatatatatatatatatatatat

SEQ ID NO: 94696 - DNA, 86 bp, Mus musculus
tgctttttttattaatgaaaacttttttttttgttgtggctgatcagagttacaacctcagaacaggttatcattaaccaacagca

SEQ ID NO: 94697 - DNA, 74 bp, Mus musculus
gtttggctgtgagtgtctatatctgtctgagtgagctggtgggtagagcctttcagaggacagccatgctagac

SEQ ID NO: 94698 - DNA, 83 bp, Mus musculus
agatgtgtatatatacatatatatatgcgcgcacatgcgcgagcgcgcgcgtgtgtgtgtgtgtgtctatgtattacatgttt

SEQ ID NO: 94699 - DNA, 115 bp, Mus musculus
tgtttttagattgttgttagggtttatgcgggtttaataagtcagtggtagtagattctctgctaataaccatgacttcatctgcactgaatagttagggttctagtaccaagca

SEQ ID NO: 94700 - DNA, 133 bp, Mus musculus
ttctaaactagtatttattttcatttaaaagtggtatttattatgtcttttatttgacaaagtaacatttattttattaaataaaatagatgcttcaaaataagtcataggaaattaattttgagcatgagaa

SEQ ID NO: 94701 - DNA, 83 bp, Mus musculus
gcagagaggagggcagtagcagcgtctgttaggtaggctgcagtaaagattctgctagtgtgtgtgtctgtctgtcacgttgc

SEQ ID NO: 94702 - DNA, 85 bp, Mus musculus; identical to SEQ ID NO: 57439

SEQ ID NO: 94703 - DNA, 85 bp, Mus musculus; identical to SEQ ID NO: 57470

SEQ ID NO: 94704 - DNA, 114 bp, Mus musculus
ctggtaatctttggagtcagttgttatagttgtctctggttagagttgttcttctcgtgattctgttgttctctaccagaagacctgggagactagctctctcctgagtttcag

SEQ ID NO: 94705 - DNA, 82 bp, Mus musculus
gtggttggctgtaagtatctgcctctgtctcagtcacctgcagatagagtttctcagaggcctttctttcagtctctgctac

SEQ ID NO: 94706 - DNA, 97 bp, Mus musculus
tcatatatataggtctcagatgtctagtgagtttcatgtactctactgtttaatcatgactactcatggtgggaaagtgaatggcctattccaatga

SEQ ID NO: 94707 - DNA, 85 bp, Mus musculus; identical to SEQ ID NO: 57439

SEQ ID NO: 94708 - DNA, 67 bp, Mus musculus
ggatatgtatgcacggatgtgtatatcatggatgtatctatgaatatatgtgtgtttatacatattt

SEQ ID NO: 94709 - DNA, 85 bp, Mus musculus; identical to SEQ ID NO: 57439

SEQ ID NO: 94710 - DNA, 76 bp, Mus musculus
gcttgagagaataacctgtcaggggacacaactctgggatgggaatgactgactgactgattctctttttcttagc

SEQ ID NO: 94711 - DNA, 92 bp, Mus musculus
tctgtttcaataatgtatttaccatatactctatagaagtatagacgtaagtatatacttacataagtatagaagtaagacataagtataga

SEQ ID NO: 94712 - DNA, 112 bp, Mus musculus
gtgaaggaatttttaggtaagtacagccattggaactgctcttcacaagtctgcattttggttgggtgcagttttttgtaatggttttcacctgctggaaagagaaatttgc

SEQ ID NO: 94713 - DNA, 84 bp, Mus musculus
gtttgatgctcgatttgacaaattacattcagattttacacaacctctcctgtgtgcgtctgtctgtcagtcatctcatccaac

SEQ ID NO: 94714 - DNA, 93 bp, Mus musculus
ctagtatgttctagctgccaaatttttttctgtaaaattatcatcagtctagatgacaattcctgctgagaggtgaggcaggtagagagctgg

SEQ ID NO: 94715 - DNA, 71 bp, Mus musculus
tccacgtcattagtctatcactgaagggagtcaggacagggactccagcagggtggggcctgaaggctgga

SEQ ID NO: 94716 - DNA, 99 bp, Mus musculus
ataagagtgagccctgtactagtctttgtagcagaataggtcatttattgttatatataataccaaaattctattacagtacagtcagctaatttttgt

SEQ ID NO: 94717 - DNA, 61 bp, Mus musculus
tctctatatgcatgtatatatgtatgtatgtatacatgcacatatatatgggtatgtatga

SEQ ID NO: 94718 - DNA, 115 bp, Mus musculus
ggtctccaggcgtgtctatcagagcagaagtgatggtcttacctgtgctcacaagtgtgtcagcactcctgggatatcacctctctctctctgcagtatttgggtaaagagcact

SEQ ID NO: 94719 - DNA, 110 bp, Mus musculus
ggacattttgatgtaaactgatttgatgctgtgagtatgcaatgcacaatttaattttgattttatgctatatgcagtatagcataaggaattttttgcttgaaatgacc

SEQ ID NO: 94720 - DNA, 98 bp, Mus musculus
acaatctcctcagggtgaaactgcatcatgtcatgacagaagattgacacaattcattctcatagagcagccatgtcactttcagttccctagattgt

SEQ ID NO: 94721 - DNA, 74 bp, Mus musculus
tctaagtggtgtttgaagactgagcccagagaccaaacacagctctaacctcggggatttcattgccatgtaga

SEQ ID NO: 94722 - DNA, 56 bp, Mus musculus
gtatgtatgtatgtatgtatgtatgtatttagtgcatatgaacatgcagtacatgc

SEQ ID NO: 94723 - DNA, 117 bp, Mus musculus
tggaggcttgctgaaggctgtatgctgttaatgctaattgtgataggggttttggcctctgactgactcctacctgttagcattaacaggacacaaggcctgttactagcactcaca

SEQ ID NO: 94724 - DNA, 71 bp, Mus musculus
agagagagaaagacagagagagacagagagagagactctctctctctgtctctctatgtagacctggctct

SEQ ID NO: 94725 - DNA, 115 bp, Mus musculus
gcaggcaatgttagactctgtatatatgtgtatacatatgtgcatatgtgtgtgtgtatatatatatatgtgtgtgtgtatatatatatatatatatatatatatatatatacat

SEQ ID NO: 94726 - DNA, 83 bp, Mus musculus
gcctcttactcctggctaagacagctgtcttgactctctctgtcccttcaagaggtcatggaagctggcacagtagaggcagt

SEQ ID NO: 94727 - DNA, 91 bp, Mus musculus
ttgtgtgtgtgtatatatatatgtgtgtgtgtatgtatatgtgtatacatatatacatatacatatatatatgtatagtatgtgagcataa

SEQ ID NO: 94728 - DNA, 175 bp, Mus musculus
ttgtatatgtatatctatatgtatgtatgtgtatatatatatatatatatgcatatgcatatatatatatatatatatgtatagtgtgtgagtgcaggagtgtgtatgtgtatatatgtatgtgtgtatatatatatatgtgtgtgtgtgagaatgtatgtgtatatatgtatgc

SEQ ID NO: 94729 - DNA, 98 bp, Mus musculus
tatagtaattcaatgttatatatgtgtatatgtatgtatgtatatatatatacatatatgtgcatatgtaatgaaagatacataaactgaaagatata

SEQ ID NO: 94730 - DNA, 103 bp, Mus musculus
gtataataatgtgtatatatgtgcatatatatgtatatatacatatgcattatatacatgtgtgtatatatatatgcatatatataatgtaaaatgtatatac

SEQ ID NO: 94731 - DNA, 117 bp, Mus musculus
tggcacagatgtcatttatggctgaacactacggtctcttcttctctgcgattcgccccgtgtgagtctctctgtctaagggtcatcgattgcaaagccagacgatcttatttgcta

SEQ ID NO: 94732 - DNA, 75 bp, Mus musculus
gagtcttcagtatttatctttatttacaaggttttgattggagcccttgtagctaaagtgttggaatgcaaactc

SEQ ID NO: 94733 - DNA, 78 bp, Mus musculus
tgcacagttacaggggattcatctctggctcataggcgagtgctttgtccagacactgatcgttttgctgcctgtgta

SEQ ID NO: 94734 - DNA, 91 bp, Mus musculus
gcctcattcagacatcagttttctctctgtcagttcttattgctaacttgacacaaccaagaatcactggagaagagggaggctcgctgga

SEQ ID NO: 94735 - DNA, 125 bp, Mus musculus
tatctatgtatctatgcatctatgtatttatgtatctatgtatctatctacatctatctatctatctatctatctatctgtatgtatgtatatacatgcatgcatacatatgtacatacatacat

SEQ ID NO: 94736 - DNA, 103 bp, Mus musculus
gccatagacatttggaatgcaggcaaaggtttcatttaaaatgtctcaatgattcgtgacatactgcacctggatctgtataataataaatgtctatcatggt

SEQ ID NO: 94737 - DNA, 71 bp, Mus musculus
tgtgagtgtgtctgtcggtctgtccaggaggctggaaaatgcaagtgtagagagacagaagaaaacttgca

SEQ ID NO: 94738 - DNA, 138 bp, Mus musculus
tgtatgtatgtatgtatgtatgtatatgtgtatatgtgtatatgtgtatatatgtatatatacacatacacatgatatatatgtatatatatatgtatatatatacacacacacatatatcatatatatacatatatg

SEQ ID NO: 94739 - DNA, 84 bp, Mus musculus
tcctatacactacccggatttatgcatatataatgtattattacttattagaaatacatggatatggcatgaaagtgtaaggga

SEQ ID NO: 94740 - DNA, 77 bp, Mus musculus
gggccaggtctgcctgcctgcctgcctgcctgcctgctgcctgcctgcctgcctgctgcctgcctgcctgcctgcct

SEQ ID NO: 94741 - DNA, 90 bp, Mus musculus
gtgtgtgtgtgtgtgtgtgtgtgtatcctgattattttcttttaaataatgactctcttggatccagaacatccatacaaatcatgttac

SEQ ID NO: 94742 - DNA, 66 bp, Mus musculus
actctccgtagaactctgtcctagatctggcatttaagaaatgtgacaggagtgactggtgagagt

SEQ ID NO: 94743 - DNA, 78 bp, Mus musculus
ctctctctgtgtatgtgtgtgttcgtgcatgcacctgtatgtcacttgcatgtaggtacccatggaagccagaggaag

SEQ ID NO: 94744 - DNA, 67 bp, Mus musculus
tctgactagttgtgagctcattggataggctagagtgtccagccagtgagcccttgtaaagagaaga

SEQ ID NO: 94745 - DNA, 66 bp, Mus musculus
tccatgcaatgtatctgtgtgtatgtatgtatgtatgtatatatgtgcatatgtgaagttgttgga

SEQ ID NO: 94746 - DNA, 80 bp, Mus musculus
ctcataagcacagcaggcatttcttggggactctggcattagcttgtgacctgcaggtgtgttattgttgttctcttggg

SEQ ID NO: 94747 - DNA, 68 bp, Mus musculus
ctcttccactgaggtccaggtgttcagtccaatggttggctgtgagcatctgcatctgtattggtcag

SEQ ID NO: 94748 - DNA, 91 bp, Mus musculus
gtttgggtgttgtgggtgatgagtgttttgtgtatgtgggagttttactgggacaattgtatagacagattacagagtgaacaagccagac

SEQ ID NO: 94749 - DNA, 73 bp, Mus musculus
tccagggtgggtgaactcagtcttattctgtctctatcaagtgcaggagtgagagggggagcctagaacagga

SEQ ID NO: 94750 - DNA, 97 bp, Mus musculus
gcttgggtgaccatgtcctataaggtgaccagagcctgggggaggagtcttggtctcactcccagactcacagctctatgggaacagaagcccttgc

SEQ ID NO: 94751 - DNA, 85 bp, Mus musculus; identical to SEQ ID NO: 57439

SEQ ID NO: 94752 - DNA, 119 bp, Mus musculus
gtgtgtatgtatatgtgtatatgtggtatatttgtatctatgtatatgtatgtgtgtatatatgtgtgtatgtatatgtatggatgtgtgtatctatgtgtatgtatatgtgtgtgtat

SEQ ID NO: 94753 - DNA, 116 bp, Mus musculus
gtagaagtacaatcttcgtccatgttgaccttatagaatacaagggattatttcaatttcattgtatttgttggtcaaattatatggtcatatttggagaaggttccacaagatac

SEQ ID NO: 94754 - DNA, 71 bp, Mus musculus
ttctcaggcagtgagagctgagagagctgacagaaggcatcagcctatctcctccattcattgctggaggg

SEQ ID NO: 94755 - DNA, 84 bp, Mus musculus
acttgttgttggctcacttgtctgtccctgtctgtcaccctgctctaattggcagcagggctgaattctcctgcttcagctggt

SEQ ID NO: 94756 - DNA, 106 bp, Mus musculus; identical to SEQ ID NO: 87907

SEQ ID NO: 94757 - DNA, 114 bp, Mus musculus
gttgctgagaacatagctgaggaagtctggaaactgctgctgacccactgtccctgcctccggccaggtggtggggcagcttctgaggcctggacttgcccagctctgggaaac

SEQ ID NO: 94758 - DNA, 101 bp, Mus musculus
aaggatatagcgcatattaaaattgctatttttgttgttgaaaatggtgtaatgccagccatttcacataatggagcctaatagcagccatcagcatcctt

SEQ ID NO: 94759 - DNA, 109 bp, Mus musculus
tggtgtttctgttgtttcctaactgtgggagcatgtatgtctctctctgactcttttgtctgctcttgggattcttttcctcctattcagttgtgataaccgataacca

SEQ ID NO: 94760 - DNA, 85 bp, Mus musculus; identical to SEQ ID NO: 57470

SEQ ID NO: 94761 - DNA, 61 bp, Mus musculus
atgtcctatatatgtatgtatgtacaatatatgtctattgtatatatgtatatatgtacat

SEQ ID NO: 94762 - DNA, 79 bp, Mus musculus
tcgctgactctatgcccatttgtctgagaccctgattcccacagattgaggggggctgactgggcctggtccgtagcgg

SEQ ID NO: 94763 - DNA, 61 bp, Mus musculus
gctccatcctttatttggctatgggtgtctgtatctgtctgagtcagctgctgggtggagt

SEQ ID NO: 94764 - DNA, 61 bp, Mus musculus
tgtgcatatgtatatcatatgtaacgcatctgtgtgtatttatatgtataatgtatgcata

SEQ ID NO: 94765 - DNA, 86 bp, Mus musculus
tttgtgtgtgtgtgtatatatatatgtgtgtgtatatatatgtgtgtgtgtatatatatatatatatatatatatatatatataaa

SEQ ID NO: 94766 - DNA, 110 bp, Mus musculus
tatgctcttatcttagaaactctgatcagtgctcatctgcaaggacaatgttacttttgtatatatttgtctatatagagtgaggcatatttcagtcaagtcatagcatg

SEQ ID NO: 94767 - DNA, 81 bp, Mus musculus
gtatatgtatatgtatatgtataatgtatatgtattatgcataatgtataatgtatatgtatatgtacatatatattcata

SEQ ID NO: 94768 - DNA, 77 bp, Mus musculus
gactagacaaaatttacacagtagggccaaggtgtatgtatgaatgtatgtatgtccctgtctgtgtctgtctgtct

SEQ ID NO: 94769 - DNA, 73 bp, Mus musculus
gactgacagtcagtgactgggttatggctgttatgcaaagctaactgtcagttctcattcctagctgtttgtc

SEQ ID NO: 94770 - DNA, 71 bp, Mus musculus
gtgtgtgtgtaagtgtgtgtacatgcagaagcacatatgtgtttatgttgttcatacattcaggcacacat

SEQ ID NO: 94771 - DNA, 88 bp, Mus musculus
tccatatatatgtatgtatatatatacatatatatatacatatatatatgtgtgtgtatatgtatatatatggatatatggatatgga

SEQ ID NO: 94772 - DNA, 126 bp, Mus musculus
gtgtgtgtgtgtgtgtatgtgcgtgtatatatatatatatatatatatatatatatgtgtgtgtgtgtgtgtgtgtatgtatatacatatatatgtgtatatatatgtatctatatatatggctgc

SEQ ID NO: 94773 - DNA, 77 bp, Mus musculus
gtagtctgagctggcttctgtggcctcttagagttttcaacatatctttccaggcccattagtcttttagagtctgc

SEQ ID NO: 94774 - DNA, 99 bp, Mus musculus
gagacactagttgggttggagagatggctcagaggttaagagcactgactgctctatcagaggtcctgagttctaattccagcaaccacatggtggctc

SEQ ID NO: 94775 - DNA, 108 bp, Mus musculus
ttctatactccattttttgattgggttgtttggttttttggtgattaacttcttgagttctttatatattttggatagtagccctctatccgatgtggggttagtgaa

SEQ ID NO: 94776 - DNA, 85 bp, Mus musculus; identical to SEQ ID NO: 57439

SEQ ID NO: 94777 - DNA, 97 bp, Mus musculus
ggagacagcaggtactgttctagctagttctagacttacgtttcattttttattaatgatgctttatagaactaacgttattgtcaagcttccctcc

SEQ ID NO: 94778 - DNA, 117 bp, Mus musculus
tcttttgccttcttagcctccttttgacccctctcccaaaatatgttcatattttttgaataatgttactaatgaggaaatggggtacagagatgaaggtctcaagattagacagga

SEQ ID NO: 94779 - DNA, 85 bp, Mus musculus; identical to SEQ ID NO: 57470

SEQ ID NO: 94780 - DNA, 88 bp, Mus musculus
cacacggacaaggggtgagcgcgcacacacacacgggcacacactgtggcgccctctccggggtgtgtctctctgtgtgtctgagtgt

SEQ ID NO: 94781 - DNA, 83 bp, Mus musculus
ggtagatttcatggtttggcctgtgcttcagcctcacaggctaggaaactagatcttggcagaacatagagagcagatctgtc

SEQ ID NO: 94782 - DNA, 80 bp, Mus musculus
cacatggacatgcatgcacataggcacatacacacactcatacacacatgtgcgtaagtacatgtgcatgtacacatttg

SEQ ID NO: 94783 - DNA, 94 bp, Mus musculus
gcaattaggatgaacaatggcctcacctctgtcagtctgtctttgtcccaaaccctgtggtgggaaggacaacagtgtgggctcagctagatgc

SEQ ID NO: 94784 - DNA, 101 bp, Mus musculus
agactgacagacttgggctggagagatggctcagcggctaaagagcactgactgctctttcagaggttctgagttcaaatctcagcaactacatggtggct

SEQ ID NO: 94785 - DNA, 104 bp, Mus musculus
ccctcgtgggtggccgagcttgtgtaggagctgtgggagggaagaagcaagcgtgggcttcactcgctcagtccctccttgccaaggcccgagcccgtcggtgg

SEQ ID NO: 94786 - DNA, 121 bp, Mus musculus
tagattagaaaaacaccagtttactgctaaaatgtgtatgtagtatatcttaattttttaatgacttgataaaaagaatatattagattttcatagttttgtgactggatcatcttttctg

SEQ ID NO: 94787 - DNA, 92 bp, Mus musculus
tacccagatgctatatgctgggtgattacatagctattcgtctaccctaaagccttccagactgtagtcacagtgcagaatgttctggagta

SEQ ID NO: 94788 - DNA, 71 bp, Mus musculus
cagaaaactttgtgacaagagagtgtctacagtggctaataccgtgtgggggcttgatgttcagtcttctg

SEQ ID NO: 94789 - DNA, 91 bp, Mus musculus
gagtgttatatgtgtgtgtgaatgtttgtatgtgtgtgtatgagaaagagaagcatacacagagagacagagagacagattcagaaaactt

SEQ ID NO: 94790 - DNA, 77 bp, Mus musculus
gcatggatctccggagtttattacaatatgcagtgtgactgcagagtctgtcctgagtgcttcctgagagtctgtgt

SEQ ID NO: 94791 - DNA, 97 bp, Mus musculus
tgtacaccagccctagttaaatgtttttctttataagagttgccatggtcatggtgtctcttcatagcagtagaaaccctaactaagactgccaaca

SEQ ID NO: 94792 - DNA, 56 bp, Mus musculus
gatggtggttctgacagacattcgagggtcctggggtgtctgtcacactcactctc

SEQ ID NO: 94793 - DNA, 74 bp, Mus musculus
acacccacttccggagcgcctgttctcatgggagatgtctcaggagagagagcgcacacgtcctgaaccggtgt

SEQ ID NO: 94794 - DNA, 59 bp, Mus musculus
tatgtatgtatgtatgtatgtgtatgtatatatatacacacatacataccatatacata

SEQ ID NO: 94795 - DNA, 85 bp, Mus musculus
tctctgacactctctctgcctgtgtctctcttctatctctctttgcacatacaggtagaggctggacagaggtcaacaatgggtg

SEQ ID NO: 94796 - DNA, 63 bp, Mus musculus
tcactctgagagcagctgcatgtgaacataagaatgttaatttgcattcctttcaaggagtgg

SEQ ID NO: 94797 - DNA, 118 bp, Mus musculus
ctgtgtgtattactctctgtctctctgtctgtctctctctatgtctgtctgtctgtctatcttgtgagcgtgctctcagcatatgggttctgtgggtatgagtatgtaccttgcacag

SEQ ID NO: 94798 - DNA, 91 bp, Mus musculus
ttcagacttgcttatattgatgatgatgatgatgattaggagataacttagtggtgatcttctgcatatatgtgtgaggaactgagtctga

SEQ ID NO: 94799 - DNA, 85 bp, Mus musculus
ggccatggtggtctgataggatacttgggacaatttcaatatttttgtatctgttgaggcctgttttgtgaccaattatatggtc

SEQ ID NO: 94800 - DNA, 85 bp, Mus musculus; identical to SEQ ID NO: 57439

SEQ ID NO: 94801 - DNA, 84 bp, Mus musculus
aaaataagtagcgttggagttaagagtgagtgttattctctgatatactcactcacagtcttatgccagtgcatcacagatttt

SEQ ID NO: 94802 - DNA, 82 bp, Mus musculus
ggaaaagtatgaatatgtatgcatgaatctatatatgaatttatgtgagtttatccatagttatgttttttaaaacttttcc

SEQ ID NO: 94803 - DNA, 77 bp, Mus musculus
tctaacatgccttttttttttaataaaatgcagaagtcttacaattgcttttatggatgaagaaaggcaagtgtaga

SEQ ID NO: 94804 - DNA, 70 bp, Mus musculus
agttgtgtgagagatttttttctggggagacataacattctctctcacacacagaggaaaccacacagct

SEQ ID NO: 94805 - DNA, 57 bp, Mus musculus
cacacatataatacatgcatatatatatatatatatatatgtatatgtatatgagtg

SEQ ID NO: 94806 - DNA, 100 bp, Mus musculus
gccttctcctcaacttcccgaggaaaatttctgtatatatttaaaaggaaacaaaacatatgacaggatattagtgaagttggaagaatttaagacaggc

SEQ ID NO: 94807 - DNA, 106 bp, Mus musculus
gtcaccctctttggctgtgtctgaagacagctacagtgtatttatatataataataaataaatctttgggcctggagcgagcagggactgagcgagtggggttgac

SEQ ID NO: 94808 - DNA, 79 bp, Mus musculus
gatccagtgagaacacagactgcaagctaaaactgccacaaggaacactggagtacagtctgatgtttatcgccatatc

SEQ ID NO: 94809 - DNA, 84 bp, Mus musculus
gttttcagatttaaaatctgagttctttgtctgtcaccctggtacagaatacaagaaattagatattttggagctcatgtggac

SEQ ID NO: 94810 - DNA, 118 bp, Mus musculus
cctttggccaacatccaaccctaacaaataaagtcataccagttactgtaacagcaagtgtttaaatcattgtagagaaatacagggaaagttatgacataggcgttgggcttactgg

SEQ ID NO: 94811 - DNA, 73 bp, Mus musculus
gagggtcaggacttaaggacatcatccaggctgttcccggtaatctctgtgtctctgtgtctgtgtgtctctc

SEQ ID NO: 94812 - DNA, 91 bp, Mus musculus
acacatatatatgtgtatatatatacacatacatacatatacacacatatatatgtatatatatacatacatatacatatatatatgctgt

SEQ ID NO: 94813 - DNA, 76 bp, Mus musculus
acagcatatatatatgtatatgtatgtatatatatacatatatatgtgtgtatatgtatgtatgtgtatatatata

SEQ ID NO: 94814 - DNA, 83 bp, Mus musculus
ccctctatgccacatggctcctgctgaatttcacccttttaaatgacttgatgtgagaacagaaagggcagactgctggtggg

SEQ ID NO: 94815 - DNA, 86 bp, Mus musculus
gtgtgtgtgtgtgtgtgtgtgtgtgtatgtgtgtgtgtgtacgcaggtatgtgcacatgtgtgtctgtgtgtgtatgcatgctcat

SEQ ID NO: 94816 - DNA, 96 bp, Mus musculus
tcagtcctgtttttaatgtgtaatattatagcttgatgctataatttggcatcaagtatgttcatatatttttattgctgttcaaaattgttttgg

SEQ ID NO: 94817 - DNA, 93 bp, Mus musculus
atttttttgagttgcatatgtactttagatttttgtttacattttgagagagacagagtgagacaaagagagagaacatgaagtcaaatgaat

SEQ ID NO: 94818 - DNA, 81 bp, Mus musculus
gagatttctcatgactggtggagatttgaactcaggcccttgggtttgtacagcaagcactctcacccactgagacttctc

SEQ ID NO: 94819 - DNA, 70 bp, Mus musculus
gaaggagctagagacagtcctgccaagaagtgaagtggattttctatcactgtgattgtctctctctctc

SEQ ID NO: 94820 - DNA, 84 bp, Mus musculus
ggaagcctggaggctccctacccactctctgagtaatacacacacacactcagtgttggtagtaggagggcccttccactttcc

SEQ ID NO: 94821 - DNA, 100 bp, Mus musculus
aaaatgtagcagaagccaagagtgtgtggacagaagggtagactgtgggactcactgtgacacactatgctctcataagaggttttctatgctttgtttt

SEQ ID NO: 94822 - DNA, 114 bp, Mus musculus
acattgcatgaataaagtgtttatccaggtactgcttactttatacctatgtatataattatacatatttgttgtccttccaggaacctgaacttattttcttatgatttttgt

SEQ ID NO: 94823 - DNA, 119 bp, Mus musculus
ttcttcctcaaatttagggcatgttttctcagtaattgttaatgcattcacttctatatgaatgaatgaatgaatgaatgaatgaatgaatatgtatgaatgaatatgtatgtgaattt

SEQ ID NO: 94824 - DNA, 96 bp, Mus musculus
cagaatgagagtggtactatactcaatactgaatttcactctcctgatttgactgataattttgttattgatatatatttatatgctcatattctg

SEQ ID NO: 94825 - DNA, 92 bp, Mus musculus
accatggctatgatgggcttggctgtcactgtgactgtgaatacagaggctatggagacagtaggtacagttgttgctcttcatcctatggt

SEQ ID NO: 94826 - DNA, 117 bp, Mus musculus
acatggatcctagaatacatgggcatattatacatatatgtatatatatgtctatatatgaacatatatatgtatatgtgtgtgcatatgtgtatatgcttatgtgttcatgcatgt

SEQ ID NO: 94827 - DNA, 69 bp, Mus musculus
catgtgcatatgtatatatgtatgtatgtacacatgtatgtacatatttctgtgtaatatatgtgtgtg

SEQ ID NO: 94828 - DNA, 66 bp, Mus musculus
acaatgtgacaataaacttagcagagtatctatttattttagatacagttagatttgtctcattgt

SEQ ID NO: 94829 - DNA, 103 bp, Mus musculus
tcttgtatgtatatatgtatgtatataaacatgtctgagatacacacacacacatatatatgtatatatcatacatatgtacattaaatattaattacataga

SEQ ID NO: 94830 - DNA, 87 bp, Mus musculus
cttcccttttctcaaatagcccccattcctcctgctctctagcagaagagagagaggactgtagctctttggtgttagaaagtagag

SEQ ID NO: 94831 - DNA, 158 bp, Mus musculus
atgcatatatgtatgtatgtatgtatgtatgtatgtatgttttatgatgtgtatgtatatataaactatacatatatatatatgtatgtgtatatgtgtgtatatatatacatatatatgtgtgtgtgtgtgtatatatatatatatgtcttcattta

SEQ ID NO: 94832 - DNA, 157 bp, Mus musculus
cacacatatatatacacatatgcacatacatatatatgtgtgtgtgtatatatatatgtatgtgtgtgtatatatatatgtatgtgtatatatatatacatatgtatatatgtatatatatatatatgtgtgtgtgtgtgtgtgtgtgtgtgtgtgt

SEQ ID NO: 94833 - DNA, 155 bp, Mus musculus
acacatacatatatatatacacacacacatatatatgtatgtgcatatgtgtatatatatgtgtgtgtatatatatgtatatgtatgtatatatacatacatatatatatttgtataattacacatgctgcaggtgtgtgtgtgtgtgtgtgtgt

SEQ ID NO: 94834 - DNA, 83 bp, Mus musculus
gtctctgcttctctgaatgctggaattaaagtcaccctgcctcactcaaaggcaaggaatcttaagtagtatgaattagaggc

SEQ ID NO: 94835 - DNA, 78 bp, Mus musculus
gagagacagagagagactgagagagcaatggcatacttacctaaattgtcttgcaattagtcttaccacactgctctt

SEQ ID NO: 94836 - DNA, 87 bp, Mus musculus
attccttgtagaagcatgcatctttatttgatttttactactcagagttgcagagtaaagtgaactgctatggtgtcctcaaggggt

SEQ ID NO: 94837 - DNA, 85 bp, Mus musculus
tttcatgtgtatgcgtgtttgcctgtatgtatgaatgtatgtatgtgtactgtatgtatgcagtgctcacagaggccacaagaag

SEQ ID NO: 94838 - DNA, 111 bp, Mus musculus
gtgttggtctcagggggtcacacacttaatacaaactgacgctccctctctcagtagctattagttgctaatagagcctcaggtaggtatgggacttcatgatatccccac

SEQ ID NO: 94839 - DNA, 73 bp, Mus musculus
atatgcatgcacacacacgcacacatgcacatattctacccatatacatatgtgtgtgtgtctgtctgtctat

SEQ ID NO: 94840 - DNA, 63 bp, Mus musculus
gggacaaagatggagcagagactgaggacacagccaaccaatgactgctccaacttgagaccc

SEQ ID NO: 94841 - DNA, 109 bp, Mus musculus
tcatttcagcctagtttcaagataccaacttcctgaagaacctcacagaccctctctatctgactctgtagctttccaggggagaatggttgtcctagtgttgtgttgg

SEQ ID NO: 94842 - DNA, 63 bp, Mus musculus
gtatacacattgcatgctcgtgtgtgcacacacgcacacactcagttttgcgtttgtgtttac

SEQ ID NO: 94843 - DNA, 116 bp, Mus musculus
gggtgtggctttgactagaaggggtgagttaggcccctctccagccttcattccccatacctccaccaggggatgatgcggccaggtgctagccctttccatcagtctctgcagct

SEQ ID NO: 94844 - DNA, 82 bp, Mus musculus
gtgtgcttgtgtgtatgcatgtgtgtgcgtgtctgagtctgtgtatgagtgtatgtatgcaagtgtgtgtgtatctgtatgt

SEQ ID NO: 94845 - DNA, 79 bp, Mus musculus
cattatgtcattttcatatgtatgtatgtatgcatgtatgtttatatgtaatatgtacatttgtgtataatacataatg

SEQ ID NO: 94846 - DNA, 116 bp, Mus musculus
agtgtattttatgttgttagaacaaaatgtctgacaccaggtaatttataaagaatagaagtttcttcagttcttggttcaggagtttgggaagtttaagagcataggttggcatt

SEQ ID NO: 94847 - DNA, 93 bp, Mus musculus
ggctctggcttcttggcaccagacccactcactctgccttttacacactgtcttgtgggttggtgtggggggtgtagttgcaggcctggagct

SEQ ID NO: 94848 - DNA, 74 bp, Mus musculus
agcatggaggttttagtcacctgtcctttccctgcttgctagggatccgcctcagacagtctgacaccttcgct

SEQ ID NO: 94849 - DNA, 141 bp, Mus musculus
tgtgtgtatgtacctatgtatatatgtatgtgtgtgtgtgtgtgtttgtgcatatatgtatgtatgtatgtatgtatgagtgtgtgtgtgcacatctgtgtatatgtgtatgatcacctgtgtatggacctatgtgtgtat

SEQ ID NO: 94850 - DNA, 74 bp, Mus musculus
agggtgtggtggccatgacaggtccctgcacttggtaggctgaggtagaaggatcagaagttgaagcccatcct

SEQ ID NO: 94851 - DNA, 70 bp, Mus musculus
cagagatgggggcatgagatgggaaaggctctagggagctcagttgtgaatctcactgtctcatcctctg

SEQ ID NO: 94852 - DNA, 92 bp, Mus musculus
ctcgtgtgaagtccagagattgatgctggctttttatctatttattgttctttatttttttgagacagggtctctctctcattcaacttggg

SEQ ID NO: 94853 - DNA, 123 bp, Mus musculus
tgaatgtctgtgtgtgtcagagagagagagagagagagagagagagagagagagagagagagagagagagatcgtcactcagtttctctctcctgaacccacacgtcatccctttaaggacac

SEQ ID NO: 94854 - DNA, 101 bp, Mus musculus
tgtccctgttctagccagccgacactgtactggaagctgtttatttctttatttaagacaaggtcacactatattgcccaggctggccttgaacttggata

SEQ ID NO: 94855 - DNA, 68 bp, Mus musculus
gcacacatgcagatacagagtgaccgtcctcacaggttatcatactcacactgtctctgctaaactgc

SEQ ID NO: 94856 - DNA, 113 bp, Mus musculus
gcgttacaggttatctgtctttggaatagagagatggctcaatggttaagagcatacacagctcttccagaggaccagagttcaattcccagaatttatattaatttgcttgc

SEQ ID NO: 94857 - DNA, 64 bp, Mus musculus
agacacacagctatggtggtgaactcctttctgcttttgtagttgtgagcatgcatgtgtgtct

SEQ ID NO: 94858 - DNA, 75 bp, Mus musculus
gaagaaatgtttgcctgcttgcctgcctgccaagaggtctccgctgttcaaaggcaccggggcggatgtgttttt

SEQ ID NO: 94859 - DNA, 75 bp, Mus musculus
agacagtttcccaaggggcagttcctccttcagcctggcgtgataggaggtctgtctctgttagtcagactgttt

SEQ ID NO: 94860 - DNA, 76 bp, Mus musculus
gtccatctgtctgtctgtctgtgcatttgctataaaagcttgttctcctttgctttagaaaaggtagaatgtggac

SEQ ID NO: 94861 - DNA, 65 bp, Mus musculus
gtcagattctctgtctcacaggcatggtcatggagctctgacctgtgctgagccaggacttctgc

SEQ ID NO: 94862 - DNA, 87 bp, Mus musculus
agcacgaaccagtcactctgtcactcacaactgttggcaaagtcattttgctgggccaggcattgtgagcgcagtggctgacgtgtt

SEQ ID NO: 94863 - DNA, 113 bp, Mus musculus
gcttggtcttcatgtgggactcctaacagtgggagctggggctgtctctgactctgttgtctgtctttgggacccttagggctgccttgtctggcctcaatgggagaagatgc

SEQ ID NO: 94864 - DNA, 103 bp, Mus musculus
gagaagaggaaatgtttgcttctcattctcttgtttgtgtctcagtttctgttaaaagatcccgacaagagcattgtttggggagaaaggatttgtttggccc

SEQ ID NO: 94865 - DNA, 70 bp, Mus musculus
tagtgtagagtagaggctgagtacaagcaagcaggcatgcatgcatctgttctctcactctgtttgactg

SEQ ID NO: 94866 - DNA, 66 bp, Mus musculus
gtgtgtgtgcatgtgcttgtgagcatgtgcatgtgcaagtggggtaggggcacatgccacagtcac

SEQ ID NO: 94867 - DNA, 87 bp, Mus musculus
gaagaaggatacacacaagctggagagatggctcagcggttaagagcactgactgctcttccagaggtcctgaatccaattcccact

SEQ ID NO: 94868 - DNA, 86 bp, Mus musculus
tctggtgcatactgaagacatccagctaagacatccagctttgtgcactgaacaattactggatccttggatcttctgatgacaga

SEQ ID NO: 94869 - DNA, 84 bp, Mus musculus
ccattcattcagctgtttgcatcacatccaccttcaaagaacagagaacagtggatggcactagagagtgatactatgcaatgg

SEQ ID NO: 94870 - DNA, 131 bp, Mus musculus
tgtggctggacagaatggcttccttctgttgatagtgtctttggtgaaggaagctgtcacacactgtctgacccccccaggaacccataccccatggtggtggaagggaggggcagtagtttcagggcgtg

SEQ ID NO: 94871 - DNA, 102 bp, Mus musculus
actgaaagaaaaaaccccaactcattaagtgcagaagggcactgttcactctctctgagagagacacccggaagccccatgaactagatggagttcctcagt

SEQ ID NO: 94872 - DNA, 90 bp, Mus musculus
gtatgagacagcatgcacgcatgtgagtgggtatgtatgcatgtatgtataagggggtataaggctacaacaaggtgtatgtgatgaggc

SEQ ID NO: 94873 - DNA, 68 bp, Mus musculus
tgcatgtatgtatatatgtatgtatgtatgcatgcatgtatgtgtgtatgcatgtatgtatatatgta

SEQ ID NO: 94874 - DNA, 81 bp, Mus musculus
gaaagtttttataaacagggtctcgtgtagtccggggtggccgtaaagttaccgtgtagtcagagatgactgtgaactttt

SEQ ID NO: 94875 - DNA, 61 bp, Mus musculus
gcacaggagaggcagaggccttgagcacgctcgtgtgctgtgtggctctctctcacttggc

SEQ ID NO: 94876 - DNA, 86 bp, Mus musculus
aaggcaggtgtggggtagatctaactagagagtttgaagctaggactcagaaaagagagagatgtgaaccttaaacacacttcctt

SEQ ID NO: 94877 - DNA, 116 bp, Mus musculus
tggcccacacactggtaattcctgtactcagggggcagacagaacactgtgagttcagtcagagctacatagtgagaccctgtctttccctgtcgcaaaagaagaaagttgggcca

SEQ ID NO: 94878 - DNA, 104 bp, Mus musculus
ccatcccccaacaattataggagaatctgtgagagaggagagagagcttgcttgtaagctagcatgcctcttcgcagggcacgtgttgctttggtcaggggggt

SEQ ID NO: 94879 - DNA, 62 bp, Mus musculus
tgtgtgtgcatcagtatgtgcatgtgaacacacacacagacacatacacacatacacacaca

SEQ ID NO: 94880 - DNA, 104 bp, Mus musculus
tcccaggagctgggctgttcgtattgctgcactgctaaattgtctggctgcaggttaatgaaggcaggtggtagttcaggctgtggataaagtgggcacagaac

SEQ ID NO: 94881 - DNA, 114 bp, Mus musculus
ttttctcagacagctctgagacaggcactgcttttgttgtttctttacaattataaaagagacagagtcagacacagagacaaaggcttagagacagagacacagatggggaga

SEQ ID NO: 94882 - DNA, 66 bp, Mus musculus
atatgtatgtatgtatatatgtgtgtgtatatatacgcgcacacatacatacatatacatatatat

SEQ ID NO: 94883 - DNA, 100 bp, Mus musculus
ggctctatgacatacatgtgctacttaagggttgagattttcttgtgctaacaaaaatcctgtggagagtatggatgctcttgggtaatgtggtatggcc

SEQ ID NO: 94884 - DNA, 107 bp, Mus musculus
gttcatggtctctcctttttaaaaatgttgttacatgtgtatatgtatatgtgtctgtgtatacatgtgtgtgtgtgtgtgtgtgtattcctaaatgtgacctgctc

SEQ ID NO: 94885 - DNA, 109 bp, Mus musculus
tgaaaatgagaaaagtgaggctggagagatggctcagggattaagagcaccgactgctcttccagaggtcctgagttcaagtccccgccaccacatggtagttcagtca

SEQ ID NO: 94886 - DNA, 67 bp, Mus musculus
gacacaactgacactctcacagtccaaccatagaccatgctgtgaaggagtggcaggaggtgtcggt

SEQ ID NO: 94887 - DNA, 83 bp, Mus musculus
gaaaggatctctagcgctggagagatggctcagtggttagagcactgactgctcttccagaggtcctgaattcaattcccagc

SEQ ID NO: 94888 - DNA, 76 bp, Mus musculus
cagcacctcaggtactgtgcatggcccagttgctggtactgagcatggcgctgacgcacagtctgactctcagctg

SEQ ID NO: 94889 - DNA, 87 bp, Mus musculus
aggtctgagcagtcaacagtcacttattcttagcgccctggtcagttttgagtctgtgttactgtgattcactgcaaaaagaggctt

SEQ ID NO: 94890 - DNA, 65 bp, Mus musculus
gctcaagtcatcacgcttgtgcagcaggttcgccaccatctctgtgtgtgcgtgtgtctctgtgt

SEQ ID NO: 94891 - DNA, 82 bp, Mus musculus
ccagaatttaagtctgaaatgttcccaggctcctaatttaatacctaggtgggagtttgtggtactagcttgaagaccttgg

SEQ ID NO: 94892 - DNA, 69 bp, Mus musculus
ggtttcaactcaagcaggtcaaagtgttgtgaaactcacacactgtgaaagtctgcttgttttggggct

SEQ ID NO: 94893 - DNA, 70 bp, Mus musculus
gtcttactttcttactcactgtctgaaagcttaaatggttgttagcaccacagaagtggagtagtgggac

SEQ ID NO: 94894 - DNA, 96 bp, Mus musculus
tgggaacggtggagctcaacaggctgactgtggctctcttgtcattgcaaaacccaggctcactcactttgtcagccctgtgaccatggcttccca

SEQ ID NO: 94895 - DNA, 82 bp, Mus musculus
cgtctctgtccctcactcccacaccttgtcctctgcttccttagcatgtggcctggctcagtgtgcaagaatgacagagatg

SEQ ID NO: 94896 - DNA, 77 bp, Mus musculus
ggttcaattgagaatctctttctagaatgttctactgcccaggtagacttgtgaaatagaaggtgatccagtgagtc

SEQ ID NO: 94897 - DNA, 71 bp, Mus musculus
ggtggagtgagaaaagtgagtggccatgtcatactcagagagacatggctgcttaatttttatgatccttc

SEQ ID NO: 94898 - DNA, 93 bp, Mus musculus
gcaggcaccaacagtttggttttaaaacaactattttttttttggttttaaaaaactatttgtttttaaacaactttttggatggtgttttgc

SEQ ID NO: 94899 - DNA, 85 bp, Mus musculus
cctgaactgtgtgagaacagagagacccagctgggcgctcccatgcaggccccgactccccgttctctctgctcttgactgtagg

SEQ ID NO: 94900 - DNA, 82 bp, Mus musculus
accaagctacatcctcaggccttagcatgggtctttgcactctgtgtttatctgtctacttagagcctagggtagcatgtgt

SEQ ID NO: 94901 - DNA, 77 bp, Mus musculus
ggggatcctgtttgctcccagcctgccagcatgcagtgcctgctcgctcagtggctctgtcggttccctagatcccc

SEQ ID NO: 94902 - DNA, 83 bp, Mus musculus
tgaaggggtggagcagagagatccaagagacagatgaggaggataaaacagtgtgtctgtctgtctgtctgttatgtatttta

SEQ ID NO: 94903 - DNA, 89 bp, Mus musculus
gaagttcagttcccagcacccacatcaggtggctcacagctgtctgtgactccacgtgagtctgtgggagcctgctggctgctttcttc

SEQ ID NO: 94904 - DNA, 86 bp, Mus musculus
gagaacagtatgtgcaacaagtggagactgctgctcttgttccctccagtccagtgggagtctcactgttacactgtgccaggctc

SEQ ID NO: 94905 - DNA, 73 bp, Mus musculus
agtcccctctctctctctcaggccaggagcagaggacactaataggctctgggtgagatagaaagaaaggtct

SEQ ID NO: 94906 - DNA, 115 bp, Mus musculus
ctttgtcactgtctctgtcattgtctgtctctacttctgtttctctctctcccactctggttcagtgtccccggagagcagcaacacattagtttagcgtgaccaagtagaaaag

SEQ ID NO: 94907 - DNA, 102 bp, Mus musculus
ttaagcctccagcatttggggaaattgttttcacagggagcattgcagcattaagacaagcatttgttttcctgaaacacaagttaagaaactgtggcttag

SEQ ID NO: 94908 - DNA, 76 bp, Mus musculus
gctggggtggagaaaaagaatttgttgagggattgtgctccattcccaaataagttctgtctctctctcccccagc

SEQ ID NO: 94909 - DNA, 77 bp, Mus musculus
gggtccttgcctcatacccaggacacatccaggagaaactgcctgcctgcctgcctgcctgcctgccagcaagactc

SEQ ID NO: 94910 - DNA, 87 bp, Mus musculus
atatatgtgtgctatacatatatacattcacacatacacacatatacatgtatatatgtatgtatgtatgtatattaaaggttcagt

SEQ ID NO: 94911 - DNA, 115 bp, Mus musculus
tccaacctttggactgcgtgtgctcatttctggcactgagctgtgggtgcacacacacacacggaaaatatgcacagagacctgctggggtacttgtcactctgctaggactggg

SEQ ID NO: 94912 - DNA, 83 bp, Mus musculus
tcagcagcaagaagaccagaaggacacagaggcagacaggactcagtctctctgtgccatctacacggctatgctacttctga

SEQ ID NO: 94913 - DNA, 90 bp, Mus musculus
gtctgtgatgtatgtgtgtgtatatgtatgtgtgtatttctgtgtgtggtttatgtctgtgatgtatatatacatgtgcggtgtatggat

SEQ ID NO: 94914 - DNA, 72 bp, Mus musculus
gtgtcagaatgttcttctgtgagttgagagtgtggaatgaaggctcttaaagaaagaacaaccctttgacat

SEQ ID NO: 94915 - DNA, 113 bp, Mus musculus
gctcccaagaccacagcaactggccctgctcagtacaaacggtgctttcagtctctggtaaacagcctgtgccccagggctcaaatccttcaaaagtttgcctaggtaattgc

SEQ ID NO: 94916 - DNA, 84 bp, Mus musculus
cgaaggaggaaggggcctgggtgtgtgagggcagagagggatgccctgtgcctgcctgcgtgtaacaggaaatctcactcctcg

SEQ ID NO: 94917 - DNA, 113 bp, Mus musculus
cagtgattttgctaaatagcttgttgtgccatctgttcatcttgctgatcttcatgttcttcatctttggaagtgaataaaatggtacctagcttaaagagtgttgaggactg

SEQ ID NO: 94918 - DNA, 78 bp, Mus musculus
agaagaaagagcgagctagcaggttgatttgttagaactattctcactgagtggctagctggatcactgtttatgtct

SEQ ID NO: 94919 - DNA, 117 bp, Mus musculus
agcgagtcaaatggttgtctttagaggatgtgctagtttggccaaggtgagaggtctgtgagtacagacccgggcaggacaggtaggtggcgcatggctgaggaggaaggactcgct

SEQ ID NO: 94920 - DNA, 134 bp, Mus musculus
tcccaagaggataggagccaatggctgggtgcaaggcctccccaaggcccctgtctgcccaggtctctgtgtgttagtctccctctgaggatggcccattgaagagggtctaatggtccagaatacttgagtcc

SEQ ID NO: 94921 - DNA, 67 bp, Mus musculus
gtgctgatgtctgtggataggggacctcccggagacttaggatttgtctgtctgtctgtctgtgcac

SEQ ID NO: 94922 - DNA, 75 bp, Mus musculus
gataagagagagtgctcacagaggcatccagagaccaagctttgggcctcaactgtggcataatgttttccactc

SEQ ID NO: 94923 - DNA, 82 bp, Mus musculus
tcagtacagtgtctgtgagtctgtaatcaggatggcatcccaaggcctgggagatgcttgctgcacacacatgaggacctga

SEQ ID NO: 94924 - DNA, 76 bp, Mus musculus
tggagttgtttccctcagtgtcagtctcagagtgccttctactgagctacctcattgcactgaggaaggaattcca

SEQ ID NO: 94925 - DNA, 78 bp, Mus musculus
agaggttcaagagagagagctgacacacccttgccacatgaccttggggcaggttagcttccattgtcttgttcttct

SEQ ID NO: 94926 - DNA, 90 bp, Mus musculus
gaaagcggagtcacgatgctgtccagcagttctgtgatggcgctcgcgctgtctgtctgtctgccggaaggtgctttctgctccgcttcc

SEQ ID NO: 94927 - DNA, 66 bp, Mus musculus
ggagagtaggctagacgggtgggcgctggcctcagcactgtgtcactgtctgagactgttctctct

SEQ ID NO: 94928 - DNA, 107 bp, Mus musculus
tctactggctactgggagatggggagccattgtcttcagttgtgtgcccattggtaaaaccaccaggctccaatagacagtcccaattccacagtcaagcaggctga

SEQ ID NO: 94929 - DNA, 89 bp, Mus musculus
atatatatattatatatattatatatatatacacatatatacatatatatgtatgtatgtatatatacatatgtgtgtatatatatata

SEQ ID NO: 94930 - DNA, 114 bp, Mus musculus
gcatgcatgtgtgcctgtgcgtgtgcataagcatgcatgtgtgcctgtgtgtgtgcctaagcatgcatgtgtgcctgtgtgtgttcataagcatgcatgtgtatctgtgtgtgc

SEQ ID NO: 94931 - DNA, 78 bp, Mus musculus
tagatgttggggaggggtagctggaggaagtatgtcacagaaaacatgtctctgtctgcctgcctgtctgtctgtctg

SEQ ID NO: 94932 - DNA, 90 bp, Mus musculus
gtttcctttagaatagcttcaggggatacactccatgcaaatgtactatgcatggatttgtgtctctctctgggtcttttatctgggagc

SEQ ID NO: 94933 - DNA, 66 bp, Mus musculus
gtgtgtgtatacatatgtatacatgtatgtatgtgtgcagttatgtatatttgtgtatatacgcat

SEQ ID NO: 94934 - DNA, 107 bp, Mus musculus
gttttcagttttgttgctgatcgcaaatttatttttagttacaaagtttaaaaaatttccttttagagtctaaaatgataatgcgattgggggacaatggtgattgc

SEQ ID NO: 94935 - DNA, 95 bp, Mus musculus
ccaggccactcactttgtagcactctttgtaaatttttcttttctggtctttgaggatgtcggacttgaagagtttctgttgttgctgttcctgg

SEQ ID NO: 94936 - DNA, 77 bp, Mus musculus
cctctctctgtcactctctgtgtttttgtgtatgcctacgtgtatacatacatgacatggtacatgagcagaggagg

SEQ ID NO: 94937 - DNA, 115 bp, Mus musculus
gcctcatgctgtgggtcagatgtaagctctcagcaccgtgccgcctgcctacctgcctgcctgcctgcctgtctgcctgtacctgcctgcctgcctacctgcttgcctgcctgca

SEQ ID NO: 94938 - DNA, 281 bp, Mus musculus
tatatgtttgtttatatgtatttatgtgtgtatgtatgtatacatgtatatatgtttatatgtatttatgtgtgtatatatgtaagcacatatgtgcatatgtatggatgtgtgtatatatatgtatgtgtatatgtgcatgtgtctgtctatatatatgtgtgtgtgcagtatatatgtgtttatgtgtttatatgtatgtgtgcatgtatgcatatatgtgtgtatgtatatgtatttatgtatgtgtctatatgtatatatgtgtgcatatgtattca

SEQ ID NO: 94939 - DNA, 101 bp, Mus musculus
gagagtaactattgcttctatttttcatctgttttctttggtggtacctgacagtaggctgtcagggcaaattaaagtggtgaccgagcaataattgcctc

SEQ ID NO: 94940 - DNA, 92 bp, Mus musculus
ggtgaccaggaggcctctgggtttgacccatggcgatgtgctcagcctatgtcaccctctgtcactcccaggcagcttcatcaaggtcaacc

SEQ ID NO: 94941 - DNA, 90 bp, Mus musculus
cattttggtgcttgagagatggctcagcggttgagagcactgactgctcttccagaggttttgagttcaaatcccagcaaccacatggtg

SEQ ID NO: 94942 - DNA, 117 bp, Mus musculus
gcagtttctctcttgtattaaatgattgcttctgtccttgcatggctatgagcccctcctgtgggactcagtgcctgtgtgagattataagccattatatataaaaatacagcctgc

SEQ ID NO: 94943 - DNA, 106 bp, Mus musculus
tatgcatgtgtatatatgtatgtatgtgtgtatgcatgtatgtgtgtatgtatgtatgtatgtgtgtatatgtatgtgtgcatgtgtatatgtatgcatatgtgta

SEQ ID NO: 94944 - DNA, 65 bp, Mus musculus
tccctgcctctcactctcaaagacttgaccacagtcgctgaggggcatcagagagcagccaggga

SEQ ID NO: 94945 - DNA, 56 bp, Mus musculus
caaatatatatatatatgtatgtatatacatatacatacatatgtatacatgtatg

SEQ ID NO: 94946 - DNA, 72 bp, Mus musculus
tatgtgtgtgtatgtctgtgagtgtgtgtgcatgcatgcacatgtatgtgtatgagagagaaagcacatgtg

SEQ ID NO: 94947 - DNA, 135 bp, Mus musculus
ctcttaatctccgaactctctctctctggccctgaacattatgttttttaaaaacaatagccgggggctggagagatggctcagaggttaagagcactgactgctcttccagaggtcctgagctcagtccccagc

SEQ ID NO: 94948 - DNA, 74 bp, Mus musculus
gctgtgggtggttagaacagctagaaagacagaaaagaacaaccagggcttctgtcgctcagactcaccctcgc

SEQ ID NO: 94949 - DNA, 113 bp, Mus musculus
tgcggctgcggagatctctggacggtagtgtgggggaagagctgacactcagtcccactggcagtgccagctgtgttctcctgtgtgacttccagagaacactgtggtaagta

SEQ ID NO: 94950 - DNA, 85 bp, Mus musculus
gatggtttgtactgtttctgttgttctgagaaccagatccctgagcccttaggattagagcagcatcccccagccaataattgtc

SEQ ID NO: 94951 - DNA, 90 bp, Mus musculus
ggtgacggcctccttctcagcctctgtccctccctctgaggtgagtctttagttctcaggggcaggagcatggagtggcaggattgaact

SEQ ID NO: 94952 - DNA, 88 bp, Mus musculus
gcttgaggtctgcatattgatagtcatttctctctctcactgacacagatgtaggccagattagaccagattaaaagtagataaaggc

SEQ ID NO: 94953 - DNA, 112 bp, Mus musculus
tgtataggagtatattgtatatattctagtgtgtgtgtatatgtatatgtatatacatatatacatacatacatacatacttgatatacatatgtacacacacatatataca

SEQ ID NO: 94954 - DNA, 84 bp, Mus musculus
tccaacttaggctgttacttctttccctccctcagtctgtgggacatgccatcagtctgtgggacatgccatcagtctgtggga

SEQ ID NO: 94955 - DNA, 115 bp, Mus musculus
tgagatctcctggtgtcttgttaaggtttctattgctgtgacaaatcactgtgaccaaaagcaagttgggggagacaggatttgttcagtttacacttccacacccatagtttca

SEQ ID NO: 94956 - DNA, 94 bp, Mus musculus
ttaggggaacttacagtgctcttgctttgagcagaagcctgatttccagggtcaggtagttgatagaagagacgctcagataaggttctttcag

SEQ ID NO: 94957 - DNA, 83 bp, Mus musculus
aagaactcaggcaagacctcgaggcagagactttgtagaatgctggatgctggctccctctctggctcacacttagccttctt

SEQ ID NO: 94958 - DNA, 57 bp, Mus musculus
ggggagccaagagcttacaggactcctaagatctcgagtgtcactctctgggtcccc

SEQ ID NO: 94959 - DNA, 112 bp, Mus musculus
tcctggtttgcccatgggtacagcagaggttcaccagagtgtgtgctctctgcaatgtacaggcaaggggagactaacagcctggtatgcttctcctgtcacagcaaaggga

SEQ ID NO: 94960 - DNA, 72 bp, Mus musculus
gtacgcatgtgcatgagcatgtgcatgtgtgcacatgtgtgtgtacacgtgttcatgtgtgtatgtgtgtat

SEQ ID NO: 94961 - DNA, 73 bp, Mus musculus
ttcaggagctcccaggatgatgttgaacatcagtggcaaaaacaggcactgttgtctcgctctgggtcttgga

SEQ ID NO: 94962 - DNA, 96 bp, Mus musculus
gccaccaagcgagccacggggtccacgacgacaaaaagaactgcgctgagacctctctgcgtctctgtctgggatccaagacgcctgggaaatggc

SEQ ID NO: 94963 - DNA, 103 bp, Mus musculus
ttgctggattcactgcgagatgtctaactgcagtctctcacactgtttctttctctttacagactctagatggatttgtgttcgtggtggcctctgatggcaa

SEQ ID NO: 94964 - DNA, 101 bp, Mus musculus
ggaacatctcaaaacactaaaagctgcctctgtcccactgtcacttacatgccaagtaaggtgaatgacctgctggacactagctgcccttgagtggttct

SEQ ID NO: 94965 - DNA, 62 bp, Mus musculus
gtgtgtgtgtgtatggatgtgtgtgtatctctctgtgtgtgtgtgtctatgtttatgcacat

SEQ ID NO: 94966 - DNA, 68 bp, Mus musculus
gtatatgtacatgtgtgtacgtacatgtatatgtgtgtacatgtgtgtatgtgcatgtgtatgtgtac

SEQ ID NO: 94967 - DNA, 98 bp, Mus musculus
gccctttctcttgattcatttcctctcaactataactactaagtgatttattttttaatctgagacaatagtaggagttgggaaacaaggccctgggt

SEQ ID NO: 94968 - DNA, 76 bp, Mus musculus
gtgcatgactgtgtgtgtgtgtacacgtgcatgtgtgtgagcccatgtgtgtgtctgtgtgtgcatgttcatgtgt

SEQ ID NO: 94969 - DNA, 92 bp, Mus musculus
tcaagaagtagactgaacaggaagtggggacaggtgatagagccttaaggcaagctctcagagactcacttcttttagtaagaacttcttga

SEQ ID NO: 94970 - DNA, 77 bp, Mus musculus
tctgactgcagactcagtgtgcgcagctacctcgctctccctggttcctgtggccatgcctccctgtgtccctcaga

SEQ ID NO: 94971 - DNA, 67 bp, Mus musculus
ctatgtgtgttcatcagttcactcagaggtcggcgacaagccacacagtgtctgagtcacaaagtag

SEQ ID NO: 94972 - DNA, 102 bp, Mus musculus
tatgtatgtatgatatgtatgtatgtatgtatgtatgatatatgaatgctacgtattattatatgtgtatatatgtattatgatatgtatatgtgtacatgt

SEQ ID NO: 94973 - DNA, 86 bp, Mus musculus
atgtatgtattgtatgtatgcatgcatgtattatatgtatgcatgtatgtatgatacatatatctatgatatgtatgtatatgtat

SEQ ID NO: 94974 - DNA, 70 bp, Mus musculus
tatatgtatgcatgtatgtatgatacatatatatctatgatatatatgtgtatatatatgtatatatgta

SEQ ID NO: 94975 - DNA, 78 bp, Mus musculus
cggtgtctgtctgtctgtccctctacccagggtttagcagctaatactctggatggaaggatccatagatagactctg

SEQ ID NO: 94976 - DNA, 81 bp, Mus musculus
gggtgtgtctcactgaatctcaaattgcctatattctgattcataaaatggcaatccacttggttcaacatgagcacaact

SEQ ID NO: 94977 - DNA, 106 bp, Mus musculus
cagagcagttagcttacttaatatcactgaacttagtttgcttatctggaagacttggggtaaaactctgtggtaaagaatgagggttaataagtaattgactctg

SEQ ID NO: 94978 - DNA, 81 bp, Mus musculus
tatatatgtatatatacacatatacatatatgtatatatatgcatgtatgcatgtatgtatgtatgtacgtgtgtgtatat

SEQ ID NO: 94979 - DNA, 101 bp, Mus musculus
gtgtcagccctggggggctagagagatggctcagcggttaagagcactgactgctctttcgaaggtcttgagttcaaatctcagcaaccacacggtgactc

SEQ ID NO: 94980 - DNA, 117 bp, Mus musculus
gcaatgactcttcccagatcatggttctgtgagaagacagctgctgtgtgagtgtctgtgtagacactgagcacgttgtgtctctagcagttggggctaaaggtagaagaggaggca

SEQ ID NO: 94981 - DNA, 90 bp, Mus musculus
ttctgtgcagtcttcccagccctgtgtcatcctgcctgagtcccttggtcaggcccagtgagcttagggcaggaaagttctagctaagag

SEQ ID NO: 94982 - DNA, 102 bp, Mus musculus
tacagaaggctactgtaatccatgcctggacatagtcacagggacacaagtgagtgtgttctagctattatcaacaggtatggatggatggttatgtatgtg

SEQ ID NO: 94983 - DNA, 71 bp, Mus musculus
gtgttcctgatgcagaggaaggctgtagaggatgcatccttggcatgtgactctgtgtgtgtgagctgcac

SEQ ID NO: 94984 - DNA, 78 bp, Mus musculus
ttctcacactgagtcatctccccatcccttgtctgtcactctgacacaagagtttggggaggagaaactatgtgagag

SEQ ID NO: 94985 - DNA, 91 bp, Mus musculus
gtctttacttccttggacgcttgctttcttgcctttccgcagtactgataactgacagcagagagtgagtttggtggactttgctacagac

SEQ ID NO: 94986 - DNA, 156 bp, Mus musculus
gtatatatgtgcatgtgtgtatataatgtatatgtatgtatgtttaaatatgtatgtacatacatatgtataaatgtatgtgcatatagtacatatgtatatcatatatatgtatatatgacacatatgtatatggtatgtatgtatgtatgtatg

SEQ ID NO: 94987 - DNA, 127 bp, Mus musculus
ggggccagatgaaaggcttggtgccagtgtgtctctccaaaagatgtctcagccagtctgtcgctggctctcacggaacttcaaagagagtttcatgactgaagcctgagaattctgtgagaattgc

SEQ ID NO: 94988 - DNA, 68 bp, Mus musculus
ggaattcatgttactttatttttcatatgtgagctcgtgaccctgaaagatggttctacgtgagttcc

SEQ ID NO: 94989 - DNA, 79 bp, Mus musculus
aggttcaaagcttgtctctctgtgtctcttacccagctctataggtgctggtaacagctgtagagaagcctttgtgcct

SEQ ID NO: 94990 - DNA, 182 bp, Mus musculus
atgtgtatagatacatatatatgtatgtgtgcatgtatttaactatgtatcttatatgtaaatatgtatctatgtgtattatgtatgtaaatatatatctatgcatttgtgtgtatatatatatctattcatgtgtgatgtgtgtatacatgtatgaatgtatctgtgtatgtatttgtgca

SEQ ID NO: 94991 - DNA, 66 bp, Mus musculus
gactaggctaggataactgaccagtgagccccagggttttctgtctgtctgtctatctgtctgtct

SEQ ID NO: 94992 - DNA, 100 bp, Mus musculus
agttgtgtggaccaaacaccaaaatatgatgttttttagcaaaagaaatatgtttgtttttaaatgagaggtcagttttgaaagtcatggttattcaact

SEQ ID NO: 94993 - DNA, 82 bp, Mus musculus
tgtctgtatatatatgtgtgtgtgtgtatgtatgtatatatatatatatatatatatatatatatatatagacacaaacaca

SEQ ID NO: 94994 - DNA, 85 bp, Mus musculus
ctcataatgcatattttgggaaattcctgacaggacagagagtacaaatgtatgacaggcatgtttagaattctgcagagatgag

SEQ ID NO: 94995 - DNA, 88 bp, Mus musculus
tccttgttctctgtagaaagacagctgactcttcactgtgccctaagatgagtggttcttcttgttgtgttttataaaaagataagga

SEQ ID NO: 94996 - DNA, 93 bp, Mus musculus
tcagagagatgtgtagtcagtgtttgttcttctcatatcaacctgtggatataaatagaaggtatatcaatacttacaaatcataatctctgg

SEQ ID NO: 94997 - DNA, 102 bp, Mus musculus
agagctgtggagcctgggtaagccactgagtctctctgaatgtgaggcttcacccacacctgcacagtgaagagagacagctcacccacatgtcacagtcct

SEQ ID NO: 94998 - DNA, 68 bp, Mus musculus
gcctgtgtctctgggcctctgtgggtctctccaaacttctgagcccccagcacgacttccgggagggc

SEQ ID NO: 94999 - DNA, 126 bp, Mus musculus
gtatatatatgtacatgtgtattgttatgtgtgcatgtgcatatgtgtacacatgaatatatatatatatgtgtgtgtgtacatgtttatacacctgtacatgtatgtacatgtgtatgtgtacat

SEQ ID NO: 95000 - DNA, 114 bp, Mus musculus
gtgtatatgtctttgtgtgtacacacatgactgtacatttgtgtgtatctctgtatgtctgtgtgtgtgcatgtgcatgtgtgtctatacatttgtgtgtgtctgtgtgtatgt

SEQ ID NO: 95001 - DNA, 145 bp, Mus musculus
gcatacatgtgtgcatctatgtgtgcatctctctgtatgtatctgtgtgtatttctgtgtgtgtctgtgtgcatctatgtgtctgtgtgtatgtctgcattgtgtgtctgtatatatgtatgtatgtaggtaggtaggtatgtat

SEQ ID NO: 95002 - DNA, 76 bp, Mus musculus
acacatgagctctgagcagcagggaacatagatgggcaagggtgagctctctgggtactcagttcagtctctgtgt

SEQ ID NO: 95003 - DNA, 117 bp, Mus musculus
aacacatgctcacagtcttgattttcctcaggtagtgtctagaaatatctatttatatagatccaattctagatatagacttacaaacattagtgaagatgggaagggggcattgtt

SEQ ID NO: 95004 - DNA, 72 bp, Mus musculus
tgtatgtatgtatgtatgtatatgtatgtgtgtatatgtatacacgcgtatatgtacatgtagatgcatata

SEQ ID NO: 95005 - DNA, 74 bp, Mus musculus
gacctgagtctgtctgtcgctgggtcatttactctaagcacatgaggagattcagtgatcagaagaaaagggtt

SEQ ID NO: 95006 - DNA, 100 bp, Mus musculus
ccacacacacacagaggcatacagtacagaggtgtgtatccacatgtggacacagacacactcacagtcatgcagtacagaggtgtgtacctacgtgtgg

SEQ ID NO: 95007 - DNA, 81 bp, Mus musculus
ttctgtgagccattcttttttctgtttatagatacttatatcattattcaggtcaaatgtcagatggagagtggcaaggag

SEQ ID NO: 95008 - DNA, 95 bp, Mus musculus
gtgcacagctggatgttacagagctaacaggggctgcacactgctctttgtgactgcctgtgtcccttctgtgacatgtgtcccttctgtgacat

SEQ ID NO: 95009 - DNA, 116 bp, Mus musculus
tacctgtgtgttcatgtatatgttcatgtggatgcatgtatgtgtgcttgtgggtgcatgtgcatgtgtatgtgtgtgcatgtgcatgtgggtgagagtatgtgtgcattgtgtgt

SEQ ID NO: 95010 - DNA, 118 bp, Mus musculus
gtgtatgtatgtatatgcatttgtatgcatatggcatatgtgtactgcctgtgtacatgtatatatgtatatatgcctcagtatgtgcctatgtgtatgcatgtgcatacatgtgtat

SEQ ID NO: 95011 - DNA, 99 bp, Mus musculus
atgtgtgtgttatatatatttcaaatgtgtttgtgtgtgtgtgtatatatatttcaaatatatatacacacatatattgtgtgtatgtattacatatat

SEQ ID NO: 95012 - DNA, 108 bp, Mus musculus
tggtgatctctggtgtgtggaaatgaggctccgtgactgggtctgtctaacgctctctgatattgttgaagggccttctttcatttagcatgtcatattagggctcca

SEQ ID NO: 95013 - DNA, 90 bp, Mus musculus
gaggcaatggactctaccactgggcagcctgaggtagaaggaaggccacaccttctggctccctgggtccctgcctcccaatcctgtacc

SEQ ID NO: 95014 - DNA, 77 bp, Mus musculus
taaagggaggccagttacacggggagtctgagatcgtcagggatctgaccctctctctcagtgaccaggctgttttg

SEQ ID NO: 95015 - DNA, 72 bp, Mus musculus
atgtgtatgtatgtgtgtgtatatgtatatgtgcgactgtgtgtatatgtgtgtgtatatgtatgtgtgtgt

SEQ ID NO: 95016 - DNA, 115 bp, Mus musculus
atggtttgaaaagttcacattaggggctggagagatggctcagtggctaagagcaatgactgctcttccagaggtcctgagttcaatttccagcaaccatgtggctcacaaccat

SEQ ID NO: 95017 - DNA, 116 bp, Mus musculus
gctgctctttggcactgcttagaatctggtcatgtttcagaaattgtatttgattcttttcccatgtaattatttatcaaaaatattgccagggtctggggagctggctcagcgag

SEQ ID NO: 95018 - DNA, 99 bp, Mus musculus
gtatatgtgtgtatatgtctgtgttgctgtgagtacatatgcatgtgtttaatatgtgtgtgtgtctgtgtctatgtagctgtatgtatgcatgtgtat

SEQ ID NO: 95019 - DNA, 117 bp, Mus musculus
tctgagaccttgaagctcttagaacatcccatttctgtgtgtatgtgtgtgtctgtgtgcctgtatgtatataagagagagtggagggagggagtgggagggagggagggagggaga

SEQ ID NO: 95020 - DNA, 74 bp, Mus musculus
gtgtgtgagggaactgtgggcagaagctgtgggaccagagttctttctactttcacgtcgtttctctcaggttc

SEQ ID NO: 95021 - DNA, 118 bp, Mus musculus
catggaaggaccctgaattttccagaaacccactccttagaaaatcatgttgatcctgctgggcaggagtttagctctaataaggaccttggttattttgataaggcacaccctcatg

SEQ ID NO: 95022 - DNA, 78 bp, Mus musculus
tatctatctatctatctatctatctattgtgtgtatgtgcgtaggcacacacctgagatggtcagaagacagctgatg

SEQ ID NO: 95023 - DNA, 85 bp, Mus musculus; identical to SEQ ID NO: 57439

SEQ ID NO: 95024 - DNA, 83 bp, Mus musculus
tatatatatatatatatatatatccacacacatatgttccttatatacacatgtgtgtgcatgtgtatgtgtatatgtatata

SEQ ID NO: 95025 - DNA, 123 bp, Mus musculus
cacatctgcgtatctgaagtatatgaatgtctgcacatgtgtagtatatgcatgtctgcatgtgcatgtggtatatgcatgtctgcatgtgtgtggtatatatatatctctgcatgtgtgtgg

SEQ ID NO: 95026 - DNA, 104 bp, Mus musculus
tgctgtgtaaacacctggcaccatgttcctcccatggtctgatttttttttttaagcaaagtatccagaaggggagagagtattctgaacagatcaaacaagca

SEQ ID NO: 95027 - DNA, 61 bp, Mus musculus
actgtctgactctgagtcactgatgctgttgtggacagaatggggaccggatatcaacagt

SEQ ID NO: 95028 - DNA, 61 bp, Mus musculus; identical to SEQ ID NO: 95027

SEQ ID NO: 95029 - DNA, 92 bp, Mus musculus
cacatgtgctgcttactcctcttccgctcagggacattcagtgagtcactctgcaaggatgccgcttgagccatgtgagaagcagtgcagtg

SEQ ID NO: 95030 - DNA, 72 bp, Mus musculus
ttagaaagtgtagataagagtgtggactgtgtgcatgcgcgcacacacacacacactcttaacacattttaa

SEQ ID NO: 95031 - DNA, 84 bp, Mus musculus
gagtggatgcaaatcgggagtcacggggctcggtgaactcagtgcgctgtattctcatctctgtgaactgagtgtgctgtattc

SEQ ID NO: 95032 - DNA, 121 bp, Mus musculus
acccaagtgggcatctggcaataatggataaatagccactctactataaggtgctacacacagacacacacacattgttacaccgtggtttgcttgtttatattgagaccctttaaggtgt

SEQ ID NO: 95033 - DNA, 101 bp, Mus musculus
ggtgaccgtgggctccagacgacaataactgagaaaactgagtgagctcggaccccgtgaatctcagaattcagaatggtaggagtctggagcaggtaacc

SEQ ID NO: 95034 - DNA, 83 bp, Mus musculus
tatgtgtgtatgttatatatgtatgtgtgttatatgtgtatatatgtgtatgcacatatatgtgtatatgtatatatatgtga

SEQ ID NO: 95035 - DNA, 297 bp, Mus musculus
gtgggtcagatgtaaactctcagctactgctccagtgccatgcttgcctgcctgcctgcctgccatgcctgccgtgcctgtcatgcctgcctgctgcgcctgccctgccctgcctgcctgcctggctggcatgcctgctgtgcctgcctgccttgcctgcctgcctgcctgtcatgcctgctgtgcctgcctgcctgccatgcctgcctgctgtgcctgccctgcctgcctgcctgcttgcctgcctgcctgctgtagtgctcctcaccctggtggtcatgggttctaactcactgc

SEQ ID NO: 95036 - DNA, 114 bp, Mus musculus
tagttaatgtgtgtggtttgcatgtgtgcgtgcccgtgtgtgtgtgtgagagagagagagtctgtgtgtgtgtatgtgtgtgtgtgtgtgtgtgtaagagagacagagagtctg

SEQ ID NO: 95037 - DNA, 61 bp, Mus musculus
tgctctcggtcagtcacaccctgggcccgatgacagcaccaggcatgggacagcgggggca

SEQ ID NO: 95038 - DNA, 113 bp, Mus musculus
gtgtgtgtgtatgtgtgcatgtgcatatatgtgtgtatgtgtggtatgtatatgtatgtgtatatatgtgtgtgtatgtgtggtatatatatgtgtgtatatatgtgtgccat

SEQ ID NO: 95039 - DNA, 81 bp, Mus musculus
gacttctgttagtttcactgtctctctgtttagtttctgtttccaggatctgtccattgttgagagtggggtgttgaagtc

SEQ ID NO: 95040 - DNA, 81 bp, Mus musculus
gtatgtatgtatgtatgtatgtatgtatgtatgtggtgcacacacatgcacatatgcacacacacttgcacacacttgtac

SEQ ID NO: 95041 - DNA, 83 bp, Mus musculus
gtgtcttctggtgtctgaggctccttgatcatgagaacccaggatctactgggttctcctctgtctcactctgccatctgcac

SEQ ID NO: 95042 - DNA, 85 bp, Mus musculus; identical to SEQ ID NO: 60314

SEQ ID NO: 95043 - DNA, 73 bp, Mus musculus
ggagtttcctgtcagccagttctctgccttggtccctttgcaaccagagagtagagagtgaggttggaattcc

SEQ ID NO: 95044 - DNA, 76 bp, Mus musculus
tgtaaagcggcacaggtgacagcttgcctggactcactggcacccagagccagtcactgtcactgtcactgtgaca

SEQ ID NO: 95045 - DNA, 58 bp, Mus musculus
tagtctctgatgacactgagctgagaaccgaatccattgctggtgttgtcagcagctg

SEQ ID NO: 95046 - DNA, 113 bp, Mus musculus
cccatttagaggcaatgggggctgctcacaaagggagaacacattttgtaattcataaaatttaagaacatccagaatcgttcatcctcagagcagccctgcagccctcaggg

SEQ ID NO: 95047 - DNA, 73 bp, Mus musculus
tttgatctctcttactctgtgtgtgtgtcaagttgggggttgtacacatgagtaggtgtctgcagaggttgag

SEQ ID NO: 95048 - DNA, 67 bp, Mus musculus
gacacattatatcctcacaagtgtgtggcaggtgcacacacacacacacacatggaggtaaaaggtc

SEQ ID NO: 95049 - DNA, 114 bp, Mus musculus
agtgatttgtttggatttgtcaagggcaagaggggaaaatatgtctttttttttttccttaaaagcatgttggcataaactcgaatgtccttttgtatttgaatatatctgact

SEQ ID NO: 95050 - DNA, 101 bp, Mus musculus
actaacattaaaggtgggtgtgtcaccctgacccattcctgtgtccctctgtgtcttcctgaggtcactggatctgtgaagccatacacgtaactgttggt

SEQ ID NO: 95051 - DNA, 109 bp, Mus musculus
tttgtaatacagagggctggtacagacatggcagaagcttggagctatgtgcttagaacagacagtggctctgtctctggcatgcaatttcgaagccctatggtataga

SEQ ID NO: 95052 - DNA, 93 bp, Mus musculus
acacagatgcacacacacatgtatatcatatatcatacttaataatcatacatcctagatcatatatatatatgtatgtgtgtatatatgtgt

SEQ ID NO: 95053 - DNA, 70 bp, Mus musculus
gatagtttcacaggaggtagcagtgtgctccataagctaccatatctgtctctctgtgtctcgctctgtc

SEQ ID NO: 95054 - DNA, 86 bp, Mus musculus
cccggggtgtctctgggggtctctctttggggggggtctctctcggtaggtgtctctgggtgtgtatctctctgtgtgtgtctctc

SEQ ID NO: 95055 - DNA, 116 bp, Mus musculus
actattgccagctctttcaacccttggaaatgtcaaaaactaagagtgaggtctgtatttttcttttttcttttttttatgccatgtgtgtaagggtccacaggtgttgcatatgt

SEQ ID NO: 95056 - DNA, 84 bp, Mus musculus
gcaaatcactgtctctgagtcccttgcgttcatctcttgctgtcactgcatagatggagggactgggattcaggtgcactttgc

SEQ ID NO: 95057 - DNA, 101 bp, Mus musculus
gcggagccgggccgggcgcggcggagcgcagcgcagcgcggggggcgaggccggcgcgtggctcgctcgctggctcgctggctcgcgggaggccgggcagc

SEQ ID NO: 95058 - DNA, 112 bp, Mus musculus
gtccatagtcctggccgtgtgcattcaatgttagactttaaatcagggcacattctgactctgtgggtcattattttgtaaagtgccagatacggatatgtgctttttgaag

SEQ ID NO: 95059 - DNA, 124 bp, Mus musculus
gtatatacacacatatacacacacatatatacatacatgtatatatatgtatatatgtgtatatatgtatatatgtgtgtgtgcatatatatatatatacacacacacacatatatagtatata

SEQ ID NO: 95060 - DNA, 72 bp, Mus musculus
acatgtatatgtatatgcatctgtatatgtatatacagatatatatgtattgatgtatgtgtatgtatgtgt

SEQ ID NO: 95061 - DNA, 102 bp, Mus musculus
gtaccctgcaatgtcacctgggctataagttctcattgtttttcaaaatgtattaaggttgttgctgagaaaggacagagaactagagagtgggagaggtgc

SEQ ID NO: 95062 - DNA, 66 bp, Mus musculus
ctggcacccaatgggcaggttcctgtccacacctttgctgtgggctctgcctctctcactctccag

SEQ ID NO: 95063 - DNA, 76 bp, Mus musculus
ggggctagggagatggctcagtggttaagagcactgactgctcttacagagcttctgaggtcaattctcagcaacc

SEQ ID NO: 95064 - DNA, 71 bp, Mus musculus
ggagccattcagctatggggaggtgggagggaagtgagaagttccttgccccagcctcactctgtgactct

SEQ ID NO: 95065 - DNA, 62 bp, Mus musculus
atatgtatatgtgtatgtacatgtatgtaggaagtatgctatgtatatgcatgtgtgtgtgt

SEQ ID NO: 95066 - DNA, 104 bp, Mus musculus
gatctaaaggctgccaggaggagactgttttctgcaggcaaccaggaggaggctctctctttcacactgggcagagcttgaacataggtcctcaaaggcaactt

SEQ ID NO: 95067 - DNA, 76 bp, Mus musculus
tggcagttagaggggagaggatcagtaagtggttcaaggtctggcttggacagtatgagattttttttttctgtca

SEQ ID NO: 95068 - DNA, 64 bp, Mus musculus
gaagggcaggaataaaagcactagagtgtctaggaaccactcactcactgtgtgactgccagtc

SEQ ID NO: 95069 - DNA, 70 bp, Mus musculus
ttctgacactcagtgtctgtttgcagggtgtgaagactgcagccagtaccatgactcggagtgtcctgaa

SEQ ID NO: 95070 - DNA, 73 bp, Mus musculus
gatgagtaaagagattctgtctctgtagaccatgctgaccctggtctaagatccacctgtctctctgtctctc

SEQ ID NO: 95071 - DNA, 85 bp, Mus musculus
gtccatggtggtctgataggatgcataggacaatttcaatatttttgtatctgttgaggcctgttttatgaccacttatatggtc

SEQ ID NO: 95072 - DNA, 111 bp, Mus musculus
gcacacccactgagcctacaggtgtccacggggcagcacggtatcaagatgtcctgtctcacaggctgtctcacagctgccacacttccacctgtcctctcagtgtcaagc

SEQ ID NO: 95073 - DNA, 78 bp, Mus musculus
tggggctggagagatggctcagaggttaagagcactgactgctcttccagagaccctgagttcagttcccagcaacca

SEQ ID NO: 95074 - DNA, 116 bp, Mus musculus
ggtctatgaacttctgtcttcaggcatctgtctagtgctggtttagtgtgattcttgatgatgctgaatcacagtctgtgctatagtttgtttttgcagcaactgtttgtgttact

SEQ ID NO: 95075 - DNA, 98 bp, Mus musculus
tggtcaggaggaggaggctgtgactcttgggtaacagtgggcacaggacaggattctcagtcccagtctctcagtacagcgaccagctctgtaagcca

SEQ ID NO: 95076 - DNA, 119 bp, Mus musculus
agagtactttatatgcctgcatttattgaatgcctcgtaatggatttaggacttagatcactgtgtctgtcacagggccacaaaagtaataataagtaggaaggaatttaaggctctct

SEQ ID NO: 95077 - DNA, 103 bp, Mus musculus
acacatgtgtgcaagctgccatccgtacacagtgtctgtgtctgtggagatctaatgtgtatatgactacatacaatgtgtatgtaaataagaacacatgtgt

SEQ ID NO: 95078 - DNA, 100 bp, Mus musculus
tccattgttttgttttaattacatatattgcatctatgtatatttgtttctgtttaagtatatacacatgcgtgtagatgctatggaggcaagatgaggg

SEQ ID NO: 95079 - DNA, 62 bp, Mus musculus
tgacactgatttaggctgtgattctactgtagtcagcagatggaagagtcagagaagtgtca

SEQ ID NO: 95080 - DNA, 102 bp, Mus musculus
tgtaatggatatgtgcaccagtcagtcagtgcatgtgcttttgggctgtagtgaatgtgtgcatcaatcagtgcacaggctttaggcatgtaactctcttga

SEQ ID NO: 95081 - DNA, 73 bp, Mus musculus
gtgtgtgtgtgcatgcatgcatgtttgtgtgcatgcattgtgtgtgcatgtgcatgtgtgagttcacacacat

SEQ ID NO: 95082 - DNA, 122 bp, Mus musculus
gtgtgtgtgcatctatgcatatttacatgtatatgttaggaatatatgtgtatatacatgtatatgtatatgtatatgtgtgtatacatccatgttgagactgtatgtgtgtgtctctatgt

SEQ ID NO: 95083 - DNA, 64 bp, Mus musculus
gtatgcatgtatgtatacatgtatatatatatatatatatatgcatgagtgtctgtatgtatgc

SEQ ID NO: 95084 - DNA, 81 bp, Mus musculus
gcccagattctcataccaacttgcagatacacatatacacatgtaagtaagtatgtatgtgagtggtgagggaataacggc

SEQ ID NO: 95085 - DNA, 69 bp, Mus musculus
ccttccagagaaacaaaggctctctctacctcactggttcagaggcagctgggttcctcctgtgagtgg

SEQ ID NO: 95086 - DNA, 90 bp, Mus musculus
tgtttatgcttgtggatggtgagcttcatggtgctgtttttttggatgtgagaggagagacatgaaactcagcacaccttgttttggcat

SEQ ID NO: 95087 - DNA, 105 bp, Mus musculus
taagaatggataaagagagttgagcaccctgtatttatatttattgttcccttcttctgaatgtggatgtaataagaccaactgcctcatgatccttctgtcttg

SEQ ID NO: 95088 - DNA, 93 bp, Mus musculus
acatacatacatacatacatagataaaacacaaattgcatctatccatatgtgtctatgtgtgtgtctgtgtatgggtgtatctgtgtgtgtg

SEQ ID NO: 95089 - DNA, 58 bp, Mus musculus
ttacatatgtatgtatgtatgtatgtatatatatgtatgtatgtatgtatatatgtaa

SEQ ID NO: 95090 - DNA, 104 bp, Mus musculus
gacccggcagctgagctcagtctcgcccacagaagtgactgttcacaggataggtgaactgcattctctgagtggagccttcaggtagatcccagtgctgtgtc

SEQ ID NO: 95091 - DNA, 95 bp, Mus musculus
cctgctcctgctctgggaagtgcacaagtcaagtatgtcttagatacctttcccaagtcccacacactctggctttctctgagtgcagaggcagg

SEQ ID NO: 95092 - DNA, 99 bp, Mus musculus
gcactccaagtgaaagcaaggtggcactctgccactcacacaggctcacgagaggggttgcaggtgagagtggagcagaagtcttcccgtttggagtgt

SEQ ID NO: 95093 - DNA, 102 bp, Mus musculus
tcatcttatttaccaagcacaagggaaaggacttggggataggggtcaaagcctcactctctctttcactcaccacatttgaatttggtaaatcatcggtga

SEQ ID NO: 95094 - DNA, 84 bp, Mus musculus
acagtagtattggagctgaagtctggatatgtgggaaggctgtgagaagagtgcgtggccagatcagttgcagtgtactcctgt

SEQ ID NO: 95095 - DNA, 77 bp, Mus musculus
ggtgttttatgtatatatatatatatgtgtgtgtgtatatatacacacacatatatgtgtatatctatatctatatc

SEQ ID NO: 95096 - DNA, 97 bp, Mus musculus
gcagaggtattgattttagtgctggtgtctatggagtgtacagaggtatgaaagatgctctgggaaagcctgacgtggcactggtaaatctctctgc

SEQ ID NO: 95097 - DNA, 104 bp, Mus musculus
tcttggagttgcactgtggccatttccctgggtcactggctctttctctcatatctagaacattgctagaactttctgggatgtggaccttgtgaattcccaga

SEQ ID NO: 95098 - DNA, 94 bp, Mus musculus
gtatgtgtgtgtgtgtgtgtgtatacatatatatgtatataaacatatgtgtatttatacatatatatgcatatatacacacgtgtatacatat

SEQ ID NO: 95099 - DNA, 140 bp, Mus musculus
cctgtcttccctaccaggtggtcggccgtagaggtcagggctggcgtttaccttccgcatgtctggctcagatcagcaggtggcctggcatgctatgggcatagcaggcagcctggcatgctgtgggcatccttacatgt

SEQ ID NO: 95100 - DNA, 140 bp, Mus musculus
tatgtgtatgtgtatatatatgaatgtatatctgcattatatatatgtatgcatatgcatatatatgtatttatgcatatatgtatatgtgtgtatatgtattcataatatatgtgtgtgtatatatacatatatatgtg

SEQ ID NO: 95101 - DNA, 142 bp, Mus musculus
atatatatagaaaatgggatatatatgtgatatatgatatatatgtgtttgtgtgtctctctctgtgtgtatgtgtatatatatgtgtatatatataaatatatatatatgtgtgtatatatataaatatatatatatacat

SEQ ID NO: 95102 - DNA, 95 bp, Mus musculus
ccctatttttatttttaaccaagctctttttttttcttgcaagatggaattgatattttattttcttttgaaagaacttggagatatgtacaggg

SEQ ID NO: 95103 - DNA, 70 bp, Mus musculus
atctatgtgcatatgtgtgtatggggatgtgggtacatatgcatgtatgtatgtatatgtgggtgtagat

SEQ ID NO: 95104 - DNA, 76 bp, Mus musculus
ggtccttctgctttgctttggttttgagagaaggtctcactcacactgtcctagagctcaccaagcaggcgaggct

SEQ ID NO: 95105 - DNA, 109 bp, Mus musculus
gttaaagtcgtcccttgcttagggtgctgtgtaaagctgtgaaggcagagtgcacacatgggcctttgcgggtttgcacctttaacattaagcctgtgccagctttgac

SEQ ID NO: 95106 - DNA, 103 bp, Mus musculus
tgcccagtgcttttggggaaacttgggcacacatgctgtctctcagagtgtgtctgcaggctctgtgtggacttgagaacctagctctccaaaaacattggca

SEQ ID NO: 95107 - DNA, 63 bp, Mus musculus
gtctctctctgcctctgaaaatggacttaggtgtcacagttgatttaggggttcaggctagac

SEQ ID NO: 95108 - DNA, 86 bp, Mus musculus; identical to SEQ ID NO: 65018

SEQ ID NO: 95109 - DNA, 78 bp, Mus musculus
cagggctccccagcttctgtccattggctgggtataattatctcttctgtctcagtcagctgcttgttgggcatcttg

SEQ ID NO: 95110 - DNA, 118 bp, Mus musculus
catttgcctgagtgctgaagttgtgggcatgagctgccacacctgataggagtttttaaatttttagtacatttattttgtgtgtacgtgcacacacacacttactcactcacatgtg

SEQ ID NO: 95111 - DNA, 58 bp, Mus musculus
gttttgcctgcatgtatgtatgtatgtatgtatgcatgcatgcatgtatgtgcaccgc

SEQ ID NO: 95112 - DNA, 64 bp, Mus musculus
gggggacaggactagcctgtgacaggcatggcctctgtacagtgtgaggtctctgctcttcccc

SEQ ID NO: 95113 - DNA, 79 bp, Mus musculus
gaaaaaaggatagacgggagagatggctcagcagttaagagcactgactgctcttccagaggtcctgagtttgattccc

SEQ ID NO: 95114 - DNA, 117 bp, Mus musculus
tcctgcatgcagggcacacagactcctgagtgtggctatcttaggccaggtcccagcaggcttctttagcctcagagcagcagaggattctggttgctgtgggcgctgagtgtgggg

SEQ ID NO: 95115 - DNA, 104 bp, Mus musculus
ggccttgctgtaagtgctcgctccgagtgttcaagcccagagacgtgagtgaggtcaaactcccctgtgcacagtgggagccttggtacttgcatgaaacagcc

SEQ ID NO: 95116 - DNA, 109 bp, Mus musculus
gttttggcctcagtcagactgtttgcttctagccagatcatgcaactgtttattgagatagtaactatatttaattatttggctgaactatatctacagaggtctatgc

SEQ ID NO: 95117 - DNA, 80 bp, Mus musculus
ctctccctgactctgtcactgacttggcaggatgaaagcaaccaacccaagagtctagatggctagagtctatttgagag

SEQ ID NO: 95118 - DNA, 74 bp, Mus musculus
aggctgtggggaggggggtgtactcctgcaggttgcctggtaagtgtctgtcactctcttctaccccaggggct

SEQ ID NO: 95119 - DNA, 58 bp, Mus musculus
gtgtgcactatgggtatggtgtatgtgatctgtgtgtcactgtgtatgtggtgtatat

SEQ ID NO: 95120 - DNA, 68 bp, Mus musculus
gatcacgaaggcagttacccaggacaatggtttctcattgcactctgggtgtgtcagcccttgtgatt

SEQ ID NO: 95121 - DNA, 69 bp, Mus musculus
tgatggggtactgagtgtgtgacagtactcagtctggtgggagtactgagtgtattgagtattgagtga

SEQ ID NO: 95122 - DNA, 73 bp, Mus musculus
ttcatgcctgttatagagaggccggaagaatgaccatatcagagtttcaggcttctctctgtctcactgtgaa

SEQ ID NO: 95123 - DNA, 74 bp, Mus musculus
cagacaagtgaaactgggtgtcagcacactgcgtggaccgaaagtagcaggttcattgttgacctcggtgtctg

SEQ ID NO: 95124 - DNA, 99 bp, Mus musculus
agaacggtgtggcagactggagaaatgacttagcgattaagagcactgactgctcttccagaggtcctgagttcaaatctcagcaactacatggtggct

SEQ ID NO: 95125 - DNA, 59 bp, Mus musculus
ggaggtcagtgaagactgtgtcctgacctggggtcagccgcttgctactgctcatctcc

SEQ ID NO: 95126 - DNA, 83 bp, Mus musculus
gtaaactcaggattttggttccctttaaagcctagctggagagctggctctagagtgagagcacagaggattttccagaggac

SEQ ID NO: 95127 - DNA, 90 bp, Mus musculus
ctgaggtttaactagacatttagttcatcttaaatgtcctctgctcttgtaacattgaattggattaatcagtgctggtctgactctcag

SEQ ID NO: 95128 - DNA, 97 bp, Mus musculus
gaggaacccccccaaaccaaaagcgctctcaggggcaggagcctaaagaaaccaacctcacttctctgtgtgattgctgcctgcggggtgtgacctc

SEQ ID NO: 95129 - DNA, 134 bp, Mus musculus
tgtatatgtgtgtatagcagaatgtctgcatggacatttgtttgtgtgtatctgcatgtgtgtgtgtgtgcatgtgcatgtatctatgtgcctgtatagacatgtttttatgtgtctgcatggatatgtgtgca

SEQ ID NO: 95130 - DNA, 88 bp, Mus musculus
ctccataattaacccacagagcttccagaatgctgtgattactgccagcccttctgtgtgtctgtctgtctgccttttatttatggag

SEQ ID NO: 95131 - DNA, 114 bp, Mus musculus
agtctaacagcaaaagacccggataacaggattccactcaagacagtgtccacaggaggccgctggggggctctgagcatggagtgagtaaaggaggtgggggcgactgagagt

SEQ ID NO: 95132 - DNA, 60 bp, Mus musculus
ggagctgtggtcccagccgacactgtgtgtcagaacagagtggtgactgtccacccatcc

SEQ ID NO: 95133 - DNA, 83 bp, Mus musculus
ggagtcaggttacaaggcagagaggcctgggtcctaaggctccaagctctttccagagtctctcagtcagcctgtgtccagat

SEQ ID NO: 95134 - DNA, 93 bp, Mus musculus
gggcttcttgtttcctcctcagcctctctctctcacatggaattggctcctctccgaggtggcatagctctgaacaaggtctttggggctgag

SEQ ID NO: 95135 - DNA, 105 bp, Mus musculus
tatgtatatacacacacacatatatacatatatatagtgtgtatatgtatatctatatacatatatgtgtgtgtacatgtatatgtatgtgtgtgtagatacatg

SEQ ID NO: 95136 - DNA, 73 bp, Mus musculus
gtgcatgtgtgtgtttatgtgtcgtaaatatatgtgtttatatattgtattgtacatatatgtatatatgtat

SEQ ID NO: 95137 - DNA, 115 bp, Mus musculus
tttcatgttgtcataaaacaaatttatcacaagcccttcagagttgtttgtttgtttttgacttaaagtgctctaaaatgattatcggcttgtcttttttgttctgtgagtgagg

SEQ ID NO: 95138 - DNA, 102 bp, Mus musculus
agagcacacagctccctgtccctgtccactcacaggaacatcggtggcaagccttgaaaaggtcactgaagagtgggaccagagggatgtaagcctagctct

SEQ ID NO: 95139 - DNA, 83 bp, Mus musculus
agcacccttgttcatgcagagctagagagaactatatttctcactagactgtgagttctgtctgtatgtctgtccacagtgtt

SEQ ID NO: 95140 - DNA, 81 bp, Mus musculus
gtctctctgagtcactgagtaaggccccaggttctgccaactgaacaaagtaaccctactgagttaggctcagcggaagac

SEQ ID NO: 95141 - DNA, 76 bp, Mus musculus
tcagtgtctgtctctgtgactcctctaaggctgtcatgctcagcgttgggtgtggctgtggacatggtgaccctga

SEQ ID NO: 95142 - DNA, 63 bp, Mus musculus
gggcttggccagggtgtgagggagatggcgatgaggtctctccctccatctcacagaccgtcc

SEQ ID NO: 95143 - DNA, 117 bp, Mus musculus
gtaagagccagaggcccaggacacctgcttcaaggccaaaggccactggctgagttctggtcttcatgactggtctttggatgcaagcctgaggtgagggcttggtggggttcaggc

SEQ ID NO: 95144 - DNA, 76 bp, Mus musculus
tgtacacctagtatgtgcacggagatgggtgtttgttagtgtgcatgtctagtgtgtatgtagagatgggtgtata

SEQ ID NO: 95145 - DNA, 87 bp, Mus musculus
ggcctccagtggtgctcaacggtggctccccagcatgagtgggaagcccttcccacccagtcaccgtctctgagtgttcgggatgcc

SEQ ID NO: 95146 - DNA, 107 bp, Mus musculus
tttggggcacctggcccccagccattgttcagtgatatataacacagtgtggacagtgagctcacccagggccccgaagactctgtgtaagctgctacaccattgtg

SEQ ID NO: 95147 - DNA, 70 bp, Mus musculus
ggtgtgagacttcagtgagagcagaggccctgagtttatactcttatctctcatcctgtcctctctcatc

SEQ ID NO: 95148 - DNA, 104 bp, Mus musculus
tgtgtatatgtgtctctgtgtctttgtgtgtcggtgaatgtgtgtatgtcatatctagacatgttatatatgtatataacaatacatcagatattattttgaca

SEQ ID NO: 95149 - DNA, 85 bp, Mus musculus
gatggtgccagtgacagctactccatgaggtctggggagaatggtgttgatggtcctgatggagagttagttcagggcctggttc

SEQ ID NO: 95150 - DNA, 68 bp, Mus musculus
gtgagtcactgcctgtcagcctcactggaacatgcttttgtggtgtagcaacacaatcgatggctcac

SEQ ID NO: 95151 - DNA, 93 bp, Mus musculus
ttacatctactaggctggtcacaatcttttgatcctcctgtctctgactctcaggcactaggattacaggcatgtaccactatacataagtga

SEQ ID NO: 95152 - DNA, 91 bp, Mus musculus
gtctatgtgtgtgtacccagacaggcttacatgtgtgtatgtgtgtctatgtgtgtatatgtctgtgtgtgactgtgtgtgtgtgaatgac

SEQ ID NO: 95153 - DNA, 84 bp, Mus musculus
gtgcatgcgtgtgtgtgtgggtgtatgtgcgcgtctgtctgtctatgtgtgtgtctatgtgtgtctatgtatgtatgtatgtat

SEQ ID NO: 95154 - DNA, 73 bp, Mus musculus
cagacatgatcctgcaggcagttttcactacccaacccaacaccagcagagactctgtctgtctgtctgtctg

SEQ ID NO: 95155 - DNA, 103 bp, Mus musculus
ggaaagggtgaacacaagtcaggaaggctgagtgagaagactgtgcccaggcaacattaaggagcttagctctgcctagtgactgtatagacgaccggcagcc

SEQ ID NO: 95156 - DNA, 67 bp, Mus musculus
cagtcttgattgaccaacactgtggtgtctccacatggctcatgccacactgtgtctctcagttctg

SEQ ID NO: 95157 - DNA, 116 bp, Mus musculus
gtaaccagagggagccacagtccagagtcagtaaggtcacccagagagagatgtgtgtgtgcacagggatcccagagcagccgctgctgaagtgtgtggagcacagggctggtgac

SEQ ID NO: 95158 - DNA, 77 bp, Mus musculus
ccagcatctttgctacgaccccagctgagccagtactatgggacactctcacactctgtttctgttgagtagcctgg

SEQ ID NO: 95159 - DNA, 62 bp, Mus musculus
tgtactgagtggctgagtgggtggctcccgccacatgctagtgccagctgcaactcagtacg

SEQ ID NO: 95160 - DNA, 94 bp, Mus musculus
tcactttctgattatgtactagagaaaactagtccagtaaaatttaatttttaaattaaatttttgggggtttttttgagactgtctcacgtga

SEQ ID NO: 95161 - DNA, 88 bp, Mus musculus
tcatgtagaacagcttgtggtgtggaaagttgtgtggagagggaggtcacatggaagatcaaagtgcgccagtcaagtttctcattga

SEQ ID NO: 95162 - DNA, 87 bp, Mus musculus
gtcatatgtcatttacatactatttgaaatgtcaggtgtaacttagagaattttgaatgttttgtaatctaaactgttgcatgtggc

SEQ ID NO: 95163 - DNA, 89 bp, Mus musculus
ttgtccatggtgatctgataggatgcatgggacaatttcaatatttttgtatctgttgaggcctgttttgtgatcaattatatggtcaa

SEQ ID NO: 95164 - DNA, 67 bp, Mus musculus
gggaagagtctctcacacacacatgagctctcacaagacctcagtggggagggcacatgtttttctc

SEQ ID NO: 95165 - DNA, 67 bp, Mus musculus
gtgagagagagggagggagagagagagagtatgtgactgtgtctgtctatcttgtctgtatattcat

SEQ ID NO: 95166 - DNA, 112 bp, Mus musculus
tagtctgaacaggaaatcaatatttcttcttttgaacacgtggagagtcattctcactgacaaattcgcgtttcaaaagagaaaaggaagaaaagaaaatccttgctctcta

SEQ ID NO: 95167 - DNA, 91 bp, Mus musculus
aagcagaggaacaggaaatgacagaaaactactgaggtctctacaatgtgcactgtaactcagaggctgtctctgtcaaagatgtgtgttt

SEQ ID NO: 95168 - DNA, 87 bp, Mus musculus
tcttcttgaccaaggtatcattgagtagagagttgttcagtttccacgtgaatgttggctttctattatttatgctgttattgaaga

SEQ ID NO: 95169 - DNA, 86 bp, Mus musculus
gtccatggtgatctgataggatgcatgggacaatttcaatatttttgtatctgttgaggcctgttattgtgatcaattatatggtc

SEQ ID NO: 95170 - DNA, 145 bp, Mus musculus
tacatttagattttacattcacacatatatgtgtatgtataaatatatatatgtatgcattgtatgtgtatatatatatgtgtgtgtgtatgtatctatatgtatgtataggtatgtaatatatacccatatatatatatacata

SEQ ID NO: 95171 - DNA, 94 bp, Mus musculus
ctgtgattgtttatatctgcagtgaatacagacttttcattggctagggcacaatgacataaagttctgaatttcatgttctttcttttcacag

SEQ ID NO: 95172 - DNA, 69 bp, Mus musculus
tatacatgtatgtatatatgtatatgtgtatatatgtatgtgttatgtatgtgtatgtatacatgtata

SEQ ID NO: 95173 - DNA, 85 bp, Mus musculus; identical to SEQ ID NO: 57470

SEQ ID NO: 95174 - DNA, 80 bp, Mus musculus
tatatatgtgaatgtcatattgcagctgggcatatacatatatatatgtatgtatgcatatatgcacatatatatatata

SEQ ID NO: 95175 - DNA, 98 bp, Mus musculus
aaatttataagaatgtgtgacaagaaacagaacttagagagcactggggttgctttttttttggtatttttattttgtcaagcatactttttaaattt

SEQ ID NO: 95176 - DNA, 77 bp, Mus musculus
atatatttacaaatatgtacatatatgtatatatatgcatatatatgtgtgtgcatgtgtgtgtgtatgtgtgtgtg

SEQ ID NO: 95177 - DNA, 85 bp, Mus musculus; identical to SEQ ID NO: 57439

SEQ ID NO: 95178 - DNA, 72 bp, Mus musculus
atgagccccagggtgagggatttgatggagacatcccattgagtcttccaaggtctctcactctctgcttat

SEQ ID NO: 95179 - DNA, 66 bp, Mus musculus
gacagtgctgccggggatgttctgcccttagggttcactcagggtcactgtgtctggctttaagtc

SEQ ID NO: 95180 - DNA, 80 bp, Mus musculus
gtcacaggtatttacatgcatgcagggccagaaatatttcaatttaaatagatctgactgctattgaaatcactgtgtac

SEQ ID NO: 95181 - DNA, 112 bp, Mus musculus
ttcccaagattgactttaattaatcctgatatcattctctcataatttattctgttaaaaatttaatggtgagatctggagaaatggctcagggtgtcaggactcttgtgaa

SEQ ID NO: 95182 - DNA, 82 bp, Mus musculus
tcacatatttgaggtgcattgactttttttatttgaaaaacatttctctgcatggaaggttttatgtatatcagataggtga

SEQ ID NO: 95183 - DNA, 96 bp, Mus musculus
gtgcaacagagctcttacatataaatgagcaacatccccttcaggagtcctcagggtgtctgtctgtgtgttcctatgtgattggtctggaagcac

SEQ ID NO: 95184 - DNA, 83 bp, Mus musculus
agaagaaaaaagtagaggagtggaggagtgtgtttattattttgctcattgtttcatccaagtctctctgcctcagtctgtct

SEQ ID NO: 95185 - DNA, 79 bp, Mus musculus
gactggggtcagtgctatagcagctgatggaggtaagcactcaagagctgttgagggttcatgctgaaagccactagtt

SEQ ID NO: 95186 - DNA, 78 bp, Mus musculus
cacacatatatatgtgtatgtatgtatgtatgtatgtatgtatatgtatatatgcatatgtatacacgtatgtgtgtg

SEQ ID NO: 95187 - DNA, 88 bp, Mus musculus
gcagctttgatctgtatgtatgtatatatgcatgtatgtatgtatgtttatatgcatgtatgtatatatgtatgtatctccctattgc

SEQ ID NO: 95188 - DNA, 102 bp, Mus musculus
tctttggaaagtaaaacgaaacagactagatgtgaggaagctgagtgaacactgagtgggtgattaacatgtctgttgagtctggttttcttcttcactgga

SEQ ID NO: 95189 - DNA, 85 bp, Mus musculus; identical to SEQ ID NO: 57439

SEQ ID NO: 95190 - DNA, 101 bp, Mus musculus
tcagtcagagatgaggatggttgaggaaagaatttttattctttttctagaaacaaagtcagaacatggataggaccattgttagccagcaattcttctgg

SEQ ID NO: 95191 - DNA, 65 bp, Mus musculus
ttttctcacacagagcacactctgtgtcagtcaccagtctatactcagagaattgtgtgggaaaa

SEQ ID NO: 95192 - DNA, 100 bp, Mus musculus
ggactcctgggtcctggcacccacccgtagaaccgaccttgcggggccttcgccgcacacaagctcgtgtctgtgggtccgtgtcgggggctcaccatcg

SEQ ID NO: 95193 - DNA, 139 bp, Mus musculus
gtctcccatcaatccatctgtcaatctgcccacctgccgcgccccccgggctgaggtaggaggttgtatagttgaggaagacacccgaggagatcactatacggcctcctagctttccccaggctgcgccctgcactgg

SEQ ID NO: 95194 - DNA, 131 bp, Mus musculus
cctctggggaaaagggtttttctggtccaccatagctacactgccggcctctgggtccctgagaccctttaacctgtgaggacgtccagggtcacaggtgaggttcttgggagcctggcgcctggcccagc

SEQ ID NO: 95195 - DNA, 76 bp, Mus musculus
gatctgataggatgcatgggatagtttcaatatttttgtatctgttgaggcctgttttgtgacctattatgtggtc

SEQ ID NO: 95196 - DNA, 103 bp, Mus musculus
atgtatgcatatttgtatgtctagatgtctgtatgtaagtatgtatgtatgcatgtgtgtatgcatgtatgtatatgtaatttatcagccttgtacatatcta

SEQ ID NO: 95197 - DNA, 78 bp, Mus musculus
atgtttctagattcagtttgtcaggttgtattgagtatttttaaataaatattcatgaggaaaattgatctgaaacat

SEQ ID NO: 95198 - DNA, 85 bp, Mus musculus
tgatctacctgtctgtcaatgtaccaataaaatgcagtttgtatttcaatttttctgtagtatagcttgaggtcagggatggtca

SEQ ID NO: 95199 - DNA, 104 bp, Mus musculus
gtgaatgtatgcatatttgtatgtctatatgtctgtatgtaagtatgtatgtatgcatgtgtgtatgcacttatgtatatgtaatttatcagctctgtacatat

SEQ ID NO: 95200 - DNA, 108 bp, Mus musculus
gtcctctatcagatgtaatgtttgtaaagatattttcacaatcagtagacattttcttctattgacagtgttcttttctttacagaagctttgcaattttatgaaggc

SEQ ID NO: 95201 - DNA, 108 bp, Mus musculus
tttctggcttctcttggataagaattttacagaattttttttttaaactggaccgattagaaaagagttagtgttgttttcttttaagggaaggtgcacatctaggga

SEQ ID NO: 95202 - DNA, 109 bp, Mus musculus
ttatcttggccaaaagtatataattatagtcattatttataaatcatgattgaacacagttatcatttacagtgatgtcctgagtcatatatttagtcattatcgataa

SEQ ID NO: 95203 - DNA, 119 bp, Mus musculus
tatgtatataaatatgcatatgtatgcatatttgtatgtctatatgtctgtaagtatgtatgtatgcatgtgtgtatgcgtgtatgtatatgcaatttaacagctctgtacatatctac

SEQ ID NO: 95204 - DNA, 85 bp, Mus musculus; identical to SEQ ID NO: 57439

SEQ ID NO: 95205 - DNA, 85 bp, Mus musculus; identical to SEQ ID NO: 57439

SEQ ID NO: 95206 - DNA, 127 bp, Mus musculus
actcccttgcgcttccattcccttgagggttgagtgcatcatatctgaatgaacagactcagcagtcctctatgtgtggggagggtctcatatcagctgatgtatacagcctgtttgggagtctagt

SEQ ID NO: 95207 - DNA, 91 bp, Mus musculus
tgggaagttttctaagtactgggagagctgtctctttcactcactgtacaagctttttgggaccttcttttactaggaaactgcagtccta

SEQ ID NO: 95208 - DNA, 82 bp, Mus musculus
gggaagtgccggggaactgtctcactgtctgtgcggtacctctttaatccgttgtccggagggtggtcgtacctggtgcccc

SEQ ID NO: 95209 - DNA, 91 bp, Mus musculus
agttagttgacctcctgtaaggtaacttgtgggaatcagcataaattgtttttcatattaaaagtttcttgcttcatatggttagctaatt

SEQ ID NO: 95210 - DNA, 111 bp, Mus musculus
gtcccactgcttagcacatggcccacgtttctttacttacacaggttcattatattaatgaatttatttagtctgagtcctatggcttgtaatgtactatgcatttgggat

SEQ ID NO: 95211 - DNA, 67 bp, Mus musculus
tgggaggggtcgggctctggggtgaggaagagttcagtaattttttattcttcattggcagctccta

SEQ ID NO: 95212 - DNA, 85 bp, Mus musculus; identical to SEQ ID NO: 57470

SEQ ID NO: 95213 - DNA, 70 bp, Mus musculus
atgtaggaagagagtgagcagtcttgtctactccctgattgtagtgggattgcttcaagtttctctacat

SEQ ID NO: 95214 - DNA, 71 bp, Mus musculus
tgtgtgcagtgagagttgtgggcatggattcaggaaagtaatcctggagggcaatgctgtctgctgctaca

SEQ ID NO: 95215 - DNA, 108 bp, Mus musculus
ggtacgaactcctcttgggatgatttggctaaaaatatgaagcaagaaagttttcatatgaaaacaaccttgagtgtttcctacaggttacgtgagaggagcccaact

SEQ ID NO: 95216 - DNA, 140 bp, Mus musculus
tgtgtgtgtatatatatatacatacatatacattatacatatacatatatatgtgtgtgtgtatgtgtatatatatatatatatatacacacatatataaacgtatacatatatgtatatgtatacatatatgtatatat

SEQ ID NO: 95217 - DNA, 64 bp, Mus musculus
tctaggctagggatagtaggatgtgtacactttttttagatatacattttcttctggtcctaga

SEQ ID NO: 95218 - DNA, 103 bp, Mus musculus
catggtgatctgataggattcatgggacaatttcaatatttttgtatctattgagacctgttttgtgaccagttatatgatcaatttcagagaaggtaccatg

SEQ ID NO: 95219 - DNA, 64 bp, Mus musculus
tgtgtgtgtgtttgtgtgagcatatgtatatgtatatatatgcaaatacacttatatacatgca

SEQ ID NO: 95220 - DNA, 94 bp, Mus musculus
gtggtatagctgaccttgaggtagatcaatttatatttttctgaagaacagtccttgtatattccactatgtctagagaagtttgtagtgccac

SEQ ID NO: 95221 - DNA, 103 bp, Mus musculus
atcctgggatcctggaatcctacgatcctcttagtgttacagcatctggaagtggtgtctcctctgggtaccatgggtctgtctggtgtgttcaaaacgaagg

SEQ ID NO: 95222 - DNA, 85 bp, Mus musculus; identical to SEQ ID NO: 57439

SEQ ID NO: 95223 - DNA, 115 bp, Mus musculus
agggctgagccctgcttacagacattggacatttttgctgatatggattaatgtacatagtttattaatttttcttcagccagggaggtccgatgagctctgggctttgacacct

SEQ ID NO: 95224 - DNA, 85 bp, Mus musculus; identical to SEQ ID NO: 57439

SEQ ID NO: 95225 - DNA, 68 bp, Mus musculus
tcaggaagtgacatttttttttttccttaagaaccagctgttctgtgaagatcaaaatgttttcctga

SEQ ID NO: 95226 - DNA, 67 bp, Mus musculus
acacagcagcctaggtcctgtgacctgactgtcacagtctgtggctcagagcctatttcttttgtgt

SEQ ID NO: 95227 - DNA, 99 bp, Mus musculus
ggggatggggattgctggatggggtgtgcaggcaatggtggctgtttgacaaggctatcagagaagagtgactacacagaatcttggactcccatcctt

SEQ ID NO: 95228 - DNA, 89 bp, Mus musculus
gatcagccttagtgatcagataggatccatgagataatttcaatatttttgtatctgtggtggcctgttttgtgagcaattatatggtc

SEQ ID NO: 95229 - DNA, 83 bp, Mus musculus
ttgtagatgccagcaagaacttgctgacaggagcctgatataggtgtgtcctgtgaggctctgtcagtgcctgacaaatacag

SEQ ID NO: 95230 - DNA, 119 bp, Mus musculus
ccatgtgcatatacttctgtggcataaggaattagtcaataaccatccagaagcattgaatttatatgtttctaatcatatcaggttttgccaatttctcatgcaaggaacacagtggc

SEQ ID NO: 95231 - DNA, 100 bp, Mus musculus
ctatgttttgaatacctgatgtattatatgttatattatattatgttattatatattatattataacatatactgtattatatgttataaattttcatgg

SEQ ID NO: 95232 - DNA, 85 bp, Mus musculus
ggccatggtggtctgacaggatgcatgggacaatttcaatatttttgtatctgttgaggcctgttttgtgaccaattatatggtc

SEQ ID NO: 95233 - DNA, 106 bp, Mus musculus
gccttactccatggtgatctgataggatgtatgggacaagttcaatatttttatatctgtcaagtccggttttctcaccaattatatcatcagttttggagaaggt

SEQ ID NO: 95234 - DNA, 80 bp, Mus musculus
acttctgttagtttcactgtgtctctgtttagtttctgtttccaggatctgtccattgatgaagagtggggtgttgaagt

SEQ ID NO: 95235 - DNA, 79 bp, Mus musculus; identical to SEQ ID NO: 72631

SEQ ID NO: 95236 - DNA, 63 bp, Mus musculus
gcagcttagttgtcatgtgggccctgtaacaactggagcagagcctgtctctgactctgttgt

SEQ ID NO: 95237 - DNA, 85 bp, Mus musculus; identical to SEQ ID NO: 67887

SEQ ID NO: 95238 - DNA, 88 bp, Mus musculus
gaaatgttgaatgtgttcactgatatcacactctttttctgtctaaagaaaaatgtgtggttcttaactcatacaaaaattctgcatt

SEQ ID NO: 95239 - DNA, 85 bp, Mus musculus; identical to SEQ ID NO: 57470

SEQ ID NO: 95240 - DNA, 101 bp, Mus musculus
actcataggactccatgaacatgcccttttctaaactgctgctaaggacagtgtagagtgaggccagagaagggaaatacaattgctctggattactgagt

SEQ ID NO: 95241 - DNA, 85 bp, Mus musculus; identical to SEQ ID NO: 57470

SEQ ID NO: 95242 - DNA, 85 bp, Mus musculus; identical to SEQ ID NO: 57470

SEQ ID NO: 95243 - DNA, 85 bp, Mus musculus; identical to SEQ ID NO: 57470

SEQ ID NO: 95244 - DNA, 63 bp, Mus musculus
acttggccaatcagactggctagcgaaccaggactctcctgactggtcatactgaggtcatgt

SEQ ID NO: 95245 - DNA, 68 bp, Mus musculus
accagatactgagacagtctgtgaatcacttgggcaatttgctttgtgaagatctccatgtctctggt

SEQ ID NO: 95246 - DNA, 88 bp, Mus musculus
cataaatagaatgatagggagattgactaaaaagtgtctataaatgacccatcttctctgtttctctctatctctctctgtctgtatg

SEQ ID NO: 95247 - DNA, 75 bp, Mus musculus
tctgtatatctgtgtgtatatttatatctgtgtctactgctagatatagatgatagatatagagatagatttaga

SEQ ID NO: 95248 - DNA, 83 bp, Mus musculus
tctgtatctgtatgtatatctatatctatatcatatatacctagcagtagacacagatataaatatacacacagatatacaga

SEQ ID NO: 95249 - DNA, 76 bp, Mus musculus
gtatatctgtgtgtatatttatatctgtgtctactgctaggtatatatgatatagatatagatatacatacagata

SEQ ID NO: 95250 - DNA, 80 bp, Mus musculus
ttcctcaggcttctctccatttccatccctgtaattctttcagacaggaacaaatatgggtcagagaagtgactgtggaa

SEQ ID NO: 95251 - DNA, 85 bp, Mus musculus; identical to SEQ ID NO: 57439

SEQ ID NO: 95252 - DNA, 85 bp, Mus musculus; identical to SEQ ID NO: 57439

SEQ ID NO: 95253 - DNA, 104 bp, Mus musculus
tgacaatgcattcagatgaaggagagtttctatgattgaaacaaatgtactaagttgtgtaggaattatactaactcttcattaattatgaatattattgctca

SEQ ID NO: 95254 - DNA, 102 bp, Mus musculus
ggtgctaagctgcagaaatgatgactgaggagattgatgtgatgcacaccaatgcatccctgtgtcactctcactgatttttgatctactgagtgctttgcc

SEQ ID NO: 95255 - DNA, 83 bp, Mus musculus
ttctgtggatctgaggacagctgcagtacattatatatataatgattcatagatataacatgtggttgttacacttccaggaa

SEQ ID NO: 95256 - DNA, 66 bp, Mus musculus
tagcctgctgtcttgtgttccagacactggcagatatgcagatggtgtaccagtgcagctaggctg

SEQ ID NO: 95257 - DNA, 64 bp, Mus musculus
gtactgtctttcctgatgttgctgtatcagaccaggtgatacagtggagtagtgaaggctgtat

SEQ ID NO: 95258 - DNA, 118 bp, Mus musculus
gggtttttctgtacttgaccccaaaaagtcagccttagtccctaaatgaaaggaagtatgtaaatcagtagggccagtggggatcctggtactggggagggaggtgcaggacactccc

SEQ ID NO: 95259 - DNA, 95 bp, Mus musculus
cagaccaggtctgtcttgtctgtctgtctgtccgtcctgcagaaatctggagaagcatgacctcagcctgagttctgattaggacaggagggaca

SEQ ID NO: 95260 - DNA, 58 bp, Mus musculus
ccagtacagccactcagactctcagatccttgtgggtcaggagactctgagcttctgg

SEQ ID NO: 95261 - DNA, 66 bp, Mus musculus
gggtgaggaactggacttgtgaatgctttatgcacatggatgaatctcactcacagtatctcattc

SEQ ID NO: 95262 - DNA, 66 bp, Mus musculus
ggaatgggcatgctaggatagagttgcccaggtcactggcactctgtgagtcctcccccatcttcc

SEQ ID NO: 95263 - DNA, 87 bp, Mus musculus
gagctctcacggtccctaattctgagccattttgaccagtattttgctcattgtaaagtgaaactcctcagagcaaggttgagagtc

SEQ ID NO: 95264 - DNA, 115 bp, Mus musculus
gtcattagaggcagactttgaggtttcaaaagcccacagctggcccagtatctctctctgtgtctgaagatcagaatgtaaagcttccagctattgctccaactccaacctgccc

SEQ ID NO: 95265 - DNA, 66 bp, Mus musculus
gtatgtatgtatgtatgtatgtatgtatgtacacacacacacatacacacacacatatatatgtat

SEQ ID NO: 95266 - DNA, 93 bp, Mus musculus
tgggggagctggaagcaagagtatcaacttggcacagtgagggtccctgtaaccctcacatggcctgatgttatatgccagaaagccaggcca

SEQ ID NO: 95267 - DNA, 110 bp, Mus musculus
ctttgagtcaaggtctcaaagagtccagattgtttttgtaattgaggctggccctttgtctcagcctctcacataatatcatgcctggctctttgcttggtttttaagat

SEQ ID NO: 95268 - DNA, 96 bp, Mus musculus
ggctagcctcaagcttacagagatctgcctgtctctgcctctctagttccgggattaaagatgccaggcctagcagtctttcttaaggcccttgcc

SEQ ID NO: 95269 - DNA, 112 bp, Mus musculus
ccaagtactgcattctaagtattagtcactatggccagcttacattgtttatatttgaacatgtgactatcagcatatggttgaccaagggacttgcatagcatagactggg

SEQ ID NO: 95270 - DNA, 87 bp, Mus musculus
cattggctatggctccttttgaagacttgtgaattagagagggatgctttctgatccaactacaccagaggagctgagcacgtaatg

SEQ ID NO: 95271 - DNA, 116 bp, Mus musculus
gcttcttcctggggaactctgggaggcccgcaggctatactgtacttctgtctgcctctccctcacaccagtcatattaagcctcagcctttcaggagttctctcttcagttcagc

SEQ ID NO: 95272 - DNA, 107 bp, Mus musculus
gacctgaggacaaggtgggggtgtcacagagtcaatgagcaagagtcctatttctgcacagaagactgactgctcagtagaggatatcgctctcctggttcttactc

SEQ ID NO: 95273 - DNA, 83 bp, Mus musculus
tgggtacagtgggcttgtgggtcatctctactgtgggtaaaggatggcagaagagacagggctgacaggacaatggccacatg

SEQ ID NO: 95274 - DNA, 133 bp, Mus musculus
ggggtgagaaggcactgtgggcagctgagcacaccctgggcctggggtgggatgcctgagcctgcctgcctgcctgggtgctcccggcctgccaaccctgcccagctaggcccttaatcacatgtgaccacag

SEQ ID NO: 95275 - DNA, 72 bp, Mus musculus
catacgcgcgcactctctctctcatattctctgactaggccatctgagagagaggtggaaatcactgctatg

SEQ ID NO: 95276 - DNA, 94 bp, Mus musculus
agcaagagctttactgtcacactgtgtgcctgtccctaaccatgtccaagcttaatgcattaggtggtatatacatgacattcagctattggct

SEQ ID NO: 95277 - DNA, 69 bp, Mus musculus
tgggagttgtctggttgtacagtagatgatctggcttctgctgactctgtctgccagtgactatgccta

SEQ ID NO: 95278 - DNA, 69 bp, Mus musculus
gtgtgtgcatgtgtgcaagtgcatgtgtatatgtatctgcatgtttatgtgtacatggcatgtgtgtat

SEQ ID NO: 95279 - DNA, 71 bp, Mus musculus
acatgtatgtgtatgtatgtatgtatgtatggtatatgtgtgtacatattacagcaccgcgcacagcatgt

SEQ ID NO: 95280 - DNA, 82 bp, Mus musculus
ggctagtgagtgctgcacagtaagactttgtctcaaaaaaaggtgtgtgggggtgcctagtcttactgcaacttgttatgcc

SEQ ID NO: 95281 - DNA, 109 bp, Mus musculus
tcttggtgaggtgtctgaggttccttctgtgtgtttcttcaggtcaggccctgctgggactatctctgtgtcactcagacttcaggaagaatctgactgtgcagcaaga

SEQ ID NO: 95282 - DNA, 75 bp, Mus musculus
tcacctggggcctcaatgggagttggctacaccccgccacgtggagtgtgcagacagttgagtgctagcaggtgg

SEQ ID NO: 95283 - DNA, 94 bp, Mus musculus
gtgaggctgagacaggtctggggcttctagaagacctacccgcgtgcctttgtctttgtcgctctctcagacaccccaactcctgtttctcacc

SEQ ID NO: 95284 - DNA, 135 bp, Mus musculus
cttggtttgatgatgatcattttgctcagaaactttcctggctggggcttttcagaggcagtgcttgtagtttttagtctagtaataatggatcttgagctaagaggtgattgaaatgcagattagtggggatgg

SEQ ID NO: 95285 - DNA, 80 bp, Mus musculus
agctaagtctttgtttctctgtctgacttggtagctatctcctcagcagctgttgacgtcaacagaaacagagacaagct

SEQ ID NO: 95286 - DNA, 86 bp, Mus musculus
ctgcctgtgtctctcccgctctgtttatacatttgattctccctgcatggtactgaagtggggctccaggaagaaccttctggcag

SEQ ID NO: 95287 - DNA, 70 bp, Mus musculus
gccccagcttctgacaggctttgtgactgacctgagacaggtcaaactggcttccacaggactagtgggc

SEQ ID NO: 95288 - DNA, 122 bp, Mus musculus
cagagatgaggaagtcccagtgtgttttccgttctgactgaacagttcccattcagagcgcactgtgagtctctctgagaaagcctccactgtcacagactaacaggggcccatgatgggaa

SEQ ID NO: 95289 - DNA, 64 bp, Mus musculus
tggtgctcatagggctgcaagcagattcactgtctgtgtctctgtctgtgtctctgtctgccta

SEQ ID NO: 95290 - DNA, 118 bp, Mus musculus
cctctctgttggatgtttaagaaagtgtaggtagggactggagagatggctcagcgattaagagcactgactgctcttccagaggccctgagttcaatttccagaaaccacatggtgg

SEQ ID NO: 95291 - DNA, 72 bp, Mus musculus
tgtctgtgtctgcctgagtgtgtgtgtgtttgtgtgtgtctgtgtgtgcaccagcttatggaggacaggaca

SEQ ID NO: 95292 - DNA, 118 bp, Mus musculus
cgtgtctctaaagactgtgctgattagccatctggtagtctgtctgtctgtcattgtcccatgatggctagggaagatctgtcctggttggcctgagtcacacattggtgggggtggg

SEQ ID NO: 95293 - DNA, 77 bp, Mus musculus
cagcctggctgggacaggggcacagagcagggaccaccctgggctttcctctctgtgtgtgtctcagtccagtgatg

SEQ ID NO: 95294 - DNA, 82 bp, Mus musculus
tacatacatacatatatgtgtatatatatatatgtctctatatatgtatatatgtgtgtatatacatgtgtgtgtgtatgtg

SEQ ID NO: 95295 - DNA, 67 bp, Mus musculus
gtgtgtcgaaggagctggggaggtcctgcctaggtggctgtgcctctgcctctctcccagaatgcat

SEQ ID NO: 95296 - DNA, 97 bp, Mus musculus
gacagtggtgactgaggaggggggctggcctgacatctgtctcactgaacttcagctttccctatgacaattttcccatcccaaaccccactagatc

SEQ ID NO: 95297 - DNA, 63 bp, Mus musculus
tagtcactgttgggtgtctgcacagtgtgctgagccacaggcaagtcctattcacagtgagta

SEQ ID NO: 95298 - DNA, 90 bp, Mus musculus
gagccagcaaaaggaggccaggcagttatacaggacagctgccctggacagggaggctgtctggctgagtggctcagggatgaggggctt

SEQ ID NO: 95299 - DNA, 88 bp, Mus musculus
tctgaacagcgcccctcccactgtctgtgcctgtgagctaagtgttctctactggggcagccagaaagggtcttgcctactgtccagg

SEQ ID NO: 95300 - DNA, 56 bp, Mus musculus
tcgggctgatgggaagcccaggctccaggctgcctgggtccctgtaagcagaatga

SEQ ID NO: 95301 - DNA, 99 bp, Mus musculus
atctgagggccatatccatcccctctctaattaggaaaggtcatttctgtccctctgtcagccttttttggggggtggggagagaagggcactgtggat

SEQ ID NO: 95302 - DNA, 129 bp, Mus musculus
agggcctatggaagaaggccatgctctgatgtcctttgtgggccattgtctctgtctcgctgtctccttggagcctggcctggtttatgcaggaactaccaaagagggcttggtctatgtctttctgcc

SEQ ID NO: 95303 - DNA, 105 bp, Mus musculus
ggcaaagtagaagggtccctgtgtctctatatctcactgtctgatttgaatctagccatctaatccagcatgcggtgcttagcacagggctctgatgtcctttcc

SEQ ID NO: 95304 - DNA, 100 bp, Mus musculus
ccagcctagccacaccctccctgcctgcctgcctgcctgcctctgattaggatgtaggggttggacacctggcaggagatcttgcctagctatctgctgg

SEQ ID NO: 95305 - DNA, 76 bp, Mus musculus
agttctcctaacccagaaaagtagcatgtggtctctgtggaaacaggcacctggcttgtttctcagtctgagaagt

SEQ ID NO: 95306 - DNA, 71 bp, Mus musculus
ggaatgctgggcttacagtgtctgtcattgtgagagctattgctctctcaacctcagtgtaacctagctcc

SEQ ID NO: 95307 - DNA, 63 bp, Mus musculus
agcctgagtgtctgaccacctctgcaggcagctgcatggctgcctcacacagacactcacact

SEQ ID NO: 95308 - DNA, 68 bp, Mus musculus
gtatgtatgtatgtgcgtgtgtgtatatatatatgcatatatatatatacacacacatacatatatac

SEQ ID NO: 95309 - DNA, 81 bp, Mus musculus
acatcttgctaacttcaccccctaacttttttgtatataaaaacagagagagctagggtggatattggaagtcagaggtgt

SEQ ID NO: 95310 - DNA, 97 bp, Mus musculus
gcttgtgcaagagtggtgtctgtccccattttcctatgttccccaatagttcctggctgagtcagaccctcacacactttgccaccttgctcagagc

SEQ ID NO: 95311 - DNA, 88 bp, Mus musculus
gttaaaaacaggaatggccaaaggagctaatgggtaacactcggagtgtcagtgtctgtctgcttctcttgattttagcacctgcctg

SEQ ID NO: 95312 - DNA, 65 bp, Mus musculus
gtggctcagtggggaaaggtgcttgctgtaaacccagtgacctgagttctctctctgagacccac

SEQ ID NO: 95313 - DNA, 56 bp, Mus musculus
tgtgtgtatatgtgtatgtatatgtatatttacacacgcacacacatacacacaca

SEQ ID NO: 95314 - DNA, 69 bp, Mus musculus
gggcctaccatcagtcactctctctgtttctatggagacttgggggcaggtgccagcatgactgtgccc

SEQ ID NO: 95315 - DNA, 70 bp, Mus musculus
tgcagtcatctgtgagcatgcttgctgtgttagtacctgtactgacaacagtgtcagtgacaggtgtgca

SEQ ID NO: 95316 - DNA, 92 bp, Mus musculus
cattcgtgtgtgtgtgtgtgagtgtgtgtgtgtgtcttgggcatggaagtcagggtctcagatatacttgtcaagaatactatcactggatg

SEQ ID NO: 95317 - DNA, 78 bp, Mus musculus
ggccatgcacaggttacgttttctgtcaccctctaactgtcagcactgtagttagacacagagtcatcagtgtatgcc

SEQ ID NO: 95318 - DNA, 75 bp, Mus musculus
agtagggaatgaatgagtgtgtaggttccaaactttgttagtccagtcaccctcacagtcacaatgtttcctact

SEQ ID NO: 95319 - DNA, 116 bp, Mus musculus
tgtacgtgtatatgtacatgcatatgaatatgcacatacatatatataatatgtggatatatgtatgtatgcatgtgtgtacatatgtatgtacatgtgcatgttcatgtatatgt

SEQ ID NO: 95320 - DNA, 78 bp, Mus musculus
tcctgaagcttgttatgtagaccaggctggcctcaaatttacagaggtcaagctgtctctgcctctcaagtgctggga

SEQ ID NO: 95321 - DNA, 112 bp, Mus musculus
ttgggggaggggaggcggggagcggggtttcttctcactcagtggcagagtgtttgcctgaaatactcaaggccctgcctggttcatcccccagccccaccaccaccaccaa

SEQ ID NO: 95322 - DNA, 75 bp, Mus musculus
cttgtgtcaccaccaccgccaagcctatatatatttttcactgtgtgtatctgtgtgtgggtctgtgcacacgag

SEQ ID NO: 95323 - DNA, 119 bp, Mus musculus
gcaggggtttagaaaagagtgacctggggctggagagatggctcagtggttaagagcactgactgctcttccagaggtcctgagttcaattcccagcaaccacatggtggctcacaacc

SEQ ID NO: 95324 - DNA, 93 bp, Mus musculus
caccccccccagtgcgtcagtcagtgcctctgagacaggatggggttcagtagcaccatgcaatgttggggtattgatgacccctgggcggtg

SEQ ID NO: 95325 - DNA, 99 bp, Mus musculus
ggtagggggagggggagggttgagagttcaaggtcattctctgggaagagtctgaggacagggctgggttgaatgagtctcagagctccctactgtgtc

SEQ ID NO: 95326 - DNA, 81 bp, Mus musculus
gacatagccttagggtgtgattcgggggaatttggatgaaatgagatcccaggccactgtctctcactttgagactctgtc

SEQ ID NO: 95327 - DNA, 110 bp, Mus musculus
gcacttgagacgggtccaaggtgaatgtgagcctcagtgtgtgtgtgagtgcgcgcgtgcatgcacacgcatttagcgtgtacataaaggcatctccctctgagaggagc

SEQ ID NO: 95328 - DNA, 74 bp, Mus musculus
gaaacccagacaagggctggagagatggttcagcggttaaaaacactgactgctcttccagaggtcctgagttc

SEQ ID NO: 95329 - DNA, 81 bp, Mus musculus
tgtgactggggagacaggagaatctcttgctaggactaggtagggacaggaggaagtctctctatgtctcactccattgca

SEQ ID NO: 95330 - DNA, 73 bp, Mus musculus
agccaccctgtctgtgtctgtccgacgtctaggaccttttggtgtgggcttcggccagatgtgacacttggct

SEQ ID NO: 95331 - DNA, 74 bp, Mus musculus
gctgtgtttgtcactgtggctgtgacaaacacctgacagaagttgctcaagagctacagtggggaaggcacagc

SEQ ID NO: 95332 - DNA, 114 bp, Mus musculus
cttgggatgtctaagaaagcaaactgggcaagccaggaagagcaaactaatgagcagctgtcctctgtttctctctggtgtctgcttcagttcctgccctaatttcattccctg

SEQ ID NO: 95333 - DNA, 113 bp, Mus musculus
gctgccccctccgaggaaggtgaggctgcaggtgctggccctggtgttgctgggcatgcccacaactctgtctgtctgtgtttctgggattggacctttaaaggaagggaagc

SEQ ID NO: 95334 - DNA, 75 bp, Mus musculus
ccctctggcacctagtggactcttctaagaaacagaagtgtgtctgcagaacagaggagcctgagtggggaccag

SEQ ID NO: 95335 - DNA, 107 bp, Mus musculus
gttcagaggtgaggcacctggtccccgagagctctgttctctctgtggatcagttcatggatggactcatagtttggtgggttttgggaaaacagttgcaagccctc

SEQ ID NO: 95336 - DNA, 94 bp, Mus musculus
ggctggcactccctaggggactctgtgttgttagggcagtgaagcatcaggcctgacagttaagagtgggcagattcccgtcgcaggcacagcc

SEQ ID NO: 95337 - DNA, 107 bp, Mus musculus
gtggaggtggactaggctgcctgcattctagcacacagtctgtctgtcaccctggggcgggtgacatcctgaggctgtgcggctaaggtacaagaggtcaccttgac

SEQ ID NO: 95338 - DNA, 64 bp, Mus musculus
gggagttagagagagaggtggtgggggaagaggggacccctctggctcactctgtctctccctg

SEQ ID NO: 95339 - DNA, 118 bp, Mus musculus
gcttgtctctctctaatgtcaaggaaggtaatagatgcacaggtggacaggaatgatgtatgggcccaggttccttccatcttgttgctcctttggttccctagggatcaagactggc

SEQ ID NO: 95340 - DNA, 93 bp, Mus musculus
cccaggctgggaagggaggggaaagagtgaaggggagagatagaagataaagacagaaggctcactcacagtctggctcactcttggtaaggg

SEQ ID NO: 95341 - DNA, 81 bp, Mus musculus
cccctgtccctgtcttcctgggtcacagccatctctgccatccatccagcagctccttcccagacagcagacagaggggac

SEQ ID NO: 95342 - DNA, 85 bp, Mus musculus
acagacacagttgccacaataggagccagggctcaggggatcctttccttctgtccctgtgtccctctgtccctctgctggatgt

SEQ ID NO: 95343 - DNA, 66 bp, Mus musculus
agggcagccatggcagttactgtcctggtgtggacagcgagcagtgactctccgtgtgtctgtgtt

SEQ ID NO: 95344 - DNA, 59 bp, Mus musculus
cgtaggtcctgtgcttcctctcctggttctggaggacacagagagcacagagagtgacg

SEQ ID NO: 95345 - DNA, 83 bp, Mus musculus
gagacaggtggctctctgaggctcactgacaggccagcttaacctttaccagttagcttcaggacagttagagaccctgtctc

SEQ ID NO: 95346 - DNA, 106 bp, Mus musculus
gcgtggggggcaaagggtcaaatggtcaggctcagtggctcaggggctcagtggctcagtggctcagtggcaagtgcctttacccacacagctacctcagaggcac

SEQ ID NO: 95347 - DNA, 62 bp, Mus musculus
agggccttcaggctaagaatctgacttgtctctgacattgtcagtgtctgagaagggctcct

SEQ ID NO: 95348 - DNA, 65 bp, Mus musculus
catgtatgtgtgtgatgtatgtatgtatgtatatatatgtatgtacctattacgacacccatatg

SEQ ID NO: 95349 - DNA, 115 bp, Mus musculus
tgaccatctggcacagtgtatgtgtgggcatcctggcatgacagagtctgcactctctgtgacaccctcttctcctgccctagtccagctgctgctgtgagagaccagaggtgca

SEQ ID NO: 95350 - DNA, 108 bp, Mus musculus
gtatatgtgtgtatgtgtgtgtacatgtgttcttgtgtatatgtgtgtatatatgtgtgtatgtatatatgtgtgtgcatatgtatggggtggtgtcatgaggcactc

SEQ ID NO: 95351 - DNA, 71 bp, Mus musculus
tgctgggcagaggcgcatgagcgtgcgcgcacgtggatgcacacacacgcacacactccctctctctggta

SEQ ID NO: 95352 - DNA, 109 bp, Mus musculus
gggcacttgcaggttgactcttgagccttgtcacgtgtctctgtctctgttcttgaagggcagcttttctgatgctcaggtttgtcttacatttcccatgctccagccc

SEQ ID NO: 95353 - DNA, 82 bp, Mus musculus
ctgcattaaaagtgtgtgccaccatgcctagctgttccagtttttgacctcggcctggctggctggctggctggctctgcag

SEQ ID NO: 95354 - DNA, 96 bp, Mus musculus
gaggcccttggtcttttctggctgagttctgcaccaagcaggtgtgggtgaggaattgctttggctgtgggatgaactggggatgtggaggggctt

SEQ ID NO: 95355 - DNA, 96 bp, Mus musculus
ctacatagcgagtctgaggtcaacccaggctagctgtatgtgatcttccctcttgtcacatgagagtctggtaatgttgagtgtcatcctccgtag

SEQ ID NO: 95356 - DNA, 115 bp, Mus musculus
gctgtccattcatatggaagacactcccactctcagaattttttttagtgttattttttaattatgtatttatggacacatctgagtttgggtatgtacacatgaatatgcatgc

SEQ ID NO: 95357 - DNA, 61 bp, Mus musculus
gcctctcagagctgtgtgtctatctgactgcttatcccagcagaccacacacatccggggc

SEQ ID NO: 95358 - DNA, 68 bp, Mus musculus
ctctccctgcctgtctgggtcactcgattatgctacagcacctgaaatgactggagaccaagggaggg

SEQ ID NO: 95359 - DNA, 135 bp, Mus musculus
gcgttgcatgtgctgggtccccatgagcgccgccgcttccttcccagagccctcgctgtgtgcctgtgtccctctgctgcatgaagactcgcgttgtctcctgactggtctctgctgcaaggtcgcagaactagc

SEQ ID NO: 95360 - DNA, 72 bp, Mus musculus
tgtggaacctgtctgtgtctgtcagtctgtgggaagagcaaggtgactggggtaggaccagagtgttcctca

SEQ ID NO: 95361 - DNA, 105 bp, Mus musculus
tgtgagtgtctgtgtgtgtgtgcgcacgcgctcagcagctaagagcactgactgctcttccagaggtcctgagttcaattcccagcaaccacatggtggctcaca

SEQ ID NO: 95362 - DNA, 88 bp, Mus musculus
cacgccttccccgagacttagggcgttcatccggctcgctgaacagtgtctctctgtctctgcgtctctgtctgggagcatgtgtctc

SEQ ID NO: 95363 - DNA, 60 bp, Mus musculus
gcacagctgtctgtctgtctggccccagtggggggaaaggagagaagagcagtgggaggc

SEQ ID NO: 95364 - DNA, 117 bp, Mus musculus
tgtacagtcatacccagcttcgatgacatcacacccggctctgatgacatcacacccagcttcgatgacatcacacccggctctgatgacgtcacacccggctctgatgacgtcaca

SEQ ID NO: 95365 - DNA, 86 bp, Mus musculus
tgtgagtgtgtgtgtgcgcacgtgtgcgtgtgtgtgtgtgcatacagacagacacacagacagacggatggacggacagacacaca

SEQ ID NO: 95366 - DNA, 71 bp, Mus musculus
gccacagcaccaagacagtcagctctctgggcgttccgagtgcctgttctgtgctgtcctccctcttcggc

SEQ ID NO: 95367 - DNA, 79 bp, Mus musculus
ggcacagggtaagaaagtcagggttggggctggtgagatggctcagcggttaagagcactgactgctcttccgaaggtc

SEQ ID NO: 95368 - DNA, 79 bp, Mus musculus
gctggcgtctagacagttgtgtgacagcaggtccatccctgtgaccgtgcagttacagcctcccactgtccttgccagc

SEQ ID NO: 95369 - DNA, 76 bp, Mus musculus
cttgtgtctctcagaccctctcagttcctcagccctggtctgggcccagaaggatgctgggcagggctaggccaag

SEQ ID NO: 95370 - DNA, 89 bp, Mus musculus
cagatcttcctgcctgcctgcctgcctgccttctgctttcactctataatgagtccttactagaagcaaggtgatgcaggaatgctctg

SEQ ID NO: 95371 - DNA, 94 bp, Mus musculus
gtcacacagctgtgacccggaatagccatggtctcaaactgcatcttcatatttgcagcagaccaccgtagttttgaagttgctctgtgtgtgc

SEQ ID NO: 95372 - DNA, 97 bp, Mus musculus
gtggtgctgtgtggtgtgggggagagtctctgtgtgtgttagtcctgtgtatagtgtgtatatacatgtctgagtcctgtgtgtctgtgagtcctgt

SEQ ID NO: 95373 - DNA, 110 bp, Mus musculus
gttccattaaaacacatacactggggctggagagatggctcagcggttaagagcactgactgctcttccagaggtcctgagttcaattcccagcactcacatggtggttc

SEQ ID NO: 95374 - DNA, 76 bp, Mus musculus
gagagagttctgtgcaacctctgtgttcaggtgagatacactcacacagcctcagggaagccaggagctagtgttc

SEQ ID NO: 95375 - DNA, 73 bp, Mus musculus
tctgtctgtacacatatgtatgtatgtatgtatgtatctggcatgtacatacctgatgtctgtgtaggtcagg

SEQ ID NO: 95376 - DNA, 76 bp, Mus musculus
gtctgtgtgtgtgtctatgtgtctgtagtgtctgtgttactgcacatgcatatatgggcacatggaaaccagaggc

SEQ ID NO: 95377 - DNA, 82 bp, Mus musculus
ccacacacttctgtgtctgtgtgcatggtgtatatatatgcgtggtttctgcatgtgcacctgtccactccagcaggtgtgg

SEQ ID NO: 95378 - DNA, 89 bp, Mus musculus
catgcctggctctttgctgctgttttgaatcataatgtaaatatctttgtagatagagatttgctaacggggtagagacccacaggttg

SEQ ID NO: 95379 - DNA, 104 bp, Mus musculus
gacctgcagggttttgctttttaagtacaaaatgaggaagttggatctttgatttttaaggtatctttgagcattagaattgtgggtcaattttcttttttgta

SEQ ID NO: 95380 - DNA, 100 bp, Mus musculus
gaactcaggtcctttggcaggactcactatgtagaccaggctaacctttgagatctacctgactctgcctgtctgcctgtctgcctgcctgcctgctttc

SEQ ID NO: 95381 - DNA, 91 bp, Mus musculus
gcatgtaatatatgtctgtacacatgtatatatacatatatgtgtgtgttcacatgtatgtatatatatatatacacacacatatacatgt

SEQ ID NO: 95382 - DNA, 102 bp, Mus musculus
gtgagtttaaaaatcaccccaggagattggtgaggcagcctctctgaatgtgtctgtgagacatatccagaagccccactagattagggtagcactgctcat

SEQ ID NO: 95383 - DNA, 81 bp, Mus musculus
ggagtgacaattatggactggagggatggtccagaggttaagagcactgactgctcttccagaggtcctgagttcaattcc

SEQ ID NO: 95384 - DNA, 100 bp, Mus musculus
cagctgcctgttttgataaatattacaattgtgctagtagaaaacacatttgtgaagagctagttgaatgtaatgttgatcattatggagtcaagaaatg

SEQ ID NO: 95385 - DNA, 137 bp, Mus musculus
ggaaaggggaaaggtcagtgtgaaacccagaggtgaactccttccagagagagacagtccgtgggtcggtggctgccttccagagagagacagtccgtgggtcggtggctcagcaggtgctgggttttgaagggaag

SEQ ID NO: 95386 - DNA, 92 bp, Mus musculus
tatatatgtgtatatgcatgtgtacatgtaatgtgtatatatgtgtatatgtatatatgttgtgtctatgtgtgtatatgtatgtgtatata

SEQ ID NO: 95387 - DNA, 115 bp, Mus musculus
tgtgtgtgtgtgtgtgtgtgtgtgtgtatttatttatttatatgtgtgtatacatatgtatatatgtgtgtatatgtgtatatgtatatatgagtatgtgtatgtatgtgtatat

SEQ ID NO: 95388 - DNA, 103 bp, Mus musculus
gaggtgtgtcactgtgtgccagctttgaggtttcagaaacccacactggtccccatttgctctctgtctgtctcaaggttgtgactcgcataggtgagctctc

SEQ ID NO: 95389 - DNA, 205 bp, Mus musculus
atgtgtataagtgtatgggtggtgaaaatgtgtattatgtgaatgtatatgtatttgtgcatatgtttgcatatgtgtatgtatatgttgtatacatgtatatatatttgtgtgtatatacatatgtatatatgtgtatatatgtatgtacatgtatatatgtatgtatatgtgtgtatatgtgtgcatatatatttgtgtatat

SEQ ID NO: 95390 - DNA, 100 bp, Mus musculus
gatgtctcttcttgggctggtgagatggctcagcggttaagagcactgactgctcttccagaggtcctgagttcaaatcccagcaaccacatggtggctc

SEQ ID NO: 95391 - DNA, 86 bp, Mus musculus
gtatgtcacacatgtgtgtgtgtgtgcaagtgcatgcatgcacatgtgtgcctgcgtgcatgagcatgtatgtgtgtgtgtgcatg

SEQ ID NO: 95392 - DNA, 83 bp, Mus musculus
ggctcccacctggccagcgtcgccacactgaatctacccatacacttatgtccgagtcactgtgtgcctggctgggtgctgtc

SEQ ID NO: 95393 - DNA, 84 bp, Mus musculus
atgggaggctggagagatggctcagaggttaagagcactgactgctcttccagagatcctgtgttcaattcccagcaatcgcat

SEQ ID NO: 95394 - DNA, 79 bp, Mus musculus
gacaatcacctcagctctctgggtctctctgtccttgacatcaagaggaaagacagcttagcatggaggtttggatgtc

SEQ ID NO: 95395 - DNA, 113 bp, Mus musculus
gacctctgctccctctggtcaacccccgctcacttcggtctggcccaaagctgtatttattattatacataagtacactgtagctgtcttgagatgcaccagaagaggctgtc

SEQ ID NO: 95396 - DNA, 57 bp, Mus musculus
cgggctggagagatggctcagtggttaaaagcgctgactgctcttccagaggtcctg

SEQ ID NO: 95397 - DNA, 113 bp, Mus musculus
gatttccctgacaacttttccacaagctgaggctggggcatctcaaattcaaggtaactcactgagactctgcctcaagattcacataaaaggggggtgggggggaggaggtc

SEQ ID NO: 95398 - DNA, 84 bp, Mus musculus
cggagccctgaggggagggatttgatgaagacagccagtctctgactgggtgttccaaggtctctcactctctgagggtctctg

SEQ ID NO: 95399 - DNA, 67 bp, Mus musculus
gaacaggggctctagagatggttcagtggttaagagcattgactgctcttccagaggtcctgagttc

SEQ ID NO: 95400 - DNA, 77 bp, Mus musculus
tagggatctgtctgtctctgcctccccagcatacctggctctttatgtggatgctgggagtcagacttagacccttg

SEQ ID NO: 95401 - DNA, 107 bp, Mus musculus
tatgagtatatgatgtatgtatatatgatttatatgatgtatgtatatataatgtatgtgtatgagtatatgatgtatgtttatgtgtatatgattatgtgtatatg

SEQ ID NO: 95402 - DNA, 117 bp, Mus musculus
gcgggctatgtgcggatgacagggtaacaggtactgatgattattctagcgtggtttgttgtctgcgttcatcattagagaacatgttaaatctctgtcagaaataatggcgtgcct

SEQ ID NO: 95403 - DNA, 110 bp, Mus musculus
agagaaaggagtaccacaagtttgaggttagcctaggctatacagtgagaccctatcactcacactgtatatgatatgcataatctctctctctctctctctctctctct

SEQ ID NO: 95404 - DNA, 145 bp, Mus musculus
gtgtgtatatctatgtgtgtatgtgcatacatgtatctatgtgtgtgtatatttctatatgtgtatatatgtgtatatgtatatgtgtgagtatgcgtatatgtggtctgtttgtttctatgtatctgtgtgcatatgtgtgtgc

SEQ ID NO: 95405 - DNA, 80 bp, Mus musculus
gtagggactagagagatggctcagtggttaagagcagtcaactgactgctcttccagaggacctgagttcaattcccagc

SEQ ID NO: 95406 - DNA, 72 bp, Mus musculus
ttactgttttattctctgtagtaaagaactaggatcaacctagatgttcgccaacagatgagtggctagtga

SEQ ID NO: 95407 - DNA, 83 bp, Mus musculus
ctcagttctctgtctgtttcactggggcttttctgacggatgctctaagctcctcatcatgccacagccaccatggagatgag

SEQ ID NO: 95408 - DNA, 111 bp, Mus musculus
tatatatatatatatatatatacacacacatacatacatatatatgtgtgtgtatgtatatatatgtgtgtgtatgtatgtatacatatatataatttatatatatttata

SEQ ID NO: 95409 - DNA, 113 bp, Mus musculus
ttgttttgggactggtaagctgtaaaagacagacgggtgtaaccgtgactctcactttgttttttgttatacttgcatggttataaactcacagctatctttttctgaggcag

SEQ ID NO: 95410 - DNA, 73 bp, Mus musculus
gcttaagtccgagtgtcagtgtgtcagtgcgccccgcactgttcacaggacttgatcctcagaacacaactgc

SEQ ID NO: 95411 - DNA, 116 bp, Mus musculus
gtcctgaagcaagaaagtatacaggggctggagagatggctcagcggttaagagcactgactgctctttcagaggtcctgagttcaaatcctagcaactacatggtggctcacaac

SEQ ID NO: 95412 - DNA, 68 bp, Mus musculus
gtcgaaggatgtgcttaggttcagtctggctgtcttcagcagatggctgaagctgctctccaggtgac

SEQ ID NO: 95413 - DNA, 88 bp, Mus musculus
gtgagcgcctcacagtccctgtgtctgtcccctgctccccacatgatggcaggcacatctgaggagtcctgtgcccctgactgcttac

SEQ ID NO: 95414 - DNA, 105 bp, Mus musculus
atatttctgaggaacttaaaggttggttgtctaagaatgttatttatacttttttgaggttatgaatgtctttgactgaccatttataagtgaattcaataatgt

SEQ ID NO: 95415 - DNA, 90 bp, Mus musculus
ctgaaacatcttgttctgaactgtgttcaaggcccaggttttgtcagccacttgaagacagtgaacacagagagagcagggaagtgtcag

SEQ ID NO: 95416 - DNA, 130 bp, Mus musculus
gtgggcattgtctgcttgctactgagtaagagccatgtctgaactcaggggagctaaagaaagaccatgtccatctgctcagagtggattgtggatgctgggctgagcatcctgagcttgactgttggtt

SEQ ID NO: 95417 - DNA, 103 bp, Mus musculus
gtctgtttggggggatgcagtgtggcagggcaccctgaggtcactatagaaattcttcttgtgttagaggggcccgtaacagcttgtggtggtccattttggc

SEQ ID NO: 95418 - DNA, 81 bp, Mus musculus
aagccacactggcggctgttctgcactagatggactgcgctgtccagctctgtccgtctgtcgttcgctgtctcgtcactt

SEQ ID NO: 95419 - DNA, 106 bp, Mus musculus
catgtgtggcactcagtcagtgatggagcgctaacatgcatgacactcactcagtgatggagcgctgacatgcatggcgctcattgatggagcgctgacatgcatg

SEQ ID NO: 95420 - DNA, 70 bp, Mus musculus
gtccctttgtgtaaaaggctggtcttgaggcctgaaaggattcaaaagaagtttgcgctgaaccagggat

SEQ ID NO: 95421 - DNA, 74 bp, Mus musculus
catgtgtttgtgtgtatatttctgtttttgtgcatgtttctgtgtatatgcatgtttgtgtgcatgttcatgtg

SEQ ID NO: 95422 - DNA, 70 bp, Mus musculus
ttgcatgcatgtttgtgtgcatgtgcgtgtatgtgtgtgaacatgtgtgtgcatgtacatgtgcatgtgg

SEQ ID NO: 95423 - DNA, 57 bp, Mus musculus
atgggtatggaggcagaggtctcatctctctgtgtgtgcctgtgtgtctgtgtctgt

SEQ ID NO: 95424 - DNA, 118 bp, Mus musculus
gttctacccctgagctataactcagctcaaaagttttaatgatagatataagtggtgacatttttatttttattcaagactagggcaagggtggagagatggctcagtggttaagagc

SEQ ID NO: 95425 - DNA, 74 bp, Mus musculus
tgtatatgtatgtatatgtgtgtatgtgtatatgtgtatgaatgtatatatatgtatgtgtatgtttatgtata

SEQ ID NO: 95426 - DNA, 95 bp, Mus musculus
tgttgattgtggtggtgttacattaatcttcatgtgtgatgtaaatgtgtgcgcacaggcacacacacacactccaagagaacatataattggca

SEQ ID NO: 95427 - DNA, 95 bp, Mus musculus
ttagtgttagcctgacggtgggaggcaggggctgtctctgactctgttgtctgactttgggggaccctttctctctactggaatgcttagtctaa

SEQ ID NO: 95428 - DNA, 178 bp, Mus musculus
tatatatatatatatatatatatatatctccctatatgtgtgtgtatatgtgtatgtgtatatatatatatacacacatatatgtgtatatatatatgtatatatatgtatatatatgtgtgtatatatatatatatatatatatatatatatatatatatatatatatacacacata

SEQ ID NO: 95429 - DNA, 81 bp, Mus musculus
ttgacatatatgtgtgtgtatgtatatgtgtgtatacatatgtgtgtatgtatgtgtatatatatatatgttcatattcaa

SEQ ID NO: 95430 - DNA, 79 bp, Mus musculus
gtgggtcagtgggtcagtgggtcagtgggtgaaggcggttgtcacaaacctgatcacctgaggtccattctactgcagc

SEQ ID NO: 95431 - DNA, 108 bp, Mus musculus
tatgcatgtatatattatgtatatatgcatgtctatgtgcatatatatgtatatatacatgcatatatatgcatatatatgtatatatatacatacatatatatatat

SEQ ID NO: 95432 - DNA, 93 bp, Mus musculus
gtaagattggggaacccttagagacacagtaggcggtagctactgtcatttatggctattgtctctctgtgtgtctctgccctatgtctctgc

SEQ ID NO: 95433 - DNA, 65 bp, Mus musculus
acctggggacactctctggctctgctccaactgtgtgactcggggccaggcttgctttcccaggt

SEQ ID NO: 95434 - DNA, 72 bp, Mus musculus
tctgtgtgtgtctgtgtgtttgtgtcctgatagggctggctgctggcgacactcactcagaagtagcctgga

SEQ ID NO: 95435 - DNA, 88 bp, Mus musculus
tatgacctacacaagttttttgtatgtgcatgtgcacgtgcatgtatatacatgtgtgtgtatttgcatgccatacatgtagggtata

SEQ ID NO: 95436 - DNA, 118 bp, Mus musculus
tgtacatgcatgtgtttctatctgtacgcgtatgtatgtgtatgtatgtatgtatgtgtgtgtggtatgtctaagtgtatatgtgtatggtatataagtgcatgcatatgttggtaca

SEQ ID NO: 95437 - DNA, 98 bp, Mus musculus
ggctaggatcccagactacatgaatgaagagagagacctgaagagcagtaggcattcacctctctactctgactgtggatgtgttgtgatcagatgct

SEQ ID NO: 95438 - DNA, 91 bp, Mus musculus
actgactggctgactgactcactggctgaatgaatgattgattgattgattgatagattcactggccaaatgcgtggagggctgagtgagt

SEQ ID NO: 95439 - DNA, 87 bp, Mus musculus
ggccagccagcctatctattcatcctggtgggtgactcaaaaaaagagtggctcctgagtgatgagacatggtgttgacatctggcc

SEQ ID NO: 95440 - DNA, 100 bp, Mus musculus
tattgatctagacttgcctaatagactgactgaccaagaagccccagggacccttctgtctctgtctctgcctcctcagtactgggtaacaccctcaatg

SEQ ID NO: 95441 - DNA, 126 bp, Mus musculus
atatacgtatatatgcatgtgtatacatatatacatatgcatgtatatatgtatgtgtgtatatatatacatatatacatatatacgtatatacatatatacgtatatacgtatacacacacatat

SEQ ID NO: 95442 - DNA, 121 bp, Mus musculus
cacatatgcatatatgcatatatgcatattgtatatatgtatatacatatatacatatatatatgtgtgtgtatacgtatatacgtatatatgtatatacgtatatatgtatatatgtata

SEQ ID NO: 95443 - DNA, 108 bp, Mus musculus
gacagcccagatcagaagtttatccaagggctctgctgacagatgattgaaaggactggtccttctaatcaggaccagcatgcaggaccctgagtattcaaggctttc

SEQ ID NO: 95444 - DNA, 107 bp, Mus musculus
tccgctagcatataagcaagttaatgtttcataatatatatttcagatggatctttatatggttataagaaacactcaaatgtgttgaggcaagatgcgtgtgggta

SEQ ID NO: 95445 - DNA, 87 bp, Mus musculus
tctgatgtactctttgtctccatgaacgctcacagacacacacacacacagagagagagagagagagagagagtatacaacctcaga

SEQ ID NO: 95446 - DNA, 122 bp, Mus musculus
gggtgtgttgatagtgatggtgggcctgttgcggaactaaagcagccagtgagcagagagagccccgtcctggtctgcctgctgggtcagtcagtccctgtagcaaacgcccaacatagtca

SEQ ID NO: 95447 - DNA, 83 bp, Mus musculus
ctggggtgatcacaggctaagtgaggtcttgggtcagaggctgttgcgctggttcccagcctcactgagtgtctgtcctccag

SEQ ID NO: 95448 - DNA, 79 bp, Mus musculus
cacagtgaagcaatgtgacacaacagtggagcagtgtgacaccacagtgagcactgtgaaatcacattggagcactgtg

SEQ ID NO: 95449 - DNA, 86 bp, Mus musculus
ggtatttgctttaaacacatttactttatgtgcatgaatgctctgcctgcatgtatgtatgtatgtatgtatgcgtgtgcaatgcc

SEQ ID NO: 95450 - DNA, 59 bp, Mus musculus
cacagagcagaactgtgacatcgcagtggagcacagagacaccacagtggagctctgtg

SEQ ID NO: 95451 - DNA, 101 bp, Mus musculus
cactgtggtgtcatagtgctccaatttggggacacagtgctccactgtgatttcacagtgctcactgtggtgtcacattgctccactgtggtgtaacagtg

SEQ ID NO: 95452 - DNA, 91 bp, Mus musculus
catcttgacaccacagtggagtagtgtgacaccacaatggagcacagtgacagcacagtggaacactatgactgtacagtggagcagtgtg

SEQ ID NO: 95453 - DNA, 61 bp, Mus musculus
agacagaaagcaaagggaaggagctggctgcagcactactctcctctctgtctgtctgtct

SEQ ID NO: 95454 - DNA, 101 bp, Mus musculus; identical to SEQ ID NO: 95451

SEQ ID NO: 95455 - DNA, 87 bp, Mus musculus
agctgccttctgctgtcatgtctctctcttagtgctgattgtgctttctgcagacactagaactgagcttgcctagaatatccagct

SEQ ID NO: 95456 - DNA, 90 bp, Mus musculus
tgatctataccacctgagagggttccaaggtgggctctgtcacactctgcctcatgtgctctgaaatgcctgtcatttgagtaaggatca

SEQ ID NO: 95457 - DNA, 74 bp, Mus musculus
atggagcattgtgataccacagtggagcactgagacagcacattggagcactgtgacatcacagtgtgcactat

SEQ ID NO: 95458 - DNA, 86 bp, Mus musculus
ggtgatgctgggaacctgagctctcagtgtctgactgcgaccagtggccaggcagacaagagcagtttccagggaagcgcaacacc

SEQ ID NO: 95459 - DNA, 86 bp, Mus musculus
taggtccttgaagaggtggagggcttgggtacctgtctttggagtggactgtgagatatggtctccgtctgtctctctcatgcctg

SEQ ID NO: 95460 - DNA, 58 bp, Mus musculus
gccttgcatcagacccttgtgacctccctgggggtcactctggctcttactgtctggc

SEQ ID NO: 95461 - DNA, 71 bp, Mus musculus
tcagtccctctggggactttgtacttgtcacccgtgtgtgtcttgacagtgacactgagtctcttgactga

SEQ ID NO: 95462 - DNA, 92 bp, Mus musculus
acaaaaagatgcacatttgtgtgtatgcgtgagcctgtgtgtatacaagagtgtgtgcacagggatgtgtgcacacatgtgcgcatgtgtgt

SEQ ID NO: 95463 - DNA, 89 bp, Mus musculus
gctttaagtttgcctaaaccagcacctcatgcattctatccccactcagtgctgtgtctgtctggttgggaagtatcttctgaagaagc

SEQ ID NO: 95464 - DNA, 71 bp, Mus musculus
ggttactagcaagagaggttccctcgcaagacgatgactttgcggtcctgtcttgctctctggctgacacc

SEQ ID NO: 95465 - DNA, 115 bp, Mus musculus
tcagctttaatccatagtgatctgataggatgcatgggacaatttcaatatttttgtatctgttgaggcctgttttgtgaccaattgtatggtcattttggagaagggaccatga

SEQ ID NO: 95466 - DNA, 79 bp, Mus musculus
gtatatgtatgtatgtgtgcatgtgtatatggggggagtgtatgtgcttatgtgtgtatgtgagtatatatgtgtgtat

SEQ ID NO: 95467 - DNA, 111 bp, Mus musculus
gaggtgcgtattcacaaatgtggcagaaagacatcagagacaagagacagacctcaatcagtttctttcccagctggcttacctcctgacatatgtagagttcaccacctc

SEQ ID NO: 95468 - DNA, 60 bp, Mus musculus
ttgcctgtctcactctgtcccttgtgtttgcatgggtgcctatttaagggtgagaggcag

SEQ ID NO: 95469 - DNA, 76 bp, Mus musculus
cggtacagggagtcacagcatgtggaagcagagatagttttagttcttccttttcagtctgtgtgtctctgtgttg

SEQ ID NO: 95470 - DNA, 107 bp, Mus musculus
gtgcctcatcctcaggttgcagcactcactgctcggtgcctcagtgtctgcctcagacattcaatgattctggctggctgagtgcttgggagctctgtcgtgtgcac

SEQ ID NO: 95471 - DNA, 80 bp, Mus musculus
agtgaccagctagactgctctgagacactttgagctcccaaagtccccttagtgctcagagcagtgtcaggacaggcact

SEQ ID NO: 95472 - DNA, 73 bp, Mus musculus
ctcatgcacttgtggatggacttggggcatgtgagtttctgtctccagttctgtgtctctctctgggtatgag

SEQ ID NO: 95473 - DNA, 90 bp, Mus musculus
gaaacaggttctcaagtattttaggctatccttgaagtgactcactcactaactcactatatagccaaagatgaccttggtttctgttcc

SEQ ID NO: 95474 - DNA, 109 bp, Mus musculus
tgtgtctgtctgtctgtctgtctgtcttccatgtcttaaggatatatgtaaatttgaatgtattttttcctatggacctggggctagccacattggccagaaggaaaca

SEQ ID NO: 95475 - DNA, 73 bp, Mus musculus
ggctcagtagatgacggtgcttgccacggagcctggctacctggctgcctggctgcctgactgcctgactgcc

SEQ ID NO: 95476 - DNA, 65 bp, Mus musculus
gggccagccagggctatgcagtgagttccaggacacttctattactgtgaggctctctctgtctc

SEQ ID NO: 95477 - DNA, 102 bp, Mus musculus
atcatatttaccagcttagccatagtctcagattgtctgtctctttcaccggactctatcagagactccatgtgcagcccagactggtatcaaacttgtggt

SEQ ID NO: 95478 - DNA, 71 bp, Mus musculus
ggtttcagatcagtgactgtatctctctgggttgctatttgccctgtaggattcagctgcgatttcttacc

SEQ ID NO: 95479 - DNA, 56 bp, Mus musculus
tccaaggtagacaatacagagtgaggacccctggggttccctcattgtctgctgga

SEQ ID NO: 95480 - DNA, 109 bp, Mus musculus
tgcccatgagaagggatgtggccttttacagaaggtgagagtgttattggccttgtcttgcaccatttgaatagggttgaattttaagtcacacttttaagttgtctgt

SEQ ID NO: 95481 - DNA, 92 bp, Mus musculus
tggtacaggcctttgtcccaagcacttgtcaggaagatgcagagtgaattctgtgagttcaagatcaactttatctacaagtgggccagcca

SEQ ID NO: 95482 - DNA, 116 bp, Mus musculus
gaagtccacttgatcttggggaatgatgtttttgatgtgttcttgtattcggtttgcaagaattttattatttttgcatcaatgttcgtaagtaaaattagtctgaagtaatcttt

SEQ ID NO: 95483 - DNA, 112 bp, Mus musculus
gtgaatgttcggtgtctctggctcattatgacctgtaaggagacagttgtctgagtccagtagtcttaaggacaacttctccatcttactggttgggtcaaactgagttcat

SEQ ID NO: 95484 - DNA, 117 bp, Mus musculus
tcctgatgctgcttttacttttcagcccctgcattttgatctgcttgctggcctataagtacagttcagattatgatgttaagagaacagtatcaagagttgggctagagtgagtca

SEQ ID NO: 95485 - DNA, 75 bp, Mus musculus
tctgtgggggcatttgtttgattaatgatgtatgtatgtatatatattcctttaatgggacagggctactgtggg

SEQ ID NO: 95486 - DNA, 75 bp, Mus musculus
gtggccccagtgctgcacccactcagtgactcacaatcagtgtgaatcatccttaagtgcagcaccaggagctcc

SEQ ID NO: 95487 - DNA, 80 bp, Mus musculus
ccaggatctcagggtctcagaggaaggttgtctgccaagaactatgcaacacccagaatctcaggatcccaggatcccgg

SEQ ID NO: 95488 - DNA, 56 bp, Mus musculus
aatgcatggaggctgggggatggccttgggtgtccttctctgtcactctctgcatt

SEQ ID NO: 95489 - DNA, 94 bp, Mus musculus
gtgatggcatatactgagcatgcctgaaatgttaggttatcattatgtgtggtagacttgtgtattttggggtgtgtctgatgtgtagccaagc

SEQ ID NO: 95490 - DNA, 113 bp, Mus musculus
cctgtttggggattgactctcagacttggctggaatgcaatgaaaacaagactgtgtgattaaggggggcttggatttgtacagaagaggaggtggagggtggagaccagagg

SEQ ID NO: 95491 - DNA, 73 bp, Mus musculus
acagcctgtggaagttggttctttccctctaccaactgggttctagggattgaactcaggtcttcagggttgt

SEQ ID NO: 95492 - DNA, 111 bp, Mus musculus
gcttcagcctcagacagtagagaccgtgcatccccagagcaagaatagtcatattgttgagctctgagtttgattttgaggtcctgtctcatcgaataaggaggaagaggc

SEQ ID NO: 95493 - DNA, 66 bp, Mus musculus
gtagtggaagtattctgtctcagtttctcagatctgagaagttaggggcgggaggcttgcgcgtgc

SEQ ID NO: 95494 - DNA, 74 bp, Mus musculus
agacagaagcaagaggatctctttgaattctagcctgccagagctactcagagactgtgtgtgtgtttctgtgt

SEQ ID NO: 95495 - DNA, 88 bp, Mus musculus
ctaagatggctcagtggcgggctggaaagatggctcagtggttaagagcactgactgctcttccggaggtcctgagttcaaatcctag

SEQ ID NO: 95496 - DNA, 91 bp, Mus musculus
gtgtgtgtgtatatatatacatatatatatatacatatatatatatgtatgcatgtatatatatgcatgtatacaacacatatatatagta

SEQ ID NO: 95497 - DNA, 76 bp, Mus musculus
tgtcagctggagagaagtgagcctgcacacagaggccagccccgagtataggcgaggctttccattctcctcgata

SEQ ID NO: 95498 - DNA, 96 bp, Mus musculus
tgggggggggggttggggggagaactgaagagacagctcagtgctaagagcactgactgctcttccagaggttctgagttcaattcccagcaacca

SEQ ID NO: 95499 - DNA, 116 bp, Mus musculus
tttttgtagactgtgcactctggggacagactgggaagctccttctctgggactctctgaccctgaggaccccagggcttctcctgttcaaaccttctctgcagggtagttaggag

SEQ ID NO: 95500 - DNA, 68 bp, Mus musculus
ggagatggcagccttagccagccacagtgctccccccagtcactgtctctgtgcatctctgctgtcct

SEQ ID NO: 95501 - DNA, 70 bp, Mus musculus
acaagggttgtgtgggaaggccttggggttctgtagcagtcaacccacactgtgtctcactcagccctgt

SEQ ID NO: 95502 - DNA, 81 bp, Mus musculus
gaatggatctcagagaaatgacactgagcaaagcagccctgaaaagtgtcacagtatgctctccctgttaatgagccattc

SEQ ID NO: 95503 - DNA, 99 bp, Mus musculus
agtgtgtatgtatgtgtgtatgtatgtatgtgaatatatatatgtgtgcctgtgtatgtatgtgtgtatgtatgtgagtatatatatgtgtgtgtggct

SEQ ID NO: 95504 - DNA, 74 bp, Mus musculus
agacaccagggaagggagttacttacatggcttgtcctgtgggcaggtctgtctgtctgtctgtctgtctgtct

SEQ ID NO: 95505 - DNA, 70 bp, Mus musculus
gcagtggggacagtatggacagtgtggacaatgtagacagtgtggacagtgtggagactgtggacagtgt

SEQ ID NO: 95506 - DNA, 140 bp, Mus musculus
tgctggaatacatatatatgtttgtgtgtgtgtgtgtatatatatatacatatacatatatatatatatatatatacacacacacatatgtgtatgtatgtatgtatgtatgtatgtatgtatgtatgtatgtaacaaca

SEQ ID NO: 95507 - DNA, 96 bp, Mus musculus
tttcagaaacagggcaaaactagctgcagtcatagttgctagagtaagagagactcaggacacaggcagctgtgcaggtgaagggccattctggaa

SEQ ID NO: 95508 - DNA, 81 bp, Mus musculus
ggggatattctgcctgactgtgtgtctgtgcgccatgtatgtgctcagcgtccatggaggccagaagagggtcagatcccc

SEQ ID NO: 95509 - DNA, 120 bp, Mus musculus
tgtgactctggtcttcaagggaaagtgtgtggtttcctgtagtgaactctaatagctgactgatcacacacagcgaagggattattactgtgaacctggcactgacctcagaacttcata

SEQ ID NO: 95510 - DNA, 76 bp, Mus musculus
ggagagaaggatctgaggctacggggctcgtactactctcccatctgtctctctgtctctaagtgtctgtctttcc

SEQ ID NO: 95511 - DNA, 56 bp, Mus musculus
gtatgtatgaatgtatgtatgtacatatgcatgtatgtgtgtatattcatgtgtgc

SEQ ID NO: 95512 - DNA, 84 bp, Mus musculus
cacagagtggaatccttccggctcacactcagcctgtctggggagatggcaaggatggggtgggcagaggctggatccagagtg

SEQ ID NO: 95513 - DNA, 77 bp, Mus musculus
tgcatatatgtattcaagaatgtatatatatgtatatatgtgtgtctctgtatatatatgtgtatgtatatatgtgt

SEQ ID NO: 95514 - DNA, 86 bp, Mus musculus
gggttgtgatgatcttactggagtgtggtggtctgtctcttctcaggttcacccattactgtctctctgtctgggccacagagccc

SEQ ID NO: 95515 - DNA, 98 bp, Mus musculus
ggatggggttgaaaccagagattcccactctgactcactgcggcgagggtgcctgatgcctgtggtctgtggttatttctcacaagttggctttgacc

SEQ ID NO: 95516 - DNA, 111 bp, Mus musculus
tgtgtattgtgtatgttatgcgtgtgcatatatgtgtgtatatatgtatatgtatattatgtgtgagtgcataatatatatatgtatatacatatatacatgtatatccat

SEQ ID NO: 95517 - DNA, 116 bp, Mus musculus
gcgacctcatgttggctttatttgacagcctgggcagaggtttaattttcttagttgtaagattagaactatgtactagaaggagtggagaatgtgagaccccaaccttggatcgt

SEQ ID NO: 95518 - DNA, 74 bp, Mus musculus
ccagagttgatgtcggtagccagcatgagcccatcccccaccatggctctctatctctgactcccttctcctgg

SEQ ID NO: 95519 - DNA, 120 bp, Mus musculus
gcaggaaagagtcaaaggccccaattgaggcttcccagtttagtctcagagaactggtggtcacatctgacactgagagctgggataggcagggctggggtctccagggccctgaccagc

SEQ ID NO: 95520 - DNA, 101 bp, Mus musculus
gctaggctcttcatgtctgtgcggcacactatccgctgagcacgctcctgagcatgagtctgtgactctgtgagtggcctcaccagtaggaaaaggttgac

SEQ ID NO: 95521 - DNA, 77 bp, Mus musculus
gacatgccgcactgtagctcataaatactatgactgtgaaagaatagaatatgtgtgtgactgtgtgtgagtgtgtc

SEQ ID NO: 95522 - DNA, 62 bp, Mus musculus
cccctttcccagcctcctacctgggcccagctgcagcaggtagaagagagccagcagagggg

SEQ ID NO: 95523 - DNA, 109 bp, Mus musculus
atataccatatatgtgtgtatgtatatatatatatatatatatatatacatacatctatgtatatataccacatgtatatatgtatatatacacacacacatacatatg

SEQ ID NO: 95524 - DNA, 118 bp, Mus musculus
gctgtctgagatccaccttattagactgaagagatggctcagcggttaagagcactgactgctcttccagaggtcctgagttcaattcccagcaactacgtggtggctcacaaccatc

SEQ ID NO: 95525 - DNA, 58 bp, Mus musculus
gcatcttccctcactccctctgtctgcctctgcaggccagggaagggcctttctatgt

SEQ ID NO: 95526 - DNA, 56 bp, Mus musculus
gagcatgtatgtatgtatgtatgtatgtatgtatgtacatatatattacatggctc

SEQ ID NO: 95527 - DNA, 133 bp, Mus musculus
gcagcaggagaactgccggctcctgcctggccctggtcctggtgggcagcaggatgcgtctgcctgggtctgtctctggcacagtgccaggcctgagtcacggtgctctgctgccagctccccgcctccccag

SEQ ID NO: 95528 - DNA, 103 bp, Mus musculus
gtctgaagacctctctggatactggagatcaggaaaaacacacaagagactgaggagcctctctctcctgccaggatcccagttctctgtgaagtctccagat

SEQ ID NO: 95529 - DNA, 101 bp, Mus musculus
gagtgaccactgacgggctggagagatggctcagcggttaagagcactgactgctcttccgaaggtcctgagttcaaatcccagcaaccacatggtggctc

SEQ ID NO: 95530 - DNA, 58 bp, Mus musculus
gctgcgtgcgtgcctgtgtgcgtgcgtgacgtcagcacgtatccgctcgccccgtggc

SEQ ID NO: 95531 - DNA, 82 bp, Mus musculus
gactttaagaagggaccaagggaatggagagatggctcaagagatgaagagcactgtctgctcttccagaggtcctgagttc

SEQ ID NO: 95532 - DNA, 121 bp, Mus musculus
acacaggatccctggagtgagctgtggaccccagtgcagcactcactggaacacagtgagctcacagggtgtgtggtcttccctctcaatccagccctggattgcagaagaccctgtctct

SEQ ID NO: 95533 - DNA, 118 bp, Mus musculus
gaggagtataaatgtttcagaggtggggggagctggagagatggctcagtgattaagagcactgactgctcttccagaggtcctgagttcaattctcagcaaccacatggtggcacat

SEQ ID NO: 95534 - DNA, 84 bp, Mus musculus
tgtgtgtgtgtgtgtgtgtgtacatatacatgcatgtatatatatacatgtatgtatgtatatataaacacacacatatataca

SEQ ID NO: 95535 - DNA, 66 bp, Mus musculus
tgtgtgtgtttatatatacatacatacatgtatatatatacatgcatgtatatgtacacacacaca

SEQ ID NO: 95536 - DNA, 111 bp, Mus musculus
ccgcctggttctagaacctatatttatgcatggtgcataacaggcatatgtgtgtgtgtgtctgtgtgatgtaaccatgtgtctccatgtgggtcagaggtcaacctaagg

SEQ ID NO: 95537 - DNA, 95 bp, Mus musculus
gctatgtaatctgtcaacttctcactctctctctgacttcactcacacttaagagctgatgaggtgagggacatgaatgtcacagctgtgtggga

SEQ ID NO: 95538 - DNA, 67 bp, Mus musculus
gttcttgggctggagagatagctcagctgttaataacactgactgctcttccagaggtcctgagttc

SEQ ID NO: 95539 - DNA, 76 bp, Mus musculus
tgtatatttatgtgtgtatatgtgtatgtgtgtatatgtgtatatgtatgtgtgtatgtgcatatgtatgtgtata

SEQ ID NO: 95540 - DNA, 92 bp, Mus musculus
tatatatgtatacatgtgtatatttgtatatgaatatacattatattgtatatgtacaacatataatctatatacaatgtatatactatata

SEQ ID NO: 95541 - DNA, 91 bp, Mus musculus
tgcccatacttgggctccgatggggattaggttcatttattttgtttaatcacacagtcacagcctacactcctctttttcctggtgggca

SEQ ID NO: 95542 - DNA, 79 bp, Mus musculus
agtgtgggtggcactcaggctagagctggaacctgtgctggttctgatggaggtcgagttgagtgtagagactgaggct

SEQ ID NO: 95543 - DNA, 108 bp, Mus musculus
ggtgggccccagccctccaattcctttctggtatttttttttaaactgagattttgttaatgtgagaatatagaatgtttatcagatgggctggagagatggctcagc

SEQ ID NO: 95544 - DNA, 74 bp, Mus musculus
ctgttctcagaagagtcagaggatgcaggcattgatgcaggcattgccaccatccctgtcttgtgggtgaatag

SEQ ID NO: 95545 - DNA, 71 bp, Mus musculus
agccagggcagaactggagagatggatcagcaggtaagggcactgactgctcttccagaggtcctgagttc

SEQ ID NO: 95546 - DNA, 109 bp, Mus musculus
gtcatcagatagcatcttgcatcagatagcatcttggcctagaaagtctccatgtgactgcctcgctgtgtgcctaccgatgtgttttcagcttatcttgatttatgac

SEQ ID NO: 95547 - DNA, 87 bp, Mus musculus
tgtgtaagtatatgtgtgtgtatacgtatgtatgtatgtatgtatgtatgtatgtatgtatgtatgtgcgtgtgtatgttggcacac

SEQ ID NO: 95548 - DNA, 132 bp, Mus musculus
gtatgtatgaatgtgtgtgtgtgtatatatatgagcatgtgtgtatgtatgtatgtatatatgtgtatgtgcatgtatgtatatatatgtatggcatgtatgtgtgtatatatgtgtgcatgtgtgcacatg

SEQ ID NO: 95549 - DNA, 221 bp, Mus musculus
gtgtatatgtatatatgtgtgtgtatgtatgtgtatgtgagtatgtgtatatgtatatatgtgtgtatgtatgtgtatgtgagtatgtgtatatgtatatatgtgtgtggatatgtatatatgtgtgtgtatgtatgtgtatgtgagtatgtgtatatgtatatatgtgtgtatgtgtgtgtatatgtatatttatgtgtgatatatatgtatgtatatgt

SEQ ID NO: 95550 - DNA, 110 bp, Mus musculus
gtatggctgaccccaagaacagtaacattgtaacaatgccgagaaactgactgatacactgtctgtcttttagcatcaatatatcactggacatgtaagtctaaccaccc

SEQ ID NO: 95551 - DNA, 85 bp, Mus musculus
atggcagcatggagaaccttccagaaactatgtttcctgcattgagcgtcaggtgggacaggaagaaggttgtggtcatgcctat

SEQ ID NO: 95552 - DNA, 80 bp, Mus musculus
tagagaaccaaccagcatggctaaggtctctgggtccttggtcacaaaggctcacagactcacacttgctcatatctcta

SEQ ID NO: 95553 - DNA, 85 bp, Mus musculus; identical to SEQ ID NO: 57470

SEQ ID NO: 95554 - DNA, 116 bp, Mus musculus
ctgtttgtccctttctctcagtctctgtctatttctctgtccctgtctctgtggatgtttattagtgtgtcagggggcagtaatagaatattcagatacatgtatatgacaaagag

SEQ ID NO: 95555 - DNA, 75 bp, Mus musculus
gtgtgtgtgttgggggggggggggtggttcagtcaaattatggccctgagttccctctccctgtctctatctcac

SEQ ID NO: 95556 - DNA, 69 bp, Mus musculus
tggtgatcagataggatgcatgggataatttcaatatttttgtatctgttgagtcctgttttgtgacca

SEQ ID NO: 95557 - DNA, 77 bp, Mus musculus
ttgctagaagtgacagatgacactgtggttgccctgagcttgctcgggaacacagcctcctcatagcttctagacag

SEQ ID NO: 95558 - DNA, 80 bp, Mus musculus
ggggagatgttcctattagaggagacttgcagtttttataattccgagacttgtgattttcatcaggttagtgtttcccc

SEQ ID NO: 95559 - DNA, 62 bp, Mus musculus
tggaaaacggtcaagacagagagctggatgtcagactctcactgtcttttcattcatttcca

SEQ ID NO: 95560 - DNA, 103 bp, Mus musculus
ctcgctgacctggagcctagctgaagagtccttcatgtcctgcaactcttctctcaggaatcacagaacacattgaggtcatgctgagctccctaataaagag

SEQ ID NO: 95561 - DNA, 85 bp, Mus musculus
tttatatcatggtctttcctaggaggctcaggccacctacactaagccttagcttcctagtgatcagagatgatagagatgtgaa

SEQ ID NO: 95562 - DNA, 66 bp, Mus musculus
tgtgtgtgtctgtgtgtctatgtgcatgtaaaatcaaatatgtatatacacacacacacatatata

SEQ ID NO: 95563 - DNA, 87 bp, Mus musculus
aaagtctgaggctcaacctgacattacattcagattctacacaacctctcctgtgtgtgtctgtttgtcaatttaatcctacgcttt

SEQ ID NO: 95564 - DNA, 116 bp, Mus musculus
ctgtttgtccctgtctttcagtctctgtctatttctctgtccctgtctctgtggatgtttattagtgtgtcaggggacagtaatagaatattcagctgcctgtatatgacaaagag

SEQ ID NO: 95565 - DNA, 116 bp, Mus musculus; identical to SEQ ID NO: 95564

SEQ ID NO: 95566 - DNA, 100 bp, Mus musculus
tatgtttgccactgtctctgtctatttctctgtcactgtctccatgtatgtttatgagtgtgtaataggacaaagagtcaccacaaatactggaagcata

SEQ ID NO: 95567 - DNA, 110 bp, Mus musculus
tttggtagaatgtttctgtagcataaaccaagccgaagttcagtctctagcgactgtagaatgtgagcacggcggtgtactcccagctatctagaagaaggaatgccaga

SEQ ID NO: 95568 - DNA, 89 bp, Mus musculus
atcttgtccagtcctttaattgtatgtatgtatgtatgtatgtatgtatgtgcttcatatgtgctagtgcaaggagtagggatacaggt

SEQ ID NO: 95569 - DNA, 72 bp, Mus musculus
ggcctcaagttgagagtaactgttcaggtgtcagactgggtcaaaatagttgctttcagctacttggaagct

SEQ ID NO: 95570 - DNA, 111 bp, Mus musculus
ccacgggggggggggtgcggggggcggggggcagagagatggctcagcggttaagagcactgactgctcttctgaaggtcctgagttcaaatcccagcaaccacatggtgg

SEQ ID NO: 95571 - DNA, 69 bp, Mus musculus
ctggcgaaagtgaagagctggtctctggggaagcgttgtccatagcccatgctctctctcactctccgg

SEQ ID NO: 95572 - DNA, 72 bp, Mus musculus
gtcagtctcagtctgtgacaggggtcaggagtggacctgcctgacttcccatttacagtaatgcagagtagc

SEQ ID NO: 95573 - DNA, 86 bp, Mus musculus
tctggtccccattttcagacttgagtttatgttggtgtcttgctcgtgttctggatgctgtgagtttgaaatgatggagggaaaga

SEQ ID NO: 95574 - DNA, 96 bp, Mus musculus
atgtaggtatacgctagtcatatatgtatgtatgtatgtacatacatatgtgtgtatgtgtccatgtgtatgtttatgtgtatgtatgtgtaagcc

SEQ ID NO: 95575 - DNA, 84 bp, Mus musculus
tgttgagtcacaggtgtcacattccaccccagaagttctgacttaagagactggggtgagatatgagaatctgtgtttccaaca

SEQ ID NO: 95576 - DNA, 95 bp, Mus musculus
tccatggtgatctgataggatgcatggaacaatttcaatatttttgtatatgttgaagcttgttttgtgaccaattatgtggtcaattttgtgga

SEQ ID NO: 95577 - DNA, 98 bp, Mus musculus
atatgtaaaatttgttcatttggtatggtgatacatatatttacacaaacttctgtatacatgtatgtatttcctaccaataaggttctaattcatat

SEQ ID NO: 95578 - DNA, 78 bp, Mus musculus
ccttaactggatttttggagcatgtggtggctgtgtgttgtctgataaagagtctctctgtgtccctgccaagtgagg

SEQ ID NO: 95579 - DNA, 85 bp, Mus musculus; identical to SEQ ID NO: 58391

SEQ ID NO: 95580 - DNA, 112 bp, Mus musculus
ctttatatgttacttgacctttttcccttactgcttttaatattctgactttatttagtgcatttgttgttctcattatgtgttgggaggaacgggtccagtctatttgaag

SEQ ID NO: 95581 - DNA, 106 bp, Mus musculus
gatcagctttagtccatggtgaactgataggatgcatgggacaatttcaatatttttgtatctgttgaggcctgttttgtgatcagttatatggtcaattttgaac

SEQ ID NO: 95582 - DNA, 73 bp, Mus musculus
gatctgggtctgcgagttatctgagctggtcagccaactggctctcttgctctcacactctccaagccagctc

SEQ ID NO: 95583 - DNA, 81 bp, Mus musculus
tggttctcagaaaaacactgtgagttcagactgtggaattttgaggagctcttcctcagggaactcacccagtggagacta

SEQ ID NO: 95584 - DNA, 89 bp, Mus musculus
tgtgtgtgtaaacttcactctggaagaatagactttactggatccttcacagaagagtctctacagagatgtgatgcaggacacctaca

SEQ ID NO: 95585 - DNA, 109 bp, Mus musculus
tcaatgtagggaaatcactgtgaagactggagctatttacatgaatttaaagatgtatgtttcagaagcctgcagtctgaagttggggtagggtggtatctcatagaga

SEQ ID NO: 95586 - DNA, 107 bp, Mus musculus
tgtatctacatctatataatgtatctatattacatgatatatatgtgtgtgtgtatatatacatatatatcatgtaatatagatatattatatagatgtataatata

SEQ ID NO: 95587 - DNA, 85 bp, Mus musculus; identical to SEQ ID NO: 63165

SEQ ID NO: 95588 - DNA, 87 bp, Mus musculus; identical to SEQ ID NO: 86407

SEQ ID NO: 95589 - DNA, 97 bp, Mus musculus
ggagaaacaataatatttgaactttgttcaatccatcaaatatgtatatttgtatatgtgtagaacatgtgaaggtgtggttgttggcacttgctcc

SEQ ID NO: 95590 - DNA, 104 bp, Mus musculus
atatacatacacacatacatgcatatacatacatatgtatgcatatatatatgcatatatatacatatatatgtgtgtgtgtgtgtgtgtgtgtgtgtgtgtgt

SEQ ID NO: 95591 - DNA, 105 bp, Mus musculus
tatatatatgcatatatatatgcatacatatgtatgtatatgcatgtatgtgtgtatgtatatatatatatatatatatatatatatatatatatatatatagtg

SEQ ID NO: 95592 - DNA, 99 bp, Mus musculus
gatctgtacagaactgtctcatgtgctaagaagcagagaaacaaatgaggttctatatttattatttagcattaagaggcgtgagatgtgtgtaagatt

SEQ ID NO: 95593 - DNA, 87 bp, Mus musculus
taggagaccactggtaaacacatgtgttttacttgaagtttagttactaacctaacttctagataggacattaccaatcactcacta

SEQ ID NO: 95594 - DNA, 60 bp, Mus musculus
caggctggaccttttatatatatgtatatccttgtatatatgtagcagaagtacagcttg

SEQ ID NO: 95595 - DNA, 131 bp, Mus musculus
gtgtgtgtgtgtttgtgtatgtatgagtgtgtatgtatactgttttaataatatatgtgtaaatatatatatgaatgtgcatatatatgagtatatatatgtatacatatatattatggtgattagtatat

SEQ ID NO: 95596 - DNA, 85 bp, Mus musculus; identical to SEQ ID NO: 57439

SEQ ID NO: 95597 - DNA, 118 bp, Mus musculus
gcttcaagcccaaagtaggatccatctcaaggggaggtcccaaggtctgacactatcactgaggctatggagcactgacaaaaatggaccatcctgactgccctctgaaagacccaac

SEQ ID NO: 95598 - DNA, 107 bp, Mus musculus
gagaacagggtatgggtaattgttaagttttttggtcttgatcatctagaatattaatttattctgtcttggttttactcagtattctcaggaactcataaactctc

SEQ ID NO: 95599 - DNA, 107 bp, Mus musculus
gtcaggtgaaagaagtcagtgcgcaggacccctccatgatttctgcatcagcttctgcttgtgggtttctactgtggattggttctgtcctgacttctttagatgat

SEQ ID NO: 95600 - DNA, 143 bp, Mus musculus
gcagaagtcttgggttgtggaggatgttgttcttgcctgcaaaactcccactcctctcctgtgactctgtctctctctcttcaaaagcatgttgctgccacgtaagtggaaggtcccatcatttttgagataggctgactgtc

SEQ ID NO: 95601 - DNA, 85 bp, Mus musculus; identical to SEQ ID NO: 57470

SEQ ID NO: 95602 - DNA, 96 bp, Mus musculus
gatcagccttagtctatggttataagataggatgcatgggataatttcaatatttttgtatctgttgaggcctgttttgtgagcaattatgtggtc

SEQ ID NO: 95603 - DNA, 71 bp, Mus musculus
agtttggctatgtgtgtcagtatctgtctgagttaaatactgggaggagcctcacattggaaagccacgct

SEQ ID NO: 95604 - DNA, 119 bp, Mus musculus
agctgtggatgaagccagttgctaggtactagcatcatttcaagactaatatagtaagttttacttttttaaatcaatgcttctctacctttctaatactgcaaatcttcactatagtt

SEQ ID NO: 95605 - DNA, 80 bp, Mus musculus
gggctgctgaaacacactcactctatcccgtgcaatgagactagcctcgtgtggtgcaagagctgagtggccagcgacct

SEQ ID NO: 95606 - DNA, 95 bp, Mus musculus; identical to SEQ ID NO: 95576

SEQ ID NO: 95607 - DNA, 192 bp, Mus musculus
tatatatatgtatatatacatatatacatatatgtgtgtgtatacacatatatgtatatatatgtatatatgtatatatatatatatatacacatatacacacatgtatgtatatatatatgtgtgtgtatacgtgtatatatatatatatatatatgtgtgtgtgtgtgtgtgtgtgtgtgtgtgtgtgtg

SEQ ID NO: 95608 - DNA, 115 bp, Mus musculus
cacacactgtaaagtattgtttatgttcatatatatgtgtatatatatatatgaatacacttatatgtttatgtgcataattatagcctatataaagcatatttgatgctgtttg

SEQ ID NO: 95609 - DNA, 75 bp, Mus musculus
gtctactaacctagctctggaagctctcagagactgagccaccaatgacagagcacacatgggttggttctaggc

SEQ ID NO: 95610 - DNA, 60 bp, Mus musculus
gtgtgtatgtatgtatgtatatatgtatgtatgtatgtatgtatgtatgtgtgtgtgtat

SEQ ID NO: 95611 - DNA, 118 bp, Mus musculus
agaaaaggcagcccagatataggaacatatgctatgggcaaacaacattttttgattttttgaagagcccatgctacatttgttcatttctatataaagatcaagctgcagggagtct

SEQ ID NO: 95612 - DNA, 120 bp, Mus musculus
ggaggagagagagtgtcctaagcttgttctggctgcttggcttgatgaagaccatggctgagaacacagagaggccacctgcaggagattagaggtgctgctctttaaagacagacctgc

SEQ ID NO: 95613 - DNA, 114 bp, Mus musculus
cttgaaaaatggaagaagagttaaatgtatactgtgagcctgtctgtttgcctgatcaggatagactgggaggctccctggtgaagtgtattaaagtggtcctcctgcaaagag

SEQ ID NO: 95614 - DNA, 70 bp, Mus musculus
tgtgtgtatgtgtgcatgttcatgtatgtgaagaaccatgtgtatgtgtgtgcacatatacctgtgcaca

SEQ ID NO: 95615 - DNA, 72 bp, Mus musculus
gttatggttatgtagcttgatgtctttgttaggtttctaacagggagattagtctgtctttatctctgtggc

SEQ ID NO: 95616 - DNA, 115 bp, Mus musculus
cctcctgtcctaactaaaacaagttggtgccatgacttggggattttactatgacagaacagactgagttttgggaaggattatgaaaggatttgggaatttggggccagagtgt

SEQ ID NO: 95617 - DNA, 117 bp, Mus musculus
tctgtggttgtaagaataaggctttgaactaagtaaagaatcttgctattctaacatagtagaggtagtagattcttttttaagtccaaaacatacaagcgtttaaatgctgctagg

SEQ ID NO: 95618 - DNA, 85 bp, Mus musculus; identical to SEQ ID NO: 57439

SEQ ID NO: 95619 - DNA, 106 bp, Mus musculus
acaaattggaacatatatatatatatacacatgtatattcatgtatatatatatatatatgtgtgtgtgtgtgtgtgtttgtgtgtgtgtgtgtgtgtgtgtgtgt

SEQ ID NO: 95620 - DNA, 73 bp, Mus musculus
taggactgtgactgaatgtacacttgtctgcccattgctgagcattcacttgagcatcatagttccattccta

SEQ ID NO: 95621 - DNA, 106 bp, Mus musculus; identical to SEQ ID NO: 82828

SEQ ID NO: 95622 - DNA, 103 bp, Mus musculus
ccaggaatctggcaggaatctagccatctgtttttgcctgagtctcaggtgtgcccctctgagtctctgggtctcaacctgctctacctaccaagcttcctgg

SEQ ID NO: 95623 - DNA, 104 bp, Mus musculus
tctagttatctctgttgttagctggtcttactgtctctgactgtggcttgtccctcctgcaagcctgtttgtcagtactcctagccaaccagttatttcctgga

SEQ ID NO: 95624 - DNA, 75 bp, Mus musculus
gtatgtgtatgtgtacgtgtacgtgtacgtgtacgtgtatatgtatatgtatatgtacacacacattatatatat

SEQ ID NO: 95625 - DNA, 86 bp, Mus musculus; identical to SEQ ID NO: 69338

SEQ ID NO: 95626 - DNA, 110 bp, Mus musculus
gacttcttcctttcaaatttgtattcccttgatctctttttgttgttgaattgctctggctaggacttcaaatattgaataggtagagagagggagtgggcagccttgtc

SEQ ID NO: 95627 - DNA, 80 bp, Mus musculus
ggcttgagcagaatgcagtggattgcactggtcttgatttccatttactgtttctcagtctctctgcaaccttctcaacc

SEQ ID NO: 95628 - DNA, 128 bp, Mus musculus
aaggttaaaaggacacatggttgctgaggtggtggactccagataaaattcagaacctgtgagtgtcactgtcaaacaacttttactattttcagcttttttattgattttcctcccttcagatcaca

SEQ ID NO: 95629 - DNA, 111 bp, Mus musculus
taccaagctctttttgttttactgaatattgttcatatgactcatgtcacatttttttttcatatacagttgttattggataactcagtgaccaaaagaggaactgatgta

SEQ ID NO: 95630 - DNA, 85 bp, Mus musculus; identical to SEQ ID NO: 57439

SEQ ID NO: 95631 - DNA, 71 bp, Mus musculus
gtacaaatatatatacatatatgtatacatatacatttagtttacatacatgtgtgtgtatatatatgtat

SEQ ID NO: 95632 - DNA, 90 bp, Mus musculus
acaatcaagggtgagagtagtcagtggtcagtggtcagtgtgagaatgggccatcagagagcagaacacatactctcacagggtgagagt

SEQ ID NO: 95633 - DNA, 74 bp, Mus musculus
gagccacacataataataattcaaaggcttgaagctctcaagcaagccttaagattatttcattttgtgttttc

SEQ ID NO: 95634 - DNA, 78 bp, Mus musculus
acttttgttcttgtttattaaagaaaaaaacatgctggatcctttggatccattttttctctattaatagagcacagt

SEQ ID NO: 95635 - DNA, 85 bp, Mus musculus
agattggatatggatatgaagctatatatatatttttttcatgtatatattcatatatatatatcttcatatccatatctaacct

SEQ ID NO: 95636 - DNA, 109 bp, Mus musculus
ttctttgccttacagaagctttgcacaaattaaagtttttatattaccttcaggtggaaacaattaagagaattaaataaaggaatgatttgtgtcataagtgcaagaa

SEQ ID NO: 95637 - DNA, 117 bp, Mus musculus
gaacattactgccttggttctaaagagcatccaagaactgataaacaaaagtacatatttttaaattgtttactacttcctggattcttattactttccttatggtcacagaagttc

SEQ ID NO: 95638 - DNA, 82 bp, Mus musculus
agccagtcaaaaggaatagtgtctgtcttgttctgtctccctgttctaacacatgcagtagaaccctatttcttttagggct

SEQ ID NO: 95639 - DNA, 104 bp, Mus musculus
gatgttatttcaagtatatgaattatagattctcacatacatttcagatatatctttatttatgtgttgaagatatttgtgcatattcatgagatgaatcagtc

SEQ ID NO: 95640 - DNA, 102 bp, Mus musculus
gaaattccttcagacaggtacaattatgggtcagagttgtgactgtggaatgaaccccctctccctcatttgatgccctgttttcctgctggaggtgagctc

SEQ ID NO: 95641 - DNA, 85 bp, Mus musculus; identical to SEQ ID NO: 57439

SEQ ID NO: 95642 - DNA, 106 bp, Mus musculus
acaggtgaaaggatgtcttggtaacgcaaatacatgaaagacttttttcctgaagtagacacaggtagaaggatgtttagatatagcagccacgtaaaaggcctgt

SEQ ID NO: 95643 - DNA, 115 bp, Mus musculus
atataaataatacatgttatatgtatttgatatgtgaaatatatatttgattactatacattgaaatctatatatttgaatattaatatatacatttatattatattatttatgt

SEQ ID NO: 95644 - DNA, 85 bp, Mus musculus; identical to SEQ ID NO: 57439

SEQ ID NO: 95645 - DNA, 85 bp, Mus musculus; identical to SEQ ID NO: 65137

SEQ ID NO: 95646 - DNA, 85 bp, Mus musculus; identical to SEQ ID NO: 57470

SEQ ID NO: 95647 - DNA, 85 bp, Mus musculus; identical to SEQ ID NO: 59783

SEQ ID NO: 95648 - DNA, 87 bp, Mus musculus
tccataggaaactttgtactgaatgatgcttcttcccactcaagtcagaatagtgtcagaagaacaatgtatcaaatgtgctgtgga

SEQ ID NO: 95649 - DNA, 61 bp, Mus musculus
tcagggactggagagatagtttggtggataagagcactgactcctcttccagaggtcctga

SEQ ID NO: 95650 - DNA, 64 bp, Mus musculus
gttttctacagacagcagagagtgagttcttgaaaggactgcactcctcctgagaatggggaac

SEQ ID NO: 95651 - DNA, 85 bp, Mus musculus; identical to SEQ ID NO: 57470

SEQ ID NO: 95652 - DNA, 85 bp, Mus musculus; identical to SEQ ID NO: 65137

SEQ ID NO: 95653 - DNA, 106 bp, Mus musculus
aactcatccaggaagagcttactcaatctcacagtcagtcattcagaaaatccaagcaggaacaaaaggtaggacactggatgttgcttgctcctcgtggtttgtt

SEQ ID NO: 95654 - DNA, 76 bp, Mus musculus
aaccttagaagcatcgttttcaataaattgactccagaatggggagtcctttgttctaggatgtatacttgaggtt

SEQ ID NO: 95655 - DNA, 73 bp, Mus musculus
gttttgagagtcacaaagatttttttttttaagggctgccttagatacttttaatctcggttattttcaaagc

SEQ ID NO: 95656 - DNA, 70 bp, Mus musculus
atgtttgatttgtatgtatgtatatatgtttccagggatcactgttttgtacatacatacaagtaaaggt

SEQ ID NO: 95657 - DNA, 107 bp, Mus musculus
aatgtgtagtcattttgtagaacttgggaggtacagagaagaaagggaaagttccacagcatgttttctttttttttttccattttttattaggtatttagctcatt

SEQ ID NO: 95658 - DNA, 72 bp, Mus musculus
tgaattcagaacagggagagtgaaaggccacagaggtgtgagtctcactcacattctctcaatttgaactta

SEQ ID NO: 95659 - DNA, 83 bp, Mus musculus
gtgtacatgtgtgactgtgtctctgtatgcatgtgtgtctgcatatttatctgtgcatgcatgtgtgtgagtgtctctctgtg

SEQ ID NO: 95660 - DNA, 80 bp, Mus musculus
gtatctgtgtatatctatgtgtgagtatgtctctgtgagtgtgtgagtatatgtattcgtacatgggtgtacctatgtat

SEQ ID NO: 95661 - DNA, 85 bp, Mus musculus; identical to SEQ ID NO: 57439

SEQ ID NO: 95662 - DNA, 72 bp, Mus musculus
acagttctcagccctgtctaactcagggagtgagctgtcattcccactctctgaaaacaggctgttatttgt

SEQ ID NO: 95663 - DNA, 81 bp, Mus musculus
atgggacaatttcaatatttttgtatctgttgaggcctgttttgtggccaattatacagtcaattttggagaaggtcccgt

SEQ ID NO: 95664 - DNA, 107 bp, Mus musculus
tataggttttaagcatatatgtacatacatgcatatatgtatgtatatgtgtatatatatgtatatatatgtgtgtgtgtgtgtgtgcgtctgtgtgtgtctctgtg

SEQ ID NO: 95665 - DNA, 60 bp, Mus musculus
tctgtctgtctgtctgtccaccatgtgcacgcattgctgtagaggctagaagagggcaga

SEQ ID NO: 95666 - DNA, 74 bp, Mus musculus
tctgactccgactctgtcttactaacagtctctgtcaaaaagcagttctggtgagtgggatatttgtgttagag

SEQ ID NO: 95667 - DNA, 67 bp, Mus musculus
tatatgtgtgtctagtatatgtctatattatggtagcatattatatatatatattcatatacatatg

SEQ ID NO: 95668 - DNA, 95 bp, Mus musculus
acacatacacatacacactatatatatatatgtgtgtgtgtgtatacacatatatacacacacatatatgtatatacacacatatgtctatatgt

SEQ ID NO: 95669 - DNA, 112 bp, Mus musculus
atatatgtatatatacatatagatatgtgtgtatatacatatatgtgtgtgtatatatgtatgtatatatacatatagacatatgtgtgtatatacatatatgtgtgtgtat

SEQ ID NO: 95670 - DNA, 96 bp, Mus musculus
gagagaacaaattggaagttgggtaaagctcaatgcttgttgttagtgatgcacttcctccaggaaagttatagccccacactcccatcgcctctc

SEQ ID NO: 95671 - DNA, 85 bp, Mus musculus; identical to SEQ ID NO: 57439

SEQ ID NO: 95672 - DNA, 85 bp, Mus musculus
ctctctcatgtctgtgtctgtcagtcaattcttgccaactccatgcacacctgccagaacccctgattcccacggattgagaggg

SEQ ID NO: 95673 - DNA, 110 bp, Mus musculus
tgtgtcactgggtttagaatctcatgtctccctctcagcccctgtctgcttctgtgatgctaaggtaacagggaaagcagtgagcaggagtgtttgtgctcatcaacaca

SEQ ID NO: 95674 - DNA, 68 bp, Mus musculus
gtgtgtgtgtgtgtgtggtgttgtgcttgcttgtgttcataggcacaagagtgtgtgcagatgctcat

SEQ ID NO: 95675 - DNA, 81 bp, Mus musculus
gtctgtttctagtcagtgttcacagaccagggatggcaagagatcccgaatcagtgatttcttccactgctagatctagac

SEQ ID NO: 95676 - DNA, 67 bp, Mus musculus
tagggagtgggctttgaggtttcagaagcttaagccaggcccagtctcactctctgcctgctgccta

SEQ ID NO: 95677 - DNA, 81 bp, Mus musculus
gcttgtatgcctgtgcatagatatatgtatgtgtgtgtatgtgtatatatatatatatgtatgtatgtatgtatatattgc

SEQ ID NO: 95678 - DNA, 73 bp, Mus musculus
gaactggccctcaatatatctctgctatattatactatgtatgtatgcatgtatgtatgtatgagtgcagttc

SEQ ID NO: 95679 - DNA, 104 bp, Mus musculus
agctttcatacacactgttatgtttatctgtgtatttatttgtttactgagacagagagtctcattcagatgacccagactggccttgccttgtatccagagtt

SEQ ID NO: 95680 - DNA, 71 bp, Mus musculus
gatcgatgaaggtctgtcatggagtaagctgaagcttttcagacacactatctcagtcctttagtgtggtt

SEQ ID NO: 95681 - DNA, 169 bp, Mus musculus
tatatgtatatatgtatgtgtgtatatgaatatgtttatgtattgtgtatatgtatatatgtattatgtgtgtatatgtgtatatatgtatatatgtgtatatatatcatcaagcaaacactgtatatacatatacatacattatacatatacatatacatatacatat

SEQ ID NO: 95682 - DNA, 81 bp, Mus musculus
cacaatggaccagagtcatttgctgtgtgggaatgccagcaacctcacattttctatgagtctctctgtctctaaactgtg

SEQ ID NO: 95683 - DNA, 111 bp, Mus musculus
tgtgatgtaaatttgggcagggcacagacttatctcagaagatacatagcacatctgtagtgtgttagtaactgaaataacaactttaaaatctgccatttatacataaca

SEQ ID NO: 95684 - DNA, 107 bp, Mus musculus
gaggcacagtcaggctttgggtgaggtgaggcactaattaaaatggcaggtttgaaaagaactatgaatttttcctttgaacgtcgaaacaaggctcttctgttttc

SEQ ID NO: 95685 - DNA, 91 bp, Mus musculus
ttgagacatttgcatggatcatgttcaacatcttacagtctcagtcgctgactgcgtctttgaagtagttgcagccatgtcccaggttcag

SEQ ID NO: 95686 - DNA, 85 bp, Mus musculus; identical to SEQ ID NO: 57439

SEQ ID NO: 95687 - DNA, 117 bp, Mus musculus
attcatagcagtagaagcatgcaggtaaatgtctaaaagttctatgtttttaaaaatatatctgatttgtagggtttctcatttctgtggtgtatgacttccagggcttaaatgaat

SEQ ID NO: 95688 - DNA, 85 bp, Mus musculus; identical to SEQ ID NO: 57470

SEQ ID NO: 95689 - DNA, 65 bp, Mus musculus
tctgtctctctctctctctctcagagagagagagacagagacagagagagagagagagagagaga

SEQ ID NO: 95690 - DNA, 77 bp, Mus musculus
gtgtgtccctgtgtctgtgtgtccccaacaaaaggctttgctctctgttctactgacatacacacaaagtatcacat

SEQ ID NO: 95691 - DNA, 96 bp, Mus musculus
gtcaccgtgctcagcgaccatgtccttcatctagtgtcctgtgcctcgcccacagttgctgctcagaacacagagaggactcaaagagtatttggc

SEQ ID NO: 95692 - DNA, 104 bp, Mus musculus
tgtgtgtgtgtgtgtgtgagatgttgggacaggtaggtgtgtgtatgtgtgacacacacacactcacacacgcatgccctacaggaacacattatgcgaacaca

SEQ ID NO: 95693 - DNA, 72 bp, Mus musculus
gtgagcacatgtggccatgtatatttgtagatgtgtccacaagtatatgtgcaggattgtacatgtgtacgc

SEQ ID NO: 95694 - DNA, 83 bp, Mus musculus
ggctgacacactctctctatttttcaattgcccacgatggcaattaaagcttggatagataagatgtgtgtctttggaaggtc

SEQ ID NO: 95695 - DNA, 68 bp, Mus musculus
gtgtgtgtctctgtgtgtgagcacatgagcacatgtgcccgtggaggccaaaagagagaatgatatgc

SEQ ID NO: 95696 - DNA, 96 bp, Mus musculus
gtccactctgtgtccatgtgtgtctattggtggtggcaagatgtccacagcagccagacagtgtctcactcagataaaactgtgaccagagaagat

SEQ ID NO: 95697 - DNA, 70 bp, Mus musculus
gatgatgggtgagccttggaaggtcgttcctgatgctggtctgactttctcacactcttggacccgcatc

SEQ ID NO: 95698 - DNA, 86 bp, Mus musculus
cctggatttcctttacagatatcatggagtcagtcttattcactgtttaaaggccatgctttttggagcctgtactagggaagagg

SEQ ID NO: 95699 - DNA, 66 bp, Mus musculus
ggctgtctcacactcactttgtagctgcagatgaccttgagctaccgagaatgaccttgagctgcc

SEQ ID NO: 95700 - DNA, 88 bp, Mus musculus
gcatgcatggatggatatatgtaagtataatatggatgtatataagtgtaatatatatacatatatttgcatatgtgtctgtgcatgt

SEQ ID NO: 95701 - DNA, 100 bp, Mus musculus
caataaagtttaaaaaatatagaaagtctgtttttcctggctgactctttccctctacggccaggtctactgcagataattttatgtgtgaccaacattg

SEQ ID NO: 95702 - DNA, 92 bp, Mus musculus
agaaagtttcaatggctctgtctgactcagtttgtagcaaatggaaatacagtgcatgaaactgagagaagataggatgacaggatgcttct

SEQ ID NO: 95703 - DNA, 93 bp, Mus musculus
tacacagacatacacacatacatgcactcacacagagacacatactcacatattcctctctcacatataaatgtgtgtgtgtgtgcatgtgtg

SEQ ID NO: 95704 - DNA, 110 bp, Mus musculus
gcaggccaggtggtccacagcatgggtcagcacactgtgggactgtctcagtgaatgatgttgccctagccctcagtgatgctcctttgtttatagccattgctcactgc

SEQ ID NO: 95705 - DNA, 102 bp, Mus musculus
ctaggccttcactatggctcagcactcactagctctctcagagaagtttcagtcctcttagctacttcacagtaagtatctgcaccagggtgtctgcactgg

SEQ ID NO: 95706 - DNA, 77 bp, Mus musculus
gttgctttagagctaagtttgtacttaaaaagttgttctatttaagtttatatagacatagtattttctgtagtagc

SEQ ID NO: 95707 - DNA, 101 bp, Mus musculus
caaacttaagtaggggtatcaagagtttaattttgaatatttccaatcagtaattcggctaggtattcagaaataaataagcagctaaatatttgggtgtg

SEQ ID NO: 95708 - DNA, 86 bp, Mus musculus
gtgtgtgtgtgtgtgtgtgtgtgtgtgtgtagcctacatgcatatgtatgtatgtatgtatgtatgtatgtatatatatgtatata

SEQ ID NO: 95709 - DNA, 135 bp, Mus musculus
atatatagctttatatatatacctatagcttatatatagctatgtatagctatatgtatttatatttatatatagctatatttatagcctccagatatgtatatatatgaaaatatatatagctatatataaagt

SEQ ID NO: 95710 - DNA, 68 bp, Mus musculus
gtatgtatgtatgtatgtatgtatgtatgtatgtaggtaggtatgaatgtacgtatgtaggtatatat

SEQ ID NO: 95711 - DNA, 106 bp, Mus musculus
cctgctgggcctcatgtgcctgctcacgagcttcttcatctctgactcacagctcagctgactgaggagagaaaggcttcaaaatggctgtgagcgttcctgcagg

SEQ ID NO: 95712 - DNA, 78 bp, Mus musculus
ggtagacagcaaagtgcagcaggagctgctgtgtggcaccctgatgtccacagtctgtctctgtcccagcctgtcacc

SEQ ID NO: 95713 - DNA, 83 bp, Mus musculus
gtgacaatggctgtgagatatattctgcttgaatacagaaaaaatctgtatggtatgattatcatcatcatcatcatcatcat

SEQ ID NO: 95714 - DNA, 85 bp, Mus musculus; identical to SEQ ID NO: 57439

SEQ ID NO: 95715 - DNA, 86 bp, Mus musculus
tccacactgtgcttcgcactatgtacaaagatgtttcgtcccacagatcatctttctctgtgtgtgtgtctcaaagggtttgtgga

SEQ ID NO: 95716 - DNA, 85 bp, Mus musculus; identical to SEQ ID NO: 57470

SEQ ID NO: 95717 - DNA, 58 bp, Mus musculus
gctgctgcatcctctgcagtctccttggagccaggagagatcagagagatcagagagc

SEQ ID NO: 95718 - DNA, 101 bp, Mus musculus
cctgaaagcagctgtcggagctatgtgatctacatctcagagaagagtctgcacagaggaaagagcacttctgagagagaaacactccgcagttcctctgg

SEQ ID NO: 95719 - DNA, 83 bp, Mus musculus
atgtgggttggtgagatgactcagcggttaagagggctgactgctcttccagaggtcttgagttcaatccccagcaaccacat

SEQ ID NO: 95720 - DNA, 91 bp, Mus musculus
tgtgcgtgtgtatgtgtatctctgtgtctctgcgtttgtctctctctcttagagacaaacacacacacacacacacacacacacacacaca

SEQ ID NO: 95721 - DNA, 114 bp, Mus musculus
gtttgcactctggaactgtcagagggtgtcaggcacagaggactctaggctgcccccgacaggcacacacacagtcactcccaagccccctctggtgctctactcagcgcctgc

SEQ ID NO: 95722 - DNA, 59 bp, Mus musculus
ggagggggtggggcagtggctcaacaggttaagagcactgactgctcttccagagatcc

SEQ ID NO: 95723 - DNA, 94 bp, Mus musculus
ggaagacctcacatggcgagccaggctggtctcccactgtcactgagtgataactagccccttggagaactggagagtcacttggggtacagcc

SEQ ID NO: 95724 - DNA, 64 bp, Mus musculus
acgtgcagggactcatgcgctggagtgagtgcacgtgcctctgtgtgtgtgtctgtctgcacgt

SEQ ID NO: 95725 - DNA, 64 bp, Mus musculus
gtggtgagggaaggcagatatacgggacagcttggctcactttccctgtctccctccaagccac

SEQ ID NO: 95726 - DNA, 76 bp, Mus musculus
agcttcaagtgtccccaccagtggctgtggttatgtgtgtgtgcacacacatgctcacactcacacactcatagtt

SEQ ID NO: 95727 - DNA, 130 bp, Mus musculus
gccgagcacctgtgagcaactgcctcatctgctcatctttgaatgccctgtctcagtttctctctctgcttggtgggtcctgtgccggcccccaagaggctattaccactggctggtcgaccctgaacta

SEQ ID NO: 95728 - DNA, 80 bp, Mus musculus
gtcacccccacgatgctctgagtctctccctgcctctcctaccactaggtggaagagcccagattctttgtacaagtgac

SEQ ID NO: 95729 - DNA, 71 bp, Mus musculus
tctgaggccaggcaggccctgtctttctcaggctagagccgactgatgtcagacagtgtctccctcagacc

SEQ ID NO: 95730 - DNA, 118 bp, Mus musculus
gtagaactgcaaagcagaagatgaaaagggtgggttttactgtaggagaattctatttattttacattatatttttaaagatttatttatttttattttatgtgcttgaacattctgc

SEQ ID NO: 95731 - DNA, 78 bp, Mus musculus
gtgctcaatgctgagagagcagcagagagcagcgctcaggtcgcctgagtgttgctctctgcctcagtcactgagcac

SEQ ID NO: 95732 - DNA, 62 bp, Mus musculus
gtgtgtgtgtgcatgtgtatgtgcatatgtgtgtgtgcatgtgtgtgtgtcacgacgtgcat

SEQ ID NO: 95733 - DNA, 102 bp, Mus musculus
tatatacactaattagtattatatatatacctgtatgtatgtatgtatgtatgtatgtatgtatgtatatgtgtgtatatgtatgcatagatgtatatgatg

SEQ ID NO: 95734 - DNA, 114 bp, Mus musculus
cagatgccaagagggaggagtctcatggctggggctctctgtgtgtgtccctctttctgtccacaggtagcaaggggacatggctggggccctctgtgtatgtccctctttctg

SEQ ID NO: 95735 - DNA, 84 bp, Mus musculus
gtgcatgtatgtacatgtgtatgtgtgcatgtgcatgtgtgtgtttgtatatgcatgtatgtgtgtgcatgtacatacatgtat

SEQ ID NO: 95736 - DNA, 106 bp, Mus musculus
gagcctgggctcgggagcgacgagaggtcagagtagagagcgaccacaaattacaacgtcccttcatctctctattttaatttaccctcagtctctgcttgggctc

SEQ ID NO: 95737 - DNA, 116 bp, Mus musculus
tgggagagagagacaagaagacatcaagggattcagtggtcaggccttggacgccccgtggctgcctctgtccctgtcaacggtctttactctttgctttgtcctcagtggtccca

SEQ ID NO: 95738 - DNA, 95 bp, Mus musculus
tgccaagccatgtgactggagagactgagcaaacggggtaggtaataatagaacttttttttttttttttttttggtcttaaacaaggtgtggca

SEQ ID NO: 95739 - DNA, 68 bp, Mus musculus
gggaaccaggacaacctctcaccgtctctctggccactgcaggactgctggtgagagcctgtgctctc

SEQ ID NO: 95740 - DNA, 71 bp, Mus musculus
atatttgtgtgtatgtatatatgtgtgcttatatatatatatatatatatatatatatgcacatatatatg

SEQ ID NO: 95741 - DNA, 96 bp, Mus musculus
agttaaatttgtcggtctgccttatctctgtcttactctgtcttgcgtgttgtgcttagtgggcagggttaaccaggcaggagggatgatttaact

SEQ ID NO: 95742 - DNA, 102 bp, Mus musculus
tccaaaagaaagcggctgagaccttgcacacacggtcagtgggttgggcacagcaccccagtccttctgtctgtctgtctgcactgctgcagctgctctgga

SEQ ID NO: 95743 - DNA, 73 bp, Mus musculus
tacatgcatatatatgtacatatatatatgtctgattataagcagcctatataatgtcacttgtatgtgtgta

SEQ ID NO: 95744 - DNA, 88 bp, Mus musculus
gtgcgactgtgcgagcatgagagtgtgtgcatgtgcacatgcgtgggtgtgcatgtatgtatgtacgtatgtatgtatgtatgtatgt

SEQ ID NO: 95745 - DNA, 69 bp, Mus musculus
tgtgctgctcgatgccgtcgtgctggctcagtgacagaaggacgtgagcccggctccctgtaagccaca

SEQ ID NO: 95746 - DNA, 67 bp, Mus musculus
gtgagcctggtattgtctgtgggaggcaggtctgccacactgcctgactgtgaggaaaccgactcac

SEQ ID NO: 95747 - DNA, 86 bp, Mus musculus
gaggtaggcagatgtgtgtgaggtcaggccagtctggtctacataaagattccaggacagccatggctacatagagaccctgtctc

SEQ ID NO: 95748 - DNA, 113 bp, Mus musculus
gtttggaaacgtgggggaagagaaggttcttcaggccctctgtgactccctgactcccagggcgggggtgagatcggcatcatggcgttccgaagctgttttccacggcaagc

SEQ ID NO: 95749 - DNA, 66 bp, Mus musculus
ctcctgtctctctgcctgcctgagacatgccttgggcagaacgcacaggagagtgtcctacaggag

SEQ ID NO: 95750 - DNA, 81 bp, Mus musculus
gtggtcagagcagcagggacaattgacaattcaggctgtggacctgtctgtctatctgtctgtctgtctgtctgtctatct

SEQ ID NO: 95751 - DNA, 91 bp, Mus musculus
ataaatatagaggcaccaaatgtaaatataaatatatatatatatatttatatatttgtgtgtgtgtgtgtgtgtgtgtgtgtgtgtgtgt

SEQ ID NO: 95752 - DNA, 115 bp, Mus musculus
gtaccatgtacgcaaaggacctagctcagacccatacgaggctccctaattgtcacttcagtctctgtgagcccctatgagccctgggtagtagattctgtggaccatgttttac

SEQ ID NO: 95753 - DNA, 115 bp, Mus musculus
tttctcattccagactttggctctggtggtacaatgtctctgtctgtctgtgtcctttttgaagttactacgggggctggggcgggggggggggggagttatccagaggtcagag

SEQ ID NO: 95754 - DNA, 74 bp, Mus musculus
gactccatgcagctcagtgaggatggagtcctggctgtcacaagtccatctgtccgtctgtctgtccgtctgtc

SEQ ID NO: 95755 - DNA, 78 bp, Mus musculus
ttactgtgtatacatgtgtgtatatgtatgtgtatgtgtgtatgtatgtatgtattatgtatgtatgtatataagtaa

SEQ ID NO: 95756 - DNA, 71 bp, Mus musculus
acccacacaccaaggcagctgaacctctcaggcacactccctgagagatgagtatcaggtgggtggagggt

SEQ ID NO: 95757 - DNA, 114 bp, Mus musculus
ggggctgttgtgtgtttgccaggaggctctgcttctgggctgtcactgtctcggtctgagagttagatagagcacaggacagggggtggtgagccaggcaaagttgtgtgccct

SEQ ID NO: 95758 - DNA, 77 bp, Mus musculus
gtgtgtgtgtgtgtgtgtgtgtgtgtggtgtttgtgtttgtggatgtatctatgtatatatgtatatgtgtgcatat

SEQ ID NO: 95759 - DNA, 110 bp, Mus musculus
agagaggacagtgggacgtggcgtgacatccaggttctctgtgagtctgtatgtaagagaggacagtgggtcgtggtgtgacatccagggtgctcctgctggtggttttc

SEQ ID NO: 95760 - DNA, 87 bp, Mus musculus
gaaacttgaagctcaccattttggctaggctggctggccaacaaactcctgtctgtctgtctgtctgcctgtgcctgcttttgtttc

SEQ ID NO: 95761 - DNA, 66 bp, Mus musculus
tgtgtctgtctgtctgtctgccttcctgcagaacatctgtcagaggcaaggaggcaggtggattca

SEQ ID NO: 95762 - DNA, 85 bp, Mus musculus
ccatgtacttatgtgtacagatttccagttcttgcaacagaatccatcctctgtctgggtcactctgtgggaaaataaaggctgg

SEQ ID NO: 95763 - DNA, 117 bp, Mus musculus
tggatgtggccttactgaggaagtgtatcactggccaagtgtctctgtctatctgtctgtctgtctctctccacctgctgcctgctgatcaggttctaaagttcagctactgctcca

SEQ ID NO: 95764 - DNA, 125 bp, Mus musculus
acatgcatatatatatatatatatatgtgtatatatatacatatatacatatatacctatacatgtatgtatatatatgtatgtgtatatatgtgcatgagtatatatgtgtgcatgtgtgtata

SEQ ID NO: 95765 - DNA, 108 bp, Mus musculus
ctcagagacactcaaagggacatgtagggctctctgggcaggtgcagacattctctctgcttcatttcttcacagcagaacccttacagttccaggaggcttctgcag

SEQ ID NO: 95766 - DNA, 76 bp, Mus musculus
gtatgtatttgtgtatgtatgtatgtatgtatgtgatgaatacatacgtacgtatggatggatgatgtatgcatgc

SEQ ID NO: 95767 - DNA, 76 bp, Mus musculus
gtagctctcactgtctctgaggtggcccagaggggctccaggacctctctcttgcttcaggggcccagagaagaac

SEQ ID NO: 95768 - DNA, 113 bp, Mus musculus
ggctctcaaaatatgtctatatgtatatgtgtgtgtgtgtacatatatgtatatatacatacacagacacacacacacacacacacaagcacatctgagctccatctccagcc

SEQ ID NO: 95769 - DNA, 123 bp, Mus musculus
tatgtatgtgtatgtgtgtttgtatgcatgtctgtaggtatatatgtgtgtatgtatgtgtgcatatgcatgtatgtgttctgctatgtatgtatatggctgtatagatacacgtgtatatgt

SEQ ID NO: 95770 - DNA, 75 bp, Mus musculus
gtgtttgagacagggtctctctgtgtaacttagaactcaccatatagaccagactggccttgaactctcagatat

SEQ ID NO: 95771 - DNA, 74 bp, Mus musculus
actgtctgcgtgcctggttcccagagagacgagatgacagtgttggatcccctggaactggagttgcagacagt

SEQ ID NO: 95772 - DNA, 102 bp, Mus musculus
acagcaatgctcacttgctcagcaggatagtgtgaggtccagcctgagccacctctgaccctcactcactggatccagtgctaattagcgaggcttggctgt

SEQ ID NO: 95773 - DNA, 112 bp, Mus musculus
gtatgtatatataagtttccatatatagccatatctatatatctatatatgcatatctatatctatgtatatagctctatatatccatatctatatatgtatatgtacacac

SEQ ID NO: 95774 - DNA, 115 bp, Mus musculus
gctatgtatgtgtgtgtgtatatatatatatatatatatatatatatatatatatatatgtatgtatgtatctgtgtgtgtatgtatgtatgtatgtatgtatgtatgtatgtat

SEQ ID NO: 95775 - DNA, 142 bp, Mus musculus
ctgaggaccctatgctatatcctggtgtgcaggctgacagaggctcacactcagagacagagaggcagggattgagagagagacagacagacagacagacactgggccaggtgtaagcttttgaaacctctaagcccacctc

SEQ ID NO: 95776 - DNA, 86 bp, Mus musculus
gcctacctcttggcagatgaactcaccgagcttagaaggtggcctctcattctctctctcgctgcaggacatctgtttttgggcag

SEQ ID NO: 95777 - DNA, 79 bp, Mus musculus
gagttctgacatttgagctaagactgtctggttttcacgacaagtgcttgttaactcctgatcagtctcagcagacctc

SEQ ID NO: 95778 - DNA, 87 bp, Mus musculus
gctgttaagattacaggtggacaccatctctgttggttttctttctatgtaagatcctaagagactctgggtctctgtttctttagt

SEQ ID NO: 95779 - DNA, 90 bp, Mus musculus
cagtgaatacgtctggtctaaacttatgtccatcctgtttctgtctctgaggctctgagacagcaggaatatacaaccttgtgcctactg

SEQ ID NO: 95780 - DNA, 76 bp, Mus musculus
ggcccaggacagtggggctgttgaccagttatccaagaaaccttctaggactcaactgtctctctctctgggtgcc

SEQ ID NO: 95781 - DNA, 76 bp, Mus musculus
gctcacagcttccagaagagggccccctggtgctagagttatcagtacttgtgagtctgtctgtctgtctgtctgt

SEQ ID NO: 95782 - DNA, 76 bp, Mus musculus
gggtgcgtgtgtttttgtgtgtttttgtgtgtgcgggcatgtgcacgagcacacacaacagagtgtgcatgtactt

SEQ ID NO: 95783 - DNA, 74 bp, Mus musculus
cagaaggctggattcagtgtaactataggcttgcattgcctgcctgcctgcctgcctgcctgcctgcctgcctg

SEQ ID NO: 95784 - DNA, 71 bp, Mus musculus
cagatggttgtgagccactgtgtgattgctgggaactgaactcagagagcactcactgctcttaaccactg

SEQ ID NO: 95785 - DNA, 91 bp, Mus musculus
tatatgtatgtgatgtgtgtatttgtgtgtatatgtatgtgtgtaatatgtgcatgtatatatgtatgtatgagtgtattatgtatgtgtg

SEQ ID NO: 95786 - DNA, 85 bp, Mus musculus
caggtaccgtggaaggaaccttggggcgactgtgttccctagacaagctaggctttctggcagtctccccctctcactgtccctg

SEQ ID NO: 95787 - DNA, 71 bp, Mus musculus
ccctctctgtctctctgggtgcctcagagccgaagctaaggaaggccctgtctgggactagaacccgaggg

SEQ ID NO: 95788 - DNA, 79 bp, Mus musculus
cctccttgcatgatgcacatgatgacatgtgaccttaggcatgtcgtcggtccctctgtgcctcttctgtagaatgggg

SEQ ID NO: 95789 - DNA, 77 bp, Mus musculus
gaggaagtggggggtggagtattggccctttcaggaagtcaagatacatgagagggcgtctctctctcactctctca

SEQ ID NO: 95790 - DNA, 86 bp, Mus musculus
cccattgtgtgtgtgtgtatgtgcatgtatatgtgcatgtgtgcccacatgtgtgtgcacatgtgcatacatgtatgcatgtaggg

SEQ ID NO: 95791 - DNA, 82 bp, Mus musculus
tgtctgtcattctatgtgtctctctgtctttctttccttatggtactggagacagaggctcggttcttaggtagtccaggca

SEQ ID NO: 95792 - DNA, 110 bp, Mus musculus
ggtggatggagcatgtctgagaccctgggaaattcggtgggtacacacctgagacagtgactgcctccctgctccctgccaaattcctgggttggaacatgagtcacact

SEQ ID NO: 95793 - DNA, 90 bp, Mus musculus
gacagacagatggacagacagacagacagacagacagagacagagaagactcaccatgtagcctatgctggcctggaactagctgtgtgc

SEQ ID NO: 95794 - DNA, 70 bp, Mus musculus
agtgtactgtctgtctgtctgtctgtctacacaagaaggggggagatggaagagaagaaagaagtgccct

SEQ ID NO: 95795 - DNA, 92 bp, Mus musculus
gtgcatgtacgtgtgagtgtacatgtatgtatgtatgtgtgtatgtatgtatgtatgtacgtacctgtgtgtgtgtgtgtgtgtgtgtgtgt

SEQ ID NO: 95796 - DNA, 105 bp, Mus musculus
gcctgtattgtagggacatcaaagttggagggacgcacaatttttttttttttgagacaagacctgtgtagccttgtctatccttgaactctgtgttgaccaggc

SEQ ID NO: 95797 - DNA, 66 bp, Mus musculus
tctgcagcagcaggaggagatgggttcccttctcagggagagaccctctgtgtgtctatgctcaga

SEQ ID NO: 95798 - DNA, 65 bp, Mus musculus
gcatgtgtgtgtgcatgcatgtatgtgatatgtgtgtctgagtgtctgcatgtgtatgtgtgtgt

SEQ ID NO: 95799 - DNA, 117 bp, Mus musculus
agagtgtgctcacttagccatctgtttctgttactgggtgccaagtgagagtgtgctcactcggccgtctgattaggtcctggtctcggttattgtaatctttttgtgtgtatatct

SEQ ID NO: 95800 - DNA, 62 bp, Mus musculus
ggcttagggtcacacaggagcaggtgacatccccacccaggcatctctgtctgtctcctgcc

SEQ ID NO: 95801 - DNA, 69 bp, Mus musculus
atcactttcttgactctccctctcccacactggtgtgctgagcaggaaagagggaagatcgctagtggt

SEQ ID NO: 95802 - DNA, 72 bp, Mus musculus
gctcctggatacacactcacacgcactctgaggtggacatggaatgaggctgtgtgttgagagtccaggtgt

SEQ ID NO: 95803 - DNA, 87 bp, Mus musculus
tgtctgtctgtctgtctgtctgtctatgtgtgtgtgggggggtggctctcgagcacacgcatgtgccacagtgcatatgtagaggta

SEQ ID NO: 95804 - DNA, 77 bp, Mus musculus
ggagccaagggaataagaaagcggcctcctcattttaaaggagtcagtctgtctgtctgtcccattagccagcatcc

SEQ ID NO: 95805 - DNA, 64 bp, Mus musculus
gtatgtatatttatgtaagtgtgtatgtatgtatgtatgtatgcatgtatatgagtatgtgtac

SEQ ID NO: 95806 - DNA, 98 bp, Mus musculus
gaattccacaatggggctggagaccgctcagtggttaagagcactgactgctcttccagaggtcctgagtttaattcctagcaaccacatggtggctc

SEQ ID NO: 95807 - DNA, 76 bp, Mus musculus
cacgagaggactcgcaacgtaactggagagctggatttccgtctgtcatctctctgtctgtctgtctgtctctgtg

SEQ ID NO: 95808 - DNA, 92 bp, Mus musculus
aggttcttctcagtttcttaggcacacttctgagagagctgttagggtcccactgcagcttcttctctgtctgtctgtctgtctacctacct

SEQ ID NO: 95809 - DNA, 92 bp, Mus musculus
actctctcatagatatttacacagtacagtgtgacctcagcaatttctcagttgaggcttctcctgggctgtgtcaaatttatggttagagt

SEQ ID NO: 95810 - DNA, 114 bp, Mus musculus
tgtctcagactcacttttttcagggagggttaggctgctaaccattcagatgtttataggtcagaacactgagagtagacatagcctctcacttctctgtcacctactgacaca

SEQ ID NO: 95811 - DNA, 57 bp, Mus musculus
gagagagagagagagagagagagagagagaatgtctgtctgtctgtctgtagagctc

SEQ ID NO: 95812 - DNA, 71 bp, Mus musculus
agctgtgcactagcaaccaagcatgcattcatttctctctgatcttgactgtggttgtgatgtgattagct

SEQ ID NO: 95813 - DNA, 101 bp, Mus musculus
atacatagatatgtatatgtatacatatctatgtatacacacatatacatatatgtgtgtatatacatatatatatgtatatacatacatatctatgtata

SEQ ID NO: 95814 - DNA, 89 bp, Mus musculus
atatgtttgtgtgtatatacatgtatatatacatgtatatgtatacatagatatgtatgtatatacatatatatatgtatatacacaca

SEQ ID NO: 95815 - DNA, 99 bp, Mus musculus
gctttgcctgtctttatggcaagtgtctattgtcatattgttgtagtctcatctctgttgctgtgataagacactttgaccaaaaacaagcaagcgagg

SEQ ID NO: 95816 - DNA, 100 bp, Mus musculus
caggccactgtggacagtgtcatcctctaggcagggctcctgagtgatgtaagtgtgcagacatggggctgagcacacgcatgtgaataagcaggggtgc

SEQ ID NO: 95817 - DNA, 92 bp, Mus musculus
gcccatgttggtagtcctctgtctctcactcagccctgccctgcttctaaggctggcctgagcaagaattgagaccgagaccagcagacagc

SEQ ID NO: 95818 - DNA, 111 bp, Mus musculus
gacccatggacgtgagaactctgcatccactttcctcagactccaaccaacactcactctgtctatgtaaggaggagctctcaggtaagtcgcagggtgcaaaaatgtgtc

SEQ ID NO: 95819 - DNA, 101 bp, Mus musculus
gtttttacacctggcgtcttttatgagagttagtttcctttcttccatcgttggaaagaagtgactgtctctctgtctattgggtgcacggctgtgagcac

SEQ ID NO: 95820 - DNA, 76 bp, Mus musculus
gttacatgccctcatatgaccatgtgtctttgtatttgtgaatacgaacgtgtatgtttgtatgtgtgcttgtctc

SEQ ID NO: 95821 - DNA, 62 bp, Mus musculus
actgtctctgaatagagtgtgcccacaatggctattgtgtgggctttgatcagcaagacagt

SEQ ID NO: 95822 - DNA, 116 bp, Mus musculus
cttgcaggctcatcctttgctgccatgtcttacttgaagcctctgtgggtctctcaggctcctcagagtagtaccacagctccacagataatggcagccacgggcagcttctcaag

SEQ ID NO: 95823 - DNA, 67 bp, Mus musculus
tttctccatccctgtcttaaactctctgtccaaggggagggagtgaggacacagggcccttgggaaa

SEQ ID NO: 95824 - DNA, 167 bp, Mus musculus
accttaaagtacaaaacaagatcttatttttatatttaagatttatttgtgtgtgtgtgtgtgtgtgtgtgtgtgcatgtctgtgagtatgagtgtagagtgtgtgcatgtatgagtgtgtgtgtgtgtgcatgtctgtgagtgtgtgcaagtgtgtgcatgtgtgt

SEQ ID NO: 95825 - DNA, 72 bp, Mus musculus
gtgtgtgtgcatgttcatgtgatgtgtgtgcattgtgtatgtgcatgtgtgtgcacatgtgtgtacatgcat

SEQ ID NO: 95826 - DNA, 105 bp, Mus musculus
gggtggggtggggtgggggaaatatatgtgtatgagcatatgcatgtgtgtatatatgcatgtgtgcacgcctgtgcatgtgtgtggtataactggcttttctct

SEQ ID NO: 95827 - DNA, 106 bp, Mus musculus
gagggtgttgagggccattagctcaacatgaaaggcctgtcctgcgtctcacacacaccctctgcctcttcaggctcctttcaccttgagttattcaactgtcttc

SEQ ID NO: 95828 - DNA, 86 bp, Mus musculus
ggtctgtctcttgtctctctgtctgtgtatgtattatgtacatatgtatgtatatacacatatagcttctataatagccagtttcc

SEQ ID NO: 95829 - DNA, 70 bp, Mus musculus
gtctgtgcctctgtgtgtgtgcgcgcgcgcgtgcaagtgcacgcgtgtgttttcatcctgtggtagtggc

SEQ ID NO: 95830 - DNA, 80 bp, Mus musculus
atatatatgcaacatagtatatgtgcatatatacatatatatgtttattatgtatattacgtgtgtgtgtgtatatatat

SEQ ID NO: 95831 - DNA, 91 bp, Mus musculus
tacaccacgtacatactggatgcactaagaacatcagtgggattaaaaccaaaaggggggttatgtatgtatgtatgtatgtatgtatgta

SEQ ID NO: 95832 - DNA, 105 bp, Mus musculus
tctctgagaaacctctatgttgcctgattccatgtctgcaatgttgtttgggtaccagaatgatagaaacagagaagagagcagcagaagaggagtggtcaggga

SEQ ID NO: 95833 - DNA, 112 bp, Mus musculus
tgtgagcactcatctaactgctttagcactgtgcctgcatacctgcctgcctgctgcctgcctgcctgcctgcctgctgccatgctccccacggtgatgatcatggactcca

SEQ ID NO: 95834 - DNA, 89 bp, Mus musculus
gaggatatatgtttgcgtatatgcatgtatatatgtgtgtagttttgtctggtgtatatttgtaagtgcatgtgtgtatgtgtgttttc

SEQ ID NO: 95835 - DNA, 80 bp, Mus musculus
gtgtgtgtatatatatatatatacagtatccagggagtctggaagagggtttacatgtgtgtgtatatatgtatgtgtgt

SEQ ID NO: 95836 - DNA, 79 bp, Mus musculus
caggatgtggtaaggaggaaaatggcagactttttttttttaaacacaggagttctggtctagcacataccaagtcctg

SEQ ID NO: 95837 - DNA, 81 bp, Mus musculus
tgtgtggtcactcagtttctgtttgacatggagaagccaaacatcctgtaagcatttcagagagagagagaaagacacaca

SEQ ID NO: 95838 - DNA, 126 bp, Mus musculus
ttggatttttgcttgcttgtttctatttacattatttttgttgtttcttggttttattttttttaattgttttgagagagagtgggttggagaaagggaatgggagaagagacacagacacagaca

SEQ ID NO: 95839 - DNA, 80 bp, Mus musculus
tgcctgtctgcctgtctgtctgcctgcctgtctacctgcctgtctgtttatagaaggttggtatgatggcttagtgggta

SEQ ID NO: 95840 - DNA, 92 bp, Mus musculus
ctatactgtggggcatgctacagcttcttcaatgagatattttattgttctatacttcttattttgttgggggagaggttgcaagggtggag

SEQ ID NO: 95841 - DNA, 90 bp, Mus musculus
agacagaagataaggatcagcacccgaggctgttctctgaggtccacaagtgttctcacacatactctctctgtgtctctgtctgtgtct

SEQ ID NO: 95842 - DNA, 95 bp, Mus musculus
gttgtgacgaatttcaggattgtcattttctatttctctgaagaatggactttagtctatagaacactgtgatcagcgtgggcattttaagcaac

SEQ ID NO: 95843 - DNA, 79 bp, Mus musculus
ctgtctctctgtctctccttatcttcacacggataagaagaactagccatgtgagaactgaaagacgataagagaccag

SEQ ID NO: 95844 - DNA, 80 bp, Mus musculus
gtggatgaatgagagccaccatgtgattgctgggaaatgaactcatgatctctaaaagaacagacagtgctcttagccac

SEQ ID NO: 95845 - DNA, 71 bp, Mus musculus
ctgtagtaccaaggaacagtccacacccctgctttgacttctgctggctctgtggctctgtggctctgtgg

SEQ ID NO: 95846 - DNA, 82 bp, Mus musculus
catatatatatatatatacactttgaaaacctgtatatatatacatgttttatacatatatctgtatatatatacatgtatg

SEQ ID NO: 95847 - DNA, 74 bp, Mus musculus
ggctgtggggagactgaagtgactggggacacgtgattgtgagctccctgctcactcacctttacttcacagcc

SEQ ID NO: 95848 - DNA, 86 bp, Mus musculus
gtgcttttggggaccatgactatgacaagagaagagaagaggattgggcagagagccctctggctctgacacagtcacaggagtat

SEQ ID NO: 95849 - DNA, 64 bp, Mus musculus
tatatgtgtatgcatgcatgcatgtatgtttgtatgcatgtatgtatgcatgcatgcgtgtgtg

SEQ ID NO: 95850 - DNA, 116 bp, Mus musculus
ggaacagtaccatggctttctgtttggatatcttggtggctaggatactgagaacctttctatatttcttgatcatttggatgttgtctttgtaaaaaaaatgctggtttgactcc

SEQ ID NO: 95851 - DNA, 106 bp, Mus musculus
ttggatgttgcgttgatctttgcccttctaagtggggtaagatgaaatctcaaaattgtttgatttttcatttccataattgctaggggcaatgatgactatttaa

SEQ ID NO: 95852 - DNA, 122 bp, Mus musculus
cagacagggaaacagccctggctgttttagaactcaccatgcagtccaggctggctgcctgtttctgactcccgagtgctcggatcaaaggcaagcacagctgggggaggggctttttacag

SEQ ID NO: 95853 - DNA, 62 bp, Mus musculus
atggttgactgtgagcatctgcatctgtatttgccaggcagagcctctcaggaaacagctat

SEQ ID NO: 95854 - DNA, 115 bp, Mus musculus
gcactcacccacagtctgtgtcagttcctgcctccaggttcttgccttgggttcctgccagaacacatgcagcagaggatggccttatctgacatcaatggaaggggagggaagc

SEQ ID NO: 95855 - DNA, 118 bp, Mus musculus
tgcaacatgcacatgtatgtatatgtgtatatacatgtatatatgtatgtatatatgtgcatatacatgtatatatacatatgtatatatgtatgtgtgtgtatgacaataacaaata

SEQ ID NO: 95856 - DNA, 81 bp, Mus musculus
gactgtacaggaaacctataccacttttgaagcctagcataattataggtacatatgtgtgtgtgtgtctgtctgtatgtc

SEQ ID NO: 95857 - DNA, 57 bp, Mus musculus
ccggccttgctgactgactgaccaccagcaaacctgtgtcggtctctctggcactgg

SEQ ID NO: 95858 - DNA, 70 bp, Mus musculus
gcctatgtgtgtgcatgtgcatctgcatgtggtggggtgtaagtgtgtgtacatgcacaagagcatgggt

SEQ ID NO: 95859 - DNA, 111 bp, Mus musculus
gcttcatgcttgtagattaggatgtaagctctcagttactgttccagtgctctcctgcctggctgcctgcttgcctgctgccatggtctctatcacagtggtcatgaatgc

SEQ ID NO: 95860 - DNA, 70 bp, Mus musculus
cccaggtccctccctccctctttgtgattgctctcttctcccaagtgggattgaggtgtctccatttggg

SEQ ID NO: 95861 - DNA, 112 bp, Mus musculus
gtggtatcaactgtctagatagtgttctgcatatttgagtggttttatatacatatataatgttttataacattttgacaagtatgttttaccatcatcctgttgaaaccat

SEQ ID NO: 95862 - DNA, 105 bp, Mus musculus
gcatgcatgtgttatatgtgcatgtgatatgatatgatatgatatgatatgatatgatatgatatgatatggtatggtatgtatgcatgtaataagtatgcatgt

SEQ ID NO: 95863 - DNA, 82 bp, Mus musculus
gtgctgcatgtataattgtatatgtgtgaacatgttgggggaaggtggtgtgtgttgtatgtgtgattgtatatgtgtgcac

SEQ ID NO: 95864 - DNA, 102 bp, Mus musculus
gaagagcccctcagaacgccctgctaagtttcatgtgtatagcttctagcttctatactattttacgcctggattttaattgctgtgtgtgaggcgccagtc

SEQ ID NO: 95865 - DNA, 73 bp, Mus musculus
ggtgcagaaggcctaggtctgtcccatgtgtgctctctagctcgctgttcagtctctgtgagtcttgtgggcc

SEQ ID NO: 95866 - DNA, 72 bp, Mus musculus
gcctcggtctctcatctatgtttaggggcctgctcctcctggggagttcagagaacacagagagaacacagc

SEQ ID NO: 95867 - DNA, 111 bp, Mus musculus
gatgtcctttctgttgctcactttctcttcctctagcttttatatatttttcatcccatttcctgcagtcttccttgaggcttgaagttagtggtataggtgcaggtcatt

SEQ ID NO: 95868 - DNA, 65 bp, Mus musculus
tctgggcatttgcagttctttctgatacactcagtgtcactggaactgaagcatctgcttccaga

SEQ ID NO: 95869 - DNA, 65 bp, Mus musculus
tatatatgtacatgtaaaagtatatatatacatatagtatatgtataagtatatgcatatgtgta

SEQ ID NO: 95870 - DNA, 70 bp, Mus musculus
gtgacagtgtgtgtgcaggtcagaggatgactttcaggggtcacactcaggctgtcaggctcgcttttac

SEQ ID NO: 95871 - DNA, 56 bp, Mus musculus
ggtcaaatgagacagagagaagcagcgcctttaactgtctgtctgtctttctgatc

SEQ ID NO: 95872 - DNA, 73 bp, Mus musculus
ctctgtctgcatgtctctgtctctctcacacacaaacaaacatacagagagagagagagagatgtactctaag

SEQ ID NO: 95873 - DNA, 90 bp, Mus musculus
gatagatttttacagtgtggaagagtagttaattatttcaggtgtgatctgtggtttctgacgtgcgaagtttccaacctgttacctatc

SEQ ID NO: 95874 - DNA, 100 bp, Mus musculus
actggagcatgggctgtccccaagcttgttgcctgcctgcctgcctgcctgcctgtggatccagtaacaacttgatgtatggggatgtgggagtgcgagg

SEQ ID NO: 95875 - DNA, 70 bp, Mus musculus
atgtgtgtgtatacatgtgtgtacatatatgtgcatatacttacatatatgtgcacatttatacacacgt

SEQ ID NO: 95876 - DNA, 94 bp, Mus musculus
gccatgtgaacaagaaaccatgtgcaaaaacattcgcttaataatttacttgtggggaatgtagcaagcatagagtttccctagtgttcatggc

SEQ ID NO: 95877 - DNA, 117 bp, Mus musculus
agatatcttcaaactcagacatctgcattgtatgtgttcagacagacagtctgtctatgaggctttttcttctgtactctttcattagcagacttgtcagagttcagccagaaatct

SEQ ID NO: 95878 - DNA, 90 bp, Mus musculus
gagtttggtgactgtatatggaatggctaatatccacttatcagtgagtgcatactgtgtttgttcttttgtgactgggttacctcactc

SEQ ID NO: 95879 - DNA, 85 bp, Mus musculus; identical to SEQ ID NO: 57439

SEQ ID NO: 95880 - DNA, 123 bp, Mus musculus
tatacatatgtatattatatagatatgcatttagtgtatgtatatatatgtgtgtgtgtatatatatatatatgtgtgtatatgtgtgtatatatgtgtgtatatatatgtgtgtgtatatat

SEQ ID NO: 95881 - DNA, 101 bp, Mus musculus
ggtttggagtttttgcctcttgctttttaaatgtgtgtggaagagatctgaaatcagatcccccttcttcaacaaacacccacagagacatcttccacccc

SEQ ID NO: 95882 - DNA, 95 bp, Mus musculus
tcatgtgttgttgtggtggtgaggttatttttcttgatgagtcgcacccactcacagtcaacttgaaggtcttttccactgcagacagcctgtga

SEQ ID NO: 95883 - DNA, 85 bp, Mus musculus; identical to SEQ ID NO: 57439

SEQ ID NO: 95884 - DNA, 119 bp, Mus musculus
gtgtactggattataatttgataatactgtatttccatgtttaacattttcaaaagattttatttctttttagaatgaggatcaaaagggaaatccaatcagagactgagtaatgacat

SEQ ID NO: 95885 - DNA, 97 bp, Mus musculus
tctagtttgttaatctatgtcttttttattggagaattgagtccattgatgtttggagaattgagtccattgatgttaagagatgttaaggaataga

SEQ ID NO: 95886 - DNA, 85 bp, Mus musculus; identical to SEQ ID NO: 57439

SEQ ID NO: 95887 - DNA, 79 bp, Mus musculus
gccttggctacaccgagtttgaacctccctactttggggaagtgaatttaggtaacagacagcagagtgagcacaaggc

SEQ ID NO: 95888 - DNA, 89 bp, Mus musculus
aatggtgccatctatactgtcaagagctattttaaaatgtatgttcgtgtgcattttgtatgtatttaagaaggtgtgcggcagctatt

SEQ ID NO: 95889 - DNA, 63 bp, Mus musculus
acactcagatgtcttgtgcagaggtgtacaggccctgtgcatgctgtctcagtctctgtatgt

SEQ ID NO: 95890 - DNA, 64 bp, Mus musculus
atgcacgcatgcatgcatgtatgtatgtatctttgcatacatgcataagtatgtatatgtgtat

SEQ ID NO: 95891 - DNA, 118 bp, Mus musculus
acagctgacaggattccaggtcaccgggactgtggggagagttgggcaaagtcacacacagagaacagtgtgcccagaatattttttgccacagactgcctacatgatatcacactgt

SEQ ID NO: 95892 - DNA, 72 bp, Mus musculus
gaagcttactctctcagacactcagtgaggaggctggggtcatttcaatttggtgcttactgggggaccttc

SEQ ID NO: 95893 - DNA, 100 bp, Mus musculus
tagaataacgattggatgagggtgtgtaaagtattttcatatatatgaatatattacataaatagtatatataccctaagtcactttctttttacctcta

SEQ ID NO: 95894 - DNA, 80 bp, Mus musculus
ttgtgtggtttagatatcagagtaattgtggcttcattatacaaattgggtagtgttccttctgtttctattttgcacaa

SEQ ID NO: 95895 - DNA, 76 bp, Mus musculus
gctcctctctgaagagagagtaggaacaggtcttttgtttaccaacttgtgggtctctgtctgtctgagaggcagt

SEQ ID NO: 95896 - DNA, 81 bp, Mus musculus
gcactgtgagtggtgagaacatagagagtacactgtcatatttgagtgtttttctttataaacacaatcccagtcatgcgc

SEQ ID NO: 95897 - DNA, 124 bp, Mus musculus
cctaagttttacaactgtctgccattctgggttgtgtgatcccttacctgtcgcagtcagtctgtgaatatccctttggccaggtcacccatgctgtatacccaacctgcctgttacatgttgt

SEQ ID NO: 95898 - DNA, 92 bp, Mus musculus
gggccacatgtgcaaaatagtacctacactgtatgaatatgtatatatgtatgtatatatccatatatgtctgtctgtctgtctgtctgtct

SEQ ID NO: 95899 - DNA, 80 bp, Mus musculus
ggaagaagtgtgtcactgggcatgggctttggggttccaaaaatgcttatcaggcccagtctctctccctctgcctgtga

SEQ ID NO: 95900 - DNA, 79 bp, Mus musculus
gaggcctggtaactgctctctctgactctctgtagtctcgcaagcgcttggagggaggcaggtagaggtcatcagactc

SEQ ID NO: 95901 - DNA, 101 bp, Mus musculus
gaccttgttggagtggatgtggccctgttagagtaggtgtgtcactgtgtgtgtgggctttaatattcttgtcctagctgcctggaagccagtcttctgtc

SEQ ID NO: 95902 - DNA, 119 bp, Mus musculus
ctgcacaatgctttgggtggttcagatctgagattattgcgtccctggctccctatttcccagccaggatgtacaagtttcagtggtttaaatctcaatccaaagtggtttgacaggca

SEQ ID NO: 95903 - DNA, 109 bp, Mus musculus
tcccttgcttcccaactgtcatatgtatgtttctgtatgcacatacagtgtgtatgtatgtttatgtatgtgtatatatactttacttgtttgtatagggtcttcggga

SEQ ID NO: 95904 - DNA, 97 bp, Mus musculus
tgtgaatgccaacaagagcttgctgacaggagcctgataaagctgtctcctgagaggctctgtcagtgcctgacacatgcagaagtgggtgttcaca

SEQ ID NO: 95905 - DNA, 95 bp, Mus musculus
tgtgaaagtttggatactggggctgcatttcagtgcagatgtgagagagaactctgggtttgaagctagaggtgtctagccttctgagcattcca

SEQ ID NO: 95906 - DNA, 107 bp, Mus musculus
caatgctttgggtggtttagatctgagattattgcgtccctggctccctatttcccagccaggatgtacaagtttcagtggtttaaatctcaatccaaagtcctttg

SEQ ID NO: 95907 - DNA, 109 bp, Mus musculus
aagtgattttcctgagcaagaaaagtctcagaataacgaattgggagagaaagtctctgcctctctgccaccctcattcctgctgtgtgcttttctcatctcagcactt

SEQ ID NO: 95908 - DNA, 126 bp, Mus musculus
acacatacacatatatatacatacatatacatatatatgtatatatgtatgtgtgtatatgtgtatatgtgtatacgtgtatacatgtatatgtgtatatgtgtatatatgtatatatgtgtacat

SEQ ID NO: 95909 - DNA, 109 bp, Mus musculus
gattggcagcaatcaattttacccactgtggcaccctgtgatcacaagtctggctccaggaagtgtgatgggatctgggctaggggtagggctctgagtatggcacatc

SEQ ID NO: 95910 - DNA, 76 bp, Mus musculus
ctagaggaggacgttctgttgctgagctctgcttcctgtgggagacagacacactggctgagctctcccactctgg

SEQ ID NO: 95911 - DNA, 76 bp, Mus musculus
cccaaacatgcagtagtttgtcagaagagggtgatgaaacaacaccactttctgtgatgttttctattactttggg

SEQ ID NO: 95912 - DNA, 163 bp, Mus musculus
tgtgtttatgtatgtgtgtacatctgtgtatatatatatgtgtgtgtgtgtacatctgtatatatatatatatatatatatatacatatatatatgtgtatatatatatgtatatatatatgtatatatatatatatttgtatatgtatgtataagtgtatac

SEQ ID NO: 95913 - DNA, 79 bp, Mus musculus
atgtctctatatacagctgtgatagagagatacacacacacacacatcatgtttctatatacagctatgatagagagat

SEQ ID NO: 95914 - DNA, 87 bp, Mus musculus
tgcccagatatatggatatattcatatatgaatatacatacatatatatgtgtgtgtatatctatatctatatctatgaaaattgca

SEQ ID NO: 95915 - DNA, 91 bp, Mus musculus
gtgctcagcccacaaggagcctcagtgaaagccttgtgggagactgtatcccgagtcacaggctcacactctggctggtgggaggaagcat

SEQ ID NO: 95916 - DNA, 99 bp, Mus musculus
gtagctgtagctgagtactacatcttgatctgcaggcagagaagcagagataatgagagagactgagacagagatagagagacaggcagagacagagac

SEQ ID NO: 95917 - DNA, 97 bp, Mus musculus
gatcagtcttaggtccatggtggtctgataggatacatgggacaatttcaatatttttgtatctgttgaggcctattttgtgaccaattatatggtc

SEQ ID NO: 95918 - DNA, 87 bp, Mus musculus
ttacagcccgagtaaggcaggcaggagagctcggcttcccacagaccgactctgccagtggctcttgtctttcatttagcattgtga

SEQ ID NO: 95919 - DNA, 112 bp, Mus musculus
atatgtatacatgtgcatatgtatatatgcatgtatgtatgtacatatatgtgtatatgtatatatgtgtgtatatatgtgtatatgtatggttgtgtatatgtgtatatgt

SEQ ID NO: 95920 - DNA, 116 bp, Mus musculus
gtttctttttcatgatgtggtaactacgaagtgatggtagatttaaataattttttatttttattttatatattttttcattaggaccatatctccaaaaaacaagaaaaagaaac

SEQ ID NO: 95921 - DNA, 111 bp, Mus musculus
cctgtatgcagcaaaatgctgggtcctgtttaaagtaattgagtccattgaatgttaagaagttttaaggaatgatgattgctgttttcatgttatttttgttgttagagg

SEQ ID NO: 95922 - DNA, 94 bp, Mus musculus
aatggctactctagagtgtttcttggggtcatttgcttggaacattgttccccagtctttcactctgaggtaatgtctgtcattgtccctgagg

SEQ ID NO: 95923 - DNA, 87 bp, Mus musculus
taacgtttctctctgtgtgattctgtctgtgtttttgtccagatgaactggtcattagataaaggaggatattggaatgaactgtta

SEQ ID NO: 95924 - DNA, 78 bp, Mus musculus
gtgtatatgagcatatatgtatatgtgtaagtttatgtttgtctgtctgcatgtatgtatgtatgtatgtatgtacat

SEQ ID NO: 95925 - DNA, 85 bp, Mus musculus
ggccatggtggtctgataggatacatgggacaatttcaatatttttgtatctgttgaggcctgttttgtgtccaattatatggtc

SEQ ID NO: 95926 - DNA, 84 bp, Mus musculus
gggtgtgtgtgtatacacatgtatatatgtgtgtatatgtatatatgtgtatacacatgtatgtatgtgtgtatatatgtgtat

SEQ ID NO: 95927 - DNA, 89 bp, Mus musculus
ggtgctggtctaactggctgtctgtatgtagaaaatgaaaaaaagagcaatatttgtcactttgtgcaagtccaagtggatcaaggatc

SEQ ID NO: 95928 - DNA, 113 bp, Mus musculus
tggccaaggtgggagaagggctagccaagtggaagagagagaacagagtcaggggtggttcaagtcttggttttactcctccccttgattaaccactctcatatccaccttcc

SEQ ID NO: 95929 - DNA, 112 bp, Mus musculus
agtctccgagggtcactggctccactctggtcccattaaggttcagcatctgcatctgcagtcttgtctgcaacctctccagctcctgcgaccagttccccttcaggtaatt

SEQ ID NO: 95930 - DNA, 86 bp, Mus musculus
tatatggaatgaatatattgaatgaatacatacatataggtataagtatacctatatgtatatgtgaatatatttattgtgctgtg

SEQ ID NO: 95931 - DNA, 75 bp, Mus musculus
gtctgtttctctctctgtatgtgtttgtgtgtgaaaactgtgatgcatgcacacacatggttgagatgtacgtgc

SEQ ID NO: 95932 - DNA, 85 bp, Mus musculus; identical to SEQ ID NO: 58731

SEQ ID NO: 95933 - DNA, 85 bp, Mus musculus; identical to SEQ ID NO: 57439

SEQ ID NO: 95934 - DNA, 85 bp, Mus musculus; identical to SEQ ID NO: 57439

SEQ ID NO: 95935 - DNA, 135 bp, Mus musculus
tatattttaaaagtatgtttatatatacatatataaatatgtatatttatatatgtaaatatatttactctgcatatgtatatatacttatatatattgcatatatatatttaatctgactatatatgtgtatgt

SEQ ID NO: 95936 - DNA, 68 bp, Mus musculus
gctctcccagctgcacctgaaatgcttccacctgcaggaggagtgtctctgtgtccctctggttgcgc

SEQ ID NO: 95937 - DNA, 85 bp, Mus musculus; identical to SEQ ID NO: 59674

SEQ ID NO: 95938 - DNA, 72 bp, Mus musculus
gtccatggtgagctggtaggatgcattggataatttcaatatttttgtatctgttgaggcctgttttgggac

SEQ ID NO: 95939 - DNA, 85 bp, Mus musculus; identical to SEQ ID NO: 58391

SEQ ID NO: 95940 - DNA, 88 bp, Mus musculus
cttagctgcaggctttctgggttgtatggtagttctttctttaattttccgaataaccaccatgatgattttcaaaggctatgctagg

SEQ ID NO: 95941 - DNA, 77 bp, Mus musculus
tgagacctagaaagaaagaagtgagagcgctgggatcccacccaccccagtctatctgtctgtctgtctatgtttca

SEQ ID NO: 95942 - DNA, 77 bp, Mus musculus
gggagagagagaaagagagagagagagagagagaaagaatgaatatgtgtctgtctgtctcattgcatctctctctt

SEQ ID NO: 95943 - DNA, 103 bp, Mus musculus
gtttgtttgtttgtttgagacagggtctctctgtgtggctgtccagtgtagaccaggctgcctcgaactcacagagatcctcctgcctctgcctcaagaatgc

SEQ ID NO: 95944 - DNA, 117 bp, Mus musculus
gaggagcggagtacgtgagccagtgctatgtggaagacttgtgattttgttgttctgatatgatatgacaacaagtcacagccagcctcatagcgtggactcctatcacctttctcc

SEQ ID NO: 95945 - DNA, 87 bp, Mus musculus
gccctggctggcctccagctcaatgtaactaaagatgatggtgtagtccaaattctgagtacatggtgactggcgtgggtgatggct

SEQ ID NO: 95946 - DNA, 119 bp, Mus musculus
ccgcctgatgctggccccattgtggtccactgcaggtgtgcacagccctgacctgtcttgtccctgtctctctgtgtccctgtcccctgaccatggtgtttgccctcctcacagcgcgg

SEQ ID NO: 95947 - DNA, 78 bp, Mus musculus
ggttacagggacctctcagagcccactgccccatcctgagtggattcagcagtttcctgagtcagtgtctctgtagct

SEQ ID NO: 95948 - DNA, 89 bp, Mus musculus
ccctgggtcagcttgcagcctgactgtgtgcctgggtctgtctactgttcgactggctctgtgtatgtctgtatgactgtgggctgact

SEQ ID NO: 95949 - DNA, 84 bp, Mus musculus
gctcctaaccatcactcacactgcctctctgaagactaaaaaggacctacttgggtaggggtgggagtggggaatggagggtgc

SEQ ID NO: 95950 - DNA, 77 bp, Mus musculus
cttttgtatgtgtggatgtgcatgtattgtggggtgctagcgtgctcacctgtgcatgtgcatttggcgaccagagg

SEQ ID NO: 95951 - DNA, 81 bp, Mus musculus
ccacggggaggattagaaatgcccagtcactgagttaatcgaggcctagctgatgtgtgtctctcattctcaaatccaggg

SEQ ID NO: 95952 - DNA, 66 bp, Mus musculus
cctgtgggactggtgtgaaagtgttgagctccccacagtcattctctctcaccccaacctcagagg

SEQ ID NO: 95953 - DNA, 74 bp, Mus musculus
gcgctgttgtcactctcgctgtcactgaagcttagcctggagagcagtggggcggtgttagaggtaacatgttc

SEQ ID NO: 95954 - DNA, 83 bp, Mus musculus
tatatatgtgtgtgtgcatatatttgatgtgtgtatatatgtatgtatatacatataaatatgtatgtacatatatgtatgta

SEQ ID NO: 95955 - DNA, 145 bp, Mus musculus
gcatatataaacatatatatgtctatatatgaatttgtgaataatgtgtgcatatgtggatatatatatatatgtgtatacatatgtatattatatatgtatatatgtagtgtacacgtgcatatatgaatatatgtgtatatat

SEQ ID NO: 95956 - DNA, 115 bp, Mus musculus
tatgcatatgtacatgtgggtatacatatttatatgcatgtatatatgtatgcatgtaagtgcatgtgtatttatgtgtatatatatatatatatatgtgtatgaatatgtgtca

SEQ ID NO: 95957 - DNA, 115 bp, Mus musculus
gttatctttcaattgttattttatttacatatttttgagcatgagcgggtttctgtctgtgtgtctgtgccctcagaggtgtcaagtgctctggagttgatggttgaagcaccac

SEQ ID NO: 95958 - DNA, 73 bp, Mus musculus
ggcaaagggacagaggtgagggagaacgagcgacctaggccagtggttctcaacctccctgagaccctttaac

SEQ ID NO: 95959 - DNA, 91 bp, Mus musculus
atgtacatatgcacacagacacacagacacatgtatgcagtccatacacattcatgcatgaacatgtgtacatgcatgcacacatgtacat

SEQ ID NO: 95960 - DNA, 118 bp, Mus musculus
tacatgagcatatatgtgtgatccaactcttgtttagggcatttgtatgtatgtatgtgtgcatgtaactcaaattcaatgctatatgttggatttaactctatatgtatatgttcat

SEQ ID NO: 95961 - DNA, 61 bp, Mus musculus
tctgttggtacacagaataccatccatgtacccctcatggctgggtctgtcagcctctgga

SEQ ID NO: 95962 - DNA, 79 bp, Mus musculus
gacccctgcatggcagggaagaggccatcttaccttgcaggataattctggtctcagagtctgtgtctggcacttggtc

SEQ ID NO: 95963 - DNA, 116 bp, Mus musculus
ggggtgggtaagtggtggttagcgaggatgggagaaaaccatttatagaattgtactttctctgagtctctgattcccacatctgctcgtgcccctgctcagtgcccctggactcc

SEQ ID NO: 95964 - DNA, 60 bp, Mus musculus
gaggttctggattgttgtgtggtaccactccatcagagggagcatagcttaccaaacctc

SEQ ID NO: 95965 - DNA, 78 bp, Mus musculus
gagaagatgctctccagttcctctctcactgagaatctctctacagtgagagcttctgggacacagagaatcattctt

SEQ ID NO: 95966 - DNA, 85 bp, Mus musculus; identical to SEQ ID NO: 57470

SEQ ID NO: 95967 - DNA, 69 bp, Mus musculus
cactatttagctgagagtgtctttatctgtctgagtcaggctagatagagcgtctcagaggacaatgtg

SEQ ID NO: 95968 - DNA, 238 bp, Mus musculus
tatgtaagcatgtatgtatgtatgtatgtatgtatatatatatgcatgtatgtgtatatatacatgtgtatgagtatatatacatatatatgtgtgtgtatgtggatatattatatgtatatatgtggatatattatacatatatatgtatgtatattatatatacatgtacatatgtatatgtgtacatgtgtatttatgtatatatgcatgtgtgtgtgcctatataatatatgtg

SEQ ID NO: 95969 - DNA, 61 bp, Mus musculus
ctttgttctgtgagttgagtgtgttgacttctggggagatagctcagatcattgagcaatg

SEQ ID NO: 95970 - DNA, 65 bp, Mus musculus
ctgggctgtgtctctgtgggtctcagcttgacttgcaggcctgagcacccgagtttactccccag

SEQ ID NO: 95971 - DNA, 104 bp, Mus musculus
tgttactgcagctgcctgccttggctggggaaaatggagactgtgaggtcagacagagctccagacctttccatatctcttaaaaggtagatatgacattgata

SEQ ID NO: 95972 - DNA, 61 bp, Mus musculus
tagaattcagagctcagagggggaaggtaaaaatgtctatctgtctggctctgtccatcta

SEQ ID NO: 95973 - DNA, 64 bp, Mus musculus
gtgagatgagagtgagcagggaggcccacacccagaaaatagacatgttctctatcattctcac

SEQ ID NO: 95974 - DNA, 91 bp, Mus musculus
ccctaatggctctttcagagagattttgttaaaagaactttatatttttagatctcttaaaataatgttcctattagaaggatggcaaggg

SEQ ID NO: 95975 - DNA, 93 bp, Mus musculus
gtatatatgtggatgtgggtatatatatgtataatatatgtatatttatgtgtatttatgtatatctatctatctatctatctatctatctac

SEQ ID NO: 95976 - DNA, 100 bp, Mus musculus
tgcttcatagggaagaacattttctctctgtttctctgaaagacaaagatgttctctttctttagttgaatgtgaaaggatggattttgctaagtaggca

SEQ ID NO: 95977 - DNA, 94 bp, Mus musculus
catacatatacacacatatatatgaaaatgtttatatatatgtgtgtgtatacatatatacatatagacgtatatgtatgtgtatatatgtatg

SEQ ID NO: 95978 - DNA, 65 bp, Mus musculus
cgacaaccttcaataatggaagagagcacattaatattttctctgtctctctcacatggttgttg

SEQ ID NO: 95979 - DNA, 79 bp, Mus musculus
tcttgtgttttaggtgtctgacactctgagtctctgggcagctcctggagtcagggatgtagctgaacacccaataaga

SEQ ID NO: 95980 - DNA, 72 bp, Mus musculus
gcagtaggttcaatcagagtctctgtctcaatataaaagcaattggaaaagacactgaacataaacctctgc

SEQ ID NO: 95981 - DNA, 91 bp, Mus musculus
gagtaatagtgaagttcgtggaacaccttgtattctgaactttccattctaagcaaggaatgcaatgaactatgagttttgccatttattt

SEQ ID NO: 95982 - DNA, 63 bp, Mus musculus
agtgagcaatggtgttcaaggatactggtcttactgagatgtcagtgaacacactggcttgct

SEQ ID NO: 95983 - DNA, 67 bp, Mus musculus
ctgagatcagacagtccacagaggttaccccatgggagggggaagcttgtggtgagacagtcctcag

SEQ ID NO: 95984 - DNA, 90 bp, Mus musculus
gtgtgtgtacatgcatgtatatgtatgtgaatatatatgtgtatacatgtatatgtgtttgtatatatatgtgtgtatggatttaaatat

SEQ ID NO: 95985 - DNA, 88 bp, Mus musculus
tagttgccatcaagaggggcattgggctgttgattgccctcatgttaacagaacagagggacatcactcccagatatccctccagctg

SEQ ID NO: 95986 - DNA, 82 bp, Mus musculus
ctgggttgtgaacgccaggggttgtcatgtctctgcctctcaggtggcgagaccagagacaggataaatttttgggtcctgg

SEQ ID NO: 95987 - DNA, 96 bp, Mus musculus
ccacacatacacactttttcaggtcagaatttttaaatatttgtcatactgttcaaattttaagggtgatgactgggggaactctcatggtcatgg

SEQ ID NO: 95988 - DNA, 88 bp, Mus musculus
gtgatccagtgttccatatttgactagtgaagtatatttttatatcattgagggcaggattttttcactggaaagattactggttcat

SEQ ID NO: 95989 - DNA, 81 bp, Mus musculus
gggagctttctgcctgtgattggggcagaaactaggaaggagtctctctgtctcattaaaaagcgaatcacaggatgaccc

SEQ ID NO: 95990 - DNA, 76 bp, Mus musculus
tgtggagctgatgagacaggcagtcgggaccggaccagaatgtatgagtgtgtgtatgtctgtgtctctctctgta

SEQ ID NO: 95991 - DNA, 107 bp, Mus musculus
tttctttcctggtgatgattttttggtttgaagcctctgaaggatatgatagtggtttcatagtctttgaaaaggcttttcaggcatctgggccaaggtttacgaaa

SEQ ID NO: 95992 - DNA, 85 bp, Mus musculus; identical to SEQ ID NO: 57439

SEQ ID NO: 95993 - DNA, 78 bp, Mus musculus
tcagtaaatgagcaggccactttgaacatgggagctgggtgtcattccagctttgacacttcagtgtctgtcatctga

SEQ ID NO: 95994 - DNA, 73 bp, Mus musculus
ccagggcaggtggtcatgggtgatataggaaagcaagctaagtgcatctgcatctgtattggtcaggctctgg

SEQ ID NO: 95995 - DNA, 117 bp, Mus musculus
gctaattaagtgtgatggtgactgaaggcagtagctgagggaggggatcctgaagctgaatcagaagagtgtcacctctctcatgcagtgtgacttgggcccattattctgccaggt

SEQ ID NO: 95996 - DNA, 72 bp, Mus musculus
tatcagtaggatatataatgtatataagtacacatctatatgtgtatttgtatagatatatagtcatggata

SEQ ID NO: 95997 - DNA, 107 bp, Mus musculus
ggctcctccactctacaacttaattacaaatagtgaataattctgagacatttaagtaagtgtgtttggttttcatcttgtattttggttttggcaaatttggggtt

SEQ ID NO: 95998 - DNA, 80 bp, Mus musculus
ggaaccatcttatctgggtctgtctgttctgaatagccagtttcactgttactctcagacttttccaatcactggtgccc

SEQ ID NO: 95999 - DNA, 118 bp, Mus musculus
cacatatactgagcaagaggtgaagcgtgacagaggggatttcttgtgtgtatttaaatttttctcttgaattatttggcaatagttccattatgttgtgtgtctgtttttatgagtg

SEQ ID NO: 96000 - DNA, 85 bp, Mus musculus; identical to SEQ ID NO: 57470

SEQ ID NO: 96001 - DNA, 80 bp, Mus musculus
aggattggctgccctggagacaagagagtctgcacatggacccaagtgacactatatgaccttgctcttaagttaattct

SEQ ID NO: 96002 - DNA, 85 bp, Mus musculus; identical to SEQ ID NO: 57439

SEQ ID NO: 96003 - DNA, 64 bp, Mus musculus
atgtatgtatgtatgtatatatgtatgtatgtatgcatgcatgtatgtacgtgtatgtgtatgt

SEQ ID NO: 96004 - DNA, 92 bp, Mus musculus
tgaggacgcctgagctgggctgaactctgcagcagggcactggcttagcgtgtgagtccctgggtcggtctatcccagcaagctgagcctca

SEQ ID NO: 96005 - DNA, 64 bp, Mus musculus
tgtacacacacacacacacagcacacatactcaaaacacagctgtgtgcatgtgcatatgtata

SEQ ID NO: 96006 - DNA, 69 bp, Mus musculus
gaaagctgatgcagtcatacaacaggtgatttatttttcatcctgtgtctgtctgtctgtctgtctgtc

SEQ ID NO: 96007 - DNA, 78 bp, Mus musculus
acacacacacatgcacacacacatgcatgcacgtatgtatgtatatatgtatgtatgtgtgcatgcatgcatgcatgt

SEQ ID NO: 96008 - DNA, 93 bp, Mus musculus
gtgagaaacagttttagatgtgctgataggagagtggcctgggattaagtaagaagccagtgagctcactttgcagctcagcctagtgtgcac

SEQ ID NO: 96009 - DNA, 90 bp, Mus musculus
gtatcgtgtataattatatgtgcttatgtattgcatgtgttgcttgagtttgatgcatagatgtgattatgtagatgtatatgcgcatat

SEQ ID NO: 96010 - DNA, 128 bp, Mus musculus
catatacatatatgtgtgtgtaaatacatgtagtatgtatatttatgtatatatattcatatgtgtatatttatatgcaatatgttatatatacatatgtatatatatgagtatacatttgtgtgtgt

SEQ ID NO: 96011 - DNA, 136 bp, Mus musculus
atatatctatatctatatctatagctatagctatagctatagctatatctatagctatatctatatcaatatctatgtgtgtgtatatatccccacacactaaagatatatatatatatatgtgggtgtgtgtgtg

SEQ ID NO: 96012 - DNA, 104 bp, Mus musculus
agcatttggaaatatatatgtatatataaatatatatatgttcatatatgtgtgtatgtgtttgcatgtatgtatgtatgtgtatatatatatgtgtgtgtgtt

SEQ ID NO: 96013 - DNA, 97 bp, Mus musculus
aacagctgagtgttcagacatgttgatgtgtattgcctatcatatatatatatatgaagacaggtgcaaagattataggtctgaggccagccttgtt

SEQ ID NO: 96014 - DNA, 92 bp, Mus musculus
tgctcaattttctattggtgtgcgtgacattgtttatctttgtgtaattattacaaaaaggtttatagaaagttattaaggcactttgagta

SEQ ID NO: 96015 - DNA, 71 bp, Mus musculus
tgtgtatgtagtggcctttggtagcgaacacagagtgcagactgtgagctgccaacttcacttcatcttca

SEQ ID NO: 96016 - DNA, 85 bp, Mus musculus; identical to SEQ ID NO: 57470

SEQ ID NO: 96017 - DNA, 113 bp, Mus musculus
cttttggctcgggtccttatgctttgcatctaatggttgaaatgtgattttcatgtagagctctacgtataaatgattttaggcatggaagtactggtaaggaaaattaaaag

SEQ ID NO: 96018 - DNA, 75 bp, Mus musculus
gtatcacttggtttcagaacatagagagtttttaaaatagaccactgaattctatcttctgagacacgaggctac

SEQ ID NO: 96019 - DNA, 108 bp, Mus musculus
ggtaggggatggaactgaagtgagttggccacggtgcctctgacccactctcagccagaggctagagtggcgaggagccctggcatagcccttgcactgctgcctgcc

SEQ ID NO: 96020 - DNA, 85 bp, Mus musculus; identical to SEQ ID NO: 57439

SEQ ID NO: 96021 - DNA, 88 bp, Mus musculus
gtgggaatccagtggaaagagacttgatggagacattccattttaggactgagtgctccgatgtctctcagtctgcatctgatctcac

SEQ ID NO: 96022 - DNA, 86 bp, Mus musculus
acagaaaccttggccatttgccatgtttgagtgtttcttgtttcaagtgatggagtgcattgatgaatgtaatggcaggtagttgt

SEQ ID NO: 96023 - DNA, 114 bp, Mus musculus
tatttcagaatgtctgttggggtcatccttgttgctcagattggtgaaacattgaggttgtagcttatattcatagggactgactcttgcaacaaactctaatcttctgctatg

SEQ ID NO: 96024 - DNA, 86 bp, Mus musculus
gtattcatgcatgtttatattttagaaaggatctgaattaatgtcttttcatatcttttccagaaaatatttagtgttatttgtac

SEQ ID NO: 96025 - DNA, 74 bp, Mus musculus
tggctattctctgctccagaggggtctcaccagccggttcttagctcctagagactctctgactcagagttcca

SEQ ID NO: 96026 - DNA, 69 bp, Mus musculus
ggattcttgaactggagagatggctcagtggttaagggcactgactgctcttccagaggtcctgagttc

SEQ ID NO: 96027 - DNA, 64 bp, Mus musculus
gatcctggttatgtcagaactcctcagagtcaagctgcctctgagaccctgagaccctgagatc

SEQ ID NO: 96028 - DNA, 102 bp, Mus musculus
tgtttcaaattgggggctggagagatggctcagtggttaagagcactgactgctcttccagaggtcctgagatcaattcacagcaaccgcatgttggcaaca

SEQ ID NO: 96029 - DNA, 97 bp, Mus musculus
tgagatttcatttcacatctgtcagaatggctagtatcaatatatatatatgtcactgcttatgctggaaaagggtacagagcaagtagaagtttca

SEQ ID NO: 96030 - DNA, 81 bp, Mus musculus
cagtgtaaacaagaatagctattatggatggcagtaggtccaatgtaccccgatctcagagaggctgatcttattttactg

SEQ ID NO: 96031 - DNA, 91 bp, Mus musculus
gcctgctccccaaagtggcccagagatgtcagcagtgagagatcacatgattgattatgcatacagtgatgggtgagtttacgttgcaggt

SEQ ID NO: 96032 - DNA, 81 bp, Mus musculus
tgtaaggtgtgacagaacattcattgctgagggctgcaaagaaatcagaggcaatgggaagaaatgtattgcatgcttgca

SEQ ID NO: 96033 - DNA, 98 bp, Mus musculus
cacaaatatactgcatatgtatacatacatatatatgtatatatatgcacatatatacatatatgtgtgtgtgtacattcacatgcacatgctttgtg

SEQ ID NO: 96034 - DNA, 84 bp, Mus musculus
tttcataacttctgttagtttcactgtgtctctgtttaatttctgtttccaggatatgtccagtgataacagtaggttgtaaaa

SEQ ID NO: 96035 - DNA, 112 bp, Mus musculus
gctttcgataggagcccttcatggaacgcctgcaagagagattattttcagcttcactactgttattgaagataattccgttttcattaagttctcagggtatgtttttagc

SEQ ID NO: 96036 - DNA, 94 bp, Mus musculus
tgtatactataatacatacatatacatacatatatgtatatacatatatatatgataagcatatacatagtatatgatatgtattttgtatata

SEQ ID NO: 96037 - DNA, 93 bp, Mus musculus
tatgtatgtttgtatgtatatatgtatggtgtattatgtatgtatgtatctatatgtatatataagtatatgtatatatgtcatatatatata

SEQ ID NO: 96038 - DNA, 132 bp, Mus musculus
atacatacatacatacagacatacatacatacatacatacatatgtgtgtatgtgcatgtgcatgtggatgtatatgtgtatgtgtatgtgtatgtgtatgtgtatgtgtatgtgtatgtgtatgtgtatgt

SEQ ID NO: 96039 - DNA, 76 bp, Mus musculus
tgacagcagaggctctatctgtctgtctgtccgtcctgccaaggatgacgtcttagttagggttttactgctgtga

SEQ ID NO: 96040 - DNA, 85 bp, Mus musculus
gtccatggtggtctgataggatgcgtggaacaatttcaatatttttgtatccattgaggcctgttttgtgacaaattacatggtc

SEQ ID NO: 96041 - DNA, 115 bp, Mus musculus
ggcataatatttgatgaagtaaaatactagagaaagaaattataattctatattttggaaatataaacgtttctcctttttaaaaatgagtgttttcacagagtcagcacttgct

SEQ ID NO: 96042 - DNA, 111 bp, Mus musculus
aatgaatttaataccaatatgtttcaaggtaagttacaaattgacatgatgtagctgtcaccttgtaagttgtttagattttgagtgagacatgaatgtgctaactacatt

SEQ ID NO: 96043 - DNA, 68 bp, Mus musculus
acatgtgtatgtatgtatatatacatatagatgtttatatgcatatatatactcacatatacacatgt

SEQ ID NO: 96044 - DNA, 76 bp, Mus musculus
tctcgtttatatatgtgtatatatacatatatatgcatgtgtgtgtatgtatttatatgtgatggtttgaatggga

SEQ ID NO: 96045 - DNA, 65 bp, Mus musculus
ccacaccctatacttcctggatggtctgaaaccagagactagacagcctggagaccaagggtagg

SEQ ID NO: 96046 - DNA, 92 bp, Mus musculus
gtgtattgatgtgaaattatatatatgtgtgtgtgtatgcataaatttttaataaatatataaatatatatatataatgtatgtttataaac

SEQ ID NO: 96047 - DNA, 113 bp, Mus musculus
tgagctgttttgctaatctatgtgatgtgttggagattaactgtgtaagtagttctttcataataaatcaacacagctgaattctcccatactctagagatgaaacaggtaca

SEQ ID NO: 96048 - DNA, 118 bp, Mus musculus
tcagcgatttccgggctcgctcccatcatccgtgtttggaacacagacagactcagtgagtcgttttgctgttacttctctccacgtctccatggtgggtgagttcagtgtctcctga

SEQ ID NO: 96049 - DNA, 86 bp, Mus musculus
ggggttttgtttatatatatatgcatatatatgtatacatatgtatatatgtgcatatagatatgcatatatatataatttacttt

SEQ ID NO: 96050 - DNA, 85 bp, Mus musculus
ggaaaacgtgaccaatagtgtgaaaaagggaaaactaaagatgcaaagcaatgtttctctctctttcccactggtttctaactcc

SEQ ID NO: 96051 - DNA, 94 bp, Mus musculus
atacatgtatatatatatatacacacacacacacatatatatatatatatatatatatatatatatgtatatgtatatgtatatgtatatgtat

SEQ ID NO: 96052 - DNA, 106 bp, Mus musculus
gtagcttcctgcagggccccgaggagagctaactgacagttgagattatttttctaatttttcagccaatgggcttttctatgtggaatattgagagtttactgca

SEQ ID NO: 96053 - DNA, 103 bp, Mus musculus
ttacagacgtcttggtaatgttttgaacttcaacaagacatgagatggagaagacagtctctgttagtcttagtgagtacatcagaccacgttttgtttgtaa

SEQ ID NO: 96054 - DNA, 70 bp, Mus musculus
gctgaacctgggaggatgatctagccatcccatttatggctgagcactctacacttataccagatttggt

SEQ ID NO: 96055 - DNA, 114 bp, Mus musculus
tttgttcatttttattcagtgcatgcaaacatgtgtacttttgtattcatgtatgtgtgcatgtgtatgagtatattgtgtgtgcatgctaaagtgatcttggagatggaagga

SEQ ID NO: 96056 - DNA, 71 bp, Mus musculus
cagtccactgttttaaagtgaaagttatgttttatgtgaggtaacttgtgtgctttaaatgtagtgttctg

SEQ ID NO: 96057 - DNA, 81 bp, Mus musculus
ctgtggttctgagagaacactgtgaccaaaatcaacttagggaagcaaaggatttgtttggcttacgttttctagccacag

SEQ ID NO: 96058 - DNA, 85 bp, Mus musculus; identical to SEQ ID NO: 57439

SEQ ID NO: 96059 - DNA, 69 bp, Mus musculus
gaccaggctggctgtttgcctctgtctaccaagtgctgggatcaaaggcatgcactaccactgcttggc

SEQ ID NO: 96060 - DNA, 90 bp, Mus musculus
ctcttgccagtgtcccgcctcctatttcctgcctcagctcattggccatgggcttttttttttttaatcaagaggtgatgcttataagag

SEQ ID NO: 96061 - DNA, 87 bp, Mus musculus
gtgtgcccgtggttgctgagaggggagcaggggatgacacctgtgcctgttgctacctctctccttctcagtatctgtgatgcaggc

SEQ ID NO: 96062 - DNA, 68 bp, Mus musculus
tgtacatgtatatgtatatatatgtacatatatacacatacacacatatatgtacatgtatatgtata

SEQ ID NO: 96063 - DNA, 105 bp, Mus musculus
gaacttgagccttttaatcagtttgcagcactgtcaagtatttgcccctctctgggtctgagtctcttttcctgatgcaaacgaaggttagcattgcttaatttt

SEQ ID NO: 96064 - DNA, 103 bp, Mus musculus
cagaagtttgccagtagtttgaaacagagatgtgactgagctgagtcttagatgctaacatagatgcagtaaggtcatgtcatcttctggtggtagaaagttg

SEQ ID NO: 96065 - DNA, 66 bp, Mus musculus
gacgctggctgcctgtttcctagtagccccatgctcatctctgccgggaccagacagcatagcttc

SEQ ID NO: 96066 - DNA, 90 bp, Mus musculus
tagaccatgaacccacagtgctgacatgcggaaccccaacaccaggctccggtctgtcctcacagtcagtcactgttagtcactggtctg

SEQ ID NO: 96067 - DNA, 69 bp, Mus musculus
atggatcattagtatatatgtatatatgtgcatacatatatgatcacatttggatactaatgatcacat

SEQ ID NO: 96068 - DNA, 122 bp, Mus musculus
ggaacaatgtgcatacacttgtgactgcatgtcaaaacggatcagaaactgaacaaagtctgcagtctgcagagcagttctgtaccaacatgtgtctcctggtttggatcttgttctgcgga

SEQ ID NO: 96069 - DNA, 87 bp, Mus musculus
tagatagatagatagatagatagatagatagatagacatgtcatatagatagataaatagatctctgtctatatgtctctctctcta

SEQ ID NO: 96070 - DNA, 89 bp, Mus musculus
caggccccatcccgctggcgttagaacttccgagtctttctgtctcacaggaacacagtcaggagacgttcctagtgatggttttcctg

SEQ ID NO: 96071 - DNA, 113 bp, Mus musculus
tactgagagtcatggtctgggaattctgttgttgttggaaggagcaaaccactcctgtgtccttataggttggatagcttagttggcaggaatagattaggagctaagcagta

SEQ ID NO: 96072 - DNA, 63 bp, Mus musculus
ttgtatcactctccctctctccggaggctcagggaacatcgtggaagatggggcaggatacaa

SEQ ID NO: 96073 - DNA, 79 bp, Mus musculus
gcagtggttaggagggcaacacacattctgaagagacctgcacagacgcactgagtgtgagtgactctaaaacgacagc

SEQ ID NO: 96074 - DNA, 71 bp, Mus musculus
agaaggagacagcgcagagggtgctctgctgggccgcatgctgggtggactaactctgtctgtcactggct

SEQ ID NO: 96075 - DNA, 61 bp, Mus musculus
ccatgcactctatcgttcagactcactctcattgtgagatctgacaggtagcctatgcggg

SEQ ID NO: 96076 - DNA, 114 bp, Mus musculus
gagtttatgatgtggtcacattttgttagttccttccacattgggaatagtggtgactggagactgaccacagaccctggtgggaatgctagtctgtccatttctatactactc

SEQ ID NO: 96077 - DNA, 89 bp, Mus musculus
gggttacttacacatacatcctgtaaacattttctctcattctgtgactttctcttcacgctggtgtttgctttgctatgtggaagcct

SEQ ID NO: 96078 - DNA, 63 bp, Mus musculus
gcctgcctgcctgcctgcctgcctttctcctccagggtagatggtaaatgaaggcctcaaggt

SEQ ID NO: 96079 - DNA, 80 bp, Mus musculus
ggccatctcaaacactcagggaagctcaaagttatctggtaatcttgttttgtctttaatgagtgcaattttgagtggtc

SEQ ID NO: 96080 - DNA, 102 bp, Mus musculus
tggctatctgtcgtcaggagtactttatgtctgtaaaactctctcctattctagagtagtgtaggtgacctttaccctttgaattaaagccagatgaggcca

SEQ ID NO: 96081 - DNA, 130 bp, Mus musculus
atatatatgtatgtatatatgcatatatatatcaatcataatatatacatgtgttataatatataatattatatatagtatatatgtgtgcatgtgcatgtgtatgtgtacgtgtatatatatatgtatg

SEQ ID NO: 96082 - DNA, 189 bp, Mus musculus
atatgtgtatgtgtatatatgtgatatgtgataatacatatatgtatatatgtgatatatgtatatatgtgtatatatgtgagatatatgtatatatacaaaccacatgtatgtatatagtcttcatatataggtatatgtatatacatgtgtgtatgtatgtatctatgagagattttgttgttttac

SEQ ID NO: 96083 - DNA, 81 bp, Mus musculus
gcaagccatggagaacaggccagttagctgtggtcctccatcctccacagcgtctgtaagtctctgcctccaggtgcctgc

SEQ ID NO: 96084 - DNA, 74 bp, Mus musculus
tatgtatgtatgtatgtatgtatatatatatgtgtgtgtgtccatgtatgtatacccatgtatatatatgtgta

SEQ ID NO: 96085 - DNA, 57 bp, Mus musculus
gtatgtatgtatgtatgtatgtatgtatgtatatatgcatgcatgtgtttctcatgc

SEQ ID NO: 96086 - DNA, 102 bp, Mus musculus
aagtgtgccatcaagccctgtgtacacttgtttccatttatatataggtatgttagtctatatatatgtatgtcacatatgtaccaagccctgtgtacactt

SEQ ID NO: 96087 - DNA, 74 bp, Mus musculus
tgtctctcactgtgactcctgcttataaaggtgttgagcacatcactggaaataacagtagtcacagggatcca

SEQ ID NO: 96088 - DNA, 112 bp, Mus musculus
ccagtttgtacatgtgtggctctgcgtctaggcatcgctgtcctcttgctgtcactcggtctcagcacgagcctggccaggagcagcagctgcacagtggaactgaaactgg

SEQ ID NO: 96089 - DNA, 65 bp, Mus musculus
ggtgcccttgcttgcatgggaggcacttaatggctgacctctctctgtttgtctaaggtaggacc

SEQ ID NO: 96090 - DNA, 64 bp, Mus musculus
gggtgcagatctgcctcttggtgtcttgcgcacaggcgtgctcacacagacactgtctgacccc

SEQ ID NO: 96091 - DNA, 64 bp, Mus musculus
gcaacttggttttcatgtgggaccccctaacaattggtgcaggggctgtctctgactctgttgc

SEQ ID NO: 96092 - DNA, 78 bp, Mus musculus
agaggaaagttttaatgtgggtaatgagcaggtcatggcagggtgtttctgtgtctcactgcttccgaagtggcctct

SEQ ID NO: 96093 - DNA, 86 bp, Mus musculus
cagggcagggcagggcagggcagggcagtgcaggacctatacctagttacctcactgtctgtcactgatcaacactgctggccctg

SEQ ID NO: 96094 - DNA, 107 bp, Mus musculus
tatatatatatatatatatatatatatgtgtgtgtgtgtgtgtgtgtgtgtgtgtgtgtatgtatatatatgtatgtatatatgtatacacacatgtatacatacat

SEQ ID NO: 96095 - DNA, 77 bp, Mus musculus
ggaacaaggtcagagctctgtgtgttcagagtcatcacgctacaagatacctgagcatccaaatgctctgctgttcc

SEQ ID NO: 96096 - DNA, 103 bp, Mus musculus
tcatggtcacacggtgatgccccttctttctctgactgactgaatggctgcacgacaacagaaccctcaaagagatccaggtgtgttaccctccagatccaga

SEQ ID NO: 96097 - DNA, 78 bp, Mus musculus
ggtggggggggctgtctgtctgtctgtctgccacaggcatgcagtgcctgagggggtgacaagagattccttccaact

SEQ ID NO: 96098 - DNA, 68 bp, Mus musculus
cagtgtgtgttagtcactgtcactgtggtggtgtacagcctgcgttcagtgtgtgttaattgtcactg

SEQ ID NO: 96099 - DNA, 86 bp, Mus musculus
ctgcctgcctgcctgcctgcctgcctgcctttctcctccagggtagatggtaaatgaaggcctcaaggtgtcactagggtcagcag

SEQ ID NO: 96100 - DNA, 95 bp, Mus musculus
tacaagtatatggggttactgcatttatatatcaagtctcttcacctgagtggtgtgtgtatctctgtgtgtgtgcaggtatgcatgtgtgtgtg

SEQ ID NO: 96101 - DNA, 134 bp, Mus musculus
gtgtgtgtatatgtgtgcatatgtgtatatgtgtacatgtgtgtatatgtatgtatgtgtctgtatctgtgtctgcatatgcatgtacgtgcttgtatgtgtatctgtgtctgtgtgtgtgtgtgtgcatgtgt

SEQ ID NO: 96102 - DNA, 75 bp, Mus musculus
gctgctccactgtggatctcagtgactcagactggctcaaccagtgctgtttccggagccacacagccaatcagt

SEQ ID NO: 96103 - DNA, 75 bp, Mus musculus
gtagtttgtcaacagtctctgtcaggaacccctaaaaagccagctgcttgtgtctggacaggctgttgatcatac

SEQ ID NO: 96104 - DNA, 79 bp, Mus musculus
tatgtatacacacagttatatgatatatgtgaacacacacatatgtgtgtatatatgtatatgtgtatgtgtatatgta

SEQ ID NO: 96105 - DNA, 85 bp, Mus musculus; identical to SEQ ID NO: 57470

SEQ ID NO: 96106 - DNA, 78 bp, Mus musculus
tgtcctccatttcctctggctcttacactctttctgtctcctctccagtggattccctaagtgccgaggagggggacg

SEQ ID NO: 96107 - DNA, 112 bp, Mus musculus
agtattctgttggtgaggcttgccttgccctctgaggttcctgtccaagtttctaagttttttatttccagatttccctcagtcagttaaggttttctttattgattttatt

SEQ ID NO: 96108 - DNA, 95 bp, Mus musculus
tgtgtatgtatatatatgtttgtgatgtttatatcacaaatgtatatattaatacataaatatatatatatgctttatatcataaatgtgtatat

SEQ ID NO: 96109 - DNA, 86 bp, Mus musculus
tgctctgggtatgatttgcgttgtttaatattcctgtaaagctttattctagacaggaagatttatttatttttcaacccagctca

SEQ ID NO: 96110 - DNA, 111 bp, Mus musculus
actgcacactcactgcctctctattaagtgcattttgttgagtttttcataatatatttgtaaaatgtttacttatataatacactatggatggataagtgcagtaagcag

SEQ ID NO: 96111 - DNA, 75 bp, Mus musculus
gcatagaaaagatctcaccgtggacgctgcagtgtgacacagtatgtcccagtgtcccacagtgtgtccctctgc

SEQ ID NO: 96112 - DNA, 57 bp, Mus musculus
gtgtgagagagagagagagagagagagagacctctgtgtctttgtgactctctctac

SEQ ID NO: 96113 - DNA, 99 bp, Mus musculus
accttggtgctcctactgtgtacttagtgtgtctgactctgtttctttttgataagtgctccatggtgggattagcattggcctgtgggatactctggt

SEQ ID NO: 96114 - DNA, 83 bp, Mus musculus
tatgtgtgtctgtctgtctgtctgtcttccattcaagaatccaaagagttcctgggctgaaagcacgtgacctgccacacata

SEQ ID NO: 96115 - DNA, 66 bp, Mus musculus
agcaaggggctggagagacggttcagtggttaagagcactgactgctcttccagaggacctgagtt

SEQ ID NO: 96116 - DNA, 92 bp, Mus musculus
acttggatcgtttctgtgtccctgtctactgattctgtctttgttgtgagtctgtaatcagtactacgggaatcttgctttagagtctaagt

SEQ ID NO: 96117 - DNA, 120 bp, Mus musculus
aactcagatttagccttttaaaaagttacaggtcgggctggagagatggctcagcggttaagagcactgtctgctcttccagaggttctgagttcaattcccagcaaccacatggtggct

SEQ ID NO: 96118 - DNA, 122 bp, Mus musculus
ataggggaagaaacttcctgttcgctgagcttagaggtcagtgggtggagacaggagattgagacctcccttggcacttgttttttcgtctttagttctgtgaaagggtcttactatagttt

SEQ ID NO: 96119 - DNA, 77 bp, Mus musculus
tgttattgtgtccgtgtgtgcctctgagtgtgagcacacaccgtcacacttgtggaggtcacaggacagctttgagg

SEQ ID NO: 96120 - DNA, 115 bp, Mus musculus
tctctgcctgctgcctgtggatcaggatggaaagctctcggctacagctacagcaccatgcctgcctgcctgcctgcctgcctgctgccttgttcccagccacgacaaccatgga

SEQ ID NO: 96121 - DNA, 106 bp, Mus musculus
acatgtattgtttctatgctcagaagggtggaatctaaagtgaaagcagattcgtaaatatctaaacaagtttgaacctaccgtgacgggcagcagcgatccatgt

SEQ ID NO: 96122 - DNA, 101 bp, Mus musculus
cgctgctgtgaaaggcagttcagggtaggttatgccatcagagtttatatatataaatgaacgcataccttggccctggtttgggaacttttccagctttg

SEQ ID NO: 96123 - DNA, 73 bp, Mus musculus
ggttccatccatctcactttcactgtgtgtgtcttgggaacatcaggagacacctgccgtggaggaccagacc

SEQ ID NO: 96124 - DNA, 83 bp, Mus musculus
ggattctgagtgacacacactgcctgtgaggtggggtctgaaaacagtttctcccagcagcagtgggtggggcagcagcatcc

SEQ ID NO: 96125 - DNA, 99 bp, Mus musculus
tgagtaattgtgggctggagagatggctcagcggttaagagcactgactgctcttccagaagtcctgagttcaattctcagcaaccacatggtggctca

SEQ ID NO: 96126 - DNA, 63 bp, Mus musculus
tacatataatatgtgtatgtgtgtctatgtatgtatatatgtatgcatgtatgtctgtatgta

SEQ ID NO: 96127 - DNA, 87 bp, Mus musculus
cttcagtgtgtttggagtatgttgggactgtggcccacatgacactgcagatctgagtaacactgtctccctctctcggctctgaag

SEQ ID NO: 96128 - DNA, 114 bp, Mus musculus
ggcttggcggaactctgaatcgagcatgctctggcaggtgagctcgttaagaggagagtgtgaggtctcagggaagctgcctggaagcagcctagggtcttagggatgacctct

SEQ ID NO: 96129 - DNA, 81 bp, Mus musculus
actgagcagcaaggcaagagggcgggctgtgtagggtgttctggtgtgggtgagagcatcttctttttcttgagcctcagt

SEQ ID NO: 96130 - DNA, 114 bp, Mus musculus
gtgagagattgataggaattgttgggggttggagagaaggctcatcggttaagagcagtgactgctcttccagaggtcctgagttcaattcccaacaaccacatggtggctcac

SEQ ID NO: 96131 - DNA, 107 bp, Mus musculus
gatggttttagctcccttgtcaaagatcaagtgaccatagttgtgtggattcatctctggatcttcaattctgttccattggtctacttgtctgtcactatatcatt

SEQ ID NO: 96132 - DNA, 100 bp, Mus musculus
cttgttccccaaagtttatgtctgctgatcttcccacaattttattgtttatattacaaaagactcaatgataagaatgtagatgaagggggatcccaag

SEQ ID NO: 96133 - DNA, 82 bp, Mus musculus
gggtcagtccctgcctctctcttgattgcgctgtaagtcagagagattggtcaatcattcagagattctgggacatggatct

SEQ ID NO: 96134 - DNA, 100 bp, Mus musculus
cacacatatatacatatttattcacatatatacatacacacacatatgtgtgtgtctgtgtgtgtatatggcttatgtaaaactgaagatgtatgaagtg

SEQ ID NO: 96135 - DNA, 77 bp, Mus musculus
ccaggacagctcagaaaagaaaacttgtgcttttcttctactggaaagaaaagtctgttttctcaaggagttgcagg

SEQ ID NO: 96136 - DNA, 62 bp, Mus musculus
acatgcacatatgtgtatatgtgtatgtacatgaatatatgtgtgtatatatgtgtgtatgt

SEQ ID NO: 96137 - DNA, 94 bp, Mus musculus
tgaacatacatgctgttatgaaaagtaatcacgtgctggagagatggctcagcggttaagagcactgactgctcttctgaaggtcatgagttca

SEQ ID NO: 96138 - DNA, 85 bp, Mus musculus
cccctgcctgcaggtggtggagactggaggctcgtgcatcacagctccatgctgtggagagtctgtctgaatctctcaggagggg

SEQ ID NO: 96139 - DNA, 82 bp, Mus musculus
tttatttattttgtatttatctctgtgtctgtatgtgtgtgggctcacgtgcgccagggtgtctgtgtggatttcagatgaa

SEQ ID NO: 96140 - DNA, 69 bp, Mus musculus
gtgcatgtgtatgtttatatgtataaacatattgtatgtatgtatacatatgaatatatgtaaatgtat

SEQ ID NO: 96141 - DNA, 82 bp, Mus musculus
atggaaacatcccagttagggctgagtagttcaaggccccccattctcagtgtactctcaggctgtgggtctctgtattcat

SEQ ID NO: 96142 - DNA, 78 bp, Mus musculus
gccaaggcttctccccacggtcacccagcggtccctgtttgactgactgtctgtctgctctgtagagaatgcctttgc

SEQ ID NO: 96143 - DNA, 60 bp, Mus musculus
gtgtgtgtctctgtgtgcctctgtgtatgtttgtctgtgtatgtacgcatacacacacac

SEQ ID NO: 96144 - DNA, 83 bp, Mus musculus
gtctgtgtgtctgtctgtctgtctgcctgcctgcccaatccatgtaccagtctcaggaggagctatatgacttatgcagagat

SEQ ID NO: 96145 - DNA, 100 bp, Mus musculus
tggaggcaaaacacagccttggtggacccagaagagactcagcactgagacacctctgcaaagtgacagtatctcttctacctggatactgtgtcctcca

SEQ ID NO: 96146 - DNA, 117 bp, Mus musculus
gtatgtatgtatgtatgtgtatatatccctctgtgtgagtatacatatgtggtatgtgtgtctgcctgtgtgtgtgcctatgcatgcatatgaatatatgtgcatgtgtttacatat

SEQ ID NO: 96147 - DNA, 69 bp, Mus musculus
ggctcgctcactctttgagtctcccttaagaaacttctggaagctacaaggaagctgacctggtgggcc

SEQ ID NO: 96148 - DNA, 84 bp, Mus musculus
ggatgcctgctgtgttacaggtatttaataggcatttgctgagtaagtgaatgaatgaatgaatgaatgaacggcttgacattc

SEQ ID NO: 96149 - DNA, 115 bp, Mus musculus
gagaacagtttattatggctcttggttccgctggctattttgattttcttttttatttaaaattgtctgaagcattggggagatggctcagtgtttaagagcacttgctgctctt

SEQ ID NO: 96150 - DNA, 60 bp, Mus musculus
gaccagtctctctcttcctgtctgtaaatcgggcaaggatgttgagctcggagggtggtt

SEQ ID NO: 96151 - DNA, 76 bp, Mus musculus
ttgcataaacatgtatatgtgagtgtgtgtacacatgtttatgtgtgagtgcatgtacatgtatatgtgagagtag

SEQ ID NO: 96152 - DNA, 91 bp, Mus musculus
gttgcatgtcaactaaattatctgtttgattatgtcagtgtctgatgtttctgaatgactcgaaccaatactttcccttggcccatgcggc

SEQ ID NO: 96153 - DNA, 75 bp, Mus musculus
tgcatatgtatatatgtacgcatatgtgtaaggttccttctacccatcaactatgtgtatatatgtatatatgta

SEQ ID NO: 96154 - DNA, 81 bp, Mus musculus
tgtgtttatatataaatgtgtatgtcatgtacatatgtgtgtatatatatatgtacatacatacatgcatacaacagttta

SEQ ID NO: 96155 - DNA, 60 bp, Mus musculus
tgttgtatgcatgtatgtatgtacatatatatatacacacatatgtacatgacatacaca

SEQ ID NO: 96156 - DNA, 113 bp, Mus musculus
gtgtatatatgcatgtgtgcattatgtatgcatgtatgtatgaatgtatatatcattcatgtacatatcatgcatgcatgtatgcatgtgtgtatgaatgaaggtatgtatgc

SEQ ID NO: 96157 - DNA, 180 bp, Mus musculus
atgtgtgtatgtgcatatatatctgtgcatgcatgtatgtgtgtatatgtgtctgtatatatgtgtatatatatacgtttttgaatatatatgtgtgtagtgtatatatgtgtgtatatatatgtgtgtgtatatgtgtacacaagtatatatgtgtgtatatttgtgtgtatgtatgtg

SEQ ID NO: 96158 - DNA, 121 bp, Mus musculus
cgtttggtgaggagggcgagctggtcaagctgattgtcccagccaggtgtcagtctaggcgtctcttctgtcactgtcaggtaatcattgccttcaagcagggttcccatggaggagagac

SEQ ID NO: 96159 - DNA, 99 bp, Mus musculus
taggagggcgttatgtagatctgtgagctggttttattggatttgaatacatattttctttttcagaaagggtctcattgtgcagcctacgctgtccta

SEQ ID NO: 96160 - DNA, 86 bp, Mus musculus
atatgcctcagaagagacactcagggaacaaatgctgcccttcatcgcattgtcccccttctctgcctgtctgtctgtctgtctgt

SEQ ID NO: 96161 - DNA, 66 bp, Mus musculus
taaacttgaggctctcactctggctcattgtgatagtgacagtcagagtccttgcttgtgagtttg

SEQ ID NO: 96162 - DNA, 76 bp, Mus musculus
cagaagaggcagggagcacatgtttgctcagctgaaaacacctgaccaaattcttgtctgcctgcctgcctgcctg

SEQ ID NO: 96163 - DNA, 103 bp, Mus musculus
gtgctaagctcctcgctgagtctcaaagtggtgagttcaagagtagtgaaatagaaaacatttatctgagctctgcatttaagtcacaagcaaagtcaagtgc

SEQ ID NO: 96164 - DNA, 70 bp, Mus musculus
ccaggttcatacagatagaggaagagcctgtctgtctgtctgtctgtctgtctgtctggaatggatttgg

SEQ ID NO: 96165 - DNA, 65 bp, Mus musculus
gtgacagaggctggtggaagagcaatcagcacacaacccaagtgtttttcttctagtgctgtctc

SEQ ID NO: 96166 - DNA, 65 bp, Mus musculus
gaaaacatgtactgagatgtgtccatgagctaacaaagctcacctctgtctctgtgattgttttc

SEQ ID NO: 96167 - DNA, 70 bp, Mus musculus
ggaggaagtgtgtcactgtgggggtgggctttgaaaccctcctcctagctgactgaggacagtctgctcc

SEQ ID NO: 96168 - DNA, 77 bp, Mus musculus
tctgtgtgtgtgtgtgtgtgtgtgtatgtgtgtgtgagaaagagacagacagacacacacacagaagacagacaggc

SEQ ID NO: 96169 - DNA, 99 bp, Mus musculus
tgtgtgtgtgtctgtctgtctctttctcacacacacatacacacacacacacacacacacagagagagagagagaaagagagagagagagagagagaga

SEQ ID NO: 96170 - DNA, 83 bp, Mus musculus
ctctcagtctctttgtctgttattggtactattcctggtgagtgatacctgatagatccattccagaataaggaaattaaggg

SEQ ID NO: 96171 - DNA, 105 bp, Mus musculus
gctacacgtcaccaaacagactgtgaaggaaagtagaaagtgtgcagagatgttgccattcctcagcacaagtataaccatacagagtactgtagactgtgtagc

SEQ ID NO: 96172 - DNA, 106 bp, Mus musculus
ctattatagtttggtcactggggtcctttaagcaggtcactgtctctttgatagatatctatttttatttgaacactgacattggggctttcaaaaactactgtag

SEQ ID NO: 96173 - DNA, 61 bp, Mus musculus
tacatgcatatatgcatatatatgtatatatatacatgcatatgtatatatatcacatgtg

SEQ ID NO: 96174 - DNA, 85 bp, Mus musculus; identical to SEQ ID NO: 57439

SEQ ID NO: 96175 - DNA, 106 bp, Mus musculus
ctggagttggggagctgatggccatgggctgagaggacacagtgtggaggaatcacaggtattagtttctttgtttgagcacaaggccaggagttgcaagactcag

SEQ ID NO: 96176 - DNA, 74 bp, Mus musculus
ggtgtgtatgcccaaggagaaaaggagaccttgtggggtcagttctctccttcatctctctgtgtgttcattcc

SEQ ID NO: 96177 - DNA, 92 bp, Mus musculus
agagagaaagagagagagagagacagagagagagagagattttcatagatttatctatttatttggagtcttgaatctcagtcatttttttt

SEQ ID NO: 96178 - DNA, 76 bp, Mus musculus
gcatgtatgtgtatgtatgtatgtatgtatgtatatgtatgtgtatatatgtatgtatatatatatatgtgtgtgt

SEQ ID NO: 96179 - DNA, 133 bp, Mus musculus
gtatatgtatacagatgtgtatgtgtatatatgcatgtgtattttgtgtgtatgtatgtatatatatgtgtatatgtatttgtgtatttgtgtatgtcgtatgtatgtatatatgcatgcatgtatgcatgtg

SEQ ID NO: 96180 - DNA, 112 bp, Mus musculus
ggtcccgctttaattcctactgtatagcaagagagactgagaggagagtctgagcagttcaatggagaccccctcactcagtacagggcagaagttcaaaggaagagggaac

SEQ ID NO: 96181 - DNA, 83 bp, Mus musculus
acaagaatgcagtggtggctttccttaaatacacagcgtccatctgtcccctgtgctctgtgtctccatctctgtctctctgt

SEQ ID NO: 96182 - DNA, 97 bp, Mus musculus
tctcaataaaacattacaagttgatcaaagtaggaagcaaatatttattttgtttaagaacaagttgaaaattaactatgtatgtgaatgattgaga

SEQ ID NO: 96183 - DNA, 74 bp, Mus musculus
gacaccgaagtactgtctttcaggctgggaaaggttattttcctcttgtggaaagacacttcactctctgtgtc

SEQ ID NO: 96184 - DNA, 100 bp, Mus musculus
gcatgattgtatgtctatatgtgtgtatgaatgtatatgtatatatctatatgtgtgtacgaatgtatattacccacagaataatttatgaacaacatgc

SEQ ID NO: 96185 - DNA, 81 bp, Mus musculus
gggtaacacatgaagcacactgaaaggcatgctgtccggatggcggaaagtagtgtgtacagtagtgtgtacaaagtacct

SEQ ID NO: 96186 - DNA, 61 bp, Mus musculus
tggccctgatctggggtgacatacatgggccactgtgtctgacactcactgaccagtttca

SEQ ID NO: 96187 - DNA, 79 bp, Mus musculus
aggaacacagggtccttcacagagaaattaagggaacccactccctcctgctccttactgtgtgtgactctgtgtccct

SEQ ID NO: 96188 - DNA, 85 bp, Mus musculus
tatatgtgtgtgtgtatgatttatatgtatctgtgtgtatgtatgtgcatgtatgtatgtgtgtatgtctgtgtatgtctgtatg

SEQ ID NO: 96189 - DNA, 113 bp, Mus musculus
cgcatggggctgcttcccataaagtccaacagcctcctaagcagtacttcttcaggtaattgatgtctgctccgaggatgtgtcttggtggtgaagagctggcctggcatgcg

SEQ ID NO: 96190 - DNA, 106 bp, Mus musculus
ggtggctctctatataaaagacatggaagaaggatgcttgcagtctgcctgctcaccctcactcagactggcaaagtccattcctttcgctagaattagagcttcc

SEQ ID NO: 96191 - DNA, 139 bp, Mus musculus
acaatagcctatatcatatctgtgtgtgtgtgtgtgtgtgtgtgtgtgtgtgtgtgtaagtatgtctatatgtatatgtgtgtacatttatgtatgtatgtctatatgtgtgtatatatgcatataaatgcatgtctat

SEQ ID NO: 96192 - DNA, 85 bp, Mus musculus; identical to SEQ ID NO: 57439

SEQ ID NO: 96193 - DNA, 106 bp, Mus musculus
gagctcaagtttaggttgtgtttctctacaggcttctgtattatattatatacatattgatataaggaagtacctgaggctatagacattataaaacaaagaggtc

SEQ ID NO: 96194 - DNA, 65 bp, Mus musculus
tctgaagtgtgagagctcaggtagcctcgcaaggagcctgtaccagctcttagatgcatgtcagg

SEQ ID NO: 96195 - DNA, 109 bp, Mus musculus
gtatctgtgtgtgtctgtgtgtatgtatgtaaatatatatatatatacacacacatttatacatatatgtatatatgcgtatatgtatattgtgtgagtgtatatgtat

SEQ ID NO: 96196 - DNA, 73 bp, Mus musculus
acacacacacacacacacatattcctgagtacataaatacttgctctgtataatgttacctgtatgtgtgtgt

SEQ ID NO: 96197 - DNA, 91 bp, Mus musculus
tgaatgacagcaaattcaatggcagtgaatttatggtcactattaacagtctttatttattattgattgccttgggaactgctgctattta

SEQ ID NO: 96198 - DNA, 88 bp, Mus musculus
ttcaaaggagaggtatttggatcttttgtctcttgattcattctattttattagtaaaggacatggctgagtatcatctcttctagaa

SEQ ID NO: 96199 - DNA, 121 bp, Mus musculus
ggaagaggctccttaaaggaagaaaatccagcgatgtgacttgggcgcacttttctctccctccaggacttcctccgagggatacccctgaagctactctcctgtgatctctttgaggact

SEQ ID NO: 96200 - DNA, 85 bp, Mus musculus; identical to SEQ ID NO: 57439

SEQ ID NO: 96201 - DNA, 80 bp, Mus musculus
gtgtgtttgtctgagtattcacttcaatttttgattttagtaaagtctctatgagtgagactcttgtgactctaacatat

SEQ ID NO: 96202 - DNA, 116 bp, Mus musculus
gcatggatgctaaagggcagatctgcagtgatgttctggggtacggaaaggtatcagtctgattctctctctgcctgtgcatgcagatcaatttgctgttcactttactcctatgt

SEQ ID NO: 96203 - DNA, 66 bp, Mus musculus
tatgtgtgcatgtatatttatgcttgtatatctacaaatatttgtatgaatatatgtgtgtatgtg

SEQ ID NO: 96204 - DNA, 104 bp, Mus musculus
gagggaaacaacttactagagctatcatatctaaggttgggtgtttgaaggtctctcactctctgcatattttcttggctgtgggtctctgtacttttttcccc

SEQ ID NO: 96205 - DNA, 84 bp, Mus musculus
tcacctttgcatctctctctctgtgattctaagatttgctgttaagtaaagtataggcaacgtggggagggagtgggagaggga

SEQ ID NO: 96206 - DNA, 70 bp, Mus musculus
tgcatgtgtttataagtatgtgtgcatatgtatgtgtgtatatatgtatatatgcatgtgagtctatgta

SEQ ID NO: 96207 - DNA, 86 bp, Mus musculus
gtatatctgtgtgtatatctgtgtgtgtatgtgcatgttgtatgaatgtgcatgtgtgcattgtataaatgtgcatatgtgtatat

SEQ ID NO: 96208 - DNA, 115 bp, Mus musculus
tatcacttcatttttgctagggactgaaaaatgcccccctctctgtgtgtgtgtgacatcatgggaacctgtaattgggagctaatttccagccactgtgaatagtgaagcaata

SEQ ID NO: 96209 - DNA, 83 bp, Mus musculus
gtatgtatgagtgtctgtgtgtctgtatgtgtttgtgtgtgtatgcacacatatttttgtactcatatattgcttgtatttgc

SEQ ID NO: 96210 - DNA, 140 bp, Mus musculus
ctattatttatgttgttattgaagatcagccttagtggtgctctgataatgtgcatgggataatttcaatatttttgtatctgttgaggcctgttttgttaccaactatatggtcagttttggagaatgtaccatgaggt

SEQ ID NO: 96211 - DNA, 114 bp, Mus musculus
ttttgaggaggcacccagccttctggactgaatgtcgagggattcctggcctctccagtgagaagacagtcagcatcagatcacccaggctgtatcatgtaagccaacccaaag

SEQ ID NO: 96212 - DNA, 73 bp, Mus musculus
ggtagaaggtagtccgtgttgacatccactctcccatcagaggaaatcactgccacactgtctcttttctgcc

SEQ ID NO: 96213 - DNA, 101 bp, Mus musculus
gcatcaatagaatatatatacatatatatatatataatatgtaaatatagcatatgtgtgtatatgtatgtatgtatgtgtgtgtgtatatatatgtgtgt

SEQ ID NO: 96214 - DNA, 106 bp, Mus musculus
gagaatgagtcatagataaaagggagatttctgtgtttgtaaatgtgtcctaagaagagaaaagacagccatagatctcagagccgtctgtagtgtggcatctctc

SEQ ID NO: 96215 - DNA, 81 bp, Mus musculus
gcaatttcatggtgacagactgtagggagtctggtctcatcacagaggttattcatgcccaggtttgaacagtgacaaagc

SEQ ID NO: 96216 - DNA, 78 bp, Mus musculus
ctctccctgactctgtctctgacttggcaggatgaaagcaaccaacccaagagtctagatggctagagtctatttgag

SEQ ID NO: 96217 - DNA, 61 bp, Mus musculus
ggacatgtccctcctcctagctcagtctctgtctgtaacagagcaaagggtgactgtgtcc

SEQ ID NO: 96218 - DNA, 84 bp, Mus musculus
ctccataatagtatctttttaaatgatgacgcagtttctcactcagtgcattggtcataatttaacaggttcttctttatggag

SEQ ID NO: 96219 - DNA, 74 bp, Mus musculus
ggcttttccagaggacacatggcattgtgagcacgtgacaacactggctctctctgtctatgccctgcgaagct

SEQ ID NO: 96220 - DNA, 77 bp, Mus musculus
agagcactgactgctcttccagaggtcctgagttcacatggtgacttacaaccatctgtaatgagatcagatgccct

SEQ ID NO: 96221 - DNA, 68 bp, Mus musculus
catccatccatacatccatacatacatacatatgaatgtgtatgtatgtatatatgtatgcatggatg

SEQ ID NO: 96222 - DNA, 57 bp, Mus musculus
gtgtcacagtgtatcacagtgtgtcacagtgtgtcacaatgtgttatagtgtgtcac

SEQ ID NO: 96223 - DNA, 68 bp, Mus musculus
tgtgcttatgtggtgtgtctctctgtgtgtacggacacgtgtatgtgggaccaccaaagaccagcaga

SEQ ID NO: 96224 - DNA, 82 bp, Mus musculus
gtgtgtgcatatatatgtgtgtatgagtgtgagagtgagtgtatctatgtatatgtatgaatgcatgtatgtatgtatgtat

SEQ ID NO: 96225 - DNA, 74 bp, Mus musculus
aggtgtgtactaccatgcccaacttgtgctattatttttttaaattgtgcgtgtctgcgtgtgggtatgtgctt

SEQ ID NO: 96226 - DNA, 56 bp, Mus musculus
tggagcctaaagagagacacaaggcactccattctgcctgtctctgtctgactcca

SEQ ID NO: 96227 - DNA, 87 bp, Mus musculus
ttctaaatgtttattctctgaagacagtggggagagtggagccaagaaatgaaccagactaaagtctcaggcgatagccattcagag

SEQ ID NO: 96228 - DNA, 94 bp, Mus musculus
cacagattcatgctctcacacactaacactctcaatggagttacaaagagcaagttattttgttgatgatggtggtttgagatgcttgtgctgt

SEQ ID NO: 96229 - DNA, 99 bp, Mus musculus
gaccacgagtctcaggcaggcttgccttaaacttaaaaaatatctaaaagatatttattttattttaattctgtctgtgtgtctgtgtgcatgtgagtc

SEQ ID NO: 96230 - DNA, 113 bp, Mus musculus
ggttcaagagccatgtactggggctggaaagatgacttagccgttaagagcactgactgctcttccaaaggtcctgagttcagatcctagcaaccacatggtggctcacaacc

SEQ ID NO: 96231 - DNA, 70 bp, Mus musculus
gcatgtgtgtgtgtgcatgtacatgtgttcatgtgtgtgcacacgtgtgcgtgtgtgtgcgcgcgcatgt

SEQ ID NO: 96232 - DNA, 67 bp, Mus musculus
ttatccctctgtctctgtctatgcttatgactatatcaggtagatagatggatggatggatggatag

SEQ ID NO: 96233 - DNA, 114 bp, Mus musculus
cacagaaagttggtatcaagaatggggttgcgggctggagagatggctcagtggttaagagcactgactgctcttccgaaggtcctgagttcaattctcagaaatcacatggtg

SEQ ID NO: 96234 - DNA, 73 bp, Mus musculus
gtttgtgcatgtgtctatgtgtctgtgtctatgtgtatgtacagatggatgtcagaggataacttgcaggaat

SEQ ID NO: 96235 - DNA, 100 bp, Mus musculus
cccacctcctgatagactgagaaaacagagagcacagaggccaagggaccaagggagagcaggggcactagggtcattgtcttctcagctgagaagtggg

SEQ ID NO: 96236 - DNA, 78 bp, Mus musculus
agtctgtagttctgtatgtgtgtgtgtatgtatgttatgcatgtatgtatatatttgtgtgtataaaattattagact

SEQ ID NO: 96237 - DNA, 69 bp, Mus musculus; identical to SEQ ID NO: 95121

SEQ ID NO: 96238 - DNA, 161 bp, Mus musculus
atatatgtgtatgtatacatgtatatatgtgtgtatatgtgtacatgtatacatgtgtgtatatgtatatgtgtgttcatgtatataggtggatatatgcatgtatgtatgtatacatgtatgtatgtgtggatatatgcatgtatatatgtagtatgtat

SEQ ID NO: 96239 - DNA, 106 bp, Mus musculus
tatatatgcatgtatgtgtctatatacatatatatgtatatatgtatgtttaaatgtatgtgtgtttgtatgtatatatgtacatgcatgtatgtgtgtatatgta

SEQ ID NO: 96240 - DNA, 118 bp, Mus musculus
gcctgcaattctgagttcttcataggaccaaaggcagatgaaaagctggaataaacctacctcagggtctctctgtgtgtctgccttttcacgggagctggggaatcagaattcaggt

SEQ ID NO: 96241 - DNA, 116 bp, Mus musculus
gtcacttaacattttatgtttctagctgataaaaatgaagagttgagacagtgcacacactattcagcaatacatggagggaatgcaagaagcagatgaagatatagtcaagtggc

SEQ ID NO: 96242 - DNA, 115 bp, Mus musculus
gaggatttaaagcatgtacatgagccacagggtacacgggtcaagtcactggatgacttctgagtgtgttctcttgttgcaccctgtgggtctcaggactgatggagagagcctt

SEQ ID NO: 96243 - DNA, 94 bp, Mus musculus
tatatgtgtgtgtgtatgtatgtatgcatgtgtgtatatatgtgtatgtgtatatatgtatgtatgtgtatatgtgtgtgtgtatatgtatgta

SEQ ID NO: 96244 - DNA, 68 bp, Mus musculus; identical to SEQ ID NO: 95120

SEQ ID NO: 96245 - DNA, 89 bp, Mus musculus
gtgagagggctggccttggaaagagggacctaggcaggatgcaaggaagggtctgcttctgtctgtctgagtctacccagcctcctttc

SEQ ID NO: 96246 - DNA, 83 bp, Mus musculus
ttttttttacttaggtatgtgtgttgtatgtatgtatgtatgtatgcatgtatacatgcgctcacatgtgtgggtgctgagga

SEQ ID NO: 96247 - DNA, 64 bp, Mus musculus
gcatatatgtgtttgtgttcttgtgatatctgtacggtaactggatgcatatgcgcatgtatgc

SEQ ID NO: 96248 - DNA, 85 bp, Mus musculus; identical to SEQ ID NO: 57470

SEQ ID NO: 96249 - DNA, 76 bp, Mus musculus
ggcaagtggatctctgtgtgtctgtgtattttaggtcaatctggtctacacagtcaattccaggacagccaaagct

SEQ ID NO: 96250 - DNA, 111 bp, Mus musculus
tgccaaaagaatggacttcaagggcttccttatactaaagtttaaatatttctataagttggaaaggtcaaagaaattagtagaagggagttggagcccagccattaagca

SEQ ID NO: 96251 - DNA, 109 bp, Mus musculus
gccttcctggctgctgccatcaccatgtggttcagtcctcctcagagtagtcactgaggaaaattctgggacaaaggacccaactggcttgaggtggtgctaagcaggc

SEQ ID NO: 96252 - DNA, 91 bp, Mus musculus
gtgtgtgtgagtgtgtgtatctgtctgtctgtctgtgtgcacgtgagtgcccatgtgggggtggggcttgaagcaaaagcacagcaggggc

SEQ ID NO: 96253 - DNA, 78 bp, Mus musculus
gcctttcccagtggatgactacaggctgacttcccagtcatcaccttgacatgtgagagtactgtgaccagtggcggt

SEQ ID NO: 96254 - DNA, 103 bp, Mus musculus
gccttaggtttagttgctgtatgtgcatgtgtgtgcatgtgcatttgcatgtatgtgtgcacgtgcacacacatgtatatgcattcatacacataaacacagc

SEQ ID NO: 96255 - DNA, 80 bp, Mus musculus
tctttgttataaggacaggtgaattctgagcccttatatgagggatgggagctcagatcacacagtccctgagacactga

SEQ ID NO: 96256 - DNA, 64 bp, Mus musculus
gcatgtgtatgtgtgcttgtgcatgtgtatgtatgtatgtgtgtgtgggcatgtgtgtgtatgt

SEQ ID NO: 96257 - DNA, 68 bp, Mus musculus
tctggctggtcaaatcttccacaacttcaggcgagtctgaaggagtcagaagaaagtcatcagacaga

SEQ ID NO: 96258 - DNA, 116 bp, Mus musculus
tgactggtgagaggaaaacccaaggaagactttcgagaaatctaggagaatggcggtgaagctatggatagaagtatgcatgggagttgccttgtgatgtcatgatgtgccaatca

SEQ ID NO: 96259 - DNA, 83 bp, Mus musculus
aggttttctctgtgtgtctctgactatcctgggcccactcactctgtagaccaggctggcattgaactcactgagatccacct

SEQ ID NO: 96260 - DNA, 70 bp, Mus musculus
gtgtgtgtgtgtgcgcgcgcgtctccctctttgcctctctctgtctctgtgtgtgtgtgtgtgtgcgtgc

SEQ ID NO: 96261 - DNA, 69 bp, Mus musculus
catgctcctctgtgtgtgtgtgtgtgcgcgcgtgctcgtgtgcgtgtgcacagggcacaggcgagtgtg

SEQ ID NO: 96262 - DNA, 95 bp, Mus musculus
gtagtcttgttggaggaaggccactggaggtgagcttcaaaggttttcaaaagcccaagccaggctcagtgactctctcttgtgaatctgactat

SEQ ID NO: 96263 - DNA, 69 bp, Mus musculus
gactttgatgcaaggaggctacgtagacccgagtttctctgtctttctgtatgcctctctgtctctgtc

SEQ ID NO: 96264 - DNA, 75 bp, Mus musculus
actgggactttgtgagactgaacttgatgtagcctgggtcccagatgcacactcactgtgtcttataatcccagt

SEQ ID NO: 96265 - DNA, 56 bp, Mus musculus; identical to SEQ ID NO: 96226

SEQ ID NO: 96266 - DNA, 83 bp, Mus musculus
gagtcgttacttttcttgatttctctttttggatatttgttcccagctctccagaagaaactgagcacaggtgacacagactt

SEQ ID NO: 96267 - DNA, 72 bp, Mus musculus
gtccatgtgtgtctctgtgtgtccatgtatgtaagcatgcatggaaattatgtgaggcagaggagagaggac

SEQ ID NO: 96268 - DNA, 78 bp, Mus musculus
tgtgtacatatgtttgcgtatatatgtatatatacatacatatatacatacatatatacatacatacatacatacata

SEQ ID NO: 96269 - DNA, 74 bp, Mus musculus
tgtatgtatgtatgtatgtatatatgtatgtatatatgtatgtatatatacatatatacgcaaacatatgtaca

SEQ ID NO: 96270 - DNA, 80 bp, Mus musculus
ctctgaaacaggcaggggaggcaagaagtgttggacgtttcagactgtcagcctgattgcctccctggccatacatggag

SEQ ID NO: 96271 - DNA, 92 bp, Mus musculus
ttcgtatttacaggaggtcgtcaggtttggaagatcaagagaactcagggtcactctgtgattgtatagaccctgggggtttctgatgcggg

SEQ ID NO: 96272 - DNA, 72 bp, Mus musculus
gacacagtgacagaatgaagccataagagcatgcaaagttaagactcttgctgaggtctgtctgtctgtctc

SEQ ID NO: 96273 - DNA, 87 bp, Mus musculus
gtgggtacccatgtcaatgcatacacaaggaggctagaggaaattgtccagtatctccctgtgtcactcactgaatctgaagctcac

SEQ ID NO: 96274 - DNA, 76 bp, Mus musculus
gtgcatacatgtgtacctacatacataggcatgtacatatgtgtatatatgtatatgtatgtacacatagatgtac

SEQ ID NO: 96275 - DNA, 59 bp, Mus musculus
aaacagaagtcagcagatggatgatctatctatctatgtatctatctgttggtctgttt

SEQ ID NO: 96276 - DNA, 89 bp, Mus musculus
ctgagccttggcacaagtcaacaggagggacccagagggacactaggaaaggttctcagctgtgtctctcttagtgaagtgaagatcag

SEQ ID NO: 96277 - DNA, 75 bp, Mus musculus
ccagcaaaggtagagattgggagttttggaccagcctggactctgagtctgtctcaaaataaaaacaaatcctgg

SEQ ID NO: 96278 - DNA, 112 bp, Mus musculus
catgtggttgctagaaattgaactcaggatctctgagagagcagtcagtgctcttaaccactgagccatctctccagccccaagtgctcagtttctactcttaatcaccatg

SEQ ID NO: 96279 - DNA, 108 bp, Mus musculus
tctccccactccttaaccctttctgagaatactctcacaaacccaaccagacatgtctctttgttaatctgaggtccaacttaaaaagggtcagtgggtttgggctga

SEQ ID NO: 96280 - DNA, 95 bp, Mus musculus
atgtcctagattctgaccccagatccatgtgcttgctggtggtcccaggcaaatgctatgacactctgggtctcagtttgtacatacatatgtgg

SEQ ID NO: 96281 - DNA, 70 bp, Mus musculus
gcagttctgacttgtgtgtgcacacaagtgtgtgcacacatgtgtgtgtgcacacacacatgagtgatgc

SEQ ID NO: 96282 - DNA, 82 bp, Mus musculus
tttggtgttataggatggttctatagatatgaacacaaaagagagtctctcaggtgtgtgtctgagtcactgcgacatcaag

SEQ ID NO: 96283 - DNA, 90 bp, Mus musculus
ctgaccttcacaccaaccacccggattcactgatcttagctgtttgctaatagcataacctcatttggaaaggttgagtgtcaagtgcag

SEQ ID NO: 96284 - DNA, 75 bp, Mus musculus
taggctggagagatgactcagaggttaagagcactggctgctcttccagaggtcctgagttcaattctcaactta

SEQ ID NO: 96285 - DNA, 110 bp, Mus musculus
tttctatagtgttgcttgttcatgcagtgggcttacagtaatttaaccttacagtagtatatatgttgaagtctgcctttgtcaggattccaggtaattaaaggtagaaa

SEQ ID NO: 96286 - DNA, 70 bp, Mus musculus
gggtggtgacttgttggagtgtgtgctgaccatgacgtcttgttacacgcactgactgacacgttctccc

SEQ ID NO: 96287 - DNA, 115 bp, Mus musculus
ggcagagaaagacacttttgaggggctggagagatggctcagaggttaagagcactgactgctcttccagaggtcctgagttcaaatcccagcaaccacagggtggctcacaacc

SEQ ID NO: 96288 - DNA, 111 bp, Mus musculus
tatagtatatacatagtatatgtatatagtgtatatatagtatacatacatgtatatgtatgtatatatagtatatacacatatatatgtatatatagtgtatatagtata

SEQ ID NO: 96289 - DNA, 97 bp, Mus musculus
ggacaaagaacaggtagacgtgctatggaaaggaagggctcagaagtcagagagctgttacagacttttggagatgtgttccttggttactgactcc

SEQ ID NO: 96290 - DNA, 71 bp, Mus musculus
gtacaggaagagaaaaaatttggggatggcttggggatcccacctgactccctccctctctcttttgaaac

SEQ ID NO: 96291 - DNA, 123 bp, Mus musculus
atatatatgtatatatatatatgtgtgtatatatttgtacatacatatgtgtgtatatatatttgtacatacatgtatatattctatatatatgtatatatgtgtgtatactctcttttgtgc

SEQ ID NO: 96292 - DNA, 129 bp, Mus musculus
tatgtatgaatgtgtatgtatatgagcatgtgtacgtgtgtatgagtatatatgtgtgtatgaatgtatgtatgagtgtgtgcatgtatgagtatgtgtatatgtatatgagtgtgtgtatgagtgtat

SEQ ID NO: 96293 - DNA, 83 bp, Mus musculus
tccagtcctaggagaggtagcaggatgtttactggaggagaatggctcattccatttcagctgacctacctgcagtaggagga

SEQ ID NO: 96294 - DNA, 102 bp, Mus musculus
caggatggcacatctggcatctgctgtggctccaggcttgagtgtgaggttggggtcctgcgcttggatgctgtcttttccagctgtgcttcaccgctcctg

SEQ ID NO: 96295 - DNA, 101 bp, Mus musculus
acacaaagccactgtgaagtaaggaggaggtgttgggccatggtggttctccaagagcatctgggatagtgcctgtttagctttctctattgctattgtgt

SEQ ID NO: 96296 - DNA, 82 bp, Mus musculus
ggtaggctcagaggaagagagatgatggtggatgcaagatgaacatggatgaaccctggctcagagctctctcctgccctct

SEQ ID NO: 96297 - DNA, 108 bp, Mus musculus
atacatgcagggtgacttctatcactctatcttctgctgatatggatatcacagcctttttcagctatgctggtggtcagtgatcctcagtgatccttctgcctgtat

SEQ ID NO: 96298 - DNA, 81 bp, Mus musculus
ctagaagcctcctaaaaggtttgttgagtgagccggaaacaatcagaaatgatctctgggtcctggagacttgaggtctgg

SEQ ID NO: 96299 - DNA, 113 bp, Mus musculus
tactttcctagctatgtgagtttcttggagaccacagataattggatcacatttttttttaaatacagtccattagtctgtgtcttttaattattgtcttaaagccattggta

SEQ ID NO: 96300 - DNA, 149 bp, Mus musculus
tgtgagtatgtttatgtgtatatgtatgtgtacatgtgtatttgtgtgtatttgtttatgtgtgtatgtatgtatacatgtgtatgtatgtgtacatatgtatatatgtgtatatatgtatgtttgtatgtgtacatttgtgtatatgt

SEQ ID NO: 96301 - DNA, 66 bp, Mus musculus
acacacacatagagcaatgctgaataggccccatcggtatctatacatgtatgtgaatgtgtgtgt

SEQ ID NO: 96302 - DNA, 81 bp, Mus musculus
tatatacacacacatatatgtacacacacatatatgtgtgtaatacatatatatatgtgtgtgtatatatatacatatata

SEQ ID NO: 96303 - DNA, 57 bp, Mus musculus
gtgtatgtatgtatgtatgtatgtatgtatgtatgtatgtgcactacctgcatgcat

SEQ ID NO: 96304 - DNA, 97 bp, Mus musculus
ttcgtgcacagattgtgcttcacctgcaggatcacacctgctgtaggaacacggagcagtgtggacagatgacagtgagcagtgttgaggtcacgag

SEQ ID NO: 96305 - DNA, 116 bp, Mus musculus
aggagtgaaaagttctcacacctggcttctaagactatagctgaccttagataggactgactctgtctcagttattttattgcccagttcctgccagtctttgtgttttcatttct

SEQ ID NO: 96306 - DNA, 96 bp, Mus musculus
gatcagtcttagtccgtggtgatcagataggatgcatgggataatttcaatatttttgtatctgttgagacctgttttgtgaccaattatatggtc

SEQ ID NO: 96307 - DNA, 104 bp, Mus musculus
aaccctaactaagacatatgtatgtatgcatgtatgtatgtatgtacgtatgtatgtatgtatgtatgtgcctagatacctacatttgtctccaaagtagcgtt

SEQ ID NO: 96308 - DNA, 58 bp, Mus musculus
ctcacttacacacacatgcacacacacacacaccttgtctgcatgtgtatgttatgag

SEQ ID NO: 96309 - DNA, 71 bp, Mus musculus
taaataaatagcagtgtgtgtgtatgtgtgcgcgcacgtgtacacacacacacacacacatattatattta

SEQ ID NO: 96310 - DNA, 69 bp, Mus musculus
gctgaaaagatggctcagtggttaggagcactgagtgctcttccagaggtcctgagttcaattcccagc

SEQ ID NO: 96311 - DNA, 67 bp, Mus musculus
cctctgtgtgtctctgtgtctatgtatgtgtgtgtaccacatatacacactgactgtggaggccaga

SEQ ID NO: 96312 - DNA, 115 bp, Mus musculus
gtggtaaagagttaacaactggggctggaagatggctcagcctttaagagcactgactgctcttccagaggtcctgagttcaattcccagtaaccacatggtgtctcacatccat

SEQ ID NO: 96313 - DNA, 79 bp, Mus musculus
ggaaagagttgacagagagcactgttgacagagagcagcgaggcctctctgtttcaagctgagtatgtcttagctttct

SEQ ID NO: 96314 - DNA, 76 bp, Mus musculus
tctggtagttggttcttgagtagcagtcattctgcaaggcagaaagtggtgatgcgcctgaaacactagcacttgg

SEQ ID NO: 96315 - DNA, 127 bp, Mus musculus
ttctttatatgtatatgtatacatatacatataaagaatgtgtgtatatatatatatatagaatgtatatatatgtatatatatgtagaatgtatatatgtatgtatgtatatgtatatacacacat

SEQ ID NO: 96316 - DNA, 94 bp, Mus musculus
atatatgtgtgtgtgtatgtatgtatatatatgtgtgtatatacatatacatacatacatatatacattctacatatatatacatatatataca

SEQ ID NO: 96317 - DNA, 88 bp, Mus musculus
gagacaagatctctctgtgtagcgctggccatcctagaactcactctgcagaccaggctggcctcacactcagagctccacctgcctc

SEQ ID NO: 96318 - DNA, 79 bp, Mus musculus
ggttctagtgtgactgctgacagtgtgcagaaagtgtccactgagctttctccactgagatgtttacagcttgcagacc

SEQ ID NO: 96319 - DNA, 85 bp, Mus musculus; identical to SEQ ID NO: 57439

SEQ ID NO: 96320 - DNA, 79 bp, Mus musculus
acttctgttagtttcactgtgtctctgtttagtttctgtttccaggatctgtccattgatgagagtggggtattgaagt

SEQ ID NO: 96321 - DNA, 107 bp, Mus musculus
caaggagccacaaatgctagtctgagacagcttcccagcctccgagttgccaaaaactagctctctctctctgataaacagctgaactctctaggtgcctgtccttg

SEQ ID NO: 96322 - DNA, 124 bp, Mus musculus
gtggacctgtggcagagggaggacgaagaagaacacttgagtccactgtttttttatataaagaagaagatggggtcattttcagcttgtttgtttgtttgtttgtttgtttgtttgagacagg

SEQ ID NO: 96323 - DNA, 98 bp, Mus musculus
gtctgtctacctgtctgtctgtctgtttttatacttatatatctacctattatctagaaaggggatttattagaatgatttacagactgtggtgcaac

SEQ ID NO: 96324 - DNA, 80 bp, Mus musculus
gaatagcaggcctaggggctggagagatggctcagcacactattaagaacactgactgctcttccagaggtcctaagttc

SEQ ID NO: 96325 - DNA, 111 bp, Mus musculus
caggcacgagtgagacttgtaattttcttttctcatattggtctttttttttttttttttaactaaaacactaagggatggagagatagctcagttgttaaagactgcttg

SEQ ID NO: 96326 - DNA, 64 bp, Mus musculus
acagtagtcatctaacctgcagctgttgtctgactgatcagactgtactgtttgactttgctgt

SEQ ID NO: 96327 - DNA, 90 bp, Mus musculus
ctatagaattccatcttcctaaggccgctaatagtctctttgtcactatgtctgacaggcagatatttcagtccgcctaggttactatag

SEQ ID NO: 96328 - DNA, 58 bp, Mus musculus
tatgtgtatgtggtatgtgtgtgtatgtatgcatgcatgtatgtatgatatgtatgta

SEQ ID NO: 96329 - DNA, 74 bp, Mus musculus
acagtatatatgtatatatgcatgtatgcatatatatgtatatatattatatatgtgtgtatatgtatgtttgt

SEQ ID NO: 96330 - DNA, 79 bp, Mus musculus
ggcaagggtgagaaaagaaagtcagctcagcggggaggatgaatcccacaccatgggcgtggcagcctgccgccgttgt

SEQ ID NO: 96331 - DNA, 89 bp, Mus musculus
tttaaaatgttattgtggattagagtctctaggaggcaatcatattacgttattctctctagattctctgctcataaattcgttttgaa

SEQ ID NO: 96332 - DNA, 67 bp, Mus musculus; identical to SEQ ID NO: 86401

SEQ ID NO: 96333 - DNA, 97 bp, Mus musculus
tcagtcttaggccatggtggtctgatgcacgggacaatttcaatatttttgtatctgttgaggcctgttttatgaccaattatatggtctattttgg

SEQ ID NO: 96334 - DNA, 73 bp, Mus musculus
gagatctctctcaggctgtgagtaagttggtggccagggccacatttatctcagcattcactgcagaggactt

SEQ ID NO: 96335 - DNA, 99 bp, Mus musculus
taaacttagtactgccacatagttatgattatattattgagctcatcatttggctacactagtgtatttaatgttgattcccttggagaactgagatta

SEQ ID NO: 96336 - DNA, 71 bp, Mus musculus
ccacaacatagagagcacagacccaatcccagcatgctgggatgttgtactcagttcttcccctcccgtgg

SEQ ID NO: 96337 - DNA, 81 bp, Mus musculus
ggctagtgtcaggtgagagtgtggaccagatctaagtgaatgaggccaggttcttccaacctcatctgatggcttctggcc

SEQ ID NO: 96338 - DNA, 76 bp, Mus musculus
ctgagttgtgagaactgagaaggaaccaaccagtccccctagggacttctcccctgtcactccatctcacactcag

SEQ ID NO: 96339 - DNA, 92 bp, Mus musculus
acagaaatggcttttttcctgctttctatacttagtgtttatcattttatcaatagacacggatgttattaaagtagaaatctgttagctgt

SEQ ID NO: 96340 - DNA, 85 bp, Mus musculus; identical to SEQ ID NO: 57470

SEQ ID NO: 96341 - DNA, 87 bp, Mus musculus
gtatgtatgtatgtatgtatgtatgtgtgtgcgtatgtgcgtatgtgcgtatgtgcgtatgtgtgtatgtgtgtatgtgtgtatgtg

SEQ ID NO: 96342 - DNA, 71 bp, Mus musculus
gagatgtcagggggagaagtattagttatgaggcctcttcaaactgcaacacacactctgtctggcttgtc

SEQ ID NO: 96343 - DNA, 135 bp, Mus musculus
gtgtatatgtgtatatgtgtatatgtgtatatgtatgtacatatatatgtatatatgtatgcatgtgtgcatgtatatatgtatgcatgtatatatgtatgcatgtatatatgtgtatatgtatatatgtataca

SEQ ID NO: 96344 - DNA, 112 bp, Mus musculus
gcatcctgtttaggttgctactttttgggtggttggggaatgggatcgtcagggaaccttctatgtctctctttctcaatctgcagccatctatatccctgaagcagaatgt

SEQ ID NO: 96345 - DNA, 104 bp, Mus musculus
cagaattgtgagaatgaatgcttgttgtttgagtcactcacactgtgacacacacagtaattggggctgactgacagtgagcatctgaattcccttctcctctg

SEQ ID NO: 96346 - DNA, 85 bp, Mus musculus; identical to SEQ ID NO: 57470

SEQ ID NO: 96347 - DNA, 127 bp, Mus musculus
atatgtgtatgtgtatgtttaagtgtatgtgtatgtgtatatgtgtgtgtattatctacatgtatatataaacatatataatgtatgaaacatacatatacacatatttatatacatcatatactta

SEQ ID NO: 96348 - DNA, 115 bp, Mus musculus
atgtatgtgtttataatgtgctcatgtgtatgtatatgatataataagtatatgatgtatataaatatgtgtatatgtatgtttcatacattatatatgtttatatatacatgta

SEQ ID NO: 96349 - DNA, 124 bp, Mus musculus
ggtgccttaattctgtgcctccttgcactgagtcagtggagctgggccgaagagaagacagtgaggagtgcttcagggcctcaggcagcactttgggaaaagctgatctccccccaagtgttac

SEQ ID NO: 96350 - DNA, 76 bp, Mus musculus
atgcaacaaacttgcagcttagtctacaaatgagactcccaacagcaggggctgtctctgactctgttgtctgcat

SEQ ID NO: 96351 - DNA, 110 bp, Mus musculus
ctgcataatccaataagggctatgtgtatgtattttcgtttgtataaatgtgattttgtatatgacatagtatactcatgcaccttactctttaatgtacttttgtgtag

SEQ ID NO: 96352 - DNA, 119 bp, Mus musculus
tttcatagctgggcaatagagtagtgatgtggtaggtatttttgtccaatctaagcatgtagattgtaattatatcaattgagttgtgtgttctttgtacaggcattttggcgttggag

SEQ ID NO: 96353 - DNA, 85 bp, Mus musculus; identical to SEQ ID NO: 57439

SEQ ID NO: 96354 - DNA, 71 bp, Mus musculus
tatgtatatgtatgtatgtatgtatgtacgtacgtatgtatgtatgtatgtatgtatatgtgtgtgtgtgt

SEQ ID NO: 96355 - DNA, 101 bp, Mus musculus
tcattaagagtatcaggggttggatttctctcatggagtgggtctcatgttgggccagtcattggtttgctgatccctcagtctctgccccatttttaaga

SEQ ID NO: 96356 - DNA, 73 bp, Mus musculus
gaccctgatagagctgtctcttgtgagactaggccaggacagtctcacaagacagtcagctattggatggatc

SEQ ID NO: 96357 - DNA, 60 bp, Mus musculus
cgtctgtctgtgtcactgtccccaaagcctggagggcagagagtttgagttaggcaaacg

SEQ ID NO: 96358 - DNA, 109 bp, Mus musculus
tgtgatatgtatctaggacatctaaaacagagagttattgctcaaatatttgtatgaatatttgatgtaggtatcaaagctttagccatatgtcttcttccatgttata

SEQ ID NO: 96359 - DNA, 112 bp, Mus musculus
ttattgaagatcagccttaatccatgatgatctgataggatgaatgggattatttcaatatttttgaatctgttgaagcctgttttgtggatgatcatatggtcaactttga

SEQ ID NO: 96360 - DNA, 79 bp, Mus musculus
acttctgttagtttcactgtgtctctgtttagtttctgttctcaggatctgtccattggcgagagtggggtgttgaagt

SEQ ID NO: 96361 - DNA, 85 bp, Mus musculus
gtgggagttactagggggcatttgtacagacaacacaatcgaggcgctcagcagggtctagtgtcttacttgttttcatttccat

SEQ ID NO: 96362 - DNA, 85 bp, Mus musculus; identical to SEQ ID NO: 57470

SEQ ID NO: 96363 - DNA, 86 bp, Mus musculus
tatatacatatacatatatatacatgtacatatatacgcaaacatttacatatatttacatatgtatatctgtatatagtcatata

SEQ ID NO: 96364 - DNA, 64 bp, Mus musculus
actatagacattttagattctaataaactaaaattctagtttgtttttttctaaatgtctgagt

SEQ ID NO: 96365 - DNA, 90 bp, Mus musculus
gtccagtgagcctaggggatctgcctgtctctgtctctccactgatgagattataagtacatgacaccacacctggctcttttacctggc

SEQ ID NO: 96366 - DNA, 91 bp, Mus musculus
cattgtttcattttgggggcctaacagagagagcagagttagggttcaaatttattttgctatcttatagaagtcttcagtgtaatgtgac

SEQ ID NO: 96367 - DNA, 86 bp, Mus musculus
ttactgtaagggctctaaagagaattggcaggctccctcttccccagcaaccatgagttcctccaagcctcagattcttacagtaa

SEQ ID NO: 96368 - DNA, 85 bp, Mus musculus
ctgggaaaaaaaagggctcacagctgtgatcaaatcagaggcatctggatgttgaagaattgtgacaccctctctgagattccag

SEQ ID NO: 96369 - DNA, 113 bp, Mus musculus
gacaagagcacatctgagaagccaggcaggcagctttagggactctgaaaagtgacaccacacccagtttccagttcctggcctcgctgctagatctggtggtgcagggtcac

SEQ ID NO: 96370 - DNA, 107 bp, Mus musculus
gctcagccaggcaggctctgttgctgttctaggcagggagcttggtgtcccacacactgtgcctgtgaggagggagcacggggtcgaacttgctaactggattgagc

SEQ ID NO: 96371 - DNA, 100 bp, Mus musculus
agctccttgacatcgtagacagtttattccttccaggtacatgacaaacattctatatatttgtttcctgagcaagtcaaaactgcagggtctggatgct

SEQ ID NO: 96372 - DNA, 105 bp, Mus musculus
ctctcctcccagagtcatttaaggtaaaaatcaatgtcaatgtctgtgtctcacactatgaagagcatggtttttagcttgtgtcaccctgtgcctatgggagag

SEQ ID NO: 96373 - DNA, 118 bp, Mus musculus
atggttgaattataagctgtctggggctggagaaatggctcagtggttaagagcactggctgctcttccagaggtcctgagttcaaatcccagcaaccacatggtggttcacaaccat

SEQ ID NO: 96374 - DNA, 103 bp, Mus musculus
atatatgtatatgtgtatgtgttcatgtgtatgcacacacatatatatgtatgtgtgtatgtgtatatatatatatgtatatatgtgtatatatatatatatg

SEQ ID NO: 96375 - DNA, 67 bp, Mus musculus
gtcgggtatagcatagtcacttagagagcggtgtttggagccacactgtctgtgtctgactctcggc

SEQ ID NO: 96376 - DNA, 114 bp, Mus musculus
ggctgtcttcatgggagaggctgagatggttccagtgacccctggagcgtccagcaccagagagagtcactcagagagccagattcgccacctagttagaaaagatgtctagcc

SEQ ID NO: 96377 - DNA, 105 bp, Mus musculus
atggtatgacgttttccattctcatcaatgtgtgtggatttgcttcaaaaatccaatattctatttctatattgatggagaaggaaagtaaacgggtcataatat

SEQ ID NO: 96378 - DNA, 106 bp, Mus musculus
atacttttatattatgtatatatgcatatagatgtgtgtgtgtgtgtgtgtgtatatatatatatatatatatatatatatatatatatataataaggaaaagtgt

SEQ ID NO: 96379 - DNA, 83 bp, Mus musculus
gtgtatgtatatatgtatgtatatgtatgcatgtgtatgtatgtgtattatgtgtgtacatgtatgtgtgtgtatgtatatac

SEQ ID NO: 96380 - DNA, 72 bp, Mus musculus
gaaccttgcctgagctggagagatggctcagcaggtaaaagcactgactgctcttccagaggtcctgagttc

SEQ ID NO: 96381 - DNA, 85 bp, Mus musculus; identical to SEQ ID NO: 57470

SEQ ID NO: 96382 - DNA, 64 bp, Mus musculus
gggttaacttggcttacactttcacatcagtgttcatcactgaaggaagtcaggacaggaactc

SEQ ID NO: 96383 - DNA, 113 bp, Mus musculus
cccagggcaggacacaccaagtctcctcctgcactcttgttactagggctgccttgttgtgacaacagagtgtcctgaagcctgtggtgagtctgcctgaatgtgactgtggg

SEQ ID NO: 96384 - DNA, 84 bp, Mus musculus
gcccctgtggtaagtgtggaggcctgtgggtgtgctctgaggagttacacttgtgaagacagaacacacttagcacaggcaggc

SEQ ID NO: 96385 - DNA, 105 bp, Mus musculus
gtgtgtgtgtgtgtgtgtgtgtgcatatatgtattcatgtatgtatatatgtagtacagatgtgtatgtatgaatgtatgtatgtatgtatgtacatatgtatat

SEQ ID NO: 96386 - DNA, 85 bp, Mus musculus
caaagtctgccaagagcagtgcagtaagtggaatcagggtcccatgccctcttcactcttagagcaatgttgtttggtagaaatg

SEQ ID NO: 96387 - DNA, 78 bp, Mus musculus
agtggtggttggtgtcctgtgcgtaactgtgtctgtactgtcctgtctgtcacacctcagagacactcactcacctct

SEQ ID NO: 96388 - DNA, 103 bp, Mus musculus
tgtggtagagagagttagttcactgtcttcagcttcattcagttagtaggttctaatcaatgcaaggctcggactctggagattcactgaataactatccaca

SEQ ID NO: 96389 - DNA, 61 bp, Mus musculus
tacacacatgtatatgtatgattatatgtactatatgtgtgtgcatgtgttcatgtgtgtg

SEQ ID NO: 96390 - DNA, 72 bp, Mus musculus
tgtcagcaggactctctctccgtcacacaagggctcttttgtttagaccgagttagctgatgttctgtgaca

SEQ ID NO: 96391 - DNA, 57 bp, Mus musculus
tcagacaaattcactctctgggactctgtggttgagccctgagtgcatatgtgctgg

SEQ ID NO: 96392 - DNA, 73 bp, Mus musculus
atgagcatgggtaactggcagagagattagtgtgtgtgcacaggtgccctattctcttccttctccctctcat

SEQ ID NO: 96393 - DNA, 78 bp, Mus musculus
gaaggacactaggaggccttagacttagagggacagtctctatgactctctcctgctctactgtctccaaatcctctc

SEQ ID NO: 96394 - DNA, 97 bp, Mus musculus
gtgatggaagattccttgttaacaatacacacacacgtatgtatgtatgtatgtatgtatgtatgtatgtatgtatattgttaacagcagacatcat

SEQ ID NO: 96395 - DNA, 67 bp, Mus musculus
ggatgtagcgtggttctcagggacgtgccatcttggggcactctctccctgtgtctgcctctagtcc

SEQ ID NO: 96396 - DNA, 85 bp, Mus musculus; identical to SEQ ID NO: 66071

SEQ ID NO: 96397 - DNA, 82 bp, Mus musculus
gatttctgtgtctttaagcagtcaaagagaggtgcctcagagattaagagcactgactgctcttccagaaggtccggagttc

SEQ ID NO: 96398 - DNA, 90 bp, Mus musculus
tcataaacccaaggagcctctaacttgagagaacacacagcgcatatctagatactggtgtctcaagattcagagaacagggtgctaaga

SEQ ID NO: 96399 - DNA, 65 bp, Mus musculus
acattgccagaacaagtctgtggtttgaagagactgagctcacaagacttgttttcttgcagtgt

SEQ ID NO: 96400 - DNA, 84 bp, Mus musculus
ggcagggggcatcagacagtgtatactgtatgttagaactcactaagcgtgtgttccaattgtattgagtctgtttctccttcc

SEQ ID NO: 96401 - DNA, 111 bp, Mus musculus
gttgatgaattatccccccacccccaccccatggaaggttaatacgaggaaagtttacaagaatgtttatggaaagtaatctggcccagtgggtgcgtggcttcacccagc

SEQ ID NO: 96402 - DNA, 99 bp, Mus musculus
aggcttcactttgcaactggacaatggattacttaaagatgaaatattctagttcacttaagaaatcctcagcatgcagggtttgcactggtggtgcct

SEQ ID NO: 96403 - DNA, 132 bp, Mus musculus
ctgctggtgatagacaatccatgagaaaggatattggaacatgtccttcagtggaaactgtctgtgtcagtgccagtggtctgtcagggttcacaagcagtcctgcagcgtgtcctgtgactctgtgatggc

SEQ ID NO: 96404 - DNA, 65 bp, Mus musculus
gtgtgtgtgtgtgtgtgtgtatacatatatatatatatgtatacacacacacacacaggtaatgc

SEQ ID NO: 96405 - DNA, 108 bp, Mus musculus
cctttaaaaaaatgtgcaaagcctttgacctaattaaatccatttctaaaactgtgtcctaaagaagcagcagggtgtgcgtttggcaagggtgctcatctctccagg

SEQ ID NO: 96406 - DNA, 89 bp, Mus musculus
tacacatgagaaagactcacagacacacacacagatacatataaattttgtttgtttgtttgtttttcaagacagggtttttctgtgta

SEQ ID NO: 96407 - DNA, 116 bp, Mus musculus
tcctggaaactgagagcaaaagtagtcaatcgtagtatctgtgtgaacactgtgtctcactctccttccttcggctaagcacacgtaccgtcaagcactgctcaaggtattctgga

SEQ ID NO: 96408 - DNA, 64 bp, Mus musculus
cagtaggagggaccaggagggatgccagaagttctcggctgtgcctctctctctcatcgaattg

SEQ ID NO: 96409 - DNA, 112 bp, Mus musculus
ctgaggagacatagatatctattcacccttcacagagcaccaatcacagaacaaagtaagctgtccaccaaagtccaatgtgatgggccaatgagtttatctgcccttgcag

SEQ ID NO: 96410 - DNA, 70 bp, Mus musculus
gtctgtctctgtctctgtgtgtgcgtgtgtatattatatccatgtatgcacatgtgctggcctggcaggc

SEQ ID NO: 96411 - DNA, 84 bp, Mus musculus
gaggttgagctgaggtgactggaggacactagctgctattctctagcaggaaagttcagaagacactgagctctggatagcctt

SEQ ID NO: 96412 - DNA, 81 bp, Mus musculus
agttcatctcgggccctgtcacactgtcttagacactcacccatctggggacattcagtgaagactaagctcagatcaact

SEQ ID NO: 96413 - DNA, 92 bp, Mus musculus
aggcttacttggctattggccatttgcctatacatgggagcaggtcttttagcccctgtgtgtgcagtctgtggacagtggcttgattgtct

SEQ ID NO: 96414 - DNA, 79 bp, Mus musculus
gttttgaatgataaggctggagagatggctcaatggttaaaggcactgactgctcttccagaggtcctgagttcaattc

SEQ ID NO: 96415 - DNA, 79 bp, Mus musculus
tctgtgaggtccattagtggaaagttgtttgcttctcctcttgagtagagacatcctatcccaagctatcaccaacaga

SEQ ID NO: 96416 - DNA, 94 bp, Mus musculus
gtgcaatataatattatatccatatatatattttaaatgttttatatgaataaatgttttgcatgtatgtatgtatgtatgtatgtatgtatgt

SEQ ID NO: 96417 - DNA, 75 bp, Mus musculus
agcatgtttaggtgtaggcacacttacagaagaatctctatgtctctctgtctgtaagagcacatctgagcggct

SEQ ID NO: 96418 - DNA, 92 bp, Mus musculus
cttagagcttgtggagctgtgcttaggcgaggttgggtaacagtccttctctgtctctgtctagcacaatgcctttcccacctttatctaag

SEQ ID NO: 96419 - DNA, 74 bp, Mus musculus
cccgctcctgtcagtctggctgtctgtctgggctcaactctagtgtacttccttactgactgtggggccttggg

SEQ ID NO: 96420 - DNA, 79 bp, Mus musculus
tgctgagatggctggcaggggcctgcgagcttctagagttgactgagaagtgacagtgttcttagggcagaatcaagca

SEQ ID NO: 96421 - DNA, 97 bp, Mus musculus
tatgatagtatgtgtatttgattatgtatataagtatgcatgtgtgtatatgatgtataatgtgtatatatgtgtgtgtgtgatatatatatgtata

SEQ ID NO: 96422 - DNA, 81 bp, Mus musculus
ccgcctaggatgtgtcgctccctgattggctgcagcccattggcccagttgtcatcacgagaaaggcagaacacgtggcgg

SEQ ID NO: 96423 - DNA, 71 bp, Mus musculus
tcagacacttcaatactaggcacgtgtgtatgtgtgcatgtgtgcgtgcgtgcctgtgtgcctgtgtgtga

SEQ ID NO: 96424 - DNA, 81 bp, Mus musculus
ttctatctctgcccctcacactctgggactctatgtggctgccatagccaccagttcttatgtgggttctggaggtctgaa

SEQ ID NO: 96425 - DNA, 83 bp, Mus musculus
gggtgttttgttcactggctggagagatggttcagtggttaagagcactgactgctcttccagaggtactgagttcaattccc

SEQ ID NO: 96426 - DNA, 82 bp, Mus musculus
ctgccgtcttgcaaatcagactggttgatttctgggttggtatcaagtaatctttgcattgcccggtcctgatcaaaggcag

SEQ ID NO: 96427 - DNA, 66 bp, Mus musculus
tctcaaaagcaccaaatgaacacagaagacagacatgataggctgtgtgatttggaggctgtgagg

SEQ ID NO: 96428 - DNA, 127 bp, Mus musculus
tatgtgtgtgtgtatatatatatgtgtgtgtatatatatatatgtgtgtgtgtatgtatatatatatatatatatatatatatatatatatatatatatatatactcacacgcatggtatgtgtatg

SEQ ID NO: 96429 - DNA, 97 bp, Mus musculus
ttgtaacaatctaataaacatatgtgtatatgtatgtatatatatgtatagatacatatatacatatatatacacacagttataaatcttcatacaa

SEQ ID NO: 96430 - DNA, 113 bp, Mus musculus
tatgtatgtatatatatatatatatataattgtatatatgtatatatattatacatatgtataagtatatatgtaatgtatgtatatatgtgtgtatatatacatacatacag

SEQ ID NO: 96431 - DNA, 105 bp, Mus musculus
gtcagtatatgtatgtgtatgtgtatgcgtatgcgtatatgtatatgtgtatatatatatatatatatatatatatatatatatatatatatatatatatatggc

SEQ ID NO: 96432 - DNA, 91 bp, Mus musculus
gatgatcagattgtcagatcccacctttagagtccctgtctcagtctctctgggctgagggtatgtgagctgataactctgagtttgtatc

SEQ ID NO: 96433 - DNA, 82 bp, Mus musculus
tgtgtgcatgcatatgtatatgtatatatatgcacacatgcacacacatatgcatatatatacatatatatacatacatata

SEQ ID NO: 96434 - DNA, 100 bp, Mus musculus
tttccattagtatccattagtatatatatatatggttactaaattgataattataattataagaatatgtactgaaaggctatgttaattactgaggaga

SEQ ID NO: 96435 - DNA, 103 bp, Mus musculus
acacaggctttcttgagtgtctcatcagaaagtatgagccagatttagggtaggtttttttctacttcaattgatccattcaagaaaaatagctcataggtgt

SEQ ID NO: 96436 - DNA, 73 bp, Mus musculus
gcagcagatgatatgacattttagactatatatttgtctgtctgtctgcctgtctgtccatctgtctttctgc

SEQ ID NO: 96437 - DNA, 124 bp, Mus musculus
gcatacatgtgtgtatgtaaatgtatatgtatatgtctgtgtatgcatgtttgtatgtacaagtgctcatatgtatgtatacatgtatgtgtatgtatatgtatgtcatgtttgtgtatgcaag

SEQ ID NO: 96438 - DNA, 111 bp, Mus musculus
taataataacatgtattaattatacaatcaggaagacataattactgggagacaaataattgtttctaaatatttagattttcagatggtattcaggtacatattttatta

SEQ ID NO: 96439 - DNA, 123 bp, Mus musculus
atgtgtgtgtgtgtgtgtgtgcatgtatctgtgtatgtaaatgtactatgtatgtatgcatgtgtgtgcatgcaagtatatgcttacgtaaagttcagagtcagagctggacatttaggcagc

SEQ ID NO: 96440 - DNA, 80 bp, Mus musculus
acagaagatgattaaaggtcaggaaattgggagccagacctttcacctccatttgtctgtccgtctgtctgtctgtctgt

SEQ ID NO: 96441 - DNA, 71 bp, Mus musculus
gtgtgtatgtctgtctgtctatctgtctgtgaaagacatggggaagaagggaggtaggtggaactatatac

SEQ ID NO: 96442 - DNA, 57 bp, Mus musculus
cgtatatatgtgtacagtatgtgtatatgttcatatatacatatttatgtatgtatg

SEQ ID NO: 96443 - DNA, 67 bp, Mus musculus
cctccaattgggttttgcttgtctgtgtgcatcctgttttgtcatatttggttgttctcattggagg

SEQ ID NO: 96444 - DNA, 87 bp, Mus musculus
tgtgtgtatattcatgtatgtatgtgtatatatgcgtattttcataagtgtatatacatatgtatgtaagtatgtattatacatata

SEQ ID NO: 96445 - DNA, 94 bp, Mus musculus
tataatccctgtttctttttaaataaatataggcatcatgaaaagagcatatgtatttttcatttgttttaattcttttgaaaggggtattata

SEQ ID NO: 96446 - DNA, 114 bp, Mus musculus
gcatatatatgtgtgtatgtgtgcatgcatgtatatatatgtatgcatgcatatatatgtatgtatgtgtatatatatatatatgtgtgtgtgtgtgtgtgtgtgtgtctgtgt

SEQ ID NO: 96447 - DNA, 90 bp, Mus musculus
gtgtgtacatgtctgtaagcttgtatgtatgtatgtatgtatgcatgtttgtagtttatatacatgtatttatgtgtttgaggtgtacat

SEQ ID NO: 96448 - DNA, 85 bp, Mus musculus; identical to SEQ ID NO: 57470

SEQ ID NO: 96449 - DNA, 70 bp, Mus musculus
gtgtatgtgtgtatgcgtgagtgtgtatgtgtgtgtgtgtatgtatgtatgtatgtgtgcatatgtgtgt

SEQ ID NO: 96450 - DNA, 85 bp, Mus musculus; identical to SEQ ID NO: 57470

SEQ ID NO: 96451 - DNA, 108 bp, Mus musculus
gtgagagtgatgtaggtgcagttttcatgtatgaaattctatattttaaaatgagggttttaaaaatgaggagtatggaattctgtacggatattggggtatttttgc

SEQ ID NO: 96452 - DNA, 112 bp, Mus musculus
aagggaaatttgtctgaaggtctctatctttgttggatctttctgtggtttagatatcagagtaattgtggcttcatagaatgagttggttagagtaccttctatttctctt

SEQ ID NO: 96453 - DNA, 82 bp, Mus musculus
gagagtggagacatgactccacaggacaggtggccttctcaaaagagaaaactctctgtctctgtttgagtttctccctctc

SEQ ID NO: 96454 - DNA, 88 bp, Mus musculus
gagtcagggtttctctgtgtatctctggctgtcctagaactcactttgtagaccaggatggcctcgaactcagaaatccgcctgcctc

SEQ ID NO: 96455 - DNA, 85 bp, Mus musculus; identical to SEQ ID NO: 57470

SEQ ID NO: 96456 - DNA, 114 bp, Mus musculus
caggcccagtggtagcacaataagaaatggcatgtagtacctgtggtcaagattctcacacccacacagactcagaaccaggttacactgcaacattgctagaactctctgtct

SEQ ID NO: 96457 - DNA, 105 bp, Mus musculus
gaggcctattttattgttctttctagacaggtgttgatacatgtgcacacatctgtgtgagtgtgggcattcaagctttggaaagaagactgaagaatcggcttc

SEQ ID NO: 96458 - DNA, 82 bp, Mus musculus
gtgggagttaagagtttgaaagcagagctgtgtctgatccatgttggaattcagtgactctgtgtcactttgtctttaccac

SEQ ID NO: 96459 - DNA, 135 bp, Mus musculus
acataatatatatgtgtgtatatatgtgtgtatatttatatatatgtatgtgtatatatatatatatacttgtgtgtatatatatatatatacttgtatgtatatatatatatgtgtacatgtatatattttata

SEQ ID NO: 96460 - DNA, 80 bp, Mus musculus
gggctgagagccttgctacataggagtagagagtcagggacactctctcagaccttattcagatggaagttttcagtacc

SEQ ID NO: 96461 - DNA, 57 bp, Mus musculus
agttagatgagcaggctctggaccagggttaggctagaactgagtctgtcactgact

SEQ ID NO: 96462 - DNA, 61 bp, Mus musculus
tatgtatgtatgtatttatgtatgtgtgtacggtatatatgcatgagtgtgtgagtgtgtg

SEQ ID NO: 96463 - DNA, 56 bp, Mus musculus
gtgtgtatgtatgtatgtatgtatgtatgtatatatgtatgtatatgtatacatac

SEQ ID NO: 96464 - DNA, 139 bp, Mus musculus
ggcttatgcgttcatgaggcccgtgaggctgagaagtacagctgtttctaaagcagggactcgctctcactctcgctctcagggccctatagtgagaggcagtgttctaagtcaccctgtggtggaggggagctctcag

SEQ ID NO: 96465 - DNA, 162 bp, Mus musculus
gggctatgggtgtgtgtgtgtgtgtatgtgtacataagcatatatgtctgtatatatgtatgtgtatatgtatatgtgtatatatgcatatatgtctgtatatatgtatgtgtatatgtaaatgtgtatatatacatatatgtgtgtatatgtatgtatatg

SEQ ID NO: 96466 - DNA, 75 bp, Mus musculus
gacactaacggttgtctgtctgtctgtctcagaggacaacattgcggcagaagagagcaaggccctaaccgtgtc

SEQ ID NO: 96467 - DNA, 98 bp, Mus musculus
cacggttagggccttgctctcttctgccgcaatgttgtcctctgagacagacagacagacaaccgttagtgtcttaatcaaagctgccttgactgctg

SEQ ID NO: 96468 - DNA, 85 bp, Mus musculus
ccatgatgctgagaaattaaggaatgcttagggggctgcctcctcagagcctcgctctctgggtcattcctgcttgggtgagtgg

SEQ ID NO: 96469 - DNA, 112 bp, Mus musculus
ccatttgatgtgcgtgcgctcatgcgctcatgtgtggtactagaagatgtgtgtgtgtcagtgcatctgtgtggaagtgttggttcccaggtgtgtttctgaagccgcgtgc

SEQ ID NO: 96470 - DNA, 62 bp, Mus musculus
ttctgtgtgtatgtgttgcctgtatgaatatatatattcatgcaacacacatacacacagaa

SEQ ID NO: 96471 - DNA, 74 bp, Mus musculus
atatgggaaatacgttcttcatatgcatgcaccatatatatatatatatgtatgtatatgtactctctccatat

SEQ ID NO: 96472 - DNA, 77 bp, Mus musculus
gcctcctgcctgcctgcctgcctgcctgcctgcctgcctcctgccgctgtgcagtacagctccagagctgcctgggt

SEQ ID NO: 96473 - DNA, 138 bp, Mus musculus
gtcacgtgcacgggccttcgcctaggtggtaagagcctggcctggtgctaccgtctgcctgcgtctgtgtctgtgtttgagtggacagagccttccagctgtcctccctggtcaggcgagataacctgctggtcatgg

SEQ ID NO: 96474 - DNA, 91 bp, Mus musculus
agcgagcgagcgcgagagctgacagctgtctgtgagcacagcttctgagcagcaatgggtcatctgtcagcttgtaggtgtgtagctacct

SEQ ID NO: 96475 - DNA, 64 bp, Mus musculus
taaactcatcgggacgaggaggaggagatattagctcgctctctctgtctgcgaaggaagttta

SEQ ID NO: 96476 - DNA, 112 bp, Mus musculus
ctcgttgggtgtcacttccgatgctttccccagtatgtatgtatgtatgtatgtatacacatatatatattcccatgccttatgagcgagcttctcaaatccgccctcccag

SEQ ID NO: 96477 - DNA, 61 bp, Mus musculus
gaatggcaacatggcgcaggaagctgcctccgagttgcctgcctgcctgcctgcctgcttc

SEQ ID NO: 96478 - DNA, 119 bp, Mus musculus
gtctagggtcgtcctcagctacatggtgagtttgatgccagtctgggttacactgagacactgtctcaaaatgaacagagccagaacaacaaaagcagcacgctgagtgtattttagcc

SEQ ID NO: 96479 - DNA, 117 bp, Mus musculus
ccgatgtacttgtgactgaacgttgtatggcattcagctttcggtatctgtgttagctctttgacacagtgtctgacagaattgagcagctgtaatgtggcctttggcagagcatgg

SEQ ID NO: 96480 - DNA, 75 bp, Mus musculus
atgtgcatggtgttttaccggtgcatatgtacatacgtatgtatgtatgtatgtatgtatttgcaccatatgcat

SEQ ID NO: 96481 - DNA, 69 bp, Mus musculus
gtgtgtgtgtgtgcatctgtctgtctgtctctctccttaaagataggctataaatgtacacacatacat

SEQ ID NO: 96482 - DNA, 100 bp, Mus musculus
gtgtgtatatatatatatatacatatatatatatatacgtatgtatatatggagagagagagagtgtgtgtatgtctgtgtatgtgtgtgtgtgtaccac

SEQ ID NO: 96483 - DNA, 78 bp, Mus musculus
ctgtctgtctgtctgggtgtgggtatgggcacacatctgcaaaggccaaaagcatcacatccctggagtaacagatgg

SEQ ID NO: 96484 - DNA, 72 bp, Mus musculus
acagacactcagactgtcagtgatgaggccacaagacgatgcctgcatcacggcagaccctgcacagaatgt

SEQ ID NO: 96485 - DNA, 72 bp, Mus musculus
ggtggttaagatcacagactgctcttccagatgcacgggggcaggggaggcctgtggtatggggtggacatc

SEQ ID NO: 96486 - DNA, 83 bp, Mus musculus
gcatgagggtcttgttgggtgcctgtctcggtcagtcccacataatgtttttgagataggatctctcactgaacctggagctt

SEQ ID NO: 96487 - DNA, 90 bp, Mus musculus
atagacacacacacacacacacacacacacaggggccattatgtgcagggcatggggaggtgtctgtgtctgtcagtgtctgtctgtctg

SEQ ID NO: 96488 - DNA, 115 bp, Mus musculus
tatgtatgtttgtatgtatgtgcatatatgtgtgtatgtatatatgtacatgtatgtgtatatgcatgtgtttatatctatgtgtgtaagtatgtgtctgtgtgtatatatgtat

SEQ ID NO: 96489 - DNA, 78 bp, Mus musculus
gagagagagagagagagagagagagagagagaaagcaggctggctttgtttctcaagcacctacactctgtgtgtctc

SEQ ID NO: 96490 - DNA, 62 bp, Mus musculus
ggtgagtctctatctctgtttcccatgtcatcagaggagcgctgagatctcagacttgagcc

SEQ ID NO: 96491 - DNA, 81 bp, Mus musculus
tggtacgtactcctcagcctctctcactgggacaaaggttcctggttttatcaacagagaggtagaatattaatctggcca

SEQ ID NO: 96492 - DNA, 86 bp, Mus musculus
tcttatatggcaatatatatgtatgtgtttatgtgcatatatgtgcatgtatatgaatatgtatatatgtatacctgtatatagga

SEQ ID NO: 96493 - DNA, 73 bp, Mus musculus
ggtcttcagttttcaggaagaggcaggaagccggcacacacacacactccctgccacattttctagaaggacc

SEQ ID NO: 96494 - DNA, 113 bp, Mus musculus
tgactggttgtagacagctcagctcagctcagtgatccagagcctgggctgcagagccaggctccctgttacccactgcctgtgcagtcttgatctatgtactccaaatgtca

SEQ ID NO: 96495 - DNA, 71 bp, Mus musculus
gagtgagtcagttctgagagtgcacctgagagtgtgtcagttctgagagtgcacctgagagtgagtcagtt

SEQ ID NO: 96496 - DNA, 143 bp, Mus musculus
gagtgcacctgagagtgagtcagttgtgagagtgcatctaagagtgtgtcagttgtgagagtgcacttgagagtgagtcagttgtgagagtgcacctgagagtgtgtcagttgtgagagtgcacctgagagtgagtcagttct

SEQ ID NO: 96497 - DNA, 81 bp, Mus musculus
gaaggagagagcatttttcattttaaatactctggagtcattcctgagacctcaatgtatggatggctcgctctctctctc

SEQ ID NO: 96498 - DNA, 95 bp, Mus musculus
ctgtgagtgcactctatcagaggagaaagtgagctcagcacagactcccacccctctgttcttccctgtctgcctttggaagcagccacttgcag

SEQ ID NO: 96499 - DNA, 109 bp, Mus musculus
gcacgctgagctgagagagcacactgagctaagggagcactgagggagcacactgagctgagggagcacactgagctgagggagcactgagggagcacgctgagggggc

SEQ ID NO: 96500 - DNA, 63 bp, Mus musculus
taattgtacctggtgtgtgactctgtgtgacatgctttccagtcaccagatcaggggcattta

SEQ ID NO: 96501 - DNA, 151 bp, Mus musculus
ttctacatttattttgcgtgtgagtgtacgtgtgtatgtataggtatgtgagtgtatgtgtgtgagcatgagtgtgtatgtatggaagtgtaagtgggtatgtataggtatgtgagtgtacgtgtgtgagtatatgtgtatatatatatat

SEQ ID NO: 96502 - DNA, 116 bp, Mus musculus
atctgtggacttgataattataataatagcggtgtgatagaagtttgacagctcacttttcccacttatcaaactttgacgcagttctgaaagtttctagtttttagtttccaggt

SEQ ID NO: 96503 - DNA, 98 bp, Mus musculus
gctggaaaagtgcttttaaatcaaagtcgtctgttttccagctatacttctctctctctctgaaaacacggctctgattagcagaggacactgccatc

SEQ ID NO: 96504 - DNA, 99 bp, Mus musculus
gtgcaagcaggaatggggttactcttagagatttagatttttgtggggtttgcagttcttaagttttttctttaaaagtataaacatttttgtttgtgt

SEQ ID NO: 96505 - DNA, 88 bp, Mus musculus
gctctgttgttaggtaaagctatgtccttgcattcctagtgtaagagggattcttaattaatgcttacatagttttacataagggggt

SEQ ID NO: 96506 - DNA, 116 bp, Mus musculus
agtggtagaggtccaggtgaagcaggctggaggggtggctcagtggttaagagcacaaactgctcttgcagataaccaggattcaggtcagctcccaacacccacctcatgcagct

SEQ ID NO: 96507 - DNA, 100 bp, Mus musculus
gaggggtgcataacctcttatctgcacagaaggctgagagaagacgtggttaatagcctggtgacctttgctctatctgtgtggctgagatgcacgtctc

SEQ ID NO: 96508 - DNA, 79 bp, Mus musculus
agtactcctcacccgttgccagtcaagtaagtgagctcaggtgactgtctccttgtcagtaacggtttctgatggtact

SEQ ID NO: 96509 - DNA, 85 bp, Mus musculus
agagctagagacggggtctgaaagcaacactaggacagggaagaagcaaactgctgtgtgcacacagaccagagtctgggcctct

SEQ ID NO: 96510 - DNA, 74 bp, Mus musculus
ctgaagatgcacgggctccagcttcgagctccttcttggctctgacaggctgagtccctgcccatcccgctcag

SEQ ID NO: 96511 - DNA, 67 bp, Mus musculus
tgtccgctttctctcaccagccttcattctatattgagagaatggggttggggagttaaagtgtgca

SEQ ID NO: 96512 - DNA, 97 bp, Mus musculus
agtcaatgcagaaggactggagagacagctcagcagttaagagcactgactgctcttccagaggtcctgagttcaattcccagcacctgtgttagct

SEQ ID NO: 96513 - DNA, 71 bp, Mus musculus
gaatttacaaggctagagagagagctcagcggttaagagcactgactgctcttccagaggtcctggtgttc

SEQ ID NO: 96514 - DNA, 96 bp, Mus musculus
agaaaactgagtcaaatgtcatttaaatgagacaaaacttaaggctgccttgccttaagtttttatttcattaaattgcatctgtattcagtgact

SEQ ID NO: 96515 - DNA, 78 bp, Mus musculus
ctgggatctgaggcagcctgactaggctaggctggctgaccagagagcccaggcgtgtgcctgtctctgcctccctgg

SEQ ID NO: 96516 - DNA, 74 bp, Mus musculus
ggtgcatgtttgtgcatgtgcatgtgtctgtgtgcgcatgagcgactatagactgtccatgtatacagtggacc

SEQ ID NO: 96517 - DNA, 73 bp, Mus musculus
gagagccatctccatggctggctggctggctggctggctgtccaccatctacccatggaacacggtggttttt

SEQ ID NO: 96518 - DNA, 83 bp, Mus musculus
ggggtatgtgtccccagatctgtctctgtttctgagcacaatataaaatgcatcacacggggcagttccttggggggtacttc

SEQ ID NO: 96519 - DNA, 88 bp, Mus musculus
gtgtgtgtgtgtgcatgtgcactcatatatgagtgtgtgtgcatgtgcatgtgcacgcatatatgagtgtgcgtgtgtgcatgtgcac

SEQ ID NO: 96520 - DNA, 66 bp, Mus musculus
gggtgtagtgagaactcagtaagcactcaacctgtgctggccattactgtcactcagtaagcactc

SEQ ID NO: 96521 - DNA, 88 bp, Mus musculus
cagacttgttgagtataggcttttgtagtaggatctgatgaatttttttttttctgcagattctgttatgtctcccttttcatttctg

SEQ ID NO: 96522 - DNA, 76 bp, Mus musculus
ccaaagcagaggttcggctgcctgaagggaagggacagacaagcctggctctccctctgagcctgtctggaaatgg

SEQ ID NO: 96523 - DNA, 93 bp, Mus musculus
gatctctggctcctcatataactgatgacagctttcccaacaggctcagtaggaaagtgggtcagtgggtcagtgggtcagtgggtcaatggg

SEQ ID NO: 96524 - DNA, 97 bp, Mus musculus
catttctatttgttctttgaaacagggtctcactctgtggctcaggtcagcctggagctcacaatattccaaaagtggccttgaggagctagaaatg

SEQ ID NO: 96525 - DNA, 92 bp, Mus musculus
atgtgtctgagtcttttgcctgtatgtatgtatgtatgtatgtatgtatctatgtatctatgtatctatgtatgtatgtgaatcatgtgcat

SEQ ID NO: 96526 - DNA, 67 bp, Mus musculus
tgtaggatctggaactgcagaggtggctcagcggttaagagcacagactgctcttccagagaggaca

SEQ ID NO: 96527 - DNA, 108 bp, Mus musculus
tatgtatgtgtgtggatgtggatgtgcgattgtgtgtgagtgcacatgtgtgtgactgtgtgtgtatgagtatatgtgtaagcatgtgtaagtgtgtatgtatgcgtg

SEQ ID NO: 96528 - DNA, 78 bp, Mus musculus
ggagactgtgtgcctcactgagtgtagcttgagcatatatgacctcaaagccagcctccacagtgacatatttcctcc

SEQ ID NO: 96529 - DNA, 118 bp, Mus musculus
tacacacacacacacacacacacacacacacatgtgtgtctgtctgtctgtctgtctgtgtgtatacacatatgtatgtgtgtatattatgtgtgtatacatatatgtatgtgtgtat

SEQ ID NO: 96530 - DNA, 76 bp, Mus musculus
tttcatggaggatgcagggccagatgatgggggagaacagtagtctctgtcacactgggtatgtgagtctgtgagg

SEQ ID NO: 96531 - DNA, 64 bp, Mus musculus
tgtttcagagtgggccaggaatggccatggcatctgtgtgtctgtctgtcacccaccaggagca

SEQ ID NO: 96532 - DNA, 84 bp, Mus musculus
gtagaacagaagtaagctggaatgttaagatgttagtatggcatctgagcatctaactgaaccaactctgctccctgtccgtgc

SEQ ID NO: 96533 - DNA, 63 bp, Mus musculus
tgcagtcacactatgtgagagcactggggacaatcatgtacgcagtcacactgtgtgagagca

SEQ ID NO: 96534 - DNA, 146 bp, Mus musculus
ggctttgactcctctagagacttgactcggacagacatttaatttctttttttccaaactggacattgtgcagagataagtgaagtcagagagtctcactgagaaactgcttatcctggtggaagaactcaaaaagccacagctgt

SEQ ID NO: 96535 - DNA, 105 bp, Mus musculus
ggctttttgagttcttccaccaggataagcagtttctcagtgagactctctgacttcacttatctctgcacaatgtccagtttggaaaaaaagaaattaaatgtc

SEQ ID NO: 96536 - DNA, 73 bp, Mus musculus
tgtctgtctgtctgtctgtctgtatttctctctgtgagagagagagagagagagagagagagagagagagaga

SEQ ID NO: 96537 - DNA, 84 bp, Mus musculus
gcgaacttacttcaagagcagaggaagcgcagccctccaggccatctgggtctctctttctctcccctaaggaggtcagtacgt

SEQ ID NO: 96538 - DNA, 193 bp, Mus musculus
atacatacatacacacatacatacatacatatatggatatatatagatggatatatatagatgtgtatatatatgtatatgtatatatatatggtatgtgtgtctgtggaatatatgtgtatctgtgtgtgtctgtgtgtatatgtatatacatatatgtgtgtatacatgtttgtattgaattggaaatatc

SEQ ID NO: 96539 - DNA, 76 bp, Mus musculus
cagcaggcaaagctgaagttttccctgactatggtatcttcatttttttttaaagtcagggtcttctatgtcgatg

SEQ ID NO: 96540 - DNA, 56 bp, Mus musculus
gatgtatgtatgtatgtatgtatgtatgtacgtacgtatgtatgtatatattcatc

SEQ ID NO: 96541 - DNA, 118 bp, Mus musculus
acctctggaagcaaagcgggagaggggccgtactgcatgccagccttctggggaggagagagaactgagaaaggccagctcagaggcagtgaccctcagctctgctgcagcaggaggt

SEQ ID NO: 96542 - DNA, 67 bp, Mus musculus
tagagggaaggcatgtggcatagatgtctcatttaaaactaactatgtcacagactcttactctcta

SEQ ID NO: 96543 - DNA, 88 bp, Mus musculus
caatgggacttgctgcacattagaaagccattggatgtaatatattcattctgcaggacagttgtgagtgtgcacacaggtggcattg

SEQ ID NO: 96544 - DNA, 117 bp, Mus musculus
ggttctgaggttacattgagtggggcatggagagatggctcagcaggttaagagcattgactgctcttccagaggtcctgagttcaattcccagcaaccacatggtggctcacaacc

SEQ ID NO: 96545 - DNA, 113 bp, Mus musculus
ggacaaatgtctagattgggttatatattatatacaatattagatatttcttttttattgatttgtgtgtacatgtgtggtatgatgtgtgtgagaatttggggcatgtgtgt

SEQ ID NO: 96546 - DNA, 81 bp, Mus musculus
gttcccaagacaagagagtctgcacttaaacacaagtcacactatgtgaccttgtccccaagttatctctgattggtgaat

SEQ ID NO: 96547 - DNA, 97 bp, Mus musculus
ctaatggagaagtgaaggggacttgaagatttctacagagctgagagtcaccagtcagcacagttcaccttctcgagtctcctcagaacctcccgag

SEQ ID NO: 96548 - DNA, 71 bp, Mus musculus
tcatttacctggagacagtctttctcactggcctgaagctccccagtgtggtaggactggctggccaatga

SEQ ID NO: 96549 - DNA, 89 bp, Mus musculus
gacatactcacacttaggattctgtgttcatctgaaatcacagggattttaaattggcaatgggttttcctaaggactggaagtttgtt

SEQ ID NO: 96550 - DNA, 94 bp, Mus musculus
caaggattcacggatgaacctgtcagtcttacagtcagacagaaggtctgcttgtttgtttctgtaatggtttgctcttcattctgtttttttg

SEQ ID NO: 96551 - DNA, 67 bp, Mus musculus
gtctgaagagaggcaaaggggagggcccatcacaactgtatcactctctggctgcctgacctcagac

SEQ ID NO: 96552 - DNA, 58 bp, Mus musculus
tgctatatgtctgtctgtgtgtatatatatatatacacatagagaaagtatgatggca

SEQ ID NO: 96553 - DNA, 67 bp, Mus musculus
tcagcattgggaggtcttcagtcactctctacctggtatttttgagacagacagggtctctcactga

SEQ ID NO: 96554 - DNA, 63 bp, Mus musculus
ctgtctgtgcctctgtgtgagtacagtgtatgtacgtatgtgtgcccatgtaagcatgagcag

SEQ ID NO: 96555 - DNA, 83 bp, Mus musculus
tgctaacataagagcaggtagtatacagaatggaagggcagactgaagactgtgatgagctgctagaggtgctcctgtgggta

SEQ ID NO: 96556 - DNA, 93 bp, Mus musculus
gggtggtttgtataaggcagtatatgattttatttgaatcgttccccatttaatatgtaattatagtttattaccttcatgcataactcagcc

SEQ ID NO: 96557 - DNA, 121 bp, Mus musculus
ctggaagggtcccttttgtgccagcaatttgaacagagtggtagtcttaccagtgctcacaagtgtgtcagcactcctgggagacgagctcgtttctggtggtaattgggtatgtaggact

SEQ ID NO: 96558 - DNA, 81 bp, Mus musculus
tgcttttagcacatggagttcttaaaaccccttctaacaggtctagtgtggagttttagcatctccaggtcctaactagca

SEQ ID NO: 96559 - DNA, 56 bp, Mus musculus
gacaaactgaaagaactcagtggggaaacccccactcagctcccgattcagcgtgc

SEQ ID NO: 96560 - DNA, 76 bp, Mus musculus
ctgtccctgtcttcagatggagccacataagcacggaggtgtctcctgccacccgcactctactgacaagtcacag

SEQ ID NO: 96561 - DNA, 86 bp, Mus musculus
agcacgctgagagataagagtctgcacacccaacacataacttatgtgcttgagccagtgacagaattttcttgttattaagtgct

SEQ ID NO: 96562 - DNA, 87 bp, Mus musculus
gggccagtgagagccagggaccctcaccatgtgacctctgcattctactaggggagcctgaagacactgagctctgcaactgagccc

SEQ ID NO: 96563 - DNA, 97 bp, Mus musculus
gagccagcaggaaaagggcatttctccagcattaattcagaaagatgtatttttcttttattggaaaagagtggctttgactgcttgctgtaagttc

SEQ ID NO: 96564 - DNA, 59 bp, Mus musculus
catacttacatgtgtgtatatatgtatatagatgtgtgtgttctgtatgtgtgagtgtg

SEQ ID NO: 96565 - DNA, 91 bp, Mus musculus
ctcctttctgtgtggcaccacgcttcatgcccaccctgattccctggaggtaggaatggctaccagatgtgcagtcagaggaggaggctgg

SEQ ID NO: 96566 - DNA, 83 bp, Mus musculus
tcatgtcaggctccctgcctgcctgcatcaataggggagacacttactctgcttgatggaggcggggagggggtgagagatga

SEQ ID NO: 96567 - DNA, 72 bp, Mus musculus
gtctgcctctgtgtctctgaggccctgggactcctgcctagagcctacccagagtgaaccagtgacggtgac

SEQ ID NO: 96568 - DNA, 113 bp, Mus musculus
agtgtgacagccagaggggctgcaggtgtggctctggtagatgcttgttcagtcccaacccctagcactacatacagtcatcctgcctgcccttgggcccctgctgtgggatt

SEQ ID NO: 96569 - DNA, 58 bp, Mus musculus
tcctatctctatagaggaccaagtcactctttgccaatggttgatctgagagatgggg

SEQ ID NO: 96570 - DNA, 82 bp, Mus musculus
atgtgtatatgtatgtgtgtgagaatgtgtatgtatgtatgtttatatgtacatatgtatgtatgtatatgcatgtatatat

SEQ ID NO: 96571 - DNA, 83 bp, Mus musculus
gcccgtgttgtttttgtcagcagcacctccatacggggcgggaaggtgagtgtgtgcgtgtgtctgtggcaggcaggacgggt

SEQ ID NO: 96572 - DNA, 119 bp, Mus musculus
tatatttgttcttattttatgtgtacaagtgagtgtttgatgtatgtatgtatgtatgtatatatgtatgtatgtgcaccatatgcatggctggtacccttagaggccagaagagtgtg

SEQ ID NO: 96573 - DNA, 80 bp, Mus musculus
ttgaaagacttttgcctgggctggagagatggctcagcggttaagagtgctgactgctcttccagaggtcctgagttcaa

SEQ ID NO: 96574 - DNA, 105 bp, Mus musculus
ggtaggacccacctgggccagatttctctgtgactctcagactcacatcttcctcctacgactgagtactgccaagagacagacagagggcagggcggggctgct

SEQ ID NO: 96575 - DNA, 80 bp, Mus musculus
tatatgtgtgtgctcgcacacgcatgcacacacgtgtgcgtgcatgtatgtgcgatgtgtgtgtgtccatgtgcatgtgt

SEQ ID NO: 96576 - DNA, 99 bp, Mus musculus
tatatatgcatatgtatgtatatgtctatatatgtatgtgtctatatatgtatatatgtgtatatatatatgtgtgtgtgtgtgtgtgtgtatgtgtgt

SEQ ID NO: 96577 - DNA, 113 bp, Mus musculus
gtcacttgagttcccgcacatgcctgatatcgccttactggtctccgtttaggaaattaatttcttttattaagatccagggataaaggcactgtctgaggtcacaccctgac

SEQ ID NO: 96578 - DNA, 67 bp, Mus musculus
ggcctggtggataataggttggcctcaaactcatagtgatttgcctgcctgcctgcctgcctgggcc

SEQ ID NO: 96579 - DNA, 102 bp, Mus musculus
cagctgccttggatgcctgtggaagagactgaagagacacagagtgtgaggtctggcctggagcttggtcggtagtgtctatgcctacaaggcatgaagctg

SEQ ID NO: 96580 - DNA, 95 bp, Mus musculus
gcattggttttttgcctgcatgtctgtcagtctgtctgtctttgtgagggtgttggatcccctggaactagagtgacagttgtgagtcaccatgt

SEQ ID NO: 96581 - DNA, 100 bp, Mus musculus
tttcacaatcaagccacagtagacagacagacagacagacagacgctgatacatttaaatgtctgggaattgctacctttcttactaggaatgagtgaaa

SEQ ID NO: 96582 - DNA, 93 bp, Mus musculus
tgtaagttagatccggacagatacacagaaaaatgtcagcagaggttttcctctgggtgacaaaatctcaggttttgtttgtttcagaaaaca

SEQ ID NO: 96583 - DNA, 77 bp, Mus musculus
ggaagatcgtttgtatgccctgtggtatttgctatgtagggggatacatgtcaaatactgtgttgtaatgatcttcc

SEQ ID NO: 96584 - DNA, 88 bp, Mus musculus
aactgcagcttctccaccagagagaccagtcctcctggtcccagcctttcctgtgtgaccactgtgtgtgtctgtgtgtctgcctgtt

SEQ ID NO: 96585 - DNA, 121 bp, Mus musculus
tatgtatgtatcatctatgtatgtatgtatcatctatgtatgtatgtatcatctatgtatgtatgtatcatctatgtatgtatgtatgcatcatgtatgcatgtatgtctgtatgtatgta

SEQ ID NO: 96586 - DNA, 65 bp, Mus musculus
atatatatatatatatacacacacatatgtgaatatatacatacaatgtatatgtatatatgtat

SEQ ID NO: 96587 - DNA, 92 bp, Mus musculus
atgcatatctatatatgtgtgtacatatatgtatacatgtgtgtatatatgcatatctgtatatatgtgtgtacatatatgtatgagtgcat

SEQ ID NO: 96588 - DNA, 82 bp, Mus musculus
tctgataagaaggaaaagtggagaatggctgcgctctgaaggagaagcctgctgtgtgtctctatctgttccagtcagactc

SEQ ID NO: 96589 - DNA, 116 bp, Mus musculus
gctggtaaaagacagacaggcaggcaggcagacagacagacagacagacagacagacatagtggtttagggtaaggctggttctggtcacctacttaacttttgtagtgaagaggt

SEQ ID NO: 96590 - DNA, 68 bp, Mus musculus
cattagcttatggccagagctgcagcttgaattttaaaagagagagagctcagaggtcaaagcttttg

SEQ ID NO: 96591 - DNA, 115 bp, Mus musculus
tctgaacaattttaaaatctgtgacatctatgcaggggcaccggccacagttcacacttgctgtggaaatcttctcagaggcatggacctggcttcgtatttaccgtggtttgga

SEQ ID NO: 96592 - DNA, 82 bp, Mus musculus
ggcgtgatctctcttttgcacttgaatgatttaaatagtttctctgatgtctatttcttcatctgtgacatgagctcatgcc

SEQ ID NO: 96593 - DNA, 102 bp, Mus musculus
cgccctgatattaaaattgtctcatcacaggtacgcaacacaactttgatttttttttacaagtcaagcacttgatggtaggacatctttcccaaaggtgtg

SEQ ID NO: 96594 - DNA, 80 bp, Mus musculus
tagaatgtttcccatggagctccaggaaagcacaagtgagtggctccctggatggctgcaatctggtaaacaagtttctg

SEQ ID NO: 96595 - DNA, 76 bp, Mus musculus
agggtctatgtgaagtcctcgttctcctgcctttcccccctgagtgaggcagatgtgtgtgaccacatctggcctt

SEQ ID NO: 96596 - DNA, 85 bp, Mus musculus; identical to SEQ ID NO: 57470

SEQ ID NO: 96597 - DNA, 102 bp, Mus musculus
tcaacaatgcattgaactggcttagccttgtctgatagaactgactctggaaacatgaagcctgaagatatcagacctgctggagctcagtgcttgcagtga

SEQ ID NO: 96598 - DNA, 85 bp, Mus musculus; identical to SEQ ID NO: 57470

SEQ ID NO: 96599 - DNA, 88 bp, Mus musculus
ctggtgtcctccatcctctctgactctcacaatctgcccacctcctcttccacagctctgagggttagcatatgatggagacctccag

SEQ ID NO: 96600 - DNA, 78 bp, Mus musculus
gtatatgtattatgtgtgctctatgttattgtattgtgttctatataaatatatgcatacacacatacatacatatat

SEQ ID NO: 96601 - DNA, 87 bp, Mus musculus
gcctggctgcacagagaattgtggattgtataatacgtttgaaggatgggctatctcacacatactctgtctcatgtacacacaggt

SEQ ID NO: 96602 - DNA, 79 bp, Mus musculus
gctttgaaatgccaagtagagactggcaaattcagatgggagtaaacttgctagtttgtaactttaattttttcaaagc

SEQ ID NO: 96603 - DNA, 116 bp, Mus musculus
ctactctatcatatttgtcaatatatgtatatatgtgcatatatatatgtgtgtgtgtgtatatatatatatatatatatatatatatatatatatatatacagagagagagagag

SEQ ID NO: 96604 - DNA, 85 bp, Mus musculus; identical to SEQ ID NO: 57439

SEQ ID NO: 96605 - DNA, 95 bp, Mus musculus
ggatattagcttcattccccgtacagaaataaatatttaactgcagtgaaggaaagtcttctcagtaatattatttcctactgaagaatatattc

SEQ ID NO: 96606 - DNA, 60 bp, Mus musculus
gtgtatgtgttcatgcaaacatgctttttcatatgtgtgtgactgcatgtacatgtgcat

SEQ ID NO: 96607 - DNA, 133 bp, Mus musculus
gtgtatgtgtgtatgtatatatgtatatgtgtatatatgtatatgtgtatatatgcatatatgtatatatgcatatatacatatatgtatatatgtatatacttatacacatatacatatatatacatatata

SEQ ID NO: 96608 - DNA, 94 bp, Mus musculus
acaggttaccatggtctgtattcatatgtatgtatgcatgcatgtatgtatatatgtatgtatgtgtgtatgtatgactcagtctatcatctgt

SEQ ID NO: 96609 - DNA, 70 bp, Mus musculus
catatatttatttgtcttttcacatgcattgccccatcctgtatgggaagagaaagaggttggatatgtg

SEQ ID NO: 96610 - DNA, 79 bp, Mus musculus
ggcttagaatggtgtgagtttctgcatctccctgtgcctgtgccatggtgaaccataaactatttgcatcttcttagcc

SEQ ID NO: 96611 - DNA, 73 bp, Mus musculus
ttgtggatgtcaagaagtgcttgttgataggagctgtctcctgagagtctctgtcagagtcagacaaatacag

SEQ ID NO: 96612 - DNA, 116 bp, Mus musculus
gcattctcagctagaagatagatgtccaccatgtttaaagatgagaaatttgaaccaaaaaaaatgtatttcattttaactttgtttggattgtatgtcaattcagttctggatgt

SEQ ID NO: 96613 - DNA, 70 bp, Mus musculus
gctgaagcacactcactctgtcccatgcaatgagactagccccgtggtgtgcaagagctgagtggccagc

SEQ ID NO: 96614 - DNA, 85 bp, Mus musculus; identical to SEQ ID NO: 60314

SEQ ID NO: 96615 - DNA, 100 bp, Mus musculus
gctctctttttgttttcacttagtgaaaagtcatcagtgttctttatagaccaaattatatttattgataaactttggaagtaagtaactcttggagagt

SEQ ID NO: 96616 - DNA, 101 bp, Mus musculus
tgagcatgtgagatgtggtgggagagcagggtaaagccagagtgcagactgtgagcaccagacttaaaaacttccaaagagtcatttaaacagcatgttta

SEQ ID NO: 96617 - DNA, 105 bp, Mus musculus
tgacccccaaccataacattattttcactgcttcttcataactgtcattttgctactgttatgaaatgtaatgtaaatatcagtgtttcccagtggtcttagtca

SEQ ID NO: 96618 - DNA, 110 bp, Mus musculus
tgtacatactagacaagcatgcaccacttatttgtattttcagaggtcattaaatatatttttagttggaacataaggggtacactgtggcattacagtatgtgtgtaca

SEQ ID NO: 96619 - DNA, 118 bp, Mus musculus
agatggtctggaggtggggcagcgctgcacagacaaaaggttctgcagagccctcatctctctccctcagttacctctgtggagcgcggcgccccatctggccactgagtgaccttct

SEQ ID NO: 96620 - DNA, 74 bp, Mus musculus
aggtgagagtaggagaggaaggtgcagcatggggcgagaagtgccaaagctgtgtgtctaactcactcatacct

SEQ ID NO: 96621 - DNA, 106 bp, Mus musculus
gtgcatgaatgagtgaggagaaattgtgggaaagctttgtagttataaaagctctgactctgtaactcactggtacccagagtgtacactcattaaattgtgttac

SEQ ID NO: 96622 - DNA, 64 bp, Mus musculus
gtggaggtgagttactctctctctccctgttcggagaattgggtgggagaaggctcagttctac

SEQ ID NO: 96623 - DNA, 112 bp, Mus musculus
ggcttctcactctttcttctggtttgagaacaggtgtgtatttatgggtctctctgtctctcctttaacccattatcatttgcccttttccttgccagaagtagagtttgct

SEQ ID NO: 96624 - DNA, 63 bp, Mus musculus
acactaatgggggatgattaaagtggagaagtcagtctctgagtgtatgtctctggttggtgt

SEQ ID NO: 96625 - DNA, 97 bp, Mus musculus
gtatatgtatatgtatatgtatatgtatatgtatgtatacatatatatatgtatgtatatatatatatgtatatatatatatatatatatatatatg

SEQ ID NO: 96626 - DNA, 90 bp, Mus musculus
tcttttaaaatagacagcagagtgtgaactcaaagactagaaattacatctggttattgaagcacctctgccaatgttgctaatgttgga

SEQ ID NO: 96627 - DNA, 87 bp, Mus musculus
gcatctgtctgaagcacaggggtgtgtttatgctatgatgctcattcatactgggatacactcactccctcagtgtttatcttatgc

SEQ ID NO: 96628 - DNA, 111 bp, Mus musculus
ggcatggttaattctttgctctggtaggctgttgtatggattgtaggatgcttaacagcatccatttttcttactcattatattttactagaagtaaacccttaccatgtc

SEQ ID NO: 96629 - DNA, 88 bp, Mus musculus
atgaaacaattattaaaattattaggtatgagctaagttggtttgtccagtctgtttgtatttggaaatctaggtgaacgtgtttcat

SEQ ID NO: 96630 - DNA, 74 bp, Mus musculus
gcacatagtgtgagggtgtgagtgtgaacactgtacatagtgtgaacactgctcagactgtttaggctttctgt

SEQ ID NO: 96631 - DNA, 104 bp, Mus musculus
tgtctcaaataacattctctgtcttattctctgtctcttacacacacacacacacacacacacacagagagagagagagagagagagagagagagagagagaga

SEQ ID NO: 96632 - DNA, 63 bp, Mus musculus; identical to SEQ ID NO: 61653

SEQ ID NO: 96633 - DNA, 70 bp, Mus musculus
atgtgtatctgcatgtacatgtatacatatatacacacatatatgtatatatatatatacacacacacat

SEQ ID NO: 96634 - DNA, 84 bp, Mus musculus
gacattgctgccactgagaaagagatcacctggggtggagccttcccacctagatggttctattgttctgtcacaagtactgtt

SEQ ID NO: 96635 - DNA, 82 bp, Mus musculus
tcttggattttagtgtgcaaattatctgttttaagtggaaatttctctatttttatatgtaaaggcacactcattctatgga

SEQ ID NO: 96636 - DNA, 111 bp, Mus musculus
cagagacagagcgagacagagtgagacagtgacaaagagacagagaacagagagcgatcagaggaaggcctagttttttggactaggtcactcatagtcttgggcaatctg

SEQ ID NO: 96637 - DNA, 61 bp, Mus musculus
cacatttgtacatgtatgattatgtgcacatgcacatatatgtatatatgtataagtgctg

SEQ ID NO: 96638 - DNA, 101 bp, Mus musculus
gtaagcatcataagaagccacagaatgtttcatatagcattattgttatatatagttagatgcatatatgttttattgtcttgggtaatagtgttgctaac

SEQ ID NO: 96639 - DNA, 77 bp, Mus musculus
tcacctcttataaccaggaaggacagtcaatggagggatggtgtactgactgtgtgtgtgtgtgtgtgagagagaga

SEQ ID NO: 96640 - DNA, 68 bp, Mus musculus
tgcaggtgtgtgtgtgtgtgtgtgtgtgtgtgtgtggcatatacatatataggatgtgtgcatgtgca

SEQ ID NO: 96641 - DNA, 106 bp, Mus musculus
tatgtgtatatattattgtgtgtgtgtatgtttgtttgtatatatgaatgtatatatgtatgtatgtatgtatgtatgtatgaatgcatgtatgtatgtatgtatg

SEQ ID NO: 96642 - DNA, 75 bp, Mus musculus
gggtatccttggataaactcggatctctcttttgtccccgagagcacagaagactgagatgacaggaaaggaccc

SEQ ID NO: 96643 - DNA, 83 bp, Mus musculus
catgggacaatttcaatatttttgtatctgttgaggcctgttttgtgaccaattatatgttcaattttggagaaggtcccgtg

SEQ ID NO: 96644 - DNA, 114 bp, Mus musculus
taggtgagtcttttataaggtaatttaatgtgatataagaatttgagaagtgacagattcaggtctaatgtgttttaatgctgttatctgctaagtatttgttgagcttatctg

SEQ ID NO: 96645 - DNA, 97 bp, Mus musculus
cctcactatagttacctatacaaaacagtataagtcaagtactcaaatggtttgaaaagttgaatgcaagatgctggattggatgggtatgaaaagg

SEQ ID NO: 96646 - DNA, 129 bp, Mus musculus
cccaacagttcacagatagtattggtttggaggtaaaccaataaaaagctgtagatctgggcctgtgtgatgagtgtgagctgagctcatcaatatgctttctctctcttatttgcaccaccaaagagc

SEQ ID NO: 96647 - DNA, 95 bp, Mus musculus
cttaacattatgacactctacaaataggtttgaagattcaataaaagacttaatgattctgtcagactctgtttttctagtcaaataatattaag

SEQ ID NO: 96648 - DNA, 111 bp, Mus musculus
gtgatgtgaaatgccctcattaaagtgaattttatgataagtggaagacattttatatttttcattggaatgtgtttcaaatgtgcatcctaattaactggcttatattat

SEQ ID NO: 96649 - DNA, 73 bp, Mus musculus
atgggaaagaaactggtatctcagtatttctctcaagaatatgagaaaaatactctgccacagtccatgccat

SEQ ID NO: 96650 - DNA, 63 bp, Mus musculus
gactaaggaagtgaagtgttgcatgcaaagcaatgcaagctcactgtcactgtctatttggtc

SEQ ID NO: 96651 - DNA, 104 bp, Mus musculus
gcctcacagttctgtttagtttaattgtcattttgtatatcttatctccaaatatagctacaatataggagaagcacaatttcaatatgagagacctggagggc

SEQ ID NO: 96652 - DNA, 93 bp, Mus musculus
tatatacatgttttatgtatgtatgtatatgtatatattcatgtcccatataaaattatatatatatatatgtatatgtatatattcacataa

SEQ ID NO: 96653 - DNA, 106 bp, Mus musculus
gccttagtccatggtgatctaataggatgcatgggaaaatttcaatatttttgtatctgttgaggcttgttttgtgacccattatgtggtcagttttggagaaggt

SEQ ID NO: 96654 - DNA, 77 bp, Mus musculus
tcagcttccgcagttgccaccttggttccgggactccacttaaagtaatctacacaggtgagagtgtggactaatga

SEQ ID NO: 96655 - DNA, 85 bp, Mus musculus; identical to SEQ ID NO: 57439

SEQ ID NO: 96656 - DNA, 84 bp, Mus musculus
cacacttgagcattttctatttatgtctattgattttcccttaaggcaatattaaggaaacataatgggaatgtaaaggtgctg

SEQ ID NO: 96657 - DNA, 92 bp, Mus musculus
gtatcaattgtggtgatgtcatgtctcaggaggatcacaatgttcacagaagacagactgagaagtaatggtattagcatcagattgtgaac

SEQ ID NO: 96658 - DNA, 82 bp, Mus musculus
gcatgcatatcgtcagataggcatacatctatatttctaaatataaccagttgtgtccatataatgtgattcgtatgtatgc

SEQ ID NO: 96659 - DNA, 65 bp, Mus musculus
ttctggactctctctctctctctatatatatatatatatatatagagagagagagagagagagag

SEQ ID NO: 96660 - DNA, 84 bp, Mus musculus
ggccatggtggtcagataggttgaatggacaatttcaatatttttgtatctgttgaggcctgttttgtgaccaattatatggtc

SEQ ID NO: 96661 - DNA, 62 bp, Mus musculus
ctgtgtgtgtgtgtgtgtatgtgcgtgtgtatccatgtatatatgtatgttaacatatgtag

SEQ ID NO: 96662 - DNA, 85 bp, Mus musculus
gattacttatccagtctgttaatctatgtatttttattggggagttgagtccatagatgttaagagatattaaggaaaagtaatt

SEQ ID NO: 96663 - DNA, 95 bp, Mus musculus
gctaatagaaggaagttgtctagtgatcttgatgttctataccttaccacataggaatgtgggggagcaaggaataacaacatatgaggattggc

SEQ ID NO: 96664 - DNA, 98 bp, Mus musculus
gggttggtcttcatgtgggtactctaacaagtggagtggggctgtctctgtctctgttccctggtattaggtccccttcctccacctggactgcctac

SEQ ID NO: 96665 - DNA, 75 bp, Mus musculus
ccttcatgaacatgtacagtatatgtatatgaatattttccttcatgaatacctgtacagtgcatgcatgcctgg

SEQ ID NO: 96666 - DNA, 85 bp, Mus musculus; identical to SEQ ID NO: 57439

SEQ ID NO: 96667 - DNA, 85 bp, Mus musculus; identical to SEQ ID NO: 57470

SEQ ID NO: 96668 - DNA, 92 bp, Mus musculus
caggtaccttctttgtgttgaagttttccttccaggatcctcagtaggtctgggttggtagatagatactttttgaatttggtttttccctg

SEQ ID NO: 96669 - DNA, 70 bp, Mus musculus
tgtatatttatatataagtgtgcatgtagaagtatgagtatatgcacatatatgtgtgattatgtataca

SEQ ID NO: 96670 - DNA, 114 bp, Mus musculus
agtgagagatagacttttctttctccccctcctccttgtccttcatctcctcctcatcaatgatgatgatgatgatcatggaggccttacagtaagccttttgagttctctcct

SEQ ID NO: 96671 - DNA, 89 bp, Mus musculus
agggtattgtgctgacaacttctagcagggagttggaaagcttaactgatgactttgccagtcccactgtgtcagtgacagaagaccct

SEQ ID NO: 96672 - DNA, 85 bp, Mus musculus; identical to SEQ ID NO: 57439

SEQ ID NO: 96673 - DNA, 110 bp, Mus musculus
gagccagctatgacctagttcccaaaaatatctcaagttcagagagcacagtgtggacaagatcccatgtgttaggaagaaatcaggatagtatgtactagtttctgctc

SEQ ID NO: 96674 - DNA, 56 bp, Mus musculus
atgtatgtatgtatgtatgtatgtacgtatgtacgtatgtacgtatgtatgtatgt

SEQ ID NO: 96675 - DNA, 75 bp, Mus musculus
atgtatgctaggagataacagtaggaaagaaaggaagtagatgcttccctgtttcactgtctccctgagccacat

SEQ ID NO: 96676 - DNA, 91 bp, Mus musculus
gcagtcagacccagtcacacattctctgctggtgcccactgctaaatggagtgttctcaatgtctctgtgtgtccgactctgtctctctgt

SEQ ID NO: 96677 - DNA, 91 bp, Mus musculus
gagtcaagctttatagacatttagttgtttacttaaaatgtattatttgactttttgatgtgggattatatgcatatgaagctgattactc

SEQ ID NO: 96678 - DNA, 117 bp, Mus musculus
agtagtaggttaggttcatttgttcattcaaagatatttactgagttcctctgtatggtaatgtaggaggtacaagagattcagcaatgaatatgatggataaatttcctgctctcc

SEQ ID NO: 96679 - DNA, 81 bp, Mus musculus
gggtccttaggcagtactatgtccaattttctgaggaagcatcaaactgattttcagagtggttgtactatcttacaatcc

SEQ ID NO: 96680 - DNA, 58 bp, Mus musculus
tatgtgaataagcatgtgcatgtgcacacatgcaaatgcacacctgctcgcacacata

SEQ ID NO: 96681 - DNA, 75 bp, Mus musculus
gtgtatgtatatatgtatacatatatgtatgtgtatgatgtatacatgtgtatgtgtgtgtgtgtgtgtgtgtgt

SEQ ID NO: 96682 - DNA, 69 bp, Mus musculus
tatgtgtacacaggtgtgtacatgtgtgatgcatatgtgtgtgtctttatgtctgtctgtgtgtctgta

SEQ ID NO: 96683 - DNA, 81 bp, Mus musculus
gtatatatgtatatgtgcatgtgtatatgtatgatgtgcacgagtgcatgtatgtgtatgtatgttgtgtgtatgtgtgtg

SEQ ID NO: 96684 - DNA, 106 bp, Mus musculus
tctattctgagtatgtatatatttgtatctctacatatgtctatatatttttatgaaatatatagacttgaagtatggactgaaatataaaaatcttgaaataaga

SEQ ID NO: 96685 - DNA, 61 bp, Mus musculus
gggctgaccatccccacagacaggctcttccgtgtctgtgtctgtgtctgtgtctgtgtct

SEQ ID NO: 96686 - DNA, 77 bp, Mus musculus
gtgtttgtgactgaattgagaggagaaagtgagctgaacaccagcatctgtgactttccttcccaagtgtggacgca

SEQ ID NO: 96687 - DNA, 74 bp, Mus musculus
ggggttacctagattaagttacctgagatggaaagactgcccactctgagaggtatctgtctctatgtgatccc

SEQ ID NO: 96688 - DNA, 69 bp, Mus musculus
tctgtctgtctgtctgtctgtctatttgccattcactgggtgagggagaaaggcagacattgggaaagg

SEQ ID NO: 96689 - DNA, 64 bp, Mus musculus
gctctgtgttgtctgtcgctcagtgtctcatctatgataatactgaacagcttgcacaaagagc

SEQ ID NO: 96690 - DNA, 70 bp, Mus musculus
ctgtctattcagtatgtatgtatatatgtatgtatgtatgcatgcatgcatgcttgaatttttaagatag

SEQ ID NO: 96691 - DNA, 114 bp, Mus musculus
aggtttaggagttttctggtggtattttttgggatatgtatgtatgtatgtatgtatgtatgtatgtatgtattatcatatcatctgcaaatagtgatattttgacttcttcct

SEQ ID NO: 96692 - DNA, 132 bp, Mus musculus
tcccattcttaagacagttctcctggaggcgttctctactgtggaccgggtatctgtctgtctgtctgcgtggggttttagggccacacactaagtgttcctggtgctttaatcctagcactcaggaggcag

SEQ ID NO: 96693 - DNA, 87 bp, Mus musculus
cagtacaacaccctctctgcctgtctctgtggttggtgtcttggaagatggcatcatagcaagggcatttgtaagagtaagagattg

SEQ ID NO: 96694 - DNA, 105 bp, Mus musculus
ttctcacatgcaattcaccctttgccacactatgtctgcctgccccaagggctgaaaagaagagtctgtgctgagagcttgctaggtgtctgccatggatgagaa

SEQ ID NO: 96695 - DNA, 101 bp, Mus musculus
ggtcattggcatggatttatgtggaggcttgtgttacagctgtctgcactgtcccctgccagaagatagatagcagactttagtctccccagctactggtc

SEQ ID NO: 96696 - DNA, 70 bp, Mus musculus
tgtgtttgagtctttttgcttgtatatatgtatgtatgtatgtatatatgtatgtatgcatgtatgcaca

SEQ ID NO: 96697 - DNA, 92 bp, Mus musculus
gtggcccaaatgatgaggagagacagagcacaggggctgatggagggctgtgggtttttttttttttttcttttcactatccggtgggctgt

SEQ ID NO: 96698 - DNA, 110 bp, Mus musculus
gtaggcttgaatctgtgatgtatgctcatgacagttggaatgtgtcttcagtcatcacagaagtgcctgagcacatggctgtagattatgcaatgttgaaacatgcctgc

SEQ ID NO: 96699 - DNA, 75 bp, Mus musculus
tcactggtttgcctctggatgatctcagggcttctggtcttacttaagtcttttattgggtggttactgaagtga

SEQ ID NO: 96700 - DNA, 77 bp, Mus musculus
tgattctcttgagtttttctagttcttcagaaaatatctgatccatataactctggaaggggtccagagcctaatca

SEQ ID NO: 96701 - DNA, 88 bp, Mus musculus
aggatatagaagaggaaagaaagtgtacaaatcaggctggagaaatggctcagtggttaagtgcactgactgctcttccaaaggtcct

SEQ ID NO: 96702 - DNA, 74 bp, Mus musculus
gggtatcttttttaatgaaatactagtctgagcatcacagtgctcagaactgagtgtccagaggaaggactcct

SEQ ID NO: 96703 - DNA, 87 bp, Mus musculus
tccagttttcaccagtgtgtctctcacagacagccggaggaaatggacatacactgtccgctttaagtaagagacataggttctgga

SEQ ID NO: 96704 - DNA, 85 bp, Mus musculus
tttctgtgatcctggttgtgtcagaactcctcagggttcagctgtctctgtgaccctgtgattctgggaccctgtgatcctgaga

SEQ ID NO: 96705 - DNA, 87 bp, Mus musculus
tccttgacctcagtaggataaaagggcagtggaagatttgacttctgtttgtctgactgcttgctttgccaactggtaggttgtaga

SEQ ID NO: 96706 - DNA, 89 bp, Mus musculus
cttccacagtgagaggtgtactgtgtgacacactgtgacacaccacagcttccacagtgagaggtgtactgtgtgacacactgtgacac

SEQ ID NO: 96707 - DNA, 66 bp, Mus musculus
gctgtggtgtgtcacagtgtgtcacacagtacacctctcactgtggaagctgtggtgtgtcacagt

SEQ ID NO: 96708 - DNA, 103 bp, Mus musculus
gtgcatgtgtatgatgaatgtgtacctgtatatatacatgtgtatatgtatatgtgtgcctgtgtgtatgtgtgactgtgtgcgcgtgcatatgtgtatgcac

SEQ ID NO: 96709 - DNA, 106 bp, Mus musculus
ggggaaaggtatgggtgaatataatcaaaacatattgtataaagttttcaaagacgtatagaagtttatatatatgaatgatacctcatactagcaatctcttccc

SEQ ID NO: 96710 - DNA, 89 bp, Mus musculus
tagtactgagattctgatatgactctacttgtattgtgtattgactcagtgaacactgtgagagtctctcagtcttcgggttccaacta

SEQ ID NO: 96711 - DNA, 69 bp, Mus musculus
cttggtctcagtctatgtactgggctgattgtttttttataattacacagtacacttgcagtgaccaag

SEQ ID NO: 96712 - DNA, 87 bp, Mus musculus
cctggggcttactattttaggtagactggctttgtaagcaagcttcttggccacacctctctctgtgtctcactgtcccccaacagg

SEQ ID NO: 96713 - DNA, 91 bp, Mus musculus
gtgtgtatatatatgtatgtatatgtattgctggacatggtggcccatacctgtaattaatatatatatatatatattcaagtgtatttac

SEQ ID NO: 96714 - DNA, 98 bp, Mus musculus
gaagtggaactagaggaattaagctgtagctctgagaatatctgtgtcttagtcactgtatttataatctgtatcttccttccttccttccttccttc

SEQ ID NO: 96715 - DNA, 66 bp, Mus musculus
tctttctctccctctgtgtgtatgagaaagacagagacagagacagtcacagagagagagacagga

SEQ ID NO: 96716 - DNA, 86 bp, Mus musculus
caatgctttgctaaagctggtaaaatggaaccaaatcgcctcttcaatggatttggtccccttcaaccagctgtagctatgcattg

SEQ ID NO: 96717 - DNA, 110 bp, Mus musculus
ggccggcgcaggagtgcctactcagagcacatacttctttatgtacccatatgaacattcagtgctatggaatgtaaagaagtatgtattttgggtaggtaatgtccgcc

SEQ ID NO: 96718 - DNA, 70 bp, Mus musculus
cccactattgtatgtgtttgtatatgtggtgtctacacgtgtttgtatgtgtgcaagtgcatgcgcaggg

SEQ ID NO: 96719 - DNA, 107 bp, Mus musculus
ggattgctgtgatagtggtggtggactttttgtttttgttttttgttcttgttttttaagatgagctcttatactgtctggtatcactttgaatttactatgtagct

SEQ ID NO: 96720 - DNA, 72 bp, Mus musculus
catcactgagtgtggttgctgctgcctgtcccactgcccttgggaggcagaaggaagattactttagatttg

SEQ ID NO: 96721 - DNA, 83 bp, Mus musculus
gaggacccaggttcaattcccagaacccacatggcagctcacaactgtctgtgactccagttccaggggatttgacacccctc

SEQ ID NO: 96722 - DNA, 98 bp, Mus musculus
tcatgttactgacttgtagttatctcgagaactgagtcagcaagccacagctttgtctgtctctcacttttctgaaaaatagaaggcacagggaatga

SEQ ID NO: 96723 - DNA, 99 bp, Mus musculus
aggtctctctgtaaattgtctggctgtgagtctctgtgtttgttctcatctgctgcaggagaacacttctcggatgatggctgagcaagacactgatct

SEQ ID NO: 96724 - DNA, 58 bp, Mus musculus
gctactctgcttgcagttggtgacctctggtcacacacactctctgcttgtagaaagc

SEQ ID NO: 96725 - DNA, 85 bp, Mus musculus; identical to SEQ ID NO: 57439

SEQ ID NO: 96726 - DNA, 85 bp, Mus musculus; identical to SEQ ID NO: 57439

SEQ ID NO: 96727 - DNA, 85 bp, Mus musculus; identical to SEQ ID NO: 57470

SEQ ID NO: 96728 - DNA, 96 bp, Mus musculus
catgtgtatgcttagggtgagtatgtatgtatgtatgtatgtatgtatgtatgtatgtatgtatgtatgtatgagttaaggctgggcatgtgtgtg

SEQ ID NO: 96729 - DNA, 79 bp, Mus musculus
gggtaaagggactgccacaggatacagtgtgttacagggttcagtgactgtcagtgtgtatggggctttcacagtgttc

SEQ ID NO: 96730 - DNA, 117 bp, Mus musculus
tgtacaaggctatctatcacagggtacatgagctgtcacaaagtacagtgtctgcacagtgtacagggactgtcagagggcagctggcttgccacagtgtacagggcaggggtcaca

SEQ ID NO: 96731 - DNA, 80 bp, Mus musculus
ctctctctcactaagtgtaatcttttctagcttctaaaaatacttatttctatgagagagagagagagagagagagagag

SEQ ID NO: 96732 - DNA, 59 bp, Mus musculus
cagcagggtgcttgatttgaggaatattgtgatgtgtctcactcagtggtctcttgctg

SEQ ID NO: 96733 - DNA, 163 bp, Mus musculus
tacgtgtaactgtgtgtatctgtatgtgtgtgagtgtgtgtgtgtgtgtctctttgcatgtgtgtctctgtatgtgtatctgtgcatgtgcatgtgtgtgtctgtgtgtgagcatgtgtgtattgctattttgatgaaaaatgtagaggggaaggtgggggac

SEQ ID NO: 96734 - DNA, 135 bp, Mus musculus
agaaacttctaccccctgaggttttctgagggttggtggggcagaaagggtgtgtccttctttctctcacagagtctgagccactggggggggggaggctctgatccatgtcctaagcagtatgatttattcccc

SEQ ID NO: 96735 - DNA, 72 bp, Mus musculus
ggttgcctcagactgtctcactgctccagaagtgctctgtgctatttatggagacagcatggatgagtggcc

SEQ ID NO: 96736 - DNA, 81 bp, Mus musculus
gagaccctgagatcctggtgtgactaagttcctgggatcctaagatccttggagtgttagagcacctggatgtggtatctc

SEQ ID NO: 96737 - DNA, 72 bp, Mus musculus
gcatgactgcagtgtgtgagctctgagatgctgggtcctcagagccttcaccccaggactgcttctcactgc

SEQ ID NO: 96738 - DNA, 80 bp, Mus musculus
tatgtgtgtgtatatgtggtgagcgtgtatgtatgtatgtatggaatatatgtgtatatatatgtatgtgtgtatatgtg

SEQ ID NO: 96739 - DNA, 119 bp, Mus musculus
ggcccctgagagggagagagccaggctgagtgctgctgggagagctggccagcattggatttgatatgttaataagcatcttagccatttaagacctaaccctcctcccatttcaagcc

SEQ ID NO: 96740 - DNA, 65 bp, Mus musculus
tgttccagaaacatacatatgtacgtatgtatgtatgtacgtatgtatgtatgtatgtatgcaca

SEQ ID NO: 96741 - DNA, 110 bp, Mus musculus
gtgtatgtatgcatgtatatatatatatatgtgtgtgtacatatgtgtatatatatgtatatctctgtatacacatatatatatatacacacatatatatagatctacat

SEQ ID NO: 96742 - DNA, 86 bp, Mus musculus
atcagatgaaaactagtaaagtagaaaaaggcttgcacacacaaccacatgcatttctgtgtttctcacactgtaagttatctgat

SEQ ID NO: 96743 - DNA, 89 bp, Mus musculus
ggcaaggcaagttgaaagctggtgtgggcgacttgaggttttattcccagtcactggctcactggctcactcattcattcatgcctgct

SEQ ID NO: 96744 - DNA, 65 bp, Mus musculus
acacacacacacagaacacatatacatgtatatacatatatgcatatgtacacgtatgtgtgtgt

SEQ ID NO: 96745 - DNA, 115 bp, Mus musculus
cagcccactttggtgaggacagcagcagcattaaagtgtgtgcgcgcacacacacacacacacacacacacacactcacacatgtctctctttgtctctctcagctcctggtatg

SEQ ID NO: 96746 - DNA, 71 bp, Mus musculus
atgaagatgagtagacagacaacagatgagtcaacagtgctgtgactcactgactgtcagctccatcccat

SEQ ID NO: 96747 - DNA, 78 bp, Mus musculus
cttctcaatctctctgactgtggcattcccaggccagctaggcagaatcctgcagtcggcactagtgaactcaagaag

SEQ ID NO: 96748 - DNA, 108 bp, Mus musculus
ccccactggctcagcataaggagtggacaagtgctccaggccaggtgcagactcttgtctggctgcagcaggctccggctaccccttgggttgtcattctagtggagg

SEQ ID NO: 96749 - DNA, 84 bp, Mus musculus
ctcacagcagagctcagagctcagtaatgggaggccttcatgcatccctgggtttactgaactttcagagctgagcatgaggag

SEQ ID NO: 96750 - DNA, 81 bp, Mus musculus
gagacagtctcactgtgtgtatccctgcctggcctagaatattatgcaggctagcctcagactcacagacccacctgcctc

SEQ ID NO: 96751 - DNA, 86 bp, Mus musculus
catttctccatcactgacttgctcttcttagaggcacccagggtctctgagtgtctggggacgtctcaggagtggtctcaggagtg

SEQ ID NO: 96752 - DNA, 119 bp, Mus musculus
atgtatgtatgtatgtatgtatgtgtatatgtatgtgtatatatatatatatatatatatatatatatatatatatatatatatatatgtatgtatgtatgtgtatgtacactatgtac

SEQ ID NO: 96753 - DNA, 58 bp, Mus musculus
gtatgtatgtatgtatgtatatgcatgtatgcgtgtatgtatatatgtatgtgtgtat

SEQ ID NO: 96754 - DNA, 80 bp, Mus musculus
gttttgggatgctggggattgaactcaggatcttaacatcttctgtttctcagtttctgtcaccctggcattcagctgac

SEQ ID NO: 96755 - DNA, 71 bp, Mus musculus
gccagcctctttctgtcacacactgaccccgagcagtgttacctgctacagtgttgactggctctgttggc

SEQ ID NO: 96756 - DNA, 61 bp, Mus musculus
tcatggtggagaaagcacggtggcaaacatgaggtgtcttgtcactgtgtgtcagtcagga

SEQ ID NO: 96757 - DNA, 109 bp, Mus musculus
ggagcataatatatatatacatatatagatagatatagatatagatatattatgtatatttgtatctgtatgtgtgtatgtttatgtgtgtgcctgtgtgtgagtgtct

SEQ ID NO: 96758 - DNA, 105 bp, Mus musculus
agatagatatgtgtatctcaacttgaacatggtacagtatatattcatgcacatatatatgaatatatgtaactctgtaaatgtgcatattttatgtgtcagttt

SEQ ID NO: 96759 - DNA, 56 bp, Mus musculus
ctgcactgtgagcacagtgggggcagccacacccctgcactgtgagcaccgtgaag

SEQ ID NO: 96760 - DNA, 147 bp, Mus musculus
cctgcaccgtgagcacagtgggggcagccacacccctgcactgtgagcacagtgggggcagccacacccctgcactgtgagcatagtgaggatagccacacccctgcactgtgagcacagtgggggcagccacacccctgcactgtg

SEQ ID NO: 96761 - DNA, 81 bp, Mus musculus
tttgcagtaaaagggaaacacatgtgattttgatgtgggcccctgcattacaagatctccctgtgggccctgcactgcaaa

SEQ ID NO: 96762 - DNA, 112 bp, Mus musculus
ccagaataactatgaatattcttctgtcccctagccaacttctcttagattgtgagaaatgagagtcaagactgtgagctgaaagatgcaagaagtttaaaagttgaagtgg

SEQ ID NO: 96763 - DNA, 72 bp, Mus musculus
tgcatctgtgcacatgagtgcgtgtatacatgtctgtaaaggtttgaatgtttgtatgtatgagcagaagca

SEQ ID NO: 96764 - DNA, 109 bp, Mus musculus
gggggcctgactgagcccggtccgtggcagatactaaaacatctgtgtgtgtctgtatgtctatgtgcatgtcatgtatctccagaggccagaaaacatcataggtgtt

SEQ ID NO: 96765 - DNA, 113 bp, Mus musculus
ggagcactctcactgtcaggattactacaggagcactctcactgtcaggattcctacaggaacactctcactgtcaggattcctacaagaacactctcactgtcaggattcct

SEQ ID NO: 96766 - DNA, 96 bp, Mus musculus
gaacactctcactgtcaggattcctacaggaacactctcactgtcagattcctacaggaacactctcactgtcagggtccctacaggagcactctc

SEQ ID NO: 96767 - DNA, 80 bp, Mus musculus
agaagggaggagtcgcgtggtgcatggtgcatgggcatggagcctgatgaaagcctgtctctctcactcagtcaccttct

SEQ ID NO: 96768 - DNA, 86 bp, Mus musculus
agcccctgtacttccatcttttaaagaaaaaaaacatgaaatggaaggtatgtaaatttttctttaaagtacgcagtgtctgggct

SEQ ID NO: 96769 - DNA, 63 bp, Mus musculus
tcctagactcccagctgcacacgtgtatgtgtatgactctgcgtgtgtctgtgtgtctgaggg

SEQ ID NO: 96770 - DNA, 113 bp, Mus musculus
ccagtgtctgtcagcagaaaagcatgtggcacatccatcgtagcctgcaatccggcactagaaaggaatgaagtctgcgggagtcagcacgtgctgcctgcggtccatgctgg

SEQ ID NO: 96771 - DNA, 81 bp, Mus musculus
ctgagtgtggagatccaggttgacatggcagtagtcattttgttcttagctgttgtcttgtgcactgggtaatacaggcag

SEQ ID NO: 96772 - DNA, 78 bp, Mus musculus
cacagacagacagtcagacagacaggaaaagtaggcatgcacccactcttcctcctctgtgagtcctctgtatctgtg

SEQ ID NO: 96773 - DNA, 110 bp, Mus musculus
atcacacagccaggttacgggatgttaggatcacacagccaggttacgggatgttaggataacacagccaggttacaggatgttgggatcacacagccaggttacaggat

SEQ ID NO: 96774 - DNA, 110 bp, Mus musculus
tttgattgttgtttttgaggtgctagggccttgagcatgccaggtgagggctctgccactctgccacactctcagcccacacacggattttagaatgtaaaaatgttaaa

SEQ ID NO: 96775 - DNA, 62 bp, Mus musculus
gagtcctgatgaggattcagtgttggtggtgtcacagaagccagagacctcaggccagactc

SEQ ID NO: 96776 - DNA, 88 bp, Mus musculus
atatatatatatgtgtgtgtgtgtgtgtgtgtgtaatatgaaaagaataattgaatatatatgcatgtatatgtatatatatatgtgt

SEQ ID NO: 96777 - DNA, 109 bp, Mus musculus
gacacttatggcaattcaagagtgacatctttcgattcaagtcacactgaagattgtcaggtgtgtcaaagacaatgacagtctgcaggttatatttgaacttaagatg

SEQ ID NO: 96778 - DNA, 66 bp, Mus musculus
gcagtagaaattgcatccacatataacgtaattttttgttttatgtgcatgcatgttttttcctgc

SEQ ID NO: 96779 - DNA, 97 bp, Mus musculus
gcccttcctgtgatcctgattgtgtcaggactcctctgagtcaatctgtctctgtgatcctgtgattctgggatcctgagattctgagatcttgggt

SEQ ID NO: 96780 - DNA, 116 bp, Mus musculus
ttgaagatcagccttagtgcatggtgatctgataggatgcatgggaaaatttcaatatttttgaatctgttgaggcctgttttgtgacctattatgtggtcaattttggagaaggt

SEQ ID NO: 96781 - DNA, 85 bp, Mus musculus; identical to SEQ ID NO: 57439

SEQ ID NO: 96782 - DNA, 76 bp, Mus musculus
tcgtggttgattcaggactcctcagagtccagcttcctctgtgattctgtgattctgggattctgggatcctgtga

SEQ ID NO: 96783 - DNA, 108 bp, Mus musculus
gacatgcatgtgactccaaatagtgtgcgtgcactcatgtctgtgtctgtaacttctgtataaaaagtttgaccttgaatatgagctgtcgccctacaccatcatgtc

SEQ ID NO: 96784 - DNA, 82 bp, Mus musculus
tcccatgcagtggtgagtgaagtttgtctgcatctgagctggtatcagtagcatcttaaactaaatgtccatgtgcatggga

SEQ ID NO: 96785 - DNA, 107 bp, Mus musculus
tggcagctatttagggcatgaaatgtgaggtacagagagaaccccggaaaagaatgaatagttattttcttattctgtgccatctgaagcttttcttgcagccccca

SEQ ID NO: 96786 - DNA, 83 bp, Mus musculus
ttctgcaaggatttgcaaaatcctttcttctctaaatgggccaaaatcatggaagagagtgagcagtctaaaactatgcagaa

SEQ ID NO: 96787 - DNA, 102 bp, Mus musculus
gctaggtacatggttaagttctggagtctcattttccttgcctgataagcaagaggtttattgtaagtttgttgatgtcattacatggcacatgtttctggc

SEQ ID NO: 96788 - DNA, 77 bp, Mus musculus
gaagactgatgttccatggcaaagatttgtctaggctgagctcgcctagacttctgtctctgtagatgtctgccttc

SEQ ID NO: 96789 - DNA, 109 bp, Mus musculus
gtatttatggtgtaagtttaagactaatgtgtgtatgtatgtatgtatgtatgtatgtatgtattcatgtattcattagcatatcagaactggactttgtgctagatgc

SEQ ID NO: 96790 - DNA, 86 bp, Mus musculus
ggactaagggatttgcaggaggctccactctcccctacccttacccctgaatatatctgtcagtctgtctgtccatccctctgtcc

SEQ ID NO: 96791 - DNA, 85 bp, Mus musculus
gtatgccctcttctctctcacacacactgataatgtctacatgtgggcctgtggcacatagatcctggtgcatgtgtgcgcatgc

SEQ ID NO: 96792 - DNA, 80 bp, Mus musculus
ggagctgtctgtgtcactgtcacttccagcccacaatggaaagcccctggaggtcaagtggcgtagtgtcaaacctttcc

SEQ ID NO: 96793 - DNA, 84 bp, Mus musculus; identical to SEQ ID NO: 48240

SEQ ID NO: 96794 - DNA, 110 bp, Mus musculus
attctgcacgactagagtgagccattgtgtatctctggttccatctttccacactgtctgtgagtcatttgggctgctgtataataacaggtcattctatattactgagt

SEQ ID NO: 96795 - DNA, 62 bp, Mus musculus
actgacagggatcattcttgttcaaaggtgaaattcagagctcagagtcattctctgtcagt

SEQ ID NO: 96796 - DNA, 101 bp, Mus musculus
gcctcctagccaatgccaccctcctgcctgcctctatccctgtcatttgtccttggattgtcccctttggcagagtctgagcgtgtctggcataacctggc

SEQ ID NO: 96797 - DNA, 86 bp, Mus musculus
acaccatcacaaaggtcacgctcactctgagacagccggaatagatgatgtgagtggggttctcggtggtctgtgtaagtgctgcc

SEQ ID NO: 96798 - DNA, 104 bp, Mus musculus
gccctgactgtcctggaactcactttgtagaccaggctggcctcgaacacaagagatccactgcctctgtctctgcctcttgagtgctgagattaaaagcgtgc

SEQ ID NO: 96799 - DNA, 113 bp, Mus musculus
gcctgggttcgtggccatgcagcagcaaggggtctgtgtcaatgtctgtgactcatattaccaccaaaggccattcagatgcctcttgtctgggctgatgcctggagccatgt

SEQ ID NO: 96800 - DNA, 57 bp, Mus musculus
gtgtgggggggtgggggggagggagaggtaactctcagctgtctctctctgtcactc

SEQ ID NO: 96801 - DNA, 75 bp, Mus musculus
gtgtgtgtgtatgtatgtatgtgtgtgtttgtgtgtggtgcacgtgaatgcatgtatacatgtatgtacatgtgt

SEQ ID NO: 96802 - DNA, 90 bp, Mus musculus
gagcaggtcttactgtctctcagtgtgtcttcccctatgcccacatgggcaggcactaagtagcattaggctcagaaaggaaatctgatc

SEQ ID NO: 96803 - DNA, 119 bp, Mus musculus
tctgctcaattcctggctttctgctccaggtccctcaggactgggtccgtgtgtccctgagtccattcagagatttgcctgatcaccagtcctgtgacttcctgctgcttggtgacaga

SEQ ID NO: 96804 - DNA, 85 bp, Mus musculus
acattcaggagacagggaaagtgcaaacggcaaagctccatcccgagtggtttctgtctgtctgcctgcctgtctgtctgtctgt

SEQ ID NO: 96805 - DNA, 68 bp, Mus musculus
ggaattgtgtctctggggatgggctttgagatttcaaaagctcaagcctgtctcagtgtcactctttc

SEQ ID NO: 96806 - DNA, 93 bp, Mus musculus
agggagcgtgtagggaattataaaggcagttacacatgcggctcagccttctgtgtgcattgtgtctctgtctgtctgcctgtctgtctgtct

SEQ ID NO: 96807 - DNA, 81 bp, Mus musculus
gtgtgtgcatgtgtgtatgtgggggggggggtctgggaattaaacctagagccttttgtatgtatgtatgtatgtatgtat

SEQ ID NO: 96808 - DNA, 82 bp, Mus musculus
ggacaggcagattcaggtgtctctctgtctgcagttggggccacaaactgatcacacaactgtcctgcaatctgtactgttt

SEQ ID NO: 96809 - DNA, 73 bp, Mus musculus
tgtatgtatgtatgtattgtgtatatgtatacatacatatgtgtatatatatgtatacatacatacttacata

SEQ ID NO: 96810 - DNA, 93 bp, Mus musculus
cagttgtgttgagtataggctttcgtagtagaatctgatgattttttttaaatttcctcagcttctgctgttgtatcttccttttcatttctg

SEQ ID NO: 96811 - DNA, 101 bp, Mus musculus
tgcctatatactttgttctttctcgtgacaggaggattgggaagcatggcaaatcactgtgtgaatcacactcagagttatggggaactgtgtgggaggca

SEQ ID NO: 96812 - DNA, 77 bp, Mus musculus
ggtcactgtggagtgtcagcagagagggaaggaaggtcgtactgccgctgcgatgacagggcatgcacacggtggct

SEQ ID NO: 96813 - DNA, 91 bp, Mus musculus
ggacagattgtaagcagtacttttcaccttcctttgactctctgtgtgtgtgattcccaaatatggaaagtgctgtcactgccatttgtcc

SEQ ID NO: 96814 - DNA, 132 bp, Mus musculus
gtgtatatgtatgtgtttatatgtgtgtatatatgtgtgtgtgcatatgtatgtgtatatgtgtatatatatgtgtatatgtatattgtatctatactatgtatatgtgtgtatgtgtttatgtgtgtatat

SEQ ID NO: 96815 - DNA, 59 bp, Mus musculus
ggatacatacctgtgtctcagtgtctctgtagcctggtacttggcactggacagtgtcc

SEQ ID NO: 96816 - DNA, 112 bp, Mus musculus
tgtcatgaaaggtcaggattctgaggcaatcctgttggtatgagagtgagctctgaggatcactgaatgtgatataatatcccagacagaaatttctcaaagggaatgtgtc

SEQ ID NO: 96817 - DNA, 110 bp, Mus musculus
gttggacatatataggatatatgtgtgtgtacatatgtatatatatgtatgtatgcatatgtatatatatatatatatatatatacacacacagatatatatgtgtatac

SEQ ID NO: 96818 - DNA, 85 bp, Mus musculus; identical to SEQ ID NO: 57439

SEQ ID NO: 96819 - DNA, 83 bp, Mus musculus
acattgcacgaatctgtctgtgtgacacaggctggtcttgaacccccaggctggccttgaacctcagatccttctgcttctgt

SEQ ID NO: 96820 - DNA, 105 bp, Mus musculus
gtagaccagcagttgggagctggagagatcgctcaaaggttaagagcactgactgctcttccaaaggtcctgagttcaattcccagcactcacatggtggctcac

SEQ ID NO: 96821 - DNA, 73 bp, Mus musculus
aggaggtactgggctagcactctctccccatcttgctgtcaaagtgagcaggtgtgttctgtcacagtctcct

SEQ ID NO: 96822 - DNA, 84 bp, Mus musculus
atgggatggatccccaggtggggcagtctttggatggcctttccttcagtctctgctccacactgtgtctctaactctttccat

SEQ ID NO: 96823 - DNA, 114 bp, Mus musculus
gtcaggtagtttgtcacagtgtccatgagcttttaaacattcagttgacaaggaatcaccatcatcatcatcctcgtcattttgtaagctgggcatgatgacacaaactttgat

SEQ ID NO: 96824 - DNA, 60 bp, Mus musculus
gctgctaatgctctgagtgaacagagcctgcactgggctctgggctgagcagagctgcac

SEQ ID NO: 96825 - DNA, 137 bp, Mus musculus
atgtatatatacacacgtacatacataaacatacatgcatacacacaaacacacacatatacatgtatgtatgtatgtatgtatatgtatgtatgtatgtatgtatgtatatgtatgtatgtatgtatgtatgtatg

SEQ ID NO: 96826 - DNA, 169 bp, Mus musculus
gtgttgttcagtttccacagtgagtgttggctttctgttattttttttgttattgaagatcagccttagtgcatggtgatctgataggatacatgggataatttcaatatttttgaatctgttgaggcctgttttgtgactctattatgtggtcaattttggagaaggt

SEQ ID NO: 96827 - DNA, 98 bp, Mus musculus
acactaattctgtatgggcaactttctaagaactatatttgattttctctatgtgtcaaataagaataagaatgagttattgttgctcatattggtgt

SEQ ID NO: 96828 - DNA, 104 bp, Mus musculus
ggtttttttctacttcataattgtaattttatgacttttaggaattgtaatgttaatatatttgttttctaatggtcttacataaccctgaaaaggttgggacc

SEQ ID NO: 96829 - DNA, 85 bp, Mus musculus; identical to SEQ ID NO: 57470

SEQ ID NO: 96830 - DNA, 88 bp, Mus musculus
acactcatgccctctgactggctcactctcacccatgtcactctgctgtgctacctgggtgaggctcagggcccactctgcagagtgt

SEQ ID NO: 96831 - DNA, 71 bp, Mus musculus
ggggaactctatctgactccatctctgagcatcccattactggggcactggggtggggggtggggggcttc

SEQ ID NO: 96832 - DNA, 116 bp, Mus musculus
agagattaagaaagatttgggggtaacaattaaaataatagcattatttttctttaaagaagaatggttctgttcattttggtatcacctggcatgttaaagactctaaattgttt

SEQ ID NO: 96833 - DNA, 107 bp, Mus musculus
ttgactaccctgcttttataatagttagtttattgcatttgaaaacactgtatgtttatttttgtctgcaattgtttattaactgttatttctagctggcatgttaa

SEQ ID NO: 96834 - DNA, 71 bp, Mus musculus
tatattgtatatatgtgtatatccatgtgaatgtgtatatttgtgtgtatgtatatatgtatatatttgtg

SEQ ID NO: 96835 - DNA, 111 bp, Mus musculus
acatgtataagtgtacatgcatatacatatatatgtgtgtgtatatgtatgtatatatatgtgtgtgtgtgcatatatgtaaatatatgtgcatacatattcacatgtgta

SEQ ID NO: 96836 - DNA, 84 bp, Mus musculus
gactcaatctctgtttgcttatcttgctactttagtgtctgagatgaagaagtacattatggtaggaatgtaaggtagaggagc

SEQ ID NO: 96837 - DNA, 93 bp, Mus musculus
gaagttctttatctttgctgggtctttctgtggtttagatatcagagtaattgtggcatcatagaatgaactgggtagagtaccttctgcttc

SEQ ID NO: 96838 - DNA, 110 bp, Mus musculus
cttcttggacagccagtctaacctacctggttagctccaggtcagggagaagctctgtctcaaacagaagacagacagctctaaggaaatatacttaagttaacctgtgg

SEQ ID NO: 96839 - DNA, 74 bp, Mus musculus
gattacattgactttctttacagaaaaactctctttatgtgatgactctctttctgtgatgagtctctgtaatt

SEQ ID NO: 96840 - DNA, 86 bp, Mus musculus
acagatgaactgtcctagagatatacattaaattcatttggttcataacttctgttagtttcactgtgtctctgtttagtttctgt

SEQ ID NO: 96841 - DNA, 99 bp, Mus musculus
tgttaggttactaatcatacaggttcaaaggtcagaacagtgagtgtagacatagcctctctcttttctgacacctacagatgcacatgtgacacagca

SEQ ID NO: 96842 - DNA, 68 bp, Mus musculus
tcagtctgtcagtcactgagccttgtcagtaccacacacagcacaatggtcagtgagtttgaggctga

SEQ ID NO: 96843 - DNA, 85 bp, Mus musculus; identical to SEQ ID NO: 57439

SEQ ID NO: 96844 - DNA, 99 bp, Mus musculus
gcaatatgatttttccttgtgtaaacagaagaatgacagcagagagggactctcttcaactgctcttcatcatttaccttgggcactttcagaagttgc

SEQ ID NO: 96845 - DNA, 115 bp, Mus musculus
tccttgaccaagttatcattgagaagagtgttgtttagtttccacgtgaatgttggctttctattatttattttgttattgaagatcagccttagtccatggtgatctgatagga

SEQ ID NO: 96846 - DNA, 82 bp, Mus musculus
ggtcagtaacttaaggcaggaacctgggaccagaaacttatgtcattcctttctcagcctgcttttgtgtacatccaggacc

SEQ ID NO: 96847 - DNA, 85 bp, Mus musculus; identical to SEQ ID NO: 57470

SEQ ID NO: 96848 - DNA, 85 bp, Mus musculus; identical to SEQ ID NO: 57470

SEQ ID NO: 96849 - DNA, 85 bp, Mus musculus; identical to SEQ ID NO: 57439

SEQ ID NO: 96850 - DNA, 104 bp, Mus musculus
gccttagtctgtggtgatctgataggacacattagataatttcaatatttttgtacctgttgaggcctcttttgtgaccaattatatgatcatttggaggaggt

SEQ ID NO: 96851 - DNA, 56 bp, Mus musculus
gctggcaaatggtgggtgtttgagaacctatcacacagactcactatttgtccagt

SEQ ID NO: 96852 - DNA, 107 bp, Mus musculus
gtccattgttgaatgacaccttacatctgttacatgctacaatttttctttggttattgcatgtatacatgtagaaattacagtgtctccaaagcttcacaataggc

SEQ ID NO: 96853 - DNA, 115 bp, Mus musculus
tccttgaccaagctatctttgagaagtgtgttgttcagtttccacgtgaatgttagctttctattatttatgtttttattgaagatcaggcttagtccatggtgatctgatagga

SEQ ID NO: 96854 - DNA, 99 bp, Mus musculus
gagcctaggggtagaatacagcactattttaaatgagaaatttcccctgtaggagtttatatatttgaatcttagttagtagttcccttgagtaggctt

SEQ ID NO: 96855 - DNA, 85 bp, Mus musculus; identical to SEQ ID NO: 57470

SEQ ID NO: 96856 - DNA, 98 bp, Mus musculus
gactttgagttcaagagatttaaatggttcagtttttcaatggttatcatactgtaaaaaatatttattactgaggctctttgaatcagcttaaggtt

SEQ ID NO: 96857 - DNA, 85 bp, Mus musculus
gtccatggtggtctgataggatgcattggacaatttcaatatttttgtatctgttgaggcctgttttgtgaccaattatatggtc

SEQ ID NO: 96858 - DNA, 122 bp, Mus musculus
catatatatatatgtgtgtgtgtgtatgtatacatatatatacatatatgtatatgtgtatgtgtatatgtatatatatatgtacacacacacacatatatatatgtatatatatatatgta

SEQ ID NO: 96859 - DNA, 94 bp, Mus musculus
ccttagtccatggtggtctgataggatgcatgggacaatttcaatatttttgtatcttgtgagtcctgttttctgaccaattggtcaatttagg

SEQ ID NO: 96860 - DNA, 70 bp, Mus musculus
ggccagtactgaagggattgaaggttcggcgggtccaccggagtctgttcagactctgcactctctggct

SEQ ID NO: 96861 - DNA, 91 bp, Mus musculus
atgacagggtagaagctttttatttctatgtgtaataaaggttgaactttatttttcatccagaatgaggtagttctttctgccctgttat

SEQ ID NO: 96862 - DNA, 112 bp, Mus musculus
tagaatattatgagtttatatttaagttttaagataaaattaaatactggtataggtttgtaaattactgtgttaaatgtcttagaaagtatatatatatttatatatttta

SEQ ID NO: 96863 - DNA, 83 bp, Mus musculus
tgtctccatcaaatcttttatttttgatcttaaggtactctgaagaagaggaagcagaaaatgtgtaagagccagaggagata

SEQ ID NO: 96864 - DNA, 58 bp, Mus musculus
tacctatgtatgtatgtacgtatatatgtatgtatgtatgtatgtatgtatgtatgta

SEQ ID NO: 96865 - DNA, 120 bp, Mus musculus
tgtatgtatgcatgtatgatgtatgtatgtatgtatgtatgtatgtatatgtatatgtatatatgtgcatgtatatatacaatatatatgtatatacatacatatgtagatatatatgta

SEQ ID NO: 96866 - DNA, 83 bp, Mus musculus
cctgcaactgcagataccaggcagtagaattgtgggcaaaaatgataaagaacacatgccactgtactgagtgtgcagacggg

SEQ ID NO: 96867 - DNA, 60 bp, Mus musculus
tggtgcttgagtactgtattacttggttagtattggggtgcagtgatgcctcaaaagcca

SEQ ID NO: 96868 - DNA, 119 bp, Mus musculus
tattgagtacattagagttgagtatatgtatatgtgtgtatgtttatatatgtatgtaagtatatgtgtgttttttcacatttgtgctatgagttaataatatgtgatgcattttagta

SEQ ID NO: 96869 - DNA, 86 bp, Mus musculus
tcacgtacatgtgtaagcatgtacatgaatatttgtatatgtatgtatgtgattatttatgtgtgcatgagtgtacatgtatgtga

SEQ ID NO: 96870 - DNA, 85 bp, Mus musculus; identical to SEQ ID NO: 57470

SEQ ID NO: 96871 - DNA, 88 bp, Mus musculus
actccattgatctatctgtctttctctgtatcaaggtcatgcaaattttatattgcgctgtaatacagcttgaggtcagggatggggt

SEQ ID NO: 96872 - DNA, 86 bp, Mus musculus
gctcttgtgctctggctcctaaagatgtaagcaatagagctcttgctctcttgctctctggctctctggctcctgaagatgtaagc

SEQ ID NO: 96873 - DNA, 86 bp, Mus musculus; identical to SEQ ID NO: 96872

SEQ ID NO: 96874 - DNA, 85 bp, Mus musculus; identical to SEQ ID NO: 57439

SEQ ID NO: 96875 - DNA, 85 bp, Mus musculus; identical to SEQ ID NO: 57470

SEQ ID NO: 96876 - DNA, 89 bp, Mus musculus
agacgttttcaaagaattagaatgtatagtacaatgacatagctttgcctgtcacacttggctctttctgctatacaatgaaaatgtct

SEQ ID NO: 96877 - DNA, 116 bp, Mus musculus
tctgtgagagagaaagcaggcctgtagaggtggtgccagatcagtgagagcacatggtgaaagactgatttaaaatttgcctgaaggtctagggggatttgcttgcatttactaga

SEQ ID NO: 96878 - DNA, 95 bp, Mus musculus
gtcaaggggtttcactgaagagagagtactgagtgtggacagtaccatcctgtgcactaaggatcagcaccatcctctttgctaagatcccagac

SEQ ID NO: 96879 - DNA, 56 bp, Mus musculus
ctctctctctctctcgtgcatgcacacacacacacacacacgagagagagagagag

SEQ ID NO: 96880 - DNA, 62 bp, Mus musculus
catatgtatgtgcatgtgtatgtgcatgtatatgcacatacctatatgtataaaggcatgtg

SEQ ID NO: 96881 - DNA, 89 bp, Mus musculus
ctgtgtaagaaatattaggagctggagagatggctcagcggttaagagcactgactgctcttccaggggtcctgagttcaattccacag

SEQ ID NO: 96882 - DNA, 68 bp, Mus musculus
tctctctgtctctctcaaaatcatgggggcatgcttgtgccatagtgtgtgtgtagagatcagagaga

SEQ ID NO: 96883 - DNA, 77 bp, Mus musculus
tagactgtgcaagggacactgtggctcctgtcctgtgaccacaggtaaggcagtcgctccctcagtgcctgggactg

SEQ ID NO: 96884 - DNA, 89 bp, Mus musculus
catatatatatatatgcatttacatatatacaatgtatatatgtgtgtgcatatcacatatgtatgggatagcatatacattcatacat

SEQ ID NO: 96885 - DNA, 67 bp, Mus musculus
tatgcacacacatatatacattgtatatatgtaaatgcatatatatatatatgtgtgtgtgtgtata

SEQ ID NO: 96886 - DNA, 116 bp, Mus musculus
ggtggcggtactaccttctgactctgcctggaagatacagagctctcagtgacgatttcctgtgtgactttctctgtgtgcacttcgtgcagaggtttgggggcggggaagccggt

SEQ ID NO: 96887 - DNA, 101 bp, Mus musculus
gcatcagaagtgtcagaaggttctgtagctcacatggcccctcgcactctgagtttctctttcagtaggggtgaagtggcactgggaagttccttctatgt

SEQ ID NO: 96888 - DNA, 96 bp, Mus musculus
gatctcagccataacattattttcattgctacttcataactgtgatctggctaccgttatgaattgtaatgtaaatatctatgttttctgatggtc

SEQ ID NO: 96889 - DNA, 79 bp, Mus musculus
aagtcaaactgagtctgtgactctgagttgtcacgcgttattgatgataatcagagcaggcatggagttctgctgactt

SEQ ID NO: 96890 - DNA, 99 bp, Mus musculus
tctgtccctgtgtgtctgtctctatgtctgtgtctgtctctaacagagagttttctctgctgtcactgaacagcataaaagcatcacataggagaagga

SEQ ID NO: 96891 - DNA, 60 bp, Mus musculus
gtgtgggcaacacggtgagatccaggcctgtcaggccagacacacagtgtgactctatat

SEQ ID NO: 96892 - DNA, 87 bp, Mus musculus
ctcaaatacacacaccatatatatgtatattgatactgggcttaaagtgtagtatgtgtgcatgtgcatgtgtgcatgcatgctgag

SEQ ID NO: 96893 - DNA, 84 bp, Mus musculus
gtgtgtgcatgtatttgcatgtgtgtatgtatgcatgtttgtatatgcaggcatacatgcatgtttacgtatgcatgtgtgtgc

SEQ ID NO: 96894 - DNA, 77 bp, Mus musculus
ggtaagcaaagagatgtgagatgcttaggttggccagtgtcagcacagtgacagcagcatcttcctctatgccagcc

SEQ ID NO: 96895 - DNA, 84 bp, Mus musculus
atatatacatgcatacatacatatacatgtatataaattatataaaatatgtatatacatgggtttgtgtgtatatgtatatat

SEQ ID NO: 96896 - DNA, 85 bp, Mus musculus
acttcagtgtcagctatttcttctgctcactgactctcactcggaccccacctgagcaggagctagtttctgttctcatggaagt

SEQ ID NO: 96897 - DNA, 112 bp, Mus musculus
gcaaatgtctttatccattgggtcctctcactggcaaattgatatttttatttatccaagaatatgttatttgcctggagagatggctcagaagttaagaatactcatatgc

SEQ ID NO: 96898 - DNA, 130 bp, Mus musculus
ctgacacatttatgggaaagaaagttagataaagagtatagaaaactgcttctctaggcagagagttgagagtggagagtacagtgctgaggttgtatctgcttccagtgtgagaggagagcgagttttc

SEQ ID NO: 96899 - DNA, 103 bp, Mus musculus
atgtgtcagtcagacagacacactgtggcttttttttttttttttttttttttgagacagggcctcatatatgcagggtggcctaaaaactgactggctatgt

SEQ ID NO: 96900 - DNA, 109 bp, Mus musculus
catatatgcagaggacctaggtcagacccatacaggctccctgattgtcacttcagtctctgtgagcctctataagtctgggttagttggttctgggggttttattgtg

SEQ ID NO: 96901 - DNA, 86 bp, Mus musculus
tgtgtatgtatgtatctatgtatatatctatatctatgtatgtatgtgtgtgtatgcatgtatgcatatgtatgtatgtatgtatg

SEQ ID NO: 96902 - DNA, 73 bp, Mus musculus
tgccctgtatgtgtatgtggtatgtatgtgcatgggttcctatgtatatatgtgtgtatatatgtgtgtggta

SEQ ID NO: 96903 - DNA, 98 bp, Mus musculus
atatatatatatatatagtacatgtatatatgtgtggtgtatatatacttcatgtatatatgtgatatatatatatatatatatatatatatatatat

SEQ ID NO: 96904 - DNA, 77 bp, Mus musculus
ctggaaaatagttgtgggtgaaaatgaaccaaacaccagctggctgtacctgtctcagtcactcaaaatttccccag

SEQ ID NO: 96905 - DNA, 82 bp, Mus musculus
gagaggctagaagttggggaacagatgcagaatttgttaccgctctctctggctctatctctgcaaaacggaatctgttccc

SEQ ID NO: 96906 - DNA, 83 bp, Mus musculus
ctaattttcttgttatgtcctattcttacatatatgcatatatatatatatatgcacttatgtgaatatgaatacaagtgtgg

SEQ ID NO: 96907 - DNA, 112 bp, Mus musculus
cttcagggtctctgacttcagtccaatggttgggtgtaagtatctgcctctgtctcagtcagctgctggtatgccctctcagaggatagccattcgaggctcccatctgaag

SEQ ID NO: 96908 - DNA, 110 bp, Mus musculus
tttatgtcataggaaacagaagtattcatcttattacaatagcacataaaagatcagatctgtgtgtgtctgtgagagtggtgtaaatacttgttccttgtgtgtgtagg

SEQ ID NO: 96909 - DNA, 85 bp, Mus musculus; identical to SEQ ID NO: 57470

SEQ ID NO: 96910 - DNA, 81 bp, Mus musculus
gtgtacgtgtgcatgtgtgtgtatgtatgcatgtgtgtctctgtgtatatgtgtatatatatgtgtacatgcattgtgtgt

SEQ ID NO: 96911 - DNA, 67 bp, Mus musculus
gtctgtctgtctgtctgtctctccagtggagcagctatcatccacggggaactactgaccagttggc

SEQ ID NO: 96912 - DNA, 93 bp, Mus musculus
tagttgattagcagtttggtcccaaacaacaggagcaaagctgtctggacctgttgcctgcctgcctgcctgcctgtggaccctgttcaccta

SEQ ID NO: 96913 - DNA, 97 bp, Mus musculus
ctcatgtagccaaggttatctctgagtctctgattctccatctttatcatctgagtgctgagattagaagcaggtgtcattatgaccaggtttggag

SEQ ID NO: 96914 - DNA, 72 bp, Mus musculus
gttatgcgtgtactgtgtaggcctgggtgcatgtatatgtatatatgtatgtctatgtgtattgtgtgtgac

SEQ ID NO: 96915 - DNA, 113 bp, Mus musculus
gaaagtatcaacttagtgtcttgagggttggagacaggatagtatttataaatatgtgttttacaatgctatagatgtaaatgccatcccagtagggacacttacacaatttc

SEQ ID NO: 96916 - DNA, 85 bp, Mus musculus
cgccattgtcgcacacatccctctctcgatggctgactgtgcacagcatttccacaatgagagaattagatgttgacaaatggtg

SEQ ID NO: 96917 - DNA, 71 bp, Mus musculus
tattgaatgtgtatgtgcatttgcatgtgcacacacacacgtgtatgcatgcacatgccacagtgtacatg

SEQ ID NO: 96918 - DNA, 79 bp, Mus musculus
tatgtataaggcatatttcttgcattaaactgtctccaaagatggtatgtttgtatgtatgtatatgtctgcatgtgtg

SEQ ID NO: 96919 - DNA, 69 bp, Mus musculus
agtcagttacaggactgtgctagcctgggatccccagtgtgaggtcattgtctgtaacactgtgtgact

SEQ ID NO: 96920 - DNA, 81 bp, Mus musculus
gtccaaaaatcctaggccacaccctctgtcagtcagattctcaaggacgggtctgctgtagacctctgtgcctgggagggc

SEQ ID NO: 96921 - DNA, 81 bp, Mus musculus
gggctttaacctctgcctgggactgacccactgagtgcttctcaagtaaatgtgaggttctaggttagtggattctagttc

SEQ ID NO: 96922 - DNA, 78 bp, Mus musculus
gcttattacagctgacatagcacagcagtcccacagccaatgctcccttttctctgtgattctcagtgtaatttaggc

SEQ ID NO: 96923 - DNA, 115 bp, Mus musculus
gatgagtttctgagaagaaggtatagtcttttgttgtggggtagaaggttctttagatatctcttggttcataacatctgttagtttcactgtgtctctgtttagtttctttttc

SEQ ID NO: 96924 - DNA, 106 bp, Mus musculus
ttgctcagcacctatcaactgacaaaatcacagataatagtgaggtctgggattcccaggcataaatcttgcttgcctttatcttgtacaagttttgcatgggcag

SEQ ID NO: 96925 - DNA, 76 bp, Mus musculus
atgcatatacatatatgtatatatgtgtgtatgtattgaatgcatgtatatatatatatgtgtgtgtatatgtata

SEQ ID NO: 96926 - DNA, 107 bp, Mus musculus
ctttaattcactatggccattgacataaactcccaaacagaataagatagaatagactgttcacactgcagtggagcatgggctatgaccaaagctttgttttagag

SEQ ID NO: 96927 - DNA, 59 bp, Mus musculus
ccacaggccccttatgagggctccttaaatagtaattttgatgttctcaatgcttgtgg

SEQ ID NO: 96928 - DNA, 68 bp, Mus musculus
tatgtgtgtgcgcatgtgtattatgtgtgcctgtatgtgtgtatatatatatattgcaaatatatata

SEQ ID NO: 96929 - DNA, 100 bp, Mus musculus
aaagagttcattatcagttttctagtactatggaaatgtgtggctggatatagtttgtaaacatttgttgcatatgtgcagggtttcatgtgtattcttt

SEQ ID NO: 96930 - DNA, 111 bp, Mus musculus
caagttgctattccaaaggaattagtgactatacttccctgtgatctctgtgagtctgacaaagctcagtaaagtgtggatacaccaaaattctgtggttctggatacttg

SEQ ID NO: 96931 - DNA, 71 bp, Mus musculus
gcaagcatggagctctctgcacctctcccaggcatcacaagtaggtagtcccagatacagcttctgcttgt

SEQ ID NO: 96932 - DNA, 72 bp, Mus musculus
gatttcatttcattgtatttcattcttagaatcctgtttgttttctaatatgagacagaaatgaggtggatc

SEQ ID NO: 96933 - DNA, 95 bp, Mus musculus
tcaggataaactgaaattcatagtttgcttaggtgcaagagaagagatttatttctattgctaaaggagaggaatctgtgattttcttattgtgg

SEQ ID NO: 96934 - DNA, 106 bp, Mus musculus
gctttagtccatggtgatctgataggatgcatgggacaatttcaatatttttgtatctgttgaggcctgttttatgatcaattatgtggtcacttttggagaaggt

SEQ ID NO: 96935 - DNA, 80 bp, Mus musculus
gcgaacacatgagcccagagcacacagaaagcagtgtgctccttaacactgctccgggtttgcctagctgggctctgcgc

SEQ ID NO: 96936 - DNA, 73 bp, Mus musculus
caataaactagttttatttagatataactttagttgcatacccaatatatatctaaatgaaactagtttgttg

SEQ ID NO: 96937 - DNA, 86 bp, Mus musculus
tgtatgtgacatatgtatatatatgtatatatatacatatgtgtgtgtctatatgtatatatatatgtgtgtgtgtgtatatatat

SEQ ID NO: 96938 - DNA, 105 bp, Mus musculus
ggaactatttcttaggcctgtgaaggactagcagtcaatcaatagtaactttcattctcactcactttcttgaactgggctgctaaggaccatggggcaagttct

SEQ ID NO: 96939 - DNA, 77 bp, Mus musculus
ctcctttgtgtatgtatgtatgtatgtatgtatgtatgtatgtatgtatgcatgcatgcatgcatgtgtgtgagcag

SEQ ID NO: 96940 - DNA, 74 bp, Mus musculus
gtgtatgtatgtatatgtatgtatgtatgtgtgtgtatgtgtgtatatatgtatgtatgtatgtatatgtgtgt

SEQ ID NO: 96941 - DNA, 61 bp, Mus musculus
ccagaatgtatgcatgcgtgtgtgtgtatgtatgtatgtatgtatgtatgtatgtttgtgg

SEQ ID NO: 96942 - DNA, 85 bp, Mus musculus
tcttgattcttttgggggtggggtggaggtggggcggggcatcacagaagtcttcaatctctctcattctcaatttgagtctgga

SEQ ID NO: 96943 - DNA, 95 bp, Mus musculus
gtacaaaagactggtattcaggcagaaatgaagatgtgcccaccatggctacctgttctcagatctgtctctgtcccggacacacacttttatac

SEQ ID NO: 96944 - DNA, 75 bp, Mus musculus
gggctgaggcagagtagagagtagagactgtgcaatactgattgtcttactgtcctctgagctgcctcctctccc

SEQ ID NO: 96945 - DNA, 95 bp, Mus musculus
gcattgtcgtacatcacagccctagagctgtccctcctatgtgtctgttactgtcatacatcacagccctagagctgtccctcctgtgtgtctgc

SEQ ID NO: 96946 - DNA, 108 bp, Mus musculus
ttgtttgtctgtgttctgacattagctgtgcctctacattaagacagtacttccaaagactcacagactgtctggttaaggtccagctgctctagaggacttaaacag

SEQ ID NO: 96947 - DNA, 82 bp, Mus musculus
ctgagagagtacagtgagaacagaatgcttgagctgcttggatagcatccttcacgttgagactgactgactgcttttccgg

SEQ ID NO: 96948 - DNA, 78 bp, Mus musculus
gtatgtgtatgtatatatgtatgtatatacatatattcatgtgtgtatgtatatatatatatgtgtgtgtgtgtatat

SEQ ID NO: 96949 - DNA, 123 bp, Mus musculus
atattctgtgtatctgtttcttgaattttgccatcccccaccaggagttatcagagtgatgttgcgtgagggctgtgtgtgtggaggggggggcgggtggggaggtgtagctattttgtaggc

SEQ ID NO: 96950 - DNA, 79 bp, Mus musculus
acttctgttagtttcactgtgtctctgtttagtttctgtttccaggacctgtccattgatgagagtggggtgttgaagt

SEQ ID NO: 96951 - DNA, 56 bp, Mus musculus
ggtagagggagagaattgactcctgcagctgtgctctgtctgtctgtctgtctgtc

SEQ ID NO: 96952 - DNA, 82 bp, Mus musculus
ggagtagaacgttgtgtgtgagataaggagtaaacagcactgcagatgcagtcaacctgtctctgtctctggccttctcttc

SEQ ID NO: 96953 - DNA, 80 bp, Mus musculus
ttttactcagagtgtttctgtcactttctgatgacaatataagagtgtctgtcgtagagtgtagaagagtgggagtaaaa

SEQ ID NO: 96954 - DNA, 108 bp, Mus musculus
gccactctgggaaaagaacacccaccagtttcgggctggagagatggctcagcatctgactgctcttccagaggtcctgagttcaattcccaacaaccaaacagtggc

SEQ ID NO: 96955 - DNA, 88 bp, Mus musculus
tatgtgtatatgtatgtatgtatttgcatatgtaagtgtaattgtatatgtgtatatatgtgggtatctgtatgtgtttgtacatgtg

SEQ ID NO: 96956 - DNA, 123 bp, Mus musculus
gtgtgtatgccaatatgtatgtttatggctgtgtgggtgtacatatggctgtgtgtgcatgtccatgtgtgtatgtacctgtgtatgtgcccatatttgtgtttctggttatgtgggtgtggc

SEQ ID NO: 96957 - DNA, 116 bp, Mus musculus
aaatttccgcagcagaaaccttgccacaatctccaagggcatggtcagtagaatgagaccacttttcattggttgagcccctgtgacaatgtatagtgcaacctgtttattagttt

SEQ ID NO: 96958 - DNA, 103 bp, Mus musculus
tatatatatatatatatatatatatatgtgtgtgtgtgtgtgtgtgtgtgtgtgtgtatatatatatatatatgtatacacacacacacacacacacacatat

SEQ ID NO: 96959 - DNA, 94 bp, Mus musculus
ggtgttaccgcgacactgctctgaaggaggaattgagatattctagttctttcattccttttgtcagaggagtgggagctaattataaaacacc

SEQ ID NO: 96960 - DNA, 120 bp, Mus musculus
gctccctgggctcacaggatacaatgcgggtcctcaggctacaacacaggacccgggcgctgctctgacccctcgtgtcttgtgttgcagccggagggacgcaggtctgcagcagagcct

SEQ ID NO: 96961 - DNA, 89 bp, Mus musculus
tgtcactatgtaggtaggctttgagggctcctatgctcaggttccactgagcgtggaatcagagcctgcctggctgcctgcgaaggaca

SEQ ID NO: 96962 - DNA, 100 bp, Mus musculus
gaacacctttgtcaggctggagagttggcttagcggttaagagcactgactgctcttccagacgtcctgagttcaattctcagcaaccacatggtggctc

SEQ ID NO: 96963 - DNA, 77 bp, Mus musculus
ggaggctgtagcttgtatagtagtagctccatgggtgtgcacttgcccagactgcatggcaacctcgatttagcccc

SEQ ID NO: 96964 - DNA, 112 bp, Mus musculus
tggcaatagtaatttcatggggctggagagatggctcagcggttaagagcactgactgctcttccagaagtcctgagttcaaatccagcaaccacatggtggctcacagcca

SEQ ID NO: 96965 - DNA, 81 bp, Mus musculus
atgaccccatgaagacaggagaagcagtgcctggcagagcttagcatatagcccagtctgtctctctgtcctctctgttat

SEQ ID NO: 96966 - DNA, 82 bp, Mus musculus
ctcctctcagactgaagtctgtgtgtactgatgaagggttccttcaacccaagtttctggactaacaagctctgggatggag

SEQ ID NO: 96967 - DNA, 88 bp, Mus musculus
atacaaatatgtgtgtatttatatatgtgtgtgtacatagatctttaaaatgtactagcatatgtgtaaatttgtatatttatatatt

SEQ ID NO: 96968 - DNA, 74 bp, Mus musculus
agatgcacttgcctaaccagtgctggcataaaagatgtgtgcctctgcctgcctgcctgcctgcctgtccgtct

SEQ ID NO: 96969 - DNA, 117 bp, Mus musculus
aaaggacagtaagtggcacctgcctgtgactcatacataataagagctgtctctgactcagtgttctttgtcttatgtgtgctcagtattttgcaggcagagtgatggctgttcttt

SEQ ID NO: 96970 - DNA, 116 bp, Mus musculus
acaggccatgggcacacactgccttccccaggtcctctacgtacagtggctactgtgctgaaacacacagggatgttttcactgttgaggttctgtcaagtgttctgcccaactgt

SEQ ID NO: 96971 - DNA, 97 bp, Mus musculus
cttgggaggtggtggcaggggcatgaccctgggcaaagaagaactgagctccttacctttttttttgtttgtttgtttgtgctttgtgactcccagg

SEQ ID NO: 96972 - DNA, 83 bp, Mus musculus
tgtcttttctgtctgtctgtctatcttctgaacaccatgtttccagatgacaccattatttcaggatatacacagagaagata

SEQ ID NO: 96973 - DNA, 118 bp, Mus musculus
ggctcactggccagccatcctggccttctcaggtgggttttgagcctgagtcactctgtctcaaaaaggctgggccctggctgagatggggctggagactgtgcagtgcataagagtc

SEQ ID NO: 96974 - DNA, 78 bp, Mus musculus
agcatcattctgtgtgctctgcctgtcagtcagtgagatcccgcaggaagacagtagtctagactcaggagagatgtt

SEQ ID NO: 96975 - DNA, 82 bp, Mus musculus
taagtgtgtcctggcaatgctgagttgtgtctgtctgttcctgctgcagtccagtgagacacattcacttgtggactccttg

SEQ ID NO: 96976 - DNA, 85 bp, Mus musculus
aaggtcctggcctggtctcagtcagacagacagtgtagaggtcatttgggctgttagcgatttctggtcctggttgtgggagctt

SEQ ID NO: 96977 - DNA, 80 bp, Mus musculus
tggtgacagttcactctgtgcatctccttgtttactaggacctttaaggtggcaacgggggctgtgtactagtagctgtt

SEQ ID NO: 96978 - DNA, 85 bp, Mus musculus; identical to SEQ ID NO: 57439

SEQ ID NO: 96979 - DNA, 115 bp, Mus musculus
tccattgtttgaggagggctgtgctaagagtgcctgtagtcagaggccagtagccagaagttactgaggtcagagatgggatcatctaagaaacggtgcctgagcaggaagagga

SEQ ID NO: 96980 - DNA, 90 bp, Mus musculus
gctataagtagtgggaccaggattctaacaatggcagggttattactagagcagatgagaatatttatatttgtcttacgtgcttgctgc

SEQ ID NO: 96981 - DNA, 79 bp, Mus musculus
cagtgcctgtcactgtttctcagacattaacctcttctattctgtcatgagtcaaaagaagcagcacaggaaacagctg

SEQ ID NO: 96982 - DNA, 73 bp, Mus musculus
gtcatgaaggcatgttagatagtgtcaaagatcttttttgtatctatttaaatgtgatttttgtcttcaaggc

SEQ ID NO: 96983 - DNA, 73 bp, Mus musculus
ccaggagagaacggaaccaggaagacatggagtgttttatcatcactctcctcattctgtcactgagtcctgg

SEQ ID NO: 96984 - DNA, 85 bp, Mus musculus; identical to SEQ ID NO: 57439

SEQ ID NO: 96985 - DNA, 119 bp, Mus musculus
gctggattggagggttccaggatgaagtttaaatatattatgacaagataaatatctttgaatattattaagatagttcttgttcaaatgtttttgtgaaatcagcattttcttcctgc

SEQ ID NO: 96986 - DNA, 94 bp, Mus musculus
ctcactctctctctccccaccgagtctgtgtgtgtgtgtgcgcgcgcgcgcactcacacacactcattttggtgtgtgagggggcatatgtgtg

SEQ ID NO: 96987 - DNA, 56 bp, Mus musculus
ccaaaatgagtgtgtgtgagtgcgcgcgcgcgcacacacacacacagactcggtgg

SEQ ID NO: 96988 - DNA, 114 bp, Mus musculus
caggaggacctaggtattttccaatttttaattccagcttctctacagttttgttttatttttttagcctgtggattatttagaagtatgttaaatacttaccacatttttctg

SEQ ID NO: 96989 - DNA, 103 bp, Mus musculus
agagtacaaccttaggtgttggactatctttctatcttttttgatataaactactgtctgtagatagattctcaggtcttcccctttataagggaagtacttt

SEQ ID NO: 96990 - DNA, 87 bp, Mus musculus
gcgaggctgtgtgtgtatatatatgtatatctggatatatgtgtagaacatattcacctgcacatatgtgtatatacatggatatgt

SEQ ID NO: 96991 - DNA, 74 bp, Mus musculus
tgagctcctcacccactgtctgtgtgccttgtctttcaggacatggccaaagcctagggcgagtccactgctta

SEQ ID NO: 96992 - DNA, 69 bp, Mus musculus
ctcaggttcggggaaagcctgcagctgtgtgtgtgcacacactgtcattgtgcttcgctgaacactgag

SEQ ID NO: 96993 - DNA, 114 bp, Mus musculus
cagggattcttattttacaggcaggatgctaccatcaccagggtagccctcactcactcagtgagttcttccgtctaccttgtgggtgtgatcagtgctttgctctgtgccctg

SEQ ID NO: 96994 - DNA, 82 bp, Mus musculus
agacccctccccgctactgtcatggagcagagtgggtgcagacaccctgcctagcttctctcttgtggggcacaggtggtct

SEQ ID NO: 96995 - DNA, 94 bp, Mus musculus
tgttggaaggcatcgactttatgctttaagtgaggaccttctcgacagtaatggaaactttatctttatttttgcaggttggtgtttgccagga

SEQ ID NO: 96996 - DNA, 79 bp, Mus musculus
tggaagtcttacacacacacacacacatgcacacgcacgcacacgtgtgtgcacacatgttttgtggctgtagcatccg

SEQ ID NO: 96997 - DNA, 84 bp, Mus musculus
ggcctatctccctcctgcatccatgtcacacagaatctgtctctgtgggctctgtgttctgctgtgttgtcaggggctagtacc

SEQ ID NO: 96998 - DNA, 81 bp, Mus musculus
ctagtctgggagcagtccaaagatcctgtgatgagcaaacgatgctgaaaagctacagtagtctcgagtttccagaactgg

SEQ ID NO: 96999 - DNA, 70 bp, Mus musculus
ctcaggaggccccagtctgagcagagtcagaacacatgctgtggaaagcctcagacatgggattcaggag

SEQ ID NO: 97000 - DNA, 81 bp, Mus musculus
accttctgtctgtctgtcttacccaagtatcataaatcagatacttctacttcaggtttattaacagagatccagaaaggt

SEQ ID NO: 97001 - DNA, 72 bp, Mus musculus
aaggtgacagactgactctgacactgacatgctagtctataaaatgtcagtgtctgattctggagtctcctt

SEQ ID NO: 97002 - DNA, 90 bp, Mus musculus
gtccaatagatgactgtgagcatctgcttctgtatttgccaggcactggcataacctcagaagagtcagctatatcagggtcctgtcggc

SEQ ID NO: 97003 - DNA, 75 bp, Mus musculus
gtgtacatttgatggattattggaaataagagaaaccatatttttttatttacaaagaaccacacaaatatacac

SEQ ID NO: 97004 - DNA, 109 bp, Mus musculus
ttttgccatacttgtcagctttgtttgtctttttccagtctgatctctttccttgaagtgacagtactgacagagaacagcacagagactttgtttgctgggggtgaag

SEQ ID NO: 97005 - DNA, 94 bp, Mus musculus
ggtcaagtacagtggatttgcatagcagtagggcattctggtatcatgtaacagaagatagtcttcactgatctatacaattatttctttggcc

SEQ ID NO: 97006 - DNA, 106 bp, Mus musculus
tgcattaaattttgatatgtatctgtgtgtctctgtgtgtctgctacatgagtacagttacctgcatgagagagaaggtgtgtgatcccttggagttggatttgca

SEQ ID NO: 97007 - DNA, 74 bp, Mus musculus
gcccaatctaagcaagtagcatgtattcatactaattgagtcgtgttttcattgctgaggtatatttgggttgg

SEQ ID NO: 97008 - DNA, 108 bp, Mus musculus
acaggtatgtatgtatatatgtatgtatgttatgtatgtatgcatgtgtatatgtatatatgtgtgtctatgtatgtatgcatgtatgtatgtgtgtatgtatgcatg

SEQ ID NO: 97009 - DNA, 119 bp, Mus musculus
tctgtgagttctagctacttttgatgtctacttatacatgatgtttattttagtttttataaaataattaggtaagaattcatgtatatttttcagatgacagagtgcagaaaggattt

SEQ ID NO: 97010 - DNA, 66 bp, Mus musculus
gggcactatgcaattctcatgctttgtaggctttatcaacaaagtatgggagcacccttctttgcc

SEQ ID NO: 97011 - DNA, 81 bp, Mus musculus
tgtatatataatatacatatatatatgtgtgtgtgtatatatatatatatatatatatgtgtgtgtatgtgtctgtgtgca

SEQ ID NO: 97012 - DNA, 110 bp, Mus musculus
gtaggagtggtactatacacacatatgtatatgcattatatatgcatatatatgtatatagtatgtatacacacttgtataatgtatgtgtacataatatatatatatat

SEQ ID NO: 97013 - DNA, 69 bp, Mus musculus
actcacagcaactggatgtgcttgggtcacagccgacaggatgattgggcattggagttgcacttgagt

SEQ ID NO: 97014 - DNA, 88 bp, Mus musculus
gtctccctggttgtcacttcagactctgtgagtctctatgatcactgctcagttgattttgggggccatattcttgacacctatagat

SEQ ID NO: 97015 - DNA, 80 bp, Mus musculus
aaagtaatctgtctctctgtctgccatgtgggtctcaagattctaaatcatgtgactaggcttggtggcacgaatacttt

SEQ ID NO: 97016 - DNA, 115 bp, Mus musculus
acatacaaagatatgcattacctgaaatattctgggggaatatataattattttaaagatttatttatttattttatttgcctgtctcagtgcctgagtgagtgattttgtgtgt

SEQ ID NO: 97017 - DNA, 67 bp, Mus musculus
catatgtatatgtgtgtacatatatatgtatatatactgtatatatgtgagtatgcatattcatatg

SEQ ID NO: 97018 - DNA, 85 bp, Mus musculus
gtccatggtggtctgataggatgcatgggatgatttcaatatttttgtttctgttgagtcctgttttgtgaccaattatatggtc

SEQ ID NO: 97019 - DNA, 93 bp, Mus musculus
aagtcatggcaggaactcagggcaagaactatagataagaacagaaacagtaatttttttttcttaatggcttgctcccagactgctaagctt

SEQ ID NO: 97020 - DNA, 110 bp, Mus musculus
actatttcactgtatgtatttctgtaaacatctggagtctacctcatttatatgaagagagatgaatgagaggtggagataggtgtggctgaaaggtagcaatggctggt

SEQ ID NO: 97021 - DNA, 89 bp, Mus musculus
agatagcctagaataaattatggtttgcaatatataacagtgtctcaatggtggagagaactgtgtgagcagacagcctaggaagatct

SEQ ID NO: 97022 - DNA, 106 bp, Mus musculus
gccttagtccatggtgatctgataggatgcatgggacaatttcaatatttttgtatctgttgaggcctgttttgtgatctattatgtggtcaattttggagaaggt

SEQ ID NO: 97023 - DNA, 74 bp, Mus musculus
tgtatttatgtgtatatggttatatatacatatgtatatatgtgtgtatatataagcatatacacataaatata

SEQ ID NO: 97024 - DNA, 94 bp, Mus musculus
ctggtggagttttgggtttcttcaggatcttttgttatgtctcccttttcatttctgattttgttcaacaggatgctgtccctgtgccctctag

SEQ ID NO: 97025 - DNA, 127 bp, Mus musculus
gtgtgtgtgtgtgtgtgtgtgtgtgtgtggcagtattacgtatacatacacacacacatatatatatttatgcatatgcatatatatagatatatgtatatatatatctatatatatatatgttaaa

SEQ ID NO: 97026 - DNA, 84 bp, Mus musculus
catgtatatatgtgtgtttatctatctatatgatatatattatatacttgtcaatgtgatatataaatgatatatgtatacatg

SEQ ID NO: 97027 - DNA, 76 bp, Mus musculus
tcaggtgctcttatggggtaatttagtccaattgaatattaccttaatggggaagaaatgagtctgagcacactga

SEQ ID NO: 97028 - DNA, 75 bp, Mus musculus
aatgtatgtatgtatggatggatagatgaatgaatatatgtatttgtgcatgtatgtgtattacatatgtatatt

SEQ ID NO: 97029 - DNA, 65 bp, Mus musculus
ttgggaacactctgaaagtatcattaccatatatatttcccaaggtatcagagggatgttcccag

SEQ ID NO: 97030 - DNA, 118 bp, Mus musculus
tatatatatatatatgtctatctatctatctatctatagatatctatagatagatatagatatatatatagatatagatatagatagatatctatagatagatatagatatatatata

SEQ ID NO: 97031 - DNA, 85 bp, Mus musculus; identical to SEQ ID NO: 70679

SEQ ID NO: 97032 - DNA, 70 bp, Mus musculus
tcatggctcatgcaggatgaagcagcctcatttgtgggcaatgatgactgtgtcacttcaaaggctatgg

SEQ ID NO: 97033 - DNA, 85 bp, Mus musculus; identical to SEQ ID NO: 57439

SEQ ID NO: 97034 - DNA, 78 bp, Mus musculus
acatgacattggacattgttatttgtacagtatttcatatttatttatttgtgtatatgtgactgtgtcagtgtctgt

SEQ ID NO: 97035 - DNA, 69 bp, Mus musculus
gtatatgtatatgatgtatatgtatatgtatatgatgtatatgtatatgatgtatatgtatatgtatat

SEQ ID NO: 97036 - DNA, 64 bp, Mus musculus
ggtataggtataggtataggtataggtataggtatatgtgtatatgtatatgtatatgtgtatt

SEQ ID NO: 97037 - DNA, 61 bp, Mus musculus
gagcatatatgtgtacagatatttgtgtctatgtatatatgtgtatgtatatgtatgtctc

SEQ ID NO: 97038 - DNA, 75 bp, Mus musculus
tgtgtgtgtgtgtgtatgtgtgtgtgtgtgcatgcccatgcatgcgtgcacactcacactcacatgcactcatac

SEQ ID NO: 97039 - DNA, 85 bp, Mus musculus; identical to SEQ ID NO: 57439

SEQ ID NO: 97040 - DNA, 107 bp, Mus musculus
tatttccaataagtgccctgggtctgacaattcttcttagcttaatgtatgaattttatttcataacagcaatgagattctccaggctgtgcatttgttagggatta

SEQ ID NO: 97041 - DNA, 85 bp, Mus musculus; identical to SEQ ID NO: 57439

SEQ ID NO: 97042 - DNA, 70 bp, Mus musculus
tatatgtgtatctatatgtgtatctatatgtgtatttatatgtgtatctatatgtgtatgtatatgtgta

SEQ ID NO: 97043 - DNA, 118 bp, Mus musculus
tgctttgttttatgtgtggtcaggtgctaccagcatataaacggggatagtatctaccacctgagttcactctctctgtcctgctacaggtagcctagcctcctcattgctcaattca

SEQ ID NO: 97044 - DNA, 95 bp, Mus musculus
caattgtgatgagcctgtaacagcaggagcaaggacacgggagtcttgtctggctagcggcttgggttccttctgagaggtactggtacaccttg

SEQ ID NO: 97045 - DNA, 90 bp, Mus musculus
gtgtgctgatggtgactatttccctgaagctgatctttgctattttactcacaatctctctttctggggaatatactccccacattacgc

SEQ ID NO: 97046 - DNA, 109 bp, Mus musculus
catgtgtgtttatatgtgtaaataggtatgaatgtggatttcatatgtgtttatatgtatacatgtatgttcatatgtgtgtacagtttttcatgtgttggtgttcatg

SEQ ID NO: 97047 - DNA, 115 bp, Mus musculus
gcaaatggatttaaatgtaagagagaaggctgtgtaccatggaatcaaaggtgaataaaagtttttcattttaagaaatctccacagacagaattctgtcaacaggatcttctgc

SEQ ID NO: 97048 - DNA, 103 bp, Mus musculus
ggacttccatatagatataggttgtcaaattatactctagattgagcaacaggatctgtttcagagatggttttcaacctgtttacctgactcatgacagtct

SEQ ID NO: 97049 - DNA, 188 bp, Mus musculus
gtatgttatataacctagatgcaatttatatgcatatatatacttatatatgtatatatgtatttcatatatatatgcatatatatacttatatatgtatatatgcatttcatatatatatgcattatatatatatatatatatatatatatatatatatatatataagcattcacatatatagagca

SEQ ID NO: 97050 - DNA, 113 bp, Mus musculus
atacaatatgtatatgtatgtgtatatatatacatatatatgtttattatcaatctaatttaatttcaaaatatgcatgtgtgtgcttgtgtgcatgcttgtgtgtgttgtgt

SEQ ID NO: 97051 - DNA, 90 bp, Mus musculus
gcatgtgaatctatatctgtatcatctatatttatatctatctctctgagtatatataaatatgtgtgtgtataacatgaatgtatatgc

SEQ ID NO: 97052 - DNA, 114 bp, Mus musculus
ggcctgagcattccaaagtctctcatttttgcacaatgactagcagtacagttctgtatttgttcttatctactgcaggaggaagcttttatgatgatggatgagcaaaacacc

SEQ ID NO: 97053 - DNA, 106 bp, Mus musculus
gccttagtccatagtgatctgatagaatacatgggataatttcaatatttttgtatctgttgaggcctgttttgtgaccaattatatgatcagttttggagaaggt

SEQ ID NO: 97054 - DNA, 113 bp, Mus musculus
gagattttctaacaatttgggctcttacaatctttctgcctctctctctcatagaaagctgatacttgagaggaaagttttgataagaatatctcgtttatggcagcattctc

SEQ ID NO: 97055 - DNA, 85 bp, Mus musculus; identical to SEQ ID NO: 57470

SEQ ID NO: 97056 - DNA, 85 bp, Mus musculus; identical to SEQ ID NO: 57470

SEQ ID NO: 97057 - DNA, 111 bp, Mus musculus
gatcagccttagttcttggtgatcaaataggaggcatgggataatttcaatatttttgtatctgtggaggcctgttttgtgaccaattatatggtcaattttggaggaggt

SEQ ID NO: 97058 - DNA, 85 bp, Mus musculus; identical to SEQ ID NO: 57439

SEQ ID NO: 97059 - DNA, 99 bp, Mus musculus
agtgatgatgcctgtgttggtaggaactgtaaatatgatgtagagtttaaatatctatatttgtcatcctctaccacacagtactttaactttattatt

SEQ ID NO: 97060 - DNA, 95 bp, Mus musculus
cttactactcctgtgcactggtcacttacctcaatgctggatgacaccactgtagtagctattgtgagaagtgagtcagctgaagctgtggtgag

SEQ ID NO: 97061 - DNA, 77 bp, Mus musculus
agaatacaatcttgcatgtgcacacatgtatgtgtgcatacatacatatatatgtgaacctctgtctgtctgtctct

SEQ ID NO: 97062 - DNA, 110 bp, Mus musculus
gatgactgacgttggttttgatttgacatttcagccgttgaaatacacaggcatcctcacactcacacacacagagccttcaacttgagatttgattggcatcagtcatt

SEQ ID NO: 97063 - DNA, 63 bp, Mus musculus
gcatggtactctgtcatcttgtccaaagatgagactgaagacagaggagaagatgataccagc

SEQ ID NO: 97064 - DNA, 85 bp, Mus musculus
ggccatgatggtctgataggatacatgggacaatttcaatatttttgtatctgttgaggcctgttttgtgaccaattatatggtc

SEQ ID NO: 97065 - DNA, 76 bp, Mus musculus
tatttatatgtctttgtatgtatgtacatacttattcatatttgtgtgtgtgcatgtgtatgtgtatatatgagtg

SEQ ID NO: 97066 - DNA, 74 bp, Mus musculus
ggttgtgagacactcggtgtcagtgctaggtaccaaactcgggtactcagcaagcacagggcatgtttttagct

SEQ ID NO: 97067 - DNA, 98 bp, Mus musculus
ttttatataaagcataagcaaatgtatgcctgtgtatatataaatagttatatatttacttataaaaaggtgcatacatcagcactatttatataaaa

SEQ ID NO: 97068 - DNA, 111 bp, Mus musculus
tgcagcttttgggcccattcattcttaggcatttattgagtatttgctatatgtcagacactgtgacactgcaagtacacagataaataagatatgatctctttcattgta

SEQ ID NO: 97069 - DNA, 87 bp, Mus musculus
tgctcgttagctctcagatttgacagagctgctgctgctgctgctgctgctgctgtgcccttccctgatttgaaagcactctgagca

SEQ ID NO: 97070 - DNA, 81 bp, Mus musculus
gtgtgcatgtgtatgtatatgtatatacatgaatgagtacatgtgtgcccccttgtagaatgtatgtttgcacatgtatat

SEQ ID NO: 97071 - DNA, 87 bp, Mus musculus
ggttgtgtgtcagaggccaggcctgactcacctcactctctctgtgtccttcaagagagtttgtcagcagcacttacacactcggct

SEQ ID NO: 97072 - DNA, 85 bp, Mus musculus; identical to SEQ ID NO: 57439

SEQ ID NO: 97073 - DNA, 81 bp, Mus musculus
gtcttcatagctgtctttctctgtcaaaggaatgctcatggatatacatgtacaccatgggtcacaggaaaagatgagggc

SEQ ID NO: 97074 - DNA, 79 bp, Mus musculus
ggccataacaaggactctgcctcactgtgagaatggcaaagccatgctatatgcggcagactaaaaagttacaaaggct

SEQ ID NO: 97075 - DNA, 115 bp, Mus musculus; identical to SEQ ID NO: 58705

SEQ ID NO: 97076 - DNA, 59 bp, Mus musculus
tatgtatgtatgtatgtatgcatgcatggtatgtatgtatgtatgtatgtatgtatgta

SEQ ID NO: 97077 - DNA, 96 bp, Mus musculus
cctgtgtgggtcttgtgtatgctgtcagggtctctgagaatgcttctgtgtgccagccctgttctgtgtctctgaggcaacctatatgtgacaagg

SEQ ID NO: 97078 - DNA, 96 bp, Mus musculus
agattggattacaaatcaggatgctctcttctggagaaggctgactcaccctctctcggaagcccttttattttaattacctgtagttcttcatct

SEQ ID NO: 97079 - DNA, 76 bp, Mus musculus
gcctctcctctgtgccaccactgatgagcatgtgtcacagcagccacaccctcactcagtgcttccaggggcaggt

SEQ ID NO: 97080 - DNA, 110 bp, Mus musculus
ttgtaatggagaacaggaaagatagtatgaatcacctgcctgagtccctgttaggcatatcctccagggttaccaggtagaaagtatttctaggattctgtggctgacaa

SEQ ID NO: 97081 - DNA, 124 bp, Mus musculus
gctgatagatttgagggttaggaggtgtggcctttttggagaaggtgtgtcactcactgggtgtgggttttgaggtttccaatgagcactctggctctccctctctctgctgcatacttgtgag

SEQ ID NO: 97082 - DNA, 118 bp, Mus musculus
ccattgtatggagctgctgtttcggagtccctaacgcaggatgagaaggtagtgtgattcttgttgtcacatctcgagactgtgcaggacgctggatactaatggctgcagatggtgg

SEQ ID NO: 97083 - DNA, 90 bp, Mus musculus
gcagggcatgcttgtgactgctgcgccttctctctagaccttggagaaaactctgaagtgtaagagatgaaagtgagctgttccctgcat

SEQ ID NO: 97084 - DNA, 88 bp, Mus musculus
gagacaggatttctctgtgaagcccaggctgtcctagaactcactctggagaccaggctggcctccaactcagaaatctgcctgcctc

SEQ ID NO: 97085 - DNA, 60 bp, Mus musculus
tgagggctggagagatggcttagtggttaatagcactgactgctcttcctgaggtcctga

SEQ ID NO: 97086 - DNA, 80 bp, Mus musculus
gtatgtatgtatgtatgtatgtatgtatgtatggctgccctggcaggctgacttatgtatgtatgtatgtatgtatatat

SEQ ID NO: 97087 - DNA, 88 bp, Mus musculus
ggcctcaccccaaccactgcctgtgactgtcactgtctgcgacgacatggaaacatgagacctgtccctagtctggcacaatggagcc

SEQ ID NO: 97088 - DNA, 100 bp, Mus musculus
atagtttaagtgagccccagggacctgtctatctctgtctcttggtactggggttccaactgcacagcaccatgcccaggttcttgttttgcttttctat

SEQ ID NO: 97089 - DNA, 75 bp, Mus musculus
gagctatgtcactggccatgtgtatgtatagatgtgagtatttttgacactatgtctctcactggcctgtagctc

SEQ ID NO: 97090 - DNA, 70 bp, Mus musculus
ggctgactcaacatggtcactcagtaggtgaaagtctatcacccctgtgttctgactcactgagagagct

SEQ ID NO: 97091 - DNA, 81 bp, Mus musculus
ggagagagagacacacacacacagggtcttgagcttctgaaatttcaaagcccaccacccagtgacacagttcctccaacc

SEQ ID NO: 97092 - DNA, 64 bp, Mus musculus
ggccagacacaacaggcaggagtggctagctagcccccagggttctgcctgtctcagtctctct

SEQ ID NO: 97093 - DNA, 107 bp, Mus musculus
ccttagtttttgttacttctcaaaatgtttgtttgcatgttgtatttgtgtatgtaggagtgcattgatgtaagggcatgtcacagcatgtgtgtgggaatctgagg

SEQ ID NO: 97094 - DNA, 85 bp, Mus musculus; identical to SEQ ID NO: 97064

SEQ ID NO: 97095 - DNA, 60 bp, Mus musculus
gacaggtgtcactgagagcctcagagacactgagtgatagctttctgatctccacctgtt

SEQ ID NO: 97096 - DNA, 114 bp, Mus musculus
cctcccagagcaatgaagtgtctttgcattcagcagaagaaagcattttgtatgtaagcaatcaggctgtactgcttatggggatgaattaaaatgtcttcaatgttcaacagg

SEQ ID NO: 97097 - DNA, 103 bp, Mus musculus
atgtttgagttatgggaattcaaactttcactgtcactctcggtatgagaccagtaattttctccttgcctttagacagtgggctgaaagccataaccagcgt

SEQ ID NO: 97098 - DNA, 60 bp, Mus musculus
tcatgtctcaaacagttctgtttttgttttatacaaaggacagaatttaattggggctgg

SEQ ID NO: 97099 - DNA, 68 bp, Mus musculus
agagagagagagagagagagagagagcaggggtagtctatgagtatgtgtctgtctctgtgttcctct

SEQ ID NO: 97100 - DNA, 95 bp, Mus musculus; identical to SEQ ID NO: 97060

SEQ ID NO: 97101 - DNA, 113 bp, Mus musculus
tcctctcttgtcagaagcaccataagctccagcagccctcagcctctctgagtctctaactctgaggggcaggagagggtgtgcactggcatggttactgtggggttaaagga

SEQ ID NO: 97102 - DNA, 106 bp, Mus musculus
atggcaggaaagataaggcacggtggctggtcacattgcatccacagccagaaacagagagatgacagttggtgatcagctagcaaccttgtcccttttatgctat

SEQ ID NO: 97103 - DNA, 88 bp, Mus musculus
agcacttggggtgtgattaatatctgtatctttggtcactgaatatttctgtgttgaatgcaaatatatagaaaacacccttttggct

SEQ ID NO: 97104 - DNA, 82 bp, Mus musculus
gtactgagagtggagatagaggtcaaatccccagtgtgcaaaattaggggcattacacaaaaccttttcccagactcatcac

SEQ ID NO: 97105 - DNA, 60 bp, Mus musculus
tgcttttgcagaggattgaagtttgggtcccagttactcaagccagtcagctcagaagca

SEQ ID NO: 97106 - DNA, 85 bp, Mus musculus; identical to SEQ ID NO: 57470

SEQ ID NO: 97107 - DNA, 91 bp, Mus musculus
aggtcaatagtggggatgtgtaatgtcattggatttgtatcagtagtggagatatataacaccactggattcacatcaatagtggggatgt

SEQ ID NO: 97108 - DNA, 106 bp, Mus musculus
gccttagtgcatggtgatctgataggatgcatgggacaatttcaatatttttgtatatgttgaggcttgttttgtgaccaattatgtggtcagttttggagaaggt

SEQ ID NO: 97109 - DNA, 71 bp, Mus musculus
ggggggtctaggtccagatactgcatgctctttagttggtgggttcagtctctgtgagcctccatgggccc

SEQ ID NO: 97110 - DNA, 112 bp, Mus musculus
tgggaggaacggggagggaaaactataattgggatatattttatgaggaaaaaaatctatttttttttgagagatagagtttctgtgtagccctggctgtctggaaaactca

SEQ ID NO: 97111 - DNA, 94 bp, Mus musculus
gtgggtcaggaatgccctgtattcatttcaggcttggcagttacttctgggattataattgcctgcctgcctgcctgcctgcctgcctgcctgc

SEQ ID NO: 97112 - DNA, 81 bp, Mus musculus
aggcttgctcaacaggtgagtgcagctgaccacatcttcttagtaagtgctgtgagtcctgctctctctgtctctctgtct

SEQ ID NO: 97113 - DNA, 77 bp, Mus musculus
caaactgtctgtctgtctgggtcggggcagtgtggtggcagtggttaccagttgtttcaagagagaacagtagtatg

SEQ ID NO: 97114 - DNA, 60 bp, Mus musculus
agcatcacatagagtggtggcagtagaagtcagcaccgtcactctcactcaggcgatgct

SEQ ID NO: 97115 - DNA, 88 bp, Mus musculus
gtctctggctctatctctgtgtgtggcagtttgggtattggtgagtgggcgggctcacacatactcacacacacctttgtcatgggat

SEQ ID NO: 97116 - DNA, 89 bp, Mus musculus
ggtgctttcaagttgagaagaaggcaaagacatggcactctgtctatctctctgtctctgtccccactctccactataatgaaagctct

SEQ ID NO: 97117 - DNA, 85 bp, Mus musculus; identical to SEQ ID NO: 64341

SEQ ID NO: 97118 - DNA, 62 bp, Mus musculus
ggggcggagagattgtaggagccagaataccaggaagtctgctgtcaaacagtctctcactc

SEQ ID NO: 97119 - DNA, 120 bp, Mus musculus
gttaaggaaatgaagtaagaccagcagggcactgaaccagaatgtaggaactcttctgatagtgttgacatctgggagatgtttctgaattggacagtgcttttacttttcagccctgat

SEQ ID NO: 97120 - DNA, 126 bp, Mus musculus; identical to SEQ ID NO: 92337

SEQ ID NO: 97121 - DNA, 68 bp, Mus musculus
gtgtctatgtctgtatctgtgtgtgtgtctgtgtgctcacatgcttgcgcatgtgcatgtatggatgc

SEQ ID NO: 97122 - DNA, 71 bp, Mus musculus
ggtgaactctacctgggctctgtgttcaggatcatggtagagacagtacagagagtccagtagagatagcc

SEQ ID NO: 97123 - DNA, 64 bp, Mus musculus
atgtatgtatatatgtgtatatatgagtgtgtgtacatgagtgtgtgtgtgtgtgtgtgtgtgt

SEQ ID NO: 97124 - DNA, 85 bp, Mus musculus; identical to SEQ ID NO: 57439

SEQ ID NO: 97125 - DNA, 90 bp, Mus musculus
gggacaactcattttctgcatctgcatctgtgagaattgtatctgatagatctaatagtaggagagaaaataatactttgatgttgtact

SEQ ID NO: 97126 - DNA, 81 bp, Mus musculus
ttcctgtgtgtgctagcatgtgcatgtgcatgtgggtgcaccccccccccccatgtaaacgtcaactgaagcccaaaggaa

SEQ ID NO: 97127 - DNA, 95 bp, Mus musculus
tgcttaagtcgacaaattgctatttcattaattgctaagaactggacagcttatcccttttcttagaaagtattagtaatttcctgtggaaagca

SEQ ID NO: 97128 - DNA, 65 bp, Mus musculus
gagacaggctctctgtgtccctgagacaggctctctgtatctctgagacaggctctctgcgtctc

SEQ ID NO: 97129 - DNA, 100 bp, Mus musculus
agatggttgtaagctgccatgtgggtgctgaaaatctaacttaggtcctctgaaagatcagtcagtgcacttagccactgagcaatatcttcagctttct

SEQ ID NO: 97130 - DNA, 66 bp, Mus musculus
gcctccttcagtctgttagtcactgtattaacaagcacagctgctgcaccaggccacggagaaggc

SEQ ID NO: 97131 - DNA, 92 bp, Mus musculus
gggctttgtaaacactttgagagtagagagagattcaggggtagatgcttcccctcgggtcagtctgagatgctaggatgttctgcttgcct

SEQ ID NO: 97132 - DNA, 94 bp, Mus musculus
accaaattacaggctggagagatggctcagcggttaagagcactgactgctcttctagaggtcctgagttcaactcccagcaactgcagggtgg

SEQ ID NO: 97133 - DNA, 92 bp, Mus musculus
gtcagagcattccaaagtctctcactctctgtgtgtctgcctgcagttctctgtattggtccccatttgctgaaggagggagcttttctgat

SEQ ID NO: 97134 - DNA, 86 bp, Mus musculus
gcatgtgtgtgtgcatgagcatgagcatgtatgtgtgcaggagcatgtgtgtatgcatgaacatgagcatgtatgtgtgcaggagc

SEQ ID NO: 97135 - DNA, 75 bp, Mus musculus
ggtgctttgcggctctgcacacatcctccacagcgctgtgccgctctgtgaggctctgtgcatgccctccacact

SEQ ID NO: 97136 - DNA, 92 bp, Mus musculus
gctcagaataacaatttctccatcagcaatctatcttttttttaaacaacaagaaaagtggagaccgttatggtgactctgtgggtaagggc

SEQ ID NO: 97137 - DNA, 66 bp, Mus musculus
catgtgtgtgtacatgtgcatgtgcatgtgtgtatgtgcacatgtatgtgtgtgtgcaagtgcatg

SEQ ID NO: 97138 - DNA, 94 bp, Mus musculus
tctgcagtcactatctctctctctctcacacacacacacacacgcacacacacatatgagagagagagggagagagagagagagagagagaggg

SEQ ID NO: 97139 - DNA, 77 bp, Mus musculus
gagtatgtgagtgcctgtgtgcctctgtgcccgtgtgcatgtgtttacaataggctcacgggcagtgtgaacatttc

SEQ ID NO: 97140 - DNA, 97 bp, Mus musculus
acttttttcctttagaaattcgtgtgaatgcctgcatgtatgtctttgcaccacatgtgtatttgatgttcacagaggccagcagaaggtgttgggt

SEQ ID NO: 97141 - DNA, 70 bp, Mus musculus
atgtatatatgtatatgtctgttgtatatacatacatgggtagatatgtgtgtatgtgtgtaagtatgca

SEQ ID NO: 97142 - DNA, 102 bp, Mus musculus
cctaagtgcaggcaaaacattcatgtataaagtagcctaatctaaaaatgtttgttttaggtcgtacacagtggccacatgtctgtattcttagtacttagg

SEQ ID NO: 97143 - DNA, 74 bp, Mus musculus
ggtggcctgcctgtctgcctgtgagcgtgtcagaagccccggaactggagttacaaaaacaggtgtgagctgcc

SEQ ID NO: 97144 - DNA, 117 bp, Mus musculus
atctgtggggttttgtttttaagatttattttcaggggccagagagatggctcagtggttaagagcactgactgctcttccgaaggtcctgagttaaaatcctagcaaccacatggt

SEQ ID NO: 97145 - DNA, 90 bp, Mus musculus
gtatagctgctgttatttgtttatatatgtctatgaagcaacatgcttttgccacgtgaagactgaacttgtaataatagtatgctttac

SEQ ID NO: 97146 - DNA, 65 bp, Mus musculus
ccaccagagatacatagtgaaaccctacctacctctaaagagactcactgtgtgtctagggctgg

SEQ ID NO: 97147 - DNA, 120 bp, Mus musculus
gcaaataagtgttaaaaatgtgggctggagagatggctcagtggttaagagcactgactgctcttccagaggtcctgagttcaattctcagcaaccacatggtggctcacaaccatttgt

SEQ ID NO: 97148 - DNA, 100 bp, Mus musculus
attcttaatctcatagaattacaaagccaacggggcttgaccttgtccccgtcaaaccctgttctgggcaatgttgtttctgtgttgtcactataagagt

SEQ ID NO: 97149 - DNA, 144 bp, Mus musculus
ggtggccacacaattttataggttaaactactgctttatccatgtttaaaaggtttgaaaacaacagtgaagacagtgagctgacagggttgtgaggcggctcaatggttacaagcactgctttgcacaggaccttttcaactc

SEQ ID NO: 97150 - DNA, 98 bp, Mus musculus
ttctcgacgtccgcgacactcgggcgaagtgatggggaactgtctcactgtctgcgcggtacctcttgaatccgttgtccggagggtggtcatacctc

SEQ ID NO: 97151 - DNA, 74 bp, Mus musculus
gaaatctgagtctgactctgtctgggataagagtgaactccccccacaccttttattagagatagattcttttc

SEQ ID NO: 97152 - DNA, 96 bp, Mus musculus
accattgaggtggggctggagagatggctcagtggttaagagcactgactgctcttccagaggtcctgagttcaattcccagcaaccacatggtgg

SEQ ID NO: 97153 - DNA, 102 bp, Mus musculus
tgcctggctaaagactgtcttgtgactctgtccctgtgtcagcctgagcaattttacagaaagctttgacagagttcacaagggattaagtcattggttgca

SEQ ID NO: 97154 - DNA, 92 bp, Mus musculus
tacagagcactattctacctgtttcttatctatgtctctccgtctcagccagaattgaagcttagcagagatttaggcagatagtgccttta

SEQ ID NO: 97155 - DNA, 86 bp, Mus musculus
aaatgggggaggagaggagggaagatagagggagagggagagatcctctgtctgtttctctcaggtggactcaagagcccctgttt

SEQ ID NO: 97156 - DNA, 74 bp, Mus musculus
ctctgtatcagtgtgtgtctgttactcaggatggcaccaagaacctggggtttggaatatattctaccacagag

SEQ ID NO: 97157 - DNA, 82 bp, Mus musculus
cggaagacagactaagtttgaagttaaagtctctggctggtcagctggtagtagttttatagttttaaacttgttctttctg

SEQ ID NO: 97158 - DNA, 108 bp, Mus musculus
ttttctaaagtgctccaggtccagtccatcccacacgtcaagttgctgattttgttccattgtaagaagagtgtgtgcagactgcttagccggaggaagtgagcaaaa

SEQ ID NO: 97159 - DNA, 101 bp, Mus musculus
gatggatttttaggtcatttactttaaagagacttttttttttttaaaagagtcagtacttgaatatctgaggagtattctgagactgaaattattaggtc

SEQ ID NO: 97160 - DNA, 82 bp, Mus musculus
tgaatcctgggtcaactctgcctcctcctcagcaaacatcttcacagccagggtggggtggagagaagacagacagcagtca

SEQ ID NO: 97161 - DNA, 90 bp, Mus musculus
tactttaaatgtatattttgataaatatattttgtgtgtatatatatatatatataaagagggatttattagaatagcttataggttgtg

SEQ ID NO: 97162 - DNA, 92 bp, Mus musculus
ggcagaggttttgatagcaagtactttaaaattgtttcagtgtttttaatatattactttggttgaagtatgataagctattgaactttgct

SEQ ID NO: 97163 - DNA, 85 bp, Mus musculus
agaccagcatcactgaggtgaaatcttctgggaagtgttttctgagagaacagagatagccaaggttgtacctcatgctgcagct

SEQ ID NO: 97164 - DNA, 66 bp, Mus musculus
cccgctgtctctctgtcagagtggctgcagttattaccgaagagcttaggcaggtcttaggcgagg

SEQ ID NO: 97165 - DNA, 101 bp, Mus musculus
gaaatactagtgtcgggctggagagatggctgaggggttaagagcactgactgctcttcaaaaggccctgagttcaaatcccagcaaccacatggtggctc

SEQ ID NO: 97166 - DNA, 84 bp, Mus musculus
tgggtgtggagcttgagcattaggctagactggctggccagcgggccccagggatctgcctgtctctgcgtctctgcataccca

SEQ ID NO: 97167 - DNA, 89 bp, Mus musculus
ggcggggtgagttttagagatgggtgattctctctcactgacctaagtgcttacaggagactctttttcatctctgtaacacactagct

SEQ ID NO: 97168 - DNA, 103 bp, Mus musculus
ggactgaggcttaatgaggctggagagatggctcagtggttaagagcactcactgctctttcagaggtcctaagttcaattcccagcaaccacatggtggctc

SEQ ID NO: 97169 - DNA, 114 bp, Mus musculus
ctcacagagattggtctctggccctcagtttaccccaggctcagagcagacagagcacaggtttagggtctttcctgtgctgtgagcagccgggagggccagtccctgtgtggg

SEQ ID NO: 97170 - DNA, 91 bp, Mus musculus
agaggcgcagttcccactcactctcactggctctaccccatcccaaaggagggcagcagtaggggctgaggacatgggcagtgttccctct

SEQ ID NO: 97171 - DNA, 84 bp, Mus musculus
tatgtgtgtgtgtatatacatatgtatgtatatatgtgtgtatatatagatagatagatatagatatatatacatacatacatg

SEQ ID NO: 97172 - DNA, 78 bp, Mus musculus
aattcaaggtcaggggctggagagatggctcagtggttaagagcactgactgctcttccagaggtcctacgttcaatt

SEQ ID NO: 97173 - DNA, 81 bp, Mus musculus
gtgatcttgggtcagtcagtgtgtgagacttgagagtcacaaactatcacacaggtaaaacacagggagtgttggggtcac

SEQ ID NO: 97174 - DNA, 77 bp, Mus musculus
gtgggtcagctcagttcagtcggtggagcctgtggtctgggctgtctgccaactgtctgtctgtctgtctgaccgac

SEQ ID NO: 97175 - DNA, 102 bp, Mus musculus
agggataatgcaaggaaggctggccagacttcaaaaagtagtgccacagagatgagatagtgcacagcaggtgctggctgtgctcctgaagcagcggttcct

SEQ ID NO: 97176 - DNA, 62 bp, Mus musculus
ccagtctctctgtctgtctgggacaacaggagatctgtgtccttgagagcatgggagcctgg

SEQ ID NO: 97177 - DNA, 114 bp, Mus musculus
tgtgagcatcacgtgtgtgcaatgcactgcatgcccaggaggccagaagaggttgttggatcttttggaactggagttatgaggtggttgtgagctgctatgtgggtgctggga

SEQ ID NO: 97178 - DNA, 116 bp, Mus musculus
gcctcccttctcaggtctgtcacctcttacccagcctcccaccttgcaaatccccctgacagaacagagtggggactgactgggaggggccaggaccttttggaacagaggaaggc

SEQ ID NO: 97179 - DNA, 68 bp, Mus musculus
ttaggctaaccttgtgaggagggatgctgggggccctgagtgctgtctctctcagaggggtgcgctgg

SEQ ID NO: 97180 - DNA, 72 bp, Mus musculus
cagctctcagaagaggctcagaatgcaggttcacttagagcagacagttctgccagcctctctgtttgtctg

SEQ ID NO: 97181 - DNA, 93 bp, Mus musculus
gggtcctcaggcttgctcatcaggtgcatggctgactgttctctcactatccctgctgtctgtctgtttgtctgtctgtctgtctctggtctc

SEQ ID NO: 97182 - DNA, 68 bp, Mus musculus
agctagagagggacaggtggcacccggactcagaacctattgtcgcactatgcctctctgtctcactc

SEQ ID NO: 97183 - DNA, 114 bp, Mus musculus
gcccttgaaaatgacccttcccctatcatctagtctacgtggtctcagtgtctctctgtttctgttgtgatatgggggtctttaggtgatgctgtgaataggtcaaccttgggt

SEQ ID NO: 97184 - DNA, 115 bp, Mus musculus
tgagtgtgagtgtgtacatgtatatgtatgtatgtgtatatgtatgtatatatgtatgtatgtatatacatgtgcatggacattctccagtgtatgtgtatacatgaagaagtca

SEQ ID NO: 97185 - DNA, 90 bp, Mus musculus
tatgtgtgtgtgcatgtatatgtatatatctgtatatatgcatgtatacatgtgtgtacatatatatgcatgtacacacatacatacata

SEQ ID NO: 97186 - DNA, 63 bp, Mus musculus
gggggctgggcagtgagaggctgtcacttccttctgttaggcagcctctgtctgtctgtcctc

SEQ ID NO: 97187 - DNA, 59 bp, Mus musculus
gggaagaagaggcaagaagcaggcgctctatcctggccctgtctccctctctgatactc

SEQ ID NO: 97188 - DNA, 90 bp, Mus musculus
gagtcatagtaagacacagtatctcagctttcattcatcgtctcaatagaaaagggatttagagaagacactgattgtgttgtgtgactt

SEQ ID NO: 97189 - DNA, 128 bp, Mus musculus
gttgaagaaacttcctggctgctttcctgtctttctatatcattcatgtacaaagtaaacatccatcactcaaacttggagatgtaagaagactgaaatagatatgaagtggtagtgacttagaagta

SEQ ID NO: 97190 - DNA, 64 bp, Mus musculus
gtggtaccctcagctttagattttgataaagtttcattatttttatcagagttgtggttatcac

SEQ ID NO: 97191 - DNA, 73 bp, Mus musculus
gtataagggacgaggctggagggatggctcagtggttaagggcactgactgctcttccagaggtcctgagttc

SEQ ID NO: 97192 - DNA, 73 bp, Mus musculus
cctgtctctctctatctctccgctcttctccttacctcaggaacctgaggtgcagcaggaagtagtaagcagg

SEQ ID NO: 97193 - DNA, 102 bp, Mus musculus
aggcctgcagtcgcctcccaggagcagagaagagtgacaggagtggcgctatgcagcctgtctctcctgtgtttgcccaggacgcacagaggaaggcggcct

SEQ ID NO: 97194 - DNA, 73 bp, Mus musculus
ttgtgtgtatgtgtctctgtgtgagttcgtgcgtgtgaacacaggcaggtgccctggagatggagttaggcag

SEQ ID NO: 97195 - DNA, 87 bp, Mus musculus
tatgtatatgtacacatatataaatacatagcatatatacatatatatgtatatgtgtatgtatatatgagtgtgtgtgtatatata

SEQ ID NO: 97196 - DNA, 117 bp, Mus musculus
aggtatgcaccaccactgcccggcttaaatagttttgtttcttaagattttttttttttcttttttggttttttaagacacaatctctctgtgtaacttgggttgtcctggtaactt

SEQ ID NO: 97197 - DNA, 56 bp, Mus musculus
acatacacatacacgcacacatatgtgtatctgtgtgtgtgtgtgtgtgtgtgtgt

SEQ ID NO: 97198 - DNA, 62 bp, Mus musculus
cacaggaggtgggctctgaggtttctaaaacccataccaggctcagggtctctctgtctgtg

SEQ ID NO: 97199 - DNA, 68 bp, Mus musculus
ttcctctgtgtgtgtatgtgtgtgcatgtgtggaacatatgtatgggctttgtgtatgtggtcaggaa

SEQ ID NO: 97200 - DNA, 71 bp, Mus musculus
gctctcttttaaggcactggtatacactgaaggagagtagtgtgtgtgtctctatgtgtctctgtgagagt

SEQ ID NO: 97201 - DNA, 113 bp, Mus musculus
gagctttatttaaagattaatatgtggagttgaagagatggctccgtggttaagagcactgactgctcttcctgaggtcctgagttcaattcccagcaatcacctggtgactc

SEQ ID NO: 97202 - DNA, 108 bp, Mus musculus
aagaatttgtcctagatttcctggacaagaccttaaggcaatgccatgctagattcatatctcaggcagattacaggtcttacaaaaaataattggccatatattctt

SEQ ID NO: 97203 - DNA, 58 bp, Mus musculus
tcaggccggagagatggctcagtggttaaagcactgactgctcttccagaggtcctga

SEQ ID NO: 97204 - DNA, 66 bp, Mus musculus
gtgtttgtgcatgtgcaggtgtgtgtgcatttgtgtgtatgactgtctctgtgtgtgtatgtatat

SEQ ID NO: 97205 - DNA, 104 bp, Mus musculus
tgagatgtctactagagggctggagagatggctcagcgattaagagcactgactgctcttccaggggtcctgagttcaaattccagaggccacatggtggctca

SEQ ID NO: 97206 - DNA, 81 bp, Mus musculus
gtctctatcacatgggctactgaactgtgagaggccaggccgcaccttcccctcccagtcctatccatctctgaccttgac

SEQ ID NO: 97207 - DNA, 62 bp, Mus musculus
tatacatacatacatacatatatatcaatcagagactgtatatatgtatgtatgtatgtgtg

SEQ ID NO: 97208 - DNA, 109 bp, Mus musculus
tgtataagcaagctctaggaaactttgaagaattacattgaaaagtaaatatgtttgatgctaattaatttttaccagtcgaagttacctttacttgcactaatataca

SEQ ID NO: 97209 - DNA, 73 bp, Mus musculus
tccctaaccctgttctgtctctgtgtggctggaaataaggagttatcaaagcagagtagaagagcaacaggga

SEQ ID NO: 97210 - DNA, 116 bp, Mus musculus
gccttattccatgttgatctgattggatgcatgggattatttcaatatttttgtaacggttgagccctgttttgtgaccaattatgctgtcaattttggagaagataacatgaggt

SEQ ID NO: 97211 - DNA, 74 bp, Mus musculus
tgtattaccaccatctggctcattttgttatttttatacaacatagatgagcctgaaggtcattaagtaaaaca

SEQ ID NO: 97212 - DNA, 85 bp, Mus musculus
ggccatggttgtctgataggattcatgggacaatttcaatatttttgtatctgttgaggtctgttttgtgaccaattatatggtc

SEQ ID NO: 97213 - DNA, 84 bp, Mus musculus
tcacaattacaaacttatatatgtatatgtatgtgtatacatgtatgtatacacacacacatattttgttgttgttgttgatga

SEQ ID NO: 97214 - DNA, 69 bp, Mus musculus
caaaatggtgacagaagtcagtctgccttgaaaccatcattgctaggtcaagctgactttgccaggttg

SEQ ID NO: 97215 - DNA, 85 bp, Mus musculus; identical to SEQ ID NO: 57470

SEQ ID NO: 97216 - DNA, 85 bp, Mus musculus; identical to SEQ ID NO: 57470

SEQ ID NO: 97217 - DNA, 85 bp, Mus musculus; identical to SEQ ID NO: 57470

SEQ ID NO: 97218 - DNA, 77 bp, Mus musculus
gcagagcctggtggtgaccgtgcaggaccatggccagccccctctctccgccactgtcacactcaccatagctgtgt

SEQ ID NO: 97219 - DNA, 97 bp, Mus musculus
ggggacttacttgtgggtgacagaatagacagagagcaggtttgcgggaagcagcctcagtgtgttttggagttcgatattgtcgctgagaagccct

SEQ ID NO: 97220 - DNA, 99 bp, Mus musculus
agccgagtcttcctgtatcaataaaggctcatttttctcacagccctcctgactgatgagtgtgtgggcatagttgggctgggggaagatcagatggct

SEQ ID NO: 97221 - DNA, 91 bp, Mus musculus
caccttatctttttgagtcagggtctctcactggcacttggggtttgaccagttaaactagggctagccagactcatcccgtaaaccggtg

SEQ ID NO: 97222 - DNA, 115 bp, Mus musculus
gtgtttgtatgtaagagtgcatatgtatatgtgtgtgtatgaatgtgtgtatacatttatgtatatatatgtgagtatgatgtctgtgtacatatgtaagtgtatatgtatgtat

SEQ ID NO: 97223 - DNA, 68 bp, Mus musculus
aggccatcaccagcatgcatatatatatatatatgcatatatatataaatgtgcattggtgtttgcct

SEQ ID NO: 97224 - DNA, 68 bp, Mus musculus
aggcaaacaccaatgcacatttatatatatatgcatatatatatatatatgcatgctggtgatggcct

SEQ ID NO: 97225 - DNA, 98 bp, Mus musculus
gagcagccccctcacataccatgtcccctgtggcccctggcaagaattcatcaacccaggcacacacagtggctctgtgtattgggcgcaagaagctc

SEQ ID NO: 97226 - DNA, 83 bp, Mus musculus
gacacccatggttgtcttctggtctgcacacacccacaaccctaaatggagatagacagagacagacagagaccaagtgtgtt

SEQ ID NO: 97227 - DNA, 79 bp, Mus musculus
acacttggtctctgtctgtctctgtctatctccatttagggttgtgggtgtgtgcagaccagaagacaaccatgggtgt

SEQ ID NO: 97228 - DNA, 91 bp, Mus musculus
ttaaagctgtgccccatctcactgagccctacaaagcctttctaagaacacacggaggacagggacaaggaggtggtgtctgcagctggaa

SEQ ID NO: 97229 - DNA, 68 bp, Mus musculus
tgaggtgtctctcagcctgactgtcaccctcagaaagggtgttttcaggaaggagagtcacacactca

SEQ ID NO: 97230 - DNA, 83 bp, Mus musculus
ggcagctgagctgtctgtctgtgaggtagtctggcctcccttgctgaatgaagactatatgtggacatatttcctcagccgtt

SEQ ID NO: 97231 - DNA, 66 bp, Mus musculus
gcagggtgactaaagacaggcagaactgggttccaattccatctctgtcactgccagtctttctgt

SEQ ID NO: 97232 - DNA, 98 bp, Mus musculus
acttagatataaatccctttcaggtctgtcactgtccagatgtgtaactttgtttcccagacagacagaccgacagaccgtaaggtgagttctcaggt

SEQ ID NO: 97233 - DNA, 57 bp, Mus musculus
ggtctgtcggtctgtctgtctgggaaacaaagttacacatctggacagtgacagacc

SEQ ID NO: 97234 - DNA, 106 bp, Mus musculus
gcatatcattatccagccaatcctcttagctacctctcgaattaagtatacaagtatgtccattttataggtggaaggataagcccagggagaagatgtaattggc

SEQ ID NO: 97235 - DNA, 90 bp, Mus musculus
agatcatctacccagcttgtcctgtgagcctctgtctctgcctcccagctgctggaattacaggcagactgccacgcctggctagactct

SEQ ID NO: 97236 - DNA, 66 bp, Mus musculus
cttgctctgaagactgggctggcctcaaactccgagatctgcctgtctctgtctctccagtgcagg

SEQ ID NO: 97237 - DNA, 76 bp, Mus musculus
gtatacactgccactctcagcttgttgattgtagctatttgttttaattagattgatcgattgagaggcagtatac

SEQ ID NO: 97238 - DNA, 94 bp, Mus musculus
tgttacttatatatgtgcatatatttgcatgtatatatatgtatgtgtatgaatatatgtatgtatatgtgtgtgtgtatatatatatatatca

SEQ ID NO: 97239 - DNA, 115 bp, Mus musculus
gcctgccatgtggatttcttgtgatctgtgcagacacccaaaggtgccagacactcccacactcagctgatcaccaggtcctgcaaaaatcaccctcatcctttcacattaggca

SEQ ID NO: 97240 - DNA, 74 bp, Mus musculus
gaaactcctggcttctaaaccagtgtcctcagcagtgcaggaatgagactgaggtcacatggtgcttatgtttc

SEQ ID NO: 97241 - DNA, 83 bp, Mus musculus
tctatctatctctatgtgcatgtatgtatatatatatatatatatatatatatatatatatatatatatatggttaaaataga

SEQ ID NO: 97242 - DNA, 97 bp, Mus musculus
ggtactttggcggtgtttcctgaaatctgaggttggacacaactgaaaaagcaaagtgagttagtgcttcaggaagtgggaaagctgccacttcacc

SEQ ID NO: 97243 - DNA, 77 bp, Mus musculus
gagctaggacaccaggagcagaggtgctgaggtgaccctaagaactcactctacagactgtcctctcatctgagtcc

SEQ ID NO: 97244 - DNA, 85 bp, Mus musculus; identical to SEQ ID NO: 58391

SEQ ID NO: 97245 - DNA, 82 bp, Mus musculus
gtctggcaggcacactgtctctgactggacagggccagcctaagacggttccctgggctgttgcacagtgtgctacataggc

SEQ ID NO: 97246 - DNA, 109 bp, Mus musculus
aggggcatcactgaggttgaccgacttcattcaaacactgcttccatcgctcagaagtagatgcttggaaagttatcggtccactctgaacctgaacagtcacgtttct

SEQ ID NO: 97247 - DNA, 64 bp, Mus musculus
gacaattggacagagagatctttgcccatctggaggacatcagagtctctgtgtctcaggggtt

SEQ ID NO: 97248 - DNA, 80 bp, Mus musculus
ttgtctgtgggtgcgcatgtatgtacagatatgcatgtacatttatgcatatatatatatgtgtgtgtgaggatagatag

SEQ ID NO: 97249 - DNA, 108 bp, Mus musculus
cttcctgttgcatagttccttgctaataaaagctaactctggggctgggatgttctcagtagtaagctgtttgcttagcaggaatctggctcctacccaagcaggaag

SEQ ID NO: 97250 - DNA, 88 bp, Mus musculus
ggtactctgtatggatctgagtgtgacctggctggctggctggctggctggctggctggcctgagttggcatatcaacctgctgtccc

SEQ ID NO: 97251 - DNA, 91 bp, Mus musculus
ggccagggccgtctggttctcagactctcggacacccaggcgtccctgggaaccgtggaagagctgagaatgaagtgggggcccaagggct

SEQ ID NO: 97252 - DNA, 93 bp, Mus musculus
gaaagaccagagtcacagaacaaagacagctgactcaactgcccagacctgtgggcattgctctcagctcaggtgatctgagaaatggcttcc

SEQ ID NO: 97253 - DNA, 126 bp, Mus musculus
agaggaagtgtgtcactgggggagggctttgaggtttcaaatgtttaagtcaggctcagtctcactctctctgtctgctgcctgccaatccagatgtagaactttcagctccttctccagcaccat

SEQ ID NO: 97254 - DNA, 56 bp, Mus musculus
ctgtctcagacactgtctaaaggagttgccatggttttccttggcagtggggatag

SEQ ID NO: 97255 - DNA, 87 bp, Mus musculus
caggtagactggaataaattagtcctcttgcttctgaaaggactaggagaaatggttgactagagattttgtggccagaattcactg

SEQ ID NO: 97256 - DNA, 62 bp, Mus musculus
agggacttatatcctggacttcaccttgtagtgctacagagtcacaggctgtgtctgtctct

SEQ ID NO: 97257 - DNA, 105 bp, Mus musculus
gaagtgagagcgccagcaatctacctttagagagctgtgtacccagagtgttgagtgacaccaggatagctactaagaagcagtgaatttgagtattcttacttt

SEQ ID NO: 97258 - DNA, 85 bp, Mus musculus; identical to SEQ ID NO: 57470

SEQ ID NO: 97259 - DNA, 64 bp, Mus musculus
ccaattgcattttacagtgctcagccattggttcccacactctgagtcactgttacggcaatgg

SEQ ID NO: 97260 - DNA, 93 bp, Mus musculus
tatatatacatgtatgtatatacatacatatttatgtatatacacatgtatatatatatacatattatatatatgtatatgtatgtatgtaca

SEQ ID NO: 97261 - DNA, 83 bp, Mus musculus
aggaacaactgtacatgtgtggatataagtatgaaacagacacatggcattatatatgttcatatatatacacatgtaagcct

SEQ ID NO: 97262 - DNA, 112 bp, Mus musculus
tacctggtcctcagaacacccctgcttagagtgcagactgtgtgcacagagcctctcgtctctgtttcccccacagctctctatttctctaaagaatgtctaggatcaagtg

SEQ ID NO: 97263 - DNA, 118 bp, Mus musculus
atgatctttgtctatgccacccagaacagcctctctgagtttgttgactgaagactgtgtcctcatctctaaattggtatgctggatcagggtgtagagactctaggaccttcctcat

SEQ ID NO: 97264 - DNA, 115 bp, Mus musculus
gatattaggcttttctgagatcttcatatagcctgaattttaatcctttgtcatacaaatggttggcaaagatttttctctcatgctgtgagctctctctacttagttgattgtt

SEQ ID NO: 97265 - DNA, 80 bp, Mus musculus
catatacatgaatatatgtacatttgtgtttatgtatatgtacatacatacatacatacatacatacattcatatacctg

SEQ ID NO: 97266 - DNA, 74 bp, Mus musculus
gtatatgaatgtatgtatgtatgtatgtatgtatgtacatatacataaacacaaatgtacatatattcatgtat

SEQ ID NO: 97267 - DNA, 106 bp, Mus musculus
ccttcttttagctgtagcattctgtccaacctgtgcttttgaaatacctgtctttatttatttatatcatgctcaggtggatagtggaatctatagtcttggtagg

SEQ ID NO: 97268 - DNA, 101 bp, Mus musculus
agatatactctctgcctctgtctctctctttatgtgtgtctctctctcacacacacattaacatacagaaagagagagagaaagagagagagagactttct

SEQ ID NO: 97269 - DNA, 110 bp, Mus musculus
gacttggtggttgatggctagttgtctttgtcaaattgactagactcagaatcaccatggagttgagcccatgggaggctctgtgaagcagttttcaagagatttagcta

SEQ ID NO: 97270 - DNA, 85 bp, Mus musculus; identical to SEQ ID NO: 57439

SEQ ID NO: 97271 - DNA, 77 bp, Mus musculus
agttcactcaaactgcatgtgtatgtgtgtgtaactgttaccacacagtgtgcacacatgtggtagcacacggagct

SEQ ID NO: 97272 - DNA, 64 bp, Mus musculus
catctagcaatcactgatgagtgtctgctgtgtatgaggcagacctgtggtggcaagtcagatg

SEQ ID NO: 97273 - DNA, 97 bp, Mus musculus
agtgcatatgcacattttctgttggtgagagactaaagagagtacagatttttttctttcccctttttagtgcatgtaaacactgatgtggtgtgta

SEQ ID NO: 97274 - DNA, 122 bp, Mus musculus
tgaccctcagggtatctgtgtgcaagtggctcatggaaactcttcagcccattgtctacagtaaacagtgagtagaaaggtgaaaagatatggcttccaggttattttggattcagatgctc

SEQ ID NO: 97275 - DNA, 116 bp, Mus musculus
tacattgaactagaagagcaagggcaattaagaaactaatttggtcaagtgaaagtatattatttttcttgttcaaatataaaggttctattgcttgaattcagtgtgttattctg

SEQ ID NO: 97276 - DNA, 105 bp, Mus musculus
tgggaaccaagagtcagatttgtggctaaaatgagtgcagagtgaccacagtgatgccagcgctgtcaactagctcatctcatcacagtctggacttccaaaccg

SEQ ID NO: 97277 - DNA, 127 bp, Mus musculus
caagcaccacctgatggctggctgtggatctccacatatgtttccattagatgctgagtgaagcttgtcagcagacagttatttcaggcacctgtctgcaagcatagcagagtatctatcattaata

SEQ ID NO: 97278 - DNA, 81 bp, Mus musculus
aggatgtttgaggttctttgagtctctcaaactcagtggatctttgtgggatgactcagataattagttctaaacaggcct

SEQ ID NO: 97279 - DNA, 85 bp, Mus musculus; identical to SEQ ID NO: 57439

SEQ ID NO: 97280 - DNA, 88 bp, Mus musculus
gagtgaacgtcagaagtgtctttgattgtcagtgaagagtgaggagaatccatactggaactagaacaaggttgcttatggcttcctc

SEQ ID NO: 97281 - DNA, 80 bp, Mus musculus
gggaggaaacagtttatgggcattacacttcctggtcacagtctatctgtcactgagggaagtcaagacagtttctgatc

SEQ ID NO: 97282 - DNA, 93 bp, Mus musculus
tttgtctatgtctcctgaatgctgggatttaagaaagatgtgtgtcaccacacctgaccttaaccatctctttgttgtgggaaggtaggcaga

SEQ ID NO: 97283 - DNA, 119 bp, Mus musculus
gaatgggtaatgttgaggctgcaactaacacgtggtggacactgttgacttgtgttttacttgaaaatattggaaaataggcaacttcttatgttagttgattaactgtttttctagtc

SEQ ID NO: 97284 - DNA, 70 bp, Mus musculus
gtctgtcactgaggatgggctttaagatttcaaaagtcctcaccaagcccagtcagtcagtcagtcagtc

SEQ ID NO: 97285 - DNA, 75 bp, Mus musculus
ggcctggtgtgtgagtcagcctaggtggatggatctgagccctcactgggactgttctgctgcaacatatgggtc

SEQ ID NO: 97286 - DNA, 60 bp, Mus musculus
ggagacagtgtctctcactgaccagttatctagacagactgatctgggagctctgttttt

SEQ ID NO: 97287 - DNA, 85 bp, Mus musculus; identical to SEQ ID NO: 57439

SEQ ID NO: 97288 - DNA, 107 bp, Mus musculus
atctaatcctttacttataacatttgtttcatgtgaatatttgtttttctagtcctgtatgagaactttctagagtggtgcctgtgtggaaaggtggaggaaggggt

SEQ ID NO: 97289 - DNA, 99 bp, Mus musculus
tttggtgcatgttatcttgatatagtatctaaaaatctatccataaatctgtggtaaaagagattatttcctgtgctttgtctatgacatgattttgag

SEQ ID NO: 97290 - DNA, 121 bp, Mus musculus
ctctggcttctaaaggatcacatgataactatggactgctttgggaacagtactgattatgattaattattgactctaaaacttgtagccattgttattatattaattaggttaatggagc

SEQ ID NO: 97291 - DNA, 89 bp, Mus musculus
tattgttcaggttccatatgtatatgggctttctattatttatattgttattgaagatcagccttagcctgtggtgatctgataggatg

SEQ ID NO: 97292 - DNA, 120 bp, Mus musculus
ctctttgcctcttcttcccatctctttgcaatcagtattatctcagacaagagacacagctcaactctgtgatgcattgctgagaaaatgaagattgtggagaaaggcaagaagagagag

SEQ ID NO: 97293 - DNA, 84 bp, Mus musculus
tagtcacctgtgatccagtgcactataactgtcctcattagagatgttcatggtaaaatagtgttgtctggacatagccaacta

SEQ ID NO: 97294 - DNA, 116 bp, Mus musculus
ccacaggctcccaccctcaatggacattggctccagtcaagtgcttacagtgttaggagaatctgagaacaaagtgagcactattagccaagtgctagctttgggtgcttgtggct

SEQ ID NO: 97295 - DNA, 129 bp, Mus musculus
tactttcatatatttatacatatttataagcaccatatttatatatgtatatgcatatatgtgtatatatgtatatgtgtatatgtatgtatgtatatacatatatatgtatactgtttgtttatatac

SEQ ID NO: 97296 - DNA, 64 bp, Mus musculus
ggccacagaactggatgaaaaaagcaagggtaaaggtccaggtttcattcagctttctgttgtc

SEQ ID NO: 97297 - DNA, 118 bp, Mus musculus
tatataattattgagtttgctaatacatatatgtgcatgtatgtgtgtgtatatatatgtatgtgtgtatgtgcttttatatttgtgtgctgtgtgtttgtgtatgcttatgtgtata

SEQ ID NO: 97298 - DNA, 62 bp, Mus musculus
tatgtatgtatgtatgtatgtgtgtgtatgtatgtacatgtacatgtatatgtatatgtatg

SEQ ID NO: 97299 - DNA, 92 bp, Mus musculus
gtgggaacctgaaagcagtaactaagacagaagtcatagaggaaagatactggcttgtttcatcttggcttgctcagctttctttattatac

SEQ ID NO: 97300 - DNA, 85 bp, Mus musculus
ggccatggtagaatgataggatgcatgggacaatttcaatatttttgtatctgttgaggcctgttttgtgaccgattatatggtc

SEQ ID NO: 97301 - DNA, 79 bp, Mus musculus
tttccacattgctcttcttcactgaaggaagtcaggactggaactcaagcaggtcagggagcaggagctgatgcagagg

SEQ ID NO: 97302 - DNA, 91 bp, Mus musculus
acttactagccatctctctgtcttagtcactgttctacgatgacgggtagcatcgcagcatggaggcagacatgattttggagaagtaggt

SEQ ID NO: 97303 - DNA, 151 bp, Mus musculus
atctatatacctgtctgtctatctgtctgtctatctatctatctatctatctatctatctatctatctatcatctatctattgagagagagagagacagagatgcataggtacagatgagagacagacagacagacagacagatagacaga

SEQ ID NO: 97304 - DNA, 98 bp, Mus musculus
agttcaagaatgtggctggagagatgactcagcggttaagagcactgactgctcttccaaaggtctgaagttcaaattctatcaaccacatggtggct

SEQ ID NO: 97305 - DNA, 93 bp, Mus musculus
gctttatgctaaggtttcatggaactgaactatatcctatatatctaagtatatatttatgcatatgtttggattttgataccttagataagc

SEQ ID NO: 97306 - DNA, 116 bp, Mus musculus
gaaggccctgtgacagggatacttgacaaacctaaaatagattttatgtgtgctttatatttttttttcttggtatgtttgtcttattggttccttgttttaaaatagtttgtttt

SEQ ID NO: 97307 - DNA, 83 bp, Mus musculus
tgtatatatgtatatgtacgtgtatgtgtgtgtgtgtatatatatatatatatatatatatatatatatatatatatatatat

SEQ ID NO: 97308 - DNA, 92 bp, Mus musculus
gtgtgtgtgtgtgtatatatcacccctgatatgcatgtatgtgtgtatgtatgtatatatatcaggtagtgggtgagtacattttggaacac

SEQ ID NO: 97309 - DNA, 110 bp, Mus musculus
taaatgtgttctgtgtccatttgaaatgtttattgtctgcttacctgggaacttttctgaacagagtgagctgcctgttatcagttctttgagatcagaatatctgtttg

SEQ ID NO: 97310 - DNA, 85 bp, Mus musculus; identical to SEQ ID NO: 57470

SEQ ID NO: 97311 - DNA, 106 bp, Mus musculus; identical to SEQ ID NO: 58252

SEQ ID NO: 97312 - DNA, 85 bp, Mus musculus; identical to SEQ ID NO: 57439

SEQ ID NO: 97313 - DNA, 94 bp, Mus musculus
catttatgtgtgtatgcatgtgtggtatatgtgaacatgtgtgtgcatatgtatgcatgtatgaatgtcatgcatgtttatgtgtacattatgt

SEQ ID NO: 97314 - DNA, 120 bp, Mus musculus
ggcagatgtggaagactgctgcatgctttccacacttccctggctgggtgtctggctgtgtgaagccactgaccccagctcgtcggatggtggacaagaggcagtcctaggctccaggtt

SEQ ID NO: 97315 - DNA, 79 bp, Mus musculus
tgactatcaaagacatgccatcatttgttgggcaactgtttcagcatgtgaaagtggtaacttgttttagttatggtta

SEQ ID NO: 97316 - DNA, 73 bp, Mus musculus
acatgtgtgtatgtatacatgtatgtattatgtatgtatgtatgtatgtatgtatgtatgcatatgagtgtgt

SEQ ID NO: 97317 - DNA, 108 bp, Mus musculus
gtctaggctaggagataagacagtgagctagctgcagctgcacctgtcaccttgaatcagacagttgtcagactgcagaggtcatgcccttgccttcttggctcctac

SEQ ID NO: 97318 - DNA, 78 bp, Mus musculus
accttgtcctgaaggagcttcgtgtcagggggagcagaaaggaatgtatagatcattgtgccgagctttctcaggggt

SEQ ID NO: 97319 - DNA, 65 bp, Mus musculus
tcattcctttgaaatgctgagtgatgagtgggtccagtcccacagctcctacttctaaggaaaga

SEQ ID NO: 97320 - DNA, 85 bp, Mus musculus
gcgcaggctggctttggggccctttcagactccttaggtagctgtggggttggtgttcagagagagctcacaagcttcacttcgc

SEQ ID NO: 97321 - DNA, 80 bp, Mus musculus
gctagtcttcctgagaggcaatgttacatctacacacgtcttgtgcataggaattctgactgtcttactcactggctagc

SEQ ID NO: 97322 - DNA, 164 bp, Mus musculus
tgtatttgtacatctatgagtatgtgtgtgtatatatatatatatatatatatatatatacacatatgtacatatacacacatatatatgtatatatacatatatgtatatacacatactcataaatgcatatatgtatacacatatacacatatatacatata

SEQ ID NO: 97323 - DNA, 164 bp, Mus musculus
atgtgtatgtgtatgtatgcatgtatgtatatgtgtgtgtgtatacatatatatacatatatacatatatgtgtgtatgcatgtatgtatatgtatgtgtatatatacatatatgtgtgtatacatgtatgtgtttatgtgtgtatatatacatgtatgtatgt

SEQ ID NO: 97324 - DNA, 74 bp, Mus musculus
gtatccatgcaaataggaagcccacggtgaggctctgcctgcctgcctgcctgcctgcctgcctgcctgcctgc

SEQ ID NO: 97325 - DNA, 120 bp, Mus musculus
tccaagaccccgaaagatagatattgtatgacctctcttatattaggaacctagcttttaatatttatatacatgtctgggtgtgagtgaggttgtgacatcagaaagggggtcatagga

SEQ ID NO: 97326 - DNA, 103 bp, Mus musculus
atgcatatgttgtatatatttatatgtgtacatatgtatatatgtatatgtgtatatacatacattatatatgcacacatgtactgtatataagcatatacat

SEQ ID NO: 97327 - DNA, 90 bp, Mus musculus
ccaggcactgtattcaactctggagacacaaggagaagcaaaagcagatgtgcctctctgtgtctcttagagctcactgtactagccagg

SEQ ID NO: 97328 - DNA, 58 bp, Mus musculus
tgtgtgagtatgtatgtatatatgtatgtatgtatgtatgtatgtatgtatgtatgca

SEQ ID NO: 97329 - DNA, 86 bp, Mus musculus
ggttattttatgaggcttccatatgctctgtttgtctgtctggtactagataaatcagtcagtcaggggcctttttcgagagcacc

SEQ ID NO: 97330 - DNA, 130 bp, Mus musculus
tttgcagactgcagagggtcatgttatccaaaagaatgtggccatctgggcggtgcagaagtgagtgtgcagaaggagaggtctgtttatcctctgccacctccatgtcccttacaatcactcttctaga

SEQ ID NO: 97331 - DNA, 132 bp, Mus musculus
tatatatatatatatatatatatatatatatatatatatacacatatatgtatatatatacatatatgtgtatatatacatttatgtatatacgtgtatatatatgtgtgtgtatatgtatgtgtgatatgt

SEQ ID NO: 97332 - DNA, 90 bp, Mus musculus
tgctgactttccctgcctgcctgcctgcctgcctgcccagcatttaggctgatgtcagagcgagctggctgaaaggagagagagccagca

SEQ ID NO: 97333 - DNA, 89 bp, Mus musculus
tatatatatatatgtatgtgcatgtgcatgtgcatgtgcacatgcatatgcatacacatcatgcatatgtacatgtacatagatacatg

SEQ ID NO: 97334 - DNA, 85 bp, Mus musculus
gatattttgcatgtaatgtgtttatgtatatatatacatctatttgtatatataaagatttgtgtgcataggtttacagaatatc

SEQ ID NO: 97335 - DNA, 113 bp, Mus musculus
tgtgtctgtctgtgtgtgaccctgtttggtgtgtgtgtgtgtatgtgtgtatgtacatgtgcatgtgcatgcgtgtatttttgggggggagttgctaaatatgacatcccaca

SEQ ID NO: 97336 - DNA, 73 bp, Mus musculus
acattaaagagataaagctagtttaccaatgccaccctttaatggcttgggtctagtggtctctgcttcttgt

SEQ ID NO: 97337 - DNA, 68 bp, Mus musculus
tatatatatatgcatatatatttgagtgagtcagagagaacatttcagtgtatgtgtgagtgtatgtg

SEQ ID NO: 97338 - DNA, 116 bp, Mus musculus
gggtcccacatttttgtccttgtatttaatgatgacccaactgtttggcccagtcactgaacctctctgtgcctcagtttcctcatctgcaaaatgggggttaaatgttttgattt

SEQ ID NO: 97339 - DNA, 94 bp, Mus musculus
tgaacagccgtgtgtgaacatgcagacatgcactcacagacacacacgcgtgtacacaaacacacatgcatgcatgctcactcacgcatgtaca

SEQ ID NO: 97340 - DNA, 82 bp, Mus musculus
agctgtctgtctgtatgtctatctgtctgtatgtatgtatgtaatggtgcaaaatgggcattttacatgctaggcaagcact

SEQ ID NO: 97341 - DNA, 77 bp, Mus musculus
tcttgagggaaatagggtgagagaggtcaggtgtgaacaaggaaaacagcccagcagtcaccctgtgtgtctcagga

SEQ ID NO: 97342 - DNA, 82 bp, Mus musculus
gtgagtcactaaatatgagacaagagagagaagaatgacatttatgccaacgtcttttcttgtttcccctttaagtattcac

SEQ ID NO: 97343 - DNA, 111 bp, Mus musculus
gaaaatcatgaagagtaaagggttccacggcactcacagtctttgtcacagtccttgtttaaagctcagtgaggaatgtggttccaaccccagtgcattcaccgattattc

SEQ ID NO: 97344 - DNA, 97 bp, Mus musculus
gagagagagagagagagagagagagagacagacagagacagagagagacagagagagagactgtgtctatttctctctctatttctctttttctctt

SEQ ID NO: 97345 - DNA, 70 bp, Mus musculus
aaaatatttgtgtgtatatgaatatatgtgtatatatgaatatacatgcgtatgcacattagaatgtttt

SEQ ID NO: 97346 - DNA, 65 bp, Mus musculus
ttgcaactaagtgcatctttcatttgtgtcccaggaggcacacagaggactgagagcacatgcag

SEQ ID NO: 97347 - DNA, 84 bp, Mus musculus
gtatatgtatgtgtatatatatacatatatatatatacatacatgtgtatttgtacatgtatgtatgtatgtatatatgtacca

SEQ ID NO: 97348 - DNA, 83 bp, Mus musculus
gtctctctgtctgtctgtctgtctgtctgcctttatttttaacattatgggtatatagatagatgtagacaaagagaagagac

SEQ ID NO: 97349 - DNA, 94 bp, Mus musculus
catataaatgttagatgtatgtatatatatatatatgcgtgtgtgtatatatatatatatgcatgtatatagatatgtatataccatttatatg

SEQ ID NO: 97350 - DNA, 91 bp, Mus musculus
ctcagggaggcagagggtgacagatctctgtgtgagaccactaatctacagaggacattcagtacatccatgtctaaataatgagaccctg

SEQ ID NO: 97351 - DNA, 85 bp, Mus musculus; identical to SEQ ID NO: 57470

SEQ ID NO: 97352 - DNA, 83 bp, Mus musculus
catccatccaatgtatgtatgtatgtatgtatgcatgtatgtatgtatgtatgtatgtatatgtgtaaagttgttggagtttg

SEQ ID NO: 97353 - DNA, 128 bp, Mus musculus
ttcattcactcagtgtgtgtgtgtgtatgtgcgcgtgcacatgtgacacagagagagagagagagagagagagagagagagagagagagagagatttcctcctttcttttctctcatcactggctgcc

SEQ ID NO: 97354 - DNA, 90 bp, Mus musculus
tctctgtgtatgtgtgtgtgcatgtgagtgcgcgcgcgtgtgtgtgtgtgtgtgtgtgtaggtatgcatgctacagcatatatgtagagg

SEQ ID NO: 97355 - DNA, 73 bp, Mus musculus
ctcacacactttctctgcatgtgcaggtgggtgcacatgtgcttgtgtgtgtgtgtgtgtgtgtgtgtgtgtg

SEQ ID NO: 97356 - DNA, 121 bp, Mus musculus
agttcactcaatagttaaggctttgttgggcatggtagcacatgtcaccctgaaggctgagactgcaactccatgttctacgcctgcttgggctacatagtgagctctaggtcagttcagg

SEQ ID NO: 97357 - DNA, 116 bp, Mus musculus
gaagacaggaactgaatggagagtgaggctaggacagtgattgtaattatctgagagaaaagacagtacaggaagcacccacaggccaccttggtgaggttctaaattgtattttc

SEQ ID NO: 97358 - DNA, 58 bp, Mus musculus
ggttaagggagtgaaaactgaagcttgcctggcagtgagccactgtcactccctgact

SEQ ID NO: 97359 - DNA, 124 bp, Mus musculus
tttgcttggccctttgagcttgctggtcagtttgggacacggcttttgacagagtacccagtgtctgtctgtgtatgttcttagggtgtggcagaagggactcagcgggttcttgccaaaggcc

SEQ ID NO: 97360 - DNA, 112 bp, Mus musculus
aagagaacacgagaaaatgtcagccgagctattctgattcccttacaaagatagattttttttttctagaaaggataactgcaatgagctggctgtgctgtgctctcttgtt

SEQ ID NO: 97361 - DNA, 108 bp, Mus musculus
tgctgtctgccatgatgatagtggactaaacctctgaaactgtaagccagtcccaattaaatattttagtttacaagagtttccatgatcatgtgtcttttcacagca

SEQ ID NO: 97362 - DNA, 100 bp, Mus musculus
gccccggttcactccctcctagtaaagatgaggtctcagccacactgagaggctgtggcttttaggcctgagatttgcttcaggctggtaaggtaggacc

SEQ ID NO: 97363 - DNA, 93 bp, Mus musculus
atcatcacggagccccatccctgacctgagcgcttacatgaattctgtttgacaagagagggtgcttagatgagcagaattggttctaatgat

SEQ ID NO: 97364 - DNA, 63 bp, Mus musculus
tgtgtctctgtctgtctatgtgcctgtgtgtatacatgcacatgagtgtaccacagaagacca

SEQ ID NO: 97365 - DNA, 79 bp, Mus musculus
tctaactgtgtgtttttacacgcgcatacatgtgtgctgacttgctcacatgtgtgtgtgtgagagtgcgcttgatagg

SEQ ID NO: 97366 - DNA, 70 bp, Mus musculus
ccctagtattgggggcagagaggaagaggaggacccccacacacacactcagactgctacaggactaggg

SEQ ID NO: 97367 - DNA, 67 bp, Mus musculus
gatccacacagacacagtccctcagccaataggctagagcttcaggtttgagctgcttctgtagatc

SEQ ID NO: 97368 - DNA, 113 bp, Mus musculus
ggatgaacctttgaggtctcctatgctcaagctgtgcccagtgtggcacacagtctctctctgctgcctgtggatcatagataaagaactcttggcttctctaacaccatgcc

SEQ ID NO: 97369 - DNA, 231 bp, Mus musculus
tatatatgtatatatgtatatatgtatatatgtgtctatgtatatatgtatatatgtgtctatgtgtctatgtgtatatgtgtatatgtgtctatatgtatatgtgatgtacatatgtatgtatgtatgtgcatatgcatgtatgtatgtgtacatatatgtatgtatatatgtacatagtatctgtgtatatatgtacatgtgtatatattgtacatatgtatatattgc

SEQ ID NO: 97370 - DNA, 85 bp, Mus musculus; identical to SEQ ID NO: 57470

SEQ ID NO: 97371 - DNA, 85 bp, Mus musculus; identical to SEQ ID NO: 57439

SEQ ID NO: 97372 - DNA, 109 bp, Mus musculus
tcaccgtataccagagctttacatcctccagtggtgaggatccaggttgaatactctggtgtttccttgtcctgtttatggtagatatccaaagcttcaagatggggga

SEQ ID NO: 97373 - DNA, 110 bp, Mus musculus
ccccaacagggctggctcctttttagctccttggtacctcagtcacatcttgatactttttcattttttgtgcctcgaggttatctgcaagacaaaccaccctactgtgg

SEQ ID NO: 97374 - DNA, 90 bp, Mus musculus
gatgaagacatccagtttagaacaggctgttccaagctctctcactgtctgtgcattgttcagctgtggctctctggttttgtttccatc

SEQ ID NO: 97375 - DNA, 86 bp, Mus musculus
tttccaatttttattcccttcatctccttttgtagtccaaatgctctggctaggacttcaagtactatgttgaatagttatggaga

SEQ ID NO: 97376 - DNA, 101 bp, Mus musculus
acgttttccttctacaacaaaacttaagttattttgatcttctgatagctctggaataaggcagtgtttcagaagccatgtggctgtaggatggaagctgt

SEQ ID NO: 97377 - DNA, 86 bp, Mus musculus
cattcattttctgattttgttgttcatggaaccatgactacataaaaaaaagccaggtatcatgaaaggcatacagcatatgtttg

SEQ ID NO: 97378 - DNA, 73 bp, Mus musculus
ttatatatgtgtgtgtacctaaatgtattatatacatgtgtgtatgtacttgtgtgtatatatatgtgtgtga

SEQ ID NO: 97379 - DNA, 95 bp, Mus musculus
catgttttgttttgttatctattcatttatctgtctatgtatgtatatatgaatgtacatatatatgttatgcatgaatgtatgcattatatatg

SEQ ID NO: 97380 - DNA, 105 bp, Mus musculus
atttagatagtcagctttatttcaatcaatgattacatggtatgtattttcttttatatagatgtacatacatatgtttctttataaagttaatttcttttagat

SEQ ID NO: 97381 - DNA, 85 bp, Mus musculus; identical to SEQ ID NO: 57470

SEQ ID NO: 97382 - DNA, 66 bp, Mus musculus
tctctgtttctcagtgcttctgagcactcccagtagctctaagcaccaatgcctgaggttcatgga

SEQ ID NO: 97383 - DNA, 106 bp, Mus musculus
gccttagtgcatggtgatctgataggatgcatgggacaatttcaatatttttgtatatgttgaggcttgttttgtgtccaattatgtggtcaattttggaggaggt

SEQ ID NO: 97384 - DNA, 115 bp, Mus musculus
tccttgaccaagttatcattgagaagagtgttgttcagtttccacatgaatgttggctttctattatttattttgttattgaagatcagccttagtccatggtgatctgatagga

SEQ ID NO: 97385 - DNA, 177 bp, Mus musculus
tatctatatgtcacaatatttatatatatgtatatatatattcacaatatttatatatgtgtatatatatcacaatatttatatatgtgtatatatatatatctcacaatatatatatatgtgtgtatatatatcacaatatttatatatgcgtgtataatatgtatatatgtatat

SEQ ID NO: 97386 - DNA, 85 bp, Mus musculus; identical to SEQ ID NO: 57439

SEQ ID NO: 97387 - DNA, 85 bp, Mus musculus; identical to SEQ ID NO: 57439

SEQ ID NO: 97388 - DNA, 85 bp, Mus musculus; identical to SEQ ID NO: 57439

SEQ ID NO: 97389 - DNA, 82 bp, Mus musculus
tgccctatgtagtcatttagttaatatgtgcatgtaactaggttacaacatatggtgtctagagggaaagcctactggggca

SEQ ID NO: 97390 - DNA, 85 bp, Mus musculus; identical to SEQ ID NO: 57439

SEQ ID NO: 97391 - DNA, 85 bp, Mus musculus; identical to SEQ ID NO: 57470

SEQ ID NO: 97392 - DNA, 93 bp, Mus musculus
gtataaacatttaaaatctgtgtgtgtgcatgtgcatgcatacgtgtgcacactcattcatgtacataaatatagacaggaggtcaggttggc

SEQ ID NO: 97393 - DNA, 126 bp, Mus musculus
ctggacttatgtgaggcagccagaggagctcacgcactggctttccagtcagacgtgtgcctgcctgcctgcctgccatgagctgtagcagaacatactctctcccactcagacctggagctgagc

SEQ ID NO: 97394 - DNA, 86 bp, Mus musculus
gcaggactcctgagactaccaaagaggcatgtgaaggctttattaaaggctttcagtgactctgagtgacatcatgggacacaggc

SEQ ID NO: 97395 - DNA, 117 bp, Mus musculus
tgatggatcgatcactaacgagacaaaagccccaggagctccagctgtctcctcatggtgtctggcctctgcgggtttacctgggtcacatctccttggctctatgttgatcactca

SEQ ID NO: 97396 - DNA, 110 bp, Mus musculus
actggatgtgacaagcaaggtgggtctgatctgtcactgtcttactgtgtgtaacttgcttggtttcacttagtcacagattgttagaggaattttgtttcacatggagt

SEQ ID NO: 97397 - DNA, 73 bp, Mus musculus
gcatatgtatacacagaggcatgcaaacaaatgtatgtattatgtatgtatgtatgtgtgtgtgtatgcatgc

SEQ ID NO: 97398 - DNA, 90 bp, Mus musculus
agatctgatgccagttagagagctggtgaaaatgagaggtttccttgctctctgtctgttccaactctctctgcctctgtgtgtctgtct

SEQ ID NO: 97399 - DNA, 96 bp, Mus musculus
gctgccagtctcaggtctcactgggagtgttcagtctgctgtcagcacagtgcgtgagccagtcactgtgacagtctcatcagctagagtggcagt

SEQ ID NO: 97400 - DNA, 83 bp, Mus musculus
gagagagagagagagagagagagacggggccatgtctcattaagtttcccaggccaatgtttaactcactgtcattctgtctc

SEQ ID NO: 97401 - DNA, 83 bp, Mus musculus
atcagcataaacatcaagacaggggactaagcagtcatcacccctcagatgagtcacagtctgtctgttctcatgaagctgat

SEQ ID NO: 97402 - DNA, 108 bp, Mus musculus
catccttgtgtctgtcaaatgtactctttatttaaaaattattataataattctatacatttatgggataaagtgtagtgatttggttcaactgtatagtaggtgatg

SEQ ID NO: 97403 - DNA, 111 bp, Mus musculus
ctgtatggatactccttccggctgacatgtcacccttctggggaggtatggtcataatcacactgcctcactcacagcctccccagggacacatgctggaggtctgcatag

SEQ ID NO: 97404 - DNA, 80 bp, Mus musculus
tacacagtgtctgtagcaggcgggatgtgctctgtgctctaagctcactccatgtgtctcagtgtctcggtgactgtgta

SEQ ID NO: 97405 - DNA, 63 bp, Mus musculus
agtaacttttattttttgatcgtgaataggcatacgttcacgatgaactgtttggaagttatt

SEQ ID NO: 97406 - DNA, 119 bp, Mus musculus
tacaaacctcttttgtaatgtatgtccttttaacgcatttgtcttagagctactaggttgttgtctttaagggttttttaacttgcatatatttacatgtaaagatgggctttgttgtg

SEQ ID NO: 97407 - DNA, 95 bp, Mus musculus
atgtacattggtgttttgtctgcatgtatgtctgtgtgagggtgtcagatcaactgcaagtggagttacagacaggtgtgagctgccatgtaggt

SEQ ID NO: 97408 - DNA, 110 bp, Mus musculus
ctatttgatttacagtgagcatgttctaagcccagagagaacacagtgtttttatgaatattaagaagtttctatgacattaaatattgttcacaacttatttcatgtgg

SEQ ID NO: 97409 - DNA, 85 bp, Mus musculus; identical to SEQ ID NO: 57439

SEQ ID NO: 97410 - DNA, 82 bp, Mus musculus
gtgagcaggttagcagtgacagtactagatgctctcattgtatgtgtaaacattaaaggctatgtcactgtttctgtgtcac

SEQ ID NO: 97411 - DNA, 62 bp, Mus musculus
gtgcatgtgtgtgagtgtatggatgcgtgtgtaagtatgtctatatatgtatatatgtgtgt

SEQ ID NO: 97412 - DNA, 85 bp, Mus musculus
gtgtatgtatgtatatgtgattatgcatttgtgagtctatgtgtatgtatatttatgtgtataatgtatgtttgcatatgtgtgt

SEQ ID NO: 97413 - DNA, 120 bp, Mus musculus
ggaattcaggacctaattgctctgtggcctctgagggcagggcagggcattctcaagacagtttctaaatgtgtcccatagcagggttcaaagagcaggcaggcagaggtgagaatgtct

SEQ ID NO: 97414 - DNA, 89 bp, Mus musculus
ctgattcagaagactggagctgtctgtgggacaaaacagggtctcactctgtttgtgtcatgcgcctgatgcaaggtctgctgggtagg

SEQ ID NO: 97415 - DNA, 119 bp, Mus musculus
atagtttaaaaattagtgtagggctggagagatggctcagcctttaagagcactgactgctcttccagaggtcctgagttcaaatcccagcaaccatatgatgactgagaaccatctgt

SEQ ID NO: 97416 - DNA, 111 bp, Mus musculus
agttcttctgccacttgacataccttagccagaggctggagaggttgttggttctattaacagcattctcctgaccagaggctggaaataagaaaaatgtttagaagcact

SEQ ID NO: 97417 - DNA, 112 bp, Mus musculus
gtgagtatttatacagttttcagagcagcagccattaggcacagtgtgattgtcagaacagtgtgacttttaaatggactggtctttaagaaatgaggtggcaaggacttcc

SEQ ID NO: 97418 - DNA, 97 bp, Mus musculus
tgcacattctaccaaaaatatggggtggctccttactgtacattgattgctctgcaattcagtttactccgctggcatcagtccatattgtcctgca

SEQ ID NO: 97419 - DNA, 75 bp, Mus musculus
atatatgtacatatatatgtatatataatgtatgtatatataatgtatgtatatataatgtatgtatatgtatgt

SEQ ID NO: 97420 - DNA, 85 bp, Mus musculus; identical to SEQ ID NO: 57470

SEQ ID NO: 97421 - DNA, 70 bp, Mus musculus
gtatgtatgtatgtatgtatgtatgtatgttggggggcattgtgcaagggtacatatgtatgtatataca

SEQ ID NO: 97422 - DNA, 90 bp, Mus musculus
tgtaaaatatatgtgacttacatatggcatatatatgaatatatacatatatgtatatgtgtatttgtgtatatacacatatataataca

SEQ ID NO: 97423 - DNA, 103 bp, Mus musculus
agccaggatcccatggaagattttacacatgagacttcaaggtagaatacaggaaaatcaagttgacagaagtgtgtgtgaagcactggggatgctacaggtt

SEQ ID NO: 97424 - DNA, 115 bp, Mus musculus
ggccatgccctgggtgccatcaagagggacattgggctgtcaattgccctcatgttaacagaacagagggacatcactcccagatatccctccagctgatctcctaggcttggct

SEQ ID NO: 97425 - DNA, 71 bp, Mus musculus
agagagagagagataaaatgctttaaattatttctggaacaaggtagtagtgtgtgtgtctctctcccttt

SEQ ID NO: 97426 - DNA, 61 bp, Mus musculus
tccatgtagagcacagtgagcagacacccagggtctctagctaatgaaatgctctgcagga

SEQ ID NO: 97427 - DNA, 82 bp, Mus musculus
ttgttgtccatagcagctggcaggagcatggatcatgaacttctacttgctctttggtgacagcactgactgtggacatcaa

SEQ ID NO: 97428 - DNA, 86 bp, Mus musculus
gttgttccagagatactgaaaggctctgcaagttcatactcagcctctgtgtctccctgtgagtctttcagagtctatagagtgac

SEQ ID NO: 97429 - DNA, 71 bp, Mus musculus
caggctttgtatcaatttgtatttatgtcttcccaggggagcccgtcttagcaatttgtttgctcagcttg

SEQ ID NO: 97430 - DNA, 73 bp, Mus musculus
ctggtgggaggtaagagcttctttagaaggcaagtgctctctgcttgaactgaggaagccatgcttctcctgg

SEQ ID NO: 97431 - DNA, 133 bp, Mus musculus
tgtacatatgtatatatttgtgtttgtgtcaatatatatatgtatacatatgtataaagtacatatgcatatataaatgtatgtatattataatacacacatatgtataaatatatataaattataaatctag

SEQ ID NO: 97432 - DNA, 85 bp, Mus musculus; identical to SEQ ID NO: 57470

SEQ ID NO: 97433 - DNA, 73 bp, Mus musculus
tctgtctctgtatgtgtctgtgtctgtgtgtttgtggctacgcaaacacctatacaaaggctagaagagaaag

SEQ ID NO: 97434 - DNA, 117 bp, Mus musculus
atgtgtgcatataaatatataaattcattaattgttgaatgcacatatatatgtatatattacatacatatgtatatgtgtatataaatataaatgtatggaaatatatgtatatat

SEQ ID NO: 97435 - DNA, 85 bp, Mus musculus; identical to SEQ ID NO: 57439

SEQ ID NO: 97436 - DNA, 61 bp, Mus musculus
gaaaatacaagtatagttagcagggagggtccagcctccctctctcccacacttgtttttc

SEQ ID NO: 97437 - DNA, 91 bp, Mus musculus
ccattgagtggcactattagaaggtgtggcactattgagtaggtttgtcactgtcagtgtgtgctataagattctcatccttgctgcctgg

SEQ ID NO: 97438 - DNA, 78 bp, Mus musculus
tgggggaggtgtgtcactggaggtcggctttgaagtttcagaagactcaagtcatccccagtgtctctctctgcctca

SEQ ID NO: 97439 - DNA, 117 bp, Mus musculus
acacaaacacacacacacacacacacacacacacgtatgtatatatgtatatgtgtatatgtgcatatgtatatatgtgcacatgtgtaaatgtgtatatgtgcatatgtatatgtg

SEQ ID NO: 97440 - DNA, 91 bp, Mus musculus
cttctaaggctttgacctatatggggctacttccatctaaaccttggaatgtaaagaagtaagtctcctatgttggctctttcctctgagg

SEQ ID NO: 97441 - DNA, 93 bp, Mus musculus
gggttcataagttctgttagtttcactgtgtctctgtttagtttctgtttctaggatctgcccattaatgagagtgggatgtggaagtttccc

SEQ ID NO: 97442 - DNA, 117 bp, Mus musculus
tacattttttaaagcaagtgatataatatgatgtatgtatgtatgcatgtatgtatgtatacatgtgtgtatgtatgtatgtatgctaagcctgtgtctattttcaatatgtgtgta

SEQ ID NO: 97443 - DNA, 64 bp, Mus musculus
tgcatatctatgcctgctttcctcaggatagagggagataaatgagtgaagccgtaggtttgca

SEQ ID NO: 97444 - DNA, 111 bp, Mus musculus
aggcttttgtagtaggatctgatgatatatatatatatatatatatatatatatatatatatatatatatatatatatatatatatatatctttttttttttgcatttcct

SEQ ID NO: 97445 - DNA, 89 bp, Mus musculus
tacattttggagattgggtgctttacagagtggtctgaaacttacccaagtctctcttgctctctgtgatacattcttgcccttgtgtg

SEQ ID NO: 97446 - DNA, 72 bp, Mus musculus
ggtatcttgtcttggtggaggccatgtcggagaacgttgagaggcctcctgtggaagattagatgtggctcc

SEQ ID NO: 97447 - DNA, 82 bp, Mus musculus
tctagagagatgagtgtgaccagaagatccatatgtcaggagtcagaaagggatttctttggttatttttttcttcttttga

SEQ ID NO: 97448 - DNA, 116 bp, Mus musculus
agtcccaatttcacccaccctttccctccattcatggacaaagactaaattaagtattcagaatttgtagttttctctgtggtttgtggaaagtattgggcaaagagaatgagagt

SEQ ID NO: 97449 - DNA, 103 bp, Mus musculus
tggtcattatttcatattggttgtgattagtaggatatgatatgacaactaggcatcagttgcagttcacactctgctttttatagttaatatgaggtggcta

SEQ ID NO: 97450 - DNA, 119 bp, Mus musculus
actgactctcgtaactggaatttatttcttgaggttggtggctcagactgtcagtcacagctgaggatttagctcccttgtggattttcattcttgtctggtcagtgtgagagcactgg

SEQ ID NO: 97451 - DNA, 86 bp, Mus musculus
gcttctgagccctgctggacagagaaagcacacagggaaatgcaaatgtatttggcagcttctcctagtccatgcacattcagagc

SEQ ID NO: 97452 - DNA, 85 bp, Mus musculus
gtccatggtggtctggtaggatgtatgggataatttcaatatttttgtatctgttgagtcctgttttgtgaccaattatatggtc

SEQ ID NO: 97453 - DNA, 70 bp, Mus musculus
ggaggaaatatatgactgggattgggctttgagatcttagatgctcaagccaggctcagtgtctcactct

SEQ ID NO: 97454 - DNA, 90 bp, Mus musculus
cactattaaaattgatttgttaacatatatatgtatatatatacgcatatatacacatgtgtatgtatatagaggttcattttgataatg

SEQ ID NO: 97455 - DNA, 100 bp, Mus musculus
ttggtaatatgtagttataatcatttgtctactattgcatatatttgattttatacaatgaaaagttgagtagctgtaatagagaacttacatctgccaa

SEQ ID NO: 97456 - DNA, 68 bp, Mus musculus
gaacttagggctggagagatggcttagtggttaagagcactgactgctcttccagaggtcctgagttc

SEQ ID NO: 97457 - DNA, 73 bp, Mus musculus
agtgcaggaggcagagaggtgacacagaggtgtcaggtccccctgaagtctgagttacaggttgctgtgagct

SEQ ID NO: 97458 - DNA, 72 bp, Mus musculus
gagctctctctctctctctgggtggggggctagtgcagctgtatccaccctcctagaggaagctaagaactc

SEQ ID NO: 97459 - DNA, 108 bp, Mus musculus
gtgtcagtctaatggggctagtgaggactcagctgtgatttctcctccttgtgctgtatggactctgaccgtctcactgggtcgcagtgagtgtctctcctggtcaca

SEQ ID NO: 97460 - DNA, 85 bp, Mus musculus; identical to SEQ ID NO: 66051

SEQ ID NO: 97461 - DNA, 85 bp, Mus musculus; identical to SEQ ID NO: 57439

SEQ ID NO: 97462 - DNA, 85 bp, Mus musculus; identical to SEQ ID NO: 57470

SEQ ID NO: 97463 - DNA, 89 bp, Mus musculus
tatatatatatatatatatgtataaatgtgtgtacatatttttgtatgtgtatgtacatatgtatgtatatgtaaatgtatgtgaacat

SEQ ID NO: 97464 - DNA, 85 bp, Mus musculus; identical to SEQ ID NO: 57439

SEQ ID NO: 97465 - DNA, 85 bp, Mus musculus; identical to SEQ ID NO: 57439

SEQ ID NO: 97466 - DNA, 60 bp, Mus musculus
actctttgagacagagtttttctgtatagcccaggctgtcctgaaactcactcactgagt

SEQ ID NO: 97467 - DNA, 64 bp, Mus musculus
tgaatataaaattatatttacgcatacatacacatatgtatgtgtatgtatatgtatatgttta

SEQ ID NO: 97468 - DNA, 78 bp, Mus musculus
gtgtgtgcatgagtatgtgcccatgtgtgtacatgtgtgcccgtgtgtgtgcctgtgtgtgtatatttatgtatgtgt

SEQ ID NO: 97469 - DNA, 85 bp, Mus musculus; identical to SEQ ID NO: 57439

SEQ ID NO: 97470 - DNA, 93 bp, Mus musculus
atctaagatcttacatataagtatttcatgcagatgtgttatatcatgtatatgtatgaatatatgtgtgtatatatgtgtatattactagat

SEQ ID NO: 97471 - DNA, 77 bp, Mus musculus
ggaaaaaggcagggaatgcttcagggattgcgaaagtgagaaagtcccagacatctctctctgtctgtccccaaagc

SEQ ID NO: 97472 - DNA, 79 bp, Mus musculus
gcatcttctgtcacttgagattttgaacttggccattctgactgatgtgaggtggaatctcagggtcattttgatttgc

SEQ ID NO: 97473 - DNA, 78 bp, Mus musculus
aactctccctgatacatgcacatgatggaagcctatctttccggctctctgtttctgagtctgtattaggacctggtt

SEQ ID NO: 97474 - DNA, 99 bp, Mus musculus
ttcattgcatgcatctcagacctggctcatcctcagctccatctaaatctctctggtaatgagatgggacacccctcagtgtcagattcaagcatagaa

SEQ ID NO: 97475 - DNA, 107 bp, Mus musculus
gggaaactgaaaatgaacactgcttcttgattatttcattttaaaataggggcccctatgtgagaaagaacatatatatctgaagaacagaagttcacagttgaaac

SEQ ID NO: 97476 - DNA, 85 bp, Mus musculus; identical to SEQ ID NO: 57439

SEQ ID NO: 97477 - DNA, 118 bp, Mus musculus
atgtatataccctcacacatatgtatatgtatgtgtatttattatctattatctgcatatgaacattttgcctgtgtgtatgtatgtatgtatgtatgtatgtgcaacatgtgtgtgc

SEQ ID NO: 97478 - DNA, 92 bp, Mus musculus
gtttgttttctcttgaacaactactgctgtgtgcacagcctactcttaagagtagtttgtgtgtacagtgagactcccttggagaaaactac

SEQ ID NO: 97479 - DNA, 113 bp, Mus musculus
acaatgtagggtggaccaatacatgtatgtcattagcaaagaatacatgtattcatttatatttatgtgtgtgcttgtatgtatgtgtgtatgtatgtattgtgcttaattgt

SEQ ID NO: 97480 - DNA, 64 bp, Mus musculus
actgtgatattgtgtctaccagctctgtgctgaaagccagacctgcgacacactgtgtcacagt

SEQ ID NO: 97481 - DNA, 96 bp, Mus musculus
agtggcataactgcattgtatatgtgtgcgtgtgtgtatggatgtatatgtagttgcacacacagacacacacatatcatgtagttttactctact

SEQ ID NO: 97482 - DNA, 93 bp, Mus musculus
gatagattaatatatgtgtgtgtgtgtatatgtatatatgtgtatatatgtgtatatgtatatatgtgcatatatataaataatttccatatc

SEQ ID NO: 97483 - DNA, 78 bp, Mus musculus
acgattgctgtgtagtaaagtttgaaatcagcagtggtgattatttccacctgaagttattttgttgtacagcattgt

SEQ ID NO: 97484 - DNA, 105 bp, Mus musculus
atatatgtgtgagagcacacaagtatgagagaaaaagatgcaatatgtgatttaagtggagtgtgtgtctgtgtgtgtgtatctgtgtgtgtgtatgtagtgtat

SEQ ID NO: 97485 - DNA, 124 bp, Mus musculus
tgtgtatatggatatgtgaatacaagtatgtatgtatgtatgcatgtgtgtatgtatgtaggaatatatatatatatgtatatatatatacatatatatacatatatatatatatatatatata

SEQ ID NO: 97486 - DNA, 116 bp, Mus musculus
tcagagaatttttttttaatcttccaggcctttctcacatatattatggtttcatgttttattttattatgagattcctatatgtgtgtgtctgtgtttatttgtgtttcttgtga

SEQ ID NO: 97487 - DNA, 85 bp, Mus musculus; identical to SEQ ID NO: 57439

SEQ ID NO: 97488 - DNA, 106 bp, Mus musculus
ggttgtgcagttcggtcttcctttgggacttctgtaacagcagggcaggaggctgtctctgactctgttatttccctttggatccctttcccctaactgtgctgcc

SEQ ID NO: 97489 - DNA, 94 bp, Mus musculus
ctgggtttacttttggtttggttcagtttggtttttcaagacatgttttctctctgtatctctggctatactggacctcactctgtagatgcag

SEQ ID NO: 97490 - DNA, 106 bp, Mus musculus
ccttagaaccttctttaattcagtcatctacatggtttagaatcataaacattgatttattttttaagaccatagttattatgactatctgttaggagtattaagg

SEQ ID NO: 97491 - DNA, 88 bp, Mus musculus
agcccatgtgcaattttttttttgttaaaacacaagtttcaggtgactcaggtgtgaaaggacatgactgagaaagtaagcgtgtgct

SEQ ID NO: 97492 - DNA, 85 bp, Mus musculus; identical to SEQ ID NO: 57470

SEQ ID NO: 97493 - DNA, 85 bp, Mus musculus; identical to SEQ ID NO: 57470

SEQ ID NO: 97494 - DNA, 77 bp, Mus musculus
tgttgtgagttttgatgaggttcagttttaaattgggctgattttgcctgattgattttttttttcatctcatgata

SEQ ID NO: 97495 - DNA, 100 bp, Mus musculus
tgagagacacttcaaattccaagtcacagtaccatatgtgtaactaaactgcatagtatctattttttatgattggaatacattgatggtgtatatctca

SEQ ID NO: 97496 - DNA, 75 bp, Mus musculus
ggaaactcaagtcagctgagagtttaagctgggaaattgagtaatgaaactctctggctgtgtgtcagtcattcc

SEQ ID NO: 97497 - DNA, 63 bp, Mus musculus
agtcctgggtctgtctgtctctgccctgcaatgctggggtcacgggcacagacacccatgtct

SEQ ID NO: 97498 - DNA, 102 bp, Mus musculus
tggcatgtgtgcactgatctatgagtctgttgtgtgcacgtttgtgtagttgtgcactgtgtgcacacagagggcagagagattatcaggtattctctgtca

SEQ ID NO: 97499 - DNA, 77 bp, Mus musculus
gagcccagatactggacatggagctgtgcaaacagcatgtttacactgtttggactgctctttcttcatctcagtgt

SEQ ID NO: 97500 - DNA, 83 bp, Mus musculus
aggtcaggagattaggggcagagttctatctgtcttgctgattaaatttcagaggattattctcaggtccctgggattcactt

SEQ ID NO: 97501 - DNA, 107 bp, Mus musculus
agactagtgtatgcccacaggtattgatgtcattttgatgtaatagtgagtttaaaatgttattcatattttaatatctgacatctggcctgtccatgagctgaact

SEQ ID NO: 97502 - DNA, 70 bp, Mus musculus
gtgtctgtctgtctgtctgtctgtgattgtgtgtgtgtgcataatccagggccttatgcattctaggcac

SEQ ID NO: 97503 - DNA, 111 bp, Mus musculus
gtctagttataccatgcctgggttttaatctggagaatcacaatgactctgtctcagagaaacttgtcatcagtaattattccagcactattcatgagttaagttatagac

SEQ ID NO: 97504 - DNA, 165 bp, Mus musculus
atgcacatgtatatgtatgtatgtatatatgtgtgcatatgcattttatgtatatgcatacgtatatgtatatatgtgtatatatgtgtgtatgtatatgtgtgtatgtatatgcatatgtatatgtatatatgtgtgtatgtgtgtatgtatgtgtacatgtat

SEQ ID NO: 97505 - DNA, 102 bp, Mus musculus
tgagctttgaagagagggcttttagggctgagttctactggacactgttcagtggtgagtctctgtctggctctaagaaacagcttctttgataaaggctta

SEQ ID NO: 97506 - DNA, 102 bp, Mus musculus
ccaagaaagggattcaatgaagtcaggagggcaggaactgacatttctactcttgtctagctccacgtcagagaaaacgccaattccatccgtatctactgg

SEQ ID NO: 97507 - DNA, 201 bp, Mus musculus
atgtctggtgctatatatgtatatgtgtgtatgtatatatacatatatatatacacatgtgtgtatatgtatatatacatatatatgtgtgtatgtgtatatgctatatatgtatatgtgtgtatgtatatgtatatatacatatatatgtgtgtatatgtatatgctatatatgtatatgtgttcatatatatgcacaca

SEQ ID NO: 97508 - DNA, 90 bp, Mus musculus
aggatgttgggaggctgggcctagctgggtgacgtagtagcttggaggtcatcggtagtatattatgcccgagtcccttctctcacacct

SEQ ID NO: 97509 - DNA, 72 bp, Mus musculus
taagaacagacttggtctaggtgcctgttcacagcagtaaagccctaactaagacaactgtttttgttcttg

SEQ ID NO: 97510 - DNA, 102 bp, Mus musculus
cttcggtagctggtatattttgtgcactttatttctttaaagaaactttatttctttagataaacatgttgattatttcacaagggtctgcagcaacccaag

SEQ ID NO: 97511 - DNA, 85 bp, Mus musculus; identical to SEQ ID NO: 57439

SEQ ID NO: 97512 - DNA, 79 bp, Mus musculus
catgtggtctgtgaattgtatctcaggtattccgagcttttgggctaatatccactgatcagtgagtgcatactatgtg

SEQ ID NO: 97513 - DNA, 99 bp, Mus musculus
gagtacacacacgggctggagagatggctcagtggttaggagcactgactgctcttccagaggtcctgagttcaattcccagcaaccatatggtggctc

SEQ ID NO: 97514 - DNA, 145 bp, Mus musculus
tgacacagggtcctgaaatggtgagcagcgtcttccagctcaacactgaagtaccctttgactcccacagtctcactgtgtcattgtgccctttaatgacatcctaagcacactggaagagttagcactagggctccagttggct

SEQ ID NO: 97515 - DNA, 67 bp, Mus musculus
aggtaaaccctggagcgggagagatggctcagtgtttaagagaactgactgctcttccagaggacct

SEQ ID NO: 97516 - DNA, 74 bp, Mus musculus
tgaatttatctggagctggagagatggctcagcggttaagagcactgactgctcttctgaaggtcctgaattca

SEQ ID NO: 97517 - DNA, 140 bp, Mus musculus
tatacacacacatatatgtatgtatgtgtgtatgcatgtttatgtatatgtgtatatacatatataaatatgtatgtgtgtatgcatatgtgtatatgtatatatgtgtatatacatatatatatattcatatctttaca

SEQ ID NO: 97518 - DNA, 130 bp, Mus musculus
ggttatatgtaactactgagtgcttacatatggtgagactgcattggagggttctataaatatttgtatttacagaacttttaaataagtatttatatttgcacttcttctacagccttactgttaataa

SEQ ID NO: 97519 - DNA, 164 bp, Mus musculus
tacaatagctctgtgagatgtgtgcccttttgaacatttatttacttaaatcttcagaagttaaccttaggctatatcctagttgtggtgtgtgtgtgtgtgtgtgtgtgtgtgtgcgcgcgcgcgcatgtgtttcaacttgacacaagctagggtcatctagg

SEQ ID NO: 97520 - DNA, 108 bp, Mus musculus
gctgcctctggcccttcctcggtgtataggtctatcacgctctttctctctcttggattgcagcgggagggaggggcacctgcactgagtgagctgggggcattcagc

SEQ ID NO: 97521 - DNA, 86 bp, Mus musculus
acagatcttagtcatatgtgatttgtggatccttttttaaaaaaaaaattggataaaactaagtctctgtctgtctgtctgtctgt

SEQ ID NO: 97522 - DNA, 111 bp, Mus musculus
gagggggttgtggtggtagggggaggtctggagagatggcttagtggttaagagcactgactgctcttccagaggtcctggattcagttcccagcaaccacacggtgcctc

SEQ ID NO: 97523 - DNA, 118 bp, Mus musculus
gaagtcttatttaaacctgattttgttgtaagtaattacatccaagatgcatattatggactagtgtatatgatcttttgttttcacagatatataataaaattctttagaaggcatc

SEQ ID NO: 97524 - DNA, 108 bp, Mus musculus
gagatttattggctattttgtgtgtatgagtgctttgtctgagtctgtgtatgtgtgtatcatgtgcatgcctagtgcctcaaaggtcagaagagggctgtgagtctc

SEQ ID NO: 97525 - DNA, 100 bp, Mus musculus
ggctgtgtgtttgctagactcaggaatggatggaccaggtgacctgtggaggtcagtctgactctctaaattcagtgaggttgatgtgggcttttctgtc

SEQ ID NO: 97526 - DNA, 75 bp, Mus musculus
gaagctcactggagagagcactcagcgacctcactgaacacagagaagttgatctggtgcgtaactagaagcttc

SEQ ID NO: 97527 - DNA, 116 bp, Mus musculus
cagagctgtgagttcttggtgttagtttgtgagggcatgtaggggttcctctgtctgtcagtcacccgtgctcactctttcctccttatggacatatcagattatgactgttattg

SEQ ID NO: 97528 - DNA, 57 bp, Mus musculus
gtcatgaatagtgtccgtggtagctcaaggctttctcacccacactgtttgtatggc

SEQ ID NO: 97529 - DNA, 75 bp, Mus musculus
aggaagtgtgtcactggggggtgggctttgaggttttagatgctcaagccagaccctgtgtctcactctcttcct

SEQ ID NO: 97530 - DNA, 129 bp, Mus musculus
gttttctgtaccgcatgtgaggggagaaggcgagctgtagaacgagcaagcatgcactgactcactctctgattgtgggtggggtaagacggtggctttaagttcctgccacctcagcttgcctacaat

SEQ ID NO: 97531 - DNA, 107 bp, Mus musculus
ggggggtgggggtggggctggagagatggctcagtggttaagagcactgactgctcttccagaggtcctgaattcaactcccagccactacatggtagctcacaacc

SEQ ID NO: 97532 - DNA, 81 bp, Mus musculus
ggactgtggctagagttacacagggacaagactatattatatattctttgttcatgtttatgactgtaatcctcacagttc

SEQ ID NO: 97533 - DNA, 110 bp, Mus musculus
ttgaatattgatttctaagttgaatgcagtattataacaaagtcagaatatttttcttataattgaataacatgtttattagtactactttctacttggaatcaaagcaa

SEQ ID NO: 97534 - DNA, 119 bp, Mus musculus
aatgactggtgaggttaaatatcttttcatctgttcattggtgatttgtctatatttttatagaaatatctatttgagttcttgaatgctttgaaactgagttgttggtctctgttatt

SEQ ID NO: 97535 - DNA, 115 bp, Mus musculus; identical to SEQ ID NO: 59579

SEQ ID NO: 97536 - DNA, 115 bp, Mus musculus; identical to SEQ ID NO: 59579

SEQ ID NO: 97537 - DNA, 76 bp, Mus musculus
gtgtatgtgtgtgtgtgtgtatacatgcatgcatgtgtatgtatgtatgtatgtatgcatgtatgtatatgtgtgt

SEQ ID NO: 97538 - DNA, 97 bp, Mus musculus
ccaatattgtgagggctggtgagatggatcactggtgagagtgctccctgctcttgctgaggactctggttcaattcccggcatccatgcaaggtgg

SEQ ID NO: 97539 - DNA, 81 bp, Mus musculus
ggaatgtggcagagctgtgtgagtggctgagcccagccaattctaacctcccttcagtctctcacactggttctattttcc

SEQ ID NO: 97540 - DNA, 112 bp, Mus musculus
ggctcctgaatcccaggggattgtggttccctgtgtctccactcccatgctctgtctcacagcacagagtgcagacgcggggtgctgcttgcttgggtctcggatggatgtc

SEQ ID NO: 97541 - DNA, 108 bp, Mus musculus
atttataagatgaacaaacactaactcagatcagtgagagcagtcacagagaccattctgaagttgacctttcaagtgtctgattgtggatgtctgttgatctggagt

SEQ ID NO: 97542 - DNA, 85 bp, Mus musculus; identical to SEQ ID NO: 57439

SEQ ID NO: 97543 - DNA, 120 bp, Mus musculus
cctgtaccttccagaagtgactttcagctgttaacttggtctgctcactactgtctctgtgggcatgaggacagagcaggagtgacactcgtattctactgaaagatactcagacgggag

SEQ ID NO: 97544 - DNA, 110 bp, Mus musculus
ctatcatgtaattcccatggtgccgaaggagactctattttattgattcaacagttaatagaataagtcatttttatgacctgttcaaatggcttgagtttgagtgatgg

SEQ ID NO: 97545 - DNA, 113 bp, Mus musculus
gtgtggtttacgtatcagagtaattgtgtagagaagcttttgtttatatttatgaaacagtttgaggaatattagaactaggtcttctttaaaggtctgatagaattctgcac

SEQ ID NO: 97546 - DNA, 88 bp, Mus musculus
gtagaccacatagtttccatttaagtatttgtttctatatctataaggaactgagttactggaaatctaggctagacaactggtctac

SEQ ID NO: 97547 - DNA, 80 bp, Mus musculus
tgtttatatatgtgtacatgtgtatacatgcatatattcaatatatgtatatatacatataaatcacacatgtgtgaaca

SEQ ID NO: 97548 - DNA, 90 bp, Mus musculus
gtgtatatctgtgttcacacatgtgtgatttatatgtatatatacatatattgaatatatgcatgtatacacatgtacacatatataaac

SEQ ID NO: 97549 - DNA, 87 bp, Mus musculus
tgtggtatcctctgctctctctctcagtcatagaaataagtttcctgtaaacttcactctatgcttctgtgagaagtatttaccgga

SEQ ID NO: 97550 - DNA, 69 bp, Mus musculus
aaacgtcggggctggagagatggcttagtggttcagagcactgactgctcttccagaggtcctgagttt

SEQ ID NO: 97551 - DNA, 88 bp, Mus musculus
atatatatgtgtgtgtgtgtgtgtatatacatatatgtatataaatgtatatatatatgtgtacatatatacatacatatgtatatat

SEQ ID NO: 97552 - DNA, 105 bp, Mus musculus
ggaaatgaactaagacagaaaaaatggcattataccagagaacagcaacttggtagcttagtttagctccaaggagggctggatttcaatgccagggaaatttcc

SEQ ID NO: 97553 - DNA, 72 bp, Mus musculus
ctattggctgtgagtgaagagtctgatgtgtctgatttcagccacacagaggactagacatccacccattgg

SEQ ID NO: 97554 - DNA, 79 bp, Mus musculus
ggagaaatgatgtgtttctgagaagcacacgcctgtgctcttggtgtgttttacttactctgactgcctctctttctct

SEQ ID NO: 97555 - DNA, 128 bp, Mus musculus
tctgcagtgaggatgctcctctgtgggaagccctgggctcctttctcagccctcccggcaacactcactggctgtctcctactgcagagccacgtggatgcgtctttgttggtctagagtgcctgctg

SEQ ID NO: 97556 - DNA, 104 bp, Mus musculus
gactgcatgattcatttgctaactcttagaccgtttcagattagtttttatatatgtcaataaaagcctgggacgtggaagagactgaagtgtttcccatagtt

SEQ ID NO: 97557 - DNA, 108 bp, Mus musculus
ggtaagttgtcctgtgacctctacctgttttctgagacagtatctctgactggtttggaacttaccacatgggttaggtggctggacaggcaggctcaaaggtttacc

SEQ ID NO: 97558 - DNA, 78 bp, Mus musculus
gaacctgtctgccaaatgagaatatcagatgtcctgctcactctgttgctctctgctttattttcttgagacagggtc

SEQ ID NO: 97559 - DNA, 64 bp, Mus musculus
aagtatgtatgcatgtatgtatgtatgtatgtatgtatgtatgcatgtatgtgtgtacaggctt

SEQ ID NO: 97560 - DNA, 62 bp, Mus musculus
gtgtgtgtgcatgtgtgtgtatgtgcatgagtgtatgtatgtatatgtgcatgtctatgtgc

SEQ ID NO: 97561 - DNA, 112 bp, Mus musculus
atacgttctcaggtttagttcaaggagtgtttctgtggagctcattatacatgtttattatttcatgcatgtacagaattgcatgtaccatggagtagaattactgaagtat

SEQ ID NO: 97562 - DNA, 80 bp, Mus musculus
gcgcgaggaatttggaggggtatatctatctatctatctatctatctatctatctatctatccctctatgtcttcagtgt

SEQ ID NO: 97563 - DNA, 84 bp, Mus musculus
tattataccagtcaaaaagccatcagcagatggggagacctcacaagtctctgtctctcgctgaggagctattggtggccgatg

SEQ ID NO: 97564 - DNA, 112 bp, Mus musculus
gctgctgccatcaaactccagcttcttcagattttatatgtggactcagtctcagtaactctcagggaaagatctaggatttgagtgctgggttggactggactcccccagc

SEQ ID NO: 97565 - DNA, 130 bp, Mus musculus
gattttttattcatgttgacttgtgtgtgtacatgcatatgaatgcagttgctcacagaagccacagtggacaagtccccttgaggtggagtcaggaagcagatgtaaacctcaggtcactatgagccat

SEQ ID NO: 97566 - DNA, 103 bp, Mus musculus
tctggatttcttacctgggtttgtagtgggaagaaagggtcatgtaggtggcaggtccctagtgttttttttttttttaagccatacctcttcaatatttaga

SEQ ID NO: 97567 - DNA, 76 bp, Mus musculus
agtctcctggacagttttgacttaaggcttccaagttttaagatttgtcaccctgggtctctctgtccatctcgct

SEQ ID NO: 97568 - DNA, 78 bp, Mus musculus
ggagctttaggagaatgggagtaaggggtctaaaatcatattttgagtatagagtttctagcttctttataaagtttt

SEQ ID NO: 97569 - DNA, 69 bp, Mus musculus
ccatgaagtgagtctctgtctctgcattattatggtctctccatcatagtgtgtggcctcacatcatgg

SEQ ID NO: 97570 - DNA, 202 bp, Mus musculus
tcatatatatatatatatatatatatatatatatatatatatgatatatatgatatatatgatgtatatgtgtgtgtacatgtgtatgtgtatatatatacatatatatgtatatgtgtatatatatgcatatatgtgtatgtatatatatatatatatatatatatatatatatatatatatatatatatattagacatgt

SEQ ID NO: 97571 - DNA, 85 bp, Mus musculus; identical to SEQ ID NO: 57470

SEQ ID NO: 97572 - DNA, 100 bp, Mus musculus
tgagttatctatttacatgaaacccacatgacagaagagagtgtcagatcctattatagctgggtgtgagccaccatgtggttgctgggaattgaactca

SEQ ID NO: 97573 - DNA, 109 bp, Mus musculus
gatgctcagtgttgggggctgacttgggacagggactcctcagaaactgagggactctctcttgctctcagtgtccttgctggggtcatggtccagggtttcttactcc

SEQ ID NO: 97574 - DNA, 104 bp, Mus musculus
aagataagttagtgaaatgtaatgggactggactcaaggtcagtgtctgtctctgataaagcaaggttgtcactgaatccagcttactacaccatattcttctt

SEQ ID NO: 97575 - DNA, 86 bp, Mus musculus
tgtcaggtataggtctctctgtgatgcattaaattctatagtgcttcattgtgggtgccgtcacagaagagaaacaggatacgata

SEQ ID NO: 97576 - DNA, 68 bp, Mus musculus
gctgagagtgatgttgagaggtgcctggatcctgtgggtgctaatcaatggattactgattgatcagt

SEQ ID NO: 97577 - DNA, 99 bp, Mus musculus
ttttatatacatatatacatacatacatgtatatatgtgtatgtatatatgtatgtatataagaatgtatatatacatatgtgtgtgtttatatatatg

SEQ ID NO: 97578 - DNA, 63 bp, Mus musculus
ctttatttattttctgttaggggggcaggtacacactgcctcactggatgtgaaagtcagaag

SEQ ID NO: 97579 - DNA, 66 bp, Mus musculus
tgcctctctcggtcactaacaatggaactttggaggagggtatatttagtgaccaagataaaggca

SEQ ID NO: 97580 - DNA, 116 bp, Mus musculus
acacttcagtatattgctctaggtccagttgtagaaagtgactgaagagagacaggtctcatgaagatcattgggttaaacgagagctagtacaaagatggcaatagagtgttgtg

SEQ ID NO: 97581 - DNA, 154 bp, Mus musculus
tatgtatatgtatatgtatatgtatatgtatatgtatatgtatatctatctatctatctatgcatatatatgttatgcatatatatgtatatatatgcacttatttttgtacatatgtgtgtatgttgtgtatattttgaatgtgtattatgta

SEQ ID NO: 97582 - DNA, 75 bp, Mus musculus
gcatatgtcgccagaggactgataaccttccgccttatttgcgtcatggtctctgtcactcactggtgcttgtgt

SEQ ID NO: 97583 - DNA, 62 bp, Mus musculus
gctgggaaatacagggtcagacctcatcccatcccgctgttctgactgtgtctctcactagc

SEQ ID NO: 97584 - DNA, 138 bp, Mus musculus
aggcacatggcctggcagtcagtggaggtcagaaggcaacttgggtgtcagttcgtatctgcctctctgtctgagacagtcttgtttgcagctgtgttacatgtttcacggtagttgacctaagagtttctgggggag

SEQ ID NO: 97585 - DNA, 117 bp, Mus musculus
ctggcgggtgggagcgtggcggctgtggaagggcaaggcaaggcaggagacacttactctctgtcagcgtcccggctcccgaacttctggttttcaaagcatcccaactcggcccag

SEQ ID NO: 97586 - DNA, 83 bp, Mus musculus
aggggaaaggatcaaaggtggcagcagaatggaattgtcctttcatcccaatgcactgctctcttctgtgactcttatcccct

SEQ ID NO: 97587 - DNA, 80 bp, Mus musculus
tctgaactggctgctgtctgtgtatctgtgtgtgacgccatgttttaggtatctctgcatagacagcctgcctgtctggg

SEQ ID NO: 97588 - DNA, 96 bp, Mus musculus
tacacacaagtaacattaaacacacagggaaggttgggtttacatatttttgcatatatatgtatatatacaattgtgtgtgtgtgtgtgtgtgta

SEQ ID NO: 97589 - DNA, 84 bp, Mus musculus
gcttagtaactttggtttgtgtccttgtcagtatctggtctctatccagggatttgtctgggtcacttctgtttttcattcggc

SEQ ID NO: 97590 - DNA, 85 bp, Mus musculus; identical to SEQ ID NO: 57439

SEQ ID NO: 97591 - DNA, 87 bp, Mus musculus
gtctgttgatggtcctcagactcagtgtgtgtaaaagtggtgtctgccatgaatgtattgcacgcatccctgacttgccattatgac

SEQ ID NO: 97592 - DNA, 78 bp, Mus musculus
aatatatatatacatatacacatatacatatatatacacatatgtgtatgtttatgtatacatatatttatatatgta

SEQ ID NO: 97593 - DNA, 82 bp, Mus musculus
tgtatatatatacatatataaatatatgtatacataaacatacacatatgtgtatatatatgtatatgtgtatatgtatata

SEQ ID NO: 97594 - DNA, 82 bp, Mus musculus
catagtaacatagttacatagaaacatagtaatatagtaacatataggtgttactatagtatgtatctaagtatttactatg

SEQ ID NO: 97595 - DNA, 90 bp, Mus musculus
atgtatatgtatatgtatatgtatatatacatataatatatatacatataatatacacacacatatatacatatatatatatatatatat

SEQ ID NO: 97596 - DNA, 112 bp, Mus musculus
tgtatgtatgatgtatgtatgtacatatatatgtgtgtatatatgtatatatgcatgtatatgtgtctatatgtatatatgtgtatatatatgtacatatatgtgtatatat

SEQ ID NO: 97597 - DNA, 111 bp, Mus musculus
ttgccttagttttagcatggcatctatggctctctactgagcacattggaaacaatgtctcaagacatttagagaggactgtgtccctgtctgctctcctaattgtagtaa

SEQ ID NO: 97598 - DNA, 203 bp, Mus musculus
gtgtcatatatatgtatatatgtgtgtgtatatatatgtgtatgtatatatatatgtgtgtgtatatatatgcacatatatatgtgtatatatgtatatgtatgtatgtgtatatatatatatatatatatatatatatatatagtgtgtgtgtgtgtgtgtgtgtgtttgtgtgtaaacacatacataataataataatata

SEQ ID NO: 97599 - DNA, 74 bp, Mus musculus
gagacttggagctgtcatttctagcatggtgcgttccagtgctgtgtcagtgtgtgacaagtaacacagttctc

SEQ ID NO: 97600 - DNA, 117 bp, Mus musculus
agatgtctagttggggtgtgagttctgtaattcggtgattccacttagatttctttcatatatgtatatatttcaagaagtttctactgacccagaagctatctccaactgataact

SEQ ID NO: 97601 - DNA, 85 bp, Mus musculus
ggtacagcttctgtctgcctttgtctctgaaaatctccccgaaaggcctaccatgctgtgaggaagtgcaagcgcaagctctgcc

SEQ ID NO: 97602 - DNA, 69 bp, Mus musculus
ccagagccctagacttatatgagtagccattcaagagagggcagtcttgtgtggctggggtacctgtgg

SEQ ID NO: 97603 - DNA, 61 bp, Mus musculus
ggtgtgggaaggcccttgagcattcctctaaattgagtgagtgtcagtctgtgattacgcc

SEQ ID NO: 97604 - DNA, 114 bp, Mus musculus
ggaggagatggcctggaaagcagagaaaaggtcaggctgtctgtgtcactgcctcatacagtggcagagactatgttgtgtctcttacctccagctttctgcatatatccatct

SEQ ID NO: 97605 - DNA, 105 bp, Mus musculus
gctgaaggagaaatattgatcaggtttggagtttcatttcaggttctaggatgttttgtattgtctgtttcctatgtcatccaccttgggatatcttcctgttgc

SEQ ID NO: 97606 - DNA, 65 bp, Mus musculus
taccctctgtctcactgagagccttccagtttgcctggacaggaaagacagagaaccagaaggtg

SEQ ID NO: 97607 - DNA, 61 bp, Mus musculus
tctctctctctgtgtatgtgcactcgcgcaagtgtgtgttcattaatgtaggtattagagg

SEQ ID NO: 97608 - DNA, 85 bp, Mus musculus; identical to SEQ ID NO: 57439

SEQ ID NO: 97609 - DNA, 76 bp, Mus musculus
gtgtatgtatacatgcatgtgtatatatatatgtacttgtgtatgtgtatatatatatatgcatgtgtggatatat

SEQ ID NO: 97610 - DNA, 111 bp, Mus musculus
tgtgcaagcacacagataaagaggctggagagatggctcagtggttaagagcactgactgctcttccagaggtcctgagttcaaatcccagcaaccatatggtggctcaca

SEQ ID NO: 97611 - DNA, 120 bp, Mus musculus
agatgagggaggacagccagccagagctacatagtgagaccctgtgtgtgtgtctgtgtaatacctatacctatacatatatctatacctatatctatctatctatctatctatctatct

SEQ ID NO: 97612 - DNA, 66 bp, Mus musculus
ggcggattcctctgctttccgtgggacccagtaagaatttttccacagtagagtggacattgcgcc

SEQ ID NO: 97613 - DNA, 81 bp, Mus musculus
aggggatagatccccaggtggggcagtctctggatggtcattccttcagtatctgctccacactttgtctctgtgtctcct

SEQ ID NO: 97614 - DNA, 95 bp, Mus musculus
ggaaactcaggggcaggaattcagaagaaaacaaccgaggaaagaaagcctcttgtttgctttctctctgactcactcactcaccctgggtggct

SEQ ID NO: 97615 - DNA, 103 bp, Mus musculus
ggaacagaggggaacgtggtgagaccctgagagaacagagtgtgcagagagcatctgtgagaagctgccgcaggaagccactgtctcagcataaacccacgcc

SEQ ID NO: 97616 - DNA, 109 bp, Mus musculus
ctcagggtttcaattggaggtcgctgggtttcactgtttctgtgtctgtgctaaggcaaaacctcacagcagggagaggaacaaggccacccaccttactgccactagg

SEQ ID NO: 97617 - DNA, 73 bp, Mus musculus
tagtccagcattagagactgaagagagtctagagatggtttttccaccctgcagtctccatgatgtgaggctg

SEQ ID NO: 97618 - DNA, 105 bp, Mus musculus
tatcaggtctttactaactggtagctatcacatatgtcaattaaatttttttttatttgacacagtctgtgtgtgagtagagactttggacaatggagctaggta

SEQ ID NO: 97619 - DNA, 85 bp, Mus musculus; identical to SEQ ID NO: 57439

SEQ ID NO: 97620 - DNA, 83 bp, Mus musculus
taaacatatatgcatatatatccctgtctaaacatatatagtgtatatgcatgtatgtatgtatgtatgtttacattgacagg

SEQ ID NO: 97621 - DNA, 86 bp, Mus musculus
tcttgtctctgtctctctatttctgtgtctgatacaatccaaagatagctcctagacctagtgatgaagggcaatgagagattgga

SEQ ID NO: 97622 - DNA, 93 bp, Mus musculus
tcaagggcgagaagtgactcagacactggcacagaaatatcacctgatcttggcatgatatggcagactgaggcgagcctgtgagttttatct

SEQ ID NO: 97623 - DNA, 83 bp, Mus musculus
tagagctttgttctctccatcaaatgtgtgtatgtatatatgtgtatatatgtgcatgtgtaagatggttggagcttgctttg

SEQ ID NO: 97624 - DNA, 114 bp, Mus musculus
tctcattcttttaagtgtagttgttatttttatgtcatatatatatatatgacataaatatatatatatatgacagagagattatcctgataccaactacacaaatgattgaga

SEQ ID NO: 97625 - DNA, 105 bp, Mus musculus
gcaactcgctcaggtagaggagtccaatagcagcagagctgacactggagctgggctatctgtctctctgtgtgagaattttgccttgaaagtgacgcctgacct

SEQ ID NO: 97626 - DNA, 116 bp, Mus musculus
atatatatatatatatgtatatatatatacatctacttacatatatatatgtatgtatgtatgtatatatatacacatatacatgcatatatatatgtatgtatgtatatatgtat

SEQ ID NO: 97627 - DNA, 152 bp, Mus musculus
tatatatatacacatatatgtatatatgtatatatgtatgtatatatgtgtgtatatatatacacatacatacatatatacatacatacatatatatatgcatgtatatgtgtatatatatacatacatacatacatatatatatgtaagta

SEQ ID NO: 97628 - DNA, 106 bp, Mus musculus
atagctgacaagccatctctctgaccagtaaatgcagggtctgtgaatgaaatatttttgtttacaaactgtgagtgggggttttgttttgttttgtttttgctat

SEQ ID NO: 97629 - DNA, 110 bp, Mus musculus
atatatgtatatgcatatgtggatatatatacacatactatacatacacactctctctttatatagatatatgtacactcatatatccacatatgcacacatacatatat

SEQ ID NO: 97630 - DNA, 69 bp, Mus musculus
ttgcagtctctgtgtgcttctcttctgcttttgtgagtagctgtggagagccgtgctgtgagcaattgc

SEQ ID NO: 97631 - DNA, 82 bp, Mus musculus
tgtatttaactggcagataaatctagctaggataatgacacaagattgtcagtctgagaatttgtttctaggtcaaaataca

SEQ ID NO: 97632 - DNA, 89 bp, Mus musculus
gttgcatcaggccattgctgtgccattctctgtgtgtgtgacacacatttgcatggatggatggatgtgcatgtgtgtgccactgtaac

SEQ ID NO: 97633 - DNA, 104 bp, Mus musculus
gagaaaacaaagctcttcggttctagaagtgacttacacacagccacgctctcagtctgaagccaacagtgggtgttgtctgcctgctactggagggctgtctc

SEQ ID NO: 97634 - DNA, 105 bp, Mus musculus
gaagtacatatttggttgctttaatgttttgatttctgtctgcctgtctgtctgttttacagatggccaaaagagattcatatgagaagaaattaaattaatttc

SEQ ID NO: 97635 - DNA, 85 bp, Mus musculus; identical to SEQ ID NO: 57439

SEQ ID NO: 97636 - DNA, 80 bp, Mus musculus
gctacaccactgacctattttaattttattgtcttgtggtgagtgagtgagttagtgagtgagtgagtgagtgagtgagt

SEQ ID NO: 97637 - DNA, 217 bp, Mus musculus
tatatatatgtatatttctaggtgtatacatgtgtatgcttatgttcatgtgtatgtgtgtctatttgtatatttgtgtgcctgtgtgtatatttgtatgtatgcaaatgtgtgtgcatttgcatgtgcttgtgtctgtgtggaaatgtatgcatatgtgtgtgtatgtgtgtgtatgcaagtgtatgcgtgtgcagtttaggtgctgatgcagtat

SEQ ID NO: 97638 - DNA, 66 bp, Mus musculus
tctagttctcagactctcagacacccagatgccactgggagccaagggagagctgaatgaagtggg

SEQ ID NO: 97639 - DNA, 81 bp, Mus musculus
gtccgatgctcgatttgaaaaaattcattcagattccacaggacctctcctgtgtgtgtctgtctgtcaaattcatcctac

SEQ ID NO: 97640 - DNA, 66 bp, Mus musculus
gaggtgctgggtgtggtggcctttcctgcttggaatgctgtgtcactgcctgtgtctctgtatctc

SEQ ID NO: 97641 - DNA, 86 bp, Mus musculus
ggccatggtggtctgacaggatacattggcacaatttcaatatttttgtatctgttgaggcctgttttgtgaccaattatatggtc

SEQ ID NO: 97642 - DNA, 93 bp, Mus musculus
gtgtttcattctgcagaagttcagcatgatgcggtctcccattacaagaatagagagacaacagagtgagcaagcaggcctgatttaaagcac

SEQ ID NO: 97643 - DNA, 86 bp, Mus musculus; identical to SEQ ID NO: 97641

SEQ ID NO: 97644 - DNA, 89 bp, Mus musculus
gtaggcatagctcaggctctgtcactgtctgttgagttctatttattttccctccaaacatcacatgtcctccatgagtcttgcctcac

SEQ ID NO: 97645 - DNA, 83 bp, Mus musculus
gtgtgtgtgtgtgtgtgtgtgtgattctgaatcataaggatccagctggtttttatgaagaattaacaagctgccatattgtc

SEQ ID NO: 97646 - DNA, 83 bp, Mus musculus
gctagcaagattttgctgaagggaccctggtatagctgtctcgcatgagcctatgccagtgccactctgtttgtctcattagt

SEQ ID NO: 97647 - DNA, 113 bp, Mus musculus
taggaccatttgtttggtatatctttttctaactctttactctgaggtaatgtctatctttgatgttgtgatatgtttcttggatgtacagatgggtggatcctgtatacaca

SEQ ID NO: 97648 - DNA, 80 bp, Mus musculus
gctccacctaccaatatgtatatgtatgtatgttcgtatgtatgtatgtatgtatgtgtgtgtatgaaggttgttggagc

SEQ ID NO: 97649 - DNA, 106 bp, Mus musculus
gttagttgaagctttgctccatccacccaatgtgtgcatgtgtatgtctgtgtatgtatgtatgtatgtacatatctgtaggtatatgtgaagccagacgtgtggc

SEQ ID NO: 97650 - DNA, 101 bp, Mus musculus
tcctagttgtgtcagaactcctcagagtccagctgtctctgtgaccctgtcattctgggatgctgtgatcctgagaagtgcatgtgtcagagctcctggga

SEQ ID NO: 97651 - DNA, 73 bp, Mus musculus
ctatatatgtatatgtatatgatgtatatgtatatgatgtatatgtatatgtacatatatatattcagtatag

SEQ ID NO: 97652 - DNA, 83 bp, Mus musculus
catgggacaatttcaatatttttgtatctgttgaggcttgttttgtgtccaattatatggtctattttggagaaggtcccgtg

SEQ ID NO: 97653 - DNA, 84 bp, Mus musculus
gactggagaactgtgatactaagattggaagtatctggtgtcccaggttttccctccctgtgtccctctgtatccctctgtgtc

SEQ ID NO: 97654 - DNA, 74 bp, Mus musculus
gtctgtctgtctgtctgtctatctgttgtaaaagcctcaaggctggtttccatggtggccacacaagtttagac

SEQ ID NO: 97655 - DNA, 107 bp, Mus musculus
atggatgatttctgcctggcttctgtgacagttaattttgtgtctgaataaagggatgcctagagagacatagagctttccttctggctatgtatggagattagcat

SEQ ID NO: 97656 - DNA, 87 bp, Mus musculus
ttcatgagacttaagtctggcagctttggacacttgaattcagtggttgatagctccatgggtcagcatctgcttgagtgccatgag

SEQ ID NO: 97657 - DNA, 98 bp, Mus musculus
gggaaactagggggctggagagatggctcagtggttaggagctctgactgctcttccagaggtcctgagttcaattcccagcaaccacatggtggctc

SEQ ID NO: 97658 - DNA, 85 bp, Mus musculus; identical to SEQ ID NO: 57470

SEQ ID NO: 97659 - DNA, 67 bp, Mus musculus
gcacagtctctgcctgtctctgaccctggtttcgcctcctgttcaatgacggggttgtaggaggtgc

SEQ ID NO: 97660 - DNA, 85 bp, Mus musculus
ggcctcgatccacgtttggggtggggtggggggtgctgaggcataaactgaagctgatgactcctctctctctcagcgggaggcc

SEQ ID NO: 97661 - DNA, 86 bp, Mus musculus
ggttgattcaagttagtaagaaaacatgcacttcttccccgagatgactctgtaacagagaagtgagtgttcagatggcttcagcc

SEQ ID NO: 97662 - DNA, 130 bp, Mus musculus
tgtgacatcatcaccctaggagctgcaagcacgccgatgacctgccagttccctcggtctgtctgtcacataccatgaggtgccaggcacagcacagggcactgaggaggcagtggtgacccagagcttc

SEQ ID NO: 97663 - DNA, 104 bp, Mus musculus
cagggtgggagtgacagggccaccaggtgttcaggcagtggctcctcagacgctctgtgtctggctgcatctctcaagggctccacactcacttcacacagctg

SEQ ID NO: 97664 - DNA, 76 bp, Mus musculus
cacaaggtcaggttctgaccgtctctgacgctcacagaaagccatctgagacgttgcggtagaagatgagtaggtg

SEQ ID NO: 97665 - DNA, 77 bp, Mus musculus
agagttggtgacggtggctctcgggcctggcagagctcacctgggctgatggcatctctgtgtcactgtcagactct

SEQ ID NO: 97666 - DNA, 78 bp, Mus musculus
ccttggcaggactcgtggtcagagtcgcagcagctggtgtctccccactgtcactctctgactcctcactgctcttgg

SEQ ID NO: 97667 - DNA, 107 bp, Mus musculus
gtgtgtatgtggtgggtatgtctctgtgtgtatgtggtatatatgtgtgtgtctatgtgtctgtgtgtccatgtcttcaaaggtcagagtatccttcctcagaacac

SEQ ID NO: 97668 - DNA, 88 bp, Mus musculus
gtctctgtacatgcatgtctctgtctctgtgtgtggttatctgtatgcgtggtgtctgtacgtggtatctgtatgtgtgtatctagat

SEQ ID NO: 97669 - DNA, 120 bp, Mus musculus
ccagggctatcctcgtcccctctcctgcagggtcttgctccaggctactcacgtgccaacctctgtgtgtgtgtctgcctgtctgtgtgtctggggagcagggttcgcagggacacctgg

SEQ ID NO: 97670 - DNA, 101 bp, Mus musculus
tgattctttaagaaaataacttctgggactggagagatggctcagtggttaagagcactgactgctcttccagaggtcctgagttcaattcccagcaatca

SEQ ID NO: 97671 - DNA, 111 bp, Mus musculus
ttccagagatgccaagtctagataaccccttcctgatagcctcccctgacctgactcactgtgtgttagtcatgctggctctggaagaaatcttgtcagctgactttgggg

SEQ ID NO: 97672 - DNA, 96 bp, Mus musculus
gaataccagaatgcaggaagtagaggcaggaggatcatcatcatatcaacaccttgtctctgtctgtctatctgtctgcccatccatctgtctgtc

SEQ ID NO: 97673 - DNA, 138 bp, Mus musculus
ggatcctttttctcatactgggttgtctcctccagccttaatacaacgggaggtgcctactcttagtgcaacttgatgtgccatgcttgattgacatccatgggaggtctaccttgttctctgtgatataacaccacc

SEQ ID NO: 97674 - DNA, 64 bp, Mus musculus
gtgactaggcatgcgagtggacagcagagatcaattctgggtgtctgcctcagtgcctcttcac

SEQ ID NO: 97675 - DNA, 88 bp, Mus musculus
gaagggttttgtgtttctccaaggacaggtagtcacggtagtgactaagctatgtctgagtggttaagtagcaaccagaagccacttt

SEQ ID NO: 97676 - DNA, 70 bp, Mus musculus
gtgagattcctagtggcacacatttagacattgtgctggttttctgtctctgtgtgacacagggccttgc

SEQ ID NO: 97677 - DNA, 61 bp, Mus musculus
ttttatcagcactgtggccctctggggtcttcagaacccccactgtgctttgctggttgaa

SEQ ID NO: 97678 - DNA, 119 bp, Mus musculus
tgactgccagcagagcttgcttcctcctgtgaggcacagaaggggcagctcatttcagagcctgctttctagaggtggcaaaacgggccaggaactggagctagagctggtctaagcca

SEQ ID NO: 97679 - DNA, 67 bp, Mus musculus
tatgtatgtatgtgtgtatgtatatgtatgtgtgtgcgtatgcgtatatgtatatatgtatgtatgt

SEQ ID NO: 97680 - DNA, 82 bp, Mus musculus
cgatgtcagcacagtctctgtcacatagcaaaggccctttgtttgttaactgaataaatgagaccatagcgctggtgtgtcg

SEQ ID NO: 97681 - DNA, 92 bp, Mus musculus
gacaaggcttcaccgcctaaaggatccagagccttcccaaacagcatcaccaggaggctctgtgtatgtgtctgtctgtgtgtctgtctgtc

SEQ ID NO: 97682 - DNA, 96 bp, Mus musculus
gtctgttagaaaaatccttaggggctggagagatggctcagcggttaagagcactgactgctcttccagaggttctgagttcaattcctagcaacc

SEQ ID NO: 97683 - DNA, 94 bp, Mus musculus
caaaatgtggagcacatacaaatgcatatgtatatgtatatatatcctatacctaaacatgtgcatgcactttatgtcaggctgctgggggttg

SEQ ID NO: 97684 - DNA, 119 bp, Mus musculus
gcggcctgcgtgcggagcgcctgtctcccagcctgaggtgcagtgctgcatctctggtcagttgggagtctgagatgaagcactgtagctcaggaagggagaagatgtcctgcagccgt

SEQ ID NO: 97685 - DNA, 78 bp, Mus musculus
gcttcacatgcccatgcaggctgccgtgggacagccatggaacgtaagtccctggctgcctgcatgccagattctagc

SEQ ID NO: 97686 - DNA, 73 bp, Mus musculus
gggggggcctggagagatggctcagcggataagaacactgactgctctaccagaggtcctgagttcaattccc

SEQ ID NO: 97687 - DNA, 104 bp, Mus musculus
tacaaagactgtctcaaaccccacacatgcacacatatgtatgtaacgtaacactgtatatatatatatatatgggtgcatgtatgtacttggtctaaattgtg

SEQ ID NO: 97688 - DNA, 68 bp, Mus musculus
catgcacccatatatatatatatatacagtgttacgttacatacatatgtgtgcatgtgtggggtttg

SEQ ID NO: 97689 - DNA, 98 bp, Mus musculus
gagccccctgggggctggagagttggctcagtggttaggagcactgactgctcttccagaggtcctgagttcaattcccagcaaccacatggtggctc

SEQ ID NO: 97690 - DNA, 76 bp, Mus musculus
cacttcctgaagggaggttctgtgttgagtacatttatttcttttattagaagggacagagagcctcaggaggatg

SEQ ID NO: 97691 - DNA, 107 bp, Mus musculus
aaggctgcagcattaggaaagttgagaaacacgggtgtaataacaagagaaagtcatgatcaatttttttttaagattagggtctccacgtatcccaagctgatctt

SEQ ID NO: 97692 - DNA, 90 bp, Mus musculus
gtgtgtgtgtgtgtacatgggtgtagaggctgatgttggtgtctttctctgtggctgttcaccttagtgtttttgtcaggctctcacact

SEQ ID NO: 97693 - DNA, 87 bp, Mus musculus
tccattgatctacctgtctgtcactgtatcactagcatgcagttttatcacaattgctctgtagtacagcttgattgaggtcaggga

SEQ ID NO: 97694 - DNA, 117 bp, Mus musculus
tatgtgtgtgtgtatatacataatatgtatgtgtgtgtatatacatatatttatttacataaatatatgtatatatttacataaatatattataataaatatacataaatatacata

SEQ ID NO: 97695 - DNA, 76 bp, Mus musculus
gctctttaatgtgtggtacaagtgtgtgtatgtatatatatacatacatgcatacggagtacatgtgtgctggggc

SEQ ID NO: 97696 - DNA, 80 bp, Mus musculus
ctcctacttagccatctcttcagccctgtatgtaactttttttaaaaaatgcaggcatgtgggagggaggccttagtgag

SEQ ID NO: 97697 - DNA, 64 bp, Mus musculus
cagtttgcaagtgcatgtggatgtgaagtgtccccgcacatgaatgtctcatgtaggcagcctg

SEQ ID NO: 97698 - DNA, 88 bp, Mus musculus
ggttgtctatgagaatccccccctgtatttgtcagtctctgacagagcctctcaggagacagctctatcagactcctgtcagcatgca

SEQ ID NO: 97699 - DNA, 67 bp, Mus musculus
ctgggcagctcagttccctgtgtgtaagaagtgcctggacactgcacaagggatatggagggcttgg

SEQ ID NO: 97700 - DNA, 76 bp, Mus musculus
tctgactcccttacactctgtctctgaatgcttccacgctgctgcaagcacacagaagcgttggttgggagcaaga

SEQ ID NO: 97701 - DNA, 67 bp, Mus musculus
ctgtgtgtgtatatatgtatgtatagatgtatatatatatattagtttatatatatgtacacattag

SEQ ID NO: 97702 - DNA, 60 bp, Mus musculus
ggggccggacagagttagcatgggaactctgagttgtctgtctgtgacgctgtgcgcctc

SEQ ID NO: 97703 - DNA, 96 bp, Mus musculus
ccattttttgctgtgcaacttgaatctggcaattattgtttttttatacaaaggttgaagaaaactccatgtcagctggcacaaattaagagctgg

SEQ ID NO: 97704 - DNA, 92 bp, Mus musculus
tataatatatatgtaattttatatatgcccacatgtacatgttcatatatacagattatatgtatgtatatatgacagcttgggtgtatgta

SEQ ID NO: 97705 - DNA, 85 bp, Mus musculus; identical to SEQ ID NO: 57439

SEQ ID NO: 97706 - DNA, 114 bp, Mus musculus
agggtcctcacttaaatatcaagaaatgagagttaccttgaaggctataattgaagaagagtgaacaaagagagccagaggtctccagaggtctgtccttaagtccaccacctt

SEQ ID NO: 97707 - DNA, 73 bp, Mus musculus
acactttccaggaggatttggtggaactggtgattttagtaggatcagaagagagagtgctctcagaaagtgt

SEQ ID NO: 97708 - DNA, 84 bp, Mus musculus
tgggattttttataaccttacagatcttattattgtttccatatgtttttatgggtgttctgtgtctgtgagtgtgtgtgccta

SEQ ID NO: 97709 - DNA, 75 bp, Mus musculus
ttcaagtcagtgtttctctgtgtaacaagtcctggtggtcctgggactttctttataggtcatgctggctttgaa

SEQ ID NO: 97710 - DNA, 69 bp, Mus musculus
atatatatatatatatatatatatataaaatgtgtgcatgcttgtgtgtgtgtgtgtgtgtgtgtgtgt

SEQ ID NO: 97711 - DNA, 65 bp, Mus musculus
gcaacattgcctggactgtcctgggtctcacacctgagatcactgtcactctgggactcgtctgc

SEQ ID NO: 97712 - DNA, 81 bp, Mus musculus
agggtcatctaactgcacccagtgtcactcaatgtcacccaacctgggaatcacagtcattggcagtggttaagttgcctt

SEQ ID NO: 97713 - DNA, 68 bp, Mus musculus
gggccctggtgagtgccagtgttcttatgtcttcccgtggctgtcacactgtgtcttttcagtggctt

SEQ ID NO: 97714 - DNA, 113 bp, Mus musculus
tgccaatgggtgctgaggacaactgttcataaattgacctcagactgtctctgtgcctaggtggtaatagcagttgactaaatgaggcaatgtttctgaaaaaatgaattgtc

SEQ ID NO: 97715 - DNA, 80 bp, Mus musculus
aattaaatttttgaggggctggagagatggttcagctgttaagagcactgactgctcttccagaggtcctgagtttaatt

SEQ ID NO: 97716 - DNA, 109 bp, Mus musculus
gcaaacagacaagcatggctgttcgtaccacgtgtgctcagggtcactcactgactattccctgggctttaaagcacacgcactgtccatcctgctttaactgaaaagc

SEQ ID NO: 97717 - DNA, 88 bp, Mus musculus
tgtttcatgtgtctgtgtctgtgtctgtgcctgtgtatctgtgtatgtgtgagagagagacagagagagagagagagagagagagaga

SEQ ID NO: 97718 - DNA, 117 bp, Mus musculus
cggctgtcagtacaaaggacagcggagttcagtgtcatctgcccagaaaaggcctttagacaagagagacttgcaggtagatgactgagagcttcccagcctgctgtgagagggaag

SEQ ID NO: 97719 - DNA, 89 bp, Mus musculus
ggtgtgtgtgtgtgtgtgcttgtatatatgtatgtatatacattccaggtgtgtgtgtgtgcttgtatatatgtatgtatatacattcc

SEQ ID NO: 97720 - DNA, 124 bp, Mus musculus
gtgtgtgcttgtatatatgtatgtatatacattccaggtgtgtgtgtgtgtgtgtatgcttgtatatatgtatgtatatacattccaggtgtgtatgtgtgtgtgtgtgtgtgtgtgtgtgtgc

SEQ ID NO: 97721 - DNA, 175 bp, Mus musculus
gtatatatgtatgtatatacattccaagtgtgtgtgtgtgtgtgtgtgtgtgtgtgtgcttgtatatatgtatgtatatacattccaggtgtgtgtatgtgtgtgtgtgcgcttgtatatatgtatgtatatacattccaggtgtgtgtgtgtgtgtgtgtgtgtgtgtgcgtgc

SEQ ID NO: 97722 - DNA, 86 bp, Mus musculus
gtatgtatatacattccaggtgtgtatgtgtgtgtgtgtgcttgtatatatgtatgtatatacattccaggtgtgtgtgtgtgtgc

SEQ ID NO: 97723 - DNA, 71 bp, Mus musculus
gtgtgtgcttgtatatatgtatgtatatacattccaggtgtgtgtgtgtgtgtgtgtgcgcttgtatatat

SEQ ID NO: 97724 - DNA, 72 bp, Mus musculus
tatatacattccaggtgtgtgtgtgtgtgcgcttgtatatatgtatgtatatacattccaggtgtgtgtgtg

SEQ ID NO: 97725 - DNA, 87 bp, Mus musculus
gtgcttgtatatatgtatgtatatacattccaggtgtgtgtgtgtgcttgtatatatgtatgtatatacattccaggtgtgtgtgtg

SEQ ID NO: 97726 - DNA, 83 bp, Mus musculus
cacacagaggagagagtggtcagcttagcagtgttaagtggattacttcccattgtcgaagctgccaaacccttctccatgtg

SEQ ID NO: 97727 - DNA, 114 bp, Mus musculus
gctgtttttagttccaagtccctgtggatgtttgagaatgagacatgtgtttttcatgaattaatatgtatctacattgctcactcacaactgcacccaccctccagagaaagc

SEQ ID NO: 97728 - DNA, 121 bp, Mus musculus
acttatgtgtgtgtgtgtatatatatatgtgtgtgtgtgtgcatatatgtgtatatatgtatgtatatgtatatatacacgtgtatatatgtgtacatatgtatttatagatacatatata

SEQ ID NO: 97729 - DNA, 114 bp, Mus musculus
atctggtttttgttataaatagtctttagaccattaggcttattattactatgttttactatgtcataataaaccaaatggcaagaaaatatttaattggataaattacctggt

SEQ ID NO: 97730 - DNA, 70 bp, Mus musculus
tggctgctgtctgtgcatctccatgttctgcctcatttgttggcaaggaaggagaaacataaggctccca

SEQ ID NO: 97731 - DNA, 104 bp, Mus musculus
ataagatcaggcatgagggtgcacagcggtgagcccaaacatttggaaatgagttagaaggatccaaagtttaaggttatcatcccgcctacatgtaaccttgt

SEQ ID NO: 97732 - DNA, 85 bp, Mus musculus; identical to SEQ ID NO: 57439

SEQ ID NO: 97733 - DNA, 81 bp, Mus musculus
gtgtgtgtgtctgtgtgtgtctgtgtgtgtctgtgtgtaggagaactagatatagagagacagacagacagacagacagac

SEQ ID NO: 97734 - DNA, 85 bp, Mus musculus; identical to SEQ ID NO: 57439

SEQ ID NO: 97735 - DNA, 88 bp, Mus musculus
acactgtttctgtggtcagacaggactcttgtctccctggagccctcctcagggtgggtcataacagttctggatctggagagaatgt

SEQ ID NO: 97736 - DNA, 64 bp, Mus musculus
aggctaacagttcaacatgggcagagacaggatatggactctctgtgtatgtgtctgtctgtct

SEQ ID NO: 97737 - DNA, 71 bp, Mus musculus
tgtctgtctctgtgtgcgtgtgtgcacatgtgtgcatgcacatgtgtgtattatgttacagtgaatggaca

SEQ ID NO: 97738 - DNA, 171 bp, Mus musculus
tgtggttgttgggaattaaatttttaggacctctgcttgctctggtcaatcccactcactcagtcattgcttgctctggcccaaagatttatttattattatatataagtacactgtagctgacttcagatgcaccagaagaggacatcagatctcattacaggtggttgt

SEQ ID NO: 97739 - DNA, 80 bp, Mus musculus
attgttgtttcattttgctttttcagacagattcttctctatcctggccttgtctgtctgtctgtcttggaactcacgat

SEQ ID NO: 97740 - DNA, 103 bp, Mus musculus
gcaattgatttcatttactgtctgtgcatgtgcatgtgggtgtgagtgtgcacacacacacacacacacacacacacacacacacacaccagagcatcagtgt

SEQ ID NO: 97741 - DNA, 110 bp, Mus musculus
ctgcagataagaccaaggatgtcctgtagtatccgtaggcttaaaatagtttttattctatttaaagtaatcacactatatggatttacacagacaaaatgaggtctcag

SEQ ID NO: 97742 - DNA, 59 bp, Mus musculus
catgcacatacatacatgcgtacatgtattttatgtatgtatgtatgcatgtgtgcatg

SEQ ID NO: 97743 - DNA, 114 bp, Mus musculus
tgacttagagaagtacgggattgccactgggctgctggctcacagttcagagtgtcccctccctctgtggccgggcagcagcctctgcaattccttacccacgtgctcctatca

SEQ ID NO: 97744 - DNA, 85 bp, Mus musculus; identical to SEQ ID NO: 57439

SEQ ID NO: 97745 - DNA, 140 bp, Mus musculus
tatatatatataaatatgtatgtatatatacagagagagagtgtgtatatatatgtatatatgtgtgtgtatatatatacatatatatatatatatgtatatgtatatgtatatatatatacacatatatataatctact

SEQ ID NO: 97746 - DNA, 86 bp, Mus musculus
gagccacttggaaaggacacttcctaacttgttgagctgcctgcaagctgcactgtgtggctctgtgtctcagcttttgtgagctc

SEQ ID NO: 97747 - DNA, 61 bp, Mus musculus
ttagtcacaggctatggacagatctgtggattcttgtctgtccctgcctggcctggtctaa

SEQ ID NO: 97748 - DNA, 114 bp, Mus musculus
gccaggcaaaagaaggtaatgaactgagacaaaaaggtgtgagaatcctcatctttggtattgtagctgttgaggtttctgttgctctgtttccatgttcttttgaaaaactgc

SEQ ID NO: 97749 - DNA, 74 bp, Mus musculus
agggctctactctctctcagtgtcagatgccactcttaatacgggtgtctggggttgggccggggtggtactct

SEQ ID NO: 97750 - DNA, 68 bp, Mus musculus
tcaagagaaaggcagcagccccctcaggaagccagtatctgctctttctctctgcctgtatctcctga

SEQ ID NO: 97751 - DNA, 145 bp, Mus musculus
cacatatatgtatatatatatatatatatatatatatatatacatatatatgtgtgtgtgtatatgtgtatatgtgtatgtgtatatgtatatgtatatacacacatatatatatgcacatatatacatacatatgtatacatac

SEQ ID NO: 97752 - DNA, 85 bp, Mus musculus
tatatgtgtttctctgtggatatgtatgtgtgatatgtgcaggtctatgtgtatgtctgtgtgtatgtgtctgtatatatgtgtg

SEQ ID NO: 97753 - DNA, 94 bp, Mus musculus
tagtagttagagtccctctgggtgtgtctctgagtgtgtttacagataattaattagaagatcttccctgaaggtaggtgactttactccacta

SEQ ID NO: 97754 - DNA, 72 bp, Mus musculus
aggagacatctgcatcgatttctcacactcagtctggccctcagcacagagaggaatggctgcgtgcctcct

SEQ ID NO: 97755 - DNA, 76 bp, Mus musculus
gtgtaatatgtgatggtcactgagtgatggtcactgtgtgatggtcattgtgtgacagacactgtgtgatagacac

SEQ ID NO: 97756 - DNA, 73 bp, Mus musculus
tatatatgcatatatgtatctagctatgtacatatctatatagcctatctatgtatatatatatgcatgtatg

SEQ ID NO: 97757 - DNA, 102 bp, Mus musculus
gtaagaacctatgtttgtcaaatgtgaagttccatgcacctgtgtgtgtatatatgtatatatatgggtagatgatccagaagcatacgagaaggtactcat

SEQ ID NO: 97758 - DNA, 92 bp, Mus musculus
ctttccagacttcagaactgtgagccaaatatatttctttagatatttactggttttgagtaatccgttatagtgtcagaagttgggtgaag

SEQ ID NO: 97759 - DNA, 76 bp, Mus musculus
ctgacgtgggacagacagacagacagtaagtaggagagaggctgagtctgtgaggtgctggagggtccaatgtcag

SEQ ID NO: 97760 - DNA, 99 bp, Mus musculus
agtcatatggggggcgctggagagatggctcagcggttaagagcactgactgctcttctgaagatcctgagttcaaatctcagcaaccacatggtggct

SEQ ID NO: 97761 - DNA, 77 bp, Mus musculus
tatttctccgatgcttcgtgggagaggctttgagaagtgctgtctgagtctctccctcagggctctgcacagattta

SEQ ID NO: 97762 - DNA, 68 bp, Mus musculus
gtgttgacccttttgttgtctggtgtgtgtttgcataggctgagagagacagagaagacagtttgcac

SEQ ID NO: 97763 - DNA, 72 bp, Mus musculus
atcccctatttgagacagtctctggttcactgtgcttgcaccaggctagctggcctctgaatgtccagggat

SEQ ID NO: 97764 - DNA, 72 bp, Mus musculus
tctcctttgactgtgaacacacactgtggtgttgagcaccttcctatgctgtgaatcacactgcagggttga

SEQ ID NO: 97765 - DNA, 69 bp, Mus musculus
ggcctcatctctcacactgtgagaatgtaaaaagcacacgtctgtggctgtcactgtgaggttgaggct

SEQ ID NO: 97766 - DNA, 63 bp, Mus musculus
cagagggacgctgtctagcaagagccatggcccgagcacacactccctgtctcagcccctttg

SEQ ID NO: 97767 - DNA, 64 bp, Mus musculus
caggagaaccacccggagctgactgatgtcaggcaggaggatccgtcagttcacgggcttcctg

SEQ ID NO: 97768 - DNA, 72 bp, Mus musculus
gtattatgtatgtgtgtatgtatgtatgcatgtatttatttattgtgtgcatatacacacatgtgtggaggc

SEQ ID NO: 97769 - DNA, 162 bp, Mus musculus
gtatgtatgtatgtatgtatgtatgtatgtataacgtgtgtgtgtgtgtgtgtgtgtgtgtgtgtgtgtatatatatatatatatatacatatacatatatatatatatataatgtattatgtgtgtgaatgtatgtattatgtatgtatgcgtgcatgtat

SEQ ID NO: 97770 - DNA, 104 bp, Mus musculus
tatatatgtatatacatgtatatatgtgtatgtatgtatgtatgtgtgtgtatatatatacatatacatatatacactcacacacacacatatatacatataca

SEQ ID NO: 97771 - DNA, 104 bp, Mus musculus
gtgagtgtatatgtatatatgtgtgtgtgtgagtgtatatatgtatatgtatatatatacacacacatacatacatacatacacatatatacatgtatatacat

SEQ ID NO: 97772 - DNA, 112 bp, Mus musculus
ctaagagggttcagcaggctgtatttgcatatatatgtatgtgcgcatgttttatgtatgtatgcatgtatgtgcatatatataataagaaagaggtcatgaatttgaaggg

SEQ ID NO: 97773 - DNA, 101 bp, Mus musculus
acctgaggtaaatcctgcgttctttgtcccttggaaaaactgtctctttctgtgtcttcagagggactgggagacacgttcataaggtaaaagcccaaggt

SEQ ID NO: 97774 - DNA, 112 bp, Mus musculus
gtgcctgacagactttccttagcagagctgtggagtgtgacaatggtgtttgtgtccaaaccatcaaacgccattatcacactaaatagctactgctaggcaatccgtccac

SEQ ID NO: 97775 - DNA, 104 bp, Mus musculus
aagtctcccttctggaagctgggaatcctgcttctccaggttggtggagctgtctgtctgtctgtgaaggtgcaaaggaattctctgcttcagacatcgttctt

SEQ ID NO: 97776 - DNA, 74 bp, Mus musculus
gcctaagaaggcaggtagaggggagatgagccagggaagaggactctctgactgtgtgccatgagcagagaggc

SEQ ID NO: 97777 - DNA, 66 bp, Mus musculus
tgtgtatatgtatgtatgtatacatgtatatatatgtatatatgtatgtatgtatatatgtatgta

SEQ ID NO: 97778 - DNA, 60 bp, Mus musculus
acacacatgtatgtatgtatgtatgtatgtttatgcttatgtatatatgtatatgtatgt

SEQ ID NO: 97779 - DNA, 90 bp, Mus musculus
catgtctatgtgtttatgtgcgtatgtgtatatatgtatatgtatgttggtggatatatatatgtatatatattagatatagtagatatg

SEQ ID NO: 97780 - DNA, 103 bp, Mus musculus
ggagctctttttgtttttttgagacagggtttctctgcgtagctttggctgtcctggagcttgctatgtaaacaagtttggtctcaaactcaagagagccgcc

SEQ ID NO: 97781 - DNA, 84 bp, Mus musculus
gtgtatatatgtatgtatatatgtgtgtgtatgtatatatgtgtgtatatatgtatatatatgtgtgtgtatatatgtatatat

SEQ ID NO: 97782 - DNA, 74 bp, Mus musculus
gtatgtatgtatgtatgtgtgtgcatgtgtacctatgatagtgtgtgtatgtgtgtacatgtgtatttgtgtat

SEQ ID NO: 97783 - DNA, 65 bp, Mus musculus
tgtctgtgtctatgtctgtgtctgtgggtatgtaggtgccctggctctgatgtagaggtcagagg

SEQ ID NO: 97784 - DNA, 87 bp, Mus musculus
gattgattgtctatatatatgtatatatgtgtgtgtatatgtatatatgtgcatatatatatgtgtgtgtgtgtgtgtatctttatc

SEQ ID NO: 97785 - DNA, 90 bp, Mus musculus
gcatatgtatatatgtgcatgtatgtatatatgtgcatgtatgtatatatatgtgcatatatatgtatatgtatgtataggagacagtgt

SEQ ID NO: 97786 - DNA, 96 bp, Mus musculus
gggttaaattttaaaggatctaacactctctctaattcagtgagtggggaggcccccccataccgaatttcatatggagtgagcttaaattttccc

SEQ ID NO: 97787 - DNA, 90 bp, Mus musculus
tcaccttgtggtggtcttggaagcacagagaacctggttcagtccctctctctgccggtgtcttcattctagacttctagctacaggtgg

SEQ ID NO: 97788 - DNA, 69 bp, Mus musculus
gacacactgactctctgtgaggatgcaaattgttcaacaatttagacattcttaaagagtttctatgtc

SEQ ID NO: 97789 - DNA, 108 bp, Mus musculus
tacctctagaacctagtgttctggctactagtcctgtgtctgtgtctcacttagtgacgtccattaggacctagatttaaagtcctgacatgttagattactgaggta

SEQ ID NO: 97790 - DNA, 60 bp, Mus musculus
gagagagagagagagagaagtagtgtggcagaggaaaccctgtctctttgtgtctgtctc

SEQ ID NO: 97791 - DNA, 64 bp, Mus musculus
tcccccactgaggctttcttggaggaaactaattttttcttttcaagtggccatcagttggaga

SEQ ID NO: 97792 - DNA, 68 bp, Mus musculus
acacagacaacaaacagagctgatcaggaggctgggctcttctgcactggttcatctgatgactgtgt

SEQ ID NO: 97793 - DNA, 76 bp, Mus musculus
gcagagcacctgtcacagcacacaaagggcagaggaccaggctctccctcactgtcagtgtggactatggcttggc

SEQ ID NO: 97794 - DNA, 93 bp, Mus musculus
cttgacatccttggctaagattccagggcagtgatttccctccagccttgattcagcctggatcaggccttgctggcacatctggcaaccctg

SEQ ID NO: 97795 - DNA, 67 bp, Mus musculus
ttgcggtgtgctctgtgtgactcactgacatgcttagattggggggtccatgcttagcaagctgtaa

SEQ ID NO: 97796 - DNA, 94 bp, Mus musculus
gtttattttggcatcttggaaatgttctgatttttttttaaggcaatgattctcaccttgtgggtcacaacccctttgcaggaggtcaaatgac

SEQ ID NO: 97797 - DNA, 74 bp, Mus musculus
gtagccacaagagactcagcagaggagctgtagacccctcagagggacagaactcaagggtgtcctgggcatgc

SEQ ID NO: 97798 - DNA, 67 bp, Mus musculus
gtatgtatgtatgtatgtatgtatgtacgtatgtatatatgtatgtatgtactatgtacatatgtat

SEQ ID NO: 97799 - DNA, 66 bp, Mus musculus
tgtgtatgcgtgcatgcatgtgtgcgtgtatgtgaatgtgtgtgtgtgtgtgtgtgtgtgtgtgta

SEQ ID NO: 97800 - DNA, 74 bp, Mus musculus
gcaaagtctagacgtaggaaagtaagctgagctggggaactgaggctagtgtttttcaagatgtcagcaccagc

SEQ ID NO: 97801 - DNA, 84 bp, Mus musculus
tgatgttgtcaacaggatgtctcattctctgactgacgcgtcccaccttgtctaacagcatcagcagcctgtgtgggacttcct

SEQ ID NO: 97802 - DNA, 109 bp, Mus musculus
gatacacggggtaacagaacagacccaatgatgagagatgagagactccagcatgttgatactaacacattagtctgggtttccattgagggctctggaccttgcagtc

SEQ ID NO: 97803 - DNA, 76 bp, Mus musculus
aggaagcaaactgagcaagccatggggagtgagccagtaagtagcactctgtatgcctctgcatcagctttttcct

SEQ ID NO: 97804 - DNA, 107 bp, Mus musculus
gtgaagtgaagataaggatgagagaccaatgaagagttgcaaagctagctatgcaagcacactgtcactctctgttgagtcctagctatactccctccaaatatcac

SEQ ID NO: 97805 - DNA, 106 bp, Mus musculus
tctccataaagacagtggactgggcctggagagatgacttggcagtaaagagcactgactgctcttcgagaggtcctgagttccattcccagtaaccacatggtgg

SEQ ID NO: 97806 - DNA, 105 bp, Mus musculus
ggcttgcttttttgtcagggaatgttaggttaggtcagaacattgagtgtagacatagcctctctcctctctgccacctactgacacacatgtgacacagcagcc

SEQ ID NO: 97807 - DNA, 100 bp, Mus musculus
ctcatacacatatgcatgtatgtatgtatgtatgtatgtatgatatatatacatacatatacatatatatatataaacatacatatgtcaatatgctgag

SEQ ID NO: 97808 - DNA, 117 bp, Mus musculus
aaaatatgtcacaagagtatcccttgctggacacatgtctttgggtttctagctgtatcttgcatttggatatccatttctttgcctagatttgggagacttttctgttaaaatttt

SEQ ID NO: 97809 - DNA, 85 bp, Mus musculus; identical to SEQ ID NO: 57470

SEQ ID NO: 97810 - DNA, 69 bp, Mus musculus
aatgcactttctctctgtctatgtgggccttcagaggggtgacacttggtggggaaggggggtagtatt

SEQ ID NO: 97811 - DNA, 85 bp, Mus musculus; identical to SEQ ID NO: 57470

SEQ ID NO: 97812 - DNA, 118 bp, Mus musculus
ggcaggtcccccattaactggagcagggactgtgcttgggcctgttgcctgcctgcctgcctgcctgtggtttcctgtccctcttggacagtctggcttcagtgggagaggatgtgcc

SEQ ID NO: 97813 - DNA, 79 bp, Mus musculus
ctgtttcacatgacaggtatcttgcaaatgagctatttaatagcatcccatatgcaagtaggttgttttctgtgaggag

SEQ ID NO: 97814 - DNA, 83 bp, Mus musculus
gtgagacttagtttcagttcagtgagctatcttggtagtaaagatgtttgttgttgccaggactgacaactgagtttggtcac

SEQ ID NO: 97815 - DNA, 85 bp, Mus musculus; identical to SEQ ID NO: 57470

SEQ ID NO: 97816 - DNA, 85 bp, Mus musculus; identical to SEQ ID NO: 57439

SEQ ID NO: 97817 - DNA, 128 bp, Mus musculus
acacacacacacacatgtgtatatatatgtgtgtgcgcacatatgtgtgtgtatgtatatatgtatatagtcttaaatatgcatatgtatacatacacacacacacacacacatatatatatatatgt

SEQ ID NO: 97818 - DNA, 69 bp, Mus musculus
ctgacaccacttctgccttttcctttgtgagctgtgggtaacccactcacagacaggcagtctctgcag

SEQ ID NO: 97819 - DNA, 99 bp, Mus musculus
gggactccacagagggaagtctgacaggtgagagtgtggaatacagaggccagcagtctctgggacaggcaagagccacagagcctctgaggcggtgcc

SEQ ID NO: 97820 - DNA, 94 bp, Mus musculus
agacatggatccatctcttattatttataaagtattccaggaaaggtttttcttacctgggaatattcaaagtcagtgataggggctatgctct

SEQ ID NO: 97821 - DNA, 101 bp, Mus musculus
agtgacatgtgtttggggctggcgagatggctcaggggttaagaacactgtctgctcttgcagaggtcctgagttccattccctgaaatcacatggtggct

SEQ ID NO: 97822 - DNA, 119 bp, Mus musculus
gggcagtcagtgctcttaaccactgagccatctctctagcctggaagaatttttttttttgaagaagcaacttaaggaaggaagttggctcacagtttgagggttcagagcagctgtcc

SEQ ID NO: 97823 - DNA, 96 bp, Mus musculus
gagcgttgtctgcagcaggagcacacgggaagaagacatcactgactgaggacagtgggagtctgagcgcactgggcctgcaggggcaggcagatc

SEQ ID NO: 97824 - DNA, 113 bp, Mus musculus
cctcttggctcaggcctccccagtgttgagattacaggcaagagctgctacacttagttcagttgtctttttgttgtagtgatgctagggatgtagatttgtatcccatgagg

SEQ ID NO: 97825 - DNA, 81 bp, Mus musculus
gcacttgtccgtctgtctgtcactgacatatgctgacctttaaaggtttgcttactttatgtagatcagtgttgcatttgc

SEQ ID NO: 97826 - DNA, 113 bp, Mus musculus
atgggcttactggacatacatatatatgtacatatacatatacacgtttatactgaatgtataaatgtatatatgtatacgtacatatatacacatatatagtacacacacat

SEQ ID NO: 97827 - DNA, 64 bp, Mus musculus
cggcagcataggcttgtgttgtcagcttctttgtttgctgtcatctctctgtctgtgtctgctg

SEQ ID NO: 97828 - DNA, 68 bp, Mus musculus
catacacacacatatatatgtatgtatgtatgtatatatgtgtatgtatatatatgtgtgtgtgtatg

SEQ ID NO: 97829 - DNA, 75 bp, Mus musculus
gggagatgagacactgactgtctctgtatgacctgctgagggaggaggggcaggacaagacagaaaagatcaccc

SEQ ID NO: 97830 - DNA, 131 bp, Mus musculus
atatatatatatatatatatatatatatatatatatatacacatatatatatgtatatatatatacacacacatacatatatacacacatatatgtatatgtatgtatgtatatgtatatgcatatatata

SEQ ID NO: 97831 - DNA, 71 bp, Mus musculus
gaattaagtaggactagagagagggttaagtggataagagcactgactgctcttccagaggttctgagttc

SEQ ID NO: 97832 - DNA, 104 bp, Mus musculus
tagtcttgtggcatttgaatgggtgtcatttaccaggcagatgggattgtaaagaagttagaagctggctggtatcactttggcagtcatcttggtactaacta

SEQ ID NO: 97833 - DNA, 87 bp, Mus musculus
tatgggaagaagagcaaggagctaatctcacccagtgactctgtcctcgaagtttatcgtttgattctcccactatttcttcccata

SEQ ID NO: 97834 - DNA, 61 bp, Mus musculus
ctttgtctgtctgtctgtctgtgcaccaaaactctgcatttctcacagaggacagaagagg

SEQ ID NO: 97835 - DNA, 139 bp, Mus musculus
tgagggtgcagacttggactgccaggcttcaggcattaaataagcagggggtgggggggctctcagtctgtggctcttagggtattggaagaataactcatgtggtactaatgtcatagatatgggataaagggggccc

SEQ ID NO: 97836 - DNA, 70 bp, Mus musculus
cctggctcagcagtgcctctgtgtgtctctgcttgcaagctggtgtgcagctgtatgctgttgggaaagg

SEQ ID NO: 97837 - DNA, 82 bp, Mus musculus
ggttagaggacaacttgcaggagtcgggcctttccttctaccacgtgatttctggggattgaactcaggttgttaactggct

SEQ ID NO: 97838 - DNA, 80 bp, Mus musculus
ttttcagggttggtgtgagcttgggagtttctagattttttttcataaatgccggcttcctgttccataggtgctgaaaa

SEQ ID NO: 97839 - DNA, 78 bp, Mus musculus
tatatggctacatatctgtatatatacatatatatatagtcatatacatatatgtatatatatgtgtgtgaccatata

SEQ ID NO: 97840 - DNA, 75 bp, Mus musculus
cctgacagagccaacagactctctctgaggcaaaagaaacttttttttttgaggcagggtcttctgtatcccagg

SEQ ID NO: 97841 - DNA, 73 bp, Mus musculus
atactatacatgtatatatgtatgtatatacatatatatgtgtgtatatacatatgtgtgtgtgtgtgtgtgt

SEQ ID NO: 97842 - DNA, 85 bp, Mus musculus; identical to SEQ ID NO: 60145

SEQ ID NO: 97843 - DNA, 63 bp, Mus musculus
gccactgagaatgagaccacctggggtggagccttccaacctagatggttctattgttttgtc

SEQ ID NO: 97844 - DNA, 88 bp, Mus musculus
agatatgtgttggttctatttaagtttctttcatgtatgtttatatatatatgaagaagcttatatagtaataggtttccatataact

SEQ ID NO: 97845 - DNA, 73 bp, Mus musculus
agcttgctgccagagagcagtttattcctttggcctctaatgagaatttactgtggctctctctggcagtgct

SEQ ID NO: 97846 - DNA, 85 bp, Mus musculus; identical to SEQ ID NO: 57439

SEQ ID NO: 97847 - DNA, 70 bp, Mus musculus
gcagatgggcctctgtgactctgtgagccaaatgagcggaagacacagaggagcaagggcgtggttctgt

SEQ ID NO: 97848 - DNA, 73 bp, Mus musculus
gtgtgtgagtgtgtctgtgtgtctctctgtgtatttaggccaggggtcaacatcagctgccttcctcactcat

SEQ ID NO: 97849 - DNA, 83 bp, Mus musculus
agcagtctctctgtggctcagtgcctggcaagctcatgcatcagaaaatttggaccctgagagtagtccatttggaggttgtt

SEQ ID NO: 97850 - DNA, 75 bp, Mus musculus
tgggacactgaagcaagaggaacacaagttcgaggccagcctatgttacacagtgattctctgtcaaatgtccca

SEQ ID NO: 97851 - DNA, 75 bp, Mus musculus
catgtgtacttggtagaaatgcatattttgctgttgtttggtagaatgctctgtgtatatctctctggtacagtg

SEQ ID NO: 97852 - DNA, 66 bp, Mus musculus
tgttaatcactgtggagcttctgcaagcaatggatctgtgtttgcgagctcacactctgtcactca

SEQ ID NO: 97853 - DNA, 78 bp, Mus musculus
tggttcttacaatctctctgctccacgccttccttgatggtacccaaggcttttgaggaagagatgtgatatagacca

SEQ ID NO: 97854 - DNA, 113 bp, Mus musculus
gcacggctataagggtagcagatttttgtatactcttccctgtatatttattcttgtaaaaacttatgccacggggaatgtgagttttgagtctgtgaggtctgcagccatgc

SEQ ID NO: 97855 - DNA, 178 bp, Mus musculus
acacacacacacacattatatatgtatgtgtacatatatgtatatatgtatgtatgtgtgtatatatgtatatatatgtatgtatatatgtgtgtgtatgtgtatatatgtatatatacatctgctgctgcaagttttactgaacacagagagctgaaactgtgtgtgtgtgtgtgtg

SEQ ID NO: 97856 - DNA, 115 bp, Mus musculus
ataaatggtgctgctggggctggagagatggctcagtggttaagagcactgactgctcttccagaggtcctgagttcaattcccagcaaccacatggtagcttccaaccatctgt

SEQ ID NO: 97857 - DNA, 67 bp, Mus musculus
ggctttctagtggttcttggcaaagctgcagtgagacactctcactcatttttgccagcccccagcc

SEQ ID NO: 97858 - DNA, 117 bp, Mus musculus
ctgtatggattaatgttcattccacatattagagctatatgcaaaatcttagattttatatttttaaagattttactgtagtgattcttcatgttcatgtatattagtatttaatag

SEQ ID NO: 97859 - DNA, 86 bp, Mus musculus
cagagtgactctctctctctctctatatatatatatagagagagagagacattagtggtatatatatatatatatatagagagaga

SEQ ID NO: 97860 - DNA, 97 bp, Mus musculus
gtttaagtctcttttatgtaagtgacttgtgctaaaatggtaaagatttttttttaaatgttaatggcataagttagtgagtgaaactagtttggat

SEQ ID NO: 97861 - DNA, 99 bp, Mus musculus
gagaagcatcaaactgacagaccatcactctccctgtctctcccgagctatgatggagaagaaaaacaaacctgggggagtgcacctcagtgtgttctc

SEQ ID NO: 97862 - DNA, 65 bp, Mus musculus
tgatgggaagagtagtgagaacacactgaggtgcactcccccaggtttgtttttcttctccatca

SEQ ID NO: 97863 - DNA, 76 bp, Mus musculus
tgtgtgtgtctatgtatgtatgtttgtatgtatatatgtgtgtgagtatgtatgtatatatgtagatataccacat

SEQ ID NO: 97864 - DNA, 87 bp, Mus musculus
gggatgctctctccagggatcaaagagtttgcttacacatcaccacttccctatcagtctcactctgactttgtgggagttgctccc

SEQ ID NO: 97865 - DNA, 113 bp, Mus musculus
ccttagtacccaggtacatttttattgttgcatatatatatatatatatgcatacacacacatatatatgtttaaaagttgcagcttaaaaataccttaatatctatcatagg

SEQ ID NO: 97866 - DNA, 91 bp, Mus musculus
ggagttgccacaagcaagggaagagcttttctttaggagaaagagatgtgtatttgaacttgacatctaaagaggactctcctgtaagtcc

SEQ ID NO: 97867 - DNA, 91 bp, Mus musculus
ctcctagaatttacaagtgtcacactgtgtgtcttagttaggaatactactgctgtgataaaacacagtgattaaggtggaggcgttagag

SEQ ID NO: 97868 - DNA, 87 bp, Mus musculus
aggatttgaaaccacgccactctctgcctctctgtccactgattatagatggtttcaacagtgaggagagatagttgttttggtcct

SEQ ID NO: 97869 - DNA, 90 bp, Mus musculus
tgggtgttttgcatgggtgtctgtcggtcagtctgtgcagcacttgcatgcccagtgcccgaggaggccagaaaagcaaatcagacaccc

SEQ ID NO: 97870 - DNA, 120 bp, Mus musculus
gtctctctgtctctgcctctgtgtgtgttgtgctgtactgtattgtgtgttttgcatacacacacacacacacacacacacacacacacacacacacacacaggtgccgaggaggctaga

SEQ ID NO: 97871 - DNA, 72 bp, Mus musculus
tccttcagtattggtgcccctatactcaatccaatggtgggctctgagcatctgcatctgtattggtcagga

SEQ ID NO: 97872 - DNA, 61 bp, Mus musculus
gtgtgagtatacaccttctctgaagttcagttcgatttgtcagaacagtgtatgcacagac

SEQ ID NO: 97873 - DNA, 113 bp, Mus musculus
acctcaggattgtatgattcttgctgttgatagaggtgacaaaggcttagctttggctgtgtgcttagctggtagactaaacaacagggttctctagagtcagaacttatggt

SEQ ID NO: 97874 - DNA, 61 bp, Mus musculus
cctggcaactgttacggtggattacggtggaagctgtcttctctcactgacagctgacagg

SEQ ID NO: 97875 - DNA, 88 bp, Mus musculus
gaattaaagatgacagaggaggggctggacagatggctcagcagctaagagaactgactgctcttccagaggtcctgagttcaattcc

SEQ ID NO: 97876 - DNA, 132 bp, Mus musculus
ctcataaagaatgtcccgcccatgtccactgtacactgttggtgtggtttgcagtctggggctctctgtgagtgatctgaaggtgcttgctgcataccatggcccagaaaagttacaagacactagggacgg

SEQ ID NO: 97877 - DNA, 99 bp, Mus musculus
cctacctctgcctctgagtattgggattacaggtgtgagacactacccagtgaacagacaaggaaggcatcttgctctctgtgactggatgacatctgt

SEQ ID NO: 97878 - DNA, 87 bp, Mus musculus
gggtagatcctcttcccagactggataaccgaggtctcacaggatgttgtatgtagaaaacctcactgtcagtctgtctgtctgccc

SEQ ID NO: 97879 - DNA, 112 bp, Mus musculus
gtatatgtatatgtgtatatgtatatgttacatatatgtgtagatagatagatagatagatatgtatatatatacatatatatggatatatgcatatatatgactactatat

SEQ ID NO: 97880 - DNA, 77 bp, Mus musculus
gtttctgggttactctctttgtcactggctgacctggaactttccctgtagtccaggctggctttgaactcagagat

SEQ ID NO: 97881 - DNA, 81 bp, Mus musculus
agaactgactgctcttccagaggtcctgagttcaattcccagcaactacatggtggctcacaaccatctggaattggttct

SEQ ID NO: 97882 - DNA, 79 bp, Mus musculus
gaagtgtttgcatatgtatttgtatgtgtgcgtgtgaatggggagagtacatagtcacatacatatgtgtagagaagtc

SEQ ID NO: 97883 - DNA, 118 bp, Mus musculus
tgtgggtgtggtgaagatgtaaagttttttaaggcaatgtttgcaatctaaagaagatatcatttttctggagttgtaagagcaacattaaaaacattgatacgattttatacccagg

SEQ ID NO: 97884 - DNA, 138 bp, Mus musculus
ggcacggcactgtgtccagacaagccccctctctgcagttcttcaggagatgtgctccccacagagtgaagagactgcggccatgttctacacgacagcccatctaacccttggccattatatttctgtacatcttct

SEQ ID NO: 97885 - DNA, 85 bp, Mus musculus; identical to SEQ ID NO: 57439

SEQ ID NO: 97886 - DNA, 116 bp, Mus musculus
ctgcccttcctcttgctcacactgtgtgtggcccgtttcctatgcagtgaagtgagagagcagatgtgagtgcttctatcccatggcgtgtcctatcctcattcagtacaggttgc

SEQ ID NO: 97887 - DNA, 107 bp, Mus musculus
agggtttgggcatcgtgcatcatggaagttctacagtgttgggtaccagggtgaagctcagctcagttctctctatgtctatgagtctgtgtaggagtccaaaggct

SEQ ID NO: 97888 - DNA, 58 bp, Mus musculus
atatatgtatatgtgtatacatcatataggaatgtggtgtgtgtgtgtgtgtgtgtgt

SEQ ID NO: 97889 - DNA, 84 bp, Mus musculus
ggtatcacatccaaagatctgtgtctgtgagattcagcttaaatgacacacctttaagctttctgactgaaacacagacatacc

SEQ ID NO: 97890 - DNA, 107 bp, Mus musculus
tacatatatgtgtgcatatatatacatatatgtgtatatattacacaaatatatatatgtgtgtatgtatatgtatatatatgtgtgtatatatacatatatatata

SEQ ID NO: 97891 - DNA, 98 bp, Mus musculus
atgtatatgtgctgcctcctttgtgtgtatatgaatatgcctgggtgccttgccctctgtttgtgtgtgtgtctattcctctgtgtgtgcatgtatgt

SEQ ID NO: 97892 - DNA, 113 bp, Mus musculus
acagatatgcagcttggacttcatgtgggtcccctaacaattggaacagggtctgtctctgactttgttgcctgccattggatccccttctcctacctatactgcctggttgt

SEQ ID NO: 97893 - DNA, 91 bp, Mus musculus
gcatccacttctgtgtttgccaggcaccgtcatagcctcacaagagacagctatatcagggtcctttcagcaaaatattgctagtgtatgc

SEQ ID NO: 97894 - DNA, 83 bp, Mus musculus
gtgtatgagatttaggaacctaccagttctgagttgtcactttgtttatgtgttaactcttgcaagtccaagtcgtcctgcat

SEQ ID NO: 97895 - DNA, 92 bp, Mus musculus
tccatggtgatctgataggatgcatgggacaatttcaatatttttgtatatgttgagacttgttttgtgacccattatgtggtcattttgga

SEQ ID NO: 97896 - DNA, 95 bp, Mus musculus
gagatagggagttggaagggcaaggaaggagggtagatgctggacacatgataggatgtagtttgtattcttcttatttcaagttggttgatctc

SEQ ID NO: 97897 - DNA, 82 bp, Mus musculus
tgtatatttatgtgcatttacatgaagtgagtatatttttatatgtaggcatgttccatgtgtgtgtgtgcataagtgtgca

SEQ ID NO: 97898 - DNA, 83 bp, Mus musculus
catgtgcatatatacatatatgaatatatgtatgtgtgtatatacatatacacatacatatacacatattcaacgttgctatg

SEQ ID NO: 97899 - DNA, 70 bp, Mus musculus
gtgtatgtatgcatgtatgtatatatgtatgtatgtatgtatgtatgtatgtatgtttgcatgtatatgc

SEQ ID NO: 97900 - DNA, 88 bp, Mus musculus
ctgtagagacaacagagagggggatcaactatgggttcagaaggtccagttgacaggatttttctctgaagtatatttatctctagag

SEQ ID NO: 97901 - DNA, 111 bp, Mus musculus
tctaaccttgaacagaagattgtttttataaagaatggcccatatctatttatatgtatacatatgagcattttatttaaccattcaaaaacaaaatcattaggtgttgga

SEQ ID NO: 97902 - DNA, 91 bp, Mus musculus
gtattgttcagtttacacgtgaatgttggctttctattatttattttgttattgaagatcagccttagtccatggtgatctgataggatgc

SEQ ID NO: 97903 - DNA, 85 bp, Mus musculus; identical to SEQ ID NO: 57439

SEQ ID NO: 97904 - DNA, 89 bp, Mus musculus
ctgctttcatctctaatggttcaaacatcgttgctctgttatgtctgtgagagagaactctgtctggactctatcaacctgtggaacag

SEQ ID NO: 97905 - DNA, 85 bp, Mus musculus; identical to SEQ ID NO: 57470

SEQ ID NO: 97906 - DNA, 111 bp, Mus musculus
tcaggtggagtgcagagacgcttaagaaaggtttgttaaaaagaatgaattcaagtatattttaataaacgtgccaaatcctaagggttgaaggcaattgaagtcatttgg

SEQ ID NO: 97907 - DNA, 98 bp, Mus musculus
tgatcagccttagtgcatggtgatctgataggatacatgggacaatttcaatatttttgtatctgttgaggcctattttgtgaccaattatatggtca

SEQ ID NO: 97908 - DNA, 89 bp, Mus musculus
gcttctaaactcatgggtgaccctcagtctctcccaccaagatccagaataaaaggagcttttgatgggtggccccttatggatacagc

SEQ ID NO: 97909 - DNA, 80 bp, Mus musculus
tggttagcactcagtaagtaccaccatgcacaggaccacgtccgaacttgcctgtgcatctctctcactgtctctctcca

SEQ ID NO: 97910 - DNA, 79 bp, Mus musculus
ctctgtgtgtatgcatatacatatacatttatatttaagtttgattattttaaactatgtgcatgtatgtgcatcaggg

SEQ ID NO: 97911 - DNA, 100 bp, Mus musculus
tctgtttattcctccccctcccccaagaaagcagagaacagagtgagatgaccaccttgttatactaaaattcctgttctggaaagggtcaaaaacatga

SEQ ID NO: 97912 - DNA, 86 bp, Mus musculus
ggggtacatccacaagaggtgagcaggaacatccttttccctaagatcctttctcaggctctgtctgcctccccaagaagtactgc

SEQ ID NO: 97913 - DNA, 81 bp, Mus musculus
tcttcctctgtgtctctctgtatcttcatgtggcattctctcttcgaaggacaagagtcacatgggattaagagccaacag

SEQ ID NO: 97914 - DNA, 64 bp, Mus musculus
ggagtcaatgtctgtctgtgtctctaatggcctagcacactgcctgacacagattaaggacttc

SEQ ID NO: 97915 - DNA, 66 bp, Mus musculus
tgatgtgtgtgtgtatgtattatgtatgtatgtatgtatgtaaacatacatgcactcacacataca

SEQ ID NO: 97916 - DNA, 73 bp, Mus musculus
gtgtgtgtgtgtgtgtgtgtgtatgaatggatatggctacatagtcattcaatatatgtgtatatatattcat

SEQ ID NO: 97917 - DNA, 114 bp, Mus musculus
gctgatattaactggtgtgctaccacgcctgatctagttactttatttttgttgaaagtccaccatgttaacaggagagctacatttcaggtcacccatctctgcctcttcagc

SEQ ID NO: 97918 - DNA, 112 bp, Mus musculus
gtggggaggggataagaagcagaaacatcccacccgtgcaagcctgctcactctcactctgttttgggactgcctcggggtaaatgtctctgcttctctatgctctttcaca

SEQ ID NO: 97919 - DNA, 68 bp, Mus musculus
ttctgaaagcagaggccagactgggccacatagtgagttccagggcagtctgagcctctgtctcagaa

SEQ ID NO: 97920 - DNA, 107 bp, Mus musculus
gtggacttccctttaggagacagctattgttggactagcctgactgcatcctgtaagcctctagtaaaccctttccatcagtcctgttcctctagagagagagccac

SEQ ID NO: 97921 - DNA, 153 bp, Mus musculus
gtcagtctccgagatggggctttccttccccccttctacctaacatgggaagagagcgctctgtcagtcagtctccgagatggggctttccttctccccttctacctaacatgggaagagagcgctctgtctgtcagtctccgagatggggct

SEQ ID NO: 97922 - DNA, 91 bp, Mus musculus
gacactgaaaggttcaggtgccgtgagggtttccaggcagaggtgagtgaggactgaggctgcttttgaggtccagggtgtagcctggagt

SEQ ID NO: 97923 - DNA, 115 bp, Mus musculus
gtgtgtcactttggaggcaagctttgaagtctcatgtgctccatctatattcagtgtggcacacttctgctgcctgtggattaagacatggaactctcagctctgtcccccgcac

SEQ ID NO: 97924 - DNA, 88 bp, Mus musculus
gggggtaattctaagttgtctttctggggaatcttgaaatggtcataatctgaacagggaggaagtagctagaattgattgtgccgcc

SEQ ID NO: 97925 - DNA, 125 bp, Mus musculus
tctgagccggtccgtcaggtctttaatggatgaaggtgtatttgcacagccctacagaagacagtgtgcagatcttcacaattatgagttcatcttgacctgatttttcaagttaacggacaagt

SEQ ID NO: 97926 - DNA, 108 bp, Mus musculus
catttctgctactacaaacaattcaatgaccagaaacaactcacagaagagagttaattttggctttcaggtccgtgggtgtgggtccataatggtgggggaaccatg

SEQ ID NO: 97927 - DNA, 96 bp, Mus musculus
cagagtagtttttatttgcatttccccaatggctgaggatgttggatgtttttaagtgcttctcagccatttgttttatgatctgagaacgctctg

SEQ ID NO: 97928 - DNA, 92 bp, Mus musculus
ggtccagccgctgtgcgatcagtatttcctcctgtctctcttactcagacagagagatggggtggggtggggggtgctactgctgctgtctc

SEQ ID NO: 97929 - DNA, 73 bp, Mus musculus
tttctcactggctctcttactctagcaaggccctaaagagagagagagagagagagagagagagagagagaga

SEQ ID NO: 97930 - DNA, 72 bp, Mus musculus
gtcctggaactcactctgtagaccaggctggccttgaactcagaaatccgcctgtctctgcctctctgggac

SEQ ID NO: 97931 - DNA, 82 bp, Mus musculus
ttctaaaattgatatttctgggtcagcatgtgtgtgtgtgtgtatatatatatacatgattaatggtttaagtcagtgggaa

SEQ ID NO: 97932 - DNA, 101 bp, Mus musculus
tagttcactaaagctctataatgcaatttcagtttctttttaaatctatgttcttcagtaacatagtttgggtcagcatgatatgagctgatctctgacta

SEQ ID NO: 97933 - DNA, 114 bp, Mus musculus
atggtatactcaagttgtgtgtatgtctctgggtgtggttctttgtatgtgagagatagagacagagagacagagacacagactcagacagaaacatggaaagattgagatcat

SEQ ID NO: 97934 - DNA, 87 bp, Mus musculus
ggtcaggacagtttgtggtttttctcagaattcagtgtggagtgggttaggggaatttttctgggaactgctaatattgttttgatt

SEQ ID NO: 97935 - DNA, 85 bp, Mus musculus; identical to SEQ ID NO: 57470

SEQ ID NO: 97936 - DNA, 128 bp, Mus musculus
gattgtctggttcacgcaagctgtattttctggaacacttaggaatggtgggtctagctgcctctctctaagtctgaatttgaaagagcagtccctgctggccttttgaagtcccacttaaagcagag

SEQ ID NO: 97937 - DNA, 70 bp, Mus musculus
gtgtgtgtgtgcatatatgtttatgtgtgtgcatgtgtatgtatttatgcatgtatgtatatatgtatgt

SEQ ID NO: 97938 - DNA, 90 bp, Mus musculus
tcctaggcagacacgatggcctcacactgaatgactctcagtgcatcgcagcagtaagagagcacaggtgagaggactgtctgtctaggg

SEQ ID NO: 97939 - DNA, 82 bp, Mus musculus
gttggaggaagtgtgtcatggagggtgggttttgagatttcaaaagctcaagccaggccctgtgtctctctctttctgctgc

SEQ ID NO: 97940 - DNA, 109 bp, Mus musculus
ggaaggttagcagagggggctggagagatggctcagcaggtaagagcactgactgctcttccagaggtcctgagttcagttctcagcaaccacatggtggctcacaacc

SEQ ID NO: 97941 - DNA, 100 bp, Mus musculus
gttattctgagatcatcacgtgaaagtcactgctcttcctgtcatccagagaagtgtacacatttatgattttggcagtggcctgggtactgaggaaggc

SEQ ID NO: 97942 - DNA, 82 bp, Mus musculus
tgtatatagatatatatacacacatacacacatatatatgcatatatatgtgtgtgtatatgtttatatgtgtctatataca

SEQ ID NO: 97943 - DNA, 97 bp, Mus musculus
tgtatatatgtatatgtgtatatgtgtatgtatatatatgcatgtatatgtatatgtgtgtatatgtgtgtgtgtatatatatatatatatatatat

SEQ ID NO: 97944 - DNA, 120 bp, Mus musculus
tttcataggcataacaggtagtagctgggggctgctctccaatagcagtaacagagcagagtcagctgacactgagcctgagaagagggaggagtggaaactaggtactaacacggtttg

SEQ ID NO: 97945 - DNA, 62 bp, Mus musculus
ctggtagatgatcagcccttgaggccagtcggaagagtcccacagtggctgtctcacaccag

SEQ ID NO: 97946 - DNA, 68 bp, Mus musculus
catgctctctctctctctctgggtgtcccagggcaaagaatttccactgagaagcagtagggagtctg

SEQ ID NO: 97947 - DNA, 108 bp, Mus musculus
agaggaaacaagctcagagaggtggatgagtgtgagccctgggtccctcagtgactgggtggcgcccacacctcagcttatgcttgcccatcatgtggctttctccct

SEQ ID NO: 97948 - DNA, 86 bp, Mus musculus
gtgcatgtgtgtgtgtgtgtatttgcatgtgtaggtatatatgtgtatgtgcacatgcatatacacactcacacacactcccgcac

SEQ ID NO: 97949 - DNA, 67 bp, Mus musculus
aggctgggaagagtgtgagcagacgcagtaacacaccgaggcgttccctgctgtgactgtcccgtct

SEQ ID NO: 97950 - DNA, 112 bp, Mus musculus
agaatacaacccacagagtcaactgttcagggctcataggggctcacaaagactagagagacaatcacgggccctgtgggggtctggaccaggtcctctgcatatactttct

SEQ ID NO: 97951 - DNA, 77 bp, Mus musculus
tccttcctttcctctgaggcacagtctgtactcagtgtgaagatattagcagatcagctctcagggtcaagggagga

SEQ ID NO: 97952 - DNA, 108 bp, Mus musculus
aggcttcctggaagtgaggtctgagcagtattgagcatgagagatggctcagcgggtaagagcactgactgctcttccagaggtcctagttcaattcccagcaatcac

SEQ ID NO: 97953 - DNA, 87 bp, Mus musculus
agaagtggacttgctgggtcatgtgatactccgtgcttctttttgagggatcaccacgctgtctctcacagtgcctgtaccattttt

SEQ ID NO: 97954 - DNA, 62 bp, Mus musculus
tttaggagctggagagatggctcaacggtaagaacactgactgctcttccagaggtcctgag

SEQ ID NO: 97955 - DNA, 72 bp, Mus musculus
tatatgtgtgtatatatatgtatgtatatataaataaaaatatatgtatctatatgtgtgtatgtatgtgtg

SEQ ID NO: 97956 - DNA, 75 bp, Mus musculus
cagctgtaatggagatttctgggaggcaaggatggcctctggaccattctgagtccctctgtctctaagtagctg

SEQ ID NO: 97957 - DNA, 86 bp, Mus musculus
gggggtctggaggacagggacaggacaggacaggacaggacaccttccttggtttttggtctcattttgttcatctcaggtctctg

SEQ ID NO: 97958 - DNA, 72 bp, Mus musculus
gattgtggggctggagagatggctcagtggttaaggccactcactgactgctcttccagaggtcctgagttc

SEQ ID NO: 97959 - DNA, 107 bp, Mus musculus
tgtgaaaccaagtcctcgagctggagagatggctcagcggttaagagcactgactgctcttccgaaggtcctgagttcaaatcccagcaaccgcatgatggctcaca

SEQ ID NO: 97960 - DNA, 86 bp, Mus musculus
gaacagaagacccctgactggagagatggctcagctgttaagagcactgactgctcttccagaggtcctgagttcaattcccagca

SEQ ID NO: 97961 - DNA, 63 bp, Mus musculus
gtacatatgtggatgtatgtacatatgtatgtatgtatgtatgtatgtacatatgtgtatgtg

SEQ ID NO: 97962 - DNA, 114 bp, Mus musculus
acagagacggcagaggaggaaggccttttcctgatggccgctttaagaaaggaaacagatggtgttgcaggccacctggagttgtcaaagtccatgcttaactgctgagtgtgt

SEQ ID NO: 97963 - DNA, 81 bp, Mus musculus
tctctgtgtgtgtgtctctgtgtgtgtacgtgcctgttgcatgcataaatgtgcacatgtgtgtgggatgcacaaccgtga

SEQ ID NO: 97964 - DNA, 69 bp, Mus musculus
tctgtctgtctgtctgtctgtgggctgttgacttcatgctttgcagctctcagtgcactgagagacgga

SEQ ID NO: 97965 - DNA, 122 bp, Mus musculus
gcagaggagggctcgtggtttcagaatcccaaaggtgtccggtgtgccgagggctccacacatctgtgtgtctctctcaagcacagggcaaggactggtggggatcactggcaggcaggcct

SEQ ID NO: 97966 - DNA, 118 bp, Mus musculus
tgttattgaagatcagccttagtccatgatgatctgataggatgcatgggacaatttcaatatttatgtatctgttgaggcctgttttgtgactaattatatggtcagttttggagca

SEQ ID NO: 97967 - DNA, 63 bp, Mus musculus
gtgctctgtgataagcttgagggagaaggggagctctcctgtctgtctgtgagtctagggcat

SEQ ID NO: 97968 - DNA, 69 bp, Mus musculus
tcatgagtgtgagcacagcctccagcccctccgcccagagctctgtcctctgtgtgtcatacactctga

SEQ ID NO: 97969 - DNA, 89 bp, Mus musculus
agatggctcagcagttatgagcactgactgctcttacagaggaccagggttcagttctcagtgccccacatagcagctcacaactatct

SEQ ID NO: 97970 - DNA, 70 bp, Mus musculus
tgggctcggggctggagagatggctcagcggttaagagcactgactgctcttccagaggacctgagttca

SEQ ID NO: 97971 - DNA, 63 bp, Mus musculus
cccagggtctgtgtctgtttcactgtcagtgcctcgagggctgcggacggggcagagtttggg

SEQ ID NO: 97972 - DNA, 65 bp, Mus musculus
gaacggtgtgaagtcccttgaaggtttacggtcaccggagtgaactgtgggagctcacactgtcc

SEQ ID NO: 97973 - DNA, 101 bp, Mus musculus
tggatgcatttaagaatgaatataaggggctggagagatggctcagcggttaagagcactgactgctcttccagaggtcctgagttcaattctcagcacca

SEQ ID NO: 97974 - DNA, 64 bp, Mus musculus
gtggaggaaaccggctggagcggagagataacagcgtgttctctgtgtgtctgtgtgcgtctgc

SEQ ID NO: 97975 - DNA, 78 bp, Mus musculus
gcccacggtttctctttctctctcagcaaggaaattgccctcattaagtccctgctaaagatagataagaaaatgggc

SEQ ID NO: 97976 - DNA, 127 bp, Mus musculus
ccagtgacgaggaaggggcaaccctgtttgctctatacatgcatgaagtgtgctctgactctctgggtcagccagaagaggccccatccacaggcttcatcctgctggcagcccatggcaaagcaca

SEQ ID NO: 97977 - DNA, 82 bp, Mus musculus
ctcgtggaggtgccaattgctgggggttttgcctagtttgaacctgggcaggtcctatgtattctgtcacagtctctgtgag

SEQ ID NO: 97978 - DNA, 79 bp, Mus musculus
tgtgtccatctgtctgtcactcgttctctatcccagccatatgggaatccctggagccatgcaaggacacagcagagga

SEQ ID NO: 97979 - DNA, 66 bp, Mus musculus
gatgctgagagggcaagcactgtcacttactcacaggcaacagtcttctctctcacttctgctgtc

SEQ ID NO: 97980 - DNA, 63 bp, Mus musculus
cacttgtcaagattttctctgtcatgctgggccttatctctcagagatcagagaggtcaggtg

SEQ ID NO: 97981 - DNA, 83 bp, Mus musculus
atagggtgccactgtgtcactgtttcactatgaggtgctactgtatcattgtgtaactgtgtcactatgaggtgttgctgtgt

SEQ ID NO: 97982 - DNA, 116 bp, Mus musculus
gtctctgtgtgtgtctatgtatgtgtctttaggtgtgcatgtgtctcgtctgtgtgtctgtgtgtgtagatggaaatgctttcaccacacaccatccaagacccattctcagagtc

SEQ ID NO: 97983 - DNA, 84 bp, Mus musculus
ggataatgtccttcctcaggtatgtgtgtgtattgaaaatatatttgtgtttactttacattatatgatgtaaggatgacctcc

SEQ ID NO: 97984 - DNA, 99 bp, Mus musculus
cacatgggtcttggggggacatttttgactcagactatgacatctattctcctctctgccagagtccctctctacgagtcaatctccagggcacaggtg

SEQ ID NO: 97985 - DNA, 71 bp, Mus musculus
ccaggaaagcttgaaggatacccagagcagatgctaatgtgcctctctctgcctgtccctcgctttgcagg

SEQ ID NO: 97986 - DNA, 59 bp, Mus musculus
acacaaacacacatacaagcatacaataaatatatgtatgcatgtatgtatgagtgtgt

SEQ ID NO: 97987 - DNA, 139 bp, Mus musculus
acatatatatgtatatatgtatgtacatatatatgtatgtatatatgtataaaagtatgtatgtgtgtatatatatgtgtgtatatatatatatatatatatatatatatatatatatatatatacatacacacacaca

SEQ ID NO: 97988 - DNA, 71 bp, Mus musculus
gagggtgactgactcacactgaatcttgctaagacgggaaggacgagaggggagtgagaggctgcagcctc

SEQ ID NO: 97989 - DNA, 106 bp, Mus musculus
gagccagacagagcccatgactgggtgtggcattgtgtctcactgtgtgttgagtagatctaagccctcagctgggacatggagtgattcccaggctgctgagctt

SEQ ID NO: 97990 - DNA, 107 bp, Mus musculus
tgtagtgagaagaatatgtcattcatatatatatatatgaatgacatatgaatgacacacacacatatatatgtatatataaaatgtgtgtgtgtgtgtgtgtgcat

SEQ ID NO: 97991 - DNA, 86 bp, Mus musculus
gcctgtctgcctgtctgtctgtccatctgtctgcctgtctccttccccgggcttcacgtatgacggacaaatggccaccactgagc

SEQ ID NO: 97992 - DNA, 85 bp, Mus musculus; identical to SEQ ID NO: 57439

SEQ ID NO: 97993 - DNA, 108 bp, Mus musculus
gtgttcgtatgtatgtatgtgtgtatatatgtgtatgtatgtttatatgtatgtgtgtatgtatgtatgcatatatatgtttgtatgtatgtatgtatgtgtatgcat

SEQ ID NO: 97994 - DNA, 79 bp, Mus musculus
cgtctttctagtctgtctgtctgtcagtaactatgtgctgggttctgctgcatgtctgcggttgaccactggaaggagg

SEQ ID NO: 97995 - DNA, 64 bp, Mus musculus
acttggggcttgagagatggcttagtggttaagagcactgactgctcttccagaggtcctgagt

SEQ ID NO: 97996 - DNA, 84 bp, Mus musculus
agccatgaaagagcgaagcctttgcttcctggccagacattgctagtgtgagagtagagtgagcccttgcttctgttcagagct

SEQ ID NO: 97997 - DNA, 118 bp, Mus musculus
gagtcaccagtgggaggtcaggcctcacctcagggacagctctgatttctgttgagacactcacagccacagtgcatgcctggggcagagagtctttaccatttcctcatttccactc

SEQ ID NO: 97998 - DNA, 104 bp, Mus musculus
gggtattggaaatgtcagacaagcacagcagatctgtcccctctctcgttgcatttataggaagagagagaacagacttgctcctgttttcccagtcagtgctc

SEQ ID NO: 97999 - DNA, 112 bp, Mus musculus
ggatggaagtgagaattaaattatatgtatatacatgctatatatgtatatatgtgtatacacatatggtgtgctttacacatttaatccatggtactctgaactggcctcc

SEQ ID NO: 98000 - DNA, 79 bp, Mus musculus
gtatctgctgtcatctgagttttttattttaaccattctgactggtgtgaggtagaatctcagggtggttttgatttgc

SEQ ID NO: 98001 - DNA, 69 bp, Mus musculus
caaatatgtatgcatgtatgtatgtatgtattatgtaaatatgtatatgtgtatatgtgtatatatatg

SEQ ID NO: 98002 - DNA, 84 bp, Mus musculus
gcacaggagagtcagtgcacagtggccgcccacagctgcccgccactcaggccactttttaaatgtgtgctgcttttcctgtgt

SEQ ID NO: 98003 - DNA, 85 bp, Mus musculus
gaagatcagtgaagacttgagactcacaagcgctgctagctctataagcaagcctcgctcagcctctgtcactgtccactgagtc

SEQ ID NO: 98004 - DNA, 83 bp, Mus musculus
ggattctgtctcctctttgagtctgtgctttgctagtcctcagacatgtatggaaagcaccttactgtggagccatagcttcc

SEQ ID NO: 98005 - DNA, 89 bp, Mus musculus
ataagggttgaaaagacaggcagctaagaaccatactgctctggcaaagacacgagtttagtttccagcacctgtgttagactgcttat

SEQ ID NO: 98006 - DNA, 108 bp, Mus musculus
tctgtcgcttgacagtctggttcctcctgttccgttcagctctatctatcacacagatcagagaggggacagggatgaggttgaacccagaaccctgcacgcaccagg

SEQ ID NO: 98007 - DNA, 88 bp, Mus musculus
gagaaacttctgtgttattcatccctgactcagctctgctatcaaccagctgagcagagagaagagagtgtggcactccctgggtctc

SEQ ID NO: 98008 - DNA, 75 bp, Mus musculus
ggcaggcaggcaggcaggcaggcaggcaggcagacagaaagacagactgactgactgactgactctaggcttggc

SEQ ID NO: 98009 - DNA, 105 bp, Mus musculus
ggcctccctgtatgcttccctcttgtttctgaagccttctctgtctctctcactcagcaaactcaacttcagaacctaggtcagagcctacacctttgggagctc

SEQ ID NO: 98010 - DNA, 69 bp, Mus musculus
agcgagagaaagtcaaaaagggcaagaaaggatgaggcaactctctgcctgcctcccagactggctgct

SEQ ID NO: 98011 - DNA, 88 bp, Mus musculus
tatgtacatatgtatatataaatgtgtatatgtgtgtacaaatatacaaacatatttatatgtatttatgtatatttatatgtacatg

SEQ ID NO: 98012 - DNA, 111 bp, Mus musculus
tcatctatctatctatctatctatctatctatctatctatctatctatctatctatctagaggcagggaaggagagacacagacagacagataggccagactcacagatga

SEQ ID NO: 98013 - DNA, 78 bp, Mus musculus
gtgtgtgtatatgcgtgtgtgcctgcctgtgtgtgtgtacacacatgcacacatgtgtacccatgtgtgtgtgtgcat

SEQ ID NO: 98014 - DNA, 112 bp, Mus musculus
ccttggtggtgggtatcagaccattcaggcccttcctggttatcattgacactcactctgactgagataaagaactaagaaatgatagaatgtgactgcctccaatgaaagg

SEQ ID NO: 98015 - DNA, 118 bp, Mus musculus
ggagcaagggctcaaaggaccagcaggtcctgctgctttttaagtcaagagactccttcagtggccctcagtctgttgatgctgacagtccttgggtcctttgtgcacacaaggcctc

SEQ ID NO: 98016 - DNA, 108 bp, Mus musculus
actgacagtgaacatagtttaactgttaagtatgattaagatatgaaaatattgatgtctttgtttatgataaatactaaatttaagctaagttataaggtgtgcggt

SEQ ID NO: 98017 - DNA, 125 bp, Mus musculus
tgtatgccactgggagcaaaggagtcttgtattaagtttggggtatgcaggctaaggatgtaggatgtagagtgtttgcctagcatacataaagcctgggttcaatttccaacactgcatgaacc

SEQ ID NO: 98018 - DNA, 97 bp, Mus musculus
tttcctaattccattcctcccatttgaaataggattgcacatcatgtcattgtacggttaaagtatgtaacttttttttaatgggtcaattaggaga

SEQ ID NO: 98019 - DNA, 68 bp, Mus musculus
agctggtctctcaagaagggcatcgtctctcaagtatgccgaagactctctctcactgaggctcagct

SEQ ID NO: 98020 - DNA, 128 bp, Mus musculus
gtgtgtgtatttgtatatatgtatgtatgtatgtatgtattatgcctgtgtatctgtgaatatttatgtgtgtacatttgtgtgtataaatgtgtgtgtgtcacgtgatttttattatcacagcctaa

SEQ ID NO: 98021 - DNA, 60 bp, Mus musculus
gtgtgtgtctgtgtgtgtgtcctggatatcaagcttaggacctctcacgcttgtacatgc

SEQ ID NO: 98022 - DNA, 87 bp, Mus musculus
ctccctgcagccggccgagtgcaagaggcgactccaaggtacctgaccagggtgctgtctctctgtgtgcgtcacgggcagtgtgag

SEQ ID NO: 98023 - DNA, 77 bp, Mus musculus
gtgtctgtctgtctgtctgtctgtgtgcatgcatgccatgacattagcatagaggccagaagagagctttcaggtgc

SEQ ID NO: 98024 - DNA, 108 bp, Mus musculus
gtacacatacacacccatatgtatatgtatacatgtatatgtgtatatgtgtatatgtatatatgtgtatatatatgtgtatatatgtatatatgtgtatatgtgtat

SEQ ID NO: 98025 - DNA, 71 bp, Mus musculus
gccatgtggcgggtctggctgtccatgtctaaaggcaaagacacacacactcagacctgtgggacaggggc

SEQ ID NO: 98026 - DNA, 99 bp, Mus musculus
gggaccaccgccatggggtgtccccctgaggactgctgctttcaagaaggttacttcacataagtcagtcagcagagatcaccaccgtggtcagagccc

SEQ ID NO: 98027 - DNA, 82 bp, Mus musculus
gtatgcgaatgtgcaagtatgtgtgtgtgtatgtatgtatgtatgtatgtgtgtatgtatgtatgtatgtatgtatgtatac

SEQ ID NO: 98028 - DNA, 66 bp, Mus musculus
caggaatgggtagaagagactacagacagacatcagctgttgtagaaactttttatcccaatcctg

SEQ ID NO: 98029 - DNA, 68 bp, Mus musculus
gacgggctccatgaccatgatcaccaatggcttcccccatgaggtggctctcagtcactcggactctc

SEQ ID NO: 98030 - DNA, 77 bp, Mus musculus
cctgcagattgatcccaggctgccagtggccctgagttaccctgcctctctgagcctgtgatcaggtctcccacagg

SEQ ID NO: 98031 - DNA, 87 bp, Mus musculus
gtaggggcggaccaagctgagatttacagttgagattttgttaaactatttaactatctcctgtctctttaggttgctcgtttttac

SEQ ID NO: 98032 - DNA, 66 bp, Mus musculus
tctctctgggtctctgtctctctctatctgtggtgggcaggggaggcttctgagtgctaagtgaga

SEQ ID NO: 98033 - DNA, 60 bp, Mus musculus
tctgtcttgtgtctgtctctcaccaccacagagctggagggagcagccatgtgtggcaga

SEQ ID NO: 98034 - DNA, 116 bp, Mus musculus
gaatgatgcattctctcactctcttctgttgcccacctcctgtcctgtgtgtgagcacacacacagcacggcacacatgtggaagccagaggacaagtcttgggagttgcttactc

SEQ ID NO: 98035 - DNA, 113 bp, Mus musculus
ctggagcctcttttttctgtgatcatggttgtgtcagaactcctcagagtccatctgtctctgtgagcctgtgattctgagatcctgtgatcctgagatcctgggtgtgccag

SEQ ID NO: 98036 - DNA, 102 bp, Mus musculus
tatatgtgtgtgtgtgtatgtgtgtctatctatctatctatctatctatccatccatccatacatgcatacatacatacatacatacatgcatacatatata

SEQ ID NO: 98037 - DNA, 97 bp, Mus musculus
tagttcataacttttgtcagtttcactgtgtctctgtttagtttctgtttccaagatctgtccgttgatgagagtgaggtgttgaagtttcccacta

SEQ ID NO: 98038 - DNA, 92 bp, Mus musculus
ccagcccctccccccagcttgtccctactgtgtctctttatttgtatatttgaaaccagcatttcagcagccttggaagagaggcggagctg

SEQ ID NO: 98039 - DNA, 118 bp, Mus musculus
cagagatgtgaccagggaccagtttatgccaagtccgaagaattttaactgagataagacagaaaggtcagagctaaattctgtggagttatttgggctgaaatgtgaaacgtgtttg

SEQ ID NO: 98040 - DNA, 98 bp, Mus musculus
ggatgttcaagtcccttttaaaggaggaaacaatgtttagatataatctctgtatattgttctgtatgtttaaaataatttcaggattatttatgtcc

SEQ ID NO: 98041 - DNA, 107 bp, Mus musculus
tatatatgtggtatgtgtatatgtatatgtgtagtatatatatattatactcatatatgaatgagtttatgtatatgagtatgtatatatgcacatatgcatatata

SEQ ID NO: 98042 - DNA, 107 bp, Mus musculus
atttgacttctggtcctctctgtgtcctttcagtttctctctctctcgtttactgctttagagggtgcactgctttggatgctacattgaaaccgagtgagtccggt

SEQ ID NO: 98043 - DNA, 91 bp, Mus musculus
aggtgggaaatttttactctaaatatgtatatttttacacagacttatgtgtattatataggttgtattaggtaaatagtttatgatacct

SEQ ID NO: 98044 - DNA, 104 bp, Mus musculus
gaatgtgtgtatacatgtgtgtgtgtgtgtgtatgtatgcatgcatgtgtgtatatatgtatgtatgtataaatgggcacttctcactctttctttatattttc

SEQ ID NO: 98045 - DNA, 114 bp, Mus musculus
gaaaatactgggcagggttatttttgcattttctgataaggaaggtgaggtttaaggttgcaaaggaaaggcccatccagtcagaatctcgaaggttagcatgccctgactgtc

SEQ ID NO: 98046 - DNA, 65 bp, Mus musculus
gtggatgccttccttgaagttgtttaagaactagagtttttgtttttctcaagggctgtgtgtac

SEQ ID NO: 98047 - DNA, 62 bp, Mus musculus
cacttatcagtgtcaactcatgctacttacatgagatagcagagagagtgcactgtcctgtg

SEQ ID NO: 98048 - DNA, 81 bp, Mus musculus
aggaaaagtgagggaggcagcccacagccagagctgtgtccaagtcacactcaccctgtgcctcacccaaactgagttcct

SEQ ID NO: 98049 - DNA, 70 bp, Mus musculus
agtggtagacctgaaggtgctctcagctcagagcttagcagctctgagtgaggacaggggcttagccact

SEQ ID NO: 98050 - DNA, 115 bp, Mus musculus
tagaataacattctcagtcctttccatagcccggaagactctctctaactcactgagtgatttagggcttcacaccatctgtcagttgtgggaagattggcactggttacttctg

SEQ ID NO: 98051 - DNA, 139 bp, Mus musculus
acatatacatacatacacaaatatatatataatttgcactatatgtataatgtatatgtattttatttatatatattatatatgtgtatatgtattttatttatatgtattatatgtgtgtgtatgtataatatgtata

SEQ ID NO: 98052 - DNA, 106 bp, Mus musculus
gaggagtagagaaagaagagtgaggagagagacagacagacagagacagagagactatggactgttttctgcttatgtctgccccttaagaacaccatccctcctc

SEQ ID NO: 98053 - DNA, 61 bp, Mus musculus
ctgggtctgggtgggagctgagctggttagcccatcagctctctcacactcacaccatcag

SEQ ID NO: 98054 - DNA, 115 bp, Mus musculus
attgtctgtgtgtccttatccaaagtcaattgagtgtgtatgtgcatctgcttctggagccctctgctgctttgccattatgctctacagggcggtgagtccttgtattgacggt

SEQ ID NO: 98055 - DNA, 106 bp, Mus musculus
gccttagtccatagtgatctgataggatgcatgggaaaatttcaatatttttgtatctgttgaggcttgttttgtgttcaattatgtggtcaattttggaaaaggt

SEQ ID NO: 98056 - DNA, 105 bp, Mus musculus
cctttcaattatgcagaaagagactagggtttacaatactctttttgttttacacttccattttcctcctgggtggcttaaatcttggtttgtactgcagaaagg

SEQ ID NO: 98057 - DNA, 85 bp, Mus musculus; identical to SEQ ID NO: 63243

SEQ ID NO: 98058 - DNA, 113 bp, Mus musculus
gggaaagtactatcccttctatatggaaaatccagttaaacttgtatgtatgtatgtatgcatgtatgcatatatgaagcttataaaatgataaatttccatatggcttttcc

SEQ ID NO: 98059 - DNA, 96 bp, Mus musculus
tagattatcttcaagtatatgtatatgtgtatgtatatatgtgtatctacacacagatatagatagatataaatatagatatatttgaagcttcta

SEQ ID NO: 98060 - DNA, 115 bp, Mus musculus
atgttccatatatatatatgtatatatatatatgtatatatctatatacatatatatatatatatgtatatatatatatacatatatatatatatctgttaaatccatttggttc

SEQ ID NO: 98061 - DNA, 73 bp, Mus musculus
acatgtgcttgtgtgtgtgcaggtgtgggtgcatgaatatgtgtgtgtgcctctgtgtgtgtgcatgcgtgtg

SEQ ID NO: 98062 - DNA, 112 bp, Mus musculus; identical to SEQ ID NO: 61349

SEQ ID NO: 98063 - DNA, 85 bp, Mus musculus
tatataaagaaggtcacaacatgtatatgtgtatgtgtatgtgtatgtatatgtatgtatataaagagagtgacatctaagtata

SEQ ID NO: 98064 - DNA, 182 bp, Mus musculus
tatctatctatctatctatctatctatctatctacccgagctagatagatcaatagatcgatagattagatataggatatatatatatatgtatatatatatatatatatatatatatatatatatatatatatatatatatatatatacatatatatatatatatatatatatatgcccta

SEQ ID NO: 98065 - DNA, 56 bp, Mus musculus
gcttgggggtggggggacacgcacgcgtgcgtctgtctgtctctctgcctgcctgc

SEQ ID NO: 98066 - DNA, 99 bp, Mus musculus
ttggcaaagacataagaaatatggctctaagcacctctgtgatgtgactagggttcacagtgtgcacactggggccaggaaggtgtttcccagctcatg

SEQ ID NO: 98067 - DNA, 81 bp, Mus musculus
tacatacaatgagacaagtgtgtgcacacaccctcacacgtactcacaatctctgtgcacacacacacctttacatatgtg

SEQ ID NO: 98068 - DNA, 106 bp, Mus musculus
ctctcgctctttgcctgcttggactctcagaacagagtgaacagactaaacagtggaagcgtgttttctcagttctggaagaacgagtccaaagtccggagagagt

SEQ ID NO: 98069 - DNA, 75 bp, Mus musculus
aagagaagcagggtgtgtctctctctgtggatgggtgggatccggagcaggggcacagagctgtctgcttctctt

SEQ ID NO: 98070 - DNA, 117 bp, Mus musculus
gcatattttattttgatgtcattggtcctttgtgcagagcctgtcctatgagcttgttaagttaatacatgtttatggtttgcatcagtgaggaagagatgagcagatactattgta

SEQ ID NO: 98071 - DNA, 72 bp, Mus musculus
gggctgggaccagagtgaggacacagtctatgtagcatactccgactctatactctggacactgaacggcct

SEQ ID NO: 98072 - DNA, 87 bp, Mus musculus
gtatatgtgtgtatatgtatgtgtgtatatgtatgtgtgtgtatgtatgtatgtatgcatgtatgtgtatatatgtatgcatgtgtg

SEQ ID NO: 98073 - DNA, 68 bp, Mus musculus
agagtctatctgtgtctctctggtacctgcccaagtggacactgtagccaggatggacactagagtct

SEQ ID NO: 98074 - DNA, 83 bp, Mus musculus
cttgtactgagcatacgtcctgtgaaggctgtgggaaggggacaagtgcccgcctctgcctgacagctctcactgtgcacaag

SEQ ID NO: 98075 - DNA, 92 bp, Mus musculus
gaggtaggactggcactgactgtgtgtgtgtgtgtgtgccacatgctggtggatcacaggacataatgaaagccgtgaagtgcccatgcctc

SEQ ID NO: 98076 - DNA, 92 bp, Mus musculus
ggattcacagctaaggactttactcagacgtaaaacacagtgacctcagagcctgctatgttccttgtcttcaataatgtcccagtgagtcc

SEQ ID NO: 98077 - DNA, 76 bp, Mus musculus
gtcctgtgacaggctgtttggtgtcacttgtgtaagtcccacttagagaatccatgcctgcctgcctgtatgacag

SEQ ID NO: 98078 - DNA, 117 bp, Mus musculus
ttcagttagagttttattcattttcgtgatatgtatgtgtgtatgtgtatgtatatgtatatttccacagttacacataaacacatgtatgtatacactgacacaaagctgtatgaa

SEQ ID NO: 98079 - DNA, 118 bp, Mus musculus
gttatagacagtgctatgtacctgatatggaattcaggcagtttatcatcggcagagcattttttttttaaatgatagctttctaaaactcatgtcagagtattttgttatctgtaat

SEQ ID NO: 98080 - DNA, 106 bp, Mus musculus
agcagagcatagtgtgacaaagctcacatctgggctttgtgtctctgtctgagcccagctggaagcacagatgagcacatgaagatgagagtgtccacctcctgct

SEQ ID NO: 98081 - DNA, 110 bp, Mus musculus
tgtgaggctgtccacctggtgaccagaaagggaagactggtcagaagagagtttgctcttgtaggatccagaaatcgtttgttctgtaaatgccacggtgccatcttgta

SEQ ID NO: 98082 - DNA, 93 bp, Mus musculus
caaatgttagcccatagccactccactgatcgctgcttctggtgtagcctgacagaacactgagaggtgagagcatgtgccatgtgtcatttg

SEQ ID NO: 98083 - DNA, 77 bp, Mus musculus
acagagatacacctgtccaaagatgaaggccctcctgctgcctacagctcagggaagctgtgtctctctgtgagagg

SEQ ID NO: 98084 - DNA, 114 bp, Mus musculus
tctgcctgcttttcttctcttgtgttttagcttgatatgtgactgctctgtctctcactagctcagcagtggcaatcctctagtccccagtgagtctgagccaaaagttcaaga

SEQ ID NO: 98085 - DNA, 78 bp, Mus musculus
tatatgtgtgtatattgtgtgtatgtctgtgtgtgtgtataaatatacacacatatattatgcgtattcatgtgtgtg

SEQ ID NO: 98086 - DNA, 59 bp, Mus musculus
gagaggagagaggggggaggggcagaggtcagctttgaccagtctctctgtcacagctc

SEQ ID NO: 98087 - DNA, 63 bp, Mus musculus
ggcttccatttgcaatacatgttgagtcttaatatatttcaatttgatatcacagtggaagcc

SEQ ID NO: 98088 - DNA, 67 bp, Mus musculus
tactgtggctcacagagcctttctcaagggcgctgaaggtcagagctctgttctcaagctgacagtg

SEQ ID NO: 98089 - DNA, 74 bp, Mus musculus
gttccagtgatctgccatactagatacttgaaagctcttttttttttgtatactagaggaagagttactggtac

SEQ ID NO: 98090 - DNA, 66 bp, Mus musculus
gcgtgcgtgcgtgcgtgcgtgcgtgcgtgcgtgtgtgtgcacgcgcgcacgtgagcgtgtgtgtgt

SEQ ID NO: 98091 - DNA, 134 bp, Mus musculus
gtatgtgtgtgtacatgtatgtgtgtatatatgcatgtccaggtgtgtgtatatgtgtgtgcatgcctgtgtgcctgtgtgcctgtgcctttgcacatattggtgtgtgtgcaggtctgtatgtgtgcatgtgt

SEQ ID NO: 98092 - DNA, 127 bp, Mus musculus
acacacacacacatatatatatgtatatgtatatatatatgtatatatttttgtatgtacctgtgtgtatatatatatgtatgtatgcattggtgtaagtgtctgtgtgtgtgtgtgtgtgtgtata

SEQ ID NO: 98093 - DNA, 87 bp, Mus musculus
gagtctcagccacggagttaccctaaacttgtagcttgaattgtaaacaatgaactccttgtgggtggcattgaggctgatcaattc

SEQ ID NO: 98094 - DNA, 59 bp, Mus musculus
tatctgcatgtatatgtgtgtgtatatgaatatgtatatatacatatatggtgtaggtg

SEQ ID NO: 98095 - DNA, 86 bp, Mus musculus
cgtactctactctccttggatcaggtaccacacaacctgtggtcacaggaaagagtgtgcccacagaaaggacagtgcagagtccg

SEQ ID NO: 98096 - DNA, 133 bp, Mus musculus
agtctgggaggacaatcccaagccaccacaccctactccttctatgtggattctgggactcagactctggctctcacgtttgcaaggcaagcattttgctgactgagatgtcttcccatttctgttaccccag

SEQ ID NO: 98097 - DNA, 72 bp, Mus musculus
ggcatgagccactgggtcaccgagctgaggttcctgtctctatctctggctgtgactgtatggtgggttgcc

SEQ ID NO: 98098 - DNA, 58 bp, Mus musculus
atgtgtgtgtatatgtatgcatgtatgtatttatgcatgcatgtatgtatgtatgtat

SEQ ID NO: 98099 - DNA, 77 bp, Mus musculus
gactcgagaccaacaagcactgcacagctagctctataagcaagcctaactcagtccctgtcactgtcttttgagtc

SEQ ID NO: 98100 - DNA, 82 bp, Mus musculus
agcggaggctcctctctgacactcagtgcctgccttcaccatactgagccttgggcctgctgctagggggtggctgtcaccg

SEQ ID NO: 98101 - DNA, 64 bp, Mus musculus
gtatatgtatatatatgtacgtatgtatgtatgtatgcatgcatgcatgcatgtatgcctgtat

SEQ ID NO: 98102 - DNA, 76 bp, Mus musculus
cctacactgtgccttctctcactctctctgggaggccacgctcctcaggtcaaggtctagcaggaggccagggagg

SEQ ID NO: 98103 - DNA, 84 bp, Mus musculus
gggctgcatgctttatgcatccgacaaccacatgaactcaggctctgtctgtcaaaggtagattggagatgaggcccagtgctc

SEQ ID NO: 98104 - DNA, 98 bp, Mus musculus
gtttatgcatgtcagatttgaacagtactgtgagagcagttgaagtttaagatcgtccgcgtcaatcaaacagtaaagtaatctatacacgtgcaaac

SEQ ID NO: 98105 - DNA, 102 bp, Mus musculus
aggactggagagagaactcagtggttaggatgacagaagtgtgtgtgttcttggagaggatccagcttctgttcccatcacgtacgctactcacaaccacct

SEQ ID NO: 98106 - DNA, 92 bp, Mus musculus
cagttcactaactatttcttagtggacactctctctgtgagttgtcgtgtagttttgaggtgtctatgaacagaaataagaaaacgacactg

SEQ ID NO: 98107 - DNA, 101 bp, Mus musculus
tgcccatgatgaaggaaggaagcttgtagagaaaggtgactgtagaatgtatgcacaaaaggacagtgtcaactgagtgagctctatggcctagatgggcg

SEQ ID NO: 98108 - DNA, 78 bp, Mus musculus
gtatgtgtgttgtgcatgtatgtacgtatgtatgtacgtatgtatgtatgtatgtatgtatgtatacaatgcatgtac

SEQ ID NO: 98109 - DNA, 66 bp, Mus musculus
gtgcctgaagtgtgtgtgcgcatgtgggcgtgtgtagatgtgggtgtgcatatgattggaggatac

SEQ ID NO: 98110 - DNA, 121 bp, Mus musculus
ctctgtttagtttttgttaggatgatctgtacactggtgagggtggagtattgaactctctcacaatcagtgtgtaagggtcaatatgtgatttaagctctagtagtgtttatttatttta

SEQ ID NO: 98111 - DNA, 65 bp, Mus musculus
gactgcttttgagttttgaatttcttcttttaagaattggaaaagaatgtgatttgaaggcagtc

SEQ ID NO: 98112 - DNA, 76 bp, Mus musculus
gcaggggtgagagtggaaagtcagaggtgacccgtgctcagcagtctgtctcatagccaagagtcctcacccatgt

SEQ ID NO: 98113 - DNA, 105 bp, Mus musculus
cctgcctgccaggaaggaagcgctggcccagagtatcctggatgtcctgacagaggtcactgtggccattggggatgtggagtgctgcagaattgccaagggagg

SEQ ID NO: 98114 - DNA, 98 bp, Mus musculus
tctctagtgcctcctgctctctctatgtctgactgggtcctgtccttcctgtgatcctggttgtgtcagacctccttagagttcagctgtctctgaga

SEQ ID NO: 98115 - DNA, 108 bp, Mus musculus
gttatcagcttaagattaactgagggctggagagatggctcagtggttaagagcactgactgctcttccagaggtcctcagttcaattcccagcaaccacatggtggc

SEQ ID NO: 98116 - DNA, 118 bp, Mus musculus
tggggggttatcaccaagtccgctgttagagtgtagatttccctctgtgattcacgacaagatcacagaagacagactggaacatccacccctaccaggaggacagtgtagcccaaca

SEQ ID NO: 98117 - DNA, 115 bp, Mus musculus
atgtgtattgcgcatataggtatatgcatgtatttgtgtatatatgtatatgttacatgtgtatatatgtatatacatgtatatgtatattctaatatatgagagtttgatacat

SEQ ID NO: 98118 - DNA, 108 bp, Mus musculus
gggaccttcatgaggctgactccagctacaggcattgactgagcccatgtctggagtctgaagtaagtgtgctcagagctcggagttttccggtaaccagaaggtgtc

SEQ ID NO: 98119 - DNA, 59 bp, Mus musculus
gtatagagcagactggcctcaaagttatctttgagatctgcctgtctctgcctctctgc

SEQ ID NO: 98120 - DNA, 68 bp, Mus musculus
caagcacagtggactgtgttgaatcctctcactgtatgtgagacaactcagtgtccagaggtgaagtg

SEQ ID NO: 98121 - DNA, 87 bp, Mus musculus
cactggcaatgagagagggtgataagacacgggacattccccatctcactctgtatctgtctccttcccacttagcgctgaccactg

SEQ ID NO: 98122 - DNA, 67 bp, Mus musculus
tcagagcctctgtgtgttagtataatctgggacacacacacagagacacagacacacagtgttttga

SEQ ID NO: 98123 - DNA, 78 bp, Mus musculus
cttccagagcgggtttcgctgaaggccttcagcctttctcatctggaaagctgcctggctctcacaccctctctgaag

SEQ ID NO: 98124 - DNA, 135 bp, Mus musculus
ttgcaggtcctgatgtcaccctgcaccaaagagaaatagcaagctatcaatcagtgtgtttgagtgcaatgataacagggagcaaaaggctcattgccattcgtgtcttttcaggtgcgatcacatgatggccgc

SEQ ID NO: 98125 - DNA, 80 bp, Mus musculus
tgagatctgtgagagctgtgagaggagagcctggtggggaggcctggtcacctacaacatcttcacttgacgtgatctta

SEQ ID NO: 98126 - DNA, 83 bp, Mus musculus
tgcctaggcttacctcccgacgtccgtactcgacacttgagtgaagtgtcggtggactgtcccactgtttctctgtctgcgcg

SEQ ID NO: 98127 - DNA, 94 bp, Mus musculus
gtgtatgtgtgcatgtgtatgtgccggtatatgtgcgtgtgtatgtgtgtgcatgtgtgtgtgtgtctgtgtatgtatgtgtgtgcgcctatgc

SEQ ID NO: 98128 - DNA, 103 bp, Mus musculus
gtatgtataacacaggtatgtgtgtgtatgtatgtatgtatgtataacacaggtatgtgtatgtatgtatgtatgtatgacacaggtatgtgtgtgtaggtat

SEQ ID NO: 98129 - DNA, 74 bp, Mus musculus
tgtttgtatttatatatgtgtgtatatatgtttatatgagaatgtgtgtgtgtgcatacgtgtatttgacttca

SEQ ID NO: 98130 - DNA, 71 bp, Mus musculus
ggagtctgtgtcaatgtctgtggctcatactaccagtgaagaccatgaggacatccctgatctgggctgcc

SEQ ID NO: 98131 - DNA, 84 bp, Mus musculus
gtgtgtgtgtgtgtgtgtacacattcatttctcagagacagattctacacaaatatgtatgtatgtatgtatgtatgtatatac

SEQ ID NO: 98132 - DNA, 151 bp, Mus musculus
tgtatgtgtgtgtatatgtatatgtgacacatatatgtatatgacatgtatatatgtgtatatgtatatgtcacacatatatgtatatggcatgtatatatatatgtgtatatgtgcatatgacacacatatgtatatgacatgtatatgt

SEQ ID NO: 98133 - DNA, 104 bp, Mus musculus
ctgccatctatctacctactggatgtgagagttctgaggtttgaattctctctctgtatgtgtgatgagtaggattcaaggtgtgagagaggcgtgcgataagg

SEQ ID NO: 98134 - DNA, 104 bp, Mus musculus
gttttcaggactcattcacatacaacagagtgtacatagaacctgtacagcagagtgcacacagggcctttacattctgctgtacgtgaatttttgcctaaaat

SEQ ID NO: 98135 - DNA, 74 bp, Mus musculus
gtatatatgtatgtgtatatatgtatatatacatgtatatatgtgtgtgtatgtgtgtatgcttatatatgtac

SEQ ID NO: 98136 - DNA, 88 bp, Mus musculus
gtccatggtggtctgataggatgcatgggacaatttcaatatttttgtatctgttgagggccctgttttgtgaccaaattatatggtc

SEQ ID NO: 98137 - DNA, 67 bp, Mus musculus
cggtcctcaaatggggattcacggcatcatattctgagcacaaagagtccctgtgtctgagtctctg

SEQ ID NO: 98138 - DNA, 113 bp, Mus musculus
tacaaacacacatcaccaccttcaggtccatgaatattttttaatgaaaaattacatttattaacttttatttgtttatttgtgtgtttgtgtttctttgtgtgtgtatgtgt

SEQ ID NO: 98139 - DNA, 73 bp, Mus musculus
tgccttaatagtatggcatatgtatgtatgtatgtatgtagtacgtatatactatttgctattgtatgttgca

SEQ ID NO: 98140 - DNA, 96 bp, Mus musculus
gtgtgtgtctgtctgtctgtctgtctgtctccatactcctatatctataattatatatgggtagatagggatatacacagatataagtatacatat

SEQ ID NO: 98141 - DNA, 59 bp, Mus musculus
gtgaccaagctcctgggattctaagattctcggtgtgttagagcacctggaagtggcac

SEQ ID NO: 98142 - DNA, 116 bp, Mus musculus
gtatctgtggctgtggctgtggctgtagctgtggttgctgctgtggctgcatctgtggctgtgactgtggcttttgctgtggctgtggctgcagctgcagttgtggctgcatatat

SEQ ID NO: 98143 - DNA, 63 bp, Mus musculus
tcaggccacattgaaaggagacagtgagctgagcaccagcatcccctcctctcagcttcctga

SEQ ID NO: 98144 - DNA, 77 bp, Mus musculus
gagctgctgcgcttctgtctctctgtgtgctcaggtgactggaaaatgcatgtgcatctggtggaagtgtgacagtc

SEQ ID NO: 98145 - DNA, 81 bp, Mus musculus
gcacaattaggagtcacgaggtgtcttcggaggtgtcctttagctgcacgtttctggatcatttcacagttctgttggggc

SEQ ID NO: 98146 - DNA, 88 bp, Mus musculus
tacctagaactcagactgactgactcaatgaggtccctaacaagtggcttttgtgttttcctttagagctgagtcaatatgcctggta

SEQ ID NO: 98147 - DNA, 72 bp, Mus musculus
ttggactgctgggtcactgagtcactgggtcaagggtcactgggtcattgggtcactgggttgctagtttaa

SEQ ID NO: 98148 - DNA, 69 bp, Mus musculus
gttactgacatcttggtgaatggaacatttgttttgtacaacattcccagcctggatgttgtcagtggc

SEQ ID NO: 98149 - DNA, 86 bp, Mus musculus
tgtgtatgtgtgtatatgtaattgtgtgcatgtgtatatatgaattgtgtatgcgtagtgtgaatgtgcatgtatatgtgtatata

SEQ ID NO: 98150 - DNA, 66 bp, Mus musculus
cttctccatacatgctgcctgtcaggaacacgggcccccgtgtgcctgtcagtcactgagacagag

SEQ ID NO: 98151 - DNA, 63 bp, Mus musculus
ctctgtctcagtgactgacaggcacacgggggcccgtgttcctgacaggcagcatgtatggag

SEQ ID NO: 98152 - DNA, 168 bp, Mus musculus
ggttgtgtgtgttttttatgtagatgcatgtgtgtgtatgtgaaagtgtgtgtatgtatgtatgtatgtatgtgcatatgtaggtaagagtatgtgtgtgtttatgtagatacatgcacgtgtatgtatgtatgtatgtatgtatgtaggaaggtaggtatgtatgta

SEQ ID NO: 98153 - DNA, 79 bp, Mus musculus
gaagcaccacagacctgactgcatctgtgacagggtttgagtgggccttgctcctggtcagtccgtctgtgtgtcattc

SEQ ID NO: 98154 - DNA, 80 bp, Mus musculus
tatatgtcagtgtatatatgtgtatataatatagattaataaatataatgtgtatatattatatatgtacattatatata

SEQ ID NO: 98155 - DNA, 118 bp, Mus musculus
tctctaaggaggactaagttgcagcatggtaattcacaggcattttgtctgagtatttatatttacttagactgcgtgtctgcatgctcaggaccagcatcagtgtcagtgatagaga

SEQ ID NO: 98156 - DNA, 102 bp, Mus musculus
ctgtggatcatggttagagaaacgtttgcctctgtctgtctggcacaccctcacgtccttcgcagtaccagaagaggcagagtttgctgactgaagcctcag

SEQ ID NO: 98157 - DNA, 95 bp, Mus musculus
tcaggcacactgtgcagtaaggctctgctgtctgtgtttctcatacacttgagactagagaatctgatcttgttaatgctgcagtgtttttatga

SEQ ID NO: 98158 - DNA, 113 bp, Mus musculus
atagagcaatatttttcttgaacatacttacatggaacatgtcatatatctatatttgcaaactaaagatgtaattacttccatttagtgtgaagatacatatttaaatctgt

SEQ ID NO: 98159 - DNA, 68 bp, Mus musculus
ctgtctgtctgtctgtctgtctatcatatatctatctgtatttttgcatagataccaggagcagatag

SEQ ID NO: 98160 - DNA, 97 bp, Mus musculus
ttccctttgagtgtccgcgctgcactgtctgagctggtgctcttcctgaagcacttactcagttactcagtctctgcagggatcgcttgcacgggag

SEQ ID NO: 98161 - DNA, 85 bp, Mus musculus; identical to SEQ ID NO: 57439

SEQ ID NO: 98162 - DNA, 98 bp, Mus musculus
gaactcaggtcctctgcaagatcaatgcatgctcttgagctggacagatggctcagtggttaagagcactgactgctctttctagaggtcctgagttc

SEQ ID NO: 98163 - DNA, 114 bp, Mus musculus
agctgaaataaatgatctgtacccctagactcggggctctctcactctgacttgctgccatggtgacaataagagaccttactcccaagttcatagtaaagattcttatgtgtt

SEQ ID NO: 98164 - DNA, 111 bp, Mus musculus
caaggctaaggattatctttgtgttttcttcacatttatcccagattattaaaatatatatatatatatattcgggggtggtagagatggctcaagtggttaagagcattg

SEQ ID NO: 98165 - DNA, 64 bp, Mus musculus
catgtatgtatgtatgtatgtgcatgtacatgtatgtatgtgcatgtacatgtatgaattactg

SEQ ID NO: 98166 - DNA, 68 bp, Mus musculus
gtatgtatgtatgtatgtatgtatgcatgtatgtatgcatgtatgtatgcatgtatgtatgtatgtat

SEQ ID NO: 98167 - DNA, 91 bp, Mus musculus
tgaccttgaaagtacgtccttgacctcaggaaagtagacagagaggagacttaggcatctatttattccctcatggacctatttgaattca

SEQ ID NO: 98168 - DNA, 78 bp, Mus musculus
gcacgtgtgtggctccgtgtgtggctccgaacagcaaagcggcaggttccagcagtgggcgtggcagaacgaatgagc

SEQ ID NO: 98169 - DNA, 80 bp, Mus musculus
cacaggctttctagttcactctcttgctgggaccaaagacaatttaggagaaaacagttcagagagagcagaaacctatg

SEQ ID NO: 98170 - DNA, 99 bp, Mus musculus
gatcagtcttagtccatggtgatctaataggctgctgcatgggacaatttcaatatttttgtatctgttgaggcctgttttgtgaccaattatatggtc

SEQ ID NO: 98171 - DNA, 108 bp, Mus musculus
gccttagtgcatcgtgatctgataggatacatgggacaatttcaatatatttgaatttcagttgaggcctgttttgtgacctattatgtggtcagttttggagaaggt

SEQ ID NO: 98172 - DNA, 85 bp, Mus musculus; identical to SEQ ID NO: 57439

SEQ ID NO: 98173 - DNA, 104 bp, Mus musculus
tatgtgtgtgcatgcacatatgcatgtgtaactgtgtacacatgtgtgagtgtgtgtggctgtgtgtacatgtgtgcatatgcatgtgtgtttacgtgcacgtg

SEQ ID NO: 98174 - DNA, 107 bp, Mus musculus
gcctgaattgtcagttttagatgttgtcaaccattagttttcagtgttattccaccctaaatcaggaagacttgttctgggttcagcagatgtcatactcttcaggc

SEQ ID NO: 98175 - DNA, 109 bp, Mus musculus
ggtgttgcaatagtgactggaattgggtatactagctagaatttcttgtttataattaactttatagtttagaactgatatgtccccctaggctttatgcgttcatacc

SEQ ID NO: 98176 - DNA, 84 bp, Mus musculus
gaaggcagagagagatgacactcagcaagaatgcacgtggcctccaggagctgcaacacgtgaggagctctctctctctctctc

SEQ ID NO: 98177 - DNA, 92 bp, Mus musculus
atgatgtttagatctacaggacgtgagggaggagcacgaggtaagaggcaaagctccataccgactctctcactttctccaggtggcattat

SEQ ID NO: 98178 - DNA, 116 bp, Mus musculus
gtgactctttatttaattaattgctgtaacatacatatttgtatttgtatatctgttgaatatatagaaatatctatatatcctggggttggataattaattgattgcttgttcat

SEQ ID NO: 98179 - DNA, 79 bp, Mus musculus
ttctgacaagactgtgaggtgtctgccttcagtgagaggaaagcacctggagaagatagaaaagatggtacttgcagag

SEQ ID NO: 98180 - DNA, 85 bp, Mus musculus; identical to SEQ ID NO: 57439

SEQ ID NO: 98181 - DNA, 80 bp, Mus musculus
tgtgtgtctgtgtgtgtatctctgtgtgtgtcttctctactcctgacagaaaagagagtgctttaatatacagttattca

SEQ ID NO: 98182 - DNA, 72 bp, Mus musculus
tatatctatctatatatgtgtgtgtgtatacacacacacacacacacacacacacatatatatgtatgtatg

SEQ ID NO: 98183 - DNA, 98 bp, Mus musculus
tagcaaattgtatcttatatcttaggtattctaggtttttgggttaatatccacttatcagtgggtacgtacaatgtgagttctttgtgattgggtta

SEQ ID NO: 98184 - DNA, 109 bp, Mus musculus
tatatgtatacatatatacattatgtattttataatgtacacatataatatataatattatatgtatatatatatatgtatatatatatatatatataataaagtatat

SEQ ID NO: 98185 - DNA, 119 bp, Mus musculus
ggactgctataacaaaataccttggactgggtaatttttgagatgaaagacaagaagtatgtcattgaagatcagaagatttggtgattcaagggggctgtttttatagatagatgtct

SEQ ID NO: 98186 - DNA, 82 bp, Mus musculus
ggatatctgatgaaagcaactcatttgtcattctgagtcacactctgtgtagggaaatgattcttttcatgctcagatatgc

SEQ ID NO: 98187 - DNA, 79 bp, Mus musculus
ctcctgcactcctgtggggagctgagagataagagacaggagaatttttgatcttagcgattctgactggtgtgaggtg

SEQ ID NO: 98188 - DNA, 102 bp, Mus musculus
ttacagttttcctcatcatgtaatattacatggcttgatctttctatatttataaagcttccatttcatgtggttttgaacccatgagtgtttgaattgtaa

SEQ ID NO: 98189 - DNA, 93 bp, Mus musculus
gggatcaggatctgaactcatcattcactgaatgttgcacagatttttaatttttagctatagattctctgggtgagtttgaggtcaaagcct

SEQ ID NO: 98190 - DNA, 85 bp, Mus musculus; identical to SEQ ID NO: 57470

SEQ ID NO: 98191 - DNA, 77 bp, Mus musculus
ctctagctctctgagaactcattttgaagaagaggctggcctcaacttcaaagagcttctgcctacagagtgcaggg

SEQ ID NO: 98192 - DNA, 106 bp, Mus musculus
tatctgtgtgtttatgtacttatgtatgtatgtatgtatgtatgtatgtatgtatgtatgtatgtatctcttcatccatccatccatccatatgtaataccagcta

SEQ ID NO: 98193 - DNA, 79 bp, Mus musculus
tctgaaattatgctacagagtggttttaggttctttagaactgtgtgaatctgaaattatgctacagagtggtcttagg

SEQ ID NO: 98194 - DNA, 112 bp, Mus musculus
gtccttgcaggccaacacagtgacatggatatggaaaggacctttttatgtttgtagaactaggttgtatacatcaatccattattcaatccaagaccataaaggcagggac

SEQ ID NO: 98195 - DNA, 75 bp, Mus musculus
tgtatgcctctgtgtgtgtgtgtgatgaaatgtctgcatgtacacatacacatgtgtagaccagagtatcataca

SEQ ID NO: 98196 - DNA, 85 bp, Mus musculus; identical to SEQ ID NO: 78864

SEQ ID NO: 98197 - DNA, 166 bp, Mus musculus
tttggaatacatatatatatggaatatatatatatatatatatatatatatatattgaatatatatatatatatatatatacatatatatatatatatatatatatatacggatcatatatatatatgaaacatatatatatatatggagcatatatatatatgta

SEQ ID NO: 98198 - DNA, 85 bp, Mus musculus; identical to SEQ ID NO: 57470

SEQ ID NO: 98199 - DNA, 85 bp, Mus musculus; identical to SEQ ID NO: 57439

SEQ ID NO: 98200 - DNA, 82 bp, Mus musculus
agcttttccctagttcaaccacaggtgtccccaacttcagtccaatagttgtgtgtatctgtgtctgtcttagtcagatgtt

SEQ ID NO: 98201 - DNA, 81 bp, Mus musculus
gtaaggactggcaaaaatggatagaacaagagaagatcttcattcttgctattggtctctatgtatttctacagtttctat

SEQ ID NO: 98202 - DNA, 92 bp, Mus musculus
tgaggtttatttcatttgagttgcaaaataactaacatcccttccccttttaagaggtgaatttttattttgctttaaagtgaaatgcctta

SEQ ID NO: 98203 - DNA, 122 bp, Mus musculus
gtacacatatatacatgtgcatatatttatatggtgtatatgcatttatatgtacatgttatgtatatatatatgtacatgtacatgtatatatgtgtatataaacatatgattatatgtat

SEQ ID NO: 98204 - DNA, 69 bp, Mus musculus
tacgacattcactaactgagggctgtgtatatgtatgcacgtgtgtgtgtctgtctctgtgggtgtgtg

SEQ ID NO: 98205 - DNA, 84 bp, Mus musculus
tgcaggtaagctcaagcactctttctcactcagccagttccagaaagggaggatgctctattgagattacctaaattacctgta

SEQ ID NO: 98206 - DNA, 66 bp, Mus musculus
tgtgtgtatgatgtttgcatattttatatagttacatttaattatattgtagacagaatacagaca

SEQ ID NO: 98207 - DNA, 87 bp, Mus musculus
tgggagtagaggccagagaacaatctcagctgtcatttctcaagagacatgacaagagacatggttttttggtgacaatgtctctca

SEQ ID NO: 98208 - DNA, 104 bp, Mus musculus
atagcctcatttcagctggtgtatgctgcctggttggtgtctcagtgtctgagagatcttgggggtctaggtcagttgagactgctggtctgtcattggggctg

SEQ ID NO: 98209 - DNA, 75 bp, Mus musculus
aatgttcactgcatttatttatgtatatatatattcatctgtatgtatgtatgtatgtatatgtatgtatgcatt

SEQ ID NO: 98210 - DNA, 91 bp, Mus musculus
agatttccttagagtctggggtctatatctgtgtttctatatatatttgtacatacttgacacagcataagtagacatcaaaggaaagcct

SEQ ID NO: 98211 - DNA, 119 bp, Mus musculus
cattcgcaagcaaagaagtgtgaacgaaaaggaatgctatgagagacacactgtgacacactacggtgtccacagattgtttaattctgttggatagactgcatgggtggaaggtgggt

SEQ ID NO: 98212 - DNA, 99 bp, Mus musculus
gtcaagttgataatccaggatagccatcacagatgatttttaatatattcagaaaggttattaatatggaaaaatatctggatcacatatcagaatgtc

SEQ ID NO: 98213 - DNA, 80 bp, Mus musculus
tgattccaaccaaatgtaagttaaggaaccagaaaagtcattgtgggttctttggtaaaacgttaggaagaatggagtta

SEQ ID NO: 98214 - DNA, 85 bp, Mus musculus; identical to SEQ ID NO: 57439

SEQ ID NO: 98215 - DNA, 107 bp, Mus musculus
aaacccttcatggtttatttaggcttaatttgttatcactgccagtaatgttctcactcactggggatttattggttgagcccagagactgagccgtgtgagtcttt

SEQ ID NO: 98216 - DNA, 85 bp, Mus musculus; identical to SEQ ID NO: 57439

SEQ ID NO: 98217 - DNA, 100 bp, Mus musculus
tctggagaacgtcccttacaacctaaagaacttgccaatgatcataaatatttgtatttgtacattgagacaagttttgtgtgctctaacttttccaaga

SEQ ID NO: 98218 - DNA, 70 bp, Mus musculus
ttcttctgcaaatgaaagaactcagtggggaaacccccactcagctcccgattcggcgtgcacccaagaa

SEQ ID NO: 98219 - DNA, 58 bp, Mus musculus
acatacatacgtatatacctatacgtatgtatgtatgtatgtatgtatgtatgtatgt

SEQ ID NO: 98220 - DNA, 116 bp, Mus musculus
ttgaagatcagctttagtccatggtgatctgataggatgcctgggacaatttcaatatttttgtatctattgaggcctgttttgtgaccaattatattgtcaattttggagaaggt

SEQ ID NO: 98221 - DNA, 85 bp, Mus musculus; identical to SEQ ID NO: 57439

SEQ ID NO: 98222 - DNA, 100 bp, Mus musculus
tgcaagggctgggatcctagacaataagaaagaagtgtgtgagctgtgcacaagcagttatctcttattcctgactgggaacacaatgtcaccagctgca

SEQ ID NO: 98223 - DNA, 66 bp, Mus musculus
acaattgtatacatatatacacacatatatatacatatatatgtgtatatatatgtatatgtatgt

SEQ ID NO: 98224 - DNA, 69 bp, Mus musculus
cataatgtatgtatatatgtatgtacatatgtatatatatgtaaatgcatgcatatatatatatgtatg

SEQ ID NO: 98225 - DNA, 85 bp, Mus musculus; identical to SEQ ID NO: 57439

SEQ ID NO: 98226 - DNA, 109 bp, Mus musculus
tgacttctgtggcagttgctatttagaactaagttaagatgtccttagtatgtgacactgtatcttattttttatagactatctccttccacctccacattctgagtca

SEQ ID NO: 98227 - DNA, 107 bp, Mus musculus
acttaaggtaattatttttcacagccacattaactcgtatgattagtctttatagggttttcatacctatctgagtgatttggggagtgtaggtagttgcagtaagt

SEQ ID NO: 98228 - DNA, 66 bp, Mus musculus
catgcatatgcacacatacatatgagtaaatgcatatatatgtatatgtttgtgtatatatgtatg

SEQ ID NO: 98229 - DNA, 85 bp, Mus musculus; identical to SEQ ID NO: 57439

SEQ ID NO: 98230 - DNA, 85 bp, Mus musculus; identical to SEQ ID NO: 57439

SEQ ID NO: 98231 - DNA, 77 bp, Mus musculus
gagacagagatagagacagagagacagagagcttaaatgaagaagcaaagcacgctcactgtcctaccctaagtctt

SEQ ID NO: 98232 - DNA, 85 bp, Mus musculus; identical to SEQ ID NO: 57439

SEQ ID NO: 98233 - DNA, 74 bp, Mus musculus
gagcaacatgagtttgctgcagtgtttcacaactgcttccagggagtctgtgtcactgactctgctctaactca

SEQ ID NO: 98234 - DNA, 66 bp, Mus musculus
gtccaatggttggctgtaagtattgtgtctgtctcagtcacctgctggtagagtctctcagaggac

SEQ ID NO: 98235 - DNA, 85 bp, Mus musculus; identical to SEQ ID NO: 57439

SEQ ID NO: 98236 - DNA, 74 bp, Mus musculus
atgggatggatctccgggtggggcagtctctgaatggtccttccttcagtctttctctctgtaactccttccat

SEQ ID NO: 98237 - DNA, 83 bp, Mus musculus
tgacgctgatatcacacccagctatttacatgtcatgactattgcacaaggcatgtggaaagataggaagttatagggcttca

SEQ ID NO: 98238 - DNA, 85 bp, Mus musculus; identical to SEQ ID NO: 57439

SEQ ID NO: 98239 - DNA, 77 bp, Mus musculus
gagcatcagtaatagtgtcaggttttggtgcctccccataggatggatcccaagttgggcctgtcactggtcggttc

SEQ ID NO: 98240 - DNA, 81 bp, Mus musculus
tggtgatctgataggatgcatgggacaatttcaatatttttgtatctgttgaggcctgttttgtgaccaattatatggcca

SEQ ID NO: 98241 - DNA, 60 bp, Mus musculus
taggcttattttacatatacacataggtttaaattatgtgtatatgtatttgtcagtctg

SEQ ID NO: 98242 - DNA, 110 bp, Mus musculus
ttgctggcgagaaactagctcaggacacacaagtaagtaagtaagtaagtaagtaaatgaacaaacaaatgcaaactttaaacgcttggcctggtagcttgcatttgtaa

SEQ ID NO: 98243 - DNA, 84 bp, Mus musculus
gaaagtcacagtgaacacagtgaaaccctgcagtctgagctttgttctgtcacacactcaggctttcatatcatagtgtccttc

SEQ ID NO: 98244 - DNA, 126 bp, Mus musculus
gcctgtgtgtctgtgcatatgtgtgcatgtaagcctgttgtgtatgtgcctatgagtctctgtgtgtgtatgtacacgtgtgtttgtctgtatgtagagactagaagaggctatatcaatcactgg

SEQ ID NO: 98245 - DNA, 101 bp, Mus musculus
ccaggcctgttgaggcaaaaatagatagatccctgagtttccataggcagacagtctgtgtctcagtgagaaatctttgctcaaaaatgctacagctctgg

SEQ ID NO: 98246 - DNA, 73 bp, Mus musculus
gagaactgctgtcggggccagagagaataaagcagggtgtccctcgatttctctctgtctctgggagagtttc

SEQ ID NO: 98247 - DNA, 93 bp, Mus musculus
gagtcctgggacagagttctgtcaggctgcctcactgtcctttctgctgccgatggcacgtgagaggtttagactggaaaatcctggagcatc

SEQ ID NO: 98248 - DNA, 92 bp, Mus musculus
catttgtccagagtatccataatgtatgttctactgtccagtagtggctcagccttctcagtgaccagacattgtgggtttacatacaaatg

SEQ ID NO: 98249 - DNA, 85 bp, Mus musculus; identical to SEQ ID NO: 57470

SEQ ID NO: 98250 - DNA, 85 bp, Mus musculus
cgatatatctggaatgaatacaagtttgaggtcaccttgcctacatagtgagttcaaggtttattgttggttacagggggtatgg

SEQ ID NO: 98251 - DNA, 62 bp, Mus musculus
ccactctaggacgtgtctcaagagacaatatgtgagtctctttgtcactgacagtagagtgg

SEQ ID NO: 98252 - DNA, 107 bp, Mus musculus
gggagggagggagggagaaagggagagggaagaaggggggggggaggctggccgcaggagtgcctgccaccctcttagctatctgaaatgcttattcccgagattac

SEQ ID NO: 98253 - DNA, 109 bp, Mus musculus
tgccccactattatggcaaaaggatatagctgactgcttcatgaatgtattattttatactttcctaggagagtccatgggatgtccctcagagccaaagaaagatgca

SEQ ID NO: 98254 - DNA, 78 bp, Mus musculus
acttctgttagtttcactgtgtctctgtttagtttctgtttccaggatctgtccattgatgagagtgggggatgaagt

SEQ ID NO: 98255 - DNA, 72 bp, Mus musculus
agcactgcctgaggtggtcagccggcatggagcttgaggcttgctggctgaactgtgtctggccaggtggct

SEQ ID NO: 98256 - DNA, 96 bp, Mus musculus; identical to SEQ ID NO: 60322

SEQ ID NO: 98257 - DNA, 85 bp, Mus musculus
gtccatggtgatctgataggatgcatgggataatttcaatatttttgtatctgttgaggcctgttttgtgaccaattatatggtc

SEQ ID NO: 98258 - DNA, 85 bp, Mus musculus; identical to SEQ ID NO: 57470

SEQ ID NO: 98259 - DNA, 73 bp, Mus musculus
gccagggctaacactgtatgtttttttttctacagacgactttgcagaggaagaggaggtgcagtccttcggt

SEQ ID NO: 98260 - DNA, 86 bp, Mus musculus
ggggaagcatttggtagagacattcattttgggctgagagttcctaggtctctcactctctgtgtagtgtctggttgtggatctct

SEQ ID NO: 98261 - DNA, 81 bp, Mus musculus; identical to SEQ ID NO: 98240

SEQ ID NO: 98262 - DNA, 107 bp, Mus musculus
ccagattgggttctatagctatgttgtgccattcaacaagaataaacatgtcttgtaaattgaatgtaaatatttgtcagcacaaagttatgtcagaacagtccagg

SEQ ID NO: 98263 - DNA, 110 bp, Mus musculus
cttgaagatgaagtcattctgtgacctagtgcctgtggggtatttagaaagcatacattttttttttttgagaccgcattttacttacacagagggatccaataaacagg

SEQ ID NO: 98264 - DNA, 85 bp, Mus musculus
tatgcatgaacacttgtgaaattattgagacaggtagttgggcccagccaaattgtgtgtctgtgtatctgtgtgtctatgtgtg

SEQ ID NO: 98265 - DNA, 93 bp, Mus musculus
tgtttaagaattgaatagaggactgaagagatggctcagcagttaagagcactgactgctcttccagagatcctgagttagttcccagcaacc

SEQ ID NO: 98266 - DNA, 79 bp, Mus musculus
atgtatgtatgtatgtatgtaattggtgaagtagttgatgcttgattcatccaccaagtgtgtgtgtgtgtgtgtgtgt

SEQ ID NO: 98267 - DNA, 114 bp, Mus musculus
tatgtatgtatgtatgtatatatatgcatgtatgtatgtatgcacatatgaatgtataatgtatgtataaatgtaagtatatacgtatgtatgtatgcacatatgaatgtatat

SEQ ID NO: 98268 - DNA, 85 bp, Mus musculus; identical to SEQ ID NO: 57439

SEQ ID NO: 98269 - DNA, 68 bp, Mus musculus
ctgtctgcttcctgactgcagagagtgtgaccagcccatcacatactctgctggcagggccagagcag

SEQ ID NO: 98270 - DNA, 112 bp, Mus musculus
ttcatcttgggttgccccatccagtcttaatacgacagaaggtgcctagtcttactgcaacttgatatgccacgtttggttgatattcatgggaggcctgcccttttctgaa

SEQ ID NO: 98271 - DNA, 86 bp, Mus musculus
ttggcaggtgagaggtgggccctgagaggctgtctctgtctgtggtggagaccggcttatttctgtgttcccgtcttactcttcag

SEQ ID NO: 98272 - DNA, 80 bp, Mus musculus
tagactcgggagtaagtgtgtcattgtggaggcggggctttaaagttatacatgcacgcacacactcacactcaagtttg

SEQ ID NO: 98273 - DNA, 94 bp, Mus musculus
ttttaaaataacatccttaatgaagacaaatatttatatactagagaaagaacagatgtttgttcttgtttatacaagggatgtagtggtaaaa

SEQ ID NO: 98274 - DNA, 73 bp, Mus musculus
gtgtgtgtgtgtgtgtgtgactgagagagagagagagtgtcagatcttggagttacaggcagtatgtgggtgc

SEQ ID NO: 98275 - DNA, 61 bp, Mus musculus
tggagctgagaaatgacaccagagtaaaagaatttatatttctgggtctcactcagtcaca

SEQ ID NO: 98276 - DNA, 61 bp, Mus musculus
gctccagctactgtttggctgcaggtgtctgtatctgtctgagtcagcttctgggtggagt

SEQ ID NO: 98277 - DNA, 61 bp, Mus musculus
atacagtgtgtatgtttgtgcgcacatttgtgtgtgtgtgtgcacatgtatgcctctgtgt

SEQ ID NO: 98278 - DNA, 85 bp, Mus musculus
ggccatggtggtctgataggatacctgggacaatttcaatatttttgtatctattgaggcctgttttgtgaccaattatatggtc

SEQ ID NO: 98279 - DNA, 92 bp, Mus musculus
ttgctgttttgattgtgaagattttgtagttctgattagctggggctgaagaatcagctgtggttaacaagataccagaattactaaagcaa

SEQ ID NO: 98280 - DNA, 111 bp, Mus musculus
gagatgctagaagatactgaagttttactttgagatacttgagaagtgtccataccattttttatatgtctatactaacttccattctcatcaatagtgcttaagattctc

SEQ ID NO: 98281 - DNA, 83 bp, Mus musculus
cagatttagacagacagcacatctctcacatgtggagcctagcctataaagtctgtctgtctgtctgtctgtctgtctgtctg

SEQ ID NO: 98282 - DNA, 88 bp, Mus musculus
tccatctgtctatcatctatcggtctgtctgtcttacttatttttattggggcacatgtgctacagcccacttgtgaaggatagtgga

SEQ ID NO: 98283 - DNA, 77 bp, Mus musculus
tgtgtatatttgtgtgtgtgatgtaggtatgtgtgtgtttgcatgtatatgcttgtgtgaatatttatatgtgtgta

SEQ ID NO: 98284 - DNA, 75 bp, Mus musculus
ttctgtgcccttaaagcttgttaagtaaatgtggtagtacagtctcaattatttgggagctagcggggttaagag

SEQ ID NO: 98285 - DNA, 62 bp, Mus musculus
tctgtctgtctgtctgtctgtctatgtatgtgtgtgagagagaggagagagagagagagaga

SEQ ID NO: 98286 - DNA, 85 bp, Mus musculus; identical to SEQ ID NO: 57439

SEQ ID NO: 98287 - DNA, 68 bp, Mus musculus; identical to SEQ ID NO: 64137

SEQ ID NO: 98288 - DNA, 106 bp, Mus musculus
gctttagtccatggtgatctgataggatgcatgggacaatttcaatatttttgtatatgttgaggcttgttttgtgaacaattatgtggtcagttttggagaaggt

SEQ ID NO: 98289 - DNA, 97 bp, Mus musculus
aatagagcaaaatcttccaaatctcagaggttgttgttattgcccaaatcgtgaaggtaaattaatacagtagctgtcatttgagtaaagctctatt

SEQ ID NO: 98290 - DNA, 99 bp, Mus musculus
tagtccatagtggtctgataggatgcatgggacaatttcaatatttttgtatctgttgagtcctgtttcgtgacacattatatgatcaattttggagta

SEQ ID NO: 98291 - DNA, 94 bp, Mus musculus
agttaatgaataaaagtgcttggtcatagtttggaaattgcattaatattcaaatagcatatttctttatttattccaggaacttgtcataatt

SEQ ID NO: 98292 - DNA, 87 bp, Mus musculus
tacttcatgcatatatatatatacatatatatatgcacatatctacatatatgtatatatatcagtgtatatgtatatgtgcaagtg

SEQ ID NO: 98293 - DNA, 85 bp, Mus musculus; identical to SEQ ID NO: 58391

SEQ ID NO: 98294 - DNA, 106 bp, Mus musculus; identical to SEQ ID NO: 65309

SEQ ID NO: 98295 - DNA, 123 bp, Mus musculus
attgtgtgtgtgtgtgtgtgtgtgtgtgtgtgcatatgatgtgtgtctgtgtgtcagtgtatctgtgtacagttatatagttgtatagttgcatatttacatatacatctagaacaataatac

SEQ ID NO: 98296 - DNA, 78 bp, Mus musculus
gtgaatgaaactagaaaatatcatcctgggtgaggtaactcagacccagaaaaatgcatatgctatgtatttatttat

SEQ ID NO: 98297 - DNA, 70 bp, Mus musculus
tgtgtgtgtatgtatatatgtatgtatacatatatgtgtgtatatgtatatatgtatatataaaatcaca

SEQ ID NO: 98298 - DNA, 101 bp, Mus musculus
tggttgcatgtatatatcatatgtgtgtgtgtgtgtgtgtgtatatatatatatatatatatatatatatatatatatatatatatatatatatgtaatca

SEQ ID NO: 98299 - DNA, 130 bp, Mus musculus
agaatgaattccgttactgtggtaatgttattcttggccatggattcaatgtagtgactttgttcatcagaacttaagagtgatttgtaaagaaaccacaactgaaggatagtcgttttccttatgatgg

SEQ ID NO: 98300 - DNA, 116 bp, Mus musculus
ccagcttgtttcttcagaccatttgcttggaaaactgcttcccagccttttactctgaggtagtagtttctgtctttgtccctgaggtgggtttcctgcaagcagcaaaatgttgg

SEQ ID NO: 98301 - DNA, 85 bp, Mus musculus; identical to SEQ ID NO: 57439

SEQ ID NO: 98302 - DNA, 70 bp, Mus musculus
gagccagaaattagaaggacccctgtccccagggaacacgccagggactctgtctgtctggatcctagct

SEQ ID NO: 98303 - DNA, 116 bp, Mus musculus
aggcagcattaggcttgtgatgttttgagaagaaaaagtgcataccagtctctcccctctctctgtatgtgtgtatatgcctgtctctttctctgtgcctctctgtctgtctgtct

SEQ ID NO: 98304 - DNA, 87 bp, Mus musculus
gtttagaagtgcaatgtccaagacttgtgatttcatatgttcatctattggtaagggattaaagtcaggtggcatcttactaggaac

SEQ ID NO: 98305 - DNA, 115 bp, Mus musculus
cagttagtttatttaatcacctcccttagtgttgctttggctatggacagtcactttgtctctgttcaccttgagtagaatctgaggaagactacctttttttatttgacaactg

SEQ ID NO: 98306 - DNA, 103 bp, Mus musculus
tctaaatcttgtcttcctgtccacactctcttctctgagtgtcctgactgtggagaaaaaagaatcagtgagtgtggccttttagtggacaggaaatgttgga

SEQ ID NO: 98307 - DNA, 100 bp, Mus musculus
tgtacttaaccactgtggtataaggaagtcaccatcagtcaagtcagtgaggagtgatagagcagatagccctgtatgctatagtaggggtgaaagtcca

SEQ ID NO: 98308 - DNA, 123 bp, Mus musculus
tatattgtttgtgtatgtgtgtgtgtatgtatgtatgtgtgtgtatatatatatatatagatagatacacacatatatacatatatgtatatatacatacatacatatacatacacacacaca

SEQ ID NO: 98309 - DNA, 95 bp, Mus musculus
ccgttcaagagatgagtgagtgcctgaggagtgtggtttacttgtgttttacacagggcctcttttattttcatgtcagattatctgtgaaatgg

SEQ ID NO: 98310 - DNA, 76 bp, Mus musculus
ctatttagattatatttcaagaaaatgaattttgtgaataattacaagttcatttactgattatgtaattgtgtag

SEQ ID NO: 98311 - DNA, 101 bp, Mus musculus
agctactatagtgtttcaactttgtttttgaggtaggtgcttgtttagagtttttgagaagagaaaccatggcccaaaaaaatcccaaaatactgatggct

SEQ ID NO: 98312 - DNA, 93 bp, Mus musculus
atgtaagtatcaaattagtatgtctttggataggattgtgtaagaatgtttgatttttaaaattgctgtttgaattgctgacttgagcttcat

SEQ ID NO: 98313 - DNA, 68 bp, Mus musculus
tgtatatttatatgtatatatcatatgcatatatttatatgtatactatatgtacataactatatgca

SEQ ID NO: 98314 - DNA, 61 bp, Mus musculus
aggctcatagagagtggcactattaggctttgttgaaaagtgtgtcactgtcactgaggct

SEQ ID NO: 98315 - DNA, 99 bp, Mus musculus
ctgctttaatagagacatgatatatatgtatatgtatatgtgtgtgtatacacacacacacatataatgagtataccaaattggtcttttgggggacag

SEQ ID NO: 98316 - DNA, 115 bp, Mus musculus
tccttgaccaaagtatcattgaggataatgttgttcagtttccacgtaaatgttggctttctattatttattttgttattgaagatcagccttaatccatggtgatctgatagga

SEQ ID NO: 98317 - DNA, 95 bp, Mus musculus
tattttgtttatttttattatgtatgcatttatatatgtatttatgaatatacatatgtatgtatgtatatatgtatgtaattattgctttagta

SEQ ID NO: 98318 - DNA, 100 bp, Mus musculus
tctgcctcttactggagcttgctataaatgcagaacctcagacccccttcagagcttctccatctgaatctgcatttaccaagatgccaggggagacagg

SEQ ID NO: 98319 - DNA, 89 bp, Mus musculus
gtctggccagtatttgcactttcaggaccggcttccatagttctctctctcactctgcggttatggaagggtgaaatcagcttcgtgac

SEQ ID NO: 98320 - DNA, 92 bp, Mus musculus
tccatggtgatctgataggatgcatggaacaatttcaatatttttgtatatgttgaggcttgttttgtgaccaatacatggtcaactttgga

SEQ ID NO: 98321 - DNA, 134 bp, Mus musculus
tgggagaagaacccgtcctggtgtgtggtcagtctatcaggggtcacatctttaaggaaaactgactctctcacacccagcagctgtcaaatgctaacagctcctcagttactggtgggattttatgttctcct

SEQ ID NO: 98322 - DNA, 68 bp, Mus musculus
ggaggtgagggagagggctttgaggtttcagctcaagccagactcggtggctcactctctcttcctgc

SEQ ID NO: 98323 - DNA, 73 bp, Mus musculus
gaaggagcaatctcagagaagggagtgtgagcacgtgcaagccagctctcttctctctgtgtgtgcatcagtc

SEQ ID NO: 98324 - DNA, 80 bp, Mus musculus
ggtgaaggactgcctcttgttctatgggatcttctaaactgattctgaagttttatttttctctttcaaagttctttacc

SEQ ID NO: 98325 - DNA, 95 bp, Mus musculus
gaggtgaagggtgactcaggcagagtcagtgactgcctcacagcagggaatgtgatattatcattgggacgctctagcaagggcattaaaacttc

SEQ ID NO: 98326 - DNA, 107 bp, Mus musculus
atgtgtgtgtgtaatatatgtttatctcaatatgtatgtgtatatatatatatagtgtgtgtgtatatatatacaatttgagtaaattttagtttatacattcatat

SEQ ID NO: 98327 - DNA, 74 bp, Mus musculus
ccaaacagaccaaagcctttcagagtctgaggagacaggcaggtttccaggagaaaggcttaagggctgggtgg

SEQ ID NO: 98328 - DNA, 73 bp, Mus musculus
attgtataccattagagtgagcagacaggctcaaagtggagagacctgagaatctgtcctctatgatgacaat

SEQ ID NO: 98329 - DNA, 105 bp, Mus musculus
ctctctctccacacattaaagtcaggccacaaacagtccctctcccactgactcagttctggagcaggctagttctgtcaggctgctgtgtccttttgcagtgag

SEQ ID NO: 98330 - DNA, 115 bp, Mus musculus
gtgctgagagcaatagaactcaccaccatacccagcccagaacatatattatttttaattgactcttatttatttcatgtgcatgggtgttttgtcagcttttatgtctgtgcac

SEQ ID NO: 98331 - DNA, 75 bp, Mus musculus
gaaagctagattctaaactagtatggagatgagtgttagaaagtctcaaaataagggcacagagtctaagctttc

SEQ ID NO: 98332 - DNA, 78 bp, Mus musculus
tcggtatcacttgtcagtcagtccgtctgaccggtatttctgcgtggagctgaactgtcaagcggttaacaaagctga

SEQ ID NO: 98333 - DNA, 94 bp, Mus musculus
agttatgagagggaaaaccataataacagcaatttattgtatgaaaaaatctattttcagtaaaaaagtagatggctgtgtggctttcgtaatt

SEQ ID NO: 98334 - DNA, 111 bp, Mus musculus
acatatatattgtgtgtatgcatatactatatagtatacatatatactgtatatatatatgtatagtatgtatacatatgtatgcatatgtatacatgcagtatatatgta

SEQ ID NO: 98335 - DNA, 87 bp, Mus musculus
ctggcagtatgggctcgcagcatgacttcttcacatcgtggtgactcaggacacacagactgtcactctatgacctgtgtctggcag

SEQ ID NO: 98336 - DNA, 111 bp, Mus musculus
gtatgtataaatgtatgtgtgtgtgtgtatatatatgtgtacatatgtatatatgtgtgtatatatgtatatatatgtgtatacacacacacacacacacatatatatata

SEQ ID NO: 98337 - DNA, 63 bp, Mus musculus
gactttcagtgtgtactgtgtgtgcttgtgcgcactgaaacacacacacacacattgtaagtc

SEQ ID NO: 98338 - DNA, 68 bp, Mus musculus
ctgagtgtctgtgagtctgtctgtgtgtaggaatgctagtgcccacggagaccagcagagagcactgg

SEQ ID NO: 98339 - DNA, 86 bp, Mus musculus
atgtatacatatatacatatatttatgtgtacatgtatatatattatatatatacatatatatgtgtgtgtatgtatatatgtatg

SEQ ID NO: 98340 - DNA, 91 bp, Mus musculus
ttggtttttgctgtgaggtctttgtttgttgctgaggctgagcttaattgccctgtctttctgactcagactctggatagctgggaactga

SEQ ID NO: 98341 - DNA, 84 bp, Mus musculus
cctggagatgagaaaatacaggtgtttttagttcctgtagctgtaagctcacagaagactgactggtttgacatcttacacagg

SEQ ID NO: 98342 - DNA, 94 bp, Mus musculus
atgtttctgaacacgccgtatgagattgttaagggttgtccgtgattgaactctgggaccagctctctgcaagcagttgcgtggcgcctcacat

SEQ ID NO: 98343 - DNA, 107 bp, Mus musculus
gctgcctagggtcaagtgagggtccctggttgtagattgtaggttatcacttagagaagattgagagtagaaaatgtggccaagtgttcctgtgatagtgggcgtgc

SEQ ID NO: 98344 - DNA, 107 bp, Mus musculus
gtacacagtctcagtacacagtctcagtacacagtctcagtgtacagtctcagtacacagtctggtgtacagtctcagtgcacagtctcagtacagtctcagtacac

SEQ ID NO: 98345 - DNA, 71 bp, Mus musculus
gtgcacagtctcagtacacagtctcagtacacagtctcagtgtacagtctcagtgtacagtctcagtgtac

SEQ ID NO: 98346 - DNA, 110 bp, Mus musculus
cttagagtggatgcctgacactataaacaatctcaagccctatgtaggtatgtatatatgtatatgtagtttctgttttataatatatgagtcagcctttcattactatg

SEQ ID NO: 98347 - DNA, 105 bp, Mus musculus
atatgtgtatatgtgtatatgtgtatatgtgtatatgtgtatatgtgtatatgtgtatatgtatatgtatatgatgtatatgtatatgtatatgtatatgcatat

SEQ ID NO: 98348 - DNA, 101 bp, Mus musculus
gtagtagcaacaagatggttcttgctttaattgtgtgggtctgactgtcactctgaagaaggcatggcaggacaatggtggtttcaactttttgccactat

SEQ ID NO: 98349 - DNA, 97 bp, Mus musculus
tcctagttctcattagggtagagagaacactgacagcagcagctgcctcgtgagctggttgtctaggtggtaagggaggtgccttgagatgacagga

SEQ ID NO: 98350 - DNA, 83 bp, Mus musculus
gtccttgtaattggatggagcatcctttgggtgcataccctggagtggtcttgaagtagcttgatttccaattttctgaggat

SEQ ID NO: 98351 - DNA, 116 bp, Mus musculus
tgttgggggcctcatatcagctggttgtatgctgcctggttggtcactcagtgtctgagagatctcaggggtccaggttagttgagactgctagtcttcctatggggtcgccctca

SEQ ID NO: 98352 - DNA, 108 bp, Mus musculus
tctatctatctatctatctatctatctatctatctatctatctgtgtgtgtatatatatatatatggagagagagagagagagagagagagagagagagagagagaga

SEQ ID NO: 98353 - DNA, 83 bp, Mus musculus
cagacacacatgcaagcaaagtgcatacacacagttaatgaaagcctggagtgtcactcactgtcttggattgtgtgtgcctg

SEQ ID NO: 98354 - DNA, 75 bp, Mus musculus
ttggggtggttcaggggggttagatcctgcccatgtatgttgtctggttggtggttcactctctgagagctccaa

SEQ ID NO: 98355 - DNA, 63 bp, Mus musculus
gtgtgtgtgtgtgtgtgagtgtgcgtgtgaaagagagagacagactgacagagacacaggcat

SEQ ID NO: 98356 - DNA, 75 bp, Mus musculus
gggctccatcactcagggaggcaggacttggaaagttgactgcgctttccccacactgtcactgggtgggtgcct

SEQ ID NO: 98357 - DNA, 97 bp, Mus musculus
tgacaatctcataggcatatatacatgtgcgtgtgcatatatatatgtgtgtatgtatgtatacatgtatgtatgtatgtatagtgccctttgatca

SEQ ID NO: 98358 - DNA, 75 bp, Mus musculus
aaggaacgaacctgtctctcactctgtctgttgttttcaatgaagacagtgacagagttttcatgggcatccttc

SEQ ID NO: 98359 - DNA, 80 bp, Mus musculus
agggctacacctttacacaggtaatatagcaacatatggagggggaatatgttcattatatatttgtgtgaaaatgtcct

SEQ ID NO: 98360 - DNA, 65 bp, Mus musculus
gcagccaggccggaaaagtccctacactcaacattggtatgcacatttctgaggcttggttctgt

SEQ ID NO: 98361 - DNA, 89 bp, Mus musculus
gcatatttgtgctattgatctgacatcaaaaactgttccttgcccatgtttggccagagctggttggttgtaatgttcaaaagtgctgc

SEQ ID NO: 98362 - DNA, 80 bp, Mus musculus
atgcatatctatctatctttgtatgtatgtatgcattcatgtatatatgtatgtatatatgtatgcacgtagatatgcat

SEQ ID NO: 98363 - DNA, 92 bp, Mus musculus
ggctccctgtcccctttctgtgtctctgtatgtcccttgattgaactgctttagccaagatagaagacctcagagttctgggataggcctgt

SEQ ID NO: 98364 - DNA, 91 bp, Mus musculus
atacaaaagtgaatatatatgtatatatacatacatatgtgtgtgtatatatatatatatacatatatgtgtgtatatatatcataagtat

SEQ ID NO: 98365 - DNA, 94 bp, Mus musculus
ccagtacaatgtatatatgcaaaagaaagatgttaggattggagcttccaggccctcacctctctgtctgactgcctatttatatcctggcatc

SEQ ID NO: 98366 - DNA, 112 bp, Mus musculus
ctggaaacaagtatagtcagtgttagaggaaaatgattgatagaatgaatatatttatgtacatatatattcagtctaagagtctgagaatgctgtagttgcttgattcttg

SEQ ID NO: 98367 - DNA, 106 bp, Mus musculus
tttattgaacaggcaccctgggactcatcaagcagggatgtaggtcagacttgggagctgagtctgccactctgactgtttcccaggagcagcttataaagataaa

SEQ ID NO: 98368 - DNA, 85 bp, Mus musculus; identical to SEQ ID NO: 57439

SEQ ID NO: 98369 - DNA, 96 bp, Mus musculus
gagaagatgtggcttttttggaggaagtgttactggggtgaacttttttttttaatagtgtctcagagttttctggtggagtttgtagggcttttc

SEQ ID NO: 98370 - DNA, 118 bp, Mus musculus
agaatgtgccctggaagctatcctaatatatcagaacatgtaacagtctctcagtgaggcatttagttgttattgaggcttcatggtttgtctttgtggtatgatacatatagctcta

SEQ ID NO: 98371 - DNA, 85 bp, Mus musculus; identical to SEQ ID NO: 57470

SEQ ID NO: 98372 - DNA, 86 bp, Mus musculus
tatttgtatgtatatatatgtcttctttcatatgtcatatttcatatatatatgtatatgaaagaagtatagtataatattgtggc

SEQ ID NO: 98373 - DNA, 85 bp, Mus musculus; identical to SEQ ID NO: 91469

SEQ ID NO: 98374 - DNA, 109 bp, Mus musculus
caagtccttaggtgacaggaatatttcaccattatagtcatcttggaccacggttgtatgtgtgagttgacattgaccacaacagtgatgtgtagttcctgagtacttg

SEQ ID NO: 98375 - DNA, 106 bp, Mus musculus
ctcccttattcgtctctgcttggaatcctgtggaggtgtgctggttgacttgtgatattgaggtggcacagtagaagatatagctgatgtaggacaactgatggag

SEQ ID NO: 98376 - DNA, 94 bp, Mus musculus
tgctgtgacaatacaccatgaccaaaagcaatgtatggaagaaagaattcatttttgtcttacagtttcagagggtcaagggcccatcatggta

SEQ ID NO: 98377 - DNA, 85 bp, Mus musculus; identical to SEQ ID NO: 57470

SEQ ID NO: 98378 - DNA, 162 bp, Mus musculus
tacatgacccagactgtatatgtatgtgtatgtgatatatttatatgtgacatatttttatgtgtatatgtatatatgtgacatatgtgtatgtatatatgatatatttgtgtatatatgtgacatatattaatatattcagacatatatattagggaggca

SEQ ID NO: 98379 - DNA, 71 bp, Mus musculus
tagaatagtgacttagttgatcttgggcaagcaactagagctgacctgagttcatgagtacagttgttctg

SEQ ID NO: 98380 - DNA, 100 bp, Mus musculus
tccatctctacactctcattcccctctgaggtctcccacctctatttttaattttttttaacactgggtgctgcctttgggaatgttgactgaccttggg

SEQ ID NO: 98381 - DNA, 111 bp, Mus musculus
cgtctcctcacctaaagctctgacccaagaatctaaaatttgtctgatgacagtgaccatacctgatcagcagccaaacttctttggagtcatgtctttcctacagaggcg

SEQ ID NO: 98382 - DNA, 106 bp, Mus musculus
gtccaatacctgcagggcagtgcagagccactgggtagaagattcaggtgagactgacttacacacttagtcactctgtgaagactataggctttattgaagagac

SEQ ID NO: 98383 - DNA, 101 bp, Mus musculus
aaatcttatgtaagataggagaggctacttgtattttaatttctatcggtgagatcagagagagatgaaaaatgccaatcaaaaattatctcataaggttt

SEQ ID NO: 98384 - DNA, 111 bp, Mus musculus
gttagataataagagatgaaagtgagatgataatgacttcctctatattatagtatttttaaactatttacagcatatgaggaagtggcagcatcactgggttaaaatgac

SEQ ID NO: 98385 - DNA, 83 bp, Mus musculus
ggggtctgcaagaagagattgctacttgaccagagacaacaatcctatgattctctctagagagtggtcttttgacagaattc

SEQ ID NO: 98386 - DNA, 116 bp, Mus musculus
gaatggaaggagtgtatacccttgtcttgctactgatagtaacagaaatgttgtgattttcttctcatttacaacaataatgtccatcagtttgttgtttatagcctttttcattt

SEQ ID NO: 98387 - DNA, 85 bp, Mus musculus; identical to SEQ ID NO: 65376

SEQ ID NO: 98388 - DNA, 117 bp, Mus musculus
gagtttaaatgtagttaggaattacgttgtctggcaaagtagtggtagtagattcttttcaaagatctaactagctccataaaattggcccagtttctagtatatttttcttcctat

SEQ ID NO: 98389 - DNA, 79 bp, Mus musculus
actgtgctttgaggatgttaacatctgttttgactattttaatatatacaatattagataacatcttcatagcatatgt

SEQ ID NO: 98390 - DNA, 98 bp, Mus musculus
ttcatacatccaaatgtatatgtctgtttgtttatatgtacatatgtatgtatatgtgtattatgtaagtatgcatgaatacttgaaaagtgtatgag

SEQ ID NO: 98391 - DNA, 110 bp, Mus musculus
ggaaggctatttgtcagctatacttttatgttaaagaggtgtgaataagatgaaagtcaatgtatttatcaattttacatctactacagcaatatgtctacagggcttct

SEQ ID NO: 98392 - DNA, 117 bp, Mus musculus
gcgtgatgtgagtcattcctgttttctgagatgatgctgagtggatcatgatgaatctttttatattattctgaatccagcttgcaaatattttattgagaaattttgcattaatgt

SEQ ID NO: 98393 - DNA, 109 bp, Mus musculus
ggtgtctcctaatgttgtcatatattttttgcaattgccaacagcactgttaatatttcaaatagctagtttagcaatacagaaatttatgctgacattaaaagccatc

SEQ ID NO: 98394 - DNA, 109 bp, Mus musculus
gtctagatatgagctcagtggagttaaatagtttgcaagtattttattgaatatatgtacaaatgcttagctttaactccctaaactgagtagatttataattttagat

SEQ ID NO: 98395 - DNA, 85 bp, Mus musculus; identical to SEQ ID NO: 57439

SEQ ID NO: 98396 - DNA, 105 bp, Mus musculus
tttgttttggttttggtgtgtgtgtgtgtggggggggaatagaggttgtcacagaatctctccttcactctgaatctacagtcatctataccactgcaaaataaa

SEQ ID NO: 98397 - DNA, 96 bp, Mus musculus
gctgtaaaacaattcaactttgcacattctgcctcaggagataaggtggacacacacacatacacacatgagagagagggggtggggaagaccagc

SEQ ID NO: 98398 - DNA, 69 bp, Mus musculus
gtttcttcctaagtccctgaataatgtctgggtctaggactctgtacttgttctactgcaggaggaagc

SEQ ID NO: 98399 - DNA, 114 bp, Mus musculus
tgtatctggagtattctgagtttctgggctaatatccacttatcagtaagtgcatatcatatgtattcttttgtgattgggttacctcactcaggatgacatacttcatattca

SEQ ID NO: 98400 - DNA, 77 bp, Mus musculus
gaagaagagagaagactgttagctcaacgtccaggaagttttcatgggcatgttcaatagcaatgtgtctctctgtc

SEQ ID NO: 98401 - DNA, 109 bp, Mus musculus
aagattaagctatgttgttaatgtagtaattcctaagagatatatttggtttagtagctgtaagtcatctgagttaatacttttccaatagcagcatccctgagatgtt

SEQ ID NO: 98402 - DNA, 119 bp, Mus musculus
cttatctttggatcatgacttgcagtgccacaggggtgtgattatctcaggaaactcacactctctgtcatgcctaattgcttaattattatagccgtgagttcagagcaccatataag

SEQ ID NO: 98403 - DNA, 89 bp, Mus musculus
gggcaccgtgatgctctcaacggtgatgactttatctgtgtggttaggaagccttagtcatatcagaatgtatactgggagaacagccc

SEQ ID NO: 98404 - DNA, 115 bp, Mus musculus
ttttaacaacagagtctcaggagggtatttagctgctgccctcctagtcacacagtgactcagtgggggttcttccactaacctatctcccagagaaaccactttcttgtcaaaa

SEQ ID NO: 98405 - DNA, 70 bp, Mus musculus
gcatgtatgtatgtgtgcatgtgtttgtgtgtgtacatatgtatatgcatatgtatatgtatctatatgc

SEQ ID NO: 98406 - DNA, 85 bp, Mus musculus; identical to SEQ ID NO: 57439

SEQ ID NO: 98407 - DNA, 83 bp, Mus musculus
gcataccccattgactgctgggatctttctttgtactgaactgattttgttgttgtactgaaaggcctaacggttattcatgc

SEQ ID NO: 98408 - DNA, 74 bp, Mus musculus
ggttaagagcactgactgctcttccagaggacctgagttcgattgggtgagcaaccacatagtggctcataacc

SEQ ID NO: 98409 - DNA, 72 bp, Mus musculus
tctcaccctatgccctgtcacacactcagattctggcaaaagaccaagtgtgtatgctggcacaatttgaga

SEQ ID NO: 98410 - DNA, 107 bp, Mus musculus
tcatttcagcatcgctctctacagctgtggtttctctagttcttcagtgtcactctgtcattgaaggctgggcacagatgcatcctggagggttgaagaggagaagg

SEQ ID NO: 98411 - DNA, 72 bp, Mus musculus
catctctgtctctctttctatgcttgtgtctatgtgtgcatacatgcacgcgtgcatgaatgtgaaggggtg

SEQ ID NO: 98412 - DNA, 111 bp, Mus musculus
ttgaggattgcagagggtggacctaaagtttatctctcaatctgtctcagaaaaggaaggaggaatttaggtgagggtgtgattaggagttctgccagctgctgtcttgaa

SEQ ID NO: 98413 - DNA, 79 bp, Mus musculus
atgttcctcactgaaggcagtctggacaggaactcaaacaaggcaggaacctggagttaggagctgatagtaagggcat

SEQ ID NO: 98414 - DNA, 119 bp, Mus musculus
gtgtattgttcagaatcccacggtttatactgagagtggtattgtaatttatcattttaagtatgaataaatcaacttcccactttacagataataagcccttttgtgtatgcatgtgc

SEQ ID NO: 98415 - DNA, 77 bp, Mus musculus
cagggctggggtgagactgatgagactgggggtaaagatccacagttggcctatctgacttgctggcctgagttttg

SEQ ID NO: 98416 - DNA, 74 bp, Mus musculus
tagttttccaggcatcttccatatggctatatcattggacatatttgttctgaagctgccagcttgttgaacta

SEQ ID NO: 98417 - DNA, 116 bp, Mus musculus
gttgcatgtggttctcttgtcagagttctggatccttgggaatgtgatgaaggccctagatacatatatatttttttcctatagagctgtcacaagtgcttggcacatatgaaaac

SEQ ID NO: 98418 - DNA, 68 bp, Mus musculus
cagctctgaggactgtcagctatccttctcagaaaggggtggactgatgtctctctctgaaaggagtt

SEQ ID NO: 98419 - DNA, 92 bp, Mus musculus
tatgcatgagtgtttatgtgtgcatgtgcatgtgaacgtgtgtgtgtttgtgtgtgtttgtgtgtgtgtgtgtgtgtgtgtgtgtgtgtgtg

SEQ ID NO: 98420 - DNA, 94 bp, Mus musculus
acatatatacatatgcacatatatatacacacatatacatgtatatacatatatatgaatgcatatttctatgtagctttgtatgtatttatgt

SEQ ID NO: 98421 - DNA, 72 bp, Mus musculus
aaggggggggggggactaggtgaaggaagtgcctctctgtgtgtctctgtgtatttgtctctgtctctcttt

SEQ ID NO: 98422 - DNA, 107 bp, Mus musculus
atgcccaagattgatttagacatatacacatgtatgtatgaatgaatgtgtgtgaatatacgtatatatgtacatatatgtatatatgtgtaatgttacttgtgtgt

SEQ ID NO: 98423 - DNA, 65 bp, Mus musculus
ggtcaggtttgttgattgatggagccaattatgtacactagtctggttattgattgacacctgcc

SEQ ID NO: 98424 - DNA, 83 bp, Mus musculus
gtttgtcacagcactttgaggtagcatgttctgtaaagttacacaagtcacagagctgtcctagaatgtctcctggacacaac

SEQ ID NO: 98425 - DNA, 111 bp, Mus musculus
ttactcagttatttatcaaacagcagcctcagtgattccatgactgtatatttttatgtctagtaaacacgtaaaggcagctgtgaataaagtctgctgtcaactgggtga

SEQ ID NO: 98426 - DNA, 81 bp, Mus musculus
atgtcagtctctctgaaactctgtctgtccttccattagagggaggttttctactttgcagctcttttaaagggacaacat

SEQ ID NO: 98427 - DNA, 66 bp, Mus musculus
tatatgtatgtgcatatgtgtgtgtgtgtgtgtatatatatatatacatatatttatatatatata

SEQ ID NO: 98428 - DNA, 114 bp, Mus musculus
tggtttatttatttgtgcattttatgtatataggtactctgtctgcatgtccatctgcacaacagaggagagcatcagatccccttgactaaagttgtagagagttgtgaggca

SEQ ID NO: 98429 - DNA, 86 bp, Mus musculus
caggaactgaggacactgtctgcagtcaggtcacacatccaaattagctggtcctccctgcacaaatcacagtcccactcattctg

SEQ ID NO: 98430 - DNA, 104 bp, Mus musculus
ataaactatatatgtatgtatatatgttcactatatatattgtatatatatatatatatatatatatatatatatatatatatatattcactttataagcagca

SEQ ID NO: 98431 - DNA, 88 bp, Mus musculus
ctttgtgtctaagcatttgtgtttgtcttaattacatgtatgtatgtatgtatatatgtattgtgtgtgaagagcttggcttatgaag

SEQ ID NO: 98432 - DNA, 95 bp, Mus musculus
tatatatatatatgtatgtatatatgcatgtgcatatgcatatatatgtatgtgtgtgtatatatatacatatacacacacacatatatgacatg

SEQ ID NO: 98433 - DNA, 83 bp, Mus musculus
atgtcatatatgtgtgtgtgtatatgtatatatatacacacacatacatatatatgcatatgcacatgcatatatacatacat

SEQ ID NO: 98434 - DNA, 91 bp, Mus musculus
ttgcacctatattagtttcatccaacaacttccacttttccaggtcaagttagaagagattagtgtgtttgatgatgcctggtgtttgcaa

SEQ ID NO: 98435 - DNA, 64 bp, Mus musculus
caggatcttggatgaatagaaatgagtatggatgtagaataccaatattcatctacacttcctg

SEQ ID NO: 98436 - DNA, 82 bp, Mus musculus
gtgcttgaggcacaagaagtactcaactaatattcctgtacatgaatatttgttttttgagactcatgtaggcctcagccat

SEQ ID NO: 98437 - DNA, 120 bp, Mus musculus
ttttaacctttatatttatattactgtatttatttatgtgcatagtgtgtatgtatgtatgtatgtatgcatatatgtatatcatgtatgtgcctaatacaagtagagggcagaataggt

SEQ ID NO: 98438 - DNA, 94 bp, Mus musculus
cagcactgatccgctatggaaagcaaagaagattcgaggtcaatagccagagctggatgcttctcattgcatgcccagtctatccatcagtctg

SEQ ID NO: 98439 - DNA, 105 bp, Mus musculus
caaatgctacactacaaatgtgtccacctccctgcattatgggtggcgtccaacttggatgttttgttttgaggctgtcaagacaccagtgagcctgtagccgtg

SEQ ID NO: 98440 - DNA, 62 bp, Mus musculus
tatatatatacacacacatatatatgtatatatacatgtatatacatgtgtgtatatatatg

SEQ ID NO: 98441 - DNA, 108 bp, Mus musculus
tgcattcacactagcaaggcaatggttcatgtcagtctgtctatctgtctcccccctgggtcttttgctcagtctgatgaattctgcgctgagctgggatttactgta

SEQ ID NO: 98442 - DNA, 85 bp, Mus musculus; identical to SEQ ID NO: 57439

SEQ ID NO: 98443 - DNA, 139 bp, Mus musculus
gtgaaggatatatatatatatatatatatatatacatacatacatacatatatgtgtgtgtatatgtgcgtatgtgtatatatgtacatatatatacatacatacatatgtgtgtgtgtgtgtgtgtgtatatatatat

SEQ ID NO: 98444 - DNA, 109 bp, Mus musculus
gctacagtccttcttcatgtgactcgtggacttccctttgtcatcctatgcctgagaatatatgaaggaggctgggaaggcaaagggacgttcaattgtcatcactggc

SEQ ID NO: 98445 - DNA, 86 bp, Mus musculus
gggcatttttcaggttgcttgagtttcagagcctgtctttctgtcagactgactcaatctcctgagaattcccagatgtgacaggc

SEQ ID NO: 98446 - DNA, 102 bp, Mus musculus
actctcacatgtcaaaatgcaacaggtgtttggactatctatctatctatctatcatctatctatctatctatctaaactctgattttgtattttggagagt

SEQ ID NO: 98447 - DNA, 66 bp, Mus musculus
gagagagagagagagagagagagagagagagagatgctctttctatacttttcagtttcctttctt

SEQ ID NO: 98448 - DNA, 72 bp, Mus musculus
ggccccaaatcattttttttcttaaagactctgtgttcagtgatctaaataggaatccaaagatttgtggtc

SEQ ID NO: 98449 - DNA, 117 bp, Mus musculus
cccagaatgtcaccggtccatctgcaacttaccagcctgtctgaccctctcttctgtctgtgtgatttccaggccactacatgtatgtggactctgtgtatgtcaagcacttccagg

SEQ ID NO: 98450 - DNA, 100 bp, Mus musculus
agcaagggacaatatggcaccagagacaagactcagtgctaacagaataactttccagcatgagatgtggctctgtggagccagagttgtgaacgttgct

SEQ ID NO: 98451 - DNA, 102 bp, Mus musculus
catagattagctaataagtctgtagtgagataatagagagctcttcggatatattcccaagaggtgcatagctggatcttatggtagattttcagctctttg

SEQ ID NO: 98452 - DNA, 115 bp, Mus musculus
tgtatgaatcttgaatagggcccagatatcaaatttcccattgacagtagagaaagatcactaacatcacctgtgatgggcacaccattatttaatacccttaggatctgtcaca

SEQ ID NO: 98453 - DNA, 108 bp, Mus musculus
tggcattttaaggtggagtttttaagttggcattttagttgagtctttatttgtttatttgtcaaatattgaaagtgcttgctacattgaagtctgtgccagatgtta

SEQ ID NO: 98454 - DNA, 140 bp, Mus musculus
atacacacagatatgcatatatgtatatgctatatatatatatatatgaatatatactgtgtgtgtatatatatgtacatatatatactgtatacatatactggatatgtatatactgtatatctgtgtatatatgtata

SEQ ID NO: 98455 - DNA, 69 bp, Mus musculus
agagtgagaggagactgggagttgtccaaccgggtcctgggaactgatctctgattttctccacactct

SEQ ID NO: 98456 - DNA, 89 bp, Mus musculus
ggttcctgggcagtctaccctgtgagtgaccagcggtgagagcagaggtttgtgatacacagtgactcacagagaaagcaggtttgacc

SEQ ID NO: 98457 - DNA, 63 bp, Mus musculus
tgtctgtctctctctctcatccttgagtggtaccaagctcaagaagggtgagggagccattca

SEQ ID NO: 98458 - DNA, 82 bp, Mus musculus
atcccagtgctcaataggcagatagtctgtgagttcaaggccaacctggtctacatagtaacactctgtctcactctgggat

SEQ ID NO: 98459 - DNA, 76 bp, Mus musculus
ctgcaatttaaactctggactggctcagcaaacagtttcaaaagctggggctgtgtgtctgtctgtgagcaagcgg

SEQ ID NO: 98460 - DNA, 71 bp, Mus musculus
ctctccaccgcttgctcacagacagacacacagccccagcttttgaaactgtttgctgagccagtccagag

SEQ ID NO: 98461 - DNA, 120 bp, Mus musculus
gaacttcaactttaaatcaacaggaagaagagaaagtattccttgaggttcttccttgattactaaattagtacagaccctaaggcttgcttttccttttcctttttaaatgatttttag

SEQ ID NO: 98462 - DNA, 70 bp, Mus musculus
gagaatgggggctgaagggatggctcagcgtttaagaggactgactgctcttccagaggtccctgagttc

SEQ ID NO: 98463 - DNA, 86 bp, Mus musculus
aggtaaccatgttgtaagtatatacacacatagatacatatgtatataaatatattctctgtatgtgtgtgtggtacagaatatct

SEQ ID NO: 98464 - DNA, 119 bp, Mus musculus
tacataatatatcaaaatgttttatacacacatatatgcatatatacatatatatacataatgcatatgtgtatatctatgtatatatgtgtgtgtaaaacatgttgatatattatgtg

SEQ ID NO: 98465 - DNA, 108 bp, Mus musculus
gtgtgcaaagtcaggtatcttgctggagagatggctcagcggttaagagcactgactgctcttccagaggtcctgagttcaattcccagcaaccacatggtggctcac

SEQ ID NO: 98466 - DNA, 89 bp, Mus musculus
agataactgtctactccctgggtctacacaatgtctactctgtgtgtgtctgtgtggtccaaactccctgtgtctagaacagtagttct

SEQ ID NO: 98467 - DNA, 71 bp, Mus musculus
gcaggtgctcagatgaactgagttgaaaaacaaggtgtgtgatctctctctgtgtgtgtctgagtgtgtgt

SEQ ID NO: 98468 - DNA, 118 bp, Mus musculus
gctatctgatgtttttattcacctgacattttcttgccaatcagcatatatgaaaaaaaatatatatgtttataacatggactaaagagatggctcagtggttaagagcatacactgc

SEQ ID NO: 98469 - DNA, 104 bp, Mus musculus
gcctagtgtgcagagcaagttccaggacagctggctgctcttgcagaggacctgcattcagttgccagcacccatatggcagctcgtgctcaggggcaccaggc

SEQ ID NO: 98470 - DNA, 109 bp, Mus musculus
atcgataatgtgggtagcaagagcataaaccacaggacccaatgtgtagtgaatatgttgtagcagccaactaaacttgcaagtccctacttgctgcagcaaaggcggt

SEQ ID NO: 98471 - DNA, 94 bp, Mus musculus
cacggaccaggagtcagtcagtcagtcagtaacttgggatggtgataattttggaagtctcaactctgactatagcgtttctccattttctgtg

SEQ ID NO: 98472 - DNA, 100 bp, Mus musculus
ggggggtgggttttgaggtgtaggatgctcaagtcagggtcactgtctcactctcttcctgttgcttgggatccagatatagaactctcagctacctctc

SEQ ID NO: 98473 - DNA, 106 bp, Mus musculus
gagatgtatctggagtagctactcaaccagtgtttgccgaatgaatgaatgaatgaatgaatgagcaaataagtgactataaattgggctactacgcatacatttt

SEQ ID NO: 98474 - DNA, 85 bp, Mus musculus; identical to SEQ ID NO: 57439

SEQ ID NO: 98475 - DNA, 130 bp, Mus musculus
atatgtatatatgtgtatatatatgtgtgtgtatgtatatatgtgtgtgtatatatacatacatatatatgtatatatgtgtgtgtgtgtatatatatatatatatatatatatatatatatatatatat

SEQ ID NO: 98476 - DNA, 69 bp, Mus musculus
tctgtctgtctgtctttctgtctgtgtgcacgcatgcatgtgcacaaaggtcagaggacagcgttcagg

SEQ ID NO: 98477 - DNA, 93 bp, Mus musculus
gtacaggcttgcgctcgtgcacacacacactctcacaggttcagttcagatggctcttaaatatgttgtgtgcagctgtgtgcatctccttgc

SEQ ID NO: 98478 - DNA, 77 bp, Mus musculus
aaaagacaagttgaagaaggaccatgcagagcttggtaaaagcctgttgggttgtttctttctttcttttttttttc

SEQ ID NO: 98479 - DNA, 56 bp, Mus musculus
agagacagcaagagatgcctgatagcctgtggctcaggcgctctctctctctctct

SEQ ID NO: 98480 - DNA, 68 bp, Mus musculus
ccttcgttttctccagtgatgaaagtgaggagtcctgaaattcccattgtccttcgggaaagctgggg

SEQ ID NO: 98481 - DNA, 134 bp, Mus musculus
ttgggattttgattggttggttggttgatttttgtttggggtttttttttgaaacggggtctcactctgtatctctggatggcctacatctctgcatatagaccaggtttgcctaaaattcacagacatccacc

SEQ ID NO: 98482 - DNA, 96 bp, Mus musculus
gatcagtcttagtccaaggtggtctgataggatgcatgggacaatttcaatatttttgtatctgttgaggcctgttttgtgaccaattatatggtc

SEQ ID NO: 98483 - DNA, 116 bp, Mus musculus
ttaaattggctcaggccgctaagcaggactttggaccatctttgtctttcactctctgaaatgggagaatgtcacatgggatcagatttcctgtgaaagcgctttgtgcttggtaa

SEQ ID NO: 98484 - DNA, 113 bp, Mus musculus
cctcatctagcctcaatagaagaggaagtgcctagtctaactgcaacttgatatgtcatgactggttgattgctgtgggagccctgcccttttctgaagagaaatggaagagg

SEQ ID NO: 98485 - DNA, 85 bp, Mus musculus; identical to SEQ ID NO: 57470

SEQ ID NO: 98486 - DNA, 95 bp, Mus musculus
tctgtgactgtcatctttgtgagtataatcttatttagagagggtgtctttatatatataattaagctaataacatcgagatgagctcttactga

SEQ ID NO: 98487 - DNA, 91 bp, Mus musculus
tatgactattttgttcccactctgtagagtgtctcctcactctgattcctttgctatatagacgacattctttcagcttggtgaagtcata

SEQ ID NO: 98488 - DNA, 62 bp, Mus musculus
ttacatatatatgtatatgtatgtatgtgtgaatatatgtatatattcacaaatgtatgtaa

SEQ ID NO: 98489 - DNA, 105 bp, Mus musculus
ttgatgataggtgaaatcaggttatatttaagtggttaaggaccacgcttcattggcaaagtgggacaaagcaaatcttaaagattgatgggcagctgtgatgag

SEQ ID NO: 98490 - DNA, 66 bp, Mus musculus
tgtatttagattatatatatatatacacacacactgtgtgtgtgtctgtctgtctgtctgtctata

SEQ ID NO: 98491 - DNA, 117 bp, Mus musculus
tggtgcatctttgggggaagccatggcaggatcagaagcagagaccacagaagaacactgcttactgactggctgtctgtctctagaactttcttatttgctctcttccacaaacca

SEQ ID NO: 98492 - DNA, 108 bp, Mus musculus
gtgtgtgtgtgtgtgtgtctgtgtgtgtgtgtgcgtgcaaatgtatgtatgtatgtatgtatgtatgtatgtatgcatgtatatgtatggtggacaaactaggaggca

SEQ ID NO: 98493 - DNA, 103 bp, Mus musculus
cacatttctaaatgctagagggagacattttgaatttttttactataacaaagtgaggaatgtttgaggacatgactctgtttatatcaatttaaatattgtg

SEQ ID NO: 98494 - DNA, 85 bp, Mus musculus
gtccatggtggtctaataggatgcatgggacaatttcaatatttttgtttctgttgaggcctgttttgtgaccaattatatggtc

SEQ ID NO: 98495 - DNA, 93 bp, Mus musculus
tttttcctagagactcattatctgtagacattcgttcttgatttttctcctccaagaaccacagggaatgccagaagcggctcacaggaagaa

SEQ ID NO: 98496 - DNA, 111 bp, Mus musculus
gtcacatagaaaccacacaatggaggcacatagaaacctcacactctctcagagcttctcgtggcttatagactggtgaaaatggttcttcattatggaagtcagtttggc

SEQ ID NO: 98497 - DNA, 90 bp, Mus musculus
ctgccagctcgagtgacagtggcagagggttgttttctgttagagtgtctttaattccccagacttcctctgcacctgctgcggtggcag

SEQ ID NO: 98498 - DNA, 141 bp, Mus musculus
tatatatatatatatatatatatgtatatatgtatatgtatatatacacatatacatatacatatatatgtatatatgcatatgcacacatatatacatatatgcatattcatatgcatatatatatacatatatgtgtgt

SEQ ID NO: 98499 - DNA, 76 bp, Mus musculus
atatatacatatatatgtatatgtatatgtgtatatatacatatacatatatacatatatatatatatatatatat

SEQ ID NO: 98500 - DNA, 118 bp, Mus musculus
cctcttccctgcctatgcctgtgactagatggcttcctctaatagtgactgacgtgagtcactctctgagtgtcatgtcctcagtcgaggagagagctctggaagagggacttaggca

SEQ ID NO: 98501 - DNA, 98 bp, Mus musculus
atatatatgttatatatacatatatatatgtgtgtgtgtgtatgtatatatatatacatatatatatatatatatgtatatatatatgtatatatata

SEQ ID NO: 98502 - DNA, 78 bp, Mus musculus
agtctatccatcagtctgtctattacagtctatctgcctgccttcctacctgtcagtagaaagacagatgcatagtct

SEQ ID NO: 98503 - DNA, 64 bp, Mus musculus
ttgtgggggcgggcgggggggattgatggagacatcccttgtatctctctctctctctctgcga

SEQ ID NO: 98504 - DNA, 69 bp, Mus musculus
ggaggctgtgtcacagacagtcactttagagaaacaaaaattttctgggcagtggtggcacatgccttt

SEQ ID NO: 98505 - DNA, 71 bp, Mus musculus
atactgccaggatggagcatgagctggctgccttatagtgagtgagtgagtgagtgagtccgagtgtgtgt

SEQ ID NO: 98506 - DNA, 108 bp, Mus musculus
tccacagactgtctcaacttgccagctccaaataatgcacagaaactttttattatttatgaaagcttaggccttgtagctcaggcatgttcccaactagcctgtaga

SEQ ID NO: 98507 - DNA, 114 bp, Mus musculus
tatgtataaggtatgtgtgtgtatgtgtgcagtatatctgcttatattatgtgagtgtcgtgagtgtggtgtgtgcatatagtatgtgtgtggtgtgtttgtatggtgtatgtg

SEQ ID NO: 98508 - DNA, 81 bp, Mus musculus
agaaatgtattcaggggctagagagatggttcagtggttgagagcactgactgctcttccagaggttctgagttcaattct

SEQ ID NO: 98509 - DNA, 86 bp, Mus musculus
agtgtatgagtgctttgtctgtgtatgtctgtgtcccatgtatatgcctggtgcacagggaagccaaataggaggccagatgccct

SEQ ID NO: 98510 - DNA, 82 bp, Mus musculus
gtatatgtgtctgtatgtatgtatgtgtgcatgtgtgtctttgtatgtatgtatgcatgtgtgtctgcgtgcatgtatgtgc

SEQ ID NO: 98511 - DNA, 116 bp, Mus musculus
tttgatctggactgtgtgggcctagattgcatctccaattccaaggatcatgtcacagtgagcactcttggtcaggggagaagatgtgccttttaaaacccctcattactagcaaa

SEQ ID NO: 98512 - DNA, 113 bp, Mus musculus
gctgctgtatgtatatatatgtgtatatatgtatgtgtgtgtatatatatatgtgtgtgtatgtatgtatgtgtgtgtatatacatacatacatacatatatatatatggaac

SEQ ID NO: 98513 - DNA, 75 bp, Mus musculus
ttaccgcatgctgtggtagactaaggacaacttgagaaagtaggttcttttcttctaccgtgtaggtcctggtga

SEQ ID NO: 98514 - DNA, 86 bp, Mus musculus
ggagctgaacctgtgtcctttgcaagagctacaaatggtcttaacgctgagctctctctcccaccctgtgactctttttcagttcc

SEQ ID NO: 98515 - DNA, 118 bp, Mus musculus
ggagattaagggagcagaggaggacattcaagggaggcaagggcctgtgacagacagagacacatggtctctgagttacagcaagtggtttagatgtggtctaatatgattaattttt

SEQ ID NO: 98516 - DNA, 90 bp, Mus musculus
atcttctgactgtgtgtgtgtaacattgacactgtttttctttataaatgattgatagcgttcaatgttgaactcatttggtcatggggt

SEQ ID NO: 98517 - DNA, 70 bp, Mus musculus
gtctgtctgtctgtctgcatatgattgtgtgccacatatgttcaaggtcttgagggggtcagaagaggac

SEQ ID NO: 98518 - DNA, 81 bp, Mus musculus
ctgcacggggctactgcactgactgagtcactggataaggaagcttgttagtgatgttttagagtgctacagaaatgtcag

SEQ ID NO: 98519 - DNA, 146 bp, Mus musculus
gctatgtatgagggcctctttggaatgagagcgagggttcatcacagcatcatggaaatgtctgcagtctctctctctctcaggctcttagttcagagtccaggaccctgtgttggctgcagtcaggtggtttctgttgtctttgt

SEQ ID NO: 98520 - DNA, 93 bp, Mus musculus
ggtccatatgaaaggtgagcttaatcttgtctctctgtctcactcccaggaggagaaatttagagtcaggaggagttcgagaaacaggaggcc

SEQ ID NO: 98521 - DNA, 74 bp, Mus musculus
aggtcaggtgatccttctgggaagtgtcctcacaggtcttcctgagagcatgtctcttagttgattcctcacct

SEQ ID NO: 98522 - DNA, 64 bp, Mus musculus
gggaccccatgagcatgctctacttccacaagtgtgagtggtggacaactgtttgtgttgttcc

SEQ ID NO: 98523 - DNA, 68 bp, Mus musculus
cttaggatactcctcgctaggctgggtctggagagagacagctcagtgagtgaaatgtttgccttaag

SEQ ID NO: 98524 - DNA, 108 bp, Mus musculus
gagggcaaactatcaaggaaaagactggagagatggctcagcgggtaagagcactgactgctcttccagaggtcctgagttcaattcccagcaaccacatggtgactc

SEQ ID NO: 98525 - DNA, 77 bp, Mus musculus
gctgggtgggagctggagagatggctcagtggttaagggcactgactgctcttccagaggtcctgagttcagttccc

SEQ ID NO: 98526 - DNA, 85 bp, Mus musculus
agagtgagtgtgtctgacactcgcacttaatggcatccaacaggtttgggcacatttgctgtgaatggaggacttcattcactgt

SEQ ID NO: 98527 - DNA, 103 bp, Mus musculus
ataccaagcatccgattttgttttgtgtttggggtgtatgtgcatgcgcgagtgtgcgtgtgtgtgcgtgcacatgcagcaaaggaaagatgatgttgggtgt

SEQ ID NO: 98528 - DNA, 74 bp, Mus musculus
tgatcagacagacagacagacagacaggggtcaggattctcctgagttctagctgtgctgtgttttttttttta

SEQ ID NO: 98529 - DNA, 84 bp, Mus musculus
caggctgttctttgcgaaggggttttatgatcttgttctgaatttgatgatctgtccctagagcttctttctaaatcaggcttg

SEQ ID NO: 98530 - DNA, 113 bp, Mus musculus
cctggtttttatcctatggggaaaatgcatttacagcacatatataatatgtatgtatgtatgtatgtatgtatgtatgtatgtatgtatgtatatccctcttaatacttgga

SEQ ID NO: 98531 - DNA, 116 bp, Mus musculus
gtagatctgagactgaactgccctttttcggttatcatggtaccgatgctgtagctctgaaaggtacagtactgtgatagctgaagaatggcggtgccatcacgttgaggggaggc

SEQ ID NO: 98532 - DNA, 56 bp, Mus musculus
catgtatgtatgtatgtatgtatgtatgtatgcatgcatgcatttgtgtgtacatg

SEQ ID NO: 98533 - DNA, 213 bp, Mus musculus
gtatgtatgtatgatgtgtatatgtgtgtgtatgtgtatatatatgcattatatatacctacatatatatacacatacatacacacacactatatatgtatgtgtgtgtatatatgtgtgtatatatatacatgcatatatatatacatacatatgtgtatatatatatatatatatatatatatatatatatatatatatatatattgttta

SEQ ID NO: 98534 - DNA, 73 bp, Mus musculus
gtgtgtgtgtatgtatgtgtatatatatgtaggtatatataatgcatatatatacacatacacacacatatac

SEQ ID NO: 98535 - DNA, 105 bp, Mus musculus
catatatatatatatatatgtatatgcatatatatgtatatatatgtatatgcatatatatgtatatatacatatatgcatatatacatatgtatgtatatatat

SEQ ID NO: 98536 - DNA, 62 bp, Mus musculus
tatgtgtgcatgtacatgtgtgtgtacatgtctgtgtgcatgtacatctatgttcatatgtg

SEQ ID NO: 98537 - DNA, 59 bp, Mus musculus
tctctgagcactctctgtctgacctcagacctctgtagatcagtaagtggtgcctgaga

SEQ ID NO: 98538 - DNA, 100 bp, Mus musculus
gagtcccttggagaattatatttgaccttgtatcagtcacggaaggagtctgtctgtctgtctgcatgctccctctcaggtatcttggatccagagattc

SEQ ID NO: 98539 - DNA, 92 bp, Mus musculus
ttggtcgcggcggcctcgaaggagttgtgtcaccagggaactgagaggctcctcacagaactgagtgacttggggtatcgagttttggctaa

SEQ ID NO: 98540 - DNA, 69 bp, Mus musculus
tacagggaggacgcaggggtgctagctagctgatacctatcccggtaacagtctctgtgtgtctctgtg

SEQ ID NO: 98541 - DNA, 85 bp, Mus musculus
gtggtgaccactcatctgtttctgtctctttaagcatttgaacattctgggcctttgatatgagtggaaatagacagcacactac

SEQ ID NO: 98542 - DNA, 76 bp, Mus musculus
gtctacatcagcatatgtttatctttcatatatatatatacatatgaaagatagacatatgcagaaagagagagac

SEQ ID NO: 98543 - DNA, 58 bp, Mus musculus
tctgcatatgtctatctttcatatgtatatatatatatgaaagataaacatatgctga

SEQ ID NO: 98544 - DNA, 107 bp, Mus musculus
tggaatcggcagtaaactctcttctgtggcttcttgtgaacatttttattacattatttatgtgtgtgtctttctttgtggtggcagtgtgtgtctgtgtgtgtcca

SEQ ID NO: 98545 - DNA, 73 bp, Mus musculus
tccctgacaagcatgtggaggtcaaaggaaaccctgtgggagtaggttctttccttccacgtgggttctggga

SEQ ID NO: 98546 - DNA, 65 bp, Mus musculus
gtcttgtttgagacagtctttttatggtttgctgttgtccagtcaggctgactggctcacaagat

SEQ ID NO: 98547 - DNA, 120 bp, Mus musculus
gaaactttaggtcctctgcaagagcagtaagtggggctggagagatggctcagtggttaagagcactgactgctcttccagaggtcctaagttcaattcccagcaaccacatggtggctc

SEQ ID NO: 98548 - DNA, 123 bp, Mus musculus
gatgctgaaacaaagtataagcccgtgtgtactatggtgggtggcacttcgcaaatgttctctctatctgtgtatgtcattcacctatatagttaagcagcgacttgggaagacattgtttta

SEQ ID NO: 98549 - DNA, 110 bp, Mus musculus
ctggcagtatgtagtgtaggtaagaattgaatgtgtgttgacagtgagcacaatgttctcattgcacgcaggggagtttctacctctaattgtttactctgtgagcacag

SEQ ID NO: 98550 - DNA, 89 bp, Mus musculus
gccagctggagaaggatgtcagccagctatgaagaggcgaggccccagcagagcatcagctgctggcatcatgtcctttctagcttagc

SEQ ID NO: 98551 - DNA, 72 bp, Mus musculus
tgggtaagcacatcagaaagttcgagtgtctgacccagagagaactgacagaaaactagtgtgctcctccca

SEQ ID NO: 98552 - DNA, 118 bp, Mus musculus
tttctaaaaattgagattcagtgattgcagcagccatggctaactcagaaagtaaatttattctgtattttagttgatgcgctcctgttatctgggaacgtggcatttttaacagaga

SEQ ID NO: 98553 - DNA, 106 bp, Mus musculus
gttgaggacatgaagaaggaatcgagactcactcagtgactgtaagtcagtgtctaattacagagatgtcacagtatgagtgagggattcatctgagaggtacaat

SEQ ID NO: 98554 - DNA, 118 bp, Mus musculus
tagagaggaaaggttaagaaaatgagctcacagcattaacactacaacagagaacaaagtctgtaatctcatttagtgttttgcttgttgatttagcttttgagttagagtctctcta

SEQ ID NO: 98555 - DNA, 85 bp, Mus musculus; identical to SEQ ID NO: 57470

SEQ ID NO: 98556 - DNA, 147 bp, Mus musculus
tctctctctctctctctctcttgcacatatactgacacacacacacactaagtcatttaaatattttttgtgtgtgtctcaaaaaaagcccacagtgaggggggggaaagaaaattctatctgcccgtctctctgtgtgtgtgtgac

SEQ ID NO: 98557 - DNA, 111 bp, Mus musculus
cagtgctgattttgaagtttactatttaaactccacagaaggaaaagggagagtatatatatatatatatatattccttttccatctgtagtatagtggtctatcaaactg

SEQ ID NO: 98558 - DNA, 111 bp, Mus musculus; identical to SEQ ID NO: 98557

SEQ ID NO: 98559 - DNA, 115 bp, Mus musculus
tctgtctgtctgtgtatgcatgtgtatatgtatgtatatatgtatatatttcagtgtaggaagttattggactctgctttttggttcatctactctgtgtgtgtgtgtgtgtgtg

SEQ ID NO: 98560 - DNA, 83 bp, Mus musculus
ggtctcagatcagtgttagaagagcaggactcggagatgtgagtcttcagattctgttcttttgaccctgtctattctaggct

SEQ ID NO: 98561 - DNA, 85 bp, Mus musculus
gggaggaaggatggctacagattgaaaaggaagggatttcgtgtagaaggtaatttttctttctctgcatgttgtttttcttgct

SEQ ID NO: 98562 - DNA, 76 bp, Mus musculus
gtatgttcctgtgttcttatcaagggtgattatttgtaactttttatacatttatcatcctgtggcagggaatgca

SEQ ID NO: 98563 - DNA, 70 bp, Mus musculus
tctgatcaagagcagtttccaggctgtagagattggctcagcgattaagagcactgactgctcttccaga

SEQ ID NO: 98564 - DNA, 62 bp, Mus musculus
tgtgtgtgtgtgtgtgtgtgtgcatgcgcatttgtgtttgcatgagcatgtgcatgtatgta

SEQ ID NO: 98565 - DNA, 83 bp, Mus musculus
tggcttgcattgtaacagtgtactcttgagtgtgagctatctggagcatagcttaaatgtacaccacagaattaatgtaacca

SEQ ID NO: 98566 - DNA, 120 bp, Mus musculus
gacttccttcataccaatgctccttttaagctgtattactaaatggtagtagctttttatttttaatgaagagcttatagtatcgtgatttcccttttaagattattgattgacatagtt

SEQ ID NO: 98567 - DNA, 91 bp, Mus musculus
gagtccagttttcagctttaacagggcattgttatttaaaccaaaattctcaagccatgttaccaagttgcttgtattgttactggagctt

SEQ ID NO: 98568 - DNA, 140 bp, Mus musculus
ttattatctctgctaatgagtttgaatatgtgtgcctttaatggctgcctcactaagtcagtctttcttgctgggagtgtgagatgtgtctgaggtcaagtgagtctgactgccttgattcatatcacaaacttgcttcc

SEQ ID NO: 98569 - DNA, 90 bp, Mus musculus
gcatatgctaagttatcacatccttcatttagaagactcaatggtgtgtctgtctatttgactgtccattgtggttggttttcatgttgc

SEQ ID NO: 98570 - DNA, 119 bp, Mus musculus
ctctgcctcccaagtgctgggattaaaggcatgcgccaccaccacccagctcagaaatatatattttttgaaccaggtatggtggcttatgtccgtgatcccacactcaagaggcaaag

SEQ ID NO: 98571 - DNA, 93 bp, Mus musculus
tgggaggatcaggagtgttctgtcttggctacatagtgagtttagggccagcctgagctatgtgagtctctgtctcagaacccactcctccca

SEQ ID NO: 98572 - DNA, 100 bp, Mus musculus
cccagaagacgaggactgtcaattacacaagagagctaatcatatggaaagtaaacattttcattatgaatgctgcatttagttgttagacctaaatggg

SEQ ID NO: 98573 - DNA, 74 bp, Mus musculus
tgtatacatatatgcacacatatatgcatgtgtgggtgtatatatgtatatatgtgtatgtgtatatgtatata

SEQ ID NO: 98574 - DNA, 80 bp, Mus musculus
ggtctctcactgtcactatatgaaatagcaggcccattttatttgaaagttgtctcttcttcacagaacattgggggact

SEQ ID NO: 98575 - DNA, 85 bp, Mus musculus; identical to SEQ ID NO: 57439

SEQ ID NO: 98576 - DNA, 68 bp, Mus musculus
tatgtctacatggatgtgcatacatatatatgtaggaatatgtgtatgtatataaatatgtatgtata

SEQ ID NO: 98577 - DNA, 113 bp, Mus musculus
aaaggcctgtaactgtcaaactgacaccatgtgtacagcagaatttatctatagaacttagatcaagtgtgacatccagtggcctgtttagttaatgacacttagatgctttt

SEQ ID NO: 98578 - DNA, 99 bp, Mus musculus
acatggaatattggtcgtctgagagatgagattgaggagaacaggttggaaacaatgaaattctgaaaacatcatttaggggattataacagcccaagt

SEQ ID NO: 98579 - DNA, 78 bp, Mus musculus
tcacagacagactcacacctattcagtctctcagactcccaggcaggaggcagggaaggaatggggagctgaatgtgg

SEQ ID NO: 98580 - DNA, 68 bp, Mus musculus
tttgactcacctactctgtgtctgggaatttggggtactgatgccaggaggcaaagagatggatcaga

SEQ ID NO: 98581 - DNA, 66 bp, Mus musculus
tatatatgtgtatgtatgtgtgtgtacatatatatatatatacacacacacacaagcatatgtata

SEQ ID NO: 98582 - DNA, 119 bp, Mus musculus
gctcagagggaacaccagtgatgtctcctcttcccagttacagagaagagtgacagctggccttgtcagcacacttgcagggtgcaaggcgttggtctgtgtcaccatcctgtgtgact

SEQ ID NO: 98583 - DNA, 91 bp, Mus musculus
tttgtgggtgtcggtctctgtgtctatgtgtgtttgtgtgtataggcatgtgtgtgcagatgtctatagaggcaagaagggcacattagat

SEQ ID NO: 98584 - DNA, 96 bp, Mus musculus
tgtgtatacatactatatacatatacacatacacatatagtatgtatatagtatgtatatagtatgtatatgtatatgtatatgtatgtatataca

SEQ ID NO: 98585 - DNA, 90 bp, Mus musculus
cagagatgggggctggagagatggctcagtggttaagagcactgactgctcttccaaaggtcctgagttcaattcccagcaaaccatatg

SEQ ID NO: 98586 - DNA, 96 bp, Mus musculus
tgaagttctcagtgccagtgtccgtgaacagaaaaatactcactccctttgtgtcagtctcagaccaggacgccctaggaggctgattatgcttta

SEQ ID NO: 98587 - DNA, 70 bp, Mus musculus
gtgaataaatagctctgatgtaagtgagcacaggcgccatacagtcgaagactcactttgctgtggtcac

SEQ ID NO: 98588 - DNA, 81 bp, Mus musculus
ctctggaaggatgctgtttctgtctcgctcagtttctgccctttcaagaggagctgaggagcaggagattaaaacccagtg

SEQ ID NO: 98589 - DNA, 109 bp, Mus musculus
cttgttagatgtatatactgttaacaaacaagctggaatcttgtcattgttcattttatttaatgtatcttaggggtaattcttttgtgtgttagctacattgtcaaag

SEQ ID NO: 98590 - DNA, 96 bp, Mus musculus
atatatatataaaatatataaaaaatacacacacacatgagagctagtgaaatggatgtgtgcgtctgtgtgtgcctgtgtataatatatatatat

SEQ ID NO: 98591 - DNA, 81 bp, Mus musculus
ggggcggggtgctcagcctcccagcaggaccagagctgagggctgtggtctcactgactgactgttctggaaacccgtttt

SEQ ID NO: 98592 - DNA, 72 bp, Mus musculus
cgggaagataagctgtgtctgtctgtctgtctaatggaatatgacagacagagaaagcagtgctgtcacctg

SEQ ID NO: 98593 - DNA, 114 bp, Mus musculus
gtctggcagggtgagaaaattaaaagcaagaattagaaaggaaattggactcagaagacagacaggcctgagcatgaattccagtttctttgtgtgcccacctgaatcagctgg

SEQ ID NO: 98594 - DNA, 114 bp, Mus musculus
catgaggaacatttctatgtattttgggaattagtagttaaaggaagcatataatatgtaatttttgctattaaattatctcaataaaattcttgcaatgataagttccatgtg

SEQ ID NO: 98595 - DNA, 81 bp, Mus musculus
gcagaactacaaaacaccctcagtcatgtggtggccatcatcgaagatctaggtgacagatgtgtttctgaagttctttgc

SEQ ID NO: 98596 - DNA, 77 bp, Mus musculus
gtatatacatatgcatagatgtgtgcatgtgtgtatttgtgactaaatattgtatgtttgtgtgcatgtgtatgtat

SEQ ID NO: 98597 - DNA, 99 bp, Mus musculus
gtataggtcttctctgaaggtctgagagaattctgcactaataccatctggttcttgattttttttaaaatgactgcttctatttttgaggggttatgc

SEQ ID NO: 98598 - DNA, 88 bp, Mus musculus
catgggtgaggtctgtgagaagactcagagagcaaaggcaattgtttccaggcctgttgccctaagtttcactcccaggaccaatatg

SEQ ID NO: 98599 - DNA, 75 bp, Mus musculus
agaacttctgctgtaggggccagagagaataacacagggcatgcccctatttctctctgtctctgggagagtttt

SEQ ID NO: 98600 - DNA, 103 bp, Mus musculus
tgctgttaatttggctaactgagccgaagggccaggagtctctatgataacttgttgattattaataagatatccagctcgccctttagaggagccatcagta

SEQ ID NO: 98601 - DNA, 64 bp, Mus musculus
ggactgactgtcactgtgtttgtgcgcaaagtggacctgtgcagaacagaagtacagaatgttc

SEQ ID NO: 98602 - DNA, 90 bp, Mus musculus
gagtttcatgtgttttgcaaattgtatctttggtattctaagtttctggacttatatccacttatcagtgagtgcatatcatgagtgctc

SEQ ID NO: 98603 - DNA, 122 bp, Mus musculus
agatgtatgtctatatataatagtatgtatgcatgtgtgtgtatgtgtgtatatatatctatatatctatatatacatgtatacatatatacacaaatatacatatatgtatatatgtatac

SEQ ID NO: 98604 - DNA, 105 bp, Mus musculus
aggtgtgtgaatctgggtcatgtgaactgagcagctgctgtttgtctcagtcttcttatgattcaagattgtgagcagacttgccagtgtccttgagagcatata

SEQ ID NO: 98605 - DNA, 101 bp, Mus musculus
gtgtctgggtgtatatatgtatgtgtttgtatgtccatgtgcatacatgtgtctctgtgtgtgtaagtgtgtgtgtgtctgtgtgtatgttgtcttgtctc

SEQ ID NO: 98606 - DNA, 76 bp, Mus musculus
gctgcacgtggaacaatggagccctcggtggatactgaccctcagtctcagaccttttcctttccaaacagtgagc

SEQ ID NO: 98607 - DNA, 72 bp, Mus musculus
acaaaggctaggaatttcagcatcaggatctgtgatttcagccatcccaggatgtggtcttctttcctctgt

SEQ ID NO: 98608 - DNA, 102 bp, Mus musculus
tgtgttttgcctgtatatgtatatctgtgtatctgtgactctcaattcctatttcctgctggagagaagcatcctgacaccaatgctagacagcaatatgca

SEQ ID NO: 98609 - DNA, 113 bp, Mus musculus
catttatgtatgtcctcagcctatcatggcgacctgataaatgaaagctgttaattttttcatattgtacagctctcatgcagtcagccagacttgctgcgagttcatgagtg

SEQ ID NO: 98610 - DNA, 70 bp, Mus musculus
catggtgtaaaagagagctgtcttgcagcttggacctccactaatgcagatacactcacagacacacatg

SEQ ID NO: 98611 - DNA, 100 bp, Mus musculus
cctctcagccatgggaccttatgatcttgcacagattttgtgcatgctgtcacagtctctgtgagttcatatgttcatcagtcttattgtgtctgaaagg

SEQ ID NO: 98612 - DNA, 67 bp, Mus musculus
ctccctcacttcagagacagtggcaaagttttgcagggtgacactctctcactgaagtgaataggag

SEQ ID NO: 98613 - DNA, 111 bp, Mus musculus
tatgtttctatgtatctatgtatctatgcatgcatgcatttgtctacctattgatgtatgtatcgatgtatctatgcatctatatatgtatctatgtatctatgtatgtat

SEQ ID NO: 98614 - DNA, 101 bp, Mus musculus
tgtatatgtatgtgtgtggaggacagtgatcagtgtcaggtgagatccttaaaaatttcttgcccttcatcactgtcatcattattgtgtgtatgtatata

SEQ ID NO: 98615 - DNA, 111 bp, Mus musculus
acagattttaatacgttgtatcttagtttttggatagttcagatgtgtgtgtgtgtgcatgcacgcgtgtgcgtctatgtgctgtgtaaactaggggttaatcgtggctgt

SEQ ID NO: 98616 - DNA, 102 bp, Mus musculus
tcgatatttttctctgtgctttcagcttctttacagtgttgccttgtggcatggagttcaagcagcattgtacagggctatcaaagcacagagagctcgcga

SEQ ID NO: 98617 - DNA, 74 bp, Mus musculus
tgtcaactggggttgaacagttagtgtctctctctatccctggggaaggtgatggtagccagcgtcttaagaca

SEQ ID NO: 98618 - DNA, 93 bp, Mus musculus
tgttaagaattatttacagagaaactggagagatggctcagtgggtaagaatactgactgctcttccagaggacctggttttgattctcagca

SEQ ID NO: 98619 - DNA, 107 bp, Mus musculus
gagatgaggaaggctaaggaagtagagagctcaagcttgacttggtttgtttatttatctattctgagacagggtttgtctgtgtagtcctggctgtcctggaactc

SEQ ID NO: 98620 - DNA, 88 bp, Mus musculus
tgtatgagcatttgcatgtgtgtgtgtgtgtgtgtatgtgtgtctgtgtatgtatgtatgtatgtatgtatgtatgtatgtatgtata

SEQ ID NO: 98621 - DNA, 70 bp, Mus musculus
tgtgtgtgtgtatgtatgtatgtatgtatgtatgggagagacagacagacagacatgcatgtgcagcaca

SEQ ID NO: 98622 - DNA, 110 bp, Mus musculus
ggtatgagctgttttgatttgcattccctgatgactagagattttgaacatttaagtgcttctcaacatttttatattcctctattgtaaattctgtttagctctgaacc

SEQ ID NO: 98623 - DNA, 109 bp, Mus musculus
gccaaaaccaggatgtgtgtcttgcccaagacgtgagtccgtgagtctgtctgattgttctcacacctgagccagcatacaacttcagggtcatggccacgaaagggca

SEQ ID NO: 98624 - DNA, 106 bp, Mus musculus
actttgcttttggaaatctcataaaatgtgtctctgttgagtgtgaggactatactccacagctagtcttttctgtgatttgtgtcttatcccaataagcaaatgt

SEQ ID NO: 98625 - DNA, 65 bp, Mus musculus
gcatacagacagtctctgtgcctggtgtcatggggatgggcatgttggggacaggggctatgggc

SEQ ID NO: 98626 - DNA, 85 bp, Mus musculus; identical to SEQ ID NO: 57470

SEQ ID NO: 98627 - DNA, 115 bp, Mus musculus
gagagagagaacgagcatgcgtgcatgtgtgcattcagaggaggtcaggtgtcctctctgtctttctctgactaatgctcttttaagcaacgtcttcccatgagttcactgtttc

SEQ ID NO: 98628 - DNA, 57 bp, Mus musculus
agagacagagatgcagagataaattaaaacagagggtctctgtgtgtctctctctct

SEQ ID NO: 98629 - DNA, 98 bp, Mus musculus
agtcagttacttcaaaaatttcattggaatttttgttgttcatcagagttctatgaataataagatactgtcatttgaatcccattttttgtttgact

SEQ ID NO: 98630 - DNA, 70 bp, Mus musculus
accgtgaaagaagaatgaaagctgaggccccagaattgctgggtcttggtgcagtcttacatttcgctgt

SEQ ID NO: 98631 - DNA, 108 bp, Mus musculus
gatctcttggttttgagaaaattggtttaaaacattggactcaatttctttatctgtaaaatggaaatggattaaagagtctcacaaggttcttaaaacaaacctatc

SEQ ID NO: 98632 - DNA, 85 bp, Mus musculus; identical to SEQ ID NO: 92498

SEQ ID NO: 98633 - DNA, 100 bp, Mus musculus
gggagagcagacttaaataatgctgctacaaagtattttttttttagcgattaggagctattaagaaaataggaggggtatgaagtagtttaggaggacc

SEQ ID NO: 98634 - DNA, 86 bp, Mus musculus
gtataagccagcaagttcaaggaatgtattgaacattgctatctggatacaatgtggcaagttttccttgagcttcaggtttaaac

SEQ ID NO: 98635 - DNA, 74 bp, Mus musculus
gaggaggaactttggagtcaaggggccgcgggcctaagccccatcctttactaactctcactgactgtcttctc

SEQ ID NO: 98636 - DNA, 98 bp, Mus musculus
gggagataaaggtagaccagactcttgagctgtaggacagtcaagactacatagtgagtcagtctgtcagtcaatcagtcagtctgtctgtctctcct

SEQ ID NO: 98637 - DNA, 103 bp, Mus musculus
ggttattcgtattggaggctgaagagatggctcagaagtttaaagagcactgactgctcttccagaggtcctgagttcaattcccagcaaccacatagtggct

SEQ ID NO: 98638 - DNA, 70 bp, Mus musculus
gcaggattgactctgtctgtgtgggtgtggcgtcccatgcccttgcccttagcacctcagaggcatgtgc

SEQ ID NO: 98639 - DNA, 109 bp, Mus musculus
gcttttgttctttgagtctgttcccacatttgtcaactgcaaagaggaacattcccttcacagaaggttgtcagcattgtgagaaataaagcatataaagtagcatagc

SEQ ID NO: 98640 - DNA, 81 bp, Mus musculus
ggagtggattgtgatgagtcccccagagtgactgataggcctcacattcaggctccagtgacagctctctctctcaggcca

SEQ ID NO: 98641 - DNA, 108 bp, Mus musculus
gtatatgctatgatgtatgtgtgtgcaatgtggtaatgtgtgtggaatgtaagtgtgtgtggtattgttctgggcgttggtgcatgtgtgtgcatttgcagtgtgtgc

SEQ ID NO: 98642 - DNA, 75 bp, Mus musculus
tccatttgcttattcagaggcagagtctcgctaggctgtacagactggccctctctgcctctgtcttcagaggga

SEQ ID NO: 98643 - DNA, 92 bp, Mus musculus
gaggaaagaaatccctgaagaaagtgagcagttggaaaggcgatgacattattgttagactactcctgccgattaggggtgttgagttcctt

SEQ ID NO: 98644 - DNA, 109 bp, Mus musculus
aggatgatgccctccaggtccatccatttgcttaggaatttcataggtatcaaattttttatatctagaaatgccatttggtttgggacttgtggagtattttttttct

SEQ ID NO: 98645 - DNA, 81 bp, Mus musculus
tgcatagaaaacagctttcgggggctggagacatggctctgcggttaagagcactgtctgctcttccagaggctctgagca

SEQ ID NO: 98646 - DNA, 88 bp, Mus musculus
aggtagcagacatctgcagtgaaagagtgaaactatgtgctgggcatgtagggccatcacacacactaactcacagttgctgtgacct

SEQ ID NO: 98647 - DNA, 100 bp, Mus musculus
cgcttagggtggcagcaataaatatgcctgtgtctctgcctctgtggaatcctgacttagaatcctttgagtgtatacccaggactgttgctgttaggtg

SEQ ID NO: 98648 - DNA, 117 bp, Mus musculus
gcagtactccagttagtgctcagcctgcagtcctcttaacagtacattcaaactatttttaaagatgggatctacagagagtgatgtgtccagttaagagcactttgctgttcttgc

SEQ ID NO: 98649 - DNA, 122 bp, Mus musculus
ctgggttatcttggctgaggatcttcagcagctgcccgtgtggggtctctctttctctcaagcagatatggctgaggggccctgcagcttgtccagacctgccggtgggcctcagagtcaag

SEQ ID NO: 98650 - DNA, 78 bp, Mus musculus
ttctcaccttactctctgtctcagtcagggtttgtattcctgcacaaacatcatgaccaagaagcaagttggggagga

SEQ ID NO: 98651 - DNA, 81 bp, Mus musculus
gatttgtgtatacatataaataggtatcgaatatgtggatgaggtaaatgtatatatttatgtgcatatgtatacacattc

SEQ ID NO: 98652 - DNA, 98 bp, Mus musculus
tgctgtcatccagaatttgagtgtgactctgtgtgtgtgtgtgttatacatgtgagtatgcatgctcacctatcttgttgacacatgtatacagatgt

SEQ ID NO: 98653 - DNA, 112 bp, Mus musculus
ctcagaagcctacaagggaatggtcacttctcaaacttggattttttttttttttttttttttttagtataaagatgcaggctctgtgagcgtgtctctctgtgtctctgtg

SEQ ID NO: 98654 - DNA, 112 bp, Mus musculus
atgtgtatatatgtgtatatatatgtatgtgtatgtatatatatacatatatgtgtatatatatgtatacacacacacatatatatgcatatatatatatatatatatatgc

SEQ ID NO: 98655 - DNA, 90 bp, Mus musculus
tatatatgcatatatatgtgtgtgtgtatacatatatatacacatatatgtatatatatacatacacatacatatatatacacatatata

SEQ ID NO: 98656 - DNA, 67 bp, Mus musculus
tgctggctcttttcaggtcctctcaggaagtctctgctaactttctggttctgaaatgatatcagta

SEQ ID NO: 98657 - DNA, 70 bp, Mus musculus
ggtggcactctggctcagacactggaaaagccaggctgattctcaccagtgctcacccagtcctgtcacc

SEQ ID NO: 98658 - DNA, 105 bp, Mus musculus
gtgtaggccggccacctagggatgaactgaggaagagtgctggcccagttccctcggccttctgtctccgtcagtctctcacacctctatcctttctgcctacac

SEQ ID NO: 98659 - DNA, 88 bp, Mus musculus
cttccattgctgggcctggcccagtctctgtctctcttgccagttctgcatggggatgggggtaggggatgaggccttttctcccaag

SEQ ID NO: 98660 - DNA, 68 bp, Mus musculus
agtatgtgcatgtgtgagtgtctgtgtttgtgtgtatgtgagagagtgcactcgagagtgtgcgtgct

SEQ ID NO: 98661 - DNA, 74 bp, Mus musculus
gacctaatgtactaacaggaagctgccttgctggtgcaggcaggtaaggtaagaagtttgtagttttcagggtt

SEQ ID NO: 98662 - DNA, 80 bp, Mus musculus
tctgagtgcttgctgatagcttctgaaaagtcctaaaaactttcttgctctttttgagagttaaaagcagcgggtttagg

SEQ ID NO: 98663 - DNA, 116 bp, Mus musculus
gcaggactgtgatttacatggagggactttggtctctgggaaactacttctattttaatagaacttgcttttgttccaatgtggccaatggtgtctcagtgaagggaacactttgt

SEQ ID NO: 98664 - DNA, 72 bp, Mus musculus
tgagagggggaaagccttctcctgggaactgtacttcactacactgacagaagagggtgaccttgagctggc

SEQ ID NO: 98665 - DNA, 87 bp, Mus musculus
caggatcagaaaggaggggacctcttgggaggcaagatcagagctgagaagtttgtctgtctgtctgtctgcctacctgtctgtttg

SEQ ID NO: 98666 - DNA, 66 bp, Mus musculus
ggccagagagacaaagaagggtcagatatgagtctctttgtctctggcaccttttctcaattggct

SEQ ID NO: 98667 - DNA, 81 bp, Mus musculus
gaacttttttgggataatgggcaatgtagtaggttttagaacctcccaggcctggcttcagtgtctctttctcaaatgttt

SEQ ID NO: 98668 - DNA, 87 bp, Mus musculus
ccagtgtgtgtctgtctgtctgtctgtccagcttcaggctggagtctggggctgaggggcactgaatggatggcagacagagacagg

SEQ ID NO: 98669 - DNA, 60 bp, Mus musculus
agcagacaggaagactgtggagagaggatggagacttgtcagcctgactcactgtctgtt

SEQ ID NO: 98670 - DNA, 87 bp, Mus musculus
atataaactatatgtacaccatatatttcgcatgtatatttcatatatgtatggtatatataaatatatgtgtgtatatgtatatat

SEQ ID NO: 98671 - DNA, 97 bp, Mus musculus
tctaccttgaactcctatttcctcagatgtctgggtcaccatgaactctgttcaggccgcactctctcacagactgaagaaagagttgttccttaga

SEQ ID NO: 98672 - DNA, 117 bp, Mus musculus
tgttatgcatgtgtgtctgagtgtgtatatgcgtcctcatacttgtatatgtatgtaagtatgtatgtgtacacatatgtatatgtatatacatatatacatacacatacgaataat

SEQ ID NO: 98673 - DNA, 60 bp, Mus musculus
gtatgtgtatgtatatatgtatatacatatacatatgtgtacacatacatacttacatac

SEQ ID NO: 98674 - DNA, 97 bp, Mus musculus
caggcagctagagcagctgagagacagagaggcagtggtcctgacagatggggattcattttattttagttttttatttgtgtgggtgtttagcctg

SEQ ID NO: 98675 - DNA, 68 bp, Mus musculus
acccagacaagctttacaactatatatatgtatatgtatgtatatatacatatatatagttgatgggt

SEQ ID NO: 98676 - DNA, 83 bp, Mus musculus
tttgtttccctgactgagaccagagagaatacactcagtgatcactgagatataggctctgcatatgaaataagggggagaaa

SEQ ID NO: 98677 - DNA, 96 bp, Mus musculus
ggttctctgagctctggggagaaaggggttagatgaagtcatctcatgtagagctgtatgttctctgttctctatctctctgcttagtgtctgact

SEQ ID NO: 98678 - DNA, 74 bp, Mus musculus
gtcaggaagcagagatctctgtgagtctggtttggggccctatcttaaaagcaagcgagatcttcatttctgat

SEQ ID NO: 98679 - DNA, 74 bp, Mus musculus
tttaatatttggctctgagtctctgtatctgtttccataggctgctgggtgtagcatctcagagttatgttagg

SEQ ID NO: 98680 - DNA, 87 bp, Mus musculus
gggttttgataggggtgcacaggaactccagaatgggccaagataaaagcaagcaggctctctctctccctgaggacttcatctccc

SEQ ID NO: 98681 - DNA, 85 bp, Mus musculus; identical to SEQ ID NO: 70941

SEQ ID NO: 98682 - DNA, 116 bp, Mus musculus
gcttctggagttctgttcttgaaattttcaggacagggtggagagatggctcagtggttaagagcactgactgctcttccaaaggtcctgagttcaaatcccagcaaccacatggt

SEQ ID NO: 98683 - DNA, 106 bp, Mus musculus
ctctgtctttatttatcttgtctcactgtctctgtccctctgtgcctctgtatctatctagacaccagaaggtaaactgagagcagcagccaataaatgatcagtg

SEQ ID NO: 98684 - DNA, 77 bp, Mus musculus
ctctcaacagacttgccttgccctgtcccgctggaacctcattcccagctcttgtgacgtctgtcagtgtgtgagag

SEQ ID NO: 98685 - DNA, 105 bp, Mus musculus
tccatccatccatccaaatatgtatgcctgtttgtctatatgtttgtatgtatgtatatgactatatgggtaaacatgcatgaatacttgtggaactgattgtga

SEQ ID NO: 98686 - DNA, 80 bp, Mus musculus
gctcttcacttttgttagtttcactgtgtctttttttagtttttgtttccatgttctgtttattggtgagagtggagagt

SEQ ID NO: 98687 - DNA, 71 bp, Mus musculus
gaacttctgctgtagagccagagagaataaagcagggtatcctgaattctctctgtctctgggagagtttc

SEQ ID NO: 98688 - DNA, 76 bp, Mus musculus
tgaacttgaatctggatgtggtggtttgtgctagtatctctgtacagacggcctaggcaagaggggcacaagttca

SEQ ID NO: 98689 - DNA, 92 bp, Mus musculus
ttggtcgcggcggcctcaaaggagctgtgtcaccagggaactgagaggctcctcacagaactgagtgacttggggtatcgagtttcggctaa

SEQ ID NO: 98690 - DNA, 73 bp, Mus musculus
gttccatatcttgtctgaatttatgtctgtgcatgtatgtatgtgcagacatgtgtcgacattaggtggtaac

SEQ ID NO: 98691 - DNA, 71 bp, Mus musculus
ggacacgggctggagagatagattgctcaatggttaagagcactgactgctcttccaaaggtcctgagttc

SEQ ID NO: 98692 - DNA, 140 bp, Mus musculus
ggctatgaggagaggacatcctagagacaggtgagagggatggctggatcagtgaggcagtgattgacagaacagagacagttcccatgtccctgggtggtcagctgtgtaagcttttagaattcttcataatcatgtgc

SEQ ID NO: 98693 - DNA, 90 bp, Mus musculus
gggttccttatcttatggtttgtaaagaagctttgcctcaggcctgtggctatagtatgtctcttaagtgctgtcctaagtgacgaactt

SEQ ID NO: 98694 - DNA, 78 bp, Mus musculus
actctttgattcttcccagtcacatgtcctccagatattatcagaagagacgtctgactgtttcactgtctgtagggt

SEQ ID NO: 98695 - DNA, 82 bp, Mus musculus
gaagctgttctcaggggctgaagagatggctcagtcattaagtgcactgtctgctcttccagaggtcctgagttcgagtccc

SEQ ID NO: 98696 - DNA, 69 bp, Mus musculus
cattgaggctgccgcagaggcctcaagatgggaccttcatattgtgtctctctctgtggcctttcgatg

SEQ ID NO: 98697 - DNA, 122 bp, Mus musculus
atatttgtatatatacatatatatatacatatatacacatagtataatatctatatatatacactatgtgtatgtgtgtgtatatgtatatgtatgtatgtatatatataaacagtgtacta

SEQ ID NO: 98698 - DNA, 94 bp, Mus musculus
ggagaaagagaaggtactcagaaagacagacagacagacagtgtggatactggctctgcaaagtgctatttctgggactcagcctctgaactct

SEQ ID NO: 98699 - DNA, 85 bp, Mus musculus
gaggctgagtcccagaaatagcactttgcagagccagtatccacactgtctgtctgtctgtctttctgagtaccttctctttctc

SEQ ID NO: 98700 - DNA, 159 bp, Mus musculus
tatataatatatatgtgtgtgtctgtctgtatatggtgaaatatatatatgtaaatacatactatatgtatgtatatatatgtatatacacatatatgtatgtatgtgtgtgtatatatatatgtatatatatatatacacacatatatatatattgtg

SEQ ID NO: 98701 - DNA, 84 bp, Mus musculus
actcctttactctgtctgtgtgcatgtgcatgtatgcatttgtgtatgtgtgcatgtgtgtgcactccatgtgagaaaatgtgt

SEQ ID NO: 98702 - DNA, 77 bp, Mus musculus
caaggatttacaagcaccccagtaaaggtgcagtttcataggtaagcggccactctctgtgtgtttgtcggtctctg

SEQ ID NO: 98703 - DNA, 95 bp, Mus musculus
tgaggttggtacatgtgaaactggaagtaattggcacacagaagacactgaggtttcctggactcctcttgcccagaagcaatgacacagaatca

SEQ ID NO: 98704 - DNA, 114 bp, Mus musculus
atggtaatggtactttgagtgtgggggtggggctgacagtttaaagatttttttttcatgatgatccctgtgacttttagttctaatacttcatatgtaggtagttttaatcat

SEQ ID NO: 98705 - DNA, 81 bp, Mus musculus
cctgcctgcctgcctgcctgcctgccttcttgtcaatgtgtatgtgatgaggggacacctgtgtatgcatgcttgtgtagg

SEQ ID NO: 98706 - DNA, 83 bp, Mus musculus
cactgaaatgagtgaacagactggttctcttctggagtcaggaaacagagctgccaggcgaagttaggctcatcaactcggtg

SEQ ID NO: 98707 - DNA, 64 bp, Mus musculus
gggagattctgagcctggtatgggcttttgagaccacaaaggccacactcagtcacacacttcc

SEQ ID NO: 98708 - DNA, 114 bp, Mus musculus
ggcttgtcactgtggcttgattgctgggagacactttgacaggggccactgaggtacccgctgtcttactctgtgtttcataaatcccagcagtgaggacttcaggagttagtc

SEQ ID NO: 98709 - DNA, 58 bp, Mus musculus
ggagctaggctcagagtacagacagaccagggttgaagtttgtactttgctgttatcc

SEQ ID NO: 98710 - DNA, 121 bp, Mus musculus
ctattgacttaatatatattgatatatgtgtatatgtatatatgtatgtgtgtatatatatatatatatatatatatatatatatatatatatatatatatatatttataaagtagatagt

SEQ ID NO: 98711 - DNA, 64 bp, Mus musculus
tgtgtgtctgtatgtgtgtgtgtgtatacatgtgtgtgcgcgcacacacatacacagacatgca

SEQ ID NO: 98712 - DNA, 92 bp, Mus musculus
tctgcagacatggtacagcaaaggcagcaaggatcaaatgtgtgtgggcacagccatgtctagacacactgtcagcatttacctctctcaga

SEQ ID NO: 98713 - DNA, 100 bp, Mus musculus
catatatatgtgtgtgtgtgtgtgtgtgtgtgtgtatatatatatatatatatatatatatatatatatacacacacacatgtatgtatgtatgtatatg

SEQ ID NO: 98714 - DNA, 106 bp, Mus musculus
gaaccatagttgcaaaagcttatagacaaatatgaagtgctctgtgtgtgtgtgtgaagtgctacaattgcaaagttgtttttctatgtgtgctttactttggggc

SEQ ID NO: 98715 - DNA, 86 bp, Mus musculus
ctgactcctcgctgtctcagactctttgtgcctggtgactatttttcagtcacttcagtctggggcctgaaaggggaggagcttag

SEQ ID NO: 98716 - DNA, 56 bp, Mus musculus
actgtccctcaaaggcagtagcagcctcctgctgtgtctgtctctgggtccccagt

SEQ ID NO: 98717 - DNA, 89 bp, Mus musculus
agtgaaattgctgggtcagaagagagagaggtgatgcctgtttttatatgaaacttcacagttctttgtagacaccaggcatttccact

SEQ ID NO: 98718 - DNA, 105 bp, Mus musculus
ggcattttcactaaaaatctcttggctctagatactgtataaaagagcagcaatgtagaggtgtatgtatagtgttagtaatggaacataattgtagtgactgtc

SEQ ID NO: 98719 - DNA, 114 bp, Mus musculus
tttttgaaaacacttagatcctaggtatatgaacttttggccttgcaaagtggtatatttttgtatatttaaatgcagttaaaatttatatatgtgtagtagtttgaataaaaa

SEQ ID NO: 98720 - DNA, 73 bp, Mus musculus
ttgtgtatatccttgtcctgcctgcctgcctgcctgtgtgtgggggatagcagacaggtattaggggtcatga

SEQ ID NO: 98721 - DNA, 71 bp, Mus musculus
gtgtgtggtgtgcctatgattgtttgtatacacatctgtgtgtgcatgtgcatctggaggccagaggacac

SEQ ID NO: 98722 - DNA, 83 bp, Mus musculus
cctagtgctgaagcagactgaagctactgtgcccagacgtcacttcaaagcagcggggttccagcacctctgctttagtgagg

SEQ ID NO: 98723 - DNA, 82 bp, Mus musculus
gtggcgtgaggagagcgggcgtgtaaatcaccagtctacagagaacacactgctgagtgctggctcgctcgctcactcccac

SEQ ID NO: 98724 - DNA, 77 bp, Mus musculus
gactctgaggatattgtcttgcctctccaaccttgtctccccaatggtcaagcagtgggacactctttctcacagtc

SEQ ID NO: 98725 - DNA, 103 bp, Mus musculus
gaagcatctgtcctggtgcacagagttgagaaagacgaagagtggcaggagccctcggctgctctcttctctctgagcttgagtgttctttgatttttttttc

SEQ ID NO: 98726 - DNA, 87 bp, Mus musculus
gttattcaactctcaggagctggagagatggctcagtggttaagagcactgactgctcttccagaggtcctgagttcaaaccccagc

SEQ ID NO: 98727 - DNA, 76 bp, Mus musculus
ggtaagagcatacgcctgtctgtctgtctgtctgtctgtctgggaaggcggctgatagaccggcccttgttctgct

SEQ ID NO: 98728 - DNA, 68 bp, Mus musculus
gtgtgtatatatgtatgtgtgtatgtatgtatgtatttatgtatgaatgtatgtatgtgtgtgtgtat

SEQ ID NO: 98729 - DNA, 89 bp, Mus musculus
tctctgtctgtctgtcggtctgtctgtctttgatgtgcattggtgttttgcttacatgtatgagtgtgtcagatcagaggggactgggg

SEQ ID NO: 98730 - DNA, 80 bp, Mus musculus
gtggacagcaacattcaatgggctaagactggataagaagaaagcgagtaccatcagcctctgtctgtctgtctgtctgt

SEQ ID NO: 98731 - DNA, 94 bp, Mus musculus
gctgaaaaacacactcagggggctggagagatggctcagcggttaagaccactgactgctcttccagaggtcctgagttcaattcccagcaacc

SEQ ID NO: 98732 - DNA, 102 bp, Mus musculus
tagatccattctgtactcaggggagggggtggtagcatatctatgcttatctatgtgtaccatgtatgcaattcctgtcttaccacactcagttggtggcta

SEQ ID NO: 98733 - DNA, 112 bp, Mus musculus
gggattaaggactgtacctaggctggagagatggctcagcagttaagagcactgactgctcttccagaggtcatgagttcaaatcccagcaactacatggcagttcacaacc

SEQ ID NO: 98734 - DNA, 64 bp, Mus musculus
cgtcagtccgtcagtccgtcagtcctggggtggtgggggctggttgatgatgacctggatgacg

SEQ ID NO: 98735 - DNA, 72 bp, Mus musculus
ctgtctgtctgacaatctgtctgtggagactggaagagagcactggattcctagaggtggagtcacaggcag

SEQ ID NO: 98736 - DNA, 72 bp, Mus musculus
gcatatcagtgtatatgtatatgactgtgtgtatacatatgagtgtgtgtgtatatatatataaggatatgt

SEQ ID NO: 98737 - DNA, 118 bp, Mus musculus
gcacatctgttccatgaggccatcagcgctgtgctccatctcacactgggcacagatcttggtcactgaagagagaaagcaaagtgggtgtggtcttaaacagcaggacagtacaggc

SEQ ID NO: 98738 - DNA, 116 bp, Mus musculus
tctgccaggtgccacagagggtgtcagcaagtgcttctcagaggtgacactgaccacagtgttgactggcatgtggaagttctactgacagagaagagggagggcagcccagcaga

SEQ ID NO: 98739 - DNA, 57 bp, Mus musculus
gacacctgaggaggaggtcaaccctgagtgtggagtgcctgtgtgcctcactgtgtc

SEQ ID NO: 98740 - DNA, 74 bp, Mus musculus
ggcaggcccggtggagaggatgaaagcaagagaaactgtatgctctgatctcactctcactctcactgtgtccc

SEQ ID NO: 98741 - DNA, 70 bp, Mus musculus
acttcagcaggtaaagtaaggcagttagtcacaggaggacagacgctctgcaactccatctgtatgaggt

SEQ ID NO: 98742 - DNA, 83 bp, Mus musculus
atggatgtagggacagtaacacagacacagacacacaccaaaagggacagtgtgtatctgtctgtgtgtctgtctctctctgt

SEQ ID NO: 98743 - DNA, 83 bp, Mus musculus
cagtcctgtgggtctcagatgcagaaagagccgtatccaccttatgaccaattcccatctgtcactgtgtctcatagtggctg

SEQ ID NO: 98744 - DNA, 68 bp, Mus musculus
ggactctctgaaccagactcactctcagcctggctagggaggcgtttgggaagtaaggtcgagaggac

SEQ ID NO: 98745 - DNA, 118 bp, Mus musculus
aggattctcttaggagatgggttatctccagcctcgtttccaaacagacggtcctgatgagacaggagtgtgaggtcataggcagacataggttgtagaggagacaagttccaatcct

SEQ ID NO: 98746 - DNA, 115 bp, Mus musculus
ggagaggcaccgttgccaccgtccaggactcaggatgggcctgactctgtctctgcctctgtccactgtcgctttgctagaggagcacatctctgaggaaatgaccatgggagtc

SEQ ID NO: 98747 - DNA, 76 bp, Mus musculus
gaaagcatggatcaggggtgagatgactgagaggaggaacccagaccttggcgattcagaaagcccttccagcttc

SEQ ID NO: 98748 - DNA, 88 bp, Mus musculus
agtttccctttcacacacagcattgatgtgaacaagctggccttgacttatcaggctctgactggctcactgtgtgacgaatgaagct

SEQ ID NO: 98749 - DNA, 74 bp, Mus musculus
gggaatattaggctacactaatccactcagaagttcataggtcagaacactgagtgtagatgtagcctcttctc

SEQ ID NO: 98750 - DNA, 88 bp, Mus musculus
ggcttcctggaggggtgagtggaggcctgggggcctcatcctgctatcttcctgcctgcctccctgactggcccctttgggctttgcc

SEQ ID NO: 98751 - DNA, 96 bp, Mus musculus
gggtgtttctgtgggtctcactctctctcagcatttgtcagataagcaggccggctcactgaatgcaggggagtcctcacccacagattctcgctc

SEQ ID NO: 98752 - DNA, 68 bp, Mus musculus
agagagagagagagagagagagagagagagagcctggaatctgtcctcacacctgtctgactctccct

SEQ ID NO: 98753 - DNA, 85 bp, Mus musculus
tctcaccagccccttttcttttgtttaatgtgcgtggatgttttgtttgtatcacacgcacactgtgcctgtggaggccggaaga

SEQ ID NO: 98754 - DNA, 72 bp, Mus musculus
tgtctgtgtgagcatccttgtcagtgagtcctggccatccagtctctcagtctgacagtctgacactgttca

SEQ ID NO: 98755 - DNA, 62 bp, Mus musculus
tgtggacaatagctgtgatgtcagctcaggttcctgaggtcagagaagtcacagtagccagg

SEQ ID NO: 98756 - DNA, 119 bp, Mus musculus
aggaggttagaaggcaatcttggggctggtgagatggctcaggggttaagagcactgactgctcttccaaaggtcttaagttcaattcccagcaacctcatggtggctcacaactatct

SEQ ID NO: 98757 - DNA, 85 bp, Mus musculus; identical to SEQ ID NO: 57470

SEQ ID NO: 98758 - DNA, 82 bp, Mus musculus
ggtggaggaggtgtgtcactggaggtaggtttttatgcttcaaatgctcaagccatgcccagtgtcactctctctctcttcc

SEQ ID NO: 98759 - DNA, 64 bp, Mus musculus
cagaagctgacagtagacagggaacagtaactctgccccatgtctcaccaactgagagcaactg

SEQ ID NO: 98760 - DNA, 110 bp, Mus musculus
tgagactgcaaatacttatatgttcatataaagtagcattattatatattatatatttttagtcttgcttggttatgaaaaaacttgtgtgcatgtaggttgtatattca

SEQ ID NO: 98761 - DNA, 111 bp, Mus musculus
aatgagatgattaagtggatttttatctttcagttgttcagatatggattatatttatcaatttatgtatgttcaactgaaaggatgatataaacctcacttgtctccatt

SEQ ID NO: 98762 - DNA, 93 bp, Mus musculus
gcttgacttctgccatctgatcatctctagtcgtacctactctctctgtatctgactggggcctgtcctttctgtgatcctggttgtgtcagt

SEQ ID NO: 98763 - DNA, 75 bp, Mus musculus
tacatatatgtatatatacatatgtgtgtcttatacatatatatgcatgtatgtgtgtatatacatatacatgta

SEQ ID NO: 98764 - DNA, 103 bp, Mus musculus
tcatcctcagagagttgacctcagtgggcgttgaggggaggactgtgtgtcctcctgtttgagaccctcactgtctgggtgagccttttaagtgcaggggtgg

SEQ ID NO: 98765 - DNA, 117 bp, Mus musculus
tatatgtgcatgtctgtgtataagaaatatgtgtatatatgcgtgtatatgtgtgtatatgtatatatgtgtgtatatgtgtatatatatatgtatgtatgttgtatgtgatcagac

SEQ ID NO: 98766 - DNA, 78 bp, Mus musculus
gaaggtggagtgacagagagagacactgacatggggaacacccactgtttcctgtcacccctgcacactccttctttc

SEQ ID NO: 98767 - DNA, 65 bp, Mus musculus
ggagtgtgcaggggtgacaggaaacagtgggtgttccccatgtcagtgtctctctctgtcactcc

SEQ ID NO: 98768 - DNA, 118 bp, Mus musculus
ccaataggcagtgttctctagggatgtaatggtgttctgctttttggctgtggatgactagaggaagaaaggtccaaggcttggaaagatgactcatagattcgggaagttgtaaagg

SEQ ID NO: 98769 - DNA, 104 bp, Mus musculus
tgggaacatatatatatatatactgttccctatatatatagtagtatatatatatatatatatatatatatatacactagggaacagttctttctattttctta

SEQ ID NO: 98770 - DNA, 58 bp, Mus musculus
acatatgtatgtatgtatgtatgtataaatatgtatgtatgtatgtatgtatgtatgt

SEQ ID NO: 98771 - DNA, 70 bp, Mus musculus
actgtcagtagtgtgtaagcacttcacgctatcagtagtgtgtaagtgctttaatcactagtgtgtaagt

SEQ ID NO: 98772 - DNA, 88 bp, Mus musculus
gaagcccgtccagcgctcagcactttccctcacctgcggccaaggcaagcacacgggaaggtgaagctgggctcgaggaaaaggctac

SEQ ID NO: 98773 - DNA, 71 bp, Mus musculus
accatgagaaaagaatcggggaacaagcagactttcaagcaagctgctgtctctctcttagtcatcaaggt

SEQ ID NO: 98774 - DNA, 97 bp, Mus musculus
tgttaagaactaggaggggcaagtgtcagagagaaggctgccgggcaccggggtgtctcgaacactctgacacaccaggtttggtgtgattgtgaca

SEQ ID NO: 98775 - DNA, 85 bp, Mus musculus
gatgctgcggcagattttcagagatggctcctctgcctctgggggccctcactcccagtctgtcaatgtcgtcatactccaaatc

SEQ ID NO: 98776 - DNA, 64 bp, Mus musculus
acaataagcccaaaagatagatagatgtatgtatgtatatctgtctgtctgtctgtctgtctgt

SEQ ID NO: 98777 - DNA, 130 bp, Mus musculus
gtgtgtatatatgtgtgtgtatatacatataatgtatatatatgtgtgtgtatctgtgtatatatatatgtgtgtgtgtatatatacatataatgtatatatatgtgtgtgtgtatgtgtatgtgtgtgt

SEQ ID NO: 98778 - DNA, 61 bp, Mus musculus
tagagagaaggctgagaggacagggatcgctaatcgctgtcatacactagcacttgctcta

SEQ ID NO: 98779 - DNA, 72 bp, Mus musculus
agaggccagaggagtgttgtgtgctgccacgtcggtgttaggaaccaaaccccactcttctggaagagctct

SEQ ID NO: 98780 - DNA, 61 bp, Mus musculus
ggaatcaagtcatagacatgaagtaccagcgcgtggactggaactctgtctctgactttct

SEQ ID NO: 98781 - DNA, 114 bp, Mus musculus
tcccagggccacctgccccaggttatcttccttctttcgcatcatcctaatgagactagagacagtgctgagggatgggaagaaggacgtttaaatgctgctggtggactgtga

SEQ ID NO: 98782 - DNA, 127 bp, Mus musculus
gtgtaggaataacaagattatatatatatatatatatatatatatatatacacatacacacatatgtgtgtatatatatatgtatatgtgtatatatgtatgtgtgtatatatatgtgtctgtgtgt

SEQ ID NO: 98783 - DNA, 108 bp, Mus musculus
tggttgttggctcttttacaatggccagcagtaaattcggagcctcacagttcctctgacactgaaactgtgtgactgtgacaggcgcggccctgtatgcgacaccca

SEQ ID NO: 98784 - DNA, 104 bp, Mus musculus
aatgacaatgcctcttctttatgatgctaagctgatacagttgtcttttcaccccatcctgtctctgtatctctctcattgtgtctcaggcttatgctgtcgtt

SEQ ID NO: 98785 - DNA, 90 bp, Mus musculus
tatgtgtgtgtgtgtgtatacatatatatgtatgtatatatgtgtatatgtgtatatatacatacatacatacacacacacacacacaca

SEQ ID NO: 98786 - DNA, 75 bp, Mus musculus
gaacttctgctgcaggggccagagagaaaagggcagggcgtcccccaattttctctctgtctctgggagagattc

SEQ ID NO: 98787 - DNA, 75 bp, Mus musculus; identical to SEQ ID NO: 98786

SEQ ID NO: 98788 - DNA, 87 bp, Mus musculus
gttgccttatgtatctgtctgtctgtctatctatctatctatttagagatggaggtaagcaaagaagccccagaattcaaggcagac

SEQ ID NO: 98789 - DNA, 88 bp, Mus musculus
cggaggccgctcgtagaactggagggcactcatagaaacggaggccgctcactcagtccctctcaagcacgctgggcccattattccg

SEQ ID NO: 98790 - DNA, 86 bp, Mus musculus
gatcttcttgtgagactcctaacagtgggagcaggggctgtctctgactctgtgcctgcctttgggacgcttacctctacctgatt

SEQ ID NO: 98791 - DNA, 61 bp, Mus musculus
tgcacacgttttgaaagaactcagtggggaaacccccactcagctcccgattcggcgtgca

SEQ ID NO: 98792 - DNA, 65 bp, Mus musculus
tctgggcactctctctccctgtctactccttagcactccctgggcctgatcttagggtggccaga

SEQ ID NO: 98793 - DNA, 80 bp, Mus musculus
cgcatgattttaatctcagcttttggaggcagaggcagacagatgtctgtgagttcaagatgagactagtctacagagtg

SEQ ID NO: 98794 - DNA, 91 bp, Mus musculus
ggacaccggcgggagaagcctggcggggaaaactcagctccgatttggaaagggctgtctgtctgtctgtctacttctacctcccaggtct

SEQ ID NO: 98795 - DNA, 74 bp, Mus musculus
gttaccagagagtgagctgagaccgcctagggacagcaaggctgttgtaggtagccagcgtcacctccagtggc

SEQ ID NO: 98796 - DNA, 116 bp, Mus musculus
aggttcggtaaatgtaagttttcaatcgtgttgtgatgagagctggattttcttacttattcttgtcattttgatgattacaaggatcttacaagtactgaatctgattttctcat

SEQ ID NO: 98797 - DNA, 82 bp, Mus musculus
aggatcaagagttcagggccagggctggaaagatggctcagctctgactgctcttccagaggtcctgagtttaattcccagc

SEQ ID NO: 98798 - DNA, 100 bp, Mus musculus
tgggcagctctgtagtctgtagactggaatggtgtttatactggctttttcatgggtagtaactttgttcatctctctaacaggcatattacctgaccta

SEQ ID NO: 98799 - DNA, 107 bp, Mus musculus
aggcatccgtgttggctctggtttctgagtctcaacagggttgacaggtttcttgtgaggatcctgagctgggctgggtctagaacccagggctagagtgcttgcct

SEQ ID NO: 98800 - DNA, 129 bp, Mus musculus
gtcctgtccacagagagccagtcccacagggcctcgctcctctcctggcatctgaggctctgtcttgctcacaggctctttgtcgcctcacatctgtcactgtagtctaagcacctgcctcaccatgct

SEQ ID NO: 98801 - DNA, 115 bp, Mus musculus
ccccaagctgagctcctgtccctacctcaggcaggatctcacggatgcttctaatgaagttctctccgactctgtctgagcacccaccacgcgaggaaggagctgcggccgacgg

SEQ ID NO: 98802 - DNA, 117 bp, Mus musculus
ctgcatcccgtccttgtttagacagcatccacagaaggtggagactgaagacagtcagaagaccgagtccctgaagcagtctccattttcgtggctgctggcagggaatcaccccag

SEQ ID NO: 98803 - DNA, 64 bp, Mus musculus
tcctcagcaagtctcagtggaatctagttgttttggccactgtctgacactgtcacttgaaggg

SEQ ID NO: 98804 - DNA, 85 bp, Mus musculus; identical to SEQ ID NO: 57439

SEQ ID NO: 98805 - DNA, 82 bp, Mus musculus
gtgtatgcactgtcatgtgtgttgtactcatgtgtgatgtgtttactcatgtgtgtgtgcactcatatatgtgtgtgtgctc

SEQ ID NO: 98806 - DNA, 85 bp, Mus musculus
gtcagaaacatgggtgtcagatgttacagtgctcactgtacagcatgaggcttggtggggtggggtgggatttgtccagtgtgac

SEQ ID NO: 98807 - DNA, 94 bp, Mus musculus
gagaccattgttgtcgctgtgctctgtgagtgtaactcagcccacaaagcactgagtacaatggcagcagcaaggccacactgcaccgaagctc

SEQ ID NO: 98808 - DNA, 110 bp, Mus musculus
ggcaaaacttcatcctggggtcgctttagagaaacacaaagaatacagtgtccactcagccatatgtagatcttgtggaactaagcagagcttggggagatgattcggtc

SEQ ID NO: 98809 - DNA, 84 bp, Mus musculus
tgacctccatcacgttgaacatctccactctgattgctgttccctttggcattacaatgagagagagagactgacacagaggcg

SEQ ID NO: 98810 - DNA, 57 bp, Mus musculus
agcctgcaggagggaatgaagtcaagtgagctgtctcagattctctctctgtgggtt

SEQ ID NO: 98811 - DNA, 90 bp, Mus musculus
ggctgaggtccttaggcagctgagtaaagtgcacagggtgcctgctggagagcatggcttctgtcacactgacagtgtctggacaaggcc

SEQ ID NO: 98812 - DNA, 59 bp, Mus musculus
atgagattgcagtaagtggcgcaggggggagctgctcacactcactcaggcagactcat

SEQ ID NO: 98813 - DNA, 67 bp, Mus musculus
ttgagggttctaaggcctattagtgtgagtgtggtcccacccacactcagagactaggaaccctgag

SEQ ID NO: 98814 - DNA, 70 bp, Mus musculus
ggaaatcagacactggctgagttctgctgcctcgatggagccgcacagttagctggttactctgagcacc

SEQ ID NO: 98815 - DNA, 86 bp, Mus musculus
ttcttcatggcaaggacaacagactgtgctctcataggccttgtttgaactctggtctatcgctttctagttgagtggcattagaa

SEQ ID NO: 98816 - DNA, 100 bp, Mus musculus
gaccaagctctatgagccaactcctctgtcactctctgcgacataagcaatgacttgccagactgaagagttcttgggggcctcatggaataagctggtc

SEQ ID NO: 98817 - DNA, 127 bp, Mus musculus
gacagatttgaaggtggtgtggtatgccaacactggctggcaaaagattcccccatctctgcgtctgtcacagaccactgcagggtgcctagaaaacaagggccccttggggtgctccaaagcacgc

SEQ ID NO: 98818 - DNA, 61 bp, Mus musculus
tgggaagaggaaagagcgggtgacaggaagcctcgctcgctcgctcgctcactcgctctca

SEQ ID NO: 98819 - DNA, 93 bp, Mus musculus
gagtcttctggatggccccgctcttgtcttcctgagacagtgtctctgtgtggctcaggctggtctctgtgtggatgaggtgcccttggactc

SEQ ID NO: 98820 - DNA, 75 bp, Mus musculus
ctgtctgtctgtctatctgtcatcaggatggggctttccggcccactttagagctagggaaagagaggcacacag

SEQ ID NO: 98821 - DNA, 81 bp, Mus musculus
gaggagagttatgcaggtggcccagttcaaaaatctcaaacggattttaatattatgaatgtgtgtgtgtgtctctctctc

SEQ ID NO: 98822 - DNA, 106 bp, Mus musculus
gagcgagggctctcttctcccacagctcctgtccacccaccctgctctctgtgacactgtgacactgcccaggcttgaacaccgctgtgcaaaggacctcgctctc

SEQ ID NO: 98823 - DNA, 83 bp, Mus musculus
gtaagaactcaagactcaactgtgagagcactgggctggtccttcccagacatctcagatctcaccacagaggtgctgctagc

SEQ ID NO: 98824 - DNA, 70 bp, Mus musculus
ggaccggggactggagagatggctcggtggttaagagcactgagactgctcttccagaggtcctgagttc

SEQ ID NO: 98825 - DNA, 78 bp, Mus musculus
aagccggtggttcacaacaggtagtgtaacgcttctcctttgaggcagtctcactgagagtttgttcttcacctactt

SEQ ID NO: 98826 - DNA, 81 bp, Mus musculus
gccagcatgcactatcacttgagtttttgatcttaaccattgtgactggtgtgagatggaatctcagggtagccctgtggt

SEQ ID NO: 98827 - DNA, 77 bp, Mus musculus
tctgggagagagtagaattcttagttccgggccggcgagatggctcagcgattaagagcactgactgctcttccgga

SEQ ID NO: 98828 - DNA, 89 bp, Mus musculus
ggaagttggctgtctgtctgtctgttttattgagcactctagttagccactggggtgatttgcagggcacaacaagagacaaagcttcc

SEQ ID NO: 98829 - DNA, 59 bp, Mus musculus
tctcgctgtctctctctgtctcttacacacagagagagagagagagagagagagggaga

SEQ ID NO: 98830 - DNA, 140 bp, Mus musculus
gcctatgacacttgacaggtttgagcgggtcctacctgatgacaaagctgaagacactgctagttcacagaagtgtgtgaggcggggccttctccatctctgcagtcaagctttctctttagctcccatttggtaggggc

SEQ ID NO: 98831 - DNA, 68 bp, Mus musculus
gggtcagagaaatggctcagcagttaagagcactgactgctcttccagaggtcctgagttcaattccc

SEQ ID NO: 98832 - DNA, 116 bp, Mus musculus
cagggatgcatagtgagctcatatctcaagtaagtaataagtaaatgaatgaatgaatgaatgaatgaatgaatgtgtctatatgtgtgggcctatgtgaatttacatgtaccgtg

SEQ ID NO: 98833 - DNA, 84 bp, Mus musculus
tatctatctatctatctatctatctatctattgtgtatgcatgacacatgcatactttgatgtgtgtgtagaactcaggagatg

SEQ ID NO: 98834 - DNA, 61 bp, Mus musculus
tggggggctggagagatggctcagcggttaagcgcactgactgctcttccagaggtcctga

SEQ ID NO: 98835 - DNA, 126 bp, Mus musculus
gagggcagaagaagagttggcaggggttggatacacttgctgaattctgtctctggctgtctgtctcttcctacatttgaaattgggtgtaaaaatcagatctatttcaaaagttaggaaatagac

SEQ ID NO: 98836 - DNA, 80 bp, Mus musculus
caggctgcctgggaacttgcagtcctgtttcagtctcctgctctgtctgtctgtctgtctgtatccctcccatcctcctg

SEQ ID NO: 98837 - DNA, 78 bp, Mus musculus
gcttagttgtgagtctgtaactgtcagaggcccgaggaagataaatatctctgagtagacaggaagtgcagagcaagc

SEQ ID NO: 98838 - DNA, 73 bp, Mus musculus
gacaattgctacgatccagtgagtcacactgcctgaccctgagggcggcgggtgccctctgtgtctgcttgtc

SEQ ID NO: 98839 - DNA, 86 bp, Mus musculus
gtattgagagtgtgtgtatctctgtgtgtatgagaatatgtatgagtgtgtatgtgtgcatgcatgttaagacagggtctcactat

SEQ ID NO: 98840 - DNA, 73 bp, Mus musculus
gccttaatagatgagccatctctccagtccttgactcttttcttaaaaaagactctcactgtgtggctctggc

SEQ ID NO: 98841 - DNA, 112 bp, Mus musculus
gagcaggagtcccctcctgcccacgagagctcccagcggaatgttctctggcagcaggcacgggctttctgttcagaatctgccagggaacagcaggggctggggagaactt

SEQ ID NO: 98842 - DNA, 92 bp, Mus musculus
gctgacagccaggagcctgtcatccactcccactgttctacctgccagcagttatggactcagggtgtctgtctgtctgtctgtctgtctgt

SEQ ID NO: 98843 - DNA, 85 bp, Mus musculus
cacaggggatgccagccttcaggtcaggatgtagctcttaattacaaccccagcactgtgtctgactgtgtgccctgtgcccccc

SEQ ID NO: 98844 - DNA, 117 bp, Mus musculus
ttttaaaattttatttattgtttttttatgtgaattggtgttttgcgcacatgtctgtttgtttatgtgaggaaatacccatttctttgaccagaaagaaaaggtatagttttcaga

SEQ ID NO: 98845 - DNA, 81 bp, Mus musculus
taggtggtggaccagtcagagtctgtgaaatctcctgacaaattcctgctctggctggcaccaggcttcatccatccccta

SEQ ID NO: 98846 - DNA, 66 bp, Mus musculus
aacttggggctggagagatgggtcagcggttaagagcactgactgctcttccagaggtcctgagtt

SEQ ID NO: 98847 - DNA, 63 bp, Mus musculus
cctctctctcagtctctaaccttattgttgctggggtgggttggaggcaaagagcagtatagg

SEQ ID NO: 98848 - DNA, 174 bp, Mus musculus
atgtgcatatatatatacatgcatatatacattatatatatgtatatatgtgtgtatgtatatatacatatatgtgtgtatgtatatacatatatatatgtatgtatgtatatgtgtgtgtgcatatgtatgtgtatatacatatatatatatatatacacatacatatatata

SEQ ID NO: 98849 - DNA, 127 bp, Mus musculus
ggcgccttccctgaggttggcagtagctgtggaccactctcctctccagcttggctccctctgtgcctctggtcttctcttgcctctctctggcatggtgaagtcccctttcattcctaaggcagcc

SEQ ID NO: 98850 - DNA, 95 bp, Mus musculus
gagccatctctccagctcctattatatgtctagtatatgtatatatacatatatattgctattaaaaacatttagggagactggaaaattagctc

SEQ ID NO: 98851 - DNA, 107 bp, Mus musculus
aggctaaaaataattctttgcatttaaagtacaacctcacatggcgtcacatgcgtgtgacagctgagagtgtggaaagtacttatctttcaagtattgagtagcct

SEQ ID NO: 98852 - DNA, 98 bp, Mus musculus
gggccccctgcagcacggcattgtctactcagggggtgagtgaactgtctgtctgtctccctttgttctgggcacctctgcatggtgatctttggctt

SEQ ID NO: 98853 - DNA, 73 bp, Mus musculus
ctcgtgcatggtggtttgagcacacacagttgctgcatgatgtgcactgtcactgtctctctttcatgtagag

SEQ ID NO: 98854 - DNA, 113 bp, Mus musculus
tggcagcattggcagggtggtctgtagcttaagagtagtaggtttgagtgatgagggtgagcacatgtgttacacatacagctgcagttacaatactctggaaaaagattcca

SEQ ID NO: 98855 - DNA, 122 bp, Mus musculus
ttcattgtatgtgtgagatacataactacagttatctaggagctgtttgtccaaggcttgacagtacagtgtgagcacaggtaataatgagctggtgtattagaaaggcaagggagggaggg

SEQ ID NO: 98856 - DNA, 71 bp, Mus musculus
actgtttgttgtcctacatttgggaaacttctccaaggagatcattaaaaatgactgaggacacaaagggt

SEQ ID NO: 98857 - DNA, 79 bp, Mus musculus
ggcagatgtctgtgagctcaagggcagcctggtctacatattaagttctaggctgtccagggctacagagagaaatgct

SEQ ID NO: 98858 - DNA, 115 bp, Mus musculus
ctaggctaacctggaattcatgtatcctcatctggccttggatccatggcagtctgcctgcctcagtctctgtctctgagtgccaatgttctatgtgtgagtcaccgtgcctggc

SEQ ID NO: 98859 - DNA, 108 bp, Mus musculus
acaaggacaacgagagcaaagctctgtccctgggacaagcaaggctccgtctctgtgactttcagcccaagttggaggaacacagctgtgatcaagagggatccatgc

SEQ ID NO: 98860 - DNA, 84 bp, Mus musculus
tcttgtctcagctgcctcacactctgtctgtccctgcaggtaacttgatgggtgtatatggggagtcaggcagaaagagcaagg

SEQ ID NO: 98861 - DNA, 113 bp, Mus musculus
cagcagacatatgctatgcatactgctacagattgcttctcggaaagattatctatctttatttcaagtgttttgcctacatgtatgtatgtgcaccatgtgtgtgcctgctg

SEQ ID NO: 98862 - DNA, 98 bp, Mus musculus
cctcctttcctctgactgctgctctggctctgtctggggctgtgtggctacagctccttccttgggcaggaaggtgggttgtcagtgtggaaaggtgg

SEQ ID NO: 98863 - DNA, 87 bp, Mus musculus
gctctgctcggctggctcactgactgtctcctaggacctgaaggcagaggctgagccccagccagtagggcctaggagctggctcag

SEQ ID NO: 98864 - DNA, 110 bp, Mus musculus
gagaactacagagagttggcaaagcttcaggcaagagggaggcaccagaacttaattaattatttttgagacaagcctttccatgcagctctggctattctggaactctt

SEQ ID NO: 98865 - DNA, 87 bp, Mus musculus
gtgcatgtacacatgtgagtgtgtatgtgcatttatgtgtgaatccaccatatatgcatatgcacacatgtgtgtgtgtgagtgtgc

SEQ ID NO: 98866 - DNA, 118 bp, Mus musculus
agatggctgtgagacaccatgtggttgctggaaattgaactcaggacctctgacagagcagtcagtgctcttaactgctgagccatctcttcagccccacataacctccttgagatct

SEQ ID NO: 98867 - DNA, 59 bp, Mus musculus
cgggggctggagagatggctcagcggttacaagcactgactgctcttccagaggtcctg

SEQ ID NO: 98868 - DNA, 93 bp, Mus musculus
tgttggatcattacttcctccatggacagagctgcacccttgggctccagaagagcagctcgctgtggtagaaggaagtggttctcttttgca

SEQ ID NO: 98869 - DNA, 119 bp, Mus musculus
ggtgtcattagaaccatggctttcagttactgccctggccacagaaggagcggacagtgtctcccagactctgtggcacagaatggctgggcccgtggagtttaagatctgtgtaaacc

SEQ ID NO: 98870 - DNA, 107 bp, Mus musculus
aacaatatgcaaattctctgtagtcatggcagcctgcctgtatcccagctctaggaaagggtaaacagggttcctgcagcaagctggctggccagactagctgtgtt

SEQ ID NO: 98871 - DNA, 72 bp, Mus musculus
aattcatctttggggcaggagagatgactcaacggttaagagcactgactcctcttccagaggtcctgagtt

SEQ ID NO: 98872 - DNA, 87 bp, Mus musculus
gctgaagaaacagtcagctgcacaggggcgcacagaacaggaggggacctctgccagtctgactctgacagaggattgatatccagc

SEQ ID NO: 98873 - DNA, 89 bp, Mus musculus
tctagcatcatgactgtggtatagtttgttacaatggctgagagatactgagacactcttactcactgaaggccacagttgacactggg

SEQ ID NO: 98874 - DNA, 118 bp, Mus musculus
gtgtgacaaaggtggatcatggagatgctaaggaaagcaagtcagataaacagaaaagtgaacattggctgctcgcctgcaggagggcatctgacccagggtcttaaccttcgggtgc

SEQ ID NO: 98875 - DNA, 92 bp, Mus musculus
gggaaactgagcctcggctccctctagatctactgtgtttcctgtgtgaggtcacagggcccaggaaggtcgacgcacgggatggctctccc

SEQ ID NO: 98876 - DNA, 80 bp, Mus musculus
atacagattctgacggaggtgaggagtggggctgcaattctgtgtttgttttttatctctctctctgtgtgtgtgtgtgt

SEQ ID NO: 98877 - DNA, 112 bp, Mus musculus
caatttatagtgtaaccccttgagttcacttagtgttgtttatatgtatatgagtttagggctgagcacttggcattggataacctatcaagaggcttctatcgtaagattg

SEQ ID NO: 98878 - DNA, 56 bp, Mus musculus
cagaatcagtgcccgacactcccagatcccactctgggtgtctgtctgtctgtctg

SEQ ID NO: 98879 - DNA, 100 bp, Mus musculus
tcggttttcttgaagggtgtggctctggttgttttctcactctctggtgaatgatcccacacacagaagtatgtgagcagcacagaagtaacttgactga

SEQ ID NO: 98880 - DNA, 69 bp, Mus musculus
tactaccgtgatttagagaagtctgtcttaatatgtgggtcttgtgactgactctctgagtctgtagtg

SEQ ID NO: 98881 - DNA, 122 bp, Mus musculus
tgcaacgccgtggccacctcttctacaataacttgatttctgcagttatttttttaaattcttgaggacaagcaactcagagatgagcaaaacatgagagctgagagcgttccatttgtgtt

SEQ ID NO: 98882 - DNA, 58 bp, Mus musculus
cttctacctgtgacagtctcactctggttcaaaggagaaagaatcacaaggtggcaag

SEQ ID NO: 98883 - DNA, 70 bp, Mus musculus
ctttttaaatctgtgtgtgcttgtgcatgtgtgtgtatgtgcagatgtgcactggcatagatgccagaag

SEQ ID NO: 98884 - DNA, 77 bp, Mus musculus
ttgtcacctttagaatctgagttctgatcttctctgcattgtcagatgggtgtgaggtcagtagtatatggtgagga

SEQ ID NO: 98885 - DNA, 113 bp, Mus musculus
aatgaataagtgaaacgaatatgtatgtaagtatgtatgtatgtatatatgtatgaatgcatgtatgtatgaatgcatatatataggtatgtatgtatgtttaaaatgtcatt

SEQ ID NO: 98886 - DNA, 72 bp, Mus musculus
gtatgtatgtgtgtgtgtaagtatgtatgtatgtaagtatatatgtatatatctgcatctacatctacatat

SEQ ID NO: 98887 - DNA, 86 bp, Mus musculus
tctttataaaagattatatgtgtatacattcatagttatatgtgtgtgtctctctgtgtgtatacacgtatgtattaaaataacga

SEQ ID NO: 98888 - DNA, 89 bp, Mus musculus
caggtagctgagcaagaaattgaaagcaagccagtaagaagagaacctcggtggtctctgtctcagtcgctgccttgatttcctacctg

SEQ ID NO: 98889 - DNA, 69 bp, Mus musculus
agacatagaggttagccctgggagggaaaggacaggcgctctctgtctctctcctcatcttctgtttct

SEQ ID NO: 98890 - DNA, 107 bp, Mus musculus
cacagtttcacttgtgtgttcatggacacttaggatgtctactgtattggttgtccacacatggctgtcctatgtcttcctccaccccatgtatttatgttactgtg

SEQ ID NO: 98891 - DNA, 84 bp, Mus musculus
ggagagaatagactcaaagttaccatcagacttccatatatgctactgcatgtaatgattctgtctgtctgtctgtctgtctat

SEQ ID NO: 98892 - DNA, 67 bp, Mus musculus
cacatgaggttcaggaaccttctccgtaccctgctgcggagaaaaagtgacactctgaccctctgtg

SEQ ID NO: 98893 - DNA, 114 bp, Mus musculus
gtccctattggtgagaccccaaactagtgtagctactgggaagtcagtgaggagacaaagctaaagctcaatctaccgcaggaccccgatgtaacagttctcactcttgggcat

SEQ ID NO: 98894 - DNA, 95 bp, Mus musculus
gagtagggcatcaggtcagagtggttcagaagcactgtctctcccacagtgagtgttgatccactagagttcaaccatgcattccacacctgctt

SEQ ID NO: 98895 - DNA, 109 bp, Mus musculus
ataaataatgaaagatccagtgggaagacagagtagcagatagcctcataaaacacacactctgtctgcctgactgtctgtctaccactactatttatcatctatctat

SEQ ID NO: 98896 - DNA, 73 bp, Mus musculus
gtgaccacagaactcttctggcaagatgggaaatgggaatcctgaaaccaccctgtctttgtctctgtctcac

SEQ ID NO: 98897 - DNA, 96 bp, Mus musculus
cacaaacgtggctttgctttcttcttcatctgcttggctcactcaccctctctgtctttatctgctgtgttggaagaatggctttatgcctttgtg

SEQ ID NO: 98898 - DNA, 98 bp, Mus musculus
ctaaatttagctatgttagctctattatccccactttgccaactaaaacacaaaagttcagagtggttgagttgagcaatatactgggctgtcattag

SEQ ID NO: 98899 - DNA, 95 bp, Mus musculus
cagcttatcttattaaactctacctgtctgtagactgtcagaacctactgggtcctgattctaccatgaagcgtattgattgttatttctagctg

SEQ ID NO: 98900 - DNA, 91 bp, Mus musculus
gactgataactgggtgacagaggacactgagcacggtggcacaggcacacatacctatgacccgcgtgtccagctctttgtccagcagctc

SEQ ID NO: 98901 - DNA, 104 bp, Mus musculus
ttgaatttattgtgaaataatgtacatgaagccctactgtgaaacccacaatgtttcacatcagtagtgattttcctgttaaattgctttccaataacttttaa

SEQ ID NO: 98902 - DNA, 82 bp, Mus musculus
tagaagatgttagatagatatatccctagaatataacccaaaagatttgtgttctttgtctatctatctatctatctatcta

SEQ ID NO: 98903 - DNA, 63 bp, Mus musculus
gcactgtcctcagttctgtgtgactgttccttcccagcagtcatggctacactgcatgggtgc

SEQ ID NO: 98904 - DNA, 68 bp, Mus musculus
atgtatgtatgtatgtacgtatgtatgtatgtacgtatgtatgtatgtatgtatgtatttgaaataca

SEQ ID NO: 98905 - DNA, 115 bp, Mus musculus
tccttgaccaaggcatcattgagaagagtgttgttcagtttccacgtgaatgttggctttctattatttatttttttattgaagatcagccttagtccatggtgatctgatagga

SEQ ID NO: 98906 - DNA, 120 bp, Mus musculus
cagggaccacaaacatgacctccatccagtataattggatatgtttaggtaggacacactcactcttagactttatacagtgtgataagtggagcctgtgtttggattcattctgatcct

SEQ ID NO: 98907 - DNA, 74 bp, Mus musculus
ctggaaaattttgtgagtgtgtgtgtctgtgtttacatggtgtataatcgcatacatacatatgcaaaggtcag

SEQ ID NO: 98908 - DNA, 83 bp, Mus musculus
tgtgtatgcatatgtataatggagcattaagaaataaataaagggatgtgcctagttattctttaaatatatatgtctacaca

SEQ ID NO: 98909 - DNA, 111 bp, Mus musculus
gcaaactttattaacctttgtagtgtttatgtagtcctgtaccttagaaacatatattttttttattatattttgtatcattacagtgaaaagcaaagcattaaagtttgt

SEQ ID NO: 98910 - DNA, 84 bp, Mus musculus
tgggttggtaggtaggtgggtgggtgggtgagcaggcaggaaagtaggcaggcagacagacagacagacattacctacaagtca

SEQ ID NO: 98911 - DNA, 111 bp, Mus musculus
cctccatcctgtgccttgctccttcctttaattgcatgtaagcgggaggtggaagacaagtgatcctgttgatgctattgatgaaggtgaacatttcccagcagatggagg

SEQ ID NO: 98912 - DNA, 85 bp, Mus musculus; identical to SEQ ID NO: 60894

SEQ ID NO: 98913 - DNA, 108 bp, Mus musculus
gccttgtggcccatcatcttctgtgtggagcgagctttttcttaagatgtctatacagagagaccactgagagctctcattctggagagaaggttatagcctttgggt

SEQ ID NO: 98914 - DNA, 75 bp, Mus musculus
tagggtcaaacacaaactcactcactttcatgaagcatcatgaagaatgaagagagacgtttggacaactccctg

SEQ ID NO: 98915 - DNA, 101 bp, Mus musculus
tatatttggacatttgaacagtcttctgcttgtaagttgtatgtatacaatcttgtgtgctataatagacttatgctttccaatttcttaggtcatatata

SEQ ID NO: 98916 - DNA, 94 bp, Mus musculus
tgtctgtatatctatatgtatgtacattcattcttatataggtatatgtatatttatgtaagtatgcatgaacacttgtggagttgatgagaca

SEQ ID NO: 98917 - DNA, 75 bp, Mus musculus
tatgtctgtgtgtgtgtgtatatatatatatatatatatatatatatatatatgatgcatgtgtatatgtatatg

SEQ ID NO: 98918 - DNA, 85 bp, Mus musculus
tatatgtgtatgtgcatatgtgtgcacacatgattgtgtgtgtgtgcatatatatatatatatgcacatatacacttaccttcat

SEQ ID NO: 98919 - DNA, 70 bp, Mus musculus
tatatatatatgtatgtgtgtatatatatgtatatacatacgtatatatacacacacacatacatacata

SEQ ID NO: 98920 - DNA, 96 bp, Mus musculus
gcttggaaggcaattgttatgcacacacacacgtgtatacatatatgtatatgtatatgtatatgtatatgtgtgtatgtgtatatgcagacatgc

SEQ ID NO: 98921 - DNA, 121 bp, Mus musculus
ctcaggtaaaacttctacacttatccatgtggtgtcttcaaaactaaacatccttctgtctggtaaattgaagatacctgaaggagatagatggatagatgggaattgagattttttggct

SEQ ID NO: 98922 - DNA, 84 bp, Mus musculus
catctatccatctatctccttcaggtatcttcaatttaccagacagaaggatgtttagttttgaagacaccacatggataagtg

SEQ ID NO: 98923 - DNA, 94 bp, Mus musculus
atgtatatgtatatgtatatgtatatgtatatgtatatatacacatatttatatatatatacatgtatatgtatatatatgtatatatatatat

SEQ ID NO: 98924 - DNA, 62 bp, Mus musculus
tgtatgtatgtatgtgtgtatgcttgtatgaatgcatatacatgcacacacacacacacaca

SEQ ID NO: 98925 - DNA, 99 bp, Mus musculus
cccctgatgtaggcaaagccttcctcaccttcagctgggtttcagactctctctaaggctgggaagggtaagggtggcactatgggctccattcagagg

SEQ ID NO: 98926 - DNA, 79 bp, Mus musculus
cagcaaagtgtgtgccttagtttggttatagattgaatattttccttctctatcaacccaaggatatacagtgaagctg

SEQ ID NO: 98927 - DNA, 93 bp, Mus musculus
gttgattgattgatctatttttgaacatatttattgattatatgctacatcccaagcatggtatcaatatcaccatgtggatttatagttagc

SEQ ID NO: 98928 - DNA, 92 bp, Mus musculus
ggcatgtatgctaatgtatgctatgtgtgtatgtatgtatgtatgtgtgtatgtatgtatgtatgtatgtatgtatactttgggtatccgcc

SEQ ID NO: 98929 - DNA, 84 bp, Mus musculus
acagaaatgacaagattggtcctgagataacatttgttctatcatctgtctatcttctgtctacctgcctgtctgtctgtctgt

SEQ ID NO: 98930 - DNA, 117 bp, Mus musculus
caggagagaaccgactcctcgaagttattttttgacccccacacactctctctaactagttttaaaaaggagattgaggagagagttcaattggtaaagtgattgcaagaggacctg

SEQ ID NO: 98931 - DNA, 90 bp, Mus musculus
ccagatttgcaaattacattttttgtctattatatggttattgttgggcctctgagaatcccctggacaggatgtaagttgcttttctgg

SEQ ID NO: 98932 - DNA, 115 bp, Mus musculus
tggatagacagagagacagacagagttcttgtgggagagatgaatgtaaaaaataatcctttttattttatcatttagcatctcagaaaaggcagtgctatcttgggatgacaca

SEQ ID NO: 98933 - DNA, 94 bp, Mus musculus
ttcaccagccagtagtagggcctgagagagaagagagccagcacctcccctgtttcctttggtgctcatcggttttgatagctaaggctgtgaa

SEQ ID NO: 98934 - DNA, 130 bp, Mus musculus
atatatatatatatatatatatatatatatatatatatatatatgtgtgtgtgtgtgctgtatatatatatatatgtatatatatatatatacatgtgtgtgtatgtactctaggcggatgtatctatat

SEQ ID NO: 98935 - DNA, 102 bp, Mus musculus
agaccaagggcaagtagggaccaaagggatgcaattaacactccatctgtctatttgcatttctacctttatcatttccattttacatatgtgcacctggct

SEQ ID NO: 98936 - DNA, 85 bp, Mus musculus; identical to SEQ ID NO: 57439

SEQ ID NO: 98937 - DNA, 110 bp, Mus musculus
atgtatctatgtatttatgtatctatcatgtgtacactatttctgtgtatatttaagtatatacataaatatctaaacatttatgaaatttacgtgtgtgcatggattca

SEQ ID NO: 98938 - DNA, 98 bp, Mus musculus
gaagttggtgttttatcttaatctcacctttctagtctggatcatataacccattaaatgagagaacaatgagaggttagcatcagaagactgatttt

SEQ ID NO: 98939 - DNA, 76 bp, Mus musculus
gatgaaaggcaccatgccctgatatttttatcttttgtagaaagtgaaagattttgagcatggcttttgggtcatc

SEQ ID NO: 98940 - DNA, 89 bp, Mus musculus
cagtggatgcgtgttgtgatgtgttacatagttctctactccctgggtctctctgtgtgtacgcctattcaaacatacaattttacctg

SEQ ID NO: 98941 - DNA, 74 bp, Mus musculus
tgtctctctgtgagtgtctgcatccattcccatctgccaggaggatgggaacagaggaaacctctctgatgaca

SEQ ID NO: 98942 - DNA, 78 bp, Mus musculus
acatatgtgtgtgtgtgtgtgtatatatatatatatatatatatatatatatatacatacacatatacatatacatgt

SEQ ID NO: 98943 - DNA, 61 bp, Mus musculus
gatgtctgtctctgggactgacactttagaagagatgagaaggtcaggattgacaggcctc

SEQ ID NO: 98944 - DNA, 74 bp, Mus musculus
acaaagctggttgttgagtgaatttggcatgtatgtatgtatgcatataagtatgtatgttctatcagttttgt

SEQ ID NO: 98945 - DNA, 77 bp, Mus musculus
catgcgtatagtgggaatatatgtaagatgtatgtatgtagtatgtgtgtgattatgtatgtatgtatatatgtatg

SEQ ID NO: 98946 - DNA, 58 bp, Mus musculus
ctgtctgtctgtctgtctgtctgtcttactgtatatagataaggagagagagggagag

SEQ ID NO: 98947 - DNA, 100 bp, Mus musculus
tattcaccctgctcttaaagtggttctgagttgttgacaaccacctgtaactccaactccaagagatcagcctctttgtctatatggatgcacatgaata

SEQ ID NO: 98948 - DNA, 87 bp, Mus musculus
gtgtatgtggtacttggatgaaatgattcaatgtctgttgattccaggcatgaatttgtattgaatcctttttggaagtatgtatat

SEQ ID NO: 98949 - DNA, 57 bp, Mus musculus
cggtttctggcatgatgaatgtgtgatatatctcacacagactctcagccaagatgg

SEQ ID NO: 98950 - DNA, 112 bp, Mus musculus
acttatgaaatgtttcacatttctggttatgttctgatagaagtcacagttcaaatttacattcagatgtcctttctcttcttatgaccagtgctatggaaaatgtcgtagt

SEQ ID NO: 98951 - DNA, 170 bp, Mus musculus
atgtaaacatatatatatatatatatatatatatatatatatatatatatataggtatatatatatatatatatatatataggtatatatatatgtatgtatatatgtatatatgtatatatacacatacatatatatgtatgtatgtatatatgtacacacacatatat

SEQ ID NO: 98952 - DNA, 89 bp, Mus musculus
ggggagtaaaggatgttagctatgtgtgtgcatgcatcagtttcatctactctgtttgtcactccctgtgttatatctctatcctccct

SEQ ID NO: 98953 - DNA, 118 bp, Mus musculus
gtatagcttggtgtccttgtgggacccccaaatgcagaagtcaggtgtgtctctgactctttcatctgcatttgaaacattttcctcctacatggatcagcatgtccagccctgatac

SEQ ID NO: 98954 - DNA, 144 bp, Mus musculus
tatgtatgtatgtatatatgtatatctgtgtgtgtgtttatatatatgcacatatacatgtaacatatatatatatatatatgtgtgtgtgtgtgtatatatatgtgtgcatatatatgtttatatatgtatatatacacatac

SEQ ID NO: 98955 - DNA, 81 bp, Mus musculus
tctcagagctgagctgtcatggttcatattgtcacaggacctagaatcacctgagacacaagactgtgagcaagtctgaga

SEQ ID NO: 98956 - DNA, 73 bp, Mus musculus
ggaaggtggcaggttgtctggagcctgaaaatggcgccgctttctcagaggctctgtggctctcgcccgttcc

SEQ ID NO: 98957 - DNA, 84 bp, Mus musculus
ggccatgttggtctgataggatacatgggacaatttcaatatttttgtatctgttgaggcctgtttcggaccaattatatggtc

SEQ ID NO: 98958 - DNA, 112 bp, Mus musculus
attcctatagtatcatcattaagaattaagaagccatctctctatctgtctctgcagaaagtgttgtcgagaagaagagtggtattcagggggtggggagtgtttggggagt

SEQ ID NO: 98959 - DNA, 103 bp, Mus musculus
aaactgtacatgcctgagtattgtttagttttcctcatcaaaattatgttttgtattgaagaaagattaggacaataaataaatagttcaaggcacaaagttt

SEQ ID NO: 98960 - DNA, 61 bp, Mus musculus
tatgtgtatgtgtatgtatatgtatatataatctatgtgtgtgtacaaacacatgtgcatg

SEQ ID NO: 98961 - DNA, 112 bp, Mus musculus
caaggataaagccatttgttttatcaaaatatgtcagagtcacagagactgagagttgcttaagtcatggcatgacagagcttttgatttatatctatctttaccttgtgac

SEQ ID NO: 98962 - DNA, 85 bp, Mus musculus
ggccatggtggtctgataggatacatgggacaatttcaatatttttgtaactattaaggcctgttttgtgaccaattatatggtc

SEQ ID NO: 98963 - DNA, 84 bp, Mus musculus
tccattgatctctctgtctgtcactgtaccagtaccatgcagtttttatcacaattgctctgtagtacagcttgaggtcaggga

SEQ ID NO: 98964 - DNA, 87 bp, Mus musculus
gaatttgtgtcagggaaattataggctgtaggaaggaaaggtatactttttttcttattgagaatatttttttcttgtaatagattc

SEQ ID NO: 98965 - DNA, 123 bp, Mus musculus
ggaatatttataagccctcttagaatcaatcttcctaagcaaggtgcaatctctgtgtacacagtgagctctacccatcggaaggaagactccactgagggaaggacagtgtgttctttgaga

SEQ ID NO: 98966 - DNA, 104 bp, Mus musculus
caacaggttccattagctccacttaatgtttggctctgggtctctgtctctgctgccagaggaagcctctctgattgggctaggcactgagctatgactttttg

SEQ ID NO: 98967 - DNA, 112 bp, Mus musculus
gtgtgagtgtgtgtgcatgtgcatgtgtgtgtgactgtgtatgtgtgtaatttttaatttttatcatcacacaaagttacaaattatgctatatggagactatatttcatcc

SEQ ID NO: 98968 - DNA, 113 bp, Mus musculus
agctctttacaaacatattccacagttcttcaatttgtacaatttttttaaaaattagactctttttagacttaaattgtaaacatgaacactgaaaaatgtagtgcagagtt

SEQ ID NO: 98969 - DNA, 160 bp, Mus musculus
atatgtatatatgtgtatggatgcatgtatgtatatgcgtatatatatatatatatatatatatatatatatatatatatatatactttatattttatacatatacacacacacacacatatatatatatatatatgtatatatatatatatatatatat

SEQ ID NO: 98970 - DNA, 114 bp, Mus musculus
tgtgtatgttcatatatatatatatacacacatatatatatatgtatatacatacacacacatatatatacacatgtatatgtgtgtgtgtaaactatgtgtatgtatatatac

SEQ ID NO: 98971 - DNA, 79 bp, Mus musculus
actggtttcagatcttagagattccctgggtctgagccactcaaccttgtcagatcctatgtctgtctgtctgtctggt

SEQ ID NO: 98972 - DNA, 102 bp, Mus musculus
tctgtatgtgcatatgcttcagccatgcagtatatgaatgtatatgtgtttacctgtctgtctatctgtctgtctgcgtgtatgtaagcatctgtttgtggg

SEQ ID NO: 98973 - DNA, 89 bp, Mus musculus
gtatgtgtatggtgtgtgtgtgtttaaacagacttagaaggaaaataccctttaatttcatacacacacacacacagacatgcatatat

SEQ ID NO: 98974 - DNA, 95 bp, Mus musculus
gcttctctgtcagagattaaataacaatgtatgtatgtatgtatgtatgtatgtatgtatgtattcatgtgtgtgttgagatggaagcttgacag

SEQ ID NO: 98975 - DNA, 105 bp, Mus musculus
tctggcccactgaatcttgtttgccttttaaagtttactttgctctgattatcttgttctgagtgagtacaggggcagaaatcccaagagtatcttggagtcaga

SEQ ID NO: 98976 - DNA, 79 bp, Mus musculus
atgtatatgatgtatatgtgtatgtatatgatgtatatgtatatgatgtatatgtatatatatatcatattggcatttg

SEQ ID NO: 98977 - DNA, 82 bp, Mus musculus
tgggaatgacaaggggctggagagatggctcagcggttaagagaactgactgctcttccagaggtcctgagttcaattctca

SEQ ID NO: 98978 - DNA, 113 bp, Mus musculus
tcatatgtcctcagagtcacccaccttaactttccatggaaccataagagtaataattctgtttttctaaatgtgtgtaattggttaatggttatagttttcaggataaatgg

SEQ ID NO: 98979 - DNA, 101 bp, Mus musculus
acatatatatatatatatgtatatgtatatgtatatatatatatgtgtgtatatgtatatgtatatgtatatacacacatgtatatgtatatgtatatgta

SEQ ID NO: 98980 - DNA, 102 bp, Mus musculus
ggcaaaacacgtaggtgcctgagaggctaggaaattcccagtgtctgtctctctttgggcatgacatcttgacccgggaaggtttaccctatacactgcggg

SEQ ID NO: 98981 - DNA, 112 bp, Mus musculus
ggatgtaaatgtttttatggagctggagagatggctcagcggttaagagcacttactgctcttccagaggtcctgagttcaaatcctagcaaccacatggtggcttacaacc

SEQ ID NO: 98982 - DNA, 116 bp, Mus musculus
aacaaaaacaaaaaaatatatatatcataggataaaatgtaactattttaattttaatgattacattaaggtatggtaatgttatttaaactagactggttgtttttttgttggtt

SEQ ID NO: 98983 - DNA, 106 bp, Mus musculus
catctttggaagtttgtaagtgaaccaaggctcctggcagaactggacgaggctgaggttcttggttggtgggctgagcctttgaaaacatagattatcaaaagtg

SEQ ID NO: 98984 - DNA, 71 bp, Mus musculus
gggaagaggttgttcttcacgtcctcggctatccccactgcagagttgagactgaagactctcattttccc

SEQ ID NO: 98985 - DNA, 75 bp, Mus musculus
tgcgggcaagccactgtccctctctgggcctcggcctcgttgctccgtagtaaggacgctctgtggtttctggca

SEQ ID NO: 98986 - DNA, 81 bp, Mus musculus
ctgttctgcctgcatgtctgcctgtgtgggagtgttggagtctcagacagttgtaagctgccatgtgggtgctgggaattg

SEQ ID NO: 98987 - DNA, 106 bp, Mus musculus
tccctttctctcggccatgtctgtggtgcagttttctgtctgtgactgtccagtgatttgggattgtgatcgctacaatcttcgcaatgactaacatatagactac

SEQ ID NO: 98988 - DNA, 61 bp, Mus musculus
gggttgggggatgggtactcaggtgagggtcaagtgaccctctctgtctcctttaacccag

SEQ ID NO: 98989 - DNA, 80 bp, Mus musculus
gggaccaggaggctgacatgagtgtgaatatggctgtgtgcacagggctcttctctgtgtgtctgcaggaagtgagttcc

SEQ ID NO: 98990 - DNA, 103 bp, Mus musculus
tgataaatgctgacccagagcctgttcccaccctctccttgctgacagaggccctcactgtgtcagtgggagccctgaacagatgcttcgtctatgtgtgtca

SEQ ID NO: 98991 - DNA, 102 bp, Mus musculus
tgcgtgtgcatgtgtgtgtgtgcatgtatgtgtgcatgtccatgcatgtatgcatgtatgtgtgtgtgcgttcatgtgtgtccatggaagtatgtgtgtgca

SEQ ID NO: 98992 - DNA, 85 bp, Mus musculus
gtgtgtccgtgcaagttcttattaaccttacacacagtctctgttacttttgtctgtgtggttcaagttgcttttgcgtgaacac

SEQ ID NO: 98993 - DNA, 91 bp, Mus musculus
ccaagtgcttttgaaacactgtgggtctgagtgactgtgtccacaaacagacgcaacacacaggatgcagagggaggtttctcagagctgg

SEQ ID NO: 98994 - DNA, 68 bp, Mus musculus
tgtgtgaatatgtacacaagagttcagatgtgtatgtgtgtgtctgtgtgtgtgtgcatatgtacaca

SEQ ID NO: 98995 - DNA, 94 bp, Mus musculus
ctattatggggggctggtgagatggctcagcggttaagagcactgactgctcttccaaaggtcctgagttcaaatctcagcaaccacatggtgg

SEQ ID NO: 98996 - DNA, 102 bp, Mus musculus
ttgggtagaaattctggctttcttaagcctcaattttttttagtctataaaatgagtctccagactggaagtgtggtttagtggaagaacacttttgcccaa

SEQ ID NO: 98997 - DNA, 57 bp, Mus musculus
ctgttctgctctgagagtctgcatgatggatagcctgggtctctcagagtctcacag

SEQ ID NO: 98998 - DNA, 113 bp, Mus musculus
ccccaggaaaggaagtgaagttcagggcagagtttgaaaccagccggcaggtgtttgagggtggctcagactatgccacaaatatgcagtgggtgttcataaacgcagggagg

SEQ ID NO: 98999 - DNA, 82 bp, Mus musculus
aattcatcaaaaagatcttcctggactagagagacggttcagcggttaagagcactgactgctcttccagaggtcctgagtt

SEQ ID NO: 99000 - DNA, 89 bp, Mus musculus
gttgggcactgacacgctcctggcttgtctgctggtcagggggacatcaccagggacgagcatgtggctgcgctgtacagggccacagc

SEQ ID NO: 99001 - DNA, 73 bp, Mus musculus
gtgggggagccacatgctgttatatttttaaagttcttaattaaaaaaagtattgctttgtgtggtcgtgcac

SEQ ID NO: 99002 - DNA, 73 bp, Mus musculus
agagagagagagagagagagagagagagagactagtattaggtgtctgcctctgtcactctgtcttgtgtttt

SEQ ID NO: 99003 - DNA, 68 bp, Mus musculus
tatatatgcctgtatatgtgcatatgtacatgtatatgtgtatatgtgcatgtctatgtgcatgtata

SEQ ID NO: 99004 - DNA, 88 bp, Mus musculus
gcatgagctgcgactcggttacctttgaacttggagttgtgtatttatttctctttagaatgtctccctgtaggcctcgcatctctgc

SEQ ID NO: 99005 - DNA, 97 bp, Mus musculus
tcttgcatgtttgtgcatgttagtgagcagagagagaccaagggatcatcctgaaacaggtctctctgcacttcctggaggttgctggacagttgga

SEQ ID NO: 99006 - DNA, 75 bp, Mus musculus
gtatgctgctcctgtgcaggcagccacagctactgtgaggtggtggacagtggctctgtcaggcccagaaaatgc

SEQ ID NO: 99007 - DNA, 130 bp, Mus musculus
ctgggtctcagggctgctgctagctggaagagaatctaagctggccctgtgctgaagcaagaagagatagaggacaggacattggtgtggatgtagtccttccaccacctccctgtcttacctcggtgtt

SEQ ID NO: 99008 - DNA, 61 bp, Mus musculus
acggcttgaggggaggactgagaggatggaaatatcctcttcactctctgtctctttctgt

SEQ ID NO: 99009 - DNA, 63 bp, Mus musculus
gtccgagaggacggacaagcaacagcgtttgacttcagctgaccttctgtgtctctctcagat

SEQ ID NO: 99010 - DNA, 88 bp, Mus musculus
gtgactctgcattctctcccaaacccacaaacttgagccacagtaggaattcttggccctggctccctgtttgagtcatcagggtcac

SEQ ID NO: 99011 - DNA, 150 bp, Mus musculus
tatgtatgtatctataggtgtatgtatgcatgtacatgtgtctatatgtatatgtatgtgtctaaatgtatatgtatgtatgtgcatgtatgtatatatgtatgtgtgaatgtgtcatgtatatgtatatgtatatgtatatgtatatgt

SEQ ID NO: 99012 - DNA, 64 bp, Mus musculus
catccacccagtgtcaggtccccaggcccttctgagaactcctgggaccctcactgtctgtctg

SEQ ID NO: 99013 - DNA, 74 bp, Mus musculus
cagggagtgtatctatatattatagatagatgtgatttttctgtcagatgaatagatggcaaagatattctctg

SEQ ID NO: 99014 - DNA, 68 bp, Mus musculus
tagatacagagatagagattgatagagatctgtgtgtatgtgtctatctgtctctgtatctgtgtgtg

SEQ ID NO: 99015 - DNA, 65 bp, Mus musculus
tatgtatatatgtatgtgtatgtatgtgtatatgatgtatacatatgtgcacgtatatgtacatg

SEQ ID NO: 99016 - DNA, 117 bp, Mus musculus
cgcttccttcttctggtctcatgtctgctccatttgttttctcactcactgtgtctaaccagctgtctgaatgaccatgagtaatgaagacatccagtcatatccattaccattgcg

SEQ ID NO: 99017 - DNA, 112 bp, Mus musculus
tctctaaatacatatatatctgtatacctgtatatctatatctatatatatctatatatatatatatatatatatatatgtttatctatatatctatatatctctctagaga

SEQ ID NO: 99018 - DNA, 64 bp, Mus musculus
gcctgttactgtacctggaggatgcatcagtgtctctctctgggtgcgatttagcatctctggc

SEQ ID NO: 99019 - DNA, 170 bp, Mus musculus
gtgtgctcacagtgtactcagtgtgctcacagtatgctcagtgtgctcacagtatgctcagtgtgttcacagtgtattcagtgtgctcacagtgtactcagtgtgctcacagtgtgctcagtgtgctcacagtatggcagtgtgctcacagtgtgctcagtgtgctcaca

SEQ ID NO: 99020 - DNA, 213 bp, Mus musculus
tgtgagcacactgagcacactgtgagcacactgccatactgtgagcacactgagcacactgtgagcacactgagtacactgtgagcacactgaatacactgtgaacacactgagcatactgtgagcacactgagcatactgtgagcacactgagtacactgtgagcacactgaacacactgtgagcacactgaatacactgtgaacacactgc

SEQ ID NO: 99021 - DNA, 70 bp, Mus musculus
tgtgagcacactgagcacactgtgagcacactgcgtacactgtgaacacactgagtatactgtgagcaca

SEQ ID NO: 99022 - DNA, 179 bp, Mus musculus
agtgtgctcacagtgtactcagtgtgctcacagtatgctcagtgtgctcacagtatgctcagtgtgctcacagtgtactcagtgtgctcacagtatgctcagtgtgctcacagtgtgctcagtgcgcttacagtgtactcagtgtgctcacagtatgctcagtgtgctcacagtgtact

SEQ ID NO: 99023 - DNA, 70 bp, Mus musculus
tgtgagcacactgagcatactgtgagcacactgagcatactgtgagcacactgagtacactgtgagcaca

SEQ ID NO: 99024 - DNA, 76 bp, Mus musculus
gctcagtgtgttcacagtgtacacagtgtgcttacagtgtatttagtgtgttcacagtgtgctcagtgtgctcacc

SEQ ID NO: 99025 - DNA, 145 bp, Mus musculus
cactgtgaacacactgagcacaccgtgagcacaatgagcacaccgtgagcacactgagtacactgtgagcacactgagcatactgtgtgcacactgaatacactgtgagcacactgagtacactgtgagcacactgagtacactc

SEQ ID NO: 99026 - DNA, 123 bp, Mus musculus
cacagtgtgctcagtgtgctcacagtgtagtcagtgtgctcacagtgtgctcagtgtgctcacagtatgatcagtgtgttcacagtgtactcagtgtgctcacagtgtgctcagtgtgctcac

SEQ ID NO: 99027 - DNA, 87 bp, Mus musculus
gcatcatcacaagaggaaggcaggggcgggcagggactggtggggaaactgtctcagcctctctgagtcagtctgttgtgtggaagt

SEQ ID NO: 99028 - DNA, 111 bp, Mus musculus
atactgtatgcatgtatatatatatatatatgtgtgtgtgtgtgtgtgtgtgtgtgtgtgcgcgtgtgtgtgtatgtgtatacatgtatatatgtatacatgtatatatat

SEQ ID NO: 99029 - DNA, 73 bp, Mus musculus
cttgatatacatacacatacacacacacatatatatgtatatgtgtgtatatatgtacatatatatatataag

SEQ ID NO: 99030 - DNA, 65 bp, Mus musculus
cgtttatgcactttgtgtcaagagatgtcaccaagccttggatctgagcacagagtgtgctcacg

SEQ ID NO: 99031 - DNA, 69 bp, Mus musculus
gtggagaatgtctctaaagagactgcctagcacaaaggttgtttctgagtctatctgtctcattctccc

SEQ ID NO: 99032 - DNA, 81 bp, Mus musculus
ggggaacagtagactcctcagtgtgccatctcttatgtgggatggagatggccaggctctgtcgctctcagattgatcttc

SEQ ID NO: 99033 - DNA, 73 bp, Mus musculus
tatgtacacaagtgtgagtgcatctacatgtctgtatacatgaatgttgggtacttgtatgccacagtgcatg

SEQ ID NO: 99034 - DNA, 116 bp, Mus musculus
ctccttgccaaatactgtggtgacttagagcatttttgttcatttgtttgtttttatcttctttccagacagcagagcaaggggagacttgtgtcccaacagcttcttatgcagag

SEQ ID NO: 99035 - DNA, 114 bp, Mus musculus
gtatgtatgtgtgtatgtgcacgtgtatggtatatgtgtgtatatgttgtgatatatgcaatgtatgcatgtatgcacatatgtggcatgtgtgtgtgttagtgtgtgtgatat

SEQ ID NO: 99036 - DNA, 87 bp, Mus musculus
ctagacttgcccaagaagagagcctcacttgagaacttgtttagataaggttagtctgtgggggtgtctttgggggggcatgcctgg

SEQ ID NO: 99037 - DNA, 99 bp, Mus musculus
atatgtatatgtataggtatatgtatatacatatatatgtatatgtgtgtgtttatatatgtgtgtatatatagtaggtaggcagatacatgtatatat

SEQ ID NO: 99038 - DNA, 93 bp, Mus musculus
gcatggggagtgagcctgatgtctacactgcccaagctgcatgcttcgtgcatcggccggtgggtctgtctgtctgtctgccatctcccttgc

SEQ ID NO: 99039 - DNA, 90 bp, Mus musculus
gaagaggggacaggtcactaacaggaactgcatgtgacattggagagtggaacagtgcagtgtgtcacggggcaaccgtgtctctacttt

SEQ ID NO: 99040 - DNA, 88 bp, Mus musculus
gaaccaaacaagagcagacctcctcagggtcttcctgtctgtctgtctgtcttctaggataagctctgatgctgcacttcatgagttc

SEQ ID NO: 99041 - DNA, 62 bp, Mus musculus
gtatgcatgtatgtatgtatgtatgcatgtatgcatgcatgtatgtatgtatgtatgtatgc

SEQ ID NO: 99042 - DNA, 58 bp, Mus musculus
gagtgtgtgcatgcatgtgtgtgtatgtgtgtgcatgtgcatgtgtgttgccaccctc

SEQ ID NO: 99043 - DNA, 71 bp, Mus musculus
ccaagtcttcacccactcactgtctgggactccaaaaatgtcctccataggttcgtgtgactgatgcttgg

SEQ ID NO: 99044 - DNA, 82 bp, Mus musculus
gtggcagctggaagcagggagaaatgggtgaagcccagctctgatctatgggtctcaccctgtcaccctgtcccactgttcc

SEQ ID NO: 99045 - DNA, 83 bp, Mus musculus
ctgaactctaactcactgactgtttctgctaggcatttgcacaagcctgtgacctttctggggaaaggcagtggtctgtttag

SEQ ID NO: 99046 - DNA, 79 bp, Mus musculus
cctcctttcttagagtaagttctggcttcagtgagtcttccgtcagagagacacacactgccactctctgtgtctgagg

SEQ ID NO: 99047 - DNA, 84 bp, Mus musculus
gagttcagagggtcacaagtaagtgagctctgagggagacttgcattccttccttgcctgctgcctgctttaaccccgttactc

SEQ ID NO: 99048 - DNA, 97 bp, Mus musculus
tgtgcagcacactttctcatgtatgtatgcatgtatgtatgtatctctgtgaagcacactttctcatgtatgtatgtatccatctctgtgtagcaca

SEQ ID NO: 99049 - DNA, 101 bp, Mus musculus
ttctctgtgcaactgtgatcctcggggccaggaggctgctcagccagcatgtccccgtgaggtcacagtgcacagtgaggcctggacagcctggggtcccg

SEQ ID NO: 99050 - DNA, 69 bp, Mus musculus
gacacttgcggccctcatcccacactgtgggtgggacacactaccacactgagagtcacacaccgtgtc

SEQ ID NO: 99051 - DNA, 138 bp, Mus musculus
gtatatgtatgtgtgtatgtgtatatgtgcatgtgtgtatatgtgtgtatgtgtatatatgtgtatatgtatatgtgtgtatgtgcatatatgtgtgtatgtgtgtatgtatatgcatgtatatgtgtgcatgtgtgc

SEQ ID NO: 99052 - DNA, 111 bp, Mus musculus
tggtgtgtgtgtgcacacatgtgtgtgcatgtgcctatgtgtgtgtgtgagagagagagaaagagagagagagagaagcacgtgtacatatgtgtgtccccatgtgtgtga

SEQ ID NO: 99053 - DNA, 68 bp, Mus musculus
gcacacagtctgtctctttctcatcaaggtgaggagtcttagacctggagaaagtagcagagcggtgc

SEQ ID NO: 99054 - DNA, 68 bp, Mus musculus
tatgcatgcatgtatatttgtatctatgtatgtatctatttatgtatctatctatatatgcatgtatg

SEQ ID NO: 99055 - DNA, 66 bp, Mus musculus
gtctggcaagcagtcagagcgagatcagctatgccatttgttttgctgtctgtctgactgacattg

SEQ ID NO: 99056 - DNA, 89 bp, Mus musculus
ggaacagtgccactcataacatgcaacagtctcagctgagctgaggtgtctcgggcagcactcactggtgtatgtggggtggtggtgcc

SEQ ID NO: 99057 - DNA, 76 bp, Mus musculus
gctgtgctctggctctgtgtggctctgcagccagcatttctaactgttctgcatggcatctaagccaagtaaaggc

SEQ ID NO: 99058 - DNA, 69 bp, Mus musculus
agagtctgactatatatatatatatatatatatatatatgtatatgtatatgtatatgtatatctatct

SEQ ID NO: 99059 - DNA, 89 bp, Mus musculus
gacgaccctcactgatgactgtgacctgagagcttaagttagaatgaactcttttctctccacgttacttttggccacaatggggtgtt

SEQ ID NO: 99060 - DNA, 107 bp, Mus musculus
ttgtgatctgtacggtgctgacttaacaaatctgggaccagggttgttggggcatgtttaggaggtgacctgattatcagggtctcagtcccagctacaggttggaa

SEQ ID NO: 99061 - DNA, 82 bp, Mus musculus
agggcgtcttgttcagccgctctggctctgtgagtctgtttgaaatatggtagacttgttcaaggtgctgaacaactgctgt

SEQ ID NO: 99062 - DNA, 115 bp, Mus musculus
ggataggcagagagcacagggtgggctgaagatctaaagagaatttgactgtggctcacactgactgtcatcctttgcttacagctgccagggaggcttggtaaggtgggctcag

SEQ ID NO: 99063 - DNA, 64 bp, Mus musculus
tgtacatgtgtgcatgcaagtgcatgtgtgcaggtacacatgcacacacacacacacacacaca

SEQ ID NO: 99064 - DNA, 92 bp, Mus musculus
tgcttacaaattggactctggggctggagagatggctcagcagttaagaactctgactgctcttccagaggtcatgagttcaattcccagca

SEQ ID NO: 99065 - DNA, 77 bp, Mus musculus
cacaggcaagaatgcagaaacgtcaacggctttgagtatgactacatgtacttggccctgcacactctctctctgtg

SEQ ID NO: 99066 - DNA, 113 bp, Mus musculus
agagagagtcatgaatcgcttgggttcaggctgatggtttctgttcactgtgtatttctctgtgtgtttgggcagggtttgagggacctggtgtgaagcgtgactctagctct

SEQ ID NO: 99067 - DNA, 66 bp, Mus musculus
ctgtcagagcagagtgtgcactcgggctcgcaccaaacgtgcgctgatgtaggctctttcccttag

SEQ ID NO: 99068 - DNA, 80 bp, Mus musculus
gtgtgtgactctgtgtgtgtgcacatgtgtgtgcatataagcatgtatatgtatttgggaacacacactaggctatacat

SEQ ID NO: 99069 - DNA, 83 bp, Mus musculus
gtgtgtatacatatatatatgaaacatatattacataattatataattatatacatgtgtgtgtgtatatgtatatatacata

SEQ ID NO: 99070 - DNA, 78 bp, Mus musculus
ctgattaggttggggcatgctcctgacctctgaggacaaattctgagtgaggagacagagcagcctgggtctagtggg

SEQ ID NO: 99071 - DNA, 108 bp, Mus musculus
gcctggtgacataatgctgcattgctgtcatgtggggattgctgtttggtgaagtgcacatgtatgcgagagagtcatcccgggtctcggcagtggggagtagaaggt

SEQ ID NO: 99072 - DNA, 64 bp, Mus musculus
gggctgacagccgcggacatcactgggaggaaatcctctgtgaagagagactgctgtgtggctc

SEQ ID NO: 99073 - DNA, 82 bp, Mus musculus
cctgctgggtcctggctacctatgtcacacagatgagtgagtccacctgccttccattctctgagcttgtggtcacagcagg

SEQ ID NO: 99074 - DNA, 119 bp, Mus musculus
tggaataaaatgttttgcatatgggaattaattctgccacatagctggtgatgtacagcggttctctcactgactgactgccatgttgttcgaatcctatttatagcaaaatgtctcca

SEQ ID NO: 99075 - DNA, 100 bp, Mus musculus
gttgtcctttcttccaaatgtctacccttgagagtaggaagtaaacttttcaaagacgctcttgatgttttctgggttagagtttgggcgagagtgaagc

SEQ ID NO: 99076 - DNA, 109 bp, Mus musculus
agccacatctccagtgtgtccttgtgaatcatggatgttgcttgttaagttgaaggaattgagctctgaaggtcaagcagttcccatgctctgggcatagaggaaggtt

SEQ ID NO: 99077 - DNA, 68 bp, Mus musculus
tgatggctctttaagactcggtgctgactgagagcacagacctttgacagtagcacttctagccatta

SEQ ID NO: 99078 - DNA, 65 bp, Mus musculus
ccgtggagaactgtgcaaggtacactgagggctaagagcactgtgtgtgcacacaggcttgttgg

SEQ ID NO: 99079 - DNA, 109 bp, Mus musculus
agacaacaggagagaaaagcccctgttcatgctgtgaccctctctggctcccagcgctggggggggggggggggggagcacaactgagagttcaagactcctgttgact

SEQ ID NO: 99080 - DNA, 83 bp, Mus musculus
ggtgcttagctatagagaatcaacaacaaaagcaaccactgtcacatgagaggttaaggttgtagcttggttagcagagcacc

SEQ ID NO: 99081 - DNA, 81 bp, Mus musculus
tggtttccatttctctgtcacagtcagtcattgagggaattcagggcaggaactcagacaggaacttagaggcaggaaccg

SEQ ID NO: 99082 - DNA, 83 bp, Mus musculus
ggctgctagaatggagggacacagcacataaaacccatcaggtctattattctgcttctatgtctgtctgtctgtctgtagtc

SEQ ID NO: 99083 - DNA, 103 bp, Mus musculus
tggcattgttaagaaaatgaaaagccagggctggagagatggctcagtagttaggagcactgactgctcttccagaggtcctgtgttcaattcctagcaccca

SEQ ID NO: 99084 - DNA, 120 bp, Mus musculus
ggactgactgacaggccggcaagcaggtagtgctatgtcacacacactcagactgacttgacaggccggcaagcaggtagtgctgtgctcacacacactcagactgactgacaggccggc

SEQ ID NO: 99085 - DNA, 66 bp, Mus musculus
tgtctacaggtctgcactgtgtattttttttttcaaaaggatatatcttgtgtgccgctgtgggca

SEQ ID NO: 99086 - DNA, 120 bp, Mus musculus
cctgtctgtctgtctgtctccgtctcccccctcccccgacacacactcacacacacacacacacactcacacacacacacacacacacacacagagagagagagagagagagagagaagg

SEQ ID NO: 99087 - DNA, 65 bp, Mus musculus
aagacagtcacactgtcagactccctgcaagaagacagaagctgacaggagtagatgactttctt

SEQ ID NO: 99088 - DNA, 72 bp, Mus musculus
tatgtggatggtccatgtatgtatgtatgtatgtatgtatgtatgtatgtatgtgagtgaagtgtccatgta

SEQ ID NO: 99089 - DNA, 122 bp, Mus musculus
ctctaggatcccttgggctgggttgtctttcaggtttcggtaaacggagtctctcagtagtgagtgagaagcgtacagactcctataggaagccagctgagcctgcaccacggagagctttg

SEQ ID NO: 99090 - DNA, 83 bp, Mus musculus
gccttgtgagctatccttagaataagatgtggcaaagggtatgtgcctatgtgtctgagtgtctgtgggtggagtgtgtaggt

SEQ ID NO: 99091 - DNA, 93 bp, Mus musculus
gatgtatgtatgtatgtatgtatgtatgtatgtattgactggctgtgtttgtgagtgtgcatggtctatgtgcacatctatgtgacgtgcatt

SEQ ID NO: 99092 - DNA, 114 bp, Mus musculus
gccagatggggaagggtctctaaaatgattggtccacaacagacagaacacagagagatgtaaatgactgtgttctcagtggacagtgggtaaaagaaattgtttcacacttgt

SEQ ID NO: 99093 - DNA, 90 bp, Mus musculus
ggtcctggctgaagctgacttgtgtctgggtctggctagaaacacgtgaacccttgtgcagctcgaggcctggttggtagtggaggggct

SEQ ID NO: 99094 - DNA, 74 bp, Mus musculus
ccagagtgtttatgtgtgtgtgcgtgtgtatgtatgtatgtatgtatgtatgtatgtatgtgtgaaattgttgg

SEQ ID NO: 99095 - DNA, 85 bp, Mus musculus
gctgtggctgtgaccccagttctgtgggagaggaagacaggtaggtctcaggcactcactgactagtcaatcagtcagctccagt

SEQ ID NO: 99096 - DNA, 108 bp, Mus musculus
agtcccagagttaatcccttagcttctgcgtctgtctgtctgtctcggtaacttttccctggcgtctgtcacagtgcaggctgacctcagaggcttcttatggtgact

SEQ ID NO: 99097 - DNA, 56 bp, Mus musculus
ctgaactgctgaactgtgttctcccggtgagtggagagagaagtctcagaggacag

SEQ ID NO: 99098 - DNA, 79 bp, Mus musculus
cagctggggtgtctgtctctgttaccgtcatctgaggagccctgctttctctgtgtgtgacatccaacttttctagctg

SEQ ID NO: 99099 - DNA, 113 bp, Mus musculus
aggaggaaatttaaacattgttctttctccatcttttctgcacgctctatcttttaattttttgaaaactaaagacagacaagaggattcagaggacttggaaatggctgcct

SEQ ID NO: 99100 - DNA, 66 bp, Mus musculus
ctctctccacagggaatgggaatccaggctcctgttgcctgctgactcctctttctgtgctgaggg

SEQ ID NO: 99101 - DNA, 75 bp, Mus musculus
ttagatacgctgaagaaagggaagctcccgcggctcgtgcctgtgtcgctctatccttctgaagctgggatttaa

SEQ ID NO: 99102 - DNA, 114 bp, Mus musculus
atatgcatatgtatatcatatatgacacatacgtatgtgtatatgtatgtatgtgtatatgtatatgataaatatgtgtgtatgtgcatgatatatatgtatatatgtgtatgt

SEQ ID NO: 99103 - DNA, 117 bp, Mus musculus
tgtatggatcctgtcttttgttctctctcagccacagcgagtgatcagtctagctgtaaaattagcttctgactgcttgtgtgcaaaatacagctgtgagaaagagtgatatgtaca

SEQ ID NO: 99104 - DNA, 62 bp, Mus musculus
tgtatgtatgtatgtatgtatgtatatacatctatgtatatatatatatatatatatatacg

SEQ ID NO: 99105 - DNA, 106 bp, Mus musculus
cagaaagatgcagagagcccctgataaactccaaggtgatcttcaagcttgaatagcgtgaatatccctggtggcatttgaagtaaggccgtgtgaatctaccatg

SEQ ID NO: 99106 - DNA, 59 bp, Mus musculus
gtgtgacactaacagtctctgtatgtcggattcagggcatgcgctgctacagtgtgcac

SEQ ID NO: 99107 - DNA, 103 bp, Mus musculus
tgctcagtagatggattgattgttcttgctggcttctgagaagagactcattgagtatgaagaaggaagaattggaatagttgaattggaagtttaaggagga

SEQ ID NO: 99108 - DNA, 105 bp, Mus musculus
caccctcccatccatccatccatccattgtatatatgtatagtatgtatgtatgtatgtatgtatgtatgtatgtatgtatgtgcatggatatgagtgtgcatgg

SEQ ID NO: 99109 - DNA, 93 bp, Mus musculus
gtatgtccgtccatctcttctgtctcagacactctgacagcattacaatcttgcagagcctcattccttccaaggcaaagagaggtgactcac

SEQ ID NO: 99110 - DNA, 76 bp, Mus musculus
gccctagaagatcatggcttccttagacctggatgtttacgatgacccccagtctctgcctttctctctctggggt

SEQ ID NO: 99111 - DNA, 103 bp, Mus musculus
ctatagtaaaaggtaggagacaaggggctggagaaatggctgagcttaagagcaatgtctgctcttccagaggtcctgagttcaattcctatcgaccatatgg

SEQ ID NO: 99112 - DNA, 71 bp, Mus musculus
tatatataatatacacacatatatatacatatatatatacacatgtgtatgtgtgtgtgtatatatatata

SEQ ID NO: 99113 - DNA, 98 bp, Mus musculus
atatacacacatatacatacacacacatatatacatatatatatatacacacatatatgtgtgtgtatgtatatatgtgtgtatatatatatgtatgt

SEQ ID NO: 99114 - DNA, 94 bp, Mus musculus
gcttcgctgaggatcctgtctgagtcactcagtgcatgaaagacataattgcaagcaggtaacatcagaggccacccagagtcctcagagatgc

SEQ ID NO: 99115 - DNA, 111 bp, Mus musculus
gcgtgggtatgggtgtgtatgtgggggggggggctaagggagacagacagacagagacagatttgctattgaacctggagctgaccgactcagttggaatggctgtctagc

SEQ ID NO: 99116 - DNA, 75 bp, Mus musculus
ggagaggttgttaggggtcttggctctggtaacatgatagtgtctttatcactgggaccctctatgactctttcc

SEQ ID NO: 99117 - DNA, 109 bp, Mus musculus
cacaagttttatatatatatatatacacacacatgcatatatatacatatgtgtgtgtgtatatatatgtgtgtatgtatatgtgtgtatatacatatacatatgaaac

SEQ ID NO: 99118 - DNA, 117 bp, Mus musculus
cactgcagccgacagttgaggtttgggggacatattccattctcctcagggttatttgtgtggcttcaggagagttaagttctgtgaaaatattaaacatttttaggcgtaaaagtg

SEQ ID NO: 99119 - DNA, 100 bp, Mus musculus
ccagatttctcagaggctatgttcatcatctgtgtgagtttccaaaggaatagtaattttatttctaaattatggtggtgaagaagcctgtctactatgg

SEQ ID NO: 99120 - DNA, 97 bp, Mus musculus
tccgggaccacattctcacagtgtctccctgtgtctcaccttcctgtctgctcgggaaggctggggtataaggagtccgtacagagttgaacttggg

SEQ ID NO: 99121 - DNA, 74 bp, Mus musculus
gtgcaccggtgtatgcgtgtatgtgtgtgtatgagtgtgtatgtatgtgtatgtatgtatgtatgtgtgtgcat

SEQ ID NO: 99122 - DNA, 75 bp, Mus musculus
tggaactctctctgtagaccaggctggcttcaaattcacagagatcagtctgtctctgcctccagagtactgcca

SEQ ID NO: 99123 - DNA, 94 bp, Mus musculus
tgtagggtgagggatgggactcttttgtcgatctggacatgtagatacccagtttctgcagcaccaagtgaagagggtccctttctttaatgca

SEQ ID NO: 99124 - DNA, 112 bp, Mus musculus
ctctgggttatagtgtttgtacaaacatgaatgaatgaatgaatgaatgaatgaatgcattctaagttcttcaagcagatgattgtcttagggcaaagaggccaaggtagag

SEQ ID NO: 99125 - DNA, 62 bp, Mus musculus
gtgtatgtatgtgtatacctgagtatatatatatatatccatgtagcacatgcatgtatcac

SEQ ID NO: 99126 - DNA, 66 bp, Mus musculus
gtgtgtttatatgtatatgcattggctgcactatgcagacctgtgtatatatgtatatgtatgtgc

SEQ ID NO: 99127 - DNA, 56 bp, Mus musculus
gtgtgtgcatgtgtgcacatgtgcatgtgtctgtgtgtgtgtctatgtgcatgtgt

SEQ ID NO: 99128 - DNA, 74 bp, Mus musculus
gtgtgcttcagagaacatagggaaggcctgcgtttcagtgcttggccttagtctctcagtttctctaatgtcat

SEQ ID NO: 99129 - DNA, 71 bp, Mus musculus
cagtggagcagagtatctactgtttacatctgtcattgatgtgagagctcagactcactctgtatcaattg

SEQ ID NO: 99130 - DNA, 87 bp, Mus musculus
ctgagtgacaaggtaatcaggactaggaggcagcagggtgtgtgcagcccctgtgcatgtagcttgtttgctaattgccaacaccag

SEQ ID NO: 99131 - DNA, 117 bp, Mus musculus
tggtgggagggctttgtgaattgttaatctgtctctcagttgctgggagggcttggtaaactgttactctgtctctcagttgctgggagggctttgcaaattgttactctgtctcta

SEQ ID NO: 99132 - DNA, 64 bp, Mus musculus
cagagggcttgctccacacactctgggtctcacccccaaagaactgatggggcagtttcctctg

SEQ ID NO: 99133 - DNA, 101 bp, Mus musculus
ctgctactgctgctggtaatgactgatgataatgatgatgatggtggtgataatgatgatggcagtgatagtgatgatcatgatgatggtggtggtggtgg

SEQ ID NO: 99134 - DNA, 83 bp, Mus musculus
agccaacatgtttttatgttttcatcagagcctccacaccctgatggaatttctgcatgtcagggagaagcatgagaggggct

SEQ ID NO: 99135 - DNA, 64 bp, Mus musculus
cgggtgggggacaatgaagaactagtggcttcttagcctcctcagttctttgtctctcagcctg

SEQ ID NO: 99136 - DNA, 74 bp, Mus musculus
tattcagatgctcctgtggtagaggagatagggagttactctctcccagtcacagacttcaagggacctggatg

SEQ ID NO: 99137 - DNA, 86 bp, Mus musculus
cagacagccagacccaaggcaaaggtatgtacagctgtgcaccctactctcagctgtgtgtgtgcctgtctgtctgtctgtctgtc

SEQ ID NO: 99138 - DNA, 97 bp, Mus musculus
tttgtgtgcttatgaatatgtgtgtatatatatatgtatatgtgtatgtgtgtatacatgtgtgtggaggtatatgtacatgtatatgtagcccaga

SEQ ID NO: 99139 - DNA, 126 bp, Mus musculus
tacatatacacacatacacatatatatgtgtatatatatgcacacacatatatatgtatatatatgtatatgtgtgtatatatatatatatatatatgtgtgtgtgtgtgtgtgtgtgtgtgtgtg

SEQ ID NO: 99140 - DNA, 104 bp, Mus musculus
gagccttgagcctttcatgaggagagaagagagacagctctctggagctctgagctctctctctctctctctctctctctctctctggatggaagccagtgctt

SEQ ID NO: 99141 - DNA, 57 bp, Mus musculus
atatgtatgtatgtgtaggtatgtatctatcatatatatgtatatatgtgtatgtgt

SEQ ID NO: 99142 - DNA, 73 bp, Mus musculus
gtccatctgtctgtctgtctgtgtgcatgtgcacatgtgccagggtgtgtatggggtgcaggtagcagaggat

SEQ ID NO: 99143 - DNA, 82 bp, Mus musculus
tctctttattctgtagtcagcacattgggcaccataaattcttcatgtgggaagggtgatgctgattgtatggtgagtggga

SEQ ID NO: 99144 - DNA, 94 bp, Mus musculus
tctgtaacagggacttgtgagtagagactgaggaccctagaggctagcgtagaccttggtattttagtaggtatcacaggcttaggttaatgga

SEQ ID NO: 99145 - DNA, 73 bp, Mus musculus
tgtccatttcccatgtacctcacattgggcattgctctgtctctgtgtgtgttcatagcactgaaatgggtca

SEQ ID NO: 99146 - DNA, 116 bp, Mus musculus
ttgtagcgacaagaacataatgaggggactgaagacgtggctcagcagttaagagcactgactgctcttccagaggtccagagttcaaatcccagcaaccacatggtggctcacaa

SEQ ID NO: 99147 - DNA, 59 bp, Mus musculus
gccaagggattggggaagcggggtcaccaaccaggtctgtgtctccctcagtcttccgc

SEQ ID NO: 99148 - DNA, 82 bp, Mus musculus
ctgggtcctggattctttccccagcacgcaacacttgcataaacctgctgtggtggtgtgtgtctgtaatctcagaactcag

SEQ ID NO: 99149 - DNA, 74 bp, Mus musculus
gaaaagaaaagagaaaatccagtcgagagaaggcccgacaagggaagatctgtttggatatcttcatttttttc

SEQ ID NO: 99150 - DNA, 76 bp, Mus musculus
ggtgtgcatgtcatgtgcatgtatatatgtatatgtctgtgtctatgtgtttgtatctgtgtatggtatgtgtgtt

SEQ ID NO: 99151 - DNA, 80 bp, Mus musculus
gagtatgggtcaaacacattttcattacagctgagctagggaaacagactgtagtttggagattggaatggctaatactt

SEQ ID NO: 99152 - DNA, 151 bp, Mus musculus
tacatatgtatgtatgtgtatgtatgtgtgtatgtctatttgtgtatgtgtgtaagtctatctatgtatgtatatatatgcatgtatatatatacatatgtgtgtatatgtgtatccatgtgtatgcatatgtatatgtgtgtatatatgt

SEQ ID NO: 99153 - DNA, 58 bp, Mus musculus
gtgtatgtatgtgtatatgtgtatgtgagtgtatatgtgtatgtatatgtatatatac

SEQ ID NO: 99154 - DNA, 74 bp, Mus musculus
gccttactaaagtgtccagggaggtcttgaacttgtgatcatgttgtctcagcctccctgagtgcctgactggc

SEQ ID NO: 99155 - DNA, 102 bp, Mus musculus
ggaaggaaggaaggaaggaaggaaggaagaaaggcaggctgcagaggtgtctcagtggttaagagcactgactgctcttccagaggtcctgagttcaattcc

SEQ ID NO: 99156 - DNA, 102 bp, Mus musculus
gcacacacagagtcatggtaggtgacacctaatttctgtctctgtcagttggctcatttgtagctgatttacctcagatcatagaccaaaaggctctgttgc

SEQ ID NO: 99157 - DNA, 155 bp, Mus musculus
gtgtatgtatttatgtctgcatgtgtatgtatgtgtgtctgagtgtctctgtgtgtgtatatatatatatatatactcagacatatatatatatatagtttctgagtgtgtatgtgtatatgtgatttatgtgtgtatatatctatgtgtatgta

SEQ ID NO: 99158 - DNA, 67 bp, Mus musculus
ggagcaggtgtggggtagcggaactaaggggtgtgaagggagaccctctgtggctgtgagcagctct

SEQ ID NO: 99159 - DNA, 87 bp, Mus musculus
acatgtatacatatatacatacgtatatatacatatatacatatacatgtatgtatatgtgtatgtatgtatatatgtatatatgta

SEQ ID NO: 99160 - DNA, 88 bp, Mus musculus
gtgcaggcatgtatgcatgtgtataagacatgtgtgtgcatgtgcatgtgtataaggcatgtgtgtacatgtgcatgtgtgtgtgtgt

SEQ ID NO: 99161 - DNA, 66 bp, Mus musculus
gtctgtctgtctctgactgtctatgcatgtgagtaatggtgcccatgcaggccagaggcatcagat

SEQ ID NO: 99162 - DNA, 85 bp, Mus musculus; identical to SEQ ID NO: 57439

SEQ ID NO: 99163 - DNA, 103 bp, Mus musculus
tgctatttgttggggattatcttgaacacaattctcagcctgtttctctgtggccagagaaatgggtcattgaatgtgtcacctgaataccacctagcttgca

SEQ ID NO: 99164 - DNA, 85 bp, Mus musculus
gacttgatgaagggagtgtgttttcagtggcaggctttgagattaaatgtcttgtgtcactttcagtgtgctccctctgtttgtc

SEQ ID NO: 99165 - DNA, 84 bp, Mus musculus
tgggaattgaactcaggacctctggaagatcagtcagtgctcttaacctccgagccatctctctagctctctgagatattccta

SEQ ID NO: 99166 - DNA, 85 bp, Mus musculus; identical to SEQ ID NO: 57439

SEQ ID NO: 99167 - DNA, 107 bp, Mus musculus
actcatgtacacactcacacatatacacatctctctcacacagacacatttacacacagataatgataaaaatgagagaggaggaggttagtaagttgagacagggt

SEQ ID NO: 99168 - DNA, 62 bp, Mus musculus
gcattcttgctatcaatgagatgggcgtagccagggtcccaggctcgctctttggcaggagc

SEQ ID NO: 99169 - DNA, 86 bp, Mus musculus
agagccctacgctgaaatctactggccttgagagaagcagaaaggcccagtgtctctctgtctctggcccctagcacctctcctct

SEQ ID NO: 99170 - DNA, 97 bp, Mus musculus
gacctttgttctgcttttgtatgtgtctctctgtgtgttcatccttgtttgtatgtgggttcacatatgtgtgtgcatgcacatgtttgctgaggtc

SEQ ID NO: 99171 - DNA, 60 bp, Mus musculus
gtatgtatgtatgtatgtacatacatatgtatctatgtatgtgtgtatgtacatatgtat

SEQ ID NO: 99172 - DNA, 93 bp, Mus musculus
ttggcttggcaggactccaagggagggtatgatagacatgagattaagaagttttgttttgctttactattcttgagggttgagtgaaaacaa

SEQ ID NO: 99173 - DNA, 62 bp, Mus musculus
agagagagagagagagagagagagagagggtgtctgtctgtctgtctgtctgtctgtctgtc

SEQ ID NO: 99174 - DNA, 85 bp, Mus musculus; identical to SEQ ID NO: 57439

SEQ ID NO: 99175 - DNA, 91 bp, Mus musculus
taagggtccattgaatcaggtttccactggagcaatggtgcagattctcactgcaagtggatctgaatgctttgagcaatgggtaacttga

SEQ ID NO: 99176 - DNA, 116 bp, Mus musculus
aaagtggaaagtatcccttctttttctgttatctagaaatcccatgtaaaacaagtattttcttttaatatatgaaattttcatagcaaaaattatcagggtcatgagtttgcttt

SEQ ID NO: 99177 - DNA, 104 bp, Mus musculus
ggagttataaatatagatgtacattttatgtgtgtgtgcatgtgcatgagtaaatgcacatgtgttcatgtgcatgtagaacaccatccatcttttattgggac

SEQ ID NO: 99178 - DNA, 75 bp, Mus musculus
tgcatgtgcagagtgtctgtccctcatggtttttcttcttctgactttttttcagacagtccatctgcttgtgca

SEQ ID NO: 99179 - DNA, 84 bp, Mus musculus
cagggatattgttgtttttctggatttttgatcccatgaaattcagtttggtctcagaattgtttagaagaatgtccatccctg

SEQ ID NO: 99180 - DNA, 65 bp, Mus musculus
tttggccaagggatgctggggactacagagtcatgtagccttcctgggtctctctgtgtgtgaaa

SEQ ID NO: 99181 - DNA, 115 bp, Mus musculus
gtgaagatctggtgatagaatgtagtaaggttccctccatggtgtctgaccgtattttttttttttaagaattaaatttgggggactggagagatggctcagtggttaagagcac

SEQ ID NO: 99182 - DNA, 87 bp, Mus musculus
gaaatcattgtgtgggccggggagatggccagcagttaagagcactgactgctcttccagaggtccagagttcaattcaatggtatc

SEQ ID NO: 99183 - DNA, 74 bp, Mus musculus
ctgtgcgtgcatgtgtgtgtgtgcatatgcatgtaaatgtgtgtgtgtgtgtgtgtgtgtgtatgtatgtatgg

SEQ ID NO: 99184 - DNA, 81 bp, Mus musculus
cctgaccaaagcgctctaagcttttccctgatggtgaccagttttaggtcaggaatgagatagtagagagccaggagcagg

SEQ ID NO: 99185 - DNA, 110 bp, Mus musculus
gtggctcccaccctctgtaacagcaactccatgtggaagtgcccactggttccagtggggctgctgttatctggggtggcggctagtaccagcagaggaagaggagccac

SEQ ID NO: 99186 - DNA, 115 bp, Mus musculus
ggctgccaagatggcgtgcacagggctctgacctatgaattgacagccagtactcttttctctcctctggctgccaattccataggtcacaggtatgttcacctcaatgccagcc

SEQ ID NO: 99187 - DNA, 68 bp, Mus musculus
gtgatgtcacactgtgctgagtggtcacactgtgtccacaaggggtcagatgcagtgactgacgtcac

SEQ ID NO: 99188 - DNA, 85 bp, Mus musculus; identical to SEQ ID NO: 57470

SEQ ID NO: 99189 - DNA, 79 bp, Mus musculus
gctagtgtgtcactctctgcgtcacatctccagggaccagtggttttgtgtaggaagggcgcggaggctatgctttggt

SEQ ID NO: 99190 - DNA, 137 bp, Mus musculus
gctgctgattgctgctgcttattgtcactgcgctgttcggggcacagagctggcgggtttctctgtgcctgtgtcactgtgctgagtgagctgttaagtataaactagtagcatgctttggctgagcatctgtgcat

SEQ ID NO: 99191 - DNA, 73 bp, Mus musculus
cttggacttcaccatctccttcttggcattagcacctgtgatcttgccgttgacaggagacagtgtgtagaag

SEQ ID NO: 99192 - DNA, 114 bp, Mus musculus
catggaggccatcagtttgtgagagggaggccttgctgtccctcagtgtctctgtcagaaacagtcattgagactcgcacacaggacaactccacctcagccaggcattctgtg

SEQ ID NO: 99193 - DNA, 78 bp, Mus musculus
atacacacacacacacacatatacacatacacacacatatataaatatgtgtgtatgtatatgtatgtatatatgtat

SEQ ID NO: 99194 - DNA, 126 bp, Mus musculus
tgtatatgtatatgtatatgtatatgtatatgtatatagacatggacatatatatatacatatatacatacatatacatacacacatatttatatatgtgtgtgtatgtgtatatgtgtgtgtgtg

SEQ ID NO: 99195 - DNA, 103 bp, Mus musculus
gcaagtaagcggctatgggtctaggcatctctaggtgttctggaagctctaagcatgcacgcgagacactcagtggctctgatacatagcatgcttcatgggc

SEQ ID NO: 99196 - DNA, 60 bp, Mus musculus
gctctgtagcacgccaccaccctggagtgctgaccactgggtggctggctctctgtgagt

SEQ ID NO: 99197 - DNA, 86 bp, Mus musculus
tacgtatgtatgtatgcatttgtgtgtatgtatgtatgtatgtatgtatgtatgtatgtatgtatttgtgtatgtgtgtgtatgtg

SEQ ID NO: 99198 - DNA, 80 bp, Mus musculus
acatgtatataggcatatatacacatgtatgcatgtatatgtatgtatgcatgtatagttgtatgtatgtgggcatgtac

SEQ ID NO: 99199 - DNA, 90 bp, Mus musculus
gagagagagagagagagagagagagagagactgggggtagagaaaagctctcccttcatagtccaagctgactttagactctcagttctt

SEQ ID NO: 99200 - DNA, 74 bp, Mus musculus
gagccatctcaccagccccccacttttgatttttattaaatcaagtagttgggatctgtattgtgggtctgttc

SEQ ID NO: 99201 - DNA, 104 bp, Mus musculus
ctggatgctgtccctgagacccagatgtatgtatgtgtgtatgtatgtatgtatgtatgcatgcatgtgtttattatttattttggagttagggacttatgtag

SEQ ID NO: 99202 - DNA, 112 bp, Mus musculus
gtagccctggtggtaaggcaggggcatgctggaaaggagactcactctgtccctgatccggggatctcatgaccttccctccctaaccatgccccaagtcctccagctccgc

SEQ ID NO: 99203 - DNA, 115 bp, Mus musculus
cacagcccagtggaccttggtgcagatagtcaggagaggtaggactagggtgagctgactgtgcacacagagatggcacacagagaaggtccatagctctggcaggtctgacact

SEQ ID NO: 99204 - DNA, 79 bp, Mus musculus
gccatgtcagcctctggcctcacactcagacacagagtatgcgtaacgtagcctctctgagccaggcttactgctgggc

SEQ ID NO: 99205 - DNA, 98 bp, Mus musculus
gtttggattctttctaattcctaatacaatgcaaatgctatgtaaattcctgttacactgtattgtttatggaataatgacaagaaaaaagtccttgc

SEQ ID NO: 99206 - DNA, 90 bp, Mus musculus
tagatgaggtaaacatgacacacacacagacacaggtttcacccttgaaatgtcactgtttggtgtctcgtgtttcatttactcagtctg

SEQ ID NO: 99207 - DNA, 111 bp, Mus musculus
gctgatgatgacactgggacccttggaggcattattgtccatctgcctgcctgagacagacccactctggcatcttgttcctttgccttcaaccccactccagtgaaaggc

SEQ ID NO: 99208 - DNA, 90 bp, Mus musculus
tccatccttagagtctctctgtgtctgtatctccccctctcctgtgctggggattgaacctcaggcccaagttgctttctttagtgtggg

SEQ ID NO: 99209 - DNA, 72 bp, Mus musculus
gatcagaaagggctaaggtggtctggtggaagttctgtgttggacccaatcccctttgtctctctgtctgtc

SEQ ID NO: 99210 - DNA, 96 bp, Mus musculus
gaagaaaataaggtgggaagtggctgagaaagagaaagttgtcaaatccaactcctctatacacacacacacagtcacaatgtactaatttttttc

SEQ ID NO: 99211 - DNA, 92 bp, Mus musculus
gggaagcaactgagtctctgaccctctggggagtccccaccacagccaggtgctccacacagtctctttctcactcaactgactcaggtccc

SEQ ID NO: 99212 - DNA, 125 bp, Mus musculus
gtagcgcaggccttaatcctagcactcaggaggcagaaacaggcagatctctgtgagctcagagccagcctggcctacagagcaagttccaggacagccaacggtacacagagaaatcctgtctg

SEQ ID NO: 99213 - DNA, 94 bp, Mus musculus
gcgaccacagtcagagctcttgagcttctgcagggtcataacgacagttgttgacacttgtgagtgagtccagcttagctgctctgcaggtagc

SEQ ID NO: 99214 - DNA, 85 bp, Mus musculus; identical to SEQ ID NO: 57439

SEQ ID NO: 99215 - DNA, 80 bp, Mus musculus
gatgtctctgtgacagtctcagaggatctggtgagcccctaggcttttctgtcctggaggagtggaagtcagagagtgtc

SEQ ID NO: 99216 - DNA, 86 bp, Mus musculus
tatatgcatatgtatgtatgtttgtatgtacatatatatgcacatgtacatgtatacacatacatacacatatacatgtgtatata

SEQ ID NO: 99217 - DNA, 140 bp, Mus musculus
cctgtgaacctaaagtgggagtcaggggagacagtttgacaagcagggaggagagcagtctgtctgcctgtctgtctgtctaccaaggggaagctggaggtggagcagtcagggaggtagatgctacctcacttgtcaaa

SEQ ID NO: 99218 - DNA, 90 bp, Mus musculus
taccgtaggggctggagagatggctcagcggttaagagcactgactgctcttccaaaagtcctgagttcaaatgcagcgaccacttggtg

SEQ ID NO: 99219 - DNA, 85 bp, Mus musculus
atatacatacatacacacacatatgcattatatacatatatttatgtatatacacacacacatacgtgtgtgtgtgtgtgtgtgt

SEQ ID NO: 99220 - DNA, 87 bp, Mus musculus
gggaggctcctcacatctcccccttttcttttacttaaaaggcaacaggccacccagtactgagagtggagatagaggtcaaatccc

SEQ ID NO: 99221 - DNA, 99 bp, Mus musculus
ggctcactggctcactggctcactggctcactggctcacaggaatgacaggttccagtaagagacagcaaggccaggaaacaccagagataaccagatg

SEQ ID NO: 99222 - DNA, 80 bp, Mus musculus
cctgattcaactttggtacctggtatctgtctgtaatttttttcatttcatccagattttagagatttgttgaatacagg

SEQ ID NO: 99223 - DNA, 85 bp, Mus musculus; identical to SEQ ID NO: 57470

SEQ ID NO: 99224 - DNA, 114 bp, Mus musculus
ggtgattatttttggatagaccattgtcatttgagtgctcatagaaaggtcatcatgttgttgttcctcctatgggcctacaaactccttcaatatgaactaaccagtatctcc

SEQ ID NO: 99225 - DNA, 76 bp, Mus musculus
gagaacttttcctgtaggggccagagagaataaagcagggcgtcccccaatttctctctgtctctgggagagtttc

SEQ ID NO: 99226 - DNA, 82 bp, Mus musculus
gtgcctgggactgtttatggcactccaagatagctacaaaatgtttgatggcttcctgggactgttaggtcagggctggcac

SEQ ID NO: 99227 - DNA, 85 bp, Mus musculus
gtccatggtgatctcacaggatgcatgggataatttcaatatttttgaatctgttaaggcctgttttgtgactgattatatggtc

SEQ ID NO: 99228 - DNA, 73 bp, Mus musculus
gaacttctgctgtagagccagagagaataaaacagggcgtgccctgatttctctctgtctctgggagagtttc

SEQ ID NO: 99229 - DNA, 76 bp, Mus musculus; identical to SEQ ID NO: 99225

SEQ ID NO: 99230 - DNA, 114 bp, Mus musculus; identical to SEQ ID NO: 99224

SEQ ID NO: 99231 - DNA, 80 bp, Mus musculus; identical to SEQ ID NO: 99222

SEQ ID NO: 99232 - DNA, 106 bp, Mus musculus
gctctgtagtccggcttcaattcagggatggtgatacctccataaattgttttattttacaagattgttttatctatcctagttttttggggggtgggggcagggt

SEQ ID NO: 99233 - DNA, 99 bp, Mus musculus; identical to SEQ ID NO: 99221

SEQ ID NO: 99234 - DNA, 88 bp, Mus musculus
gggcggctcctcacatctcccccttttcttttatttaaaaggcaacaggccacccagtactgagagtggagatagaggtcaaatcccc

SEQ ID NO: 99235 - DNA, 71 bp, Mus musculus
gagatggatgccaaggtggagcagtctctggatggcctttccttcagtctctgcttgacactctgtctcta

SEQ ID NO: 99236 - DNA, 81 bp, Mus musculus; identical to SEQ ID NO: 63288

SEQ ID NO: 99237 - DNA, 117 bp, Mus musculus
cagatgctagagttaacagagcaatgtggataatattcaagatgtgatatttgtagaatgtttgaatgtatttcataatgttctcaagatagtaatgaagggtgtttaccatgcctg

SEQ ID NO: 99238 - DNA, 101 bp, Mus musculus
gggctacctaggaccttggcctcaggaatcctggaggagtgggtgcttgaggccattgttggtgtctgtacagactgtgcagctgggcttcatagcctcac

SEQ ID NO: 99239 - DNA, 96 bp, Mus musculus
attgaagctgagtgtgaaggtggctcctgggtagagacaggaggatagggagtctgtctcagtcagagagtaagttcatactgcacatagttcaat

SEQ ID NO: 99240 - DNA, 66 bp, Mus musculus
gcccagtctgtctgtctgtctgtttggggcagtggagcccctgaaagtgaggttagatagctaggc

SEQ ID NO: 99241 - DNA, 141 bp, Mus musculus
catgggctgtgacagtggctgtgactatgacaggggctgtgactgtgacagtggctgtgactgtggttgtgactgttcagaggggttgtgcctgtggctatgacaggggctgtgactgtggctgtgactatgacaggggct

SEQ ID NO: 99242 - DNA, 97 bp, Mus musculus
ctgtgactgtggctgtgattatgacagggactgtgactataacaggggctgtgactgtggctgtgactatgacaggggctgtgactgtgaccggggc

SEQ ID NO: 99243 - DNA, 61 bp, Mus musculus
gctctgtcactgtcactcacctgtgaagatttcatcacttgagtgactctcaccacagagt

SEQ ID NO: 99244 - DNA, 112 bp, Mus musculus
ctggatttctgttggcgggggcagttcttcttgtccatctcactctctgtctctcccctacaggggtttctagaaaatgagatttgttagagttgcccaaggatgggtggga

SEQ ID NO: 99245 - DNA, 118 bp, Mus musculus
actatccccagtgctcttttgggggcctttgttacccactgactgatagctgtaacctctgagttactcacacagtcagatctcagcacatctctagaatggcctgaatgggagatgt

SEQ ID NO: 99246 - DNA, 60 bp, Mus musculus
ggtagcagagagaggtgactgagcaaggatgcacctaaattagtttgcctctcctgtgcc

SEQ ID NO: 99247 - DNA, 94 bp, Mus musculus
gccatctcaccagccctgtgactgggttttttgtgagcaatgttctgtccccttaaaagcctgtcatcgagtcaggggcaaaaggcaaggtagc

SEQ ID NO: 99248 - DNA, 82 bp, Mus musculus
tcatgcatgcttgagtgtatgtatgtatgtatgtatgtatgtatgtatgtatgtatgtatagatgcttgagtgaatgtgtga

SEQ ID NO: 99249 - DNA, 65 bp, Mus musculus
ggaccaggactctctaactcactgactggctggactggctggctagtgagcactaggaatcctcc

SEQ ID NO: 99250 - DNA, 82 bp, Mus musculus
ctgaggtgctttttcagtctctgtgcctctgtgagccttcaagtatgttcctgttcccagagtgctccaggccctgcctcag

SEQ ID NO: 99251 - DNA, 65 bp, Mus musculus
gcatgtgtgtgcatgtacatgtttatatgtatgtttcatgtgagcatgtgcatgagcatgtgtgc

SEQ ID NO: 99252 - DNA, 79 bp, Mus musculus
gatgggtcgaaagaaagttctcttagggagactgagctcaaaatctcctctgtaggacttctctgagcctgtctctgtg

SEQ ID NO: 99253 - DNA, 76 bp, Mus musculus
ttgtgtatgtgtgtgtgtctgtgtgtatacatatatccatgtgtatacacatagtaatttatatgtgtatatgtaa

SEQ ID NO: 99254 - DNA, 75 bp, Mus musculus
ggcagcctggccactgtctgcagagagttcaggaacccaactctgcctgcctgtctgcctgcttgcctgcctgcc

SEQ ID NO: 99255 - DNA, 118 bp, Mus musculus
tgcttttagctttattttcctctcatcagcatctggatatcaatttatgtttttctatacactgggattatgataaatataatttatggggctggagagatggttcagcaggtaagag

SEQ ID NO: 99256 - DNA, 76 bp, Mus musculus
cctgagttctgggattgaaggtgtgtacacccagaaatataatgtctaacacactcactctcatccctcactcagg

SEQ ID NO: 99257 - DNA, 89 bp, Mus musculus
gaacacagtctcattgcttatcatgctgatatagttaatgcttggtgggagctgctgtggaagtatgtctttggggtgtcagtgagcct

SEQ ID NO: 99258 - DNA, 61 bp, Mus musculus
cacccaaagagggagttgatcccacatgtgagagtgggatctgtctgtgtctgtgtctgtg

SEQ ID NO: 99259 - DNA, 115 bp, Mus musculus
gagaatgtgtgactctggatgtggaggggtgcgttttgaatgtatgtatctatgagaactgtgtgtgcactctcctggacactatatgacctcttcactcatgttagcatgactt

SEQ ID NO: 99260 - DNA, 87 bp, Mus musculus
ctctacttctgagctatagtccagcccttatgtatgtatgtatgtatgtatgtatgtatgtatgtatgtagcctaagcctcacagag

SEQ ID NO: 99261 - DNA, 104 bp, Mus musculus
gggacggtgaagcagctgagtctcaggtcctggcttgagccctgtctgagtgtgtcactgggacttgggtgcaggtgcaggagccagccagccttttctcaccc

SEQ ID NO: 99262 - DNA, 78 bp, Mus musculus
gtgtatgtgtgtatatgtgtttatttgtttatatgtgtttgtgtgtatatacatgtgtgcatgtgtatgtgcatgtgt

SEQ ID NO: 99263 - DNA, 83 bp, Mus musculus
gggcctgcagagagttgagagagtccaggaattaagagcacttgctgttcttccagaggtcccaggtttgattccccaggccc

SEQ ID NO: 99264 - DNA, 81 bp, Mus musculus
ccttattgacagaagtgagtcaccagggtcaggacttttaaatagctctgcctctggtttcagaatttttctgcttcctgg

SEQ ID NO: 99265 - DNA, 101 bp, Mus musculus
ggtatactaaactgtagtcaatttatctgactttgtctctctgtctccttaaggtgacggtgaggtggtagaacaggtaattgggcagcaaaccaatgacc

SEQ ID NO: 99266 - DNA, 95 bp, Mus musculus
ttgacttgaagaaggttttttttccctcccctcgtgaatttatttactttcaaagtatatgtagttcacagaggtaggaggacctctccattcgg

SEQ ID NO: 99267 - DNA, 73 bp, Mus musculus
agataccctcacaccgacatgcatgcaggcaaaacaccaatgtctgtctgtctgtctgtctgtctgtctatct

SEQ ID NO: 99268 - DNA, 94 bp, Mus musculus
ggactatatgatgaattccagggcagagtctcactctgtctctaacaaagggtggggaagaggggaggagggaatggatatttcatagaacgcc

SEQ ID NO: 99269 - DNA, 79 bp, Mus musculus
cttgagctactgaaggtcttgtacatgctgtcacaatcactgtgacaaaaatatgaaatattgccctgttgtgttcagg

SEQ ID NO: 99270 - DNA, 115 bp, Mus musculus
tttaatcaccacaatctgcaagaagacatttctctgatgatggactaatttatttgttcataaataagtcattagtaatcagtttaatgcttaatgctatgattctgtgtttgaa

SEQ ID NO: 99271 - DNA, 89 bp, Mus musculus
gcatgggggaagggtggtggttactgtagacagagaggagattgtagacaattgtaatttggagtgtgctagcatcctgtcctctatgc

SEQ ID NO: 99272 - DNA, 85 bp, Mus musculus; identical to SEQ ID NO: 57470

SEQ ID NO: 99273 - DNA, 85 bp, Mus musculus; identical to SEQ ID NO: 57439

SEQ ID NO: 99274 - DNA, 110 bp, Mus musculus
tgtgtgtgtgtgtgaatgccagaggataacttgtgaaggttgattttctctctccactgtgtgaagatagccagctcagattgtctggtttggctgcaggtgtctaccca

SEQ ID NO: 99275 - DNA, 69 bp, Mus musculus
cccagtgagaagatttaacctgaagttaaggcattcattgacattctaggttgatatctttgcctgtgg

SEQ ID NO: 99276 - DNA, 83 bp, Mus musculus
ggtagtgtctgtgtttgtcactgagatgtgttgtctgttcttacacacgttcgcgcgaccagcctggaagaacacaacaaacc

SEQ ID NO: 99277 - DNA, 82 bp, Mus musculus
tttgtagatgggtctctccatctgtctgagtcagctgctgggtggagcctctcagagaatgtgctagactcccgtctgcaag

SEQ ID NO: 99278 - DNA, 70 bp, Mus musculus
gctggtctccaaggaggacacaaatgacagtgaacaataaagaccaccacttgtgttcaaagagacctgc

SEQ ID NO: 99279 - DNA, 85 bp, Mus musculus; identical to SEQ ID NO: 57439

SEQ ID NO: 99280 - DNA, 85 bp, Mus musculus; identical to SEQ ID NO: 68575

SEQ ID NO: 99281 - DNA, 97 bp, Mus musculus
gaataaagttgttgtaacattggtctttctaactatcaactctgtgtttgtatgtatatatgtaaggtttgtatgagagtatgttgtaacattgttc

SEQ ID NO: 99282 - DNA, 64 bp, Mus musculus
tctacatttacatatgtatatttatgtatacatgtgtatatatgtatgtatatatgtgcgtaga

SEQ ID NO: 99283 - DNA, 83 bp, Mus musculus
tctctctctctttctctctctcacaatgcttgcacacatgccacacttgggtgtagacagacagacagagacagacagacaga

SEQ ID NO: 99284 - DNA, 87 bp, Mus musculus
tgtctgtctgtctctgtctgtctgtctacacccaagtgtggcatgtgtgcaagcattgtgagagagagaaagagagagagattttca

SEQ ID NO: 99285 - DNA, 82 bp, Mus musculus
agggctgccccttggacaccccctgaagagtgggatagaggaatgcccacccagggatgagtggaatgtagttagcagccct

SEQ ID NO: 99286 - DNA, 90 bp, Mus musculus
ttctctgtaagtagggtctctgtaaatagagttctacgttccatgttaccatgtctagtgatattattgtttggatcttgcttaggagaa

SEQ ID NO: 99287 - DNA, 85 bp, Mus musculus; identical to SEQ ID NO: 57439

SEQ ID NO: 99288 - DNA, 111 bp, Mus musculus
tacagcttttatgcttttttggcacaggaacatctgtaagccagtatatatttttatagttcagaatggttcaggtttcatttggttccacaaagaagtgaattagctcta

SEQ ID NO: 99289 - DNA, 91 bp, Mus musculus
atatgaaagtccatagtgtttgacttgaacatagatgttacattcttaataattcattactctattctatgtttttgttaagctttcatat

SEQ ID NO: 99290 - DNA, 85 bp, Mus musculus; identical to SEQ ID NO: 57439

SEQ ID NO: 99291 - DNA, 94 bp, Mus musculus
tatgttccactggtctcgctgtctatatctgtgtcagtactgtgctatcattatcactattgctctatagtatagtttgaggttgtgcaatgtg

SEQ ID NO: 99292 - DNA, 74 bp, Mus musculus
gtgccttggtagactcagtattgcatgccccctctacctgggcttggtcacagtagtgagtgataaaaggggac

SEQ ID NO: 99293 - DNA, 69 bp, Mus musculus
aagcctttcactactgaatttcttgtgctaattaggcacagaatattttcttgtctgtgtaaatggctt

SEQ ID NO: 99294 - DNA, 115 bp, Mus musculus
atatatatatatatatatatatatatatagtatatatacataatatatatatgtgtgtatatgtgtatatatgtatatatgtatgtatgtatgtctatatgtctatatgtgtgta

SEQ ID NO: 99295 - DNA, 112 bp, Mus musculus
ctttctataagagaacaagcacagagcaaagcaacatcttctatgacaactgtttttgtacttaaggttatatgagaggattttttgtgaaagttctcaaaaagatagctgg

SEQ ID NO: 99296 - DNA, 85 bp, Mus musculus; identical to SEQ ID NO: 57470

SEQ ID NO: 99297 - DNA, 137 bp, Mus musculus
gctaccacatgccctctgacctccatgcatacagtttcatagaaacaacagaatgtaacattttatatatatgaatgactcctcaggctggagagatggcccaatggataagcattagtggctgttcttccagagga

SEQ ID NO: 99298 - DNA, 85 bp, Mus musculus; identical to SEQ ID NO: 58174

SEQ ID NO: 99299 - DNA, 106 bp, Mus musculus
ttgttgagggtgctatagactatgggggctttggaagttgtactaaatgtattttttattatgctgtgccgagctatgtctcccatagactcatgtatttgaacaa

SEQ ID NO: 99300 - DNA, 62 bp, Mus musculus
cacatatacatacatagagacatatgcataattatatgtatataaacatgtgtgtatctgtg

SEQ ID NO: 99301 - DNA, 106 bp, Mus musculus
gccttaatccgtggtgatctgataagatgcatgggattatttcaatatttttgtacctgttgaggcctgttttgtgaccaattatatggacaattatggagaaggt

SEQ ID NO: 99302 - DNA, 95 bp, Mus musculus
gctcagtatgatggtaggctgtgtgcatctgcatctgtattggtcaggacctggcagaacctctcagagaacagccatatcagactcctgtcagc

SEQ ID NO: 99303 - DNA, 86 bp, Mus musculus
caggggggagggactttctattttctagcattttctttcattattcatggatcgaaaatttaattgtagatagttttacttgcttg

SEQ ID NO: 99304 - DNA, 79 bp, Mus musculus
atttctgttagtttcactgtgtctctgtttagtttctgtttccagaatctgtccatagataagagtggggtgttgaagt

SEQ ID NO: 99305 - DNA, 85 bp, Mus musculus; identical to SEQ ID NO: 57439

SEQ ID NO: 99306 - DNA, 93 bp, Mus musculus
agcagggaagctgagagactgcatcttcaactgcaaagaagtcaaaagagtgacctggaagtgagaaaaggctctaagctgtgaagccctgct

SEQ ID NO: 99307 - DNA, 58 bp, Mus musculus
acatatatatgtatatttacatatatgtatgtatgtacgtgtgtatatatgtatatgt

SEQ ID NO: 99308 - DNA, 85 bp, Mus musculus; identical to SEQ ID NO: 92498

SEQ ID NO: 99309 - DNA, 102 bp, Mus musculus
gggttgaagcttactagtgatgtgtttttgtgtcaggtttacaaggggtcaattgtacaggctggttttgtgtgtcaacttgacacaagctggagttatcac

SEQ ID NO: 99310 - DNA, 78 bp, Mus musculus
gtctgtcttgtctggtcagtgtccactgtctgtgtctgttaggtcccagaaggggatgactggtttcaggttctggat

SEQ ID NO: 99311 - DNA, 85 bp, Mus musculus; identical to SEQ ID NO: 57439

SEQ ID NO: 99312 - DNA, 105 bp, Mus musculus
gggggcttctcagcttggccggattggctgacaataagctgcagaggtctgtctgtctctgtcccacttacctggaactggggttacaattgcaaaccagacctc

SEQ ID NO: 99313 - DNA, 85 bp, Mus musculus; identical to SEQ ID NO: 57439

SEQ ID NO: 99314 - DNA, 122 bp, Mus musculus
acatatatatatatatatatgtatatatatatatatatgtgtatatatatatgtatgtatgtatgtatatatatatgtatatgtatatatatatatatatatatatatataacatgtttgta

SEQ ID NO: 99315 - DNA, 105 bp, Mus musculus
ctcctaagcaagtagaggaatccattgttttaactcacactgtcaggatctctgtccaccatggcagggaagacatgctagagcagctcggttccttgttgtgag

SEQ ID NO: 99316 - DNA, 124 bp, Mus musculus
acagccaggcctcagccttggtataaatcagcaggagggaccaggaggaaagtcaggctgtgcctctcttagtgaagtgcagatcagcaaagatgagagacccacaaacattgcgcagcttgct

SEQ ID NO: 99317 - DNA, 126 bp, Mus musculus
gtgtgtatgtgtctgtgtgagtgtgtttatgtattaggtatatatgtatatatatatgatgtgtatatatatatatatatatatatatatatatatacatatacatatatatgcatgtatatatac

SEQ ID NO: 99318 - DNA, 93 bp, Mus musculus
gtttaaggtgttgaaaaaagggggactggagagatagttcagtggttatgagcactgactgctcttccagaggtcctgagttcaattcccagc

SEQ ID NO: 99319 - DNA, 96 bp, Mus musculus
gaggagaacaatgagctaagacttgtgtgtgtgctcagtgaccagctgccagtcctgcctcttgggcaacaccatcttgttttctttacctttcct

SEQ ID NO: 99320 - DNA, 100 bp, Mus musculus
ggatttgatggagacatataatttagagctgtgttccaaggtctctcacactctgtgtcatgcctggctgagggtctctgtgtttgttctcatctgttgc

SEQ ID NO: 99321 - DNA, 85 bp, Mus musculus; identical to SEQ ID NO: 57439

SEQ ID NO: 99322 - DNA, 99 bp, Mus musculus
atgtggtcaaatatatatacacacatttatatatgtatgtatatgtatgcatatcacatatgtatatatgtatatgtatgtgtatatgtatatgtatat

SEQ ID NO: 99323 - DNA, 82 bp, Mus musculus
tgatgagtgaacactgagagaactagagagcacaggattggctcaagtctttcaaaacctcagagtcagctctcagtgacac

SEQ ID NO: 99324 - DNA, 118 bp, Mus musculus
atctaaattttccagtttcattgagtataaacttttatagtaggatctgatgtttttttgaatttcttgttcccgttgctatgtatccattttcatttctgattttgttaatttggat

SEQ ID NO: 99325 - DNA, 96 bp, Mus musculus
gattctgtcatcatattagaatggcaggtaatgaactaagttacaaactttttgaacttaaattgttattgctgctcagaggaaaagcatagaatt

SEQ ID NO: 99326 - DNA, 115 bp, Mus musculus
tgctatatgtcctgtatatatgtcttatatatgtatacatatgtatatataactattttatatacttgtgtgtgtatatatatatgtgtgcatatatacatataagatgtataca

SEQ ID NO: 99327 - DNA, 85 bp, Mus musculus; identical to SEQ ID NO: 57470

SEQ ID NO: 99328 - DNA, 94 bp, Mus musculus
aacagtattacatcatcagtgtggctgagttcaggtagaatagaataatttgccacctggctccaattacatacatttgaatcagaatattgtt

SEQ ID NO: 99329 - DNA, 101 bp, Mus musculus
gaagtccatgctagctaggcctagtgtctgactctgtctctaacctgcaaattgcatgaaagatccagtgccatgctttcccatgccggctgctgtgcttc

SEQ ID NO: 99330 - DNA, 117 bp, Mus musculus
ggagcctgtctgtcctataatcccagttgattcaggactcctcagggtccagctttctctgtgattctgtgattctgggctcctgtgaacctgagattttgggtgtgtcagagttct

SEQ ID NO: 99331 - DNA, 85 bp, Mus musculus; identical to SEQ ID NO: 57470

SEQ ID NO: 99332 - DNA, 112 bp, Mus musculus
gttcagaggtttagtccattgtcatcaaggcaggaaacttgtcaacgtccaggcaggcatgacactggaagagttgagagttctctatcttcatccaaaggaagccaggagc

SEQ ID NO: 99333 - DNA, 113 bp, Mus musculus
ggtagcaggaagagagaatgccatgttggacctagctagagcatctgagagctcaaagctcactctcagtgacacacttcttccaataatgctacacctacttcagcaaggcc

SEQ ID NO: 99334 - DNA, 114 bp, Mus musculus
caaacaaacaaacaaaaatttgtgcatgtatgtacatattcatatatataccggtgcaggtatgtatacaagtgtgtgcatttgtgtgtgtgtacatttgtgtgagtgtgtttg

SEQ ID NO: 99335 - DNA, 100 bp, Mus musculus
atgcacaggtatacacacagacatatatatgtgtgtgtatacatgtatatatatgtgtatatatacgtgtgtatgtatgtatgtgtgtatacctatacat

SEQ ID NO: 99336 - DNA, 95 bp, Mus musculus
gtggaacacacaacagtatataaaaattgttttttgtctacattctttgtatttttcttaagaacttatttattgtacgtgtgtgagtgttttgc

SEQ ID NO: 99337 - DNA, 76 bp, Mus musculus
gacttttaaagtagcaggtagatatcaaggtaaattgatatagtttgtctttatctcactatctgttaaagaagtc

SEQ ID NO: 99338 - DNA, 99 bp, Mus musculus
ttctctggtggtggggttaatagatgtgtgcaaatggaaggaaaactaggtggtctggagcataaactgtatcactctactaatgctgtcatctgagaa

SEQ ID NO: 99339 - DNA, 77 bp, Mus musculus
ggaagtagtagaggaacctgaagaaagagagcagacaccagaggtgatgtctgatgactctggaactctctatggtc

SEQ ID NO: 99340 - DNA, 85 bp, Mus musculus; identical to SEQ ID NO: 57470

SEQ ID NO: 99341 - DNA, 85 bp, Mus musculus; identical to SEQ ID NO: 57439

SEQ ID NO: 99342 - DNA, 86 bp, Mus musculus
tagaggttaaacacacaatttacatattaatttcatgattcatttattcaatgatttatgtggatatagattgtatttaatctctg

SEQ ID NO: 99343 - DNA, 84 bp, Mus musculus
tgtctggcttgaaactgcaagccctgtgcacgcttccacagtctctctgtgttaatttgtgcatggtcttgtatctggaagaca

SEQ ID NO: 99344 - DNA, 64 bp, Mus musculus
tgcctctcactctcatgctctgtgctaggtagggccttggttggcagagcgggaaactgaggca

SEQ ID NO: 99345 - DNA, 77 bp, Mus musculus
tatatatatatatacatacacacacatatatgtatgtaatgtgcatatatatacatatgtgtgtatatatatatata

SEQ ID NO: 99346 - DNA, 85 bp, Mus musculus; identical to SEQ ID NO: 57439

SEQ ID NO: 99347 - DNA, 58 bp, Mus musculus
agtatctgtctctgtctcagccagttgctggtagagcctctcagaagacagccatact

SEQ ID NO: 99348 - DNA, 89 bp, Mus musculus
acatatatactgtgtgacacactgtgacatactagtttctaagatgagatttttttatgcttcattctctttggtgtgtgtgtgtgtgt

SEQ ID NO: 99349 - DNA, 96 bp, Mus musculus
atggatctgatggtgttttgaatttcttcaggatctgttgtaatgtttcccttttcatttctgattttgttgattaggatgctgtccctgtgccat

SEQ ID NO: 99350 - DNA, 82 bp, Mus musculus
ccgtctgtctgtctgtctgtttagggacagtctcattatatagccttggctgtcctgaaactaattatgtacaccaggctgg

SEQ ID NO: 99351 - DNA, 64 bp, Mus musculus
gtgtttagcaatgtgtgtgtatgtgatgtatataagtgtgtatacatacataagcacataacac

SEQ ID NO: 99352 - DNA, 80 bp, Mus musculus
ggaagttaaatatatacatatatgtatacatatgcaaatatatatatgtacatatatatattgtgtatatctttgcatcc

SEQ ID NO: 99353 - DNA, 122 bp, Mus musculus
ggagatgggctttatttaatgtttcaaaattgcatggaagttccagtgtctgtccctctctccctgagaatccagatgtagaactcacaattccaatgtctgtcagcataccatgttcccca

SEQ ID NO: 99354 - DNA, 112 bp, Mus musculus
aggtcttcagtggctttgtcatagatcctcaagaggaatctgaggaagtagtagaggaacctgaagaaagagagcagacaccagaggtggtgtctgatgactctggaactct

SEQ ID NO: 99355 - DNA, 90 bp, Mus musculus
gtacaaagaatgttctgtattcaaggtcattggcaagacttgctgttctggcccgtagtctctgagtctctgaaatataacattatgtac

SEQ ID NO: 99356 - DNA, 69 bp, Mus musculus
gtgtctctctgtctctctgtctctatctccttcctatatgatacagatagaatattatcagatagatac

SEQ ID NO: 99357 - DNA, 106 bp, Mus musculus
gccttagtgcatgatgatctgataggatacatgggacaatttcaatatttttgaatctattgaggcctgttttgtgacctattatgtggtcagttttggagaaggt

SEQ ID NO: 99358 - DNA, 123 bp, Mus musculus
gccttccatacttctctgttagtgttgagggcctatgaacaactacttttcattctactgactttaacatgtacaggctgtgtgcagggcaccacagcttctgtgagtccatgagtgtagttg

SEQ ID NO: 99359 - DNA, 86 bp, Mus musculus
ggttagtgtaggtaaagtaagtgtagtttgagtcctcaatattgatgttcctaaaactgataccttgcatggcctcattgtgtacc

SEQ ID NO: 99360 - DNA, 85 bp, Mus musculus; identical to SEQ ID NO: 57439

SEQ ID NO: 99361 - DNA, 85 bp, Mus musculus; identical to SEQ ID NO: 60894

SEQ ID NO: 99362 - DNA, 60 bp, Mus musculus
ggaagacagactcttgggagtaggtagggaaagttcactggatctctctgtctctcttcc

SEQ ID NO: 99363 - DNA, 83 bp, Mus musculus
tcaggtacagagcctaatgacaatttatggggatctatctttagcctactaaatcatcactctttgtctctatctgtgtctga

SEQ ID NO: 99364 - DNA, 71 bp, Mus musculus
ttccagagtaatgtggagtaagccccatagacatgccctcgaggggacacacacacacacattctttgggg

SEQ ID NO: 99365 - DNA, 71 bp, Mus musculus
actgcgggtggttatggcacgtctttgatcccagcactgtggaggcagagacaagtgagtgatctctgagt

SEQ ID NO: 99366 - DNA, 98 bp, Mus musculus
ggtcctttccttaaatcttccagtggggtatgtaagctcagtccaatggttagctctgagtatctgcatctgtattggtcgcatgttggtcatcagcc

SEQ ID NO: 99367 - DNA, 85 bp, Mus musculus; identical to SEQ ID NO: 57439

SEQ ID NO: 99368 - DNA, 85 bp, Mus musculus; identical to SEQ ID NO: 57439

SEQ ID NO: 99369 - DNA, 94 bp, Mus musculus
tatgcttgcttgcaaaggcttcaggattatgacacaaaactgtgtgctgaggggatggggatgcagttcaaagacagaatgcttaggtagtatg

SEQ ID NO: 99370 - DNA, 113 bp, Mus musculus
atcagccttagtccgtgatgatctgatagaatttatgtggttatttcaatatttttgtatctgttgaggcctgttttgtgaccagttatattcatttttggagtaggtatgat

SEQ ID NO: 99371 - DNA, 75 bp, Mus musculus
tgttcttcattcaggtcacccaaacaactggaacatgggctgtccctgagcctgttgtctgtctgtctgtgaaca

SEQ ID NO: 99372 - DNA, 85 bp, Mus musculus; identical to SEQ ID NO: 57439

SEQ ID NO: 99373 - DNA, 63 bp, Mus musculus
gggtgtttctcagtccattttatatttataaacaagtacacagatgggctgaggagaaggttc

SEQ ID NO: 99374 - DNA, 83 bp, Mus musculus
gatacatacatttgtgtgtgtttgtgtatatgtacatatgtatatatgtatgtacatgcaaaatacccatacatgtaattgtc

SEQ ID NO: 99375 - DNA, 80 bp, Mus musculus
ttcagtgttgggggctgagttgggacagggactcctcagcaaccgagggcctctctcttgctctcagtgtccttgctggg

SEQ ID NO: 99376 - DNA, 103 bp, Mus musculus
attttgtgcattcatgtatttcataagacattatataaatatacattgtttcaatgaagttaaataaatattgtcttattaaatatatggaagcaagcaaaat

SEQ ID NO: 99377 - DNA, 85 bp, Mus musculus; identical to SEQ ID NO: 68432

SEQ ID NO: 99378 - DNA, 100 bp, Mus musculus
tttaatatttattatttatttttaggggtaccagttcttaactatatatgtatattatgtgcatatctagtacccatagaggctagactatgacattaga

SEQ ID NO: 99379 - DNA, 126 bp, Mus musculus
cttcatttgtgtatgtgtatatgtgtattttctgcacattgtgtgtgtgtgttcaggtagatggatgtattgttacctatgtggaggttagaagacaatctcaggtgatgatcttcactgctacct

SEQ ID NO: 99380 - DNA, 66 bp, Mus musculus
acagacaatgtacatcagaggtaaagtggaatccctccctgcctgtctgtctgtatgtctgtctgt

SEQ ID NO: 99381 - DNA, 93 bp, Mus musculus
tgccccaattttaggagggcttcgatacactggatcaataaactgctttcttattgcatagatctctgtctctgtgtttctgtgagtgggaca

SEQ ID NO: 99382 - DNA, 85 bp, Mus musculus; identical to SEQ ID NO: 57439

SEQ ID NO: 99383 - DNA, 85 bp, Mus musculus; identical to SEQ ID NO: 57439

SEQ ID NO: 99384 - DNA, 60 bp, Mus musculus
atgagtgttgtctactctttggttggttctttagtaccagagagctctggggatactggt

SEQ ID NO: 99385 - DNA, 77 bp, Mus musculus
agacctggggaggcagagacaggagagtccctggggttcactgcctaatatctctctgtctctgtctgtctctgtct

SEQ ID NO: 99386 - DNA, 88 bp, Mus musculus
gcggaataccttgctgctctctcattgtacagtttttgatgttttctaatatctttaacaattagagatgctttgttatctattctgc

SEQ ID NO: 99387 - DNA, 85 bp, Mus musculus; identical to SEQ ID NO: 57439

SEQ ID NO: 99388 - DNA, 85 bp, Mus musculus; identical to SEQ ID NO: 57470

SEQ ID NO: 99389 - DNA, 63 bp, Mus musculus
aaggacttgtaactctttagcagtgctctactgtatttctttaagtgagttatgaaagtcctt

SEQ ID NO: 99390 - DNA, 93 bp, Mus musculus
gacactgtggtcttgagaaattccttgcacagtttctttacatattgcatagacacatgtgagtgaagagacttccttcatggccaccttgtt

SEQ ID NO: 99391 - DNA, 85 bp, Mus musculus
ggccatggtggtctgacaggatacatgggacaatttcaatatttttgtatctgttgaggcctattttgtgaccaattatatggtc

SEQ ID NO: 99392 - DNA, 112 bp, Mus musculus
gaaaacaagaaagaagatcccttttaaatattgagaactagtacttattgagaaaaatatgttaatctttatatttactggtattcaaatcttctgaaaacagctttttttt

SEQ ID NO: 99393 - DNA, 87 bp, Mus musculus
ttaactgcatgcttatgcacagatgtgagtgtacagagatctgaatatgaagatgcatgtgtgagtttgtgcatataagtgtgttaa

SEQ ID NO: 99394 - DNA, 58 bp, Mus musculus
atgtatgcatgtgtatatgaatgtatgtatgtatgtatgtatgtatgtatgtatacat

SEQ ID NO: 99395 - DNA, 104 bp, Mus musculus
tggttgctcttcaagttgtaggatcccatgattacctgaccctagtctcccattttaggatttttgtctggctagagcttacaaagtttttgtgcatgcagtca

SEQ ID NO: 99396 - DNA, 85 bp, Mus musculus
ggccatggtggtctgataggatacatgggacaatttcaatatttttgtatctcttgaggcctgttttgtgaccaattatatggtt

SEQ ID NO: 99397 - DNA, 86 bp, Mus musculus
gtaggacaaattgaccttgaacttcagagccttctgtcacattctctctaatactggccttaagggcatgtgttaacatgtcctcc

SEQ ID NO: 99398 - DNA, 136 bp, Mus musculus
gcatacatgtagtggatatatatacatgcaggcacttgtatatatatatacatatgtatatatgtatgtatatatataatatatatgtatatatatatatattatatgtgtgtgtggtggtggatatatatatata

SEQ ID NO: 99399 - DNA, 113 bp, Mus musculus
gattcagttttacaggtaacatgtggctaacaatgtattgtctcaaataacttctgatttagttattgagagtactttggcacatcacacaatgccctcagtgctttagagtc

SEQ ID NO: 99400 - DNA, 86 bp, Mus musculus
aattaatgcagtctcaggtcccacaagattcatattgtttatttttacatctgtgttcatgagggaaaatggacgatgtatttgtt

SEQ ID NO: 99401 - DNA, 105 bp, Mus musculus
ggatctcctggagctggtgctataggcgtttatgacaatcctgatgttggtgctaggcactgaacttggatactcaaaacacctgtgcagccacatctccaatcc

SEQ ID NO: 99402 - DNA, 97 bp, Mus musculus
gttttaaagtatctttatattttgatattagcaaatgattcttgattttttttcatggaagtattgctagcttcagagttagtgtactttctataac

SEQ ID NO: 99403 - DNA, 67 bp, Mus musculus
agcagacctgggagactagctctctcctctgagtgtcagtggtcagagagctctccgcaggcaagct

SEQ ID NO: 99404 - DNA, 71 bp, Mus musculus
ccatggataatttgtcctgtctatgtatgtatgtgtgtatatatatatatattcctcagggctttctaagg

SEQ ID NO: 99405 - DNA, 85 bp, Mus musculus; identical to SEQ ID NO: 57439

SEQ ID NO: 99406 - DNA, 85 bp, Mus musculus; identical to SEQ ID NO: 57439

SEQ ID NO: 99407 - DNA, 70 bp, Mus musculus
cctctctctctctaactgtaattctgagtttccaggtgattctcggggcctcaagacagagaagggcagg

SEQ ID NO: 99408 - DNA, 75 bp, Mus musculus
gcatgggtctaatgttgggttggttatcagttgaccattagctcggtctctgtttcaatcaacccatgagcctgc

SEQ ID NO: 99409 - DNA, 84 bp, Mus musculus
tgcacacacacacacacacacacacacacacacacacacacacacgtgcgcgcgtgcatgtgtatgtgtgtgtctgtgtgtgta

SEQ ID NO: 99410 - DNA, 57 bp, Mus musculus
attgagatgatgtaaagtatgggctctctgagcctgtgacagtgggtcaggatcgat

SEQ ID NO: 99411 - DNA, 70 bp, Mus musculus
ctgtctccctggtccctctgagaccagtctgagcacatcagctcacagactgtggagggtgagcaagcag

SEQ ID NO: 99412 - DNA, 89 bp, Mus musculus
gctttcattttaaattatgtattttatgcccctgatccagaatactgtttctgtgtgcttgtatgttgtagtaattgttttctgaaagc

SEQ ID NO: 99413 - DNA, 85 bp, Mus musculus; identical to SEQ ID NO: 57470

SEQ ID NO: 99414 - DNA, 112 bp, Mus musculus
cgcaatagttccagcagatcttctgggaggccttcaaacttttgggtcttcagaagagtagtcaatctgttgtcgtgtttgaagatgtcctccaggggccctatggattgtg

SEQ ID NO: 99415 - DNA, 106 bp, Mus musculus
ggactctttaaggacactagctgaacatgagagtaaaggtacgctagtaagcattatttcttcacactcactctctcagttctttcaggttccatgtaaagtttct

SEQ ID NO: 99416 - DNA, 116 bp, Mus musculus
tcgaagatcagccttagtgcatggtgatctgataggatacatgggacaatttcaatatttttgaatttgttgaggcctgttttgtgacctattatgtggtcaattttggagaaggt

SEQ ID NO: 99417 - DNA, 86 bp, Mus musculus
gataacttctgttagtttcactgtgtctctgtttagtttctgtttccaggatctccccattgatgagagtggggtgttgaagtatc

SEQ ID NO: 99418 - DNA, 85 bp, Mus musculus; identical to SEQ ID NO: 57439

SEQ ID NO: 99419 - DNA, 83 bp, Mus musculus
catgggacaatttcaatatttttgtatctgttgaggcctgttttgtgaccaattatatgttcaattttggaaaaggtcccgtg

SEQ ID NO: 99420 - DNA, 81 bp, Mus musculus
ggaagggatccaaggtggggcagtctctggatggtcattccttcaccctctgcttcacactttgtctctgtaactccttcc

SEQ ID NO: 99421 - DNA, 100 bp, Mus musculus
taagcaacttttctagagggtgaaatttctggggagaacaagtttattcttttattttagagataactattacctctcgccttctctttagtacagctta

SEQ ID NO: 99422 - DNA, 59 bp, Mus musculus
gtgcttcctgacagtagcctaatgtagctctctcctgagaggctctgtcagtgcctcac

SEQ ID NO: 99423 - DNA, 80 bp, Mus musculus
agtttattctctatttttgtagctgtattggaaaggaagtacttaatatttaattctatattatagagatggagaagact

SEQ ID NO: 99424 - DNA, 83 bp, Mus musculus
gccacttcctcagagtgttgtcagatgagacagacgaatatggagttttgctgagactcatatgctaaggcaggtcatgtggt

SEQ ID NO: 99425 - DNA, 63 bp, Mus musculus
ttgagctttctgtaaggtgacaaatgtgaaattattttcatttttgtacatacagactgccag

SEQ ID NO: 99426 - DNA, 85 bp, Mus musculus; identical to SEQ ID NO: 57439

SEQ ID NO: 99427 - DNA, 88 bp, Mus musculus
ggtgggcaaagtgtggatgaatgacagacagacacacacacaggagagtttgtgtggaatctgaatgtaattttccaaatcgaacatc

SEQ ID NO: 99428 - DNA, 64 bp, Mus musculus
tggaaaattacattcagattccacacaaactctcctgtgtgtgtgtctgtctgtcattcatcca

SEQ ID NO: 99429 - DNA, 115 bp, Mus musculus
tgtagctctttatgaaggatagagccttgtgacatttcccatatccatagcagcatgacaactgattttgctgttttgtatggcatttttacgagaacctattgttaaagtttca

SEQ ID NO: 99430 - DNA, 102 bp, Mus musculus
taaagatgtaaacaatagagctcttgctctggcgctctggcgctctggctctctggcgctctggctcctaaagatgtaagcaataaagctcttgcattctta

SEQ ID NO: 99431 - DNA, 89 bp, Mus musculus
tggagagaaatcaaatggatagaaaagatgtagctgagtggcagagaatgataggcatagctctatcgaggtcctgtggtttatcttca

SEQ ID NO: 99432 - DNA, 64 bp, Mus musculus
tctctctctctctctcccagaagttatcaattataaatagcttcttggttgaggttgggataga

SEQ ID NO: 99433 - DNA, 91 bp, Mus musculus
gagataatagcttcatatatgtgtgtgtatatatacatatttttatgtacatatatatgtacacatatatatatgtgtgtgtataattttc

SEQ ID NO: 99434 - DNA, 85 bp, Mus musculus
gtccatgatgatctgatgggatgcatgggacaatttcaatatttttgtatctgttgagatatgttttctgtccaattatatggtc

SEQ ID NO: 99435 - DNA, 83 bp, Mus musculus
agagagagagagagagagagattgagagagaaaatgaatgaattgggatttgtttgcctgcctgcctgtctgtctgtctgtct

SEQ ID NO: 99436 - DNA, 68 bp, Mus musculus
tgggagataggacatggctaacctgcatgcctcacattcagtgttggtgacacagtctctatctctca

SEQ ID NO: 99437 - DNA, 81 bp, Mus musculus
ccacttgaagatttctgtaaatatctctgcacattggaagcagaagcttctttgatgaagatagaaagttctcttctgtgg

SEQ ID NO: 99438 - DNA, 118 bp, Mus musculus
agtggctacaatgtaaatttttctaaattcatgtctttcatcatttgcatatgcttatatatttttaaatgcagatgtctagctatgtagcggaagggttgatagcacattttctggc

SEQ ID NO: 99439 - DNA, 93 bp, Mus musculus
cagcatattttcatgtcctctggatcgttcactctttctgtctccttctcagcaatgatgtctgaaacaaccatatgtgcatgagttgtgttg

SEQ ID NO: 99440 - DNA, 97 bp, Mus musculus
gtgtagccctggctgtcctagaactcactatgtagaccaggctagcctcaaactcagtctctgcctcttgagtgctggaatcaaaggcatgggccac

SEQ ID NO: 99441 - DNA, 85 bp, Mus musculus; identical to SEQ ID NO: 57470

SEQ ID NO: 99442 - DNA, 85 bp, Mus musculus; identical to SEQ ID NO: 57439

SEQ ID NO: 99443 - DNA, 72 bp, Mus musculus
tctgtcttgtccttggggattgaagatgagctggaatggagtcagtgacacagactctgagaacaggggaga

SEQ ID NO: 99444 - DNA, 116 bp, Mus musculus
gaaggtacctgggagatgatgaagagagaaaagggagggagtaaattatgtaattctatttgaattatcatattgtaaaagttaagttctctatgtttttcttctctcttatcttt

SEQ ID NO: 99445 - DNA, 72 bp, Mus musculus
tgaagatatatatatatatatatacatatatatgtatgcatatatgtatgtatatatgtgtgtgtgtcttca

SEQ ID NO: 99446 - DNA, 85 bp, Mus musculus; identical to SEQ ID NO: 57470

SEQ ID NO: 99447 - DNA, 73 bp, Mus musculus
gctggtcttgctctctctgactgtggcttgtctgacttgcaagcctgtgtgtcaatagtcctgggagaccagt

SEQ ID NO: 99448 - DNA, 70 bp, Mus musculus
tttgtgggcaggtgctgctgggagttgggtttccctctggtgagcctctctcacacacacaggcctcaga

SEQ ID NO: 99449 - DNA, 92 bp, Mus musculus
ctaaaaataatctctctatccacttatgtatagatgttagttgttaactttaagcagtctataatacatgtaaccagagaggttatatatag

SEQ ID NO: 99450 - DNA, 72 bp, Mus musculus
gaggctgaggccagctttgggccacatagtgagttctatgcaagccacagtctgtctgtctgtctctctctc

SEQ ID NO: 99451 - DNA, 70 bp, Mus musculus
tctctgtgtgtgtgtgtgtgtgtgtatgtatgtgtatgtatgtatgaatatacattggcatgtgtggagg

SEQ ID NO: 99452 - DNA, 66 bp, Mus musculus
ggacttgtagcagatgtacaagtgcccttagggacactatgttcacttctgtctgtctgttggtct

SEQ ID NO: 99453 - DNA, 85 bp, Mus musculus
tagagagatggctcactctgtgtgtgtgtgtaacctcagcacttgggaggttgtaggagggccacacagttgaagccatcctgtg

SEQ ID NO: 99454 - DNA, 101 bp, Mus musculus
tgaacatatcttcttatatatatatatatatatatatatatatatatatatatacatatatatgtatgtatgtatatgtatatgtatattgcaatctttca

SEQ ID NO: 99455 - DNA, 85 bp, Mus musculus; identical to SEQ ID NO: 57439

SEQ ID NO: 99456 - DNA, 115 bp, Mus musculus
tccttgaccaaggtatcattgaaaagagtgttgttcagtttctacgtgaatgttggctttctattatttattttgttattgaagatcagccttagtccatggtgatctgatagga

SEQ ID NO: 99457 - DNA, 92 bp, Mus musculus
acaatttgttatacatgtgtgtgtgcatgtgcatgtgcctgtgcctatgcatatgtgtgtgcatgtgtatgtgtgtgtgtgtgtgtgtgtgt

SEQ ID NO: 99458 - DNA, 140 bp, Mus musculus
acatatttttataaggtttcattgggtgatgatggacattttaaaaagccacactaaattgatggaaatgcaatgttaacatatcaaaactcatcaaattctataaataaagtgtttggctatgtgaaaatgttgcttgc

SEQ ID NO: 99459 - DNA, 85 bp, Mus musculus; identical to SEQ ID NO: 66071

SEQ ID NO: 99460 - DNA, 99 bp, Mus musculus
gaaggatgaaaaattgatttttacctagtatatttatttctttagtgcctggtattaattgaagccatgtctatgtatatagattgattttttttcttc

SEQ ID NO: 99461 - DNA, 85 bp, Mus musculus; identical to SEQ ID NO: 66071

SEQ ID NO: 99462 - DNA, 84 bp, Mus musculus
gggcagagaacttctcttgtaaagcccagagagaataaagcagggcgtctctgattctctctgcttctgggacatgttcctccc

SEQ ID NO: 99463 - DNA, 118 bp, Mus musculus
cataaaaattcctgactagtttttgtctcctgatcggatcactatttgtttatgtgatttgcttaaacagcaagtaataaaatgatgcagactgacatataaactatacatttttgtg

SEQ ID NO: 99464 - DNA, 120 bp, Mus musculus
cccaggaaatctttaacgtctttatttgttccctgaccaagttatcattgagtagagagttgatcagtttccacgggtatgtaggttttctgttgtttttcttgttacttagtccttggt

SEQ ID NO: 99465 - DNA, 109 bp, Mus musculus
tctctgttatcctttgtttatgggctcctgtgaacctgagactctggctgtgtcagagttcttggcagtcaagctcctttgagaccctgaaatactggtgtggcccaga

SEQ ID NO: 99466 - DNA, 112 bp, Mus musculus; identical to SEQ ID NO: 57513

SEQ ID NO: 99467 - DNA, 85 bp, Mus musculus; identical to SEQ ID NO: 57439

SEQ ID NO: 99468 - DNA, 85 bp, Mus musculus; identical to SEQ ID NO: 57439

SEQ ID NO: 99469 - DNA, 75 bp, Mus musculus
ttgaatacttaagatactgaatgatggctcagcggttaagagcgctgactgctcttccagaggtcctgagttcaa

SEQ ID NO: 99470 - DNA, 120 bp, Mus musculus
ccaagtgctgggattaaaggcgtgcgccaccactgcccggctattctaagtttttttaaacttaaaaatagatacatgcgctgggcagtggtggtgtatgcctttaatcccaacacttgg

SEQ ID NO: 99471 - DNA, 76 bp, Mus musculus
atgtgtatgtatgtatgtatgtgtgtgtgtatatatatgtacacacacacactcacatataataaaataaatacat

SEQ ID NO: 99472 - DNA, 85 bp, Mus musculus; identical to SEQ ID NO: 57439

SEQ ID NO: 99473 - DNA, 85 bp, Mus musculus; identical to SEQ ID NO: 57439

SEQ ID NO: 99474 - DNA, 78 bp, Mus musculus
aagaaaaaactcaagacaggaatgactaccaagttctcccagattttgtcagtttgtttttgttttttgttttttgtt

SEQ ID NO: 99475 - DNA, 64 bp, Mus musculus
gtgcacatgtgtgtgcatgtgcatgtgtgtgcgtacacacacacacacacacacacaaatacac

SEQ ID NO: 99476 - DNA, 75 bp, Mus musculus
ttcgtgcacatgtgtgtgcatgtgcatgtgtgtgcgtacacacacacacacacacacacacacaaatacacagaa

SEQ ID NO: 99477 - DNA, 64 bp, Mus musculus; identical to SEQ ID NO: 99475

SEQ ID NO: 99478 - DNA, 76 bp, Mus musculus
gtgcacatgtgtgtgcatgtgcatgtgtgtgcgtacacacacacacacacacacacacacacacacacaaatacac

SEQ ID NO: 99479 - DNA, 72 bp, Mus musculus
gtgcacatgtgtgtgcatgtgcatgtgtgtgcgtacacacacacacacacacacacacacacacaaatacac

SEQ ID NO: 99480 - DNA, 78 bp, Mus musculus
tccatcatctatatatgtatgtatgtatgtatgtatgtatgtatgtatgaatgtatatatgtatgaagtaatgattga

SEQ ID NO: 99481 - DNA, 114 bp, Mus musculus
agatagaataagacaggagagaaaaagaagtatgggagtgagagtgccaggctgtctctctgtctttcccattttattcctgtctaattctctctatctctatcttcttttact

SEQ ID NO: 99482 - DNA, 85 bp, Mus musculus; identical to SEQ ID NO: 57439

SEQ ID NO: 99483 - DNA, 93 bp, Mus musculus
gtatttgaatgattgcatcttaattagagtcgtcatttcttttttttagaaattgtttttgactctgtcagaagagtgtcagcatccagaaac

SEQ ID NO: 99484 - DNA, 84 bp, Mus musculus
gtccatggtgatctgataggatgcatgggacaatttcaatatttttgtatctgtgaggcctgttttgtgatcaattatatggtc

SEQ ID NO: 99485 - DNA, 84 bp, Mus musculus; identical to SEQ ID NO: 99484

SEQ ID NO: 99486 - DNA, 85 bp, Mus musculus; identical to SEQ ID NO: 57439

SEQ ID NO: 99487 - DNA, 82 bp, Mus musculus
gtttgttattttgcaaatcatatgttttattttaaacttgtgttcaaaagtcagaaaggaacacatgtggcaaagtaaaagc

SEQ ID NO: 99488 - DNA, 85 bp, Mus musculus; identical to SEQ ID NO: 57470

SEQ ID NO: 99489 - DNA, 85 bp, Mus musculus; identical to SEQ ID NO: 57439

SEQ ID NO: 99490 - DNA, 111 bp, Mus musculus
ccaggaggctaagttttactggagtggatgtaggatcactttttctaattctgtgaagaattgagttggaattttgatgggaattgcattgaatctgtagattgctttcgg

SEQ ID NO: 99491 - DNA, 105 bp, Mus musculus
tcattcatagtggtatatgtatgtatgtatatatatatgtacatatatatatatgtgtgtgtatgtatatatatacatgtatttatagaagagtatattaatatg

SEQ ID NO: 99492 - DNA, 85 bp, Mus musculus; identical to SEQ ID NO: 57439

SEQ ID NO: 99493 - DNA, 134 bp, Mus musculus
ctggccaaggagctctggggaggcagagctgctgtttctgggagagttgttggcaaggagagccactcagtctctgtctcaggctatgtagcaggctgggaacagactgagaccgcctgtgtctagccagcaat

SEQ ID NO: 99494 - DNA, 85 bp, Mus musculus; identical to SEQ ID NO: 57439

SEQ ID NO: 99495 - DNA, 112 bp, Mus musculus
ggtttaaaagctctatagggagctggagagatggctcagtggttaagagcactgactgctcttccagacgtcctgagttcaattcccagcaaccacatggtggctcacaacc

SEQ ID NO: 99496 - DNA, 111 bp, Mus musculus
gtcagaaccagaaattaagacagaaacttggaggtagggaatgaaccaaatgcaatgaaaaaatgcttctgtccattacttccttagtttgcttttttacttaacctaggc

SEQ ID NO: 99497 - DNA, 116 bp, Mus musculus
tttatgtagaggtgtttgatctatttgacgttgaattttgaagtgtaggtgataagtatggaactatgtacatttttgacatgcaagcatccaatagatttatgtgttgaaataag

SEQ ID NO: 99498 - DNA, 114 bp, Mus musculus
atatatatatacatacatgtatatgtatatatatacacacacatatatatacatacatgtatatgtatatatatgtatatgtatatatatgtatatgtatatgtatatgtatat

SEQ ID NO: 99499 - DNA, 93 bp, Mus musculus
agccctgcaattgtttcccaatgaggccttaaatattaaattgtatcttaatattaaattgtgtctccttttggaaactgctgcttttgtggg

SEQ ID NO: 99500 - DNA, 69 bp, Mus musculus
gatttggaaaatacattcagattccacacaaactctcctgtgtgcgtctgtctgtcatttatccacgtt

SEQ ID NO: 99501 - DNA, 106 bp, Mus musculus
gatcagccttagtccatgttgatctgataggatccatcggacaatttcaatatttttgtatctgttgagacctgttaattatatgatcagttttggaaaaggtatc

SEQ ID NO: 99502 - DNA, 105 bp, Mus musculus
tgaaatctgggcccacatagttgtgctatatatctatttctatatggtaggatttagcctatcacccagaggcaggtatgtggtaatttttaggtccctagagca

SEQ ID NO: 99503 - DNA, 68 bp, Mus musculus
tgtatatgtatatgtatatgtatatgtgtgtatacacacacacatataatatgtataatatatatata

SEQ ID NO: 99504 - DNA, 95 bp, Mus musculus
ggctttgttgttagtagaacagagtattcagagtgctgccttgaaactccagatgggtccaaacagtttatcttgtacgtactgcaaacagagtc

SEQ ID NO: 99505 - DNA, 119 bp, Mus musculus
atgtatgtatgcatgtatgtatgtatgcatatatgaaagtatgtattatgcatatatatatacatatatatatatatatatatatatatatatatatatcccttattcattcttttcta

SEQ ID NO: 99506 - DNA, 74 bp, Mus musculus
gagcaattagcttgtgttgttttgagggtctttgaacctgactcctctcaaaaaggcaactcaagatttgtctc

SEQ ID NO: 99507 - DNA, 68 bp, Mus musculus
atgtgtgtgtgtatgcaatataaatatatatgcaatatatatgtatatatttcatatatttgtcacat

SEQ ID NO: 99508 - DNA, 69 bp, Mus musculus
tggtgacctgataggatgcatgggacaatttcaatatttttgtatctattgaggactgttttgtcacca

SEQ ID NO: 99509 - DNA, 83 bp, Mus musculus
gctttgtatttgcttttaaagattatttctaattgtgtgtgtgtacacactagaaaccattgtaatcccagcaactgggaggc

SEQ ID NO: 99510 - DNA, 85 bp, Mus musculus; identical to SEQ ID NO: 57439

SEQ ID NO: 99511 - DNA, 74 bp, Mus musculus
gtcctagaattcagtaagtagaccagactgtctttgacctcacagagatctctgtctgcctgtctcccaggtgc

SEQ ID NO: 99512 - DNA, 115 bp, Mus musculus
tccttgaccaagttatcattgagaagagtgttattcagttcccaattgaatgttggctttctattatttatgtttttattgaagatcagccttagtccatggtgttctgatagga

SEQ ID NO: 99513 - DNA, 85 bp, Mus musculus; identical to SEQ ID NO: 57470

SEQ ID NO: 99514 - DNA, 70 bp, Mus musculus
gagagtctgttggagtcctctggccagcatgtctggtagtaggatttttattaaatagcatatggctctt

SEQ ID NO: 99515 - DNA, 85 bp, Mus musculus; identical to SEQ ID NO: 57439

SEQ ID NO: 99516 - DNA, 120 bp, Mus musculus
atatatgtgtatatacatgtatatatgtgtatatgttatatatgcatatatgcatacatatgtatatatatatgcataacataatggaaagtatccattaatatgtgcatttgtatatat

SEQ ID NO: 99517 - DNA, 100 bp, Mus musculus
gtgtgctactcctactgaaatcaacaggaatctctcaaacccactatcatcagatgtggttttcttgttttaaaccagttgaaggccttaattagcatgc

SEQ ID NO: 99518 - DNA, 91 bp, Mus musculus
agatattgttagttatgaatacaagtttctccttttttttaagttgttgaactagtttgagggagacaccagtatcatatatataaaatct

SEQ ID NO: 99519 - DNA, 85 bp, Mus musculus; identical to SEQ ID NO: 57470

SEQ ID NO: 99520 - DNA, 73 bp, Mus musculus
gtctggggaaaggatctgcttaagcatttagccaccacatatctcagtgctcttagtgtcacttgctccagtc

SEQ ID NO: 99521 - DNA, 101 bp, Mus musculus
gccaatatggtctaatttctcagtgagtatatgagcatatacaatgtatatttttatcaaaagtcatgtttaacctctgctaagaagctagatggggtggt

SEQ ID NO: 99522 - DNA, 110 bp, Mus musculus
accatgtattattgtctttcactttgtttatatgggaaattacattgatgaatgtttaaatatattgaactgtatctgtgtctatgtgatgaagactatgtgatcatggt

SEQ ID NO: 99523 - DNA, 84 bp, Mus musculus
tgtcctggttttagcttgtataccagatgtaggggaaagtgttgtttccctaattggttcttgaattggttaataaagaaggca

SEQ ID NO: 99524 - DNA, 85 bp, Mus musculus; identical to SEQ ID NO: 57439

SEQ ID NO: 99525 - DNA, 85 bp, Mus musculus; identical to SEQ ID NO: 57439

SEQ ID NO: 99526 - DNA, 89 bp, Mus musculus
ggaccagggaaacagtctatctcacagtctcctgaagagaggagagctctgtggagagatcagcaaactgtttctgtaaatttaggacc

SEQ ID NO: 99527 - DNA, 93 bp, Mus musculus
tgacaaaaagagaatatgactatgagtccaaattatttttgcttatttaagtagattacttttcactttctgaagttatttttctcgttgtca

SEQ ID NO: 99528 - DNA, 85 bp, Mus musculus; identical to SEQ ID NO: 57470

SEQ ID NO: 99529 - DNA, 107 bp, Mus musculus
tctgggtaactttaaataggctttggttgaaattgttgtaatttgattagttctatttttgtataagcaggataaccaaagcttatatagaattgttttttctaaga

SEQ ID NO: 99530 - DNA, 105 bp, Mus musculus
ctaatcctggaaggaattgttatattctaaatatgaaatactgtgaattttaatatttgttctatagtataaatcgttttacaatctacagtttcaggttgttgg

SEQ ID NO: 99531 - DNA, 105 bp, Mus musculus
tctatctgtctatgtgtatatatctgagtgcatatatatatatatatatatatatatatatatatatatatatagatgcacaatatgaatgcaggagcccatgga

SEQ ID NO: 99532 - DNA, 96 bp, Mus musculus
ttggctacatggttcttgttttagggacagggatagaaaaaaagagggggggctatggaatctctcactgtgactaagaaaaattgtttaagccag

SEQ ID NO: 99533 - DNA, 91 bp, Mus musculus
gattgaaaatcttaacttctaggtgggagagatggctcagcagttaagagcactgactgctcttccagaggtcctgagttcaattcccagc

SEQ ID NO: 99534 - DNA, 112 bp, Mus musculus
ttgaaagacatgaaaagaacatatgaggaagtgatcttggagggagtgatcagacaagctgatttgattatcctgaaagcagttacaatttcttagacccacatggtttcaa

SEQ ID NO: 99535 - DNA, 78 bp, Mus musculus
ctggctgttctggactctgtagaccaggctgtcctcgaaatcacagagatcagtctgtctctttctcccgagtgctgg

SEQ ID NO: 99536 - DNA, 73 bp, Mus musculus
tctgtatgtctgtctatgtctgtctttcctctctgggggaatctgtcaggcagatctcagtatctcacctagg

SEQ ID NO: 99537 - DNA, 118 bp, Mus musculus
aggtggtgaatagttatttggtcatgtgtcctccaggaaaattcatacaacataatctttttttttttttttgagatggtgtctcatgtagtccaggatgtcctcaaactcactttct

SEQ ID NO: 99538 - DNA, 85 bp, Mus musculus; identical to SEQ ID NO: 57439

SEQ ID NO: 99539 - DNA, 114 bp, Mus musculus
tcagtttagttctatattccatttttattgggttgtttggtttcttgatgatcatcttcttgagttctttatatattttggacattagccctctattggatgtgggattagtga

SEQ ID NO: 99540 - DNA, 85 bp, Mus musculus; identical to SEQ ID NO: 57439

SEQ ID NO: 99541 - DNA, 67 bp, Mus musculus
gtggaggagggctttgaggcctcctatgttcaagctatgcccagtgtctcacacagtctccttctgc

SEQ ID NO: 99542 - DNA, 121 bp, Mus musculus
ggtctttgaattgatttttgtgtatggtgagagatatggatctaatttcattctatatatgtatatccagttttgccagcattgtttatgaaaaggctatattttttttcagtaccaggaa

SEQ ID NO: 99543 - DNA, 119 bp, Mus musculus
tggctttctacctcagtccatgatgatctcataggatgcatgggaaaatttcaatatttttgtatctgttgagacttgttttgtgtccaattatttgatcacttttggagaaggtacca

SEQ ID NO: 99544 - DNA, 116 bp, Mus musculus
gcttgaaattgttccttttttagacactgctatttctcaaattctgtaattgtttatgtgaatacagcttaatttaagagaatgtactgttcctactttataggacacttaagagc

SEQ ID NO: 99545 - DNA, 84 bp, Mus musculus
gggcggctcctcacacactgtgtctctgtttagtttctgtttcaatgaactgtccattggtgagaatggggtttgaagtctccc

SEQ ID NO: 99546 - DNA, 97 bp, Mus musculus
caatttgtatccccttgatctctttttgttcttgaattgctctggctaggacttgaaatacaatgttgaataggtagggagaaagtgggcagctttg

SEQ ID NO: 99547 - DNA, 95 bp, Mus musculus
ccagagcatctacgagagccatcttcattcccagatcctgccaagactagtcttcacaggtgagagtgtggacgagagaagctaacaacttctgg

SEQ ID NO: 99548 - DNA, 118 bp, Mus musculus
agtaattagatagaaaaggtgcatggaatttttatgcagctcgcacttggtcatgtgaacatgttcaaggttgatttgcattggccaaattccaatcactgcagcagcatctgttact

SEQ ID NO: 99549 - DNA, 85 bp, Mus musculus; identical to SEQ ID NO: 57439

SEQ ID NO: 99550 - DNA, 113 bp, Mus musculus
tagcctacttctagaaggaaaaacaatatatgtatatgtatgtgtatgtgtatatgtatatgtgtatatatacatatgcacatcctttgtgttttaacttctctgaaaagttg

SEQ ID NO: 99551 - DNA, 87 bp, Mus musculus
ggcagtggggctgagaagctgcctgcatgatgcaaacatttgaaactaaagcaaggtggaagagcagggcttcccgcgtcccatgcc

SEQ ID NO: 99552 - DNA, 74 bp, Mus musculus
gaacttctcctgtaggggccagagagaataaagcagcgtgttccccaatttctctctgtctctgggagagtttc

SEQ ID NO: 99553 - DNA, 82 bp, Mus musculus
ttgtggatgtcaacagagctagctgacaggagcctgataaagctgtctcctgagaggctctgtcagtgcctgacaaatacag

SEQ ID NO: 99554 - DNA, 100 bp, Mus musculus
gccttagtccatggtgatctgataggatgcatgggacaatttcaatatttttgtatctgttgcgccctgttttgtgatcaattatatggtcaattttggt

SEQ ID NO: 99555 - DNA, 106 bp, Mus musculus; identical to SEQ ID NO: 65309

SEQ ID NO: 99556 - DNA, 99 bp, Mus musculus
agaatgatgctgttaataattgattcaatgtatttaatatatagtagacctattatagttttgtacatcttgtgtgaattatgacagactgtatcttct

SEQ ID NO: 99557 - DNA, 102 bp, Mus musculus
ttctgaagtctccttaagctgttaaaatatttgctactagagtacagattatgatgttcttattagttatatgtggatcccttttgggaacttattccagaa

SEQ ID NO: 99558 - DNA, 111 bp, Mus musculus
ccatttgagattgtggtagggttcggccctgtgctgctaccagagaccacatctgtgtctgtgaccatgtagcaacacagcagggttctgttgccaccaaagtccaggtgg

SEQ ID NO: 99559 - DNA, 105 bp, Mus musculus
ctctaagctccatttatttagtgtctatctggatgacttgtgcattggtgagagggcagtgtttaagtctcccaatatgtattggtttctatgtgtgatttagag

SEQ ID NO: 99560 - DNA, 85 bp, Mus musculus; identical to SEQ ID NO: 57470

SEQ ID NO: 99561 - DNA, 105 bp, Mus musculus
tgtcttgtaacatgtgtgtattatgtatgtatgtatgagtgcatgtttgtgtggatgtggacacatgcatttttgtgtacatgtgtacatgtgtaccttagggca

SEQ ID NO: 99562 - DNA, 85 bp, Mus musculus; identical to SEQ ID NO: 57470

SEQ ID NO: 99563 - DNA, 85 bp, Mus musculus; identical to SEQ ID NO: 60314

SEQ ID NO: 99564 - DNA, 90 bp, Mus musculus
ttctgcaatggggagtggttatcttcagactcacaacactcaaaatgctgagaaaagtgactgctgagaggtgctcatccctaaatagga

SEQ ID NO: 99565 - DNA, 115 bp, Mus musculus
tacatatatagtattactaaatatataaatgcaagctgctctgtttgtatataattgaatgtatgaatatatattcagagatgagcatttggtattagataagtaactgatgtat

SEQ ID NO: 99566 - DNA, 92 bp, Mus musculus; identical to SEQ ID NO: 57641

SEQ ID NO: 99567 - DNA, 112 bp, Mus musculus
gttttgtatcccactgtgtaattagactatttagactgttgatgtccagtttcttaagatctttatatattttggatgttagccctctatcagttgtggagttggtaaaaat

SEQ ID NO: 99568 - DNA, 71 bp, Mus musculus
tcagaggtggtgagagtcagaactgagagaggccagtatacttctcaggctttgaacttctcgagatctga

SEQ ID NO: 99569 - DNA, 80 bp, Mus musculus
gcaattcttgtgctgtattgtaattatttctgtctgtttctctcagtagactgtgaatactttgaggtcagggtcattgc

SEQ ID NO: 99570 - DNA, 103 bp, Mus musculus
tatgctgtgtggcaagactggtaatgttgatcttgagtattatggagtagtattaaagtatttgtatttcattagagccagctcataatggctacaccctata

SEQ ID NO: 99571 - DNA, 83 bp, Mus musculus
tccgatgtcctgcaactcccactgtcactgtttccctctgtaacaaggcaagggtgggtggggcttggcaggaagagaaagga

SEQ ID NO: 99572 - DNA, 85 bp, Mus musculus; identical to SEQ ID NO: 57439

SEQ ID NO: 99573 - DNA, 179 bp, Mus musculus
acacatatatacatacacacatatacgtatatgtatatatacacatatgtacatatatatacatacacacatatgtatatgcatatacgtatatatacatatatatgtgtatatatatgtatatatacatgtatttgtgtgtgtatatatgtgtgtgtattgtgtatgtgtgtgtgtat

SEQ ID NO: 99574 - DNA, 66 bp, Mus musculus
atgggtgtctgtatctgtctgagtcagctgctgggtggagcctctcagaagacaatatgcatctgt

SEQ ID NO: 99575 - DNA, 82 bp, Mus musculus
cacacacacacaaaaggatggtctcaagatagacttggtctttgccatttactgtgtttgtgtctctctatgtgtgtctgtg

SEQ ID NO: 99576 - DNA, 120 bp, Mus musculus
tccacatgctgtctatgctccatgtgttgtcttttatcaaaatgctgtctgttgctgtgtctgactctgttaggtaagctacaaccatttgagagggaaaaacatcagtagtggaaacag

SEQ ID NO: 99577 - DNA, 112 bp, Mus musculus
gtatagaccttgttttctaggactggcttcagtcaatacttagtttttgttttgcttaaaaaaataaatgggagagttgtttggaggagggtagattaagacagagttttgc

SEQ ID NO: 99578 - DNA, 80 bp, Mus musculus
tatagatagatgtatatatgtgtatgtatatgtgtatatatacatacacacacatatatatgtatacatatatatgtata

SEQ ID NO: 99579 - DNA, 83 bp, Mus musculus
cctagaaatctttatttgtatatataggtgtgcatgtgcccattcctgtgtatgtgtagtcatgtgtgcacgtgggggtgggg

SEQ ID NO: 99580 - DNA, 86 bp, Mus musculus
gtccctgagccactgtattaggcatggtgtaaggtagaagcttctagtctttggtatacctcagccagtgtggactctgccgggac

SEQ ID NO: 99581 - DNA, 103 bp, Mus musculus
gctgtttaaacacttattctgtggtgttttgttgtagcctcttagtatattaatatacatagtatagtattatataacatctgttgaatgagtgagggtcagt

SEQ ID NO: 99582 - DNA, 127 bp, Mus musculus
gggcaggtgggttgtgtgtgcaggtatgtgtatgtgtatgtgtgtgtgcaggtgtgtatgtgtgtctgtgtgtgtgtatgcaggtatgtgtacatgcatgtgtgtgtatgtgtgtgtgtgcacacag

SEQ ID NO: 99583 - DNA, 80 bp, Mus musculus
agatagatagatagcaggcttatatgtatatatatgtatacattatgcatacttgtgcatgtgcatatatgtatgtgttt

SEQ ID NO: 99584 - DNA, 60 bp, Mus musculus
ttagaattgttaggtagagagagagagagagtctgtctgtctgtctgtctgtctgtctga

SEQ ID NO: 99585 - DNA, 115 bp, Mus musculus
gatcagctaccccaagtagatacagggacttgaactctgatctgagagagcagtgtgtgctcataagcgctaagccatctctccaggcaccctgttttgtttattgaagctgttt

SEQ ID NO: 99586 - DNA, 115 bp, Mus musculus
tgtgtgtgtccatagcatgtgtgaaaaaagtagctcctctttgtatgattatatatagatagacacgaagagttgattctcagaatcatactgtaacagaattgtgtgccctaca

SEQ ID NO: 99587 - DNA, 92 bp, Mus musculus
cactaagccatcactctagtcctacatgtatgtatgtatgtatgtatgtacgtatgtatgcatgtatttatgttgaggtgtggtctgaggtg

SEQ ID NO: 99588 - DNA, 86 bp, Mus musculus
ggtcctctggaagagctgccgctgctctgtactgctgagccatctctcctgccctacaagtagtatctttttttttttttaagacc

SEQ ID NO: 99589 - DNA, 63 bp, Mus musculus
gcagaagacagctcactgtgcacacagagcaccagtgcacagggcacagtgactcagaacagc

SEQ ID NO: 99590 - DNA, 78 bp, Mus musculus
gctgtagggagaaggcactgaaagcacgggtatttaagtcattcttgttctgtgtctcggtgtctcggtgtctcaggc

SEQ ID NO: 99591 - DNA, 85 bp, Mus musculus; identical to SEQ ID NO: 57439

SEQ ID NO: 99592 - DNA, 92 bp, Mus musculus
gtacagaaggaaccagcccgaagatacatgggattgacagggttagcctgccccctctctgtctctctgtctgtgtctttgtctctctgtat

SEQ ID NO: 99593 - DNA, 95 bp, Mus musculus
attactactgtgacatagaacttataagttgatttcttttgaaaaatttcatattacctcaagggagatttactagtagttcctacagctgtgat

SEQ ID NO: 99594 - DNA, 74 bp, Mus musculus
tacatacacatatatatgtatgtatgtatgtatgtatgtatgtatgtatgtatatgcgtgtgtgtgtgtgtgtg

SEQ ID NO: 99595 - DNA, 95 bp, Mus musculus
attactactgtgacatagaacttataagttgatttcttttgaaaaatttcatactacctcaagggagatttactagtagttcctacagctgtgat

SEQ ID NO: 99596 - DNA, 73 bp, Mus musculus
tgggatgatatgtgatatagcttgtaaagttaatgcagcaggcttaaattcaagaagatgatgtattatctca

SEQ ID NO: 99597 - DNA, 94 bp, Mus musculus
gatcagccttagttcgtggtgatttgaatagatgcatgggataatttcaatatttttgtatctgttgaggcctgttttgtgactgattctggtc

SEQ ID NO: 99598 - DNA, 95 bp, Mus musculus; identical to SEQ ID NO: 99595

SEQ ID NO: 99599 - DNA, 84 bp, Mus musculus
acatacacatatatatgtatgtatgtatgtatgtatgtatgtatgtatgtatgtatgtatatgcgtgtgtgtgtgtgtgtgtgt

SEQ ID NO: 99600 - DNA, 95 bp, Mus musculus; identical to SEQ ID NO: 99595

SEQ ID NO: 99601 - DNA, 84 bp, Mus musculus; identical to SEQ ID NO: 99599

SEQ ID NO: 99602 - DNA, 95 bp, Mus musculus; identical to SEQ ID NO: 99595

SEQ ID NO: 99603 - DNA, 78 bp, Mus musculus
tacatacacatatatatgtatgtatgtatgtatgtatgtatgtatgtatgtatgtatatgcgtgtgtgtgtgtgtgtg

SEQ ID NO: 99604 - DNA, 95 bp, Mus musculus; identical to SEQ ID NO: 99593

SEQ ID NO: 99605 - DNA, 82 bp, Mus musculus
gagacattttcctacatggttagaaagttatacagcaccctaagcctgtctgtgccttcttccctattaggaaacgatgctc

SEQ ID NO: 99606 - DNA, 94 bp, Mus musculus
ggctctggctgtctggctctatagctttctgactcactggctctggctctggttatggctttttggctcaggatctctggctctagctttggct

SEQ ID NO: 99607 - DNA, 73 bp, Mus musculus
ggctctgactgtcaggctctcacttcagccgtgcctctggctatctgactttggctgtctggctctctgactc

SEQ ID NO: 99608 - DNA, 92 bp, Mus musculus
gccccatggctctgtggccctatgactctatgactttatggccctggttcactggctcactgactcactagctctatggatatggctctggc

SEQ ID NO: 99609 - DNA, 94 bp, Mus musculus
gctcaaggaccctctgggtctggctctgactctagatctggctctggctttctgagtatctgtctctgtctctggttctgctctggctctatgg

SEQ ID NO: 99610 - DNA, 90 bp, Mus musculus
tagctctgcttctggctctagctctcagcctgattcatagatctggttcactgtctctctgtctcaggtttggctcagtctgtcttgctg

SEQ ID NO: 99611 - DNA, 83 bp, Mus musculus
accttctctgtctctgtctctggttaaggttctctgtggctgcggctcaggatttttgactctgtttggctctggctttaggt

SEQ ID NO: 99612 - DNA, 90 bp, Mus musculus
tttttgttctttgagacagggtgccactatatagttctgactgactcagtgagtttgctgtgagtctatgtctcctaggaatgtcagaag

SEQ ID NO: 99613 - DNA, 67 bp, Mus musculus
gggaaagaattccaaaagcaagtgaaagagtcagagacacactctgactcccactgttaggagtccc

SEQ ID NO: 99614 - DNA, 122 bp, Mus musculus
ggatttgattgtgacagatggttgggccaggccagtgtgggtgtacaaatgtttgaatgtatacatgtctgtgcatatttgcctgtataaagcatttcaggttctgtttcattttcataatt

SEQ ID NO: 99615 - DNA, 129 bp, Mus musculus
tatatgtacattggtgtatatgtgcagtgcatatgtgtatatgcatatgtatatatgtatatacatataattgaaattgtaacactgtgaaggcatgtgcatatatgtatatatacatatgtgtatata

SEQ ID NO: 99616 - DNA, 74 bp, Mus musculus
ttgtaccaccatttaaattctcatagttactgaagtattagtgtaatttgagacactgttaaatggatggacaa

SEQ ID NO: 99617 - DNA, 82 bp, Mus musculus
tgcagggtgttcaatcggcggctccctccacgcgggctccaccggcgctcgctggctggctggctggctggctggctctgca

SEQ ID NO: 99618 - DNA, 77 bp, Mus musculus
gatctcctttcacactctgtgtgtttgcttcctttatagtggaagtttagtgagaggctcaaagtgggatggagctc

SEQ ID NO: 99619 - DNA, 81 bp, Mus musculus
cagatggttgtgagccactatgtagtttctgggaattgaactcagtacctctgagagaacagtcagtgctcttaaccactg

SEQ ID NO: 99620 - DNA, 70 bp, Mus musculus
caagagggcaaggtcagttttgcttgtgtagaaggcaactcctcgaagcactcaggctctggctctcttg

SEQ ID NO: 99621 - DNA, 118 bp, Mus musculus
gaagtgatgttaaaagatagaaatggggaatggagagatagctcactggttaagagcaatgactgctcttccagaggtcatgagtagctcacaaccgtctgtcatgggatctcatgtc

SEQ ID NO: 99622 - DNA, 82 bp, Mus musculus
agcccgcattaacctgaaactcaggaatgtatagaactttgttctgtacatactgagttgtccatgtcagtgtatcagggtt

SEQ ID NO: 99623 - DNA, 112 bp, Mus musculus
ctagggtgcactggagccattgcaggagaagggactgaggatagggagataggacagaatatagtgtgcactctctgaccccagtgttccctgtgtgaaacaggtatgagag

SEQ ID NO: 99624 - DNA, 108 bp, Mus musculus
ccttagtccatggtggtctgataggatggatgcatgggacaatttcaatatttttgtatctgttgaggcttgttttgtgaccaattctatggtcaattttggagaagg

SEQ ID NO: 99625 - DNA, 106 bp, Mus musculus
accttaggccatggtggtctgataggatgcatgggacaatttcaatatttttgtatcagttgaggcttgttttgtgaccaattctatggtcaattttggagaaggt

SEQ ID NO: 99626 - DNA, 106 bp, Mus musculus; identical to SEQ ID NO: 57715

SEQ ID NO: 99627 - DNA, 85 bp, Mus musculus; identical to SEQ ID NO: 57470

SEQ ID NO: 99628 - DNA, 85 bp, Mus musculus; identical to SEQ ID NO: 57439

SEQ ID NO: 99629 - DNA, 65 bp, Mus musculus
gctggtcagtggcactgtctgtcatcctctgatggaatgtcctttgagattggaccatgaccagt

SEQ ID NO: 99630 - DNA, 79 bp, Mus musculus
gcctgtctgcctgcctgcctgcctgtgtgtgctgtgtgcttgtgcatggtgtgtgtgtgctgtgtggtttgttgcgtgt

SEQ ID NO: 99631 - DNA, 86 bp, Mus musculus
ggaacaatctgtgaaatgaaaagaagactgtctgcaatgtggatttatcctgtgccagtccagtcatttctgtcgtagaagtcaca

SEQ ID NO: 99632 - DNA, 78 bp, Mus musculus
cctgtgtgtgtgtctgtctgtcattcatccacgctttgcccacccgcgtcgagagaccctgttccacgcagacacagg

SEQ ID NO: 99633 - DNA, 120 bp, Mus musculus
tagtggtggtggtggtggtggggctggagagatggctcaatggttaagagcactgactgctcttccagaggtcctgagttcaattcccagcaaccacatggtggctcacaaccatctcta

SEQ ID NO: 99634 - DNA, 91 bp, Mus musculus
tgttcaggaccaaaaggagcagtttattggttttgtgggcaatgctcagatactgccaatagaaagtataaaactaactggattgtgagca

SEQ ID NO: 99635 - DNA, 116 bp, Mus musculus
ggctcttatcctttgtgttcctggtgcccaaagaggccagagaagtgagtcagatctcctagaattagagctctggacagttgttagcctgccacgtgggtgctgggaattgagcc

SEQ ID NO: 99636 - DNA, 86 bp, Mus musculus
ttgttttcacagtgcacagaaacgtttgactttttcgcactattttcttgtacgttgaaaagttgtgtctgtagctgaggtcacag

SEQ ID NO: 99637 - DNA, 81 bp, Mus musculus
cacacacacacacacactcaggttctttgcctctctcctgctcttttcttttctctttttctgtgtgtgtgtgtgtgtgtg

SEQ ID NO: 99638 - DNA, 106 bp, Mus musculus
tgttaattatgtttgctatacatacatatatacatgcatatatgtataacatgaatatatatatatatacatagatatataacatatgtatacacacatacacaca

SEQ ID NO: 99639 - DNA, 120 bp, Mus musculus
tgtatatatgtgtgtgtgtgtatgtgtgtatacatatgttatatatctatgtatatatatatatattcatgttatacatatatgcatgtatatatgtatgtatagcaaacataattaaca

SEQ ID NO: 99640 - DNA, 91 bp, Mus musculus
gcaagagctgcagagctggcccagtcagtccctctcaggctgcagcacgtgggagagctggccccagtggagctgtctctggaggtgtggc

SEQ ID NO: 99641 - DNA, 81 bp, Mus musculus
tctgctacatatgaaactagagacacagctctggagggtattggttagttcagattgttgttctttttatagggttgcaga

SEQ ID NO: 99642 - DNA, 81 bp, Mus musculus
atgtcttttggaagaacaactagtgttgttaatctctgagccatctcattagccttcaatatttttgttttcaaaagatgt

SEQ ID NO: 99643 - DNA, 83 bp, Mus musculus
ggtggcagaactatgtcactgaggatgggttttgaaattttaaaaacccatgccaggcccagtgtctctttctgtctgctgcc

SEQ ID NO: 99644 - DNA, 101 bp, Mus musculus
gagcatttcaaatagtgtgtttgtcacttcaatatttattgaataatttatttaatttccttccatattcaaatgacaggtttactgtacattgaatgctc

SEQ ID NO: 99645 - DNA, 112 bp, Mus musculus
gatcagtcttaggccatggtggtctgataggatacatgggacaatttcaatatttttgtatctattgaggcctgttttgtgaccaattctatggtcaattttggagaaggtc

SEQ ID NO: 99646 - DNA, 107 bp, Mus musculus
aatgtgagtgaaaataaactaggcattcattcttttattgattatataacaccgagttttgtataatgcattatgtgtagggtggctgcctccagctcactgacatt

SEQ ID NO: 99647 - DNA, 113 bp, Mus musculus
cttcacaactatctccaaataattagcaagtcttatcgcataggtagaatacagaaagtaatctgggttggtgggaaatgaacagtaattgaaatgagataaattaaatgaag

SEQ ID NO: 99648 - DNA, 96 bp, Mus musculus
gatcagccttagtccatggtgatttgataggatgcatgggacaatttcaatatttttgtatctgttgaggcctgttttgtgaccaattatatggtc

SEQ ID NO: 99649 - DNA, 81 bp, Mus musculus
atctctcacagtctcacttactggcatatgggaacagataggatcagtctgagtacttcagaagctgagaaactgggcgat

SEQ ID NO: 99650 - DNA, 96 bp, Mus musculus
gatcagccttagtccatggtgatttgataggatgcatgggacaatttcaatatttttgtatctgttgaggcctgttttatgaccagctatatggtc

SEQ ID NO: 99651 - DNA, 96 bp, Mus musculus
actggaccaagggctgtctctgactctgtgcctgccattggattccctccccctacctggttaggcttcagcaggagaggatgtgcgtggtcctgt

SEQ ID NO: 99652 - DNA, 65 bp, Mus musculus
tctgtagctggcttcctgagagggactggaaaaaaactctctgaggaagtagtttgtaattcaga

SEQ ID NO: 99653 - DNA, 119 bp, Mus musculus
atatgatatatcatatgtgatatattgcatattatatatcacacatattatatatggatatcatatgtatggtgcataatacattatatgcaatatgtaatatatagcataaatcatat

SEQ ID NO: 99654 - DNA, 83 bp, Mus musculus
gtgaggttagagatccctgggctatactagaaaatcctgattgattcaaacattttcaacagtagatccagttctaatctcat

SEQ ID NO: 99655 - DNA, 89 bp, Mus musculus
cagatttgtgcatggtctcatgtctattgcgtggctagttaagactctaactagacagtctgacactagagcctgtgctgcttagtctg

SEQ ID NO: 99656 - DNA, 104 bp, Mus musculus
tatagccatgggtatatatatatatatatatatatatatatatatatatatatatatacatatccacccctgtatatgtatatgtatatgtatatgtatatgta

SEQ ID NO: 99657 - DNA, 85 bp, Mus musculus; identical to SEQ ID NO: 57470

SEQ ID NO: 99658 - DNA, 112 bp, Mus musculus
tcagccttagtccatggtgttctgataggatgcatgggacaatttcaatatttttgtatctgttgaggcctgttttgtggtcaattttggagaaggtaccatgaggtgctga

SEQ ID NO: 99659 - DNA, 62 bp, Mus musculus
gagctccggggtactggttagagacagggtttctctgtatatctctgtctgtcctggaactc

SEQ ID NO: 99660 - DNA, 116 bp, Mus musculus
ttgaagatcagccttagtccatggttatctgataggatgcatgggacaatttcaatatttttgtatctattgaggcctgttttgtgaccaattatatagtcaattttggagaaggt

SEQ ID NO: 99661 - DNA, 104 bp, Mus musculus
gccttagtccatggtgatctgataggatgcatgggacaatgtcaatatttttctatctattgaggcctgttttgtgaccatatatggtcaattttggaaaaggt

SEQ ID NO: 99662 - DNA, 74 bp, Mus musculus
agagtggtttgctgttcttctagaggacacaagttcagttcctagaacctatatgagacagctcacaaccacct

SEQ ID NO: 99663 - DNA, 61 bp, Mus musculus
gtgaccagctgggtgtggagagacatgctgtttactctgagtctctctccaactgagccac

SEQ ID NO: 99664 - DNA, 85 bp, Mus musculus; identical to SEQ ID NO: 57439

SEQ ID NO: 99665 - DNA, 65 bp, Mus musculus
taggccatggttatcagataggatgcatgtgaatatttcaatatttttgtatctgttgaggcctg

SEQ ID NO: 99666 - DNA, 87 bp, Mus musculus
atctcttctgtgcactggggagagtgtcctgaactacatgctgcagtttaatcagttagtgacaggagacacagagcacggagggat

SEQ ID NO: 99667 - DNA, 111 bp, Mus musculus
gcgacttttctctgtcagcctcacgcttagccaaaccctctctctgtctctgacatattccacatcgtttggcttccaaactagttttgacgtctctccagagaggactgt

SEQ ID NO: 99668 - DNA, 76 bp, Mus musculus
tcttgatcacaatatatatgatctatgtatatgtgcacatgtgtaggtatatgtgtatgtatgtatgtatgtagga

SEQ ID NO: 99669 - DNA, 76 bp, Mus musculus
tatgctcttgagtatttatatatatatgcatatgtttgtgactctggcatatgcatacatgggagatgcatgcata

SEQ ID NO: 99670 - DNA, 116 bp, Mus musculus
gctatatagttgtatgtttttaatgctcaatactaatgagagaaaaagatgtgtttttcatgcattttgttcatttctctttaatgtatcaattgaacacaaacgatgggaaaagt

SEQ ID NO: 99671 - DNA, 71 bp, Mus musculus
atatatatacatatatatattacaagtatatacatatatatacttgtagatatataaacttgtatgtatat

SEQ ID NO: 99672 - DNA, 143 bp, Mus musculus
caagattgggagttggcagaaagagggaagctattatttttgatttgcttcaatccatcttgtcttgtctgtctgtctgcctgtcttgcctgtcccctccatccctctctccattcagggacttttagaactgtggcagcagg

SEQ ID NO: 99673 - DNA, 101 bp, Mus musculus
tcattccttgggtttgggtcctggactgtacagaaggaagaaagtgagcacacatgcatcagttgctcttttctctatactgaggatataatttcatgtga

SEQ ID NO: 99674 - DNA, 71 bp, Mus musculus
cttgaccaacaagtgttgcccagctagctctataggcaagcctagctcaggctctgtcactgtccgtcaag

SEQ ID NO: 99675 - DNA, 111 bp, Mus musculus
ctctcttgttctcttttctgtacattatactgtttgcatatgtacatttgtttatgtatatacatatattattggctagacggagaagatgcagcctttttttcctgagag

SEQ ID NO: 99676 - DNA, 109 bp, Mus musculus
ctggtcagcaagatttagagctctatctgcctagttctccaattaggaactgtagtgattttaatgagaatgtctcccataggctcataggtttgaatacttagtccag

SEQ ID NO: 99677 - DNA, 83 bp, Mus musculus
ggttaagggcactgactgctcttccagaggaccctggttcaaatcccagcacctgctgtaacagctcacaactgtctataact

SEQ ID NO: 99678 - DNA, 85 bp, Mus musculus; identical to SEQ ID NO: 57439

SEQ ID NO: 99679 - DNA, 111 bp, Mus musculus
ctgtttcaaccttaataggagaggaggtgcctagtcttagtgcaacttgatgtgtcatgtctggttgatatccatgagaggcctggtcttttctgaagagaaaggaagggg

SEQ ID NO: 99680 - DNA, 90 bp, Mus musculus
ctccttccgcatacagaggtcttaggttatactatttatatgtattacagtgcaagtaagaataggtgtaggcttaaaactgggaagggg

SEQ ID NO: 99681 - DNA, 81 bp, Mus musculus
tgacacacatccctgacagtttggactatgtatgtatgtatgtacgtatgtatgtttgagtctctgctctcttggagttca

SEQ ID NO: 99682 - DNA, 105 bp, Mus musculus
gggaacagtatactccagtcggaaggaatcctagagtcggtttaaagttaaagattgaatattactttataattaatgctacatagactgtaagtgtatcttcct

SEQ ID NO: 99683 - DNA, 111 bp, Mus musculus
ccattgtttggattaggtagtttgggttcagggaagagaactaagagtgcagagttctatgacgctttagaggtggcattctctcaatttttttatttgcttcatgaatgg

SEQ ID NO: 99684 - DNA, 99 bp, Mus musculus
ccaaagtgggtggctaattcacatggccatttagaaacttttaatttttaattcgtcgaatctttctcagtcacataaagtgtgttgctcccaaattgg

SEQ ID NO: 99685 - DNA, 85 bp, Mus musculus
gcagatgtgcagcttggtcttcatgtgggtccccttacaagtggaagggggactgtctctgactctgtcctctgccattggatcc

SEQ ID NO: 99686 - DNA, 101 bp, Mus musculus
cttagagtccttgggtatagctccaagaacaatatagttgggtcatatggccattctatttttagtttttaagaggtgtccatacctaatgactgcataag

SEQ ID NO: 99687 - DNA, 79 bp, Mus musculus
tgtctttgtacaagtaacaccccagataagagtggcttagaagactggatgccctctggctctgactgtgtcagggaca

SEQ ID NO: 99688 - DNA, 108 bp, Mus musculus
agtagggtataaagtatatattatatacttgctatatatactatatataataaaggctaaaagtatatgtatatatactatatatatgttatatactgtatctgtact

SEQ ID NO: 99689 - DNA, 105 bp, Mus musculus
gttcagctcattttgagaatgcttcatgttggctgcagaaagcacaagatttatctttttgaatttatggtaagaaggcaaacagaagtccttgaaagagaaggc

SEQ ID NO: 99690 - DNA, 74 bp, Mus musculus
gaactcactatgcagagcaggatagcctcaggctcacagagatctgtctgtttctgtctctggatcgtgagttt

SEQ ID NO: 99691 - DNA, 106 bp, Mus musculus
aagattgatggtgggtgctgctggatttctgcacctcttcttccattgcctgcctctctctggctctgggatctgagagaattctttgtgttccattcatattctt

SEQ ID NO: 99692 - DNA, 111 bp, Mus musculus
tacagttcgtgggtgcggtgggggggggggggaatgaaaagtcactctaggtgaagtagtattagcttgattagcatttcccaaattgacttctatggtattccacctgtg

SEQ ID NO: 99693 - DNA, 74 bp, Mus musculus
tatgtgtgtatgcatatgtatgtatgtatgtatgtaaatatgtgcatatgtgtgtatgtatatatgtgtatgca

SEQ ID NO: 99694 - DNA, 74 bp, Mus musculus
ccttttttcctttaaaaataagtatgtacgtacgtatgtatgtatgtatgtatgtatgtattaatgaagtaggg

SEQ ID NO: 99695 - DNA, 102 bp, Mus musculus
agcatgtagggagagaaaataggcacaggacccaaagaagtgagagaggacacagcaaactcccatttcctgtttgtcggttactgttttgctccttcgtct

SEQ ID NO: 99696 - DNA, 56 bp, Mus musculus
tacatacatacatacacacatatatgtatgtatgtatgtatgtatgtatgtatgta

SEQ ID NO: 99697 - DNA, 86 bp, Mus musculus
gtggtagcatatctgtctgtttgtctgtctaccaggtcagtgagatctcatagatccttcaggacattacagactcttgctgttac

SEQ ID NO: 99698 - DNA, 94 bp, Mus musculus
tcatgtgatcctggttgtgtcagaactcctctgagtcaatctgtctctgggatcctgtgattctgggatcctgagatcctgagatcctgggtgt

SEQ ID NO: 99699 - DNA, 66 bp, Mus musculus
ggttccggctcaggctcaggcttaggctcaggctcaggctcaggctctgtctcagtctccgggtcc

SEQ ID NO: 99700 - DNA, 105 bp, Mus musculus
agagggagacattattactatattattacagatgaggaaattatgaggaagaaaagctaagtttcttaatatttgtagttaatgtagttgaaaatggcagcatct

SEQ ID NO: 99701 - DNA, 119 bp, Mus musculus
tattgaagataagacttagtccatggtggtctgataggatgcatgtgacaatttcaatatttttgtatctgttgaggcctgttttgtgaccaattatattgtcaatgttggagaaggtc

SEQ ID NO: 99702 - DNA, 57 bp, Mus musculus
caggctgtctgctttgtacctactgggattaattctcagtctcagtcagtcagcttg

SEQ ID NO: 99703 - DNA, 88 bp, Mus musculus
tgtgtgtgtgtgtgtacatgtatatatgtatatgcatatatatgtgtgtgtgtatatatgtatatgcatatatatataaccaacatgt

SEQ ID NO: 99704 - DNA, 108 bp, Mus musculus
gggcagaagtggggatttggaagggatgaagttataagaaatagggtggagagcagaggggctctgtctctcagtgaattatggctgcccttggccttttttaggttc

SEQ ID NO: 99705 - DNA, 73 bp, Mus musculus
ctctaatgacacacacgcactgtgtttgccttacattgcattgctgagctccacttgtggtgatgttctagag

SEQ ID NO: 99706 - DNA, 101 bp, Mus musculus
gggtttaggaagtatatgaatgacacatgagcttggtgtttagacttgagtgctatccctaaaatatttcattatatgcatataaatattccgtgtcaccc

SEQ ID NO: 99707 - DNA, 80 bp, Mus musculus
atgtgtgaatgcttgtatgtatgtatgtatatacatatgtatgtatgtggatatgtgtgtatctatttctatttacacat

SEQ ID NO: 99708 - DNA, 77 bp, Mus musculus
gttagtcactttgtgatttgtgtatatatcaatatttgatatatttaaaacacatgcacttttggaaaggtggtagc

SEQ ID NO: 99709 - DNA, 63 bp, Mus musculus
tatatgcatatgtatatgtatgtatgtatgtatgtatgtgtatacaatatatgtatgaatata

SEQ ID NO: 99710 - DNA, 106 bp, Mus musculus
ggccatggtggtctgataggatacatgggacaatttcaatatttttgtatctgttgaggcctattttgtcaccaattatatggtcaattttggagaaggtcccgtg

SEQ ID NO: 99711 - DNA, 119 bp, Mus musculus
ctctacactgtgttagtccttgttgtttgatggacatttgggctttttacaattcttgttgattatgaataaagctcctatgaacatagacttacagatttttatgcaaagcttcagag

SEQ ID NO: 99712 - DNA, 86 bp, Mus musculus
tcctcccattgatgccagatgagaccatcctctgctacatatgcaggtggagctgtgagtccctctctgtgtgtcctttggttgga

SEQ ID NO: 99713 - DNA, 74 bp, Mus musculus
tgtgtgctctatgtgtgttctatgtgtgctcaaccgaagtgccgtggttgaaagagaacacagagagttcagca

SEQ ID NO: 99714 - DNA, 64 bp, Mus musculus
ggatatatatagatatagatatatagatatacatatatatgtatatctatatctctatatatac

SEQ ID NO: 99715 - DNA, 117 bp, Mus musculus
ctaggaaaggcagtggagtgtgatgagtagttcgtggcaggcaaaatggtggttgaatctatgactgtggcagttctaacacatagctcaactcagtggcacttggcaggagtctag

SEQ ID NO: 99716 - DNA, 109 bp, Mus musculus
gtttgagacagggttgcccactgaaagacactgctcactcactctctcagctaaagtaactggctaggaaagcactgggattcaaaggcctttacacccactcttccac

SEQ ID NO: 99717 - DNA, 120 bp, Mus musculus
cataagggaaattggtatgaagttctctatcattgttgggtctttctatggtttagatatcagagtaattgtggcttcatagaatgaattgggtagagtactttctgcttctattttgtg

SEQ ID NO: 99718 - DNA, 118 bp, Mus musculus
gggtttcctggatagggtttgtttgacagggtttgttgagggtggtgaatatgtagttgtgacagaagggagattatcactcaatggaatgcttgaccaaccaaatttcagagaatct

SEQ ID NO: 99719 - DNA, 107 bp, Mus musculus
gggtaattaaagacagtagtggggctggagagatggctcagtggtaagagcactgactgctcttccagaggtcctgagttcaattcccagcaaccacatggtggctc

SEQ ID NO: 99720 - DNA, 111 bp, Mus musculus
gatcagccttagtccatggtgatctgataggatgcatgggacaatttcaatatttttgtatctgtggaggcctgttttatgacagattatatgatcgattttggaggaggt

SEQ ID NO: 99721 - DNA, 88 bp, Mus musculus
cacggtgttccttaggtgtttttctttatgattatgtccataaaacatgactagtgtctaggaagatggcttgatgggtaagcacgtg

SEQ ID NO: 99722 - DNA, 71 bp, Mus musculus
ctgggccagagggtctctgtcactcttaggtgtcgccagaacagaaagcagagagagggagagagggtcag

SEQ ID NO: 99723 - DNA, 113 bp, Mus musculus
ctttagatgaactaagtctatgtgctagaggagggacattgaagacagcaggaactcgaagtgcatgtgctctctacctcacatatggcgtggggctaatagtaaagctaggg

SEQ ID NO: 99724 - DNA, 71 bp, Mus musculus
gtcccgttatctcaagctgtactggggtcaagagactgagctcaaatggtgccagtggtggatagagggat

SEQ ID NO: 99725 - DNA, 65 bp, Mus musculus
tgcacaataagtagctcatcatatatacatatatatgtatatatgtgagtatatatgtatgtgta

SEQ ID NO: 99726 - DNA, 76 bp, Mus musculus
gactgtgtgactgtgtatctgtgtcttttttcaaggatttaagggaaggcaggaggggggatggtagcatggtcac

SEQ ID NO: 99727 - DNA, 70 bp, Mus musculus
gctgaaacacactcactctatcccgtgcaatgagactagcctcgtggggtgcaagagctgaatggccagc

SEQ ID NO: 99728 - DNA, 107 bp, Mus musculus
agagagagccaaggaaaagaaaccaaatggcctgtgtatgtgctgtaaaattatttttctatatgcatttattgtttcttttttcaggttataattacatttctctc

SEQ ID NO: 99729 - DNA, 77 bp, Mus musculus
cctagacactgagtaaacatggaccaggcatgtttctcctatttcatgtctgaacaccagttgctgagcaaattggg

SEQ ID NO: 99730 - DNA, 106 bp, Mus musculus
gtgcatgcacatgcaagtgcattcatttatgtgtgtctgtgtctgtgtatctgtgtgtgagatgtgtggttatgggttggtatatgtatagattaactggcatgtg

SEQ ID NO: 99731 - DNA, 81 bp, Mus musculus
tttctgttggttgaatgaactgaattggacccttaagttcaatgagactcacttcagtggcactcagtcactttatagaaa

SEQ ID NO: 99732 - DNA, 108 bp, Mus musculus
gataactatgaatgtgtgttttttctgattatcacactggaaagcaagttccactaagattttttttttatctactagccctagtgaggagcacagcaattggctatc

SEQ ID NO: 99733 - DNA, 85 bp, Mus musculus
ggccatgatggtctgataggatacatgggacaatttcaatatttttgtatctgttgaggcctattttgtgaccaattatatggtc

SEQ ID NO: 99734 - DNA, 85 bp, Mus musculus; identical to SEQ ID NO: 57439

SEQ ID NO: 99735 - DNA, 116 bp, Mus musculus
ggtgtgttgtgtgagtatatgtgagagagagacagacagatagagacagagagacacagagagactctatgtagtcctgagtgattttgagattgctatgtatatcaggctgaccc

SEQ ID NO: 99736 - DNA, 85 bp, Mus musculus; identical to SEQ ID NO: 58391

SEQ ID NO: 99737 - DNA, 85 bp, Mus musculus
gtccatggtgatctgatagggtgcacgggataatttcaatatttttgtatctgttgaggcctgttttgtgaccgattatatgggc

SEQ ID NO: 99738 - DNA, 96 bp, Mus musculus
gatcagccttaatctgtggtgatcagataggatgcataggataatttcaatatttttgtatctgtggaggcctgttttgtaaccaattatatggtc

SEQ ID NO: 99739 - DNA, 75 bp, Mus musculus
tatatttagcactcactagctcactgacaggcaccaactggaaggatgccatttgttaagtgactgcgatgtata

SEQ ID NO: 99740 - DNA, 85 bp, Mus musculus; identical to SEQ ID NO: 57439

SEQ ID NO: 99741 - DNA, 61 bp, Mus musculus
gctccagccactgcttggctgtgggtctctaaatcactctgagtcagctgctgggtggagc

SEQ ID NO: 99742 - DNA, 106 bp, Mus musculus
gccttagtccatggtgatctgataggatgcatgggacaatttcaatatttttgtatctgttgaggcttgttttgtgaacaattatgtggtcaattttggagaaggt

SEQ ID NO: 99743 - DNA, 116 bp, Mus musculus
gaaagccttttaaaagaaatggtgttggagctggtgagatggttcagaggttaagagcactgactgctcttccaaaggtcctgagttcaaatcccagcaactacatggtggcttac

SEQ ID NO: 99744 - DNA, 118 bp, Mus musculus
gtgacatttcatggaagcagtgctagacttaatgttgagggacctggagttcagttctgtctctgccaccaaatttgttgcatgatatttagcaagccactctggatttcagttcctc

SEQ ID NO: 99745 - DNA, 97 bp, Mus musculus
ggatgaaaggttatgtaaatatctgttagatccatttggttcataacttctgttagtttcactctgtctgtttagtttctgtttgcatgatctgtcc

SEQ ID NO: 99746 - DNA, 77 bp, Mus musculus
gatgaaagtgcctctgtgtttaagcaagaccatgtgcatccccaggcgtcttgtttgtcagtctgggagactttctc

SEQ ID NO: 99747 - DNA, 97 bp, Mus musculus
gttgacctatatgaggatactcagaacccatacgtggcagctcagtgacactctttctgtctcatgcttcacagtctggtacttcattaccatctac

SEQ ID NO: 99748 - DNA, 85 bp, Mus musculus; identical to SEQ ID NO: 57439

SEQ ID NO: 99749 - DNA, 73 bp, Mus musculus
gttcatggtggtctgataggatgcatgggttagtttcaatatttttgtatctgttgaggcctgttttgtgagc

SEQ ID NO: 99750 - DNA, 98 bp, Mus musculus
tctatacaccaattttaatagggttatctgattctctggagtctaacttcttgagttctttatttatattggatattacccctatattggatgttgga

SEQ ID NO: 99751 - DNA, 99 bp, Mus musculus
cttcttgaaagaggctaatgtgctagatgtgttggctagttttatgtcaacttgacacaagatagagtcatcaaagaggaggaagcctcaactgagaag

SEQ ID NO: 99752 - DNA, 110 bp, Mus musculus
gagtttcacttcatgtaacactgcagatatgtctgcaaactgaggtatagttgacataatagactgagaactctagtaatgaatatatctgtagtaatctaaagctgctc

SEQ ID NO: 99753 - DNA, 65 bp, Mus musculus
ctgcaggcctgagctacttggttctttgttactagaacgaagtgcctgagatagtcagcttaagg

SEQ ID NO: 99754 - DNA, 69 bp, Mus musculus
ttgtgtgtgtgtctctctgtgtacttaatgttgtttcatatatatacatatacatagacatatacatag

SEQ ID NO: 99755 - DNA, 115 bp, Mus musculus
tcacaattttatggactctattgaatggcttccttgctagactgtttctttttttttatgcagagggggacaggttgttgtagaagccttcaatgtctcccattctcaactatga

SEQ ID NO: 99756 - DNA, 85 bp, Mus musculus; identical to SEQ ID NO: 57439

SEQ ID NO: 99757 - DNA, 104 bp, Mus musculus
tatcctagtgtagaaatgcctgattgttcatgttcattgcttttctatgcagaacagctaagacatgtaaagaacttagatatccaccagctaaattatggata

SEQ ID NO: 99758 - DNA, 80 bp, Mus musculus
ctcagtgttggaggctgagttaggacagggtctcctcagcaaccgagggcctctctcttgctctcagtgtccttgctggg

SEQ ID NO: 99759 - DNA, 85 bp, Mus musculus
atgtgtgtgtgtgtgtgtgtgtgtgtatccactatatatgtgtgtgtgcatgtgcatatatatacatacatacatacatacatat

SEQ ID NO: 99760 - DNA, 93 bp, Mus musculus
cactgatattttggctaaaccatttttttttttgtcataggaaattgtcctatgttctatgttagagggaaagtccaggttcaatggtgagtg

SEQ ID NO: 99761 - DNA, 101 bp, Mus musculus
tacttcaaatggatgctttgctatgtaaatttttatctttcaatgttcagaaagcaatgaaataagcatcacttaaagttgggctatccagtatggtagta

SEQ ID NO: 99762 - DNA, 100 bp, Mus musculus
gttttgtgcaccaaaaagcctgttcacctctgtcacagtagtatgaaagcactacagacaaattattagtggaatgggtgtggttatatttgaataaagc

SEQ ID NO: 99763 - DNA, 135 bp, Mus musculus
atgtatatatgtaaacatatgagtgtgtgtgtatatatatatatatatatgtatatatatatatatatatatatatatatatatatatatatatatatacatatatatatatatatattgggaaagccagtactc

SEQ ID NO: 99764 - DNA, 60 bp, Mus musculus
gtggttacgagtactgactgctcttccagaggaccagggttcagtcagttctcagcacgc

SEQ ID NO: 99765 - DNA, 76 bp, Mus musculus
tttcttcactgtcattcactgtcattggagcctacttctttgggattccagcatatacagaagaccagttgagaaa

SEQ ID NO: 99766 - DNA, 85 bp, Mus musculus; identical to SEQ ID NO: 57439

SEQ ID NO: 99767 - DNA, 85 bp, Mus musculus; identical to SEQ ID NO: 58391

SEQ ID NO: 99768 - DNA, 78 bp, Mus musculus
ctaggactgtgcaagatttttgtagtaggaacatgtgattttttttttctgagacagggtttctctgtgtagccctgg

SEQ ID NO: 99769 - DNA, 85 bp, Mus musculus; identical to SEQ ID NO: 57439

SEQ ID NO: 99770 - DNA, 120 bp, Mus musculus
tctgtaagcttttatctgtcagcatgaaaagaccaatacaggccactctaatgatttttcattattatatgtccctattgtcttttcttttagggatgcaactagggctcaagctaagga

SEQ ID NO: 99771 - DNA, 68 bp, Mus musculus
atagatggacagaaccaaacagggtatcctatctgtttatctgtctgtctgtctgtctgtctgtctgt

SEQ ID NO: 99772 - DNA, 81 bp, Mus musculus
gaccagctagtatatgctgcctggttagtgtctcagtgtctgagagatataaggggtctaggttagttgagactgctggtc

SEQ ID NO: 99773 - DNA, 78 bp, Mus musculus
acttctgttaatttcacagtctctctctttaatttctgtttccaggacttgacattgatgagagtgtggtgttgaagt

SEQ ID NO: 99774 - DNA, 88 bp, Mus musculus
agaatggttgcacaagtttgcaatccccccagcaatgttccccttgccagcatgagctgtcacttgtgattttgttcttagccattct

SEQ ID NO: 99775 - DNA, 92 bp, Mus musculus
ataatactttatatatgtacatatgtatacttatatatatgtatacatgcatatatatgtatatatatatcaaaatgcttaatgaatattat

SEQ ID NO: 99776 - DNA, 91 bp, Mus musculus
atgatttcgacatgcttaagtcacttgtcatctcattcactctctcaaacatcgggaaagtgaggaatggaagtgagttgatattgatcat

SEQ ID NO: 99777 - DNA, 67 bp, Mus musculus
ttgacagatattacagatattagtactgaaacatgattgtttttggtatctgtcagatgtttgttgg

SEQ ID NO: 99778 - DNA, 133 bp, Mus musculus
tagtctgctgatggttgagtggtctattgatctattggtataaaatcatgtcattaggagtcattttcttgttctttagcagattattagtagtaggttttgccctagggtcaatgacctgtccagtctcaac

SEQ ID NO: 99779 - DNA, 65 bp, Mus musculus
ggtcttcatatcacacccccttttcaagtcccaggaaacatcacagaagagtgggtggaaagatc

SEQ ID NO: 99780 - DNA, 85 bp, Mus musculus; identical to SEQ ID NO: 57470

SEQ ID NO: 99781 - DNA, 121 bp, Mus musculus
tggagctttggtattctgttttgaaatagttttcttctcaatttatacatatatgtatatatctgtatatatggaagtgtagagaaaatgttgtttttcacttagaataacttttccagag

SEQ ID NO: 99782 - DNA, 93 bp, Mus musculus
gtatacagacaagaataaatgtacgtatgaatgtatgtatgtatgtatgtatgtatgtatgtgttatgtatgtacgtgtgcttgtgtgtgtat

SEQ ID NO: 99783 - DNA, 81 bp, Mus musculus
ggtctcattttgttccttttgaaatctctaatgtttgtgctatcactgtgatagtgagagacagaggaatagctactgact

SEQ ID NO: 99784 - DNA, 96 bp, Mus musculus
gatcagccttagtccatggtgatttgataggatgcatgggacaatttcaatatttttgtatctgttgagtcctgttttgtgaccaattatatggtc

SEQ ID NO: 99785 - DNA, 92 bp, Mus musculus
ttcttggagatttacatggaacactgtgaatgcaaaaaagatgtacatttgttttattcagggaaatttaaaatgtatgtttccccaaagaa

SEQ ID NO: 99786 - DNA, 113 bp, Mus musculus
tgctttttatggtcctgatgtttcataatgcacataatagattgaatgtttttattaaacatgtatttatgtgtgcgtaggtgtgtgcgtatgtgtgtctgtgtgcatgtttg

SEQ ID NO: 99787 - DNA, 86 bp, Mus musculus
tgactgtctatatgtatatatatatgtgtgtatatatgtatatacatacatatataacctcatatttaagaagatcaaagacagtc

SEQ ID NO: 99788 - DNA, 85 bp, Mus musculus; identical to SEQ ID NO: 57470

SEQ ID NO: 99789 - DNA, 85 bp, Mus musculus; identical to SEQ ID NO: 57470

SEQ ID NO: 99790 - DNA, 92 bp, Mus musculus
cacgcaaatgcatttttcatagcttgtatttctggtagcttatagcatttcttggattgtgagcacagatctctgtgtgagtgattagcatg

SEQ ID NO: 99791 - DNA, 66 bp, Mus musculus
tcctctgttcagctgatctccttcaaacacagaggcccactgccactgtgtctcagtctgctggga

SEQ ID NO: 99792 - DNA, 72 bp, Mus musculus
cttttggactggaagtggagtttggggcctggggcatgtagagatgatctcaggctctgtcagtcttacaag

SEQ ID NO: 99793 - DNA, 118 bp, Mus musculus
tctgaacatgtggtgcatatgctgaaggtttcacactcttttgggaagataacaatgtttttttttagttccctgagtaaatgaaaaagatctcagagcccctgtatcagatggtgga

SEQ ID NO: 99794 - DNA, 85 bp, Mus musculus; identical to SEQ ID NO: 78692

SEQ ID NO: 99795 - DNA, 85 bp, Mus musculus; identical to SEQ ID NO: 57470

SEQ ID NO: 99796 - DNA, 85 bp, Mus musculus; identical to SEQ ID NO: 57439

SEQ ID NO: 99797 - DNA, 113 bp, Mus musculus
gtctgtgttttgtcactcaatgtaatactttctagttctatccataggtcccccggtttcatttctgtttatgatgtttagatgaaggttattccatagtgtacatgtaagac

SEQ ID NO: 99798 - DNA, 67 bp, Mus musculus
cttcaaggggaaaagcaaaggtctattataattattaatttgaaggactttattttttcttttgaag

SEQ ID NO: 99799 - DNA, 89 bp, Mus musculus
gcgcaatggtggctgctagcatctgactctgtatttgtcaggctctgacagggcctctcaagagactgctatattaggctcctttcagc

SEQ ID NO: 99800 - DNA, 78 bp, Mus musculus
caggggtgagttgtatggctaattcttaatttcttgacacaacaaagtgagaggaagctgtttcttaacttccctctg

SEQ ID NO: 99801 - DNA, 68 bp, Mus musculus
ggaaaactcgagacacccaagcattgcacagcttgtattagcaagccaggctctgtctcagtcactcc

SEQ ID NO: 99802 - DNA, 85 bp, Mus musculus
gtccatggtggtctgataggatgcatgggacaatttctatatttttgtatctgttgaggcctgttttctgaccaattatatggtc

SEQ ID NO: 99803 - DNA, 96 bp, Mus musculus
gatcagtcttaggccatgatggtctgataggatacatgggacaatttcaatatttttgtatctgttgaggcctgttttgtgacctattatatggtc

SEQ ID NO: 99804 - DNA, 77 bp, Mus musculus
cagcatgaagtcctcaggatacagtcctcggtgttcgcctctctcaggcactcccactgtgcttgggctatctgctg

SEQ ID NO: 99805 - DNA, 85 bp, Mus musculus; identical to SEQ ID NO: 57470

SEQ ID NO: 99806 - DNA, 62 bp, Mus musculus
agatcaagtgagcatagatgtgtgggttcatctctgggccttcaattctgttccattggtct

SEQ ID NO: 99807 - DNA, 85 bp, Mus musculus; identical to SEQ ID NO: 57470

SEQ ID NO: 99808 - DNA, 78 bp, Mus musculus
tgtaggtatgtatatatatatgtgtatgtgtatgtgcttttttatgtgcatgtgtttgtgtgtgtatttttattaata

SEQ ID NO: 99809 - DNA, 106 bp, Mus musculus; identical to SEQ ID NO: 58252

SEQ ID NO: 99810 - DNA, 126 bp, Mus musculus
ctcagattcttgctgtctctagtatcctggtatccttgtatcctgagaccctgagaccctgagaccctgagatcctgagatcctgagatcctgagatcctggggatgtcatagatcctaggaatca

SEQ ID NO: 99811 - DNA, 115 bp, Mus musculus
tagtctaactaataggacatgatatggtctatctgagaggtcatagtgtactatatctgaatggttatgatgtggactttctgagaggtcatggtgtggtctatctgtagagcta

SEQ ID NO: 99812 - DNA, 83 bp, Mus musculus
catgggacaatttcaatatttttgtatctgttgagaatcattttgtgagcaatgatatggtcaattttggagaaggtaccatg

SEQ ID NO: 99813 - DNA, 66 bp, Mus musculus
gagatctcccatctgggtgccaagtgagagtgtgctcacttggccgtctgattgggtcctggtctc

SEQ ID NO: 99814 - DNA, 106 bp, Mus musculus; identical to SEQ ID NO: 58252

SEQ ID NO: 99815 - DNA, 85 bp, Mus musculus; identical to SEQ ID NO: 57470

SEQ ID NO: 99816 - DNA, 62 bp, Mus musculus; identical to SEQ ID NO: 99806

SEQ ID NO: 99817 - DNA, 96 bp, Mus musculus
ctgtgtgtgtttctgtctgtgtgagtctgtctatgagagtatgtatgtgaatatggcataaaatgtttaacaagttacataggctgcaggttacag

SEQ ID NO: 99818 - DNA, 115 bp, Mus musculus; identical to SEQ ID NO: 99811

SEQ ID NO: 99819 - DNA, 96 bp, Mus musculus; identical to SEQ ID NO: 99817

SEQ ID NO: 99820 - DNA, 85 bp, Mus musculus; identical to SEQ ID NO: 57470

SEQ ID NO: 99821 - DNA, 80 bp, Mus musculus
aggtgctcagacatcctcctttgggtcctccttgttatttatagtttctttgggtctgtggattgtagtgtgggtatcct

SEQ ID NO: 99822 - DNA, 115 bp, Mus musculus
tagtctaactaataggacatgatatggtctatctgagaggtcatagtgtactatatctgaatggttatgatgtggactttctgagaggtcatggtgtggtctatctgtatagcta

SEQ ID NO: 99823 - DNA, 71 bp, Mus musculus
ctcagattcttgctgtctctagtatcctggtatccttgtatcctgagaccctgagaccctgagaccctgag

SEQ ID NO: 99824 - DNA, 165 bp, Mus musculus
tatatatatatatatatgtatatgtatatatatatatacacacacacacatatatatgtatgtctgtatatatatatatatatgtatatatgtatgtctgtgtatagatatgtatatatgtatgtctgtgtatagatatatatatatatatatatatatcagaga

SEQ ID NO: 99825 - DNA, 106 bp, Mus musculus; identical to SEQ ID NO: 58252

SEQ ID NO: 99826 - DNA, 66 bp, Mus musculus; identical to SEQ ID NO: 99813

SEQ ID NO: 99827 - DNA, 84 bp, Mus musculus
tagtgtagtatatctgaatggttatgatgtggtctacctgagagttcatggtgttggtcactgtataattattagttctaccta

SEQ ID NO: 99828 - DNA, 115 bp, Mus musculus; identical to SEQ ID NO: 99822

SEQ ID NO: 99829 - DNA, 106 bp, Mus musculus; identical to SEQ ID NO: 58252

SEQ ID NO: 99830 - DNA, 66 bp, Mus musculus; identical to SEQ ID NO: 99813

SEQ ID NO: 99831 - DNA, 115 bp, Mus musculus; identical to SEQ ID NO: 99811

SEQ ID NO: 99832 - DNA, 106 bp, Mus musculus
gccttagtgcatggtgatctgataggatgcatgggacaatttcaatatttttgtatctgttgaggtctgttttgtgacctattatgtggtcaattttggagaaggt

SEQ ID NO: 99833 - DNA, 75 bp, Mus musculus
ccttgatccgtaacagctcatcctgtgcagcaggcaccagctaattggctgtctgtcacatgctctgtctcaagg

SEQ ID NO: 99834 - DNA, 66 bp, Mus musculus; identical to SEQ ID NO: 99813

SEQ ID NO: 99835 - DNA, 115 bp, Mus musculus; identical to SEQ ID NO: 99811

SEQ ID NO: 99836 - DNA, 85 bp, Mus musculus; identical to SEQ ID NO: 57439

SEQ ID NO: 99837 - DNA, 115 bp, Mus musculus; identical to SEQ ID NO: 99811

SEQ ID NO: 99838 - DNA, 66 bp, Mus musculus; identical to SEQ ID NO: 99813

SEQ ID NO: 99839 - DNA, 106 bp, Mus musculus; identical to SEQ ID NO: 58252

SEQ ID NO: 99840 - DNA, 115 bp, Mus musculus; identical to SEQ ID NO: 99822

SEQ ID NO: 99841 - DNA, 80 bp, Mus musculus; identical to SEQ ID NO: 99821

SEQ ID NO: 99842 - DNA, 66 bp, Mus musculus; identical to SEQ ID NO: 99813

SEQ ID NO: 99843 - DNA, 85 bp, Mus musculus; identical to SEQ ID NO: 57470

SEQ ID NO: 99844 - DNA, 106 bp, Mus musculus; identical to SEQ ID NO: 58252

SEQ ID NO: 99845 - DNA, 70 bp, Mus musculus
ttctttagtgtttatggtgtgtgcacacatgtgtgtgtgtgtgtctatacaaatgaagaatgttagagga

SEQ ID NO: 99846 - DNA, 96 bp, Mus musculus; identical to SEQ ID NO: 99817

SEQ ID NO: 99847 - DNA, 71 bp, Mus musculus; identical to SEQ ID NO: 99823

SEQ ID NO: 99848 - DNA, 115 bp, Mus musculus
tagtctaactaataggacatgatatggtctatctgagaagtcatagtgtactatatctgaatggttatgaagtggactttctgagaggtcatggtgtggtctatctgtatagcta

SEQ ID NO: 99849 - DNA, 80 bp, Mus musculus; identical to SEQ ID NO: 99821

SEQ ID NO: 99850 - DNA, 71 bp, Mus musculus; identical to SEQ ID NO: 99823

SEQ ID NO: 99851 - DNA, 115 bp, Mus musculus; identical to SEQ ID NO: 99822

SEQ ID NO: 99852 - DNA, 85 bp, Mus musculus
ggccatggtggtctgataggatacatgggacaatttcaatatttttgtatgtattgaggcctgttttgtgaccaattatatggtc

SEQ ID NO: 99853 - DNA, 84 bp, Mus musculus; identical to SEQ ID NO: 99827

SEQ ID NO: 99854 - DNA, 66 bp, Mus musculus; identical to SEQ ID NO: 99813

SEQ ID NO: 99855 - DNA, 106 bp, Mus musculus; identical to SEQ ID NO: 58252

SEQ ID NO: 99856 - DNA, 103 bp, Mus musculus
tcagtgtgtgatatgtgaaaatggtatatatatatatatatatatatatatatatatatatatatatatatatatatattacaatgacaaaaacagtcactga

SEQ ID NO: 99857 - DNA, 72 bp, Mus musculus
gggacacagacaccgtacatcggaggtaaagtggaatccctccctgcctctctgtctgtatgtctgtgtgtc

SEQ ID NO: 99858 - DNA, 87 bp, Mus musculus
actccataaagtacagcctttgttcctattgccctccctccctgatgggtgaagctagagagtagagagtcagtgcaggagtggagt

SEQ ID NO: 99859 - DNA, 97 bp, Mus musculus
gcatgggagatctttccatcttctgatttcttcaggatctgttcttatgtctctcttttcagttctgattttgttaattaggatgctgtccctgtgc

SEQ ID NO: 99860 - DNA, 115 bp, Mus musculus
ctgtctctgtgactgcctgcctgtacagctgttgtagcctgtcttcctgtctgtctctgtgtattggcaggttctcaatacatagctggggcttgcctggaactcagtttataat

SEQ ID NO: 99861 - DNA, 110 bp, Mus musculus
ttgaagatcagccttagtccatcgtgatcaaataggatacatgggataatttcaatatttttgtatcggtggaggcctgttttatgaccaattatatggtgaattttgga

SEQ ID NO: 99862 - DNA, 119 bp, Mus musculus
gaataagcaggaggtgtgggggggaagcaagggaagacgaaatgatgtaattttaatctcaaaatttgtcttttttttaaaaagtgcatacccatcattcaccatggcaacctgccttc

SEQ ID NO: 99863 - DNA, 78 bp, Mus musculus
tgtgtgtgtgtgtgtgtgtgtgtgtgtgtgtatatatatatatatatattcacatgtatgcatatatgtacacacata

SEQ ID NO: 99864 - DNA, 94 bp, Mus musculus
tccgctcttgttgtgactactgtttttctagaaatgggacaatctgtgtccactcccctttctctgactctggagcattagaaggaggtgcggg

SEQ ID NO: 99865 - DNA, 79 bp, Mus musculus
agactgctcagatatgggtttaagccaatagaaacttattagccagttggtggtgactactctgtgtgtgagagagtgt

SEQ ID NO: 99866 - DNA, 92 bp, Mus musculus
acattcacaattggacaaagcagacagtgattatgataatgagaggggatgggaaattctctctttctgtgtgtgaatgtgtatgtgtgtgt

SEQ ID NO: 99867 - DNA, 113 bp, Mus musculus
cctgttgttttcatgtttatatacatatatgtatatgtgagtgtatgtatatatatatatacacacacatatacatatatgttgtcaaggtatatttttaatatagaacctgg

SEQ ID NO: 99868 - DNA, 60 bp, Mus musculus
acatatatgtatatgtgtgtgtatatatatatatacatacactcacatatacatatatgt

SEQ ID NO: 99869 - DNA, 85 bp, Mus musculus; identical to SEQ ID NO: 57439

SEQ ID NO: 99870 - DNA, 115 bp, Mus musculus
tcctggcaagaaatttggttgtgagagttgcatttctagtctttgatatgaattcacagacactgtctgtgaattggatgttagtattatagcaatgttggcttcttggttagga

SEQ ID NO: 99871 - DNA, 106 bp, Mus musculus
cagtaaaagaagaacatgagaaaaaaagatgtgtatgtatatttgtatgtatatatatgcacatatacatatgatttttaatatatcatctcatcgtagaaggctg

SEQ ID NO: 99872 - DNA, 85 bp, Mus musculus; identical to SEQ ID NO: 57470

SEQ ID NO: 99873 - DNA, 85 bp, Mus musculus; identical to SEQ ID NO: 57470

SEQ ID NO: 99874 - DNA, 103 bp, Mus musculus
ctttagtccatgatgatctgataggatgcatgggactatttcaatatttttgtatctgttgaggcctgttttgtgaccgattatatggtcaattttggagaag

SEQ ID NO: 99875 - DNA, 77 bp, Mus musculus
cagctctgccactgtgtctgtctctgtcctccccacccacctcactggtctcaagagaaggagactatggctccctg

SEQ ID NO: 99876 - DNA, 81 bp, Mus musculus
tatattacaaggtactatatgtaattatatattttatatgttataaagtatataaatacatgaagcatatattgtaatata

SEQ ID NO: 99877 - DNA, 85 bp, Mus musculus; identical to SEQ ID NO: 57470

SEQ ID NO: 99878 - DNA, 111 bp, Mus musculus
gatagtaggggtcccatgtgctccatacatatcctattccttgtgtaaggtccccagcaggagtcagaagaaagagaggatgatcagtagtcgtggcattccagccttttc

SEQ ID NO: 99879 - DNA, 91 bp, Mus musculus
gtcttcattccctctagagccagcactgattctctcatactgtccctgtcagtctcctatagtgcatcatgagctccttgatctggaagac

SEQ ID NO: 99880 - DNA, 116 bp, Mus musculus
tattttttgactttgataatgtggggtatgtgtgtgtatctgtgtgtgcatgtgcatgcacatgttctatgcctgtaaatacacatgtgttcctgtgagccttgagttaacatgta

SEQ ID NO: 99881 - DNA, 60 bp, Mus musculus
tctctatgtcaatgtctctctctcatacacatgcaggagagagagagagagagagagaga

SEQ ID NO: 99882 - DNA, 114 bp, Mus musculus
tgtatccttggcatagacttatttggacataatgtggcatttaaaatactttattggatttgatttacttacattttgttgggaaattttaaatcttaagttcatgagggatca

SEQ ID NO: 99883 - DNA, 77 bp, Mus musculus
catgcagatcttgttttctgctgtagtctggctgaagtaatgggccctaaaacttgacagaagacagactctacatg

SEQ ID NO: 99884 - DNA, 92 bp, Mus musculus
ctgggactagagagatagcttagtggttaagagcaagcttagtggttaagagcactgactgctcttccagaagtcctgagttcaattcccag

SEQ ID NO: 99885 - DNA, 103 bp, Mus musculus
agtatggtatgctagcacaggctttgagtgtgtgtatatctgtgtgtgtgtgcgcgcacgtgcacatgtgtgcacacatgtcctgtgccaagtgtagaaagct

SEQ ID NO: 99886 - DNA, 85 bp, Mus musculus; identical to SEQ ID NO: 57439

SEQ ID NO: 99887 - DNA, 118 bp, Mus musculus
tgttgtataaaagatctatatgtggggctggagagatggctcagtggttaagagcactgactgctcttccagagtttctgaattcaactcccagcaaccacatgttgtctcacaaaca

SEQ ID NO: 99888 - DNA, 96 bp, Mus musculus
gtgtcaagttgacacagaactagccagtacaggatgcatgggacaatttcaatatttttgtatctgttgaggcctgttttgtgaccaattctatgc

SEQ ID NO: 99889 - DNA, 103 bp, Mus musculus
tatatatatacatatacacatgtatatatattccacaacatatatatatatgtatgtgtgtatgttgtagaacttattacacacacacatatatatacgtata

SEQ ID NO: 99890 - DNA, 111 bp, Mus musculus
cttgaaggactctattatcttcatgagataggattttaggtcagcatcctggttttcaggtgtgtttggttatctatgtcttgctgtggtgggagaactgggttctgatgg

SEQ ID NO: 99891 - DNA, 106 bp, Mus musculus
gtatactaagttttcctttgcagtttggctcctttctgacccactgtgtcacaacctgacaggcgatctcagccccaggagcacatgtagtttaatgctcatatgc

SEQ ID NO: 99892 - DNA, 91 bp, Mus musculus
gtgtactactttgcctgtctgtctgtgtctgtttatggaacctttcacataccaatagaaaattcagtactatatgtcaaggtttggacac

SEQ ID NO: 99893 - DNA, 131 bp, Mus musculus
gcctactgcccttactagacacatctgcacatgctggggtgaggtagtaagttgtattgttgtggggtagggattttaggccccagtaagaagataactatacaacttactactttccttggtgtgtggca

SEQ ID NO: 99894 - DNA, 114 bp, Mus musculus
gagttgctctctgaggttacagattcccagccccttggtctgctcttggacactctctgtctggtaatggtgctggcgattatcttgctttttcagtctaagtttgttgaactc

SEQ ID NO: 99895 - DNA, 86 bp, Mus musculus
gtagcttgctagatagaccagactggccttgaactctctctgtctgcctttacctcccaagtgctgggatatcaagcaagtactac

SEQ ID NO: 99896 - DNA, 105 bp, Mus musculus
gctacaggctaagggttctttgaagttctgtctttgttccttgtatagttatttgtttctgactgcactctgtaactcaggctggcatcaccctcatcatgtagc

SEQ ID NO: 99897 - DNA, 67 bp, Mus musculus
tcactgatctgagtgtgtctgtgtttcatttaaaagaggttaacacatgcacaaattagacgtgtga

SEQ ID NO: 99898 - DNA, 82 bp, Mus musculus
tttatcattattatatacatacatgtatgtatgtatgtatgtatgtatgtacgtacgtatacatatggataaaatgtgtaaa

SEQ ID NO: 99899 - DNA, 68 bp, Mus musculus
gcccactcagtgagcatcagcaactccattttagagagggagaaactgaggcttcaagatgaaggggc

SEQ ID NO: 99900 - DNA, 69 bp, Mus musculus
gtcaaatcacagagacctgagtgagctgatgatggcagcacaaggctaactcaagtctggactgaggac

SEQ ID NO: 99901 - DNA, 74 bp, Mus musculus
ggattggactttatgtgacactggattggatagcaaaaggccctgctcctgtcgtcactctctctgtcagctcc

SEQ ID NO: 99902 - DNA, 94 bp, Mus musculus
ctcatatgtgtgtatgtggatgtatgtatgtatatgtatgtgtatgtacatatatatgtgtatatatatgtgtgtgtgtgtgtacatatacaca

SEQ ID NO: 99903 - DNA, 75 bp, Mus musculus
tctagggctggagagatggctcatcgtttaagagcactgactgctcttccagaggttctgagttctattcctaga

SEQ ID NO: 99904 - DNA, 64 bp, Mus musculus
tcagtctgtgtctctctggctgtttcatggatgcttcttctatgaaacaggtcctgcagtctgg

SEQ ID NO: 99905 - DNA, 112 bp, Mus musculus
gggcacaagaaaaactacagcattcagtaacctaggctcataggggctcacagagactgaacctgcattgaactggcctaggacttctgagtatgttatagttgtgtagctt

SEQ ID NO: 99906 - DNA, 85 bp, Mus musculus; identical to SEQ ID NO: 57439

SEQ ID NO: 99907 - DNA, 64 bp, Mus musculus; identical to SEQ ID NO: 99904

SEQ ID NO: 99908 - DNA, 74 bp, Mus musculus
ccagcttctatctgtgtgtcatgggcaggcctatgtgtatatgtgcatgttcatgtgatatgatagtataaggg

SEQ ID NO: 99909 - DNA, 115 bp, Mus musculus
ggaaggaaaacaaaggacaaagagagatgatatatgaatagggaccacggtagcctgagaagtgtctctgtcagcttttctcaagtacaaccctcagtgcttttgttttgttttt

SEQ ID NO: 99910 - DNA, 64 bp, Mus musculus
gtctgtctgtctgtctgtgggtatgtgaatatgagtgcaggtgcccaagaggctggaggcattc

SEQ ID NO: 99911 - DNA, 62 bp, Mus musculus
ggaacctcatgaaggagcggggtctaaggagcgcatgctcagtggcttagttgtgatgttcc

SEQ ID NO: 99912 - DNA, 97 bp, Mus musculus
gaagttttccaggctagagaggtggctcagcggttaagagcactgactgctcttccaaaggtcctgagttcaaatctcagcaaccacatggtgactc

SEQ ID NO: 99913 - DNA, 106 bp, Mus musculus; identical to SEQ ID NO: 66964

SEQ ID NO: 99914 - DNA, 94 bp, Mus musculus
ctgcatttgaagcactgtggttttttgcactggtttacattggcagtaaaaggaagctgctttgaaaaggggtaagagctatatttatctgcag

SEQ ID NO: 99915 - DNA, 83 bp, Mus musculus
gggctgggggggggagggggcaggttgatgggctttgagaaatgaaagccttgtcctgctcacagttcactctctctgcttca

SEQ ID NO: 99916 - DNA, 152 bp, Mus musculus
tatatatttatgtgtaatatataacatacaatattatatattaatatatactataggatatgttactttatatatgttatatactacataagaaatatataagtaattatatataattaattgtatgatatatactatcttatataatatat

SEQ ID NO: 99917 - DNA, 114 bp, Mus musculus
tgtctgtctatctgtctgcctgcctgcctgcctgtctttctctctctcagtgttaacaccacagaactaaagggaaaatgtgcagatgcagagtcacgtgtcattgatctgaga

SEQ ID NO: 99918 - DNA, 100 bp, Mus musculus
tctttcataacttgcagccactgattttgtgcgggaattgtgcatacagtccctgtcactgtgagataatgtgcacaacagccctgccacttttggaaga

SEQ ID NO: 99919 - DNA, 132 bp, Mus musculus
atctatctctatatctctatatatctctatatttctatatctctgtatatctgcatctctatctctctctatatatatttacctaggtataggttatagatatagatatagatacgggtaaatacactgata

SEQ ID NO: 99920 - DNA, 60 bp, Mus musculus
agagatgactcagtggttaagagcactggctgctcttccagaggtcctgagttcaattct

SEQ ID NO: 99921 - DNA, 110 bp, Mus musculus
tgaagtgtgtcatgaggtgggggagggctttgatgtttccgtagattcttgccattttagtctctgtcagattctctccctcagtctctccagcgctcacactctacctc

SEQ ID NO: 99922 - DNA, 69 bp, Mus musculus
gctagagatatgacttactggttcagagcactgactgctcttccaggggtcctgagttcaaatcccagc

SEQ ID NO: 99923 - DNA, 79 bp, Mus musculus
acttctgttagtttcactgtgtctctgtttagtttctgtttccaggatctgtccattgatgagagtggtgtgttgaagt

SEQ ID NO: 99924 - DNA, 79 bp, Mus musculus
gctatgggaaaggaacactgtctctgtgtcagccaccttcctggcacatgttaactgtgatggactcctttcttctagt

SEQ ID NO: 99925 - DNA, 91 bp, Mus musculus
gtatttttcagattccatgtgtatgcgggctttctattttttatgtttttattgaagatcagggttagtccatggtgatctgataggatgc

SEQ ID NO: 99926 - DNA, 70 bp, Mus musculus
agatcaagtaaccataggtgtgtggattcatctctgggtctgcgattctgttccattggtctacttgtct

SEQ ID NO: 99927 - DNA, 85 bp, Mus musculus; identical to SEQ ID NO: 57470

SEQ ID NO: 99928 - DNA, 69 bp, Mus musculus
gagagccagttataccagcaccatttattaaagtgtgtctgtgagtgtgtggttatatttctgggtctt

SEQ ID NO: 99929 - DNA, 64 bp, Mus musculus
gtgtccactgtctgtgtctgttaggtccctggaggggaccactagtttcaggttctggtttcat

SEQ ID NO: 99930 - DNA, 77 bp, Mus musculus
ttattccttcaggttctatgaataattctgttgaaattttaatgagaatttgttgatcagtgggcatgggggaatga

SEQ ID NO: 99931 - DNA, 100 bp, Mus musculus
ggaaattggtctgcagttctataattttgttggatatttctgtggtttagatatcagagtaattgtgacttcatagaatgagttgggtagagcaccttct

SEQ ID NO: 99932 - DNA, 85 bp, Mus musculus; identical to SEQ ID NO: 57439

SEQ ID NO: 99933 - DNA, 112 bp, Mus musculus
caggcatttctaatgtgcaatatgacccaaatactgtgtatcaaagaggacagctgaacagaattgattttcttgtttgatcacagagttcatattcatgtaaagatgcttg

SEQ ID NO: 99934 - DNA, 62 bp, Mus musculus
gccagcagaggcaccttagttaattttaggggagctcccactctgagacactctgcctgtgc

SEQ ID NO: 99935 - DNA, 128 bp, Mus musculus
gccatcggctggtccctggtcttcctttcaccatggccttcagatgatcagatgaatgactgaccagagagaggaggcctctccaggttactcagccagatagtgaatgtatgaatggatggaacggc

SEQ ID NO: 99936 - DNA, 76 bp, Mus musculus
tgcaggtattctgtccggcttgaatctgtgaaggccttatgtgtgccgtcactgtctctgagtgtgtatatgtgca

SEQ ID NO: 99937 - DNA, 83 bp, Mus musculus
gagactaattgtatttctgactttgtcactgtctagctgtgtgaccacagactagtcagttagagtctttgggcttcagtttc

SEQ ID NO: 99938 - DNA, 118 bp, Mus musculus
tctccatctatggtaattgagagtttggctgggtatagtagcctgggctgacatttgtgtctcttagtgtctgtataacatctggccaggctcttctgtctttcatagtctctggtga

SEQ ID NO: 99939 - DNA, 98 bp, Mus musculus
ggagctctaaaaatgtctaccctgaaatatttctcttagaaaaaatattgatgtgatgagaagatatatttttgttttagacaaatttggttagttcc

SEQ ID NO: 99940 - DNA, 117 bp, Mus musculus
cttgccctcccatctcactgttggagtcactgtaatctgatattttaatgtatattcttggatgtgctcgttaggattctgtcaacgtgacacaagctatagtaatctgggaacagg

SEQ ID NO: 99941 - DNA, 88 bp, Mus musculus
atgtgcgggagttgtgtatatatgtctgtacatatgtgtagatatccatgtgtatgtatgtctgtacatatgtgtagatatccatgtg

SEQ ID NO: 99942 - DNA, 93 bp, Mus musculus
tgaacatgacattgacagtaatatttttatatatatctgtggcatacacagcacatgtataggtgttacatttgggaagatagtctatgtgca

SEQ ID NO: 99943 - DNA, 78 bp, Mus musculus
ctctcaggtttctcaatctctctgtctgtggtttctagatactatttaccactaaaatggaagcagagttacttggag

SEQ ID NO: 99944 - DNA, 70 bp, Mus musculus
tgcatacttatatgtgtacatgcatacataatgtaatgcatatgtatatatttatacatgcatatatgca

SEQ ID NO: 99945 - DNA, 85 bp, Mus musculus; identical to SEQ ID NO: 57470

SEQ ID NO: 99946 - DNA, 100 bp, Mus musculus
gcttctatttgaatagctcttgaaaaaaaccttggatttgaattgaaaagttcttgttagccatgctgttatgttctgctactagtcttcagatgagagc

SEQ ID NO: 99947 - DNA, 79 bp, Mus musculus
taagtattatgtgcagatatctgaccataactctgtgagtgtccaagagtgaattgtgtttatatttcatatgtactta

SEQ ID NO: 99948 - DNA, 89 bp, Mus musculus
gagttatggtcagatatctgcacataatacttagatatctatctatctatctatctatatatgtggccttaggatgttctgatttactt

SEQ ID NO: 99949 - DNA, 87 bp, Mus musculus
tgtgtggtggctactggaagtggggtagtatgttgtatattttgaccctttattggaagataatgcatatgccctaaagccctttca

SEQ ID NO: 99950 - DNA, 111 bp, Mus musculus
ttgggctggaagttggcaagttttagcaaagttaaatatctttttatatgtcaccattatatataccatagttattttttctaaaatggaacctatttgcttttagtttaa

SEQ ID NO: 99951 - DNA, 85 bp, Mus musculus; identical to SEQ ID NO: 57470

SEQ ID NO: 99952 - DNA, 78 bp, Mus musculus
ggtgttacagcacctggaagtggtacctcctctgggggaacatggggctgtccactgtgttagaaaccaatgtagacc

SEQ ID NO: 99953 - DNA, 112 bp, Mus musculus
gaggttttatttttgtcttttggactgtgaagaggttagcaattttatttattcttaagaagtgttaactcttttttaaaaaaacattcatcagttctagtgatagtcactc

SEQ ID NO: 99954 - DNA, 93 bp, Mus musculus
tccatggtgatctgataggatgcatgggacaatttcaatatttttgtatctattgaggcctgttttgcaaccaattatatggtcaattttgga

SEQ ID NO: 99955 - DNA, 85 bp, Mus musculus
gctcattccaagaaaagttctgagtttttgaagagactgaggtgacaaaactcttgtcttctttgcttggagttttcttagaagc

SEQ ID NO: 99956 - DNA, 115 bp, Mus musculus
catagtttatctcgggaaaacctaattccaaaatatatagcctttatattttaatatagtaactatgttgtagatgataggcttatcttgtgagtgcttgagtttgggcgtagtg

SEQ ID NO: 99957 - DNA, 82 bp, Mus musculus
gagcttactccaaccaccatttgtgtgtgcatatatatatatatatatgcatgtttatgtgtgaaatacttggagcctgctt

SEQ ID NO: 99958 - DNA, 95 bp, Mus musculus
aaaactggctggcctccctgttatcctcgcagactgtactttgtgtcctcacacaaggtttttgtgatgttggtgtttatttgtttgcttgtttt

SEQ ID NO: 99959 - DNA, 70 bp, Mus musculus
tgtgtgtgcacttgtgcatttgtgtgtgtgcacatgcgcgcacacacacacacacacacacacacacaca

SEQ ID NO: 99960 - DNA, 85 bp, Mus musculus
gtccatggtggtctgataggatgcatgggacaatttcaatatttttgtatctgttgaagcctcttttgtgaccaattatatggtc

SEQ ID NO: 99961 - DNA, 107 bp, Mus musculus
atttttaaaaagaaagtgctagttaacatttgtcatgattatttttacattgatttacaagataagtttcagataaatgtgaaaggcaccatgattttctgaggaat

SEQ ID NO: 99962 - DNA, 93 bp, Mus musculus
tccatggtgatctgataggatgcatggaacaatttcaatatttttgtatatgttacagcttgttttgtgaccaattatgtgatcaattttgga

SEQ ID NO: 99963 - DNA, 73 bp, Mus musculus
gcacatgtgtagttgatgagacacgtggtaaggcccaaccagtgtgtgtgtctgtctgtctgtgtctgtgtgc

SEQ ID NO: 99964 - DNA, 118 bp, Mus musculus
gtgttatggctatgtagcttggtgttcctaagagtgagaacagaggctgactctgtctctttcttctgtatattggaacctttctatcctactgggttgccttgtccagccttaatgt

SEQ ID NO: 99965 - DNA, 85 bp, Mus musculus; identical to SEQ ID NO: 63165

SEQ ID NO: 99966 - DNA, 86 bp, Mus musculus
atgatgatggactgactctctgaaactctaagccagctccaattaaatgttttctttataagagttgccagagttgccttcgtcat

SEQ ID NO: 99967 - DNA, 66 bp, Mus musculus
ctgtgtttaatcatactgaacaaaatgggaggcctgagactctcattgtcagtgtttgaagcccag

SEQ ID NO: 99968 - DNA, 59 bp, Mus musculus
tttgtgcgatatgtatgtatgtatgtacgtatatacatatgtatgtgcatatgtatgaa

SEQ ID NO: 99969 - DNA, 61 bp, Mus musculus
tttgggctggagagatggctcagtagttaaaagcactgactgctcttccagaggtcctgag

SEQ ID NO: 99970 - DNA, 85 bp, Mus musculus; identical to SEQ ID NO: 57439

SEQ ID NO: 99971 - DNA, 103 bp, Mus musculus
accttctgtgcaaagttaaggataggtgatagaaacacaaataagaatcagattttttttttgtctcatcagtctgcaactttattctttgtacagtttgggt

SEQ ID NO: 99972 - DNA, 80 bp, Mus musculus
aggatactttatacatatgtatgtatgtatgtgtgtatgtatgtatgtatgcatgcatgcacatacatgtgtgacatcct

SEQ ID NO: 99973 - DNA, 99 bp, Mus musculus
gttttatttttattatgtgactgtgtgtctgtgtctgtgttatgtgcttgtttgcaagtaccaacaaaggccagaagagggcgctacatcctctggagc

SEQ ID NO: 99974 - DNA, 80 bp, Mus musculus
gtgttggatgggagctgtggtctagcactgagccctgggcaagaggtctttgtgctgggtcctggcttcatgctccatgc

SEQ ID NO: 99975 - DNA, 112 bp, Mus musculus
acatcttgttagtgatcttctggttctttgccaggctttacaaatctagagaagagagagagctctttaacttgagccaggcagtgttgaaatagttgagagtagacattgt

SEQ ID NO: 99976 - DNA, 69 bp, Mus musculus
ttcacagtgaccacacacactctgagcacacagtgctttttttttttttgagtgttgtgggtgctggaa

SEQ ID NO: 99977 - DNA, 118 bp, Mus musculus
tcaccatggtgggaagcatggcattgagcagtcagacttggtgctggaggagcccattctgcatctggatctgaaggcagcaaggaagctgactctctttcataggcagccaggagga

SEQ ID NO: 99978 - DNA, 106 bp, Mus musculus
atagtgagtgggatgtaaagtgaataagtatatatatgtgtatatacatatatatgtatatatacataaatatttctctctctgtgtgtatgtatgtatgtatgta

SEQ ID NO: 99979 - DNA, 119 bp, Mus musculus
gtcatccacaaagaggagatacagaaagctggcattttgaaatatacaaatactatgaaaataactttcaatattgtttttttttctcaagactaaatctgttatttctttggagagat

SEQ ID NO: 99980 - DNA, 85 bp, Mus musculus
gacacacaccttctctgtctgtgggtctgtggtgtcccttacatgttgttgctgtagcttgtactactcacctcatggtgtggtc

SEQ ID NO: 99981 - DNA, 85 bp, Mus musculus; identical to SEQ ID NO: 57439

SEQ ID NO: 99982 - DNA, 110 bp, Mus musculus
caataatactggtataagtaggtgtgacatgatattgatccaagtgtttatatatttagatacataaacaagaaagaatcattttgccttctagttcatcagattatgtg

SEQ ID NO: 99983 - DNA, 70 bp, Mus musculus
atgtgtacccttgtgtgtgagcttgtgcatgtacatctgtagaagccagaggttcactttgggtgggtgt

SEQ ID NO: 99984 - DNA, 115 bp, Mus musculus
gttatctttattaaggcacaacataattaatttcttttatgtgagaatttaatggaatgaattctagttttataatagaaagacaatgaaatattatggtggatgatgaagtaat

SEQ ID NO: 99985 - DNA, 90 bp, Mus musculus
agcagatgtgcagcttggctttcatgtgagtcccctaacaattggaatggggttgtctctgactgactctgttgcctgcttttgtatctc

SEQ ID NO: 99986 - DNA, 85 bp, Mus musculus
ggccgtggtggtctgataggatacatgggacaatttcaatatttttgtatctgttgaggcctgttttgtgaccaattatatggtt

SEQ ID NO: 99987 - DNA, 85 bp, Mus musculus; identical to SEQ ID NO: 57439

SEQ ID NO: 99988 - DNA, 79 bp, Mus musculus
aaactcaacatccttcagtctggtgcagatatctccaggactggatatatcaaacacctctagtttggtgttagagttt

SEQ ID NO: 99989 - DNA, 66 bp, Mus musculus
gctcaaggatcccaactgaggcagacctgtgcagggcctatgcaggctgtgtcagtctctgtgagt

SEQ ID NO: 99990 - DNA, 102 bp, Mus musculus
aatggtcgtcatcctcgcagtagatggggcaaaagctatttcataacttctgttagtttcactgtgtctctgtttagtttctgtttctaggatccatccatt

SEQ ID NO: 99991 - DNA, 109 bp, Mus musculus
ggcaggcacccacccagctaaatttattgtttgtacttacaaaggcaggcagatctctgaatccatttgtaatgttaaaaagtgtactttctgggatgtggagatggct

SEQ ID NO: 99992 - DNA, 98 bp, Mus musculus
tatatatgtatctatctatatctatatctatctatctatctatatccatatatatgtgtatatatatggatacatatatggatatatatgcatatata

SEQ ID NO: 99993 - DNA, 85 bp, Mus musculus; identical to SEQ ID NO: 57439

SEQ ID NO: 99994 - DNA, 82 bp, Mus musculus
gctcaggctgacatcaaacttgtgatcctactgtctcagactctcacatgcaaggattacaggtacatgataccacactggc

SEQ ID NO: 99995 - DNA, 120 bp, Mus musculus
ccaaagtgcttccaaattgcaagcatggttcctaggaatgaattggaagaatcccaggtagattctctcactctgacttagtgctttagtttgttttggtgataataaaataggacatgg

SEQ ID NO: 99996 - DNA, 85 bp, Mus musculus; identical to SEQ ID NO: 57470

SEQ ID NO: 99997 - DNA, 85 bp, Mus musculus; identical to SEQ ID NO: 57439

SEQ ID NO: 99998 - DNA, 78 bp, Mus musculus
gaaggacagcgaagatgtgagaccaatgagctctataagcaagcctagctcagcctcacactgtctgtcgagtccttt

SEQ ID NO: 99999 - DNA, 91 bp, Mus musculus
gtgtgtgtatgtgtatatgtatatgtatatgtatgcacatatatataatatacatatatatctaatatatatatacatgcatacatacata

SEQ ID NO: 100000 - DNA, 91 bp, Mus musculus
agtaatattgagtataggcatttgtaatagaatctgatgatttttttttaatttcctcagtttctgttgttatgtctcccttttcagttct

SEQ ID NO: 100001 - DNA, 116 bp, Mus musculus
tacagtctcttatcttaagtggtgattatgttttgttgaccatataaattgatttttatatcatgatcttatatgtgaaaatctttaaatctgacctggtcatctagatttctgtg

SEQ ID NO: 100002 - DNA, 85 bp, Mus musculus; identical to SEQ ID NO: 57439

SEQ ID NO: 100003 - DNA, 81 bp, Mus musculus
tgcttcaggaggctggagagttggctcatcagttaagagtactgactgctcttccagaggtcctgagttcaaatcccagca

SEQ ID NO: 100004 - DNA, 110 bp, Mus musculus
ccaaatttggtgaatgaaaagagaatcagggatcggggagatgtcctagagcttgagagcactgactgctcttccagaggtcctgagtttaattctcagcaaccacatgg

SEQ ID NO: 100005 - DNA, 89 bp, Mus musculus
gcctctgctttagtgatgtgattaaaggtgcctgtgccaccacaccaggtaagttccttatcttaatgaatatatattttgcatggggc

SEQ ID NO: 100006 - DNA, 78 bp, Mus musculus
ccacctgcttgtctctctgcctctgagtgttgggattaaagatgtatgtattactggactagagagatggctcagtgg

SEQ ID NO: 100007 - DNA, 85 bp, Mus musculus; identical to SEQ ID NO: 57439

SEQ ID NO: 100008 - DNA, 106 bp, Mus musculus
aggatctccccaggattcgggttcctgtgaccacagaggctgctctgttccccaattcccaccctgtgtggtccttaggatcactcatgcccttccttggtttcct

SEQ ID NO: 100009 - DNA, 69 bp, Mus musculus
gctcacttactctctgactcacttttaatctttgaaagagagagaaggtgagtgtgtgtgtgtgtgtgt

SEQ ID NO: 100010 - DNA, 83 bp, Mus musculus
aacctgttacttttgtatcgatctgtgtctcagtgcctcacttggggggcatctcgaagtaagtaccactgaccaagggttga

SEQ ID NO: 100011 - DNA, 116 bp, Mus musculus
gatacaactgtagtagtctttgtgtgtgagtgtgtgtacatgtttttatgtatgtatgcatgtgtgcatgtatgcagggtcggggggcagagatcgagagcttgacagcaggtgtc

SEQ ID NO: 100012 - DNA, 73 bp, Mus musculus
tcagtaggtgagtgggtctctctcacacggactttacatttctgtcagaggttaagttcccaccccattctgg

SEQ ID NO: 100013 - DNA, 80 bp, Mus musculus
atataacaactttatcaaggcatgtatatattaggtattatgtatgtatatatgtatgtcagtgataatatatgttatat

SEQ ID NO: 100014 - DNA, 67 bp, Mus musculus
aagctttgtcaattagacaggctactcaatggaaactcacctctggtctgtctctgtgatgatgttt

SEQ ID NO: 100015 - DNA, 95 bp, Mus musculus
tcactctcacacacatatacatacaaagaaatggtttatattaattggtttaaattttttttatttacttatttttttgtagtgttagggagtgg

SEQ ID NO: 100016 - DNA, 63 bp, Mus musculus
gtcagaaatgtcaagagagtgtgcgcactggggccagctgccacttgtttgaacaagcctgat

SEQ ID NO: 100017 - DNA, 85 bp, Mus musculus; identical to SEQ ID NO: 57470

SEQ ID NO: 100018 - DNA, 101 bp, Mus musculus
tgctctttgtctccaatgttagcactcagtagacagtgagcattttagtttgaataaacaagccagaaatgaactgtgtgtgtgacatttgcaaagttgta

SEQ ID NO: 100019 - DNA, 81 bp, Mus musculus
actggggacataactcactccatcacgtctctgctccagaacaacccctacaggtcgcacagaagacagtgaggtcccagt

SEQ ID NO: 100020 - DNA, 118 bp, Mus musculus
tagagctctaggctactttccagaatcatgtctccagtactatgtctccctgtgtgcctgccatgtttccggtcttgacattctggccattctgataatggactaagcttctgaaagc

SEQ ID NO: 100021 - DNA, 87 bp, Mus musculus
caggcagacacactcacacacacagacacaaggacacacacactgggagggatgttggaaatagttgtgtggtttggtgcatgcttg

SEQ ID NO: 100022 - DNA, 94 bp, Mus musculus
tgcatgtatttttccataaagtctacaaggactactgtgtttatcattttaaatataatgtcttagtgggtgagcctccctggataaacctgcg

SEQ ID NO: 100023 - DNA, 59 bp, Mus musculus
tcctatgaaaagtgaatgtatatgcatatatatgtatatattctaaatttatcatggga

SEQ ID NO: 100024 - DNA, 119 bp, Mus musculus
gtgttcaatgtcttctgcttctctctttctctggaatagcatggcactgacagaagaatgatagcagagtaaagatatgcagttaacaccagaaatagaattaagtattacggaggata

SEQ ID NO: 100025 - DNA, 86 bp, Mus musculus
gtcttctgcaaattacttcactttacatttctatctgtatgctatggatggtgtgaatgctgataagggtaagaggtgttgaggtc

SEQ ID NO: 100026 - DNA, 108 bp, Mus musculus
tgggactctctggcccacttagaagcatagcacaaaacctcacagatgagaaagagcacccatccctgatgtttgagccctaggctctctggctggcagggacctcca

SEQ ID NO: 100027 - DNA, 105 bp, Mus musculus
gcttaaattggcctcacaccaggcaagctagcttgggggccctcagagttcaacgtctcacactgtatttctctctactagctgctgtgtaagacctgccaaagc

SEQ ID NO: 100028 - DNA, 67 bp, Mus musculus
aggtatgccagtgggggttggttctgaggcttcaaaagccaaagccattctgtctctgtctctgcct

SEQ ID NO: 100029 - DNA, 117 bp, Mus musculus
acgtgttaggcagccactctatcactgagctatatcctcaatcctttgtttcattttttataagaactttgagacagactcttaagaagttgctcaggtgagcagtagactcgttcc

SEQ ID NO: 100030 - DNA, 93 bp, Mus musculus
tgcctccataggattggtttgtaagcaagtctgtggtgggtattttctagactaatgattgatgtgggataggccagcccactgtggatggca

SEQ ID NO: 100031 - DNA, 77 bp, Mus musculus
acattgtatctttggaatttcaaattgaatttgtttgaaacttccttcacaaagtcagtttggatgggatgccctgt

SEQ ID NO: 100032 - DNA, 74 bp, Mus musculus
tatgtgaatgtatgtatatatgtgtgtgcatatgcacatgtgcacatacaggtgttcatgcatatagacacatg

SEQ ID NO: 100033 - DNA, 116 bp, Mus musculus
gtgtgggtttatttatatatgtatttatttgtttttactgtgcaggtcttgatttctgattttgttcttaggggttttctgtgtgttcgagtgtgcatgtctctgtgtgactatgt

SEQ ID NO: 100034 - DNA, 103 bp, Mus musculus
cctggatatctgaaaacagtggggggttccattaggagagaaggaggctctgaggctggttctccatctggaagtggtgagactcttgctgagacatgtgagg

SEQ ID NO: 100035 - DNA, 119 bp, Mus musculus
ctggaggtagcatagagactcccccaagatgccctgcttagcctcgggatcactctgactctgggtaacaagaggatatctgagatgagtcacagcaatggtccagtattttatggtat

SEQ ID NO: 100036 - DNA, 108 bp, Mus musculus
ccatagctacaccagcttcattcagcccgtgtgtaacccagagctggttcctcggcctcagtcactgccactgtgttttgcccttgaaagaagcttcaacttctgtgg

SEQ ID NO: 100037 - DNA, 120 bp, Mus musculus
atgtttttcctggatgctggatgacctctctggggaatatatatgtgtatatatgtgtatatatatacacacacatatatattattccaggatgtatgtgtgggggtgtggggggtgtat

SEQ ID NO: 100038 - DNA, 85 bp, Mus musculus
gaagcagaagttaagaacgatgctgtcctgggcagcttttgttgagaggtctgctgccaaggtgagcttctagcttgtttctttt

SEQ ID NO: 100039 - DNA, 85 bp, Mus musculus; identical to SEQ ID NO: 57470

SEQ ID NO: 100040 - DNA, 72 bp, Mus musculus
gtctgtgtctgtctctgagttctggcgttaaaggcatgaactgccatggccaactcggattcttaaatggat

SEQ ID NO: 100041 - DNA, 71 bp, Mus musculus
tgtggtcttgccaggtgctgtgtgtgtatatatatatatgcatatacatatatagaaaatggaaggaaaca

SEQ ID NO: 100042 - DNA, 103 bp, Mus musculus
ggaattttatttcatttggcagatacaacaaatgagagtaatgagactgtagagagatgggtgcatttatggtttgtgtgactatggaaggagaaagagtttc

SEQ ID NO: 100043 - DNA, 56 bp, Mus musculus
tacacacaagccagagcaaacagactcaggtgtgtgtgtgtgtgtgtgtgtgtgtg

SEQ ID NO: 100044 - DNA, 120 bp, Mus musculus
ttagaagttctccctctgctgttagtcatgagttgtttttacttgatttgtatagatataaaatctatttgaaaattatttgtagcttgggaactctgtgttggttatgtatgcttttaa

SEQ ID NO: 100045 - DNA, 84 bp, Mus musculus
ctgcctgcctgcctgcctgcctgtggattctgtgcctctaaatggacagcatggcctagcctcagtgggacaggatgtgtctag

SEQ ID NO: 100046 - DNA, 85 bp, Mus musculus; identical to SEQ ID NO: 57439

SEQ ID NO: 100047 - DNA, 108 bp, Mus musculus
gttcaaataccatttgtaggggctggagagagggctcagtggttaagagcactgactgctcttctagaggtcctgagttcaattttcagcaaccacatggtggctcac

SEQ ID NO: 100048 - DNA, 81 bp, Mus musculus
gcttcattgagtagaagggatggattttattttacatattttgcaatatagagtaaactcttcctgagacctttgggaagc

SEQ ID NO: 100049 - DNA, 138 bp, Mus musculus
ataagcatgtgtgtatatttatacatgtatgtatatgcatgcatataaatacatacatattacatacaaatgtctatatatacatattttatatgcaaacatgcatataaaacatgtatatataagaatatgtgtgta

SEQ ID NO: 100050 - DNA, 85 bp, Mus musculus; identical to SEQ ID NO: 57470

SEQ ID NO: 100051 - DNA, 69 bp, Mus musculus
tgtctaggtgaagcatttaatctctggggtgaaatcttagtccagagaacacagagaggtttcacagca

SEQ ID NO: 100052 - DNA, 85 bp, Mus musculus; identical to SEQ ID NO: 57439

SEQ ID NO: 100053 - DNA, 90 bp, Mus musculus
gacatggtgctggagaagcagctgagaattctacatccagatctgcaggcagcagagagaaatcacaaagcacattcccagtgacatatc

SEQ ID NO: 100054 - DNA, 101 bp, Mus musculus
tgtctagtggaggtcagaactcatccctgcacatcctctactcacctagtgacagaaggcagtctgtagagtctgttcttgtttgatcctccctcttagca

SEQ ID NO: 100055 - DNA, 182 bp, Mus musculus
gtgtatatatgtatatatgtgtatgtatgtgtgtatatgtgtatatatgtatatgtatgtgtgtatgtttctgtgtgcatgtgtgtatgtgtgtatatgtatatgtgtgtatatatgtatatatgtgcatatgtgtgtatgtgtatacatgtgtttacatgtgtgtatatgtgtatacatat

SEQ ID NO: 100056 - DNA, 75 bp, Mus musculus
ttactcagtgtggtggcttgaataagtatggcctacatagattcatatgtttgagtgcttgaccatagggagtaa

SEQ ID NO: 100057 - DNA, 77 bp, Mus musculus
gatgcaactgagggttctcggctgctggctgcactcttaggagagcagtgtgtgcacactggaaaccaagtgaagtc

SEQ ID NO: 100058 - DNA, 101 bp, Mus musculus
cctaaatgggacacccttatcaccccctacaaggcttatgaaacatcacagaagagagggtggaaagactgtaagacctggaggaagtggaagactggtgt

SEQ ID NO: 100059 - DNA, 119 bp, Mus musculus
gctcacttgtaactgagactttctccacagcctcttgcagaaggcacagagaaattgagactcccactctgtatctacagcaaacctggacttggtcacaatagcattcattagtaagc

SEQ ID NO: 100060 - DNA, 92 bp, Mus musculus
gcactcgggaggcagagacagaggcattgtagggctggagagatggctcagcagttaagagcactgactgctcttccagaggtcccgagttc

SEQ ID NO: 100061 - DNA, 82 bp, Mus musculus
ggtctggatactgccccccaccaagactgtgttgtaggaattagccttcttcctgtcatcattgtctgtcagtgtttcagcc

SEQ ID NO: 100062 - DNA, 79 bp, Mus musculus
ggttctgaggatcaaacccagtgctttgtgtgtgctaggaaagcactaactgagccactgagtgagtgaaatcccagcc

SEQ ID NO: 100063 - DNA, 66 bp, Mus musculus
ggatttcactcactcagtggctcagttagtgctttcctagcacacacaaagcactgggtttgatcc

SEQ ID NO: 100064 - DNA, 59 bp, Mus musculus
tctgtctgtctgtctgtctgtctgtctatgagagagagagagagagagagagagagaga

SEQ ID NO: 100065 - DNA, 85 bp, Mus musculus; identical to SEQ ID NO: 57439

SEQ ID NO: 100066 - DNA, 72 bp, Mus musculus
tgggtgaatgctatcatgctgggttaagtctttttgaaacaaaagaagaaactgcaagatctcaagcaccca

SEQ ID NO: 100067 - DNA, 107 bp, Mus musculus
gtggtagaaaaatctaaaagatgctttgaagagagaactcagaggcctcactgagggtagggctcctgttatctcactttacaaaagacatccagtcattttgccat

SEQ ID NO: 100068 - DNA, 113 bp, Mus musculus
tggccacttcatccactgtagaaaggaatattaagtatctatctatctatatatatctatgtctatatatatatatatataggcactggtttttaagtctttcttggctatag

SEQ ID NO: 100069 - DNA, 95 bp, Mus musculus
ttaggacagtgtttctgcctgtatttcaagctaaccttggatttagtatgtaatccaggttggcttgaatttacagcaaatttccagcctcctaa

SEQ ID NO: 100070 - DNA, 90 bp, Mus musculus
gcctgatgtgcttcatgtagtcagggctaagtggttaagtcaatggactagatatatatttattttcctgggtaagaagtcaattacggc

SEQ ID NO: 100071 - DNA, 89 bp, Mus musculus
cctttcagcgaggactttgacgaagacatcggatgtgagactaagtgttccaaagtctctccctctctgcatgttgtccagttgagagg

SEQ ID NO: 100072 - DNA, 118 bp, Mus musculus
aacttaaaggctaagtgattcagagctacccctaaatgtcgtactagcttgattggaattacagacaatagaggagtagactagacttcaagctaatgtgcacagagtgaattgagtt

SEQ ID NO: 100073 - DNA, 85 bp, Mus musculus; identical to SEQ ID NO: 57439

SEQ ID NO: 100074 - DNA, 75 bp, Mus musculus
ccattgtgtatgtctgtctctgtgtgtctgtgtgcatattcatacatgtgcagagatcaaaggacaactttcagg

SEQ ID NO: 100075 - DNA, 100 bp, Mus musculus
agtaatagcttgatctatggtaacagttaatggtgctattgacattttctagtagaagagagagtccacagaacccctaccaagaatttaaactattgct

SEQ ID NO: 100076 - DNA, 153 bp, Mus musculus
tatgtatatatgaatatacatatacatgtatatatgcatacatgtatatatacatgtatatatgtgtatatatttatgcatacagctatgtatgtatatatgcatgcatgcatgtgtgtatatgtatgtatgtatgtatgtatgtatgtatct

SEQ ID NO: 100077 - DNA, 85 bp, Mus musculus; identical to SEQ ID NO: 57470

SEQ ID NO: 100078 - DNA, 89 bp, Mus musculus
tcagttctgttcagtcagttgagttcaggcaatgtagtcagttctgtttattcagttgggagtcagttcagtgagtgcacgggagttga

SEQ ID NO: 100079 - DNA, 85 bp, Mus musculus
tgagttcttttgtgattttgttgactctagctgcatatgtaatcaaaagatggcctagtcagccatcactggaaagagaggctca

SEQ ID NO: 100080 - DNA, 65 bp, Mus musculus
gcaggtgaggttatttgagactcactcagtgactgaggcgctggggagagtgagccctcatctgc

SEQ ID NO: 100081 - DNA, 73 bp, Mus musculus
atatttgacaaatacaggtttgaaatatatatatatgtgtgtgtgtataatcacatgtgtgttttccagatgt

SEQ ID NO: 100082 - DNA, 64 bp, Mus musculus
tatggatatatgtgtgtctgcatgagcatatatgtgtatatatgtatctatatatgtatctata

SEQ ID NO: 100083 - DNA, 95 bp, Mus musculus
gggaaagataacagtgagaaaagacagaagaatcacagctgggagcggagtcaagagtttccatggatgggattttgttctcacaagtcatttcc

SEQ ID NO: 100084 - DNA, 90 bp, Mus musculus
ttttctcactagagtgaagattgactggactcagcaaggtagtttgccctgagctctctctagttgtttctgttaggcaggtgttgaaga

SEQ ID NO: 100085 - DNA, 92 bp, Mus musculus
gtgctttatctaaatgtttgtatatgtatatgtctgtggtacacatgcatgcatggggacatacatgaagggtacatatgcatgggtatgca

SEQ ID NO: 100086 - DNA, 105 bp, Mus musculus
gttgttgtttattcttatttgatccatgtgcatattttgtctgtgtatgtctgtgcatcacaggcatgcctatgccacaaaggctagaagagggtatctgattcc

SEQ ID NO: 100087 - DNA, 72 bp, Mus musculus
tatatataggaatacatacatatatatatgtgtatatatatgtgtatatatgtgtgtgtatatttgtgtgtg

SEQ ID NO: 100088 - DNA, 84 bp, Mus musculus
tataagccactgaccctctggcttacatttcaatgttatatcaatttttaaacatgaagggtaaaccagccatagtggtgtata

SEQ ID NO: 100089 - DNA, 60 bp, Mus musculus
ggatatatgtatgtatgtatgtatgtatgtacatatatacatacatatatacatatacac

SEQ ID NO: 100090 - DNA, 113 bp, Mus musculus
atggtcggtatatatgtatatgtatatgtgtatatatatatatatatatatatatatatatatatacacacatacatacacacacatatatacatacatatatatatactcca

SEQ ID NO: 100091 - DNA, 90 bp, Mus musculus
attctataagagagaattgagagagcagaatagaccgctcctggactaggagatagggtcagacaggtgctttgtgattggcttaggaat

SEQ ID NO: 100092 - DNA, 76 bp, Mus musculus
tcttttcagtgctggagacaggactgaggctctcattcgcgttaggctctgtcactgtcactctgtcactgataga

SEQ ID NO: 100093 - DNA, 118 bp, Mus musculus
gaggaaagctcacagcacactttgttttctggcttttacaatgattctattttattttaactgacaatcagtttcaatataaatactattgccaggtgagactgctgtagttgagctc

SEQ ID NO: 100094 - DNA, 97 bp, Mus musculus
tcactacccagtctccctttggctgccagtgtgtgtacatatatggttttatatatctgtatacaataataggatccacaaaagagagaaaatgtga

SEQ ID NO: 100095 - DNA, 85 bp, Mus musculus; identical to SEQ ID NO: 58391

SEQ ID NO: 100096 - DNA, 85 bp, Mus musculus; identical to SEQ ID NO: 58391

SEQ ID NO: 100097 - DNA, 74 bp, Mus musculus
tatgtatgtatgtatacatgtatacatatatacatatatatatatatgtgtatacatgtatacatatatacata

SEQ ID NO: 100098 - DNA, 83 bp, Mus musculus
gagcacagtctctcggaccagggactcaccgattaggctaggctgccttcaagggtctgtctgtctgtctcactgtccagctc

SEQ ID NO: 100099 - DNA, 85 bp, Mus musculus; identical to SEQ ID NO: 57439

SEQ ID NO: 100100 - DNA, 108 bp, Mus musculus
gtgagtaaagggctcatagactgtgaactgccttatcagctctggggctttagttagatctgattttgttgttgatatagtctactcaatgactctgtctgtcctcat

SEQ ID NO: 100101 - DNA, 128 bp, Mus musculus
ctctgtctggagcctgcctcttttgtccctggtttggtttaggtcttctggtaggtctgtggctctgactgtatcagaccacctgtggggccttccaactggggcctcttcagaggggcagagaagct

SEQ ID NO: 100102 - DNA, 100 bp, Mus musculus
ttctgtccatctgtgttcctggttgtcattcttcttgcagtagtggtcactcactcactgtgacaatggcatttggtccaggatcgccatatttccagaa

SEQ ID NO: 100103 - DNA, 95 bp, Mus musculus
gactggagtgtagaaaaaggattggtgttgatgatgatgatgatgatgatgatgatgatgataagcaaatcactagatggattatactgccagtc

SEQ ID NO: 100104 - DNA, 85 bp, Mus musculus
gtggtggcagacttgtgatattgtagggcttataataaggaactcctttatacaagatgcaagtgattttcagagtcagccttgc

SEQ ID NO: 100105 - DNA, 114 bp, Mus musculus
gtcatccagaaatactcacatttccatatgcagattcatctgattaattgaatattattttactatgatggtggttggaatgaggctgatgatgatgatgatgatgttgatgat

SEQ ID NO: 100106 - DNA, 69 bp, Mus musculus
catctgagatcaagctgtcaacagaattggcttcttttagagccactctctgagtgtgactttcagatg

SEQ ID NO: 100107 - DNA, 114 bp, Mus musculus; identical to SEQ ID NO: 100105

SEQ ID NO: 100108 - DNA, 69 bp, Mus musculus; identical to SEQ ID NO: 100106

SEQ ID NO: 100109 - DNA, 109 bp, Mus musculus
cttaccttgaggagttgcctgagccttgagagcagtgttgtgatatagatgtcctgtttgtagctgcatagcaactcaagaggtggaaatggacacttggtatcgtgag

SEQ ID NO: 100110 - DNA, 85 bp, Mus musculus; identical to SEQ ID NO: 58722

SEQ ID NO: 100111 - DNA, 111 bp, Mus musculus
gctcttcccctggactttgaatttccatgtacattttattatcagtttgtgtatttgtgtgatgactgtgatcacataaaatgtatagatcaatttgggcaggaatgatgc

SEQ ID NO: 100112 - DNA, 115 bp, Mus musculus
tgggaaagaatattgttaccactcatttgcaaaatgaaaagaatttgagaaaacgttaaactcaatttcttgatctattggaaatctgacttggcactgcaatcagttgatccca

SEQ ID NO: 100113 - DNA, 83 bp, Mus musculus
atgtatatttatatatacatgtatatgtatatattcatatgtgtgtacttatatatacacatatatgtatatattatatacat

SEQ ID NO: 100114 - DNA, 81 bp, Mus musculus
tatgataagtgattcagtgtataacatgtatgtatatacatatatatgcatatacgttatatttctggatatttatatata

SEQ ID NO: 100115 - DNA, 85 bp, Mus musculus; identical to SEQ ID NO: 57439

SEQ ID NO: 100116 - DNA, 69 bp, Mus musculus
gtcctgagggcccttcagtgtatgcacagactgtgatgctcagtggcactgacaggctgcctggctgac

SEQ ID NO: 100117 - DNA, 85 bp, Mus musculus; identical to SEQ ID NO: 57439

SEQ ID NO: 100118 - DNA, 96 bp, Mus musculus
tcagccttagtccatggtgatctgataggatgcatgggacaatttcaatatttttgtatctgctgaggcctgttttgtgaccaattaaatggttga

SEQ ID NO: 100119 - DNA, 110 bp, Mus musculus
ttgaagattagccttactccgtggtaatcagataggatgcatgggataatttcaatatttttgtatctgtggaggcctgttttgtgaccaattgtatggtcaattttgaa

SEQ ID NO: 100120 - DNA, 82 bp, Mus musculus
cttttgtgaactgtgtttttgtacatgtgtgttctgaatatcaacattcagtttactaatttgcaaaattacaaatcaaaag

SEQ ID NO: 100121 - DNA, 72 bp, Mus musculus
ctgtgactttgtacttctttattcatatttgctttatccttgagcatactgattagggatgagcaaggacag

SEQ ID NO: 100122 - DNA, 85 bp, Mus musculus; identical to SEQ ID NO: 57470

SEQ ID NO: 100123 - DNA, 78 bp, Mus musculus
ggaaagtgagctgagtgtctgcaggcatcattctgcctcttgtggctggaatgatcagcaacctcaggctcctgctgc

SEQ ID NO: 100124 - DNA, 81 bp, Mus musculus
aattagctcaaaaactgggctggagagatagcttagtggttaagagcactgactgctcttccagaggtcctgagttcaatt

SEQ ID NO: 100125 - DNA, 75 bp, Mus musculus
ggaacatcaatagtcaccagaggggtgattaatggattctttacagtatccctctctcagtgactatgaactgcc

SEQ ID NO: 100126 - DNA, 67 bp, Mus musculus
aactagggtgattttgtcattcaggggtgtctggcaatgtctagacacattttgagttgtcacagtt

SEQ ID NO: 100127 - DNA, 85 bp, Mus musculus; identical to SEQ ID NO: 57439

SEQ ID NO: 100128 - DNA, 85 bp, Mus musculus; identical to SEQ ID NO: 57470

SEQ ID NO: 100129 - DNA, 89 bp, Mus musculus
tggtagaggtacaattgaagttctatataaatttattgtgtctaacacagtaatattgatggtaaatttttaagatgtatcctctctca

SEQ ID NO: 100130 - DNA, 112 bp, Mus musculus
cacaggctaatgtgtcccagttactcaaatgaacattctcagattctctctgattctttaaagaatcttatttttcattgggtaaggagccatcttgttactttagaatgtg

SEQ ID NO: 100131 - DNA, 81 bp, Mus musculus
gtctttgcccttgaatgaaaaaggcttccttcagcagtcaagcattataggctggctgcgtgtatggagcgtgggagagat

SEQ ID NO: 100132 - DNA, 76 bp, Mus musculus
gagagagagagagagagagagagagagagagagagagcaagcatcttccctttgattcttgagcttagctttcctc

SEQ ID NO: 100133 - DNA, 62 bp, Mus musculus
tgtgtcatacaacaaactgagctgatttggttccatgttagttcactgttgtgatttccaca

SEQ ID NO: 100134 - DNA, 66 bp, Mus musculus
gaaattacacaggcctggagagatggttcagatggttcagactgctcttccagaggtcctgatttc

SEQ ID NO: 100135 - DNA, 58 bp, Mus musculus
tacatgtgtatgtatgtatgtatgtatgtatgtatgtatgtatatatgtatgtgtgta

SEQ ID NO: 100136 - DNA, 110 bp, Mus musculus
ttgctgacaggagcctgatattgctgtctcctgggaggctctgacagtgtctgacaaatacagaagtatatgctcacagccaattggatagagcacagggtcctcagtgg

SEQ ID NO: 100137 - DNA, 77 bp, Mus musculus
ggaggaagtgtgtccttatagaatttgagttttgaatatatatattcaagctacaatcagtgaagcacatagtctcc

SEQ ID NO: 100138 - DNA, 77 bp, Mus musculus
cgtgtgtatatatatatatgtgcatgcatatgtatataatattatgagtgcctgcttgcatgtatgtctgtgcatcg

SEQ ID NO: 100139 - DNA, 83 bp, Mus musculus
ttggtgatatgataggatgcatgggaaaatttcaatatttttgtatctgttgaggcctgttttgtgacctattatatggtcaa

SEQ ID NO: 100140 - DNA, 89 bp, Mus musculus
gaatgccactgtaagcttctgtcagtcactcaggctgctccagatttcagaagcaaactttagtattgaaggagtttaaattaaaattc

SEQ ID NO: 100141 - DNA, 93 bp, Mus musculus
aacactgacaagtgaagatgtgtggacagagggatacacagtgtgagacacactgtgacacactttctgtgctttgttttattttgttttgtt

SEQ ID NO: 100142 - DNA, 79 bp, Mus musculus
gcttctgttagtttcactgtgtctctgtttagttcctgtttccaggatctgtccattgatgagtgtggggtgttgaagt

SEQ ID NO: 100143 - DNA, 90 bp, Mus musculus
gtgttgagtataggcttttgtggtaggatctgatgatttttttttttttttggatttcctcagattctgttgttatgtctcccttttcat

SEQ ID NO: 100144 - DNA, 91 bp, Mus musculus
gtgttgttcagtttccatgtgaatgttggctttttattatttattttgttattgaagatcaaccttagtccatggtgatctgataggatgc

SEQ ID NO: 100145 - DNA, 88 bp, Mus musculus
gttgtgactcacaggttgaaaactactgttatagaacttaaaagagtctgtctgtctcagtggttttggaggtagaagagagttaaac

SEQ ID NO: 100146 - DNA, 100 bp, Mus musculus
cagttctccagtaacgacctgatgatttcatttattttgtaaacatctgcagtcgtgaactttcctgttgaggtcattctgttgttgggcatatgaattg

SEQ ID NO: 100147 - DNA, 87 bp, Mus musculus
agcatcactcccagacttctgtattgccctgtctttcactctgtgtatcagttaggaagtcagaccaacaaagtagagtgttaagct

SEQ ID NO: 100148 - DNA, 73 bp, Mus musculus
tgggacgaaaggatggaccatccagagactaacccacctgggatagtgtttttgttcttctgcctgaagccta

SEQ ID NO: 100149 - DNA, 118 bp, Mus musculus
tcactgctggaggactttgaggttataaaaggacacaccaggcccaggcttgcttactctctgcctgactgcctgctatcatgctccttgccatgatgttcatagactaagcctttga

SEQ ID NO: 100150 - DNA, 85 bp, Mus musculus; identical to SEQ ID NO: 57439

SEQ ID NO: 100151 - DNA, 63 bp, Mus musculus
gtttatatgtatatatctatgcatgtacatataaacacatgtttatatatgtacaatatgaac

SEQ ID NO: 100152 - DNA, 117 bp, Mus musculus
ctctgtcataagattgagtatgaatatattagcagacttctgataagattgaaagcagtatatctgagttagacaacctgtgtttgtttagttacttgttcgggaatgtaaatagag

SEQ ID NO: 100153 - DNA, 90 bp, Mus musculus
atgcatttaagggggcagagttgtaatcatcctacagtgaatcatctaattgaccgaggccctgagcagaaatttcccttctaactgtat

SEQ ID NO: 100154 - DNA, 108 bp, Mus musculus
ctatatattatacatatacacatatatacataagcttttatattgagtatctatatttatttacagttacttaattttagtttatggatgtgttatttttaagaatgg

SEQ ID NO: 100155 - DNA, 74 bp, Mus musculus
cttttacctatttgagagtagggagtgagtacacacagtcatctcaaattctttattttgcctctaggtaaaag

SEQ ID NO: 100156 - DNA, 83 bp, Mus musculus
agggattcaatggagatatcccgtttagaactgagtgttccaaggtctctcactctctgcataatatctgactatgggtctct

SEQ ID NO: 100157 - DNA, 87 bp, Mus musculus
caggagttagagatgattgtgagctaacatataggtactgagaattaagaccaggtcctcaacaagatcaagtgctcttaacccctg

SEQ ID NO: 100158 - DNA, 95 bp, Mus musculus
gagtttcttacataactactgttatttttttcttagtaaacatctgcataaattgagataaggaggaacagagggaggtttgaggtaggaaggtc

SEQ ID NO: 100159 - DNA, 96 bp, Mus musculus
agaaaccaaagatgaggtcatgtaacagagcagagacaggactgcagtcaagctttctggtttcattttatttttacagaccctgatttgggatct

SEQ ID NO: 100160 - DNA, 114 bp, Mus musculus
actgtctatgtatgcatgtgtgtgaattcatatttacatacattctgcttacatgcattctatgtatgtatgtatgtatgtatgtggcatgtgtcacagtgtgaaactagaggt

SEQ ID NO: 100161 - DNA, 74 bp, Mus musculus
gtaacagatgcgcagcttggtcttcatgtaggttccctaaatattggagcagggactgtctctgactctgttgc

SEQ ID NO: 100162 - DNA, 75 bp, Mus musculus
agctggtcttgctgtctctgactgtgacttgtccctcctgcaagcctgtatgtcagaactcctgggagaccagtt

SEQ ID NO: 100163 - DNA, 116 bp, Mus musculus
aggaagtcctataactaagccactaagctctgacacaatcaaggaagccattagtctatttctatttctgtctgattcactttgcctgtttctgcttatgtgtctttgtccttctt

SEQ ID NO: 100164 - DNA, 101 bp, Mus musculus
tatgaatggtgaagatgtcctaattctgttctcattctgtctcacacactccttggacaggcctcgaattcacttggtcacttcatatcccactcttcata

SEQ ID NO: 100165 - DNA, 102 bp, Mus musculus
caagctgttccttgtgagctttgcacagtactggtaattctatgagaggaaataacctctcacagaacagtcattgctgagagagttaagtgctatggtttg

SEQ ID NO: 100166 - DNA, 73 bp, Mus musculus
cagtcatccccctgcctcacacggtcactcagggtcatccccctgcttcagtagcagtgagcccggaaagctg

SEQ ID NO: 100167 - DNA, 63 bp, Mus musculus
tccgtccctctgtctgtctgtctgtccacccgtctgcacgggcatgcacaggagagaaacggg

SEQ ID NO: 100168 - DNA, 78 bp, Mus musculus
gtctgtctgtccgtccgtccgtgtgtgcggaggctgagctcccagcaggctctgctgcggcgggtgtgcggacctgac

SEQ ID NO: 100169 - DNA, 85 bp, Mus musculus; identical to SEQ ID NO: 57439

SEQ ID NO: 100170 - DNA, 105 bp, Mus musculus
gactaatctgccgggatgtccctgttcaggcgccaattgccacagacactctgggtccctgtgtgtgcatggagcgggatctcttaagcagatgtgcaaagagtc

SEQ ID NO: 100171 - DNA, 81 bp, Mus musculus
gtgctgagagtggagatagaggtcaaatccccagtgtgcaaaataggggcattacacagaaccttctcccaggctcatcac

SEQ ID NO: 100172 - DNA, 116 bp, Mus musculus
aattataaaggaaagtatttttcattgttatatatctgtgcttatctatgaatgtatgtactacatttaggtatgtataaatttatgaataaaacatactgagttcatttatggtt

SEQ ID NO: 100173 - DNA, 79 bp, Mus musculus
gctcagttgtaaaattacattcagattccacacaaactctcctgcgtgtgtgtctgtctgtcattcatcaacgctttgc

SEQ ID NO: 100174 - DNA, 81 bp, Mus musculus
gtgctgagagtggagatagaggtcaaatccccagtgtgcaaaataggggcattacacagaaccttctcccaggctcgtcac

SEQ ID NO: 100175 - DNA, 116 bp, Mus musculus; identical to SEQ ID NO: 100172

SEQ ID NO: 100176 - DNA, 133 bp, Mus musculus
gactcctcacatctcccctatttcttttatttaaaaggcaacaggccaccaagtactgagagtggagatagaggtcaaatgcccagtgtgcaaaaatgggggtattacacaaaaccttctcccaggctcatca

SEQ ID NO: 100177 - DNA, 85 bp, Mus musculus; identical to SEQ ID NO: 57439

SEQ ID NO: 100178 - DNA, 117 bp, Mus musculus
aattataaaggaaagtattttttcactgttatatatctgtgcatatctatgtatgtatgtactacatttaggtatgtataaatttataaataaaacatactgagttcatttatggtt

SEQ ID NO: 100179 - DNA, 85 bp, Mus musculus; identical to SEQ ID NO: 57439

SEQ ID NO: 100180 - DNA, 69 bp, Mus musculus
tctgtctctgtgagtgaccagagagtccaaaggtatttatgcctgaatctgtcctgaacagaagataga

SEQ ID NO: 100181 - DNA, 64 bp, Mus musculus
tcactcagactgtgggactgtgtttctggcaacagaaaacagtctaatctctttcacatgagga

SEQ ID NO: 100182 - DNA, 72 bp, Mus musculus
catgaccctcacaagattgagtccactgatctctcttggtgggagagggagggctcacagactccaggcatg

SEQ ID NO: 100183 - DNA, 110 bp, Mus musculus
agagatagtcgcattataattcttttgaatgtatatctgtgtgtgcatgttcatgtggtgacattgtgcacatatggttggaggtctggagttaatgtcatgtgtcctct

SEQ ID NO: 100184 - DNA, 124 bp, Mus musculus
gttctggatgacataagaaagtaactggggaagctatagttagcaagctagtgttcctatatgacttctgatttagttcttacttctaggttcttaccttgtgttcttgccatgacttctctgg

SEQ ID NO: 100185 - DNA, 72 bp, Mus musculus
tgtacctacaatggcagaagtctgagagcacatgtagcacaggaggggcttgatctggtattgctaggtaca

SEQ ID NO: 100186 - DNA, 83 bp, Mus musculus
gatagctcttagggtagggatttcatggaagcaaccagtttaggactgagagttccaagatctctcactctgtgagtgttgtc

SEQ ID NO: 100187 - DNA, 165 bp, Mus musculus
aagagtgttgttcagtttccacgtgaatgttgcttttctattatttatttttttattgaagatcagccttagtgcatggtgatctgataggatgcatgggacaatttcaatatttttgtatctgttgaggcctgttttgtgaccaattatgtggtcaattttgga

SEQ ID NO: 100188 - DNA, 106 bp, Mus musculus
gccttagtccatggtgatctgatatgatgtatgggataatttcaatatttttgtatctgttgaggcctgttttgtgatcgattatatgatcagttttggagaaggt

SEQ ID NO: 100189 - DNA, 111 bp, Mus musculus
gtttggctgccttaattgtttttatctgtgatcataattacgtttttattttaaagtatcaaaatataagaacttgtgattgcagacaatgactataaggcaaaacagtca

SEQ ID NO: 100190 - DNA, 85 bp, Mus musculus; identical to SEQ ID NO: 57470

SEQ ID NO: 100191 - DNA, 81 bp, Mus musculus
aacttctgttagtttcactgtgtctctgtttagtttctgtttgcaggatctgtccaatgaggaaagtggggtattgaagtt

SEQ ID NO: 100192 - DNA, 124 bp, Mus musculus
gagtttttgtttttaaaataagagtttgcacagaaagaatagaagtaagattgccagtggttgaattcagaatctccaaaactgtatttctgtctttaacatgtgttgatttggaactttaaaa

SEQ ID NO: 100193 - DNA, 85 bp, Mus musculus; identical to SEQ ID NO: 57470

SEQ ID NO: 100194 - DNA, 82 bp, Mus musculus
ggaatgcccagggagtaggcagtggaatggagcagggaaggaatctaatcttgtttgttttttcagtgggccttgatgttct

SEQ ID NO: 100195 - DNA, 100 bp, Mus musculus
gtgttgctagggtgttggttttgaggtttcaaaagtccatgccagtctcagtctctgtgtctctgcctgaagcctaagatcaggataaagctttcagcac

SEQ ID NO: 100196 - DNA, 72 bp, Mus musculus
tgatcaacagaactagcctacaggtaccataccagttaggtggtaggctaaggtacaaggttgttctgttca

SEQ ID NO: 100197 - DNA, 79 bp, Mus musculus
attcattcaaagtatttgttgagtatccactagtactgagcatacttctaggtaactcagtaaatactatcgaatggat

SEQ ID NO: 100198 - DNA, 86 bp, Mus musculus
catgtgtgtgtatgtgattttgaaactttttattgtaataaactcaagatattgcaaatgttcaggatattgcaaacatgcacttg

SEQ ID NO: 100199 - DNA, 85 bp, Mus musculus; identical to SEQ ID NO: 57439

SEQ ID NO: 100200 - DNA, 103 bp, Mus musculus
gcctggggtgggcatctggctgtgtttagccactgaccacacatggtgggtggtggacaaggggcagccccaggtaccaggttctcattgtctgtcatcccac

SEQ ID NO: 100201 - DNA, 62 bp, Mus musculus
tcctcttgcagggcaggtgcataaatatctggcgttcggacttgcctcctggcagaagagga

SEQ ID NO: 100202 - DNA, 96 bp, Mus musculus
gcatccaaagaaaagtaagcaccttttcactgtgtttctctcatctatgtaaagaatggtgggatttacaaggaaggatcagctgttttctgatgc

SEQ ID NO: 100203 - DNA, 85 bp, Mus musculus; identical to SEQ ID NO: 59761

SEQ ID NO: 100204 - DNA, 85 bp, Mus musculus; identical to SEQ ID NO: 57439

SEQ ID NO: 100205 - DNA, 94 bp, Mus musculus
gcatttaaaatatgttgtggtagttccttctaaacttcttgtgttgtatgagaatatagagttttcaaattgccatggccccaatgagaaatgt

SEQ ID NO: 100206 - DNA, 85 bp, Mus musculus; identical to SEQ ID NO: 57470

SEQ ID NO: 100207 - DNA, 93 bp, Mus musculus
tccaggtctggggcatgaacctggcatacaatgtagatttctgtgtttgttaggcaacagctacattgtctgctgggtttcaggctacctgga

SEQ ID NO: 100208 - DNA, 106 bp, Mus musculus
gaaggattagggtgccctcagtggctcagtagccagtgtagatcctgtctttggtaatcagcagctacatctggctactgggtctctggtggcatcatctagcttc

SEQ ID NO: 100209 - DNA, 119 bp, Mus musculus
atctggtttctctgtgtaaccctggctattctggaactcactctgtagatcaggctggctgcctctgtctctgcctcttgagttctgggattaaaggtacatgcttccatagcctggat

SEQ ID NO: 100210 - DNA, 85 bp, Mus musculus; identical to SEQ ID NO: 57470

SEQ ID NO: 100211 - DNA, 77 bp, Mus musculus
ttctgtgtgtggtacacatatgcataaatgtttgtatatgtgtgcatgcatatgtatatggtaccagtgcacatgaa

SEQ ID NO: 100212 - DNA, 120 bp, Mus musculus
gagtttttgtctgcttttcctgtcattatatgtatgtatgtatgtatgtatgtatgtatatacacacatttatacacacacacacacacatcttagtgaatcaccttgtatatatatctt

SEQ ID NO: 100213 - DNA, 85 bp, Mus musculus; identical to SEQ ID NO: 59744

SEQ ID NO: 100214 - DNA, 114 bp, Mus musculus
ttgagttatatataattttactctcatgaaatattcttgtgattttgttcaactatcctaaaaattcttgaacctttagctcagaagtcatgcagtaagatacagtgtgcttga

SEQ ID NO: 100215 - DNA, 107 bp, Mus musculus
ggcaatgctaggaaatacgggcaaaggtcaatgtgtatgtatgtatgtatgtatgtatgtatgtatgtatgtatgtgtgttgtcttgttgtcgtttcttaatatacc

SEQ ID NO: 100216 - DNA, 105 bp, Mus musculus
tgagacatatatatgtgtgtgtgtgcttaagtgtatatatacatatgtgtgtgtatgcacatatgtatatgtatatatgtatacatatgtatgagtatatgctgg

SEQ ID NO: 100217 - DNA, 85 bp, Mus musculus; identical to SEQ ID NO: 57470

SEQ ID NO: 100218 - DNA, 63 bp, Mus musculus
tctcttctcagctcttccatagcatccagtggcgcctgagtgcctgagagcctgagaaccaga

SEQ ID NO: 100219 - DNA, 127 bp, Mus musculus
gttctcaggctctcaggcactcaggcgccactggatgctatggaagagctgagaagagagtgagggcagtgggctggatctatctctggaccaaggggctccgcaggagagagagagtccttggctt

SEQ ID NO: 100220 - DNA, 96 bp, Mus musculus
gatcagccttagtacatggtgatttgataggatgcatgggacaatttcaatatttttgtatgtgttgaggcctgttttgttaccaattatatggtc

SEQ ID NO: 100221 - DNA, 85 bp, Mus musculus; identical to SEQ ID NO: 57439

SEQ ID NO: 100222 - DNA, 77 bp, Mus musculus
ttgtgtatctgcatgttcatgtgtgtgggtacatatgtgaatgcaagtactcacaatgagcagatagaggactacaa

SEQ ID NO: 100223 - DNA, 119 bp, Mus musculus
gcttgtgatgctcctgaccaggagaatggcacagcagttgataccaaatcagtcccagtgtctcacagtgtgatagatcgcctccaccgtgcagcctctccagtgcgggggcagcatgc

SEQ ID NO: 100224 - DNA, 94 bp, Mus musculus
tccacccactgtttggctgtaggtgtctgtatctgtctgagtcagctgctgggtggaacctctcacaggacagccatgctagactcctgtctga

SEQ ID NO: 100225 - DNA, 76 bp, Mus musculus
gtttacccaggagggctggagagacggctcagcggttaagagcactcactggctgctcttcagaggtcctgagttc

SEQ ID NO: 100226 - DNA, 95 bp, Mus musculus
cgtatgtatgtatgtatgtgtatgtatgtgtgtatatatatatatatacatatatatatacacatatatatttaaatatatatattctacatatg

SEQ ID NO: 100227 - DNA, 83 bp, Mus musculus
gtgtgtgtgtgtatatatatatatatatatatatatataaaccctgtgtgtatgtgtgtatatatatatatatatatatatat

SEQ ID NO: 100228 - DNA, 68 bp, Mus musculus
cacacatatatacacagacacacacatatatatgtatatatatgtgtgtgtctgtgtatatatgtatg

SEQ ID NO: 100229 - DNA, 77 bp, Mus musculus
ttgcagcaacaaagttttagacagaaacaatgcaaggatttggccctgtgtagagtctgaggactgaatgctgtcaa

SEQ ID NO: 100230 - DNA, 85 bp, Mus musculus; identical to SEQ ID NO: 57470

SEQ ID NO: 100231 - DNA, 74 bp, Mus musculus
gacggagaggcaaggtggatctctatgtttgaggatagccagggctacacagagagaccatctctctctctctc

SEQ ID NO: 100232 - DNA, 72 bp, Mus musculus
aggccaaggtactagatggatagactcataatcccttagtcttattctgtctgtctgtctgtctgtctgtct

SEQ ID NO: 100233 - DNA, 112 bp, Mus musculus; identical to SEQ ID NO: 61349

SEQ ID NO: 100234 - DNA, 69 bp, Mus musculus
cagacacagacagacagacagacagacagacagacagactgactggctggctggctggctggctggctg

SEQ ID NO: 100235 - DNA, 57 bp, Mus musculus
ttacatgtgtatatatgtatacgtgtgtatgtatgtatgtatgtatcacacatgtag

SEQ ID NO: 100236 - DNA, 102 bp, Mus musculus
ggccattcactggttattcattcccagtctctgttctctctgtcactgaataacacatatgcaggacacattttgggtcgaaggttttatgggtgggttgct

SEQ ID NO: 100237 - DNA, 76 bp, Mus musculus
cctgggggtcagatgtgtctgtgtgtgggccgagtggttgggaatccacagcacaggctttgctctgagattcagg

SEQ ID NO: 100238 - DNA, 80 bp, Mus musculus
tctgttactagtcagtacaagctgcacaggggaaaacctatcctccactgcccctgaatcagtcactgtcacataacagg

SEQ ID NO: 100239 - DNA, 86 bp, Mus musculus
tctaaaaggaaggaacctcaattgaggaagtatcttgaaaagatcaggctctaaggtattttcttaattggtgattgattggtagg

SEQ ID NO: 100240 - DNA, 80 bp, Mus musculus
ctcagtgttgggggctgagttgggacagggactcctcagcaacaaagggcctctctctttctctcagtgtccttggtggg

SEQ ID NO: 100241 - DNA, 89 bp, Mus musculus
gttggttaccaaaaacattcgacagtgatcagataaatatttgatttgtaaatattttaaaaagaaaacttcaatgtctggaagccagc

SEQ ID NO: 100242 - DNA, 105 bp, Mus musculus
gtacagctgagttgtctcagtgggtatgaattcctttagctgttttgttttttttttttttaaccagtgggaatcttttttatctattatgacaaatagctttgc

SEQ ID NO: 100243 - DNA, 92 bp, Mus musculus
acatccacattactcactgaacacagagaggtcaagctgatactacctagagcattcattcctattgactactgttcagtgtatgagaatgt

SEQ ID NO: 100244 - DNA, 85 bp, Mus musculus; identical to SEQ ID NO: 57439

SEQ ID NO: 100245 - DNA, 100 bp, Mus musculus
gtatcaataaaagatgcttaatagtccttgtgattttcttgtttttatgagttttttttttagattattacttggtatttattttatattttattgatat

SEQ ID NO: 100246 - DNA, 85 bp, Mus musculus; identical to SEQ ID NO: 79488

SEQ ID NO: 100247 - DNA, 74 bp, Mus musculus
ggacaatgttatgaagtttgttctttcctctcacctttatgtgaactctggagaggaaatttcggtcatgagcc

SEQ ID NO: 100248 - DNA, 83 bp, Mus musculus
tgatgagtgtcaggggggaaaggtggggatgtgggttgcagtgactcactggctcagtgtttcccttaaagacaatagagtca

SEQ ID NO: 100249 - DNA, 85 bp, Mus musculus; identical to SEQ ID NO: 57439

SEQ ID NO: 100250 - DNA, 85 bp, Mus musculus; identical to SEQ ID NO: 57439

SEQ ID NO: 100251 - DNA, 91 bp, Mus musculus
gcttttgatttggttttgcttattggtccctagcatcaagtattcccaccagatagtgaacagatgagtgtgaccagtttcctaaaagagc

SEQ ID NO: 100252 - DNA, 85 bp, Mus musculus; identical to SEQ ID NO: 57439

SEQ ID NO: 100253 - DNA, 110 bp, Mus musculus
tctcattgtgtcctggatttcctggatgttttgagttaggatcattttgcattttgcattttctttgattattgattccatgttctctacggaatcttctgcacctgaga

SEQ ID NO: 100254 - DNA, 85 bp, Mus musculus; identical to SEQ ID NO: 57439

SEQ ID NO: 100255 - DNA, 85 bp, Mus musculus; identical to SEQ ID NO: 57439

SEQ ID NO: 100256 - DNA, 85 bp, Mus musculus; identical to SEQ ID NO: 57439

SEQ ID NO: 100257 - DNA, 119 bp, Mus musculus
atacatacatatgcatatatatgtatatatggtactctacctgttttttaattagcctttatttttaattatatgagtgttttgtctccttgtatatctgtattgccatgtatgtatgt

SEQ ID NO: 100258 - DNA, 116 bp, Mus musculus
ttttaacatagaattagagtttcttataacatttgtcagaacttaattttattaaatattatttgaagaatttgtgactgagataaggaatttataatcagatttctatgctaaga

SEQ ID NO: 100259 - DNA, 104 bp, Mus musculus
caagatggaaaataccctggaaaacttctaattctgaatggttaagaattttaatcatcttagccattctgactggtgtgaggtgaaatctcagggttgttttg

SEQ ID NO: 100260 - DNA, 100 bp, Mus musculus
ggttttggaggtaaaagaagtcgcgtggtaagaaactacaggcaccttatttctctgtctatgtctctgccactctgtgtctctgtgtatctccatctct

SEQ ID NO: 100261 - DNA, 61 bp, Mus musculus
tgtaaatgtaccacattttgtttttcaattcatccattgacaagcatttgtggtatttaca

SEQ ID NO: 100262 - DNA, 157 bp, Mus musculus
ataccagaatatatatatatatatgtgtgtatatatatatatacacacatatgtgtgtatgtctgttgtgtgtgtatatatatatatgtgtgtgtgtgtatatatatatatatataaacaaactcatatatatatatataaacaaactcatatatgt

SEQ ID NO: 100263 - DNA, 106 bp, Mus musculus
gccttagtccatggttgtctgataggatgcatgggacaatttcaatatttttgtatctgttgaggcctgttttgtgaccaattatattgtcaattttggagaaggt

SEQ ID NO: 100264 - DNA, 94 bp, Mus musculus
aggactcttattaagaggaagatgaaaaatggtatgatagattaaaatagtcatgttactttataattaatcatacttcctaggaggtgagcct

SEQ ID NO: 100265 - DNA, 99 bp, Mus musculus
tcatagttcaatagaattttgtctttcatttgttagttgatggacatttaggttgtttacatttcctggctattgtgagtagagtttcagtgaatgtgg

SEQ ID NO: 100266 - DNA, 113 bp, Mus musculus
tttttttttttttttttttggaagggcagtattattttgagtacagagagagctgagttcctgacacagcttttacatgaataatttgttacctgaaagttgtaaggaagagg

SEQ ID NO: 100267 - DNA, 85 bp, Mus musculus; identical to SEQ ID NO: 57439

SEQ ID NO: 100268 - DNA, 73 bp, Mus musculus
tttgttttttttttttttttttccatgtgtgggctctgaaactgagctccagcagagagagaaaagaggcaag

SEQ ID NO: 100269 - DNA, 88 bp, Mus musculus
ttggtcttcctcagtctgtgactgtctttgtcctcatattgaaactttttatgtgctttggtcagttattttgctgagtgtttctcaa

SEQ ID NO: 100270 - DNA, 77 bp, Mus musculus
ctgtctacaaacatgtatatgagtattttgtatgctatgtaagttacatatatatatatgtgtgtgtatgtagatag

SEQ ID NO: 100271 - DNA, 100 bp, Mus musculus
gcatgtgtttatgtgagagagatagagacagagacacagagagcgagtcttcatgtacatcagtgtctattgtggatgtatgtccacatatgatgcatgt

SEQ ID NO: 100272 - DNA, 67 bp, Mus musculus
tgtcaggcatgatcttgtgtagtcccagtgcagataactgcatttgctatgaaatcatgtttgcaca

SEQ ID NO: 100273 - DNA, 63 bp, Mus musculus
gacatttcaaaaactcaggccaggcccaatgtctgtgtctgtgtctgtgtctgtgtctgtgtc

SEQ ID NO: 100274 - DNA, 87 bp, Mus musculus
cagaggcaaccaaaaatagggacgtagaatatttgcatctaattttgcaatgtggtatctgtctgtctatttgtctgtctgtctgtg

SEQ ID NO: 100275 - DNA, 103 bp, Mus musculus
ccttgtccctacatagaaccttcacccctaccttccagtgtttttttttttttttttttttttataggaaggtactctgcaggttaccaaaagtggaacatag

SEQ ID NO: 100276 - DNA, 67 bp, Mus musculus
ttcatgtctttgacccttatgtgccctgaatataagtccagagagaacacagagggcagagactgaa

SEQ ID NO: 100277 - DNA, 85 bp, Mus musculus; identical to SEQ ID NO: 87029

SEQ ID NO: 100278 - DNA, 116 bp, Mus musculus
gtggtctctctgaggctggtccaggtaagagagcaccaggtcacagaagaaacagagcttcttcgacagggtccctttgggctttcatcctcagccaccaggcagagctgaacctc

SEQ ID NO: 100279 - DNA, 93 bp, Mus musculus
tgattcagatgccaattttggttttctgcttgggtgtattcatcgcggaatatcagctcatcacagtcagcacagcggggcttctcactatca

SEQ ID NO: 100280 - DNA, 85 bp, Mus musculus; identical to SEQ ID NO: 57439

SEQ ID NO: 100281 - DNA, 100 bp, Mus musculus
gaagaagagttcacaatttgtagctagaaggacatgctataaaatatttcccatggaggagaatatgttcttctgattagtgtggacctagacctacttc

SEQ ID NO: 100282 - DNA, 110 bp, Mus musculus
tattgtattgtaccttgtaaattgtgatattattgatacataaatctgattttttaattaagctttaagtgtcatgattctacaaggctactgggtgttgtgagatgcaa

SEQ ID NO: 100283 - DNA, 85 bp, Mus musculus; identical to SEQ ID NO: 57470

SEQ ID NO: 100284 - DNA, 110 bp, Mus musculus; identical to SEQ ID NO: 100282

SEQ ID NO: 100285 - DNA, 56 bp, Mus musculus
acctgtgggtgtctgtgtctgtctgagtcagctgctgagtagagactcctagaggt

SEQ ID NO: 100286 - DNA, 106 bp, Mus musculus
gccttagtccatggtgatctgataggttgaatgggataatttcaatatttttgtatctattgaggcctgttttgggacccattatatggtcaattttggaggaggt

SEQ ID NO: 100287 - DNA, 70 bp, Mus musculus
gacttcacagaaagtagtctgcacaggtgagagtgtggactactgaaattaacagcttctgggacaggtc

SEQ ID NO: 100288 - DNA, 105 bp, Mus musculus
tgcataaaaagtctgatgattgatttgaaaaaaacattcaaatttcacacaacctctcctgtgtgtgtctgtttgtcaattcatcctaagctttgcccacctgcg

SEQ ID NO: 100289 - DNA, 105 bp, Mus musculus; identical to SEQ ID NO: 100288

SEQ ID NO: 100290 - DNA, 70 bp, Mus musculus; identical to SEQ ID NO: 100287

SEQ ID NO: 100291 - DNA, 106 bp, Mus musculus
gccttagtccatggtgatctgataggttgaatgggataatttcaatatttttgtatctattgaggcctgttttgggacccattatatggccaattttggaggaggt

SEQ ID NO: 100292 - DNA, 106 bp, Mus musculus; identical to SEQ ID NO: 100286

SEQ ID NO: 100293 - DNA, 70 bp, Mus musculus; identical to SEQ ID NO: 100287

SEQ ID NO: 100294 - DNA, 105 bp, Mus musculus; identical to SEQ ID NO: 100288

SEQ ID NO: 100295 - DNA, 97 bp, Mus musculus
ctttccaatttttatccccttgatctcattttgttgtagtattgctctggctaggacttcaaatactataatgaataggtaggtagaaagtgggcag

SEQ ID NO: 100296 - DNA, 56 bp, Mus musculus
acctgtgggtgtctgtgtctgtctgagtcagctgctgagtacagactcctagaggt

SEQ ID NO: 100297 - DNA, 97 bp, Mus musculus
ctttccaatttttatccccttgatctcattttgttgtagtattgctctggctaggacttcaaatacgataatgaataggtaggtagaaagtgggcag

SEQ ID NO: 100298 - DNA, 56 bp, Mus musculus; identical to SEQ ID NO: 100285

SEQ ID NO: 100299 - DNA, 78 bp, Mus musculus
cccttgatctcattttgttgtagtattgctctggctaggacttcaagtactatattgaataggtagggagaacgaggg

SEQ ID NO: 100300 - DNA, 106 bp, Mus musculus; identical to SEQ ID NO: 100286

SEQ ID NO: 100301 - DNA, 70 bp, Mus musculus; identical to SEQ ID NO: 100287

SEQ ID NO: 100302 - DNA, 113 bp, Mus musculus
tctgcataaaaagtctgatgattgatttgaaaaaaacattcaaatttcacacaacctctcctgtgtgtgtctgtttgtcaattcatcctaagctttgcccacctgtgactaga

SEQ ID NO: 100303 - DNA, 88 bp, Mus musculus
taaggggggacaagcagtagggaacacttgatataaatatttaattttagaaaagactttgatgtcagtgacaatgattcccccttta

SEQ ID NO: 100304 - DNA, 85 bp, Mus musculus; identical to SEQ ID NO: 57439

SEQ ID NO: 100305 - DNA, 56 bp, Mus musculus; identical to SEQ ID NO: 100296

SEQ ID NO: 100306 - DNA, 106 bp, Mus musculus
gtaaagggggttggaatagggtatttacagagggaaaacctggaaagggtatatatatatatattgcaatccagcatttgcttctgctcctggttccccccttcac

SEQ ID NO: 100307 - DNA, 85 bp, Mus musculus
ggccatgttggtctgataggatacatgggacaatttcaatttttttgtatctgttgaggcctgttttgtgaccaattttatggtc

SEQ ID NO: 100308 - DNA, 106 bp, Mus musculus
gccttagtccatggtgatctgataggttgaatgggaaaatttcaatatttttgtatctattgaggcctgttttgggacccattatatggtcaattttggaggaggt

SEQ ID NO: 100309 - DNA, 113 bp, Mus musculus; identical to SEQ ID NO: 100302

SEQ ID NO: 100310 - DNA, 90 bp, Mus musculus
gtacaaagttatacgttgaggtgaatgttctgagctggcattggggataagcttgatgtctgagagcttacctgttgctgaaaactgtgc

SEQ ID NO: 100311 - DNA, 98 bp, Mus musculus
ctctaggaggctctactcagcagctgactcagacagacacagacattcacagccaaatattgaatggagcttgggtctcttatggtagagttggggag

SEQ ID NO: 100312 - DNA, 66 bp, Mus musculus
tcatgaatgtagagggcctagtacagacccacaggggctctgtggttgttgcttctatattaatga

SEQ ID NO: 100313 - DNA, 85 bp, Mus musculus; identical to SEQ ID NO: 57439

SEQ ID NO: 100314 - DNA, 92 bp, Mus musculus; identical to SEQ ID NO: 57641

SEQ ID NO: 100315 - DNA, 90 bp, Mus musculus; identical to SEQ ID NO: 100310

SEQ ID NO: 100316 - DNA, 85 bp, Mus musculus; identical to SEQ ID NO: 57439

SEQ ID NO: 100317 - DNA, 66 bp, Mus musculus; identical to SEQ ID NO: 100312

SEQ ID NO: 100318 - DNA, 85 bp, Mus musculus; identical to SEQ ID NO: 57439

SEQ ID NO: 100319 - DNA, 90 bp, Mus musculus; identical to SEQ ID NO: 100310

SEQ ID NO: 100320 - DNA, 66 bp, Mus musculus; identical to SEQ ID NO: 100312

SEQ ID NO: 100321 - DNA, 75 bp, Mus musculus
tcagggattctgcgacaacccacacatatttggtcaggccctggtttctgactgactatctctgtctgtccctga

SEQ ID NO: 100322 - DNA, 90 bp, Mus musculus; identical to SEQ ID NO: 100310

SEQ ID NO: 100323 - DNA, 99 bp, Mus musculus
caagcttcacaactatatcatgaatgtagagggcctagtacagacccacaggagctctgtggttgttgcttctatattaatgaacacctaaaagccttg

SEQ ID NO: 100324 - DNA, 98 bp, Mus musculus; identical to SEQ ID NO: 100311

SEQ ID NO: 100325 - DNA, 90 bp, Mus musculus; identical to SEQ ID NO: 100310

SEQ ID NO: 100326 - DNA, 92 bp, Mus musculus; identical to SEQ ID NO: 57641

SEQ ID NO: 100327 - DNA, 85 bp, Mus musculus; identical to SEQ ID NO: 57439

SEQ ID NO: 100328 - DNA, 66 bp, Mus musculus; identical to SEQ ID NO: 100312

SEQ ID NO: 100329 - DNA, 90 bp, Mus musculus; identical to SEQ ID NO: 100310

SEQ ID NO: 100330 - DNA, 66 bp, Mus musculus; identical to SEQ ID NO: 100312

SEQ ID NO: 100331 - DNA, 98 bp, Mus musculus; identical to SEQ ID NO: 100311

SEQ ID NO: 100332 - DNA, 90 bp, Mus musculus; identical to SEQ ID NO: 100310

SEQ ID NO: 100333 - DNA, 92 bp, Mus musculus; identical to SEQ ID NO: 57641

SEQ ID NO: 100334 - DNA, 99 bp, Mus musculus; identical to SEQ ID NO: 100323

SEQ ID NO: 100335 - DNA, 98 bp, Mus musculus; identical to SEQ ID NO: 100311

SEQ ID NO: 100336 - DNA, 90 bp, Mus musculus; identical to SEQ ID NO: 100310

SEQ ID NO: 100337 - DNA, 92 bp, Mus musculus; identical to SEQ ID NO: 57641

SEQ ID NO: 100338 - DNA, 85 bp, Mus musculus; identical to SEQ ID NO: 57439

SEQ ID NO: 100339 - DNA, 66 bp, Mus musculus; identical to SEQ ID NO: 100312

SEQ ID NO: 100340 - DNA, 110 bp, Mus musculus
aagcggagctgagaccctgacacctgggcaacttccttgtcagaggagagtctgcttacacggagggctctgacacctggattcaggaggtggatgagagctccagactt

SEQ ID NO: 100341 - DNA, 97 bp, Mus musculus; identical to SEQ ID NO: 100295

SEQ ID NO: 100342 - DNA, 99 bp, Mus musculus; identical to SEQ ID NO: 100323

SEQ ID NO: 100343 - DNA, 90 bp, Mus musculus; identical to SEQ ID NO: 100310

SEQ ID NO: 100344 - DNA, 98 bp, Mus musculus; identical to SEQ ID NO: 100311

SEQ ID NO: 100345 - DNA, 98 bp, Mus musculus; identical to SEQ ID NO: 100311

SEQ ID NO: 100346 - DNA, 90 bp, Mus musculus; identical to SEQ ID NO: 100310

SEQ ID NO: 100347 - DNA, 92 bp, Mus musculus; identical to SEQ ID NO: 57641

SEQ ID NO: 100348 - DNA, 85 bp, Mus musculus; identical to SEQ ID NO: 57439

SEQ ID NO: 100349 - DNA, 66 bp, Mus musculus; identical to SEQ ID NO: 100312

SEQ ID NO: 100350 - DNA, 85 bp, Mus musculus; identical to SEQ ID NO: 57439

SEQ ID NO: 100351 - DNA, 90 bp, Mus musculus; identical to SEQ ID NO: 100310

SEQ ID NO: 100352 - DNA, 66 bp, Mus musculus; identical to SEQ ID NO: 100312

SEQ ID NO: 100353 - DNA, 98 bp, Mus musculus; identical to SEQ ID NO: 100311

SEQ ID NO: 100354 - DNA, 85 bp, Mus musculus; identical to SEQ ID NO: 57470

SEQ ID NO: 100355 - DNA, 85 bp, Mus musculus; identical to SEQ ID NO: 57439

SEQ ID NO: 100356 - DNA, 152 bp, Mus musculus
caccagacagcgctcacacgcttttgaactggaggctttgggtgcctgtgtcggtgcctgtgtcagtgcctgtgttagtgcctgtgtcagtgcctctgtcggtgcctgtgtcagtgcctgtgtcagtgcctgtgtcagtgcctctgtcggtg

SEQ ID NO: 100357 - DNA, 93 bp, Mus musculus
caggcaccgacagaggcactgacacaggcactgacacaggcactgacacaggcaccgacagaggcactgacacaggcactaacacaggcactg

SEQ ID NO: 100358 - DNA, 87 bp, Mus musculus
ctaggctcagttcccagcacacacatactggttcactgtcacatttaacttcagatccagtgattttgttgttcacttctggccttg

SEQ ID NO: 100359 - DNA, 100 bp, Mus musculus
tagaagttctgctctttggttccctttatttacttatctagcatatgaaatgtttttatgacaatgataggaagctaaagatgctacagaaaagaagcta

SEQ ID NO: 100360 - DNA, 94 bp, Mus musculus
gacactttcataagctcctgggtgattctttttgaaaaagatgtattttactttttcaatatgtgtatatgtttgagtctgtgtattgggtgtc

SEQ ID NO: 100361 - DNA, 80 bp, Mus musculus
atgtatgtgtgtgtatgtatatatgtacacatgtgtatatatatatatgtatacatatatatgcgcgaacatatatacat

SEQ ID NO: 100362 - DNA, 81 bp, Mus musculus
ggactggagaggagaagacaggtgagttgagaacagcaactaatttgcagtgctcactcactggctctgatactaaagtcc

SEQ ID NO: 100363 - DNA, 85 bp, Mus musculus; identical to SEQ ID NO: 57439

SEQ ID NO: 100364 - DNA, 107 bp, Mus musculus
gggcatgagaaaagattaaaacctgggactggaaagatggctcagtggttaagagcactgactgctcttcctgggtccagaagacccaggttcaattctcagcaacc

SEQ ID NO: 100365 - DNA, 96 bp, Mus musculus
gtcacttattcagcactcatagactgagctccttgacagtcttgtcagtaggagatactactctgtcactctttgtgtctgctttgtaattctgat

SEQ ID NO: 100366 - DNA, 71 bp, Mus musculus
atggtatatgtgcatgcttatatacatgcttgcatttgtgggagtgtatgtgtgtctgtctgtctgtccgt

SEQ ID NO: 100367 - DNA, 105 bp, Mus musculus
gaagcgtctctgatgaaggttggacagggcactgatctatgaatatagtggaatgttgttaggagtcatgttatgcaatgttctttgggcagagctgtaatattc

SEQ ID NO: 100368 - DNA, 96 bp, Mus musculus
tgtgtgtgtgtgtatctgtgtgtgtgtctgtgtgcgcgtgcgacaagcggtgtgcatgtgcaaacacacacacacacacacacacacacacacaca

SEQ ID NO: 100369 - DNA, 115 bp, Mus musculus
agatgttaaaaaccaaaatgcgggactggagagatgtctcagaggttaagagcactggctgctcttccagaggtcctgagttcagttcccagcaaccacatggtggcttacatct

SEQ ID NO: 100370 - DNA, 116 bp, Mus musculus
gggggtggtggtggtggtggtggtggagagatggctcagcggttaagagcactgactgctcttccgaaggtcctgagttcaaatcccagcaaccacatggtggctcacaaccatcc

SEQ ID NO: 100371 - DNA, 106 bp, Mus musculus
tgtgtgtgtgtgtgcgcgcgcgcgtgctcatgtgggagcatgtgatgtatgtgtgcacacagcagcctgttggatgtcttactctaccaccgtgtgtcatattccc

SEQ ID NO: 100372 - DNA, 69 bp, Mus musculus
gagcagcctgcctctctctgccagtgctcacattacaggcactgcggcattgagcctccatgcttgctc

SEQ ID NO: 100373 - DNA, 84 bp, Mus musculus
tgagtttgacagggcagctaatcatgaattccagccccacagaagatggggagagtgtcagcttctgcatctgtaatgaactca

SEQ ID NO: 100374 - DNA, 69 bp, Mus musculus; identical to SEQ ID NO: 100372

SEQ ID NO: 100375 - DNA, 103 bp, Mus musculus
ttagagctgaaaagtaacttggtgcagacagcagagacagctcagtggctaagagtccttgctgctcctgcacatgggccagagtttgcttcccagtgtctga

SEQ ID NO: 100376 - DNA, 69 bp, Mus musculus
gagcagcctgcctctctctgccagtgctctcattacaggcactgcggcattgagcctccatgcttgctc

SEQ ID NO: 100377 - DNA, 69 bp, Mus musculus; identical to SEQ ID NO: 100372

SEQ ID NO: 100378 - DNA, 105 bp, Mus musculus
cttagagctgaaaagtaacttggtgcagacagcagagacagctcagtggctaagagtccttgctgctcctgcacatgggccagagtttgcttcccagtgtctgag

SEQ ID NO: 100379 - DNA, 69 bp, Mus musculus
gagcagcctgcctctctctgccagtgctcacattacagtcactgaggcattgagcctccatgcttgctc

SEQ ID NO: 100380 - DNA, 105 bp, Mus musculus; identical to SEQ ID NO: 100378

SEQ ID NO: 100381 - DNA, 136 bp, Mus musculus
atatacttgtgtgtgtatatatatatatatgtgtgtgtgtgtgtgtgtgtgtgtgtgtgtgtgtgtgtgtgtgtgtgtatctcgctggctggcatggaacctatctagctcaagtggtggtgcaagccttttatac

SEQ ID NO: 100382 - DNA, 69 bp, Mus musculus; identical to SEQ ID NO: 100372

SEQ ID NO: 100383 - DNA, 103 bp, Mus musculus
ttagacctgaaaagtaacttggtgcagacagcagagacagctcagtggctaagagtccttgctgctcctgcacatgggccagagtttgcttcccagtgtctga

SEQ ID NO: 100384 - DNA, 84 bp, Mus musculus; identical to SEQ ID NO: 100373

SEQ ID NO: 100385 - DNA, 69 bp, Mus musculus; identical to SEQ ID NO: 100376

SEQ ID NO: 100386 - DNA, 105 bp, Mus musculus; identical to SEQ ID NO: 100378

SEQ ID NO: 100387 - DNA, 69 bp, Mus musculus
gagcagcctgcctctctctgccagtgctctcattacaggcactgtggcattgagcctccatgcttgctc

SEQ ID NO: 100388 - DNA, 105 bp, Mus musculus
cttagagctgaaaagtaacttggtacagacagcagagacagctcagtggctaagagtccttgctgctcctgcacatgggccagagtttgcttcccagtgtctgag

SEQ ID NO: 100389 - DNA, 69 bp, Mus musculus; identical to SEQ ID NO: 100372

SEQ ID NO: 100390 - DNA, 111 bp, Mus musculus
ggccataaaatgtgccagaaaggagctttaagtcagctgtgacccttagacctcagttgtcagtctgagagagcctgggtttcaaacttgatgtggtggcgcttagtggcc

SEQ ID NO: 100391 - DNA, 118 bp, Mus musculus
ctttgagaaagatgcatttttcaggtctgtagatttatcacatgcatgagtgtgtgcatgtgcttgtatgcatgtgcatgcatgtgtacgtgtacaggtggattcatcaaggtcaaag

SEQ ID NO: 100392 - DNA, 75 bp, Mus musculus
gctgctggggattgggatctgtgtgtttatatgatttttttttctgagataggatctcatgtagcccaggctagc

SEQ ID NO: 100393 - DNA, 107 bp, Mus musculus
gtgtgtgtgtgtgtgtgtatctgcatgtacactatgtatatatgtctgtatgtgtgtctgtataaatgtatgtacatacatatgtaggtatatgtatatacatatgc

SEQ ID NO: 100394 - DNA, 113 bp, Mus musculus
gggaaggtgtgtgtggctttgaggtttcaaaagtccatcatgccaagaccagtctctccctgtctgcctgtggataaggatgcagctcccagctactgctctagtgcctgcct

SEQ ID NO: 100395 - DNA, 64 bp, Mus musculus
ttggtgtcagtctctctctgtccctgccagtctctctttctgtgtctggcagtctgtctgccag

SEQ ID NO: 100396 - DNA, 85 bp, Mus musculus; identical to SEQ ID NO: 60314

SEQ ID NO: 100397 - DNA, 80 bp, Mus musculus
tctccctgggcttggatgtgctgtagtttatgtgaactcagctacgctggggagtgtgtctgtggctctgacagaggaga

SEQ ID NO: 100398 - DNA, 80 bp, Mus musculus; identical to SEQ ID NO: 100397

SEQ ID NO: 100399 - DNA, 110 bp, Mus musculus
gaaatcctttaagagagttggtgcagggactggagagatggctcagtggttaagagcactgactgctcttcccaagggtcctgatttacaaggcacttattaagggattc

SEQ ID NO: 100400 - DNA, 106 bp, Mus musculus
cttactgcttttaatattctgtcttcatttagtgcatttgttgttctgactattatgtgtcaggaggaatttcttttctggtccagtctatttggagttctgtagg

SEQ ID NO: 100401 - DNA, 82 bp, Mus musculus
gctcaggtctgtttttgttattctgagggagtctcattatgcagctcaggctggccttgggcccttacttaagtgaagcagg

SEQ ID NO: 100402 - DNA, 72 bp, Mus musculus
gacggaaaactagccagcacatcagataaggtaaacaccctccttgtctggctctgggtctctgtatctgtc

SEQ ID NO: 100403 - DNA, 85 bp, Mus musculus; identical to SEQ ID NO: 57439

SEQ ID NO: 100404 - DNA, 116 bp, Mus musculus
atgcaactgtggaagaacaattttaaccctttaggaggcttaggagggagtcttcagtctgaagtgtgtctgcagcaaggccagaggggaacaaataacatactactcagtcacat

SEQ ID NO: 100405 - DNA, 81 bp, Mus musculus
tgtcaggatctggtagagcctctcaggagacagctatatcaactctgaggatggttttaaactaacacacacactctgaca

SEQ ID NO: 100406 - DNA, 118 bp, Mus musculus
ttggttaaaaactccaagatgcttcaaatgccagagagatgacagtgatgacagcgagcacacactaggtggagtaagggcatggcatcctctggtcatgcatcttggagtgctccaa

SEQ ID NO: 100407 - DNA, 85 bp, Mus musculus; identical to SEQ ID NO: 57439

SEQ ID NO: 100408 - DNA, 85 bp, Mus musculus
ggccatggtggtctgataggatccatgggacaatttcaatatttttgtatctgttgaggcctgttttgtgaccaattatatggtc

SEQ ID NO: 100409 - DNA, 79 bp, Mus musculus
ggtcttgctgtctctgactgtgtcttatcactcctgtgctcacagctgtatttgtactcctgggagaccagctctctcc

SEQ ID NO: 100410 - DNA, 112 bp, Mus musculus
atgctagcatgtctattgtttttgtccttgctgagcttatgtttacagagtcattttggtgagagtttattataggtgtagtttctgatattagcaggagatataatctcat

SEQ ID NO: 100411 - DNA, 85 bp, Mus musculus
ggccatggtggtctgataggatacatgcaacaatttcaatatttttgtatctattgaggcctgttttgtgaccaattatatggtc

SEQ ID NO: 100412 - DNA, 106 bp, Mus musculus; identical to SEQ ID NO: 75517

SEQ ID NO: 100413 - DNA, 85 bp, Mus musculus; identical to SEQ ID NO: 57439

SEQ ID NO: 100414 - DNA, 77 bp, Mus musculus
tattgtgtgtatgtatgtatgtatgtatgtatgtatgtatgtacgcatgcatgcatatgtgcatgtatataccttta

SEQ ID NO: 100415 - DNA, 75 bp, Mus musculus
cagtctgttactctgtgtctttttattggggaattgtatccgttgatgttaagagatattaagaacaagtgattg

SEQ ID NO: 100416 - DNA, 111 bp, Mus musculus
cctcaaggaaaggctaatagccctacattatgtaaaaaatttttgtcactgcttcaatacagtgtatattattgattatatgggtattttattagctggttcctctgatgg

SEQ ID NO: 100417 - DNA, 82 bp, Mus musculus
agttcttactcctcccaagtatgtatgtatatatgtatacatgtatgcgtatatatgtatatatttgaagtgtgttggaact

SEQ ID NO: 100418 - DNA, 123 bp, Mus musculus
ttatatatatatatatatatatatatatatatatatatatatatatatataaagtatatgtatatatatgtagtatatgtgtatatatatgtgtgtgtgtgtgtatacatatatatatatata

SEQ ID NO: 100419 - DNA, 90 bp, Mus musculus
actgcagttggcatttgaatgtatatttctataaagtgtcctatatagtggccatgtgatggagtgtttgtttagagtgtgttaggcagt

SEQ ID NO: 100420 - DNA, 85 bp, Mus musculus; identical to SEQ ID NO: 57470

SEQ ID NO: 100421 - DNA, 85 bp, Mus musculus; identical to SEQ ID NO: 57439

SEQ ID NO: 100422 - DNA, 86 bp, Mus musculus
gacagagagagagagacagacagagagagagagagagagagagagagagagagagactgtctctgactctgtgtctgtgtctctgt

SEQ ID NO: 100423 - DNA, 93 bp, Mus musculus
tggccaattaggaggggaactatatctgacacctaaacagggaccctctgggacttgcagaagagagtgagtactcccctctgagggccactg

SEQ ID NO: 100424 - DNA, 113 bp, Mus musculus
gatcaatttctctgccttaatttcttttactgttgcagtgattttatgtttttaaaaagaccttatgaaatcaccttaggggcaacagtttcaattatctcagactttgagtc

SEQ ID NO: 100425 - DNA, 115 bp, Mus musculus
actaaagtagtagataatatatatacatgtgtatgtgtatgagcatgtgtatgtgtatatgtatatgtgtgtatgtgtatgagtatgtgtatgagtatatgtatgtgtgtgtatg

SEQ ID NO: 100426 - DNA, 109 bp, Mus musculus
cttccctttgtataatcttttactcagtaactgtttaaccagatcattgtaagacaatttggttatatatttatcatttgtaaaataagtattatcaagaaaggtgaag

SEQ ID NO: 100427 - DNA, 85 bp, Mus musculus; identical to SEQ ID NO: 57439

SEQ ID NO: 100428 - DNA, 85 bp, Mus musculus; identical to SEQ ID NO: 57439

SEQ ID NO: 100429 - DNA, 85 bp, Mus musculus; identical to SEQ ID NO: 57470

SEQ ID NO: 100430 - DNA, 112 bp, Mus musculus
tgtacttcatttgctgctgaacaaccagttatttttttaagaaaattcattgtataattttttacttatatgtatgggtctgtgtaactctgtgtatgtgcacttgagtgca

SEQ ID NO: 100431 - DNA, 84 bp, Mus musculus
tgagcaatacttttatatttggaggaataattatctatttatatgtacttaggtagttgggtttggccaaatatgcaatgctta

SEQ ID NO: 100432 - DNA, 89 bp, Mus musculus
taggccatggtggtctgataggatacatgggacaatttcaatatttttgtatctattgaggcctgttttgtgaccaattatatggtcta

SEQ ID NO: 100433 - DNA, 106 bp, Mus musculus
actagcaagcagggaatcccagggtggacactctctcagagaaaaaagagagcggtgatgagagactctctgagaggttactagttgggcaccattgtatgtaagt

SEQ ID NO: 100434 - DNA, 85 bp, Mus musculus; identical to SEQ ID NO: 57482

SEQ ID NO: 100435 - DNA, 102 bp, Mus musculus
tagaaggatctgatggtgttttggatttcttcaggatctgttgttatgtctcccttttcatttctgattttgttgattaggatattgtccctgagccctctg

SEQ ID NO: 100436 - DNA, 59 bp, Mus musculus
gagactcctaacagtgtgagtgagtgtgtctctgattcacttgcttgtacttgggtctc

SEQ ID NO: 100437 - DNA, 85 bp, Mus musculus; identical to SEQ ID NO: 57470

SEQ ID NO: 100438 - DNA, 75 bp, Mus musculus
ttcagtgtctctctttctttgtggaggtccttgattttcttggacttggtctctgtacaaggaaataagaatgga

SEQ ID NO: 100439 - DNA, 85 bp, Mus musculus; identical to SEQ ID NO: 57439

SEQ ID NO: 100440 - DNA, 112 bp, Mus musculus
gaaagatagacttaaaatgaactgcctaacttcattcagtgcttttccagtggaatatttattttctttgaaaaagtgagaggttttcaggcagccatagtctttatgtatc

SEQ ID NO: 100441 - DNA, 85 bp, Mus musculus; identical to SEQ ID NO: 57470

SEQ ID NO: 100442 - DNA, 115 bp, Mus musculus
tattgatgctagttaatttgcaatttgcttctaggtatgcatgaatttttttttaaatcaccagatttacagacagaattccctatttaatagagggcgattaatttgaacaata

SEQ ID NO: 100443 - DNA, 116 bp, Mus musculus
tgtaatctcttattctctgcaccttggaaagttgcgcttctctgtgttaatcactgtaaattgtaaatagtttttcacatgaaggtttggagatgcattgacttatggatattaca

SEQ ID NO: 100444 - DNA, 85 bp, Mus musculus
ccacagcatgataagaggctaggttgtaaatgccaacaaggcagaaatggacatcagcaatttgcttctatacattataatgtgg

SEQ ID NO: 100445 - DNA, 83 bp, Mus musculus
gagtggtggtcataatgaggtgtacttcagtaacaaagggctgggagtgctgtgtcactatcagtcaaggtatgatactggag

SEQ ID NO: 100446 - DNA, 87 bp, Mus musculus
cacacacacacacacacactaacatgagaattacagatttatctctttgtatgtctgtctctgtgtaagtctgtgtgtatgtttgtg

SEQ ID NO: 100447 - DNA, 111 bp, Mus musculus
cctcaaggaaaggctaatagccctacattatgtaaaaattttttgtcactgcttcaatacagtgtatattattgattatatgggtattttattagctggttcctctgatgg

SEQ ID NO: 100448 - DNA, 109 bp, Mus musculus
gatcttgtatggtgatcctggacagaggcagtgagttgctccttcttagccatgtagctgccagaatgatgtatctctgcagtgtcctgtgttgttcagctatgatatc

SEQ ID NO: 100449 - DNA, 82 bp, Mus musculus
tgaagtcgcccttttacaaagtttttctctgtctgcagtacgtgcagtacagtactgattttgtacattgtggctttcttca

SEQ ID NO: 100450 - DNA, 74 bp, Mus musculus
tggtgggtctgggttgtattccaaagctggctgagtataagtcagagatgaatgacagcaaagacacttctcca

SEQ ID NO: 100451 - DNA, 113 bp, Mus musculus
acggtgaccaggtggcatagtgatagagccacatatgaaaaggtatataattaacaaatatgtttatattttacttgtatatgtattgtattacttgtattacttgtatatgt

SEQ ID NO: 100452 - DNA, 109 bp, Mus musculus
ctctgtttgttggaagatgtaaacttaagggctggagagatggttcagaggttaagagcactgactgctcttccagaagtcctgagttcaattcccagcaactgcatgg

SEQ ID NO: 100453 - DNA, 113 bp, Mus musculus
agactgccagaggcacagtttagggggggaaagaaactgttgattaatattgattaatgcagtagaatgttaattagatgtttattcctaatgtctctgccttagcactgtct

SEQ ID NO: 100454 - DNA, 81 bp, Mus musculus
cttctatcctttgctcgcctctctgtctgcctctgtttgtgtagggactgttgtagagggccacctggcaaggaacagaag

SEQ ID NO: 100455 - DNA, 108 bp, Mus musculus
tgcctgtaagtctcatatatatatatatatatatatatatatatatatatatatatatatatatacatacatatgtatgtatatgtatatatgagtcttttgcttgca

SEQ ID NO: 100456 - DNA, 81 bp, Mus musculus
gtcaggggttagagtcagaactcagtcagtaaactgcttgcaagcatgtagaccccagttcgactcccagtgctcccaggc

SEQ ID NO: 100457 - DNA, 77 bp, Mus musculus
gatcaagtaaccatcccgcagcaagaaggacagttaggctgcctgatctctgtacctctctgactgacagcttggtc

SEQ ID NO: 100458 - DNA, 77 bp, Mus musculus
cctgagtcctagtcttgtgtctttctctgttactgacagggggaaaaagaaaggaaagagaattcgggtatcttagg

SEQ ID NO: 100459 - DNA, 107 bp, Mus musculus
tttgtagttttgaagtatgacagtctgctatgtagcccaggagggacttttgtgagacagagtctctctgtgtaacaaacaaccttgcatgtcctagaactcataga

SEQ ID NO: 100460 - DNA, 77 bp, Mus musculus
tgttttagtgatagggtctcacactgtggctcaggcttgcttggaaatcactgtgtatcccaggctcacttcaaaca

SEQ ID NO: 100461 - DNA, 85 bp, Mus musculus
aactgtcctggaactcgctttgaagagcaggctggcctcaaacccccagataccttcctgcctctgtctctgtctccagagtgtt

SEQ ID NO: 100462 - DNA, 65 bp, Mus musculus
gagagagagagagagagagagaaagagagagagactgtctctgactctgtgtctgtgtctctgtc

SEQ ID NO: 100463 - DNA, 74 bp, Mus musculus
gtgcatgcaacttggtcttcatgtgggtcccctaacaattggagcaggggctgtctctgactctgtagcctgcc

SEQ ID NO: 100464 - DNA, 83 bp, Mus musculus
gtgtgtgtatctgtgtgtgtctgtgtatgtacacaggatgtatatgagtacatgtgtgtgtctgtgtatgtgtgtgacacaca

SEQ ID NO: 100465 - DNA, 77 bp, Mus musculus
gtaggaaaaggatgtatacaactgtgtgtcacacacatacacagacacacacatgtactcatatacatcctgtgtac

SEQ ID NO: 100466 - DNA, 107 bp, Mus musculus
agtgctgggattaaaggcgtgcaccaccactgtccggtgaattcattttttttaaaaaaggagatattgaacccgatttagtggtacatacttgtgatcttagcact

SEQ ID NO: 100467 - DNA, 85 bp, Mus musculus; identical to SEQ ID NO: 59783

SEQ ID NO: 100468 - DNA, 72 bp, Mus musculus
atgtactcataggggacctgatatagatgcatgcaagccctatgcatgctctctcagtctctgtgagttcat

SEQ ID NO: 100469 - DNA, 116 bp, Mus musculus
ggctcccaggtgctgagattataggcatttaatatccacacctggctgtagatcttttgttttaaaattattattatatgtgtactggatgttttgtctgtgtgtatctgtgtacc

SEQ ID NO: 100470 - DNA, 90 bp, Mus musculus; identical to SEQ ID NO: 100419

SEQ ID NO: 100471 - DNA, 96 bp, Mus musculus
gtctttatgtggtaattcagatggcagggcatctcaaggaactgaatttttttttctgtagatgagacacccatggttgaatcttcacattcttgc

SEQ ID NO: 100472 - DNA, 63 bp, Mus musculus
tctctgtctctctctctctctgacacacacacacacacacagagagagagagagagaaagaga

SEQ ID NO: 100473 - DNA, 106 bp, Mus musculus
ttgggctagaattcatgaccctgagattaagtcttatgctctattgactgaactatctgagcactccctgtaggcaaggttttatggtatgtaaattatgtcccaa

SEQ ID NO: 100474 - DNA, 111 bp, Mus musculus; identical to SEQ ID NO: 100447

SEQ ID NO: 100475 - DNA, 91 bp, Mus musculus
ggccatgagacacaaagtatgataggaagcaatgttatttctctgagatgagagaagacattgaggaaagcctcacacttgaatttctgct

SEQ ID NO: 100476 - DNA, 113 bp, Mus musculus
tagaacaatagtttaataactgagcttatcattaaataaaatctccaaatgtatatattatttcattcatgatttggagtaagaggtaaagttcatgatatagactgtttcta

SEQ ID NO: 100477 - DNA, 62 bp, Mus musculus
tatatacacacacacatatacatatatatacacatatatatgtatatgtatgtgtgtatata

SEQ ID NO: 100478 - DNA, 81 bp, Mus musculus
ggaaaaataacagagcaagaaatccaatggaggcgtttgcacaagtgttcatctctggatgtcttctgtatgtgtttgtcc

SEQ ID NO: 100479 - DNA, 118 bp, Mus musculus
catctgtgcttatttcgtgcagcaggtactgttcacacactgtcgtagcacacatttgcatttctgagaacatggtgacatgtactacactgcttttccacgagggatcactagtttg

SEQ ID NO: 100480 - DNA, 85 bp, Mus musculus; identical to SEQ ID NO: 57439

SEQ ID NO: 100481 - DNA, 74 bp, Mus musculus
ctgtctgcatgtatatatgtgcatatgtatatatgtatgtatgtatatatgcatgcgtgcatgttagtgtgtat

SEQ ID NO: 100482 - DNA, 111 bp, Mus musculus
tatggtttagagagacctattattcaggtatcatgtgtatagtttccctgtcttttctagagacagaccacacaatgattttcctagttccctggtcctctagttgtcatg

SEQ ID NO: 100483 - DNA, 85 bp, Mus musculus; identical to SEQ ID NO: 57439

SEQ ID NO: 100484 - DNA, 136 bp, Mus musculus
tatatatatatatatatatatatatatatatatatatatgtgtgtgtgtgtatacatatatatatgtatatatacatatgcatatatgtatatatatatatatatatatattaccttacaagaacatattcatgca

SEQ ID NO: 100485 - DNA, 119 bp, Mus musculus
atatgttcttgtaaggtaatatatatatatatatatatatacatatatgcatatgtatatatacatatatatatgtatacacacacacacatatatatatatatatatatatatatata

SEQ ID NO: 100486 - DNA, 82 bp, Mus musculus
atgtatatatgtatatacatatatatggatatgtatatccatatatatatatatccatatatatgtgtgtatgtatatatat

SEQ ID NO: 100487 - DNA, 74 bp, Mus musculus
gaatgaaagggattcttctgatatattgtttcttgttcattataatttattgtaagacagagtccctaacattc

SEQ ID NO: 100488 - DNA, 93 bp, Mus musculus
ttaagtaaaaagtaaactgcatgagtgcgctagagtagctgtcaatattgactgaattgacagagcagtcattgaggtttctatttcatttga

SEQ ID NO: 100489 - DNA, 86 bp, Mus musculus
ctgtatttatatttttagaatcagtttataattaaaagaagagattttttttaattatcaaaggagtaggaatactgtgagtatag

SEQ ID NO: 100490 - DNA, 85 bp, Mus musculus; identical to SEQ ID NO: 57439

SEQ ID NO: 100491 - DNA, 85 bp, Mus musculus; identical to SEQ ID NO: 57439

SEQ ID NO: 100492 - DNA, 112 bp, Mus musculus; identical to SEQ ID NO: 75981

SEQ ID NO: 100493 - DNA, 85 bp, Mus musculus; identical to SEQ ID NO: 57439

SEQ ID NO: 100494 - DNA, 85 bp, Mus musculus; identical to SEQ ID NO: 57470

SEQ ID NO: 100495 - DNA, 106 bp, Mus musculus
agccttagtccatggtgatctgataggacgcatgggacaatttcaatatttttgtatatgttgaggcttgtgtgttaccaattatgtggtcaattttggagaagct

SEQ ID NO: 100496 - DNA, 112 bp, Mus musculus
aaattagatcccagctaagtttatcactatggcccattgagcaaagattctatatttaattttgtaccttgaaccattgaaaaaggtggtaagaatttagttgatttaattt

SEQ ID NO: 100497 - DNA, 85 bp, Mus musculus; identical to SEQ ID NO: 76427

SEQ ID NO: 100498 - DNA, 100 bp, Mus musculus
actgctatagaccatggggactttggaagtcagactaaatgtattttttattatcctatgtctaggtatggcccccacagactcatatggttgaacaagt

SEQ ID NO: 100499 - DNA, 85 bp, Mus musculus; identical to SEQ ID NO: 57439

SEQ ID NO: 100500 - DNA, 85 bp, Mus musculus; identical to SEQ ID NO: 57470

SEQ ID NO: 100501 - DNA, 71 bp, Mus musculus
ggaagcagaggcttggagccagggtctcctgacatgaagccaggggacactgcctccctccctgtctgtct

SEQ ID NO: 100502 - DNA, 100 bp, Mus musculus
cagttgtgttggatataggcttttatcataggatctgatgatgattattatttttttggatttcctcagattttattgttatgtctccctttcatttctg

SEQ ID NO: 100503 - DNA, 85 bp, Mus musculus; identical to SEQ ID NO: 57439

SEQ ID NO: 100504 - DNA, 65 bp, Mus musculus
gcagctgagactcagcacagtgagaggccatagaaggccatcagtgaagctgcagcctcagctgc

SEQ ID NO: 100505 - DNA, 68 bp, Mus musculus; identical to SEQ ID NO: 63726

SEQ ID NO: 100506 - DNA, 82 bp, Mus musculus
catgcaatttagatatgtactctgtataaacatgcatatatatatatatgcatacgtatatgcaagtttagatctgtgtatg

SEQ ID NO: 100507 - DNA, 113 bp, Mus musculus
aagatcagctttagttggtagtgatctgataggatgcactggataatttcaatatttttgtatctcttgaggcctgttttgtgaccaattctattgtcaattttgaaaaaggt

SEQ ID NO: 100508 - DNA, 85 bp, Mus musculus; identical to SEQ ID NO: 57439

SEQ ID NO: 100509 - DNA, 74 bp, Mus musculus
tatatatatatacacacatattatattatatacacacatatatatatatatgtgtgtgtgtgtgtgtatgtgtg

SEQ ID NO: 100510 - DNA, 109 bp, Mus musculus
gtaggatattatttcaattttcttgcaactgttgagactttcttcttgtctgaatatgtggtcagttttgaagaaggttcaaggtgctgagaagaaggtattttcttgc

SEQ ID NO: 100511 - DNA, 84 bp, Mus musculus
ggcaggctagtatgttgcttgtatagtacttgaatatcataaattattcatgagtttgaggcagagagggacacagagcctggc

SEQ ID NO: 100512 - DNA, 81 bp, Mus musculus
gttggagggagtatatcattgatggtgggatttgaagtttaaaagcttatgccaggctctgtgtccctctctgcctcaaac

SEQ ID NO: 100513 - DNA, 68 bp, Mus musculus
gtccaggtgcttcctctcccattgaagccagacaaggcagctcaggtagtagaatgtatcccttgggc

SEQ ID NO: 100514 - DNA, 99 bp, Mus musculus
gttctgtaggcttcttgtacctttatgttcatctctttcctcaggttggggacgttttcatctgtgattttgttgaacacattttcaggtcctgtgagc

SEQ ID NO: 100515 - DNA, 85 bp, Mus musculus
gtccatggtggtcagataggatacatgggacaatttcaatatttttgtatctgttgaggcctgttttgtgaccaattatatggtc

SEQ ID NO: 100516 - DNA, 85 bp, Mus musculus; identical to SEQ ID NO: 57470

SEQ ID NO: 100517 - DNA, 85 bp, Mus musculus; identical to SEQ ID NO: 57439

SEQ ID NO: 100518 - DNA, 87 bp, Mus musculus
ctatagcactttagccactacactgtttacctatatatgaattttacatttatgtttaatgtaaggagctggagtggttagctgtag

SEQ ID NO: 100519 - DNA, 98 bp, Mus musculus
ggtctgaagttctctatctttgttgggtcttactgtggtttagatatcagagtaattgtggcttcataaaacgagttgggtagagtacattatgcttc

SEQ ID NO: 100520 - DNA, 116 bp, Mus musculus
caaccataacatatatgcagaggacctagatcagacccatacaggctccctgattgccactttagtctcagtgagcccctatgagtccaggttagttggttgattaggtaggctgt

SEQ ID NO: 100521 - DNA, 85 bp, Mus musculus; identical to SEQ ID NO: 57470

SEQ ID NO: 100522 - DNA, 63 bp, Mus musculus
atgggtaccaagagcaggcaaaagagtaagagacactcctactctcactgtcatgtgtcccat

SEQ ID NO: 100523 - DNA, 113 bp, Mus musculus
acatagcttaaaataaccttgctcagaaaacagttgtcctttcagactagtgatattcttgctgtgttgtcaaagggactgttcaaaaggtaaaaggtcagccaagttgttgt

SEQ ID NO: 100524 - DNA, 85 bp, Mus musculus; identical to SEQ ID NO: 57470

SEQ ID NO: 100525 - DNA, 85 bp, Mus musculus; identical to SEQ ID NO: 57470

SEQ ID NO: 100526 - DNA, 92 bp, Mus musculus
tgtctatgtctatgtctatatctatctctctacatatatatatatatatatatatacatagagagagagagaatgagagagagagagagaga

SEQ ID NO: 100527 - DNA, 113 bp, Mus musculus
gatgggagaattttaattactgcttctctttccttaggggtaatagaactatttaaatatattgtgtggtcttgatttaactttgataagtggcatgtatttaggaaatcatc

SEQ ID NO: 100528 - DNA, 123 bp, Mus musculus
ggtatatttggaatattacactcaaatattccatgtatttgaaatcaaacttctatgtttatatatcaaattaggatagaagttaaaattagatgaggaattgtgtttaagtttgccatgata

SEQ ID NO: 100529 - DNA, 106 bp, Mus musculus
ttgggacataaacaatgtgcaacctttaagtgtgagttcatgtatgtatgtatgtatgtatgcatgcatgcatgtatgtccaccatttgcataccggtacctgatg

SEQ ID NO: 100530 - DNA, 60 bp, Mus musculus
tgtatatgtatatgtatatgtatgtatgtatatatgtatgcatgtatgtatgtatgtata

SEQ ID NO: 100531 - DNA, 103 bp, Mus musculus
tgaaggttgttttgtctatggaaaccagtttattagaggtagaatgatatatttattttgctaatgtacaaactttcataatcacagaaacatgataccatca

SEQ ID NO: 100532 - DNA, 106 bp, Mus musculus
atatgtcagatcatggacctaaattacttctctagttgaaggatgtattcttgatatcaaaattgttacaactggcagcacaaatttctgtcaggatggatcatgt

SEQ ID NO: 100533 - DNA, 85 bp, Mus musculus; identical to SEQ ID NO: 58174

SEQ ID NO: 100534 - DNA, 96 bp, Mus musculus
gatatgatatatgctatatatgacttatatgtgatatatggtaagtgataacatatttatatattatacagacatatatatgcatatttatctatc

SEQ ID NO: 100535 - DNA, 97 bp, Mus musculus
acaagtgtcaattacttatgagtacttaggtagtggtaggaggtagttatgtggtcctctcatttccatagtagaatagtgatgtgtccatatttgt

SEQ ID NO: 100536 - DNA, 85 bp, Mus musculus
gtccatggtggtctgataggatgcatgggacaatttcaatatttttgtatctgttgaggcctcttttgtgaccaattatatggtc

SEQ ID NO: 100537 - DNA, 122 bp, Mus musculus
tgaagattttcattggatgtgttgttatgcatctgtgtacctggcaggacaaaaagcttgtttacataagcatagtcacatagtagcatattattttataactttactatatccaagaaatc

SEQ ID NO: 100538 - DNA, 90 bp, Mus musculus
cttagtccatggtgatctgataggatgcatggaaaaatttcaatatttttgtatctgttgaggcctgtttattggtcaattatggagaag

SEQ ID NO: 100539 - DNA, 85 bp, Mus musculus
gagagactagtgattatgttttaatccctaaatgtagtgcatatacaattgggctataagtaaggatgacaatcttagttctctt

SEQ ID NO: 100540 - DNA, 99 bp, Mus musculus
cagtgaattccaagttttccaagtgtcacttgactttcttccttgtttactttaggattttggtctgttgtgtcaaaattggggagactcaaatcattg

SEQ ID NO: 100541 - DNA, 85 bp, Mus musculus
ccttactgtaactgtgtactatgctaagttgtttatatatgtatcttacttagtaattactaaagtacataagttatgtcctagg

SEQ ID NO: 100542 - DNA, 71 bp, Mus musculus
tgtttgtctgtgggtctctgaatctgtttctgtcagttgctgagtggagcctttcagagtatagttatgca

SEQ ID NO: 100543 - DNA, 105 bp, Mus musculus
tttaagttagtgagtctttgtggaaagttactgtgatagactgaattgccttcatgaagatggtagaattgtttatttcagtgactgaataagaagctacgtgaa

SEQ ID NO: 100544 - DNA, 152 bp, Mus musculus
tatatagaacaattatatatatatgtgtgtgtgtgtgtgtgtgtcatatactatatatgtatttatatcatacactatatatgtatatatataccatgtgctatatatgtgttaatatatatacaaatacatatatgtatgcttatatacac

SEQ ID NO: 100545 - DNA, 77 bp, Mus musculus
agtatttttgtgatagactctcactttctatgtagagcatgctggcctagtacttgtgagtttctatcccaagtact

SEQ ID NO: 100546 - DNA, 84 bp, Mus musculus
cttctggtctggatggtggccggctgtctgaggcccgcaaagggtgctgcctcagtggctctgtgcctccacctgtcctagaag

SEQ ID NO: 100547 - DNA, 70 bp, Mus musculus
aacaacaacctggtcagtccctgtaatgctatttgtatgtatacattttcagggctgaccgtttgttgtt

SEQ ID NO: 100548 - DNA, 85 bp, Mus musculus; identical to SEQ ID NO: 57470

SEQ ID NO: 100549 - DNA, 85 bp, Mus musculus; identical to SEQ ID NO: 57439

SEQ ID NO: 100550 - DNA, 101 bp, Mus musculus
agcaaaacttgatttatgtaaatgtatatacatatatatattgcatatatatatatgtgtgtgtacatatactgcacacatgaatgtaaatatattttgct

SEQ ID NO: 100551 - DNA, 100 bp, Mus musculus
cctgagatttattctaccttgacaagtttctggaagatgtctgtgtctaacactctgaaactacatcacttagaaaatacaagaataggatatttccagg

SEQ ID NO: 100552 - DNA, 113 bp, Mus musculus; identical to SEQ ID NO: 100424

SEQ ID NO: 100553 - DNA, 85 bp, Mus musculus; identical to SEQ ID NO: 57439

SEQ ID NO: 100554 - DNA, 96 bp, Mus musculus
gatcagccttagtccatgatgacctgataggatgcatgggataatttcaatatttttgtatctgttaaggcctgttttgtgactgattatatggtc

SEQ ID NO: 100555 - DNA, 85 bp, Mus musculus; identical to SEQ ID NO: 57439

SEQ ID NO: 100556 - DNA, 74 bp, Mus musculus
ggttgtgagctgtcttgtgtgggtgccaggaaccacattttggtcctctagaagagcagcaagtgctcttaacc

SEQ ID NO: 100557 - DNA, 114 bp, Mus musculus
tcagactgggagtaatctgtgacagtggtcgtgtggagttcctgggtgcctgagtcccactggtcccagttacttctggcattgtggcagatgttgtgtcctcctcacctctga

SEQ ID NO: 100558 - DNA, 64 bp, Mus musculus
ctatatctatatctatatatgtgtgtgtgtgtatacatatatacacatatatatgtatatatag

SEQ ID NO: 100559 - DNA, 65 bp, Mus musculus
agctctgatctctctctctctctccaggctcagaaaagtttggagtaagggctaggacccaggtt

SEQ ID NO: 100560 - DNA, 81 bp, Mus musculus
acaaagagacttagtagagttcttaaggtaaaagtcactatgttcagggcattgcctatctctgtctatctgtctgtctgt

SEQ ID NO: 100561 - DNA, 57 bp, Mus musculus
gagagacagacagacagacagcgcctagcatgggtgcatgggtgtttatcttctccc

SEQ ID NO: 100562 - DNA, 57 bp, Mus musculus
gggagaagataaacacccatgcacccatgctaggcgctgtctgtctgtctgtctctc

SEQ ID NO: 100563 - DNA, 97 bp, Mus musculus
ggtcatgtaactctgatgaaagtggtaagctattgagatctatttgtcagactcaggctctctctctaccccaggctggcctcagactctaccctcc

SEQ ID NO: 100564 - DNA, 65 bp, Mus musculus
gtatgtgcctgacatatgtatgtatgtatgtatgtatgtatgtatgtatgtatgtatgtatgtat

SEQ ID NO: 100565 - DNA, 115 bp, Mus musculus
gctagctgtctcatgagcttccggccagttctcccatctctctcactgtatgagtgctgggcttataagtgactttttaagtgggggcattctggaaatcatgaactcaggtggt

SEQ ID NO: 100566 - DNA, 74 bp, Mus musculus
gggacttagctttattgactaagatagcattaagtggccagctgtgtgtgtgtctgtgtcagataaatagtccc

SEQ ID NO: 100567 - DNA, 85 bp, Mus musculus; identical to SEQ ID NO: 100408

SEQ ID NO: 100568 - DNA, 128 bp, Mus musculus
aatgtatgtgcttatattgtgtgtagaggtgagaggacaagctcgggtgtaggtcccttgtttgagacagtctctctgtttttctgctgcatgcactgggtaagcaggaatggatttttttctgtctc

SEQ ID NO: 100569 - DNA, 79 bp, Mus musculus
ggagtcaggagtctccctcagtctatctctatgtcatttagtggggcagggtctctcaggtgactctagagctcactga

SEQ ID NO: 100570 - DNA, 108 bp, Mus musculus
aggtgctatgacttgttaatatcttgttgacgtgagtgaagagtgtgagagtgtgtttctagaaactatggttttaccgcacaacagggagcaattcctaaagtattt

SEQ ID NO: 100571 - DNA, 63 bp, Mus musculus
ggtcaccaatagcttgtcttgaatctttgcatctttaaagaagaaactgagctcttggtggcc

SEQ ID NO: 100572 - DNA, 66 bp, Mus musculus
ggcaggcttgatatgaacaaggctggcctcaaatttccttgctgtccgtctgtctctgtctctgcc

SEQ ID NO: 100573 - DNA, 111 bp, Mus musculus
tcagggaaataggaaaaactagagaacctaagtgtattttgacaagtgtttttgaagagtttgaaagcaacctaaagataaactgtctctgacttagccttttaaatatga

SEQ ID NO: 100574 - DNA, 111 bp, Mus musculus
ttctggctttcctcaatagttccttcatgtcttccataataaaaatcactgacaagcatgatcagtttttctttatctgagtcagtggtagctttgcttacagcctttgaa

SEQ ID NO: 100575 - DNA, 101 bp, Mus musculus
gttttattagggctaggctaaattataagaactctatttgttaatgttagtgccatggcataggaaggagaggaaatatgaagcatttagtccctggaaac

SEQ ID NO: 100576 - DNA, 80 bp, Mus musculus
ggtctcactctgtgtgtgtatgaggggtatattatctggatgtaagtctatattgttcccatctgctgcaggaagaagcc

SEQ ID NO: 100577 - DNA, 73 bp, Mus musculus
agccctgacagaacagtgtatgcacctgctctacaaaccagtagctccgagggcatttatctgttgtgctgct

SEQ ID NO: 100578 - DNA, 96 bp, Mus musculus
ttggagccaacttgctatctttatttctgtatttcatgttctgttggcattttggaagaggtggagtgagaggatagctaagtagtgaagctctag

SEQ ID NO: 100579 - DNA, 115 bp, Mus musculus
tgagctagagataggatatgcccaactctcaggagaacagcttcttaaaagcagagtagagagagtgcagtcaggagttgagttaattgagagtcagcacaggcagttcagctga

SEQ ID NO: 100580 - DNA, 82 bp, Mus musculus
tgtcctggaatgggagttacaggtgggtgtcagctaactgatgcaggtgctgggagctgaactctgactctctgtgagagca

SEQ ID NO: 100581 - DNA, 70 bp, Mus musculus
tagaaaataaactatatatatatatgtgtgtgtgtgtgtatatatgtatgtatgtatgtttagggaacta

SEQ ID NO: 100582 - DNA, 86 bp, Mus musculus
tttattctgtgacgttgtatgttgtattagttactttttggttgctatgataaaacagcataatcaaaagcaacttacagaaggaa

SEQ ID NO: 100583 - DNA, 102 bp, Mus musculus
tagcagcatcagagttctgtggtctgttacttttatttttaaatcgagatggcgagatggcgtttcagtctatagtccaggttggccttgaacttgttgcta

SEQ ID NO: 100584 - DNA, 61 bp, Mus musculus
ctctcagtcgtggaggtctcgctggctagttcgtatttcctggagactctctgactcagag

SEQ ID NO: 100585 - DNA, 98 bp, Mus musculus
cattaaggtatgtgaggagaagagaattttgttgataaaacccaagaagtatattttctttttaaacagcattgctcatttgtttacattatatgatg

SEQ ID NO: 100586 - DNA, 117 bp, Mus musculus
tatatatgcacaacactaaatagatacagtaggttgcgtgtatgtgtgcatgtgcttgtgcttgcattcatgtgtacatgtgcatgtgtgcatgtgtgtgtgcgtgtgtgtaatata

SEQ ID NO: 100587 - DNA, 90 bp, Mus musculus
ccctcttttggacagttgagtttctttctttatacattttgtaaagttccccagtgaaaccacctgaaaatatagtcttctttagggggg

SEQ ID NO: 100588 - DNA, 115 bp, Mus musculus
tgggcacgtatgacacaattggttgggaactggggagatggctcagaggttaagagcactgactgctcttccagaagttctgagttcaattcctagaaaccacatggtggctcac

SEQ ID NO: 100589 - DNA, 120 bp, Mus musculus
gcagaattgttccctagatccacctgaatgtgggctgatttatttatttatttatttatttatttatttatttataaaagaagggatatagggagggtctgggagatttttaactactgc

SEQ ID NO: 100590 - DNA, 69 bp, Mus musculus
ttgggttcataaaaaaaatctatatgtatttgtttctatcacaaatacctgtagattcacggaacctaa

SEQ ID NO: 100591 - DNA, 73 bp, Mus musculus
ggtttttgcaggagtgtgtgaggagacagagccctgggtgggctctgggcacaggtacaatctggaaggaacc

SEQ ID NO: 100592 - DNA, 85 bp, Mus musculus; identical to SEQ ID NO: 57439

SEQ ID NO: 100593 - DNA, 100 bp, Mus musculus
agcctctcacagtctcattctaaccaaagaattagcaatgtaattgagtttcaatatttaatatttttgttaatatggtggggaattgggcatgctggct

SEQ ID NO: 100594 - DNA, 82 bp, Mus musculus
ctccctcccctttgtagagtattttagtgaatgtcgtggctcagaggttaagagcactgactgctcttccagaggtcctgag

SEQ ID NO: 100595 - DNA, 85 bp, Mus musculus; identical to SEQ ID NO: 57439

SEQ ID NO: 100596 - DNA, 85 bp, Mus musculus; identical to SEQ ID NO: 57439

SEQ ID NO: 100597 - DNA, 85 bp, Mus musculus; identical to SEQ ID NO: 57439

SEQ ID NO: 100598 - DNA, 85 bp, Mus musculus
gtccatggtggtctgataggatgcatgggacaatttcaatatttttgtatctgttgacgcctgttttgtgaccaattatatggtc

SEQ ID NO: 100599 - DNA, 85 bp, Mus musculus; identical to SEQ ID NO: 57439

SEQ ID NO: 100600 - DNA, 80 bp, Mus musculus
gaacatcagccttagtccatggtgctctgataggatggatgggacaatttcaatatttttgtatctgctgaggcctgttt

SEQ ID NO: 100601 - DNA, 115 bp, Mus musculus
catatatatatatatatatatatatatatatatatgtgtgtgtgtgtgtgtgtgtgtgtgtgtgtgtgtatacatatatatgtgtgtatatatatgtatacatacatatatatgc

SEQ ID NO: 100602 - DNA, 89 bp, Mus musculus
acacacacacacacacacacacacacacaggttagggagggaagctaagaactactctaatttttgttgttgttttgatacctgtgtgt

SEQ ID NO: 100603 - DNA, 85 bp, Mus musculus; identical to SEQ ID NO: 57439

SEQ ID NO: 100604 - DNA, 90 bp, Mus musculus
tccacatacctttctccttgtctgtctgctaaggtggttggtacacgtacttaagcttttgtccagcgcaaagggggaaaaaagtgtggg

SEQ ID NO: 100605 - DNA, 103 bp, Mus musculus
gaaagggagaacaaagggactcggcttctactacttcacaggcatgcagcatctgagcaataaggaatgtaaagatcattgtgtccgcccactctccctcatc

SEQ ID NO: 100606 - DNA, 76 bp, Mus musculus
tctatctatctatctatctatctgcatggtactggtatagagacagaccagtagaccaatggaatagaattgaaga

SEQ ID NO: 100607 - DNA, 83 bp, Mus musculus
gtattgatcaaagtcattttggaatttttctagtacacctcacctgtctcgggagtgtctagaaacctatagcttcgcattac

SEQ ID NO: 100608 - DNA, 70 bp, Mus musculus
ggatgaatatatatatgcatatatacatacatatatacgtatatatgtgtatgtgtatatatatattacc

SEQ ID NO: 100609 - DNA, 85 bp, Mus musculus; identical to SEQ ID NO: 57439

SEQ ID NO: 100610 - DNA, 119 bp, Mus musculus
tttgtttatctgtaagtttcttgtgtgtgtgtgtgtgtgtgtgtatatatatatatatatatatatatatatatatatatatatatatatgcatatatttctttaggttggggaaattt

SEQ ID NO: 100611 - DNA, 85 bp, Mus musculus; identical to SEQ ID NO: 57470

SEQ ID NO: 100612 - DNA, 83 bp, Mus musculus
gagtcaggttctgatttgggttaggatttggattctgactcagattctgacctggactctggctctggctctgaccctgactc

SEQ ID NO: 100613 - DNA, 93 bp, Mus musculus
tgctcctctctggacatgcctccattcactcaagtaccgtgacactgggtctctcaggatggtaatgtaatggaagttcctatggataaagca

SEQ ID NO: 100614 - DNA, 85 bp, Mus musculus; identical to SEQ ID NO: 57439

SEQ ID NO: 100615 - DNA, 114 bp, Mus musculus
tgcttgaactatttctattttattttggccaaataattgtgcagacagtatttgtgactggttttgatgcaggtatattccaagagtacaataggctgtggtagttcattagca

SEQ ID NO: 100616 - DNA, 81 bp, Mus musculus
cttatgagtgcttggcctgcttggatgcatgtgtaccatgtgtgcacagtgaccacagaggccacaaaacggtgctagaag

SEQ ID NO: 100617 - DNA, 119 bp, Mus musculus
tcattctttgtggatgaatgaaacacacacacacacactatatatatatatatatatatatatatatatatatatatatagtcttagtcagggtttctattcctgcacaaacatcatga

SEQ ID NO: 100618 - DNA, 104 bp, Mus musculus
tttttaaaattttatttgatatttatgcatggttttcctatatatgtatatatatgtgccatatatatgcctagtgcctgcatctgatcacttagaaatgaaga

SEQ ID NO: 100619 - DNA, 85 bp, Mus musculus
ggcatgcacagtgaaaccccataccaaaaccaaaatcaaaccccaacaacaacaaaatgtgtgtgtgtgtgtcactgcaaatgcc

SEQ ID NO: 100620 - DNA, 94 bp, Mus musculus
ctacaatgattcccgagccttaggtgcaagagttgtgttatagatgtaccagtctggactgggctccacaactctgtattttgattggttgtgg

SEQ ID NO: 100621 - DNA, 82 bp, Mus musculus
gggtacaccaaacagggctggagagatggctcagcggttaagagcactgactgctcttccagaggtcccgagtttgaatccc

SEQ ID NO: 100622 - DNA, 122 bp, Mus musculus
gatgagtcctctaatagtttcataaagtggcatggagagaggagtcggcccctgagcctgcctgcctgtatgcctctctgcttgcttaacttgcctctctcgacttcttccctccctccctc

SEQ ID NO: 100623 - DNA, 138 bp, Mus musculus
atacatatatatatgtgtgtatgtatacatcttccataaacacatgtatgtatatatatatatgtgtgtatgtatatatctttcataaacacacacacatatatatgtatatacatacatatgtgtatatagaaattg

SEQ ID NO: 100624 - DNA, 87 bp, Mus musculus
catgggaggaaaggtagcctattgttctctttctcactaagtctcagagagaacaggaactaagtggctgttggaatcttcagcgtg

SEQ ID NO: 100625 - DNA, 69 bp, Mus musculus
gtactggagtattgtatgtatatatgtatatatgcctgtatgtatgtatgtatgtatgtatgtatgtat

SEQ ID NO: 100626 - DNA, 118 bp, Mus musculus
gcatgacaacttattatactactcattatatctatcttaagacagagcattttatatctattttttggcaatggctttgaagataggagcctataatgaaagaagtttaagcagtgat

SEQ ID NO: 100627 - DNA, 92 bp, Mus musculus
tttaggggacttaaggaagtgctgaggtagtaggctgaaatgtacaagcatgaagaatttgcttggcacattcatagaacagttcatatgaa

SEQ ID NO: 100628 - DNA, 63 bp, Mus musculus
ttggagatctcagactgttgtgagccaccacttgggtgctggcaattgaacctgggtcttcag

SEQ ID NO: 100629 - DNA, 117 bp, Mus musculus
ggttgtatttcctagcaaagaaaggtagagtgtgtgtgtagggccagccatccctccccaggctgaggtagaagcatgcattaagcctggatgttcaggaccagccagagagacaca

SEQ ID NO: 100630 - DNA, 89 bp, Mus musculus
gcccattcatccacaggtggggattggtggcattacttgtgttagatataaagtattgcacttgtcccggcctgaggaagaaagagggt

SEQ ID NO: 100631 - DNA, 116 bp, Mus musculus
gcgcaaggacattgctacttacgattagttttgcagatttgcagttcagcgtatatgtgaatatatggctgtgcaaatccatgcaaaactgattgtgggaatgtgtacctttctgc

SEQ ID NO: 100632 - DNA, 109 bp, Mus musculus
agaacaagctcggatcctagtagtgccaaagtgctcatagtgcaggtagtttttataccactctactgcagtgtgagcacttctagtactcctggatcaaccaaggtct

SEQ ID NO: 100633 - DNA, 94 bp, Mus musculus
gagtatgccttggccatgtcaaagtgctaacagtgcaggtagctttttgagttctactgcagtgccagcacttcttacattaccatggtgattt

SEQ ID NO: 100634 - DNA, 117 bp, Mus musculus
gttaattttaaggcttgtcatggtggcacagacctttaatcccagaactcaggaggcagaggaagatggatctctaggtgtttgaggccagcctggtctacatagccaattagttac

SEQ ID NO: 100635 - DNA, 101 bp, Mus musculus
agaggctggcattacaggcagttgtgggccactctatgtagactctagtcctctgctagaacagactgtgcttaagcctgagacgtctctccaatccctct

SEQ ID NO: 100636 - DNA, 118 bp, Mus musculus
gcgcatatatatatatatatatatgtgtgtgtgtgtgtgtgtgtgtgtgtgtgtgtgtatacatgcatatacatatatgtgtatatgtatgtatatatctatatgtacatatatatgt

SEQ ID NO: 100637 - DNA, 91 bp, Mus musculus
tggcacctccgtttccctgaggagccctttgagcctggagtgaaaaaaaaaaacaggtcaagaggcgcctgggaactggagaagagtgtta

SEQ ID NO: 100638 - DNA, 120 bp, Mus musculus
gcggcccccaccctcgttgactccgaagggctgcagcagcaattcatgttttggagtattgccaaggttcaaaacatgaagcgctgcaacaccccttcgtggggaatgtagaaggtgggg

SEQ ID NO: 100639 - DNA, 77 bp, Mus musculus
agtgtctgcaggagaatgaggctaagcagttcatccaggaaatggatttaggctctctgtctctttctcaaaggcct

SEQ ID NO: 100640 - DNA, 94 bp, Mus musculus
gggcagggtctctctatgtagtcctggctgtcctgggacttgctttgtagaccaggcttgtctcagactcacagagaaacatctgattttgcct

SEQ ID NO: 100641 - DNA, 110 bp, Mus musculus
ttgaagatcagccgtagtccatggtggtctgataggatgcatgggacaatttcaatatttttgtatctgttggggcctgttttgtgaccaactatatggtcaattttgga

SEQ ID NO: 100642 - DNA, 98 bp, Mus musculus
cgatattcttaaggaaaattggtctgaagttctctatctttgttggatttttctatggtttagatatcagagtaattgtggcttcatagaatgagttg

SEQ ID NO: 100643 - DNA, 111 bp, Mus musculus
ggttcctctccatttccatccctgtaattctttcagacaggaacaattatgggtcagagatgtgactgtggaatggcaaccccatccctcacttgatgccctgtcttcctg

SEQ ID NO: 100644 - DNA, 97 bp, Mus musculus
tgcacttacacaaatgcgggcatgcacacacatacaccaagagctgaataatcacaataggtgtgtctgtgtgtgcctgtgtatgtctatgagtgta

SEQ ID NO: 100645 - DNA, 75 bp, Mus musculus
tatttttgagatgtggtcttatgtagcccagtgtggcctcaaactcactgtgtgagtgagactgactttaaagtg

SEQ ID NO: 100646 - DNA, 76 bp, Mus musculus
tggccacagttgcctgcctctcactgtctgtgtgagaaggactagctctcatgttgagaggctgtttttgtagtca

SEQ ID NO: 100647 - DNA, 91 bp, Mus musculus
tacatgcatatatgcatacatatgcatatgtgagtatatgtgcatatatatgtacacatgtgtatatgttcatatgtatatatgtatagta

SEQ ID NO: 100648 - DNA, 89 bp, Mus musculus
taaagcttgtctcagtgtgtgttggagcttgctatgtatttatgtatgtatgtgtaaaatgcttggaacctacttgctgaagctttgct

SEQ ID NO: 100649 - DNA, 68 bp, Mus musculus
gtggtaattaagactacagatattgttgtttcagagtctgtttgatatctgtgtctgtcaattactac

SEQ ID NO: 100650 - DNA, 65 bp, Mus musculus
gtggctggctgagatgagagatttaaactctagactctcattctgaatgcactatatgccaccac

SEQ ID NO: 100651 - DNA, 98 bp, Mus musculus
tctggctctggctcttttctgctctgtccctgcctgcctctcttggtctgccttctcacaggctcctaggcacaagcagatggtgtccttgtaaagga

SEQ ID NO: 100652 - DNA, 76 bp, Mus musculus; identical to SEQ ID NO: 100646

SEQ ID NO: 100653 - DNA, 77 bp, Mus musculus
ttacttttacacactgtcacagtctgtgggatgctgttccaagaagtccagggcctgtcacacagtgtgatcagtga

SEQ ID NO: 100654 - DNA, 64 bp, Mus musculus
tgggagaaatgagtgtgaggtctgaggccccttcctcttagacctcacactacagggaagccca

SEQ ID NO: 100655 - DNA, 85 bp, Mus musculus
aagccctcgtggattgaacgcagtcacagtaagacttgtatatcctggatgctctctctgtttctgagttccttcactgtggctt

SEQ ID NO: 100656 - DNA, 113 bp, Mus musculus
gtgtacacactttggtcttctttgttcttgagtatcatgtgttttgtaaattgtatcttgtatctttggtattctacgtttctgggctaatatccacttatcagtgagtacat

SEQ ID NO: 100657 - DNA, 85 bp, Mus musculus; identical to SEQ ID NO: 57439

SEQ ID NO: 100658 - DNA, 67 bp, Mus musculus
atgcatttttatatatgatataatatgcatttatatatgcatatatgtactttatgtatatatgcat

SEQ ID NO: 100659 - DNA, 94 bp, Mus musculus
taatccatgccacacatagaagacagacagctgtgtcagggtagccatcaagacattctatcctcagacagcttagcttcagttgcatgtctta

SEQ ID NO: 100660 - DNA, 110 bp, Mus musculus
atgtggcaaccctgttcattgcatgagactagtcattgagttccatcaggggtgtggaatgtagtgaagtgagttcagtaaaggaagaggcaattaagaggataaagcat

SEQ ID NO: 100661 - DNA, 72 bp, Mus musculus
catgttctcatatgtgaacaaatgtgtgtgcatcaatgaatgtgcatgtgcatgtttgtgtgtgtgttcctg

SEQ ID NO: 100662 - DNA, 115 bp, Mus musculus
tatatacaagaaaaattaaaaagactcagcagaatatatacatgtgtttatgtatatgtatgtatagggtatgcttgtatatacaatacatacaataactaaataaaaagatgct

SEQ ID NO: 100663 - DNA, 96 bp, Mus musculus
gatcagccttagtccatggtgatctgataggatgcatgggacaatttcaatatttttgtatctgttgaagcctgttttgtgacccactatatggtc

SEQ ID NO: 100664 - DNA, 80 bp, Mus musculus; identical to SEQ ID NO: 62887

SEQ ID NO: 100665 - DNA, 81 bp, Mus musculus
gtgctgagagtggagatagaggtcaaatccccagtgtgcaaaagaggggcattacaaagaaccttctcccaggctcgtcac

SEQ ID NO: 100666 - DNA, 86 bp, Mus musculus
gaaggaaaagagcccaaaatcgggcacatgttccaaggtctctctcactctacataatgtctgactgtgggtctctgtgttaattc

SEQ ID NO: 100667 - DNA, 81 bp, Mus musculus; identical to SEQ ID NO: 100174

SEQ ID NO: 100668 - DNA, 85 bp, Mus musculus; identical to SEQ ID NO: 57439

SEQ ID NO: 100669 - DNA, 81 bp, Mus musculus; identical to SEQ ID NO: 100174

SEQ ID NO: 100670 - DNA, 85 bp, Mus musculus; identical to SEQ ID NO: 57439

SEQ ID NO: 100671 - DNA, 81 bp, Mus musculus; identical to SEQ ID NO: 100171

SEQ ID NO: 100672 - DNA, 113 bp, Mus musculus
tgtcattaaaaacatgggctatgggctggagagacggctcagcagttaagagcactgactgctcttccagaggtcctgagttcaattcccagcaatgaccatctgtaatgaga

SEQ ID NO: 100673 - DNA, 81 bp, Mus musculus; identical to SEQ ID NO: 100174

SEQ ID NO: 100674 - DNA, 82 bp, Mus musculus
aagctcagtcagtctctcatagataagagagcagaacgtggcagcttactttcacttctgctcggggagcaggcttctgttt

SEQ ID NO: 100675 - DNA, 85 bp, Mus musculus; identical to SEQ ID NO: 57439

SEQ ID NO: 100676 - DNA, 81 bp, Mus musculus; identical to SEQ ID NO: 100171

SEQ ID NO: 100677 - DNA, 105 bp, Mus musculus; identical to SEQ ID NO: 100170

SEQ ID NO: 100678 - DNA, 85 bp, Mus musculus; identical to SEQ ID NO: 57439

SEQ ID NO: 100679 - DNA, 105 bp, Mus musculus; identical to SEQ ID NO: 100170

SEQ ID NO: 100680 - DNA, 81 bp, Mus musculus; identical to SEQ ID NO: 100171

SEQ ID NO: 100681 - DNA, 85 bp, Mus musculus; identical to SEQ ID NO: 57470

SEQ ID NO: 100682 - DNA, 74 bp, Mus musculus
acagatttgtcagatattctgggcccagatgacaccacctttctgtctatctgtcagtcagtctgcctgtctgt

SEQ ID NO: 100683 - DNA, 86 bp, Mus musculus
ggagccccaaagaccccttggaggtatgtctctgtgagtcttacatgttgtttgagtgcatcgccactgggtttgtgtctggtttc

SEQ ID NO: 100684 - DNA, 116 bp, Mus musculus
atggaaaattaataatggaaattaataaatggaaaatctgaaatgtcattttgatgttcctttctcatcaagatattgtcaagtgttttatttattcttgccagaaggataaacat

SEQ ID NO: 100685 - DNA, 85 bp, Mus musculus; identical to SEQ ID NO: 57470

SEQ ID NO: 100686 - DNA, 85 bp, Mus musculus; identical to SEQ ID NO: 57439

SEQ ID NO: 100687 - DNA, 67 bp, Mus musculus; identical to SEQ ID NO: 100658

SEQ ID NO: 100688 - DNA, 85 bp, Mus musculus; identical to SEQ ID NO: 57470

SEQ ID NO: 100689 - DNA, 90 bp, Mus musculus
tattcataaggcaaattggtctgaagttctctatctttgttggatctttctgtggtttagatatcagagtaattgtggcttcatagaatg

SEQ ID NO: 100690 - DNA, 73 bp, Mus musculus
cacattatgtgcgtgtgagtgtgtgtgtgtgcaggtgcatgtgtatacacgggtgcacaggcatatgcatgtg

SEQ ID NO: 100691 - DNA, 89 bp, Mus musculus
gggtgtgaatggaatctgctttgattctcttgctgctttgagcatcatgctggcagcatgatgatttatctttttctctatgaatgcct

SEQ ID NO: 100692 - DNA, 67 bp, Mus musculus
gctgtctttcactgtcacacttaaactggcatacttgggctggtgagatggctcagtgggtaagagc

SEQ ID NO: 100693 - DNA, 69 bp, Mus musculus
gctttagtgtgtgtgtgtatgtatgtatgtatgtatgtacgtacgtatgtatgtacatgtttttcttgc

SEQ ID NO: 100694 - DNA, 63 bp, Mus musculus
ggctggaggctggaagcccagtgctgtgaaactattgcactgtctgtgtcactgcctaaagcc

SEQ ID NO: 100695 - DNA, 88 bp, Mus musculus
ccacgggaaacgcttgcctctcaccctgtttcccagcgccaacctccggggcaggcatccgggtggagagaggacttgtccctcgtgg

SEQ ID NO: 100696 - DNA, 68 bp, Mus musculus
gtatgtgtgtacatgtatgtgtgtatatacatatatgtgtatatacatatatgtatttatatacatac

SEQ ID NO: 100697 - DNA, 75 bp, Mus musculus
gccccgctgtctccagggtatctaggatacaatttgaatgacactgtgtctgtgatatacatggttcctctgggc

SEQ ID NO: 100698 - DNA, 94 bp, Mus musculus
gactttaaaaccatgaacagtggtgagatttctctcagtgacagcttagtcccatgaccttgatacctcactagcacactcagtcaagagagtc

SEQ ID NO: 100699 - DNA, 70 bp, Mus musculus
acacacacacacacacacacatacacacacatatgcacacgtgtgtgtgtgtgtgtgtgtgtgtgtgtgt

SEQ ID NO: 100700 - DNA, 93 bp, Mus musculus
tagaccgaaagtctcagttccagatcacttttgacaagtttattgaaaactgcctcagttagatgtgagtgaggactcatgactctgggttta

SEQ ID NO: 100701 - DNA, 111 bp, Mus musculus
ccagtttcagtggttgaattattaccccattcagcattatttatcaatatctgtcaaaagacagggaggtcagggtcatagaaagggtcagagtcacaacctctgatctgg

SEQ ID NO: 100702 - DNA, 114 bp, Mus musculus
gagactaaattaactgtctgcctgagctgccttactggttcttccttgctttgaatagttaaatttaagtcccacatactagcacttggttaaatagttcacatatttaggctc

SEQ ID NO: 100703 - DNA, 74 bp, Mus musculus
acacacggacggacacacacacacacattgatgcagtcggcctcagtttgaggtgtgtgtgtgtgtgtgtgtgt

SEQ ID NO: 100704 - DNA, 107 bp, Mus musculus
agtgctaggaatataggtatgtgccacttcactggctctgtgtgtcttttaagaaatgtttgtttagagctaagtgtggtgtcatatacctctgaattctagttact

SEQ ID NO: 100705 - DNA, 110 bp, Mus musculus
ttgaagatcagccttagtccatggtggtatgataggatacatgggacaatttcaatatttttgtatctgttaaggcctgttttatgaccaattatatggtcaattttgga

SEQ ID NO: 100706 - DNA, 84 bp, Mus musculus
cttgaagggcagtggcagtctctctgtgagttcaaggccagcttggtctacatagagagatccaggatagccatggctacagag

SEQ ID NO: 100707 - DNA, 93 bp, Mus musculus
aatacagtgcctacctgttgaagtggagtaaattatgtagagattgtgatgtagtcttttatgtaagggttacttggacagaaacactgtgtt

SEQ ID NO: 100708 - DNA, 105 bp, Mus musculus
catctatggtaattgagagtttggctgggtatagtagcctgggctggaatttgtgttctctcagtgtctgtataacatctgtccaggctttcatagtctatggtg

SEQ ID NO: 100709 - DNA, 80 bp, Mus musculus
cttcagacatcatgtgtcctcctacaagtcttgcctcagcaaaacaccatgtgagggggcctcactctgtgagtctgtag

SEQ ID NO: 100710 - DNA, 99 bp, Mus musculus
gttttgaatcagtgggactccctctttgttctctgtagattctgaacaccgaaaggtaaaagagtagaaacaaggattggggctcttaagaagagaaac

SEQ ID NO: 100711 - DNA, 108 bp, Mus musculus
tattggcaggcagtggttgctgtgggagggaagaaccttttcttcagtagtgtatttgaagatgagtttatccttgctccggcaaataacccttcacccatgcttatg

SEQ ID NO: 100712 - DNA, 85 bp, Mus musculus; identical to SEQ ID NO: 78336

SEQ ID NO: 100713 - DNA, 105 bp, Mus musculus
ctgtctgtctgtctgtctctctcgtgcgcgctctttctctctctcacacacacacagagagaaagtgagagagacaggcagagatggagttagacagacagagag

SEQ ID NO: 100714 - DNA, 136 bp, Mus musculus
tgtatgtatgtatgtatgtatatatataatatgcttgtatatgtgtatgtgtgctatatatatacatatatatgcatatatatgtgtgtgtgtttgtgtgtgtgtgtaaaactggtcacattattctgcattttgt

SEQ ID NO: 100715 - DNA, 99 bp, Mus musculus
agggcttgtctttatcagtggaagttttctggtcttagaaacagattttttttttaaggttggaacaatagctaagtggttacgggcattttatgcttt

SEQ ID NO: 100716 - DNA, 116 bp, Mus musculus
ggctaccccaagttagacaatcatatttttttcaggccttctcagaacctttgatgatctgatgtgaatttcatgttctcaagagcaggctatatgtgatatgctattatatagtt

SEQ ID NO: 100717 - DNA, 95 bp, Mus musculus
ggctctgtgagctgtatgcctgtgtgtgtctgtgtatctttgagcgcccttgcagggcgtgtacaggcgcgtgcgtggatgtgtgtttgtgagct

SEQ ID NO: 100718 - DNA, 97 bp, Mus musculus
gggggatggaagtggttttgaggagctagagagatggctcagcagtaaagcgccctgactgctcttgcagaggtcctgagttcgattcccaccaccc

SEQ ID NO: 100719 - DNA, 84 bp, Mus musculus
atggggggctaagttttctcctgcatttatatcagtcccacccccaccaggggccagaagacagtgacaagactgccactctat

SEQ ID NO: 100720 - DNA, 68 bp, Mus musculus
ggaatagctgtgtcactctgtgtgcgggctttaaggccctcatcctaactgcctgaaagctaatctcc

SEQ ID NO: 100721 - DNA, 93 bp, Mus musculus
tctggcagtcattgctgacaatctgtgtctctgagttcttccctagggtggttggtgattgagtcattaatctgttcaagcagtggtgcctga

SEQ ID NO: 100722 - DNA, 84 bp, Mus musculus
gataaaatcagtcaatttctctctggatctagggcctagaatagattcgtgaggtaagatcttctggaagtggactgtggtatc

SEQ ID NO: 100723 - DNA, 85 bp, Mus musculus; identical to SEQ ID NO: 57439

SEQ ID NO: 100724 - DNA, 87 bp, Mus musculus
gttcaagagattcagcttgttttcagagtagagtatttgctctattatgtgagtagaatgcagtttggaaaagagagttatatggac

SEQ ID NO: 100725 - DNA, 73 bp, Mus musculus
tgcttgttttttctttgtgtttttgtatgtgtgagagagagacagagactgagaaacagagagagaatgagca

SEQ ID NO: 100726 - DNA, 92 bp, Mus musculus
gcattgatttgcctaaaatcagagcaagctaaggcaaagattaacttaagtattctgactgtagtggctgtgctctttctgtcagatcaagc

SEQ ID NO: 100727 - DNA, 103 bp, Mus musculus
ggagcaattctggattaatatttttgagatgagagagtggccacattcctcaaatgggggccatgcctatccactaaatatgttctctacaggttttctctcc

SEQ ID NO: 100728 - DNA, 95 bp, Mus musculus
ttgtccttaagaatcctcaagctccatacactgtttgactgtgggtgtctgtatctgtctcagtcagctgttgggtagagcttctcagagcacaa

SEQ ID NO: 100729 - DNA, 85 bp, Mus musculus; identical to SEQ ID NO: 57470

SEQ ID NO: 100730 - DNA, 85 bp, Mus musculus
cacatacacacacacatacatcatatcataagtataccatatatatatttatgtataaccatagatgtatatgtgtgcatatatg

SEQ ID NO: 100731 - DNA, 105 bp, Mus musculus
agatacttgttgtacaatgtagacagtggtacaatgggatctttcctcctatgtgtggaggttgaaggtagtattgaacgaatgtcttttcataagcaataatct

SEQ ID NO: 100732 - DNA, 84 bp, Mus musculus
ggctcaagattcagacactgcctgtctgtcatcatggtcctcaccatgacagtcaggtactccagtgctctgaatctgtaagcc

SEQ ID NO: 100733 - DNA, 111 bp, Mus musculus
ggccactcacacatgcatgaacacacacaaattcctgtattatatagcatgtatagttttatatatccatgtatatttgtgattactgtgtgcatacaatgtttgaaagct

SEQ ID NO: 100734 - DNA, 81 bp, Mus musculus
tggagatgagtgtataagtgattttgttgtggcttaggttatccagaccttctgacaatcactctcatacagttgactcca

SEQ ID NO: 100735 - DNA, 97 bp, Mus musculus
ggcctcagagtgagacaaagcagaaactctgccagacagggctaaaggtcactcctgctgtctgtccctgtgtctgctattggtgactctcgcagct

SEQ ID NO: 100736 - DNA, 78 bp, Mus musculus
gtgacatctcgaggagctgagaatatctcatgcatattatgcctgtctctgagagcctgtcagttaaacaggtgttac

SEQ ID NO: 100737 - DNA, 85 bp, Mus musculus; identical to SEQ ID NO: 57439

SEQ ID NO: 100738 - DNA, 85 bp, Mus musculus; identical to SEQ ID NO: 57439

SEQ ID NO: 100739 - DNA, 89 bp, Mus musculus
tgactctgaaggagcccctcaccctctctttgtctgacctcctcctaaccaaaacttggggtgtctggtgatcaggactttcagatgca

SEQ ID NO: 100740 - DNA, 76 bp, Mus musculus
cagtcttaggccatggtggtctgatagaatacatgggacaatctcaatatttttgtatctattgaggcctgttttg

SEQ ID NO: 100741 - DNA, 83 bp, Mus musculus
gcttttatgtgagttcatatgcgcatgtatctctgtgtttatctctgtatgtgtgtatgcatgtaaaacttatgttcctgagc

SEQ ID NO: 100742 - DNA, 104 bp, Mus musculus
tctgaattgcagtgtcttttagtatacacaagcttttttgtttcatgaggtcttatttattaattgttgatcttagtgcttgttctatcagtgttctgttcaga

SEQ ID NO: 100743 - DNA, 85 bp, Mus musculus; identical to SEQ ID NO: 57470

SEQ ID NO: 100744 - DNA, 64 bp, Mus musculus
atgcatgtatgcatctatgtatctatgcatcatgtatgtgtgtatatatgatgtatgtatgtat

SEQ ID NO: 100745 - DNA, 90 bp, Mus musculus
tacatatatctgtatatataattatgtatatgtattatgtataattatatatgcatatatgtatatatgtgtgtgtgtgtgtttgtgtgt

SEQ ID NO: 100746 - DNA, 83 bp, Mus musculus
agggatttgatggagatatcccatttagggctgagtgtcctaaggtctctcactctctgtatgatatctgggtgtgggtctct

SEQ ID NO: 100747 - DNA, 62 bp, Mus musculus
ggttcctggaagctggagagagagctcagaggttaagagcactgactgctcttccaggggtc

SEQ ID NO: 100748 - DNA, 56 bp, Mus musculus
ggctgtgcagggatcctgggtgtgcatatgcatctctgtgtctctgtctctctgcc

SEQ ID NO: 100749 - DNA, 110 bp, Mus musculus
gagacagagagataatgttcacaagtgtgtgtgtgtgagtgtgtgtgtgtgtgtgtgtgtgtgcgcgcgcgcgctcatgattgtgcacatggagatcagaagagaccatc

SEQ ID NO: 100750 - DNA, 88 bp, Mus musculus
atatgcatgcatatatatatatatgcatgtgtgtatgtgtatatatgtatgtgtgtataatatatatgcatgtatgtatatgtgtgtg

SEQ ID NO: 100751 - DNA, 85 bp, Mus musculus; identical to SEQ ID NO: 68804

SEQ ID NO: 100752 - DNA, 116 bp, Mus musculus
gctaagaaattggtttaagattctgagagaagggctggagagatggctcagcggttaagagcactgactgctcttctgaaggtcctgagttcaaatcccagaaaccacatgttggc

SEQ ID NO: 100753 - DNA, 107 bp, Mus musculus
tgtggctatggttcaagaatgattattagggactagagagagagctcatcggttaagggtactgactgctcttccagaggatccaggtttgaaccccagcacccaca

SEQ ID NO: 100754 - DNA, 79 bp, Mus musculus
gctgctgctgctgctgctgcttttgatgatgatgatgatgatggtgatgcttatcacaaggctatacaaaggcagcagc

SEQ ID NO: 100755 - DNA, 80 bp, Mus musculus
tgtatgtatatatatgtatatgtatgtatatatatgtatgtatatgtatatatatatatgtatgtgtatatatatatata

SEQ ID NO: 100756 - DNA, 85 bp, Mus musculus; identical to SEQ ID NO: 57439

SEQ ID NO: 100757 - DNA, 127 bp, Mus musculus
atatatatatatatatatatatatatatatgtatatatatgtatatatatgtatatatatgtatatatatgtatatgtatatatatatatacatgtatgtatgtatgtatgtatgtatgtatgtata

SEQ ID NO: 100758 - DNA, 92 bp, Mus musculus
cagatcaatgttctttctggtcactctgactgcctctcttatactctggggggggggggagggggtaagatatgagatttgaagataatttg

SEQ ID NO: 100759 - DNA, 75 bp, Mus musculus
atcttcttctcacacatgtgtgtgtgtgtacagatgtatacatgtacacatacatgatagtgtgtatttgggggt

SEQ ID NO: 100760 - DNA, 85 bp, Mus musculus; identical to SEQ ID NO: 57439

SEQ ID NO: 100761 - DNA, 104 bp, Mus musculus
tgttttgtgagtttctctcttttggtgtgaagtctgccggcaagacaaactgtctgtctttctcagctggagacctggatttaaagtgaggcctgacttttaca

SEQ ID NO: 100762 - DNA, 95 bp, Mus musculus
gatatgtgcacagtcagtggagctcaaggtattgtctgtggtagtgaattgctttccaaccagagaattaatgatgagttctcagtgctaatatt

SEQ ID NO: 100763 - DNA, 80 bp, Mus musculus
atatatatacatatacatatatacatatatatgtgtgtgtatatatatatatgtgtgtgtatgtatgtatgtgtgtgtat

SEQ ID NO: 100764 - DNA, 69 bp, Mus musculus
cttgtcaggctctgtcagagcctctctggagacagtcatatcaggctccagtcagcaagcactttcagg

SEQ ID NO: 100765 - DNA, 66 bp, Mus musculus
gccctagcttgtttgtaacaccatctgcttctggatcctgagtcttggggttacaggtgctagttc

SEQ ID NO: 100766 - DNA, 85 bp, Mus musculus; identical to SEQ ID NO: 57439

SEQ ID NO: 100767 - DNA, 84 bp, Mus musculus
attatagagattgtcaataagtatgtatgtatgtatgtatgtatatatgcatgtatgtatgtgtgaatataatatttttgtggt

SEQ ID NO: 100768 - DNA, 85 bp, Mus musculus
ggccatggtggtctgataggatacatgggagaatttcaatatttttgtatctattgaggcctgttttgtgaccaattatatggtc

SEQ ID NO: 100769 - DNA, 130 bp, Mus musculus
ggatgtcagtcagtcagtctgtctgttgtctgtcagtctgtctatcagtctgtcagtctgtttgtctgtcagttggtctgtctgtctgtttgttgtctgtcagtcagtcagtctgtctgctgtctgtcag

SEQ ID NO: 100770 - DNA, 85 bp, Mus musculus
cagtctgtcagtctgtttgtcagttggtctgtctgtctgtttgttgtctgtcagtcagtcagtctgtctgttgtctgtcagtctg

SEQ ID NO: 100771 - DNA, 85 bp, Mus musculus; identical to SEQ ID NO: 57470

SEQ ID NO: 100772 - DNA, 108 bp, Mus musculus
gagcataaaattgggtgagtagggctggagagatggcttagtggttaagagcactgactgctcttccaaaggtactgagttcaaatcccagcaaccacatgatggctc

SEQ ID NO: 100773 - DNA, 62 bp, Mus musculus
gaggagagggatttcacagaaacatcccatttagagatgtgtgtttcacagtctctctcttt

SEQ ID NO: 100774 - DNA, 119 bp, Mus musculus
ttgaagatcagccttattccgtggtgatctgataggatgcatgggataatttcaatatttttgtatctgttgaggcctgttttgtgaccaattctatggtcagttttggagaaggtatc

SEQ ID NO: 100775 - DNA, 107 bp, Mus musculus
cctggacttgacaagatgctgaaactcatatatatatgcccaatctaatatgtatatattattatatatattagattgggcagagaataagattaagtatgtttggg

SEQ ID NO: 100776 - DNA, 116 bp, Mus musculus
gctcataaaacatatgtgagtatgtgtgtttgtgcatataaatgtgaatatgtatgtgtgtgtctctgtgtgtatgagtgtgcatgtgtgtatgtgtgtgcaggtgtgtgtgtgag

SEQ ID NO: 100777 - DNA, 85 bp, Mus musculus; identical to SEQ ID NO: 57439

SEQ ID NO: 100778 - DNA, 120 bp, Mus musculus
tcatccttagtccatgttgatctgataggatgcatgggatgcactctttcaatatttttgtatctgttgaggcttgttttgtgtacaattatttggtcagttttggagaaggtaccatga

SEQ ID NO: 100779 - DNA, 85 bp, Mus musculus; identical to SEQ ID NO: 57439

SEQ ID NO: 100780 - DNA, 85 bp, Mus musculus; identical to SEQ ID NO: 63165

SEQ ID NO: 100781 - DNA, 97 bp, Mus musculus
ctatgattgatgttttcccctctgagtctctctcacacagatatgtcagaagtgttcatgcctaaagagaatgactggagagcaaatgaatccttag

SEQ ID NO: 100782 - DNA, 104 bp, Mus musculus
ccaatgggacacttccatttttctgtgctgagaggctaagaaagttggatgttttcaacagagtactggccaccaggcactatatgtaggagttccagtcttgg

SEQ ID NO: 100783 - DNA, 75 bp, Mus musculus
tggtctgagtctgacagtctgagaatgagcaatggtaagtcagtatgttcctcactgtggtcaaattaaagacca

SEQ ID NO: 100784 - DNA, 81 bp, Mus musculus
ttgtgatgtgtgatgatgcaaaccacaaagtgagttctcactggtagaatagtgagtgtaggggtggtctctaggttacag

SEQ ID NO: 100785 - DNA, 81 bp, Mus musculus; identical to SEQ ID NO: 100784

SEQ ID NO: 100786 - DNA, 85 bp, Mus musculus; identical to SEQ ID NO: 66071

SEQ ID NO: 100787 - DNA, 85 bp, Mus musculus; identical to SEQ ID NO: 57439

SEQ ID NO: 100788 - DNA, 85 bp, Mus musculus; identical to SEQ ID NO: 57439

SEQ ID NO: 100789 - DNA, 85 bp, Mus musculus; identical to SEQ ID NO: 57470

SEQ ID NO: 100790 - DNA, 128 bp, Mus musculus
tatacaagtacaaaatatgtatatatgtgtatatgtgtatatgtgtatatgtatatatgtaagtgtatatgtgtattagcatatatatatatgtgtgtgtgtgtgtgtgtgtgtgtgtgtgtgcgtgc

SEQ ID NO: 100791 - DNA, 83 bp, Mus musculus
agcaccacataatttttgtctgtgagtctctgcctctgcttcaatcagcagttgcagaaaacttctctaatgacaattgggct

SEQ ID NO: 100792 - DNA, 85 bp, Mus musculus; identical to SEQ ID NO: 57439

SEQ ID NO: 100793 - DNA, 120 bp, Mus musculus
gtgtgtatgtatgtaagtatgtatgtatatatgtatgtatgtatatgtgtatatgcatatatatgtatatgtgtatatgtgtatatatgtacatatgtatgtatgtatgtatgtgtgtat

SEQ ID NO: 100794 - DNA, 85 bp, Mus musculus; identical to SEQ ID NO: 58722

SEQ ID NO: 100795 - DNA, 106 bp, Mus musculus
cttactgcttttcatattctgtctttatttagtgcatttgttgttctgacaattatgtgtcagaaggaatttcttttctggtccagtctatttggagttctgtagg

SEQ ID NO: 100796 - DNA, 80 bp, Mus musculus
ttacaataaatgcactttaatgtatttttatacttggatatttccaataaagaataactaaagccatgcattttctgtag

SEQ ID NO: 100797 - DNA, 73 bp, Mus musculus
ctctgcctaggatgtgtcgctccctgattggctgcagcccatcggtcgagttgtcgtcacggggaaggcagag

SEQ ID NO: 100798 - DNA, 92 bp, Mus musculus
tctatagtgatctgataggatgcatgggataatttcaatatttttgtatctgttgaggcctgttttgtgatactttatatggtcagtttgga

SEQ ID NO: 100799 - DNA, 113 bp, Mus musculus
gtctgggttacctcattcagagtgatatttctagctccattcatttgacagccaaattcattatgccctcattcttaatagctaaatattattcccgtgtgggaggtagggat

SEQ ID NO: 100800 - DNA, 84 bp, Mus musculus
ttctattgtgtttctctctccccctgtcaatcattatccagtatgggcccagacagtgaacaggggtggaatagcggttcagaa

SEQ ID NO: 100801 - DNA, 95 bp, Mus musculus
tccccatgacaagatgcttttctgagatcagcacaaaataggagactcctttttctagtctctctgcctctgtctggagagtatctgtttgaaga

SEQ ID NO: 100802 - DNA, 85 bp, Mus musculus; identical to SEQ ID NO: 57439

SEQ ID NO: 100803 - DNA, 85 bp, Mus musculus; identical to SEQ ID NO: 59663

SEQ ID NO: 100804 - DNA, 94 bp, Mus musculus
caaagaaggaattaaggggaatagcaagttgcttggtttgtttttaaaaatcattgtagcttattgacattactactttattaaaccctctttg

SEQ ID NO: 100805 - DNA, 85 bp, Mus musculus; identical to SEQ ID NO: 57439

SEQ ID NO: 100806 - DNA, 85 bp, Mus musculus
gaccatggtggtctgataggatgcataggacaatttcaatatttttgtatctgttgaggcctgttttgtgaccaattatatggtc

SEQ ID NO: 100807 - DNA, 60 bp, Mus musculus
atgtgtgtatatgtatatatgtatgtatatgagtatgtatatgtgtatatgtatatgtat

SEQ ID NO: 100808 - DNA, 86 bp, Mus musculus
actgaacccagacccagaagtccctgctgtatgtgtttgaggagcctcatatcagctggtgtatgttgtctggttggtggtccagt

SEQ ID NO: 100809 - DNA, 85 bp, Mus musculus; identical to SEQ ID NO: 57439

SEQ ID NO: 100810 - DNA, 91 bp, Mus musculus
gcctctgtacttgtcaggctctgtcagagcctctcaggagacatctgtatcaggctcctgtcagcctacacttcttggcattcacagtagt

SEQ ID NO: 100811 - DNA, 106 bp, Mus musculus; identical to SEQ ID NO: 82828

SEQ ID NO: 100812 - DNA, 106 bp, Mus musculus; identical to SEQ ID NO: 65673

SEQ ID NO: 100813 - DNA, 101 bp, Mus musculus; identical to SEQ ID NO: 59975

SEQ ID NO: 100814 - DNA, 121 bp, Mus musculus
ttctaccctgcattgataatttagttcccagataaaaggcacacacaaactttatatttataagagacatgggtgtggtttaggattcttgggtttggggtcagttggagaagaaccaggg

SEQ ID NO: 100815 - DNA, 85 bp, Mus musculus; identical to SEQ ID NO: 57470

SEQ ID NO: 100816 - DNA, 117 bp, Mus musculus
ttgtaaaaaaacaacccaggaaatatagagtgtctgttaaaaagagaatggttctttatagatttattttcatctcaacctcaatgaatatagtctgggtctgttcttctgttataa

SEQ ID NO: 100817 - DNA, 83 bp, Mus musculus; identical to SEQ ID NO: 65342

SEQ ID NO: 100818 - DNA, 89 bp, Mus musculus
ggagttagttgttatagttgtctctggttagagcttgttcctctagtgattctgttctcctctattagcagacctgaggcactagctct

SEQ ID NO: 100819 - DNA, 72 bp, Mus musculus
gctgaggaagggaggctggtgagatggctcaatgttaagagcactgactgctcttccagtccaaatcacagc

SEQ ID NO: 100820 - DNA, 85 bp, Mus musculus
ggccatggtggtctgataggatacatgggacaatttcaatatttttgtatcaattgaggcctgttttgtgaccaattatatggtc

SEQ ID NO: 100821 - DNA, 119 bp, Mus musculus; identical to SEQ ID NO: 84345

SEQ ID NO: 100822 - DNA, 85 bp, Mus musculus
gtccatggtggtctgataggatgcatgggtcaatttcaatatttttgtatctgttgaggcctgttttgtgaccaattatatggtc

SEQ ID NO: 100823 - DNA, 76 bp, Mus musculus
atatctatatctatatgtgtgtgtatatatatatacatatatatatatatatatacacacatatatgtgtgtatat

SEQ ID NO: 100824 - DNA, 85 bp, Mus musculus; identical to SEQ ID NO: 57439

SEQ ID NO: 100825 - DNA, 79 bp, Mus musculus
tgtggatggtagaataataggatttgtctatcagggataactagggtggattatttaatctgtattcatttttctcaca

SEQ ID NO: 100826 - DNA, 94 bp, Mus musculus
ttactggcaagtcatgttcatagtaatgaaattatgtttttcattttacaaatttgaagactgatgaagttactctctcatagctggctagtaa

SEQ ID NO: 100827 - DNA, 67 bp, Mus musculus
tgagacaaattacattcagattcagcacactcccttgtgtctgtgtctgtctgtcacccccttctca

SEQ ID NO: 100828 - DNA, 85 bp, Mus musculus; identical to SEQ ID NO: 57439

SEQ ID NO: 100829 - DNA, 104 bp, Mus musculus
ttctgtcagcacctgaccaatgcagatgtggatgtttggggccaactttcagactgagctcagagaccacattgagggagctggcagaaggcctggaggagtgg

SEQ ID NO: 100830 - DNA, 96 bp, Mus musculus
gaagttaaggtcattctgagtttgcattgagaatgtttaagtctcggtgtctgagtctgacacattaaagtgtctttgctcatggtgaaagatttc

SEQ ID NO: 100831 - DNA, 100 bp, Mus musculus
tcatattatgtgcatatgcatattatatgcatatacatgtattaatatatgtttgcaaatgttcatgtatgcatgcattcatatatatgcatatggatga

SEQ ID NO: 100832 - DNA, 89 bp, Mus musculus
tctatgatcctgggcatgttacagcatctggaagtggcacctcctctgggggaccatggggctgtccgctgtgttcaaaccaaggtaga

SEQ ID NO: 100833 - DNA, 67 bp, Mus musculus
tacttagaagatatagtgatcaattaaggagtgtatattcctgtccctgtgtctgtcagtctgagtg

SEQ ID NO: 100834 - DNA, 65 bp, Mus musculus
tcagtcagtgtagtagtagcttgtaattattgaatgattatcacatagctgtgctaagcggctga

SEQ ID NO: 100835 - DNA, 79 bp, Mus musculus
ctgcatcctgagtaagatgttataggtctgtataaagggacaaagtcatgtgcatttgtagatctgtgttacgatgtag

SEQ ID NO: 100836 - DNA, 85 bp, Mus musculus; identical to SEQ ID NO: 57439

SEQ ID NO: 100837 - DNA, 85 bp, Mus musculus; identical to SEQ ID NO: 57470

SEQ ID NO: 100838 - DNA, 85 bp, Mus musculus; identical to SEQ ID NO: 57439

SEQ ID NO: 100839 - DNA, 113 bp, Mus musculus
gaggttaaaattacatgaactctggaaaacctgcctttggtttcataaggctgaacagtgtgaggtcagattgggggttacttatatttgtctagggaattaattttgttctt

SEQ ID NO: 100840 - DNA, 96 bp, Mus musculus
tatctctctctctctctctctctttctctctctctctcatacacacccatgatagatagatagagagagagacagacagacagacagagacagata

SEQ ID NO: 100841 - DNA, 85 bp, Mus musculus
ctctgtctgtctgtctgtctctctctctatctatctatcatgggtgtgtatgagagagagagagaaagagagagagagagagaga

SEQ ID NO: 100842 - DNA, 85 bp, Mus musculus
gtgactctgtatcaagtctatacaagtgtttgtaaagttatctttggaatactaactgttatatactttcaggtgtcagggatac

SEQ ID NO: 100843 - DNA, 101 bp, Mus musculus
ggtgtgtgtacgtgtgtatgtacatatgtatgcacgcatgcatgtatgtattatgcatgtatgtatgtatgtatgcatatatatatggatatgtgaatgct

SEQ ID NO: 100844 - DNA, 85 bp, Mus musculus; identical to SEQ ID NO: 57470

SEQ ID NO: 100845 - DNA, 92 bp, Mus musculus
ctattgctgatgcaaagaggtgcttactgacaagaggccaatatagctgtgcctggagaggctctgtcagtgcctgacaaattcagaggtgg

SEQ ID NO: 100846 - DNA, 94 bp, Mus musculus
gactccatgtggccttggctgggactcagtgtgtctgagtgcctccctggtgctggcttgcagctgagtcctctcatgggaatgctgtggggtc

SEQ ID NO: 100847 - DNA, 85 bp, Mus musculus; identical to SEQ ID NO: 57470

SEQ ID NO: 100848 - DNA, 116 bp, Mus musculus
ctagtacagttgtgtcatgactatatatatatatatgtgtgtgtgtgtgcgtgtatatatatatatatatatatatatatatatatatatatatatgtaacaaattgttatcctgg

SEQ ID NO: 100849 - DNA, 100 bp, Mus musculus
aagtaagtttgtagcagagttgttctatcaaaaatctatgattttttttcagaaaatttatcatatgttgatagttcacttttgattttaaaatttactt

SEQ ID NO: 100850 - DNA, 85 bp, Mus musculus; identical to SEQ ID NO: 57470

SEQ ID NO: 100851 - DNA, 85 bp, Mus musculus
ggctatggtggtctgataggatgcatgggacaatttcaatatttttgtatctgttgaggcctgttttgtgaccaattatatggtc

SEQ ID NO: 100852 - DNA, 82 bp, Mus musculus
tgtctctgtctgtccctctgtctctgcgtgtatgggttgcaaaacatgtacaacagggcacttaatggatagatcagtagca

SEQ ID NO: 100853 - DNA, 85 bp, Mus musculus; identical to SEQ ID NO: 57439

SEQ ID NO: 100854 - DNA, 102 bp, Mus musculus
tgacacttgccaaatttggcctctatggtttgcaaacaaagacaaaatgtaactttttagttataattctatgttgttgatgggctgaatttgggagcatca

SEQ ID NO: 100855 - DNA, 93 bp, Mus musculus
gagttgtgtgcagtgctctattcagattagtgccagtcatgtgaaatacatatgactggcaccattctggataatgtaatgctcactatattc

SEQ ID NO: 100856 - DNA, 100 bp, Mus musculus
gggtaccctgtgttccatcttatagatgactgtgagcacacacttctgtatttgccagacacttgcatagcatcataccagacagcaatagcagggtccc

SEQ ID NO: 100857 - DNA, 85 bp, Mus musculus
ttactatctagcaatccaatctcttcatatatatatttgtaagcatgaatattaatgtagttaggggattatgttggcttagtaa

SEQ ID NO: 100858 - DNA, 85 bp, Mus musculus; identical to SEQ ID NO: 57439

SEQ ID NO: 100859 - DNA, 72 bp, Mus musculus
gaaggaagtgtgtctctgggggtggattttggcataacaaagccaaagccaggctcagtggctctctctttc

SEQ ID NO: 100860 - DNA, 65 bp, Mus musculus
agaagacaggcaatagcccagctgactctatgtgtgtgtctgtctgtctgtctgtctgtctgtct

SEQ ID NO: 100861 - DNA, 85 bp, Mus musculus; identical to SEQ ID NO: 57439

SEQ ID NO: 100862 - DNA, 170 bp, Mus musculus
tacatatgatatatatatatacatacatatatatacatatatatatatatatatatatatatatacatacatatatatatatttgtgtgtatgtgtatatatgtatgtatgtgtgtatgtatctatatgtatgtatgtatgtatatatacatatatgtatatacatatat

SEQ ID NO: 100863 - DNA, 105 bp, Mus musculus
tgtgtttgtagaaggaagggtctgctcaacctggagcattggctctgtggttaagagctcatagtgctcctccaaaggacatgggtttaattcacagcactcaca

SEQ ID NO: 100864 - DNA, 91 bp, Mus musculus
tgtgtgtatgtgtgtgtatgttgtgtacatatacattcacatgcatatatacacacacagacacatacagacacacagacacatacataca

SEQ ID NO: 100865 - DNA, 140 bp, Mus musculus
gcatcttagtctttatgcaggtccctcaataactggagcaaggactgtccctgaatctactgcctgcctgcctgcatgcctgtgaatcttgtgcctctaaatagtctgccttgtatggtctcagtgggagaggatgcacc

SEQ ID NO: 100866 - DNA, 106 bp, Mus musculus
tgtgtgtgtgtgtgtgtgtgtgtgtacatatgtgtatatgtatatgtatatgtatatatatatatatatatatacacatatacacacacacatacacacacatata

SEQ ID NO: 100867 - DNA, 85 bp, Mus musculus; identical to SEQ ID NO: 57439

SEQ ID NO: 100868 - DNA, 186 bp, Mus musculus
tatatatatatatatatatatatatggtatatgtacagatatatcattcatataaatatatatatgtatacatatgtaggacatttcatatacttgtgtataaatgatatatatatgtgtatgtatatatatatgtatatatatatatacacatatatatatatatatatatatataattttgttc

SEQ ID NO: 100869 - DNA, 64 bp, Mus musculus
gcaggctcacatgtgtgcatgtttgtgtacacatgcacacacacacacacatacaggagtgtgt

SEQ ID NO: 100870 - DNA, 114 bp, Mus musculus
gctgctctgtgctgcctggttggtggtccagtgttgggagagttctcagggtccaggttaattgagactgtggctcctcctacagggtcaccctcctcctcagcttcttctagc

SEQ ID NO: 100871 - DNA, 110 bp, Mus musculus
cattaaccagtaccgttctagtcactgttgaaaatccacattgagaaaaaaaaaatccctatctctgtgaggtttacatcatatcaggaaaggagacaggtttcacaatg

SEQ ID NO: 100872 - DNA, 92 bp, Mus musculus
ggaaggtggccggttgtctggagtcgaagatggcgctgcctcagaagctctgtggctctctccttcccagaaacggctggcctctgtattcc

SEQ ID NO: 100873 - DNA, 122 bp, Mus musculus
gttggctactttcaatgatgctgtgtacagtaccttactcagtaaggcattgttcttctatattaataaatgaacagtgcctttctgtgtagggtaatgtgcaacatggacaacatttgtgg

SEQ ID NO: 100874 - DNA, 85 bp, Mus musculus; identical to SEQ ID NO: 57439

SEQ ID NO: 100875 - DNA, 113 bp, Mus musculus
ggcgtgggccagcagggttttgtcctttactacttttaatattctatctttatttagtgcatttgttgttctgattattatgtgtcagaaggaatttcttttctggtcctgtc

SEQ ID NO: 100876 - DNA, 153 bp, Mus musculus
tacatacacatgcacatgcacatatacgtacatatatatgtacatatatatatatatatgtgtgtgtgtgtgtgtgtgtgtgtgtgtgtgtgtgcatgtgcgtgcgtgcgtgcgtgtatgtgtgtatgtatgtatgtatgtatatgtatacat

SEQ ID NO: 100877 - DNA, 86 bp, Mus musculus
gtccatggtggtctgatagtatgcatggaacaatttcaatatttttgtatctgttgaggcctgtttttgtgaccaaatatatggac

SEQ ID NO: 100878 - DNA, 105 bp, Mus musculus
gctggggttaaaggtgtgtgctactagtggactgcttgagaatatttctatttaaaagaaagagtctctacgttgacaacctttaccacacacttgagcctctgc

SEQ ID NO: 100879 - DNA, 85 bp, Mus musculus; identical to SEQ ID NO: 57439

SEQ ID NO: 100880 - DNA, 117 bp, Mus musculus
tgatgtgttagcatgttcaagtctttggattcctgccgcagactctctgggtccctgtgtctgcgtggaacggggtctctcgacgcgggtgggcaaagcatggatgaatgacagaca

SEQ ID NO: 100881 - DNA, 111 bp, Mus musculus
aagtctggctaagctaaactgagttgttttctttcattgaaactatttcttttcctctttgatgagctgaggtgggatatctgagaatgaaaacatgtttctccagtgctt

SEQ ID NO: 100882 - DNA, 156 bp, Mus musculus
atatatatatatgtgtgtgtgtgtgtatatgtatatatatgtatatatatatatatatatgtatgtatatatatgtatatatatatatatatgtatatgtatatatagatagatatatgtatatatctatctatctatctatctatatatgatata

SEQ ID NO: 100883 - DNA, 85 bp, Mus musculus; identical to SEQ ID NO: 57470

SEQ ID NO: 100884 - DNA, 68 bp, Mus musculus
ggaaaggaggctggagagatggctaagtggttaagagcactgactgctcttccagaggtcctgagttc

SEQ ID NO: 100885 - DNA, 81 bp, Mus musculus
tggtgatctgataggatgcatgggacaatttcaatatttttgtatctgttgaggcttgttttgtgaccaattatgttgtca

SEQ ID NO: 100886 - DNA, 105 bp, Mus musculus
agagatggtatgatagagaggtgagatcggtattgtctaagagaggtggatgttaggaatgtaaggaactttgaggaatgttgaatcacttcctttactgtgtct

SEQ ID NO: 100887 - DNA, 74 bp, Mus musculus
tgtttctgtcacaaagcacaatctctgcaaatgagcagaaatcatgaacacagatgtgtgggagcacagagata

SEQ ID NO: 100888 - DNA, 98 bp, Mus musculus
gctgttccactgggagctgcagagaagtgtgagagctgaaatttgggctgtgacagcatgcttaactttgattctcaagcagccttagatttgaaagc

SEQ ID NO: 100889 - DNA, 103 bp, Mus musculus
ggtggatgagcaagagatacttcctgtggatatagtttgagaatgtcatttgaagtcattttattgttgtgttcctttagtaagacagtatttggtttacccc

SEQ ID NO: 100890 - DNA, 73 bp, Mus musculus
tgattggacaagacacagctgaagccttgggaatgcgaaggacagctttgggactgtgtctgtctgcacatca

SEQ ID NO: 100891 - DNA, 80 bp, Mus musculus
tgtctgtctgtctgtccgtggtacatacacatgagatgtcagttcatgcatgtacataccaaggccagaagaaaaggaca

SEQ ID NO: 100892 - DNA, 108 bp, Mus musculus
gtgctaggattataggcataccccagtatatctggcttaaaatctgattttttttgagttagcacataaagccacatatgggaattccacacctgaccaccaatgcac

SEQ ID NO: 100893 - DNA, 101 bp, Mus musculus
cagataatggctgtgcttccctgctttattactgtgtgtgtctctctctccagggatcacatttgttcaggagttgtgaaagctagtaaatattgtatctg

SEQ ID NO: 100894 - DNA, 91 bp, Mus musculus
ttagcagtagcaagcggcatattcagtgctgaaatcttgattttttttcaactacatttccactgaaaatgcatgcttggaagatagctga

SEQ ID NO: 100895 - DNA, 85 bp, Mus musculus; identical to SEQ ID NO: 57439

SEQ ID NO: 100896 - DNA, 107 bp, Mus musculus
gggtcagctgtaataaagtcataataggagatcagtgaagagagtgtgtattttaaaatagaggtctcaaaggatttcaaatgtctaaagggtgaagtttagggccc

SEQ ID NO: 100897 - DNA, 87 bp, Mus musculus
ctctctctctctctctctcaaacacacagaaggagagggaggaaaagggagaggggaagggggaggaggggagggggagggggaggg

SEQ ID NO: 100898 - DNA, 108 bp, Mus musculus
tattatggaaggtatggtactgtgatggctctaggtctggtggatggcatgaatgtgaagtgtctgatcacactgagtctatagacagaactattgatactaataatg

SEQ ID NO: 100899 - DNA, 107 bp, Mus musculus
tagtgtgttagagattttcaaaaaaaggctatgatattaatatggatttgggtggaatcttgtctccatcttccactgcatggttttaggaataaggctgataactg

SEQ ID NO: 100900 - DNA, 84 bp, Mus musculus
ttatatatatgtatatgtatgtgtgtatatatatctatatatatctatatctatatatatatatgaaaacactcatacacatac

SEQ ID NO: 100901 - DNA, 119 bp, Mus musculus
gtcttcagtggcaaggatggggttcctgttcctaaagaaagccttattatgtccttcacagaacagagtctcaggcccttgaaggcagatttagagggaggtatctgacatggcctctg

SEQ ID NO: 100902 - DNA, 93 bp, Mus musculus
acatgactatggggtattatgtggtcattgggtgcaaatacataatgcactcagtatatattaatttaaacatagttcttcatatgtccatgt

SEQ ID NO: 100903 - DNA, 69 bp, Mus musculus
tgtacaagggctggagagatggctcagtggttgagactgctgactgctcttccagaggtcccgagttca

SEQ ID NO: 100904 - DNA, 91 bp, Mus musculus
tagtcctggctgtcctgtaactcactttgtagaccaggctggcctcgaactcagaagtctgcctgtctctgcctcccaagtgctgggatta

SEQ ID NO: 100905 - DNA, 85 bp, Mus musculus; identical to SEQ ID NO: 57439

SEQ ID NO: 100906 - DNA, 97 bp, Mus musculus
agtaatagtcaatgtatggtgtatgcttgtgtgtatatgggtaaatgatcataaatatacatatatgtgtaagtcagcatattaatgagatgtttct

SEQ ID NO: 100907 - DNA, 62 bp, Mus musculus
ccagtggttagagaagttactcagcagacctttctctgagggaacaaagcttgattcgctgg

SEQ ID NO: 100908 - DNA, 85 bp, Mus musculus; identical to SEQ ID NO: 57470

SEQ ID NO: 100909 - DNA, 85 bp, Mus musculus; identical to SEQ ID NO: 57470

SEQ ID NO: 100910 - DNA, 86 bp, Mus musculus
agaactcaggaagggtgcccagctggtggcagagggtgtctctaaggaataatgactgtcacacacactgactgttcttgaattct

SEQ ID NO: 100911 - DNA, 90 bp, Mus musculus
gggcctgcagcatgtgaggacatcccactgaagaccaactgtcccacagtctctgactctgtgtattgtccagttgtgggcctctgtgtt

SEQ ID NO: 100912 - DNA, 105 bp, Mus musculus
ggagagcaaccactagtgtaccagagtctcatcttccagaatgcctatgcccaggtatactgagagatgtgtgtctccactagcaagtgagaatggaggctctcc

SEQ ID NO: 100913 - DNA, 82 bp, Mus musculus
ccattctctcagtctctgattcatgtttgcctttcatgtcttgtagggagcacacattttgagtcaaagtttttgtgcgtgg

SEQ ID NO: 100914 - DNA, 105 bp, Mus musculus; identical to SEQ ID NO: 100912

SEQ ID NO: 100915 - DNA, 117 bp, Mus musculus
gctctttgaaatccatattctctgcttcactatctgtatctgcatttagcatctataaaattatgcagaactacattagtggcaagactatttgggggtgtgtggatgattaactgc

SEQ ID NO: 100916 - DNA, 99 bp, Mus musculus
gtgtatatgaatggaacaagctctttggctatgtgaacgatttttgaaagtacatttaaactcttctgatatagttcttgttttccataaaatgtgcac

SEQ ID NO: 100917 - DNA, 88 bp, Mus musculus
aggatctgatggcgttttggattacttcaggatctgttgttatgtctccattttcatttctgattttgttaattaggatgctgtccct

SEQ ID NO: 100918 - DNA, 85 bp, Mus musculus; identical to SEQ ID NO: 57439

SEQ ID NO: 100919 - DNA, 69 bp, Mus musculus
tatctctgtgtgtctgtgtgtgcaagcatgtgctcatgtaccatgcatattcaaactaccacaggcgta

SEQ ID NO: 100920 - DNA, 93 bp, Mus musculus
gattattattgttacatatgtattcatgtatatatgtgtatatatgtatatatgcatgcacaaatatacaaaaacaatgtgttgattctgatt

SEQ ID NO: 100921 - DNA, 85 bp, Mus musculus; identical to SEQ ID NO: 57439

SEQ ID NO: 100922 - DNA, 119 bp, Mus musculus
tgtgtgcatgccatgctagtgccattggtgtgaggatgtggctgttgtgatctgtgtggctctgctcagctgtattgaagtgatacccttccagccctagtcactggatgctgacagtc

SEQ ID NO: 100923 - DNA, 72 bp, Mus musculus
atgtatgtatgtatgcatgtatgtgtgtatatatatatatatatatatatatacatggcatagcatgatcat

SEQ ID NO: 100924 - DNA, 106 bp, Mus musculus
gttttacatttgtctgactgtctgactgtctgtctgtctatgtacacacacacacacacacacacacacacacacacacacacacaccacagcatgggtgtagagc

SEQ ID NO: 100925 - DNA, 124 bp, Mus musculus
atccctgcagcaacgtccttgggcagtaggtttttgttgaacacacaggatatgttggtattactctgtcactgtctgactcttacttctctagaaccctgctgttcagatcctcagcatctgc

SEQ ID NO: 100926 - DNA, 116 bp, Mus musculus
gtgcatgtggaaagagtgtgtgggtgtaaactaaatggaataataatcacagtggctgttttaaaatgtgcacttcccctaaacatacacctcaggcagctcccttgcatttccat

SEQ ID NO: 100927 - DNA, 106 bp, Mus musculus
tgatgggtggtaatgggagctttaggggtggtgcaagttttgtcagtatttgtagtgattttgatgatactaggcacacctaaggacaatcaggagcacacagtta

SEQ ID NO: 100928 - DNA, 99 bp, Mus musculus
tcctcaggcagatttggtccccagtggtttgtgagcagattatatttatataagctatattgactgtcacaaacctttgtgcactagttaggccaggga

SEQ ID NO: 100929 - DNA, 112 bp, Mus musculus
gtgtgtaaggaaagtatgtgtggttgtcagttcttgggagcttaatctgaagacagtagacagatagcatggctaacagaaaagatgacttgtgcctgtgattccttatagc

SEQ ID NO: 100930 - DNA, 101 bp, Mus musculus
tcaaggaatccgaacagagtaattaaaggacataatgtgcaggcacagtgaaaaatgactgcattctcagtgttctgaaggctgaggcaggaggatcttga

SEQ ID NO: 100931 - DNA, 107 bp, Mus musculus
gtcttcaatttctttatttcatcattgaccaaggaatcattgagtagagtgtcattcagtttccacgtgaatgttggctttcaattattaatgctgttattgaagat

SEQ ID NO: 100932 - DNA, 103 bp, Mus musculus
gtatccaaattcaattcccagcacccacatggcagctcacaactgtctgtgactccagttgcaggagatctgatctgatgccctcttctggctttcacaggca

SEQ ID NO: 100933 - DNA, 97 bp, Mus musculus
ttgcatctggttgggcttcttatgtgaacatttccaaatcagagtctggcagagaagatagacacctcagagatcactaggtccaatccacttgcaa

SEQ ID NO: 100934 - DNA, 79 bp, Mus musculus
cactcacacagacacatacacactgggtgaagcagaaaataggtgcaccactacaagtgggtagaaggatggatggatg

SEQ ID NO: 100935 - DNA, 74 bp, Mus musculus
atgtgaacatagaagacctggtgcagacctgtgcaggccctgtgcatactgcctctgtctctgtgagttcatat

SEQ ID NO: 100936 - DNA, 110 bp, Mus musculus
ttgaagatcagccttagtccatgatggtctgataggatacatgggataatttcaatatttttgtatctgttgaggcctgtttagtgaccaattatatggttgattttgga

SEQ ID NO: 100937 - DNA, 92 bp, Mus musculus
cagtgctcttgatacttaaacaattctgggggttgcagagatggcttggcagttaagagcactgactgctcttccagaggtcccgagttcag

SEQ ID NO: 100938 - DNA, 75 bp, Mus musculus
gtaccaaggagaatacagaagagagagacggctctgcaaggcagagacgaggcttgactttgcttttccaggagc

SEQ ID NO: 100939 - DNA, 77 bp, Mus musculus
tggatttgtgtgtctgtcttgtgaacatgtatgagagatgtcagagtgaacagtaggcagacacagatttctttcca

SEQ ID NO: 100940 - DNA, 92 bp, Mus musculus
ggggtagcactggatagtctggagagagagagctcagggaggtagagggtactctccagcctgacagtggttctgcctccccggctgggtcc

SEQ ID NO: 100941 - DNA, 66 bp, Mus musculus
tgtgtgtgagagagagagagagacaggtggaaaatgaatgtgtgtgtctctgtgtgcttgtgtgca

SEQ ID NO: 100942 - DNA, 96 bp, Mus musculus
ggagggaaataaaacatgtcacagtccttttcatgataatgattctattgatctatgagcataagaggtctttcgacttgtattgtcagtctctcc

SEQ ID NO: 100943 - DNA, 105 bp, Mus musculus
gccttagtccatggtggtgtgataggatgcatgggacgtttcaatatttttatatctgttgaggcctgttttgtgaccgattatatggtcagttttggagaaggt

SEQ ID NO: 100944 - DNA, 119 bp, Mus musculus
tgctcaggatgcttttgatatctagttctcttgtgattccatatgagttttaagataattttatctatttctgtgaagaattaaatgggaattttgattaggattataatgcatctgca

SEQ ID NO: 100945 - DNA, 85 bp, Mus musculus; identical to SEQ ID NO: 57439

SEQ ID NO: 100946 - DNA, 132 bp, Mus musculus
tgtatgtatatgtatatatgtacatagctatatatgcatgtgtacatgtatgtacacgtgtatgtatatatatgtgtatatgtatatacacatatatgtatatatatatgcatatatggtgcatatatgtac

SEQ ID NO: 100947 - DNA, 85 bp, Mus musculus; identical to SEQ ID NO: 57439

SEQ ID NO: 100948 - DNA, 118 bp, Mus musculus
cctctccattcccatccccgtaattctttcagacaggaacaattatgggtcagagatgtgactgtggaatggcaaccccatccctcacttgatgtcctgttttcctgctgaaggtggg

SEQ ID NO: 100949 - DNA, 67 bp, Mus musculus
gaaaagggactggagagatggctcagcagtttagagaactgactgctcttccagaggtcctgagttc

SEQ ID NO: 100950 - DNA, 59 bp, Mus musculus
gagcctgcctgcctgcctgcttgtctgcctacagacatccaaagggcagcctggagttc

SEQ ID NO: 100951 - DNA, 87 bp, Mus musculus
ggggtgggggtctgagtttaggctagagagattgttgagtggttaagagcactgactgctcttccagaggacataggttcaaatccc

SEQ ID NO: 100952 - DNA, 115 bp, Mus musculus
gaagagacaaggcccgggggcttttaagtcactagtggttccgtttagtagatggtttgtgcattgtttcaaaatggtgccctagtgactacaaagccccagagccagcatcatc

SEQ ID NO: 100953 - DNA, 77 bp, Mus musculus
ctaggttgaggctccagctgggactggggctctgatttcatctctggctctggctctggctctggctctggctctgg

SEQ ID NO: 100954 - DNA, 60 bp, Mus musculus
taagagcactgactgctcttcctgagttcaacatggggaggggccaatcactgtttcttg

SEQ ID NO: 100955 - DNA, 78 bp, Mus musculus
gaagtcccttggaccatcctaaccaaaatattgaaaggagttttttttttcttttaatgcctggtactgagggtttcc

SEQ ID NO: 100956 - DNA, 85 bp, Mus musculus; identical to SEQ ID NO: 57470

SEQ ID NO: 100957 - DNA, 93 bp, Mus musculus
cacttctgtatttgtcaggctctgacagtgcctctcaggagacagctatattaggttcctgtcagcaatcacttcttggcatctgcaatagtg

SEQ ID NO: 100958 - DNA, 108 bp, Mus musculus
gactaaagtagataatatatgataggtatgcaatcagtgattatgttgttctaataataatttctgtatattcatgatatactttggcatctgttatcatattttatc

SEQ ID NO: 100959 - DNA, 104 bp, Mus musculus
cactatatatctatatctatgtctatgtctatatatttgtgtgtgtatatatatatacacatatatatacatacatatatatatatatatatatttatatagtg

SEQ ID NO: 100960 - DNA, 112 bp, Mus musculus
caaaaatcaaacagctgtggcaataatgtttaatacttctaggatacaatttagagtctacacttgtgattttggtgtagagaagaaagcaagctatggatgggaggcattg

SEQ ID NO: 100961 - DNA, 77 bp, Mus musculus
gaaacagtatctctctgtgcctctgtctctctctgggggagggggtgtgaggggctctttcaaatacagcagattga

SEQ ID NO: 100962 - DNA, 86 bp, Mus musculus
agggaaattacatttcctggttttataatatgaatgtatgtatgtatgtatgtatgaaatcagggtctgtctctctctatatccct

SEQ ID NO: 100963 - DNA, 85 bp, Mus musculus; identical to SEQ ID NO: 57439

SEQ ID NO: 100964 - DNA, 136 bp, Mus musculus
ggtggaagtggaaaggtaggctgggagaacattgagatctgctaaagcattgtgagtagtgaggtagaatctagaattgttttaggtctgacatccccaggactggaagagggacagatcagcttgctatcacagc

SEQ ID NO: 100965 - DNA, 93 bp, Mus musculus
gcagtgtggctggtttctgagtctttaggcagctggtccgttctcagtcttgtctgcagcttggtttgtctgagagagtctcagcagcattgt

SEQ ID NO: 100966 - DNA, 98 bp, Mus musculus
tcactcaggaaaagatatggataaggataaatctggatagtaagtatgaatgcaaagttcatttattgttgtacacttaattgcatcttagccagtga

SEQ ID NO: 100967 - DNA, 117 bp, Mus musculus
gtataaatattccttttgtgtgtggtacttatgtatatgccttcatgtgtataggcacagctgtgtgtgtgtgtgtgattgcacacatgtacctttgcatgtagggggcagagatac

SEQ ID NO: 100968 - DNA, 95 bp, Mus musculus
gtcttactgcagggagggaagccattgttcccatctggagaaaatgtgaaaagacacagcacagagggaatgtgtgcaagttcttgatagaaggc

SEQ ID NO: 100969 - DNA, 95 bp, Mus musculus; identical to SEQ ID NO: 100968

SEQ ID NO: 100970 - DNA, 102 bp, Mus musculus
agagcaattgaaaaagaagtgtttggggctggagagatggctcagcagttaagagcactgactgctcttccagaggtcctgaattcaattcccagcaaccac

SEQ ID NO: 100971 - DNA, 118 bp, Mus musculus
gtataaatattcctttttgtgtgtggtacttatgtatgtgccttcatatgtataggcacagctgtgtgtgtgtgtgtgattgcacacatgtacctttgcatgtaggggccagagatac

SEQ ID NO: 100972 - DNA, 116 bp, Mus musculus
agtagatatagctaattattattttcatttggacatgccttcacatggtgaagaatattaatttttccacttcagaaatgctggtgattaaatggcatagtatagtcagagctact

SEQ ID NO: 100973 - DNA, 112 bp, Mus musculus
cagagaatggataaatggaaggtagacccttgattcataacacactttgtatatctgtgtactgatatggctgacaaagtgtttagaactgcaaacatgggccagatctttg

SEQ ID NO: 100974 - DNA, 96 bp, Mus musculus
ccctcactcctgggtgtgtgtgcatgtgcatgagcatatatgtgtgtgcatgagcatatgtgtgtgcatgccacagcaaatgcagaggtcagaggg

SEQ ID NO: 100975 - DNA, 97 bp, Mus musculus
tgtgtgtgtgtgtgtatgtgcatgtggagcatgtggaatctagagaacaatctcagatactatatttttttaaatgagacagaatcacacactggca

SEQ ID NO: 100976 - DNA, 87 bp, Mus musculus
ctttgggcagacagtctcacagagtcaaactttccactatccaaaaggggacactgaggtgcttgctgttgtggggctaggcagaag

SEQ ID NO: 100977 - DNA, 91 bp, Mus musculus
gccatgaaaatcactgggtttcagtctctgtgtgtgtgaatacccgccccccccacacacacacacaacacaaacctagggcattttaagc

SEQ ID NO: 100978 - DNA, 85 bp, Mus musculus
gacagaacccaggatgtccctatcgaaggctgcatccccagagatcctagaggacagttgggagtcagcacaggtgtcactcctg

SEQ ID NO: 100979 - DNA, 92 bp, Mus musculus
gggtaatgtttgtcaaagtctgaagtaagtgaggagaaagactcagaggtcatcctacctgctaagtactagttgttgatctgtgttttccc

SEQ ID NO: 100980 - DNA, 115 bp, Mus musculus
ggcattcaggaactaatttgttgggctggagaggtggctcagcggttaagagcactgactgctcttccagaggtcctgagttcaattctcagcaacgacatggtggctcacaacc

SEQ ID NO: 100981 - DNA, 118 bp, Mus musculus
gtgacttctcctttgccccagttagaagtgtgagtggctcctgagaactttctgtcacagacactctgctttggttgccacttcaggcttgagaacattgtgcgtgtggggaaggggc

SEQ ID NO: 100982 - DNA, 65 bp, Mus musculus
ggaggctgcctgggtccgtcactggctagcagggttagagtgtgggaactaggcagaaaaattcc

SEQ ID NO: 100983 - DNA, 91 bp, Mus musculus
gggtagggtcaagagtagaatggtactgtagaatgatagcacagagggtgaacacattaattccatcagcccatgagtctttactgagccc

SEQ ID NO: 100984 - DNA, 113 bp, Mus musculus
ggtacatgtatagaaggctaagggttttgtttttgggagaacaaacagtggtaagatgaggaggctcagattgaccactcagtacctttcacaaaccccttagtgtaggggcc

SEQ ID NO: 100985 - DNA, 84 bp, Mus musculus
tgggtttcagagatcaaagtgaggtcattgagctgggcaacaggtgcctatagccactgaaccatctctctggtctagttctca

SEQ ID NO: 100986 - DNA, 109 bp, Mus musculus
gggttcagagattcagtccattatcatggcagacacagtgctgggggagagagaagagactgtgcactacactaagtgtagcctgaacatatatgaaacctggaagccc

SEQ ID NO: 100987 - DNA, 66 bp, Mus musculus
acatacacacatgtatatgtgtatatatatacatgcatatgtatatacatatacatgtatgtatgt

SEQ ID NO: 100988 - DNA, 71 bp, Mus musculus
tcttctggtaacatcatgctcagtgatgaaagattgcaaccttttctcctaacagcaggtgtaatagaaga

SEQ ID NO: 100989 - DNA, 117 bp, Mus musculus
gtaccaaatacagttggagaaggggctgaagttctagtgggtcttaaaatcatttattgttattaattactactaccactacatgcatttctgatcttcttatgtgtgtgtaggtgc

SEQ ID NO: 100990 - DNA, 117 bp, Mus musculus
cttagggctggagatgaaattagcatgttgttaaattgtccatattgcattatattgtggaagtcatatgattaagttaatatcagtgggataagaaagtgtgtatcttgtcaatag

SEQ ID NO: 100991 - DNA, 63 bp, Mus musculus
ctccctctctgtctgtgcatgctttttgtgactctctgtctcatgcatgcataagaatgggag

SEQ ID NO: 100992 - DNA, 79 bp, Mus musculus
gaagttaaatgggaatggaaagatggctcagcagttaagaggtcctgactgctcttccagaggtcctgagttcaacttc

SEQ ID NO: 100993 - DNA, 91 bp, Mus musculus
gtttgttctcaagtgtcgtgagttactagtattgcagttttccctagtatgtaggaaggcttagtagtgtgtcattaataatgggaacaac

SEQ ID NO: 100994 - DNA, 105 bp, Mus musculus
ccacttaaaggtcttcagagctggtgggctactggaaggtcaaagtatttaaatatttacaatagatggctcatttaatgccagcttgttttttttcccccttgg

SEQ ID NO: 100995 - DNA, 81 bp, Mus musculus
ccacaaattgtgtgtagttttagtcatttttgcttttgtgtcttactcagtgagcttatgatggaactatataggacatgg

SEQ ID NO: 100996 - DNA, 111 bp, Mus musculus; identical to SEQ ID NO: 69966

SEQ ID NO: 100997 - DNA, 114 bp, Mus musculus
gtccattaatattgagagatattaaagagagatgactgttgcttcctgatatgtttgtttttatagatggctttatgtgccggtggttctctcctcttggttttgttgtgagat

SEQ ID NO: 100998 - DNA, 85 bp, Mus musculus; identical to SEQ ID NO: 60314

SEQ ID NO: 100999 - DNA, 109 bp, Mus musculus
gactagtaagagtatatttttatgtataagcaatccatgatctttgaaaaagaggtagttttttttaaagatttatttattttatgtatgtgagtacactgtggctgtc

SEQ ID NO: 101000 - DNA, 114 bp, Mus musculus
ctgcgcccctgctcccgttgtacctgtagaagtgcagggactggggctctctccgtgtctccctgtcttgccatcctcacttcccgggcccagcctgagttcgtgttggcccag

SEQ ID NO: 101001 - DNA, 96 bp, Mus musculus
atatgggattcctgtcatatgtgcatatacatatatgtacacatataaatatgtatacatatacatctatatacatatatgaatacatatacatat

SEQ ID NO: 101002 - DNA, 102 bp, Mus musculus
gtttacatgtataggtatatgtatataaatgcatatgcgaagttatatatatttgtatacgtatatatgtatatgtattcatatatgtatatagatgtatat

SEQ ID NO: 101003 - DNA, 114 bp, Mus musculus
ctatatgtataggcatatatgtatatatgactatgtatatacatatatatgtatatataggtataggtataccagtatatatatctatatgtatgtgtatatatatatatgtat

SEQ ID NO: 101004 - DNA, 148 bp, Mus musculus
tatacacatacatatatgtacatgtaaggatatgcatagctatatatgtatatatgcatgtatatatgtatgtatgtttaggtatattcatatatatgtatatatatgcatatatatttatgtatatgtatatatgcatgcatacctg

SEQ ID NO: 101005 - DNA, 65 bp, Mus musculus
agcttgactgtagagagtgctctgaccacagaaactcaggagagagctagtctcccaggtctgct

SEQ ID NO: 101006 - DNA, 117 bp, Mus musculus
cctgaaatgttttgtttaaaaagaaagtgcctggggcaggagagatggctcagtgtttaagagcactgactgctcttccagaggtcctgaattcaatttccagcaagcacatggtgg

SEQ ID NO: 101007 - DNA, 61 bp, Mus musculus
gagatactgagacagagcagagaagcatgataacctgcatctctctctctctctctctctc

SEQ ID NO: 101008 - DNA, 102 bp, Mus musculus
ctctctctctctctctcacacacacacacacacacacacacacacagagtttgtctctctctgtgtattcacggggtggggttggggggagtgttggatggg

SEQ ID NO: 101009 - DNA, 61 bp, Mus musculus
gagatactgagacagagcagagaagcatgataacctgcatctctctctctctctgtctctc

SEQ ID NO: 101010 - DNA, 61 bp, Mus musculus; identical to SEQ ID NO: 101009

SEQ ID NO: 101011 - DNA, 61 bp, Mus musculus; identical to SEQ ID NO: 101009

SEQ ID NO: 101012 - DNA, 74 bp, Mus musculus
cacaaacatatacagagcatgtctctctctctatgtatcacagggtgggggtgtgggggggtgttggatgggtg

SEQ ID NO: 101013 - DNA, 72 bp, Mus musculus
cacacagaaacacacacagtttgtctctctctgtgtatcacggggtgggggtgggggggggttggatgggtg

SEQ ID NO: 101014 - DNA, 108 bp, Mus musculus
gagtagcaccaagatgtggggctggaaaggtgattccctaggttaagagcacatactgctcttgcagaggacttaagttttattcccagtacccatgctaggcagctc

SEQ ID NO: 101015 - DNA, 93 bp, Mus musculus
gacatagctcaccgtggatatgttgttggaaactgtatcttctgctctgtgcatctctgtctctgccacatgtcacatgtcacatgctctgtc

SEQ ID NO: 101016 - DNA, 101 bp, Mus musculus
gcaccaggaaatgtgacctttgaacttgtcagtgtctctctaagtgcctccagctacttggggggggggggggcgggcgggggcacatgcggccactgtgt

SEQ ID NO: 101017 - DNA, 81 bp, Mus musculus
tgcatctgtgtgtctgcatgtgcatgtgcaattttctatgcagtttttagttacatgtacattttgaggacaactggagca

SEQ ID NO: 101018 - DNA, 66 bp, Mus musculus
tatctatacatacatatatatgtgtatatatgtatatatgcatatatatctgtatatgtatatata

SEQ ID NO: 101019 - DNA, 80 bp, Mus musculus
aggtgctcaggcatcctcctttgggtcctccttgttatttatactttcttcgggtctgtggattgtagtgtgggtatcct

SEQ ID NO: 101020 - DNA, 85 bp, Mus musculus; identical to SEQ ID NO: 57470

SEQ ID NO: 101021 - DNA, 106 bp, Mus musculus; identical to SEQ ID NO: 83200

SEQ ID NO: 101022 - DNA, 81 bp, Mus musculus
taacttctgtaactttcactgtgtctctgtatagtttctgtttcaaggatctgtccattgatgaaagtggggagttgaagt

SEQ ID NO: 101023 - DNA, 68 bp, Mus musculus
ggaggtagtgggttgctgaagatgggctttgaggtttcaaaagccaggcagtctctctctgtcactct

SEQ ID NO: 101024 - DNA, 85 bp, Mus musculus; identical to SEQ ID NO: 57439

SEQ ID NO: 101025 - DNA, 96 bp, Mus musculus
gatcgtaattaatctgtggtgatctgataggatgcatgggataatttcaatatttttgtatctgttgaggactgttttgtgaccaattatatggtc

SEQ ID NO: 101026 - DNA, 106 bp, Mus musculus
gccttagtccatggtgatctgataggatgcatgggacaatttcaatatttttgtatctgttgaggcctgttttgtgaacaatcatatggtcaattctggagaaggt

SEQ ID NO: 101027 - DNA, 79 bp, Mus musculus
gccaagctcagtctcagtcactgtctgtggagtcctgtttatatccctccaaacatgacgtgtctgccaggggcattgc

SEQ ID NO: 101028 - DNA, 71 bp, Mus musculus
ttggtgaggctgtcactgaactctgtgaggagagaactctttcagtcaatgaacttgaatgcttcagccag

SEQ ID NO: 101029 - DNA, 126 bp, Mus musculus
accataaaattacttgcattgcttcttcataactgtaattttgccactgttatgaattggaatgtaaacaagtgatttgcagggtatctgatatgcaacccctgtgaaagggttgtttgatcccca

SEQ ID NO: 101030 - DNA, 85 bp, Mus musculus; identical to SEQ ID NO: 57470

SEQ ID NO: 101031 - DNA, 108 bp, Mus musculus
agccttattccatggtgatctgatgtgatgcatggtaaaatttcaatatttttgtacctgttgaggcctgttttatgatcaaatatatggtcaattatggagaaggtt

SEQ ID NO: 101032 - DNA, 101 bp, Mus musculus
ttcccccatttaaaggcaggcaggattggtgaggtagatgcatgtattagtttagtttctactactgtgacaaacaccaaaccaattgcaactggagagaa

SEQ ID NO: 101033 - DNA, 89 bp, Mus musculus
tagagtccttttatctgtaacttatattcccccttgccaggaatcatccatagttccagcttgaggggattgaagtgagggaaactcta

SEQ ID NO: 101034 - DNA, 69 bp, Mus musculus
gtgatggtgtgtgggtagagaaatgaaatgttttcagtcaacactcatatcagtgaacacacacagcac

SEQ ID NO: 101035 - DNA, 86 bp, Mus musculus
gctctggctagtacttcaagtactatgttgaatagatagggagaaagtgggcagccttgtctagttcttgaatttagtcagattgc

SEQ ID NO: 101036 - DNA, 85 bp, Mus musculus; identical to SEQ ID NO: 69220

SEQ ID NO: 101037 - DNA, 82 bp, Mus musculus
gtgctgagagtggagatagaggtcaaatccccagtgtgcaaaattaggggcattacacaaaaccttctcctaggctcatcac

SEQ ID NO: 101038 - DNA, 94 bp, Mus musculus
tcaatgactattgttctcaagaactgtactgatatatttcttggcttgatactcaagcttagtacattcaaaagaggacagctttaaaatttga

SEQ ID NO: 101039 - DNA, 94 bp, Mus musculus; identical to SEQ ID NO: 101038

SEQ ID NO: 101040 - DNA, 114 bp, Mus musculus
gttcccttcttatgcctgtaacacagggtagttgggaggctgaggtagaaggatcgtatgttcaatgcctgtctgagtcaactataaagtgagttctaggccagtgtgggtaat

SEQ ID NO: 101041 - DNA, 96 bp, Mus musculus
gatcagccttagtccgtggtgacctgataggatgcatgggataatttcaatatttttgtatctgtggaggcctgttttgtgaccgattatatggtc

SEQ ID NO: 101042 - DNA, 85 bp, Mus musculus
gtccatggtcatcagataggatgtatgggataatttcaatatttttgtatgtgttgacacctgttttgtgaccaaatatatggtc

SEQ ID NO: 101043 - DNA, 92 bp, Mus musculus
tcctctgatatctatatgtatatctatatctatatctatatctgtatatgtatatatatatgtatatatatgaggatatatatagcagagga

SEQ ID NO: 101044 - DNA, 106 bp, Mus musculus
gtactatctacgtctcaatggggcacaattcttgagttattgttttactgatctccatgtaggaaataacaagaagaatttaaataatttgaaacttagattctac

SEQ ID NO: 101045 - DNA, 102 bp, Mus musculus
gaccaggcaactgtatgatgacttctgtatccatataagacatcaaaatagaggatcttaaagtatttttttttcaggagtaacgtaatagttgttgttgtt

SEQ ID NO: 101046 - DNA, 85 bp, Mus musculus
ggccatggtggtctgataggatacatgagacaatttcaatatttttgtttctgttgaggcctgttttgtgaccaattatatggtc

SEQ ID NO: 101047 - DNA, 83 bp, Mus musculus
gctggatgtagatgagggaagttctttcctgtaggagggtggaaacctgtacaagtagaggggaaagttgattggcatctagt

SEQ ID NO: 101048 - DNA, 143 bp, Mus musculus
tatgtatgtatgtatgtatgtatgtatatatgtatatatgtatgtatgtatgtatacacacatatataatacatatatatatatacatacacatatatacagatgtacataaatacatacacatatgtgtatatatatatata

SEQ ID NO: 101049 - DNA, 61 bp, Mus musculus
ggaccagtgagagaggtcagtgggttatgacagttgtcataaagcctgacaactcaagttc

SEQ ID NO: 101050 - DNA, 72 bp, Mus musculus
cggctatgggaaccacagaaggcagagagcacaggagactcagggttctcagcagggctctcagcagggctg

SEQ ID NO: 101051 - DNA, 94 bp, Mus musculus
agcatgaaggcacaagagtaggaactcactgatcacactgtggccacagagaagagaaagaggtgaattcctgtactcagcccactttcttgct

SEQ ID NO: 101052 - DNA, 85 bp, Mus musculus; identical to SEQ ID NO: 57470

SEQ ID NO: 101053 - DNA, 105 bp, Mus musculus
gccttagtccatgtgatctgatagaatgcatgggacaatttcaatatttttgtatatgttgaggcttgttttgtgaccaattatgtggtcaattttggagtaggt

SEQ ID NO: 101054 - DNA, 112 bp, Mus musculus
ctggatatgttacttgaccttcttcccttactgtttttaatattctatctttatttagtgcatttgttgttctgattattatgtgtttggaggaatttcttttcttgtccag

SEQ ID NO: 101055 - DNA, 118 bp, Mus musculus
attattgacaatcagcctttgtccgtggtgatctgataggatgcatgggataatttcaatatttttgtatctgttgaggcctgttttgtgaccaattatatagtcaattgtggaggat

SEQ ID NO: 101056 - DNA, 104 bp, Mus musculus
ccttagtccatggtgatatggtaggatgcatgggacaatttcaatatttttgtatctgctgaggcctgttttgtgcccaattataggatcagttttggagaagg

SEQ ID NO: 101057 - DNA, 109 bp, Mus musculus
gcataagagaaattggtctgaggttcactttccttgttgaacctttgtgtggtttggttatcaaggtgattgtggcctcataaaatgaatttggcaatgatccttctgc

SEQ ID NO: 101058 - DNA, 113 bp, Mus musculus
gtaccaaatacagttggagaaggggctgaagtactagtgagtcttaaaatcatttattgttattaattactactaccactacatgcatttctgatgtgcttatgtgtgtgtac

SEQ ID NO: 101059 - DNA, 107 bp, Mus musculus
tcccttttatggagaattgtcctccgcctcggatgtgtcgctccctgattggctgcagcccatcggccgagttgtcgtcacggggaaggcagagtacatggagtgga

SEQ ID NO: 101060 - DNA, 107 bp, Mus musculus
tcccttttatggagaattgtcctccgcctcggatgtgtcgctccctgattggctgcagcccatcggccgagttgtcctcacggggaaggcagagcacatggagtgga

SEQ ID NO: 101061 - DNA, 114 bp, Mus musculus
gttcccttcttatgcctgtaacacagggtagttgggaggctgaggtagaaggatcttatgttcaatgcctgtcggagtcaactataaagtgagttctaggccagtctgggtaat

SEQ ID NO: 101062 - DNA, 71 bp, Mus musculus
atgtatacatctatatatgtacatatttgtatgtatacatctatatatgtacttatatttagtgtatatat

SEQ ID NO: 101063 - DNA, 65 bp, Mus musculus
ggatctcaggttctcagaggaatcttgactgccaagaactctgacacacccagaatctcaggttc

SEQ ID NO: 101064 - DNA, 101 bp, Mus musculus
ggccgaccgtctggagctgaagatggtgccgccccagaatctctgtgactctctcgcccgtcccagaaatggctggcactctgtattccacagggtcaccc

SEQ ID NO: 101065 - DNA, 78 bp, Mus musculus
gcatgtttacttttgtgtttgtacatgtatatacatgtgtgtatatacatgtatatatttaagttcatgtgcagatat

SEQ ID NO: 101066 - DNA, 109 bp, Mus musculus
cattctcttcattgaaactacattcattatacctataccattcaacagaataacatttcacagcttttttgttgagtgtgggcatatttgtttctgtgaaaacagtgag

SEQ ID NO: 101067 - DNA, 85 bp, Mus musculus; identical to SEQ ID NO: 57439

SEQ ID NO: 101068 - DNA, 96 bp, Mus musculus
gatcagccttagtccatggtggtctcataggatgcatgggacaatttcaatatttttgtatctgttgaggcctattttgtgaccaattatatggtc

SEQ ID NO: 101069 - DNA, 116 bp, Mus musculus
ttgaagattagccttagtccttggtgattgtataggatgcatgtgataatttcaatatttttgtatctgttgagtcctgttttgtgatcaattatatggtcaattttggaggaggt

SEQ ID NO: 101070 - DNA, 85 bp, Mus musculus; identical to SEQ ID NO: 57439

SEQ ID NO: 101071 - DNA, 85 bp, Mus musculus
ggccgtggtggtctgataggatacatgggacaatttcaatatttttgtatctagtgaggcctgttttgtgaccaattatatggtc

SEQ ID NO: 101072 - DNA, 108 bp, Mus musculus
ccagtgcagaaaacagatggatcatggagaatgacagttgattattgaaaactaaatcagtaactccaattgcagctgctataccagatgtagtttctttacttgagg

SEQ ID NO: 101073 - DNA, 85 bp, Mus musculus; identical to SEQ ID NO: 57439

SEQ ID NO: 101074 - DNA, 85 bp, Mus musculus; identical to SEQ ID NO: 57439

SEQ ID NO: 101075 - DNA, 104 bp, Mus musculus
aatgctttaatgtgataggtcagggaaaattctgcaagagttgtgaatttgtattattgatttcagccactctatctcccaagacaattacttgttatagtatt

SEQ ID NO: 101076 - DNA, 101 bp, Mus musculus
gtggtccctgcccaacctaaacacagtctgcagtctctgtctccctgtcctctgtaagcaaatggactgaggaagttttgggtcctgggcaaggcagcctc

SEQ ID NO: 101077 - DNA, 85 bp, Mus musculus; identical to SEQ ID NO: 57439

SEQ ID NO: 101078 - DNA, 81 bp, Mus musculus
tgtcctctgcctcggatgtgtcgctccctgattggctgcagcccatcggccgagttgtcgtcacatggaaggcagagcaca

SEQ ID NO: 101079 - DNA, 76 bp, Mus musculus
gaacttctgctgtagagccagagagaataaagcagggcgtcccctgatgatttctctctgactctgggagagtttc

SEQ ID NO: 101080 - DNA, 79 bp, Mus musculus
gctatttctcagtctctctctctgcatccattagttacttatggctctctgtctagggatgggactctcatgagatagt

SEQ ID NO: 101081 - DNA, 118 bp, Mus musculus
gagttttacagaggaattatatttcagggttttatttgactatacattttattttgtaaaattatcatgttgggtcatattgaagctcagaagtgtagacatacccaaattgctactc

SEQ ID NO: 101082 - DNA, 101 bp, Mus musculus; identical to SEQ ID NO: 59975

SEQ ID NO: 101083 - DNA, 112 bp, Mus musculus; identical to SEQ ID NO: 71922

SEQ ID NO: 101084 - DNA, 114 bp, Mus musculus
tggagcatcttctaggtatatgcacaggagtggtatagctgagtctcaggtagtactatgtccaaatttatgaggaactgagataccacactgataaccatagtggttgtacca

SEQ ID NO: 101085 - DNA, 106 bp, Mus musculus
tcaattatgtcaatggtattttctgcatctaatgagatgaatgtgttttttttttctttcagtttgtttagatgttaggttatacttattgattttcatatattga

SEQ ID NO: 101086 - DNA, 87 bp, Mus musculus
gggacatttcaaattgaatacagaagtctggagatagcttgagattctaaactgctctctctttgccactgcatcaatgcctgtccc

SEQ ID NO: 101087 - DNA, 85 bp, Mus musculus; identical to SEQ ID NO: 57470

SEQ ID NO: 101088 - DNA, 85 bp, Mus musculus
tcttacagaagattttcagttccatgaggttctatttatcaatttttgatcttatggccttagcccactggtattctgttcaaga

SEQ ID NO: 101089 - DNA, 104 bp, Mus musculus
tgggaacagatccagaaccctaaagatctgctaaaattccatcttcagtgattagttgagatttgaaattgttgttgagattgggggatacagtctgtgaccca

SEQ ID NO: 101090 - DNA, 117 bp, Mus musculus
atcagccttagtccatgatgatctgatagtttgcatgggaaattttcaatatttttgtatctgttgaaatgtgttttttgaccaattatatggtcagttttggagaggtaccatgat

SEQ ID NO: 101091 - DNA, 115 bp, Mus musculus
tccttggccacttcgtgcatgttgagcaggctctggttgatcagcatctccatgtggaaggcacattccatggcttgaaatcccccgtgccagctgtcacgttctggtctcgcga

SEQ ID NO: 101092 - DNA, 85 bp, Mus musculus; identical to SEQ ID NO: 57439

SEQ ID NO: 101093 - DNA, 105 bp, Mus musculus
taaattccaaagatgtaatattttactaaggaaatgaagagtcaatttatgtctcttgatgaatctttttaaattatatatttttgatatgaaaatttgaattta

SEQ ID NO: 101094 - DNA, 115 bp, Mus musculus; identical to SEQ ID NO: 101091

SEQ ID NO: 101095 - DNA, 108 bp, Mus musculus
tatgcatacacagatgttcaggcaaaacatgagtataaatatttaattaaaaatttaaatgtaatgagcatgtttatctatatatttgtgcatctctttatatgtata

SEQ ID NO: 101096 - DNA, 117 bp, Mus musculus
tgtgttgaggttcagttcccctttcgtccagtatggccattctgtctgtgtgtgtccctgcagtggaccagtatcgacaggaagagaagagtctgagacaaggttttcacagataca

SEQ ID NO: 101097 - DNA, 115 bp, Mus musculus; identical to SEQ ID NO: 101091

SEQ ID NO: 101098 - DNA, 99 bp, Mus musculus
tgtagatttttttttccaggcctttactgtgaggtagtatctgtctctatcactgaggtaggtttcctgtatacagcacaattttgggtcttgtttaca

SEQ ID NO: 101099 - DNA, 85 bp, Mus musculus; identical to SEQ ID NO: 57439

SEQ ID NO: 101100 - DNA, 114 bp, Mus musculus
ggccagccttagtccatggtgatttgataggatgcatgggaaattatcaatatttttgtatctgttgaggcctcttttgtgaccaattatattgtcaattttggagaaggtacc

SEQ ID NO: 101101 - DNA, 76 bp, Mus musculus
aatatatctgttcacacacacacacacacacacacacacacacacacacgtttgtgtgtgtgtgtatagatatatt

SEQ ID NO: 101102 - DNA, 85 bp, Mus musculus; identical to SEQ ID NO: 57439

SEQ ID NO: 101103 - DNA, 85 bp, Mus musculus; identical to SEQ ID NO: 57439

SEQ ID NO: 101104 - DNA, 85 bp, Mus musculus
ggccatggtggtctgataggattcatgggacaatttcaatatttttgtatctgttgaggcctattttgtgaccaattatatggtc

SEQ ID NO: 101105 - DNA, 105 bp, Mus musculus
tttgaaaaattccagttaccatattttggcttttgattgtgctttgtcatgatatatttttaaaatatttcatgaagtagaaacatacaagttaggtaattcaaa

SEQ ID NO: 101106 - DNA, 115 bp, Mus musculus; identical to SEQ ID NO: 101091

SEQ ID NO: 101107 - DNA, 117 bp, Mus musculus; identical to SEQ ID NO: 101096

SEQ ID NO: 101108 - DNA, 108 bp, Mus musculus
tttctgtctctctctgtgtacacacacacacacagacacacacagagacagacagagatagagacagaggtgtgtgtgtgtctgtatctctctctgtttgtgtgtgtg

SEQ ID NO: 101109 - DNA, 115 bp, Mus musculus; identical to SEQ ID NO: 101091

SEQ ID NO: 101110 - DNA, 85 bp, Mus musculus
ggccatggttgtctgataggatgcatgggacaatttcaatatttttgtatctgttgaggtctgttttgtgaccaattatatggtc

SEQ ID NO: 101111 - DNA, 85 bp, Mus musculus; identical to SEQ ID NO: 57439

SEQ ID NO: 101112 - DNA, 107 bp, Mus musculus
tgaggttttacatcacttttagaaactggtaaattattcaaaagtaacttttgtttatatatatgtgcttaagtgaaaaacaaccagttggtgcttctacaacttca

SEQ ID NO: 101113 - DNA, 107 bp, Mus musculus
taggtcagtgtttatgttgctcctttctacctatcaggaaaaataaacatagcatttatgtttgtctctctctgtcttaggttgataggagatcaagaatactctta

SEQ ID NO: 101114 - DNA, 92 bp, Mus musculus
cacatcctcatcatcatgtactgtgacttgagtttttgatcttaaccattctgatgggtgtaaaatggaatctcaagtcattttgatttgtg

SEQ ID NO: 101115 - DNA, 73 bp, Mus musculus
gggtcagtctctgagtgtcaccaaggatccaggttagttgactgtgttggtttttctgtagagatcctgtccc

SEQ ID NO: 101116 - DNA, 85 bp, Mus musculus; identical to SEQ ID NO: 57439

SEQ ID NO: 101117 - DNA, 128 bp, Mus musculus
ctaatagaaaaagaaatttagaaaaagtagtgcaggcttacaaacattttttttctgaatatgttgttctgttggttcataggaaagcataacttgaagaagaaaagtacaaagtgtaagaaaaatgc

SEQ ID NO: 101118 - DNA, 85 bp, Mus musculus; identical to SEQ ID NO: 57439

SEQ ID NO: 101119 - DNA, 96 bp, Mus musculus
tcattatccatcatagggcattttagactgttttcattttctagttgtaaatagagcagcaatgaacatggctgagcaagcatgtgtggattatga

SEQ ID NO: 101120 - DNA, 85 bp, Mus musculus; identical to SEQ ID NO: 57439

SEQ ID NO: 101121 - DNA, 92 bp, Mus musculus
acatatgtatatgcacagatgtttataaatatatgtacatatgtatacatgtgcatacatacatatattcctatatgtgcatatatatgtgt

SEQ ID NO: 101122 - DNA, 85 bp, Mus musculus; identical to SEQ ID NO: 57439

SEQ ID NO: 101123 - DNA, 115 bp, Mus musculus
gtcgacaaatggtgctagccaaactggttagctgcaagaagactgaaagtatatctatatttatcctccatcagaaatctcagctccatatggatcaaggacctcaatacaagac

SEQ ID NO: 101124 - DNA, 102 bp, Mus musculus
aagctctctgtgtcctgaaacttagtgtacagttacgagacataatcaagaggaagacttgtaaattagtaaatctataggtcagggtacacaggatggttt

SEQ ID NO: 101125 - DNA, 111 bp, Mus musculus
gctgagattaaaatgttaaatgtaagaggcaattgcaaggtcattatttttttctaagtaatgaaaatatagtacttgatccattgtaaaattacaggctaatgactcagt

SEQ ID NO: 101126 - DNA, 71 bp, Mus musculus
gggcaggcagacttgtaatgccacctcataggaaggttgaggtggaaggatcacaagttccagtcctgcct

SEQ ID NO: 101127 - DNA, 98 bp, Mus musculus
ccactggcaattccaaatgctaacaaatgctttgtcatcattactgttctctgtgtgtctgtcaatcttgcgtactatggtagttggaatgagaatgg

SEQ ID NO: 101128 - DNA, 83 bp, Mus musculus
ccaaagcatgctgaaggtctgctaggtcaagcacctactgtgtgtctcagtgtttctgcctcaaagattttccagtgtcatgg

SEQ ID NO: 101129 - DNA, 95 bp, Mus musculus
gatcagccttagtccatggtgatctgataggatgcatggacaatttcaatatttttgtatctgttgaggcctgttttgttaccaattatatggtc

SEQ ID NO: 101130 - DNA, 110 bp, Mus musculus
aatgcagtttagtgtagagagacatttttctttttaagtcaaggtcattttagtttattttttctttaaggatagatttgaaaagttgctgctacccaggaataagcatt

SEQ ID NO: 101131 - DNA, 97 bp, Mus musculus
tgctatgaaccacaatctgttcagtggacaagattaggagtgaactgctgagctcgctctttctgtctgtcacactgagtaaagactcttggaggca

SEQ ID NO: 101132 - DNA, 61 bp, Mus musculus
ttagagtgaactaatgtgctctctgcctctgtcttacagaggatggtagagttctctctga

SEQ ID NO: 101133 - DNA, 59 bp, Mus musculus
actgtgtctgtccatcggtctgtctatgtctcaaaggatggatggatggctgactctgt

SEQ ID NO: 101134 - DNA, 78 bp, Mus musculus
tacccttctgtttgtctgtgtgtctgtccatctgtctatgtctggaaggatggctggtgcctgtcaaacctgtttgta

SEQ ID NO: 101135 - DNA, 80 bp, Mus musculus
agtttctgtatgtatatatacacatatatatacacatatatatgtgtgtatgtatgtatatatatatgcatgctaggatt

SEQ ID NO: 101136 - DNA, 121 bp, Mus musculus
atatatgtgcacatttgtatgcatatatcatacatatatgtatatgtatacatgtgtgtttacatatatatgtatttatacttatgtacatgtattcatgtgtgtatatgtgtctgcttat

SEQ ID NO: 101137 - DNA, 94 bp, Mus musculus
tatatgcatatatacatgaatccatgtgggtatatgtgtgtgtgtgtatatatatatatatatattcatgtgtttatatgtgtatatgtatata

SEQ ID NO: 101138 - DNA, 106 bp, Mus musculus
gccttagtccaaggtgatctgataggatgcatggggtaatttcaatatttttgtatacattgaggcttattttgtgaccaattatgcggtcaattttggagaaggt

SEQ ID NO: 101139 - DNA, 113 bp, Mus musculus
tttttagtacctttggtctatcatattggcattgttttatatatatatatatatatatatatatatatatatatatatatatatgcttttaagtagccaaaggataagaggaa

SEQ ID NO: 101140 - DNA, 86 bp, Mus musculus
ttctgactcttggatacagtatcatatatattattgatcatttattatatattgcattaatgtgtataaccatctgggtgtcagaa

SEQ ID NO: 101141 - DNA, 135 bp, Mus musculus
atactttatatatatatatatatatatatatatgtgtgtgtgtgtgtgtgtacacgtatatatgtatatgtttgtgtatacatttatatgtgtgtgtgtgtgtgtacacgtatatatgtatatgtttgtgtatac

SEQ ID NO: 101142 - DNA, 59 bp, Mus musculus
taggattctactctgtttgatcttgtgtcttggacttggaaaaggcagagagaagcctg

SEQ ID NO: 101143 - DNA, 110 bp, Mus musculus
gtttccaatttggcatctcttttatagaatcacaaactgcaaatgtcaatttttataattgaccagaactatagcagtgggaaaatggaggagacaagagtacggatatc

SEQ ID NO: 101144 - DNA, 128 bp, Mus musculus
atatatatatgtatgtatatatatgtacatatatatgtatgtatatatatgtacatatgtatgtatgtatatatacatatgtatgtgtgtatatgcgtatatatatatatatacatatatatatatac

SEQ ID NO: 101145 - DNA, 82 bp, Mus musculus
gtctcttgagtttttgatcttggctattctgatggtctaagacagaatgtcagggtcgttttgatctgtatttcctgaagac

SEQ ID NO: 101146 - DNA, 98 bp, Mus musculus
tcttaaaggtagttaaaatgtgtttgctattataatgattaaagcatttatttttttcttgatcacagtgatagtaggttcactttaatacctcaaga

SEQ ID NO: 101147 - DNA, 79 bp, Mus musculus
gccaagaagtttatgctgacaggagcctgatatagctgtctcctgagaggctctgtcagtgtctgacaaatatataggc

SEQ ID NO: 101148 - DNA, 84 bp, Mus musculus
ttttactgtagtctacttacaaaatttccaaagttgtatggaaatacaatgaatggaaaataaagtgtgacaaaggcagaaaaa

SEQ ID NO: 101149 - DNA, 58 bp, Mus musculus
ggattgctggtgggattgcaacctggtacaatcactgtgtaaatctctctggcagttc

SEQ ID NO: 101150 - DNA, 73 bp, Mus musculus
cacgtgtctgtgtcgctgctgagacatgcggtgaatggtaccgtcagtgaaatgagagagatcagacaaagtg

SEQ ID NO: 101151 - DNA, 85 bp, Mus musculus; identical to SEQ ID NO: 57439

SEQ ID NO: 101152 - DNA, 98 bp, Mus musculus
tacaagttgtgtatgtgtgtttgtatatatgtattatgtctgtctgtctgtctgtctgtatgtatgtatgtatacgcacatatatacatagtactgta

SEQ ID NO: 101153 - DNA, 115 bp, Mus musculus
aaactgagaaaaaagaatagaatattttaggactttggaaagtagttacctttggattcttatgaagtgtctgacaaggttctgataatattttgtttctagacttgtgtagttt

SEQ ID NO: 101154 - DNA, 96 bp, Mus musculus
gatcagccttagtccatggtgatctgataggatgcatgggtcaatttcaatatttttgtatctgttaaggcctgttttgttaccaattatatggtc

SEQ ID NO: 101155 - DNA, 77 bp, Mus musculus
catgtatgtattgtgtatgtattatgtgtatatatatatatatatatatatatatatgctaatcaaatctgtgcatg

SEQ ID NO: 101156 - DNA, 145 bp, Mus musculus
tgtctctgtctgtctgtctgtctgtctctctctccatatatatatatatgtatatatatatatgtatatatatatatatatacacacacacacacacacacacacacgcgcgcgcgcgcgcgcgcgtgtgtgtgtgcgtgtgtgt

SEQ ID NO: 101157 - DNA, 157 bp, Mus musculus
atatatataatatatatgaatatatgtttatatatacaaatatgaatatatccagtataaatatatatgtgtgtatatatatatatatgtgtgtgtgtatatacatatttatttgcatatacaagcatgtatgtatatatatacatatatatatatg

SEQ ID NO: 101158 - DNA, 102 bp, Mus musculus
gctgttacttcaggaatagctgtaaagaagcagcagataatggtaataacatgctttaaccagtctgctcctttccaaccagccaccccttcgcatttcagc

SEQ ID NO: 101159 - DNA, 102 bp, Mus musculus
ctctgttgttgatttcctagattagttatataacttgggtttatgaatagtattgaagtaaatattaatccccaggattttttgtgacatgttaacttggag

SEQ ID NO: 101160 - DNA, 86 bp, Mus musculus
aagcatgaagcagagagaatgaaccagaaaatggtttgaagcttttcattttatagtctgaccctcagtgcctccgtgacatgctt

SEQ ID NO: 101161 - DNA, 87 bp, Mus musculus
ggagagtatgggtcaaactcacacaatgactctgagaggcctttgaggcctggggaacgctgtgtaattgaaaaggccctgcttcac

SEQ ID NO: 101162 - DNA, 85 bp, Mus musculus
tctattccttgtcattttcttattctattctgcagttttatactgctaattttggagtaacactgaaaatcacaagtagcctaga

SEQ ID NO: 101163 - DNA, 115 bp, Mus musculus
taaagtgtgagtactagcctaaggcagaaatgttgcaaaagttttttcttttttgaaaaatggttagatttgctttttgtgtggtaatttaggccaaacttgtacttatatttta

SEQ ID NO: 101164 - DNA, 74 bp, Mus musculus
gacatgtacagtatcagataaagattagatccgaatattagcgttctctctgtctgtctgtctgtctgtctgtc

SEQ ID NO: 101165 - DNA, 116 bp, Mus musculus
catgttgagttaggcttgatactggaaagaaaaaatccaccgattcctatggaatgtatgtatttaagtttcaatatctggattttctcgtttttgcagtagtattcatttgattt

SEQ ID NO: 101166 - DNA, 68 bp, Mus musculus
atatatatatgtatatatacatacatatatgtgtatatatatgtacatatgtatatatgtatatatat

SEQ ID NO: 101167 - DNA, 117 bp, Mus musculus
ggaggatgattttcatatctgtctacaatgctgagaggtttggggaagggtatatatatatatatatgtctagttccttgactagtaacatgtgtagacaccatggtgtataacttc

SEQ ID NO: 101168 - DNA, 101 bp, Mus musculus
gtgaagaggaaattagaggacagtgtttcagtagactgacagcagagcattaagcatgagcagtcagactactgtggaggatgccaggtcctcctttgctc

SEQ ID NO: 101169 - DNA, 65 bp, Mus musculus
gggccatgtttaggattatgactatgcagcagcaaggcagaggtcagtgtcactgtcagtggctc

SEQ ID NO: 101170 - DNA, 79 bp, Mus musculus
ggatatggggaaatgaacacagaaaggctttctcaggcataaatgcctctctgccagtctctgtgagcccctcaaaccc

SEQ ID NO: 101171 - DNA, 85 bp, Mus musculus; identical to SEQ ID NO: 57470

SEQ ID NO: 101172 - DNA, 110 bp, Mus musculus
cttctaggtaactcgtcaatgccgaaccttgagattcaccactgtcagacactctctgcttagaatcacttggacagctggtcaattcgcattaagtaagaacctctgag

SEQ ID NO: 101173 - DNA, 116 bp, Mus musculus
gagatattaaggaaaagtaattgttgcttcctatcatttttgttattagagttggcattttgttcttgtggcagtcttcttttaggtttgttgaaggattactttcttgctttttc

SEQ ID NO: 101174 - DNA, 114 bp, Mus musculus
ggttttccctaatcccatgttctgtctagtgtcaggtccttggttgtattgtactgtcaggcatgcgttccatctcatggccttgaatttaatcacgtagtggttggtgactcc

SEQ ID NO: 101175 - DNA, 111 bp, Mus musculus
cactaattttagaagtgtttttagaaaaatgatgctaggtgtggggttgcatatctgtaaacctagtaggtagcatagtttatgagaccatcttcaaaatggaataaagtg

SEQ ID NO: 101176 - DNA, 79 bp, Mus musculus
ggaggaagtgtgtcactatagaggtgagctttgagatttaagatgctcaagctaggctgagtggctcactgtctcttcc

SEQ ID NO: 101177 - DNA, 85 bp, Mus musculus; identical to SEQ ID NO: 57470

SEQ ID NO: 101178 - DNA, 66 bp, Mus musculus
tatgtacacacacatatgtatgtatatatgtgtgtatatgtgtatgtatgtatgtgtgtgtatgta

SEQ ID NO: 101179 - DNA, 75 bp, Mus musculus
ccttagacagtgctgttcctgtctgtggaaatgactttacttccagctactcaatgaggaaagtactttctcggg

SEQ ID NO: 101180 - DNA, 105 bp, Mus musculus
gccttattccatgatgatctgataggatgcatgggacaatttcaatatttttgtatgtgttgaggcttgtttttgaccaattatgtagacaattttggagaaggt

SEQ ID NO: 101181 - DNA, 58 bp, Mus musculus
tatcattattattattattattattattattatgatgatgatgatgatgatgatgatg

SEQ ID NO: 101182 - DNA, 85 bp, Mus musculus; identical to SEQ ID NO: 64457

SEQ ID NO: 101183 - DNA, 58 bp, Mus musculus
gagagagagagagcgagattaaagcacttgggccgacaattctctctctaactctctc

SEQ ID NO: 101184 - DNA, 85 bp, Mus musculus; identical to SEQ ID NO: 57439

SEQ ID NO: 101185 - DNA, 119 bp, Mus musculus
gttgctttggttatggtgtctgtccacagcagtaaaaccctaagacagaagttggtactggaagtgggatgttttgtttggaagactgtggatttggtgcattggatttggaaagtcat

SEQ ID NO: 101186 - DNA, 74 bp, Mus musculus
atatgcagctagagtcacaggctcttgtttttctttgtaattaaaacagtctgagactgttcatagctgcatgt

SEQ ID NO: 101187 - DNA, 63 bp, Mus musculus
agacatcccatttagagctgagtgagagctgagtgcctcaaggtcactctatgtgtaatgtct

SEQ ID NO: 101188 - DNA, 85 bp, Mus musculus; identical to SEQ ID NO: 57439

SEQ ID NO: 101189 - DNA, 61 bp, Mus musculus
ttgctgtgacacagcagagagagatgaggtgcaacccaaactctgtctgctgactcagcag

SEQ ID NO: 101190 - DNA, 75 bp, Mus musculus
tctgtacttttcccactctgtgactctgttagttcaacctagggcttcaggattcctacagaggattcctacaga

SEQ ID NO: 101191 - DNA, 84 bp, Mus musculus
gtggggctacatttcacacagtgctttcttgtcgtcttatccagttacacagtacaggatttcatatgagtgaaatgctctcac

SEQ ID NO: 101192 - DNA, 77 bp, Mus musculus
agggatctgtctgtctgtgtccctagtctcccccctccccccctggactgaagtcacagactaacaagactatttct

SEQ ID NO: 101193 - DNA, 85 bp, Mus musculus; identical to SEQ ID NO: 57439

SEQ ID NO: 101194 - DNA, 75 bp, Mus musculus
catttaaagtttatgtgtatgatatgtgtatatatttgtatgtacatgttttatgtatatgaatgtgaataagtg

SEQ ID NO: 101195 - DNA, 101 bp, Mus musculus
tgttctattaatttgtacttactattattgctgtgtgcatgtgcatgtgcatgtgtgcatgcatatgcatcctacagattgcatgtggaggtcagaggaca

SEQ ID NO: 101196 - DNA, 107 bp, Mus musculus
cttgagttatcattttgaataaatatttaacttttgcttatttatgcatttattattttaaattaatgtattttatcacaaagtagtttattgagaagtaattcaag

SEQ ID NO: 101197 - DNA, 78 bp, Mus musculus
ccttctctgagccagtgggagtgcccttgggtatcccctcacctggcacacccactctcccactgaggctagacaagg

SEQ ID NO: 101198 - DNA, 85 bp, Mus musculus; identical to SEQ ID NO: 57439

SEQ ID NO: 101199 - DNA, 85 bp, Mus musculus; identical to SEQ ID NO: 57439

SEQ ID NO: 101200 - DNA, 107 bp, Mus musculus
catgtttttttcatgtactgatatatttaagagtttttgatgtgattctatctatattttatactcttggttatcttgtatcagcaatatatataaaaccattcatg

SEQ ID NO: 101201 - DNA, 85 bp, Mus musculus; identical to SEQ ID NO: 57439

SEQ ID NO: 101202 - DNA, 85 bp, Mus musculus
gtgtatgcacaatatgtatgtatagatgtatgaacaaagacatgtatggtaattttcatgtacacacatgtgtgagtgcaggctc

SEQ ID NO: 101203 - DNA, 93 bp, Mus musculus
tgactgactctacagctggaattggtgtttgtttctttttgttttttatcacaatacaatgttgttaataattacttctttcagagtcagtca

SEQ ID NO: 101204 - DNA, 93 bp, Mus musculus
ggagatgggattataattatctgtggattgatgtttggctcaaatctctaggcttcagtaggaacaccacagacaaagttggcatccgtctct

SEQ ID NO: 101205 - DNA, 115 bp, Mus musculus
gcttatctgtctgtctgtctctctgtctgtcttatgtctccttatttctttatctattaagttttaaccaggtcttgcacaaggtagacacgtagtaacaaagtagcaaattggc

SEQ ID NO: 101206 - DNA, 86 bp, Mus musculus
aagcatgaagcacagagaatgaaccagaaaatggtttgaagcttttcattttatagtctgaccctcagtgcctccgtgacatgctt

SEQ ID NO: 101207 - DNA, 62 bp, Mus musculus
tgtatgtgtgtgtgtttatgtacatatggacatacatatgtatatatgtatgtgcatgtata

SEQ ID NO: 101208 - DNA, 106 bp, Mus musculus
gataggctctagaatcatctgagagtcaaatttccaggcctatgaaattcattatatttctagggcagggtactttgctttacttttattttatttttaagttttc

SEQ ID NO: 101209 - DNA, 116 bp, Mus musculus
ctgaaatattctgggttagagatcattatgtcctcattcctggcttcctgtctgagttttttttttaaacattgccacatgcacaggatgttttctgcagacttggcctatggcag

SEQ ID NO: 101210 - DNA, 67 bp, Mus musculus
gtgtgtgtgtgtgtgtgtgtgtgtgtgttcctgctgggaataaacacacatttatacttatctgcac

SEQ ID NO: 101211 - DNA, 108 bp, Mus musculus
cttcatgtgggaaccctaacagtaggagcaggaactgtctctgactctgttgtctgtctttgggaccctttcttgtaacttggctgttttgtctagccccaatagaag

SEQ ID NO: 101212 - DNA, 78 bp, Mus musculus
accatatacagattattaacaaaagtagaatcagcagattgtacttatatttgtgtgaatgtgtgtctgtgtgtgtgt

SEQ ID NO: 101213 - DNA, 120 bp, Mus musculus
tcctctgatatttaaaacatgtacatatatatatatatatgtgtgtgtgtgtgtgtgtgtgtgtgtattcatttaatacatcagataaggatatatatatatatatatatatatatatat

SEQ ID NO: 101214 - DNA, 68 bp, Mus musculus
gaaagtctttcctggtttcaggagctgctcagttcagtctctgtatctcctatgactatgagcctttc

SEQ ID NO: 101215 - DNA, 85 bp, Mus musculus; identical to SEQ ID NO: 63114

SEQ ID NO: 101216 - DNA, 106 bp, Mus musculus; identical to SEQ ID NO: 65977

SEQ ID NO: 101217 - DNA, 102 bp, Mus musculus
gtgttttgtggtgtttatattgtatttggtatgtgcagtgtgtggtgtgttctgtatgtctgtcataattgtgggtgtgtgtggtgtgaatgtatgtgatat

SEQ ID NO: 101218 - DNA, 96 bp, Mus musculus
gatcagccttagtccatggtggtctgataggatgcataggacaatttcaatatttttgtatctgttgaggcctcttttgtgacaaattatatggtc

SEQ ID NO: 101219 - DNA, 74 bp, Mus musculus
tgtccatagtctctgtctctgttcaggcaccacttgccatactgcatgtcttcaggaactgaactaacagggca

SEQ ID NO: 101220 - DNA, 96 bp, Mus musculus
gatcagccttagtccatggtgatatgataggatgcatgggacaatttcaatatttttgtatcagttgaggcctgttttgtgaccaattatatggtc

SEQ ID NO: 101221 - DNA, 85 bp, Mus musculus; identical to SEQ ID NO: 57439

SEQ ID NO: 101222 - DNA, 75 bp, Mus musculus
ggccgggagggtggccggatgtctggggccagaaaagggcgctgcctcagaggctctgtggctctcacctgtccc

SEQ ID NO: 101223 - DNA, 85 bp, Mus musculus; identical to SEQ ID NO: 57470

SEQ ID NO: 101224 - DNA, 83 bp, Mus musculus
gtgtttgtgtctgtgtttgtgtctgtgagagcatattgaacatctctgggttgctgtcctggatgtaaactttgagtaaacat

SEQ ID NO: 101225 - DNA, 110 bp, Mus musculus
tttatgttttattttgttataatttattttaaaatctctttggtatcattttttttctaatgagagacacaaaggggatggaatgggatggtatatggtgaggaactgga

SEQ ID NO: 101226 - DNA, 97 bp, Mus musculus
agccataggggtagtaaatagagatgtcccatttgaggctgggcacccacagtcacttagtctctgcttgaccagctattattccctctaataggct

SEQ ID NO: 101227 - DNA, 105 bp, Mus musculus
gccttagttcatggtgatctgataggatgcatgagaaattttcaatatttttgtatctgttgaggcctgttttgtgaccaattatattgtcaatttggagaaggt

SEQ ID NO: 101228 - DNA, 98 bp, Mus musculus
agtaaagcccaatatcattagagttaattttcattactacaattttctttgtttttaagaaaagtagtatttgattttatcctaggtctctgggtact

SEQ ID NO: 101229 - DNA, 79 bp, Mus musculus
acttctgttagtttcactgtgtctctgtttagttcctgtttccaggatctgtgcattgatgagagtggggtcttgaagt

SEQ ID NO: 101230 - DNA, 73 bp, Mus musculus
gtgattacttaagtgtgtatatgtatatgtatgtatgtatagtgcatatatacatacatatattattaattat

SEQ ID NO: 101231 - DNA, 99 bp, Mus musculus
tttgacagacaattttatgcttgtagaatctaacaatagcttaagggtgagcttgaagtttgtttcttctttacataacatgaacattgttctattaaa

SEQ ID NO: 101232 - DNA, 106 bp, Mus musculus
gccttagtccatggtgatctgataggatgcatgggacaatttcaatatttttgtatatgttgaggcttgttttgtgaacaattatgtggtcagttttggagaaggt

SEQ ID NO: 101233 - DNA, 85 bp, Mus musculus; identical to SEQ ID NO: 57439

SEQ ID NO: 101234 - DNA, 101 bp, Mus musculus
cagatcccccgaaacttgagttgcaggcagttgtgagtcactgcatgtggatgttggggtttgaacccagggcctttggatgaacaacagctgtttgtaat

SEQ ID NO: 101235 - DNA, 78 bp, Mus musculus
gtggtagctgtgtctttctctttattgtgaaatttagtcatatatttcaaaatatatgagagaacattgactgcttac

SEQ ID NO: 101236 - DNA, 116 bp, Mus musculus
tatgaagttatatggccattgttgacagatctgaaggagttccttgaaaagtaaaaatgtaaccacaccgaggtccatcaggtatactggaaatatatccacaaagcactgacata

SEQ ID NO: 101237 - DNA, 101 bp, Mus musculus
agaattttagtgttgacatgagagcagggacaatgtagggttatgtttacacatgacagagagcatggagcaaagttcaatatgtcatcactttaaatttt

SEQ ID NO: 101238 - DNA, 115 bp, Mus musculus; identical to SEQ ID NO: 59791

SEQ ID NO: 101239 - DNA, 85 bp, Mus musculus; identical to SEQ ID NO: 57470

SEQ ID NO: 101240 - DNA, 85 bp, Mus musculus; identical to SEQ ID NO: 57439

SEQ ID NO: 101241 - DNA, 85 bp, Mus musculus; identical to SEQ ID NO: 57470

SEQ ID NO: 101242 - DNA, 92 bp, Mus musculus
agaggaatttctttaagatatttatcatgatacaggtctagaaactcagtgtttctctgtttctgtgccatcagatttaaagatgttagtct

SEQ ID NO: 101243 - DNA, 133 bp, Mus musculus
tgcctgtagtataagtagggattgcttctcttgtcaaagtgacctttttgcttatgttacattgtttttgataaagggaaatcttattgtggtagttggcaaattttgtacttttctaacaaaagggtacctt

SEQ ID NO: 101244 - DNA, 132 bp, Mus musculus
gggctataatggctctgctttttactcctgttttgctcagtgaggcacattggctcttttcagaagaatgtgacctctgatgaaacagttttatgcagctgattgagagcctgcctaggctgatagctggag

SEQ ID NO: 101245 - DNA, 82 bp, Mus musculus
tatatctatatgtatttatctacatctacatatatgtatatggatatgtggatatgtatatatatatatggatatgtggata

SEQ ID NO: 101246 - DNA, 85 bp, Mus musculus
gtccatggtggtctgataggattcatgggacaatttcaatatttttgtatctgttgaggcctgttttgtgaccaattatatggtc

SEQ ID NO: 101247 - DNA, 113 bp, Mus musculus
gtgctgggctcagggacatcctcatggtgttataggtcctttttatttctgtaatataagtgtagtaaattggatagttaacaaaagtaaatgaaaggatatttaacagatac

SEQ ID NO: 101248 - DNA, 84 bp, Mus musculus
cagatattgctgcaactgtgaatgagaccacctggggtggagccttcccacctagatggttctattgttctgtcatcaacactg

SEQ ID NO: 101249 - DNA, 94 bp, Mus musculus
ggacaaaaagtgatgaattgtggatatatatatatatatatatatatatatgcatatatatatatatgtctgaatgtctatatgtctgtacatc

SEQ ID NO: 101250 - DNA, 85 bp, Mus musculus; identical to SEQ ID NO: 57439

SEQ ID NO: 101251 - DNA, 85 bp, Mus musculus; identical to SEQ ID NO: 57439

SEQ ID NO: 101252 - DNA, 85 bp, Mus musculus; identical to SEQ ID NO: 57439

SEQ ID NO: 101253 - DNA, 85 bp, Mus musculus; identical to SEQ ID NO: 57439

SEQ ID NO: 101254 - DNA, 85 bp, Mus musculus; identical to SEQ ID NO: 58391

SEQ ID NO: 101255 - DNA, 110 bp, Mus musculus
gctggtgtattccatattttttatcacatagactaagtttgtatgctactgctgaaagattatatataaatttataaagactatgtgtgtgtgtgtgcatgtggacctgc

SEQ ID NO: 101256 - DNA, 105 bp, Mus musculus
tgtgtgtgtgtatatatgcatatatatatacatatatatacatatatatagtatatatactgtgaatatatatttggtatgtatgtgtatatatatacatatata

SEQ ID NO: 101257 - DNA, 68 bp, Mus musculus
tatgtatgtatgtgtatgtatgcatatacatatgtgtatatatatgtatatgtacatgtatatgcatg

SEQ ID NO: 101258 - DNA, 84 bp, Mus musculus
gggttttgagttaggagatatttgcattttgcattttctttaactgatgtgtcaatatttttatatcttctgcacctgagattc

SEQ ID NO: 101259 - DNA, 79 bp, Mus musculus
gtctctgtctctgtcatacatgattgtacatgggtccgtgtatatgtagtgtgtacatgtgtttatagaagccagagat

SEQ ID NO: 101260 - DNA, 90 bp, Mus musculus
gcatcagagacaaggcagaaggcagagagctcagggagggacccaggtttggaattgccactggaagtcctggggcagcgatggcactgt

SEQ ID NO: 101261 - DNA, 76 bp, Mus musculus
ctttgttcttgctaaaaatgctctctctgtgtgtgcctggtacccaaggttgccagaagagagtgtcagaactgag

SEQ ID NO: 101262 - DNA, 66 bp, Mus musculus
gtgtgtgtgtgtgtgtgtgtgtgtgtttgtgtgtagcaggagccatggaccaattcatgtatacac

SEQ ID NO: 101263 - DNA, 85 bp, Mus musculus
tgggctgggtacagaataagaccactgacttttgcacagctggtggtagcatggcatgatttaggttgttttgtaataattacca

SEQ ID NO: 101264 - DNA, 57 bp, Mus musculus
gccatatatatgtatgtatgtatgtatatatatgtatgtatgtatatgtatatgtgt

SEQ ID NO: 101265 - DNA, 134 bp, Mus musculus
gtgtgtgtgtgtataagcatacatatatgtatagatgcatatgtgtatgtagatatgtacatacatgtatatatgcacatatggtgtatgcatatgtacatacatgcatatatgcatatgttttgtgcatatgt

SEQ ID NO: 101266 - DNA, 69 bp, Mus musculus
gccatatatatgtatgtatgtatgtatatatatgtatgtatgtatatgtgtatgtgtatgtgtatgtgt

SEQ ID NO: 101267 - DNA, 85 bp, Mus musculus; identical to SEQ ID NO: 58731

SEQ ID NO: 101268 - DNA, 74 bp, Mus musculus
gtggctgtggccttaaagaggatattaggttactggactcttcccctcagtctctctgtgagggaagcagctgc

SEQ ID NO: 101269 - DNA, 68 bp, Mus musculus
aacttctgtagcggccagagagaataaaacagggcgtcccccgatttctctctgtctctgtgagagtt

SEQ ID NO: 101270 - DNA, 90 bp, Mus musculus; identical to SEQ ID NO: 101260

SEQ ID NO: 101271 - DNA, 92 bp, Mus musculus
gaatgccctgtcagtctcaggaagtcacctggagttggctgcctctccctctcacagtgccatcgctgccccaggacttccagtggcaattc

SEQ ID NO: 101272 - DNA, 106 bp, Mus musculus
gccttagtgcatggtgatctgatagggtacatggaacaatttcaatatttttgaatctgttgaggcctgttttttgacctattatgtggtcaattttggagaaggt

SEQ ID NO: 101273 - DNA, 129 bp, Mus musculus
gtgtgtgtgtgtgtggtgtggtatgtgtttgtttgtatgtgtgtgtctatgtgtctatgcttatctatgtgtatggtgtatgtgtatgcatgaatgtgtatctgtgtacatatatatgtgtgtctgtat

SEQ ID NO: 101274 - DNA, 71 bp, Mus musculus
tgagatcctgggtgtttcagagctccccggagtcaagctgtctctgggtccctgagttcctggtgagatca

SEQ ID NO: 101275 - DNA, 85 bp, Mus musculus; identical to SEQ ID NO: 57439

SEQ ID NO: 101276 - DNA, 115 bp, Mus musculus
atgcaccattagaacttccatgcattttgccagtctcttttgttattatgatcatggtaagttatttttatttcaaagtaactggtaatcatcagaagatgttttgaattgtcat

SEQ ID NO: 101277 - DNA, 85 bp, Mus musculus; identical to SEQ ID NO: 57470

SEQ ID NO: 101278 - DNA, 82 bp, Mus musculus
gcttcagaaagagagaattgatttgtatcagagcttcggcaatgaaagttgtagtatatatataaatcacactttttgaagc

SEQ ID NO: 101279 - DNA, 94 bp, Mus musculus
agcgacaggaatttaatagtaatttaatgtattcttcaagcctatctggtcttatttttatatagttattattatttttctgagtacttttgct

SEQ ID NO: 101280 - DNA, 100 bp, Mus musculus
tatatgtatatgtatatacacatatgtatatacacatgcatatgtgtatgtatgtatgtatatatatatatgtgtatatatatatatgtatatatatata

SEQ ID NO: 101281 - DNA, 119 bp, Mus musculus
aacttcatgttatctctccctacactaaaccctagcaaagatatatgtgaaccaactcagagatgagtgtgtgcatttttttgctgctatagttaagttctgaaaggtcccctaaggtt

SEQ ID NO: 101282 - DNA, 90 bp, Mus musculus
tggcagtactgtcactgtgtcactgtcagctaaggtgggtgcttagttctagtgactgtaatacatacagtagaatcaattggactgcta

SEQ ID NO: 101283 - DNA, 85 bp, Mus musculus; identical to SEQ ID NO: 57470

SEQ ID NO: 101284 - DNA, 101 bp, Mus musculus
ccttgactaaggtgtcattgagtagagtgtcattcagcttccatgtgaatgttggctttttattatttatgtttttattgaagatcagccttagtccctgg

SEQ ID NO: 101285 - DNA, 84 bp, Mus musculus; identical to SEQ ID NO: 55223

SEQ ID NO: 101286 - DNA, 111 bp, Mus musculus
tttccatatatgtatatatatatatatatatatatatacatacttgggaatatatgtatatatatgtacatatacatacttgggaattttatatatatacgtatataccta

SEQ ID NO: 101287 - DNA, 85 bp, Mus musculus; identical to SEQ ID NO: 57439

SEQ ID NO: 101288 - DNA, 92 bp, Mus musculus
gaacagttttgtgtgacaaacagctttctctgtgagtaaagacaagtatgatttttattttatcaagagaaatctgagacataagaatgttc

SEQ ID NO: 101289 - DNA, 78 bp, Mus musculus
gtatgtatgcatgtatgtgttatgtatgtatgtatatatgtatgtatgtatgtattgtgtgtatatgtgtatgtgtat

SEQ ID NO: 101290 - DNA, 107 bp, Mus musculus
tacagaagggggtaactgtgtttgcaatggatagtaagaggctctctgatggatttttttctttaaaaagtgagtaaattagtttctttacattctctcattttgta

SEQ ID NO: 101291 - DNA, 85 bp, Mus musculus
gtccatggtggtctgataggatgcatgggacaatttcaatatttttgtatctgttcaggcctgttttgtgaccaattatatggtc

SEQ ID NO: 101292 - DNA, 111 bp, Mus musculus; identical to SEQ ID NO: 64079

SEQ ID NO: 101293 - DNA, 77 bp, Mus musculus
ggtgtgaatgtgtatgtgtgtatttgtacttgtgtgtggggatagaggtcaagctcacatgtccatcctcaggaacc

SEQ ID NO: 101294 - DNA, 73 bp, Mus musculus
ttttatgtgcatgagagttttgcttatatgtatatatatgtgtgtactgtgtacatttcttgtgcccatagag

SEQ ID NO: 101295 - DNA, 93 bp, Mus musculus
agcgtggaataaacttgtcttcaacaccaatataatcttcatagatgctgtgagtatggttgttgttattgaagtctgcgaggcttccattct

SEQ ID NO: 101296 - DNA, 76 bp, Mus musculus
cccataactctagccccacaaaaggcagaaataggaggatcactaagactcactgtctgtgcagcttagttctggg

SEQ ID NO: 101297 - DNA, 99 bp, Mus musculus
tgcttaatgtaacaaatgagatcttgaagaaaagtatctaattgtttatattaaattctgtattttggcgctttagagatgtctcagtggttaagagca

SEQ ID NO: 101298 - DNA, 106 bp, Mus musculus
gtattacaactgtgttaaatgcaataattttcttcctggaaacaagtatttttttgtataaatccaggtaacagtaaaataattgaagccattacattaataatac

SEQ ID NO: 101299 - DNA, 65 bp, Mus musculus
cctggtcttgctgtctctgtctgtggcttgtccctcctgcaagcctgtgtgtcagtattactggg

SEQ ID NO: 101300 - DNA, 81 bp, Mus musculus
gactggtccatgtgtgtgcctgtgtgcgtgtgtgtttatgcctgtatctgtatgtatgtgtggaggtatacgtgtgtagtt

SEQ ID NO: 101301 - DNA, 70 bp, Mus musculus
gaatgtgtagactactgtgtcctcatatgcaaagcggaagacagtgaggacagtgagtcttgtactattt

SEQ ID NO: 101302 - DNA, 85 bp, Mus musculus; identical to SEQ ID NO: 57439

SEQ ID NO: 101303 - DNA, 110 bp, Mus musculus
taacttacacatgaaatgaatgttcgttgcagagtttgtacccataggtacaagtctgagctgattcactctgtgcctctgttgacttaaattacagtgatgaatgtaca

SEQ ID NO: 101304 - DNA, 68 bp, Mus musculus
gtgtacatgtgtatgtatgtatgtatgtgtgagcactgatgtgtacatgtgtatgtatgtgtgtgcac

SEQ ID NO: 101305 - DNA, 77 bp, Mus musculus
ggaggaagtgtgttactggagatgggctttgagattttagatggtcaagtcaggctcagtggctcactgtcttttcc

SEQ ID NO: 101306 - DNA, 108 bp, Mus musculus
tcagagcaatagaaacactaagacaatatgtatgtatgtatgtgtgtgtatgtatgtatgcatgtatgtattatgtattatagtcttactatgtaaccctagcttcga

SEQ ID NO: 101307 - DNA, 71 bp, Mus musculus
gcccagctctgtctctgtcagtccattagcatcaaagtgggaatatggtagcatccaggcaggcatggtgc

SEQ ID NO: 101308 - DNA, 61 bp, Mus musculus
gtctgaggaatgtagtcagcctctcccttccagaggggagggtgcctgtgtactctatgac

SEQ ID NO: 101309 - DNA, 95 bp, Mus musculus
cttccacagcactgttcatcactgaaggaagtcaggacaggcactgaaacagtgtaggaacctggaggcaggagctgatgcagaggccatggagg

SEQ ID NO: 101310 - DNA, 75 bp, Mus musculus
ctatctctctgtgtttgtgtctgggtgcatttacatatcctgtaccacaatttgaggacaacttgcaggagttgg

SEQ ID NO: 101311 - DNA, 56 bp, Mus musculus
gacaggagagtaaaatgtctgccacagattctgtgaagacaatttctatttctgtc

SEQ ID NO: 101312 - DNA, 81 bp, Mus musculus
atggtgctttctagggtgctgagaaagtaatgacatggaagaaaatcagagttgctgttcaataggcctagacagcatgat

SEQ ID NO: 101313 - DNA, 70 bp, Mus musculus
tatctatctatctatctatctatctatctagagatatatctagagagatagagatatagatagatgtgtg

SEQ ID NO: 101314 - DNA, 76 bp, Mus musculus; identical to SEQ ID NO: 78149

SEQ ID NO: 101315 - DNA, 84 bp, Mus musculus
tagaaactggtcagtgtgtagtgattggtgtcagcacgttcatcaggagaagctgcattgtctctgtcagtgacttcttgccta

SEQ ID NO: 101316 - DNA, 93 bp, Mus musculus
ggaagaaaaggtcagccaaaacatgtttagctatgcaatcaagcacagctcagcctctgtcactgtctgttgagtcctttgtgtactctctcc

SEQ ID NO: 101317 - DNA, 111 bp, Mus musculus
acattgagtcctcttgaaacagtttattttaacaatttgtttatatcagttaaatttcatgttttaaactttatattgttacaaaatggtaactggtttagtattcaatgt

SEQ ID NO: 101318 - DNA, 94 bp, Mus musculus
ggctttttcagactttttgttactacagaatatatatttttctgtcatttacagaatatatattctctgtcaattacacacgaagttgaaagct

SEQ ID NO: 101319 - DNA, 110 bp, Mus musculus
gattggctcttctgttccatgtgcatgttaaaagtatctgtttcagctagtgcatctgattttagtggctctagataccaggctgtgggtggttgcatttgtagttgttc

SEQ ID NO: 101320 - DNA, 58 bp, Mus musculus
cattatagtgtgtgtatatgtatatatacatatacagatatacacatacatatatatg

SEQ ID NO: 101321 - DNA, 74 bp, Mus musculus
tataattgtatctatatatctatctatatagatatctgtaaatctatatagatagatatatagatatgtgtgtg

SEQ ID NO: 101322 - DNA, 67 bp, Mus musculus
gactggagccagagtagagagtcacagcacagcagactgcctgcctctctgacacgtggctcttgtt

SEQ ID NO: 101323 - DNA, 85 bp, Mus musculus; identical to SEQ ID NO: 57439

SEQ ID NO: 101324 - DNA, 69 bp, Mus musculus
tctcacaaggcctctctcagtcactgcatctaccttggagcacgtgcttgggatgctggttcagttgga

SEQ ID NO: 101325 - DNA, 83 bp, Mus musculus
gtatatatttatagttacatatgtaaaatgtacatatgtatgtatatatgtgtataaaggtatatatgtatttgtttttgtac

SEQ ID NO: 101326 - DNA, 67 bp, Mus musculus
tatatatatatatatacatagttatatgtgtgatatatatatgtatgtgtgtatgtatatgtatgta

SEQ ID NO: 101327 - DNA, 85 bp, Mus musculus; identical to SEQ ID NO: 57439

SEQ ID NO: 101328 - DNA, 85 bp, Mus musculus; identical to SEQ ID NO: 57439

SEQ ID NO: 101329 - DNA, 84 bp, Mus musculus
gtcagttacctctcatttgtctgtctcagtatctccatgcacttaaaaagcaggcgactaatccaggcagtggtggtgcacgac

SEQ ID NO: 101330 - DNA, 103 bp, Mus musculus
tcattaaaaataaggtttagggttggagacatggctcactggttaagagcactgtctgctcttccagaggtcataagttcaattccaagcaacaacatggtgg

SEQ ID NO: 101331 - DNA, 80 bp, Mus musculus
gagagagagagagagagagagagagagagagagagagaacagactctgaaattttgtctttggatctctctctctctctc

SEQ ID NO: 101332 - DNA, 73 bp, Mus musculus
gcctgactgtctgctggtatatgtgcctgtgtgtcttcatgctagcagtgtgtgtgtgtgcctgactgtctgc

SEQ ID NO: 101333 - DNA, 122 bp, Mus musculus
tgtatttacacatataggaatatatatgtatatatgtgtgtgtgcgtatatatacatatgtatatatatatatatatatatatatatatatatatatatagtgtgtatatgcatgtaacaca

SEQ ID NO: 101334 - DNA, 121 bp, Mus musculus
ctgatctggccatctgcagtgtcacgctccgtgtatttgacaagctgagttggacactctgtgtggtagagtgtcagtttgtcaaataccccaagtgtggctcatgcctatcagctccagg

SEQ ID NO: 101335 - DNA, 85 bp, Mus musculus; identical to SEQ ID NO: 57470

SEQ ID NO: 101336 - DNA, 85 bp, Mus musculus; identical to SEQ ID NO: 81018

SEQ ID NO: 101337 - DNA, 72 bp, Mus musculus
cttcccaaactgcttttgttcttctgattgctcttgggttgaagcagaccaagtcctgcccagtttgggagg

SEQ ID NO: 101338 - DNA, 85 bp, Mus musculus; identical to SEQ ID NO: 57439

SEQ ID NO: 101339 - DNA, 85 bp, Mus musculus; identical to SEQ ID NO: 57439

SEQ ID NO: 101340 - DNA, 119 bp, Mus musculus
cagttcatcaatatacatatatgcatatatatgtatatacatgtatgtgtatgcatgtatgtatatatgtatatatatgcatgtatatatttgcatatgccattttataatgagaaatg

SEQ ID NO: 101341 - DNA, 96 bp, Mus musculus
cttcctgtgtgagctaagaaatgtgaatttctttttgtcagccttgatttcatctagcatgcatcgctgaaattacattactagagaataaggaag

SEQ ID NO: 101342 - DNA, 103 bp, Mus musculus
tctctgtgctttgtgtgtgcctgtaagtctgtgtctgtatctctaacaaatggttggactttattgaatagcacagaaagcatcacatggggacaaaatgagg

SEQ ID NO: 101343 - DNA, 63 bp, Mus musculus
gagagttgtcagcctccaggagtgtggaagcttggtccagcactgtggagagttggcaggttc

SEQ ID NO: 101344 - DNA, 90 bp, Mus musculus
gtgtctgtgtgtgtgtctgtgtgtatgtctgtgtgtgagagcgaagggcaaagacagagagacagagactgagagacagagagagaacac

SEQ ID NO: 101345 - DNA, 76 bp, Mus musculus
tatatatatatatatatatatatatacacacatatatatatatgtgtgtgtatgtatgtatatgtatatgtatatg

SEQ ID NO: 101346 - DNA, 63 bp, Mus musculus
gtgtgtgtgtgtgtgtgtatctatatgtatatgtgtgtagacatgatacacacatctactcac

SEQ ID NO: 101347 - DNA, 99 bp, Mus musculus
ttcctaaacatatcctgttcagtctgtatagtgctacttgtatgtatattttcagagttgagcatttggcactagacaatgaatttttgtgctcaggaa

SEQ ID NO: 101348 - DNA, 85 bp, Mus musculus; identical to SEQ ID NO: 57439

SEQ ID NO: 101349 - DNA, 116 bp, Mus musculus
ccaaatggactgtaatgggggctgagtatggcttgcttgcacagtgtttgttcatctcacacctttgtttcactgaatgaggcacagccaaaaacttttcctagcattcttgttgg

SEQ ID NO: 101350 - DNA, 82 bp, Mus musculus
tcaagagttcctatcaaattatgtattattatttcaacattgccaaaggcaatgaaaaatggtaatacttataggtatttga

SEQ ID NO: 101351 - DNA, 117 bp, Mus musculus
tcattcacattcttgattataattattcctgagttatagtattaatatatatatgatatagtacttctctatcatatacattatgtatatattatatatcatagttattgtaaatga

SEQ ID NO: 101352 - DNA, 95 bp, Mus musculus
atctatctatctatatctatatctatatatgtgtgtgtgtatgtatatatatatatatatatatatatatatatatatttcttattgggaatgat

SEQ ID NO: 101353 - DNA, 117 bp, Mus musculus
gaaaatacaaaagtttctgtggtaatttaaatgagaatgttcccccacgggttcctaaatttatatatttggttccctgttggtgggactgtttgaaaaggattaggaggtatgttc

SEQ ID NO: 101354 - DNA, 118 bp, Mus musculus
ctgtggttttctgtttatgcatatatatatgtacatgtatatatatatatatatatatatatatatacatgtatatatatgtacatgtatatatacatatatatgcatgaaatacaga

SEQ ID NO: 101355 - DNA, 82 bp, Mus musculus
atgtatatatacatgtacatatatatacatgtatatatatatatatatatatatatatatacatgtacatatatatatgcat

SEQ ID NO: 101356 - DNA, 85 bp, Mus musculus
gtccatggtggtctgataggatgcatgggacaatttcaatatttttgtatctgttgatgcctgttttgtgaccaattatatggtc

SEQ ID NO: 101357 - DNA, 85 bp, Mus musculus; identical to SEQ ID NO: 57439

SEQ ID NO: 101358 - DNA, 105 bp, Mus musculus
actttcgatttgtaaactgtttcaagattgagaaggactatgcaacttttaaagttggatgtatttttcattataatatgactataagtctatggacaagagagt

SEQ ID NO: 101359 - DNA, 96 bp, Mus musculus
tgtgttaggaggtgagtgtggtttcatgtgcatgtgtgtgtatgacagtgtggtttcatgtgcatgtgtgtgtatgactttttatcttttttcgga

SEQ ID NO: 101360 - DNA, 85 bp, Mus musculus; identical to SEQ ID NO: 57470

SEQ ID NO: 101361 - DNA, 105 bp, Mus musculus
accttagtgcatgatgatctgagaggatgcatgggacaatttcaatatttttgtatatgttgaggcctttttgttaccaattatatggtcatttttggagaaggt

SEQ ID NO: 101362 - DNA, 90 bp, Mus musculus
tgccaagattttcccgttaggataaggaagtatataacttagtttatattttatagggctttggatttgcggggatctttatcttatgca

SEQ ID NO: 101363 - DNA, 107 bp, Mus musculus
gactgccaatcaccatattaggggctattagtcagactctgaaagacaagtgttattgttgcattcatatgtgttgtctagattttagtgtgtgtgtgttgaaagca

SEQ ID NO: 101364 - DNA, 72 bp, Mus musculus
gaattgtatcttgggtattctgatcttttggactaatgtccactgatcattgagtgcataccatgtgtgttc

SEQ ID NO: 101365 - DNA, 101 bp, Mus musculus
aggactctattattctcatgagataggattttaggacagattactgattttcatgtatgttggtgtattcaggacttgctgtgttgggagaactgggttct

SEQ ID NO: 101366 - DNA, 88 bp, Mus musculus
taacaaagcagactgagcagactgtggagagaaagtgaataagcagcatccctccatggcctctgcatcagttcctgcttccaggtta

SEQ ID NO: 101367 - DNA, 107 bp, Mus musculus
gttctaaggataagatatgcctgccaagcttccttcctagtatttatgtttatgtctaaaggttattactacagtcagaggatccaggggatattttttctctttgc

SEQ ID NO: 101368 - DNA, 113 bp, Mus musculus
gtttgggtaagggagccaggcagcaggaaagggaatctgtctctgtatgtgtatatccatgtaacatatccttaggataaaatctttgtcccatgccttagctaggattaaac

SEQ ID NO: 101369 - DNA, 128 bp, Mus musculus
gtctctgatttaactttggtacctggtagctatctagaaaattgtccattctattcagattttctagttttgttgagtataggcttttgtagtgggatctgatgatgttttagatttccccaggttct

SEQ ID NO: 101370 - DNA, 105 bp, Mus musculus
gagcttgtatcaggtcatttgcatacatactgtagctttcagtttagtacttttatgggatttctgaatatgttaatgtgtaggtctctgatcttatgctttctc

SEQ ID NO: 101371 - DNA, 85 bp, Mus musculus
gtccatggtggtctgataggatgcatgggacaatttcaatatttttgtatgtgctgaggcctgttttgtgaccaattatatggtc

SEQ ID NO: 101372 - DNA, 85 bp, Mus musculus; identical to SEQ ID NO: 57470

SEQ ID NO: 101373 - DNA, 85 bp, Mus musculus; identical to SEQ ID NO: 57439

SEQ ID NO: 101374 - DNA, 85 bp, Mus musculus; identical to SEQ ID NO: 57470

SEQ ID NO: 101375 - DNA, 102 bp, Mus musculus
aacctttattttagcttttcttttctttatgcttatatatatacatatatgtatatatatacatatatagtgtgtgtatttcattgtctaaaataccagtta

SEQ ID NO: 101376 - DNA, 102 bp, Mus musculus
tcctcaccggagagtttttataaagttggcggatgtgcatggagatacagtcttagtctctcatactgtttatgttttaacgatgaaatctgggcatgtgga

SEQ ID NO: 101377 - DNA, 76 bp, Mus musculus
gtatagatatatgatgtgtatgtatatgatgtatatgtatgtgtatgtaacatgtatatgcatatgatgtctatgc

SEQ ID NO: 101378 - DNA, 83 bp, Mus musculus
gctttggttattccatagagcagcacatgggttttccgaactttaagtccccatctctgtctctctgggcctcagttcacagc

SEQ ID NO: 101379 - DNA, 86 bp, Mus musculus
aagaagccaactcccgtgtcagctcagagtccacacacagtgagctgcctgcggatgagagttgaaagcactacacgactcttctt

SEQ ID NO: 101380 - DNA, 73 bp, Mus musculus
ttctttttcaagtttttttcatgagttgagtagtcagtcactcactctcagtttgaacagaaaagagagagaa

SEQ ID NO: 101381 - DNA, 77 bp, Mus musculus
attgccaacattctgtctgtccctctgtcagctgggtgtctgcagcgatgagaaaggcatgataactccaaggcaat

SEQ ID NO: 101382 - DNA, 81 bp, Mus musculus
ggaaaacagaacagaggaaggataaacccatacaactatatatatatatatatctgtctgtctgtctgtctgttttgtccc

SEQ ID NO: 101383 - DNA, 85 bp, Mus musculus; identical to SEQ ID NO: 57470

SEQ ID NO: 101384 - DNA, 121 bp, Mus musculus
gggttatttttagttcttgttacacatacatatatgtatatgtacatgtatatgtgtatatgtatatatgtgtatatgtgtatatatgtgtgtgtgtgtgtaacaacctgatgagacctga

SEQ ID NO: 101385 - DNA, 84 bp, Mus musculus
tggaggcaaggataacctttaacttctaatctttctgtcactgtctcgcaggtgccaggattagaggtatgtcattgatctcta

SEQ ID NO: 101386 - DNA, 87 bp, Mus musculus
gacaaggtttttggagtcttgtgtctgtctcacatttgagtttcgtttatggtctgtgggatgttagcaatgggacttgaacctgtt

SEQ ID NO: 101387 - DNA, 77 bp, Mus musculus
ggctgagagaagagagtcattgagcttgtgagtttcaggccattctgagtttcacagcaatattctgtctcagaaac

SEQ ID NO: 101388 - DNA, 117 bp, Mus musculus
cagaattagttcattgaatccgggaaacagtagcactcacaagactgaaataaacagagcaatgttgattggctgtggttggctctggcaaggcatctcattccttgactgtgtctg

SEQ ID NO: 101389 - DNA, 73 bp, Mus musculus
gatatgaggctcaaaggagaaagtgtcaggtgatctccatgtgcctgcctgcctgcctgcctgcctgcctgtc

SEQ ID NO: 101390 - DNA, 82 bp, Mus musculus
tatgtatggtatgatatatatatatatatacatatacacacaatataaatatggtatatatgtatatatgtatacctacatg

SEQ ID NO: 101391 - DNA, 65 bp, Mus musculus
ccagaacttgtgctcccagaggtctctgcgacagagaaggaactgtgctcagcaagaagtcctgg

SEQ ID NO: 101392 - DNA, 107 bp, Mus musculus
ggtatctagaacaggatgtctacctagctatcatgtccacatttgccctgctggtcacagtttacagagaggagatgaacaaagacaggcctacatctaacactacc

SEQ ID NO: 101393 - DNA, 97 bp, Mus musculus
cactgaggcttctagaaagatatgattcctggtttctacaaatggctgtaactatttttgtatttcatcaggcctccagcttgcttatgccttgctg

SEQ ID NO: 101394 - DNA, 84 bp, Mus musculus
actgtggctgccccactgagtgcctgtcactgtgtaaagtgcttagtgctgagcatggcacatagtaggtgctcagttcacggt

SEQ ID NO: 101395 - DNA, 95 bp, Mus musculus
ggagggccacggctgacagggcagagtgggcacaggctgcccgggagggagagctgtgtgtgtttgtctgtctttttgtaggcgtgtgtgtgcct

SEQ ID NO: 101396 - DNA, 83 bp, Mus musculus
cctacctaccacccctagtgggagccctgggagatgcctctggccattgttcccagagacaactcactggggtcagacctggg

SEQ ID NO: 101397 - DNA, 76 bp, Mus musculus
gggtgctggggattaaacttggctatttgttcttgtgtggcaaaccctttgccaagagagccatcttttcagcccc

SEQ ID NO: 101398 - DNA, 112 bp, Mus musculus
gactgaatgagtgcctacagtagccatgcccttagtgagaacattgtctgcagtcttgcctgcagtacacagtgcatgggcttatggctgtgtacatttgtgactcttgaag

SEQ ID NO: 101399 - DNA, 114 bp, Mus musculus
atgtcttattccgctttctgttgctgtaatagatcacccaagactgaatctttttataaagaaaagaagtttctttcggttcatggttctagcatctgggaagtctaagagcgt

SEQ ID NO: 101400 - DNA, 79 bp, Mus musculus
gacaagatggagggaagagctccaggagccccagggcaaccaaatctaactgagggtcagtctgtccctctgtctcatc

SEQ ID NO: 101401 - DNA, 119 bp, Mus musculus
gccctggccatttcttcattcgtggccttttgtcattcagaaagctcggagctcaatgccattggaagacttgaccccagccatggtcacaatccttatgtcatctttggcagttgggt

SEQ ID NO: 101402 - DNA, 129 bp, Mus musculus
gctactggctttggaaaaatggagagaggagggaggtgggcaccttgctccttggtactaactttctgtctgtctgtctgtctgtctgtctgtctgtctcacatgcacagagggaggaagagagagaga

SEQ ID NO: 101403 - DNA, 66 bp, Mus musculus
tctctgtgtctatgtgtttatgtgcatgcacgtgcgtgtgcgcacacacacacacacacacagaga

SEQ ID NO: 101404 - DNA, 72 bp, Mus musculus
aggctttactggacagcctgtatccagttcgagggagaccctccagactgctgtatcagtctccagaagtct

SEQ ID NO: 101405 - DNA, 80 bp, Mus musculus
agaggtcatcaggcttggtggtagccattttaacccacgcagccatctcactggctctcactgatacatctgcgacttct

SEQ ID NO: 101406 - DNA, 111 bp, Mus musculus
gagctctcaatactgtggcagttggatacattagggctgaacagactcactaactctgactatagaggctgtgtgtgtatgaaaggccatcctctgccaagttaggccctc

SEQ ID NO: 101407 - DNA, 159 bp, Mus musculus
tgtgtgtgtgtgtgtgcgtgtgtgtgtatgtgtgtgtatatatgtgtgtgtgtatatatatatgcatatatatatatgtatatacatatgtatatatatgtgtgtgtgtatatatatatatatatatatatatatatatatatatatatatatatatat

SEQ ID NO: 101408 - DNA, 76 bp, Mus musculus
tgtgtgtatgcatgtgtctatctgcacatatatgtgtctatctgcacacatgtgtatgagcatgtgcatgcacata

SEQ ID NO: 101409 - DNA, 78 bp, Mus musculus
ccagagagagtcaggactcagggcgtggtacatcctgaaatggtggccagatgggtcctgagcctgtgaccctcatgg

SEQ ID NO: 101410 - DNA, 61 bp, Mus musculus
ctgtgcatgcacacatgcgcacatgcgctcgtatgtatgtatgtatgtatgtaggccatag

SEQ ID NO: 101411 - DNA, 85 bp, Mus musculus; identical to SEQ ID NO: 92145

SEQ ID NO: 101412 - DNA, 85 bp, Mus musculus; identical to SEQ ID NO: 57526

SEQ ID NO: 101413 - DNA, 79 bp, Mus musculus
acttctgttagtttcactgtgtctctgtttagtttctgtttccagggtctgtccattggtaagagtggggtattgaagt

SEQ ID NO: 101414 - DNA, 85 bp, Mus musculus; identical to SEQ ID NO: 57439

SEQ ID NO: 101415 - DNA, 84 bp, Mus musculus
ggtgtgagatttgggacttggttgtattgtacagcaaaaatcagctggaagattttagccagagtcaggtaagttatgaagact

SEQ ID NO: 101416 - DNA, 114 bp, Mus musculus
tcttgtcattcttgtgagacttctaacagtgggagtaagtgtgtctctcagtcttttgcctgatctttggacccctttcctcctactaggttgcttcatcaagccttgatatga

SEQ ID NO: 101417 - DNA, 122 bp, Mus musculus
tgtgtatatgtatgtgtgtataaatacatatgtgtgtatatatgtattttgtaggtatttataaatatatttgcatatatatacatatacatatatgtatatatactgatgtgtgcatatat

SEQ ID NO: 101418 - DNA, 85 bp, Mus musculus; identical to SEQ ID NO: 57470

SEQ ID NO: 101419 - DNA, 92 bp, Mus musculus
ttcaatctgtgtctgtctgtctgtctctcatattcctgttaccatactctgcaaacaggattctgtgaaattttagaaagctatttattgaa

SEQ ID NO: 101420 - DNA, 79 bp, Mus musculus
acttctgtcagtttcactgtgtctccgtttagtttctgtttccaggatctgtccattgatgagagtgggatgttgaagt

SEQ ID NO: 101421 - DNA, 85 bp, Mus musculus; identical to SEQ ID NO: 57439

SEQ ID NO: 101422 - DNA, 80 bp, Mus musculus
ataggtgtttatcatgtagagaacaaatctgggaggaatatactctggactgaagagtctctgcagagaggctatcctgt

SEQ ID NO: 101423 - DNA, 60 bp, Mus musculus
ctggggctggagagatggctcagcagttaagaggactgactgctcttccagaggtcctgg

SEQ ID NO: 101424 - DNA, 99 bp, Mus musculus
gcctgtctgtgagtccttaggatactgatttccaggtgccagaatctgtcatctgagaagtgagtgtacactaaaacgggctttagtaccacatcctgc

SEQ ID NO: 101425 - DNA, 90 bp, Mus musculus
gtctccttgtgtacacaatcattttgaagctgttaaacagtaatctcgctgggtcccagtttcccaatctgtgtgctgagtgggttggac

SEQ ID NO: 101426 - DNA, 121 bp, Mus musculus
ccccattgccttcagaaacctggcttcatcaagggcccatactccctgactgtatctgtctgtcttttgtggggatagaacgcaggtgtttgcatgggttaggaaagcctttagcactgaa

SEQ ID NO: 101427 - DNA, 72 bp, Mus musculus
acacatatatatgatatatatatatgtatgtgtgtgtatatatatatatatatatatatcacgtgtgtgtgt

SEQ ID NO: 101428 - DNA, 63 bp, Mus musculus
agtcaactggctgtgtctctctcagcctggggtcagaatgagaacctcagcttcaggttgact

SEQ ID NO: 101429 - DNA, 116 bp, Mus musculus
cttaccgggtggcactgtgtgtgtgtgtgtgtatatatatatatatgtatatatatatatatatatatatatatatatatatatatatatatatatatatattctcctctcttaag

SEQ ID NO: 101430 - DNA, 109 bp, Mus musculus
tggatgaggtagcaaaatggattatgtagaatgattgactatagagagatacaggttgtagattgtagaatataaagattatacattatataagtagtactacctccca

SEQ ID NO: 101431 - DNA, 116 bp, Mus musculus
cccctaaggctttaatctcccttctgacattgcttttgctcatgtggtgcctgggagttgtgagaagagagtgggcagctgggagcacatgcggggaggagggtgcgcttgggggc

SEQ ID NO: 101432 - DNA, 134 bp, Mus musculus
atgtatatgtatatgtatatgtatatgtatacacatatatgtatatatatatgtatttgtgtgtatatatatgtacatatatatacatatacatacacacacacacatatatatatatacatacatgtatatat

SEQ ID NO: 101433 - DNA, 78 bp, Mus musculus
gactccgtctccgtctctccgtctctggtggcccgaagccgaggccggaaggagagattcacgctttaccagagagtc

SEQ ID NO: 101434 - DNA, 80 bp, Mus musculus
gtatgtgtatatatatgtgtgtgtgtgtgtatatatatatatatatatatacatacacacacatatatatatatatatgc

SEQ ID NO: 101435 - DNA, 70 bp, Mus musculus
tggtttttcgagacagggtttctctgtgtagccctggctgtcctggaactcactctgtctctgtagacca

SEQ ID NO: 101436 - DNA, 72 bp, Mus musculus
cagaaaaaggactgcaactcttcagaagattttttttttctttctgacagtagttgcagttttcatttcctg

SEQ ID NO: 101437 - DNA, 98 bp, Mus musculus
atttcgcccattactgagggtatgttgagttgatgtacagaagtttcattttcatgtaaaatatatttatcttttgtcatgccgtgtttggttgagat

SEQ ID NO: 101438 - DNA, 78 bp, Mus musculus
gtccttatcaccagctccacgtgtctgtcattctcacacccctcttatctctctcagtcaggagcttgagggtaggac

SEQ ID NO: 101439 - DNA, 81 bp, Mus musculus
gtgtagctctgttttgatttccaaagtatatgtatatacatatatatgtgtgtatatatatattggactccagttgtacac

SEQ ID NO: 101440 - DNA, 118 bp, Mus musculus
ccatcaaagagggtgaggtggctctgtacagtgacgacgaatctttatttcattttatgagtgattcctaaggagccttgtatttatttgtgccccccacccccactaccaccaatgg

SEQ ID NO: 101441 - DNA, 94 bp, Mus musculus
tttcactagatgggaaggcagaatctgagcagaagctagtttgagaacctagttctcatgtgtgagtttctctgactgacttccttgaaggaaa

SEQ ID NO: 101442 - DNA, 89 bp, Mus musculus
tccagcactcaggaggtagagacaggcagtgtcacattctctgtgaattcaaggccagcctggtctgcatggtgagttctaggacagcc

SEQ ID NO: 101443 - DNA, 81 bp, Mus musculus
gtgtatgtatgtatgtatgtatgtatgtatgtgtgtgtgcacacacatatgtctacatttgtgtttccacatacagtgcac

SEQ ID NO: 101444 - DNA, 118 bp, Mus musculus
gcacatatgattcccagcactatatatatatatatatatatgtatatatatatatatatatatacatacacatatatgcatatatatgtgtgtgtgtatgtatgtatatatgtgtgta

SEQ ID NO: 101445 - DNA, 108 bp, Mus musculus
acttgtgcagcttggttttgaagtgggactcctaacagcagtagcagaggctgtctctgagtctgttacctgtctttgggatcctttcctcctactgggctgccttgt

SEQ ID NO: 101446 - DNA, 116 bp, Mus musculus
ttcttctttaaatgttcaatacgtatgcttgtgtacacgcgcttgtgctattgtgcgaacgtccctgtgtgcctgtgagtgtgcctgcctgcgtgcctgtgtgtaccaaggaggaa

SEQ ID NO: 101447 - DNA, 113 bp, Mus musculus
ggtggatttgagaatagctaagattggggtggaaagatggctcagcggttaagagcactgactgctcttccagaggtcctgagttcaattcttagcaatggtggctgataacc

SEQ ID NO: 101448 - DNA, 85 bp, Mus musculus; identical to SEQ ID NO: 57470

SEQ ID NO: 101449 - DNA, 90 bp, Mus musculus
gactcagatgaaggtgatcaggtttcaggagaagagtggcgccttgctggcatctgtccctgtctgtacctctctgccttcggaagagtc

SEQ ID NO: 101450 - DNA, 84 bp, Mus musculus
atctcaacttttgaacctttgtgccttgccctggtcacagtccctgtctcccaggtcaggccctgatgtctctagagaagaggt

SEQ ID NO: 101451 - DNA, 66 bp, Mus musculus
gtgtgtgtgtgtgtgtgtgtgtgtgtgtgtgcttaaacatgtacgtacatgcatgcgtgtgtgtgt

SEQ ID NO: 101452 - DNA, 80 bp, Mus musculus
gggtactgcaaaagggggctggcattttcttcaggaatgagagagggcaatgaagagtgaatgctcacaacacagtatct

SEQ ID NO: 101453 - DNA, 75 bp, Mus musculus
ccgttcctgcttctgagagatagccctggcagttgcaagtctgtcagtctctgtgcctctgagagatagccatgg

SEQ ID NO: 101454 - DNA, 84 bp, Mus musculus
aagcagtattgaggcacaagatgcaacaggtacttggttgaaaagaattttactaatgcattttttttgtttctttgcttgttt

SEQ ID NO: 101455 - DNA, 84 bp, Mus musculus
taggagagtataagtgcaattaaaagatgggagaaggagactggagagatggctcagcggttaagagcactgactgctcttctg

SEQ ID NO: 101456 - DNA, 116 bp, Mus musculus
tcttggaattggagttacaggcagttagttgtgaaccatcatgtgggcggggtcttctgcaagactagtgtcttagttagggttttactactgtcaacagacgtgatggcctaaga

SEQ ID NO: 101457 - DNA, 103 bp, Mus musculus
gggtgcacaattatagtgggcataaaaggagaaccagttatagcttaaagaaagtctctgtgtctgtccctcctgttttgtagtagtctaatgatgctttctc

SEQ ID NO: 101458 - DNA, 74 bp, Mus musculus
gcacagcagctcggaaccgatctagccctcccttccgtgaggtaggagctagtttaggatggggaacagtgtgt

SEQ ID NO: 101459 - DNA, 85 bp, Mus musculus; identical to SEQ ID NO: 57439

SEQ ID NO: 101460 - DNA, 73 bp, Mus musculus
ggaagaaatgtatcactggaggtaggcttggaggtttcagaagcttaagtcagacccagtctctctgtcttcc

SEQ ID NO: 101461 - DNA, 119 bp, Mus musculus
ttctttggtttgtggtttagtctctgggagctctgggtggtccagttatttgatattgttcttctgatgggatttttccccttcagctccttaagtttcaattttcttaagaacaggcc

SEQ ID NO: 101462 - DNA, 87 bp, Mus musculus
ggttttaattgttcttactgtctctgactgtggcttttccctcctgcaaggctgtgtgtcagtactcctgggagagcagttctctcc

SEQ ID NO: 101463 - DNA, 108 bp, Mus musculus
ggaaattcatggctctcagtttattgttagggtgttctcaattattttaattagaagtggctgagagtagttagagaacagtcaagattacatagatagttggttttc

SEQ ID NO: 101464 - DNA, 71 bp, Mus musculus
aagcaggattatgaaggatttgcctacactgtcttggcacagcttggcagtcaaattcactgtctctgttt

SEQ ID NO: 101465 - DNA, 90 bp, Mus musculus
tacatatatatgtatatatatgtgtgtgtgcgtacaaacatatatatacctatatatgtgtgaaaatatatatatgtatatacacatata

SEQ ID NO: 101466 - DNA, 84 bp, Mus musculus
cctgcttgcctgcctgcctgcctgcctgctggtggttaaaagcccatagctcttttggcaaagagtaggtgtgtcctggccagg

SEQ ID NO: 101467 - DNA, 102 bp, Mus musculus
gcaaatatttaggagtggaatggctagatcatatactgtgtatatatatattttgcctgtgtatgatgttttccatagaagttgttactattttgtatctgc

SEQ ID NO: 101468 - DNA, 83 bp, Mus musculus
gtctgtgtgtctgtgtgtgtctttcccgcgggaagccccccttcctctggatgctggaacactgcttctaggctccttcaggc

SEQ ID NO: 101469 - DNA, 98 bp, Mus musculus
cctgcagattagagacacatcatgttctgggcaatgattggtgcttgatgatggcatgaacagggctagccagaccaggccagtgcactgaatgtagg

SEQ ID NO: 101470 - DNA, 85 bp, Mus musculus
gctctgaccaggaaggtggcaagttgtctggagccggaaatggcgccgtctcagaggctctgtggctctcgcccgttccagaagc

SEQ ID NO: 101471 - DNA, 82 bp, Mus musculus
gggtgccaagtgagagtgtgctcactcagccatctgtttctgttactgggttccaagtgagagtgtgctcactcggccatct

SEQ ID NO: 101472 - DNA, 112 bp, Mus musculus
gcctggtgttgaacagttagccaagatacaaatagttagacatatatctcttaagtcagtttttaagatttatttatctgtttatgagtgctttgtctgcatgtacacctgc

SEQ ID NO: 101473 - DNA, 80 bp, Mus musculus
aggaggaagaagaaaagtggagcagaagcacatggcctggagaatctgcaagttggttgtttcatattgttgttcctcct

SEQ ID NO: 101474 - DNA, 70 bp, Mus musculus
gggaattagtgaccttgaagctagattagttaaattctgtagtctgagctgggcatggtactttaatccc

SEQ ID NO: 101475 - DNA, 80 bp, Mus musculus
ttattttaaaaatgtttttgagtgctaggattaaaagcatgtgcttttaacattttttttcttggaggctgttgaagtaa

SEQ ID NO: 101476 - DNA, 91 bp, Mus musculus
gttgtttgggttttagtcttatcttacgcttctaaccaaagcccagctttgagtcagggtgcctgaagactgtgagcaccattgccttaac

SEQ ID NO: 101477 - DNA, 85 bp, Mus musculus; identical to SEQ ID NO: 57439

SEQ ID NO: 101478 - DNA, 113 bp, Mus musculus
agtgtgagacacactgtgacacactgcagattccacagcaaggtttttttttttttttaattttaaaaatatttttagggggctggagagatggctcagtggttaagagcact

SEQ ID NO: 101479 - DNA, 94 bp, Mus musculus
gggatatgtgctaaaactcagttcctgggctggagagatagctcagtggttaggagtgctgactgctcttccagagggcctgagttcaattctc

SEQ ID NO: 101480 - DNA, 95 bp, Mus musculus
aggggaaagggtggcatctctttaggttgggaaaattttcttctgattttgttgatatttttccgggacttggagctggggactcttcactttct

SEQ ID NO: 101481 - DNA, 94 bp, Mus musculus
ccaaccaagcatgctggtgagatggcttagaggttaagagtactgactgctcttccagaggtcctgagttcaattcccagtaactacatggtgg

SEQ ID NO: 101482 - DNA, 93 bp, Mus musculus
tgagggtaccaggtatatatgtagtgcatgtatgtgtgtgtgtatatacatgtatatatgcttatatgtatacatatatatgtaaaactttta

SEQ ID NO: 101483 - DNA, 173 bp, Mus musculus
tatccatctatgtatgtatgtatgtatctatcatgtatgtatatatgtatacatgcatgtatgtatgtgtctgtctgtctgcttatctatcctatgtctatatatctatatctgtatgtcatctgtacctatatctgttatttagtcccagagctgttgtgggcagaccagca

SEQ ID NO: 101484 - DNA, 72 bp, Mus musculus
tctgtctctgcctcctgagtgctgggaataaaggtgtgccctaccactcagccgctcactggctctcagaga

SEQ ID NO: 101485 - DNA, 84 bp, Mus musculus
ggaaggaaggaaggaaggcaggcaggcaggtaggcagaatttatctatgtcctgggatgtgtcactgtcacttaactttgtttt

SEQ ID NO: 101486 - DNA, 104 bp, Mus musculus
gggagtgttaagaggaaggtaatcctttgcttacatcttcctaggaaggaattcttacaatggtatgcaatgaaggattattcaatactttcttgtcacctcct

SEQ ID NO: 101487 - DNA, 73 bp, Mus musculus
atgttctacacagagaacctggtgcagacctgtgcaggccctgtgcatgctgtctcagtttctctgagttcat

SEQ ID NO: 101488 - DNA, 75 bp, Mus musculus
atatatacacatatataaacatatatgtaccatatattcatatatgtatatgtatgtatgtatgtatgtatgtat

SEQ ID NO: 101489 - DNA, 87 bp, Mus musculus
ctgagagtacaaatctatacatgtttgtgtatgcagatgcatgtgagtatgcaggtatgagaaggacagagatggatggacattgag

SEQ ID NO: 101490 - DNA, 78 bp, Mus musculus
tctggcagctagtgattagacattttgttgttgtttcttggaaatacttagcaaaaattgtctcccacagaacctaga

SEQ ID NO: 101491 - DNA, 85 bp, Mus musculus; identical to SEQ ID NO: 57439

SEQ ID NO: 101492 - DNA, 92 bp, Mus musculus
gttttacttttctgactagtgtttaagttctgatgaagctccccaaaggaaagtttcttggggtttaactggagttgggagggaagtaggat

SEQ ID NO: 101493 - DNA, 79 bp, Mus musculus
tctgtgcctgtgcacagagcatgtctttcagcccaactgggtctcttagacactctgacagcagaaattttagaacaga

SEQ ID NO: 101494 - DNA, 119 bp, Mus musculus
tcctgctgaaaccttcttctcagcaagtcttcaggtcttatatctttatgtgtgtgtgtttctcactcacataaatcagtgctgcttgcatgtgcatgggtaagaggctatttactgga

SEQ ID NO: 101495 - DNA, 85 bp, Mus musculus; identical to SEQ ID NO: 57439

SEQ ID NO: 101496 - DNA, 69 bp, Mus musculus
tggacacataggctgattccatatgtatctgtatatgtatatatgtatatgtatctgtatgtgtgtgca

SEQ ID NO: 101497 - DNA, 99 bp, Mus musculus
tggaaaagctgtcatatatacatatatatgcatatacttataaatgtatatacggtatgtatacatgtatgtaggtatgtatgctcagtaaaagttcta

SEQ ID NO: 101498 - DNA, 79 bp, Mus musculus
acaagtgcctcagttttgttttttgttttatcttgttatatattgtgtgtggatattattgaaaatgctaggcaagtgt

SEQ ID NO: 101499 - DNA, 85 bp, Mus musculus; identical to SEQ ID NO: 57439

SEQ ID NO: 101500 - DNA, 85 bp, Mus musculus; identical to SEQ ID NO: 59783

SEQ ID NO: 101501 - DNA, 80 bp, Mus musculus
tctctctccttctgtcagcccatcatcccaccggtgacttgtattcctcaccttgaagggctcatttctgcagcagagag

SEQ ID NO: 101502 - DNA, 104 bp, Mus musculus
tctccctgtctctgtctctgtctttctctgtttctctcatataaataaataaataaataaatatgaaaaggagcggctggagagatagctcagcatataagaga

SEQ ID NO: 101503 - DNA, 98 bp, Mus musculus
gggcccaactttatggtatagactctttgttgttctctagattcacctttcaggactgaagatagaggacctcgtgtacataatccgtttccttgcct

SEQ ID NO: 101504 - DNA, 108 bp, Mus musculus
tttgtattagagtaatactggctttattgaaatttggaagtgtttcttttttaatttaagaggtaatggttgctgatcttttaatgtctggtagaattctgttataaa

SEQ ID NO: 101505 - DNA, 86 bp, Mus musculus
tgttcctcctgtgagtctgttagtctgtgtcagcactctctggaggcaatctctcccctggcaagaccagtacacagaggggtgca

SEQ ID NO: 101506 - DNA, 86 bp, Mus musculus
tttggatgtcaacaagagctttctgacaggagcctggtatagctgtctcctgagacgctctgtcagtgcctgacaaatacagaagt

SEQ ID NO: 101507 - DNA, 85 bp, Mus musculus; identical to SEQ ID NO: 57439

SEQ ID NO: 101508 - DNA, 114 bp, Mus musculus
ttgctttgcaagaattgtcaaatatatatatatatgtgtgtgtgtgtgtgcgtatatatatatatatatatatatatatatatatatatatatatatatttctgtatgagtcag

SEQ ID NO: 101509 - DNA, 138 bp, Mus musculus
actaggggccaagtgttgtggattctaacagagccgatatagtgcttggttcctagtaggtgctcagtaagtgtttgtgacataattcgtttattgagcacctcctatcaatcaagcactgtgctaggctctggggcc

SEQ ID NO: 101510 - DNA, 116 bp, Mus musculus
tctacactcatgtgcacactggcaacaccaaccagattcagtgagttatttatttttaaaaggaagatatgaagtttggaggaatatatgttgtgcagtcccagggagtttgtagg

SEQ ID NO: 101511 - DNA, 102 bp, Mus musculus
aatcagatgtgaaaatatgtgtcactctcagtctctgatggttttgagagagaggggtgggggtagggaagactgggaatatgatgagaaggaacatcggtt

SEQ ID NO: 101512 - DNA, 60 bp, Mus musculus
tgtctatatctctctctctctgtatatatatatatatacagagagagagagagagagaga

SEQ ID NO: 101513 - DNA, 56 bp, Mus musculus
tctctctctctctctctctgtatatatatatatatacagagagagagagatataga

SEQ ID NO: 101514 - DNA, 85 bp, Mus musculus
ataacttctgttagtttcactgtgtctctgtttagtttctgtttccaggatctgtccattgatgagagtggggtgttgaagtcgt

SEQ ID NO: 101515 - DNA, 106 bp, Mus musculus
gccttagtgcatggtgatctgataggatacatgggacaatttcaatatttttgaatctattgaggcctgttttgtgacctattatgtgatcaattttggagaaggt

SEQ ID NO: 101516 - DNA, 115 bp, Mus musculus
gtttggggctgagcaaactgagaacatttttcaggccagcctttccctcctgccctaaacagggtgactgaacagagtgtggcctgtgtgtcattcgttagagtcagctacaggc

SEQ ID NO: 101517 - DNA, 65 bp, Mus musculus
caaagctgtggctgggtatcaaaagttctaggtaactgaacattgatagcttaggtaatgttttg

SEQ ID NO: 101518 - DNA, 79 bp, Mus musculus
tttgagatttagcctgggcgctatctatctatctatctatctatatatagatagatagatattgaaaccatatctcaaa

SEQ ID NO: 101519 - DNA, 65 bp, Mus musculus
tgtccttccatccgtctgtgtgtgtgacatgcttgcatggtacccgcagaagccaggagaaggca

SEQ ID NO: 101520 - DNA, 104 bp, Mus musculus
gcctgtgggtctacgcactgggagaaaaaccatctgagacagcatttttttttattttctggggaatgtcgttcagtgtctgtctgtgtgtattctatttgtgc

SEQ ID NO: 101521 - DNA, 66 bp, Mus musculus
ctcactttgtagaccaggctggcttcaaactcacagagctctgcctgactgtctctcggagtgcag

SEQ ID NO: 101522 - DNA, 111 bp, Mus musculus
agcacaatgtagcggtgaggttctcaagctctgaacacgttactcaatctctctgtgtctcaatttcctctgtgatatagaatgatcatggcacagcctcatagcaatgct

SEQ ID NO: 101523 - DNA, 81 bp, Mus musculus
gccagtttctccttctgttctgtatatgttgttgagtcctcctcctgcctccacatcaagttatagggcagtgagaacagc

SEQ ID NO: 101524 - DNA, 60 bp, Mus musculus
atgcatgtatatatgtgtgtgtgtatataaatgtatgcatgtatgtatgtatgtatgtat

SEQ ID NO: 101525 - DNA, 72 bp, Mus musculus
ggagcccacataaagatgtaaggagagaacggactctataatgtctctctctgcgtctctgtctgtgtctcc

SEQ ID NO: 101526 - DNA, 98 bp, Mus musculus
atatggaacttgtaaactagttaagctgacactttccatatttctattaaaatatagtattgagaatattccccatttgacaggtttgctgttcctgt

SEQ ID NO: 101527 - DNA, 97 bp, Mus musculus
cctctgcttggctctggtgagaggagtgtgaggtcagggagggtggacctaggctaggcctagcagtgctttgtggcatgaagcagctgggcagagg

SEQ ID NO: 101528 - DNA, 110 bp, Mus musculus
gtgtgtgtttgtgtcacaagaagtgtattgtctgcagctagggataccagagagaacaaactgtccagaggctgcagggtagaaaaaactgatgtgacaagactggaggc

SEQ ID NO: 101529 - DNA, 85 bp, Mus musculus; identical to SEQ ID NO: 57470

SEQ ID NO: 101530 - DNA, 125 bp, Mus musculus
cttcatatatttgtttcttcattacacacattttcaaatttctatatgtatgtttagaaatatgtacttataggtgggttctgagagggggaaaaagagatctgaagggggtgaaaaatgaagaa

SEQ ID NO: 101531 - DNA, 85 bp, Mus musculus; identical to SEQ ID NO: 57470

SEQ ID NO: 101532 - DNA, 85 bp, Mus musculus
gaaaagatagcaccactgttggtgtagcatcgagggggtgccccccccctctgacttctttatttctttagttgtgtctctgttc

SEQ ID NO: 101533 - DNA, 58 bp, Mus musculus
tctgtctgtctgtctgtctgtgggcattggattccatggaatagaagttacagacagg

SEQ ID NO: 101534 - DNA, 98 bp, Mus musculus
acaggttttcttcaacatttaacaaataatgaaggtatttcaagcaaaggtaagacctttatttgaaagtatttgataaattgggagtcacagtatgt

SEQ ID NO: 101535 - DNA, 84 bp, Mus musculus
tttcttcattaattatgattgatagttttgctggatatagtagctcgggttgccatctctagtctcttagatcttgtgaaggaa

SEQ ID NO: 101536 - DNA, 105 bp, Mus musculus
gtggtgatcatttggtattggataaccaattgaggttttattctttggagaagaatatttcttcatctcttagcatacctcagttgattgtcttcccaagtccac

SEQ ID NO: 101537 - DNA, 78 bp, Mus musculus
gcaagcatagacttagcaagagagttttctgtggctcccacctgagtatgactctgtctctgggtctgaagtgtaagc

SEQ ID NO: 101538 - DNA, 69 bp, Mus musculus
tgcagtgggcatggtgatgacctagtagagccacctagcactgacactaactcactcaccagccaggca

SEQ ID NO: 101539 - DNA, 114 bp, Mus musculus
ttttttgttgcagccaaagtgtgtttgggtaggtctgtttctcactttctcagtgtttattttggattataggaattgggatgattgaaaactcagtgctaaacaagaaaacac

SEQ ID NO: 101540 - DNA, 113 bp, Mus musculus
tatatacatacatatgtgcatttatatacacgtacacacatacatatatatatgtatatgtgtgtgtatatatatacaaacatatatatacatatatatatgtatatgtgtat

SEQ ID NO: 101541 - DNA, 89 bp, Mus musculus
tattagcttcctcttgaacaccttacacaagagagtatgctcacatactcaatcttttgtgaggtttttgctgtttatcacagttgatg

SEQ ID NO: 101542 - DNA, 73 bp, Mus musculus
gtgtatatatatgtttatgtatgtatgtgtatatatatatgtatatatatatacatatacatatatatactgc

SEQ ID NO: 101543 - DNA, 101 bp, Mus musculus
atagatagatatagatatagatatagatatgtgtgtgtgtatacagatatatatatatatatatgtgtgtgtgtgtgtgtgtgtgtgtgtgtgtgtgtgtg

SEQ ID NO: 101544 - DNA, 102 bp, Mus musculus
gggtgtatggaggcagtggatgaacacgctggctctctctctctggagtgtgcaaactctgagggtgtttctcagcattccccagctggcctcacctaaccc

SEQ ID NO: 101545 - DNA, 64 bp, Mus musculus
tctttaactgtgtgtgtgtgtgtgtgtgtgtgtgtgtgtgcgctcacacacatgtgagtgtgga

SEQ ID NO: 101546 - DNA, 85 bp, Mus musculus; identical to SEQ ID NO: 57439

SEQ ID NO: 101547 - DNA, 66 bp, Mus musculus
ggggggggagggtctgacaaagacatctcatttatggtgagtgctctgaagtctctcactctccgc

SEQ ID NO: 101548 - DNA, 91 bp, Mus musculus
ataagggtattaatctctctgattctctctctcagaagtaattgctcatagctcttcatcatggggtgaggcttcgtgagattttccttgt

SEQ ID NO: 101549 - DNA, 63 bp, Mus musculus
tatatatagcacacatacacacatatatgtatgtatgtatgtatgtatgtgtgtgtgtatgta

SEQ ID NO: 101550 - DNA, 96 bp, Mus musculus
caagtgattcattttcaaaatttgtatttgtatatgtcattttgcttaagagtaaacttttgtgacaaacagaagcatgttgatctgtagtccttg

SEQ ID NO: 101551 - DNA, 103 bp, Mus musculus
acacttgttaacagcaccttgagcagccatgattttctgcattcactttttgattattataaagagaggcttctttcattaaagctgagggttgtctaagtgt

SEQ ID NO: 101552 - DNA, 85 bp, Mus musculus; identical to SEQ ID NO: 62293

SEQ ID NO: 101553 - DNA, 121 bp, Mus musculus
cacttggtacatgtcagcctgctcactcccctgccatacctcacagcctgcctgtctcccatgaggtctgttgtaaccagggacacaggtgagtcacccaccctaatatccatgccaactg

SEQ ID NO: 101554 - DNA, 77 bp, Mus musculus
ccctgcccaaggtacaaggttgatttctttcaaggcaagaaagaaaacttaaatatgagtgttcctgggagacaggg

SEQ ID NO: 101555 - DNA, 81 bp, Mus musculus
aacttctgttagtttcactgtgtctctgtttagtttgtgtttccatgatctgtccattgcagagagtgtggtgttgaagtt

SEQ ID NO: 101556 - DNA, 85 bp, Mus musculus; identical to SEQ ID NO: 57470

SEQ ID NO: 101557 - DNA, 85 bp, Mus musculus; identical to SEQ ID NO: 57439

SEQ ID NO: 101558 - DNA, 115 bp, Mus musculus
catggaagtgaatctgtgtataaaaggtgagcaaacatcttagcaacatttctcaatttgtttatctctaaacgaaggatggtgtagtactgttccttgaatatacgttcaaatg

SEQ ID NO: 101559 - DNA, 85 bp, Mus musculus; identical to SEQ ID NO: 57439

SEQ ID NO: 101560 - DNA, 85 bp, Mus musculus; identical to SEQ ID NO: 57470

SEQ ID NO: 101561 - DNA, 85 bp, Mus musculus; identical to SEQ ID NO: 59376

SEQ ID NO: 101562 - DNA, 99 bp, Mus musculus
agcaatccatttctgttactgggtgccaagtgagagtgtgctcactcagtcatctgtttctgttactgggtgcaaagttaagagtgtgcttactcggct

SEQ ID NO: 101563 - DNA, 71 bp, Mus musculus
ttttacatatgtgccaagggccaaggtcattctcatgaatgctaccttgttgtctcagtgtctgtgtggaa

SEQ ID NO: 101564 - DNA, 71 bp, Mus musculus; identical to SEQ ID NO: 101563

SEQ ID NO: 101565 - DNA, 99 bp, Mus musculus; identical to SEQ ID NO: 101562

SEQ ID NO: 101566 - DNA, 87 bp, Mus musculus
ttctgtggtataaataggaatctagaggaagaaaggtgtttaaagtcactgacacacacacttaacttaggtttcctttgcacagga

SEQ ID NO: 101567 - DNA, 85 bp, Mus musculus; identical to SEQ ID NO: 57439

SEQ ID NO: 101568 - DNA, 99 bp, Mus musculus; identical to SEQ ID NO: 101562

SEQ ID NO: 101569 - DNA, 99 bp, Mus musculus; identical to SEQ ID NO: 101562

SEQ ID NO: 101570 - DNA, 86 bp, Mus musculus
gcttagaaaattgttttccagccttttactgtgaggaaatgtctctctttgtccctgaggtttgtttctggtatgctgggtcttgc

SEQ ID NO: 101571 - DNA, 85 bp, Mus musculus
gtcccaagaggcgacagtcaatgacaatgagcaagcataccatggtgcaacacggtctatctctctgacaaatccctcttaggtc

SEQ ID NO: 101572 - DNA, 68 bp, Mus musculus
gtgtacaagtgtgtgcatgtgcatgtgtgtgcggacacacacacacaaatacacataagcttatgcac

SEQ ID NO: 101573 - DNA, 71 bp, Mus musculus; identical to SEQ ID NO: 101563

SEQ ID NO: 101574 - DNA, 71 bp, Mus musculus; identical to SEQ ID NO: 101563

SEQ ID NO: 101575 - DNA, 99 bp, Mus musculus; identical to SEQ ID NO: 101562

SEQ ID NO: 101576 - DNA, 71 bp, Mus musculus; identical to SEQ ID NO: 101563

SEQ ID NO: 101577 - DNA, 71 bp, Mus musculus; identical to SEQ ID NO: 101563

SEQ ID NO: 101578 - DNA, 99 bp, Mus musculus; identical to SEQ ID NO: 101562

SEQ ID NO: 101579 - DNA, 87 bp, Mus musculus; identical to SEQ ID NO: 101566

SEQ ID NO: 101580 - DNA, 68 bp, Mus musculus
gtgcacaagtgtgtgcatgtgcatgtgtgtgcggacacacacacacaaatacacataagcttatgcac

SEQ ID NO: 101581 - DNA, 85 bp, Mus musculus; identical to SEQ ID NO: 57439

SEQ ID NO: 101582 - DNA, 113 bp, Mus musculus
cgtttaatttattgccatgttgtatgctttaactgtttggtagttgtctgttaatttttgatttatcatacatataaagcaagtttgataaaaatttggtacggaattttatg

SEQ ID NO: 101583 - DNA, 85 bp, Mus musculus; identical to SEQ ID NO: 57439

SEQ ID NO: 101584 - DNA, 87 bp, Mus musculus; identical to SEQ ID NO: 101566

SEQ ID NO: 101585 - DNA, 113 bp, Mus musculus; identical to SEQ ID NO: 101582

SEQ ID NO: 101586 - DNA, 89 bp, Mus musculus
tactgcaatggtatggtgctgattcatacattgccaaatgagcagattcgacaatgttgcaatttatatttatgtatgtgcctgcagta

SEQ ID NO: 101587 - DNA, 68 bp, Mus musculus; identical to SEQ ID NO: 101580

SEQ ID NO: 101588 - DNA, 85 bp, Mus musculus; identical to SEQ ID NO: 57439

SEQ ID NO: 101589 - DNA, 87 bp, Mus musculus; identical to SEQ ID NO: 101566

SEQ ID NO: 101590 - DNA, 68 bp, Mus musculus; identical to SEQ ID NO: 101580

SEQ ID NO: 101591 - DNA, 99 bp, Mus musculus; identical to SEQ ID NO: 101562

SEQ ID NO: 101592 - DNA, 99 bp, Mus musculus; identical to SEQ ID NO: 101562

SEQ ID NO: 101593 - DNA, 87 bp, Mus musculus; identical to SEQ ID NO: 101566

SEQ ID NO: 101594 - DNA, 85 bp, Mus musculus; identical to SEQ ID NO: 57439

SEQ ID NO: 101595 - DNA, 68 bp, Mus musculus; identical to SEQ ID NO: 101580

SEQ ID NO: 101596 - DNA, 99 bp, Mus musculus; identical to SEQ ID NO: 101562

SEQ ID NO: 101597 - DNA, 99 bp, Mus musculus; identical to SEQ ID NO: 101562

SEQ ID NO: 101598 - DNA, 99 bp, Mus musculus; identical to SEQ ID NO: 101562

SEQ ID NO: 101599 - DNA, 85 bp, Mus musculus; identical to SEQ ID NO: 57439

SEQ ID NO: 101600 - DNA, 73 bp, Mus musculus
taagtgtccattttatccagattttcaagttttgttgagtacagccttgaaaagtaggatctgatgatattta

SEQ ID NO: 101601 - DNA, 99 bp, Mus musculus; identical to SEQ ID NO: 101562

SEQ ID NO: 101602 - DNA, 99 bp, Mus musculus; identical to SEQ ID NO: 101562

SEQ ID NO: 101603 - DNA, 87 bp, Mus musculus; identical to SEQ ID NO: 101566

SEQ ID NO: 101604 - DNA, 85 bp, Mus musculus; identical to SEQ ID NO: 57439

SEQ ID NO: 101605 - DNA, 99 bp, Mus musculus; identical to SEQ ID NO: 101562

SEQ ID NO: 101606 - DNA, 85 bp, Mus musculus; identical to SEQ ID NO: 57439

SEQ ID NO: 101607 - DNA, 87 bp, Mus musculus; identical to SEQ ID NO: 101566

SEQ ID NO: 101608 - DNA, 101 bp, Mus musculus
tgttggttctagggcccctatttgcattcagttcaagatacaggcattaatcagtgtttctctgtgtttcttataatgattatgggcaactgaaataagca

SEQ ID NO: 101609 - DNA, 107 bp, Mus musculus
attatatatatatgcataatgttataaaactatggtgtatatattatatataatttattttatatgtaaaatattttatcatttataatattttgttatataatata

SEQ ID NO: 101610 - DNA, 84 bp, Mus musculus
tcccaggctacataaattttacatatgtgccaagggtcattctcatgaatgctaccttgtctcagtgtctgtgtggccccagga

SEQ ID NO: 101611 - DNA, 96 bp, Mus musculus
cctatcagggtgccaagtgagagtgtgctcactcggctgtctgtttctgttattgggtgccaagtgagtgtgtgctctctcggccatcttattggg

SEQ ID NO: 101612 - DNA, 85 bp, Mus musculus
gtggtgtgaatgtttccatgtgtgtgtgtctgtgactcagtatatctaggtgtatatgtacatgtgtgtgttaggattttattgc

SEQ ID NO: 101613 - DNA, 85 bp, Mus musculus; identical to SEQ ID NO: 57439

SEQ ID NO: 101614 - DNA, 92 bp, Mus musculus
gaaaatgtaagacatattgggagaatttggatgtgtgtggacaaaacatttcattgtgcatacattttatgttttttaaacatcttatggtc

SEQ ID NO: 101615 - DNA, 109 bp, Mus musculus
tttctggtcaacattttcctactgaagagatagaaatatttactatttttatatctttatactaacattatatttctgttttatttgtaggggacaggtttatttgaga

SEQ ID NO: 101616 - DNA, 89 bp, Mus musculus
ctccatggtgatgtgatagggtgtatgggataatttcaatatttttgttgagtcctgttttgtgactgattatatggtctattgtggag

SEQ ID NO: 101617 - DNA, 71 bp, Mus musculus
ttacatatgtgccaagggccaaggtcattctcatgaatgctaccttgtctcagtgtctgtgtggccccatg

SEQ ID NO: 101618 - DNA, 90 bp, Mus musculus
acagtatatctctatttagtgcatttcttcttctgattattatgtgtcaggaggaatttattttctggtgcagtctatatggaattctgt

SEQ ID NO: 101619 - DNA, 120 bp, Mus musculus
gagttggtgagcctagagcctagagtggaatgttacctggggtgcctgaagttggtctagactttttgtttataaattcaggaaacatccatgttaatcaaagggtgtgtagaaattatt

SEQ ID NO: 101620 - DNA, 115 bp, Mus musculus
gctatatgtttagaaataagttagatacgtgcacatgtgtgtgcatgtgcatgtgtgtgagtacacatacacacaaatacacacaagcttatacacttaatcctggatatatggt

SEQ ID NO: 101621 - DNA, 85 bp, Mus musculus; identical to SEQ ID NO: 57470

SEQ ID NO: 101622 - DNA, 96 bp, Mus musculus
ttattaaagtttcttttatcaatgtggatgtcattgcatttggattataaatttttagatttgggagtccatcttggtaaatattaactttaatga

SEQ ID NO: 101623 - DNA, 119 bp, Mus musculus
gaaccagtctgagagtggttctatgatgtaagttgaactagagtgatgtcacagagcactggctggaggttgcacatctattctacttggaggcgctagaatccattgaaggtgagttc

SEQ ID NO: 101624 - DNA, 85 bp, Mus musculus
gtccatggtggtctgacaggatgcatgtgacaatttcaatatttttgtatctgttgaggcctgttttgtgaccaaatatatggtc

SEQ ID NO: 101625 - DNA, 85 bp, Mus musculus; identical to SEQ ID NO: 57439

SEQ ID NO: 101626 - DNA, 85 bp, Mus musculus; identical to SEQ ID NO: 57439

SEQ ID NO: 101627 - DNA, 98 bp, Mus musculus
ggttgattcataaaattaggtatgtctgagtgcttttcttgagaaccttgatgaggatatgttctgaggaagaattgtgagacaattgtgaattgatt

SEQ ID NO: 101628 - DNA, 85 bp, Mus musculus; identical to SEQ ID NO: 57439

SEQ ID NO: 101629 - DNA, 109 bp, Mus musculus
ttctctttggaaggaacttcagtctcttgataagcccctctatatataattttagtttcaaaattagaagaagtatatagattatatgagcctcaagccacatcgagaa

SEQ ID NO: 101630 - DNA, 85 bp, Mus musculus; identical to SEQ ID NO: 78067

SEQ ID NO: 101631 - DNA, 66 bp, Mus musculus
tgcacaagtgtgtgcatgtgcatgtgtgtgcagacacacacacacaaatacacataagcttatgca

SEQ ID NO: 101632 - DNA, 85 bp, Mus musculus; identical to SEQ ID NO: 57439

SEQ ID NO: 101633 - DNA, 85 bp, Mus musculus; identical to SEQ ID NO: 57439

SEQ ID NO: 101634 - DNA, 110 bp, Mus musculus
tttctggtcaacattttcctactgaagtgacagaaatatttactatttttatatctttatactaacattatatttctgtttaatttgtaggggacaggtttatttgagac

SEQ ID NO: 101635 - DNA, 85 bp, Mus musculus; identical to SEQ ID NO: 57439

SEQ ID NO: 101636 - DNA, 85 bp, Mus musculus; identical to SEQ ID NO: 57439

SEQ ID NO: 101637 - DNA, 120 bp, Mus musculus
ccttgatctctgaaaatacagctaggaagaagctctttgttctctatatccagcaaaaaaagctttttgtttctatactttacaaccagagatgcctgccttccttttccaaggacaagg

SEQ ID NO: 101638 - DNA, 122 bp, Mus musculus
cctgatctctgaaaatacagctaggaagaagctctttgttctctatagccaacaaaaaagctttttgtttctatactttacaaccagagatgcctgccttcctgtgccaaggacaaggagat

SEQ ID NO: 101639 - DNA, 109 bp, Mus musculus
ttgttgagcctagagcttagagtggaatgttacctggggtgcctgaagttggtctagactttttgtttataatttcagctaacatccatgttaatcaaagggtgtatag

SEQ ID NO: 101640 - DNA, 111 bp, Mus musculus
ggagttggtgagcctagagcctagagtggaaagttacctggggtgcctgaagttggtctagactttttgtttataatttcagcaaacatccatgttaaccaaagggtgggt

SEQ ID NO: 101641 - DNA, 63 bp, Mus musculus
ccagcctgagaggggttctatgatgtaagctgaactagagtgatgtcacagagcactggctgg

SEQ ID NO: 101642 - DNA, 87 bp, Mus musculus
ttctgtggtacaaatagaaatctagaggaagaaaggtgtttaaagtcactgacacacacacttaacttaggtttcctttgcacagga

SEQ ID NO: 101643 - DNA, 108 bp, Mus musculus
tattttcagaccattctgtggtataaataggaatctagaggaagaaaggtgtttaaagtcactgacacacacacttaacttaggtttcctttgcacaggaagaagata

SEQ ID NO: 101644 - DNA, 64 bp, Mus musculus
aggaacacaccatagagaagacagtgaggaaggaggaatcctcagtgtgtttctaagggatcct

SEQ ID NO: 101645 - DNA, 77 bp, Mus musculus
cagttgatgaaggatgaatagtaaattttcatcaaaggtattgactttgaaggttatagattgttcatcctctactg

SEQ ID NO: 101646 - DNA, 87 bp, Mus musculus
ttctgtggtatatataggaatctagaggaagaaaggtgtttaaagtcactgacacacacacttaacttaggtttcctttgcacagga

SEQ ID NO: 101647 - DNA, 89 bp, Mus musculus; identical to SEQ ID NO: 101616

SEQ ID NO: 101648 - DNA, 85 bp, Mus musculus; identical to SEQ ID NO: 57439

SEQ ID NO: 101649 - DNA, 118 bp, Mus musculus
attttagtatttctggtcaacattttcctactgaagtgacagaaatatttactatttttatatctttatactaatattaaatttctgtttgatttgtaggggacaggtttatttgagt

SEQ ID NO: 101650 - DNA, 82 bp, Mus musculus
gtactgagagtggagatagaggtcaaatcccaagtgtgcaagcatagggtccttacacaaaacctcttcccaggctcatcac

SEQ ID NO: 101651 - DNA, 99 bp, Mus musculus; identical to SEQ ID NO: 101562

SEQ ID NO: 101652 - DNA, 99 bp, Mus musculus; identical to SEQ ID NO: 101562

SEQ ID NO: 101653 - DNA, 85 bp, Mus musculus; identical to SEQ ID NO: 57439

SEQ ID NO: 101654 - DNA, 85 bp, Mus musculus; identical to SEQ ID NO: 57470

SEQ ID NO: 101655 - DNA, 85 bp, Mus musculus; identical to SEQ ID NO: 57439

SEQ ID NO: 101656 - DNA, 109 bp, Mus musculus; identical to SEQ ID NO: 101615

SEQ ID NO: 101657 - DNA, 81 bp, Mus musculus
cttagatgttagtccttgcaggccctctttttcacttatgtgctaggctgggcagggtctctctctcacttacatgctagg

SEQ ID NO: 101658 - DNA, 99 bp, Mus musculus; identical to SEQ ID NO: 101562

SEQ ID NO: 101659 - DNA, 85 bp, Mus musculus
ggccatgatggtctgataggatacatgggacaatttcaatatttttgtatctattgaggcctgttttatgaccaattatatggtc

SEQ ID NO: 101660 - DNA, 90 bp, Mus musculus
acagtatatctctatttagtgcatttcttcttctgattattttgtgtcaggaggaattttttttctggtgcagtctatatggaattctgt

SEQ ID NO: 101661 - DNA, 85 bp, Mus musculus; identical to SEQ ID NO: 57439

SEQ ID NO: 101662 - DNA, 85 bp, Mus musculus; identical to SEQ ID NO: 58174

SEQ ID NO: 101663 - DNA, 89 bp, Mus musculus; identical to SEQ ID NO: 101616

SEQ ID NO: 101664 - DNA, 110 bp, Mus musculus; identical to SEQ ID NO: 101634

SEQ ID NO: 101665 - DNA, 99 bp, Mus musculus; identical to SEQ ID NO: 101562

SEQ ID NO: 101666 - DNA, 81 bp, Mus musculus; identical to SEQ ID NO: 101657

SEQ ID NO: 101667 - DNA, 105 bp, Mus musculus
ggccctctttctcacttatgtgctaggctgggcagggtctctctctcacttatatgctaggctgaccaggtcccctctctcacttatgtgctaggctgagcagcc

SEQ ID NO: 101668 - DNA, 85 bp, Mus musculus; identical to SEQ ID NO: 57439

SEQ ID NO: 101669 - DNA, 89 bp, Mus musculus; identical to SEQ ID NO: 101616

SEQ ID NO: 101670 - DNA, 110 bp, Mus musculus
ggttcaaaaaggtttcaatgaagaatctttgacatagatactctttcaaggaagaaactttcattttatctttgaattagggaaatatagattcacctttaaatttgacc

SEQ ID NO: 101671 - DNA, 90 bp, Mus musculus; identical to SEQ ID NO: 101660

SEQ ID NO: 101672 - DNA, 85 bp, Mus musculus; identical to SEQ ID NO: 57470

SEQ ID NO: 101673 - DNA, 94 bp, Mus musculus
ccaataagatggccgagagagcagacagtcacttggtacccagtaacataaacaaagagctgagtgagcacactctcacttggcaccctgatgg

SEQ ID NO: 101674 - DNA, 71 bp, Mus musculus; identical to SEQ ID NO: 101617

SEQ ID NO: 101675 - DNA, 85 bp, Mus musculus; identical to SEQ ID NO: 76427

SEQ ID NO: 101676 - DNA, 85 bp, Mus musculus; identical to SEQ ID NO: 58722

SEQ ID NO: 101677 - DNA, 74 bp, Mus musculus
tctatttagtgcatttcttcttctgattattttgtgtcaggagaaatttttttttctggtgcagtctatatgga

SEQ ID NO: 101678 - DNA, 85 bp, Mus musculus; identical to SEQ ID NO: 78067

SEQ ID NO: 101679 - DNA, 99 bp, Mus musculus; identical to SEQ ID NO: 101562

SEQ ID NO: 101680 - DNA, 108 bp, Mus musculus; identical to SEQ ID NO: 101643

SEQ ID NO: 101681 - DNA, 66 bp, Mus musculus; identical to SEQ ID NO: 101631

SEQ ID NO: 101682 - DNA, 82 bp, Mus musculus
gtactgagagtggagatagaggtcaaatcccaagtgtgcaagcatagggtccttacacaaaacctcttcccaggctcgtcac

SEQ ID NO: 101683 - DNA, 120 bp, Mus musculus
ccctgatctctgaaaatacagctaggaagaagctctttgttctctatagccatcaaaaaaagctttttgtttctatactttacaaccagagatgcctgccttctttttccaaggacacgg

SEQ ID NO: 101684 - DNA, 57 bp, Mus musculus
gtgctacagcagataagggacggagctaggtctctagttctcactctctctgagcat

SEQ ID NO: 101685 - DNA, 71 bp, Mus musculus; identical to SEQ ID NO: 101563

SEQ ID NO: 101686 - DNA, 87 bp, Mus musculus
catatcattatctgtctatccatcatctatatatgtatgtatgtttgcatgtatgtatgtatgtatgtatgtatgaagtaatgattg

SEQ ID NO: 101687 - DNA, 99 bp, Mus musculus
agcaatccatttctgttactgggtgccaagtgagagtgtgctcactcagtcatctgtttctgttactgggtgcaaagttaagagtgtgcttactcagct

SEQ ID NO: 101688 - DNA, 82 bp, Mus musculus; identical to SEQ ID NO: 101650

SEQ ID NO: 101689 - DNA, 85 bp, Mus musculus; identical to SEQ ID NO: 57439

SEQ ID NO: 101690 - DNA, 90 bp, Mus musculus; identical to SEQ ID NO: 101660

SEQ ID NO: 101691 - DNA, 85 bp, Mus musculus; identical to SEQ ID NO: 76427

SEQ ID NO: 101692 - DNA, 110 bp, Mus musculus
atgtaaaatttatgtagcttgggattcatgtggaaatcttaacaatgtgagaacagtctctccctgtctctgttgcatgcctttgagacattttcagctgattgagctgc

SEQ ID NO: 101693 - DNA, 109 bp, Mus musculus; identical to SEQ ID NO: 101615

SEQ ID NO: 101694 - DNA, 82 bp, Mus musculus; identical to SEQ ID NO: 101682

SEQ ID NO: 101695 - DNA, 57 bp, Mus musculus; identical to SEQ ID NO: 101684

SEQ ID NO: 101696 - DNA, 120 bp, Mus musculus
tacttgacctttttcccttactgcttctagaattctctctttatttagtgcatttgttgttctgattattatgtgtagggaggaatttcttttctggtccagtctatttggagttctgta

SEQ ID NO: 101697 - DNA, 71 bp, Mus musculus; identical to SEQ ID NO: 101563

SEQ ID NO: 101698 - DNA, 97 bp, Mus musculus
gtagcttgggattcatgtggaaatcttaacaatgtgagaacagtctctccctgtctctgttgcatgcctttgagatattttcagctgattgagctac

SEQ ID NO: 101699 - DNA, 109 bp, Mus musculus; identical to SEQ ID NO: 101615

SEQ ID NO: 101700 - DNA, 82 bp, Mus musculus; identical to SEQ ID NO: 101682

SEQ ID NO: 101701 - DNA, 90 bp, Mus musculus; identical to SEQ ID NO: 101660

SEQ ID NO: 101702 - DNA, 85 bp, Mus musculus; identical to SEQ ID NO: 57439

SEQ ID NO: 101703 - DNA, 123 bp, Mus musculus
cctgatctctgaaaatacagctaggaagaagctctttgtactctatagccaaaaaaaaaagctttttgtttctatactttacaaccagagatgcctgccttcctgtgccaaggacaaggagat

SEQ ID NO: 101704 - DNA, 116 bp, Mus musculus
ggcgtaggtctttcaagtcagagatcattacaaagcacaggcttcctttgagggaaaagttttttttttttccatcagagcctgaatttgcccatctagtgataaaaaggcaagtc

SEQ ID NO: 101705 - DNA, 90 bp, Mus musculus; identical to SEQ ID NO: 101618

SEQ ID NO: 101706 - DNA, 71 bp, Mus musculus; identical to SEQ ID NO: 101617

SEQ ID NO: 101707 - DNA, 89 bp, Mus musculus; identical to SEQ ID NO: 101616

SEQ ID NO: 101708 - DNA, 110 bp, Mus musculus
atgtaaaatttatgtagcttgggattcatgtggaaatcttaacaatgtgagaacagtctctccctgtctctgttgcatgcctttgagacatttttagctgattgagctgc

SEQ ID NO: 101709 - DNA, 100 bp, Mus musculus
gaaaatgtaagacatattgggagaatttggatgtgtgtggacaaaacatttcattgtgcatacattttatgttttttaaacatcttatgttcatattttt

SEQ ID NO: 101710 - DNA, 78 bp, Mus musculus
agtatagaactgacatttgagagtaaggagtgtgtctcatacattcaagtacagctcgggtgtgcttaaaactaaact

SEQ ID NO: 101711 - DNA, 71 bp, Mus musculus; identical to SEQ ID NO: 101563

SEQ ID NO: 101712 - DNA, 57 bp, Mus musculus; identical to SEQ ID NO: 101684

SEQ ID NO: 101713 - DNA, 120 bp, Mus musculus
ccctgatctctgaaaatacagctaggaagaagctctttgttctctatagccagcaaaaaaagctttttgtttctatactttacaaccagagatgcctgccttctttttccaaggacatgg

SEQ ID NO: 101714 - DNA, 83 bp, Mus musculus
agatggccgagagaggacacactcagttggcacccagtaacagaaacagacagctgagtgagcacactctcacttggcacact

SEQ ID NO: 101715 - DNA, 85 bp, Mus musculus; identical to SEQ ID NO: 57439

SEQ ID NO: 101716 - DNA, 105 bp, Mus musculus
gaagaagctctttgttctctaaagccagcaaaaagctttttgtttctatactttacaaccagagatgcctgccttcctttgccaaggacaaggagataaaaattc

SEQ ID NO: 101717 - DNA, 85 bp, Mus musculus; identical to SEQ ID NO: 57470

SEQ ID NO: 101718 - DNA, 68 bp, Mus musculus; identical to SEQ ID NO: 101580

SEQ ID NO: 101719 - DNA, 89 bp, Mus musculus
ctccatggtgatgtgaaagagtgtatgagatactttcaatatttttgttgagtcctgttttgtgactgattatatggtctattgtggag

SEQ ID NO: 101720 - DNA, 87 bp, Mus musculus
ttctgtggtataaataggaatctaaaggaagaaaggtgtttaaagtcactgacacacacacttaacttaggtttcctttgcacagga

SEQ ID NO: 101721 - DNA, 88 bp, Mus musculus
tgcatagattcctgattcttgaagaagagagctcgataaaggcatcctctttaatctttaattctctgagtctctcactatctgtgca

SEQ ID NO: 101722 - DNA, 83 bp, Mus musculus
atatatgagtaaatagacaaatatatttttatgtaatctcacgtgcaataggcatgaaagtgtgtgtctgtgtgtgtgtgtgt

SEQ ID NO: 101723 - DNA, 101 bp, Mus musculus
ctacttttaacagtatatctctatttagtgcatttcttcttctgattattatgtgtcaggaggaatttgttttctggtccagtctatatggaattctgtag

SEQ ID NO: 101724 - DNA, 87 bp, Mus musculus
ttcggatgactgtcataaatttttacaggttctttcaccaaagaggagaaggagaggattctgagagaattctgagaggattctgaa

SEQ ID NO: 101725 - DNA, 90 bp, Mus musculus
agggaattaacaaagttttgctctcatacgtgtttgaggtcatttttatatattttcatgcatgtgtgaggttgagtgatagtattctct

SEQ ID NO: 101726 - DNA, 110 bp, Mus musculus
gtagcctcgtgtgacatttgtcttcttctagggtctgtataacattttccaggaaattatttatttcatagtttctagtgagaaatctgatgtaattctattaggtctgc

SEQ ID NO: 101727 - DNA, 75 bp, Mus musculus
ttagagcacctgggttttgaccttcctctcggtgttgtgggactaggaacagagtcagcacccagggtctactaa

SEQ ID NO: 101728 - DNA, 62 bp, Mus musculus
ttctctatactacagcttgaggtcggggatgattccccctgaagttattttgttgttgagaa

SEQ ID NO: 101729 - DNA, 99 bp, Mus musculus; identical to SEQ ID NO: 101562

SEQ ID NO: 101730 - DNA, 87 bp, Mus musculus; identical to SEQ ID NO: 92736

SEQ ID NO: 101731 - DNA, 105 bp, Mus musculus; identical to SEQ ID NO: 92735

SEQ ID NO: 101732 - DNA, 72 bp, Mus musculus; identical to SEQ ID NO: 92739

SEQ ID NO: 101733 - DNA, 103 bp, Mus musculus; identical to SEQ ID NO: 92738

SEQ ID NO: 101734 - DNA, 102 bp, Mus musculus; identical to SEQ ID NO: 92737

SEQ ID NO: 101735 - DNA, 71 bp, Mus musculus; identical to SEQ ID NO: 71683

SEQ ID NO: 101736 - DNA, 99 bp, Mus musculus; identical to SEQ ID NO: 101562

SEQ ID NO: 101737 - DNA, 99 bp, Mus musculus; identical to SEQ ID NO: 101562

SEQ ID NO: 101738 - DNA, 99 bp, Mus musculus; identical to SEQ ID NO: 101562

SEQ ID NO: 101739 - DNA, 90 bp, Mus musculus
aggcagtgcaggccctctctctctcacttatgtgcttggccactcaggcccactctctcacttaggtgttaggctgggcaggtcctctct

SEQ ID NO: 101740 - DNA, 80 bp, Mus musculus
cagccaacatgcaagcacaaagtaaagatgatgaaggtgtcttattttcacattgtttctttatgtttgaataaaagctg

SEQ ID NO: 101741 - DNA, 99 bp, Mus musculus; identical to SEQ ID NO: 101562

SEQ ID NO: 101742 - DNA, 99 bp, Mus musculus; identical to SEQ ID NO: 101562

SEQ ID NO: 101743 - DNA, 87 bp, Mus musculus; identical to SEQ ID NO: 101566

SEQ ID NO: 101744 - DNA, 85 bp, Mus musculus; identical to SEQ ID NO: 57439

SEQ ID NO: 101745 - DNA, 99 bp, Mus musculus; identical to SEQ ID NO: 101562

SEQ ID NO: 101746 - DNA, 85 bp, Mus musculus; identical to SEQ ID NO: 57439

SEQ ID NO: 101747 - DNA, 88 bp, Mus musculus
atacatacatatatatatatatatatatatgtatgtatacatacatacatacatacatatatatatacacatacatatacatatgtat

SEQ ID NO: 101748 - DNA, 99 bp, Mus musculus; identical to SEQ ID NO: 101562

SEQ ID NO: 101749 - DNA, 99 bp, Mus musculus; identical to SEQ ID NO: 101562

SEQ ID NO: 101750 - DNA, 68 bp, Mus musculus; identical to SEQ ID NO: 101580

SEQ ID NO: 101751 - DNA, 89 bp, Mus musculus
atctctgaaaatatagctaggaagaagctctttgttctctatagccagcaaaaaaaagctttttgtttctatactttacaaccagagat

SEQ ID NO: 101752 - DNA, 89 bp, Mus musculus; identical to SEQ ID NO: 101586

SEQ ID NO: 101753 - DNA, 98 bp, Mus musculus
atcattctatgctatataaaggaacatagaggaggaaagctgtttggagtcactgacacacacacttaactgaggtttcctttgcagagtaagaagat

SEQ ID NO: 101754 - DNA, 115 bp, Mus musculus
tgtttaatttattgccatgttgtatgctttaactgtttggtagttgtctgttaatttttgatttatcttacatataaagcaagtttgataaaaatatggtacggaattttatgca

SEQ ID NO: 101755 - DNA, 68 bp, Mus musculus; identical to SEQ ID NO: 101580

SEQ ID NO: 101756 - DNA, 110 bp, Mus musculus
gatcagtcttaggccatggtggtctgataggatacatgggacaatttcaatatttttgtatctattgaggcctgttttgtgaccaaacatggtcaattttggagaaggtc

SEQ ID NO: 101757 - DNA, 87 bp, Mus musculus; identical to SEQ ID NO: 101566

SEQ ID NO: 101758 - DNA, 99 bp, Mus musculus; identical to SEQ ID NO: 101562

SEQ ID NO: 101759 - DNA, 99 bp, Mus musculus; identical to SEQ ID NO: 101562

SEQ ID NO: 101760 - DNA, 85 bp, Mus musculus; identical to SEQ ID NO: 101571

SEQ ID NO: 101761 - DNA, 82 bp, Mus musculus; identical to SEQ ID NO: 81264

SEQ ID NO: 101762 - DNA, 80 bp, Mus musculus; identical to SEQ ID NO: 81263

SEQ ID NO: 101763 - DNA, 109 bp, Mus musculus; identical to SEQ ID NO: 81262

SEQ ID NO: 101764 - DNA, 71 bp, Mus musculus; identical to SEQ ID NO: 81261

SEQ ID NO: 101765 - DNA, 96 bp, Mus musculus; identical to SEQ ID NO: 81260

SEQ ID NO: 101766 - DNA, 88 bp, Mus musculus; identical to SEQ ID NO: 81259

SEQ ID NO: 101767 - DNA, 105 bp, Mus musculus; identical to SEQ ID NO: 81258

SEQ ID NO: 101768 - DNA, 87 bp, Mus musculus; identical to SEQ ID NO: 81257

SEQ ID NO: 101769 - DNA, 99 bp, Mus musculus; identical to SEQ ID NO: 101562

SEQ ID NO: 101770 - DNA, 85 bp, Mus musculus; identical to SEQ ID NO: 57439

SEQ ID NO: 101771 - DNA, 68 bp, Mus musculus; identical to SEQ ID NO: 101580

SEQ ID NO: 101772 - DNA, 87 bp, Mus musculus; identical to SEQ ID NO: 101566

SEQ ID NO: 101773 - DNA, 85 bp, Mus musculus; identical to SEQ ID NO: 57439

SEQ ID NO: 101774 - DNA, 68 bp, Mus musculus; identical to SEQ ID NO: 101580

SEQ ID NO: 101775 - DNA, 71 bp, Mus musculus; identical to SEQ ID NO: 76663

SEQ ID NO: 101776 - DNA, 86 bp, Mus musculus; identical to SEQ ID NO: 76664

SEQ ID NO: 101777 - DNA, 68 bp, Mus musculus; identical to SEQ ID NO: 101580

SEQ ID NO: 101778 - DNA, 140 bp, Mus musculus
tcactccccagttctgaggaagttccagggatacctggagatctcctatcagggtgccaagtgagagtgtgctcactcggctgtctgtttctgttaatgggtgccaagtgagtgtgtgctctctcggccatcttattggg

SEQ ID NO: 101779 - DNA, 99 bp, Mus musculus; identical to SEQ ID NO: 101562

SEQ ID NO: 101780 - DNA, 87 bp, Mus musculus; identical to SEQ ID NO: 101566

SEQ ID NO: 101781 - DNA, 85 bp, Mus musculus; identical to SEQ ID NO: 57439

SEQ ID NO: 101782 - DNA, 85 bp, Mus musculus; identical to SEQ ID NO: 57439

SEQ ID NO: 101783 - DNA, 99 bp, Mus musculus; identical to SEQ ID NO: 101562

SEQ ID NO: 101784 - DNA, 68 bp, Mus musculus; identical to SEQ ID NO: 101580

SEQ ID NO: 101785 - DNA, 85 bp, Mus musculus; identical to SEQ ID NO: 57470

SEQ ID NO: 101786 - DNA, 115 bp, Mus musculus; identical to SEQ ID NO: 101620

SEQ ID NO: 101787 - DNA, 67 bp, Mus musculus; identical to SEQ ID NO: 93044

SEQ ID NO: 101788 - DNA, 59 bp, Mus musculus; identical to SEQ ID NO: 93045

SEQ ID NO: 101789 - DNA, 77 bp, Mus musculus; identical to SEQ ID NO: 93046

SEQ ID NO: 101790 - DNA, 73 bp, Mus musculus; identical to SEQ ID NO: 93047

SEQ ID NO: 101791 - DNA, 79 bp, Mus musculus; identical to SEQ ID NO: 93048

SEQ ID NO: 101792 - DNA, 122 bp, Mus musculus; identical to SEQ ID NO: 93049

SEQ ID NO: 101793 - DNA, 99 bp, Mus musculus; identical to SEQ ID NO: 101562

SEQ ID NO: 101794 - DNA, 89 bp, Mus musculus
ctccatggtgcagtgatagggtgtatgagatactttcaatatttttgttgagtcctgttttgtgactgattatatggtctattgtggag

SEQ ID NO: 101795 - DNA, 99 bp, Mus musculus; identical to SEQ ID NO: 101562

SEQ ID NO: 101796 - DNA, 85 bp, Mus musculus; identical to SEQ ID NO: 57439

SEQ ID NO: 101797 - DNA, 68 bp, Mus musculus; identical to SEQ ID NO: 101580

SEQ ID NO: 101798 - DNA, 68 bp, Mus musculus; identical to SEQ ID NO: 101580

SEQ ID NO: 101799 - DNA, 94 bp, Mus musculus
tcatgagcaactgggccatatgggaaatataattagtatatgtctgctgactgaagatcagatgtgtttttgttatcatgtgtgctgttcatga

SEQ ID NO: 101800 - DNA, 85 bp, Mus musculus; identical to SEQ ID NO: 57439

SEQ ID NO: 101801 - DNA, 87 bp, Mus musculus
ttctgtgttataaataggaatctagaggaggaaagatgtatggagtcactgacacacacacttaactgaggtttcctttgcacagga

SEQ ID NO: 101802 - DNA, 115 bp, Mus musculus
gctatatgtttagaaataagttagatacgtgcacatgtgtgtgcatgtgcatgtgtgtgcggacacatacacacaaatacacacaagcttatacacttaatcctggatatatggt

SEQ ID NO: 101803 - DNA, 62 bp, Mus musculus
cgtctgggtctctttgtctgtgtggaatggtctctattcgaaggtgggcaaggggtaggatg

SEQ ID NO: 101804 - DNA, 89 bp, Mus musculus; identical to SEQ ID NO: 101616

SEQ ID NO: 101805 - DNA, 71 bp, Mus musculus; identical to SEQ ID NO: 101617

SEQ ID NO: 101806 - DNA, 90 bp, Mus musculus; identical to SEQ ID NO: 101618

SEQ ID NO: 101807 - DNA, 123 bp, Mus musculus
cctgatctctgaaaatacagctaggaagaagctctttgtactctatagccaaaaaaaaaagctttttgtttctatactttacaaccagagatgcctgccttcctatgccaaggacaaggagat

SEQ ID NO: 101808 - DNA, 120 bp, Mus musculus; identical to SEQ ID NO: 101619

SEQ ID NO: 101809 - DNA, 85 bp, Mus musculus; identical to SEQ ID NO: 57439

SEQ ID NO: 101810 - DNA, 90 bp, Mus musculus; identical to SEQ ID NO: 101660

SEQ ID NO: 101811 - DNA, 85 bp, Mus musculus; identical to SEQ ID NO: 57470

SEQ ID NO: 101812 - DNA, 123 bp, Mus musculus; identical to SEQ ID NO: 101703

SEQ ID NO: 101813 - DNA, 120 bp, Mus musculus; identical to SEQ ID NO: 101619

SEQ ID NO: 101814 - DNA, 85 bp, Mus musculus; identical to SEQ ID NO: 57439

SEQ ID NO: 101815 - DNA, 90 bp, Mus musculus
acagtatatctctatttagtgcatttcttcttctgattattatgtatcaggaggaatttattttctggtgcagtctatatggaattctgt

SEQ ID NO: 101816 - DNA, 89 bp, Mus musculus; identical to SEQ ID NO: 101616

SEQ ID NO: 101817 - DNA, 71 bp, Mus musculus; identical to SEQ ID NO: 101617

SEQ ID NO: 101818 - DNA, 90 bp, Mus musculus
acagtatatctctatttagtgcatttcttcttctgattattatgtgtcaggaggaatttattttctggtgcggtctatatggaattctgt

SEQ ID NO: 101819 - DNA, 87 bp, Mus musculus; identical to SEQ ID NO: 101566

SEQ ID NO: 101820 - DNA, 85 bp, Mus musculus; identical to SEQ ID NO: 57439

SEQ ID NO: 101821 - DNA, 99 bp, Mus musculus; identical to SEQ ID NO: 101562

SEQ ID NO: 101822 - DNA, 99 bp, Mus musculus; identical to SEQ ID NO: 101562

SEQ ID NO: 101823 - DNA, 87 bp, Mus musculus; identical to SEQ ID NO: 101566

SEQ ID NO: 101824 - DNA, 85 bp, Mus musculus; identical to SEQ ID NO: 57439

SEQ ID NO: 101825 - DNA, 68 bp, Mus musculus; identical to SEQ ID NO: 101580

SEQ ID NO: 101826 - DNA, 102 bp, Mus musculus
ggtagaggggtcatactctacagtgctacagcaggtaaaggatggagccaggtctctaattctcactccctctgagcatgctcaccagtaaccccccaaacc

SEQ ID NO: 101827 - DNA, 85 bp, Mus musculus; identical to SEQ ID NO: 57439

SEQ ID NO: 101828 - DNA, 68 bp, Mus musculus; identical to SEQ ID NO: 101580

SEQ ID NO: 101829 - DNA, 85 bp, Mus musculus; identical to SEQ ID NO: 57439

SEQ ID NO: 101830 - DNA, 87 bp, Mus musculus; identical to SEQ ID NO: 101566

SEQ ID NO: 101831 - DNA, 57 bp, Mus musculus; identical to SEQ ID NO: 101684

SEQ ID NO: 101832 - DNA, 77 bp, Mus musculus
tctgctgcatacagtgctggagagaggaatggctgtatgctgggtagctctcttactcactgagtgcattctgcaga

SEQ ID NO: 101833 - DNA, 87 bp, Mus musculus; identical to SEQ ID NO: 101566

SEQ ID NO: 101834 - DNA, 85 bp, Mus musculus; identical to SEQ ID NO: 63114

SEQ ID NO: 101835 - DNA, 68 bp, Mus musculus; identical to SEQ ID NO: 101580

SEQ ID NO: 101836 - DNA, 71 bp, Mus musculus; identical to SEQ ID NO: 101563

SEQ ID NO: 101837 - DNA, 87 bp, Mus musculus; identical to SEQ ID NO: 101566

SEQ ID NO: 101838 - DNA, 85 bp, Mus musculus; identical to SEQ ID NO: 57439

SEQ ID NO: 101839 - DNA, 68 bp, Mus musculus; identical to SEQ ID NO: 101580

SEQ ID NO: 101840 - DNA, 87 bp, Mus musculus; identical to SEQ ID NO: 101566

SEQ ID NO: 101841 - DNA, 99 bp, Mus musculus; identical to SEQ ID NO: 101562

SEQ ID NO: 101842 - DNA, 112 bp, Mus musculus
tgtatgtatgtatgcatgtatatgtataggtgtatgtgtatatatgtatgtatgtgaatatatatatgtgtatatatatgtgtatatatatatatatatatatatatatata

SEQ ID NO: 101843 - DNA, 102 bp, Mus musculus; identical to SEQ ID NO: 59928

SEQ ID NO: 101844 - DNA, 79 bp, Mus musculus
tggacagacttgctgctatcacacatgtcgtggcttcaatttctagcaattacattgtgactgtttctctgtctctcta

SEQ ID NO: 101845 - DNA, 99 bp, Mus musculus; identical to SEQ ID NO: 101562

SEQ ID NO: 101846 - DNA, 87 bp, Mus musculus; identical to SEQ ID NO: 101566

SEQ ID NO: 101847 - DNA, 85 bp, Mus musculus; identical to SEQ ID NO: 57439

SEQ ID NO: 101848 - DNA, 68 bp, Mus musculus; identical to SEQ ID NO: 101580

SEQ ID NO: 101849 - DNA, 77 bp, Mus musculus
agtccctctctctctcacctatgtgcttggccactcaggccctctctctcacttaggcgttaggctgggcaggtcct

SEQ ID NO: 101850 - DNA, 114 bp, Mus musculus
accccaatagaagtcgcaccagttttcagcttcacaatgatggggggcaccctgtttgccactcccataccttccatctctgcccatgcatgaagataatctctctaaccaggt

SEQ ID NO: 101851 - DNA, 99 bp, Mus musculus; identical to SEQ ID NO: 101562

SEQ ID NO: 101852 - DNA, 71 bp, Mus musculus
ttttacatatgtgccaagggccaaggtcattctcatgaatgctacctttttgtctcagtgtctgtgtggaa

SEQ ID NO: 101853 - DNA, 71 bp, Mus musculus; identical to SEQ ID NO: 101563

SEQ ID NO: 101854 - DNA, 99 bp, Mus musculus; identical to SEQ ID NO: 101562

SEQ ID NO: 101855 - DNA, 99 bp, Mus musculus; identical to SEQ ID NO: 101562

SEQ ID NO: 101856 - DNA, 71 bp, Mus musculus; identical to SEQ ID NO: 101563

SEQ ID NO: 101857 - DNA, 71 bp, Mus musculus; identical to SEQ ID NO: 101563

SEQ ID NO: 101858 - DNA, 99 bp, Mus musculus; identical to SEQ ID NO: 101562

SEQ ID NO: 101859 - DNA, 99 bp, Mus musculus; identical to SEQ ID NO: 101562

SEQ ID NO: 101860 - DNA, 99 bp, Mus musculus; identical to SEQ ID NO: 101562

SEQ ID NO: 101861 - DNA, 71 bp, Mus musculus; identical to SEQ ID NO: 101563

SEQ ID NO: 101862 - DNA, 78 bp, Mus musculus; identical to SEQ ID NO: 71422

SEQ ID NO: 101863 - DNA, 89 bp, Mus musculus
ctccatggtgatgtgatagggtgtatgggatattttcaatatttttgttgagtcctgttttgtgactgattatatggtcaattgtggag

SEQ ID NO: 101864 - DNA, 72 bp, Mus musculus
gcaggcatgaatgtatgtatgtatgtatgtatgtatgtatgtatgtatgtatgtatgtatgtatgtgtctgt

SEQ ID NO: 101865 - DNA, 117 bp, Mus musculus
gtatttctggtcaacatcttcctactgaagtgacagaaatatttactatttttatatctttatactaacattatatttctgtttaatttgtaggggacaggtttatttgagacaggc

SEQ ID NO: 101866 - DNA, 99 bp, Mus musculus; identical to SEQ ID NO: 101562

SEQ ID NO: 101867 - DNA, 85 bp, Mus musculus; identical to SEQ ID NO: 89807

SEQ ID NO: 101868 - DNA, 74 bp, Mus musculus; identical to SEQ ID NO: 94536

SEQ ID NO: 101869 - DNA, 82 bp, Mus musculus; identical to SEQ ID NO: 94535

SEQ ID NO: 101870 - DNA, 110 bp, Mus musculus; identical to SEQ ID NO: 94534

SEQ ID NO: 101871 - DNA, 115 bp, Mus musculus; identical to SEQ ID NO: 101620

SEQ ID NO: 101872 - DNA, 85 bp, Mus musculus; identical to SEQ ID NO: 57470

SEQ ID NO: 101873 - DNA, 96 bp, Mus musculus; identical to SEQ ID NO: 101622

SEQ ID NO: 101874 - DNA, 86 bp, Mus musculus; identical to SEQ ID NO: 72974

SEQ ID NO: 101875 - DNA, 116 bp, Mus musculus
ttgaagatcagccttagtccatggtgatctgataggatgcatgggacaatttcaatatttttgtatatgcagaggcttgttttgtgatcaattatgtggtcaattttggagaaggt

SEQ ID NO: 101876 - DNA, 78 bp, Mus musculus
gatggtgttttggatttcttcaggatctgtggttaggtctcacttttcatttctgattttgttaattaggatgctgtc

SEQ ID NO: 101877 - DNA, 81 bp, Mus musculus
gcagaagatctagtatgcagggtccaggagtgtaccttcagtgtctgtgagtccctctgagccctgcttagtttattctgt

SEQ ID NO: 101878 - DNA, 100 bp, Mus musculus
ctttaatctgtgatgatctgataggatgcatgggataatttcaatatttttgtatctgttgaggcctgttttgtgaccaattatatgatcagttttggag

SEQ ID NO: 101879 - DNA, 108 bp, Mus musculus
caaatcgagaaacaattagggaaccctccctctacagaaatatcacagtcattttgatttatatttctctcatagcttaggattctctaagtgttccttagccatttg

SEQ ID NO: 101880 - DNA, 91 bp, Mus musculus
gactattgtctcagtatactttataaatattgataatacagtcaattatttttttgaagatataggtgaagtgtactgtattgctttagtt

SEQ ID NO: 101881 - DNA, 93 bp, Mus musculus
gtgcatagtctgatatctggctaagagcatctgcttcaggctctgtcagagcctctcaggagacagctatactaggtttctgtcagtaaacac

SEQ ID NO: 101882 - DNA, 92 bp, Mus musculus
taggaactctgttgtgtgttagacaagtacagaaggattcatcacctggactctgaggaagtaggatgtatgaaacaaggacagggtaacta

SEQ ID NO: 101883 - DNA, 114 bp, Mus musculus
tgaacttcctagtcagtgttaaataaagcttgctttagttggatattgtggaacaggtctttaatattttatatataggcaggcttattgggaagctgctcttgggcaagttca

SEQ ID NO: 101884 - DNA, 80 bp, Mus musculus
acctctaagacttaacagattcctcttacctggttattgttctttggaaacattatggtgagagatgttacagaggtctt

SEQ ID NO: 101885 - DNA, 119 bp, Mus musculus
agaaactggctgaaaaactagcttgcatccttgtgtgaatatgtatatgtctgtctgtaagtctctatatatgaatgcatatgtgcatatttgtttgtatgaagttattggattctgcc

SEQ ID NO: 101886 - DNA, 106 bp, Mus musculus
caggcctaccctgattgagattagtatacccatctagattcagttggagaaaactaatttttttctttgaaatcatgtattaataaaagacaggagtgggagtctg

SEQ ID NO: 101887 - DNA, 106 bp, Mus musculus; identical to SEQ ID NO: 101886

SEQ ID NO: 101888 - DNA, 106 bp, Mus musculus; identical to SEQ ID NO: 101886

SEQ ID NO: 101889 - DNA, 152 bp, Mus musculus
atatgtttatatatgtataatacatatgtatgtatgtgtgtatatatatacatatatgtacatgtaaagatatatagaggtatatatgtgtataaacatatatgtatataatttaggtatatatgtatgtatttatgtgtatatatatagat

SEQ ID NO: 101890 - DNA, 147 bp, Mus musculus
gcatatgttacacatataaatatatgtataggcatatatgtatatatgtatatgtgattatgtatatacatatatatttatatgcatatgtatatataagtataggtatacatatatgtgtatatgaatgtggatatgtatatatat

SEQ ID NO: 101891 - DNA, 113 bp, Mus musculus
atgtgtatgtatatatgtatatgtatgtatgtatgtatatatatatgtatgtatgtatgtatgtatgtatgtatgtatgtatgtatatatgtatgtatatatgtatatgtgta

SEQ ID NO: 101892 - DNA, 251 bp, Mus musculus
aatatgtatatatgtatgtatgtgtttatatgtatgtgtgtgtatatatatatatatgcatgtctatatatatgtattatatatatgtattatatatatgtatatatacacacatgtatgtatatatatacatgtatatatgtgtgtgtgcatatgtataggtatatgttataaatatatgtatatatttacatgtttatgtgtacgtatataaagaatttatatgtgtatgtgtatatatgtgtatatat

SEQ ID NO: 101893 - DNA, 85 bp, Mus musculus; identical to SEQ ID NO: 57470

SEQ ID NO: 101894 - DNA, 85 bp, Mus musculus; identical to SEQ ID NO: 57439

SEQ ID NO: 101895 - DNA, 85 bp, Mus musculus; identical to SEQ ID NO: 57439

SEQ ID NO: 101896 - DNA, 85 bp, Mus musculus; identical to SEQ ID NO: 57470

SEQ ID NO: 101897 - DNA, 254 bp, Mus musculus
tacaatatgtatatatgtatgtatgtgtttatatgtatgtgtgtgtatatatatatatgcatgtctatatatatgtattatatatatatgtattatatatatgtatatatacacacatgtatgtatatatatacatgtatatatgtgtgtgtgcatatgtataggtatatgttataaatatatgtatatatttacatgtttatgtgtacgtatataaagaatttatatgtgtatgtgtatatatgtgtatatat

SEQ ID NO: 101898 - DNA, 110 bp, Mus musculus
ttgtatatgtatctatatgtctatgtatgtacatatatatgtatgtttatgtgtatatataagtgtatatatgtatttgtgtgtatgtatgcatgtatatgtgtatgaat

SEQ ID NO: 101899 - DNA, 76 bp, Mus musculus
tatatgtatgcatatatatgtatataaatatatatgtgggcgtatgtgtatatatatgtatgtatgtgtatgtgtg

SEQ ID NO: 101900 - DNA, 117 bp, Mus musculus
atgtgtatgtatatatgtatatgtatgtatgtatgtatacatatatgtatgtatgtatgtatgtatgtatgtatgtatgtatgtatgtatgtatgtatgtatatatgtatatgtgta

SEQ ID NO: 101901 - DNA, 167 bp, Mus musculus
gtctatgtacatttatatgcatgtgtgcatatgttacacatataaatatgtgtataggcatatatgtatatatgtatatgtgactatgtatatacatatatatttatatgcatatgaatatataagtataggtaaacatatatatgtatatgaatgtggatatatgt

SEQ ID NO: 101902 - DNA, 80 bp, Mus musculus
tatgtatatatgtatatatgtgcgtgtgtgtgtatatatatgtatatatatacacacatatatatatacatatatatatg

SEQ ID NO: 101903 - DNA, 74 bp, Mus musculus
tatatgtgtgtgtgtatatatgtgtgtatatacacatatatgtatatatgtatatgtatatacatgcacatatg

SEQ ID NO: 101904 - DNA, 80 bp, Mus musculus
atatatagatatatatgtgtgtgtgtatatatgtgtgtatatacacatatatgtatatatgtatatgtatatacatgcac

SEQ ID NO: 101905 - DNA, 70 bp, Mus musculus
tgcacacacacacacacatgcatccatgagcatgagttcaagcatccctctgtgtgtgtgtgtgtgtgca

SEQ ID NO: 101906 - DNA, 85 bp, Mus musculus; identical to SEQ ID NO: 57470

SEQ ID NO: 101907 - DNA, 85 bp, Mus musculus; identical to SEQ ID NO: 57439

SEQ ID NO: 101908 - DNA, 85 bp, Mus musculus; identical to SEQ ID NO: 57439

SEQ ID NO: 101909 - DNA, 63 bp, Mus musculus
ccaagttcctgctttctgggagagcaagaagcactcactctcagccactgaatcaggtcttgg

SEQ ID NO: 101910 - DNA, 77 bp, Mus musculus
gctgagtgtatgtgtctgtctgtctgtatgtgtacacacaagtacaggtgtataacacacaaacatatatacaatgc

SEQ ID NO: 101911 - DNA, 69 bp, Mus musculus
tctatagatatctattgatatagatatatctctaagtatatatatctatagatttagatatgtgttaga

SEQ ID NO: 101912 - DNA, 68 bp, Mus musculus; identical to SEQ ID NO: 101580

SEQ ID NO: 101913 - DNA, 85 bp, Mus musculus; identical to SEQ ID NO: 57439

SEQ ID NO: 101914 - DNA, 87 bp, Mus musculus; identical to SEQ ID NO: 101566

SEQ ID NO: 101915 - DNA, 121 bp, Mus musculus
caatacaccagacattagctggaaagtgaggtacaagtaggtcatgtcctttggattcttctctctcagtctgttaaatgggcgtcctgtcattgtttgttattgttgttggttgttgttt

SEQ ID NO: 101916 - DNA, 76 bp, Mus musculus
gttttcagcttcacaatgatggggggcaccctgtttgcctctcccataccttccatctctgcccaggcatgaagat

SEQ ID NO: 101917 - DNA, 98 bp, Mus musculus
atcattctatgctatataaaggaacatagaagaggaaagctgtttggtgtcactgacacacacacttaactgaggtttcctttgcacagtaagaagat

SEQ ID NO: 101918 - DNA, 81 bp, Mus musculus
acagatggatatgtgtatatatgtattatagctatatgcttataggtgttatattatatatatatatatatatgtgtgtgt

SEQ ID NO: 101919 - DNA, 85 bp, Mus musculus; identical to SEQ ID NO: 101612

SEQ ID NO: 101920 - DNA, 85 bp, Mus musculus; identical to SEQ ID NO: 57439

SEQ ID NO: 101921 - DNA, 85 bp, Mus musculus; identical to SEQ ID NO: 57439

SEQ ID NO: 101922 - DNA, 69 bp, Mus musculus
gggaatgagactggtcactcactgtgtctttgataacatatgtctcgtgagtgactctctttccttccc

SEQ ID NO: 101923 - DNA, 74 bp, Mus musculus; identical to SEQ ID NO: 78018

SEQ ID NO: 101924 - DNA, 104 bp, Mus musculus
agccgtgaaatagagtgggagtttggagttaggtacagactctgcctaagctgtctctgtctctcaggccacccttcatagctcccctctgccacttcgctgct

SEQ ID NO: 101925 - DNA, 87 bp, Mus musculus; identical to SEQ ID NO: 101566

SEQ ID NO: 101926 - DNA, 85 bp, Mus musculus; identical to SEQ ID NO: 57439

SEQ ID NO: 101927 - DNA, 68 bp, Mus musculus; identical to SEQ ID NO: 101580

SEQ ID NO: 101928 - DNA, 99 bp, Mus musculus; identical to SEQ ID NO: 101562

SEQ ID NO: 101929 - DNA, 88 bp, Mus musculus
ggaggaaatgtaatactgtgcttgtggactttgaggtcggctatgcttaagctgtccccagtgtgacacacagtctctatcttctacc

SEQ ID NO: 101930 - DNA, 99 bp, Mus musculus; identical to SEQ ID NO: 101562

SEQ ID NO: 101931 - DNA, 85 bp, Mus musculus; identical to SEQ ID NO: 57439

SEQ ID NO: 101932 - DNA, 68 bp, Mus musculus; identical to SEQ ID NO: 101580

SEQ ID NO: 101933 - DNA, 99 bp, Mus musculus; identical to SEQ ID NO: 101562

SEQ ID NO: 101934 - DNA, 99 bp, Mus musculus; identical to SEQ ID NO: 101562

SEQ ID NO: 101935 - DNA, 119 bp, Mus musculus
aaaaggtctaaaaattagaaagacacacactaggtacatgcacaccacagattctgactctgtctctgattctgaatctccctttgactgtccctgtgactctgcctgtccttcctttt

SEQ ID NO: 101936 - DNA, 99 bp, Mus musculus; identical to SEQ ID NO: 101562

SEQ ID NO: 101937 - DNA, 87 bp, Mus musculus; identical to SEQ ID NO: 101566

SEQ ID NO: 101938 - DNA, 68 bp, Mus musculus; identical to SEQ ID NO: 101580

SEQ ID NO: 101939 - DNA, 85 bp, Mus musculus; identical to SEQ ID NO: 57439

SEQ ID NO: 101940 - DNA, 89 bp, Mus musculus; identical to SEQ ID NO: 101616

SEQ ID NO: 101941 - DNA, 87 bp, Mus musculus; identical to SEQ ID NO: 101566

SEQ ID NO: 101942 - DNA, 99 bp, Mus musculus; identical to SEQ ID NO: 101562

SEQ ID NO: 101943 - DNA, 87 bp, Mus musculus; identical to SEQ ID NO: 101566

SEQ ID NO: 101944 - DNA, 85 bp, Mus musculus; identical to SEQ ID NO: 57439

SEQ ID NO: 101945 - DNA, 85 bp, Mus musculus; identical to SEQ ID NO: 57439

SEQ ID NO: 101946 - DNA, 99 bp, Mus musculus; identical to SEQ ID NO: 101562

SEQ ID NO: 101947 - DNA, 85 bp, Mus musculus; identical to SEQ ID NO: 57470

SEQ ID NO: 101948 - DNA, 120 bp, Mus musculus
ccctgatctctgaaaatacagctaggaagaagctctttgttctctatagccagcaaaaaaagctttttgtttctatactttacaaccagagatgcctgccttctttttccaaggacacgg

SEQ ID NO: 101949 - DNA, 85 bp, Mus musculus; identical to SEQ ID NO: 76427

SEQ ID NO: 101950 - DNA, 87 bp, Mus musculus; identical to SEQ ID NO: 101566

SEQ ID NO: 101951 - DNA, 85 bp, Mus musculus; identical to SEQ ID NO: 57439

SEQ ID NO: 101952 - DNA, 68 bp, Mus musculus; identical to SEQ ID NO: 101580

SEQ ID NO: 101953 - DNA, 68 bp, Mus musculus; identical to SEQ ID NO: 101580

SEQ ID NO: 101954 - DNA, 85 bp, Mus musculus; identical to SEQ ID NO: 57439

SEQ ID NO: 101955 - DNA, 87 bp, Mus musculus; identical to SEQ ID NO: 101566

SEQ ID NO: 101956 - DNA, 99 bp, Mus musculus; identical to SEQ ID NO: 101562

SEQ ID NO: 101957 - DNA, 87 bp, Mus musculus
ttctgtggtataaataggaatctagaggaagaaaggtgtttaaagtcactgacacacacacttaacctaggtttcctttgcacagga

SEQ ID NO: 101958 - DNA, 85 bp, Mus musculus; identical to SEQ ID NO: 57439

SEQ ID NO: 101959 - DNA, 68 bp, Mus musculus; identical to SEQ ID NO: 101580

SEQ ID NO: 101960 - DNA, 68 bp, Mus musculus; identical to SEQ ID NO: 101580

SEQ ID NO: 101961 - DNA, 85 bp, Mus musculus; identical to SEQ ID NO: 57439

SEQ ID NO: 101962 - DNA, 87 bp, Mus musculus; identical to SEQ ID NO: 101957

SEQ ID NO: 101963 - DNA, 71 bp, Mus musculus; identical to SEQ ID NO: 101563

SEQ ID NO: 101964 - DNA, 71 bp, Mus musculus; identical to SEQ ID NO: 101563

SEQ ID NO: 101965 - DNA, 99 bp, Mus musculus; identical to SEQ ID NO: 101562

SEQ ID NO: 101966 - DNA, 90 bp, Mus musculus; identical to SEQ ID NO: 101660

SEQ ID NO: 101967 - DNA, 85 bp, Mus musculus; identical to SEQ ID NO: 57470

SEQ ID NO: 101968 - DNA, 60 bp, Drosophila melanogaster
ttgcgaactatatgcatatatgccatggcaacgttatatgtatgtatgtatgtatgtcaa

SEQ ID NO: 101969 - DNA, 95 bp, Drosophila melanogaster
ttatggcgaatagagtgagccaaatgtgtgggcagttggttgtctagttaaaatagcattactctgtccggtttggtgtatcaattttaatgtaa

SEQ ID NO: 101970 - DNA, 73 bp, Drosophila melanogaster
gccgtgtgttaatttgttgcatgcatttgcattgttataatgtccaacagaatgtgcaacattctcgcattgc

SEQ ID NO: 101971 - DNA, 89 bp, Drosophila melanogaster
ccgctttagtacttagtatttagtattgcacttgtctgataagtcgactgataagttcatcaagtgcttaattgagttaatcggggcgg

SEQ ID NO: 101972 - DNA, 108 bp, Drosophila melanogaster
cgagtgtggtaactgagtaactgagtgactgagtgaagactgtgggcatgggcatgggcatcaccggcctctcatcatcggtaaggcaagtttaacagacggcaattg

SEQ ID NO: 101973 - DNA, 85 bp, Drosophila melanogaster
aatgctgtgaatggtgaatagtgagcagtgagtgtgcagtcagttagtcactcggtctgcacatgccggataagtgaatagcatt

SEQ ID NO: 101974 - DNA, 82 bp, Drosophila melanogaster
ctggcacttgtctggatgcagggaataaagtttatagattgaagttgtattactttagccactgtatatatatttgtgtaag

SEQ ID NO: 101975 - DNA, 119 bp, Drosophila melanogaster
ttagtaataggattatttttataaataaagaaatcctaggaattcatagcaaagttattaaatatttattctatgaataaacttaggttctttttttattttcattatttaaatactgg

SEQ ID NO: 101976 - DNA, 82 bp, Drosophila melanogaster
taagtgtctgcatgtgcaagtcgatatgtggccatatgtaatatatgtggctatgtttgtacaacaaaccaggggacacttg

SEQ ID NO: 101977 - DNA, 98 bp, Drosophila melanogaster
gggaaacttatggcaatggcttggccggaaattcaattggctggaaaatgtttttttttttctccggatgtttccgtgagagcacttgtcgtgttgcc

SEQ ID NO: 101978 - DNA, 109 bp, Drosophila melanogaster
ccttcgttcgtaattgagttgataaagctttcggtgcggcgcactcgcactcacactgtttgtgtaatttgtgtaatgcatgcaaagttaattacctcggggagcttgg

SEQ ID NO: 101979 - DNA, 116 bp, Drosophila melanogaster
ctgtgagatacatttctgccgctcatatgtacgtatatgtatatctatatgtatatatatgtgtatgtgtgatataagcatcgtatattttggccaggcaaaaagtcaaatgacag

SEQ ID NO: 101980 - DNA, 92 bp, Drosophila melanogaster
ctcgaactgcgcagtgcgcatgcgcagcgtatgtagctgttagacccacacacagacactcacacgtgcacttgcactgtccgcggacagag

SEQ ID NO: 101981 - DNA, 87 bp, Drosophila melanogaster
tctgtgtctgtgtttctgtgactctgtgtgggttggcagcaatacgtgctgccttaataagcccgttaatggaatattaggcaaaga

SEQ ID NO: 101982 - DNA, 79 bp, Drosophila melanogaster
gagcatgagacagtgtgtgtgtgtgtgtgcgagagagggtttgtttatgtacagggcaaatacataattcataacgctc

SEQ ID NO: 101983 - DNA, 85 bp, Drosophila melanogaster
agggaggatgggatgagtgcagacaggcaaggatgtgtggtgcacaggtacacacgctcactcgcacactcacgtaatgctcttt

SEQ ID NO: 101984 - DNA, 85 bp, Drosophila melanogaster
tcggcagactttatgaccaatcaattgacacagattataactattatcaactaatcattgttttttgatttatgaagagtggcga

SEQ ID NO: 101985 - DNA, 104 bp, Drosophila melanogaster
cgtcactttggcacacacactcacaccactgaaatagggatatatgtatatatgtatgtatgtattctgtgcgtatgtgtctgtgtgcggaatacaaaatggcg

SEQ ID NO: 101986 - DNA, 119 bp, Drosophila melanogaster
gcacagaattaagcatacttccaggcactcagcggcatattatgtttatcattatgtttatactatgggtatatatggggcctaatgttgccgctttcttggccaacgccagctgttgc

SEQ ID NO: 101987 - DNA, 110 bp, Drosophila melanogaster
agatcatcaaaggctcggtagagctcgagtagcacatcaccatccgtctcgtcctctttgaggaactccatgtcgaagcagcgtcgcagctttgcccttttgaggaggct

SEQ ID NO: 101988 - DNA, 100 bp, Drosophila melanogaster
cacgtcctggaactgaaagtcaggctgactggctcgtcgagttgtcacaatcactctgacagggaggtcagccaaagtatttctctatatcctagatatg

SEQ ID NO: 101989 - DNA, 84 bp, Drosophila melanogaster
gagaccgtaccgaaatataattcctaattagccagaactgcactgcagctgcatctgcatatggatctgcatttcggtggtctt

SEQ ID NO: 101990 - DNA, 70 bp, Drosophila melanogaster
tagtcaagagtttgccaggctgtgtgtgtgtgtatgcatgtatgtatgtgactggctgagtgtttggctg

SEQ ID NO: 101991 - DNA, 88 bp, Drosophila melanogaster
gcatctcaacgtgtgtccgcacacacactcgctcacacgtaagtgagagtatctgtgtgtgcgtatatctttgcctgcgtgtgtgtgt

SEQ ID NO: 101992 - DNA, 109 bp, Drosophila melanogaster
attatggctgtgatttgtggaaggtgtgctcttgagtagaaatttcaatgtttttgatatggaacaatgcccaaatgaaatactcataatacttaagtcaaaacataat

SEQ ID NO: 101993 - DNA, 109 bp, Drosophila melanogaster
tggtatatagatctcggcacagttaatggcactggaagaattcacggggtaatttttatacaacccgtgatctcttagtggcatctatggtgcgagaataaaacatcca

SEQ ID NO: 101994 - DNA, 123 bp, Drosophila melanogaster
gaccgatacagtcgccggatgagagctccatatggtttccgcgccatcaggtgagtggttgtcttgtgtatttcgtagacgcaattcgtttcgagacacacaaaaggctcctccacctgcagg

SEQ ID NO: 101995 - DNA, 110 bp, Drosophila melanogaster
ttggtgcagtttaagcaatatagttgatatgttgaaattaatatttatttacagctctaaatatgttataatttataatatttactatttcatttgtttagtagctctgg

SEQ ID NO: 101996 - DNA, 81 bp, Drosophila melanogaster
gaaccatttcacacacactcgcacacacttagtcacccacacgagcacccggttagtgtgtgtgtgtgtgtgtgtgctgtc

SEQ ID NO: 101997 - DNA, 79 bp, Drosophila melanogaster
gcatactcactcacacactcataaacccacgaataaagaaaagttggctgttttctgtgggtggcgagtgggtggtggc

SEQ ID NO: 101998 - DNA, 118 bp, Drosophila melanogaster
aattaaaagggagagaaggggagacatagaggaatacatatgtatgtatgtatgtatgcaccgaatgcacgactttggtatatttgtgttctggctagaccaatatctcatattaatt

SEQ ID NO: 101999 - DNA, 67 bp, Drosophila melanogaster
cgcgcacactcacacactctcggctgaaatggcggcaaatatgacccgtttttttgagcgttgcgcg

SEQ ID NO: 102000 - DNA, 68 bp, Drosophila melanogaster
gagtgagagggagagcaagagagcggtcagctagtcactcactcggtttctcactcgctcactcactc

SEQ ID NO: 102001 - DNA, 94 bp, Drosophila melanogaster
agtgagagctcgagcgatgctgagtactgtttttgttgatttgtcaaatgtgaagaaagcgtggcgtggcgttgctgttgttgtggctgtggct

SEQ ID NO: 102002 - DNA, 77 bp, Drosophila melanogaster
gtttcgaaatggcgaagatggcatgatgtacatatatatgtatgtatgaatgtatgtcaaattctcatttcgcttac

SEQ ID NO: 102003 - DNA, 106 bp, Drosophila melanogaster
gcaaagtatctgtgtgtgggtctctgctactgactgtgtgtgtgtgtttgtacgcctcattgagctacggcagagaaaacaaaaaaagaagcaaacaagtacgggc

SEQ ID NO: 102004 - DNA, 73 bp, Drosophila melanogaster
atatatatatctttatatccctgcgggagtcgctcccctgtgtctgtgtgccggtgtgtatttgtgtgtgtgt

SEQ ID NO: 102005 - DNA, 115 bp, Drosophila melanogaster
ctttgtctgtccccggagcagatgtgttatcctgctgatgaggactgcatggtgaatgcaagttcgtcgttcagccacaatggcaatgtgtgaatgtttccactgacaaatgaag

SEQ ID NO: 102006 - DNA, 81 bp, Drosophila melanogaster
cctccgtccgtccgtccgtccgtctgatgtttgtatttgtgcacctgactagaaagacatagggagtgggcgggcaggtgg

SEQ ID NO: 102007 - DNA, 84 bp, Drosophila melanogaster
ttgtcagtctgcctctcagtctgttatgggtcgaaatctggtttgggttccgactttccatggctgctgttgttgcgatgacaa

SEQ ID NO: 102008 - DNA, 93 bp, Drosophila melanogaster
ggcgagtggaaaaaatagtcggggaaaactttatttgcccattccggctgcatattcccaaagtcagtcagtccgtctgttttcccgcttacc

SEQ ID NO: 102009 - DNA, 67 bp, Drosophila melanogaster
ggcgaaggatatttctttaaacttgtcgcccgcatcgggattcttgtctggatggaactcttttgcc

SEQ ID NO: 102010 - DNA, 116 bp, Drosophila melanogaster
atgccatgactactcgtatatgaaactccatcctatatatatatatattacgaatatgtacatatatatatatacctacggctggtcagttttcactgctgagctgttgtgggcat

SEQ ID NO: 102011 - DNA, 72 bp, Drosophila melanogaster
gtcctgcacgtcctgctaatgtttgcatgtgcactcccacgctcacacagtctttggcgtcggcggcggctc

SEQ ID NO: 102012 - DNA, 82 bp, Drosophila melanogaster
tgtcacaaaaatttggcttgggaaattgacatctatgaatacgtatgtatgtatgtatgtcgaagtgtttcaaattgtgaca

SEQ ID NO: 102013 - DNA, 116 bp, Drosophila melanogaster
tgcagctgcaggaggcaggaggaccagggccaggatgtctgcaactcgttcacggtgcatgtatttttaattaattgcaagacccccgccccatcccctacattttccgcaaggta

SEQ ID NO: 102014 - DNA, 76 bp, Drosophila melanogaster
gcaaaatcacaaaacaatttgcatatacatctacaatatatttctatgtatatgtatatgtatatgtatgatgtgc

SEQ ID NO: 102015 - DNA, 115 bp, Drosophila melanogaster
cgagagttggtccttttcgcaagtacagcccttccctgcgctttgttgtctgccaccagtggttattgttattgttcttaatgttggctttcttgtgtgccagacttcgccgcgt

SEQ ID NO: 102016 - DNA, 91 bp, Drosophila melanogaster
gtcggaatctgcaaggataaacacgggttgaaacagatagtttattttgtttacttagtccttttcaattccctgggaccttgccgctggc

SEQ ID NO: 102017 - DNA, 115 bp, Drosophila melanogaster
agatatggcaaatcactttcaacacgtatccgccaagtgggcttgtctatgcgtctgtgtgtgtgcgtacgcatgtctgcttgtcaaatggttgaacgaatcaatgggccactct

SEQ ID NO: 102018 - DNA, 101 bp, Drosophila melanogaster
cgctctgactccggactgcacatctatatatatatatacgtatatatgtatgtatttcgatatatgtatgtatagaagtgtgtatatagcgaaaagtgcgg

SEQ ID NO: 102019 - DNA, 82 bp, Drosophila melanogaster
gcacgcacacacacacagacgcactctcgccgctcactggacagcatcagcggtaggctccattgcatcagtgttggcgtgt

SEQ ID NO: 102020 - DNA, 84 bp, Drosophila melanogaster
attaattatttaagttttacctacttaattgattgcgatagtaatttttgtttttctaaaaagtaggtgtcttagatgagagat

SEQ ID NO: 102021 - DNA, 92 bp, Drosophila melanogaster
tgccgtggcatattgactgggtcagtcagtccgtgatatgcatatgagtgccactttctacactccatgggaagagacccatagccacgacg

SEQ ID NO: 102022 - DNA, 84 bp, Drosophila melanogaster
gaaaggattttcggtgggtgcggatgccgatgcggttgtatctctgtatctcagtatctcactgtctggccgagaacccctgcc

SEQ ID NO: 102023 - DNA, 106 bp, Drosophila melanogaster
aagcacggcatgtaactcatatcgtcaggctgcctgcctgttagcccgactgcctggtggcggcttgaaacaagaaaaagccgaaggagaaacatgttaactgctt

SEQ ID NO: 102024 - DNA, 87 bp, Drosophila melanogaster
tcgcgatgttaatcattttaattggcgccacttgaacgagtcgcactctgtgtgagtgtctgattggtgtccattaattttgtggca

SEQ ID NO: 102025 - DNA, 80 bp, Drosophila melanogaster
tgttctgaatttccacgaaaatttcatgtaattatatgtatgtatgtatgtatgtatgtatggatgtgtggacaggggca

SEQ ID NO: 102026 - DNA, 118 bp, Drosophila melanogaster
caaggcacttaagtggtttggacttttctgagtggcacctcgttgacgctggtgggtgctcattcactcactgactctcaccgctcgtttcgaatatcatgtccattcgaatgccctg

SEQ ID NO: 102027 - DNA, 85 bp, Drosophila melanogaster
gttcgggatgggtatggttacgggggatccagctcaaagctctgacagaaacagagctggccactgactgactgactcaccgagc

SEQ ID NO: 102028 - DNA, 108 bp, Drosophila melanogaster
gactgacttagcctgatgaaagcctgacagcagctgcaagctgcaactgcaactgcaacttgcgattgcaattgcggctactgttgctgcaacggttgcaagtctctc

SEQ ID NO: 102029 - DNA, 73 bp, Drosophila melanogaster
caagtcaagtcccaaacaaacctggtccaacttcgagttggagtggaaagttgtttgcagcttcaatctcttg

SEQ ID NO: 102030 - DNA, 83 bp, Drosophila melanogaster
tactgcgatccatcgatggtctgtggagtgctgagcttgagcctgagcccagcttagatatcatcatcatcatcatcgtagta

SEQ ID NO: 102031 - DNA, 111 bp, Drosophila melanogaster
cgtatctatgagattgccattgcagtgtttgcctcactcgcactctgtgtgtattgcaaaattgagttgtgcgctttggggttttaattgttaattgttggctcagcgggc

SEQ ID NO: 102032 - DNA, 117 bp, Drosophila melanogaster
ggtctaagcaggcagtggaaaacgggggaaaacgcggcgaaatagatttcattcaatggaaagaagtgtgatgtagcttgttgaatgttctgtccgaccattagtattgatttgact

SEQ ID NO: 102033 - DNA, 100 bp, Drosophila melanogaster
ttgatagtgcataaaatagaatggagtgtttctttatttataagtaagctgcagggaaagttggctagtaaaaagtgaatccctattttatgtaggtcag

SEQ ID NO: 102034 - DNA, 78 bp, Drosophila melanogaster
gccctcatcgtcatgcacttgcgatatcagcacatgtatctttgtatctatgtatctgcgtgtgtgcgcgcttgtggc

SEQ ID NO: 102035 - DNA, 91 bp, Drosophila melanogaster
tttgataaaaattccatttgttttttttttttcatttggggacatcagttgttgggtagaaaactgaaaaactgaatggttaggtaacaaa

SEQ ID NO: 102036 - DNA, 104 bp, Drosophila melanogaster
ggtgcaccgcggtaagtgctcggaaatggagagctttggcatttatatatgatttttgatcattaccagctcacgtttccctcttggttgcgcaccttttccgc

SEQ ID NO: 102037 - DNA, 78 bp, Drosophila melanogaster
gttgatgttttgacgttgtacgttgattagatactcgtacctggcgagcttgttagatgcatgtcagatgcagtcggc

SEQ ID NO: 102038 - DNA, 58 bp, Drosophila melanogaster
ttcggctcaacagaaatgccgatgcatgcaaatttgtgtatttcttgttgagctcgaa

SEQ ID NO: 102039 - DNA, 99 bp, Drosophila melanogaster
gattgtcggccagccaggctctggctctgactctggctctccagtgaacctgagcttgagtctcggccatagactttgactgtgactgagcctccattc

SEQ ID NO: 102040 - DNA, 73 bp, Drosophila melanogaster
gccactcagtacctcactcagtctaatggccagaacaccgcggtcatctcgagtggacaggttgtaaagtggc

SEQ ID NO: 102041 - DNA, 112 bp, Drosophila melanogaster
cggtggagcaaattgttcagcagttatcgtgtgattgtatttatatatgtacatacgtaccttgcatatatggatcttttagttaaatgttaattgactgatgaattgactg

SEQ ID NO: 102042 - DNA, 87 bp, Drosophila melanogaster
ccccgtctgcgttactctgtgcctgtgtgtgtgcgttgcccaattatgcaattttagcgcataaatttcatgactcgcgaccggcgg

SEQ ID NO: 102043 - DNA, 63 bp, Drosophila melanogaster
gacgaccaactgtgcatctgcatctgcatttttatgtgtgtgcgggtgcgcagtatatttgtt

SEQ ID NO: 102044 - DNA, 118 bp, Drosophila melanogaster
caggcagagtgagttcttagtgtgcccgaaataaaccacttctccggatcgcgtgtatgaggatgtggatgtggtcttggatgctgaaggttgggtgcggggggcaggacgttgaatg

SEQ ID NO: 102045 - DNA, 86 bp, Drosophila melanogaster
gcagattttcgctgggatttgtagagtactgcaggatttgctcccaatgggtaaggtagtacattgtgctgagggaatccgtctgt

SEQ ID NO: 102046 - DNA, 74 bp, Drosophila melanogaster
gtatagccaaggagtcagctctagctgtgttggttatcgttatcgcggctagcagcttgttttgttttgcttac

SEQ ID NO: 102047 - DNA, 117 bp, Drosophila melanogaster
tgtgtggatgttacaatcttgctgatgcagttgaattttaatgaaactttttctattttccacttttttttttttttattattttgctcagcaaattgaattatagcagcccacaca

SEQ ID NO: 102048 - DNA, 92 bp, Drosophila melanogaster
tgcacaaaaaggagggtagaaggatgcatacgcatcctgcaccctgaatgtatgtatgtatgtatccgtaactccttctgacatcaagtgca

SEQ ID NO: 102049 - DNA, 110 bp, Drosophila melanogaster
gtggtgtgcggaatctatttcattgcggagagggaaactgactgactgactgactgactgtcaagttatggcttctctgtcctaagtgtgtgtgtgtgtgtgtctactgc

SEQ ID NO: 102050 - DNA, 95 bp, Drosophila melanogaster
cgaggcagcggcacactcgcacactcgcacacacccacatgtgcggagactccgcataattgatgtgtttttgtgagttatgtctgagctcctcg

SEQ ID NO: 102051 - DNA, 76 bp, Drosophila melanogaster
gcaacgcagacaggactcaagtgagacagcactcgtcggtgccaactcaagtgtaatttccattgtttgcgctcgc

SEQ ID NO: 102052 - DNA, 112 bp, Drosophila melanogaster
ttggccaattccttatgttaaaggcatttcgattatggtatgtattggagaatccattgtggaatagctagtgatattgaaacgcgtgaaactaattaagaagcgggcgcaa

SEQ ID NO: 102053 - DNA, 76 bp, Drosophila melanogaster
gcaatccgggccagctgcttattcctgcaggttatgccgctccgttgactgttactgcagcttgaactggatgtgc

SEQ ID NO: 102054 - DNA, 92 bp, Drosophila melanogaster
tgatttcgtcttttcgtgtacctctgctgattttttattttaccattttgttttgaaaatgtgtcaaggcagagagcagacaagagggttca

SEQ ID NO: 102055 - DNA, 110 bp, Drosophila melanogaster
tatcatttttgctgtttctttggtattctagctgtagattgtttcacgcacattgtatatcatctaaagcttttataccaaagctccagcttaaattgcttaacatgata

SEQ ID NO: 102056 - DNA, 103 bp, Drosophila melanogaster
tagtttaaaagtccactcgatggctcaggtacttagtgactctcaatgcttttgacattttgggggtcactctgtgcctgtgctgccagtgggacataatcta

SEQ ID NO: 102057 - DNA, 103 bp, Drosophila melanogaster
gagtgaagctgacttgccattgctttggcgctttagctgtatgatagatttaaactacttcataaagctagattaccaaagcattggcttctgcaggtcaatc

SEQ ID NO: 102058 - DNA, 73 bp, Drosophila melanogaster
gccaatgctttggtaatctagctttatgaagtagtttaaatctatcatacagctaaagcgccaaagcaatggc

SEQ ID NO: 102059 - DNA, 114 bp, Drosophila melanogaster
gctcttttgtttgcatattatttgctctttggtgattttagctgtatggtgtttatgtatattccatagagctttattaccaaaaaccaaatggtttctgcattatgtttgagt

SEQ ID NO: 102060 - DNA, 59 bp, Drosophila melanogaster
ctgtgcagccaagagagtgaccaagagaaacgctctctctctctctctcagttgtccag

SEQ ID NO: 102061 - DNA, 85 bp, Drosophila melanogaster
gccggcaacaaaaagcctgaagctgcaactgcaactggcgctgctgttgtgctgatgcatttgtagatgttgctgctgctgctgc

SEQ ID NO: 102062 - DNA, 85 bp, Drosophila melanogaster
ttaagcagcttgtgtgtatttggttaaaggagtgtttttattttatacataaggccctcccaaccacactcggtcgattgcttga

SEQ ID NO: 102063 - DNA, 90 bp, Drosophila melanogaster
cgggtcgggggttgagtcgttggcagcccggcaatgcagttggcaacactctgtttggccattcgcacacactcacagactttctgcccg

SEQ ID NO: 102064 - DNA, 106 bp, Drosophila melanogaster
gtgtgggtgtgtccttgtccgcttgtcagtgtgtctgtgtgtctgtgcggcgtatccgtttaggttttccaacagcagcaggcgaagaaggagcagcactcagcgc

SEQ ID NO: 102065 - DNA, 82 bp, Drosophila melanogaster
gcttcgttacatacatggcttcgtgcacataaaatgtgtatatcatttattacacattttgttgatgtccctgtaagtgagc

SEQ ID NO: 102066 - DNA, 85 bp, Drosophila melanogaster
agaaatgcctcactgactgactgactgaatgactggcattgccctctgcgtgctagtgtgtgtgttacccattgtgggtattgct

SEQ ID NO: 102067 - DNA, 117 bp, Drosophila melanogaster
ttgttgagttcactgagcgaaatgagttgtttgtctgtccgtccgtccgtccgtcagtgtgctcacgtatgtgtaaatgggtgggcattagctcgcttcagcaggtgggcggagtgg

SEQ ID NO: 102068 - DNA, 84 bp, Drosophila melanogaster
gttattgtgtggaattttcactggctttcagttttatgctgatttgcatggggcgcaaggtcaacgatgttgcacgcagctgat

SEQ ID NO: 102069 - DNA, 120 bp, Drosophila melanogaster
acaaacaagtttgctcttcggccacatccttgcgtccttcgtcctgtctgtctctctgtgtgcgtaacaggtgcagtgtgaacagcagaagatggagaggagatagaaactgagttttgt

SEQ ID NO: 102070 - DNA, 103 bp, Drosophila melanogaster
ccaaacagtgggtggcacacgagcgaattccttgcatatttcaatatatttcaatatacatacatagcaagaaatttgttttgtgactcattgtgtttcgtgg

SEQ ID NO: 102071 - DNA, 82 bp, Drosophila melanogaster
gcatacatacatagcaagtacatgtacatgtgtatgtctgtatgttacacttaagtacgtatgtatgcatgtatgtaactgc

SEQ ID NO: 102072 - DNA, 79 bp, Drosophila melanogaster
acagtttttaggtacttatgtgcatatttatttgtataatcatatgcaaaagaatgacacatttaccaaaacaagctgt

SEQ ID NO: 102073 - DNA, 67 bp, Drosophila melanogaster
cattgttgtcttgcagcagctgatcggcaaacagcaagctgaataggcggccgtaaagaaaacggtg

SEQ ID NO: 102074 - DNA, 117 bp, Drosophila melanogaster
cgattttcctctgttgtgcattttccagatgcaaccgggatttctatcggtctgtgtgactgattcgccgtttcggtgtgtgtgagagcgtttgaaaaagggatatcgatcggaaaa

SEQ ID NO: 102075 - DNA, 115 bp, Drosophila melanogaster
gtcatttggtacgtttttctcctggtatccactgtaggcctatatgtatttccaccataaggcacgcggtgaatgccaagagcgaacgcagttctacaaattactcatacccaat

SEQ ID NO: 102076 - DNA, 95 bp, Drosophila melanogaster
gatgtatgggtgtgtagggtctgaaattttgcacacatttacaataattgtaaatgtgttgaaaatcgtttgcacgactgtgagcaaaacacgtc

SEQ ID NO: 102077 - DNA, 75 bp, Drosophila melanogaster
ccacataacacacacacccacctttatgcatatatgcaagagtaagtgggtgtctctctatgtgtgtgtgtgtgg

SEQ ID NO: 102078 - DNA, 115 bp, Drosophila melanogaster
tgtgcagaagccaccgaaggttgtcccttggtatgcaagttttatagattttttttcacacgtgaagcatttaaacgcgccattaatctcaaacagtcgtggcgactctcgcaca

SEQ ID NO: 102079 - DNA, 94 bp, Drosophila melanogaster
cttttgctcttaactatgtgcagtaaaaatttgcgttgtgtgcattaaaaaatcgtacacaacagaatttcttgaagcgtcttttgtgcgattg

SEQ ID NO: 102080 - DNA, 70 bp, Drosophila melanogaster
cggcggcctgtgtgtgtgatttcccagtttgcatgtgtggaatggctcacacacactcacgcactcgctg

SEQ ID NO: 102081 - DNA, 88 bp, Drosophila melanogaster
gcggactcacacgcacacacacacacacacgcaggcactctgagtggttcgcgcggctgtgtgtgtgcgcttgtgtgatgatgttggc

SEQ ID NO: 102082 - DNA, 78 bp, Drosophila melanogaster
gcgggggctggggcgcaaaagaggagagcggatgcggtaaggtgggtgtctcctgtgtgtgtctatgtcagtgtgtgc

SEQ ID NO: 102083 - DNA, 66 bp, Drosophila melanogaster
cgctcatcgaaaaatctcagagacgagcagcgcgttcggtcggttgtctgtgtgtgtcagtgggtg

SEQ ID NO: 102084 - DNA, 70 bp, Drosophila melanogaster
gattgactgactgactggctggctgagtgagtgaagttttgtttggtcagccggaaacgtgcggaaaatc

SEQ ID NO: 102085 - DNA, 117 bp, Drosophila melanogaster
gttttgcagttgacttggctttctccactggcggattttggtatctggctgtggctgcttgtcagtcagtcagtcagtcatctgctcggtactgcggctccctcaactttttctgac

SEQ ID NO: 102086 - DNA, 118 bp, Drosophila melanogaster
tgcatacttacatatggaccattaacagaaacccgtaaatccgaacttgtgctgttttatatctgttacaagaccggcattatgggagtctgtcaatgcaaacaactggtttttggca

SEQ ID NO: 102087 - DNA, 110 bp, Drosophila melanogaster
caaggacctttttctctctggcaaattgaggtagtaggttgtatagtagtaattacacatcatactatacaatgtgctagctttctttgcttgactacaagccgcatttg

SEQ ID NO: 102088 - DNA, 122 bp, Drosophila melanogaster
gcattggtgacatgtgcaaatgtttgtatggctgattccctgagaccctaacttgtgacttttaataccagtttcacaagttttgatctccggtattggacgcaaacttgctgatgttagta

SEQ ID NO: 102089 - DNA, 124 bp, Drosophila melanogaster
ttttgagttgctgtcatttatcatttcatttagttagcaacctcgactctcagtcactgtctgtggaaagtggaagtgtggcagagtgggaaagttgttggccagatgcgagttaaagttgtaa

SEQ ID NO: 102090 - DNA, 113 bp, Drosophila melanogaster
cgcggtagtattccgaataaggctgtatatcagttggatttagttggacagtctttccctctacaaccgaaataatatttgagtgcatatatagcttttcaggtatgatcacg

SEQ ID NO: 102091 - DNA, 118 bp, Drosophila melanogaster
gccgtattctgataggaaaaatcgaggggtaaataaggccatcgcactctctctctcttgctcattctctgtccctgtctcgttgatggccatctccctctgttatcctttctgtggc

SEQ ID NO: 102092 - DNA, 88 bp, Drosophila melanogaster
gtgagagagtcgtggagaaagtgctgcagataaggtttttgtttataaataaaacagattacctgttgcacctttgcggaacccagac

SEQ ID NO: 102093 - DNA, 107 bp, Drosophila melanogaster
tgcgaggctttcgcgccatctccttcgcactcgaacgacagctggccagcagaaaacagctgactgatgtctgtgtgttcgcctgcgagggtgtgtgtgccggcgta

SEQ ID NO: 102094 - DNA, 68 bp, Drosophila melanogaster
gtggcactgactgactggctggctggctggccgggttggccgcttccgctttttacgttcattgcctc

SEQ ID NO: 102095 - DNA, 107 bp, Drosophila melanogaster
ttgccttgttgtttttgtttttacatggcctgcagtttaagtatgtatatatgtatgtattgagagccggcgtttttgtggctcgtgtgtgagtgagagcgaggcag

SEQ ID NO: 102096 - DNA, 88 bp, Drosophila melanogaster
ctgtcctgtcctgtccgtctgtctgtctgtgcgtgcgtttattgcatttgtgtccgtctccgcgcaaaggataaaggttagggggtag

SEQ ID NO: 102097 - DNA, 124 bp, Drosophila melanogaster
gctggatttgtgggaaagatggattagtgaatgactggatgattgagtgagtgagtgagtgagtgattgagtgactgactgattgagtgactgactgatcgagtgagtatcatgcagggtatct

SEQ ID NO: 102098 - DNA, 73 bp, Drosophila melanogaster
gctcgccattttgcagcggacatgtttgtatttgcctcgccataagtgtgactgtgcgtctgtgtgtgtgagt

SEQ ID NO: 102099 - DNA, 97 bp, Drosophila melanogaster
ttcgagggcattgataagacaaagcaatcagtcagtcagtcagtcagtcagttaggatgtttgaaaactgcccgacatgaaggtttttgcttttgaa

SEQ ID NO: 102100 - DNA, 72 bp, Drosophila melanogaster
gaagagtggctaaaacgtacctcacgtgttgaatggcaacgtgtgttctgtgtatctttttagttattaatc

SEQ ID NO: 102101 - DNA, 92 bp, Drosophila melanogaster
gagaaaagtttttggaaattgaatgtatattttcgcatacgatgctaaaagttgatgcatatgatttccatgaaactatagcattttttctc

SEQ ID NO: 102102 - DNA, 109 bp, Drosophila melanogaster
tgcctgcatatacatatgatgtattagctttacaatagctttaaaaaatagttttttcataaaaatatttgtatattcagttagttattatgagcgtattttgcaggca

SEQ ID NO: 102103 - DNA, 102 bp, Drosophila melanogaster
tgtacgatgttgattatctaagcctcatcaagtggttgtgatatggatacccaacgcatatcacagccagctttgatgagctaggataatcaacgggagaca

SEQ ID NO: 102104 - DNA, 97 bp, Drosophila melanogaster
ggcgcattcatgctgggctctcaaagtggttgtgaaatgcatttccgctttgcgcggcatatcacagccagctttgatgagcttagcgtaatgtatc

SEQ ID NO: 102105 - DNA, 93 bp, Drosophila melanogaster
gagaattgtgtcattcttcaaagtggttgtgaaatgtttgcctttttatgcctattcatatcacagccagctttgaggagcgacgcgatgctc

SEQ ID NO: 102106 - DNA, 71 bp, Drosophila melanogaster
gccgccatgaccaagttgcaacactctctgtgtgtgtgcactcgatgctcgtgttgtatttttaatgcggc

SEQ ID NO: 102107 - DNA, 115 bp, Drosophila melanogaster
gcactgctctagcatccatcttttcgcatggccaatcggtgggtgtgtcctcgctcactcacacaggcacacacacacgcacagttgattagcctcgacattttgttactgttgc

SEQ ID NO: 102108 - DNA, 110 bp, Drosophila melanogaster
gcaacagtaacaaaatgtcgaggctaatcaactgtgcgtgtgtgtgtgcctgtgtgagtgagcgaggacacacccaccgattggccatgcgaaaagatggatgctagagc

SEQ ID NO: 102109 - DNA, 93 bp, Drosophila melanogaster
ggcaatgtgtgtgcgttcgtgtgtgcgtgtgagagagtgagtgccatggcacacgcttcttacctgtcaaaaattcccgcatttttcgttggc

SEQ ID NO: 102110 - DNA, 105 bp, Drosophila melanogaster
cacgtctctgggaaagattcgcgccgcgactgcgcacgattatggcacatttcgagtgacgagagcaaagttgactgcgctgcggccgcctgttgcagaaacgtg

SEQ ID NO: 102111 - DNA, 86 bp, Drosophila melanogaster
gcagacagacagacagacagacacacagacgaatggacatatggtggagttgtcccaggtgagagtgtgtgtgtgagtgtggctgc

SEQ ID NO: 102112 - DNA, 84 bp, Drosophila melanogaster
ggcagccacactcacacacacactctcacctgggacaactccaccatatgtccattcgtctgtgtgtctgtctgtctgtctgtc

SEQ ID NO: 102113 - DNA, 70 bp, Drosophila melanogaster
gtgttatcctggccagctgcgagatggctggctggctggctgactgactggctgactggctgggaagcat

SEQ ID NO: 102114 - DNA, 78 bp, Drosophila melanogaster
ctgcaactgcaactgcaacggcaactgcgaagtgtcaaagtcaaatatgcaaaaagccaaggggggtagcggtggcag

SEQ ID NO: 102115 - DNA, 75 bp, Drosophila melanogaster
gagatatattcgatgcagctggatggctggttggctcgttggctgtctggctggctgactcgatggctatatctt

SEQ ID NO: 102116 - DNA, 71 bp, Drosophila melanogaster
tctttcactttgcatatcgccggtgctgaaattacaatataaatttatgtacacggcatacgtatgaaaga

SEQ ID NO: 102117 - DNA, 65 bp, Drosophila melanogaster
acttgatgcatggacgcagttgaagcgcatcggttgccgcagcaactgcaagtgcaagtacaagt

SEQ ID NO: 102118 - DNA, 119 bp, Drosophila melanogaster
ggcacaggaactgcacgatcttacgctcggcacttgcccgctcagacggactcagtccgtccagcagcatctgagccttggcaagcaggctgttggcaggctgtgtacttcgctgttct

SEQ ID NO: 102119 - DNA, 114 bp, Drosophila melanogaster
gaccatcccatattcagcctttgagagttccatgcttccttgcattcaatagttatattcaagcatatggaatgtaaagaagtatggagcgaaatctggcgagacatcggagtt

SEQ ID NO: 102120 - DNA, 125 bp, Drosophila melanogaster
agaatttccacctgcaacactgtgtgtagctggttgacatcgggtcagatctgtttttcaagcatttggtccccttcaaccagctgtagccagtggttgatgacaacgaaagcctagtgaactgc

SEQ ID NO: 102121 - DNA, 69 bp, Drosophila melanogaster
catcgcacactcactctcgctctcactcgctctcgcgagcgcagcacggcgccagctgaggcagcgctg

SEQ ID NO: 102122 - DNA, 114 bp, Drosophila melanogaster
cagttttcgaatccactggtttttaagaagaataaccatgaatcctttcgatcattttatttttaaatgcaagttgaatgatttttgttatccttctaaatggtttgattagtg

SEQ ID NO: 102123 - DNA, 103 bp, Drosophila melanogaster
cattcacgtgtgctgcggatggagaggtgtggaatgttgtgtgctggagtgctggcactgcgataactcacccgacatgaaatgcaaaagtatcgatgtaatg

SEQ ID NO: 102124 - DNA, 65 bp, Drosophila melanogaster
ctcgcgaaaaatatgccttgtatgtgggtactcctctatatacaatgtatatttatataagtgag

SEQ ID NO: 102125 - DNA, 105 bp, Drosophila melanogaster
gttagacctcggtctttaaggcgattcatggcttcataagtagtttggtctttggtttgactggacagcatcaatgccactaagttttggaagcgctgggtctgc

SEQ ID NO: 102126 - DNA, 114 bp, Drosophila melanogaster
gatattttatgaatatttgtttgtaagaaatacctacaggaacatatttgtatttaaattagtctaaatccttaggtttttctcttagtaagaataattatttgctgtaatatc

SEQ ID NO: 102127 - DNA, 93 bp, Drosophila melanogaster
gcttgtgtgcgtgagaacttttgataaatgcagattttattgtaattcaatatcaatttgtgtgtatgcgagggcacctggagctcactgggc

SEQ ID NO: 102128 - DNA, 91 bp, Drosophila melanogaster
gaattttatccagcagagtgtctgtctatgtgtctgtgcgcttgttgtgctggtcccacattatttagctcaggtaatgttgtgtgtgttc

SEQ ID NO: 102129 - DNA, 56 bp, Drosophila melanogaster
tcgcacatgtgagtgcgagtgagtcagttgctggctgactgtgtgtgtgtgtgcga

SEQ ID NO: 102130 - DNA, 80 bp, Drosophila melanogaster
tatattcttgatcaggagcaacagtcgagtcgaactggtcatgaccgtctgtccgactgtccgtttgaacgtttgatatg

SEQ ID NO: 102131 - DNA, 87 bp, Drosophila melanogaster
agcgtttccgacggtatatatattcttgatcaggatcaatagccgcgtcgaaccggccctgtccgtctgtctgtccgtatgaacgtt

SEQ ID NO: 102132 - DNA, 95 bp, Drosophila melanogaster
gtgacgacctcgccgcagtagatcgctctcgctcgctcgctgactgcccgacggtcgtctcgctcgctcttacggcgcatagatcgacctgctgc

SEQ ID NO: 102133 - DNA, 109 bp, Drosophila melanogaster
tgcatttgcattgcaattatatttgtttgtgccgctctcgcacacactgacacaaaagcgcatcaccggaggggcaacaaaagcaagagtgataaagcaaacgagagca

SEQ ID NO: 102134 - DNA, 83 bp, Drosophila melanogaster
ataagtctatgtttgcattttatgtttatgtacatgtatatatttatgtacatatgaacatatatgtatgtatgtttccttgt

SEQ ID NO: 102135 - DNA, 120 bp, Drosophila melanogaster
atttgtacgggttggatcggttgttgcccttcatttatgaacccatgattttgatatggattgtattgattttggtcataatactgttgttcgtaataattaggttggacttgttcgaat

SEQ ID NO: 102136 - DNA, 81 bp, Drosophila melanogaster
gtggagcacatctgaggacccgtatctgcatctccatctgaacgtaggcagttgtgaggtcctttcaggttgtcaatttgc

SEQ ID NO: 102137 - DNA, 79 bp, Drosophila melanogaster
tcgcgtgagacgctatgttatattcatatatatacacattcgattgtatatatatatatgctatggtgtttttgggcga

SEQ ID NO: 102138 - DNA, 101 bp, Drosophila melanogaster
tccggcctgctacacaattctaaagcaaatttgacgcgtttatgcatgtaaattaaacaaatttgattttaaatatcttgtggcagtggtggggatgggcc

SEQ ID NO: 102139 - DNA, 70 bp, Drosophila melanogaster
gcatagaagtacgtgtgtacattacatatgtatgtatgtatgtatgtatgtatgtgcatatgtgccaggc

SEQ ID NO: 102140 - DNA, 102 bp, Drosophila melanogaster
tagtcaaactattctggacttttaatgtaatctgttaaaactaagatttattatctttaaaattggtattggtgatgattacatggtaaagagtggagatta

SEQ ID NO: 102141 - DNA, 64 bp, Drosophila melanogaster
ccaaatcatttgtatgtatgtatgtttgactttcaaactaaatacatgcatgaaatagagctgg

SEQ ID NO: 102142 - DNA, 95 bp, Drosophila melanogaster
tgttgctgctgctgtgccataacgcgcgcttagtacaaataaaataattaaattatcctcagctgagagagcacacacagacagtcagacagaca

SEQ ID NO: 102143 - DNA, 62 bp, Drosophila melanogaster
gttgagacccatttttgtggagcatgcgcctggggctgtcagtggctctcaaactgggcagc

SEQ ID NO: 102144 - DNA, 66 bp, Drosophila melanogaster
ggcaaacggttgcataatgaatgcagatgcatatacatatgtatatgtatatatatgcaactggcc

SEQ ID NO: 102145 - DNA, 84 bp, Drosophila melanogaster
ctgacgaactgactgactgagtgagtgacgaactgaacgcagcccaaactgcattcgtattgtgtatcggtgtgagttcgccag

SEQ ID NO: 102146 - DNA, 116 bp, Drosophila melanogaster
cggtaattctcagtccagtagcagtactgtgtgtgcgtgtgtgaagtgtgtgagctgcacttggcggcttatcagttgttgcattgccacagtgataatcgctcggaatcgaactg

SEQ ID NO: 102147 - DNA, 88 bp, Drosophila melanogaster
tcacgtttgtgcctttctcttatgggagaattcaatttgaaaatatatttttgcggttgactttgatttgatatggtgcataaatgga

SEQ ID NO: 102148 - DNA, 80 bp, Drosophila melanogaster
gccggcgactgtatctgtgtgtgtatctgtctctgctcctctacgggttctatgtgctccacaatgtccggtggcttggc

SEQ ID NO: 102149 - DNA, 114 bp, Drosophila melanogaster
tccatttcctttttttcggatttccaatttaaattgatgatgttgatgttgatgctggttccactccacacacacacatacgcactttagaggagaacgttaggcgcaaatgga

SEQ ID NO: 102150 - DNA, 66 bp, Drosophila melanogaster
atgaggatgtacatatgtatgtatatatctatgtatgtatgaatgtatgtttgctcgcatcgtcat

SEQ ID NO: 102151 - DNA, 94 bp, Drosophila melanogaster
gtatatactaggtatatgtatgtggtttgtatgaatgtatgtagatctgtatataggtatataatatccaattgctactgcctcgaaatgatgc

SEQ ID NO: 102152 - DNA, 80 bp, Drosophila melanogaster
cgccaccaagatatgaatgaatgaatgaatgactgcggtgcgcttcagttcagttcagttcggtgtggtgtggtatggtg

SEQ ID NO: 102153 - DNA, 101 bp, Drosophila melanogaster
aaccaatgttgtcggacatgttttagatgcccctgttcgcaatttttggatctcggatgtgtgagaactgtctgtggatatgtggccaagtgcattgtgtt

SEQ ID NO: 102154 - DNA, 97 bp, Drosophila melanogaster
tacgaaagatcaaaacaaaagccatgcggggtacggaagctgtggtcagtcagtcagtgagtctgcttagagtttttttttttttcgttttttcgtg

SEQ ID NO: 102155 - DNA, 116 bp, Drosophila melanogaster
ggtaagttgtgttggtcataaacgttaggaggaagttaaggtgtcgatcaatatttattttagcttgtttcctattggatgctcttaccaaacacccaattaaatcccgctgaacc

SEQ ID NO: 102156 - DNA, 86 bp, Drosophila melanogaster
ttcaaatagggctcgatttatacatgtgtggtgtatataaatatatacttatgcataggataggtacaaatcaggctcaggctgag

SEQ ID NO: 102157 - DNA, 65 bp, Drosophila melanogaster
ggctgagattgctgtctgtccgactgtcggtggggggtaactacacttggagaagcaatagagcc

SEQ ID NO: 102158 - DNA, 112 bp, Drosophila melanogaster
gtcgctggcatatgccgctcaatgtcatgggagcttttggcgttcagcagtcgcatcatcatcatcatcatcgtcattttcagtaggcatcagaggtggcatcagttggatc

SEQ ID NO: 102159 - DNA, 68 bp, Drosophila melanogaster
tttgcctttgccatgattgttgccaccgccgagataagtgcggcaacaactgcatctgcaactgcaaa

SEQ ID NO: 102160 - DNA, 76 bp, Drosophila melanogaster
tactgacacacatacgagtgtgcatgttaacgttcgaatgcccgatatacatatgaatgtttgtatgtatgtagta

SEQ ID NO: 102161 - DNA, 96 bp, Drosophila melanogaster
tctgcagagggtgaagcgtcggcaggaaaacttcagccaggatcaggatggcagcctgcctggctgactggctggcaggtccaaactttaggcaga

SEQ ID NO: 102162 - DNA, 92 bp, Drosophila melanogaster
agcattcataaatgcacacacacacacactgagtgtagtagttgcatgtcaaaaagcacttagagcaccgtgtgcgcgcgtgtatgagtgct

SEQ ID NO: 102163 - DNA, 73 bp, Drosophila melanogaster
accttcttgacggctgaacagctcgcctgcgtgttttatggtgtgcgtgagtgtctgtgtgggtccgtctggt

SEQ ID NO: 102164 - DNA, 112 bp, Drosophila melanogaster
gctggtgtgtgtgtgtgcggctttgttgcattgtttgattgtttcacacgccccagctttgtctctcattctgtgcgtgtgtgcgaaataacatttgtctaatgaaaagcgc

SEQ ID NO: 102165 - DNA, 56 bp, Drosophila melanogaster
gcgtgtctgtgtctgtctgcaatcgccagagataagcgggcagactgagaagtcgc

SEQ ID NO: 102166 - DNA, 134 bp, Drosophila melanogaster
ggatatttgggggtacgatgggtatttatagtagcaccgattgcaatagaaatcccactctctctctcgcactctcggtggctctccctcccgccaaatagtcgctgctaattgggggctgccattgcggtagg

SEQ ID NO: 102167 - DNA, 112 bp, Drosophila melanogaster
ctaacaaggagatgtttgggctgatgtgggctacatttgaagctgcattttataagaatttttattcatgtagtctattttctgtttacaagcctatttgctaccccaggag

SEQ ID NO: 102168 - DNA, 119 bp, Drosophila melanogaster
ttgggcgataccctgcaatcgttggagaccataacgtacttagacttaaagtatttaaatattttctgttggataataatgtactgggaattggcggagccaactgttgcattggccga

SEQ ID NO: 102169 - DNA, 68 bp, Drosophila melanogaster
ggggcggggcgggcccatcaattttagcatatttaaatatttatagttctgcgccaggctctggcacc

SEQ ID NO: 102170 - DNA, 99 bp, Drosophila melanogaster
gtccttgcccttggcccacacacatgaggcaatattatatagaaaagcaaacattcatttttatatgtatatgcatatgcgtgtgcaggaggattggac

SEQ ID NO: 102171 - DNA, 108 bp, Drosophila melanogaster
ggtcaagctattattttaggatgcagcaaactggatgtgattggaaaatttgttgatttttaatcttacccgagagcgacccgttgttaataaattagtaaaagggcc

SEQ ID NO: 102172 - DNA, 83 bp, Drosophila melanogaster
ttgacactgacacgtttgactcactcacgcacactgcaatgcaggcaggatgtgtatggtgtgcatctgtgtgtgggtgtggg

SEQ ID NO: 102173 - DNA, 117 bp, Drosophila melanogaster
atatatagttgcattgggtcgttctgctttttgtattaaatgtaggcataatttatatagtttttcatcagtgcatgggggatacgtggtcggcagaccggatgcagtttgtggtgt

SEQ ID NO: 102174 - DNA, 115 bp, Drosophila melanogaster
cgggtcagggggggggtggggtcgtaggtaaaaaatatactatatatgcgtgtatataaatgtgtatatatgtatatcaagtttagcttagtatcacactagtagagataatgcg

SEQ ID NO: 102175 - DNA, 94 bp, Drosophila melanogaster
aaatgggcaggatatttgaaaatatacccgttgcgttttgcacaactttgtgaagcgaaatatgtatgtatgtttgtatattgctgccatattt

SEQ ID NO: 102176 - DNA, 118 bp, Drosophila melanogaster
aagcatcacgaattaaataccttttagcaattaatctgcttagctaatggacgttttcactgtagactgtgacgacatcggttggcgcagggagctggggaggatttacattaggctt

SEQ ID NO: 102177 - DNA, 74 bp, Drosophila melanogaster
gtcgtgtgactgcctcgctgtgtggcagggattccgcgtaattaggctgcgcacatggagctgcagatggagac

SEQ ID NO: 102178 - DNA, 73 bp, Drosophila melanogaster
ccactcggggttccatgtcacgtgcgctcgctcggcggagtaagtatgtatgtatgtatgtgggtctgtgcgg

SEQ ID NO: 102179 - DNA, 89 bp, Drosophila melanogaster
gcccacaatcggtctgaatgacgatgcgcgacttgtaatttcatcagccctatcagtccgtccgtccgtctgtcagtctgtctgtctgt

SEQ ID NO: 102180 - DNA, 111 bp, Drosophila melanogaster
tcattttgaaaattttttgtaatttcttaatatatatagtacgtgtatatgtattttatatgtatttatatatatatgtgtgtttggataaacagaaaattcttgttttga

SEQ ID NO: 102181 - DNA, 111 bp, Drosophila melanogaster; identical to SEQ ID NO: 102180

SEQ ID NO: 102182 - DNA, 111 bp, Drosophila melanogaster
caattagccagatcgtgacattacttaatgcatttatccgcccgatcgacgcgtgcaagtgtgtgcctgtgtgcgtgagtgcgtgcgtgcgtaaacatgaataccgaattg

SEQ ID NO: 102183 - DNA, 107 bp, Drosophila melanogaster
cgagattgtattgttattgtatcacctgaaattctcagggtgtttactttcgactgagtgaaaacagagagcaaatccttgggcaatacaatcgatttgaaatctcg

SEQ ID NO: 102184 - DNA, 80 bp, Drosophila melanogaster
tgtttgtgtgtgggacttgttgttgctcgatgtgttttccttttacgcaggctagatacacacactctcacacacacgca

SEQ ID NO: 102185 - DNA, 83 bp, Drosophila melanogaster
gcgtgagtctgtgtctgtgagtcagcgttgcgtttgcctcttgccaggccacttgccactcgaagtcgccgcacggagcaggc

SEQ ID NO: 102186 - DNA, 117 bp, Drosophila melanogaster
gctgacggccaatgatgatgatgatcttaggagccgacccaaaaacagagtccaagtcttgtgaaattggaagccattttctggagctccctcttcctgccatcgtcttcgtctgct

SEQ ID NO: 102187 - DNA, 72 bp, Drosophila melanogaster
attgagtgcagacagtggccagacaacaacacacccgagggcagttgcttgggccatgcaattttcgccagt

SEQ ID NO: 102188 - DNA, 73 bp, Drosophila melanogaster
cacgtgtgtatctgcatctgtatctgtacctgtgtgtctgccgggttacgtgtatccgacagatacaaaagtg

SEQ ID NO: 102189 - DNA, 80 bp, Drosophila melanogaster
gacttggctcacacagatacgcacgcacacatggagatgagatgctgtttgccagtttgcctgtttgcctgtttgccgtc

SEQ ID NO: 102190 - DNA, 85 bp, Drosophila melanogaster
cctagatacatacataaatacattgacaatacatacaaggcaagtcgcttcgatgcctgtgtgtctgtatgtgtgtgtgcgcagg

SEQ ID NO: 102191 - DNA, 111 bp, Drosophila melanogaster
ttgagggaataatttgccaaagctgggaaaacacgatggagtcattcaatttaaatttatgaagacaacgtgttggaaaacccctaaagcagcagctaaaatattcatcga

SEQ ID NO: 102192 - DNA, 69 bp, Drosophila melanogaster
gtgtgtgtgtgtgtgagtgcgtgtgtggcaaagtgcatttcccatttcgccatcaccacaagttgacat

SEQ ID NO: 102193 - DNA, 86 bp, Drosophila melanogaster
gtctcctaccttgcgcgctaatcagtgaccggggctggttttttatatacagtcaggtacctgaagtagcgcgcgtggtggcagac

SEQ ID NO: 102194 - DNA, 107 bp, Drosophila melanogaster
tgtgtatcaactgtctcccatgtctattgtacttcatcaggtgctctggtgtgtctcgtaacccggcacatgttgaagtacactcaatatgaggcgatttgcatacg

SEQ ID NO: 102195 - DNA, 114 bp, Drosophila melanogaster
gggaggagcaggtctccctccaagctgatgctgatgttgatgatgatgatgctgctgattatgatggcgctttaaacagacatcggcccacatctgctgtaagccggtaccccc

SEQ ID NO: 102196 - DNA, 72 bp, Drosophila melanogaster
tttgtgtccctctgtctgtcggcaacttttaaaatggtcatgtttcaaaagttatcgacgttgggatagaaa

SEQ ID NO: 102197 - DNA, 113 bp, Drosophila melanogaster
tgtccgttcgtttgttcggttttcgcacgcaaaaggacaacgcctgtctgtctcgctctgaccccccaatcgccgtccttgtctggcgacaaacagaacacacagaactgacg

SEQ ID NO: 102198 - DNA, 72 bp, Drosophila melanogaster
tgtgtggcatgactcgtctgtctgtctgtcagtcagtcggtaggcggacggcggagggggtaaaggcgtgca

SEQ ID NO: 102199 - DNA, 77 bp, Drosophila melanogaster
tttctttgaaataatggaagtggctggtttggaccacccaaatacgtcactatatatatacatatattgcgaagaga

SEQ ID NO: 102200 - DNA, 87 bp, Drosophila melanogaster
aaaaacttcaactgtcttcaaagtggcagtgacatgttgtcaacaatattcatatcacagccagctttgaggagcgttgcggttttt

SEQ ID NO: 102201 - DNA, 143 bp, Drosophila melanogaster
gcgtcgcctacatgtctttgtgtgtgtggtgtatgtgcttgcgtgcctggggtagtgtgcctgtgtgcgtgcctcgctgcatgtgtgagtcctttacgaatggagtgggtgggcagaggccgaggaggaagaagcagaagcgc

SEQ ID NO: 102202 - DNA, 89 bp, Drosophila melanogaster
gaaatggaaacgggaacttcgacttcggtggacacaggagcaacaagcacgaatccctcggcctctgtctcagtctccgtttcggcttc

SEQ ID NO: 102203 - DNA, 78 bp, Drosophila melanogaster
tctccgaatccgagtctgaatcgctggcaggttctatgccactttttgccacgaattcggattcatctatttcgctgg

SEQ ID NO: 102204 - DNA, 109 bp, Drosophila melanogaster
ttgcggagtgtgaatgcttgtttcaatttcatctgttccccatttgtactctgaagacagtgtgcaagctcgagacggttgtttgacagtgggtagacaacatcctcga

SEQ ID NO: 102205 - DNA, 108 bp, Drosophila melanogaster
agcagtccgtcagtctgccagtccgtcattcaggcagtcagtcagtcattcagtggggctgacattgctgttcaaatgacgtcgctttgccggacatggcgaaatgtt

SEQ ID NO: 102206 - DNA, 76 bp, Drosophila melanogaster
agactgatagccgccagcgacagaggcttggattcttttgaatctcctctctcactgtcagcggatgtcacagtct

SEQ ID NO: 102207 - DNA, 116 bp, Drosophila melanogaster
gtcattgcgaatgcaaggattcaataggtttttttatgctttcgacaatatttgttgttcacataacaaattacaaaagctgcaaaataatttataacaatcgattgttgttggac

SEQ ID NO: 102208 - DNA, 72 bp, Drosophila melanogaster
ggctatggcattatatactgcttactatatatatttgctacatatatatgtatgcatgtatgtatgtagcca

SEQ ID NO: 102209 - DNA, 66 bp, Drosophila melanogaster
tgcggatgtttgctgtgtcgctgtctgtgtggaagcgcgcatatttgcacatgtttcgcatttgta

SEQ ID NO: 102210 - DNA, 82 bp, Drosophila melanogaster
gatattttcagcatgcttgcgcagtttgttgaacttggtatattcatatatattttagcaaatttgcttgcgtggaaatttc

SEQ ID NO: 102211 - DNA, 94 bp, Drosophila melanogaster
ggggtgggggcagcggcgatgggctgcatcgtttattggctcgttatggccattattatgattgcctgcctgcctgcctgcctacctgccagcc

SEQ ID NO: 102212 - DNA, 113 bp, Drosophila melanogaster
ccatgctgtcggaagccatcaggtaggtttgcattttaagatgactagtgaaattgtttattatactcccatattttatgtcagactgctgcaggaaggcgtggaccccaagg

SEQ ID NO: 102213 - DNA, 63 bp, Drosophila melanogaster
ggcgccgatgtctgtatattgtatgtatatatgtatatgcatatatatacatgttggtaagct

SEQ ID NO: 102214 - DNA, 79 bp, Drosophila melanogaster
acggttcgatgtaaatgtatctgtatctgcatttgcatctgcatcttgcagctgcatctcgcatcctgcatctgagtgt

SEQ ID NO: 102215 - DNA, 74 bp, Drosophila melanogaster
cgtatgcaaaatatttgcattgataaacagccacggccaatacgtgagtgtgtgtgtcagtgtgtgtgtgtgcg

SEQ ID NO: 102216 - DNA, 80 bp, Drosophila melanogaster
ctgaatgaatgaatgaatgaatgaatggccgcagaacacatgcagtggcgtctgagtgcgtcagtctgtcattctatcag

SEQ ID NO: 102217 - DNA, 81 bp, Drosophila melanogaster
tgtgtgtctggctgtctggctgttaaaatttcgattcgtttcattgaaattaatcgaataatggccagatgccagcccgcg

SEQ ID NO: 102218 - DNA, 118 bp, Drosophila melanogaster
tgtgtgggcgtgtgttcttcaataatgcacatctctatgtatgactatatatatatataaaggctatgaatatagaagtgcttatctttcgattagatttcacgtgtttaaccagata

SEQ ID NO: 102219 - DNA, 82 bp, Drosophila melanogaster
cacacactcgcacacacacacacacactgcctcattttgcgtcatatgtgtttgcaagtgtgtgtgagtgtgcgagtgtgtg

SEQ ID NO: 102220 - DNA, 84 bp, Drosophila melanogaster
gtggatttctggctggctggctggctgggtggatggaattcgaatgggggatggtcatgtgggaggccgggtagtgtcatctat

SEQ ID NO: 102221 - DNA, 111 bp, Drosophila melanogaster
gtcgtaaagctaaaaacacacaaatgctgcatttcaaatgctttatttgattttgaattcaaaaatgtattgtatgtgaaattagctttgaagttaccttggctcttctgc

SEQ ID NO: 102222 - DNA, 124 bp, Drosophila melanogaster
agtgatcttcaagttggccagcttccgtttgtcaatggttctggagctggacagcactgggtcactgtttcccagaccgctagtgccctcattggctaccacattgatctgcgaacgggttggt

SEQ ID NO: 102223 - DNA, 112 bp, Drosophila melanogaster
gtttatttctatgtcgcaaggctattccagctagttctcttctcattttgttgtataaaaatttgacctggggtgcatggtagtcggtacgtagtctttgctcaaaataatc

SEQ ID NO: 102224 - DNA, 77 bp, Drosophila melanogaster
gcaatttaattcaatgtgaattatttattagctgccagataggggcggtcgcatgaataattccccatatttaatgc

SEQ ID NO: 102225 - DNA, 114 bp, Drosophila melanogaster
ggccgattctttttgagaacgataacgcgcatgatgtggcagatatatatatatttatttatgtatatattttgtgagagagggggtgtacgtgtgtgcgtgtgtctctcggct

SEQ ID NO: 102226 - DNA, 89 bp, Drosophila melanogaster
gaggctgagcatattttaatatgctgcacgcatgcaaactgcccatttgttgcttgtagtgtagaaagttgattggatttattcgtctc

SEQ ID NO: 102227 - DNA, 100 bp, Drosophila melanogaster
gaccatggtaatggtacggtgcgaccggatgatggttcacaacgaccgtgtcatttaaacgggtcggtgggactttcgtccgtttgtaacgccatttgtc

SEQ ID NO: 102228 - DNA, 76 bp, Drosophila melanogaster
actctctcactgatttggcggcgttgggtttatttatttttataagcgaataaacacagccagcaatcagaggagt

SEQ ID NO: 102229 - DNA, 90 bp, Drosophila melanogaster
cgttgggtgtatagtacttgtgctatataattgtgtacatatatataaatatgtgtatctagatatatacacacgtatggcggagtaacg

SEQ ID NO: 102230 - DNA, 63 bp, Drosophila melanogaster
agacctcgcccatcatcgtgatgttaatgttgatgatgacaatgatgatgatggtgggactct

SEQ ID NO: 102231 - DNA, 80 bp, Drosophila melanogaster
tcccacctggctgcgtgtctgactctgagtctgcgattgagcttgctgctgcagctgagatgactgctccctctgttgga

SEQ ID NO: 102232 - DNA, 83 bp, Drosophila melanogaster
ccacaaaaaacacagaaatatgcgtatatatgtacatatatgtatgtatatatctttatctgcatgtttcgatggacatgtgg

SEQ ID NO: 102233 - DNA, 78 bp, Drosophila melanogaster
cctcgttgtcgctctcctggctcctgggaacattgccgcagtgattgggagccagaaccatggagcagatgggcgagg

SEQ ID NO: 102234 - DNA, 95 bp, Drosophila melanogaster
gggcccagcagctgttctgccgcttcactgtgaatggcaagttttttttttaataaaccagcaccgtgggcgtagattgaatatattgtgggtgc

SEQ ID NO: 102235 - DNA, 84 bp, Drosophila melanogaster
tgacccacagcatacaggtggcctttcttgtcgcagaacagactgtggtaagctccaagtgccacctgttccagccaaaggtta

SEQ ID NO: 102236 - DNA, 106 bp, Drosophila melanogaster
tcagatctttttcttcctgttgaacaggacttaaagaattcccttaaagcaatcacacgcagctttcctttggggttccatctttttctcggaataaggagaatga

SEQ ID NO: 102237 - DNA, 60 bp, Drosophila melanogaster
tgcctgactgctcgccgttgcatatctatgtatgtatgtacatgtgtgagctagttcgta

SEQ ID NO: 102238 - DNA, 115 bp, Drosophila melanogaster
attttgtattgcatactttgcgtactatgaagttacacacacacataccaagaaactttctttttatttgtgtggaaaatttcccgactttttcgctttcccaatatggaatata

SEQ ID NO: 102239 - DNA, 101 bp, Drosophila melanogaster
gtcgtacttgacgagggtttaaaaaatttgtgtgcgaaagaaatgtgaggtttgttgtttgcaaattactttttattgggcatttccttgactttgccgac

SEQ ID NO: 102240 - DNA, 109 bp, Drosophila melanogaster
tgctaattagcaaggacatctgttcacatcttaccgggcagcattagatcctttttataactctaatactgtcaggtaaagatgtcgtccgtgtccttaaccttcagta

SEQ ID NO: 102241 - DNA, 80 bp, Drosophila melanogaster
cgtcaaagctggttatactatatagtatagtatatatatgtatagtatatatgtggctatatatagggtaccatttggcg

SEQ ID NO: 102242 - DNA, 116 bp, Drosophila melanogaster
ggggcgacaaataacaaatggctttggtggctgataaagttctgcttttgtagtagtcacatagatttactacgtacacaggctggcgcgcgagcttctggctttgttgttgttct

SEQ ID NO: 102243 - DNA, 74 bp, Drosophila melanogaster
tgagatctcatatcaaatattgaatgtcaatatttaaatataatgacattcaaaatatttgaaaatatttctta

SEQ ID NO: 102244 - DNA, 88 bp, Drosophila melanogaster
actgtcaccccaaaagtcagcctgtctgtcagggtcaagtatgcgtatgtctgtctgtctgtctgtcaaggtgacatcggtgagaagt

SEQ ID NO: 102245 - DNA, 77 bp, Drosophila melanogaster
tgtggtgccgaagggagcagggggttaaacaattgcatttaaattgcatgcctcgctgtttgactcttggcacggca

SEQ ID NO: 102246 - DNA, 130 bp, Drosophila melanogaster
gctttgttttctgtccagaaattttgctcgttttcgcatttcttgttgcctgttaagtaaaatgttttcattgtatttgaaatgctgccaggagcaggacgaggaagttggagcagggtggtggaggcag

SEQ ID NO: 102247 - DNA, 99 bp, Drosophila melanogaster
ttgaaatggaactcataaatgtgatttattagataatggagctaagggaaactgtagtctactgtttatgtactttgcgtttattacttgttattttaa

SEQ ID NO: 102248 - DNA, 117 bp, Drosophila melanogaster
gatcgtatatcaactccgttggtaaattggcaagatgtcggcatagctgacgttgaaaagcgattttgaagagcgctatgctgcatctagtcagttgttcaatggaacagtcagcga

SEQ ID NO: 102249 - DNA, 90 bp, Drosophila melanogaster
ccagtgcatagccatctgtccgtctctgtctgtgcgcaggtaattgaacaacatttgtggaatgacacggaaagaatggaaagtgagtgg

SEQ ID NO: 102250 - DNA, 106 bp, Drosophila melanogaster
gatggggaggcatggccaatagacacacttgtgccgggtctgaatacgaaatatttgtttatttctagttcataccgctcatgtgcgctacacttgtttccctttc

SEQ ID NO: 102251 - DNA, 112 bp, Drosophila melanogaster
tttgccgaaagaggaaaatctattgctggcctgtcacatcagtttccatgtacgcatgtatgtatgtatgtttgactgttgggcaaagagagtggctttgttttttggggaa

SEQ ID NO: 102252 - DNA, 70 bp, Drosophila melanogaster
gcaggacaggcgactgagatttatgcgattttatttacgcacacaatcgcactcacagcctctcacatgc

SEQ ID NO: 102253 - DNA, 84 bp, Drosophila melanogaster
tctctgtgtctgactgactggctgactggcaatttgtcaagcaatcaacaaagccagaaattgcccggcaataagacagagcga

SEQ ID NO: 102254 - DNA, 118 bp, Drosophila melanogaster
tgcccaccgcgtttgtatgcgtgctagtgtttgcctgtgtgtgggtcaatattttttcatgttaattcaacttgcatgggcgcggcacacggggcgaatgtgtgatggtgatgaggca

SEQ ID NO: 102255 - DNA, 58 bp, Drosophila melanogaster
gggtgcaactgcaactgcatctgccacagacaagggcactggcaaatgcgtggcacgc

SEQ ID NO: 102256 - DNA, 116 bp, Drosophila melanogaster
aaagaaaaaaagcggcgtggctttcggtcttctattcgtctctctgtctgtgtgtctgggtggcaacactggtacatgtgacagtcggtagacatggcaacgttggcatttgcttt

SEQ ID NO: 102257 - DNA, 80 bp, Drosophila melanogaster
cgggggagagcagggcatatagtttgccgccagagcttaaactttagtctcacgctctctgtgtccctcgttctctttcg

SEQ ID NO: 102258 - DNA, 84 bp, Drosophila melanogaster
ctgacacactagcgacacaattagcacggccatttcagtgccccgtgactctggctgtgactgcgactgtgatcgtggatgcag

SEQ ID NO: 102259 - DNA, 113 bp, Drosophila melanogaster
tgtcatgactatgtaagttctcacaggcgcaggcgtgctcagatagccagatactcgtgtatctgcatctgcatctgcatctgttggatgcttttccatatttcaaagtgaca

SEQ ID NO: 102260 - DNA, 81 bp, Drosophila melanogaster
caggggcagggagaaaggtaaccaggtaacttggcgagcccaggtagaaactggctggctgactgcctgcctggctgactg

SEQ ID NO: 102261 - DNA, 118 bp, Drosophila melanogaster
gagcctttagaaagttttttcaatagcaagtatttaaagatcatatttaatatgtatatatacatatttgtatatatttggctttaatttgcattgaaattgtgttaatcaaatgctt

SEQ ID NO: 102262 - DNA, 116 bp, Drosophila melanogaster
ttgttgagactataagtctgaagtttggtccaccaaaagccagtggttatgtatatatatatacataataagagagtttagaaatagctacgcttgagtttttatcatttttgcaa

SEQ ID NO: 102263 - DNA, 57 bp, Drosophila melanogaster
cagtcagtcaatcactcactcacttacccacttggaggtggagtggtaggtggattg

SEQ ID NO: 102264 - DNA, 84 bp, Drosophila melanogaster
tgtcgccgcacatgcttcttgagactgtgcttgttcttatgccaggatccgcagatgtcgcactgaaccttgggctccgtgaca

SEQ ID NO: 102265 - DNA, 104 bp, Drosophila melanogaster
gtgagcatcgatcacgatctgacagactgacagactaactgactggctgacatcacccgcggccagtttatgaagggaaaaatcagatttttgattgcgcctcc

SEQ ID NO: 102266 - DNA, 70 bp, Drosophila melanogaster
ctttccatggtgaaaattaattgccagccgtgttgcagtctcactctttgtctggcaattaattggaaag

SEQ ID NO: 102267 - DNA, 105 bp, Drosophila melanogaster
gactgcggcaaagcgcagctaaaaccatggcaattactcgggcgtacatatatatatataattgattcgactaattgccgctgtaacaggtgcacgagcagggtc

SEQ ID NO: 102268 - DNA, 92 bp, Drosophila melanogaster
gctcgtgcacctgttacagcggcaattagtcgaatcaattatatatatatatgtacgcccgagtaattgccatggttttagctgcgctttgc

SEQ ID NO: 102269 - DNA, 88 bp, Drosophila melanogaster
ccaatcattcactcgaatgaacaatggatttcatgcctggtgcgtcaggtcttccaagttattttgtatatttttcgaggaaatatgg

SEQ ID NO: 102270 - DNA, 78 bp, Drosophila melanogaster
gacccgaccggcttacaaatgtgtatttctatatttatatatacactttatatacatagaatccggtatgacggtgtc

SEQ ID NO: 102271 - DNA, 109 bp, Drosophila melanogaster
ggtttgttaatgcgtttgcctcgcctgataagattgatgtgtgtatatatagatataaacgtatatatgtatatatatgtctggttatggctgattatgtctgtgtgcc

SEQ ID NO: 102272 - DNA, 62 bp, Drosophila melanogaster
atatatatatatatatatttatatataaatatttatgtatataagtatttgtatgtgtgtat

SEQ ID NO: 102273 - DNA, 86 bp, Drosophila melanogaster
gggggaatcggattctgcaactgtatctggaagatatgaaattgggcagaagaagtaagtgcagcgcgggtgattctggttctctt

SEQ ID NO: 102274 - DNA, 72 bp, Drosophila melanogaster
ggtgtccgaaaaagagagaggagagagtgttgcaactctaattctctcagtctcactctctctcccgctctc

SEQ ID NO: 102275 - DNA, 133 bp, Drosophila melanogaster
gtcagccaacagatttaagcttgtattcagctgcgtggcttcggtagtaggagccactgtagatacagtgctctctggcagggtggccgatgtggtgctcgttgttgtggtgctactggtccctgtagttagc

SEQ ID NO: 102276 - DNA, 115 bp, Drosophila melanogaster
aacattggatagacacatgtattgtatgccttcataattcaatttagatatatattttaccattactctgtctaaattccaggcttgatggcattgatatttatttgtttatgtt

SEQ ID NO: 102277 - DNA, 116 bp, Drosophila melanogaster
gcgaaaattgaaaattgtacaaaaagaagggaacggttgctgatgatgtagtttgaaactctcacaatttatatcacagtggctgttcttttttgtttggcaatcgatctacgttc

SEQ ID NO: 102278 - DNA, 117 bp, Drosophila melanogaster
acgaataaccatgccgtttttaacccaagggaacttctgctgctgatatattattgaaaaactactatatcacagtggctgttctttttggttgcacggccaattccaacgatttgt

SEQ ID NO: 102279 - DNA, 89 bp, Drosophila melanogaster
gcctttaatgtagagggaatagttgctgtgctgtaagttaatataccatatctatatcacagtggctgttctttttgtacctaaagtgc

SEQ ID NO: 102280 - DNA, 91 bp, Drosophila melanogaster
gggccattcgctaaaaggaacgatcgttgtgatatgagttgtttcctaacatatcacagtgattttcctttataacgcatgtttaaagtcc

SEQ ID NO: 102281 - DNA, 109 bp, Drosophila melanogaster
ttatggagcggttgcaattagtttctttggtcgtccagccttaggtgatttttccggtcataaagctagacaaccattgaagttcgttgtggcattagcagcaccacga

SEQ ID NO: 102282 - DNA, 108 bp, Drosophila melanogaster
ttgtgagccacctaaggtcccgatcctgggatgcatcttgtgcagttatgtttcaatctcacatcactgggcaaagtgtgtctcaagatcctggccacatcgtcgcaa

SEQ ID NO: 102283 - DNA, 104 bp, Drosophila melanogaster
gtcttaaagtttggaatagcaattatacgacaaaccttgttcggttttgccaatttccaagccagcactgggtaaagtttgtcctataatcccgaaacgacgac

SEQ ID NO: 102284 - DNA, 78 bp, Drosophila melanogaster
gttgctccagctgacggctgcctcactgtctgaatgtctgtgcgtccggatggctgactggctgcggcaacgggtggc

SEQ ID NO: 102285 - DNA, 112 bp, Drosophila melanogaster
cactggtaaccaaacaaagtcagtgtttttcttagatgtgagaacatacagaggtttaagtgtttgggagaaatttaacacaaattgacgaaaatatgtggctaaaccaatg

SEQ ID NO: 102286 - DNA, 75 bp, Drosophila melanogaster
tggcacattgactgactgactggctgactggtccttgacttggtgacccagttggcctttgttttagccccgcca

SEQ ID NO: 102287 - DNA, 84 bp, Drosophila melanogaster
ttacttatcgagcatctgcctgtctgtctcactgcaattagctacctgagtgaagggaaaatgcatcaaagtgtttgaaagtaa

SEQ ID NO: 102288 - DNA, 98 bp, Drosophila melanogaster
acattctcattgtaatgcggcgctggtgtctcaaatattgtgtatatatatacatattttttgggaacaaaaggttctctgcgttattatcgaggtgt

SEQ ID NO: 102289 - DNA, 74 bp, Drosophila melanogaster
ggtggggcagtgtggctgctcttactgttgcaacactcggattgtcagtgcgtcagtcagccactctcgcagcc

SEQ ID NO: 102290 - DNA, 124 bp, Drosophila melanogaster
ccaaccagttgagttgattaggagctgtccgagtgcctgactttttgctcgactgtctaactgactgactggatggctagatggctatatggttagatggctatatggctgactgcctctcgag

SEQ ID NO: 102291 - DNA, 89 bp, Drosophila melanogaster
gcaccctttattcagacatatctatcagtttgtttgctctgctgacgtagctggatgagtgactggctgactggctgcctgactgactg

SEQ ID NO: 102292 - DNA, 81 bp, Drosophila melanogaster
ggcggctctgtctctctgtctgtctgtctgcgttgaacacacattaccgacgccggggcagaatgcacgcaacatgttgcc

SEQ ID NO: 102293 - DNA, 58 bp, Drosophila melanogaster
gaccgactgagtgactgagtgactgactatttggccggcggtctggttgcttggggtc

SEQ ID NO: 102294 - DNA, 104 bp, Drosophila melanogaster
ttcagcgacaacaacagcagcagtcactgcaaatgaaactgcaattgcatctgcaaatgcaactgcaaccagcatctgcagttggtgtagcgaatgcatctgaa

SEQ ID NO: 102295 - DNA, 104 bp, Drosophila melanogaster
gcttattgcttatagctccccacgatcgtcatcagctgagtgatcatcagcagatgatgataatgatgatgatggtgatggtgatgatgattgagcggccaggc

SEQ ID NO: 102296 - DNA, 118 bp, Drosophila melanogaster
gttggtgtaagtgatggatgccgtgtgctattgcgtgtgtgctgagtgtgtgtgtgtgtgcgcgccacaaataaatactgcataaagtcaaataggataggcccgtgcacacagaaac

SEQ ID NO: 102297 - DNA, 82 bp, Drosophila melanogaster
ggagaaacagagatggaacgacatccttgttcatggtgtatttaatcagtcgccttgtcgctgctgtttctgtctccgtctc

SEQ ID NO: 102298 - DNA, 111 bp, Drosophila melanogaster
aagtgtttgcgaaaacataaacatttgcagggcgggtcgtgtgtcagtgtatttatatcttagctatattgcacacttcccggcctttaaatgtccaatgtttcaacattt

SEQ ID NO: 102299 - DNA, 103 bp, Drosophila melanogaster
tcgaaatttctagatcatttttcggacggtatatgggttaatatttcatttgtcgaatatattgcacattcaccggcctgaaaatatcaagaattaacatcga

SEQ ID NO: 102300 - DNA, 109 bp, Drosophila melanogaster
gaaatgtgaattaagtttgaagcgatttggttcgtcacaagggcaattctgcattttttaactagtattgcacttgagacggcctgattactttaaaacgaatcatttt

SEQ ID NO: 102301 - DNA, 84 bp, Drosophila melanogaster
gccaacaattttctgctgcggatgggggcagtactgtttttttaacattgagtattgcacttttcacagcccgaaaatgttagc

SEQ ID NO: 102302 - DNA, 113 bp, Drosophila melanogaster
tattttacagggaaagtggactcgccgacgagaagaaagcattcatatgtgacacacacgcagtcactgaaagaaaatggggcttacttgtttgtatctacaaattggaaatg

SEQ ID NO: 102303 - DNA, 115 bp, Drosophila melanogaster
ctgtgcatgcatattaaatgagattttcgccgcttttctttcgctgatgcagcatctcgttgtaagttgtttactttgtcggcaaaaactttaccagtgttaatgtgcctaacag

SEQ ID NO: 102304 - DNA, 82 bp, Drosophila melanogaster
tgtgtgtgtgtgtgcgtctaagggagagccttgtacttgtgtgtatgagtgtgggcgcgcctcacacgctcacagacacaca

SEQ ID NO: 102305 - DNA, 89 bp, Drosophila melanogaster
agtaaatactctgaacggaaatctgtttcacatcagtaatgaacatttattttattattgcagaacagaacagttcagtaatacatact

SEQ ID NO: 102306 - DNA, 79 bp, Drosophila melanogaster
cagtctctgtctctgttatttgcagtggtctaaaaaaggggaaacccatcatagcaaagacacgagcattgctgagact

SEQ ID NO: 102307 - DNA, 86 bp, Drosophila melanogaster
gcttgtgtatcctggctgcctgactgcctgactagcaggatttgccctggggagcagggagtgatttgccaactgtgcgggcatgt

SEQ ID NO: 102308 - DNA, 73 bp, Drosophila melanogaster
agtgagcagcagatatgaaagactgggctcgtgccatttgctcactcgctcagtcactcattcactcactcgc

SEQ ID NO: 102309 - DNA, 79 bp, Drosophila melanogaster
acgaagagaggttagatcggttggtgtgtgggtttggcttgccagcatctcgtactccgatctctctatctctctctgt

SEQ ID NO: 102310 - DNA, 79 bp, Drosophila melanogaster
tggctcgggcggagtttctaagctggcatggggcgaaaggattgtaaattacgctgtcagccagtcactcagtctgtca

SEQ ID NO: 102311 - DNA, 111 bp, Drosophila melanogaster; identical to SEQ ID NO: 102180

SEQ ID NO: 102312 - DNA, 84 bp, Drosophila melanogaster
actgcctgcctgcctgcctggctgcgtttgaattggccatgtcaatcaaccaccgacagcagagaggtagtagctatgtggcag

SEQ ID NO: 102313 - DNA, 139 bp, Drosophila melanogaster
ggatgtctgttaacccctccgaggccccacgaatcaacgagactacgaaactctggggagttgtaggcaaagttgtgtggcaagtggctggctgtgttgacaatttccaagttgaccggtctttgcctttcgtgttggc

SEQ ID NO: 102314 - DNA, 84 bp, Drosophila melanogaster
gtgctttggcaatggcaacgacgtcgggattaggccgccagctaatgcgtccttgtgcccgtgtctgtgtctgtgtctgtgtgc

SEQ ID NO: 102315 - DNA, 114 bp, Drosophila melanogaster
aaattaactttcgctgaatcatgtaaataaaattgagtgtgaacatgcaagaaatatttgtttatttcaatgtaaagttgtaagtcctcacatgattagtgagaggtttggttt

SEQ ID NO: 102316 - DNA, 80 bp, Drosophila melanogaster
cttgttttgccaagtgcatttatgtatatgtatatacatatatatgtatatgcaaccaactttgtggccaaaattacagg

SEQ ID NO: 102317 - DNA, 110 bp, Drosophila melanogaster
cccaaggagctgaaggggcctactggttgcagtgagggtctgtcagtcactcaaaggaggcagcgaaggacggccgaaggattgacgattgcccaggagcacaggtagct

SEQ ID NO: 102318 - DNA, 117 bp, Drosophila melanogaster
ggagctaggctaaaatgacaagttggcgcttatgttattgggtggccaacactcgcgcgtctgtgtgtgtgagagcccccacccatgttcgccagcgtgtgtgtgtgtgtgagcgct

SEQ ID NO: 102319 - DNA, 57 bp, Drosophila melanogaster
gccggaaatagacatgcggacatgtgtgtgtgtgtcagcgtgtgtgtgtgtgttggc

SEQ ID NO: 102320 - DNA, 96 bp, Drosophila melanogaster
tcttatatgggtatatgtatattattagcaccacgaacagaacacttcacctgggctgagtgatgtgagtgggcacacacagaacttccggaaaga

SEQ ID NO: 102321 - DNA, 97 bp, Drosophila melanogaster
gccacaccgccacactgccacactgccacactgccacactgccacaattttcctttcccctcagcgcttttgtgtcgtgtgtgtgtgcgcgacgagc

SEQ ID NO: 102322 - DNA, 63 bp, Drosophila melanogaster
ttggaccggctgtgcctgtcgcctggcttgactgactgactgactgactggctggctggctga

SEQ ID NO: 102323 - DNA, 73 bp, Drosophila melanogaster
atcgactgactgactgactgactatagctatactacggctatagctgactggcggagagtaaacgatgtcgat

SEQ ID NO: 102324 - DNA, 68 bp, Drosophila melanogaster
gtgtgtgtgagagtgtgcgcaatacgccgccttcttattcgctcattccgatacactcacacacacac

SEQ ID NO: 102325 - DNA, 105 bp, Drosophila melanogaster
gcaattgaaaagcgtttttttaaagtatgccataatcattttgaccgcaactgcgtgtggaattgcatgtgcaacattttcgccatagaagcgctttgcattcgc

SEQ ID NO: 102326 - DNA, 99 bp, Drosophila melanogaster
gctcaatgtgccatttcattgtatctgcatctatgtatctgtgtatctgtgtatctgtgcattgcatttgcatttgcattgtcaactggggcaatcagc

SEQ ID NO: 102327 - DNA, 100 bp, Drosophila melanogaster
catcagtatctgcaaatgcatttgcatttgcatctgcatttgcatctgcatctgcatctgcatgtgcatagccatgtgcttagatgccgaacagagcgga

SEQ ID NO: 102328 - DNA, 66 bp, Drosophila melanogaster
tgggggatgaaggacggggggacgggcttggggattgccagtcagagtcagagtcagtgtctctca

SEQ ID NO: 102329 - DNA, 76 bp, Drosophila melanogaster
ctccatcgatttaaggttacgtatacgcagcgtggtcccagccatgcatctgtgtgtgcgtctctctctcagtgag

SEQ ID NO: 102330 - DNA, 116 bp, Drosophila melanogaster
gagccccgggtcgcaggctcttttgtgcgcgtaacatgtgtcaattacaggcgcccacacccacacactcgcacactggcacacacgcacacacacagagagcgagcgggaggaac

SEQ ID NO: 102331 - DNA, 88 bp, Drosophila melanogaster
ctctgccgctgtcgctgcctctgtctctgccaccaatttggatgaataatgcaggagactcccaggtgagagtgagagttttggcggg

SEQ ID NO: 102332 - DNA, 112 bp, Drosophila melanogaster
cagatggacagatggactcaggacagatggactcgtggaccgactgactgactgtctgcccgactgcagagacatcaatctagaaacggcaggcagaaagatagccgggaca

SEQ ID NO: 102333 - DNA, 118 bp, Drosophila melanogaster
gtccagcgatgcttcagaacccatcgtgcaataaaaggcagttgtatacatgtttaaatatctatttttacgacgttttatatgggacaatgggctaagttgtgctagttctatggat

SEQ ID NO: 102334 - DNA, 109 bp, Drosophila melanogaster
gcatatttcttgctgcttctgaattctgctgtttgtttctggtcctcttgtgattttctattctgtcagaactattgcagtagtttttttggaatttgcaaacccatgc

SEQ ID NO: 102335 - DNA, 77 bp, Drosophila melanogaster
gcaggacatgtgtctgtgtgtgtgggtgactgtgtgcgattggcgcacataagtgagaatgcgtgtaaagtgtttgt

SEQ ID NO: 102336 - DNA, 75 bp, Drosophila melanogaster
gccgtttgccattgtagctgcatgttgcatgttgctggtactgcaactgcaactgctggtgtttagctcaagtgc

SEQ ID NO: 102337 - DNA, 70 bp, Drosophila melanogaster
tatacatatacagccagccacgagtatgcgtgcgtgcgagtgtgtgtgcctgtgcgtctgtgtgtgtgtg

SEQ ID NO: 102338 - DNA, 58 bp, Drosophila melanogaster
tcgctcagtctctctgtctctctgattctctctggaagggacgacaggagctgccaga

SEQ ID NO: 102339 - DNA, 104 bp, Drosophila melanogaster
ggcaatgccccacgaaaccagttactacttgccgtggcacacaggtgtctccgtctccgtctctgtatttgtgactggcttttgtcgctcgaacggcaagtgct

SEQ ID NO: 102340 - DNA, 107 bp, Drosophila melanogaster
ggaacggcagcaaaaactcatcaattaaaagtgctaatggctatcataatgatatgttaatatcactcgcagctatggccattctgcctttgtttttgcgctctgcc

SEQ ID NO: 102341 - DNA, 93 bp, Drosophila melanogaster
ctcgcaaagttctcgactcctcctcagtccgccgtcaaaacttgttttatattcaaattttgatgcttctgcttgggttcgatttgtttggag

SEQ ID NO: 102342 - DNA, 117 bp, Drosophila melanogaster
gggacagaaatggcggtgcgtgtgctcacatctttggtaagcaattaacggcagcaactctgtctgtctgtcgcccttgacaaaagtgtgtgccacagttgcccctctctgctttcc

SEQ ID NO: 102343 - DNA, 66 bp, Drosophila melanogaster
gagcatgtatgtatgtatgtatgtatgctcatatgtgtatgcgggatttcgagtgcatgcgtgctc

SEQ ID NO: 102344 - DNA, 93 bp, Drosophila melanogaster
accaagctgatagtcagcccatgatcataacaataacatatgtatgtaaatatgtacatatatatgtgcatgcaatttgaagaagcttctggt

SEQ ID NO: 102345 - DNA, 115 bp, Drosophila melanogaster
catttgaaaaatgtttgctacaattttaaatagttgatatcacaaaagttcttctttaaatatgaatttttcaaattttgaatttactatttaaaattgcgcgccattccaaatg

SEQ ID NO: 102346 - DNA, 110 bp, Drosophila melanogaster
gccgcgcactcccttcgggctgaagctgaaactgagactgcatctaaaattgaaactgaaactgaaactgcatctgaattcgaatccgagtccgaagcccgggcagctgc

SEQ ID NO: 102347 - DNA, 70 bp, Drosophila melanogaster
cgatgccacaaactgtgtggtacatatccatatgtccatgtggatgtgcatctgaatggtttgggaaacg

SEQ ID NO: 102348 - DNA, 75 bp, Drosophila melanogaster
tatatatgtagatgtatagttttgcgggctagtctaggctagtctatgttaagtaactatgtatgtatgtatgta

SEQ ID NO: 102349 - DNA, 120 bp, Drosophila melanogaster
cgttttgtactcaattgctccataattattacatatgttatgtacgtgtatttatgtatgtatgtatgtatgcttatgcgttgcgtatgcgtatgtttatgttcataatttccaaatgag

SEQ ID NO: 102350 - DNA, 77 bp, Drosophila melanogaster
gacagtgagtgagtgagagagggagcgcgttgtttttcttttctctccctcactcaatttgtctctctgtctcgctc

SEQ ID NO: 102351 - DNA, 79 bp, Drosophila melanogaster
taacaactatttccaataccatatcatatcagtgtttttgatctttgaaatttggtattgataactgacctagttgtta

SEQ ID NO: 102352 - DNA, 61 bp, Drosophila melanogaster
gccctgtggctccaatatatgtatgtatatatgtacatatatatgggtccatgtgtggggc

SEQ ID NO: 102353 - DNA, 63 bp, Drosophila melanogaster
cagtctcagactgtctcagattaagtcgcgtctcttgtggctctcaggtggttgttgtgattg

SEQ ID NO: 102354 - DNA, 61 bp, Drosophila melanogaster
gatactctgtctccagatgtgggtgatattttctctctgtgtgtctgtgagtctgcgtgtc

SEQ ID NO: 102355 - DNA, 99 bp, Drosophila melanogaster
tgcattattttgtattttcgtctgcccaaaaagtggacggtaaagttgggctgcctaaatttgaatctttttttactagacgaggtgctacattttgca

SEQ ID NO: 102356 - DNA, 113 bp, Drosophila melanogaster
gacgtgtgtatgctggcttttatgtatttacgttgcatatgaaatgatatttatagtaaacagattattttatatgcaggtatatgcaagtcgaggtcctccacactgcactc

SEQ ID NO: 102357 - DNA, 133 bp, Drosophila melanogaster
agcccccactcccgccttcgagcgaccgtgtgtgtgcgagtgtgtgtgagtgggtctgctaagagcttgttaacatttctgtggaaagccgcaacagcggaggccacaactcgagagtccaagtgcaagtcca

SEQ ID NO: 102358 - DNA, 78 bp, Drosophila melanogaster
gatttagaagtggaagacccacgcagctgctgtcattctgccattcaggcagctagtcagtttgtcactctgtcagtc

SEQ ID NO: 102359 - DNA, 77 bp, Drosophila melanogaster
ttggggacacgcacacacactgtggcacacactccctcacggatgagttattaagccatgtttgcgcttgtctctgg

SEQ ID NO: 102360 - DNA, 79 bp, Drosophila melanogaster
catgtccaggctgggaatgtcggagggaatcagtgattcattcggacattgattcattccgtctgtctgtctgtgtgtg

SEQ ID NO: 102361 - DNA, 114 bp, Drosophila melanogaster
tgtcgggggatatctctctgcatatttcaatgttttcgctggcgaaacttgacttgtgtttttgttgcagccctcggatatgcatttttaatgtgcatttgtgcctttgtgtca

SEQ ID NO: 102362 - DNA, 56 bp, Drosophila melanogaster
cggatagtggatgtggtggatagtggctggtctggccgtcccgcattcgtcgtctg

SEQ ID NO: 102363 - DNA, 95 bp, Drosophila melanogaster
tgtctagctatccgggctccgaatgcgactccgtccgcgaatgcgaatgcgactgcggctccgtctgtgtctgtgtctccggctgcggctatccg

SEQ ID NO: 102364 - DNA, 87 bp, Drosophila melanogaster
gtacaaggatatcgagggaataataggtagctatgcacattcgactcgcttgcatcaattaatgtgtcttgttttgtcctcatgtgc

SEQ ID NO: 102365 - DNA, 83 bp, Drosophila melanogaster
gcatctgtctgtggctctgactttggacggttttggcctaatggccatgagatcgtgtttaatagttaacagctttgatttgc

SEQ ID NO: 102366 - DNA, 84 bp, Drosophila melanogaster
tatatgtatatatatatatatataactctatgtttcgtatgtgtttggggtgtatcagtgtctgtgtctgtacatatacatata

SEQ ID NO: 102367 - DNA, 92 bp, Drosophila melanogaster
acgtactgcaacctatgtgggagcgagacggggactcactgtgcttattaaatagtcagtctttttctctctcctatacaaattgcgggcgt

SEQ ID NO: 102368 - DNA, 121 bp, Drosophila melanogaster
gatgcgatgaggaggtgctacacagggagaaacactcagcacacaatagttttaccttgactagagttattgttgttgggtagaaaggtgtgatttatctgcttggacatcattcacttat

SEQ ID NO: 102369 - DNA, 96 bp, Drosophila melanogaster
attttgtcttgctttgactcactcaacctgggtgtgatgttatttcgatatggtatccatcacaacctccttgagtgagcgatagcaggacagagt

SEQ ID NO: 102370 - DNA, 58 bp, Drosophila melanogaster
actcgccatgtggtagtgtgtgtgtggacacacatacacactctctcttaacgtgagt

SEQ ID NO: 102371 - DNA, 112 bp, Drosophila melanogaster; identical to SEQ ID NO: 102223

SEQ ID NO: 102372 - DNA, 106 bp, Drosophila melanogaster
ctgctggggatgtgaatgtggatgtggctgttgccgttgtcgctgaagcatttcattagccacccacgcactctgacactcacaaccacagcaaagcggcccacag

SEQ ID NO: 102373 - DNA, 76 bp, Drosophila melanogaster
aaggctgttctactgcatcaggatgtgctcggcaatggagctgagcttgcgattcttgtgcttggctcgtcgcctt

SEQ ID NO: 102374 - DNA, 107 bp, Drosophila melanogaster
cgggccgcatcgggcgtctactgcgattaactgaatccaaattgtatgtatatctatatgcatctctttaggtatctggtaaactctagttggctgctgccgcctcg

SEQ ID NO: 102375 - DNA, 67 bp, Drosophila melanogaster
agagcagtcagccagccactcatttcgggaccaactggctgactgactgactgactgactccgctct

SEQ ID NO: 102376 - DNA, 75 bp, Drosophila melanogaster
gctccctctctttctctgccaccctctctcttagacgaagaaagccacggggtgtaaaaagagagagagcagaga

SEQ ID NO: 102377 - DNA, 115 bp, Drosophila melanogaster
ggtgcgccattactaaatatacggcatgacgtacaatccgagggagaaaatgttgtatatttattacaatatttgcaatgctcccaattgttgttcgctattcgtgttagccgcc

SEQ ID NO: 102378 - DNA, 72 bp, Drosophila melanogaster
tggttgcatgtatagttgtatgtagatttcccattgatttttaagtctattacggctagaaattgcggacca

SEQ ID NO: 102379 - DNA, 97 bp, Drosophila melanogaster
gagacggggaataaggtggacatcagttagtggggtggctcaacaccacccgcactcgctcactgtccctatctctctctctcgctctcatttcccc

SEQ ID NO: 102380 - DNA, 99 bp, Drosophila melanogaster
gatttgatatcacgatgttttagttaccttaaaaggggcttttctataaagtcctagtaacttttttaattaactgatttaagattgattttgcgaatc

SEQ ID NO: 102381 - DNA, 117 bp, Drosophila melanogaster
gactgtcaatctgtgtgctcgtcctcgaatgcgttctgtatacgtatgtatgtatgtgtgtatgtatatgcgcggcatgaggcagcagaggcataggaagcgacaacccgacaagtc

SEQ ID NO: 102382 - DNA, 101 bp, Drosophila melanogaster
cacactcgcactcgcactcgcactcgcactctcgcactcgcacattgctgacagtttaaggaacatgtggaggcagcacggtacagatggggttgaatgtg

SEQ ID NO: 102383 - DNA, 104 bp, Drosophila melanogaster
tgtgtgcgtgagcgtatctgtatctgggtgtgtgcctgtctgagtggctatgtgtgcgtgcgtgcgctcaatgattaattgcaataaaacactcatgatccaga

SEQ ID NO: 102384 - DNA, 125 bp, Drosophila melanogaster
actttactgccaaagtgccgtaaattggcagctcgcagttgcttttgtggttctatgtcagtgtgtgtgtgtgtgccttgcgtgcgtgtatgtgttagtcatgttcggtgagcgcgagtgtgtgt

SEQ ID NO: 102385 - DNA, 112 bp, Drosophila melanogaster; identical to SEQ ID NO: 102223

SEQ ID NO: 102386 - DNA, 105 bp, Drosophila melanogaster
gccatttaaaattacgtgcctggatttctcgccttggctgcctggctgcctggctgccttgcagcctggctggttattgagagcttgagtacgtggacagagggc

SEQ ID NO: 102387 - DNA, 75 bp, Drosophila melanogaster
tctctcagcgagtctgtctgtctgtcgtttgtcataaaattagcgacagttcagggggcgtgatgcggtgagcga

SEQ ID NO: 102388 - DNA, 93 bp, Drosophila melanogaster
gtctcggaaaatgagcaactgcaactccaattgcaaccggagaccacacgcactcaggaccaatgaaagagggaggaacggtggccccgagat

SEQ ID NO: 102389 - DNA, 102 bp, Drosophila melanogaster
gcgatgaaggagctgaggatggcataatgggctgctgggaggagatctttaattttatatagtagaccttcagccacaccttataaaacgcttatttcacgt

SEQ ID NO: 102390 - DNA, 114 bp, Drosophila melanogaster
gcccgtgtagaaccacgtccgaaatccactaaatagaaattaacttcttttttttagcaacatgcttaaaaaaattgcattgtttcttattatctggagttgcggcacattggc

SEQ ID NO: 102391 - DNA, 78 bp, Drosophila melanogaster
gctgtaccagcaaaatgtatctgcatctgcaaatgtatctgtatctgtatttgtaaatgtggccgcttggcacgcagc

SEQ ID NO: 102392 - DNA, 102 bp, Drosophila melanogaster
ttggtttccttatcagtttcccatcgtatatttatttttcaagaagcttttatgagagctttattaattaaattagttatactagaaagctgatcaagccaa

SEQ ID NO: 102393 - DNA, 112 bp, Drosophila melanogaster
gctcgcagtgccagagcaacgagacccagactgactggctcactggctcactgggggatggggagctagagggatggtgggttgatgggctagtgggccaggcggagcgggt

SEQ ID NO: 102394 - DNA, 68 bp, Drosophila melanogaster
ttgttttacacagatggtgggtatactatatatatatatatggtgtatcttatgtaggtttgaaatag

SEQ ID NO: 102395 - DNA, 77 bp, Drosophila melanogaster
atgtatgtatatagctggtagttcttgcctggagtttcgcagttgtcattctcccgcatctatatatgtatgtatat

SEQ ID NO: 102396 - DNA, 77 bp, Drosophila melanogaster
ggccagcttttgggctgctgtcgtcaaactggctgaatgggccaccatcacgcacactctcacccagacaattggcc

SEQ ID NO: 102397 - DNA, 103 bp, Drosophila melanogaster
agcttatgtctgaatgggacctgtgcttttctatttgattatttcggttaactgagatttttccaagtgcatgaacccgagctgcccagctagaccacttgct

SEQ ID NO: 102398 - DNA, 122 bp, Drosophila melanogaster
cgctttcagatcctccgcgaattgtgaaatgaagagagctatccgtcgacagtcaagttaagaccgattgtaatactgtcatggaattgctctctttgtataacattcgaaaggcgacgatt

SEQ ID NO: 102399 - DNA, 110 bp, Drosophila melanogaster
cgaatccaaatgcgaataagtgaataaagagagctgtccgtcgacagtccagaaactatttaatatcactgtcatggaattgctctctttgtataatattcgacgatgcg

SEQ ID NO: 102400 - DNA, 109 bp, Drosophila melanogaster
gaatgtttaatgtttccgtcagattcctgactgcctgcctggctggctgttgtgaccagcgtgagtgggccatgtgagtgggtgattcggatggccacaaaatacattc

SEQ ID NO: 102401 - DNA, 79 bp, Drosophila melanogaster
agcagtgcaagtcgcgtggtcgcgcttttccgataactcgcctgtggttgttgctcgtgtgactctgactctgactgct

SEQ ID NO: 102402 - DNA, 93 bp, Drosophila melanogaster
ccttgcgcatctgatagtttttaattttatcgatcatggttgcttgaagcgaggagtgaagactttgaaagcccatcgggttgtttgcaatgg

SEQ ID NO: 102403 - DNA, 93 bp, Drosophila melanogaster; identical to SEQ ID NO: 102402

SEQ ID NO: 102404 - DNA, 111 bp, Drosophila melanogaster
ctttatattttggcaacggcctgcccattaatgctatatatatatatgtatacacccaggctgctgggatacgaggatatatggataacagcatgtgatgcgtgtgcgccg

SEQ ID NO: 102405 - DNA, 71 bp, Drosophila melanogaster
gcttacgaccatataaagtatgtacatatgtatgtacatacatatgtatattcttgatcaggatcaatagc

SEQ ID NO: 102406 - DNA, 106 bp, Drosophila melanogaster
ttgaggatgcggacgaggacgaggtcggaggatgtggatgtggatgtgcttgtggggatgtgtaatgtttgtgcttggctgccgtcgcgattcgacaactttggcc

SEQ ID NO: 102407 - DNA, 97 bp, Drosophila melanogaster
ttaatggtgtacacgattatttgtgccgggtgactgagagacaaacagaaggtcggtcggtcggtcggtcggtcggtcggatgagcaaacatattaa

SEQ ID NO: 102408 - DNA, 115 bp, Drosophila melanogaster
tttaatgagcttccattacttcgtatcaacaatgcatttttggtctgacaatatatatttctgttaaaattacattaattatgttaatgggtttcgaagtaataagtttaataaa

SEQ ID NO: 102409 - DNA, 65 bp, Drosophila melanogaster
gctattgtacgtacatatgtatgtaagtatgtatatgcatcgtgtgtgtatgtactggatgtggc

SEQ ID NO: 102410 - DNA, 109 bp, Drosophila melanogaster
atgtcagtactctccaacaggtggcgcttttttaaatatttatttgcgattcttttaaacaaatatttcttccaatttgccaaatgttattttttgagtgcataggcgt

SEQ ID NO: 102411 - DNA, 117 bp, Drosophila melanogaster
ctggatgtacagaaagtgagtgcggtgcaaaagtgtggaaaccgttataactatatatatttcgttaaaggattctctattggctgcgcctatcgaacctggacccttcatcggcag

SEQ ID NO: 102412 - DNA, 119 bp, Drosophila melanogaster
cttttcatatcagcaattttctgcacgtctcgttgagttttgtttaaatgtgtttacaattgactacacccgggtaaggaaaacccgtcgaaattgcagagggaagatgccaagagggg

SEQ ID NO: 102413 - DNA, 97 bp, Drosophila melanogaster
attttgctagctttatcttagataactttggttttcatccagtaatttagacgtctaagctggtaatattagaatctaagctatagacccgtaaaat

SEQ ID NO: 102414 - DNA, 113 bp, Drosophila melanogaster
gggttggccggtgcattcgtacccttatcattctctcgccccgtgtgcacttaaagacaactggacggagaactgataagggctcgtatcaccaattcatcaaaccaataccc

SEQ ID NO: 102415 - DNA, 93 bp, Drosophila melanogaster
atatggtgcgggttgtgggctgcgagtacgaccatgtcaagtatatatatatattcttgatcagggtcactagccaagtcggtctggccatgt

SEQ ID NO: 102416 - DNA, 79 bp, Drosophila melanogaster
aacaggcaacaggctggctggctggatggctgggtgggtgaccctctcctcccgtagctccacccacttctgtactgtt

SEQ ID NO: 102417 - DNA, 67 bp, Drosophila melanogaster
ggataattacgaccctgacagtccgactgtcagtcagtcagtcagtcagccagtcagtcagttgttc

SEQ ID NO: 102418 - DNA, 114 bp, Drosophila melanogaster
gctcgatcgtattattgtaaatatatgtgctgaagttttacactgttctacataatgcatttcgtatgtaaagcagtgacttctaaataatttgcgaattatgtatgtctacgc

SEQ ID NO: 102419 - DNA, 76 bp, Drosophila melanogaster
gggcggctggcccactgctgtgtgtgtgtatatgtgtatatacaatataccgtgcgtggtgtgggtgggtgcgctc

SEQ ID NO: 102420 - DNA, 74 bp, Drosophila melanogaster
gaggcggcagcgtgggagtttcgttaacagctgtacccaaaaacacgacgtctctctcgctctttctcgcactc

SEQ ID NO: 102421 - DNA, 88 bp, Drosophila melanogaster
cacgtctcgacgcctcgcagtatatttttgtgttttgtttcgttttgcaatccaaatcacaggattatactgtgagatgaccagcgtg

SEQ ID NO: 102422 - DNA, 116 bp, Drosophila melanogaster
cgtcatcaacatttttcgcacatacatacacgattcacgggcgccacacggggcattgcgtctgtgcgtgtgtgcgtgcgtgtgccagtgtgtgtgagcgtgtgtcctggtagatg

SEQ ID NO: 102423 - DNA, 72 bp, Drosophila melanogaster
cagaaagccaattgaaggcattaagcgtaaattcgtaaggcgtacgtaattgagtcgctgcctggctgcctg

SEQ ID NO: 102424 - DNA, 115 bp, Drosophila melanogaster
ccaataatacataatcataatttcaatcaatcaaggcttttggtttttgtttatcaatatatactgaagttgttgtgttgttgatttttgattttgggttgttactttttattgg

SEQ ID NO: 102425 - DNA, 82 bp, Drosophila melanogaster
taacctggtggcatttgctgcgggccatgcttcggattgtcagttagtcagttggccagtcagtcagtcagtcagtcagtta

SEQ ID NO: 102426 - DNA, 79 bp, Drosophila melanogaster
tgacttctgtctgtctgcctgccagcctggcttaacaatcagcagatggcgtgaaataagtggtgcggacagtaatgca

SEQ ID NO: 102427 - DNA, 115 bp, Drosophila melanogaster
tggcaatttctttgagtactttcttctatttcccctttgctataatatatatatgtatgtgtatgtatatatgtaggtgtataggtgtgtgtgagttgccccaaaaaacgtgcca

SEQ ID NO: 102428 - DNA, 83 bp, Drosophila melanogaster
ctgcccccgaagctgtttgttgttcggggaattctggttctagggctgattgagtgactgacaaactgactgactggcggcgg

SEQ ID NO: 102429 - DNA, 101 bp, Drosophila melanogaster
ttattggcattatctagatctggattagagtcgccttttgatgtggtgatcaacttctgtggctcgaggacaatatcaggatcttctgaggcagacaataa

SEQ ID NO: 102430 - DNA, 94 bp, Drosophila melanogaster
gatgacgccaaagctgacatgcctgactcagcaggcggcaatcagcgaggttcgcgctgtgtcactgtatgagtgtgtgtccctgggcatcgtc

SEQ ID NO: 102431 - DNA, 91 bp, Drosophila melanogaster
gcactcagatactcgcacacacacacacagacgtatgtatctgtgggacacgtcccttcagttcggatgggtgtgtgtgtgtgggaagtgc

SEQ ID NO: 102432 - DNA, 112 bp, Drosophila melanogaster; identical to SEQ ID NO: 102223

SEQ ID NO: 102433 - DNA, 116 bp, Drosophila melanogaster
gccattgttttacaactgccaacgaaagcagcaaatttaacttctttgccttttatacatgtgtgtgtgtgtctgtgtatgctgtttgtgtgttaagtgacttgttttacaatgcc

SEQ ID NO: 102434 - DNA, 71 bp, Drosophila melanogaster
aatgtctacaagcaaccggagaagagcttgtggcaaataccgcgatgcgtgtctgtctgtatgtctgcgtt

SEQ ID NO: 102435 - DNA, 91 bp, Drosophila melanogaster
cgaagtctttttaccatcagcgaggtatagagttcctacgttcctatattcagtcgtaggaacttaataccgtgctcttggaggactgtcg

SEQ ID NO: 102436 - DNA, 81 bp, Drosophila melanogaster
gcaactggctggctggctggctggctggctggtcggtcggtcaggagttccagtccagttccagtttcagttcccggccag

SEQ ID NO: 102437 - DNA, 96 bp, Drosophila melanogaster
acccaaataatagcaagtgaaatgtgtttccatgcatacacatacatatatgtatgtatgtatatacatttttataaaggcggttctcgagggggt

SEQ ID NO: 102438 - DNA, 106 bp, Drosophila melanogaster
tttacctggtttttgccatcagcgaggtatagagttcctacgttcattataaactcgtaggaacttcataccgtgctcttggaagaccaaaaaacaaccaagtgaa

SEQ ID NO: 102439 - DNA, 84 bp, Drosophila melanogaster
aatgctgttggatctgtaccttcatacatatgtacgtatgtatgtatgtatgtatgtagtttacgcacaagatcaagtggcatt

SEQ ID NO: 102440 - DNA, 97 bp, Drosophila melanogaster
taaggatggatacaggtgggcagttggttacaggtgatggggtgactaggtgcctgggtgcctcggtgcctggcagatggactactggttccccttg

SEQ ID NO: 102441 - DNA, 90 bp, Drosophila melanogaster
gccttcgtttatacatatgtatatgtatatataccaatcgggtaaatacccttgtatatgtatactgccccacatctgtgcgtcgtcggt

SEQ ID NO: 102442 - DNA, 76 bp, Drosophila melanogaster
gctgtgtgttggccgtcatgttgcgcctgcgcctgcaactgcaactgcatctgcatctgaatgcgagtcgcatagt

SEQ ID NO: 102443 - DNA, 71 bp, Drosophila melanogaster
cgccttgtaagcgagtcccagtcaccgactcttttattttcagtcacagtgactgacagccgtacgagccg

SEQ ID NO: 102444 - DNA, 62 bp, Drosophila melanogaster
gcagcagcagcaactgcagcggtaactgcaactgcaactgcggctgcggctgccgctgctgc

SEQ ID NO: 102445 - DNA, 79 bp, Drosophila melanogaster
agaagtacatatatgtgtgtacatatgtgtaatatgaatatatatttgtcagtcatgtgtgtcatgtgtatgtgtctct

SEQ ID NO: 102446 - DNA, 78 bp, Drosophila melanogaster
tacgatgtatctgcggaagacggacagacaggcaggccttatagctgtcactgtatctgtgtatctgtatatctcgta

SEQ ID NO: 102447 - DNA, 98 bp, Drosophila melanogaster
aagagctgcgtttgtgggtgagttgcatgtgcatgtgcatgtgcatgtgcggtgtgtgtgcatgtgttgctgctgcagcgaaacgcactgttgcatgc

SEQ ID NO: 102448 - DNA, 73 bp, Drosophila melanogaster
gaggcaattaaatcgtatgtcattcattggtaatttataccatttacaggcatctgctcgatgtggttggttc

SEQ ID NO: 102449 - DNA, 94 bp, Drosophila melanogaster
tgccgttacgagtgatgtatgcatgtatgtatgtactcgccaaatctatatgtggctgtgtgtgtgcgtgtgtttacttatatgaccgtatgta

SEQ ID NO: 102450 - DNA, 86 bp, Drosophila melanogaster
gtttgttggtatgcgtgtgtctgtctgtgtctggcgaaaacaattgcataatactaggggcatgtgcatttgggagccgtggtaac

SEQ ID NO: 102451 - DNA, 92 bp, Drosophila melanogaster
gcttatcggtgacactttttgtattgtcggccggcttagaaattttgttgttcaaaaatatatatgcacgacaataaaatgtgctgataagc

SEQ ID NO: 102452 - DNA, 94 bp, Drosophila melanogaster
caggttgatgagtgactgactgactggctggctgactaaccgacagtccgttggctaccggttcacggagttcggacaactttaattagatctg

SEQ ID NO: 102453 - DNA, 66 bp, Drosophila melanogaster
atgtacatatgtatatatgtatatatatatatctccttacatatgtacatatgtatttatgtatgt

SEQ ID NO: 102454 - DNA, 112 bp, Drosophila melanogaster; identical to SEQ ID NO: 102223

SEQ ID NO: 102455 - DNA, 110 bp, Drosophila melanogaster
atgtacccagtggatggcaaagccgcacaattcccgcaactatctttgtatctatatatctatgtatctgttgccacaatcagcggtctgctgcacgagcacatgtacat

SEQ ID NO: 102456 - DNA, 61 bp, Drosophila melanogaster
ggacactcataactgggtgagtgggctggccgggttcccactgactcactgactgaatgcc

SEQ ID NO: 102457 - DNA, 60 bp, Drosophila melanogaster
ggagtcggagacagggacgaacaggcaacagaatgactgtgtgtgactctctcggaatcc

SEQ ID NO: 102458 - DNA, 112 bp, Drosophila melanogaster
ggtagttttggtgacgaatcctgtgttgcagtttcgttttgtgaccgacactaacgggtaattgtttggccgccaggattactcgtttttgcgatcacaaattatgaaattg

SEQ ID NO: 102459 - DNA, 108 bp, Drosophila melanogaster
tggcccgcactcttatcgtaacttgtgtggcttcgaacttacctagttgaggaaaactcccatgtcggattttgttacctctggtattcgagccaataagttcggcca

SEQ ID NO: 102460 - DNA, 92 bp, Drosophila melanogaster
gtcctgcagcaactgagtatgtctgtcaatctctggagatttttgcgcccccaattcgccggagtctgtgcagacggaacgcatgcgccgat

SEQ ID NO: 102461 - DNA, 76 bp, Drosophila melanogaster
ttgggtatgggtctgggtctgagtctgtgtttgtgattgggtttgcgattgggactgggtttgggactgggcttgg

SEQ ID NO: 102462 - DNA, 116 bp, Drosophila melanogaster
cctgccacttcgaatcgaagaactgagatcgattggtgcatagatatcaggagaacccactcaatttaactctagcaccattcgaaatcagtgcttttgataagaaacaatcagcg

SEQ ID NO: 102463 - DNA, 82 bp, Drosophila melanogaster
catcatcatcatcatcatcaaccatcctagttcgccatggtcgtgtgctgtgtttcgctttggtgtgatcatgatgtatatg

SEQ ID NO: 102464 - DNA, 82 bp, Drosophila melanogaster
tgcctgctggcgcttgattgcatgttgtcatgggctcggcgcactcgacgcgcatccattcagtcagaagtgacagacggca

SEQ ID NO: 102465 - DNA, 65 bp, Drosophila melanogaster
tctctcgctcactcactcacatccgccaagtgagtgcgagtgttggtggggtttatgccgaggga

SEQ ID NO: 102466 - DNA, 67 bp, Drosophila melanogaster
cactatcgcactcgcacacacactgtcacccgagggattgtcaccagtgtgtgtgtgtgtgtgtgtg

SEQ ID NO: 102467 - DNA, 78 bp, Drosophila melanogaster
gttgcacatgttgctggtgctgtacggatatggctgcttctgttggccagattctggaactgcaactggaactggaac

SEQ ID NO: 102468 - DNA, 111 bp, Drosophila melanogaster
ccctccgccaggagtccacgcaccaataccatttcatttgtttcaaactattatataattgtggagaattgtgaagtcgaggttgagggttgtggtgactctctaaatggg

SEQ ID NO: 102469 - DNA, 101 bp, Drosophila melanogaster
cctgctcgaaaagcacccgttccatatcccatatcccatgtggatgccacacacacacacactgggattgtggggcaatgttggccgtgtgtgcgagtggg

SEQ ID NO: 102470 - DNA, 103 bp, Drosophila melanogaster
aggaccaatattcggttatctatatagcatctgcatctgcatctgcgaattcagccattgcaaatgcatctgtatctgcggatatctggccataatatagcct

SEQ ID NO: 102471 - DNA, 92 bp, Drosophila melanogaster
aatggccagcggtttgcattgcgttcggagttgccacacagagagattggctgcttaatctgcaactccatgtgcatgtacatcgcgccatt

SEQ ID NO: 102472 - DNA, 68 bp, Drosophila melanogaster
tatatatatatacatatatgagtttctatatatcctttttcgcaaggacgtgtgtgtgtgtgtgtgtg

SEQ ID NO: 102473 - DNA, 108 bp, Drosophila melanogaster
ttcaacaaattcaaagcttgtttttacattggaaacatctacacaatatattttgttgttctgtagcatagcgtaaattccatttgaaaataagtaataattgttgaa

SEQ ID NO: 102474 - DNA, 84 bp, Drosophila melanogaster
ctggtgatgtcaatgtttattaatatttgacattcagcaccccaaccgctggcaaatgtttccaatctgtgtccggcatcccag

SEQ ID NO: 102475 - DNA, 77 bp, Drosophila melanogaster
gggagacattgttccttcttatggccttttgttgcgacgactgacagacagacagacggaaggaccgacggtcactc

SEQ ID NO: 102476 - DNA, 80 bp, Drosophila melanogaster
gtcgacaattcgtgctcgtcagccgcagtggcactacgaaaacgactggctgactggctggctggctggctattattgat

SEQ ID NO: 102477 - DNA, 91 bp, Drosophila melanogaster
ccgtctataagtccgtccaaacagcagcagcaacagcaacagcagttaccattgctgcaactgcaactgcaacttggcggcaagaaaacgg

SEQ ID NO: 102478 - DNA, 105 bp, Drosophila melanogaster
ctaccagcacatatttcccacctctcagtcgattttctttgtatataattcgcagcggaaaagtgaaggaagtgaagggagcattgggtacattgacgttgatgg

SEQ ID NO: 102479 - DNA, 106 bp, Drosophila melanogaster
gttgagtttacagtaaaataaatatttaagtggagcctgcgacttcagtccctctgactgactggggtaagtcacttgagcgtttgttggcacgtaaaagacatca

SEQ ID NO: 102480 - DNA, 88 bp, Drosophila melanogaster
gcaggcagcgtgtgtacacttgaaaatgtatctctggcacacactcacacactcacattgaacgtgtaactcacatcgccgccgcggc

SEQ ID NO: 102481 - DNA, 75 bp, Drosophila melanogaster
agttatggcaaacggcgagaaggagcaaccatccgaaggatcctggggtggctctctctcactcactcacatact

SEQ ID NO: 102482 - DNA, 77 bp, Drosophila melanogaster
ttattagaaagttcacacacccacacacagtcacaatcagggatatctgcgtgcgtgtgtgcgtgaaaagtcaataa

SEQ ID NO: 102483 - DNA, 82 bp, Drosophila melanogaster
gggaccccctcggtgatatatatatacatatatatgtatgtgtacgtaatacgtattgtatattttacgcaaatgcggtccc

SEQ ID NO: 102484 - DNA, 98 bp, Drosophila melanogaster
tcacatgaaaacatgtgcattttctctttattccacaagctgagttcttactaagtttttgataaaccggaatatgcagcgtgttgattgtcagatgg

SEQ ID NO: 102485 - DNA, 77 bp, Drosophila melanogaster
ccgggcgttttatggtcaaaagttttggtttctgcggcgacaaaaagaactgaaactggatgtggaactggaactgg

SEQ ID NO: 102486 - DNA, 82 bp, Drosophila melanogaster
atatgtgtctactcatcgtatgtatagcatagttgagtacaaatacgcacatacttatgtacatgcttgtatagatgtatat

SEQ ID NO: 102487 - DNA, 75 bp, Drosophila melanogaster
ttcacttttccctttcacactggcactctgtcataattgagacaacgtgcgtaaagtgggcggtgaatgggtgag

SEQ ID NO: 102488 - DNA, 78 bp, Drosophila melanogaster
cggatccttttgatgatgatgatgatgatgaattcgctctcgaagagttacgcatcgttttgtgtcaagagtgtgtcg

SEQ ID NO: 102489 - DNA, 70 bp, Drosophila melanogaster
gattggccaagtgtactggcgggattagtgggattaaagtgcagtcagtcagtcagtcagtcagtcagtc

SEQ ID NO: 102490 - DNA, 113 bp, Drosophila melanogaster
gcaatccgtgcaaatatgtgaataatgtcgaagagtgtattgtgatttaatcaaagtttattaataaatcatgaacgaaaattgagcaaaagcagttgaatgcattcgattgc

SEQ ID NO: 102491 - DNA, 78 bp, Drosophila melanogaster
ttgtgggcagctgtcagaaaagtcacaccagaattttctgtttccctcagactctttctcactatttgctgctcacaa

SEQ ID NO: 102492 - DNA, 89 bp, Drosophila melanogaster
gagctgcaggagttgtgacgttgccattcggtactacctttctagaaggtatcatcgatttggaatgttttcaaactaaaaaaaagctt

SEQ ID NO: 102493 - DNA, 99 bp, Drosophila melanogaster
taagcaatagcagctttttgttcaaatatttttgattaattacttctatgtaattaagaccaaaaaaattatttaaggggatatcctgctttatgctta

SEQ ID NO: 102494 - DNA, 89 bp, Drosophila melanogaster
gtgtgttctagttaatgaagtgggactgtattgatagcgccgatcactctcgctctctgtgtacccaatctccttcttcagcttcgtgc

SEQ ID NO: 102495 - DNA, 82 bp, Drosophila melanogaster
cattcattatccttctctgtgccgcacatccactcatgtgcctctgtatgtatgtatgtatgtgtgaggaaggacttgtgtg

SEQ ID NO: 102496 - DNA, 118 bp, Drosophila melanogaster
tattaaaatagattaagtctttggagttatatatatgtatgtatatgtatgtatgtatacatatatgtatatgtatatgtatgtatttatatatggagtgataataataataattaat

SEQ ID NO: 102497 - DNA, 112 bp, Drosophila melanogaster; identical to SEQ ID NO: 102223

SEQ ID NO: 102498 - DNA, 58 bp, Drosophila melanogaster
gctggctggctggctgactgcctggaaacgagttcccgcgcagtttccatctaccagc

SEQ ID NO: 102499 - DNA, 110 bp, Drosophila melanogaster
gtataattactagtatattatattgaaaggttattaaattctggtatgtaagtggttgcttgtatagtatttaatggcattcaaattatattaatattaataatatatat

SEQ ID NO: 102500 - DNA, 73 bp, Drosophila melanogaster
ggccaagctctgtgtgtcagtgtgagtgtgcgtgtattgtgcaatttattttaacggctcacgcttttggacc

SEQ ID NO: 102501 - DNA, 87 bp, Drosophila melanogaster
cagtatgcatataagtatgcacataagtatgcatataagtatgcacataagtatgtttatatgtatgtctgtttatatgtatgtctg

SEQ ID NO: 102502 - DNA, 111 bp, Drosophila melanogaster
gattcaattaccggaagcagtccgtccaatctgtccgtccgtccgtctgtccggcggaacagagcggagcggatcggaaccgccgggccctgacgctcctcggaaattttc

SEQ ID NO: 102503 - DNA, 119 bp, Drosophila melanogaster
caaacggcgcacacatagacaagtgccttctgggccgccttcttctggtcgttggcactgtgtccttgttgcttctttagtttggcctgcttctcggaggccttcgcctgcgactggat

SEQ ID NO: 102504 - DNA, 119 bp, Drosophila melanogaster
caaacggcgcacacatagacaagtgccttttgggccgccttcttctggtcgttggcactgtgtccttgttgcttctttagtttggcctgcttctcggaggccttcgcctgcgactggat

SEQ ID NO: 102505 - DNA, 96 bp, Drosophila melanogaster
caatttgctgactttgagtcttggcactgggagaattcacagttgactttattattctgtggttctgcgggtgccaaaacttaaaaaccggctttg

SEQ ID NO: 102506 - DNA, 110 bp, Drosophila melanogaster
gtgctgctgtaattgctgctgttgctgttgcagcagccgaaggagttgcaactgcaactgcaactgctgctgctgctgctgattgcgcgtcaaatgtttatggcattcat

SEQ ID NO: 102507 - DNA, 104 bp, Drosophila melanogaster
gcgggatataggcacgtctaggtacatatacatatgtgtatattttctatatatatgcatatatatcatatggtttatgtatcttctttgcacttttatcttgt

SEQ ID NO: 102508 - DNA, 95 bp, Drosophila melanogaster
gttgtcgtttaatagtgatttgcatggtagtttcttttttaatgaagtttatccacagcattagaaatcacatgcttaattcctgagacggcaac

SEQ ID NO: 102509 - DNA, 92 bp, Drosophila melanogaster
tgctccatggcactgccgggtctgtagacagcctccacatagatgtgtccctgctgatcgtagtaatccagaccgggcgagtatctggagca

SEQ ID NO: 102510 - DNA, 91 bp, Drosophila melanogaster
agttttcaatatcctggtgtctttgtatctatttctttataatttgtatctctatatgtatataagacaagttcaagggatgttgaagatt

SEQ ID NO: 102511 - DNA, 77 bp, Drosophila melanogaster
attctctctcagtgctaagccgcaaaaaagcgaagattaaattttttgttttagttggcccgcacttgaggttgagt

SEQ ID NO: 102512 - DNA, 73 bp, Drosophila melanogaster
acattaaactagttgtatgcatgtatgtatgtatataactttctatacactactgtatatagcagtatagtgt

SEQ ID NO: 102513 - DNA, 74 bp, Drosophila melanogaster
gtatatatatgtatataattaggtgtgggtgtatatatttaatgtatatttatattggtgtatattttatgtat

SEQ ID NO: 102514 - DNA, 69 bp, Drosophila melanogaster
gctgctggttgcacacacacactctcgcacacatggccctctgcgagggtgtgtgtgtgtgtgtgcagc

SEQ ID NO: 102515 - DNA, 82 bp, Drosophila melanogaster
ggtttcagtgtgactgtgtgtgtgtgcctgggcgaggggctattttgcaactctcttttatatagaccacaaatgccgcact

SEQ ID NO: 102516 - DNA, 71 bp, Drosophila melanogaster
gaccaaaaatttgtgtagctcctttgcataaccgaaaattgtttcggttgttgcagacaacacggttggtt

SEQ ID NO: 102517 - DNA, 115 bp, Drosophila melanogaster
cgcaccgccccgcctgccacgccccctcttgcacgccacttgttatgacattttgattatttatttagacaaaagagttgcttcggttgagtccagtgcagtccagcttggtgcg

SEQ ID NO: 102518 - DNA, 104 bp, Drosophila melanogaster
ggttaattcgatttttagctatgattgtccaaacgcaattcttgttgatattcaatattcaagggttgcgactgggcatcgcggctcgaaataagaatacaact

SEQ ID NO: 102519 - DNA, 68 bp, Drosophila melanogaster
tgtgtgagtgcgtgcgtgcgtgcgtgtgtgtttgtggtgcagcgggcaagcaaaattgcattgagata

SEQ ID NO: 102520 - DNA, 139 bp, Drosophila melanogaster
cgacacacgagagcttgaatccttcaccttgctctttgcagttcctgaaatggagtttatgtctggctctctgactctgtcggacacatctggctgtagcgtcgtggcgagatttgtggatcgcatgttctcagaagcc

SEQ ID NO: 102521 - DNA, 68 bp, Drosophila melanogaster
ggaactaattaacgaaggttaggaaacataaaacatatatgtatcttaatacatttttagttagttct

SEQ ID NO: 102522 - DNA, 66 bp, Drosophila melanogaster
acgccagcatatgtacgtagatgaaacgattttggtgtctgagtatgtatgtatgtatgtaggtgt

SEQ ID NO: 102523 - DNA, 59 bp, Drosophila melanogaster
caggtatatgtggtatgtatatacatatatctatatctatatctatccacatatatctg

SEQ ID NO: 102524 - DNA, 108 bp, Drosophila melanogaster
cctttcgcacaaacatccgtctcgctctggccgcaaactgtgtctgtgtcactcaacccactaaactagcgcacaatgcgaattgcgaaatgcgacgatgacgctagg

SEQ ID NO: 102525 - DNA, 93 bp, Drosophila melanogaster
gaaaattatgtaacaggcagaaggaagcgttttcgactatataaagtatattcttgatcgggatcagtctgtctgtctgtgcttatgaacttc

SEQ ID NO: 102526 - DNA, 101 bp, Drosophila melanogaster
cggtgtgtgcgtgtgtgtgaatgtcggtgtgcagagagcgggtatcagatgtgtgtcagtgtgtgtaagtcgagacattatgtataagtacaatgtaatcg

SEQ ID NO: 102527 - DNA, 78 bp, Drosophila melanogaster
ccacgtatatatgcatttatgtatgtgtatttgtagatggggtttcaaacatatatgtatgtatgtatgtatatatgg

SEQ ID NO: 102528 - DNA, 95 bp, Drosophila melanogaster
tttgcatctttactgttgttcatataattcgtatatttcacagatttctctcactgtagaaagtgtgcaatggagagcgaaagagagggtgcgag

SEQ ID NO: 102529 - DNA, 91 bp, Drosophila melanogaster
ggacacttatataattttgattgttgctcagaaagccctcattgtttaccagttggctttcgagcaataattgaaaccagataagtgatcc

SEQ ID NO: 102530 - DNA, 74 bp, Drosophila melanogaster
gtgaacttgaacttgagtggctgagttcacgtggcaacacgacggcactttgacactttggcaaatcgatttcc

SEQ ID NO: 102531 - DNA, 94 bp, Drosophila melanogaster
ctcccgcacttgtattatgatattgtagttctattttttggggcacccaaagtattgaacttatgactcaccttgtaaagcaactacgcggcag

SEQ ID NO: 102532 - DNA, 96 bp, Drosophila melanogaster
tccctgctgaattgagtgactgacttgagtaactgactaactgactcgctggccgagtgtcaatgcgcctgtcgataaattttttgcagcagcgga

SEQ ID NO: 102533 - DNA, 75 bp, Drosophila melanogaster
gcagttgccacctggagctgaatcatgggactggggagtagtggtacgagtcccagtcagtctctctatcgctgc

SEQ ID NO: 102534 - DNA, 91 bp, Drosophila melanogaster
attaattgccgtgaaatacctaattacgagtctctttgtgtttttatttaaaactaaagcggctatgttaggtatacatatgtgagataat

SEQ ID NO: 102535 - DNA, 101 bp, Drosophila melanogaster
tcaatagatggcactagcaaagtttcaaccggcagcataaatctatttatttctatgtgtgcgctgggctgttttccactttctgaggctgcatctgagga

SEQ ID NO: 102536 - DNA, 107 bp, Drosophila melanogaster
ctctatatacagggtgctatgttgtctttggttatctagctgtatgagtgataaataacgtcataaagctagcttaccgaagttaatattagcgtctgcccagcgag

SEQ ID NO: 102537 - DNA, 102 bp, Drosophila melanogaster
gcggcgtctccccatttcttttcattcatttctgcatgggtcagcggtgaatctgtgagattctgtgactcagtgcatcttgagatactttcgggtgcgtgt

SEQ ID NO: 102538 - DNA, 93 bp, Drosophila melanogaster
gacagttgctcatcgtcagcgggatatctatatgtatgtatgtaagtacgtatggatgaattcagatggcggggtgcgtggttgcggctgctc

SEQ ID NO: 102539 - DNA, 91 bp, Drosophila melanogaster
tggagatgacacgaaggtgcattgtagtcgcattgtctgtcccaattgcttcaggcaatacaacttcagtgcaagctctgtgcatttcaca

SEQ ID NO: 102540 - DNA, 94 bp, Drosophila melanogaster
ggggaatctaaatgatgcgtgcgtggatcagggcgagatagtatacgatatactaatggacatctctctgactctcacactctctttgagctcc

SEQ ID NO: 102541 - DNA, 118 bp, Drosophila melanogaster
tgacaaactgtgtacgtatgtatctttttacaataacaggttgattctagtgattttgtagaaatttttcatttaagatttgttcagtaaaagtataatatccttacacagggactca

SEQ ID NO: 102542 - DNA, 66 bp, Drosophila melanogaster
tcaatcgaatgagtatatatgtatatatatgagtatatatgtacgtacatactcatatgtgtatga

SEQ ID NO: 102543 - DNA, 98 bp, Drosophila melanogaster
tcgaatcaacaattgatggatggctggctggctgactgactgaatgactggcatccatgtcagaggggatcaattagaatcaatcgaaagttgttcgg

SEQ ID NO: 102544 - DNA, 105 bp, Drosophila melanogaster
aaggagatacatttttgttcatattggtttaagttctttatttaaatatagtaacctgtgaagacctaaagtatttaataatattagcgagccggtaagttcctt

SEQ ID NO: 102545 - DNA, 76 bp, Drosophila melanogaster
gtgaatccagctcgctcagttcgtttagttcggggacagctaataccgtccgattctgactggctgactgactcac

SEQ ID NO: 102546 - DNA, 112 bp, Drosophila melanogaster; identical to SEQ ID NO: 102223

SEQ ID NO: 102547 - DNA, 87 bp, Drosophila melanogaster
gtcgatggctccaactgactgactgactggctgccggataatatattagccgtaaacagctgaacactagcgaaatgagcaatcgac

SEQ ID NO: 102548 - DNA, 108 bp, Drosophila melanogaster
agcattaagctaacgaggggcgaataagtaccatttgattacggatgacttggcgtgtgaagtcttctgtttttgttcttacgtcactggttaatagaacccaatgct

SEQ ID NO: 102549 - DNA, 130 bp, Drosophila melanogaster
ctgggcccgccgtcgcggccgattatacagtcaatgttggtcaggtcgtcgatcggtgggtcgatcggtgggtcgatcggtgggttgttcagttggccaggtcgatagggtcgggtcgggtttcgcgtcg

SEQ ID NO: 102550 - DNA, 110 bp, Drosophila melanogaster
atgatctttatgatccccggcgatcttgactgttgatgatcttcatcatgatcaatgtccgagatcatctagagcgagggagctgtggctgggatcttgggggacttcgt

SEQ ID NO: 102551 - DNA, 77 bp, Drosophila melanogaster
ggatcatttgcaaggcagctgcattttcattcttttgttttaatatgcagactgcaactgcaactgcaactgaatcc

SEQ ID NO: 102552 - DNA, 110 bp, Drosophila melanogaster
ggcctacgaataaaagggatataatataggtaagccagagacaatatgttcatatagtgattatatgttaatatatatgttggttaaacgctagtttcttttcctttgcc

SEQ ID NO: 102553 - DNA, 107 bp, Drosophila melanogaster
aatgggtctgtatgtctgtatccgaggctgtgtgcgaaacttgagatcttcttggcttcttaagttctgagttttctgtctgcggcgttctgcatcctcgctccatt

SEQ ID NO: 102554 - DNA, 70 bp, Drosophila melanogaster
atttaccccatacatatgtatatatatttggaagtgagtgtgtgtgtgtccgtaagtggtgggggtggat

SEQ ID NO: 102555 - DNA, 72 bp, Drosophila melanogaster
tcttacgtatgtacgctgtactatttatttataattatgctttatgaaatggataagaagcgtattgtaaga

SEQ ID NO: 102556 - DNA, 91 bp, Drosophila melanogaster
gctcggtctctctctgtctgcctctcgctcaaaatggttgcatccccaagagatgcacaaagagcgagcgagagcgagataaacagacgcc

SEQ ID NO: 102557 - DNA, 85 bp, Drosophila melanogaster
gttccccgactatcagatacccgtgaatatcgtgtgaattcgaaattttataatttttcaaggatacctataggtattggggaat

SEQ ID NO: 102558 - DNA, 78 bp, Drosophila melanogaster
atgtgaaattataaaatgtgagctgatttcgctttgtgcaaccgaagacagcacatattttattaattaaaatcgcat

SEQ ID NO: 102559 - DNA, 85 bp, Drosophila melanogaster
ggtttccaattatggcagaactgcacagacacacacacacactctcaatcattctatgtcagtgcaaagtttcggtatagaagcc

SEQ ID NO: 102560 - DNA, 117 bp, Drosophila melanogaster
caactgaacacaatttgttgtgcttgcatatcgaatgttgcatttcatactttatttttggttacaaggaaaagttgcacgaaattggaggcagtattcatgacggttggtcagctg

SEQ ID NO: 102561 - DNA, 113 bp, Drosophila melanogaster
gctctcgtcgctgttgtgcctccagttcgcgttgtttttggatgcgctccagtcgtagcttctctgcctcctcgtccgctgcgtgctggcggtctgcttcagcctgccgttgc

SEQ ID NO: 102562 - DNA, 117 bp, Drosophila melanogaster
cggcgaaagggaatagtttctgctcggtttgatacatagattcattcgatattgaatgtattcaagtatccagatttatgtgctcatgtggattggtgtgtgcgtttcacttagttg

SEQ ID NO: 102563 - DNA, 119 bp, Drosophila melanogaster
gccgcatagccaatccgaggtccttgccgctaatgtatgcagaccggctggcaactgcctggcacacacacacacacactctgacggactctcgacagagctgcgtgtgtgtgagagtc

SEQ ID NO: 102564 - DNA, 107 bp, Drosophila melanogaster
gagagcgggacagcgaccacgggaaataacagtttcgacagctaataacactcgctctgtgcctgtgcgtgttttgcctctgtgttggtgactgtactttttggcgc

SEQ ID NO: 102565 - DNA, 90 bp, Drosophila melanogaster
gactgaccgactgtccaactgactgactgactagctacctgctgagctggtttactttagcttttaacatctgtatgtttaggggttagc

SEQ ID NO: 102566 - DNA, 116 bp, Drosophila melanogaster
actctcttctctcaggttaagagcgtgtgtctgcgaggagagtgcgtgcgcgttcggtctctctctcagtctgccccggcacctgtctctgtctcaatgtgagagtctgcgagagt

SEQ ID NO: 102567 - DNA, 91 bp, Drosophila melanogaster
gataagttacttggtttacctttctgtatacatgtatgtacatacatatatgttccgattatgctgtacatatgggctgagtttaaagatc

SEQ ID NO: 102568 - DNA, 90 bp, Drosophila melanogaster
gtttgttcgtacttctgtctgtccgtccgtatatctgtccgtatgaacagaaactataaaagaatgtacaacaggaagttgagattaagc

SEQ ID NO: 102569 - DNA, 113 bp, Drosophila melanogaster
tgaagaaggtcgcccagaactgagcccgagtcaaatagctgaccgtctgtccggctgtctgtccgtccgtttgttcgtaattctgtccgtccattccgtctatgcctcattca

SEQ ID NO: 102570 - DNA, 79 bp, Drosophila melanogaster
gtcagccagtcagtcacttattcagtcagtcagtcagtcaggcggttggccctgatgtgaatttggattatactgtgat

SEQ ID NO: 102571 - DNA, 76 bp, Drosophila melanogaster
gtaattttagtttatacatatatacaagtacgtattggaccccagccaatacctgcaggtatatatatgacattgc

SEQ ID NO: 102572 - DNA, 72 bp, Drosophila melanogaster
tctcaaatctccaaacttgcatcgttctgtgccattctgggcagcagtccgtgtgtctgtgagtcagtgtga

SEQ ID NO: 102573 - DNA, 82 bp, Drosophila melanogaster
tttcactagctgagtaacgggtatctgatagtcgggaaagtggactatagcattctttattatttattatggggcagtgaaa

SEQ ID NO: 102574 - DNA, 113 bp, Drosophila melanogaster
gcgtctatcttctcgcgaatcgagtcgttcctcggtcggttgtgcgggaggtgtgttcgtctgtccctctgtccgtctgtccatctgtccgtatgaacgtttggatctgagga

SEQ ID NO: 102575 - DNA, 118 bp, Drosophila melanogaster
cagattttaaatgtgtgggtgtggcagtattgtgcggtttttggacgttaaagtgggctctgagtctatgtctctggaagatgcatattcatacggacagaccctccgtctgggactg

SEQ ID NO: 102576 - DNA, 112 bp, Drosophila melanogaster; identical to SEQ ID NO: 102223

SEQ ID NO: 102577 - DNA, 114 bp, Drosophila melanogaster
cgagagaggtgagcacttcacggttatcgattgcagcgagctgaattatgtaataccatcactgatgacagtcagctgtttttgagagacttcgacggcgtcgctttaaaatcg

SEQ ID NO: 102578 - DNA, 106 bp, Drosophila melanogaster
ctttttggtacaggagcgtgtttttgcgctagtgtttgtccctgtgtgcgtgtgtgtgccgcgcttgcttgcgtatgtgtgtgtgttttttctgctgctatgttgg

SEQ ID NO: 102579 - DNA, 110 bp, Drosophila melanogaster
tggtaacttggctagtggcttagcaacaatatcagcatgggtttataactaaattagcatgtatgtatgtatgtatgtttaatgcaaggccaaattggcttttaaaatca

SEQ ID NO: 102580 - DNA, 84 bp, Drosophila melanogaster
cgatgtggatgagggtctggcttgtagtatgaggaatgggcctgggcaatccctcgaccacagacagtctgtctgccagtgtcg

SEQ ID NO: 102581 - DNA, 93 bp, Drosophila melanogaster
tggttattgaactcctcgttgagacagtcagtcagtgagacagatagacaaacagtcaaccagctgacgggcgataggagtgagagtaattca

SEQ ID NO: 102582 - DNA, 95 bp, Drosophila melanogaster
gtttccttctaaatctagcctctactaggctttgtctgtgcattcgaaagccgatcagacatagcctataagaggttaggtgtaccaaggcgaac

SEQ ID NO: 102583 - DNA, 115 bp, Drosophila melanogaster
ggcttgtccacagtctggtggtattcggctttgggaacctgtccgtccgtccgtctgtcccatttatgcggagcacgttcgcctatcgcgggctgcctggctgggattaagagct

SEQ ID NO: 102584 - DNA, 111 bp, Drosophila melanogaster
tttgtcgccgtcatgtttactgcgctcgtttcgaaaatcaattatggccagccgactgactggctgactgactgactgagtgaatgagtgacgaactgacagagtgacaga

SEQ ID NO: 102585 - DNA, 101 bp, Drosophila melanogaster
gggcgaaatgttacggtattttgcctacaagaccgccgactgcgtaacattcagtgtcagtgtctgtcagtctgcggaagtgtgggtgtgtgtgtgcgtcc

SEQ ID NO: 102586 - DNA, 106 bp, Drosophila melanogaster
tgcgggcaaatgttcaaaccaattcaatttgcctggtttctatgtatgtatataaattgttgtaaggggtagggatttaacaggaaattttggttttattatggca

SEQ ID NO: 102587 - DNA, 100 bp, Drosophila melanogaster
gttgggagtgggggaggactggaggccaaacgggcagcagcattccccgtgggagtcttttgttattgttgtgctgatctcttggatttttcgtttcgat

SEQ ID NO: 102588 - DNA, 63 bp, Drosophila melanogaster
catactgactgttcagactgtgctcattggtgtacgagggctgtttgttcatgtggtagtatg

SEQ ID NO: 102589 - DNA, 129 bp, Drosophila melanogaster
ggttctgatggttctgatggtgctgcatgtgctggtggtgctggtgatccacctcatcttcatcatcatcgacctgatacttggaatccaccttcttcaccggacttatgggctgctgatctgtgatgc

SEQ ID NO: 102590 - DNA, 113 bp, Drosophila melanogaster
gattcggtgttgaaggcaatgtcgagagcatcactgtgcgttaccttatccagatgcgttctctgcactttgattacacagttctcaaatccattgactttaatgctaaggtc

SEQ ID NO: 102591 - DNA, 73 bp, Drosophila melanogaster
cgggtctaacttagcagagctttatttcatttcgtttccaatttcacagagtctctgtttctgtttgggctcg

SEQ ID NO: 102592 - DNA, 80 bp, Drosophila melanogaster
tgtgtcggtgtctgtgtccgtgtgtgcgtaaatgaaaagcggatgttgaaagttcagcgcaactgacaggaccaagcaca

SEQ ID NO: 102593 - DNA, 112 bp, Drosophila melanogaster
tgaggggattccccattgcccgagctcgaacctcctgtcactctcattgtgtctcgttttaagcgcattaagtgaccggtgggtggagtgggcgccgtgggcggttgtctgg

SEQ ID NO: 102594 - DNA, 83 bp, Drosophila melanogaster
atggggagaaacacctgacggatttaagttttatcatgagctcaactgccgttgactgactgtctgtctgtctgtctacctgt

SEQ ID NO: 102595 - DNA, 106 bp, Drosophila melanogaster
tgcttcgagctggcagcgcaaaataagagttgctacttttatatatgtatgtatgtgtgttataatccccctcatttcgtctcgttttgatttgtgtgcttttgca

SEQ ID NO: 102596 - DNA, 119 bp, Drosophila melanogaster
ccatgcatggcgactatagctagattgttgctcagctaacactgtgtatatatgtgctgattttatatatatatagggggttcagtggttgctgcttattctgctagttgtttgtggtt

SEQ ID NO: 102597 - DNA, 120 bp, Drosophila melanogaster
ggcggcggatgcttgtcgggcatgggcggcagctgagagactttgaggtgcagcgtctgcatgtgcatctgattcagcaccacctggcactgcagtccatcgaccttgaagagcaccact

SEQ ID NO: 102598 - DNA, 110 bp, Drosophila melanogaster
caccgctgcagatctctgatctctgatgacgacgacgacgatgatgatggggatggcgatgatgatgatgatgatggtggatattggacggcggatggtgtacggcgatg

SEQ ID NO: 102599 - DNA, 108 bp, Drosophila melanogaster
cccatcacccaaaaaaaaatgcaaccactggcacagacacacacacacgcattcctggcgttcagtggcactcgaaatgcgtttatctggtgctgggactgcgttttt

SEQ ID NO: 102600 - DNA, 85 bp, Drosophila melanogaster
ggcagagcgcatcatgtctggccgtttgtctgtatcacaaacttggctgaaacagactgactgactgactgactgccagcctgcc

SEQ ID NO: 102601 - DNA, 82 bp, Drosophila melanogaster
caggaggaggaggagcatccagccagtctgtcattcagtgactgagtgggcgagctggttagtcagctttgtttttgttttg

SEQ ID NO: 102602 - DNA, 76 bp, Drosophila melanogaster
tgtgggtatgtgtgtgtgtgtgagtgcgaaggatacccgagctgagtgttaatttacacacccacacacactcgca

SEQ ID NO: 102603 - DNA, 79 bp, Drosophila melanogaster
ttgactacgaaaccggttttcgatttggtttgactgtttttcatacaagtgagatcattttgaaagctgattttgtcaa

SEQ ID NO: 102604 - DNA, 72 bp, Drosophila melanogaster
gtgtgctctgctctgttattttgtgtgggacccgcgacccagactctcacactgacagaccccagaccatgc

SEQ ID NO: 102605 - DNA, 89 bp, Drosophila melanogaster
ggttgccgcagatacatccatcagatacaaatgagggcccgcagatgcaaccgccgccaactcacttctgtgtctgtctgtcggcaatt

SEQ ID NO: 102606 - DNA, 91 bp, Drosophila melanogaster
agagacagttgtaggaggggaagaaagggatggaaagatgtaagagcacacgttctgtgtctgtgagtccgtgtgccgcctgcctgtgtgt

SEQ ID NO: 102607 - DNA, 72 bp, Drosophila melanogaster
aataaaaagtatacgaacaggtatatatacatatatatatatatatatatacatgttcttgtaccttgtatt

SEQ ID NO: 102608 - DNA, 77 bp, Drosophila melanogaster
ctccgccaccatcagcgaccagagaccgggaaaatatttaattcaactgtgtgtctatgtctgtggatgcggcggag

SEQ ID NO: 102609 - DNA, 84 bp, Drosophila melanogaster
ctgggttcggtttgggaactggaactgcaattgggattggggctcagactcagactcagactcagattcaggcccagacccgga

SEQ ID NO: 102610 - DNA, 78 bp, Drosophila melanogaster
atattatcaactcatttgtcacactcgccaatcgactgactgactggctgactgattggctgaatgagcgactgatgt

SEQ ID NO: 102611 - DNA, 119 bp, Drosophila melanogaster
caccacacaacgcactgattatatggcagtcacacggacacacacttatataaatttaattgactgtggacacatgtgtgtgtgtgtgtgtgcggtgggttactctttattttgcgggg

SEQ ID NO: 102612 - DNA, 109 bp, Drosophila melanogaster
cttttgctccatttcgagttgcactttttggcattgcgtggctggctgaatgccagcgaatggaaatacgaaaaaatattcacaggcaacatcatctctatgtacgaag

SEQ ID NO: 102613 - DNA, 79 bp, Drosophila melanogaster
tgctcactgtgtgcctctctgttattcggaactggttcgcgaaccggttaccagcgtttggagcgcgcgcaatcgggcg

SEQ ID NO: 102614 - DNA, 114 bp, Drosophila melanogaster
tcgagtacggaagagaatggggatccgcaataaagttttcaaccaaatcaaagtgcatgtctaatggttcttgtcctgatgtcggattccgcttgttcttgctgcataatttgg

SEQ ID NO: 102615 - DNA, 100 bp, Drosophila melanogaster
gctgcaaaattcaatgtcgattagttatatttatttcaatgtttcatttcgcgaaagctaatgtactaataataagcgactgacatgcagagtttttagt

SEQ ID NO: 102616 - DNA, 63 bp, Drosophila melanogaster
ggcgagagcaactgcatctggaagacaacctgggggtggacttgtggctgcgactgcactgcc

SEQ ID NO: 102617 - DNA, 114 bp, Drosophila melanogaster
gcaaatgtgagcgaccgattgatgagcatgtgacgttccgttctggcccttgggctgtctgtctatctgtctctccggccacatgtccgtccgacaatccgtccgctttccggc

SEQ ID NO: 102618 - DNA, 110 bp, Drosophila melanogaster
ttgcaagaagaagagggagaatttcgtgtgttagtgtgtgtgtctgtgtgtgattcttgagcaacagtacacgccgcaccccccgcgaaaaacctacccttttttgggga

SEQ ID NO: 102619 - DNA, 64 bp, Drosophila melanogaster
cgtgcattggcgagagtgcgaatcggttttgtttgctctgcctctcactcacactttgtgcgcg

SEQ ID NO: 102620 - DNA, 103 bp, Drosophila melanogaster
ttgtttttctatttaagcaacttcaccgcgctgtctcgctctaacactatgtgtctgtctcattcgctcggctgtttttatgcttgaaaaattgggacagcaa

SEQ ID NO: 102621 - DNA, 86 bp, Drosophila melanogaster
ttgcaccgagctatgtacagcgatcgaagtcgatagtatgggagatgacgatgatgatgatgatgatggtggcattgcaggcgtga

SEQ ID NO: 102622 - DNA, 73 bp, Drosophila melanogaster
aggtgtctttggtctaggctcactcagtcactaactcactagcaactgattcggcttagccagttcagttcct

SEQ ID NO: 102623 - DNA, 79 bp, Drosophila melanogaster
gcttacttgcaatgctcgtcgcagctgcaactgcaacagaaattgcaactgcaacagcaacagcaacagcaactttggc

SEQ ID NO: 102624 - DNA, 120 bp, Drosophila melanogaster
cagccgctcaatgaaagcgaaactgcgattgtgggcgttgtttttgtagcttgtatagttttcatttagtaggtcgacggctgattgcgttcatacagactacatcggttcgcatgtgta

SEQ ID NO: 102625 - DNA, 81 bp, Drosophila melanogaster
gcaactggagagttggatatagattttcctataactgcccgcagttttaaccgttggctctgtgtttccctctctttgcag

SEQ ID NO: 102626 - DNA, 94 bp, Drosophila melanogaster
gtttgtttggtcagagttaagccaaccggataaggatgccaagtcaatctccgtcagcgtctggctggctctttgccacctaaccaattcgaac

SEQ ID NO: 102627 - DNA, 89 bp, Drosophila melanogaster
gatttttggcgtgtcactgtgtcagtgtcaatggacagcataatccgaaagattcgtcttaattgaggtcccactgtgggcgccacttc

SEQ ID NO: 102628 - DNA, 72 bp, Drosophila melanogaster
tgaaagtgcaactgcaactgctgcattatgcattcgagagtgtggtgtgtgcggtcgtgtaattgtttttca

SEQ ID NO: 102629 - DNA, 96 bp, Drosophila melanogaster
cggccatatctcgtactttgcctggctggctggatggctgccttcttgtctttacggctaaagtggttttttggccgccatcgcttgttagccggc

SEQ ID NO: 102630 - DNA, 65 bp, Drosophila melanogaster
agttttgaaacggactgtctgtgtgtccgggtccaaacctccaacacagattccattcgatcact

SEQ ID NO: 102631 - DNA, 83 bp, Drosophila melanogaster
agtgtgtcactctcactcgcacacataccactgccgacgagcgcagcaaggtctccgtctgtgtgtgcgtgtaagtgagtgct

SEQ ID NO: 102632 - DNA, 90 bp, Drosophila melanogaster
ggtgtagctgtatctgtatctgtagctgtagctctatacgtctgcccctagctttgtatctgcatctgcatgtgtatgtatgtgtacatc

SEQ ID NO: 102633 - DNA, 61 bp, Drosophila melanogaster
acacacaggccggggaaaaaaagaggctggcccgctgcctgcctgtctgcctgccgtttgt

SEQ ID NO: 102634 - DNA, 67 bp, Drosophila melanogaster
aagcaaagaccacccgggttcgcgtccaacaaggagactgcctggctgcctgactgcctggttgctt

SEQ ID NO: 102635 - DNA, 85 bp, Drosophila melanogaster
gcttctagtcagggctttctccgtacttctccgcttgttgaagtctctcagtcagtgagttagttggttgtttaggcagcgaggc

SEQ ID NO: 102636 - DNA, 72 bp, Drosophila melanogaster
ggccatttcttttacccagtccccaagatggccggccgacaagcttgtgtggatgtggatgtggatgtggct

SEQ ID NO: 102637 - DNA, 133 bp, Drosophila melanogaster
ctgccaatgcaattgcagctgcatctggctctaatgatgccataattgcctttgttctgcctggcagactgtaagcgatacgagtgccatacccccaccagcccacctgtatggcttgtcattgtcgagcaga

SEQ ID NO: 102638 - DNA, 116 bp, Drosophila melanogaster
tgttgtatgtggtggaatcaggggcgcgctactcgtagaaatgggccatgaatttttatttatacttcgctaccgtttcctttcagcgagcaacgagcaagcaataacagttaaca

SEQ ID NO: 102639 - DNA, 59 bp, Drosophila melanogaster
gattattatatgtacatatgcatacatttctatatatatgtatatgtgtatatagaatc

SEQ ID NO: 102640 - DNA, 119 bp, Drosophila melanogaster
tgcgtgagcttaagagcaagagggcggggggatgcgacgggtggccaacaaatctagatgtgactctgtctgtgtgtttgtgataaagcggagcgtaatgagcgtggtgagtgtttggg

SEQ ID NO: 102641 - DNA, 108 bp, Drosophila melanogaster
tccgtagcgcggatccatggtcatcgggtgttgatgttgatgttgatgctgctgttgctgcgccgtcgatgatgtcacatagcctgctggcatggtcacggcattggg

SEQ ID NO: 102642 - DNA, 81 bp, Drosophila melanogaster
cgtctgctcactatgcttttcacgatgataatgatagtagctatgacgatcatgatcatcatgatgatggtggggatgacg

SEQ ID NO: 102643 - DNA, 102 bp, Drosophila melanogaster
tgtttgacaatgtttgaccatgtttaccctgtggctgtcttcacatcttcacaaggcgactggaagagagccacagactctggccgcacaaaaaccaaaaca

SEQ ID NO: 102644 - DNA, 92 bp, Drosophila melanogaster
gtgtacatatagtatgtatgtgggaatgccatgttcaagtgttcgtatgtatgtatgtatgtgtatgcatgctgggtaatgaatgtgtgtgt

SEQ ID NO: 102645 - DNA, 114 bp, Drosophila melanogaster
atatgtttgcttctgtatcttttgcagtgtgatatggtttaaactatatatatatgataaactatgatgatataggcgagttcaatgacacatagaggtatatatttgacatat

SEQ ID NO: 102646 - DNA, 103 bp, Drosophila melanogaster
tggttcggcggttcggcggttcggcggtttggtggcttagcggtacacagggttgagtggctgagtgcctgggtcgctgagtggctgaatggtggccgcgtgc

SEQ ID NO: 102647 - DNA, 111 bp, Drosophila melanogaster
tgccgtctgccatcgttcggatattcaggcagctagtcagccagccagtcagtcagtcggtcggtcagttcagtctgggttcaggaatgctataaatatggatatattgca

SEQ ID NO: 102648 - DNA, 119 bp, Drosophila melanogaster
aaccattatgtaaatactctcaagtgtttcgtgtttgtgattaagtggtgttcactggaaatatatttatattagcatagtgtttggataggagaggattgagagaatttgagagggtt

SEQ ID NO: 102649 - DNA, 63 bp, Drosophila melanogaster
atatgtgtatatgtatgtatatatatgtatgcctatacatatatgtatatgatatttatatat

SEQ ID NO: 102650 - DNA, 116 bp, Drosophila melanogaster
gaaaacaatgcaaaagtacaaggcatattgcttgcgaaacacacacacactcatagaaagtacgggtccggtcaatatttgccagcagcttgtgcactttatgcagttgttatttc

SEQ ID NO: 102651 - DNA, 71 bp, Drosophila melanogaster
ggcgatatgaggcgcacatatggcgctggtttgtttgcctaaccgtctgtatgtctgtctgtctgcccgcc

SEQ ID NO: 102652 - DNA, 69 bp, Drosophila melanogaster
tgcattcggcagacgtctgatgaacgaacgacggggtaaatgtgtctgtgagtcagtctggcgatcgca

SEQ ID NO: 102653 - DNA, 70 bp, Drosophila melanogaster
tcagcagcggcatctccaactgcatctgcatctctgcaacctctgctgctgatgctgctgctgctgctgg

SEQ ID NO: 102654 - DNA, 74 bp, Drosophila melanogaster
tgtgtggctgtctgtctgtctggcggcttccttttcgctcgctgccaacctcaagccctcttcaccgccgcaca

SEQ ID NO: 102655 - DNA, 98 bp, Drosophila melanogaster
cacgtattccaaccttgattgttgctagggaccgagatgaagtatcttaattttttgaagattctatatatttaatgcatcagcacttgggatgcgtg

SEQ ID NO: 102656 - DNA, 76 bp, Drosophila melanogaster
gccagaggcgggcaggcaaatctggtgaattccggccaggtcagttggtcactcggtgtctctctctctctctggt

SEQ ID NO: 102657 - DNA, 74 bp, Drosophila melanogaster
gtgaaattcgcgtctcagtgtgtgtgtgtgtgcaataaatacatacacgcgagtcaaacacatgcccagttcac

SEQ ID NO: 102658 - DNA, 69 bp, Drosophila melanogaster
ctctcgctgtctgtgtgtgtgcgtgtatccgtcagatacacggccaaaaatagccacaagcagcaagag

SEQ ID NO: 102659 - DNA, 86 bp, Drosophila melanogaster
tttcttataccatgtcgttaaaatgtttgtgaacttatgtattcacaatcatatcacagccattttgacgagtttgggtaaagaaa

SEQ ID NO: 102660 - DNA, 114 bp, Drosophila melanogaster
tgatccaagccataattcttacgtaactcctcaaagggttgtgaaatgtcgactattatctactcatatcacagccattttgatgagtttcgtgcgaatcgcggcagcggatca

SEQ ID NO: 102661 - DNA, 89 bp, Drosophila melanogaster
gttgcatacatatgtatatatgtatgtgtatgcatcgcaggatatgcctgcctatgtgctagtgcattttcataagtgtgtgtgcgtac

SEQ ID NO: 102662 - DNA, 68 bp, Drosophila melanogaster
cttgttgtgcttggcattggcagtgcagtttttaattgcttctgattatgtacttgagtaacaacgag

SEQ ID NO: 102663 - DNA, 100 bp, Drosophila melanogaster
aactctgcatcggcgacacatcgattgtccctgcagcgcagccaagttaactgcgttaaagagttgtcattgtgttgtttgcagagttgtccttcgtccg

SEQ ID NO: 102664 - DNA, 70 bp, Drosophila melanogaster
aatttccgtctcacactccgtgtttcccacaccagttgtggaaatctctgagttgcctgattcggaaatt

SEQ ID NO: 102665 - DNA, 73 bp, Drosophila melanogaster
gcctctcgtctccaagtcatcctcggaatatggcgatgatgagtacgatgatgatgatgatgatgatgatggc

SEQ ID NO: 102666 - DNA, 117 bp, Drosophila melanogaster
ttttcggggagctgagacaggcgcacatacccatcactgtatatatatatatatctatgatatattgggtttttatgaagttactatggttatgccagcccgtctcctcctcgagga

SEQ ID NO: 102667 - DNA, 97 bp, Drosophila melanogaster
gacgaagattctcttcagggcatctggctttgcctttagcaggacttcaaaaagcttgaaaagtgaaagcaaatcctatgaggggctctaccttgtt

SEQ ID NO: 102668 - DNA, 113 bp, Drosophila melanogaster
cgtggtcgtcgccgcttcgactttgaatgcataaattgccggcagacagactgtcggtctgcggggttctctaatttggccattcgaattgcagctcagacaagaggcaatcg

SEQ ID NO: 102669 - DNA, 105 bp, Drosophila melanogaster
tggcgattctgtgcgacctcgtaaacgtatactgaatgtatcctgagtgtatcctatccggtataccttcagtatacgtaacacgagagagcactaacaacgtgg

SEQ ID NO: 102670 - DNA, 115 bp, Drosophila melanogaster
tgcgctaaacgaaaccggcaagtacggggcaagtatgactctatatatgtatgtacacatgtatgtgtatcgggatcagggcgtggcacctgaaatgctgtaaaagccagctgca

SEQ ID NO: 102671 - DNA, 113 bp, Drosophila melanogaster
gccaagcgccaaaaccagaacaacagcctttaagaggtatacacacacacgcacacagatactctggcctgctggtgtgtgtgctggctggctgtgtgtgtgcggtatggggc

SEQ ID NO: 102672 - DNA, 118 bp, Drosophila melanogaster
ttggatttcttggctgtggattttgacaatagatgtagagcttcatttaatgtatatacatatatactattacttactcttcaacctttttaaagccattttacacgaggataaccgg

SEQ ID NO: 102673 - DNA, 104 bp, Drosophila melanogaster
gccataaacaactgaacactgcagctgcttgtaacatgtgtttgtccacatacacacacatatatatatatatatctgggtgttttggcattgtcggtgttgca

SEQ ID NO: 102674 - DNA, 74 bp, Drosophila melanogaster
ggagggggcatagagaacgggtgtgtcggtggtcggaaacacacacaccctggcacacacactcagtcacttcc

SEQ ID NO: 102675 - DNA, 80 bp, Drosophila melanogaster
ttccaggatcgccagacgttgcggatttctgagccctgcccttttggctggtcactgcgactcagtcggtctgaaaggaa

SEQ ID NO: 102676 - DNA, 90 bp, Drosophila melanogaster
ccaaagaaaacttggctgtgtctgtgcgtctctgtatttggctaaatagttgaaataattaggctcattagaagttttgtaggtctctgg

SEQ ID NO: 102677 - DNA, 114 bp, Drosophila melanogaster
gcttgttagcccgatgcaactgcagctgagatgattagcggtactgagactgcatctgcatttggagtgcggagcagggtaggaatgtgtagtttctgcggcgacttgcctgac

SEQ ID NO: 102678 - DNA, 87 bp, Drosophila melanogaster
tgcacccttggccgcagcgaaagaggtcaactaaatgttaatgtcacacacacacattctggcttttctgtctgaggttcggttgca

SEQ ID NO: 102679 - DNA, 116 bp, Drosophila melanogaster
gaaagcaaagagtacatgttctgcatcggagtcactacccatgtccgtctgtctgtccgtccgacatacgaacagacgggtagtgttcctggtcaagaatgtaaaccttaaatttc

SEQ ID NO: 102680 - DNA, 116 bp, Drosophila melanogaster
gaaatttaaggtttacattcttgaccaggaacactacccgtctgttcgtatgtcggacggacagacagacggacatgggtagtgactccgatgcagaacatgtactctttgctttc

SEQ ID NO: 102681 - DNA, 89 bp, Drosophila melanogaster
gtatagctagcaattcgtatggcggcctttgtttgtatattttataacttgcagatgcgtctccacgcggatttcgcaaatgctcttac

SEQ ID NO: 102682 - DNA, 74 bp, Drosophila melanogaster
ggccacagtctgagtctgagagtctggctctgaaagccccagcatcagtacagcatcagcatcagcatacagcc

SEQ ID NO: 102683 - DNA, 74 bp, Drosophila melanogaster
ggctgtatgctgatgctgatgctgtactgatgctggggctttcagagccagactctcagactcagactgtggcc

SEQ ID NO: 102684 - DNA, 80 bp, Drosophila melanogaster
gtgtgtttggtcttttgtgtgtgacagtttttcgtgtaattgattaactgttactgcaacttctactggaacaaaaacac

SEQ ID NO: 102685 - DNA, 62 bp, Drosophila melanogaster
tgaggctggaaaatctccatgagtaggcaatccccagattgtctgtcagtgggtcagtgtca

SEQ ID NO: 102686 - DNA, 102 bp, Drosophila melanogaster
caaattctcgatcagcttgctatatatatatgcatgtatatataggtgtttatgtatgtatatatgtgtattcgtttatagggggcatatcggctgtatttg

SEQ ID NO: 102687 - DNA, 102 bp, Drosophila melanogaster
gtgtggcacttgtgccgttttgtcgacaatgcgcgcgctccctctctcgcactcacgcaagtacggtcgcacacactgacacaaatacacgacacaccgcac

SEQ ID NO: 102688 - DNA, 76 bp, Drosophila melanogaster
ggtgatggtggcgatgggcttgagtatctgtctacccctcagtcgggaatccgtccgtctgtctgtctgtctttcc

SEQ ID NO: 102689 - DNA, 96 bp, Drosophila melanogaster
ggttgggtagcacaatggggcaggtgctcaagtgtgtgtggcacacacacagtgtcacaatcgcagcacacagttgcacattgtgttaacacgacc

SEQ ID NO: 102690 - DNA, 101 bp, Drosophila melanogaster
gtttttggcaattgtctgggcgcaagaggtacagttgggttcagttgccgctatacaatttttgattttgattactcgctgcccacttatttgttagacac

SEQ ID NO: 102691 - DNA, 76 bp, Drosophila melanogaster
cagttggccaaagtcgccgttcagccattccctgcgcatgtctgtctgactgactgaatgactgactggctaactg

SEQ ID NO: 102692 - DNA, 81 bp, Drosophila melanogaster
tgcggttagcagctgatggcagttagccgagcaactaccacacaaaaggtagctaacaatgcaactgcaactgcaactgcg

SEQ ID NO: 102693 - DNA, 102 bp, Drosophila melanogaster
gagaggcggtggcatgaaggacgcaggacgagcagacaaacaatctgttggtttgacgaactaactgactctctgactggcagttactccggctgcggcgtc

SEQ ID NO: 102694 - DNA, 106 bp, Drosophila melanogaster
ctgggagagtgtgtaaattgtcttgtgtaaatatgcaaatttttcttattttcataccctgaaagggagtcgcactgctgcaacaagaactttacaagcctctcag

SEQ ID NO: 102695 - DNA, 56 bp, Drosophila melanogaster
ctgtcggtcggtcggtcggtcggtctgctggctggctttccatcgggtggccatag

SEQ ID NO: 102696 - DNA, 115 bp, Drosophila melanogaster
gaataagttggacagatcttttcggtgatttcgttgatgcatttacataatcaaatatgaatatatgtatttgttgtaaaatatccccctggtcgaaatctgttttcaattagtc

SEQ ID NO: 102697 - DNA, 96 bp, Drosophila melanogaster
aaaatggcgatggcagagaggcggtgcggttttttggggcgtggctggctatatatgcgtctgtccgtctgtctatttgtgccaagcgcacgtttt

SEQ ID NO: 102698 - DNA, 82 bp, Drosophila melanogaster
tgtttgctagtgtgtgtgagcttgtgttttggaaagctcttaataatttccgctggctttggcacacacacacagacaggca

SEQ ID NO: 102699 - DNA, 74 bp, Drosophila melanogaster
gagatcgagataccaactttttgtaattgccagtaacaatacgtgactggttttactgtctctgtctcaatctc

SEQ ID NO: 102700 - DNA, 69 bp, Drosophila melanogaster
gctctcagacacacacacgctttacatagtgagacgccgagtgggtggagtgaatggagtggatggagt

SEQ ID NO: 102701 - DNA, 78 bp, Drosophila melanogaster
catgaatctatatttatattatccagtgctttacttaccggccatgagaacgagaaggggaactggatgggattcgtg

SEQ ID NO: 102702 - DNA, 107 bp, Drosophila melanogaster
ggcgataagtttttgggaatttacgactcggacttgcccataaaacagacactgtctgtgattatgtgggtagctatatcccatttaaatctcacattgctttagct

SEQ ID NO: 102703 - DNA, 85 bp, Drosophila melanogaster
ggggaaagtagggatgtacataagtatgtacataagtatgtacgtatgtatgtatgtatgtatatgcggatacttatacccctat

SEQ ID NO: 102704 - DNA, 56 bp, Drosophila melanogaster
tctgtcagtctgtgtgtcggctgctggcagtatgttcgtcgccatttgctgacagg

SEQ ID NO: 102705 - DNA, 79 bp, Drosophila melanogaster
caaatcgttgtctaatttaagcggtgagtgtaggcgcaagagtaaatactttttgtttaaattacctcgcggctatttg

SEQ ID NO: 102706 - DNA, 99 bp, Drosophila melanogaster
gctcatctccactgactccccgtccggctgaagttgcctgtctggtcgagagctccattcacttcctgcaactccaagtgcaacggcagtggcaacagc

SEQ ID NO: 102707 - DNA, 63 bp, Drosophila melanogaster
tgtgcgtgggttgaagtgtgtttgtgttggttttaccaaaacacacactcgcactcacacaca

SEQ ID NO: 102708 - DNA, 116 bp, Drosophila melanogaster
aaatgtatgtgtggcaggcaaaaagggtgcagagttctgtggcagctgcaactgcaactgcagctggagcattgaagttgccctgagttgtcagcctaaaaaacctcatcatattt

SEQ ID NO: 102709 - DNA, 60 bp, Drosophila melanogaster
ccccaggtggctcgcactgactgactgccggggattgtaaagtgacagcgatatctgggg

SEQ ID NO: 102710 - DNA, 85 bp, Drosophila melanogaster
agtgaatcgatctataattaagatagctccgatacccgactgagtaccttagtctgtctgtctgtctgcatggaatggcttcatt

SEQ ID NO: 102711 - DNA, 72 bp, Drosophila melanogaster
gatggcgcaggcaagtggttaaacatctggcagattgaaagccgagaatgacacgctctctgtctgtctgtc

SEQ ID NO: 102712 - DNA, 121 bp, Drosophila melanogaster
cagctccagctccagcatcgggcacaatttatttttcagcccctctcaaaagtggttgctattaattgtaaagaagtttcgaggctgcgacgttgagagttgatcttggccacttgtgttg

SEQ ID NO: 102713 - DNA, 91 bp, Drosophila melanogaster
gtggcgatgcgatacagatacagatacccggctggctgggcagtcagtcagtctcagagtcccggttttcatagtctcagtcgttggcgac

SEQ ID NO: 102714 - DNA, 111 bp, Drosophila melanogaster
tcattattcaaatatgtgtgaacgtggagagcgtgctgactgattgactatctgactgactgagtggcaggcgactttgttctgcaattggcactatgggggaagaacgga

SEQ ID NO: 102715 - DNA, 95 bp, Drosophila melanogaster
cggctcgggctggctaattgagaatttcaagttgtgaattgtgaaaaatggatcagatagcgattataggatgttcaataagctcggctagaccg

SEQ ID NO: 102716 - DNA, 92 bp, Drosophila melanogaster
aggataaggaacagagtggcagtggaacactggccaggcgataacaactgcgccgctctctctcgctgtcgctctccgatgttccccatctt

SEQ ID NO: 102717 - DNA, 127 bp, Drosophila melanogaster
ttgcagtcctgacacactcacacacacactggccaagaatgggagttgggagagagtgggtgaggtgagtaaaagagggtgtaagtgctggtagtactctctctggctctctccatttggcacattt

SEQ ID NO: 102718 - DNA, 86 bp, Drosophila melanogaster
cgttaccactctgcctcgctctgtctcactcgctcgcccgcaaatcacccctgcagagcgagtcagccaactgacgagcgaaagag

SEQ ID NO: 102719 - DNA, 96 bp, Drosophila melanogaster
ttgaaagccatattgcagtagtcatgtaatcgcatatataaaatatgtatgtttatatatttaatgcaaagagatgttgcgtgcggtagattttaa

SEQ ID NO: 102720 - DNA, 95 bp, Drosophila melanogaster
ggattggaatgttgttggcttttggcttcggccgctcagtctctctgtttctccgatctccgatctccgattctcctctttacattcttctgtct

SEQ ID NO: 102721 - DNA, 62 bp, Drosophila melanogaster
cagaaccagtctgctatctcaatcaacgtctgggtggctctgactgactggctggctggctg

SEQ ID NO: 102722 - DNA, 91 bp, Drosophila melanogaster
tgaggcgcacttgtcaagaactttctctgtgacccgcgtgtacttaaaagccgcatcacagtctgagttcttgctgagtgcgaaatcctcg

SEQ ID NO: 102723 - DNA, 106 bp, Drosophila melanogaster
gaaaaagaatcaatgaataattcagtttacaattggtttaatattatactatgttattatgtaactatattaaatcagaatataaagtgggttgcaattcttattc

SEQ ID NO: 102724 - DNA, 84 bp, Drosophila melanogaster
ggcgtaatgggatgaggaagagcaagtgaaagtggaaagtggacgattgattggcgggctcaccagcattcgttgcaattggcc

SEQ ID NO: 102725 - DNA, 112 bp, Drosophila melanogaster
agatcgggggtggtagggggcgtacactgatgggaatgtgattgtaaaatatatttcatattgtatatattcatatatgataagtgcatgtatcgattccattaaagttgct

SEQ ID NO: 102726 - DNA, 70 bp, Drosophila melanogaster
gtattcagtcggtcggtcggtgggtcggtcatacagtaccgtaccgcaccgtaccgtaccgcaccgtggc

SEQ ID NO: 102727 - DNA, 112 bp, Drosophila melanogaster
atgcacacacatacgaacatattcggtgcacgcacgcaatgcactcacgcacacagtcagtgtctggcgtgttttgtctctggctgcacgagtgtgcgtttgttttgtgcat

SEQ ID NO: 102728 - DNA, 79 bp, Drosophila melanogaster
atcgaaccgatgacggagtcagtcactgattcacttctggggccaagccagatgaatggattgatagcggcatttagat

SEQ ID NO: 102729 - DNA, 108 bp, Drosophila melanogaster
gagtttggagtttggcgttcggaggggttcagtgttttagtagttgtgtaagtgacatgtggtggctcaggatatctgacttttggttacgcttttttgttagcttca

SEQ ID NO: 102730 - DNA, 99 bp, Drosophila melanogaster
gcaatttataagtctctgcaataatcagttctgagtgccacactcgctcactaacgaatggtactaattgaaatcatattgcatccacaggctggcggc

SEQ ID NO: 102731 - DNA, 107 bp, Drosophila melanogaster
aggaggatctgcagccggaggaggagcacatggtcaagtcgagcttcctgccagccagtctcgatcactgagtgactgtgactgttgttgtcttcggcctgtcccct

SEQ ID NO: 102732 - DNA, 104 bp, Drosophila melanogaster
ccttccctttgacggcagatgagcaagttgcatgtttttttaattatgaattatcgttccgccccagaggagatgcctgcttgactgactgactgactggctgg

SEQ ID NO: 102733 - DNA, 57 bp, Drosophila melanogaster
cgtccgtttgaatgtgggcacggtctccaggtctgtgtctgcgtctgtgtctggatg

SEQ ID NO: 102734 - DNA, 115 bp, Drosophila melanogaster
tgtgtgtgtgcctgtgtgtgtgtgtgtatgtaacacgctaacattctgtttgtatttcattaatatttcagaggtggcgttgtttgaaatcaaaacataaatattaacatacacg

SEQ ID NO: 102735 - DNA, 93 bp, Drosophila melanogaster
tttttgcatataaatttgcattgtacagaagtatgtgtatatatgattatatggacacgtgatgtcagtatgtgtgtgcgtggtaaacaaaaa

SEQ ID NO: 102736 - DNA, 75 bp, Drosophila melanogaster
gacgagtggggagcacgcggatgatatgtcatgctacttattttataattattgctgtgctactgctactgcgtt

SEQ ID NO: 102737 - DNA, 118 bp, Drosophila melanogaster
agtaaggcaggcggataagggctggcatcgattaccaggctagcaaattgcaaaataaatgtatataatttcaaaattgacatttgctaatgataagcctctgcctcatgcccatgct

SEQ ID NO: 102738 - DNA, 103 bp, Drosophila melanogaster
gataaccgaaacctgcaggcacagcatgtcgatttcccaatgccaacgcacaggtaaatggaaagaaatgtagtttgtgaaatgcttatggatcggttctatc

SEQ ID NO: 102739 - DNA, 84 bp, Drosophila melanogaster
agttgtatgtagttgctgagtgtgtgtgtgtgcgtatttgatcacattttggcccacactctcgctcacacctacacactcact

SEQ ID NO: 102740 - DNA, 77 bp, Drosophila melanogaster
gttgaataaaggagtggcaaggacgcggggcggtgaaatgctggcaacatgttctagctgtcatatattttttcaac

SEQ ID NO: 102741 - DNA, 90 bp, Drosophila melanogaster
cgcggctatttacagccattgtacagacttggcgaatttatcaagcatggcggagtcgctcagtgggtcactggatggtgaatgttggtg

SEQ ID NO: 102742 - DNA, 106 bp, Drosophila melanogaster
tgtcaatggtagaatccggcacttaatttggctctttctctctatctctgccatgtttttccgccgtacagatgaatgagacttaccagcagccgggcaggtggca

SEQ ID NO: 102743 - DNA, 108 bp, Drosophila melanogaster
gtttttcgtctgtctgttgattttttttcgagccagctggctggctggtgtatgtggctggctggctggctggctggctgaaaagttgccgagcggcgagcagtgaac

SEQ ID NO: 102744 - DNA, 118 bp, Drosophila melanogaster
tccgccgtctgtgtgtttatctctgtgtgcgagtctgcttctgtctctgtctgtggcacgcaaaattaattacaagaattaagcagcgcaacgcccgatctgccggcattgacacagg

SEQ ID NO: 102745 - DNA, 97 bp, Drosophila melanogaster
ggctctgtcagtttcaaattaatagccacgcacacacactcactctgtgccgctgtggggtgtgcatttattatgtgagtgagccagtgcttgccta

SEQ ID NO: 102746 - DNA, 67 bp, Drosophila melanogaster
gcttggctttgatctgcggatgttgcaggcaggacggcaggcagtcagtcagtcagtcagtccgggc

SEQ ID NO: 102747 - DNA, 111 bp, Drosophila melanogaster
ggcgtttccattcgattcttgctaatgtatgcccataatatccattctatatatgtatgtagtttctgatcaaagttcacataaaatgcagaaaaggatgttctgcgcgcc

SEQ ID NO: 102748 - DNA, 95 bp, Drosophila melanogaster
cagctcaaaacggggaggaagtgcatatggttgtcccactcgcactcattgtctgagcacgagctgagagcgccatttctcttgcgctactgcct

SEQ ID NO: 102749 - DNA, 67 bp, Drosophila melanogaster
cctctgtgtgtgaatgtctctcgctgtatgggtgaacctgggcttgtgtgcatttatggcgcactgg

SEQ ID NO: 102750 - DNA, 59 bp, Drosophila melanogaster
caacaactgctgcaactgcaactgcggcaactgcaactgcaactgcagcaccctggttg

SEQ ID NO: 102751 - DNA, 76 bp, Drosophila melanogaster
actgccacattttagtagcttccccactgagcagccgggccaaaaccactgtcagtcagtcagtcagttaggcagt

SEQ ID NO: 102752 - DNA, 70 bp, Drosophila melanogaster
tggccagggcactcactctcacacacacacatagccacatgtggaaatgtgtgtgtgaggttgcctttca

SEQ ID NO: 102753 - DNA, 112 bp, Drosophila melanogaster
cagcaactggatgcaatggtgcttctttcaaaagtatatagttctatatatatagtatagtatagtatatagtttgaataaagctagaaaaactaagcacttgaccttgttg

SEQ ID NO: 102754 - DNA, 88 bp, Drosophila melanogaster
gtttgaaagtatctctttttttttttgcttaagtgatcatattatctttcagtgtgtcttgggcaatctcagtcgaggtactcaaaac

SEQ ID NO: 102755 - DNA, 65 bp, Drosophila melanogaster
gtcagtcagtcactctctgggccattacccttccaggacacgctttgagggcaccgctggctgcc

SEQ ID NO: 102756 - DNA, 95 bp, Drosophila melanogaster
agggggaaatgttggggagctcccgttagggagagagccaggtcgctctctatctctctcgttcgcagtcaggatgctctctggcgaccccccct

SEQ ID NO: 102757 - DNA, 113 bp, Drosophila melanogaster
ccctgagtatgtgtgtgcgcgcgcccggtgcgtgagcagctcctgaccaggtgtgtgtctggctgcgtgtgtgcatgtttggggtaaaaaggaaagcacgcgaaaaaaggctt

SEQ ID NO: 102758 - DNA, 59 bp, Drosophila melanogaster
ggcacacacacatacactcacgctctgcataaatgtgcgagtgtgtgtgtgcttacgcc

SEQ ID NO: 102759 - DNA, 94 bp, Drosophila melanogaster
gacactcatacgccgcgttgtccggctctatacacatacatatgtatatatgtatatctgtgtgtgggcttgtcgctcgctgtgtgtgtgaatc

SEQ ID NO: 102760 - DNA, 70 bp, Drosophila melanogaster
tgtgtgtccagcagaatgatggctatcttgtcgccgttgggatagtcgtgcaggaatatgtcggaccaca

SEQ ID NO: 102761 - DNA, 99 bp, Drosophila melanogaster
ctcgtcgtccttcgtgtgtcgcaggataccttggtatatgtgtgtcagtcagtcactggccgagcgtgggtgtgtgtgtgcgtgcgccaggatacgcag

SEQ ID NO: 102762 - DNA, 70 bp, Drosophila melanogaster
gttgcaagtgcggcacacacagtcgcacacacacacggatatgtgcgaggtgtgttcgaacagttgcagc

SEQ ID NO: 102763 - DNA, 94 bp, Drosophila melanogaster
gataacatcatgggcccctcagtgcctcagtcccagcctctgtaagccaagggttgttggccggacgagcggcgcctccgtttgtggtgatgtc

SEQ ID NO: 102764 - DNA, 102 bp, Drosophila melanogaster
tgaggctaaaccaaaggctgcgactctggctctgtgactccgacttcgactcgaacttggcccgaaagcggtcccgggatctggctcttcactctttgggcc

SEQ ID NO: 102765 - DNA, 92 bp, Drosophila melanogaster
ggcggtgcacgcggggcagttgctgctgcactggctcatggtttccaagagcaagagcaagagcaactgcaaccagaaccacggacaaaacc

SEQ ID NO: 102766 - DNA, 116 bp, Drosophila melanogaster
caattccccaaacagccttgccaaattggccaccgactgactggctgactgactgcctggctagctgggattaggggttggggattggggattgggtattgtagattggggatcgg

SEQ ID NO: 102767 - DNA, 94 bp, Drosophila melanogaster
gcattttaattaaaaatgcctgaaatgtctacccttatatataaatatatatcgtgtatagagtatagtggagtcaggcagtggctataatgac

SEQ ID NO: 102768 - DNA, 73 bp, Drosophila melanogaster
tggaaaagccttcgttagcatatcaaaaggtgtctcttgtcagagagctatcttgtgtcggctgtcgtgtcca

SEQ ID NO: 102769 - DNA, 109 bp, Drosophila melanogaster
tgtgatagatgcggtttgcggaggctgggcgatggggcgcgaggtgtggcacacacacacacatacacactcgcagtggcacacaactacacacacacgcagagacaca

SEQ ID NO: 102770 - DNA, 85 bp, Drosophila melanogaster
cacattcttaaatttaagcaatagatgaccggacatgtgtgtgagtctgtgtgtgtgtatgtgtgtgcttgtgtgtgggagtgtg

SEQ ID NO: 102771 - DNA, 86 bp, Drosophila melanogaster
ctgtcaaaattgtgcagttaagtagacattagattggtttcgagtgccaacgaactgactgactgactgactgcttcattagatgg

SEQ ID NO: 102772 - DNA, 86 bp, Drosophila melanogaster
tatgaatttcccgtaggacgggaaggtgtcaacgttttgcatttcgaataaacattgcacttgtcccggcctatgggcggtttgta

SEQ ID NO: 102773 - DNA, 64 bp, Drosophila melanogaster
cagtcagtctgttagtcagtcagtaagccggcttttaggtttgttggactggccaaactgtttg

SEQ ID NO: 102774 - DNA, 73 bp, Drosophila melanogaster
actaacacactcgtcaaatgcgtgtcactcgggttctctctctgtgtgtgtgtgtgtgagcgtgtgtgttagt

SEQ ID NO: 102775 - DNA, 84 bp, Drosophila melanogaster
tttcccaggcatcgacttcctggccgagctgatttatttcaaaatcgaatttaaacaagtttgcaggcgacgatggcgaggaaa

SEQ ID NO: 102776 - DNA, 111 bp, Drosophila melanogaster
acctcgaccgtgaaaattagagccggacgaaaatcgatatgcatagtatatatctatcgatatttgttgtatcgatgttctttctggaacgtaaccccgctaaatggaggt

SEQ ID NO: 102777 - DNA, 99 bp, Drosophila melanogaster
tggctgtaggtactttattgcacagtattgttcacatatttatgtatgtagaagtacttctttatatatttatgtagatctgctagtgtcaattggcca

SEQ ID NO: 102778 - DNA, 105 bp, Drosophila melanogaster
tggagctggaagtgttgatggttgttgaggcgtttcactcacattcactgatttccttgagtggaaagcgagtatcccttaaaaaaccattccgaagtaagtaca

SEQ ID NO: 102779 - DNA, 111 bp, Drosophila melanogaster; identical to SEQ ID NO: 102180

SEQ ID NO: 102780 - DNA, 73 bp, Drosophila melanogaster
gactccagttgagagagcacacacatcagatgtgtgtgtctgtgtctatgtgtgtgtgtgtggcttggatgtc

SEQ ID NO: 102781 - DNA, 59 bp, Drosophila melanogaster
gatacacagacacacactcacgcatttacatgcggctagtgagtatgtgtgtgtgcttt

SEQ ID NO: 102782 - DNA, 85 bp, Drosophila melanogaster
gtccgtgcgtccgtccgtgcgtccgtcgcgtttctccggagaaagatggtggagaaatggcgaaatggagggacggggtttgagc

SEQ ID NO: 102783 - DNA, 139 bp, Drosophila melanogaster
tagccagactggcagggggcggattgaggggcgtggctgtttgtctctgtccgggtatgtcggtctgtcggtctgtcggtctgggtagctgtgaatgtgtggcaaagttcagacctttgacatttttgtttcggcatgc

SEQ ID NO: 102784 - DNA, 68 bp, Drosophila melanogaster
tgtgtgtgactgagtgtggagtgtgtgtgcttgtgagagaacacacactgcacacctggtctaacccg

SEQ ID NO: 102785 - DNA, 124 bp, Drosophila melanogaster
ttcaattgacaaaatataatttgtatgcacacaaaggaaatgcaaactttcacattgtatttgtatttgcatttaaatgtgtgtgaatgtgtttacaattgtcatgaatattgcaatttatttg

SEQ ID NO: 102786 - DNA, 116 bp, Drosophila melanogaster
gttgtatttctacatttttatgacttttggaagtttccatttgaagaatgttgaatagtttttacacatgcccagcgtaacaagtggaattttaagtatgggagaagaaaagcaat

SEQ ID NO: 102787 - DNA, 110 bp, Drosophila melanogaster
gactctccgccccaaaagcccaaaactgcgcagttcggcaggtttgtttttttctgtttttttttttttttatcgctgcctggctgcgagtttgccagttaaaggtagtc

SEQ ID NO: 102788 - DNA, 78 bp, Drosophila melanogaster
ttatcatcgattgcgacacattttcggggcctcatgaatatgcaatggggctgatgatgatgatgatgatgatgatga

SEQ ID NO: 102789 - DNA, 83 bp, Drosophila melanogaster
tctagagatgcatacaaatgaaaacactggggcaaaccttccgtctgccccctaatgtcgttctctgtctctgtcactctgga

SEQ ID NO: 102790 - DNA, 84 bp, Drosophila melanogaster
gcgaatgggtgtcttttcctggccgtgagtgtgtacacatatgtatatacacatttactctcgcacagtggctcacttgtttgc

SEQ ID NO: 102791 - DNA, 61 bp, Drosophila melanogaster
gtgtgtgtttgtgtgtgtaaataacttttaaagtgctttactcgcacactcactcacacac

SEQ ID NO: 102792 - DNA, 113 bp, Drosophila melanogaster
ttgacatatcagtgacacttttttgggggccgcactgccattgctgcattgcaacaatattttattttattgcatggcaaagctgtcgctgctccgtgtgctttgtgcctcaa

SEQ ID NO: 102793 - DNA, 84 bp, Drosophila melanogaster
actgacgaactgtgggcggctcgcctatatatatatgtatgtatgtatgtatattcgaaaggggcgtggccagctgttttcggt

SEQ ID NO: 102794 - DNA, 118 bp, Drosophila melanogaster
acacacacacgcacacacaaatacacgcacgcaatcggttagaattcgtatgagcatatatattttttacttatattatttttagaatatcgattttgtgccgcgtgcgtgtgtgtgt

SEQ ID NO: 102795 - DNA, 109 bp, Drosophila melanogaster
gtatatatggtatatggtagattgtacgtggatggataccgccgggggatttgccagagtatctctgtctctgtatccatgtgtgtatgagtgtgcctatgctgtggac

SEQ ID NO: 102796 - DNA, 128 bp, Drosophila melanogaster
gtttgtggccaggaactccagcaacagtgtctcagttgcttgtcccccagtctttcggtctgtctgtctgtggctcctccaaaagctccatggtgttgggctggcattgtgggacctgcactttacat

SEQ ID NO: 102797 - DNA, 69 bp, Drosophila melanogaster
gtggttgggtggcatggtggctcgatggcaggttagcctcagtggagtggcacagacacagagacacac

SEQ ID NO: 102798 - DNA, 102 bp, Drosophila melanogaster
gcctgtgtgttcccactgtctttctggctgtgactctgactctgacttcgtctccgggtgaaatacggccataagacatcggccgtaatcaacatgcgtggc

SEQ ID NO: 102799 - DNA, 81 bp, Drosophila melanogaster
gctcggtggctcagtggctcagtggagcactgctgggaatcatttcgtttggccctgctcctgctgctgcagttttcttgc

SEQ ID NO: 102800 - DNA, 99 bp, Drosophila melanogaster
gctgccacactgcgtatacgtatccttgatgcagccaaacaatttatttatttaagttgagctgagtagcagcaagtacgagctggggtgtgagaaagc

SEQ ID NO: 102801 - DNA, 69 bp, Drosophila melanogaster
ttgcgtgcgtgtgagtgtgtctattatcacaaagatttcgagcaccgtctcacacacacatacacgcaa

SEQ ID NO: 102802 - DNA, 74 bp, Drosophila melanogaster
gggccatccgatggcattgccaaccggaagcgcgtcccatcgatttgtctctgtcgctgtcattcactgggtcc

SEQ ID NO: 102803 - DNA, 111 bp, Drosophila melanogaster
ccgtgtgccagtgcagctgtgtgggtgtgcaaagtgtgtccttagtgcatatataaatttatatgcatgtgcctgttacgctctgctcctttcggtttgccggcagtttgg

SEQ ID NO: 102804 - DNA, 101 bp, Drosophila melanogaster
ggccgaaaagccggagtggaataagccgcctgaggttttgtacgcaaattttttaatttattgcataaaatgttgtcggggttttcccatgttggcaagcc

SEQ ID NO: 102805 - DNA, 56 bp, Drosophila melanogaster
cagtgagtacagtgggtacagtggggccacaatggcactgactcactgactcactg

SEQ ID NO: 102806 - DNA, 110 bp, Drosophila melanogaster
gttggctgccttttggacagtgtctgttgccaaatgctcggcgactgagtgaatgaatgactgagtgactgactggctggctgacaatgtcctgcgtttttggggccaac

SEQ ID NO: 102807 - DNA, 74 bp, Drosophila melanogaster
taatgcctttagctgcagagtttatatttttaagtatacatacagaatatatatttatccagcaaaaggcatta

SEQ ID NO: 102808 - DNA, 80 bp, Drosophila melanogaster
ttgtttggctgttgctcgtcgggtgtataaataaaaagttttgcacatgtgacgagcaataaatgcagcaaattaaacag

SEQ ID NO: 102809 - DNA, 116 bp, Drosophila melanogaster
tgtcttggccatcatcatttacgcttttcagctggccaaaggtgctggaattcgctatacagtctgcgtctctgggtctctggctttatttatggtagcgtaataatgatcaaaca

SEQ ID NO: 102810 - DNA, 71 bp, Drosophila melanogaster
tctgtctgtctgtctgtctgtgggtgaatgtgaatttgccaacggacgaaatgattctttgcgcacgcaga

SEQ ID NO: 102811 - DNA, 59 bp, Drosophila melanogaster
caaactctcgcacacacactcgcacggagatgtcctgtgtgtgtgtgtgtaggaaattg

SEQ ID NO: 102812 - DNA, 93 bp, Drosophila melanogaster
gctgagccatttagcgaattaaaccagacaaaatctgataatatagcccctggggataggagtgtctgtctgtctgtgtggtagttggccagc

SEQ ID NO: 102813 - DNA, 78 bp, Drosophila melanogaster
gctcgcaaacgtacacacagacacacactcgctgcgaaaaaggaagcgatggaaatttgtgtgcaatttaaatcgagt

SEQ ID NO: 102814 - DNA, 75 bp, Drosophila melanogaster
ttaatatatggctaaccatacacatacatagctgcttaaatatatgtatgtatgtatatgtgagctgtataggga

SEQ ID NO: 102815 - DNA, 130 bp, Drosophila melanogaster
gctggaattggaattcatactactgtttttagtgggtgggggtccagtgtttcacattgattttcttagtatttgtgactagatccacactcattaataacggtagttcaatcatcaagcacgtgttttc

SEQ ID NO: 102816 - DNA, 88 bp, Drosophila melanogaster
agggatcgcaaacagcagcgggagcttatatgtatcttgtttaattatttaaaatgcaaaagtttcggtttctttagtcgcgatttct

SEQ ID NO: 102817 - DNA, 58 bp, Drosophila melanogaster
gttgccagttgccaggcgaatgaggaatgaagagtgactgactggctgactggctgac

SEQ ID NO: 102818 - DNA, 75 bp, Drosophila melanogaster
cacactcacacacgctcagacacaagccaggacatgcaatcactgctcccgagcatgtgtgcgtgtgtgtgtgtg

SEQ ID NO: 102819 - DNA, 76 bp, Drosophila melanogaster
agtggcgtaatcgagcgcgaacacaggtttgacatttcataattatttcaactgtgtgcctgcctggctggctgct

SEQ ID NO: 102820 - DNA, 69 bp, Drosophila melanogaster
caagtacatgcgacttggtcctgggaaatgggaaatggccctgtgcctgaatccctgtgtgtgtgtgtg

SEQ ID NO: 102821 - DNA, 92 bp, Drosophila melanogaster
ctctcgttcttccttcaatttcgaattaaaatggctgagttctccatttgttttgctgatcaaaggacatcaaccggatgcgagagcacagc

SEQ ID NO: 102822 - DNA, 93 bp, Drosophila melanogaster
aagtgcctgactttatagcttcagatcgctggatgtctatatatgtatgtctatatatttctatcgctctgtatgtcaagagttcagttgctt

SEQ ID NO: 102823 - DNA, 106 bp, Drosophila melanogaster
gaccaagcgcctaagttaattgtgaaattctgggtccctgtatcgctgtccaagccaagcaagcagggctaataaatagtaaatcgcttccgacttaatgatggtt

SEQ ID NO: 102824 - DNA, 91 bp, Drosophila melanogaster
ctccttaggcaccttgttatgcgcattcagcgtgggagagttcatgttgttgccgatgctgttgatgttgttgatgctgctgccgttggag

SEQ ID NO: 102825 - DNA, 63 bp, Drosophila melanogaster
gatatggtatttctgcaagtgtatctgctagcgcagcagccctgacgtgacgcatgccatgtc

SEQ ID NO: 102826 - DNA, 81 bp, Drosophila melanogaster
cgaatcctgtttctgtcagtgactctttgggtgtttcgcttcagcagcggcacacacgggggcattcagcattcagggtcg

SEQ ID NO: 102827 - DNA, 109 bp, Drosophila melanogaster
catgagcatttcgcggaatttgtcaccgtcgatgagaccatcgttatcgaatgttttgaaggcagcaataacaacttcgtcttcatcgttggcaccggaggtggccatg

SEQ ID NO: 102828 - DNA, 86 bp, Drosophila melanogaster
gcaactgcgaccgagagtgtctctgtgtctctggacctgaaaaaacggtaattgatggtcttggccaggacggcgagtgcagttgt

SEQ ID NO: 102829 - DNA, 84 bp, Drosophila melanogaster
ctcggttttctgcctccataaacagagatatgccaaatgtcaacccaggtggatgtggatgtggatgtggatgtggattatggg

SEQ ID NO: 102830 - DNA, 67 bp, Drosophila melanogaster
ggttcagtggctcagacggcagctgcaatttccaactgcaactgcaactgcaattccaggccgagcc

SEQ ID NO: 102831 - DNA, 91 bp, Drosophila melanogaster
ttggcctggactgtttggctgactggctgactggctgacttaacatacaggccaggccaagacagaccagtcagtccacacacctggctag

SEQ ID NO: 102832 - DNA, 98 bp, Drosophila melanogaster
tctgttttgctaccacttagttggcgagttgaggggtatgatgaatgtgttttaaatccacctaagattatactcgaacataaccagtgtagagcaga

SEQ ID NO: 102833 - DNA, 87 bp, Drosophila melanogaster
ttgctccacgtctaccctgtagatccgaatttgttttatactagctttaaggacaaattcggttctagagaggtttgtgtggttcaa

SEQ ID NO: 102834 - DNA, 81 bp, Drosophila melanogaster
gactgccatgatgcattattcatccgagagccgctgacgtcaagtcaaggattgtatggatgtgtgtgctgtccccttgca

SEQ ID NO: 102835 - DNA, 65 bp, Drosophila melanogaster
cacactgtctctctctctgctctcggaaaactcatttaagttttcctcggccagagagataggtg

SEQ ID NO: 102836 - DNA, 95 bp, Drosophila melanogaster
gccattgttgtggcacctacacagagtgtgtgtgtgtgtgtgactgccataattgagtgaaagatggcgacaatttacaaccacagacacgactg

SEQ ID NO: 102837 - DNA, 104 bp, Drosophila melanogaster
agcctttgatgccccagacatcatctacgtcactggttcggggaaaatctaatttattgaactctgtcagtgagtgagttgtgtggaaattggcgttggaggtt

SEQ ID NO: 102838 - DNA, 100 bp, Drosophila melanogaster
tgtattttttctctgttttttttgtttttttttgttttttgtgcggcaaccattaaggcgcgcggatccaaatcgtatagaacaggggaaggaggtggcg

SEQ ID NO: 102839 - DNA, 94 bp, Drosophila melanogaster
tcactcttagcaagtgtctcgcttggcctgtgccactgactgacagtcagcgccctcgtcttggtcttagtttcgaattcttggtttgatgtgg

SEQ ID NO: 102840 - DNA, 92 bp, Drosophila melanogaster
cactcttagcaagtgtctcgcttggcctgtgcgactgactgacagtcagcgcccccgtcttggtcttagtttcgaattcttggtttgatgtg

SEQ ID NO: 102841 - DNA, 101 bp, Drosophila melanogaster
gcaggtataatgggtttatgatctatctttgccagtatttaaaataatctatattgatatgtttatagtgtgtaaccatttcgtgttttccttgttcttgc

SEQ ID NO: 102842 - DNA, 113 bp, Drosophila melanogaster
tcgtgggttttaaccctatgaaatgctgggaatgggtatgggaatggaaatggcagtggccagaccgtctctctcacgctcgcgcattccatacccgaggtacacatctacga

SEQ ID NO: 102843 - DNA, 85 bp, Drosophila melanogaster
ttttgcactcactctctatctctctccgcccggcatcatccttaagcggaatgtcggtcggtgggtgggagccactggtggaaaa

SEQ ID NO: 102844 - DNA, 116 bp, Drosophila melanogaster
caatttgtaatgcaatatgctgatttctccccctgacacgcctgcaatccctggttgcctgtttggctgccagtcaacactcgtgtgccaatagaaatgccaatgcgtctcacttg

SEQ ID NO: 102845 - DNA, 81 bp, Drosophila melanogaster
gagtagtggtaagtaaagtaatttgggtattgccgcacgaatggtgagcgggccaactaaagaactttgtagctgctgctc

SEQ ID NO: 102846 - DNA, 77 bp, Drosophila melanogaster
cagtgccagagtgcgtgtgtctgcgtgttatttgatacggtaatcatgtgacaaatatgctgctgcctccgcttctg

SEQ ID NO: 102847 - DNA, 85 bp, Drosophila melanogaster
gggtttgtcctccacgttctcacctattagtgataaacattatgaataatggcatcaatgtatgtatgtttgttgaagaaaaccc

SEQ ID NO: 102848 - DNA, 109 bp, Drosophila melanogaster
gccgactctgactgcgagacagcctttgaatctgactgactgactgcctggaagcgtccagtaccaaagaaaaattcatttcagctcttcgtcgtcgtattggagcggc

SEQ ID NO: 102849 - DNA, 89 bp, Drosophila melanogaster
gcaagaatctcctcttatcagtgctttaaactctgttaactatagtatactcacagaattaagagagctgataagacacgtattaatgc

SEQ ID NO: 102850 - DNA, 77 bp, Drosophila melanogaster
tggctgtgggtggtgtgggtgtgggcctggcttactaaaggccgccgccggccgacacaaacacactcacacagcca

SEQ ID NO: 102851 - DNA, 90 bp, Drosophila melanogaster
ctgatagtcggaccacaggcagacagtcagtcagtcggtcgggtcggtctgtctgtcagttggttagttggtcttgtccccaaccgactg

SEQ ID NO: 102852 - DNA, 80 bp, Drosophila melanogaster
gtggcttttgtgggctacggatggcactttattattatatatagtctatggtctggcatctgttgccgttacgcgtccgc

SEQ ID NO: 102853 - DNA, 79 bp, Drosophila melanogaster
gcttttcctccatgcagcgggcccacaaaaagagcagtcggctggctggctggctggctggctggctggaaaagaaagc

SEQ ID NO: 102854 - DNA, 61 bp, Drosophila melanogaster
aactgctcgacggcaatggaggttcagccgcagagcgactgcctcagtctgtcagccagtt

SEQ ID NO: 102855 - DNA, 89 bp, Drosophila melanogaster
agcacagttcttggctggctgttgatgctgtgatgcatttttgacaatgaacatcagatgtctgtcagtcaggcagttgggtgtgtgtt

SEQ ID NO: 102856 - DNA, 105 bp, Drosophila melanogaster
acctgtgatacttagaaatctgagctatttgcacatctgttttctatttgaagttttcattattttaaataggatggcaaatagagaccaataaggttacggagt

SEQ ID NO: 102857 - DNA, 75 bp, Drosophila melanogaster
ctggaagcactcatgaaaatgtatctaagtatctatatttaaaagtgtatatgtgtatttttcatgagtggctgg

SEQ ID NO: 102858 - DNA, 90 bp, Drosophila melanogaster
ggaactggtttagcttttcctggcatcccctgtagacttccccaacttctatggcagtcagtcagtcggtcaggcggtcgaatcatttct

SEQ ID NO: 102859 - DNA, 98 bp, Drosophila melanogaster
gcggccaaaagggctacacactcacacacacgcacacttgctcactcatttagtgtcacacatggcgtatacgtgctggctgtgtgtggccgtgccgc

SEQ ID NO: 102860 - DNA, 88 bp, Drosophila melanogaster
atacatgcgcagcgcaccgcagaaacccgtttgcatgaggcccagcctacgtgtgtgcgtgtgtgtgtgagtgtgcgtgcgctagtat

SEQ ID NO: 102861 - DNA, 79 bp, Drosophila melanogaster
agcgagggccattaaaatcaaagtcaatagccgacgacgcgtcaactctttggctggctggctggctggctgcctggct

SEQ ID NO: 102862 - DNA, 85 bp, Drosophila melanogaster
gtcatccagtcagtcactcagttagtcattcagccggttagccagctcacacgtggctaactagggggtgtggggctggatcggc

SEQ ID NO: 102863 - DNA, 107 bp, Drosophila melanogaster
gcttctgttaccagtttgcattcaattttgcgccatcgtccgtctgtccgtccgtctgtcgttgtcatcgtcatggctggctaacagttttcgccattgttaggcgc

SEQ ID NO: 102864 - DNA, 89 bp, Drosophila melanogaster
cagactagagacgagacacgaatgtatctatatatatgtacatatctatacatatatgtatctacgtgtgtgtatttggatgactggcc

SEQ ID NO: 102865 - DNA, 63 bp, Drosophila melanogaster
ttattcatacgcagatgtatgtatagcacgggaatctgaatatatatatttgcgtgtgcttga

SEQ ID NO: 102866 - DNA, 69 bp, Drosophila melanogaster
tacccactaccatcgctctgaactgtcagcgagctgccctgattgtgagcagagtgtggactgagggtg

SEQ ID NO: 102867 - DNA, 86 bp, Drosophila melanogaster
ggcgtggcacagttgctatacggctgaactgtggctacgatcctgtggttgtgactttgactgtggctgtgactgtgactgtgact

SEQ ID NO: 102868 - DNA, 105 bp, Drosophila melanogaster
ggatggagcgaaaaagagagctcaagagagaaaattatgagacgccatcgctctctttctctctctggcagctgtttcttatttactatggtttcgctttgtgcc

SEQ ID NO: 102869 - DNA, 113 bp, Drosophila melanogaster
gctccctgctcctcctcctcccttctgcggcagccttttgtgcaaatgaattcgtttattttgtaaaatgtcaattgctatgctggcttacagggcggaggagcagcagggac

SEQ ID NO: 102870 - DNA, 89 bp, Drosophila melanogaster
tgttttgtggggtatgaatatatatacatatatagagtctaatcatattagattttagtttaagtgtgttattaatgcaactcaaggta

SEQ ID NO: 102871 - DNA, 116 bp, Drosophila melanogaster
tcttgttgttgatgttgtgttctcggttagttttaccatattatttgctcttgtctttggaattaaaatgtaattatgtcgtaaagcagctgagtgtggcattgcatacaatttgg

SEQ ID NO: 102872 - DNA, 89 bp, Drosophila melanogaster
tggctcccctgcagcgttgacgttgccccatatgatgatgatcttcatcatcgcggtggttggtttctgtcggtctcttgggtttgtca

SEQ ID NO: 102873 - DNA, 106 bp, Drosophila melanogaster
catacgtcaacaagcacgcgcggctgctgtgccaaagtttttttttatacatatcaagaataaaagctttgcatatgtattgggtttatttattttgttttgtatg

SEQ ID NO: 102874 - DNA, 120 bp, Drosophila melanogaster
gcaatcatcggcgggccagcattagatcatatatacagacagaaacgacgacgacatcatcatgatgatcatgatcatcatcgtacactctgactcatgaacctcactcgcctcacttgc

SEQ ID NO: 102875 - DNA, 123 bp, Drosophila melanogaster
aggatcatcttgcaggcgttcttattgttctccttgtcgcctatgatggtgatgcagcgctcctgcaacgacacatccgtgggcttctgcgagatctggacataggagccgctctcctccttg

SEQ ID NO: 102876 - DNA, 124 bp, Drosophila melanogaster
cagggaaacgcaacaggcggggggatgccaaatgcatcagatgcctcttgcatctgcgactgcaactgcatttggatttggtctggcttttggatatttgcagccagcaagtgcagtgcgagca

SEQ ID NO: 102877 - DNA, 89 bp, Drosophila melanogaster
gtcatgagagttgagtggattgtcgagtgggattcaactcgaattgaatcgaatcgaattgcatcgtatcgatggagctccaatttgac

SEQ ID NO: 102878 - DNA, 117 bp, Drosophila melanogaster
gttagcaaggcgaaaccttgaacaagcctgtcaatctttttattttttgctgcacatgcgagtatttaaatttttatttatggcacgcaatttgtttggttttggctaatgtttgag

SEQ ID NO: 102879 - DNA, 73 bp, Drosophila melanogaster
ttcgagcgcaatttgttgtcgtgcagctgatggtggaagtgaaactgtagctgcaactgcaactgcaattgaa

SEQ ID NO: 102880 - DNA, 67 bp, Drosophila melanogaster
gtgggggaaagtgcagcagattggccatatcgtttcgatatgcaactgcaactgcaactgcaactgc

SEQ ID NO: 102881 - DNA, 113 bp, Drosophila melanogaster
agcgaattttccatatgcaactgccattgggatacaccctgtgctcgctttgaatgaaatgcaagcaagtgaacacagctggtggtatccagtggccgtttggcatccttgct

SEQ ID NO: 102882 - DNA, 118 bp, Drosophila melanogaster
tgcatcctttgaaggttttgggctgcgtgtcaggagtgcatttgcactgaaactatctgaagcatgtaaatgcactatctggtacgacattccagaacgtacaatcttcccgaatgca

SEQ ID NO: 102883 - DNA, 128 bp, Drosophila melanogaster
gtgaattaatccaaacaagtattcttaattggctatgcgctttggcagtgtggttagctggttgtgtagccaattattgccgttgacaattcacagccactatcttcactgccgccgcgacaagctaa

SEQ ID NO: 102884 - DNA, 124 bp, Drosophila melanogaster
tcctggatgaaaaggtccttcggtttcagtttatgggatacacacagttcagttttgtcacacttcaagcatcactgggctttgtttatctcatgagagcgaaatttattcaacaggaaacctt

SEQ ID NO: 102885 - DNA, 97 bp, Drosophila melanogaster
ccgaatcagccgcactgatggcctgtgcaagtcgaagtcagagtcagtcactcaaactggctgcggctgttactgtcagtgaatccgtctggtttgg

SEQ ID NO: 102886 - DNA, 69 bp, Drosophila melanogaster
caaacacattcagcaaacattacacgcatcgcgctgtgtgtgtgtgtgtgtgtgtgccaaatgtgcgtg

SEQ ID NO: 102887 - DNA, 90 bp, Drosophila melanogaster
gctcacggctgcggcttcctgtttctgcgatcttttaaaatgagaaatttctttttaatttagacttaaacagactgcgcaccggacagc

SEQ ID NO: 102888 - DNA, 67 bp, Drosophila melanogaster
gatgatgatgatgatgatgatgatgaggccggagtctgagcccaaagtcgttaacatggtggtcgtt

SEQ ID NO: 102889 - DNA, 89 bp, Drosophila melanogaster
gtttctggccagaaagggtcgccaagtgcatatatctacatgcacgaatgtatatatatatatgcaacaagtatccctcggataggaac

SEQ ID NO: 102890 - DNA, 119 bp, Drosophila melanogaster
tctcaagtatcggagcagaatatcttacaggtaagcacagaagtcttatgaatcgaatgaacaatttttatttataatgcttgcttttcataggactttttgcgtcagaaatacgaaga

SEQ ID NO: 102891 - DNA, 112 bp, Drosophila melanogaster; identical to SEQ ID NO: 102223

SEQ ID NO: 102892 - DNA, 110 bp, Drosophila melanogaster
gttggtagctggtagctggtagccatgttcgtgtggctcgatatatacagatatgtatctgtatatatatatataaagcaacttggctagttcctgcagcagcagtcgac

SEQ ID NO: 102893 - DNA, 78 bp, Drosophila melanogaster
gcatgtgttgtgtttttgcagttgtcactattaatttgaacgtagttgttagtgccgaccaggtgagaacggaacagc

SEQ ID NO: 102894 - DNA, 107 bp, Drosophila melanogaster
agaagccttgataacgattaattgtagagttatataagcatataaacatatacatatgtatatttcatattttggtatgaccttcagcttgattgttttccatttct

SEQ ID NO: 102895 - DNA, 72 bp, Drosophila melanogaster
ggctagaaaggtgtttgagggccttgtctaagcggcgatcgtctagactgtgacagtcactcactttcagcc

SEQ ID NO: 102896 - DNA, 66 bp, Drosophila melanogaster
actcacacacacacgcacagaagtaggggccaaagttctcaagcgaatgtgcgtgcgggtaaaagt

SEQ ID NO: 102897 - DNA, 91 bp, Drosophila melanogaster
gccaagaaagttgtacatggccaaatatgtatgtatgtatgtgtgtgtatattaaaatatatgtaccgcattgtttgtcggtgtatatggc

SEQ ID NO: 102898 - DNA, 73 bp, Drosophila melanogaster
ttgggctgtggctgtgactctgtggctgtggctgtgtagctgccgagctgtagctgtggctgctatttcccaa

SEQ ID NO: 102899 - DNA, 76 bp, Drosophila melanogaster
tgttgctgcgagggagtgggaaagggataagcggtgggcactacgtttatcactccgtccctgtctcgctgctaca

SEQ ID NO: 102900 - DNA, 69 bp, Drosophila melanogaster
actggcacgcacaatccttcttggcaaggacctcctttgtgtaggccctgtctgtgtctgtgtgcgagt

SEQ ID NO: 102901 - DNA, 96 bp, Drosophila melanogaster
gttgtcctgttttgatgactctctctctctgtctgcctgtgggtgtataagtatttatgtgaccgtgggcgagtgtgtgcgtgtgtctgggccaac

SEQ ID NO: 102902 - DNA, 64 bp, Drosophila melanogaster
gtcactcggcgagagagaaatccttcggctggctgtccggctctctctctctcgctcacaggac

SEQ ID NO: 102903 - DNA, 109 bp, Drosophila melanogaster
ctgccgggaggtccttctatttgcctgtgagtctgcgtgtgtgtgtgtgtctctatctatgtgtttgtttcgatgcccactggctatttttatttgatgtcctgtgcgg

SEQ ID NO: 102904 - DNA, 100 bp, Drosophila melanogaster
gttcggaacaaacttaagcggattcaaatggatttggaatgtttagtggtatgtacataccaacagagaattatttgaagcccttcgattcgttatgaac

SEQ ID NO: 102905 - DNA, 116 bp, Drosophila melanogaster
gcgagatgcgattgggatttggattcggatttagattctgtctctggctgtggctctgactggagctcagctgcatgccacacatcatcaaacgatccaaactgatccgggatcgc

SEQ ID NO: 102906 - DNA, 106 bp, Drosophila melanogaster
atgggtggtagctgcgttgaatgcaagtgcaatggtatctgagttgactgcgcaaagacactcacacacactcgttggcatctggcttttaattttgcacatctat

SEQ ID NO: 102907 - DNA, 78 bp, Drosophila melanogaster
gtttgttacgatatatgcatgtatatatatgtgtctgtttctatatatatatatgtcactatatatgtgtggtcaaat

SEQ ID NO: 102908 - DNA, 98 bp, Drosophila melanogaster
gatttatcttaagggcagccggatgatttctgtttttgtcgatgatgaaatggtgaaagtggaacgatgaaagtggaaattgtttcttttgatgaatt

SEQ ID NO: 102909 - DNA, 121 bp, Drosophila melanogaster
cagacaaacacatcagacattgtgaaaaaaaaccatgtgtatgtatgtatgtatgtatgtatgtatgtatgctatgtgctatatgctatatatgcgtttgtttgttgtgttgggctgagtg

SEQ ID NO: 102910 - DNA, 103 bp, Drosophila melanogaster
gcgctggtattgattctgcggccacaggaggtacaacgggtggtgttgtctcagcaacagcaactgaagcaacttctggggtttctgcaacaacaggtggtgc

SEQ ID NO: 102911 - DNA, 80 bp, Drosophila melanogaster
ccttcttattgtctctctcactgggtttctggataaggggagcctcacctggagttccggaaaagaggggtggcagatgg

SEQ ID NO: 102912 - DNA, 97 bp, Drosophila melanogaster
gctatttgcgttttgtctggtcaaagttcttgtctatctctctcggactctctgtcttctggcggactacttacacgcagagaaaatttgcaacagc

SEQ ID NO: 102913 - DNA, 83 bp, Drosophila melanogaster
gtgtctgtctgtcagtccatctgtcgcacatgcatgcataacttgggatagtctgtggtatagttttgacagcccagtttcac

SEQ ID NO: 102914 - DNA, 86 bp, Drosophila melanogaster
tgcgtgcatgtgccttgagttagggttttacgcgtctctaatgcttaaattacacattcaaactcacacagacactcgcattcgca

SEQ ID NO: 102915 - DNA, 81 bp, Drosophila melanogaster
gccgtaagcctttcagtgagctctgtccgccctgttggccctgcccaactgtctgactcgctggctgcatggctgcctggc

SEQ ID NO: 102916 - DNA, 110 bp, Drosophila melanogaster
ggctgctggcggttgacggctgacggtggactgcgagcagaatgcgcctgcatctctatctgcatctgcatctgcatccgcatcagaacgggaatcggaatcagcatccc

SEQ ID NO: 102917 - DNA, 91 bp, Drosophila melanogaster
gcttgggggggggggggggtcatgtttggctccatctcaatctgaaattgtggttattgcactcagacccactcattgtcctgccacgagt

SEQ ID NO: 102918 - DNA, 66 bp, Drosophila melanogaster
acactcgcacacacacgcacacattcggggatacaaaggtgtttgtgtgtgtgtgtgtgtgtgtgt

SEQ ID NO: 102919 - DNA, 119 bp, Drosophila melanogaster
gtttaaattggtcagaagggaactgagaattatagtttttaataatattagaatttgtttcttataatatttattaaattgaatatatttccagttcaagcgttttgtaattgttatac

SEQ ID NO: 102920 - DNA, 107 bp, Drosophila melanogaster
ggcacgtgctattgtctgcccccatctatttcaatttgattatattgaagagcatatgatgtaatatatggaaatgtaatctgattagaggctggctaagctgagcc

SEQ ID NO: 102921 - DNA, 101 bp, Drosophila melanogaster
tttttagaattctgttggcataattttctgctcacacacacacacactcattaaatgggtttcttgttgttgctgggcggcggttttgcttaagctaaaga

SEQ ID NO: 102922 - DNA, 116 bp, Drosophila melanogaster
ggtattatttgtatgcttcgtttctatgtgtaatgcataactatataattgtagttatatatctatgtatatgtattgtatgtatgtatgttagattagaagcgaccagatttatc

SEQ ID NO: 102923 - DNA, 81 bp, Drosophila melanogaster
tgcatgggaatcgcgtagtgaggggtggtatatatgtatatgtatctatctatctcactggaggcgaaacccacaattgca

SEQ ID NO: 102924 - DNA, 101 bp, Drosophila melanogaster
ttgaagtatgtgctgttgcaccgccttgttggaaccaatttttgtatataaaaaacactttggccacaaaacgagcgaaacggtcacgcccacattttcaa

SEQ ID NO: 102925 - DNA, 72 bp, Drosophila melanogaster
gggaactacaaagtcagagagttgagactgagcatgcagtttatagtaactcttctgttttagatggttgcc

SEQ ID NO: 102926 - DNA, 92 bp, Drosophila melanogaster
gagctcagcgaatgcctgtttacactcagaacgtacgttgctttctaatgtaatcatctgtatctgaatacgtttatactcgcgttttgctt

SEQ ID NO: 102927 - DNA, 105 bp, Drosophila melanogaster
tgatctctgaaggtaaaaaaaatacgctacatatacagatacagatttttcattatatataggtgaaagcttctgatttgcttagcgattttagctttctcgtca

SEQ ID NO: 102928 - DNA, 119 bp, Drosophila melanogaster
cagtgtacacctcaacctcaagaccgcagtatatctctcagtaccgagcttaatgtcagtctgtctgtcataaccaggtatatttatagactgctcttcttcacgtttagcggtaattg

SEQ ID NO: 102929 - DNA, 85 bp, Drosophila melanogaster
gcagttctcagacatttacatgattgtatgtatgtatgttttagttagggcatatgtacatacataatgtacactgtttcaatgc

SEQ ID NO: 102930 - DNA, 107 bp, Drosophila melanogaster
catctttcaacaaagccatttttttttattttgagacgattttttgtttatatttaggcttgaaagtaaaggatccgataaatccatggatggtttgctttttgatg

SEQ ID NO: 102931 - DNA, 80 bp, Drosophila melanogaster
gtagcactaaaatgtgattttcattttataagtagcctgtttttaagtgctgcgttgaaaaaaatctcactactgtgcac

SEQ ID NO: 102932 - DNA, 103 bp, Drosophila melanogaster
ggattcagatgcagatggtgatgcagacgcatatgcagatactgcctctgaatccaaatcggtatctgcatctgcatctgcatccgtatctgtatccgtatct

SEQ ID NO: 102933 - DNA, 127 bp, Drosophila melanogaster
gcagagatgaagcaagaggaaatgcgaaggcaggtgatgtgagccggcggtggtggactgactctgactctctgcatatgtatctgtatccatatctgtatctgtatctgtgtgacgttactttccc

SEQ ID NO: 102934 - DNA, 100 bp, Drosophila melanogaster
cccatcctctcatcccttcgcactcctcactctcagtctccggctcgaaggacaattgccgctgctggcacggatgatgagttcggtgggatgagttggg

SEQ ID NO: 102935 - DNA, 96 bp, Drosophila melanogaster
ccgtcacaataagctgtcgtttattaacttatatatattgattttctgttctgaaaatcggctattatcaggcgactaagctagtttagctgacgg

SEQ ID NO: 102936 - DNA, 56 bp, Drosophila melanogaster
gaaagcggcggaagggagattggggcgctcgctcactctcactctccgtcgctctc

SEQ ID NO: 102937 - DNA, 106 bp, Drosophila melanogaster
gtgagtaggtgagcgagtgagtgcgagtgcgagcgaggtggcgtgtgtggagtgttgagtggctccaatgtcttcttcttgctgccatcgctcttcggaaattgat

SEQ ID NO: 102938 - DNA, 113 bp, Drosophila melanogaster
gcggcaaaaacgaatacgagtacgagtacgacaacaattgttgtgcaatttatctttatttaattgaacttttactttcgtcgtcgctgctcttgtcgttttgttgttgccgt

SEQ ID NO: 102939 - DNA, 121 bp, Drosophila melanogaster
gggcaagaagtttacggagcttgttgtgcaagtatagaaattttaaaatattatttttatgataataatgtcaaatgaagtcgagatgcttaacagcaggtattgctgtctttggccctct

SEQ ID NO: 102940 - DNA, 91 bp, Drosophila melanogaster
ttggctaatgtgtggttgatatggttgatatggttgaatgctcggtcggtcggtgggtcaatcagtcagtcagttatcggaaagccaaaca

SEQ ID NO: 102941 - DNA, 87 bp, Drosophila melanogaster
tgagtttgctggccggcaaattgaaatagacaatttgaatttgcataatgcaaagtaaataagtttcatgttcgcgagtcaaattca

SEQ ID NO: 102942 - DNA, 76 bp, Drosophila melanogaster
acggcggcaacttgctgctactgttgctggctgtggccgtggccgtgactgtggtgactgtggtgttgctgattgt

SEQ ID NO: 102943 - DNA, 105 bp, Drosophila melanogaster
tgggcattttttcttcttcctctttggctcatttaaaaataatcgttaagttattgttcatcattattattagttgtcggggcgaaggtaacgggggaaagttca

SEQ ID NO: 102944 - DNA, 111 bp, Drosophila melanogaster
ccagaagttaaacatcaaaattgggagttgtcgatgtcaaaacgtttatatatatatatcaatgtttttatattccaaaagctcatatttgtgacatactaaagattttgg

SEQ ID NO: 102945 - DNA, 84 bp, Drosophila melanogaster
gctttttgtttcattccgtctgtcccactcccaggctcactccatctctttctggcggaggtgctaagtggaacaccaattggc

SEQ ID NO: 102946 - DNA, 58 bp, Drosophila melanogaster
ctatgtatatatatatggctatacatatatatgtatatgtatatgtatatgtatatgg

SEQ ID NO: 102947 - DNA, 80 bp, Drosophila melanogaster
ctggatgcatgtaccaaattgcatatggatatatacaagtctatatattttgttttatgcaatttgttgcggctgagtag

SEQ ID NO: 102948 - DNA, 97 bp, Drosophila melanogaster
ctcataacccatccatatatcgccaatttacatatgtatgtatatatgtatatacacacatatgtatgtgtgtgtacatatatttgggcactctggg

SEQ ID NO: 102949 - DNA, 114 bp, Drosophila melanogaster
tcagctggatttcatttgaatttatcgcacaagttggcaagcaacttcatatttttttttagatacttgccaactttaaatttaatgtaataagttttttggtttcttccctga

SEQ ID NO: 102950 - DNA, 114 bp, Drosophila melanogaster
ttgcaagtgggatgtcataagtgcattgctgccttgggtttttcggatggttggctggctggctggctgtttggctggctggaggtggagatgcaaatgaaagtggaggtggag

SEQ ID NO: 102951 - DNA, 118 bp, Drosophila melanogaster
acacttgaaacaataataataacacaatcaagtgcctgttcacacacgctacgagagtgtctgtctctttctttgagtgcgtttgtgtctgtatatgattatgtgtgtgtgtgtgtgt

SEQ ID NO: 102952 - DNA, 89 bp, Drosophila melanogaster
ctgcgagttttcactgtactttgacagcactgcgatggcagcaccgcgaacgtcagcagtgtgcaattcaattacaatcaagttggcag

SEQ ID NO: 102953 - DNA, 134 bp, Drosophila melanogaster
catcagatgcatcccaaggtttcttttcgtcttggttttgtattttcctaacaagctgtcagtcagtcagtcagtcagccctttagacgggaaatgtaacgtggtgatggtggtggtgggggaaaaagtgtcag

SEQ ID NO: 102954 - DNA, 70 bp, Drosophila melanogaster
tgcttctgctgctcttgttgattgcaaatgaaatgaatattatttgattgaataacaagagcgtcgggca

SEQ ID NO: 102955 - DNA, 112 bp, Drosophila melanogaster
gcagatgaagtgcaatttttaatgcattttttcaatgctattcttaactatccaagtatctaaaaggattctccgaacagcaccttaatcgcatttcagttgcttctgctgc

SEQ ID NO: 102956 - DNA, 66 bp, Drosophila melanogaster
gcatatgcatgtatgtatgtatgtatgtgtctggggtacatacacattattgcatgctggcatgca

SEQ ID NO: 102957 - DNA, 85 bp, Drosophila melanogaster
attagaagagaaaaaggagagctgtatgtgtgtttgtgcaacctacctgcctgcgaatgtgtgtttactctctctctctcgtaat

SEQ ID NO: 102958 - DNA, 70 bp, Drosophila melanogaster
acgcgcgttctaaagtgcagctatgtatctgcctgtatgtgtgtgtgcgtctgtgtctctgtgcgtgtgt

SEQ ID NO: 102959 - DNA, 69 bp, Drosophila melanogaster
cagctcaatggagatacatatacacatatagacgtatgtatgtatgtatgtatgtgcatggacgggttg

SEQ ID NO: 102960 - DNA, 107 bp, Drosophila melanogaster
ttgtatgtatatatttatgattctagttggtatgtgtgtgtatatatatgtgtatgtatatatccatttctattcattgacataaaatttgaaaatatactatataa

SEQ ID NO: 102961 - DNA, 57 bp, Drosophila melanogaster
cagcaacacaagtttttatgttgtcctgtaataacagacatgggaactggttgactg

SEQ ID NO: 102962 - DNA, 74 bp, Drosophila melanogaster
tgcgtgtgtctgtgtgtgagtgtgtgtgtgccatgcggtatgcaatgcgaatttaatgcacttcttgatgcagc

SEQ ID NO: 102963 - DNA, 74 bp, Drosophila melanogaster
tatttatgcataaaaatttataggtgctaaggtacgcatcagtacatatgtatgtatatatgtatgtatgaatg

SEQ ID NO: 102964 - DNA, 66 bp, Drosophila melanogaster
tagagagcgcagtctctctctctctctcttgggagagtcgcatttcctggtagattgcgcaatcta

SEQ ID NO: 102965 - DNA, 62 bp, Drosophila melanogaster
ggagctcccaggcgccctagtcgctttttgtggtctgcgtctgtgtctgtggctgtggctct

SEQ ID NO: 102966 - DNA, 76 bp, Drosophila melanogaster
ccagtagcccagcggctcggaaggatcctctgctaaatgtctggctaactgactgactgactggctggctggctgg

SEQ ID NO: 102967 - DNA, 68 bp, Drosophila melanogaster
gtgtcgtcaatatgttcatcattaacaactcgtcagcagaatgatgatgatgatgatgttgattatgc

SEQ ID NO: 102968 - DNA, 87 bp, Drosophila melanogaster
gtcagtgtgagagaggagtgggtgttcgggtgctgggggtggagtgaatatcaagctgctctctcgttctcactctctgttgttgtc

SEQ ID NO: 102969 - DNA, 74 bp, Drosophila melanogaster
cagacatgtgccacgtaatttgccgcagtgtactaatgcctgcatttatgtgctctgtctgtgtgagtctcgtg

SEQ ID NO: 102970 - DNA, 99 bp, Drosophila melanogaster
ggctcacaatggatttaactatatgtatatacatatgtatatctttaaatattcatcacatatttgtgtacatatgtacatatagtatcgttgcgggtc

SEQ ID NO: 102971 - DNA, 80 bp, Drosophila melanogaster
tgcagcaattcgtttcacctctcttttggtgcactctctttctctgagttgcgcgatctaggaagacagaaattgtagca

SEQ ID NO: 102972 - DNA, 78 bp, Drosophila melanogaster
agggagagagagagagagagagagagcggcaggcgggtttgttggtgggtggctttctggcggtttctggtggtttct

SEQ ID NO: 102973 - DNA, 77 bp, Drosophila melanogaster
gcgtttgcatatgcatgtgcatgtgcatgtgcatctgtgctgtgtacatgtgtatgtatatgtgtagtagcaaacgc

SEQ ID NO: 102974 - DNA, 67 bp, Drosophila melanogaster
gtgggtcacatccagacgcacacatacatatgtatgtatgtatgtatgcatccaagcatggactcgc

SEQ ID NO: 102975 - DNA, 131 bp, Drosophila melanogaster
gagcctcataggccgaaaaaggacgaaagcgtcgctcatttgccacgcatctgtgtccgtgtgtccgtgtgtccgtttgcctgtgtgtccgtatgcctgtgtgtgcgtggggcgcaggggagaagggctgg

SEQ ID NO: 102976 - DNA, 85 bp, Drosophila melanogaster
gtgagcatctgactactgggtgactgggtgactgggtggctgggtggccaggggactcactcaccatcatgcagcggtccttgcc

SEQ ID NO: 102977 - DNA, 81 bp, Drosophila melanogaster
tagattcggaaccctgctttctttatgatcatgatgatgatgatgattatgatgatgatgagacaatgcattttgagactg

SEQ ID NO: 102978 - DNA, 70 bp, Drosophila melanogaster
gtggggcgggggttagactggaaggtgcgaggggccacccatccaccgtctgtctacctgtctgtctgac

SEQ ID NO: 102979 - DNA, 108 bp, Drosophila melanogaster
agtatcaccgcaaaatcgccagactcataaaaagtatactagtatatacataaatacatatgtatgtatgtacatatttgcaatctggataatttttgcttagatatt

SEQ ID NO: 102980 - DNA, 77 bp, Drosophila melanogaster
gcaccgccgtgccggagaccacagtctgcggctgctccttgtcgctgcgtgcctgtatcgcttgggcatcgtgttgt

SEQ ID NO: 102981 - DNA, 77 bp, Drosophila melanogaster
ctctccttacttcactgtcggtaaaataaatcagcgttggaactctagtattttagttgtacatgagcgtgggagag

SEQ ID NO: 102982 - DNA, 92 bp, Drosophila melanogaster
caaaaattgcaatttatatatatatatgtatgtatatgtacgtatatatcctgcagtgtgtatgtatgtatatataatctggaaaatagttg

SEQ ID NO: 102983 - DNA, 64 bp, Drosophila melanogaster
ccgactagacgctgtctgcgtactgtgtctgtgcctgtgcctgtgtcagtgtctgtgtattagg

SEQ ID NO: 102984 - DNA, 63 bp, Drosophila melanogaster
ggtgcatgtgaaacatattgttggtggggcgacactctcgccctctctcactcactccgcgct

SEQ ID NO: 102985 - DNA, 99 bp, Drosophila melanogaster
gctagtgtgaatgtaaacgcgaaatttcataatatttttaagatatccatagatattggaatatcaaaatgagaaaaaatttctacaccaagcacttgc

SEQ ID NO: 102986 - DNA, 63 bp, Drosophila melanogaster
tgacctaaactgggctggaactgaactgattcacagtcgcagtcacagtcgcagtcacagtca

SEQ ID NO: 102987 - DNA, 116 bp, Drosophila melanogaster
ttcaaacagagcggtgcatatatatttcatacatacatacatatgtaagtatttacatatacatatatgcatatgtatttttcattgataaagtgggtgtgcttgttttcaaagaa

SEQ ID NO: 102988 - DNA, 108 bp, Drosophila melanogaster
tgctgctgtgactttgaccgtgattgcgactgtgactgtgactgtggctgtgactattacgctggtagaggtagtagtcgtacagggtcattatctgtcgctgctgta

SEQ ID NO: 102989 - DNA, 78 bp, Drosophila melanogaster
gtgttcattaggtaagctggctggatattatttcattatatattgctggaaatttatgttggcgctgctaaatgggcc

SEQ ID NO: 102990 - DNA, 79 bp, Drosophila melanogaster
gtttcactcacacacacacatacagtcaaaagcgtgcaactgagcagtttgtgcgcggtttgctgactcccgaggaggc

SEQ ID NO: 102991 - DNA, 114 bp, Drosophila melanogaster
atgtattcgcttacattgatgtacttgttgcatgttgtgtttttgttgttgtttcaacgaagttataggtcatatacatagttcaagagcaggagatgggcaggcgtttggcgt

SEQ ID NO: 102992 - DNA, 80 bp, Drosophila melanogaster
gcaaaactatgtatgtatgtatgaaggcccagcagaggagccacgtccctcgtgcagcctttgcatttatttacatttgt

SEQ ID NO: 102993 - DNA, 112 bp, Drosophila melanogaster
gctaaaatggaaccattcgaattctagtacgatttcttcattagtaattgcataattatttatattaatgcatgtaaagttttagaaaatcacaaaatgctttgattttagc

SEQ ID NO: 102994 - DNA, 68 bp, Drosophila melanogaster
gcgtactgaggagtatgcatgtacatacatacatatgtacatatatatttctatatgcataggtatgc

SEQ ID NO: 102995 - DNA, 93 bp, Drosophila melanogaster
gtggtgtggcgcgtacgtgacatgtatagagtgcttcccaatatatatctatatatagtagtaggcatgcatgtatggctggccaggaaccat

SEQ ID NO: 102996 - DNA, 110 bp, Drosophila melanogaster
tgtttaatctcctttcgtggaacgccattcagtcagtcagtcagtcagtcagttgaagtttttggagttgtttctgttgctgccttaatgccgagcgaaaagcgtggaca

SEQ ID NO: 102997 - DNA, 99 bp, Drosophila melanogaster
cggcataggacaactttgaaacatctgcatgtacatatgtacatatctatgtatgtatgtatgtatgtggcactgtgcttctgtgtttctctatttccg

SEQ ID NO: 102998 - DNA, 113 bp, Drosophila melanogaster
gtcattgccattgctcatcttcagcgctgtgtggcccgcaaatgtgtctttgtcagtgcgtcagtggagcgtgccgcgttgcagcgccaggaggtcaccagcatgagcaggtc

SEQ ID NO: 102999 - DNA, 91 bp, Drosophila melanogaster
tgtatatgtttgtatacgtctgtgtctgtgtgtgagcgcatatgccacctgcccgctcatctgaccacagcaaagtttgccaataactgca

SEQ ID NO: 103000 - DNA, 87 bp, Drosophila melanogaster
tggagtgtacgtatgtatgtatgtatgtatatgccatgccatggatgtgaatggaatggagtacttatgtggatgatgttacctccg

SEQ ID NO: 103001 - DNA, 110 bp, Drosophila melanogaster
ccaaagccgaaaccaaagctctaagtatgaaaataaataagttcgtctacagtttttcccacttgttttattttttattttttatcagcttgttttctgggctgcgttgg

SEQ ID NO: 103002 - DNA, 92 bp, Drosophila melanogaster
cgtatccgttccatttcgcttcgtttcgctgccactcgctcgtgtgtcgctgtgtgtgtgcgtgagtatctgtgtgtgggcctgatttcccg

SEQ ID NO: 103003 - DNA, 107 bp, Drosophila melanogaster
tcacacgattctcaaaggtaaatatcagctggtaattctgggagctaagcctaaatatgaaacactcggaatttcagttggtatcgacttttttgaattgcatttga

SEQ ID NO: 103004 - DNA, 101 bp, Drosophila melanogaster
gtatctgcagcattgaataatctcaatttgtaaatgtgagcggtttaagccatttgacgcactcactttgcaattggagattgctcgagactgcggcatat

SEQ ID NO: 103005 - DNA, 104 bp, Drosophila melanogaster
ggagcagcgtctgtacggttgagtattacatcaggtactggtgtgccttaaatccaacaaccagtacttatgtcatactacgccgtgcacggatcgcactaacc

SEQ ID NO: 103006 - DNA, 74 bp, Drosophila melanogaster
cgctcgctgtgcccactggagtacggagtccacgcgctcaccactgccactctgacccactgtgccgctgtgcg

SEQ ID NO: 103007 - DNA, 83 bp, Drosophila melanogaster
agttttacgtataagtgtgtatttctatatattaagttatgcatatattgatttcctggtaaatacgggcttgttcgtaaact

SEQ ID NO: 103008 - DNA, 79 bp, Drosophila melanogaster
tcgtttatatatgtatgtatgtatatgtatgtataagcggatatatatatatgtatgtacattatgtatgtgtatgcga

SEQ ID NO: 103009 - DNA, 86 bp, Drosophila melanogaster
ggggttgccgcattcattttgaagaatgtcatatatacatatgtatgtatttatgtacatccgttcgttttctttgaagatgcctc

SEQ ID NO: 103010 - DNA, 130 bp, Drosophila melanogaster
actttagttggcttgagctcagattattaaatactatatatggatattgatttgttaagaagtttgatgtaaatacaaatcgatctatcttaatctagcatatcccaatttgttgtcgtaattcgtgctt

SEQ ID NO: 103011 - DNA, 118 bp, Drosophila melanogaster
gcaaagccgttttaagttgcgctaagaatgcgaatactatccaatcattattgaatgattcttattaaataatataagggtagtaagcgcgggtgcttgtgcatttgatgcgatatgc

SEQ ID NO: 103012 - DNA, 75 bp, Drosophila melanogaster
ttggcaggactcgtcgtactcggacacggactcggtttgggtccctgtctgtgccactgactatattccaaccaa

SEQ ID NO: 103013 - DNA, 107 bp, Drosophila melanogaster
gggcggtggtgtggtccacgagtatccacaagtaagcaagtatctatctatctaagaggtaacgagtcatatattgtcttcttggcattcgtggccttctgtggcct

SEQ ID NO: 103014 - DNA, 79 bp, Drosophila melanogaster
gttgaggatgtgcctttacctttgggggaacacgggctaactggctgcctggctccctggctggctggaggacctcgat

SEQ ID NO: 103015 - DNA, 80 bp, Drosophila melanogaster
ggttcttgtgtgtgtgtgtgtgtgcgaggacatgcgactgagtggcacaaccacacatgcacacacacacacactgcgcc

SEQ ID NO: 103016 - DNA, 89 bp, Drosophila melanogaster
gcatttgccaactgcagactgcaaactgcaaactgcaacttcgaaggcaacccgaaatgcatctgcaactgcaactgcagctgccgtgc

SEQ ID NO: 103017 - DNA, 74 bp, Drosophila melanogaster
gcagtgggacatgaagatatgtatgtatgtatgtacgtacatatatgtatgtatgtctatatgtacatacattc

SEQ ID NO: 103018 - DNA, 71 bp, Drosophila melanogaster
gcacacacggcattcgcctctgcgtgcacgaccgtgagtgactgtgtgcgtgcgtctgtgcatgtgtgtgt

SEQ ID NO: 103019 - DNA, 110 bp, Drosophila melanogaster
attttttaatttaatttaatttttagctggctataaacattttcgaaatatttatttatatttcgaaatccaataaagtctactggtagttgagctgagtgtataaaagt

SEQ ID NO: 103020 - DNA, 117 bp, Drosophila melanogaster
gctataggtctatacgggtcgcaaatactgtgagcagttctttagtatatgctttgaaattattttttaagcgtagaattcagaagtcgttatcacagttgtctctgtccagaaggc

SEQ ID NO: 103021 - DNA, 80 bp, Drosophila melanogaster
gtgtgtgtgtgagtgcttgactggggcggctaaaaatagttaaatgcagtggctcggtctgtcggtcacttgccaaacac

SEQ ID NO: 103022 - DNA, 117 bp, Drosophila melanogaster
agggggcgcagttgaggagtgcggaacatgtcggtctgtccgtctgtctgcctgtcaaacacttaaaatccacttcccagcggacactcgagtgtgtcccacacttcaaagccccct

SEQ ID NO: 103023 - DNA, 97 bp, Drosophila melanogaster
ccccatcggatgcatacctatgtgatattgtgatatatacatatataaatacgtatgtatgtatgtatatgtaggagaatctcggaggggtgaagat

SEQ ID NO: 103024 - DNA, 112 bp, Drosophila melanogaster
gttggtgataaaaagcgaagaacacggctatcgcctaatcggagatatatatatatatatacatgtgtatcatacgttgaggttccgtgtgcttgtgagttttatgaaatac

SEQ ID NO: 103025 - DNA, 76 bp, Drosophila melanogaster
agaggtttccgaggtttcgccttcgggagagtgtgcactcccatcgccctctctctgtctgccagcctctgactct

SEQ ID NO: 103026 - DNA, 60 bp, Drosophila melanogaster
gaaacaaagaaatgcatacttacatatgtatgtatgtatgtatgtatgtatatttgtatc

SEQ ID NO: 103027 - DNA, 93 bp, Drosophila melanogaster
tacaactttatgatcggcggcggccgtttgacgtcagaatcgcttggcttggctgtctgtctgtcggactgcgccaatgtacgtgtggtggta

SEQ ID NO: 103028 - DNA, 118 bp, Drosophila melanogaster
gcatgtctgcagcagaagaaggagagcgattaaagcagctgtgcgaagttctcgttttatttacatttattaatattttcgtcttttttcactcacttttatcactctgcgactgtgt

SEQ ID NO: 103029 - DNA, 95 bp, Drosophila melanogaster
tcgctcgaaagtttgtcattcatttcggttcctgcacatgcatgcgaacacatgtcctcgcacgcacacacacactgaggcacaagttggagcga

SEQ ID NO: 103030 - DNA, 82 bp, Drosophila melanogaster
ggtgcttattgcagctgctggccactgcacaagattagacttaagactcttgtgcgtgtgacagcggctattgtaagaggcc

SEQ ID NO: 103031 - DNA, 102 bp, Drosophila melanogaster
aaattcagatcggaaagcttaactttttcaaagtttttggtgattttcttgtacaattacgaaggtaagaatggctatattttgtatgagctttatgaattt

SEQ ID NO: 103032 - DNA, 91 bp, Drosophila melanogaster
tctcatcgaagacgcgaaagacgagcgatgcgaatttactgggatcgccttgtggaaagaattgtttgtatattttgatgaagccctgaga

SEQ ID NO: 103033 - DNA, 84 bp, Drosophila melanogaster
gcagagcttgcttgccgactcgcttgcgcacacgcagtggcgcctctcgccctctctgtcgctcgcaggcgcagcgagtgctgc

SEQ ID NO: 103034 - DNA, 88 bp, Drosophila melanogaster
tttctctcagtgcagcgactatggcaggcgacagtttcatgtcaacagaaacaggaacagcaactgttcgctcggccacgaagagaaa

SEQ ID NO: 103035 - DNA, 65 bp, Drosophila melanogaster
gtctgtctccctgtgtctctggccccctaaatggggctgcgtaatgagggccactggaagaaaac

SEQ ID NO: 103036 - DNA, 92 bp, Drosophila melanogaster
gcccatttctgcccaataagcgcgtgtgtatacatacatatatgtatatatgtatatgtatgtattgcagcggtatttatttcgcagcgggt

SEQ ID NO: 103037 - DNA, 94 bp, Drosophila melanogaster
cagagaagcactcggatgcgttcgctcagactctgagtgtcatggcatcggcctcgactcccagcttctgttgctccagctccagctgcatctg

SEQ ID NO: 103038 - DNA, 73 bp, Drosophila melanogaster
gtgttaagtccttggttttagcccgaagctgacaggttgtcactgtaactcgaactggaactggaacggagac

SEQ ID NO: 103039 - DNA, 74 bp, Drosophila melanogaster
tgggtgtgatatagtatgataccatcatatatgtatgtatgtatgtatgtatgtgttgtagctataggcatcta

SEQ ID NO: 103040 - DNA, 58 bp, Drosophila melanogaster
gttgactgcctggttgactgcctgcctggcacccaaaaggttctcctccagcagcagc

SEQ ID NO: 103041 - DNA, 97 bp, Drosophila melanogaster
gactgcctgcctgcctgcctgcctgcctgcctgcctgcccttgattgcctcttggagtgacaacatggtcctgccggcgaagttggtggttgtggtc

SEQ ID NO: 103042 - DNA, 88 bp, Drosophila melanogaster
gaatattttgttggaggtgagggtggtgagcgcagtgcaactgcaactgcaactgcaactgcactactggcgccgaaatattgatgtc

SEQ ID NO: 103043 - DNA, 80 bp, Drosophila melanogaster
agagagtcagtcagtcagtcagtcagctatgttcgactttttaaagtatttcattattgactagactacggctatttgct

SEQ ID NO: 103044 - DNA, 113 bp, Drosophila melanogaster
agtcctccgattcttgtgagatatattatagttaatacttgttaaacacttgtgaattatttgttgacaaaagtaaaatgatgttgatgtttcttaattaaaacgggggtatt

SEQ ID NO: 103045 - DNA, 77 bp, Drosophila melanogaster
gggcccgagtgtgcgagcaggaggaggctgctgagctcgtgagtcggctgtcgctctctcgctctggcaggcggttc

SEQ ID NO: 103046 - DNA, 62 bp, Drosophila melanogaster
gtgtgcgtgtgtgcctgtgtgtgtgaatgcgtatgctcgtgtacgtgtgtgtatgtgcatac

SEQ ID NO: 103047 - DNA, 81 bp, Drosophila melanogaster
gtgtgtgataagcaacgaaatgccagttagaattgagtgggataacctacgatttcatcagtggcatagttctgcacgtac

SEQ ID NO: 103048 - DNA, 76 bp, Drosophila melanogaster
aatttgggttaatttcctttcactgccaactttgacgttgaatgggcaaagttgtggagaggagcgctaccaagtt

SEQ ID NO: 103049 - DNA, 67 bp, Drosophila melanogaster
gcgtgtgtccgtgtgtctgtgtgcgtgcgaaacggcgaaaggatataggatacacgtatatacacgc

SEQ ID NO: 103050 - DNA, 90 bp, Drosophila melanogaster
acgccgacgcacacacacacacagactcacacgcacacgcatagggtgaaagcgaaagcgtgtgtatgtgtgtgtgtgtgtagtaccgtg

SEQ ID NO: 103051 - DNA, 84 bp, Drosophila melanogaster
cggtactacacacacacacacatacacacgctttcgctttcaccctatgcgtgtgcgtgtgagtctgtgtgtgtgtgtgcgtcg

SEQ ID NO: 103052 - DNA, 93 bp, Drosophila melanogaster
tggatcaaatgacgaaacaccggactctttgtgtctaattgtttattaataataacacatcggaatacagtggcgtggcgtcgatctgattcg

SEQ ID NO: 103053 - DNA, 74 bp, Drosophila melanogaster
gctcgctcacttgctcactcgctctcacttctgagacatcgcaagcggagtggagtgagcgtgtgagtgccggc

SEQ ID NO: 103054 - DNA, 104 bp, Drosophila melanogaster
gcattttagaaacgatagtgcattatttaagcaacactaaattatcgctagataagtgtacaatgtttttatatatacatgcactcttttaattgtttagttgc

SEQ ID NO: 103055 - DNA, 79 bp, Drosophila melanogaster
tcagcatcagacaatcatatgtacatatgtacatacatatgtatgtatttatatgcatatacatatgtatgtttgccga

SEQ ID NO: 103056 - DNA, 80 bp, Drosophila melanogaster
gcgaacagctgactcctgcagtcttattgctgcctttgcctcacctggctggctgtctgtctgtctatccgtctgtccgt

SEQ ID NO: 103057 - DNA, 84 bp, Drosophila melanogaster
gcattcatttgctcgtttgtttatttatgttaatttaaatcaacatgcaaaaattagcacatgacacaaagaggatgtggatgt

SEQ ID NO: 103058 - DNA, 70 bp, Drosophila melanogaster
agcctcctcacatgtgagtgtgttgtcctgatttgtacaaatagttactgccctcagaggtgggggggct

SEQ ID NO: 103059 - DNA, 81 bp, Drosophila melanogaster
tctcagtttaaaaataaacattcttttggcctgctgtgctaactaagcgatctaaatatgtatgtatgtattaaactggga

SEQ ID NO: 103060 - DNA, 62 bp, Drosophila melanogaster
caggatagctggatctccaacagcaactggagttgaaggtgctggtggtggttggttgcctg

SEQ ID NO: 103061 - DNA, 93 bp, Drosophila melanogaster
tgtctgtgtgtatgatgatgggtaccttaagccgttccctggatccccatacactcaggcactcaggcactcaggcactcatacactcacaca

SEQ ID NO: 103062 - DNA, 89 bp, Drosophila melanogaster
tcaagtgtcgatgcggatgtggatgtggatgtggatgtggatgatgtcgcagttgcagtagcagagcgaaacgaggttactacacttga

SEQ ID NO: 103063 - DNA, 65 bp, Drosophila melanogaster
gtgtgtaggaggggtccaggagcagtccaagccgaaggactaactgtgcatctgcatctgcatgt

SEQ ID NO: 103064 - DNA, 122 bp, Drosophila melanogaster
tgaccagagtagaagcacatgatacgcttattttcgaatctgtaattatggccgactgactgactgactatatacagagttctgaagtttagacgtgcagccccatattcgtgcagcccctc

SEQ ID NO: 103065 - DNA, 86 bp, Drosophila melanogaster
acctactcgattgtatgactcattcacacacactcaatggtatggaaccggcacatggatctggatctcccatgcatacgataggt

SEQ ID NO: 103066 - DNA, 64 bp, Drosophila melanogaster
ggaggatgaggaggagcaggatgagtcggccgactccggctgactgcctctctggatgactgac

SEQ ID NO: 103067 - DNA, 72 bp, Drosophila melanogaster
gtatatatgtacatatatactgttattatatattaacagtatatatataacagtatatatatacatatatat

SEQ ID NO: 103068 - DNA, 79 bp, Drosophila melanogaster
cagtgatcactgtacattgaaagctgaggcaaacgaaacttttcgaaattgcttcaataaaatcgagagggtgttgttg

SEQ ID NO: 103069 - DNA, 94 bp, Drosophila melanogaster
gttatgcgttatttgttatctatgtatgtatgtatgtattgtatatatgttgtagggtatatgttagagggtatagagggtggtatgcatatgc

SEQ ID NO: 103070 - DNA, 113 bp, Drosophila melanogaster
atttctttatttttaaataatttcttcggaagctgtatgatgtagtctttttcttgttcatacaagtatacgctatactcatcgtatagaagaacgccttttagaccagaagt

SEQ ID NO: 103071 - DNA, 82 bp, Drosophila melanogaster
gtgtgtgtcttggcgtttgtttgaaattttaccaagcctcgcaagtaatgggtagaatttttaattatttacactcacacac

SEQ ID NO: 103072 - DNA, 79 bp, Drosophila melanogaster
tgacggacggggtgagacggtggggcaggtgagttgtttggtggtcaattttttttacccactgtctgtctgtctgtca

SEQ ID NO: 103073 - DNA, 70 bp, Drosophila melanogaster
ctatatatgtatgtatgtatgtataatgtatattggtatattggttcatccatgtagtctgcatatgtag

SEQ ID NO: 103074 - DNA, 80 bp, Drosophila melanogaster
tcgtgtatctctgtctgcttatcagtccgagcttctctctgataacttgattggcgcaaaaataaggggggaatgcgcga

SEQ ID NO: 103075 - DNA, 105 bp, Drosophila melanogaster
agtaaatggcaacatgtgtatgcatgcacacagcgtcgggcttacagacacacacacacgctggcaggccgacgctttgaatgcaagcccacatacatatttatt

SEQ ID NO: 103076 - DNA, 112 bp, Drosophila melanogaster
ttgggtgacactccaattatgttatattaagatatgcatgtatgtatgtatgtatgttggtatacacccaagcatgcgtaagtatttataatccgaatttgcggttaaccaa

SEQ ID NO: 103077 - DNA, 96 bp, Drosophila melanogaster
agtggcaggcttcactaaattcaaactttccaagtggagcaatgtaaattcatttcgttgttttgttaggaatacaattataaggagttttttatt

SEQ ID NO: 103078 - DNA, 91 bp, Drosophila melanogaster
ccggacggacaagcggacggacggacagatggacagacggacagacggactgacggtcagccagccggacagtacacgagtcgagttgcgg

SEQ ID NO: 103079 - DNA, 81 bp, Drosophila melanogaster
gcagtgttgtggttcatatatgtatgtacgtatgtatgtatgtatgtatgtatgtgcgcatgcatgaacatatagtgcggc

SEQ ID NO: 103080 - DNA, 75 bp, Drosophila melanogaster
accctttgagcaggactgaggtaaaccgagcccaaagtaatctttgagtctcactgtcagcctacgacggcgggt

SEQ ID NO: 103081 - DNA, 110 bp, Drosophila melanogaster
tgtaagtcaagcggtatacgagcgacatttgtaagctccttgttgatatatgtatgtatgtatgttacagattgcttaagttgtcagttcataaaactgtatgtatcaca

SEQ ID NO: 103082 - DNA, 110 bp, Drosophila melanogaster
ttatttttcgtccaaatttcagtgtggttgtagttgaagcttgtatagttcttcgtgaatctgttggaaacaagttacattatgtacacatcctgtttcgctgagtgtaa

SEQ ID NO: 103083 - DNA, 74 bp, Drosophila melanogaster
cctgcttagctgagcgactctgttctttcaccggaagagcggtgagagtagagagcgaggagtggttcaacagg

SEQ ID NO: 103084 - DNA, 93 bp, Drosophila melanogaster
cgaaacaattcgaattggttatttgtttttcaattaggttccttctgcttggtttgaaaaattcaacttaacaataatttcgaatcagtttcg

SEQ ID NO: 103085 - DNA, 91 bp, Drosophila melanogaster
gcatgtgtgtgtgtgtgtatctgtgtctgtgtgtgtgcatttaagagcacttgtgtgcgtgtgtgtgtgtgctcgctatactccccgatgc

SEQ ID NO: 103086 - DNA, 88 bp, Drosophila melanogaster
gtgcgagcgagggagtccatgtgggtgcaattaaacggaactgtccgtctgtctgtctgtccatctggcaacctcatctcatctgcgc

SEQ ID NO: 103087 - DNA, 80 bp, Drosophila melanogaster
actgtctgtctgtctgtcggtctgtgcgtcttgagaattttacatattttctatgaaaattaccatagacacatggcggt

SEQ ID NO: 103088 - DNA, 58 bp, Drosophila melanogaster
tcagtgagtcagtgagtcagtgggtggttggtccatccgcactccttgaattagttga

SEQ ID NO: 103089 - DNA, 81 bp, Drosophila melanogaster
gtattccattgtgttgcctgccgcagatacaagtgtatctctatgtgcatctgcaactgcaactgcaacgactaggagtac

SEQ ID NO: 103090 - DNA, 118 bp, Drosophila melanogaster
ggcatatgtgtgcgtggcaactctagacaaacatatggctctccgaatgcacaatgtatctgcatccgcaagtgctactgtatctctgtctgcgtctgcatctcgcaaaacttctgct

SEQ ID NO: 103091 - DNA, 94 bp, Drosophila melanogaster
acaggagtttgcagtaacatacgcacagatcgtatatagctagaatatcaactaaatagctgtgttgtgttattgttgctgtgacaattcaagt

SEQ ID NO: 103092 - DNA, 87 bp, Drosophila melanogaster
ggatagatatggaggctgagtgggggtggggcagcacacatgtgccggccactcactcacacactcgcacacttgatatttaattcc

SEQ ID NO: 103093 - DNA, 105 bp, Drosophila melanogaster
acatacttatgtatgtgtgcaagtgcacgtgcaattcgaatggaatttgtgttatttgtttcttttttgttgttgtgattctttctaatacgtacaaaagtatgt

SEQ ID NO: 103094 - DNA, 96 bp, Drosophila melanogaster
gactccttcttctcgtggcaaacgattaatttgtgaattaagttcagcggtcagttgagcaagtccaagtccaagtccaaagacaaaggccaagtt

SEQ ID NO: 103095 - DNA, 76 bp, Drosophila melanogaster
gccgtgctgcctgatgttgctgttgctgttgctgttggtattgccactgcaactgcaactgcaacagcagcaatgc

SEQ ID NO: 103096 - DNA, 90 bp, Drosophila melanogaster
atgttggtttctcagagagcaatgggggagaaggagagcaagacaaatgcgctctctctctctctccaccgttgcgcctgcgcttcgcat

SEQ ID NO: 103097 - DNA, 64 bp, Drosophila melanogaster
cgcatgtatgtatgtatgtatgtaatatatggtatatagtatatggcgtatatattatatgtgc

SEQ ID NO: 103098 - DNA, 106 bp, Drosophila melanogaster
tgtgccacgcccatcgcggcaaacgtcttgcatgactaacagatatcaatatgccagtctgactgtcagtctgcttccacgggttgccatgagaaaaaaaaacaca

SEQ ID NO: 103099 - DNA, 73 bp, Drosophila melanogaster
cgtactcacatacatatgcacacatcatatccttggaaatggttgtatgtatgtatgtatgtatgtgagtatg

SEQ ID NO: 103100 - DNA, 66 bp, Drosophila melanogaster
ccgcacactcacacacatatatatatatataggtacatatatgtatgtatgtatgtatgtgagagg

SEQ ID NO: 103101 - DNA, 94 bp, Drosophila melanogaster
aacacacataaataaatgtatatatatataataatgagtcgtttaactttaagctgccatctccagttatgtatatgtatatctttatagggtt

SEQ ID NO: 103102 - DNA, 104 bp, Drosophila melanogaster
acacatattaagccgcagactgcattgaattgccgagtgatcaatatacaatatatatgtatatatacacaatgcagcgatgctgcaatgccagctacttgtgt

SEQ ID NO: 103103 - DNA, 117 bp, Drosophila melanogaster
gcttgaggtcaggttcgttgggatccgattgttcgcatacactacacactatgtgtatatatgtttgtatgtatgtatgtatgtggtcggtcgtagatgtgcttgtaatttgtatgc

SEQ ID NO: 103104 - DNA, 88 bp, Drosophila melanogaster
attcatttcggcagccattcacacagactcattcgctcagacgcagcgcagactgtggatgtggtcagatggctaggttggattgagt

SEQ ID NO: 103105 - DNA, 64 bp, Drosophila melanogaster
cgcgtgggtgacgatatatatatatatacgatttgtatgtatgtatgtatgttatgcgtatgtg

SEQ ID NO: 103106 - DNA, 103 bp, Drosophila melanogaster
gcgtgtgtgtatgtttgtgtgtggctcacttgggcattgtttgtctgtctgtctctctgtctgtttgtctgtgtgcggccgtgtttgtgtttgtactgcccgc

SEQ ID NO: 103107 - DNA, 114 bp, Drosophila melanogaster
gatcactgagataataataatgatcttcatcatccgctggtctggtttctatatatatgtatattgcaccagccgcctgagagggtgactgtcttatggttttcctcatggctc

SEQ ID NO: 103108 - DNA, 73 bp, Drosophila melanogaster
cagcgttttccccttcgtttttattttttttttcgctccttaaacattgatgacgacgaagtggaaagtgttg

SEQ ID NO: 103109 - DNA, 80 bp, Drosophila melanogaster
ttcggtgtggtttatataatcccatacatacgtacatacatacgtatgtatgtatgtgtgtagttgctagactccaagaa

SEQ ID NO: 103110 - DNA, 88 bp, Drosophila melanogaster
gatttggtaggtattatttggcagtcagctggaaacaatatatatatatgcatattgtgcacagagctttttgattgcttaccatatt

SEQ ID NO: 103111 - DNA, 78 bp, Drosophila melanogaster
aacaaaacccactcacacgcgcacaactgactgccaaaaggacatgtgtgtgtctgtgtgtgtatagagtcctttgtt

SEQ ID NO: 103112 - DNA, 76 bp, Drosophila melanogaster
ttgccaatcgaagacatacatgtattttacaattttacacaatatgtgtgtgtgtgtgtgtgtcaaatttgtgtaa

SEQ ID NO: 103113 - DNA, 82 bp, Drosophila melanogaster
ctgtaactgcagctggaactgtaactgtagttggagctggagctgaggctgcgactgcggttgaggtagttgttacagctgc

SEQ ID NO: 103114 - DNA, 64 bp, Drosophila melanogaster
gatttttgtatgtacttcaatgcatatgcatgtgtgcgtatgcatgtatgtatgtatgtttctc

SEQ ID NO: 103115 - DNA, 113 bp, Drosophila melanogaster
ggtccatcaatcagtcaatcagcctgccagccagccagtccgtcagtgagtcagtcactcctttggcagacgtcatagactgtcagaaatgtttgatatgtatgtatgctgcc

SEQ ID NO: 103116 - DNA, 110 bp, Drosophila melanogaster
gagagtaacaggtcctcgagctaggacatccactagcgcatccaatccaccccatgaaaatgattgaagcgagagaccaaagtgttctggacttgtctcctgtcgccctc

SEQ ID NO: 103117 - DNA, 67 bp, Drosophila melanogaster
gcaggagcagcagtagcaactttaactgtaaatcgatattcagactgtctgcctgtctgccccctgc

SEQ ID NO: 103118 - DNA, 81 bp, Drosophila melanogaster
gcaggcgggatatatgtatgtatgtatgtatgtacgaagatgtaggtgggttatatgtacatatgtacattatgtggcggc

SEQ ID NO: 103119 - DNA, 75 bp, Drosophila melanogaster
gggaaatggaaatgggaaatggcgacggcaacttcttagcactgtctgtccgtccgtccgtccgtccgtcttgcc

SEQ ID NO: 103120 - DNA, 89 bp, Drosophila melanogaster
caaattgatatcttggtttaggtttcacaggaaactggtttaataacgaaaactagtttcctctaaaatcctaatcaagacatcatgtg

SEQ ID NO: 103121 - DNA, 107 bp, Drosophila melanogaster
atcagggggaaatcaaagaaagtccgggtatatgtgtatgtgtatatgcgtcagtacttatgtatgtatgtatgtgtgtggcctttgtctttgtgcttccatccgat

SEQ ID NO: 103122 - DNA, 101 bp, Drosophila melanogaster
ttgctgtgattgttggcaagttgttggttgaattgttgtaagctcggtttgaggacgcggacgcagctaataacagtcatcacacacgtcagacactcata

SEQ ID NO: 103123 - DNA, 77 bp, Drosophila melanogaster
ttttggaactgtttatttttttttgtccagaccagacatctgacatttggccaagagaaaatgcatcaaatcctgga

SEQ ID NO: 103124 - DNA, 102 bp, Drosophila melanogaster
gctaaaatggcagtggaaatgggctggaatgggtgaggtagatggttggatggttggatggctgggcgtgatagttcggaagactgtatctattgtcagggt

SEQ ID NO: 103125 - DNA, 131 bp, Drosophila melanogaster
tgtatctatgtgagcgcacgcccagtatctgtgtgcggcagccagactgttcggcctgtgcctgtgtgcgtgcgtgagtgctgctgcgctctcattacacttacacctgagttttggtttttgttgttggc

SEQ ID NO: 103126 - DNA, 73 bp, Drosophila melanogaster
tatggatggacaaagactatatatatctatacatacatacatgtatgtatatgtatatgtttgtatatgtata

SEQ ID NO: 103127 - DNA, 102 bp, Drosophila melanogaster
tggaaagagtgcgacagagtcgggcagaaagagaggggactactacagtcgtacagagagagtcagtcagtcagtcagtcagccagtcagtcaaccattcca

SEQ ID NO: 103128 - DNA, 78 bp, Drosophila melanogaster
cacttgcctgtgcctgtgcctgtgtgtgtgtgtgaaaaacaagcaaatttacagcacacacaggcctgcatacatgtg

SEQ ID NO: 103129 - DNA, 118 bp, Drosophila melanogaster
cgaaaaggcgcctcggcagccgaggcagcagaaaagcagttgcagttgcagtcacagtcacagtcacagtcaattatacaaattgcatttgtgttgctctcttgcagggccgcatttg

SEQ ID NO: 103130 - DNA, 104 bp, Drosophila melanogaster
cttccaggggatatatgtatgtatgtatgtatgtacctatccgccatctttatatagtacatatattatatatgtatatatattacatttactgtatatggaag

SEQ ID NO: 103131 - DNA, 78 bp, Drosophila melanogaster
tcattcagtcctcttgttctgcatatatattttactatatatatgtatactttttttttgggcatatggattttatgg

SEQ ID NO: 103132 - DNA, 88 bp, Drosophila melanogaster
cagccatttatcattcgcctgagctcggctcagtttactggccaaccaactgactgactgactgagtgcctgagtgcctaaatgactg

SEQ ID NO: 103133 - DNA, 112 bp, Drosophila melanogaster
gtggtaggggcgtggtctgatttagcgaaaaggggtgagcagttgccatcgggctagtttattattatttactctgatttggctttgttgagaaagtaaacggtcagaccgc

SEQ ID NO: 103134 - DNA, 86 bp, Drosophila melanogaster
atggtcatgatgatgatgatgatgctcctgctgcggggaattacctcatcttcgagtagttgcatttgttgcctgtcgtcgaccgt

SEQ ID NO: 103135 - DNA, 88 bp, Drosophila melanogaster
gtttcaaaaggcattgaattaagattttttttcatagtgtaacaattgacaattgctggagttatattcataatgccttaattgaagc

SEQ ID NO: 103136 - DNA, 74 bp, Drosophila melanogaster
gtttttgtgtgcagaactgatatttatatatgtgtgtagttatgtgtgtgagtgaaagttttctagttaagaac

SEQ ID NO: 103137 - DNA, 70 bp, Drosophila melanogaster
tctatgcaagcgtgaaatgtcaagtgctcaagtttgaatttggcttggcaaacactcactctcgcacaga

SEQ ID NO: 103138 - DNA, 103 bp, Drosophila melanogaster
catgctattgtttaatgggtaaccgccagtcgactattttgtatacttttttttttatgacaacaaagtgactgtcactccgtctccgcccattttgggcgtg

SEQ ID NO: 103139 - DNA, 56 bp, Drosophila melanogaster
cacgcacacacacacactcaaatgacagctaatcactgcgtgtgtgtgtgtgtgtg

SEQ ID NO: 103140 - DNA, 101 bp, Drosophila melanogaster
gtagtaaaattttatgaacttatgagcttggaagatgagtgtctggaaaatctcacacactcacacacacattcgttgatagtcggtataaaattgtttgc

SEQ ID NO: 103141 - DNA, 98 bp, Drosophila melanogaster
gcccgatccttgcgacttcaactatatatatatattcctattctatatatgggtggtaaaatggatatgtgtgtgtgtgtgaggcgtggggggggggc

SEQ ID NO: 103142 - DNA, 61 bp, Drosophila melanogaster
actggcaactgactgatagttgggatattcagttagtcagtcagtcagtcagtcagtcagt

SEQ ID NO: 103143 - DNA, 97 bp, Drosophila melanogaster
gttttggtatcaaagcaatttgtttatcagccgtatatgtatatatatacatacatatacatatatatcgagggagttggttggatgagtctagaat

SEQ ID NO: 103144 - DNA, 83 bp, Drosophila melanogaster
caacacacagacagacagacacagcatataacgggacggagggcgtccgtctcgctttcacgttgatgtttccgttagtgttg

SEQ ID NO: 103145 - DNA, 93 bp, Drosophila melanogaster
gaagaaattgcattggttcaaagtgaccagactaggtgttgtaagcactgtcgaagctggtcacattgaagcatccgtttttgtttttttttc

SEQ ID NO: 103146 - DNA, 119 bp, Drosophila melanogaster
tcactcagcattttccgctctgcattagaatatgtgaatctgtgaaactgtgaatgtctctgaatctcagtcagtcgaggcgattgtgcaagtgaccttggccaggaggcgggggccac

SEQ ID NO: 103147 - DNA, 93 bp, Drosophila melanogaster
acacactgtgcgtgtgagcgctgctggtgtgcgtgttaattacacgggatttcatttcacaccgagtttttcggctcttcgatttcagtttgt

SEQ ID NO: 103148 - DNA, 116 bp, Drosophila melanogaster
gtagttgctgaaatacatatatccagtttgctttggaacgccgattattttatcattgtaaatatttatctttgatagaactcgctgtgttcggttatgcataattggtatactgc

SEQ ID NO: 103149 - DNA, 86 bp, Drosophila melanogaster
agcggtgtctgtggaacagcattgtactgggcaatccacttgttgctaatgacgtcctggatgcgcagacgcttgctggggtccac

SEQ ID NO: 103150 - DNA, 69 bp, Drosophila melanogaster
cagttgccataaatctgcaataggaaagtattttagtttattatctatgtatgttagtagtggcaactg

SEQ ID NO: 103151 - DNA, 75 bp, Drosophila melanogaster
catacatatgcaccatgacagatctgatatgtgataaggtgtgacaagcgatttctgtcagtgcatctgcttatg

SEQ ID NO: 103152 - DNA, 115 bp, Drosophila melanogaster
gttgcagatttcgcctatgttgttattgttacagttttatgactatttgttgttgtcattacgataacgatcaatacactacactgtaggaaaaaatttaggcggctctcgcgat

SEQ ID NO: 103153 - DNA, 77 bp, Drosophila melanogaster
atttcgaactgaactgcgcgatttgcaggagaagatgtgtctatacctgcatgtgcatgtgtatctgtgtgtgaggt

SEQ ID NO: 103154 - DNA, 110 bp, Drosophila melanogaster
gctggcatttgcccattggccggcgttttagtgtgtatatttgaatatatgtatgtatgtacaatatatgcatgtatacacatttccccgattgctgtttgcatgtgagc

SEQ ID NO: 103155 - DNA, 99 bp, Drosophila melanogaster
ctgcatttcccatttattattttcgccaggactcgccctttgaatggttgatttctttggatttttatggccatcgctggctagtaactggctctgcag

SEQ ID NO: 103156 - DNA, 86 bp, Drosophila melanogaster
tatatgtatatgcatgtatgtatgtatgtacatttatgctccgcatatacatatgtatgtatatacatagatgaccgtatcgtata

SEQ ID NO: 103157 - DNA, 106 bp, Drosophila melanogaster
ggtcatcggttgcttctgccattgaaatctgagaacttattgggggcgtcatctttatcatcatcatcatcgtttcaccggctagaaccgggcattcgattcgatt

SEQ ID NO: 103158 - DNA, 91 bp, Drosophila melanogaster
tggctttccttgagatgcacgtacctatgtacatatgtttttatatacatatgtatgtatctaattgcttgcaaacgtcagcggagcgtca

SEQ ID NO: 103159 - DNA, 120 bp, Drosophila melanogaster
gggcatgcttgagtgccagccatttgtctgttcgtctgtccgcttgtccgtctgtccgtctgtcaaatgcttaaagtgctttgcattggcgactaatcgaatcggggttaagcatgactc

SEQ ID NO: 103160 - DNA, 66 bp, Drosophila melanogaster
gggagaacttaaggtccgtcactgtgtccgtgtgtccatggagcagcggcatggtcttgctcttcc

SEQ ID NO: 103161 - DNA, 111 bp, Drosophila melanogaster
gaaacagcaggggagtgtgtcggagtaaacttgtggaaaggtgcggcgttactgtgtctggttatcctgccacaccagttattagttagctctcaccatcaccgagctttc

SEQ ID NO: 103162 - DNA, 101 bp, Drosophila melanogaster
gtctcttgccgggtactcgtccaagcagcgcagcgcaggcaagtccgtccgtctttttgtctctccgtcgctgcgtcactcattcaagcacgctgctaggc

SEQ ID NO: 103163 - DNA, 65 bp, Drosophila melanogaster
acatacatacatacatatgtatgtatctattttgttattatacatatgtagctatgtatgtatgt

SEQ ID NO: 103164 - DNA, 75 bp, Drosophila melanogaster
cgccttgcaagtgtgtgcgcgtgtgtttatgcgtttgcgggcatatacacactcgcacgctctctcacgtaggcg

SEQ ID NO: 103165 - DNA, 107 bp, Drosophila melanogaster
cttcacgtcacgctagaaaccctgtgcatgtatgtatatatatatatctatatgcatatatatgtacatgctgcagtgtctgtgtgtgtattgttttttcgatgggg

SEQ ID NO: 103166 - DNA, 78 bp, Drosophila melanogaster
cacacagacactgcagcatgtacatatatatgcatatagatatatatatatacatacatgcacagggtttctagcgtg

SEQ ID NO: 103167 - DNA, 74 bp, Drosophila melanogaster
tgtatgtatgcatgcacacatacataagcatatacatgtatgtatgcatgtatgtatgtgtgtgtgtattggca

SEQ ID NO: 103168 - DNA, 59 bp, Drosophila melanogaster
ttggcggctaatgtctgaggtccatgtcgcagacgctcctcagtcagtcagtcagtcag

SEQ ID NO: 103169 - DNA, 66 bp, Drosophila melanogaster
gggcagaggaactctgagacgcggacggaagactcgaaatgtggcactcgctctctttctctggcc

SEQ ID NO: 103170 - DNA, 76 bp, Drosophila melanogaster
gctcatacagatacacacacgcacacacacgtgtgcaaaaggcacctttgaatggtgtgcgtgtgtgcgccagagt

SEQ ID NO: 103171 - DNA, 60 bp, Drosophila melanogaster
cttttgcggcaaacggagacggcaaacggcgacaactctgaatctctgtttgtgtgaaag

SEQ ID NO: 103172 - DNA, 81 bp, Drosophila melanogaster
agcggcgttggcagcgacagaggcgccacaaacacacaacacactcatgcagcgcaactctctcgctcgctctctcacgct

SEQ ID NO: 103173 - DNA, 78 bp, Drosophila melanogaster
tctgatttgcgcacacacacacacacagatatgatatgcgaacgtgtttccctatgtgtgtgtgagagaacggtcaga

SEQ ID NO: 103174 - DNA, 64 bp, Drosophila melanogaster
tgtgcgtctctggctgtgtgtgagcgagtgtatcatttgcacatcacacagacacagacgcaca

SEQ ID NO: 103175 - DNA, 101 bp, Drosophila melanogaster
tatagagttgatttatatgcacgtcgattcgacgtaattgaagacgtgatcgaaattcaaatttttgatttttagaacccgtgactggattggcatttgta

SEQ ID NO: 103176 - DNA, 85 bp, Drosophila melanogaster
gcttttcatgggtccaaccggcggtgcatgtatctatgtatgtatatacttttacacagatatttgctgggtgaacataaaaagc

SEQ ID NO: 103177 - DNA, 82 bp, Drosophila melanogaster
gcaaatatatctctgtgtatctgcatgtgtatgtatgtatcagtatatatatatatatataatatatatatatatatctgca

SEQ ID NO: 103178 - DNA, 77 bp, Drosophila melanogaster
cctgtctgcctgcgtgtctgtctgcgtttccttcccatcctgtgagtggggattgcgaatatcctgcaggaggctgg

SEQ ID NO: 103179 - DNA, 95 bp, Drosophila melanogaster
gtccacctcccacacacttttcccctcgtctgtcagtctgtctgggtccggttttcacattgatttacgtggggaatgggaaggagcaaaaggac

SEQ ID NO: 103180 - DNA, 102 bp, Drosophila melanogaster
ttctgccaggacatgccgggataaatgcacacacacacacacattcatgtatatatatatatggtgtgtaagtttgtgtgcattccgcgcccttgtctagaa

SEQ ID NO: 103181 - DNA, 114 bp, Drosophila melanogaster
gtggaaaattggaattagaagccaaaagtacttaatcgatatgatatgatattttcctgatagccatattaaacggtcgaaagcaatgcttttttactgccctccatttttggc

SEQ ID NO: 103182 - DNA, 112 bp, Drosophila melanogaster
aataaaattgtgggtcttgtatctaaagtcgcaatctgtatttgcatctgtatctgcacttgtatctgcatctgcatcggtttttgtgtgtttagtgagtttgctgtttgtt

SEQ ID NO: 103183 - DNA, 114 bp, Drosophila melanogaster
ggcggctgtgatggcgctactgttgtcaccacggccgatggaactggctgtggctggtgaggatgatgatgatggtgctgctgctgttgctgttgctgctggtggtgatggtgc

SEQ ID NO: 103184 - DNA, 118 bp, Drosophila melanogaster
gcgaaaatatagtggcgattaatcagttgagcaacaaatgccggctaaaattatatatataaatgcagtgatttaaaagtgtgtgcatttgttgtttgctgctttacttttaggcact

SEQ ID NO: 103185 - DNA, 108 bp, Drosophila melanogaster
gccgagaattactaacaacattttgccacattcacttaggctaatgtgtatatatatacatatatatgtgtttggaatctggcaaaaaccatgagtcccattaacagc

SEQ ID NO: 103186 - DNA, 75 bp, Drosophila melanogaster
gcttcgcatttttgaatcgttcggttttggcctggctaactggctggctggctggctggctcaaagcgaaagcga

SEQ ID NO: 103187 - DNA, 103 bp, Drosophila melanogaster
ggacttgcggctggaactcgagacactggagtccagagataccttgatgatgtccgactgtcactggctctgtccttttgttgacctttcccgtccggtgtcc

SEQ ID NO: 103188 - DNA, 65 bp, Drosophila melanogaster
gtgcatatgtatgtatgtatgttatgtatgtatgtatgtatgtatgtatgtatgtatatgtgtgc

SEQ ID NO: 103189 - DNA, 81 bp, Drosophila melanogaster
gagcgagagcgaaacagagtgggagcacaacagccaagttctccggctgcccatctccaactccaactccatctccatctc

SEQ ID NO: 103190 - DNA, 82 bp, Drosophila melanogaster
ttgggatatgagagggcaatcatcaaataaatatgtacgtatgtatgtatgtttgtatgtgagtgcctctccaaagtgccga

SEQ ID NO: 103191 - DNA, 101 bp, Drosophila melanogaster
tggcacagggaaatcgctgcgacgagggttatatatccacatacatatatgtatgtatatatagagttgacctgtgtgccggcgaggtgttttccctgcca

SEQ ID NO: 103192 - DNA, 87 bp, Drosophila melanogaster
agaaatgccacagatggaatgaattgaagtggagtggacctgaacccggtcccccgaatatgtatctgcatctgtatctgtatatct

SEQ ID NO: 103193 - DNA, 86 bp, Drosophila melanogaster
gccagccagcatttgcaagtcaaatgaaattatttattttgcatacagaggaacaggattgtcgggtggctgggaatggggctcgc

SEQ ID NO: 103194 - DNA, 91 bp, Drosophila melanogaster
agccagacggagggcagcgcttcggggcagtggatgaagtactcggcaaggagagaggagtccaactgtctgcctgtctgtctgtctgtct

SEQ ID NO: 103195 - DNA, 117 bp, Drosophila melanogaster
catcgtctacctctgctgtctattaacgcgtcaaaatgactgtgagctatgtggatttgacttcatatcacagccattttgacgagtttgttggacagccagcctcatcaacgtgga

SEQ ID NO: 103196 - DNA, 68 bp, Drosophila melanogaster
ccttttgatttcgcctgaacgactctttctctcacacagagagaatgtcagagcaggaacaataaagg

SEQ ID NO: 103197 - DNA, 82 bp, Drosophila melanogaster
gatgcgtctggctgtcagtgtgtgcgtgtgtgtgtgcctacgtgtgtgtgtgcgcgtgtcctttgtgcaatgtcttcgtgtc

SEQ ID NO: 103198 - DNA, 74 bp, Drosophila melanogaster
cggcactcacacacacacactcgcgtaggaggctcgtcgccggcctgcgcatgtgtgttggtgtgtcggtgtgg

SEQ ID NO: 103199 - DNA, 87 bp, Drosophila melanogaster
ccgcagaaagtcaggaaatgcaatatatatatgtatgtaggtgtagtatatacatacatgtatgtgtatgtatggttaggtgggcgg

SEQ ID NO: 103200 - DNA, 78 bp, Drosophila melanogaster
gtgcttctctcgctgttttagtgtgtgtgtgtttgagtgcaaacagactcacacacacacacacacacggacaggcgc

SEQ ID NO: 103201 - DNA, 93 bp, Drosophila melanogaster
ttcataccaagcacatagacacacacacacacccttgcatttccctgccggaattcgcaaagcggttgagtggataatggtgaactttatgag

SEQ ID NO: 103202 - DNA, 118 bp, Drosophila melanogaster
ttttctaggggcctaaaaccctgggctaaaagtgtctgagtggattgttatatatatatatagcattacgtatatggatttggctgacatttcgaagacagaggggtcaaagggggga

SEQ ID NO: 103203 - DNA, 88 bp, Drosophila melanogaster
ctcacatcatcatcatcatcaacatcatcctcagtctccacctccacgtcggtggcagctgcagcagatggagcatattgaatgtggg

SEQ ID NO: 103204 - DNA, 103 bp, Caenorhabditis elegans
gttcgttgttgttgttccgtggaaataattttagaaaagaaatagagcataacgtttatatatcttttcaaaatcacactaaatgggaatcacaagaagaaac

SEQ ID NO: 103205 - DNA, 104 bp, Caenorhabditis elegans
taggcgtacccctgagttagacctgagaagcattttgtgtgcctgcctgagtgcctgcaaggtaggcctgcaagacatttttttttctaatattctggtgccta

SEQ ID NO: 103206 - DNA, 118 bp, Caenorhabditis elegans
cttttttgtaaaaaatttggttgccgagttggaaccaattgatttgagcttcattatttttgaatattctaaatagttaaaggtctatatctcagcaaccaaattttttacaaaaaag

SEQ ID NO: 103207 - DNA, 109 bp, Caenorhabditis elegans
gcttctataatcaaattataaacggcaatatcctctcgatcaagtgtgtgagcaacacgaagtgttccatcctgatcaatagtgaattgacgtttcggatccgattggc

SEQ ID NO: 103208 - DNA, 68 bp, Caenorhabditis elegans
gacagtgtgatgggttattacgtcgttggttgttggagacgatgatgatgatgttgatggtgctgtca

SEQ ID NO: 103209 - DNA, 84 bp, Caenorhabditis elegans
cagttgcaccacttccttctcactgcctgcctgcctgactcatcacattttgccgtttttggagtgagagaggcggttgtcctg

SEQ ID NO: 103210 - DNA, 115 bp, Caenorhabditis elegans
ggctgctaattgaaaagtggagagaaaagcgataactatgcgatgatgatgatgatcatcatcatataatccatataatgattattgttagtgttatcactcccagatttgtgtc

SEQ ID NO: 103211 - DNA, 83 bp, Caenorhabditis elegans
atggcaagtgtcgaaaataatgtagtttgtagtatttaaatacttgaaaatttgtggactacaaactgcaaacattaagctat

SEQ ID NO: 103212 - DNA, 66 bp, Caenorhabditis elegans
ttctatctgcgtctctctttctctctctctcatctaagagagatagagacagagattgttatcgaa

SEQ ID NO: 103213 - DNA, 119 bp, Caenorhabditis elegans
cgcggaaattctaaaaattaggctccgcccctatttcttggttgtaagaatttttgaatttctaaaaaattttgacaaactccgtgaaggagacctagaatttgagagaaaattcggtg

SEQ ID NO: 103214 - DNA, 101 bp, Caenorhabditis elegans
gagcgcagacgacgagacactctgcctgtctgcgtctctcttgatgtcgccgagaagaaggaggagacgcagagaagcagagtgtctcgtcgtctgcgctc

SEQ ID NO: 103215 - DNA, 76 bp, Caenorhabditis elegans
tactgtaggggtactgtagtaataatttaggataactcgaggggttccttagtggtactgtagtgataatttagta

SEQ ID NO: 103216 - DNA, 106 bp, Caenorhabditis elegans
ttcagctcccttagagcgtcaatttgagccccatattgcctaggtttcaatatttttatattgagctcaccgagcacctgggtgctccacgagcttgaaagctgaa

SEQ ID NO: 103217 - DNA, 92 bp, Caenorhabditis elegans
accaatacattaacaaagtaacaacagatgtgaacaatttaacggctccagctgattttgttgttgtctcaggtggcgttgtttgtcttggt

SEQ ID NO: 103218 - DNA, 93 bp, Caenorhabditis elegans
aaaaaattgggaattttcggagaaaaattgatatattttgaaatattgtgatttttcagaaattctggttttttcccattttcttgatttttt

SEQ ID NO: 103219 - DNA, 91 bp, Caenorhabditis elegans
tttacaaattttttgaaattttcagctaaattttgcaattttttctgaaattttgcatttttttttgaaattttcatctaaatttcgtaaa

SEQ ID NO: 103220 - DNA, 72 bp, Caenorhabditis elegans
gttatgagtgggtccaaccatcaatcgcccccgtggagaatgaggagggaaagggaatcatccattcaaaac

SEQ ID NO: 103221 - DNA, 117 bp, Caenorhabditis elegans
tatctcagttctcgataaagatgaagagatacttacaactatcaatatgtttattgttttaaacttaacaacgttgtagttgatgactttttgatatcttgcctctagaattagata

SEQ ID NO: 103222 - DNA, 110 bp, Caenorhabditis elegans
aggttgggattttttacgtgcctccttagccggcctaggtacttgtctcataccttcatgcctgcctgcctggttgcctttcttcgcgcctacatgatgtctaccagcct

SEQ ID NO: 103223 - DNA, 66 bp, Caenorhabditis elegans
gtaggcagagagggaggacgcgcagacagcgagactgtctgtctgtctgcgtctcacctaggtcac

SEQ ID NO: 103224 - DNA, 101 bp, Caenorhabditis elegans
gtatttttgccatttttggcaggaaatccaagattggtatttctgaactttttgtcgggaatttaatttttgatatttttgaaaatatttggcgaggattc

SEQ ID NO: 103225 - DNA, 85 bp, Caenorhabditis elegans
tattcaagtaatgtagcaaaatgtatttaaatacatttgtgacgtcacaaatgtatttaaatacatgtttttatatacttgaata

SEQ ID NO: 103226 - DNA, 115 bp, Caenorhabditis elegans
gagtagaagtttggcaaaagttgggtcagactagggctaaacgttggcgcagaataaatccaagtttagccaaagttttgcccgacttttgctcaagttcagccaacttctgatc

SEQ ID NO: 103227 - DNA, 107 bp, Caenorhabditis elegans
cctcttgcgccgcttctgatgttggcttgggctcacggagcaattgtttttgttttttacacaagcaggcttttaggcagcctatgagagctgtggcgataacctgg

SEQ ID NO: 103228 - DNA, 117 bp, Caenorhabditis elegans
atatcggccattaaattttttgaagaaatactatcaactacaaagttgtactttagattaaaataaacaactttgtagttgatcactttgtcagaaaaaatttttgaacaaagatat

SEQ ID NO: 103229 - DNA, 108 bp, Caenorhabditis elegans
tacaatacaatacaagtcttttggtagttaataattttttgctaaaatcgaaactaaactagttacgagctgtcaaagttgagtacgcaggggttttggtgcatcgtg

SEQ ID NO: 103230 - DNA, 96 bp, Caenorhabditis elegans
attgcgtacttttggggctaccgtaacccaaaatttattaatttagatcaaatttcaaaaaatttggggattcaggggatttcagaggttttcagt

SEQ ID NO: 103231 - DNA, 83 bp, Caenorhabditis elegans
aaattgaaacatttttaatttttaacgatgaaaatctgatttttggcggattttcagggttaaacaacgagaaaattcgattt

SEQ ID NO: 103232 - DNA, 93 bp, Caenorhabditis elegans
ggaaattgggcgttttacagaaaaatactgtggaattctgaaaaatatttttttttttgaattttcaataatttaggttatacctcaattttc

SEQ ID NO: 103233 - DNA, 91 bp, Caenorhabditis elegans
ggttgtgtctgtctagctgtctgcgtatctcctctctctctcactatgtgaaagagacacagagaatgacaggagagagacagacagaggc

SEQ ID NO: 103234 - DNA, 78 bp, Caenorhabditis elegans
gagacgcagacaaggcggccccccacatctctctgacacaacattcgatcgcttactgactgcctctgtctgtctctc

SEQ ID NO: 103235 - DNA, 104 bp, Caenorhabditis elegans
tcttgcattcactgcatccgaatccagtcactctctcctgcaatttttcttcttctattgacaaattgctggtcattgatccccatctatgtagttgttgcaga

SEQ ID NO: 103236 - DNA, 108 bp, Caenorhabditis elegans
agcaattctttgggatctcatgagatttttgaaaacatcgccgaactttcattttttttttacgtgcgaaaccatccagattaagggcgattctaaagaagttacgct

SEQ ID NO: 103237 - DNA, 87 bp, Caenorhabditis elegans
gtgtcctttccttgacagaactcgaagaaataaagacgaccatctggatggtgtagtccaatagttctgattttcatgaatgagcac

SEQ ID NO: 103238 - DNA, 123 bp, Caenorhabditis elegans
ctgtctctcgcgttctcacgatgtctagcgcgcgcaccgcccgtgttgaccagcgagagagtgtgtgaagagtgagagccgcagtggtgttggtggtggctggtggcgggtgcaacaaggtat

SEQ ID NO: 103239 - DNA, 87 bp, Caenorhabditis elegans
tgtcctcttcactctttttcccgccccgattgctcaccggccctcccactctgtgtgtgtgtgtctaaacgggaaagaagacggaga

SEQ ID NO: 103240 - DNA, 85 bp, Caenorhabditis elegans
ggaaactgttggagaggggagagggcgcagagaaaccagacactctcgcttctctgcgctttctcactctctctcacaacttacc

SEQ ID NO: 103241 - DNA, 90 bp, Caenorhabditis elegans
tgggtctccagacgacgggcgaatgttcagttggagcggcggcaggctttgggtcgaatcatgtgtggcacgagttctggaaatgattga

SEQ ID NO: 103242 - DNA, 85 bp, Caenorhabditis elegans; identical to SEQ ID NO: 103225

SEQ ID NO: 103243 - DNA, 78 bp, Caenorhabditis elegans
agatctaaggatctaaggatctaaggatctaagtatctaagtatctaaagatctaaagatctaaggatctaaggatct

SEQ ID NO: 103244 - DNA, 87 bp, Caenorhabditis elegans
ttattcaagtaatgtagcaaaatgtattaaaatacatttgtgacgtcacaaatgtatttaaatacatgtttttatatacttgaataa

SEQ ID NO: 103245 - DNA, 74 bp, Caenorhabditis elegans
cgataatttgatgtattccaggtttggatgagatcctcttatccagtgcctaaggaatatgttgacttctttcg

SEQ ID NO: 103246 - DNA, 118 bp, Caenorhabditis elegans
tgtcggagccattggaattgggtggaaaacctatgacaacggcgtgggcacaactgaaagatagaagtaagagtgcacgtggatgccagagtgtcccattttgttttgatctacgata

SEQ ID NO: 103247 - DNA, 137 bp, Caenorhabditis elegans
tacgttgcgcacacctcaagctgcggaaccctgaacgtgtcggccgctgtttgaagtgtaagtaagtaagtaagtaagtcaaaagtgcttgcaaaaatggcttttttaactttgagcggcgctaacttgaggtacgt

SEQ ID NO: 103248 - DNA, 93 bp, Caenorhabditis elegans
ggggggtgctatagaagttggacgcactgtatatatatatatatatatatatagcctagtttccacaaaaaatatatttgtatacatacatcc

SEQ ID NO: 103249 - DNA, 77 bp, Caenorhabditis elegans
agaattattgattttccgttgaaaagtattgattttctattgaaaattatcggtttttaatgaaaattgttgatttt

SEQ ID NO: 103250 - DNA, 114 bp, Caenorhabditis elegans
tttcgtaacaaacctgggagatctgcttgaattgctcagctccgtctggattcttgtctggatggaatttgagcgccattttacggtaggccttcttcaactcattgtctgaag

SEQ ID NO: 103251 - DNA, 119 bp, Caenorhabditis elegans
ttcgggcagatgcgacacggaaaagtggccaaaattcgagattttagctgaagtcagtttaattatatattttctcgaaattttgaaccgccataaaaaatcgttgaaacatttttgaa

SEQ ID NO: 103252 - DNA, 90 bp, Caenorhabditis elegans
gaaaatttcggaattttttttttaaactaaaattgaatttttccagaaaaatctatgtttttcttaaaatttgaaaatttcggaattttt

SEQ ID NO: 103253 - DNA, 104 bp, Caenorhabditis elegans
tattcctgcccgccggccgctgatatgtctggtattcttgggtttgaacttccagcgttgaacccgcatattagacgtatcgacggccggcggggcaggtaatg

SEQ ID NO: 103254 - DNA, 116 bp, Caenorhabditis elegans
ctgaaaattcgagtttttgttgaaaaatgtaaattttaaggattttttgcgaaagtttttttttttttgcaaatttgatcaattttatttgattttgtcgcaatttttaatttcgg

SEQ ID NO: 103255 - DNA, 112 bp, Caenorhabditis elegans
cggtttctcggcgaaattcgattagattcttgagtgttttttccgacttttttttttttgaaatatcggtgtagtatttaatgaagtattgttgtttcaatttttgaaattg

SEQ ID NO: 103256 - DNA, 119 bp, Caenorhabditis elegans
tcttgaaatttattgattttctgaaaatttatcgcttttctggaaaaatattgattttctaaaaatttattgattttctggaaatttattaattttctgagattttattgattttttga

SEQ ID NO: 103257 - DNA, 82 bp, Caenorhabditis elegans
taggcagccaggcattccacgtaaaattatctgcaactttataaatttgttgaaaatgtttgcctgcctgcctgcctgccta

SEQ ID NO: 103258 - DNA, 118 bp, Caenorhabditis elegans
ttcagcaattttttagagaaaaaaaacaaaaaaaaactttttttttcattttcaaaaattagaattttttcggaaaaagttttttttttcgatttttctaaaatttcttatttttgga

SEQ ID NO: 103259 - DNA, 111 bp, Caenorhabditis elegans
aagcacagtttttcaattttttttcagacacttttccgtgaataaaacttaagaatagttgtttataattttttttcggaaaaatgtctgagaatttgacaaataaagttt

SEQ ID NO: 103260 - DNA, 74 bp, Caenorhabditis elegans
taggcttaggctcagactcagtctcagtctcaggctcaggcttgtgtaaggcttaggcttaggagtagacttag

SEQ ID NO: 103261 - DNA, 108 bp, Caenorhabditis elegans
agtccgctgtattgattttttttgtttgaaaaactaagtttttgtttatttgcagcggcaaatttttattaattttttttgataaaagttcatcaatgccatcagact

SEQ ID NO: 103262 - DNA, 76 bp, Caenorhabditis elegans
tatgacaaagtgatcaactacaaagtttttttttcttaatccaaagtacaactttgtaattgatcactttgtcata

SEQ ID NO: 103263 - DNA, 80 bp, Caenorhabditis elegans
catacatatatatattggccagtagttggtggtcatcttgcgtatgtctccatctctccgtgtgtctatgtgtgtgtgtg

SEQ ID NO: 103264 - DNA, 106 bp, Caenorhabditis elegans
tctatttttgatcaaaattttcgatttttaatggaaattattgatttttgattgaaaattatcggtttttttattgaaattatcgatttttttattgaaattcaga

SEQ ID NO: 103265 - DNA, 109 bp, Caenorhabditis elegans
tttttttagttcaggctagaaattttcgcagaattttttaatttttcataaggaaaattagacaaaaatttagaatattggaagattttaggttagaggcctagaaaaa

SEQ ID NO: 103266 - DNA, 117 bp, Caenorhabditis elegans
aaatgactactgtagcgctcttgtgtgtgtcgatttacgggatctcattttcatgatgtgaattaaattcgaaaatcgagatcccgtaaatcgacgcaagagctacagtagtcattt

SEQ ID NO: 103267 - DNA, 81 bp, Caenorhabditis elegans
tcagtttatttttattgaaaattttacgaaaattgcatttttcttgaatttttcgttaaatttccagtaaaaatacattga

SEQ ID NO: 103268 - DNA, 123 bp, Caenorhabditis elegans
aaatttgggccaaagtttggcaagagttgggtgaaacttgggttagactttggtaaagcttgaatccaagttttgccaaagtcttgcctaacttttgcccaagtttagacagcttctgatcca

SEQ ID NO: 103269 - DNA, 112 bp, Caenorhabditis elegans
ttggtatgccaatctattttttggtataccaatctattttttggtatgtcaatctattttttggtatgccaatctattttttggtataccaatctattttttggtatgtcaa

SEQ ID NO: 103270 - DNA, 81 bp, Caenorhabditis elegans
cgactttttaaaaaaaattatcgatttttaaagaaattatctatttttttggaaattatcgattttttttgaaaatcatcg

SEQ ID NO: 103271 - DNA, 84 bp, Caenorhabditis elegans
gatgaccagtcgttggtctcttttttgtctctgaatatatatattttttaacaggaaaaaatgagaccccacggaaaggggatc

SEQ ID NO: 103272 - DNA, 105 bp, Caenorhabditis elegans
cactgaaattttttaaaatttttcgacagaaaaaaatgttttgtaattttttttcaagagaattcagcccattttttgtcttaaatttttctgaatttttttgtg

SEQ ID NO: 103273 - DNA, 85 bp, Caenorhabditis elegans
tgagcctctttactctctctaactctcactctttctttcctaaagcttctgcctgctagtggttgtggtggtggttgggtgctca

SEQ ID NO: 103274 - DNA, 104 bp, Caenorhabditis elegans
cagtcgtcgaggaagagaacatctctgaaaatcatttgtaatttttttaaaatcagattatacaacaaactttttcaagagagccttcaactcttcagcaactg

SEQ ID NO: 103275 - DNA, 108 bp, Caenorhabditis elegans
gtgaagttgtgcatttcgggggtggcgttaaggtcgtagatttcatgctgaacattttttttaattcatgtaaaatgccattagaaacactcaccgtcaaaatttcat

SEQ ID NO: 103276 - DNA, 112 bp, Caenorhabditis elegans
tgtaattaagttcaaccgtattgtggaagttatcaagtggattattgccgaaatttatattaattttacgtatgaatccataacattctaatcttactgaatttgttccgca

SEQ ID NO: 103277 - DNA, 89 bp, Caenorhabditis elegans
actgactcagcctcagtcagtcagtcaaatattttttttggagggaatttgaaactgatgaatgatatcgattagggtgatccttcagt

SEQ ID NO: 103278 - DNA, 101 bp, Caenorhabditis elegans
aagagctctggatctctgtagccttaccatggataaatgagtttttctttttgaaatatcatgtctgacccattgtattactgcggaaaaaactagctctt

SEQ ID NO: 103279 - DNA, 88 bp, Caenorhabditis elegans
ataagcgcgaagttgagttttatttttttttttgaaaaacgtgaggtttcacgttttttggtcaaaattgttatcaaaatttgtttgt

SEQ ID NO: 103280 - DNA, 87 bp, Caenorhabditis elegans; identical to SEQ ID NO: 103244

SEQ ID NO: 103281 - DNA, 112 bp, Caenorhabditis elegans
ttggctttgctcgtttttttacgactaaaaatattactattgcttgattttttttaaaataaggtcaattgtttgtatttacgtattccaaagaacttgcagaagagctcga

SEQ ID NO: 103282 - DNA, 95 bp, Caenorhabditis elegans
cctccatatctcaatctctttggttgtacaaagtggtatggctcatcgaataagcacatactgcttttcagctaaaggaattgagattttgtagg

SEQ ID NO: 103283 - DNA, 78 bp, Caenorhabditis elegans
tgaactaatggtcagaaagtggaattgtcttatcatttcttatcagtgatgatgctctctctctttctcactatgtca

SEQ ID NO: 103284 - DNA, 85 bp, Caenorhabditis elegans
tatggttgtgcagtgtgaagagagagaaaacagttggagattacagcaaacacttcctgtttgctcatccacacatgccactgta

SEQ ID NO: 103285 - DNA, 72 bp, Caenorhabditis elegans
agtctctctctatcactctctatcctttagaaaataaaaaaagaatgaaggatgagcagctggagatggatt

SEQ ID NO: 103286 - DNA, 97 bp, Caenorhabditis elegans
cgtctcacactctctcggactcgtctcacatttatttgtttgtttttgtaatgaccgatgatgatgacgagtctctccggtcggctgtacttggatg

SEQ ID NO: 103287 - DNA, 79 bp, Caenorhabditis elegans
tctctcactttcacactgtttctccgccccctcaacttctgatgggatcccgccgcaggacgatggacaggagaggaca

SEQ ID NO: 103288 - DNA, 87 bp, Caenorhabditis elegans
ggttcccggttcacagtaaattgatgtgcactctggaaataactttttttatttgctagataggcatcaaaagtattacgggtattc

SEQ ID NO: 103289 - DNA, 123 bp, Caenorhabditis elegans
agctctggaccatgtaggtatttataggtaggtataggtatgtgacaatttcataatattatagttatttactttagaatgtcatgtccctatagtttacctaccttggtaagttatccttta

SEQ ID NO: 103290 - DNA, 75 bp, Caenorhabditis elegans
gtgttgaacaagtggactgaaggcgagagcacggcgaatgtcttgtctgaccgtctgagtctcattgttcaacac

SEQ ID NO: 103291 - DNA, 85 bp, Caenorhabditis elegans
gtttttcttaactgtctgttacctctctgtctatctttatatttctttgaccggagaggagctaaaaaggcatcttaggaggggc

SEQ ID NO: 103292 - DNA, 77 bp, Caenorhabditis elegans
ggaacctggtggctgtaggatgttttcttcctcgagatctgattgaaacacggaagatcatcataagcaggagttcc

SEQ ID NO: 103293 - DNA, 117 bp, Caenorhabditis elegans
tcagtgcatatgaaatcagttagagctgttgaaaattaattttttgtagaagatctcagataattttattttttctacgattgatttcttggctctattctcccgttttctcatcga

SEQ ID NO: 103294 - DNA, 118 bp, Caenorhabditis elegans
ctgacttcttccacacactcgatattaaaacatgagcgctggaaaaagtttgagcaaattttttttttaaagacacctggttcttaagcataaatattgatgaggaaatgcagagcag

SEQ ID NO: 103295 - DNA, 92 bp, Caenorhabditis elegans
aatgggaggaaaggaaaggtatactcattgtttctttttcaaactgtttgactgtgagagaaagaatgtatgtttgtacttttagtaccgtt

SEQ ID NO: 103296 - DNA, 112 bp, Caenorhabditis elegans
gctgaaaatcgtccgaagatatcaggatcaggccttggctgattgcaaaattgttcaccgtgaaaattaaatattgcactctccccggcctgatctgagagtaaggcgaagc

SEQ ID NO: 103297 - DNA, 123 bp, Caenorhabditis elegans
acgctatattcaaagtgaccgtaccgagctgcatacttccttacatgcccatactatatcataaatggatatggaatgtaaagaagtatgtagaacggggtggtagtgttttaatggtgagta

SEQ ID NO: 103298 - DNA, 108 bp, Caenorhabditis elegans
ttctaattccttttcgatttgatcgactttgctcaaatatttgaaatcaagctgtacaatatttttaaattttgaggactttgtcggatcacgaaaatcctttggaat

SEQ ID NO: 103299 - DNA, 56 bp, Caenorhabditis elegans
ctggaaagttattgattaaccgtgcggattcggtttgaaagtttttaattttccag

SEQ ID NO: 103300 - DNA, 89 bp, Caenorhabditis elegans
aacggagagcagtgaagcctgagaaagggggaatttctctgattctctcactatttttcacccgtatagctgttacttacctttccgtt

SEQ ID NO: 103301 - DNA, 72 bp, Caenorhabditis elegans
tgatgtcaaaaaaataaatatttggcaatgtggtcttcaattagaaactacgttgtaaagtattcaacatca

SEQ ID NO: 103302 - DNA, 91 bp, Caenorhabditis elegans
gatatctttagttctctaaactctctctctgtttcacctacaaaatgctagagaaataaaagagtagagtgaaagagacaaaaagatgatc

SEQ ID NO: 103303 - DNA, 83 bp, Caenorhabditis elegans
caagactgttatgttcgacaaacaatgtcacgggtacttataaatattttttatattcttgtcgaaatctagtgactttcttg

SEQ ID NO: 103304 - DNA, 85 bp, Caenorhabditis elegans
tattcaagtaatgtaacaaaatgtatttaaatacatttgtgacgtcagaaatgtatttaaatacatgtttttatatacttgaata

SEQ ID NO: 103305 - DNA, 85 bp, Caenorhabditis elegans
caatgttggagagctatttgcaaggtacctaattgtttgattattgattctcaattggtcccctccaagtagctctattgcattg

SEQ ID NO: 103306 - DNA, 122 bp, Caenorhabditis elegans
ttgttaaattgatttgttcttgaattttgaatttctttgattgttgaaaaatgaaacaaattttatttttgaacaaattgtgattcgaagtttagagctgcacaagaatggaattcaatttg

SEQ ID NO: 103307 - DNA, 105 bp, Caenorhabditis elegans
ggaactggatcagcttcctgagctttttgcatttgttgctgttgttgaatttgatgaaattgttgttgttgctgctgaaggtacatgatttgttgatgatgttcc

SEQ ID NO: 103308 - DNA, 81 bp, Caenorhabditis elegans
cagcatcatgagcatcagcaactggagctggcgattcataatcgtgaagctttggtggagcaactggagctggtggtggtg

SEQ ID NO: 103309 - DNA, 82 bp, Caenorhabditis elegans
gctcatctctctctctctcaattaccgtacccattatcattccgcccatggatgatgatgatgatgaaaatgagcggtgggc

SEQ ID NO: 103310 - DNA, 67 bp, Caenorhabditis elegans
gttgggtgaaacttgggttaaactttgatattgcctgaatccaagttttgccaaagtattgcccaac

SEQ ID NO: 103311 - DNA, 82 bp, Caenorhabditis elegans
gtctcctgatgtgtgtgtgagtctgtgagtctgtgagtgcagtgtacaacaccttttgcggagtcttatcacatactgatac

SEQ ID NO: 103312 - DNA, 62 bp, Caenorhabditis elegans
gttccggctgaatgaagtaccatacttccgtcgctgtatgtcacttgagcgtttgttggaac

SEQ ID NO: 103313 - DNA, 97 bp, Caenorhabditis elegans
ttcgaaactgcttccgctttttacgttcaaatctgaaaatttttaattttcttgacgttatggtgaatattaataggcggatcagcgtaaatttgaa

SEQ ID NO: 103314 - DNA, 96 bp, Caenorhabditis elegans
gtagacattctccgatctttggtgattcagcttcaatgattggctacaggtttctttcataaagctaggttaccaaagctcggcgtcttgatctac

SEQ ID NO: 103315 - DNA, 87 bp, Caenorhabditis elegans; identical to SEQ ID NO: 103244

SEQ ID NO: 103316 - DNA, 95 bp, Caenorhabditis elegans
acagtatacagaaagccatcaaagcggtggttgatgtgttgcaaattatgactttcatatcacagccagctttgatgtgctgcctgttgcactgt

SEQ ID NO: 103317 - DNA, 108 bp, Caenorhabditis elegans
acagaggttgtctgctctgaacgatgaaagacatgggtagtgagacgtcggagcctcgtcgtatcactattctgtttttcgccgtcgggatcgtgacctggaagctgt

SEQ ID NO: 103318 - DNA, 98 bp, Caenorhabditis elegans
tgtgtcgcgcctgcagtttttggggtcagtgtccctgtgtgtctcgcatctcaaagctctgcacactattttacatttgccaccggcgcagcacaggc

SEQ ID NO: 103319 - DNA, 118 bp, Caenorhabditis elegans
ctttcttttaaaaaatttggttgccgagttgggaccaattgatttgagcttcattatttttgaatattctaaatagttaaaggtctatatcttggcaaccaaattatttacaagaaag

SEQ ID NO: 103320 - DNA, 80 bp, Caenorhabditis elegans
tctctctctctctctcaagtcccgcccaccatccaatagacatggaagccacagggcggggcctggagagtagggaaaga

SEQ ID NO: 103321 - DNA, 85 bp, Caenorhabditis elegans
atgtaatttcagaaagatacatgtttattctgggaagaaattttacttcttagaaacatagtttttgttttttcgcggagttcat

SEQ ID NO: 103322 - DNA, 93 bp, Caenorhabditis elegans
ttagtgttggtttggtcagaaaatacttgatgtgtatcgcgcgggggaagcgggctcacattttatatttttatgtgcaaatgtcatagctaa

SEQ ID NO: 103323 - DNA, 102 bp, Caenorhabditis elegans
ttcgtgagaagcaggtcatccagtgagatgtcgatttggaagatagaaagtatttgaaatttctgagtcaaaattcgttttagtgagagcttttgaaacgag

SEQ ID NO: 103324 - DNA, 69 bp, Caenorhabditis elegans
caccactaaaattgaggccaatgctgtttccggagaatacgttggcggtggctctcgatgatggtggcg

SEQ ID NO: 103325 - DNA, 99 bp, Caenorhabditis elegans
cgtaggaaaaataaagatgaaactggacatgcaattcgtagttttctttcgttttattgatgtctggacatgttcggtttctttttggagaaccttttg

SEQ ID NO: 103326 - DNA, 87 bp, Caenorhabditis elegans; identical to SEQ ID NO: 103244

SEQ ID NO: 103327 - DNA, 90 bp, Caenorhabditis elegans
gcagctacagtaatcccgacagagatgagagtcacgacacgaagtgtccgaatttcaacgtcatctgcttccggtctatgcttctgctgc

SEQ ID NO: 103328 - DNA, 111 bp, Caenorhabditis elegans
tttcactgtttttttctggcactgtttttctctgaatctcttgttctctctctggtactagttagttaacgggatggttgtagatgatgataggcatcttttattagggaa

SEQ ID NO: 103329 - DNA, 105 bp, Caenorhabditis elegans
ggtagctgctagtggcgatccaatggctccagcaatcaacatacattttgagaaaatagtgagctctgtgaatgtgcatgccataaatgccaccatcagacatcc

SEQ ID NO: 103330 - DNA, 100 bp, Caenorhabditis elegans
gcagtatagaagtggttgacgagtgttttccagatttatctgttattcttattctgatgtctagattttttgggagtttgttatgctgtagttgtgttgc

SEQ ID NO: 103331 - DNA, 110 bp, Caenorhabditis elegans
taaatgtgccagtctacctactgcctaaattagtgctcgccgttttttcaatggatatagtttgaatacctaatcattaacagtaggcaggtgtaggtcgtgagtttttg

SEQ ID NO: 103332 - DNA, 115 bp, Caenorhabditis elegans
caggggtctctttcagttataagtagtagtgccgcaggtaaccgccagtctaaaaggcttacctactgccttctgcttaaaattgaaatattgatgaccattgattgtttacctg

SEQ ID NO: 103333 - DNA, 93 bp, Caenorhabditis elegans
ggatcagatcgagccattgctggtttcttccacagtggtactttccattagaactatcaccgggtggaaactagcagtggctcgatcttttcc

SEQ ID NO: 103334 - DNA, 94 bp, Caenorhabditis elegans
ccgctgtcggggaaccgcgccaattttcgcttcagtgctagaccatccaaagtgtctatcaccgggtgaaaattcgcatgggtccccgacgcgg

SEQ ID NO: 103335 - DNA, 208 bp, Caenorhabditis elegans
tcgattctagaaacccttggaccagtgtgggtgtccgttgcggtgctacattctctaatctgtatcaccgggtgaacacttgcagtggtcctcgtggtttctctgtgagccaggtcctgttccggttttttccgtggtgataacgcatccaaaagtctctatcaccgggagaaaaactggagtaggacctgtgactcattccgatttc

SEQ ID NO: 103336 - DNA, 206 bp, Caenorhabditis elegans
ttcctgatataccgagagcccagctgatttcgtcttggtaataagctcgtcattgagattatcaccgggtgtaaatcagcttggctctggtgtctccgaacctcctgtccgcacctcagtggatgtatgccatgatgataagatatcagaaatcctatcaccgggtgtacatcagctaaggtgcgggtacaggtgcatttgatatc

SEQ ID NO: 103337 - DNA, 119 bp, Caenorhabditis elegans
ggtgagttatttttaagtgggtcccagagaccttggtggtttttctctgcagtgatagatacttctaacaactcgctatcaccgggtgaaaaatcacctaggtctggagcctcctgctc

SEQ ID NO: 103338 - DNA, 117 bp, Caenorhabditis elegans
tttttctagttctacagtaacttgacttaccatttgctgattcactatccccacgttttctgacagaagtgtctctgctcaacaggtttggagcagttgcgtagtagtcgagaggag

SEQ ID NO: 103339 - DNA, 99 bp, Caenorhabditis elegans
atgcaccatgtgccacgctggatgtgctcgttagtcataatatcctccacaaagcaaggactatgactagagacacattcagcttggcgccgaatgcat

SEQ ID NO: 103340 - DNA, 108 bp, Caenorhabditis elegans
ttttcatcgatttttagttttttttttcgatagaaacttttttatttattaaaaaaactaaaaagttacaatatattcttaagaaaaactgtgaaaaatcgatgaaaa

SEQ ID NO: 103341 - DNA, 89 bp, Caenorhabditis elegans
aaaaagcggatcagaccggattactgtagacgtggaggcaatggaaattgaacgtttcatagttttttttagtgtgaaagccaattttt

SEQ ID NO: 103342 - DNA, 87 bp, Caenorhabditis elegans
ttattcaagtaatgtagcaaaatgtattaaaatacatttgtgacggcacaaatgtatttaaatacatgtttttatatacttgaataa

SEQ ID NO: 103343 - DNA, 78 bp, Caenorhabditis elegans
gaacagtttcaattcgaaaagtgtaatgttttcttttttagttgacattatatatttcttttcgaacagggatttttc

SEQ ID NO: 103344 - DNA, 97 bp, Caenorhabditis elegans
atgtatatgtattagttaatgtgtatgatatatatatatatatatatatatatatatatatatatatatacatacacagtaacttatatatatatat

SEQ ID NO: 103345 - DNA, 72 bp, Caenorhabditis elegans
tgtgtacatttccggtgtccatgtatacgtatatatctatgtatatatgtagatttacgggggatgtgtaga

SEQ ID NO: 103346 - DNA, 78 bp, Caenorhabditis elegans
ccggaggttttcctatgtcacggccagaaatagtcgaatcattgattatatttttctgagaacggcaggaaattctgg

SEQ ID NO: 103347 - DNA, 71 bp, Caenorhabditis elegans
gtttatttcgaggtttttatgttttgaaaactgattttttttcaaaaaaccatcaaaatttcggagtaaac

SEQ ID NO: 103348 - DNA, 87 bp, Caenorhabditis elegans
aaaagttatgggtcctcaaagttttcaaaataatttttttaattttttttttcgaaattgaataaagtttgagcacccataactttt

SEQ ID NO: 103349 - DNA, 114 bp, Caenorhabditis elegans
ttttgcatctgccaaaccgcccgtttggatggttgtgctctgaggaaatacgcacagaatgtcatttcatcaggccatagctgtccaaattggtatagagtttggaatgttgaa

SEQ ID NO: 103350 - DNA, 107 bp, Caenorhabditis elegans
aataaaataaaagtttcaaaaccccgtgaagtgtctgctgcaatctaaatttttagatatagatgcagtcgactcttcattgggttttcaggaacccgtaaagtgtt

SEQ ID NO: 103351 - DNA, 174 bp, Caenorhabditis elegans
aagaaaaaaaaatctggttttttattcagaaaatctgcgtttttccgataaaaaatttggatttttttttaaatacggtttttttctttaaaaaatctggtttttttttcttaaaaaacggatatttttctccaaaaaaatctggttttttattcagaaaatctgcgtttttcc

SEQ ID NO: 103352 - DNA, 74 bp, Caenorhabditis elegans
gcacccgggcggctccgagagcacggccacggccgttgttgttgctgtttagctctctggggctctctctgtgt

SEQ ID NO: 103353 - DNA, 93 bp, Caenorhabditis elegans
ggctgggatctatcttgctttgagtggattgttgaatcgatttttggcttgatagttggtttgattgttggctcacttgttgtggatctggtt

SEQ ID NO: 103354 - DNA, 110 bp, Caenorhabditis elegans
tgatttcgcatggttaagaacttgctgacgtcatatttttttggtttaaaaactcccgcattttttgtagatcaaatcgtgatgggacagcttgacaccacgtgatttta

SEQ ID NO: 103355 - DNA, 83 bp, Caenorhabditis elegans
tctgggcgaatgctactcccttagtcatttcgtaagtgtcgtttgacagtctatgtctctgagtaggagtattagcccccaga

SEQ ID NO: 103356 - DNA, 79 bp, Caenorhabditis elegans
ttctagaattttctaggaaattttcaaattttctagatgttttttagggaatttcaaaaaattctagagcgttctagag

SEQ ID NO: 103357 - DNA, 76 bp, Caenorhabditis elegans
gcttgtccgtgtgtagtacaaaacgctttgtaaatcgacatgtaaaaatcctgattttgtactacacgtggaaagc

SEQ ID NO: 103358 - DNA, 89 bp, Caenorhabditis elegans
gaaaactatgctatattattacgtaatgtatatgtatttaatgtatacattatatacagtgtatatataatgtataatgtatagttttc

SEQ ID NO: 103359 - DNA, 87 bp, Caenorhabditis elegans
tagcagacccaaattgaaaatgggtctgctagactacacactacacgattatatttagcagacacaaattgaagaatgggtctgcta

SEQ ID NO: 103360 - DNA, 114 bp, Caenorhabditis elegans
tgaattttttgaaaatttaaaaatgagaatttttaatttttatctgaaaatgagtatttttttctttttttttggataaaaattgaaaattttctgccaaaaattaaaaaatcg

SEQ ID NO: 103361 - DNA, 73 bp, Caenorhabditis elegans
gttccaaattaatccagaaggtgtctggacgccaagtctcctcttgtttcacacacactgtctcgtttggaac

SEQ ID NO: 103362 - DNA, 85 bp, Caenorhabditis elegans
ggaagtcctagtttaatgtttgaaagtttttgaaaaaatggccttttttggaggaaaattcgaattcaaactagagttttcttcc

SEQ ID NO: 103363 - DNA, 112 bp, Caenorhabditis elegans
ggattagactaagaaaaatgcatggaatttgaaaatggcgatgacaattttttttttgaaaaaatcatagagcatgcaaattgcatgtgccaaattttagttttttaaattc

SEQ ID NO: 103364 - DNA, 108 bp, Caenorhabditis elegans
ggttttaatagcaaatttaagagcaaaatcaatagtttttgatattttttcgtagatttcttgctgaaaatcgaagaaaaatgagtttggtctgctaggctacaaact

SEQ ID NO: 103365 - DNA, 57 bp, Caenorhabditis elegans
gtatcgatttagcagacccaacagtttttttttctaaatttgggtctgctagactac

SEQ ID NO: 103366 - DNA, 98 bp, Caenorhabditis elegans
tttcacggcggccgacaattcccgagtttggtcactaactgtatgtatataattttatgatgagttgctaaactcggaaattgactgccgctgtgaaa

SEQ ID NO: 103367 - DNA, 98 bp, Caenorhabditis elegans
acacaaaaaatgatcaaacggtattccagagttgataataaaaatgcgtcagtccgcaatctattattgctcgagaataccctttgactactatgtgt

SEQ ID NO: 103368 - DNA, 70 bp, Caenorhabditis elegans
agctgaaaattgagagtttgatctgatctgtcgatccgggaaaagatcaaaatttttgatttttaaagct

SEQ ID NO: 103369 - DNA, 96 bp, Caenorhabditis elegans
tttgttggatttcaggccacatatgagcttgaaactgcattttttgtttttgaaaaaacaaaaaatgttcgatctcactgcttcaaattccgcaaa

SEQ ID NO: 103370 - DNA, 118 bp, Caenorhabditis elegans
tggaaacccggttagtttttgggatggtgtagggggattctaatcattttttgaatatctaaaactctgaaatctaagctcccaaccaccaccacaatggctccaaccacaagctcca

SEQ ID NO: 103371 - DNA, 117 bp, Caenorhabditis elegans
tgtatatttaatgaacctcgttttgggagcagccggcattttacgggctacactttttttaaaattgatgtgtgcccgtactgtgtcggctgctttgaaaatttcggtcaatctaca

SEQ ID NO: 103372 - DNA, 95 bp, Caenorhabditis elegans
gaattttagaaatccgcaatttttttgatttttacagaaactaatttttttgtaatttgaagaaatttagaaaattttggaaatgtctaaaattt

SEQ ID NO: 103373 - DNA, 112 bp, Caenorhabditis elegans
tgttagttgacaacttcttgctagcttttatggttgtggagataaaacgagttaaaacttttttttgaatatttcaacaaccataatagctattaaaaagttttcaactaca

SEQ ID NO: 103374 - DNA, 110 bp, Caenorhabditis elegans
ttgctcctgggacaacaatggatgcagtgctaaaagttgagaggaactcagagtcttctgaatttcttgttctaaatcaatgtagccatttgttgaaaatgcgttggcaa

SEQ ID NO: 103375 - DNA, 113 bp, Caenorhabditis elegans
actacaggacataaagacttttactcatagtggggcctttcgtgtattccacaaaccttggattttttcaatttttacataggcatctatgatgacgtggtcgtcgactgagt

SEQ ID NO: 103376 - DNA, 107 bp, Caenorhabditis elegans
ccttgaaagtttcccgaaatttctccaaaaaaattttttttttcagatgttgtccaaaacttctgaaaacttccaaaaaattttagagtgttccagaactttcctgg

SEQ ID NO: 103377 - DNA, 78 bp, Caenorhabditis elegans
taggtaattcgttgcaatagttactcaactgtaatcaatttttaattttcagttgagcacgctttaatgaattatttg

SEQ ID NO: 103378 - DNA, 99 bp, Caenorhabditis elegans
aggtcccgtcagagctaggcaagatgttggcatagctgaatgatcgctataacaactatcagcttcgccacattctgccacgcactgatgtgaggacct

SEQ ID NO: 103379 - DNA, 72 bp, Caenorhabditis elegans
agacagcagtgagagagggggagagattcagacagtctagcaatctgcgtctctccctcacacaggctgtct

SEQ ID NO: 103380 - DNA, 70 bp, Caenorhabditis elegans
gacagcctgtgtgagggagagacgcagattgctagactgtctgaatctctccccctctctcactgctgtc

SEQ ID NO: 103381 - DNA, 92 bp, Caenorhabditis elegans
gcgattaaagttgatgagcaagaggtgagaggcgcaggaggcgaaggtgtctgcctgtctgcgtctctccttcacctcaccattttcaaagc

SEQ ID NO: 103382 - DNA, 111 bp, Caenorhabditis elegans
gaaattcccgagaattatcagtagagcgcagtttcatttttcgaaaaattcaaattttttgaattttcaaataatgcgccgcgctctactgatattttttctaaaaatttc

SEQ ID NO: 103383 - DNA, 95 bp, Caenorhabditis elegans
gaaaaaaggggtaagagagtgtgagaggaggggagacccaggttgtctcgctgtctgcgtctcccctccgccgcactctttttctagttaagttc

SEQ ID NO: 103384 - DNA, 85 bp, Caenorhabditis elegans
cacttttttttgaaagctaagggtgacgtcacttttttgccgaaaaccaaatgtgacgtcactttttttttttgaaaaccaagtg

SEQ ID NO: 103385 - DNA, 71 bp, Caenorhabditis elegans
ggtagtttgacagtagtctgtgggcactggcgttgcttgcctttcaggcttgatttgcaatcatacatgcc

SEQ ID NO: 103386 - DNA, 97 bp, Caenorhabditis elegans
ttttcgcctccattagggctccatcaaagtgctcatccggcctgaaagaaaatagcttgaaaagattttggactggaggtcaagagtgggaagaaag

SEQ ID NO: 103387 - DNA, 110 bp, Caenorhabditis elegans
tttttttggaaatttcagaagttttttctatgaatgtttctacatatattttgaaaagtaagcaaattatatgaaaacatctaaagaaaacggcaaaaatttcaaaaagg

SEQ ID NO: 103388 - DNA, 103 bp, Caenorhabditis elegans
tgttttttttttggattttttggttttttttcggtagatttaaaactctttttttttgaaactttgctttaaaattggaaaatctgaactcctgaagttgaca

SEQ ID NO: 103389 - DNA, 111 bp, Caenorhabditis elegans
gggtttttcagatttgttggaaagaaactcttcacagttccgaattacttttgtcattttgtacatgtgagccgaatgaagaatcccttcaacgttctcgtctgaaatatt

SEQ ID NO: 103390 - DNA, 84 bp, Caenorhabditis elegans
gagagagagaggcgtgggagagagaggggaaacaagaagcatccctctctctctctcagcttttcagcttcttcctatttctct

SEQ ID NO: 103391 - DNA, 113 bp, Caenorhabditis elegans
gctcgtttaaagtttaggccgaaaatgagggtggagacgcagagaagcagcgcgtctcgctgtctgcgtccctcaatctctcactctctcgtttttttcaactgtaaattagt

SEQ ID NO: 103392 - DNA, 62 bp, Caenorhabditis elegans
gggggagaggagagacgcagagaggcagggagtctcgatgtctgcgtctctcactctctctc

SEQ ID NO: 103393 - DNA, 77 bp, Caenorhabditis elegans
aagccgatgtgctcaagggttctatcaagaattcttattaatatttaatgatggagaccctagaaaagcatttgctt

SEQ ID NO: 103394 - DNA, 83 bp, Caenorhabditis elegans
ttgcattatggggttattcaagtaatgtagcaaaatgtatttaaatacatgtttttatatacttgaataaggttgtgacgtaa

SEQ ID NO: 103395 - DNA, 111 bp, Caenorhabditis elegans
tgagcagcaattgtatagagtgtatagagattagaaaaagcttgaattgtttaaaaaatgattagagctacttttaatttgtctaagttaggcctatttgagatgcgtcca

SEQ ID NO: 103396 - DNA, 84 bp, Caenorhabditis elegans
gtgatatggtagtgttactgtactggtaatggagggttactgtaacggtactgtagtggtagagtagtgatattgtagtgtcac

SEQ ID NO: 103397 - DNA, 104 bp, Caenorhabditis elegans
ccctcatctgtgacagattgtggtggtagtggtgaatgagtgagggtgagggaaacgagttgatgatgatgatgatggtcaccatatggtcatagagatatggg

SEQ ID NO: 103398 - DNA, 87 bp, Caenorhabditis elegans
cgtgtcgagctcgagccgatcgccttgctcgccgagccaatacgagatgagtgatgagacggtgcacaggaaggttcgagagacgcg

SEQ ID NO: 103399 - DNA, 66 bp, Caenorhabditis elegans
tcatctcagcactttggaaagcaacggctcgcagagcagctagacagatgtgctcgcgttgggtga

SEQ ID NO: 103400 - DNA, 111 bp, Caenorhabditis elegans
tttgtagtctagcagaccaaaaattttcaattttcgcatggaaaattggaaaattgatgaatttttcaatttttcagcgggaaaatgaacatttttcaaatagaaatcaga

SEQ ID NO: 103401 - DNA, 87 bp, Caenorhabditis elegans; identical to SEQ ID NO: 103244

SEQ ID NO: 103402 - DNA, 101 bp, Caenorhabditis elegans
actaaaaaaggaatgaccttgataaacatcgtgatccaaagatattgataatgatcaatgagagaagagagttggctcaaggtcatctggactactgtagt

SEQ ID NO: 103403 - DNA, 92 bp, Caenorhabditis elegans
tgagctggtccagcgacagcctgtgtctgtggctgtgctccaaatccagctggagctccccattgatgttgtggccatgctggtgcagctgg

SEQ ID NO: 103404 - DNA, 102 bp, Caenorhabditis elegans
gagctcagtggcttagaggtggtggctgaacggccacttcactgtgactctgtatctcagaggtggtggccgaaaagccacttctcgtcggctcactggctc

SEQ ID NO: 103405 - DNA, 93 bp, Caenorhabditis elegans
cttttactcttcaagctgtactataagctcgaaagttttttttttaaactaagacaaaaactgacagagttacaccgacttgaagtatttgag

SEQ ID NO: 103406 - DNA, 115 bp, Caenorhabditis elegans
tgtgcaattatttttttcggttgagctatatggttaaatggttgaggtgatgaaataaatatgttcttgtattttaaattatgcaataaaatggctcaagaaatcgaattacaca

SEQ ID NO: 103407 - DNA, 105 bp, Caenorhabditis elegans
atcatttgtgcaatacgcacttggatcgtccttttttcatgtctatagtttagaatatttgttgatatctaaatagttgtttccgagttccttttgtattctgat

SEQ ID NO: 103408 - DNA, 129 bp, Caenorhabditis elegans
ccggtgacaaagtagtcgtagttggaataggagcagttgttactggaatatttgctggtactgcatcttcaactgctggaatcgcatctactggtctttattcttaatcttaaattttatggcaaatac

SEQ ID NO: 103409 - DNA, 146 bp, Caenorhabditis elegans
gtctctattgtgaaaatgtattttctttataaaatagagacactaataaaaattttaaatttttattcgtctctattttgaaaatatattttcttgatgaaatagagacactaataaaaattaaatttttattcgtctctattttg

SEQ ID NO: 103410 - DNA, 95 bp, Caenorhabditis elegans
aaccgcttgttcttgaactggaagagtgccataaaatcatgacaaagtacgtgatattatgcacattttctagttcaagacttgagaaatcggtt

SEQ ID NO: 103411 - DNA, 120 bp, Caenorhabditis elegans
catttaagctgttctatgtttacacaagtaatgagtcatttatgggaattgagaactttttgttttcacagccacattagttcaatatattgatgttgatcatatttttgaagctttatg

SEQ ID NO: 103412 - DNA, 78 bp, Caenorhabditis elegans
gaatttggcactcttttcaactgtggcacaagtctcgtggagatatgactgcaattttgatgagtgtaaatcaaactc

SEQ ID NO: 103413 - DNA, 100 bp, Caenorhabditis elegans
ggcggtaaacttggatttgatatgatcctaaatcaatttgtatattaataaaacagtatatctagttatttgcccttcttcagtgtccaattctaccacc

SEQ ID NO: 103414 - DNA, 123 bp, Caenorhabditis elegans
gcacggacacagcacaaaggagcacttattcatttgaatagtttagtttgatagactattgattttatatttatcaaggcggaactaactgaaaatgggtgtttaccgcgtgtttttgttttc

SEQ ID NO: 103415 - DNA, 100 bp, Caenorhabditis elegans
tatcgatttttcaacgtttttctctatttggtgaaatttgaattattttatcattaatttgagttttcgttttaatataaaaaaactatgaaaatcgata

SEQ ID NO: 103416 - DNA, 91 bp, Caenorhabditis elegans
gatataggggtaaggggcacatacgcagaatctggcttgctgccagtcgttttcctctcaccctctctgtctcgtcgtttctcatactcct

SEQ ID NO: 103417 - DNA, 87 bp, Caenorhabditis elegans
gatatttttttgggaatattatagattctagggattacaaaatatcacgactctctagttcgttgaatagtatcctaaaaaagtatt

SEQ ID NO: 103418 - DNA, 97 bp, Caenorhabditis elegans
ggtgaccgatgtccagcgtcttacctgttcaatatttagactgactatcaaagagatctaatactgtcaggtaatgacgctggattgtcatgtcatt

SEQ ID NO: 103419 - DNA, 90 bp, Caenorhabditis elegans
gttatgataactggcaaaatagtcatgggatgatgcttgattttaaaagtatcaaaataactttgatttttctgcgagatctatcaatac

SEQ ID NO: 103420 - DNA, 77 bp, Caenorhabditis elegans
gctctctctttttcacacgctctctcgctaaaggcgttttgcataggcgttagacagcgtgcgagaaagagagacgc

SEQ ID NO: 103421 - DNA, 79 bp, Caenorhabditis elegans
aactttagcactcagcatttgacgagacaccaatgagtaatacattccgtctgtgtctgtcataagttcggtgtgtgtt

SEQ ID NO: 103422 - DNA, 85 bp, Caenorhabditis elegans
tattcaagtaatgtagcaaaatgtatttaaatacatttgtgacgtcactaatgtatttaaatacatgtttttatatacttgaata

SEQ ID NO: 103423 - DNA, 80 bp, Caenorhabditis elegans
attcgccgcacaaaaaagtgggcggagactgaaacgcaatgtgtgcgcacgttatctcactcctctttctgtgtaagaat

SEQ ID NO: 103424 - DNA, 105 bp, Caenorhabditis elegans
tggcatttcagcagaaacaatgattccacccaaatattcgtctgtgactctctgtgttccagacagtgcagatgcaatatttccattcttttcaagctgtcgtcg

SEQ ID NO: 103425 - DNA, 113 bp, Caenorhabditis elegans
tgtcaaaatctctcaatatcacatgatctttaactaactgctatggagtttcaaatgtcagacgacacagagcagatcactggttttgaattgtaattttgatatgatggaca

SEQ ID NO: 103426 - DNA, 114 bp, Caenorhabditis elegans
gtatgtgaactcatcgacatgctcgtctaccctgtagatcgagctgtgtgtttgaaacaatcatacacgagctagactacaaggtgcacgaacaaaccgaagatttatgaatat

SEQ ID NO: 103427 - DNA, 69 bp, Caenorhabditis elegans
gatgactcacattttctctcactgaacaattgtacatattccaatcggtaggaggggctgtgattcatt

SEQ ID NO: 103428 - DNA, 117 bp, Caenorhabditis elegans
gtattctatagaattttggcgtcggagcccgatttttcaatagtttgaaaccagtgtacacataaatggttacaaagtatttgaaaagtcgtgctctgaaaatgaattcttacatga

SEQ ID NO: 103429 - DNA, 106 bp, Caenorhabditis elegans
gagaagaagcaggcagaagaagaagaacgaggataagaccggagaagaagcacactcactcttactctcctcttattgtgctccatttctctactcatccgttttc

SEQ ID NO: 103430 - DNA, 113 bp, Caenorhabditis elegans
tggaagtcctggggctcctggtggtccttctggtctgaaatttttatatttacaagaagtcgtttaatatttttttcatcctacccgtcctctccagcagctcctccatatcc

SEQ ID NO: 103431 - DNA, 85 bp, Caenorhabditis elegans
tattcaagtaatgtagcaaaatgcatttaaatacatttgtgacgtcacaaatgtattaaaatacatgtttttatatacttgaata

SEQ ID NO: 103432 - DNA, 99 bp, Caenorhabditis elegans
tctccccccgttcgtaccgaaatttctgtgtatatttgtgtctcctatatttgaatatagtggacacgtagatagaatgaaagacgtagaggtcacaga

SEQ ID NO: 103433 - DNA, 92 bp, Caenorhabditis elegans
gtatggaaccggaatgcggtcatttggaagttgtaatcaatctttttatttcagttaattgaaactttcgaaggtattctgattttccttat

SEQ ID NO: 103434 - DNA, 120 bp, Caenorhabditis elegans
acttgggccaaagtttggcaagagttgggtgaaacttgggttagactttggtaaggcttgaatccaagttttgccaaagtcttgcctaacttttgcccaagtttagacagcttctgatcc

SEQ ID NO: 103435 - DNA, 111 bp, Caenorhabditis elegans
gggccaaagtttggcaaaagttgggtgaaacttgggttagagtttggtaaagcttgaatccaagttttgccaaagtcttgcctaacttttgcccataatattttttgggct

SEQ ID NO: 103436 - DNA, 58 bp, Caenorhabditis elegans
ggaaagtaagagaggaagagagaaagcacgcgctttctatctcactctctgcgtttct

SEQ ID NO: 103437 - DNA, 98 bp, Caenorhabditis elegans
ttttcatcagctgccctttgctctactcgtttcgtcaatgcaatttccaaagtgtgcattagagaagtgacagtttgagctgttggaacttttgagaa

SEQ ID NO: 103438 - DNA, 86 bp, Caenorhabditis elegans
ggatccaacagattttctagttctgagaatgttttcaaagaggcaggtggtagcttctgaaaaattagaactttaatttttggacc

SEQ ID NO: 103439 - DNA, 93 bp, Caenorhabditis elegans
ttcaattttaatctatttttacagatattgttggaaaattatgaattttttcatagtttttcaagagaagtcgcctaaaaagctgaaattgag

SEQ ID NO: 103440 - DNA, 114 bp, Caenorhabditis elegans
aactgaaaactagtatttattttttcaaaattgaagatgttgatttttttttgttcttttgctcaaaaactaacatttttagtgatttttaattgaaaaagtatttttccagtt

SEQ ID NO: 103441 - DNA, 75 bp, Caenorhabditis elegans
tgtatggtgcgagagtgagagggcgcagacaacgagagtgtgtagctgtctgcgtctatctctctccttcttaca

SEQ ID NO: 103442 - DNA, 109 bp, Caenorhabditis elegans
tccaccgatctcctcctcatttcatgattagtgtctgtgtgtctgtgtccttggacaccatttagagcagcagtaggagcagcagatgatgatagatgactacgcggga

SEQ ID NO: 103443 - DNA, 80 bp, Caenorhabditis elegans
ggacactctgtctctcagggaaccacgggcggttcaatgaaccatttcccgttggtgtttcagaatccggtagattgtct

SEQ ID NO: 103444 - DNA, 56 bp, Caenorhabditis elegans
acgtcacaaatgtatttaaatacatgtttttatatacttgaatacagttgtgacgt

SEQ ID NO: 103445 - DNA, 110 bp, Caenorhabditis elegans
ttgtaggcttgtagacttgtatgcttgtaggcttgtaggcttataggcttgtatatttgtagatctgtaggtttgtaggcttgtaggcgtgtaggctagtaggcttgtag

SEQ ID NO: 103446 - DNA, 117 bp, Caenorhabditis elegans
agaaaaaaaatttttgagcaaaaaaaacctattttttaaggaaaatttaatttttatagaaaattgaaatttttccagaaaaaaattttttttgagcaaaaaaacctatttttttct

SEQ ID NO: 103447 - DNA, 73 bp, Caenorhabditis elegans
cgagagagcgtgaggagaggcgagtcgcagacaccatcactgtctgcgtctctccacaccctacactcttttg

SEQ ID NO: 103448 - DNA, 107 bp, Caenorhabditis elegans
aaattttcagcgcttcgcaaaatcgggagttttgccacacaataatttttgtttaaatttcaaaaaaattgtgggaaattttgtgattcttatgatagtggaagttt

SEQ ID NO: 103449 - DNA, 111 bp, Caenorhabditis elegans
tcgggcatcacattctggaaattcacaatttttttttgaaaaaatcgaaaaacattttttttcaattttttcagaaaatttaattttcttatttttatggagcagtaacgg

SEQ ID NO: 103450 - DNA, 112 bp, Caenorhabditis elegans
agagacacgtgtccacgccgtctaagtgaatgctttgccacagtcttcgatgttctgaaatgaagcctgggctcagattcgcttaggccggagtttgacacggcatttttct

SEQ ID NO: 103451 - DNA, 119 bp, Caenorhabditis elegans
ttccagaatttcttggaattttccaaaaggttctagaacattccagaattttttttaaattttccagaaggttctagaacattccagaattttttaaaattttccagaaggtcctagaa

SEQ ID NO: 103452 - DNA, 90 bp, Caenorhabditis elegans
tttctattaaaaagcacgctcacaggtgtaaatcagtgaaattaattaattcgttactttttcatttttaagcgtgctttttaatcgaaa

SEQ ID NO: 103453 - DNA, 84 bp, Caenorhabditis elegans
ggcaagagttgggtgaaactttgggtaaactttgatgtcgcctgaatccaagttttgccaaagtcttgccaaacttttgcccaa

SEQ ID NO: 103454 - DNA, 90 bp, Caenorhabditis elegans
aaaaatacttatggggttattcaagtaatgtagcaaaatgtatttaaatacatgtttttatctacttgaataaggttgtgacgtaatttt

SEQ ID NO: 103455 - DNA, 110 bp, Caenorhabditis elegans
actgtttttgtattggtcctcttattttttggtgtgggtgtgtcaaatctacatatatatagattatggtgatctacacaaaagacaaacaaaaaaaacgaaaaagtcag

SEQ ID NO: 103456 - DNA, 109 bp, Caenorhabditis elegans
tgaaggtcgttgtctgtgttgctgttcctcatcgtatcgtcaagctgtatctccatcagaatgtgcaagcggtacaatcatatcagccggatgctcttcaactccttca

SEQ ID NO: 103457 - DNA, 88 bp, Caenorhabditis elegans
tttggcaagagttgggtgaaacttaagttagactttggtaaagcttgaatccaagttttgccaaagttttgcctaactttggtccaag

SEQ ID NO: 103458 - DNA, 85 bp, Caenorhabditis elegans
tattcaagtaatgtagcaaaatgtatttaaatacatttgtgacgtcagaaatgtatttaaatacatgtttttatatacttgaata

SEQ ID NO: 103459 - DNA, 94 bp, Caenorhabditis elegans
tatagtaagtatgtaagtagtaagtatatatatatacatacctatagtacctatatattcatatagtacttacttgcctacatacctacttata

SEQ ID NO: 103460 - DNA, 82 bp, Caenorhabditis elegans
aaactttgtaaatttccaatttttttttgtaaattgccaaatttctggccaatttccaaatttttggtaaattgccaagttt

SEQ ID NO: 103461 - DNA, 104 bp, Caenorhabditis elegans
tgtgtgtgacctgccattccaatccatttactctcacagtctgacatcattccgaattcggtgaagaagacaagatggtgtggagatgattgtcggtcgacagg

SEQ ID NO: 103462 - DNA, 88 bp, Caenorhabditis elegans
gaatgattcgttggtgtgatgggcgaagaggcgagccgaatacattaaatctctgcagctctctcactttatcacactctatcagttc

SEQ ID NO: 103463 - DNA, 113 bp, Caenorhabditis elegans
tatttccagttctcttgatatcctcctgctgctccgatgtcttgaaagagagctttgactctctgaatctcatattttcagtccgaatgaatccttccaagaacatgttgata

SEQ ID NO: 103464 - DNA, 117 bp, Caenorhabditis elegans
attcttgtcgaacaactagtgaactccggtttagcagcgaatgatgagagaacattcacacctctcacatctcgcctaccacccgctatccgcacaagagtcactcagttctggggc

SEQ ID NO: 103465 - DNA, 99 bp, Caenorhabditis elegans
gaaattttattttttttcagaaaaaatcgactattttgatttttttttcacaggaaatcagaaaaatttgattattttcagagaaaatctaataatttc

SEQ ID NO: 103466 - DNA, 105 bp, Caenorhabditis elegans
ttttttcacagataatcgaaattttttaagttttttaagagaaaatcgaaaaattttgattttttttcacagaaaatcagaaaattttgattttttcagagaaaa

SEQ ID NO: 103467 - DNA, 77 bp, Caenorhabditis elegans
cggaagatggacggctcgatgtttctgtggtccatttgagaagatgttcagagatgaatgagagtggagtccagctg

SEQ ID NO: 103468 - DNA, 117 bp, Caenorhabditis elegans
attttttgtgacgattttgcatgatttggcaagcaaaaaagtatcaatttatgtttttacagtactgaagttccgttgctctcgtaaatcgacacaatggtcaattattcgaaaaat

SEQ ID NO: 103469 - DNA, 90 bp, Caenorhabditis elegans
agtttaatagcactcctgcaattacaacactatccgctgatggatgccagtacatgcgtagttgtggtcaaggtggagagcatttgaatt

SEQ ID NO: 103470 - DNA, 85 bp, Caenorhabditis elegans; identical to SEQ ID NO: 103225

SEQ ID NO: 103471 - DNA, 82 bp, Caenorhabditis elegans
ctacgcatctctgccgcactgcgtctctctggcactgtgccaatacaccgaatgccacgcgagattgcggactgagagttgg

SEQ ID NO: 103472 - DNA, 118 bp, Caenorhabditis elegans
agggtccaaactgctgaggtgaagctgaagagagccgtctattgacagttcaagaccacgagtcgttgtgtgctgtcatggagtcgctctcttcagatgatccggtcaatggtatttt

SEQ ID NO: 103473 - DNA, 91 bp, Caenorhabditis elegans
tagacacagtgactggagggtctagaggaggagacactttctctcctaaaaagttatgtttcactcactctcttattgatcattgtagctg

SEQ ID NO: 103474 - DNA, 75 bp, Caenorhabditis elegans
ctccgtgtctttctgagacgagtagaaggaaagtgaatcgtcatcatcttcttcttgttctcgagaaatatagag

SEQ ID NO: 103475 - DNA, 102 bp, Caenorhabditis elegans
ggagtaactcaagtcagataatatctcatagggccccccgctgaggcagcccagtggtgtctgttacactgtctgcgtctcctccactctgtgtactctctc

SEQ ID NO: 103476 - DNA, 76 bp, Caenorhabditis elegans
tgtgtgtgcaatgaagtttggaaggtggctgtttggaagcggccgacgcgttcggggtttcgcgtcgcatcataca

SEQ ID NO: 103477 - DNA, 113 bp, Caenorhabditis elegans
gaaattgttcgaaacttaaattttcagatttgccacggcaccagctttcatatgacacccatattgtctaggttccgctaattttcaaaattttcagattttcgaaaagtttc

SEQ ID NO: 103478 - DNA, 68 bp, Caenorhabditis elegans
gagtgagaagggggagagtcgcagacggcgcgcgcctctcgtcgtctgcgtctctccctctctcactt

SEQ ID NO: 103479 - DNA, 78 bp, Caenorhabditis elegans
gagagagtacggagggggagagacgcagacgacacgcgcctctcgtcgtctgcgtctctcgccctctctcactcgctc

SEQ ID NO: 103480 - DNA, 73 bp, Caenorhabditis elegans
ttcgtctgtgtcagtgtcacttggttcgatacaaagtgccagcagagagagagagagactgagacgcagagaa

SEQ ID NO: 103481 - DNA, 116 bp, Caenorhabditis elegans
ccgtttgccggatatcagacttgccggaaatgtttagagggatttttttataagacggaaacttttttttatttttccgaaaattttcagcaattgccgatttgccgaattgccgg

SEQ ID NO: 103482 - DNA, 109 bp, Caenorhabditis elegans
gaaaaatcgttaaaatcgacaaatttacggatttttgaaaatccgaaagttttggaaaaaaaactttttttttgaatttttcgaaatcttgttactttttcagtttttc

SEQ ID NO: 103483 - DNA, 75 bp, Caenorhabditis elegans
gaattttggaaggcggagcgtaagatggctggcctggcaggcagtcagtcagtctctctccactcacattcagtc

SEQ ID NO: 103484 - DNA, 98 bp, Caenorhabditis elegans
cgctgacctcgccgaatatgacactgaagcgttaccgaaccgttttcccacacctggattcggtgcaacgatcagtggcatgctcggctagcgccagt

SEQ ID NO: 103485 - DNA, 218 bp, Caenorhabditis elegans
tggagccatggagccttcgccgattatgacactgaagcgtaaccgaacaccatattttgagattctgctacgcgcagtgccatgctcggcgcgttggctccattaaaaaacggccacaaaaatgccatacatgacactgattagggatgtgatgaatgttaagatcccgatcaaattcctaacggtgtcaaacatggcgtatgtggttgtagttggtg

SEQ ID NO: 103486 - DNA, 85 bp, Caenorhabditis elegans
ctcggcggcgctaaagacaaaaaagaagtggatgggggcggggctctttttctctgaatttctctctgtttgaagctttgatgag

SEQ ID NO: 103487 - DNA, 118 bp, Caenorhabditis elegans
tcgagacgggtcgccacaggagaggagaggtagagaggggaggcgccgagccttatatactctgcgtctcactctctgacatctcccttccagaggaaagttgaggctcctgcctcga

SEQ ID NO: 103488 - DNA, 63 bp, Caenorhabditis elegans
gcctgcctgcctgcctgcctgactacctgcctgataggtcgccttgcaggcaggccggtaggc

SEQ ID NO: 103489 - DNA, 65 bp, Caenorhabditis elegans
tgagagaggaggggagacgcagagagtgcgccctctctcgctgtctgcgtctctccctgtcttca

SEQ ID NO: 103490 - DNA, 69 bp, Caenorhabditis elegans
aaatagtgtgggaggagagagacgccgacagcgcgcgcacactgcgtctctccctctcccacactattt

SEQ ID NO: 103491 - DNA, 118 bp, Caenorhabditis elegans
aggtaagataaaatttcagctcctgtctgggcttcacaatagtcgaataccttaaatttcaaaatttggatattcgttgttgatgaagccttgatgggggtgagaaagaagtttgctt

SEQ ID NO: 103492 - DNA, 77 bp, Caenorhabditis elegans
gataacagagttgttcatcaacaaaatatagcccttgaaatttgctatattttgttagttggaaactttttgatatc

SEQ ID NO: 103493 - DNA, 96 bp, Caenorhabditis elegans
gtttggggcgcagaaagtgtgtgggaggagacgagacgcagagcgtctgcacgcactgcgtctctcccactgccacactctctcgctcgtgtaaac

SEQ ID NO: 103494 - DNA, 79 bp, Caenorhabditis elegans
gatatcaaaaagttatcaactgacattttgtagaacttaaagtttcctatattttgttagtgagaaactttttgatatc

SEQ ID NO: 103495 - DNA, 99 bp, Caenorhabditis elegans
aaaaattcgatttttccgggaaagtaaaaacaaatttcaatttttttttcatagaaaatctgagaatttttgattttttcaaagaaaatcagaattttt

SEQ ID NO: 103496 - DNA, 94 bp, Caenorhabditis elegans
cgttttcactttgttaagcaattttttactttaaatatcgatttttcagaagaaagcgatgtggaactcgaaggatttcttccagaagtgaacg

SEQ ID NO: 103497 - DNA, 96 bp, Caenorhabditis elegans
attcaagtaatgtagcaaaatgtatttcaatacatttgtgacgtcacaaatgtatttgaatacatgtttttatatacttgaatacagttgtgacgt

SEQ ID NO: 103498 - DNA, 78 bp, Caenorhabditis elegans
ctggcggtttctttttccgttcctcaaaggcttctgttcccgtcgggagactagagagagagagagagagagagaaag

SEQ ID NO: 103499 - DNA, 74 bp, Caenorhabditis elegans
agctcgcacacacagacacagacatacgcttgcgcgcgcgcaatgaaatgggtgtgtgctcgtgtgtgaccgtt

SEQ ID NO: 103500 - DNA, 94 bp, Caenorhabditis elegans
aatggcgccatgatggtcgtattgatgggtttgatgatgaagctgatgataactatcatcatcatcatcatcatcatcgaagtggcgccattat

SEQ ID NO: 103501 - DNA, 115 bp, Caenorhabditis elegans
gtgctcggagcgatgcgctaaatggtcgagtatcattttcactctgactaatttttctatttgaatttccactgaaattgaaaattctgaccaatcagcgtgttgctcagactac

SEQ ID NO: 103502 - DNA, 77 bp, Caenorhabditis elegans
gctggtcattccttgtctcagtctgtcacagtcgccggtcctaggtggtgacttgtgtgacctgaatagtgttcagc

SEQ ID NO: 103503 - DNA, 92 bp, Caenorhabditis elegans
ggttttccgatttatttttttgaaaaaaatattcaagaattattggaattcgcttgcaatttttctttgatttttcaagtttttggaaaact

SEQ ID NO: 103504 - DNA, 127 bp, Caenorhabditis elegans
gctgttgttgctgttgttgttgtggagccgaagatgcgttcattcttgaattattatgatgatgatgatgttgagaattatgaggtggaggaggaggacgattaaactgttggtttgatgaggatga

SEQ ID NO: 103505 - DNA, 98 bp, Caenorhabditis elegans
cccattcttctgaaaattgatcaaaatatattttccataaaaagcaattattttatatgaatctatatattggagatcgtgtacaaagagagaatggg

SEQ ID NO: 103506 - DNA, 98 bp, Caenorhabditis elegans
gcaattgcagacattgatggtccatgatttaagcataaattgaatgtagatttctgattatgaagatcaaaagatggaaaaacgtgtcgagcagatgt

SEQ ID NO: 103507 - DNA, 85 bp, Caenorhabditis elegans; identical to SEQ ID NO: 103225

SEQ ID NO: 103508 - DNA, 83 bp, Caenorhabditis elegans
ccggataatgtgtggtttgttgattgcctgaatcgaaaagaattgagtggtgtaataggcactcaaatgaatcaaatattcgg

SEQ ID NO: 103509 - DNA, 78 bp, Caenorhabditis elegans
tcaagtttcattatgaaattcggtgttttcagacaatttttttttgtctgatgactttgacatttattatgggtttga

SEQ ID NO: 103510 - DNA, 110 bp, Caenorhabditis elegans
aggccatctttaccgcatgtcatgaaaacatcaaagtcagtacttggccaacatgcatctgttacactgtctctgtgttcatcatatgtgacatacggtagatagggcct

SEQ ID NO: 103511 - DNA, 109 bp, Caenorhabditis elegans
cgatcaaagattcgtcgatccgctcattctgccggttgttatgctattatcagattaagcatcacaacctcctagaaagagtagatcgattttaaaactttgaatttcg

SEQ ID NO: 103512 - DNA, 63 bp, Caenorhabditis elegans
gacacagcttctgcaagaggaggtggcacacacacacatacacacttctgaagcggaagagtc

SEQ ID NO: 103513 - DNA, 63 bp, Caenorhabditis elegans
agagcacagagaagcgagagtgtctagcttttctacgatctctctccctctctctaaagttct

SEQ ID NO: 103514 - DNA, 88 bp, Caenorhabditis elegans
gagaaggagaggaaaagagagatgagaaagtgcccggtgccagtggtcgtcctcgcaatgtctgcgtctctctgtaactctgttcatc

SEQ ID NO: 103515 - DNA, 115 bp, Caenorhabditis elegans
gaatagaaaatgcctggtcacacctcctgggacgccacttttcttggttaggttatgcttgtaaagttatcaaatagtagtagttcttgaggagctttgttttctccaaatattc

SEQ ID NO: 103516 - DNA, 84 bp, Caenorhabditis elegans
acgtttgacgggtgacctgctcaagagtgtttcgaataattacattttttttgaaacatccctgatcaacacatctccaagggt

SEQ ID NO: 103517 - DNA, 108 bp, Caenorhabditis elegans
agaaataaaattttaggttttggaaaatatactgtggagatgttctcaaaaattttatcatttttgaatattttcacaaactattactaaaattgaaaacaactttct

SEQ ID NO: 103518 - DNA, 85 bp, Caenorhabditis elegans; identical to SEQ ID NO: 103431

SEQ ID NO: 103519 - DNA, 97 bp, Caenorhabditis elegans
ccacttagcacatctttcattagctggaaaaatgtttttttatgaatcatatcctcgtagcaaacgttggaaaaatcggtgactatttgctatgtgg

SEQ ID NO: 103520 - DNA, 98 bp, Caenorhabditis elegans
aggtgtcaagagtaaggcatatgagttggtgggaagactcgagttgaggggattgatcattccactataggcacagaaatgtttatttttgtctgact

SEQ ID NO: 103521 - DNA, 117 bp, Caenorhabditis elegans
tcaaagttagcaccacaggttgttctgactgtttcaaaagcttgtagtatcttaataaataaacatataagctcgtgatcaacaggcagaacaactcggttttgtgtgcacgctgat

SEQ ID NO: 103522 - DNA, 94 bp, Caenorhabditis elegans
acgtgacagtacttggagacgtggtagacttgacaagtgattttggagaagtggttattggtgttctaccttgtttaaaaggagtgtttgaagt

SEQ ID NO: 103523 - DNA, 85 bp, Caenorhabditis elegans
tattcaagtaatgtagcaaaatgtatttaaatacatttgtgacgtcacaaatgtatttaaatacatgtttttatatacttaaata

SEQ ID NO: 103524 - DNA, 101 bp, Caenorhabditis elegans
gactttatttataagttgttcaatgtggaaaattacggtttgttcagtggaatttactgtttttttttcaaaagttggtcgtatgcaaaattaaatatatc

SEQ ID NO: 103525 - DNA, 99 bp, Caenorhabditis elegans
gtcctttgttgggagaaaattctagtttcttattaaattcagtatacttgtagtctgatctctagtgttccgaacttttgttctcttgcaggagtggac

SEQ ID NO: 103526 - DNA, 84 bp, Caenorhabditis elegans
ccaaggaattggataataattttgtcttgaatatggattatatccatttggattgtatgtttgcatttgttgctgatttattgg

SEQ ID NO: 103527 - DNA, 101 bp, Caenorhabditis elegans
ccatacctgtcacctaaacgctgagcatctttcctcggatatctcaatttgtttttgtgtatgctaagattgatcggttctcgggtttggttacgggatgg

SEQ ID NO: 103528 - DNA, 113 bp, Caenorhabditis elegans
attggagacttcgatgttgtccataatgtttctgtgttctttttgacagattttgttgtagtttgataagttggtggcatagttgtagttgaggtagttgttgaagcagtagt

SEQ ID NO: 103529 - DNA, 78 bp, Caenorhabditis elegans
taactgttatggggttattcaagtatataaaaacatgtatttaaatacatgtttttatatacttgaatacagttgtga

SEQ ID NO: 103530 - DNA, 217 bp, Caenorhabditis elegans
ggctacgtgcctacgtggctacgtgcctacgtggctacgtgcctacgtggctacgtgcctacgtgcctgtgtgcctacgtgcctacgtgcctacgtgcctacgtgcctacgtgcctacgtgcctacgtgcctacgtggctacgtggctacgtgcctacgtgcctgtgtgcctacgtgcctacgtgcctacgttcctacgtgcctacgtgcctagtgc

SEQ ID NO: 103531 - DNA, 108 bp, Caenorhabditis elegans
gacgtgatattgaacatttagcacgtgaaagttttgaatatatttttcaaagttaaatatatacaaggttttttttaagtgttaaccaaattttcagatagaatggtc

SEQ ID NO: 103532 - DNA, 117 bp, Caenorhabditis elegans
cacatacacacacaactcggcgagccctctccgaatcagacgctttcaggctttgctctctctctgtgtcagttgagcaggcgagcgtctctttccggctcacttcgcgtgtatgtg

SEQ ID NO: 103533 - DNA, 60 bp, Caenorhabditis elegans
gggagagtggtgagaaatgggggagagtgctctcggtctctccgtctcaaaggatctctc

SEQ ID NO: 103534 - DNA, 114 bp, Caenorhabditis elegans
tgataatgtttaatcgtattgatacgagctcgatcaaagaactctttttgaacatctgcatgtggagaaagtagaagatagattgtattggctccgtatcgatccacagcatca

SEQ ID NO: 103535 - DNA, 87 bp, Caenorhabditis elegans
ttattcaagtaatgtagcaaaatgtatttaaatacatttgtgacgtcacaaatgtatttaaatacatgtttttatatacttgaataa

SEQ ID NO: 103536 - DNA, 117 bp, Caenorhabditis elegans
atggcaattctccattgactgtttggatgttctcggacgttcaaagctacatccaacaaattggtagctttgtactccgatgccattcagatagttatgagccatggatgtattgtt

SEQ ID NO: 103537 - DNA, 111 bp, Caenorhabditis elegans
aaaacgggcgccatttcgagcggctttcaacgacgatatcaaccgacaactcacacttttgcgtgttgatatgttgtttgaatgccccttgaattggatgccacaggtttt

SEQ ID NO: 103538 - DNA, 78 bp, Caenorhabditis elegans
gaaccaccctgtctctatttctctcgattcactctctctctcgaccttcagttaatcggaaatgagagaaaggtgttc

SEQ ID NO: 103539 - DNA, 85 bp, Caenorhabditis elegans; identical to SEQ ID NO: 103225

SEQ ID NO: 103540 - DNA, 102 bp, Caenorhabditis elegans
gacacgcttttctggaaactaataacaaatgggcataattttttacacacgtaaataccgtacacctagttggttctatggtttccagtcagaataaatgtc

SEQ ID NO: 103541 - DNA, 68 bp, Caenorhabditis elegans
cgcttgagaaggtggcgaagacggagagaggtcagtactctttctctgtctctttctacatcaagtcg

SEQ ID NO: 103542 - DNA, 94 bp, Caenorhabditis elegans
acgttattccaaatgaacaggacaatccagaagtgagttaatgaaataatttgaaacattttttcgtttataattctgttcatcaggaagtagt

SEQ ID NO: 103543 - DNA, 100 bp, Caenorhabditis elegans
ttagcaatacaatcgaaaatatgtcaagattatggaattccaagaatgataaatgttgagatttcagtgtgaacagagaaggtttcggacttgttgctaa

SEQ ID NO: 103544 - DNA, 114 bp, Caenorhabditis elegans
gcgacaaatgtggaattttttttttgaaaaactaaatagttttggcgcgaaatttgaaatttttatttttttttgtgctcaaaattcaaaataaaaattaattaaatttggcgc

SEQ ID NO: 103545 - DNA, 112 bp, Caenorhabditis elegans
tcggaagaattgggaaaaaatcaaaatgtttgtgcatccttttgatttctgaagttttgatttcaatagaagtttgaatagagcacaattagatgcaaagtccttaaaccga

SEQ ID NO: 103546 - DNA, 90 bp, Caenorhabditis elegans
ccacttgttcattcaaagaccatttgaaatgtgagaagtgaatggtttagatcatgcttttcatgttgcgtgaaatttgacctaaagtgg

SEQ ID NO: 103547 - DNA, 103 bp, Caenorhabditis elegans
ttctcattgtgtgtcgtttttttttgaataaatgtggtttacaagcgacacgtgcagattgttgactggaaccactcgcgtccaaaaacgacttggtgcagaa

SEQ ID NO: 103548 - DNA, 107 bp, Caenorhabditis elegans
tcagcatctgaattataaaacatcgcctaaccgttgtcatgtaatatttcccagagaaaatgatattacatgtttcgggtaggagctgttcaaactttggacattgg

SEQ ID NO: 103549 - DNA, 118 bp, Caenorhabditis elegans
tttgaaaaataagttcaatttttggatccctgcagtttcgatgattttatccttaattctgaagatgtgataaatgcatcttaactgcggtgatctagatcatgaacacttttttaaa

SEQ ID NO: 103550 - DNA, 117 bp, Caenorhabditis elegans
gcctgctcacttgtccgaaaagtccgtctacccgtagctcctatccatgttactggtcaaaaagtgaacatggaagcaggtacaggtgcacggcgagtagggtcatgaagctggggc

SEQ ID NO: 103551 - DNA, 94 bp, Caenorhabditis elegans
ccgattctgacagtccacccgtacatttgtttccgtgcttgacttcaaagctcaatcacggcacaatatatgggtcgccagtcattgtagtcgg

SEQ ID NO: 103552 - DNA, 82 bp, Caenorhabditis elegans
taatgctgacagaacagagaaaacatacctctattgggtactgatgggggccaatagttgtcctgtgaattgtgtgacattg

SEQ ID NO: 103553 - DNA, 150 bp, Caenorhabditis elegans
tttgagttgatctagatatgacatcgtcctgaaaacgaaacggaacaaaagttcaagatattgatttcgaatcgtttatcaggatgatgtgattaaaatcaactcggacggtaagcgagagttttcaattatttttaacttttttttggt

SEQ ID NO: 103554 - DNA, 118 bp, Caenorhabditis elegans
cttttttgtaaaaaatttggttgccgagttggaaccaattgatttgagcttcattatttttgaatattctaaatagttaaaggtctatatcttggcaaccaaattttttacaaaaaag

SEQ ID NO: 103555 - DNA, 81 bp, Caenorhabditis elegans
tgctctgaaaatcgtagtttttcaacaggaaatatattgaaattcaatataaaatttttgtcaaggttgattgccagagca

SEQ ID NO: 103556 - DNA, 124 bp, Caenorhabditis elegans
tgcctatcacctcacaatctctcgttctcttttcttccaatgcatcaatatttgaatatcaataaaatgtgcaaatgagagaaaagaggacaagaatgaatgaagaggaattggtaaaggtggt

SEQ ID NO: 103557 - DNA, 104 bp, Caenorhabditis elegans
caccatgtcccacttgtcatctggcatgcaccctagtgactttagtggacatctaagtcttccaactaaggcacgcggtgaatgccacgtggccatgatggggc

SEQ ID NO: 103558 - DNA, 80 bp, Caenorhabditis elegans
ctctgggataatgacgagaaagacgagtgaaattgttgacatttcacagccacttgtcggcttttctcggtatgacagag

SEQ ID NO: 103559 - DNA, 66 bp, Caenorhabditis elegans
agccaatcgatgaactaacagtgctggcactcgacgctggcctattgtaaggattgtagactggct

SEQ ID NO: 103560 - DNA, 98 bp, Caenorhabditis elegans
gtctcctcatgtttacttgggtttagcggagagtttgtggtgtctctctctctctttgactatgtgtaccgtattattcaagaaagtcaagagggtgc

SEQ ID NO: 103561 - DNA, 117 bp, Caenorhabditis elegans; identical to SEQ ID NO: 103221

SEQ ID NO: 103562 - DNA, 117 bp, Caenorhabditis elegans; identical to SEQ ID NO: 103221

SEQ ID NO: 103563 - DNA, 70 bp, Caenorhabditis elegans
acggtccctctcactcactctttgcgctttcattcagaaacggagacgtgcagtacaacagaggtactgt

SEQ ID NO: 103564 - DNA, 116 bp, Caenorhabditis elegans
ggtaaccaaaacgagaagagtaaaggtgtgcatgttgtctgttgaaaatacaactagtaggttggatatttataggagattttagtttgtatgaacaactggatgtcgtcgtcgcc

SEQ ID NO: 103565 - DNA, 118 bp, Caenorhabditis elegans
gcagtctggaataaagacaaatttaaggcaataatgctaacgttcaaatagaaacttgagatttagttgttaattttgaaagtttgctttaaaaaagctcttcaaattcggaatatgc

SEQ ID NO: 103566 - DNA, 81 bp, Caenorhabditis elegans
tcatcaacttatggggttattcaagtaatgtagcaaaatgtatttaaatacatgtttttatatacttgaataaggttgtga

SEQ ID NO: 103567 - DNA, 80 bp, Caenorhabditis elegans
ctggtccagaagagagagagcagttagtttcagacgaagaatcggatgttctggaaatactaatttctgttctctgccgg

SEQ ID NO: 103568 - DNA, 115 bp, Caenorhabditis elegans
tgttcttccaactctaacagtccacccgtacatatgtttccgtgcttgacagcgaagctcaatcacgttacaatgaaagggtagccggttattgaagttgggtcttttttgggcg

SEQ ID NO: 103569 - DNA, 107 bp, Caenorhabditis elegans
cgcaagatatcggatgtcgttggctatgtctaattatatttgtttgaatagggaattttgttgctttgccgaaaaatatgtgctaaacgaacactttgtgtgttgtg

SEQ ID NO: 103570 - DNA, 117 bp, Caenorhabditis elegans
tctaaaaaatacgaaaaatggtcaaaatttgaagctagttttgcggaaaaatacattttttttttcgaaattccggaaaattggagaaaaaattgagaatttttggaaaaaagggga

SEQ ID NO: 103571 - DNA, 87 bp, Caenorhabditis elegans
tgtgaaaaaactgggtctcgcagcgatattctgattttcaccgaaaatttttaatattttttcgctccgagacccaataaatttaca

SEQ ID NO: 103572 - DNA, 87 bp, Caenorhabditis elegans; identical to SEQ ID NO: 103244

SEQ ID NO: 103573 - DNA, 100 bp, Caenorhabditis elegans
gcattattttacaactagcgattttcagcagaaatctctaattttttttgtaaaaatccgagcttttggcttaaaatccagttttgtaaactattttggc

SEQ ID NO: 103574 - DNA, 114 bp, Caenorhabditis elegans
cgtttttcaggtcgtaaacgctttcaaattgttaacaaaatttttgtttttgaaatggcatcagcttttttaagaaaacgcaacatttttggattgaaagtcgttgggaaagcg

SEQ ID NO: 103575 - DNA, 87 bp, Caenorhabditis elegans; identical to SEQ ID NO: 103535

SEQ ID NO: 103576 - DNA, 118 bp, Caenorhabditis elegans
ttgcgttcttctccaaattttcatgtttatcattcgttttcggtataaaactgtttttcatttaaaatatagtccttgattgaacctgataaaatgaaaatatggagaaaaaacacaa

SEQ ID NO: 103577 - DNA, 117 bp, Caenorhabditis elegans
gagactcaaagcggaaaatgtgtgcgccttgagcttgcaacgacactccgcaattacagagtgcgtgttgtttagtcaaattggcggatgtttaaatttaggtttttattgagtttt

SEQ ID NO: 103578 - DNA, 87 bp, Caenorhabditis elegans
ttgttcaagtaatgtagcaaaatgtatttaaatacatttgtgacgtcacaaatgtatttaaatacatgtttttatatacttgaataa

SEQ ID NO: 103579 - DNA, 101 bp, Caenorhabditis elegans
tggagagaaaactgtcggaaaatgttggacgaagtttaatcagtgaggttttgttgaaaagtttagaagaaacatttttgaaacagtgaaaaaaatttcca

SEQ ID NO: 103580 - DNA, 101 bp, Caenorhabditis elegans
cgattctaatgatatgtaatgatttttgttaaaattccattgagaataaatcatctttgttgatatttttttaaagtttttattgaatgtcgtttatatcg

SEQ ID NO: 103581 - DNA, 63 bp, Caenorhabditis elegans
gcggagagagtgagtgagaaagggaatgagcgctcaaattcactctcactcacactcacacgc

SEQ ID NO: 103582 - DNA, 94 bp, Caenorhabditis elegans
gcaatttcaatcaaagaaattgaaaaaatgacaatatttcagtgagaaaaccgataaattttcatagtttttgatgtcttagagctgattttgc

SEQ ID NO: 103583 - DNA, 79 bp, Caenorhabditis elegans
ggaaaccgcaggagagatgagacctgagagagatcagaaatcactctctcacagtctcttattcctattcctgattttc

SEQ ID NO: 103584 - DNA, 98 bp, Caenorhabditis elegans
ttttgattttgacaactttttgaaacaggaaattttttttggatttttttcattgaaaaaaaaatccactgtttcaacattgtgattaattttcaaag

SEQ ID NO: 103585 - DNA, 91 bp, Caenorhabditis elegans
ggaaaacggagattttttactgtttgaaactttttgaattttaaaatccgaattttatttttcagaatttaaaaatgttctccttttttcc

SEQ ID NO: 103586 - DNA, 87 bp, Caenorhabditis elegans
tttgttttcgaaaaggaggacacattgagattgcatcccacatattacggtacttgatctcatgtgtttttcttgacgtcatataaa

SEQ ID NO: 103587 - DNA, 104 bp, Caenorhabditis elegans
tttccctctctccactctgcgtctcacactctcttcccgcacgttggcactctgccaaagtgtgtagagagagtggagaaatagagagtgagacagaaggttaa

SEQ ID NO: 103588 - DNA, 86 bp, Caenorhabditis elegans
ataactggagagctgaaaatctaggttgaatagatgtacttttaaagtcttttcatactataggttacagtttttttttgagttat

SEQ ID NO: 103589 - DNA, 84 bp, Caenorhabditis elegans
agagttgggggaaacttgggttagactttggtaaagcttgaatccaagttttgccaaagttttgcctaacttttgcccaagttt

SEQ ID NO: 103590 - DNA, 97 bp, Caenorhabditis elegans
ttcacctgcctcttggaaaccatgcaaaactgagagagtttatgattagaaacaacttatcagtaatttgcgatgggggtcagtgattggtggggaa

SEQ ID NO: 103591 - DNA, 117 bp, Caenorhabditis elegans
taatatttttgaagcaccaaaactactgagttctgttcagttaaaaattactcaattttgtttcattttacaaaatctttggcgaaaaagtcaatagttttggtcagacttgtattg

SEQ ID NO: 103592 - DNA, 79 bp, Caenorhabditis elegans
gagacaggggaaaagtggtgtgaaaacacacaagtctctgcgtctagcggtgtgtaacactgtctgcgtctctgtgctc

SEQ ID NO: 103593 - DNA, 93 bp, Caenorhabditis elegans
tttgaatccactgtttcattgtgtctatatatttctctgtagatttttcaagtcagtaattagaaggcccggtggaactgcttggtattcagg

SEQ ID NO: 103594 - DNA, 108 bp, Caenorhabditis elegans
gagcttttttagacccaaaattgcttttaaaaagtgaaatttcagctgaaatctctttttttttgtagaaaattcggttttttggcgattttcggcctaagaaagctc

SEQ ID NO: 103595 - DNA, 80 bp, Caenorhabditis elegans
tcgcaaaaaaatcccgatttttatgattttttcaactactttttaggggaaaaatcataaaaattgcgaattttaggtga

SEQ ID NO: 103596 - DNA, 116 bp, Caenorhabditis elegans
actcggccaccgcttttttttgaaattcgacctattttccgagtattttttccacaaatttttgtttaaaaaaaactactcggccatcaatttctaattgagcaagactgggtggc

SEQ ID NO: 103597 - DNA, 83 bp, Caenorhabditis elegans
gagttttcacgacagtgatcacacactctgttactaacttcacccaacttttaaatagagtggatagatctgggtcaaaactt

SEQ ID NO: 103598 - DNA, 57 bp, Caenorhabditis elegans
acagctggcctctttccttcagacaactgacaggacagagagaggatagaaagttgt

SEQ ID NO: 103599 - DNA, 143 bp, Caenorhabditis elegans
cccgtcttgaaagttgaacggagtgaggggagagaaagacactttctctctctctcactgcctcagaaaattggcagcataggtctctctctctctcgaaaaactggggggagatgaagctgaagacgtcggttggcaaggag

SEQ ID NO: 103600 - DNA, 111 bp, Caenorhabditis elegans
gcccctttttctcgcgcgctttttttcctatttgaatgatgatgatgatgatggtcgtgatgatcgcaacatttgcaattctcgaaggacggctagggagtgtgagcgggc

SEQ ID NO: 103601 - DNA, 75 bp, Caenorhabditis elegans
gttatggggtgattcaagtagtgtagcaaaatgtatttaaatacatgtttttatatacttgaatacagttgtgac

SEQ ID NO: 103602 - DNA, 102 bp, Caenorhabditis elegans
gtttcagaacatttcaactctttcatatattttctgaaaattgtaaatttttattaacgaattttcaggcaaaattttgaaaaagaattgggattttcggac

SEQ ID NO: 103603 - DNA, 85 bp, Caenorhabditis elegans
gttgctgaaaatcgccaatcggatggggtctacctgaaaattgcaaaattttttgtttttgatctagcaaaacgcgatcggcggc

SEQ ID NO: 103604 - DNA, 87 bp, Caenorhabditis elegans
tgaaaaaccatcacaaattcgattttgcgatgcatataagaaatgaccgcaatgaaattatctatctttatttgtgatgaattttcg

SEQ ID NO: 103605 - DNA, 104 bp, Caenorhabditis elegans
gcaaatttatgaaaatttacgtatttctcgagaatttttattttttgtaaattacagttcgagaaaatctcgagaaatacgtaaatttttctgtgaaaatttgc

SEQ ID NO: 103606 - DNA, 111 bp, Caenorhabditis elegans
agggaaaaatcgatttttcagtggaaaattggaacaaaaaaagtgaatttttacattttttgaaaactttaaatttttcaccaaaaaatcgcagaagaaggatttttctct

SEQ ID NO: 103607 - DNA, 118 bp, Caenorhabditis elegans
gaaatttagtgaacagtttgggtctcaccgcgaaaacttaaaaacccctctaactctgtcagtttttgagattttttcatgatttttgggtagatcattcaaaattttgttacgtttt

SEQ ID NO: 103608 - DNA, 115 bp, Caenorhabditis elegans
tgattttggagtgttttctccattatttttcgagttttgatattattttttcaagatttcaataattttggataaatacattgaaaaaacactgggaaaaaacactccaaaatca

SEQ ID NO: 103609 - DNA, 90 bp, Caenorhabditis elegans
tccaagtgacgaaccaaattattgtcgagcatcattttcttgaccgaataggcaagagaaagagtaacagcaagtggaagtccttctgga

SEQ ID NO: 103610 - DNA, 91 bp, Caenorhabditis elegans
gctcgtcatatccattgccctactcttcgcatctcatcacttcgtccaataccatagggatgagatcgttcagtacggcaatggactgagc

SEQ ID NO: 103611 - DNA, 119 bp, Caenorhabditis elegans
tttgatttttttggattaattgttcttgttatattgcatatcggtgaaaatgaatattagtacttgattatttatgtattgatgcactacatacatacagtgcgccaactgctatcgga

SEQ ID NO: 103612 - DNA, 95 bp, Caenorhabditis elegans
cgctcactttctctaattctccgcgtttcgtgtactctctcgcactttctctcgggcgatcacatgtttgctgaggcagagagagaaagtgagcg

SEQ ID NO: 103613 - DNA, 67 bp, Caenorhabditis elegans
attttcgctcactttctctctctgcctcagcaaacatgtgatcgcccgagagaaagtgcgagagagt

SEQ ID NO: 103614 - DNA, 102 bp, Caenorhabditis elegans
aaaatgtttgcagctgtcatggtttttgagaaaaaagcgttgaagcaaaagtaaacggaaaatctttttttttttgaaaacctatgatctacattacatttt

SEQ ID NO: 103615 - DNA, 95 bp, Caenorhabditis elegans
agaaaatcacttatggggttattcaagtaatgtagcaaaatgtatttagatacatgtttttatatacttgaatacagttgtgacgtaatttttct

SEQ ID NO: 103616 - DNA, 114 bp, Caenorhabditis elegans
gggtgagttttttttgagaactccaaaaataattttattggaaattcgaacaaatttgtttttaatttcaaatcatcaatttttcaggaagtatgtcagaaataatgttcacct

SEQ ID NO: 103617 - DNA, 98 bp, Caenorhabditis elegans
ggtaagaagctgctgagagctaaagttgggcaagaagctgcaggtaaatgccgagatagttttttttttcaaaaaatggcataaactcagttattgcc

SEQ ID NO: 103618 - DNA, 108 bp, Caenorhabditis elegans
gtgccaaaagcggaacgagcgtaaactttaaagtcatgattatagaaacaaatgtgaatttgttctagacttacatgccaagtaattgcttgtatctttatttggaac

SEQ ID NO: 103619 - DNA, 84 bp, Caenorhabditis elegans
ttttagcttagaaacggttatttttaaggtagttacaggctttttggcttaaaatgagctattttatacttttttaagcttaaa

SEQ ID NO: 103620 - DNA, 58 bp, Caenorhabditis elegans
gtgaagagaggcagagttcttagctgatttcgcacggtaaagaacgtgctgaagtcac

SEQ ID NO: 103621 - DNA, 91 bp, Caenorhabditis elegans
cgtggctcgcgagagtattgcgtaggcctttgcttcgagagagaagcttcagttcgcagcaatatcctccgcaaaactttccccggctatg

SEQ ID NO: 103622 - DNA, 116 bp, Caenorhabditis elegans
cacagaaattctgttcacgcataagcctgatatctcggtgcgatcgtaccgtatcgctcacacttagattacggtacgatcgcggcgggatatcaggtacgtgattggaagctgtg

SEQ ID NO: 103623 - DNA, 67 bp, Caenorhabditis elegans
gggtcttgtcttctggaattgttctatttttatttagaaaaagagccgagacttggaagtgtgaccc

SEQ ID NO: 103624 - DNA, 85 bp, Caenorhabditis elegans
aggcatttttgtgcaataggaggcattttgtgtaggcagaaaaatggatgcctgcctgcctgcttgccaacaaggctgcctacac

SEQ ID NO: 103625 - DNA, 90 bp, Caenorhabditis elegans
ctacctgcctgcctgcctgcctgcctgcctacgtacttccggaatgttagtatattggtagccacatgtgtaggcacgggacaggcgtag

SEQ ID NO: 103626 - DNA, 94 bp, Caenorhabditis elegans
gcaactgaaacagcatgcgacctcaagactcgttcaaaatttttgattttcaattcaaattgtaaaagttaggattacatgcagtttcagttgc

SEQ ID NO: 103627 - DNA, 96 bp, Caenorhabditis elegans
aggtatatacagggtgtgggcctgaaaaaaaacagatctttttttttctaaacagatctttttttttctgagccacgtttttttctgtttacgcct

SEQ ID NO: 103628 - DNA, 112 bp, Caenorhabditis elegans
gggccaaagtttggcaagagttgggtgaaacttgggttagactttggtaaagcttgaatccaagttttgccaaacttttgccaaacttttgcccaagtttagacagcttctg

SEQ ID NO: 103629 - DNA, 113 bp, Caenorhabditis elegans
tgggccaaagcttggcaagagttgggtgaaacttgggttagactttggtaaagcttgaatccaagttttgccaaacttttgccaaacttttgcccaagtttagacagcttctg

SEQ ID NO: 103630 - DNA, 113 bp, Caenorhabditis elegans; identical to SEQ ID NO: 103629

SEQ ID NO: 103631 - DNA, 112 bp, Caenorhabditis elegans; identical to SEQ ID NO: 103628

SEQ ID NO: 103632 - DNA, 114 bp, Caenorhabditis elegans
tttttgtaaaaaatttggttgccaggttggaaccaattgatttgagcgtcattatttttgaatattctaaatagttaaaggtctatatcttgggaaccaaattttttacaaaaa

SEQ ID NO: 103633 - DNA, 108 bp, Caenorhabditis elegans
ttagcagtttactttgagccacactcttcatatggcagttcctttttttaagtttaaaattgcaggtaaaaatgccacagggagaagtctcattctttgaggtgctga

SEQ ID NO: 103634 - DNA, 114 bp, Caenorhabditis elegans
atcctggttcgctggagttacagccagaatgatagaagaaggatttgaaatgtagagaagaatcatttcacggatttgctcttcaatattgactggttgatcaccaactgggat

SEQ ID NO: 103635 - DNA, 108 bp, Caenorhabditis elegans
cattttcctccttatcccgttcgcaatggcactgcatgaattcacggctatgcataacgacagaccgcggatcatacggtaccatagcggacggtgatgaggttaatg

SEQ ID NO: 103636 - DNA, 101 bp, Caenorhabditis elegans
gtttcggttttaatcagctgacctgtgtgtatgtctgtgtatgagtgagtggcagcaaaaagacaaacacgtgaagtttttgaatagtgacaaattgaaac

SEQ ID NO: 103637 - DNA, 109 bp, Caenorhabditis elegans
ctcagtttctcaacacggtacggtgtcaactgatgactgtttttgttgtagtcaactgactgcaatggcccagtttcttttgttccacaaacgatcagagatgactaag

SEQ ID NO: 103638 - DNA, 114 bp, Caenorhabditis elegans
ttgtcagaagaagtgcacacagacacaatcatgcctgcctgcctgcctcaatgtcaacctgataatttaaaaatgctcgcaggcaggcatgtgtcaggcacgtctttctgataa

SEQ ID NO: 103639 - DNA, 100 bp, Caenorhabditis elegans
gggtcaaagtttggcaagagttgggggaaacttgggttagactttggtaaagcttgaatccaagttttgccaaacttttgcctaacttttgcccaagttt

SEQ ID NO: 103640 - DNA, 113 bp, Caenorhabditis elegans
tgggccaaagcttggcaagagttgggtgaaacttgggttagactttggtaaagcttgaatccaagttttgccaaacttttgccaaacttttgcccaagtttacccagcttctg

SEQ ID NO: 103641 - DNA, 102 bp, Caenorhabditis elegans
cggatttcaaaccaaatcaaaaaccgccattacgaaattttctagttcaaattttcagttttcaaaatatggcaattttgatttgtttggaaaaaaatttcg

SEQ ID NO: 103642 - DNA, 87 bp, Caenorhabditis elegans; identical to SEQ ID NO: 103244

SEQ ID NO: 103643 - DNA, 105 bp, Caenorhabditis elegans
cttgaaaataatcaaatcattacaacagaattatgtgaggagttatgtatttatttagaaactttttagttaaattttgtaacttgtattgaagattattttagg

SEQ ID NO: 103644 - DNA, 105 bp, Caenorhabditis elegans
ttgagatttgcagatcatacatgttaagctgagtggaattgttggagctgaaaaatgggaagtttctttatttttataaaaggtttcctgtacctggaatctcga

SEQ ID NO: 103645 - DNA, 76 bp, Caenorhabditis elegans
gcattcaaggttgccgacagctgcctagtgcctagacgtgtgcctactcgctctctcactctgtaaaccttgaagc

SEQ ID NO: 103646 - DNA, 87 bp, Caenorhabditis elegans; identical to SEQ ID NO: 103535

SEQ ID NO: 103647 - DNA, 104 bp, Caenorhabditis elegans
cagtaatggggttattcaagtaatgtagcaaaatgtatttaaatatatttgtgacgtcacaaatgtatttaatacatgtttttatatacttgaatacagttgtg

SEQ ID NO: 103648 - DNA, 101 bp, Caenorhabditis elegans
tgcaaaacagtctgagttttctgatttgataagaaagttgttatgaacaatttgaacaattttttaaatatttggaggattcatgagaatattgaaatgca

SEQ ID NO: 103649 - DNA, 104 bp, Caenorhabditis elegans
attatagctcttggattcgtgcagcaatgtttgattttgttcttgaaatgaagaatagttctactagtattgatgatgaagatgatacaatgagcacttatgat

SEQ ID NO: 103650 - DNA, 86 bp, Caenorhabditis elegans
tgcaaaatttcaagaaaattctaaaaagtcttgtgaattttttgaaaaattctaggaacttctagaaatttctaggaagtcttgcg

SEQ ID NO: 103651 - DNA, 111 bp, Caenorhabditis elegans
ctggtgacaatgttctttgagctccttctccagagaatttcttttttagatattcatatactgaaagataagcggctgaagctgggatgtctctgagcagagtggcaccag

SEQ ID NO: 103652 - DNA, 111 bp, Caenorhabditis elegans
tgcatatgcaaattgtaattttttggttagtttcggtctctctatctcactctcgggtgtcgttttttgtgagagagaggcaaagagaggcgggccttttttgcatcagca

SEQ ID NO: 103653 - DNA, 93 bp, Caenorhabditis elegans
gggacaaatggccggtctctctctttctcattctgtcaaagtactgtatattgatcgaagagacagagacacgtagagagattgaccagtaac

SEQ ID NO: 103654 - DNA, 98 bp, Caenorhabditis elegans
agcaccactcggaaccactgaatttatgtgtgtacttgacggccaacaagagcatcgatctagcaccatataaattcagtaatttcgcgtcgagagct

SEQ ID NO: 103655 - DNA, 85 bp, Caenorhabditis elegans; identical to SEQ ID NO: 103225

SEQ ID NO: 103656 - DNA, 83 bp, Caenorhabditis elegans
gaggtatttgctgatgaattgaagttgaagggtggcgggtccatcacctgtaaaatttttatttatgtcagaaaagatgcttc

SEQ ID NO: 103657 - DNA, 83 bp, Caenorhabditis elegans
gaaaatggccttgatcgtgtaatgacggacggattggtggccccgtgggttctgtctctctctcaccgccgtgtcgacttttc

SEQ ID NO: 103658 - DNA, 107 bp, Caenorhabditis elegans
tttttctccaaattttcatgttcatcattcgttttcggtataaaactgtttttcatttaaaatatagtctttgactgaacctgataaaatgaaaatatgaagaaaaa

SEQ ID NO: 103659 - DNA, 98 bp, Caenorhabditis elegans
ttttctttttgggacacttcgagtatatgcaagcaaaccaaaggaaaataagtttttctttttgagtccgagtcactctactttcccaaaacagaaaa

SEQ ID NO: 103660 - DNA, 84 bp, Caenorhabditis elegans
agagttgggtgaaacttgggttagactttggtaaagcttgaatccaagttttgccaaagttttgcctaacttttgcccaagttt

SEQ ID NO: 103661 - DNA, 68 bp, Caenorhabditis elegans
gatttcttgtgtgtttcttgatgacattctagcaaattaccggaattttattaaaacacaatgagatc

SEQ ID NO: 103662 - DNA, 108 bp, Caenorhabditis elegans
gttttaggcaaaagacagaacgatgagtcagattttttatatttagtactcatactttatagatggtattgtgaatgtgaggttatgtattgttattctgcataaaac

SEQ ID NO: 103663 - DNA, 96 bp, Caenorhabditis elegans
ttcaaatttgtcatggcttggaatggatagaagattgttgagacgatgggtatatcagatttcttattctgttcgtaaagtctggatcattttgag

SEQ ID NO: 103664 - DNA, 83 bp, Caenorhabditis elegans
gtgtattgtctagttacagtagtctgcagatttgtagaagttgttacgtttgcatcactactccgaacaatgtagctctgcac

SEQ ID NO: 103665 - DNA, 115 bp, Caenorhabditis elegans
atctccgcggaaaaaatgttcatgatcaagtgattaactacaaagttgtttatcctaatttagaaaacaactttgtagttgaccggtttttgtcaaaaaatttgttggtcgagat

SEQ ID NO: 103666 - DNA, 87 bp, Caenorhabditis elegans; identical to SEQ ID NO: 103244

SEQ ID NO: 103667 - DNA, 82 bp, Caenorhabditis elegans
cggagtaggaaaacgttctggaagttgtttgaaactttattttcatttgaataacttctgaaaaatgttttcacccaattcg

SEQ ID NO: 103668 - DNA, 118 bp, Caenorhabditis elegans
ctttcttttaaaaaatttggttgccgagttgggaccaattgatttgagcttcattatttttgaatattctaaatagttaaaggtctatatcttggcaaccaaattttttacaagaaag

SEQ ID NO: 103669 - DNA, 106 bp, Caenorhabditis elegans
cattatgttcttgtcttgattcgatttcacagtgatgaatcaataattgatattttgaatactgattttgaagtcattgtggggataggagatgtgggaagatttg

SEQ ID NO: 103670 - DNA, 74 bp, Caenorhabditis elegans
ctatctcgttgtctgtctctctaaatgtctgcgactactggacagagagagtgtcttaccgacccgtgagatag

SEQ ID NO: 103671 - DNA, 107 bp, Caenorhabditis elegans
gtctcgttatataatgaaagatctgggacagagataagaatatttcatggaaagggcacgtaaatatttaaatttctttgaaaaggtcattcattgtttttcacagc

SEQ ID NO: 103672 - DNA, 74 bp, Caenorhabditis elegans
ttaggatattctttaattttttctagagttctaaagaaaaatgagacgctctagagaaaagttgaatatgttgg

SEQ ID NO: 103673 - DNA, 95 bp, Caenorhabditis elegans
tgaaaaaaacgagagtttttttttagttgattgggctaaaatcttttttatttttggaacatcaactttcttggaagaaatttggatgtttttcg

SEQ ID NO: 103674 - DNA, 88 bp, Caenorhabditis elegans
ttttttttaaaattcggtaatctaaacttttcgaaaatatcgaaaagctcaatttttatttttggaattactgaattcattctgaaaa

SEQ ID NO: 103675 - DNA, 110 bp, Caenorhabditis elegans
tcatattgcaatttaaatacctgcaactgaactatatgtagtcagttggtaaataattagaactgattatgaagttcagaaaatttcaggtattaaattacaagtgttga

SEQ ID NO: 103676 - DNA, 117 bp, Caenorhabditis elegans
gtaagttcggttcagtcattgaaacgagtaaatctcatcctaatctggtagcatctttcgaaccttgccaccgatttggcatgggattgacttgttaaatagtgacttttttcttgc

SEQ ID NO: 103677 - DNA, 95 bp, Caenorhabditis elegans
gaaaatgcatgaatactcgtttggaggatggcatgtggaaatgaaatgaaatgttattttcaagctatatcttcaggattgtggaatgaaatttc

SEQ ID NO: 103678 - DNA, 85 bp, Caenorhabditis elegans
aatccagcaggttttctttttgaatttattggaacgctatcatcatctggtttaaattcattttcaaaatgatacacgctggatt

SEQ ID NO: 103679 - DNA, 118 bp, Caenorhabditis elegans; identical to SEQ ID NO: 103668

SEQ ID NO: 103680 - DNA, 148 bp, Caenorhabditis elegans
tttgcccgcctctttcttccgaaatcttgattcgaaacattttggagaggaagtggctttgaagcggcaagaattagaagcagtttggtgtcagacacactactcactcactgcttcttgttttttctgctttctttgcttttcctct

SEQ ID NO: 103681 - DNA, 67 bp, Caenorhabditis elegans
ccagtacatagtgactctgattttccgagtgaactctcagaagatacacagcagctacatagactgg

SEQ ID NO: 103682 - DNA, 90 bp, Caenorhabditis elegans
gattcttgatagagggaaattttgacaaacttaagttatgataaattaattttattcttaagaatgtctgactttctgactgtctgaatt

SEQ ID NO: 103683 - DNA, 103 bp, Caenorhabditis elegans
cataactcacccatatcgacagcagcctcagaggtgcagaacatataatctaaaaaactgagagaactgacagaggttggatggcagagtaagggtgtttgtg

SEQ ID NO: 103684 - DNA, 102 bp, Caenorhabditis elegans
tgttggttcgaaagatgacgacgagccaaagtaaacacggcctcttagatattggggtcgtccctctgtgcctctctctattcgcttcgtttattatcaaca

SEQ ID NO: 103685 - DNA, 93 bp, Caenorhabditis elegans
gggtcttcggaccacgccttcagttgcctcgtgatccgccaaacacaataaatggacgaatcacagtcaactgttggcatggtgctcgtaccc

SEQ ID NO: 103686 - DNA, 90 bp, Caenorhabditis elegans
atcgctgaacctcgagatgggttacggggcttagtccttcctccgtatggcaatgactagaaccgttactcatctcgaggtttcggtgat

SEQ ID NO: 103687 - DNA, 74 bp, Caenorhabditis elegans
ataattacgttgttaaatttgaaacctggtaaatatatatatatatcatgttttagatctaataacatagttat

SEQ ID NO: 103688 - DNA, 94 bp, Caenorhabditis elegans
ggttgtgccatccggccgcctgatactttcgtctcaacctcgctgtcagattggtcgtaggtgagcaaagtttcaggtgtgccggaacacaccc

SEQ ID NO: 103689 - DNA, 103 bp, Caenorhabditis elegans
tcggtctgaaaacaagatggaagttttctaagtttttttaaacaattgacctggttaaaaatgtgttatattgttttgaaaattctacatttgtccagattga

SEQ ID NO: 103690 - DNA, 82 bp, Caenorhabditis elegans
tccaaaagcttgacatttgacaactgtttgccaacttaccgaaaatttcactgcaaatttcaaaagtatacaagtttttgga

SEQ ID NO: 103691 - DNA, 100 bp, Caenorhabditis elegans
tcgtttgtcgtttcttttttcttctattatacattatatatgaaacaatatttcatatttcatatactcgtgatgaataatagagatgcgattcacacga

SEQ ID NO: 103692 - DNA, 118 bp, Caenorhabditis elegans
ttgtattactgtgagagtcaattgggagatacggtggttaatgtggcaaaactaatttggtagtaaagatttgttagaataagaaatacatctccaaatcgaaaattacagaaatcaa

SEQ ID NO: 103693 - DNA, 103 bp, Caenorhabditis elegans
aatgtattttttgagcttcctaaatattgctttttatatgtttcaaaaaagagtaaaacttggagactggagcattatcaacagggaagtttaatactatgtt

SEQ ID NO: 103694 - DNA, 106 bp, Caenorhabditis elegans
atcatgagccacgtatgatttgtgtgtatatttataaaggaatgaatattttattatgtgatcgttcaattttaaattgtagcacataaagttgcacggctttgat

SEQ ID NO: 103695 - DNA, 92 bp, Caenorhabditis elegans
ggagggtcaaatgtggcaaagaaaagagtatcacacgagccccacaactcaatttgatattgtctgtgacttttgtcttcgttgcttcctcc

SEQ ID NO: 103696 - DNA, 116 bp, Caenorhabditis elegans
tcgtgacatttttcatgacaatttttgcaatttttctcactgtgtttattttgtttttacaaccaaaaaaagcgtgcgaagaattttttttttgaaatattcatgtttgctcacga

SEQ ID NO: 103697 - DNA, 107 bp, Caenorhabditis elegans
tgtggacgattttctgaatgaagttctggacgatttggctatttttcgaaagaaaacaagtatttaaatagagggtggttcaattcattatttataccgtcaaaaca

SEQ ID NO: 103698 - DNA, 112 bp, Caenorhabditis elegans
catgtagcttcttggagaaatgtagttgaatggagctaccgattgtccggataatctgaatgagtggaatattgattggtatatttaaactatttttaacgagaaaattgtg

SEQ ID NO: 103699 - DNA, 106 bp, Caenorhabditis elegans
gacgacttttacagccgatttaatgaaaaaaaaaaactcgaaaaatagcgcttcggaaacttttttttttcatttgagacgcgttgttccaatagaaaaggaagtt

SEQ ID NO: 103700 - DNA, 110 bp, Caenorhabditis elegans
caattaaccaattgaaactcccgggaacttgaggtaggctcagtagatgcgaattgaacggtatctcacatccaccagcctagctcgcattcccagagtttacggtattg

SEQ ID NO: 103701 - DNA, 98 bp, Caenorhabditis elegans
gcgggggtgtcaaagttgaggtaggtgcgagaaatgacggcatccatatagtaatcgttcattgtctctcagctgcttcatctgtgacatggctacgc

SEQ ID NO: 103702 - DNA, 98 bp, Caenorhabditis elegans
gaattcttatgaggaagtggtggaatagacatttattgcacacaaaaggatgtatgaattattctatttaaattccctactattttattactggattc

SEQ ID NO: 103703 - DNA, 92 bp, Caenorhabditis elegans
gaagcgtgtcctgtcgtcgtgctcctcctcttttatagtcttgtttatatatatacaaaaaagagagatggatgatgaatcagatttttttc

SEQ ID NO: 103704 - DNA, 104 bp, Caenorhabditis elegans
tgtgattacttatctctataagagtaccattttccatttcaatcctatgtgattctaacggtaaaaccgaagtgaagaaaatgcttataccacatagtatcaca

SEQ ID NO: 103705 - DNA, 68 bp, Caenorhabditis elegans
tcgaggaaacggggtacggtagacaactaaacgatcccgtggtgtcagcctgcctcattgcggttcga

SEQ ID NO: 103706 - DNA, 116 bp, Caenorhabditis elegans
tttcaatgtttttcaaaacggttaaaagtaggtaagcattctggaaaatttttgaaaatttttaaattttttcaaaaaatctgaaaaatttttgaaccgagtggagtggattgagg

SEQ ID NO: 103707 - DNA, 123 bp, Caenorhabditis elegans
agagaatgagagaaaagactgccgatgcggacgaacaaacggacggccggagcagtacacactcttcgtctctgactcacagcaacaccgtctctccgcttcttttctcactctctatctctc

SEQ ID NO: 103708 - DNA, 60 bp, Caenorhabditis elegans
ctctctcgctctctcattgcattttggaacatacagatagggagtcagagagatagagag

SEQ ID NO: 103709 - DNA, 100 bp, Caenorhabditis elegans
aatatgtcaccgcacttttccttcattcttgcacatcaatcactccgattctcggctcatctgtgggtgtgtgtgaggcgaaaaaaattggatacttgtt

SEQ ID NO: 103710 - DNA, 79 bp, Caenorhabditis elegans
gcaaaattttggcaagagtttggtaaaacttgggtgcagcctgaatccaagttttgccaaagtcttgcccaacttttgc

SEQ ID NO: 103711 - DNA, 75 bp, Caenorhabditis elegans
gattaaggttcgacggctgaaaaaacggtactctaactttgccgaactctgtcaaactctgtcgaactttttgtc

SEQ ID NO: 103712 - DNA, 131 bp, Caenorhabditis elegans
gccggtaaatcaaaatccatagcttcacggactgcatctgaggagtttgtagagttttgagctctttggtttccatggtcagcaatacgacgtcctccaacttttgttgctggttggtgaccgaccacagc

SEQ ID NO: 103713 - DNA, 99 bp, Caenorhabditis elegans
tggaaatcagaagctttttcttgggtttcttggagatttgagatagaatttttgtacttgtttctcaagttttcagacagaaaaaaaagtgtgttttca

SEQ ID NO: 103714 - DNA, 89 bp, Caenorhabditis elegans
gaccgacttgtcagcggctggatactaattttttttgaaattaccgactaattttaggtctaatagtatcaggcgttttcaagttggtt

SEQ ID NO: 103715 - DNA, 95 bp, Caenorhabditis elegans
tacgtttttttttcgtgcaaaaatttatttgcaaatctgaatatttttgataattttcaagttcgatttacaagtcttttgctggaaaaattgta

SEQ ID NO: 103716 - DNA, 90 bp, Caenorhabditis elegans
aattaaaaaatgtagtcatttatatgtctgaaggtcagtttttttttgattgaactgaaagcttctggcacctagaaaaattttttgatt

SEQ ID NO: 103717 - DNA, 80 bp, Caenorhabditis elegans
agacttctgaaatataacgttttttttttcatactgacaactacgtagttcagataaagaaaacggtgaggtggaagtct

SEQ ID NO: 103718 - DNA, 93 bp, Caenorhabditis elegans
gttgtgttagacgcattttcagcatgttgtgctcttcgtagtaaagttttgaattctgaggggatagtgagttggggttactgtagaggcggc

SEQ ID NO: 103719 - DNA, 118 bp, Caenorhabditis elegans; identical to SEQ ID NO: 103206

SEQ ID NO: 103720 - DNA, 112 bp, Caenorhabditis elegans
ggcaagtctaatttacggacagttttttcagttgcaaatttaaagggtgcaactttatttttatgaatttcacactgataaagaacaaatgtaaatcttcaagaatactgtc

SEQ ID NO: 103721 - DNA, 117 bp, Caenorhabditis elegans
atatttttttgacacgaagtttaaatttcatatgtgtataattttttgacagaaattttttaattttttcagaaaaaataatttggcgggaaattaaaattttgggcgaagaaatgt

SEQ ID NO: 103722 - DNA, 117 bp, Caenorhabditis elegans; identical to SEQ ID NO: 103721

SEQ ID NO: 103723 - DNA, 112 bp, Caenorhabditis elegans; identical to SEQ ID NO: 103720

SEQ ID NO: 103724 - DNA, 90 bp, Caenorhabditis elegans
ttttgaatttaaaaatctgaaaagttcgatttttcgaaaaaaattttttttttgaaaaaaccaactttttgcctttttttaatctcgaaa

SEQ ID NO: 103725 - DNA, 105 bp, Caenorhabditis elegans
cctgtgtgtgtgtgttgtctgcgtctccacagttccccgtactctctctccctctctaactagtcatgtaggggttgagggactgactgacagactatattgtgg

SEQ ID NO: 103726 - DNA, 87 bp, Caenorhabditis elegans; identical to SEQ ID NO: 103535

SEQ ID NO: 103727 - DNA, 83 bp, Caenorhabditis elegans
cgatgtgataccttatcaagtttctttgtttttctgagctcacggagcaggaaaaatgtgaggattggaaaggcaccacatgg

SEQ ID NO: 103728 - DNA, 93 bp, Caenorhabditis elegans
ccgctgagtatcaggagtacccagtgatcgccttcacatattgggaagaagtatgtgattgcgtcctgcagttcttccatgatgtactcaggg

SEQ ID NO: 103729 - DNA, 104 bp, Caenorhabditis elegans
gggctattcaagtaatgtagtgacgtcacaaatgtatttaaatacatgtttttatatacttgaatacagttgcgacgtaatttttctacactttttaattttcc

SEQ ID NO: 103730 - DNA, 118 bp, Caenorhabditis elegans
tgggccaaagtttggcaagagttgggtgaaacttgggttagactttggtaaagcttgaatccaagttttgccaaagtcttgcctaacttttgcccaaatttagacagcttctgatcca

SEQ ID NO: 103731 - DNA, 56 bp, Caenorhabditis elegans; identical to SEQ ID NO: 103444

SEQ ID NO: 103732 - DNA, 97 bp, Caenorhabditis elegans
atttggtagtttttcaacggttttttggtagtttaaatcaaaaatatcagttatttttgatttaaactaccaaaaaaccggtgaaaaaccaccaaat

SEQ ID NO: 103733 - DNA, 78 bp, Caenorhabditis elegans
gagagcattgagagctgagagagacgagagaaaacatggaacctctcgttgtctgccgtctcttcatctcatcattgt

SEQ ID NO: 103734 - DNA, 110 bp, Caenorhabditis elegans
agaaatttattgaattttcccgaaagttctagaacatttcagatattttttgaatttttcagaaaactctagaacattccagaactttctcgaattttttagaagattct

SEQ ID NO: 103735 - DNA, 114 bp, Caenorhabditis elegans
aaaaattttggcgggaagttcaaatttttttcgaaaacagtattgtcagaaatttcaaattttttagtacaattttgacgggaaatttaagtttttctgcaaacagatattttt

SEQ ID NO: 103736 - DNA, 96 bp, Caenorhabditis elegans
tagtttaattaaaaggttgactatgagagagcgcagagaaacgagacactctcgctgtctgcgtctcttctctaatactccagcttggataaactg

SEQ ID NO: 103737 - DNA, 129 bp, Caenorhabditis elegans
ctcagactttccgtgtacatttccattccggcaccacgtaagtagtcgttaagccagagaggggtgtgaggagactgcaaacatggggtggtgggttagatgtaggtgttaggtgaggcgagattagac

SEQ ID NO: 103738 - DNA, 104 bp, Caenorhabditis elegans
gggtttttgcacgcgcccacacaagagacgagagtgtgcagagaaagcagacacgctgtcagtctgcgctctccaatctctcgccgcggagcccacaaaaacct

SEQ ID NO: 103739 - DNA, 119 bp, Caenorhabditis elegans
tttttcatgaaattttcgatttttctggaaaatttttgaaaaaatcgattttttttgaaaatctttgaattatcgattttttcgaatttttcatgaaattttcgaaaaattttgaaaaa

SEQ ID NO: 103740 - DNA, 119 bp, Caenorhabditis elegans; identical to SEQ ID NO: 103739

SEQ ID NO: 103741 - DNA, 119 bp, Caenorhabditis elegans; identical to SEQ ID NO: 103739

SEQ ID NO: 103742 - DNA, 225 bp, Caenorhabditis elegans
gaatttattgatttttctggaagtttattgatttttctggaaatttatggatttttttggaaatttattgatttttttggaaatttattgatttttttggaaatttatttatttttcatgaaatttatcgatttttcaagaaaagcaataattttttctgaaaatttattaattttttctggaaatttattgatttttctggaaattaatcgatttttctgaaaa

SEQ ID NO: 103743 - DNA, 79 bp, Caenorhabditis elegans
tctccggagtcagatgtcacagagtacttgatatccttgtaggaggcaggacaagtggcttctggcaactctgtctaga

SEQ ID NO: 103744 - DNA, 77 bp, Caenorhabditis elegans
gtgaggaaaaagttgcagtgtacaatacatgtttttatatacttgaatacagttgtgacgtgtgaatttttctacac

SEQ ID NO: 103745 - DNA, 118 bp, Caenorhabditis elegans
ggagagttgtaaatttgagacaaaaattttgaagttgtggaatttctactaattttgatgttctaaaaggttcaaaaacactgaaaattcaaatttcgcggttttttttcttcaattc

SEQ ID NO: 103746 - DNA, 114 bp, Caenorhabditis elegans
gttgtaaatttgagacaaaaattttgaagttgtggaatttctactaattttgatgttctaaaaggttcaaaaacactgaaaattcaaatttcgcggtttttttttcaattcaat

SEQ ID NO: 103747 - DNA, 103 bp, Caenorhabditis elegans
gctgcacaatggagaattgtcaagtgctccttatccctgcacaataaatcgcctccagaattgtacagggctttgatagcttccagatttccattgctggagc

SEQ ID NO: 103748 - DNA, 104 bp, Caenorhabditis elegans
tctgaaaatttatcgatttttctaaaaatttattgatttttctagaaattatcgatttttctaggaatttatcgatttttctggaaatttatcgatttttctga

SEQ ID NO: 103749 - DNA, 119 bp, Caenorhabditis elegans
cttgagtagaagtttggcaagagttgggtgaaacttgggttaaactttggtgcagcctgaatccaagttttgccaaagttttgcccgacttttgcccaagttaaaatttccttggcaag

SEQ ID NO: 103750 - DNA, 203 bp, Caenorhabditis elegans
gagttttctgaaaatttattgatttttctgaaaatttatcgatttttctaaaaatttattgatttttctgaaaatttattgatttttttgaaaattgattgatttttcaggaaatttatcgatttttctaaaaatttattgatttttctgaaaatttattgatttttcggaaaatttattgatttttctgaaaatttatcgat

SEQ ID NO: 103751 - DNA, 122 bp, Caenorhabditis elegans
aaaatttgttgatttttctgaatattcattgatttttctgaaaatttattgatttttctgaaaatttattgatttttctgaatgttcactgatttttctggaaatttattgatttttctgga

SEQ ID NO: 103752 - DNA, 122 bp, Caenorhabditis elegans
aaaatttattgatttttctggaaatttattgatttttctgaaaatttattgatttttctgaaaatttattgatttttctgaaaattgattgatttttctgaaaattgattgatttttctgaa

SEQ ID NO: 103753 - DNA, 60 bp, Caenorhabditis elegans
gaatatgagagagcgcagagaaacgagacactctcactgtctgcgtctcttctctctttc

SEQ ID NO: 103754 - DNA, 103 bp, Caenorhabditis elegans
ctagaagtttccaaatgttcctaggaaagttaagaagtttgcaggtttttttagacagttctaccagtcttgaatttttctagaagtttccagatttttctag

SEQ ID NO: 103755 - DNA, 58 bp, Caenorhabditis elegans
gtatatagtatgtatagtagtatgtgtagtatgcatagtacatgtatgtagtatgtat

SEQ ID NO: 103756 - DNA, 116 bp, Caenorhabditis elegans
aaaaatttgaatttttaataaattttttcagcgggaaatttgaatatttttcaattacttttggcgggaaattttcgagtttttaaataatttttaagctagaaatttgaattttt

SEQ ID NO: 103757 - DNA, 102 bp, Caenorhabditis elegans
gtcaaatggaagatcataaaaggagtttagagttttgaacgtaatgtaaatatatttacatgattgtatataacgcatatttttcttttgaaccttttagac

SEQ ID NO: 103758 - DNA, 115 bp, Caenorhabditis elegans
gattttttgagaaattattgatttttctggaaaattattgattttttcgaaaatttattgattttttcgaaaatttattgatttttctggaaatttattgatttttctggaaatt

SEQ ID NO: 103759 - DNA, 116 bp, Caenorhabditis elegans
tataggaaaaaattaaaaatttgaatttcgcggcttttttttggacattttagatttttttttaaaggaaaaatgtcaaaaatggctacaaaatttgaatttttttcgaatttata

SEQ ID NO: 103760 - DNA, 65 bp, Caenorhabditis elegans
cgaattttgaaactatttgatatcagcccatatcagggcaatagaagaaaatgtttcgaaatttg

SEQ ID NO: 103761 - DNA, 89 bp, Caenorhabditis elegans
cggctggacattgtttctcactctctgcgtctctctgtctctctttcaaaagaacgagagagtgtgataatctagaagagacgcaggga

SEQ ID NO: 103762 - DNA, 94 bp, Caenorhabditis elegans
gctttttatttctaaaacggtaagatgtaaagttttcaacttttatgttagttgagcacttttttttaattttgaggtttgagaaacggatagc

SEQ ID NO: 103763 - DNA, 78 bp, Caenorhabditis elegans
cggtcaccgtgaaaatggttaatttttctttaaaattggctttagctctacgataagaaacaggacattttcagaccg

SEQ ID NO: 103764 - DNA, 114 bp, Caenorhabditis elegans
ccaaacttgtttgaaatgtaatgaagctatagtttatgatgcatgatcagtatatttttaaatgtatgtctgtaaagtttcatcaggaaagctttatcggctgctcagatatgg

SEQ ID NO: 103765 - DNA, 72 bp, Caenorhabditis elegans
tgtagatgccagctgtgcctctgtcaagtcagtgtgctcatttatggacagatgtgtgcaaactgtactgca

SEQ ID NO: 103766 - DNA, 81 bp, Caenorhabditis elegans
tcggcaaattgtagttttgcacatttttctggaaatttcaaaatttttgattttaatcggcaaaatgagtaaaattgccgg

SEQ ID NO: 103767 - DNA, 81 bp, Caenorhabditis elegans; identical to SEQ ID NO: 103766

SEQ ID NO: 103768 - DNA, 93 bp, Caenorhabditis elegans
ttttggcatttttagaaaagggtttttctggaaaaaatcgaaaaatctaaaaatattttttttccaattttcgcctacttttgaaaaccaaaa

SEQ ID NO: 103769 - DNA, 100 bp, Caenorhabditis elegans
tttttgaattacctcccaaattaatgatgtcattttcaaaatttttgtaatgccggaaaacgcaaaaatgacgtcactcaatttcgaggtcaatcgaaaa

SEQ ID NO: 103770 - DNA, 103 bp, Caenorhabditis elegans
tgtatgacaacaaaaaccgattgcatatttgcgaatagttttagtgtcttcattgatttcaaattttgttctagagaaaatcggtttgaaagtgttgcggtca

SEQ ID NO: 103771 - DNA, 103 bp, Caenorhabditis elegans
tatagttcttgatgtgttctataagttcttagttaattactttttgatatcttgcctctccaaaaagataggagctgtcgaagttgatgcatctagagccata

SEQ ID NO: 103772 - DNA, 56 bp, Caenorhabditis elegans
acgtcacaaatgtatttaaatacatgtttatatatacttgaatacagttgtgacgt

SEQ ID NO: 103773 - DNA, 56 bp, Caenorhabditis elegans; identical to SEQ ID NO: 103772

SEQ ID NO: 103774 - DNA, 56 bp, Caenorhabditis elegans; identical to SEQ ID NO: 103772

SEQ ID NO: 103775 - DNA, 80 bp, Caenorhabditis elegans
gtgctctctgcgtctctcactctttgagacccttgtgaggccacgcccactttcttggggagcccggagacccaccccac

SEQ ID NO: 103776 - DNA, 117 bp, Caenorhabditis elegans
atgaagcaagcgagaaggaagacgagaatcagaattgaagaagttgaaatcatttttgtattttaaaagtcacgaaaatgattttctgatgtttaccacgtttttcgcctcttttat

SEQ ID NO: 103777 - DNA, 101 bp, Caenorhabditis elegans
gagaatgatggaaatgtttgtttttgagtgtaaaatgagcagacaacaggagatttggaatacttgtgatatacatacatgagcattttcataccatattc

SEQ ID NO: 103778 - DNA, 117 bp, Caenorhabditis elegans
gtgtatgacgatcggtaagaatttttggttttctgaatttgaatttgtgttgaaaaaacttttttttaaattgaaattgtggagcttgaccactatatgcctagatgtgttacgcac

SEQ ID NO: 103779 - DNA, 63 bp, Caenorhabditis elegans
tgtttctgcatttctatatcaatttttgatttgaaaagttgataagcagatttgtagattgca

SEQ ID NO: 103780 - DNA, 106 bp, Caenorhabditis elegans
aaacttggcccaaagcttggcaagagttgggtgaaacttgggttagactttggtaaagcttgaatccaagttttgccaaacttttgccaaacttttgtccaagttt

SEQ ID NO: 103781 - DNA, 95 bp, Caenorhabditis elegans
aaagtttggcaagagttgggtgaaactttggttagactttggtaaagcttgaatccaagttttgccaaagttttgcctaacttttgcccaagttt

SEQ ID NO: 103782 - DNA, 99 bp, Caenorhabditis elegans
gtaggcaggcttacgactggccagaagaactagctgttaatatgccaaaaactagccttttttacttagtttttcattactaattgtaagtatgtatat

SEQ ID NO: 103783 - DNA, 115 bp, Caenorhabditis elegans
atctcagctctctttgattttatcagaaaaattttaactgacaaaatatgcgcaaaatgtttttctatattttaccagttaaacattttttgatccaatcaaaagcaacagagat

SEQ ID NO: 103784 - DNA, 78 bp, Caenorhabditis elegans
tttgtttcaaacttgggtcaacctttggtacagcctgaatccaagttttgccaaagttttgcccaagttttgcccaaa

SEQ ID NO: 103785 - DNA, 106 bp, Caenorhabditis elegans
ggtatagaaggcagttatgttgtttgtgtatctctacaggctcacagacaatctctctgtgggaaatcaactgccgagatgttttgacgtagaaattgtatgtgcc

SEQ ID NO: 103786 - DNA, 116 bp, Caenorhabditis elegans
ctacatcggccgacatccgacttcacatgctgaaggcgagagacgcagagaaataaaaacctccctctctgcgtctctcgccttcagcatgtgaagtggactgtcggtcgatgttg

SEQ ID NO: 103787 - DNA, 109 bp, Caenorhabditis elegans
agaattgttccgatcgccgctcttttcacacacctcactaacactgaccaccgatgcatagatgttagtaggcgttgtgggaagggcggcgacagtgaacgtcgtttct

SEQ ID NO: 103788 - DNA, 88 bp, Caenorhabditis elegans
gccatccggctaaaagttcaatattctctacattaagctctaatttaatcttgtctgacgtgagtgtgtacattttgtggtgggaggc

SEQ ID NO: 103789 - DNA, 82 bp, Caenorhabditis elegans
cagcgccagagagaagagttagaggtgcatagaaatgtatctacaccgtggcatactctctcgttctctgaaagtgaaaatg

SEQ ID NO: 103790 - DNA, 78 bp, Caenorhabditis elegans
gaccaaatctgtgtgtgtgtgtgtgtcaaaaagactcaaaaaagagtcatttggccgtgtgccaacaactgctcagtc

SEQ ID NO: 103791 - DNA, 78 bp, Caenorhabditis elegans
gcttctccccgtctctctgatccacacactctctcaagctgcccagatcaggtccggtggaagagggatgccagaagt

SEQ ID NO: 103792 - DNA, 118 bp, Caenorhabditis elegans
ctttcatgtaaaaaatttggttgccgagttggaaccaattgatttgagcttcattatttttgaatattctaaatagttaaaggtctatatctcagcaaccaaattttttacaaaaaag

SEQ ID NO: 103793 - DNA, 118 bp, Caenorhabditis elegans; identical to SEQ ID NO: 103792

SEQ ID NO: 103794 - DNA, 97 bp, Caenorhabditis elegans
tgacaatggagttagagttgtcaatttgttattttgaagattcaaggaagttaaagttttcaatgggcgtctgataattgtttttatcgagttgtta

SEQ ID NO: 103795 - DNA, 91 bp, Caenorhabditis elegans
tgaaaaacgtatgtatttccagtaattgcctctcagtctgtctgtcggcggcgggtggagttgttaagaaagagagaaacgtagtgtgtca

SEQ ID NO: 103796 - DNA, 57 bp, Caenorhabditis elegans
gtgaactctagcgattttgttgtaggtctgcggattgcacgtgtcgctgaggttgac

SEQ ID NO: 103797 - DNA, 114 bp, Caenorhabditis elegans
tcaaaataaaacgatgaaaactatcgaaatactatcgacgaataacacttatgaagaaatgtaatacgtcgttggtgtttccatagtttgaattgtttattccattatttttga

SEQ ID NO: 103798 - DNA, 114 bp, Caenorhabditis elegans
gagtgcagaggcttactatgagacggtcaagaggcgcctccgtcacgtggatacgtcgggtggaatgcatagaagactgtactcaaaaaattttacaaaaatagttattacttt

SEQ ID NO: 103799 - DNA, 70 bp, Caenorhabditis elegans
ttcgtgaacttttctcaccatggcgcgaagttgcgtgtgactttgtctctgtgtgtgcgagtattaggaa

SEQ ID NO: 103800 - DNA, 118 bp, Caenorhabditis elegans
gagtgaattggaagcgtgtcgatttacggagctcgtgtactccccgaggaaaacagtgaatttttgtttttcaaaaaaatatatagttctttgtgaaacgattttcgcgaattctttt

SEQ ID NO: 103801 - DNA, 95 bp, Caenorhabditis elegans
cgattaaaaggtttgcctagactgtttttgaaaatgcaaaattattaatttatattgcagagtagaatctattaagtctgggaaatatgtaattg

SEQ ID NO: 103802 - DNA, 85 bp, Caenorhabditis elegans
gttcgaaatacctcactgttgagagtgtgctcactgatattgagcacagtgtgctgatactcgtacatgtatggttcagtcggac

SEQ ID NO: 103803 - DNA, 92 bp, Caenorhabditis elegans
gatgattgagaacgtcactgtgaagatttgagttatgttaagatgtttcttttttaaacattgatttcaaaaacaggacttctcgtgttatc

SEQ ID NO: 103804 - DNA, 119 bp, Caenorhabditis elegans
gaaaaaaatgagtttgaagctttgaatttttgttgttgaaagaactttgaaatgaagatttttaaaattttttttaatagagaaacatatttggctggaaaatcaaatttacacttttc

SEQ ID NO: 103805 - DNA, 86 bp, Caenorhabditis elegans
gggaagtttggttgaatgaacaagaattgcatgatatcgttaaacggcattcattgagtatttctttatgtttgattgagctctcc

SEQ ID NO: 103806 - DNA, 120 bp, Caenorhabditis elegans
tcttttttgaatacttgaggctgcctcttcgttttttttcttgcatttctcaattagtttatttcattttaagaaaattttcacagaaaaatgaagggtatattcattgagaaatgagag

SEQ ID NO: 103807 - DNA, 111 bp, Caenorhabditis elegans
atcaagcttcttcagcagtaaattccgttcgtggcggcaacttctcaatttctttttgtgaattattcaccatcctttgggatttccatacactctccaaaaagtcttgat

SEQ ID NO: 103808 - DNA, 79 bp, Caenorhabditis elegans
tgtggccgaaggcacgtgtgcgcgcggcagcttctttcataatacgctcgctgcctgcgtctctgtgtttcagtataca

SEQ ID NO: 103809 - DNA, 96 bp, Caenorhabditis elegans
gtttcgggaataaagatttttgaaaaaggtttatatttttctaaattagactggaagaaaaactcacttcaatgagactttttgaattcctaaaac

SEQ ID NO: 103810 - DNA, 103 bp, Caenorhabditis elegans
gaagtgtgtcgatttgttcttgagttggattcactgtctttgtcactgaaattggagcgccgagaacagtgttgataggttttctggaagaaagataatattc

SEQ ID NO: 103811 - DNA, 68 bp, Caenorhabditis elegans
gtactattctcgcactttttcgttgatggacagcagacatctctgtgtgtctctgtgtgagtgtgtgc

SEQ ID NO: 103812 - DNA, 85 bp, Caenorhabditis elegans; identical to SEQ ID NO: 103431

SEQ ID NO: 103813 - DNA, 82 bp, Caenorhabditis elegans
gaacttccataattgagtgtagtttctatttttctatttgaaatttcatgggattttgggaattttacttcattggaaagtc

SEQ ID NO: 103814 - DNA, 91 bp, Caenorhabditis elegans
atgtgatacgaggtattaaatgttttccggtagatactgtatttcaatgtatattttagagtttggattacatttgatttgtgttttacat

SEQ ID NO: 103815 - DNA, 110 bp, Caenorhabditis elegans
tgccattcttggattcgacggagctgtatgggcaaagagtgataactttaatgtaagttttcaaagtttttaaaattgtcaagttgccaaaatctcgactttcagtggca

SEQ ID NO: 103816 - DNA, 99 bp, Caenorhabditis elegans
gaaaaatccgtttgaaaaataaaagagtcccgaaaagatggagattatttttctatttttcgcatcgagctacttaccattttttcaatcgaccctttc

SEQ ID NO: 103817 - DNA, 97 bp, Caenorhabditis elegans
ttcaactttcaatgaccccttgttaagtagtggtgccgctcttattaggttgaaaagtaataagagtagttcactacttatcaaggtgaaatttgaa

SEQ ID NO: 103818 - DNA, 99 bp, Caenorhabditis elegans
ggccaaagtttggcaagagttgggtgaaacttgggtcagactttggtaatgcttgaatccaagttttgccaaagttttgcctaacttttggccaagttt

SEQ ID NO: 103819 - DNA, 110 bp, Caenorhabditis elegans
tctgaaaaacttcttcttgaacagcttggcgcacatggtgattctgattttgttgttgttcatggacttgtgttgcctgctgcccactgttgaattggaaattttgatga

SEQ ID NO: 103820 - DNA, 111 bp, Caenorhabditis elegans
tctttaaaaaatttggttgccgagttgggaccaattgatttgagcttcattatttttgaatattctaaatagttaaaggtctatatcttggcaaccaaattttttacaaga

SEQ ID NO: 103821 - DNA, 100 bp, Caenorhabditis elegans
ttttctgccacttttttgttgccttggcttctaacaattgttcataaatatttaatgaacgtaaacgtgttttatgttaagacatttgagaggcacaaga

SEQ ID NO: 103822 - DNA, 117 bp, Caenorhabditis elegans
tgctgagcacggactatgcatattgccgcctacagaagcatagatttccacaaaccattcgaggtgtttgtgcaaatctttcgcgactgtaggcggcgaacatgcagttttttcgca

SEQ ID NO: 103823 - DNA, 103 bp, Caenorhabditis elegans
gatcgggaagaagaggaacattgccaacttgattttcaatagttactgtttttatttcattgagattgtgctaaagttgtgtgtttctgttttcaaattggtt

SEQ ID NO: 103824 - DNA, 111 bp, Caenorhabditis elegans
agtttgttttgcgtggtgctcaagatatcgctgataaaattaatgtgtaagttatacatattaattgctatgtgttgcttaaaaaaagtgctcaaaatgcaggaattaatt

SEQ ID NO: 103825 - DNA, 83 bp, Caenorhabditis elegans
atgatgctctcgagtgatattcacattatgttcatcagttttatgagcggtcagtggaatgtagtgatgctcgtgaacaacat

SEQ ID NO: 103826 - DNA, 109 bp, Caenorhabditis elegans
tcaaataactctacacgtttgcaatttttgtactacacataggtactggacaattttcaaaatatatccagtgtctagtctagtgcaaacattgctcggtgttgtttga

SEQ ID NO: 103827 - DNA, 119 bp, Caenorhabditis elegans
gccccttatatagcatctttctgtctcgcccatcccgttgctccaatattctaacaacaagtgattattgagcaatgcgcatgtgcgggatagactgatggctgctttttgtccggagc

SEQ ID NO: 103828 - DNA, 113 bp, Caenorhabditis elegans
cacttgagggtgtggatcatgattaatatgcaagttatttgatagtttctgattatttttaaattgtcatcctctagctctaggcaaaaatatgaactaaatcatatcacgtg

SEQ ID NO: 103829 - DNA, 99 bp, Caenorhabditis elegans
ttgtgtgtttagttctagttcttttcataagctgtgttaatacccgagaaattacgacacacaagtgagtgtggtgtgaaaatgaatgtaaatactcaa

SEQ ID NO: 103830 - DNA, 82 bp, Caenorhabditis elegans
gacagttgttagtaatactgcgaaacgaatttttcttttacaaaagaaagatacatgttttgtgttaatattaactattctc

SEQ ID NO: 103831 - DNA, 73 bp, Caenorhabditis elegans
gctactgtctctctctcactccgctgtcacctcaaaaatggcattgcggcggatttcagaaaaatggcattgc

SEQ ID NO: 103832 - DNA, 56 bp, Caenorhabditis elegans
gtgagttagatctcatatccttccgcaaaatggaaatgatatgtaatctagcttac

SEQ ID NO: 103833 - DNA, 92 bp, Caenorhabditis elegans
gagtttggttacaaatttcaggtcccgttatgtgtcggtcgcactttttttgttaatatacaaacgggtgacaccggtcttgaaccaatctc

SEQ ID NO: 103834 - DNA, 120 bp, Caenorhabditis elegans
gcgaagcatgtctagatttggaacttaatgggactcggcagaaacctatcggttatactttttggatatgctatacccgtataagtttctgctgagccccttattcctgtttggcgcttc

SEQ ID NO: 103835 - DNA, 126 bp, Caenorhabditis elegans
tctggaattggtaatgtgagtcgcgctctgactaggatatgagacgacgagaacattgcttttttaaaagacttgtacccgtaatcttcataatccgagtcagggctagctgaccataaacatgcc

SEQ ID NO: 103836 - DNA, 111 bp, Caenorhabditis elegans; identical to SEQ ID NO: 103820

SEQ ID NO: 103837 - DNA, 120 bp, Caenorhabditis elegans
ccaaggaaactcaaaggggtggaatttttgggggatgtgataagacggaaaaaattacatatatgtatctatttttgagaggtcctagaatcccgattgattttttgtgctggagcgttc

SEQ ID NO: 103838 - DNA, 81 bp, Caenorhabditis elegans
gtctcttacaggcacggcggctttgaatttctttatttttagaaatttgcgcttcgctgaaactgtatgctgtaagtgcac

SEQ ID NO: 103839 - DNA, 102 bp, Caenorhabditis elegans
tttggaatgatgggcacctctgcgctatgaaaaaaagtatcttaaaaagtggggcgagtagctcactgtttcaaaatacagtcacaggtcccatttttcaaa

SEQ ID NO: 103840 - DNA, 116 bp, Caenorhabditis elegans
gctcagaacaaggaacttcaaaggctgaaaattattgaatatcataaaagtgagctatttaatttttttgtaacaaaattttcaacaagttggtgatatttcatattttctgttgc

SEQ ID NO: 103841 - DNA, 98 bp, Caenorhabditis elegans
agcgttcacttcggccattcttctgggatcgactaaattcatatcaatagaatttgacagatcagcgtgaggtcttggtggctctgtgccctctcgct

SEQ ID NO: 103842 - DNA, 96 bp, Caenorhabditis elegans
tatttcgacactgtgagttgttgttagtttctacgtaaagtttttagaaatgttctatttaaatttttcgaagctgttgatttgcagtgtgaagtg

SEQ ID NO: 103843 - DNA, 111 bp, Caenorhabditis elegans; identical to SEQ ID NO: 103820

SEQ ID NO: 103844 - DNA, 118 bp, Caenorhabditis elegans
gttgatcgagagccgactgaaactgaagagagcagtctattgacagtcggttactcgaaatctttactgtcatggaggcgctctcttcagatgatgtctggcccattttttaatcaat

SEQ ID NO: 103845 - DNA, 77 bp, Caenorhabditis elegans
gttcaacaagtcacagactctgtgtttgaaactgtgccaaagtaatcaactacgatgtgtttgtgactttgaagaac

SEQ ID NO: 103846 - DNA, 121 bp, Caenorhabditis elegans
ggccctggtgataattgggcggatgagtttgatgttgtggaggcaggggttgtagtcctgtatcagcatgtgaaactgtcgctggcgccggggccaggtcttgcttcgccgacattcgaac

SEQ ID NO: 103847 - DNA, 114 bp, Caenorhabditis elegans
tttgaagcaaaaatcacaaaattttgcttttcggtagtaccatggtttttgtgtctggttaactggaagtcccattatttcagaaaatcaaaaaatgttttgtaatgctttaaa

SEQ ID NO: 103848 - DNA, 83 bp, Caenorhabditis elegans
cagtttgtggaaataattatgatgatgatgatgatgatcataattatcatcataaacattttatcgtaaaactatacaaaatg

SEQ ID NO: 103849 - DNA, 89 bp, Caenorhabditis elegans
ttttgtatagttttacgataaaatgtttatgatgataattatgatcatcatcatcatcatcataattatttccacaaactggcacgaaa

SEQ ID NO: 103850 - DNA, 126 bp, Caenorhabditis elegans
gttgtggttgtagacgtagaagttgttgtagttggaattgtggtagttgccaaaacagttgtgctagtaggtttcatagttgtcgtgctgttcatttttggcggtgcaatatcagcagcaaacctc

SEQ ID NO: 103851 - DNA, 115 bp, Caenorhabditis elegans
gtggacggtctacactgtggatccggtgaggtagtaggttgtatagtttggaatattaccaccggtgaactatgcaattttctaccttaccggagacagaactcttcgaagctgc

SEQ ID NO: 103852 - DNA, 85 bp, Caenorhabditis elegans
ctgtctccggtaaggtagaaaattgcatagttcaccggtggtaatattccaaactatacaacctactacctcaccggatccacag

SEQ ID NO: 103853 - DNA, 60 bp, Caenorhabditis elegans
gaccaacagttgcagtttgcctgattccaaatggtgtcagaagattgtcacgacatggtt

SEQ ID NO: 103854 - DNA, 114 bp, Caenorhabditis elegans
atgaggacgagaaaaagaaaatgatgaatgggttgtgacaaggcgagatttaattatcactatttgttattgttattacatagatatgagttattttcactttggctcttttat

SEQ ID NO: 103855 - DNA, 85 bp, Caenorhabditis elegans; identical to SEQ ID NO: 103225

SEQ ID NO: 103856 - DNA, 68 bp, Caenorhabditis elegans
agctggctcttgtggagctggggatgggtatccagaatctggagtctctggctctctgactggtggct

SEQ ID NO: 103857 - DNA, 118 bp, Caenorhabditis elegans
ggctcgtaaggcaaggctgtctagaggtctgcacttttcgaaagatcagggaagtgactttttcacattgcgtgttctttttgaaacaacctaacggaaatcttatactttaaaagtt

SEQ ID NO: 103858 - DNA, 70 bp, Caenorhabditis elegans
gtcttacttgtttttttttcaaagtttcctcacttgttaaaaattttgaaaaaaaaacttggtatgagac

SEQ ID NO: 103859 - DNA, 114 bp, Caenorhabditis elegans
gaagagttgctatcatttatgcaggcaagaggatttatggtacgtatttttttatttaagaggaggtaactttatgaaaagtgcgttgttggatattgctgtagtttagccttc

SEQ ID NO: 103860 - DNA, 114 bp, Caenorhabditis elegans
ttgaggttattttcaggcttaggcttatctaattctcaatttttgttgttgtctgaaatttgaactatataattatataattgaccgttgtacaggcctagaaattcagctcaa

SEQ ID NO: 103861 - DNA, 90 bp, Caenorhabditis elegans
gacaaaaaggcaaatatatattaccttgcagaaaatgttttcaaaacccatgcgatatttgtgcatttgatgttctgtttgtcgtgtgtt

SEQ ID NO: 103862 - DNA, 82 bp, Caenorhabditis elegans
gtagtgatacggtaggagtacttttgaagttctacggtagaggtactgtagtgatatggttgaagtactgttaaagttctac

SEQ ID NO: 103863 - DNA, 112 bp, Caenorhabditis elegans
ggtttctaattgcagaatatcagctgttccaggtgttctatttatcacaagtctcaaaattttttgttgttaaacagacacgtgagaacaagaaatttgctcaaaaaaaact

SEQ ID NO: 103864 - DNA, 73 bp, Caenorhabditis elegans
tcaagtaatgtagcaaaatgtatacatttgtgacgtcacaaatgtatttaaatacatgtttttatatacttga

SEQ ID NO: 103865 - DNA, 61 bp, Caenorhabditis elegans
ctgaggtagtatgtaatattgtagactgtctataatgtccacaatgtttcaactaactcgg

SEQ ID NO: 103866 - DNA, 102 bp, Caenorhabditis elegans
ggctttttggtgtggtctgtctgggctttaaaatattttctgcagatgtaatttttcagaggaatgttttaaggttttttctagttactgcatctgtgagct

SEQ ID NO: 103867 - DNA, 101 bp, Caenorhabditis elegans
ttttctccacgagctcgttttcatttctcattttgttgttatatcctggtgctctgttgggtttttccatgctgatgagaataggcggaccacggggaagg

SEQ ID NO: 103868 - DNA, 82 bp, Caenorhabditis elegans
agcgaggagagagagagagagacatagagacagagagagatttagattcggtgagggcccctctctctctcactgggctatg

SEQ ID NO: 103869 - DNA, 118 bp, Caenorhabditis elegans
gggctagaagagggaaaaagagaggcaagaagctgcgaaaccgatcatcatcatcatcatcatcatcatcatcaaccgtcttcctcttcatcctctgcatctcatactctccttttcc

SEQ ID NO: 103870 - DNA, 174 bp, Caenorhabditis elegans
gtttctagaaattttatcgatttttatggaaatttattgatttttctagaaatttattgatttttctagaaatttattgatttttctggaaatttattgatttttatggaaatttattgatttttatgaaaatttattgatttttctagaaatttattgatttttatggaaatt

SEQ ID NO: 103871 - DNA, 98 bp, Caenorhabditis elegans
tttgccgattgaaattgaaattctgaaattcattttttttaaatgtgtgaaaccacaatttaccgaaaatcttcggcaatcgccttcttcccggcaaa

SEQ ID NO: 103872 - DNA, 77 bp, Caenorhabditis elegans
gctccggggttgccgggctgcagggttagattcgtgattgaaagatcagggtaactgtctctcagtgtgagatgagc

SEQ ID NO: 103873 - DNA, 90 bp, Caenorhabditis elegans
accacaacaacattgatcgccgtctctctcgcgcacggaacaatgagtgagatgagtgaagtgagtgagggggcgtgagcgtgcagtggt

SEQ ID NO: 103874 - DNA, 110 bp, Caenorhabditis elegans
taccactacggtctgaatgtgacttttttaatcttcagattttgttgatcaatttagttgtttatttcacgttatttgattgattgagtaacatttgaagcggataggtg

SEQ ID NO: 103875 - DNA, 95 bp, Caenorhabditis elegans
caagcagacacaatttctaactcgtcggtagtcatcgttctagctgaaaaggacactatgacactgaagcgagttggaaatagtggttctacttg

SEQ ID NO: 103876 - DNA, 98 bp, Caenorhabditis elegans
gaaaattctggaatttttcagatttttctataaaattttgaatattttcagttgaaaatgccaaaaatcctggaaattttctgaaaaaacacgttttt

SEQ ID NO: 103877 - DNA, 107 bp, Caenorhabditis elegans
gatttcaaatctacgacgaatgcgggggttgacaagtgtatatatatatatttctcgctatttataaaaatatttgcagtgccccacttcttcttagatcctttttc

SEQ ID NO: 103878 - DNA, 82 bp, Caenorhabditis elegans
taggagtcggctggtatactatatatgtttgtattttaacattgtaggagttcaaacatatgatagtgctttagatttcttg

SEQ ID NO: 103879 - DNA, 118 bp, Caenorhabditis elegans
ctttcccggctgcaactacggtaagcggtatccagccgatgttttcaatactgcatttgaatacacgtgcacggataacgctcattgtttttcgcatgccaatttcacaaatggaaag

SEQ ID NO: 103880 - DNA, 129 bp, Caenorhabditis elegans
ctttatccaatagtcgatccgcaggcaatggttttgagaggaatccttttacatatttgttgaagttttcgctcgaatttgtggtcgaatactgtagaaggaagcctgcacgaagttttgcaaatgtcg

SEQ ID NO: 103881 - DNA, 114 bp, Caenorhabditis elegans
tccagtgagagtcccacacacgactggacttccatatcgagccacagctatcaacgaatttgctggcaagatgtaggcagttcagttgtgcgtttatggagaccaacatccgga

SEQ ID NO: 103882 - DNA, 111 bp, Caenorhabditis elegans
caaagcaaaatggttcaaaaaacgttcgggcttccatctctttcccagcctacatctcaacctgggctggcaagaaatggcagtctacacgtttttcaaccaaatgctatg

SEQ ID NO: 103883 - DNA, 119 bp, Caenorhabditis elegans
ttttttctactttcttgttgctttgaagaattgcagtcggttgcaagcttaaatacaaatccgaattgttattaaagctaccaaccggcttcaagtctgaaagagcagttgaaaaaagg

SEQ ID NO: 103884 - DNA, 129 bp, Caenorhabditis elegans; identical to SEQ ID NO: 103880

SEQ ID NO: 103885 - DNA, 84 bp, Caenorhabditis elegans
ttagcgtgggcagaagtttgacaagagttgggtcgcatgaatccaagtttagccaaagtttagccaacttctgatccaagctaa

SEQ ID NO: 103886 - DNA, 111 bp, Caenorhabditis elegans
tgtatagcgtttttcactgaagagtgttaggtgaacaaagaacagtccacaatgtttttgttgttttttctttctatctcgaatagtcagacaaagaaaatgctcgtcaca

SEQ ID NO: 103887 - DNA, 116 bp, Caenorhabditis elegans
gcataaaatcagtgccatcgtgcccaacagtcggttttcaccgtgatctgagagcaatccaaaaatgcttttctgagatcatcgtgaaagctagttgttggtctacgggcttttgc

SEQ ID NO: 103888 - DNA, 110 bp, Caenorhabditis elegans
tcatgaaataggttcttttagcaaccggttttctctgtgatctacagaatgacagctaatcgtctgagatcatcgtgaaagccagttgtttttatgaactcttatcaaga

SEQ ID NO: 103889 - DNA, 118 bp, Caenorhabditis elegans
ctttcttgtaaaaattttggttgccgagttggaaccaattgatttgagcttcattatttttgaatattctaaatagttaacggtccatatcttggcaaccaaattttttacaaaaaag

SEQ ID NO: 103890 - DNA, 98 bp, Caenorhabditis elegans
cattctttattgcatattttggtattttatcttacattattgattaagctacattaccttaattaataaaaaacgaccaaaatatgctataaatgatg

SEQ ID NO: 103891 - DNA, 103 bp, Caenorhabditis elegans
gggaatcactcagtttttagactcaaaattttggtagtctatcattatttaattttgcttaatttttttagacattttgatggtcggaacatgtgacaatccc

SEQ ID NO: 103892 - DNA, 87 bp, Caenorhabditis elegans
ggacaatgctcgagaggcagtgtggttagctggttgcatatttccttgacaacggctaccttcactgccaccccgaacatgtcgtcc

SEQ ID NO: 103893 - DNA, 118 bp, Caenorhabditis elegans
tgtgtatctatactcttgaacgactagcaacgcacaaacgtcttctgtgcgacaacatctgaatgtttgtcacaggacttttgagcgttgccagtcgaaagaggaatttttttataca

SEQ ID NO: 103894 - DNA, 115 bp, Caenorhabditis elegans
taaggcttcgaaggagatgatagtgcttgcagtaaacacgaaaattagtgataattatgaaaatcaatataattttaaggatacttagagggcaatcaaaaagcttctcgactta

SEQ ID NO: 103895 - DNA, 76 bp, Caenorhabditis elegans
ggggcccgccggctcgccgggtgggaaagcattcgacagcaagacgtgtttttcaatctgcgactcggcgattccc

SEQ ID NO: 103896 - DNA, 111 bp, Caenorhabditis elegans
agttgaaatatggtcgctttgtcaatgtaacagcggctggaaactagtttttttttttgaaatcacagtctaattttgggtacgtatgttgattatttcacgttttcaact

SEQ ID NO: 103897 - DNA, 61 bp, Caenorhabditis elegans
ctttctcatctgttcgaaaaactgtttttttttgaaaagatgcgtgcgtaagatgagaagg

SEQ ID NO: 103898 - DNA, 81 bp, Caenorhabditis elegans
gagacacttattacaaactcttcatcaaagttttgtcagtgcttcttgtatttttgtcagtgctttttgtaattgtgtttc

SEQ ID NO: 103899 - DNA, 90 bp, Caenorhabditis elegans
taggaaccgcaaaaaactattttcttttaggaatgtgtgctttgtgacacaacataattttttttttcgaaagtagtaaggcggttttta

SEQ ID NO: 103900 - DNA, 118 bp, Caenorhabditis elegans
tggatcagaagctgtctaaacttgggcaaaagttaggcaagactttggcaaagcttgaatccaagttttgccaaagttttgcccaacttttgcccaaattcagccaacttctgatcca

SEQ ID NO: 103901 - DNA, 91 bp, Caenorhabditis elegans
gcagatgtacaagttgttctgtttggaaatgtatctgggggcttgtgtatatacgccttggtacaacctctgaaacagctgttaaaattgc

SEQ ID NO: 103902 - DNA, 117 bp, Caenorhabditis elegans
tggtggtttaagtacatttgatgtttctcaattcttcgatttttggtctcaaacatacattatattttttgaaagaccagtctaaaaattgtataattcaacaaactcagactgcta

SEQ ID NO: 103903 - DNA, 69 bp, Caenorhabditis elegans
ggggaaaatatagagagtaagagggaggggagagtaatttaaatctgctcactctctctgtcaatcctc

SEQ ID NO: 103904 - DNA, 81 bp, Caenorhabditis elegans
tagggggtccagcagatgtcaagtccatttccatcggaatctcattaagtgatgacagtgagctgtctgccgagccctgtg

SEQ ID NO: 103905 - DNA, 118 bp, Caenorhabditis elegans
gccttcgtggttattttagtatgcgcactagcggtgtggtaagatttgatttttctttaaaaactcttgagtcaatttttatttccagcatctgcatgctcatcgagagggccgacgg

SEQ ID NO: 103906 - DNA, 116 bp, Caenorhabditis elegans
actcgatacatgtgactgcgtagtgtatcgttgcctgcaaaattgtttcttaaggtttcctaatgactgaacagtgagagcagtgccggctcatttcgcactcattttattatggt

SEQ ID NO: 103907 - DNA, 118 bp, Caenorhabditis elegans
cactagttgtctacaaattaccagctattttccaagtagagaaaagtttctaattacccatcatgcacaaatgtggtgactagagcctattctcttcttggaaaagtggcgactcttg

SEQ ID NO: 103908 - DNA, 63 bp, Caenorhabditis elegans
cagaagttgaacgatttgggtgtgggctctcaacagcttcatcttcatcatcttcaacttttg

SEQ ID NO: 103909 - DNA, 111 bp, Caenorhabditis elegans
agtttcactagtgcatcaagttccgggcttttggaagttagaagtggttgttggttgaactgaaataaaaattttttgagcaggccagaatttgggatattttttcaaact

SEQ ID NO: 103910 - DNA, 86 bp, Caenorhabditis elegans
accgtcgtcactccttctctcgagaatgcggtccgggggcaagttacctcctttactctgtctctctttctccggggacgggcggt

SEQ ID NO: 103911 - DNA, 111 bp, Caenorhabditis elegans
caagatcggttgctcagactgttcactcatattctgattataatcgcactggttgacttgtgacgattgatgtgtattgtcggtcagttcattttgttgcaactgacattg

SEQ ID NO: 103912 - DNA, 102 bp, Caenorhabditis elegans
gtgccttgatggttgcaatgtagtcttctccagttaacttcaatttttttttgaaattcaagcttaaaacttggaaaaattaccgttggaacgtcaattgcc

SEQ ID NO: 103913 - DNA, 71 bp, Caenorhabditis elegans
ctacaagctacaaaccactcagtggggcaggttttcttacctgagagaagagtgagtgatgtctccggtag

SEQ ID NO: 103914 - DNA, 95 bp, Caenorhabditis elegans
cggacacgtgtagtttgtcagaagtttgaaagtagttaagttctatgttaaaaataaggctcctagctgagtgaagcgcgaaatcacgctggccg

SEQ ID NO: 103915 - DNA, 113 bp, Caenorhabditis elegans
gatgttgatgtaatgccgtcacttggtcggcgatttaatattatcagaacataggaaattgttagtattagttgtgcgaccaggagacggtattcgcatatttcttaaatatt

SEQ ID NO: 103916 - DNA, 104 bp, Caenorhabditis elegans
ctgtgaaatttaatattcaactttctagggaccactgggaatgaaaactagtttgaaataaactggtgaaaaggggaccagatataggtggaagttgaaagcgg

SEQ ID NO: 103917 - DNA, 75 bp, Caenorhabditis elegans
gaccaaaaagtgcaaagtcataatttttagatttttagctagagtcttgaaaaaatgttattgcattttttgttc

SEQ ID NO: 103918 - DNA, 74 bp, Caenorhabditis elegans
tgcaggtggtcagtgcaattgcaagtggtcagtgcaaatgcaagtaatcagtgcaactgcaagtggtcagtgca

SEQ ID NO: 103919 - DNA, 93 bp, Caenorhabditis elegans
gtaaatgttggcacaatttgtcatctcagtcgtgttccagaaaacagattcagaaaactgagatttgagacacattgagcttgaaacgtgaac

SEQ ID NO: 103920 - DNA, 59 bp, Caenorhabditis elegans
gaccttatatagcggtttcagtggtgcacatctgtcattgtcactgtctgtgtgcagtc

SEQ ID NO: 103921 - DNA, 117 bp, Caenorhabditis elegans
aaaatattttttttatattgtttccccacaatttttgaacacattcgttgtaatgttttgagaattataggagtgaattaaaggaaggtggaggagggcctgtggggaaattgtttt

SEQ ID NO: 103922 - DNA, 109 bp, Caenorhabditis elegans
gctacgtcgtatttcttagttttcgattaacccacccattttttatgacattgttgttctgtgtcacatctgaaaatgacaggtttagtttttctatatgtatgctggc

SEQ ID NO: 103923 - DNA, 80 bp, Caenorhabditis elegans
ctcacgtgcaggagcttggcaattctgtgtcacactctctcatacacacggtacttgttgcgattttcctgatcgatgag

SEQ ID NO: 103924 - DNA, 118 bp, Caenorhabditis elegans
atgacagtgtagatttggatagtatagaacggtgcctggaaaaattgtttttgaatatcatattttgttagaatttaagagcccatgcttttcatatgattcttgtgctataattcat

SEQ ID NO: 103925 - DNA, 108 bp, Caenorhabditis elegans
tgattcgatgatattttttcaaggtaagtgagatcgcctgtaaattattaatatttcaaagatgtgttactatgctcattcttaccaagtggagttggtggttgaaca

SEQ ID NO: 103926 - DNA, 95 bp, Caenorhabditis elegans
tcacacagtcactcacacacactgtatcgtaatctgtgattttttttttcttccaattacagtatatcgaatataaagtgtagaagactgcatga

SEQ ID NO: 103927 - DNA, 75 bp, Caenorhabditis elegans
aatctagctgaaattgatgtttatttcaattattttccgaagaatgcgaaattgtttcatcagaaaagctagatt

SEQ ID NO: 103928 - DNA, 114 bp, Caenorhabditis elegans
aagttttttctttttttttcaaattttactcgtcggcaattatgtagtttttttttcaaaaaccatatatcctgttcgtaattgtgactattttggttatgaaaaagaatgctt

SEQ ID NO: 103929 - DNA, 115 bp, Caenorhabditis elegans
cttagatttttgcccgtctttttcgaaatagtcccaaatctgagacattctgaacagaaaaattatttttatttcagtacagtcaaagatcggaaagaggggcgagatattaaag

SEQ ID NO: 103930 - DNA, 107 bp, Caenorhabditis elegans
gttgagcatattttggcgagatccctactctaaaattaacagcaaatctcaacgttttgaaagtaatgaaattagttttgaatacttttttcgcgaaattgttcagc

SEQ ID NO: 103931 - DNA, 129 bp, Caenorhabditis elegans
gtgataggcggagtcgagtggatctgccacaccgatatattgtggagcacatacacactcactctcatacacagctgtttgtaaggtgcccagacatgatgaacgtggctccttgcgggaggtgggagt

SEQ ID NO: 103932 - DNA, 108 bp, Caenorhabditis elegans
gatatcaatctctgacgtttattatgaagtgagagaagactgagaggaaaaagacacaatcgtctcgctcacttgtcgcactctatattcccccagaggcttgttatt

SEQ ID NO: 103933 - DNA, 109 bp, Caenorhabditis elegans
aagttgtaagaaaatgaatctgagagcgcgtttattttgagttaataaaactgtttatttattaattcctaagtttatttagctccggcctgattttccagaagagctt

SEQ ID NO: 103934 - DNA, 118 bp, Caenorhabditis elegans
tcgttgttagaaactttttcaaatcgaggattttgagactagaatgcttgaattgtactagcatactggcccccaaatcttcgcttagaaatacagttcacaattattttaatggtga

SEQ ID NO: 103935 - DNA, 95 bp, Caenorhabditis elegans
ctagttctgaaggtgagtcagtgacgaaaacagtcttagttgttgtctacaaccggaaaatttgagcattgagctcaacaattgggaattactgg

SEQ ID NO: 103936 - DNA, 108 bp, Caenorhabditis elegans
gtatgagaaacgtgttagagtatttttggaagtaggcgagacaacaaagacagcagtgaaaagaggctgtttgccatctgccgtgatgtgtacgcaactcgctcatac

SEQ ID NO: 103937 - DNA, 116 bp, Caenorhabditis elegans
tcaagctgttcaaaacttctacattgcgtggtccctgagaattctcgaacagcttcaaagtgttcaagctgtcgagttttgtcaaggaccaaacaatagaagatcacttgggaaca

SEQ ID NO: 103938 - DNA, 85 bp, Caenorhabditis elegans; identical to SEQ ID NO: 103225

SEQ ID NO: 103939 - DNA, 99 bp, Caenorhabditis elegans
tggctgtttgctggttggacactagaaatattacctacgtggcagtcatccaatctaataatgtaagttgttttgatgctcaatgagcacaatgtgcta

SEQ ID NO: 103940 - DNA, 109 bp, Caenorhabditis elegans
tgcggaacgtgtcaagtgaaaacacgtcacaaatgtatttaaatacatgtttttatctacttgaataaggttgtgacgtaatttttctacactttttaattttccgaca

SEQ ID NO: 103941 - DNA, 113 bp, Caenorhabditis elegans
gggtaagctatggctgaatccaagatggtgggcgtgtcactctttgtgtctgagagcaggttgtgccgctctcgctcccaaagttggcttgttttggaggcagtggggctcct

SEQ ID NO: 103942 - DNA, 108 bp, Caenorhabditis elegans
tgtttaacgccgagtagtcttgtgatgctaccgtgaaagtttttatttgtaataagtaacttttttgtgtcgtgtttgaacagcttgaatgatcggtaaagttgcaac

SEQ ID NO: 103943 - DNA, 102 bp, Caenorhabditis elegans
tactatctcgaaaaccatcacaaaatcgattttgcgatgcatataagaaatgaccgcaatgaaattatatatctttatttgtgatgaattttcgattttgta

SEQ ID NO: 103944 - DNA, 110 bp, Caenorhabditis elegans
tgtcattacttttttgagggatgtgacttgctcatatgtacaaaaggagttaaataacctaaaatgtatatatttttagcttcaaagtttccagtgagaaaattctgaca

SEQ ID NO: 103945 - DNA, 91 bp, Caenorhabditis elegans
cagtgatttgctgacttataaagatctacttttttaatagtttacattgtgcagctgttacggtctgagatctatctgagtcaaagttctg

SEQ ID NO: 103946 - DNA, 68 bp, Caenorhabditis elegans
ttttctctctagatgtatatttcatttttatgaataaccacaaaatgagtgtgcataaagggggaaaa

SEQ ID NO: 103947 - DNA, 107 bp, Caenorhabditis elegans
tcgaaaaaattacaccgattttagctaaaatttcaaattttgtaaatctgtgatacggagaagttggcaaaatttgagatgttggttgaaatagtgtaatttttcga

SEQ ID NO: 103948 - DNA, 147 bp, Caenorhabditis elegans
tgtacttttgaaaaagaccaccgtccgcagtttgttgtgatgtgctccaagcaatcatgagtctgaagcaccacgagaagctgcagatggaggttctgattttcgaacgagttcagacaagtcgttttgaggtacaagataaataac

SEQ ID NO: 103949 - DNA, 23 bp, Homo sapiens
gggtctcactctgtcacccaggc

SEQ ID NO: 103950 - DNA, 18 bp, Homo sapiens
tgatgatttaatctgtag

SEQ ID NO: 103951 - DNA, 22 bp, Homo sapiens
atcatggtcattctctgtctca

SEQ ID NO: 103952 - DNA, 23 bp, Homo sapiens
gcatgtatatgtatgtgtgtgtg

SEQ ID NO: 103953 - DNA, 23 bp, Homo sapiens
gcatgtatatgtatgtgtgtgtg

SEQ ID NO: 103954 - DNA, 23 bp, Homo sapiens
tatgtgtatatatatgtatgtat

SEQ ID NO: 103955 - DNA, 21 bp, Homo sapiens
cctgtcacagtcagtttgggg

SEQ ID NO: 103956 - DNA, 21 bp, Homo sapiens
tgagaacgtgtgtgtagtgtc

SEQ ID NO: 103957 - DNA, 19 bp, Homo sapiens
ctctgtgcgtgagtccctg

SEQ ID NO: 103958 - DNA, 23 bp, Homo sapiens
agtccctctgtctgtgtgtgcct

SEQ ID NO: 103959 - DNA, 21 bp, Homo sapiens
gatgattagttaaggtcctag

SEQ ID NO: 103960 - DNA, 23 bp, Homo sapiens
catgactcactgcagtctcagcc

SEQ ID NO: 103961 - DNA, 23 bp, Homo sapiens
catgactcactgcagtctcagcc

SEQ ID NO: 103962 - DNA, 23 bp, Homo sapiens
catgactcactgcagtctcagcc

SEQ ID NO: 103963 - DNA, 21 bp, Homo sapiens
atctcggctcactgcaggctg

SEQ ID NO: 103964 - DNA, 23 bp, Homo sapiens
ctctctgacagtgaagtgtgatg

SEQ ID NO: 103965 - DNA, 23 bp, Homo sapiens
tctgtctaatactgtctggtaaa

SEQ ID NO: 103966 - DNA, 19 bp, Homo sapiens
tgtgcgtgtctgcatgcca

SEQ ID NO: 103967 - DNA, 21 bp, Homo sapiens
accttgtctcaaaaaacaaga

SEQ ID NO: 103968 - DNA, 23 bp, Homo sapiens
ggagtctcactctgtcactcagg

SEQ ID NO: 103969 - DNA, 23 bp, Homo sapiens
ttagagacaggctctcactctgt

SEQ ID NO: 103970 - DNA, 23 bp, Homo sapiens
gacagagtctcgctctgtcaccc

SEQ ID NO: 103971 - DNA, 23 bp, Homo sapiens
tggctcactcatgtaatcccagg

SEQ ID NO: 103972 - DNA, 23 bp, Homo sapiens
gctgaggtaagaggatcacttga

SEQ ID NO: 103973 - DNA, 23 bp, Homo sapiens
tttttacatttactgctgcaaac

SEQ ID NO: 103974 - DNA, 23 bp, Homo sapiens
agatggagtctcactctgtcacc

SEQ ID NO: 103975 - DNA, 23 bp, Homo sapiens
caatgtctgtctgtctgagtctc

SEQ ID NO: 103976 - DNA, 19 bp, Homo sapiens
agtctggggtaagtgtgag

SEQ ID NO: 103977 - DNA, 23 bp, Homo sapiens
cgctgcctctgtctctctgtcca

SEQ ID NO: 103978 - DNA, 18 bp, Homo sapiens
gactcctctgtgtgtgag

SEQ ID NO: 103979 - DNA, 22 bp, Homo sapiens
tctctgcctctgtccctgggtc

SEQ ID NO: 103980 - DNA, 23 bp, Homo sapiens
cctctctgtctgagactctctgg

SEQ ID NO: 103981 - DNA, 21 bp, Homo sapiens
cccacactctctgggtgtcct

SEQ ID NO: 103982 - DNA, 22 bp, Homo sapiens
ctgtgtctgtctgtgaggctgt

SEQ ID NO: 103983 - DNA, 23 bp, Homo sapiens
tgacttttctgtgtgagctgctc

SEQ ID NO: 103984 - DNA, 23 bp, Homo sapiens
ttctgcaactgcaactggaagag

SEQ ID NO: 103985 - DNA, 23 bp, Homo sapiens
acacacttgacactcagctgtgt

SEQ ID NO: 103986 - DNA, 23 bp, Homo sapiens
ctccctcgctcactgccttcatc

SEQ ID NO: 103987 - DNA, 23 bp, Homo sapiens
ctctgtgtgtctgtgtcctcatc

SEQ ID NO: 103988 - DNA, 23 bp, Homo sapiens
ccctgcctccctccgtgtctgcg

SEQ ID NO: 103989 - DNA, 23 bp, Homo sapiens
ggggactcagtctgtgtctccat

SEQ ID NO: 103990 - DNA, 22 bp, Homo sapiens
agtggacgaggtccagccaaca

SEQ ID NO: 103991 - DNA, 23 bp, Homo sapiens
tgtgtgtgtctgtccctcagtgc

SEQ ID NO: 103992 - DNA, 23 bp, Homo sapiens
tgtgagtctcagtctctattgtc

SEQ ID NO: 103993 - DNA, 23 bp, Homo sapiens
tgagaccgagtctccctctgtca

SEQ ID NO: 103994 - DNA, 23 bp, Homo sapiens
ctgagggtttctgtcacttttct

SEQ ID NO: 103995 - DNA, 21 bp, Homo sapiens
ctctccctctgtctctgccac

SEQ ID NO: 103996 - DNA, 23 bp, Homo sapiens
tttcagtgaagtttgaatgcaga

SEQ ID NO: 103997 - DNA, 21 bp, Homo sapiens
actcactctgtcactcaggct

SEQ ID NO: 103998 - DNA, 23 bp, Homo sapiens
acagggtctctctctgtcgccca

SEQ ID NO: 103999 - DNA, 21 bp, Homo sapiens
tggcaggcagcctgaatccga

SEQ ID NO: 104000 - DNA, 23 bp, Homo sapiens
tggcatgaagaggagacagcact

SEQ ID NO: 104001 - DNA, 23 bp, Homo sapiens
cactgagtgacaccctgtcatgt

SEQ ID NO: 104002 - DNA, 23 bp, Homo sapiens
ctgtgtgtgtgtctgtgtctaaa

SEQ ID NO: 104003 - DNA, 22 bp, Homo sapiens
atacgtatatatacgtgtatgt

SEQ ID NO: 104004 - DNA, 23 bp, Homo sapiens
tgagttcattgtagattctggat

SEQ ID NO: 104005 - DNA, 23 bp, Homo sapiens
tgagttcattgtagattctggat

SEQ ID NO: 104006 - DNA, 23 bp, Homo sapiens
agtgctgagatgtgagtcagctc

SEQ ID NO: 104007 - DNA, 22 bp, Homo sapiens
tcagatggatatgttagtgtat

SEQ ID NO: 104008 - DNA, 23 bp, Homo sapiens
tggagtctcactctgtcacccag

SEQ ID NO: 104009 - DNA, 19 bp, Homo sapiens
acacatatgtatatgtaaa

SEQ ID NO: 104010 - DNA, 19 bp, Homo sapiens
atatgtgtatatatacatc

SEQ ID NO: 104011 - DNA, 19 bp, Homo sapiens
ctcagactgtctctctggg

SEQ ID NO: 104012 - DNA, 23 bp, Homo sapiens
atgccagtggctgtcttgagttg

SEQ ID NO: 104013 - DNA, 23 bp, Homo sapiens
cagacagagcacagtgagtttcc

SEQ ID NO: 104014 - DNA, 23 bp, Homo sapiens
ctccctctgtgtgtatgtctctg

SEQ ID NO: 104015 - DNA, 23 bp, Homo sapiens
atggagtctcactctgtcaccca

SEQ ID NO: 104016 - DNA, 23 bp, Homo sapiens
actgtgagctcatggtgagtgct

SEQ ID NO: 104017 - DNA, 20 bp, Homo sapiens
atgtgtgtatatatatgttt

SEQ ID NO: 104018 - DNA, 18 bp, Homo sapiens
cagtcggtctgacagagc

SEQ ID NO: 104019 - DNA, 23 bp, Homo sapiens
acactgaccctgactccctgcca

SEQ ID NO: 104020 - DNA, 19 bp, Homo sapiens
gtccatgctctcctgccag

SEQ ID NO: 104021 - DNA, 20 bp, Homo sapiens
gtggtaggatcacttgagct

SEQ ID NO: 104022 - DNA, 23 bp, Homo sapiens
tagaatagtgaatgctttccaat

SEQ ID NO: 104023 - DNA, 21 bp, Homo sapiens
tcactctccctcactgagctg

SEQ ID NO: 104024 - DNA, 23 bp, Homo sapiens
tctcactctgtcacccaatctgg

SEQ ID NO: 104025 - DNA, 23 bp, Homo sapiens
cagtctcactctgacactcaggc

SEQ ID NO: 104026 - DNA, 21 bp, Homo sapiens
actgctcccactctgcctgcc

SEQ ID NO: 104027 - DNA, 23 bp, Homo sapiens
cacagtctcactgtcactcaggc

SEQ ID NO: 104028 - DNA, 23 bp, Homo sapiens
agtggtgtgatcatggctcactg

SEQ ID NO: 104029 - DNA, 23 bp, Homo sapiens
aggtgctaagtagtaaaggtgct

SEQ ID NO: 104030 - DNA, 20 bp, Homo sapiens
tatttaatactgcagccaaa

SEQ ID NO: 104031 - DNA, 23 bp, Homo sapiens
tgtgcttggacactctcactcag

SEQ ID NO: 104032 - DNA, 22 bp, Homo sapiens
tgtgtggcacagaaatgaccag

SEQ ID NO: 104033 - DNA, 23 bp, Homo sapiens
ggcactcactgtccctctctaga

SEQ ID NO: 104034 - DNA, 23 bp, Homo sapiens
gtctctctctgcctctcagccag

SEQ ID NO: 104035 - DNA, 23 bp, Homo sapiens
gtctctctctgagccagtcgatg

SEQ ID NO: 104036 - DNA, 23 bp, Homo sapiens
gacactttctcactcacagcaga

SEQ ID NO: 104037 - DNA, 23 bp, Homo sapiens
tgagtctcactctgtcacccagg

SEQ ID NO: 104038 - DNA, 22 bp, Homo sapiens
tgtctgtctgtctgataccatc

SEQ ID NO: 104039 - DNA, 23 bp, Homo sapiens
tccaggctcactgtgtgactgtc

SEQ ID NO: 104040 - DNA, 23 bp, Homo sapiens
tgcgtctgtgactgggtgtctgg

SEQ ID NO: 104041 - DNA, 23 bp, Homo sapiens
agagcaagactctgtctcaaaac

SEQ ID NO: 104042 - DNA, 23 bp, Homo sapiens
tttgagacaagagtctcgctctg

SEQ ID NO: 104043 - DNA, 22 bp, Homo sapiens
tggtgtctctctgtgtcgctca

SEQ ID NO: 104044 - DNA, 23 bp, Homo sapiens
atcgggtttttgttgttgctgct

SEQ ID NO: 104045 - DNA, 19 bp, Homo sapiens
tgagatggagtctcactct

SEQ ID NO: 104046 - DNA, 23 bp, Homo sapiens
ccatttgtttgcatattgtccaa

SEQ ID NO: 104047 - DNA, 23 bp, Homo sapiens
cagagttgagagactgcacagag

SEQ ID NO: 104048 - DNA, 19 bp, Homo sapiens
ttgttgttgttttgagaca

SEQ ID NO: 104049 - DNA, 19 bp, Homo sapiens
atctcgattcactgcaacc

SEQ ID NO: 104050 - DNA, 23 bp, Homo sapiens
tggagtctcactctgtcacccag

SEQ ID NO: 104051 - DNA, 22 bp, Homo sapiens
acacacaacacagtctgcccaa

SEQ ID NO: 104052 - DNA, 20 bp, Homo sapiens
agtctcgctctgtcacccag

SEQ ID NO: 104053 - DNA, 19 bp, Homo sapiens
tctgctgtgcctcgtccca

SEQ ID NO: 104054 - DNA, 23 bp, Homo sapiens
acacaggagagagtgttgacaag

SEQ ID NO: 104055 - DNA, 23 bp, Homo sapiens
cagagtctcactctgtcacccag

SEQ ID NO: 104056 - DNA, 20 bp, Homo sapiens
aatggtgcgatctctgctcg

SEQ ID NO: 104057 - DNA, 19 bp, Homo sapiens
atgaccttctcctttgcag

SEQ ID NO: 104058 - DNA, 18 bp, Homo sapiens
tgccaaagggcatagagt

SEQ ID NO: 104059 - DNA, 23 bp, Homo sapiens
agagtctcactctgtcacccagg

SEQ ID NO: 104060 - DNA, 23 bp, Homo sapiens
tggctcactgtgacttctgcctc

SEQ ID NO: 104061 - DNA, 23 bp, Homo sapiens
agagtctcactctgtcacccagg

SEQ ID NO: 104062 - DNA, 23 bp, Homo sapiens
agatggagtctcactctgtcacc

SEQ ID NO: 104063 - DNA, 23 bp, Homo sapiens
acagattctcactctgtcaccca

SEQ ID NO: 104064 - DNA, 23 bp, Homo sapiens
agagtctcactctgtcacccagg

SEQ ID NO: 104065 - DNA, 23 bp, Homo sapiens
agagctggcagtcactgtctcag

SEQ ID NO: 104066 - DNA, 22 bp, Homo sapiens
gactgagtctcactctgtcgcc

SEQ ID NO: 104067 - DNA, 23 bp, Homo sapiens
tggctccctgtatgggtctctgt

SEQ ID NO: 104068 - DNA, 23 bp, Homo sapiens
tttcacactgtagggtgaagatt

SEQ ID NO: 104069 - DNA, 23 bp, Homo sapiens
tttttgcctcactgtatgtgtga

SEQ ID NO: 104070 - DNA, 19 bp, Homo sapiens
actgtgagggtgagcaagg

SEQ ID NO: 104071 - DNA, 23 bp, Homo sapiens
ttgaaagagagtctcactctgtc

SEQ ID NO: 104072 - DNA, 22 bp, Homo sapiens
tcacacctgtagtcccagcact

SEQ ID NO: 104073 - DNA, 21 bp, Homo sapiens
cccctgtagctccagctgctc

SEQ ID NO: 104074 - DNA, 23 bp, Homo sapiens
cggagtctcactctgtcacccag

SEQ ID NO: 104075 - DNA, 23 bp, Homo sapiens
gagtctcactctgtcacccaggc

SEQ ID NO: 104076 - DNA, 23 bp, Homo sapiens
tgtgacagtgtctcactctgttg

SEQ ID NO: 104077 - DNA, 21 bp, Homo sapiens
ttttttctttttgagatggag

SEQ ID NO: 104078 - DNA, 23 bp, Homo sapiens
acactcagctaatctttatattt

SEQ ID NO: 104079 - DNA, 22 bp, Homo sapiens
tgaggggctgtgtctgggggtg

SEQ ID NO: 104080 - DNA, 23 bp, Homo sapiens
cgcactcactctcagactgcccg

SEQ ID NO: 104081 - DNA, 20 bp, Homo sapiens
aggttgtgtgtgtgcacaca

SEQ ID NO: 104082 - DNA, 18 bp, Homo sapiens
tcacgctgcctctctcct

SEQ ID NO: 104083 - DNA, 19 bp, Homo sapiens
acagacagacagaggggct

SEQ ID NO: 104084 - DNA, 23 bp, Homo sapiens
actgagtatctcactctgtcacc

SEQ ID NO: 104085 - DNA, 23 bp, Homo sapiens
gatggctgggtctgtgaggctct

SEQ ID NO: 104086 - DNA, 23 bp, Homo sapiens
gatggtctcgctctcttgacttc

SEQ ID NO: 104087 - DNA, 20 bp, Homo sapiens
ttacagtcgtgagccaccac

SEQ ID NO: 104088 - DNA, 21 bp, Homo sapiens
agaccacctagaatcctgaaa

SEQ ID NO: 104089 - DNA, 23 bp, Homo sapiens
acagagtctcgctctgtcaccca

SEQ ID NO: 104090 - DNA, 19 bp, Homo sapiens
ctatatatatatctgtaca

SEQ ID NO: 104091 - DNA, 23 bp, Homo sapiens
agagtctcactctgtcacccagg

SEQ ID NO: 104092 - DNA, 20 bp, Homo sapiens
ttctgtgtcccttagaagtg

SEQ ID NO: 104093 - DNA, 23 bp, Homo sapiens
agagagtcgcactgtgtctccca

SEQ ID NO: 104094 - DNA, 21 bp, Homo sapiens
agagtctcactctgtcgccca

SEQ ID NO: 104095 - DNA, 23 bp, Homo sapiens
tgtgtgtatatatatatatctgt

SEQ ID NO: 104096 - DNA, 23 bp, Homo sapiens
tgtcaggctgactcccagccaca

SEQ ID NO: 104097 - DNA, 23 bp, Homo sapiens
attgagacggagtcttgctctgt

SEQ ID NO: 104098 - DNA, 18 bp, Homo sapiens
gcctgagtgtgtgtccca

SEQ ID NO: 104099 - DNA, 20 bp, Homo sapiens
agtctcgctctgtcgctcag

SEQ ID NO: 104100 - DNA, 23 bp, Homo sapiens
tgcctgcctgcctgcctgtttca

SEQ ID NO: 104101 - DNA, 23 bp, Homo sapiens
tgttctttttgcttaggattgtc

SEQ ID NO: 104102 - DNA, 20 bp, Homo sapiens
tgcagtggtctccgcctgta

SEQ ID NO: 104103 - DNA, 23 bp, Homo sapiens
gtcaccgtccctgactggctggc

SEQ ID NO: 104104 - DNA, 23 bp, Homo sapiens
agtgatctgagactgtgccactg

SEQ ID NO: 104105 - DNA, 23 bp, Homo sapiens
gacagagtctcgctctgtcaccc

SEQ ID NO: 104106 - DNA, 23 bp, Homo sapiens
gtcaccgtccctgactggctggc

SEQ ID NO: 104107 - DNA, 23 bp, Homo sapiens
agtgatctgagactgtgccactg

SEQ ID NO: 104108 - DNA, 23 bp, Homo sapiens
ttgatggagtctcgctctgtccc

SEQ ID NO: 104109 - DNA, 23 bp, Homo sapiens
gacagagtctcgctctgtcaccc

SEQ ID NO: 104110 - DNA, 23 bp, Homo sapiens
atctgagggttgtagaagtatgt

SEQ ID NO: 104111 - DNA, 22 bp, Homo sapiens
cttcacacactttctctctctc

SEQ ID NO: 104112 - DNA, 23 bp, Homo sapiens
tgagttcattgtagattctggat

SEQ ID NO: 104113 - DNA, 23 bp, Homo sapiens
tgagttcattgtagattctggat

SEQ ID NO: 104114 - DNA, 23 bp, Homo sapiens
tgagttcattgtagattctggat

SEQ ID NO: 104115 - DNA, 23 bp, Homo sapiens
tgagttcattgtagattctggat

SEQ ID NO: 104116 - DNA, 23 bp, Homo sapiens
cagtgtctcactgtgtcacccca

SEQ ID NO: 104117 - DNA, 21 bp, Homo sapiens
atgcagtggcatgatcttgac

SEQ ID NO: 104118 - DNA, 23 bp, Homo sapiens
tgtgtatgtgtgtatacatatgt

SEQ ID NO: 104119 - DNA, 19 bp, Homo sapiens
tatatatatgtacacacac

SEQ ID NO: 104120 - DNA, 20 bp, Homo sapiens
gcagtctctctctgcctgtc

SEQ ID NO: 104121 - DNA, 23 bp, Homo sapiens
tcactagactgtgagctctgaga

SEQ ID NO: 104122 - DNA, 23 bp, Homo sapiens
gactgagtctcgctctgtcaccc

SEQ ID NO: 104123 - DNA, 21 bp, Homo sapiens
acacagaaaagactctggcca

SEQ ID NO: 104124 - DNA, 23 bp, Homo sapiens
tggagtctcactctgtcacccag

SEQ ID NO: 104125 - DNA, 23 bp, Homo sapiens
tctgggtccctctgaccgtctct

SEQ ID NO: 104126 - DNA, 19 bp, Homo sapiens
ttccactgaacagtgctgc

SEQ ID NO: 104127 - DNA, 18 bp, Homo sapiens
tctggagagagacagcag

SEQ ID NO: 104128 - DNA, 21 bp, Homo sapiens
tgctcctgcctctccagggtc

SEQ ID NO: 104129 - DNA, 23 bp, Homo sapiens
actctggactcactatctgtctc

SEQ ID NO: 104130 - DNA, 23 bp, Homo sapiens
ctccctgtctgtgtgtcttcttg

SEQ ID NO: 104131 - DNA, 23 bp, Homo sapiens
gtggccttcagtttgcagtctca

SEQ ID NO: 104132 - DNA, 20 bp, Homo sapiens
agtgttttgattaccctatc

SEQ ID NO: 104133 - DNA, 23 bp, Homo sapiens
agtctcagcttctccatctgtaa

SEQ ID NO: 104134 - DNA, 23 bp, Homo sapiens
tgagttcattgtagattctggat

SEQ ID NO: 104135 - DNA, 23 bp, Homo sapiens
tgagttcattgtagattctggat

SEQ ID NO: 104136 - DNA, 22 bp, Homo sapiens
tggagtctcactctgtcactca

SEQ ID NO: 104137 - DNA, 23 bp, Homo sapiens
tttttgagtctcgctctgttgcc

SEQ ID NO: 104138 - DNA, 23 bp, Homo sapiens
agaatctcactcactctgttgcc

SEQ ID NO: 104139 - DNA, 21 bp, Homo sapiens
ctcactctgtcactcaggctg

SEQ ID NO: 104140 - DNA, 19 bp, Homo sapiens
agtgagccatgatcatgtc

SEQ ID NO: 104141 - DNA, 23 bp, Homo sapiens
tgcagtggcatgatcttggctta

SEQ ID NO: 104142 - DNA, 22 bp, Homo sapiens
aaagtgctggaattgcagatgt

SEQ ID NO: 104143 - DNA, 21 bp, Homo sapiens
gtgacatctgaccagcagaca

SEQ ID NO: 104144 - DNA, 23 bp, Homo sapiens
agagtctcactctgtcacccagg

SEQ ID NO: 104145 - DNA, 19 bp, Homo sapiens
ctggggctgtgtgaccctg

SEQ ID NO: 104146 - DNA, 23 bp, Homo sapiens
tgtctgtttctctcagggtttcc

SEQ ID NO: 104147 - DNA, 19 bp, Homo sapiens
atcagttcaatctgcttcc

SEQ ID NO: 104148 - DNA, 23 bp, Homo sapiens
gactgagtctcactctgtcacct

SEQ ID NO: 104149 - DNA, 23 bp, Homo sapiens
tttgagacggagtctctctctgt

SEQ ID NO: 104150 - DNA, 20 bp, Homo sapiens
aggctatagttggccttgag

SEQ ID NO: 104151 - DNA, 21 bp, Homo sapiens
tctcagtgattgtatgctgtg

SEQ ID NO: 104152 - DNA, 22 bp, Homo sapiens
ggtgtgtgtgggctgtgtgact

SEQ ID NO: 104153 - DNA, 23 bp, Homo sapiens
acactctgaggctcagttttctc

SEQ ID NO: 104154 - DNA, 23 bp, Homo sapiens
tcacaatgacactctctcagtca

SEQ ID NO: 104155 - DNA, 23 bp, Homo sapiens
tacagtggcttgatcatggctca

SEQ ID NO: 104156 - DNA, 23 bp, Homo sapiens
agagctggtgagagtcaggacag

SEQ ID NO: 104157 - DNA, 21 bp, Homo sapiens
tcaatctctctaagtctttgt

SEQ ID NO: 104158 - DNA, 22 bp, Homo sapiens
tgggagtctcactctgtcgctg

SEQ ID NO: 104159 - DNA, 21 bp, Homo sapiens
actctcccactgtgtgacctt

SEQ ID NO: 104160 - DNA, 23 bp, Homo sapiens
aggctctctctgtcaatgtagtc

SEQ ID NO: 104161 - DNA, 23 bp, Homo sapiens
ctctgtcactgtctagctgtgtg

SEQ ID NO: 104162 - DNA, 23 bp, Homo sapiens
cactgtgtgtgtgcctctgtgtg

SEQ ID NO: 104163 - DNA, 23 bp, Homo sapiens
aggtcctgagaaaggttcatctt

SEQ ID NO: 104164 - DNA, 23 bp, Homo sapiens
cgtctctgtgtgtctgtgtatgc

SEQ ID NO: 104165 - DNA, 18 bp, Homo sapiens
tgctgtccttcaaagacc

SEQ ID NO: 104166 - DNA, 23 bp, Homo sapiens
tgcctccctccctcactgacagc

SEQ ID NO: 104167 - DNA, 23 bp, Homo sapiens
tggagtctcactctgtcacccag

SEQ ID NO: 104168 - DNA, 23 bp, Homo sapiens
gattgtagtaccagagtagtccc

SEQ ID NO: 104169 - DNA, 19 bp, Homo sapiens
ttggtactgtgtcagtcag

SEQ ID NO: 104170 - DNA, 23 bp, Homo sapiens
gtgtgtgcatctgcatgtgtatg

SEQ ID NO: 104171 - DNA, 23 bp, Homo sapiens
agatctctctctgtctctcaggc

SEQ ID NO: 104172 - DNA, 23 bp, Homo sapiens
tccttcactgttttacattacag

SEQ ID NO: 104173 - DNA, 21 bp, Homo sapiens
tggctgggtcactgcaagaat

SEQ ID NO: 104174 - DNA, 23 bp, Homo sapiens
tggggtctctctctgtcacccag

SEQ ID NO: 104175 - DNA, 20 bp, Homo sapiens
gtggcatgcatctgtagtcc

SEQ ID NO: 104176 - DNA, 20 bp, Homo sapiens
tgtatctgtgcatgtggttg

SEQ ID NO: 104177 - DNA, 23 bp, Homo sapiens
gccagagttcagacttcattctc

SEQ ID NO: 104178 - DNA, 18 bp, Homo sapiens
agacaagactccgtctca

SEQ ID NO: 104179 - DNA, 23 bp, Homo sapiens
tcagagtctcactctgtcaccca

SEQ ID NO: 104180 - DNA, 23 bp, Homo sapiens
cagtgtcactctgggtcagatgc

SEQ ID NO: 104181 - DNA, 23 bp, Homo sapiens
cagtcccagactctctgcctctg

SEQ ID NO: 104182 - DNA, 22 bp, Homo sapiens
tgggtgtgactatgtaataagg

SEQ ID NO: 104183 - DNA, 23 bp, Homo sapiens
tttgagacagagtctcactctgt

SEQ ID NO: 104184 - DNA, 23 bp, Homo sapiens
actgaggcacagagacgggacat

SEQ ID NO: 104185 - DNA, 23 bp, Homo sapiens
agtgtctgtttatctgtctgcct

SEQ ID NO: 104186 - DNA, 23 bp, Homo sapiens
gactgagtctcgctctgtcaccc

SEQ ID NO: 104187 - DNA, 18 bp, Homo sapiens
acacagtggagccacggc

SEQ ID NO: 104188 - DNA, 23 bp, Homo sapiens
tgtgtgaacagtgtgtgcacagt

SEQ ID NO: 104189 - DNA, 21 bp, Homo sapiens
ctgctcagtgttcacatggca

SEQ ID NO: 104190 - DNA, 21 bp, Homo sapiens
aaagtctcactctgtcaccca

SEQ ID NO: 104191 - DNA, 22 bp, Homo sapiens
tatgactctgtcactcaggctg

SEQ ID NO: 104192 - DNA, 22 bp, Homo sapiens
gtagacagcttattgggatcta

SEQ ID NO: 104193 - DNA, 22 bp, Homo sapiens
aggtggtaggatcacttgagca

SEQ ID NO: 104194 - DNA, 22 bp, Homo sapiens
aatttctgtatttttattagag

SEQ ID NO: 104195 - DNA, 23 bp, Homo sapiens
ataaggagatgcagatatatgct

SEQ ID NO: 104196 - DNA, 18 bp, Homo sapiens
aaggtgggactgagaggg

SEQ ID NO: 104197 - DNA, 23 bp, Homo sapiens
tgtatctctgacacagtctcacc

SEQ ID NO: 104198 - DNA, 23 bp, Homo sapiens
tgtgtgagagagagacagactga

SEQ ID NO: 104199 - DNA, 23 bp, Homo sapiens
aggtttttgctgttatcacacag

SEQ ID NO: 104200 - DNA, 23 bp, Homo sapiens
tgtctctgactctgtgatctttg

SEQ ID NO: 104201 - DNA, 19 bp, Homo sapiens
tatatgtatatgtatatgt

SEQ ID NO: 104202 - DNA, 23 bp, Homo sapiens
tatgtgtatgtgcatatgtatat

SEQ ID NO: 104203 - DNA, 23 bp, Homo sapiens
gtctcactctcagggttgttaat

SEQ ID NO: 104204 - DNA, 18 bp, Homo sapiens
actttctttttgagacag

SEQ ID NO: 104205 - DNA, 23 bp, Homo sapiens
gactggggaagatctgtgtgtgg

SEQ ID NO: 104206 - DNA, 23 bp, Homo sapiens
agggtctcgctgtcacccaggct

SEQ ID NO: 104207 - DNA, 21 bp, Homo sapiens
tgtggctttggaccagtttcc

SEQ ID NO: 104208 - DNA, 21 bp, Homo sapiens
aggttctggcaagactgtcac

SEQ ID NO: 104209 - DNA, 23 bp, Homo sapiens
agactgagtctcgctctgtcacc

SEQ ID NO: 104210 - DNA, 23 bp, Homo sapiens
gactgagtctcgctctgtcaccc

SEQ ID NO: 104211 - DNA, 23 bp, Homo sapiens
cggagtctcactctgtcacccag

SEQ ID NO: 104212 - DNA, 19 bp, Homo sapiens
taagcctttacattttctg

SEQ ID NO: 104213 - DNA, 23 bp, Homo sapiens
tgtgagccactgtgcctggctgt

SEQ ID NO: 104214 - DNA, 23 bp, Homo sapiens
gggtctcactctgtcacccaggc

SEQ ID NO: 104215 - DNA, 23 bp, Homo sapiens
actttctcactctgtaagatggc

SEQ ID NO: 104216 - DNA, 23 bp, Homo sapiens
atgtgaaaagttgaaatggtgac

SEQ ID NO: 104217 - DNA, 23 bp, Homo sapiens
tcttagctctgtctgtctgtctg

SEQ ID NO: 104218 - DNA, 23 bp, Homo sapiens
ggcctgtctgtctgcctgtgatg

SEQ ID NO: 104219 - DNA, 23 bp, Homo sapiens
cagagtcactgactcactgtgtg

SEQ ID NO: 104220 - DNA, 21 bp, Homo sapiens
taagtgactccagtctctggg

SEQ ID NO: 104221 - DNA, 23 bp, Homo sapiens
tgtacagtggataagagtgtggg

SEQ ID NO: 104222 - DNA, 23 bp, Homo sapiens
tacacctacacgctctgtgactt

SEQ ID NO: 104223 - DNA, 18 bp, Homo sapiens
cagtcccactgacactgg

SEQ ID NO: 104224 - DNA, 23 bp, Homo sapiens
ggaatagcaggaacagggtgcac

SEQ ID NO: 104225 - DNA, 23 bp, Homo sapiens
gtcctgagtcactctgtgcctgc

SEQ ID NO: 104226 - DNA, 23 bp, Homo sapiens
aggaagtcttgagtcttcctctt

SEQ ID NO: 104227 - DNA, 23 bp, Homo sapiens
tcactgattttctctatgcttta

SEQ ID NO: 104228 - DNA, 18 bp, Homo sapiens
atgcctgtagtaccagct

SEQ ID NO: 104229 - DNA, 23 bp, Homo sapiens
tgcctgtctccctgtttgtctct

SEQ ID NO: 104230 - DNA, 22 bp, Homo sapiens
ctcactctctcagtgcctctgg

SEQ ID NO: 104231 - DNA, 23 bp, Homo sapiens
actagtgagaactgtgcctgcac

SEQ ID NO: 104232 - DNA, 23 bp, Homo sapiens
agacactatcctctctgggagtt

SEQ ID NO: 104233 - DNA, 23 bp, Homo sapiens
agagtctcactctgtcacccagg

SEQ ID NO: 104234 - DNA, 23 bp, Homo sapiens
gagtctcactctgtcacccaggc

SEQ ID NO: 104235 - DNA, 23 bp, Homo sapiens
cggagtctcactctgtcacccag

SEQ ID NO: 104236 - DNA, 23 bp, Homo sapiens
tggagtctcactctgtcacccag

SEQ ID NO: 104237 - DNA, 18 bp, Homo sapiens
caggcaggttttctgtgt

SEQ ID NO: 104238 - DNA, 23 bp, Homo sapiens
cgaagttctgcacgtccaggtgg

SEQ ID NO: 104239 - DNA, 20 bp, Homo sapiens
ctgggagcaactgaacaggg

SEQ ID NO: 104240 - DNA, 20 bp, Homo sapiens
aatcactatcaggaagacga

SEQ ID NO: 104241 - DNA, 20 bp, Homo sapiens
cagtctcgctctgtcacccg

SEQ ID NO: 104242 - DNA, 20 bp, Homo sapiens
cagtatatagtaagtgtgtg

SEQ ID NO: 104243 - DNA, 23 bp, Homo sapiens
tgtgtctgattctcactcacttg

SEQ ID NO: 104244 - DNA, 23 bp, Homo sapiens
gagacagagtctcactctgtcgc

SEQ ID NO: 104245 - DNA, 22 bp, Homo sapiens
cagagtctcactcagtcaccca

SEQ ID NO: 104246 - DNA, 23 bp, Homo sapiens
acagattttcaggaggaggtcaa

SEQ ID NO: 104247 - DNA, 18 bp, Homo sapiens
ttggagacccacctttgt

SEQ ID NO: 104248 - DNA, 19 bp, Homo sapiens
gtacagtggtgaaatcact

SEQ ID NO: 104249 - DNA, 23 bp, Homo sapiens
cggagtctcactctgtcacccag

SEQ ID NO: 104250 - DNA, 23 bp, Homo sapiens
gggagtctctctctgtggctcag

SEQ ID NO: 104251 - DNA, 23 bp, Homo sapiens
tcaggctctcagtgggtccctct

SEQ ID NO: 104252 - DNA, 19 bp, Homo sapiens
ggaatcgcttgaacctggg

SEQ ID NO: 104253 - DNA, 23 bp, Homo sapiens
ttctaggaggttctagtttctat

SEQ ID NO: 104254 - DNA, 23 bp, Homo sapiens
tgtgtgacctgccttgaatcccc

SEQ ID NO: 104255 - DNA, 23 bp, Homo sapiens
ctcactgagtgcctctctgcttc

SEQ ID NO: 104256 - DNA, 18 bp, Homo sapiens
acagttgtgtgatctctg

SEQ ID NO: 104257 - DNA, 23 bp, Homo sapiens
tggctctgtccctgactgtgtga

SEQ ID NO: 104258 - DNA, 22 bp, Homo sapiens
tgagacagggtctggctctgtc

SEQ ID NO: 104259 - DNA, 23 bp, Homo sapiens
actgagtctcactctgtcgccca

SEQ ID NO: 104260 - DNA, 23 bp, Homo sapiens
agaccgagtctcactctgtcacc

SEQ ID NO: 104261 - DNA, 23 bp, Homo sapiens
ctgaggtaagaggatcacttgag

SEQ ID NO: 104262 - DNA, 23 bp, Homo sapiens
tgtcagtgacagctaatccttga

SEQ ID NO: 104263 - DNA, 23 bp, Homo sapiens
tgtgtatatatatatgtgtgtgt

SEQ ID NO: 104264 - DNA, 23 bp, Homo sapiens
gacagagtctcactctgtcgccc

SEQ ID NO: 104265 - DNA, 23 bp, Homo sapiens
tgtgtgtatgtatacatgtgtgt

SEQ ID NO: 104266 - DNA, 23 bp, Homo sapiens
agagtctcactctgtcacccagg

SEQ ID NO: 104267 - DNA, 23 bp, Homo sapiens
tggagtctcactctgtcacccag

SEQ ID NO: 104268 - DNA, 23 bp, Homo sapiens
cagggtctcactctgtcacccag

SEQ ID NO: 104269 - DNA, 23 bp, Homo sapiens
cagagtctcacactgtcgctcag

SEQ ID NO: 104270 - DNA, 23 bp, Homo sapiens
agagtctcactctgtcacccagg

SEQ ID NO: 104271 - DNA, 23 bp, Homo sapiens
agagtctcactctgtcacccagg

SEQ ID NO: 104272 - DNA, 23 bp, Homo sapiens
gagtctcactctgtcacccaggc

SEQ ID NO: 104273 - DNA, 23 bp, Homo sapiens
tgagacagagtttcactcttgtt

SEQ ID NO: 104274 - DNA, 23 bp, Homo sapiens
actggctgtgtgtctgtgcctgt

SEQ ID NO: 104275 - DNA, 23 bp, Homo sapiens
acagagatgagagactggtccct

SEQ ID NO: 104276 - DNA, 23 bp, Homo sapiens
actgtgtctcgctctgtcaccca

SEQ ID NO: 104277 - DNA, 23 bp, Homo sapiens
atgtatatatctatatatgtgta

SEQ ID NO: 104278 - DNA, 19 bp, Homo sapiens
tatgtatctatatatatgt

SEQ ID NO: 104279 - DNA, 19 bp, Homo sapiens
tatgtatctatatatatgt

SEQ ID NO: 104280 - DNA, 19 bp, Homo sapiens
tatgtatctatatatatgt

SEQ ID NO: 104281 - DNA, 23 bp, Homo sapiens
gacagactctcgctctgtcaccc

SEQ ID NO: 104282 - DNA, 23 bp, Homo sapiens
tgtttgtttgaaatgaagtctca

SEQ ID NO: 104283 - DNA, 20 bp, Homo sapiens
atatgtgtgtgtgtatatgt

SEQ ID NO: 104284 - DNA, 23 bp, Homo sapiens
ctgagtaggaagttggatgtttt

SEQ ID NO: 104285 - DNA, 21 bp, Homo sapiens
tgacagagtgagaccttgtct

SEQ ID NO: 104286 - DNA, 23 bp, Homo sapiens
agacagagtcttactctgtcacc

SEQ ID NO: 104287 - DNA, 21 bp, Homo sapiens
tgaggtaggaggatcatttga

SEQ ID NO: 104288 - DNA, 23 bp, Homo sapiens
aatggtatagtttttcttgaaga

SEQ ID NO: 104289 - DNA, 23 bp, Homo sapiens
tctctgtccctctctgggcctct

SEQ ID NO: 104290 - DNA, 23 bp, Homo sapiens
gtgcgtgcttgtagtttcagcta

SEQ ID NO: 104291 - DNA, 21 bp, Homo sapiens
tgaggtagaaggatggtttga

SEQ ID NO: 104292 - DNA, 23 bp, Homo sapiens
cggagtctcactctgtcaccccg

SEQ ID NO: 104293 - DNA, 23 bp, Homo sapiens
gagtctcactgtgtcacccaggc

SEQ ID NO: 104294 - DNA, 23 bp, Homo sapiens
tatgagtctgtgtgtgtcagggg

SEQ ID NO: 104295 - DNA, 23 bp, Homo sapiens
gctagtgagtggtaaagaaagga

SEQ ID NO: 104296 - DNA, 21 bp, Homo sapiens
agccactgatgagagatgtga

SEQ ID NO: 104297 - DNA, 23 bp, Homo sapiens
tcagtcactgtcactcagcttgg

SEQ ID NO: 104298 - DNA, 23 bp, Homo sapiens
tctgcctgagagtgtgtcctgtg

SEQ ID NO: 104299 - DNA, 23 bp, Homo sapiens
ttcactctctgagtctcagtttc

SEQ ID NO: 104300 - DNA, 23 bp, Homo sapiens
ctgtgcctcagttttctcaccta

SEQ ID NO: 104301 - DNA, 21 bp, Homo sapiens
ggtctcactttctgtctctcc

SEQ ID NO: 104302 - DNA, 21 bp, Homo sapiens
aacacatcattggaattctga

SEQ ID NO: 104303 - DNA, 21 bp, Homo sapiens
tttatctcgtagtttttgaat

SEQ ID NO: 104304 - DNA, 23 bp, Homo sapiens
tgacagtagagactgaggtaagc

SEQ ID NO: 104305 - DNA, 23 bp, Homo sapiens
actgactctgtgtctggcagcct

SEQ ID NO: 104306 - DNA, 18 bp, Homo sapiens
tctgactctctcttccag

SEQ ID NO: 104307 - DNA, 20 bp, Homo sapiens
tctctgaaagtgaaagacag

SEQ ID NO: 104308 - DNA, 23 bp, Homo sapiens
tgtcttagctattctaggtctta

SEQ ID NO: 104309 - DNA, 22 bp, Homo sapiens
acagtctactctctgctcaagt

SEQ ID NO: 104310 - DNA, 23 bp, Homo sapiens
aagcagagagtagagtgtgtcta

SEQ ID NO: 104311 - DNA, 22 bp, Homo sapiens
tttgagacagagtcttgctgtt

SEQ ID NO: 104312 - DNA, 20 bp, Homo sapiens
tggacagggttgactgtcac

SEQ ID NO: 104313 - DNA, 23 bp, Homo sapiens
acagcctttaactgtctccactt

SEQ ID NO: 104314 - DNA, 23 bp, Homo sapiens
ttctctctgtgtctcaaaggcct

SEQ ID NO: 104315 - DNA, 23 bp, Homo sapiens
tcagtgaggtaagtgactgtccc

SEQ ID NO: 104316 - DNA, 23 bp, Homo sapiens
ggctcagacagtagagactgagg

SEQ ID NO: 104317 - DNA, 22 bp, Homo sapiens
tgcctctcagtgtcacatgaga

SEQ ID NO: 104318 - DNA, 18 bp, Homo sapiens
cacagagaggttaagttc

SEQ ID NO: 104319 - DNA, 23 bp, Homo sapiens
tcacactcacccagtgggacacc

SEQ ID NO: 104320 - DNA, 23 bp, Homo sapiens
aggtgtgtgtgcatgtgcatgtg

SEQ ID NO: 104321 - DNA, 21 bp, Homo sapiens
cacacggtctcactcaccctc

SEQ ID NO: 104322 - DNA, 18 bp, Homo sapiens
tctgtgcatcagacacct

SEQ ID NO: 104323 - DNA, 23 bp, Homo sapiens
gtatctgtgtgtgtctgtacatg

SEQ ID NO: 104324 - DNA, 23 bp, Homo sapiens
tatatgtaggatgaacatgggtt

SEQ ID NO: 104325 - DNA, 21 bp, Homo sapiens
gcctgagtgcctctctgcccc

SEQ ID NO: 104326 - DNA, 21 bp, Homo sapiens
ttttgagacggagtctcactc

SEQ ID NO: 104327 - DNA, 18 bp, Homo sapiens
aagtgctaggattacagg

SEQ ID NO: 104328 - DNA, 23 bp, Homo sapiens
aaacatgatttacagctggactt

SEQ ID NO: 104329 - DNA, 23 bp, Homo sapiens
agagtctcactctgtcacccagg

SEQ ID NO: 104330 - DNA, 23 bp, Homo sapiens
gagtctcactctgtcacccaggc

SEQ ID NO: 104331 - DNA, 23 bp, Homo sapiens
tctcactctgtctgttgctcatt

SEQ ID NO: 104332 - DNA, 23 bp, Homo sapiens
ggcacagggtgtccactgcagct

SEQ ID NO: 104333 - DNA, 23 bp, Homo sapiens
agccactgtgcgtctctcccacc

SEQ ID NO: 104334 - DNA, 22 bp, Homo sapiens
tggctctctgatactcagactg

SEQ ID NO: 104335 - DNA, 20 bp, Homo sapiens
tgagacagagtctcgctctg

SEQ ID NO: 104336 - DNA, 23 bp, Homo sapiens
ggagtctcactctgtcacctagg

SEQ ID NO: 104337 - DNA, 22 bp, Homo sapiens
tcccgctagactgtgagctctg

SEQ ID NO: 104338 - DNA, 21 bp, Homo sapiens
tcaagcaggtcacagtctact

SEQ ID NO: 104339 - DNA, 18 bp, Homo sapiens
atcaagacttggttagac

SEQ ID NO: 104340 - DNA, 19 bp, Homo sapiens
gtctcgctctgtcacccag

SEQ ID NO: 104341 - DNA, 23 bp, Homo sapiens
ctctgtgtgtctgtgagggtgtc

SEQ ID NO: 104342 - DNA, 18 bp, Homo sapiens
ccagagtgcacaggagtg

SEQ ID NO: 104343 - DNA, 21 bp, Homo sapiens
tgtgtgtctgtgtgtctctgt

SEQ ID NO: 104344 - DNA, 23 bp, Homo sapiens
tgtctttttctctctggaagttc

SEQ ID NO: 104345 - DNA, 23 bp, Homo sapiens
cagagaagagggatctgggtcag

SEQ ID NO: 104346 - DNA, 20 bp, Homo sapiens
ccctggctctctcactgtct

SEQ ID NO: 104347 - DNA, 22 bp, Homo sapiens
tgaattgctccttgtgtgagag

SEQ ID NO: 104348 - DNA, 23 bp, Homo sapiens
tgcatcaataaggttgtggttca

SEQ ID NO: 104349 - DNA, 18 bp, Homo sapiens
tgtatgcttcagatggtg

SEQ ID NO: 104350 - DNA, 22 bp, Homo sapiens
cagagaggctgagatgtaggaa

SEQ ID NO: 104351 - DNA, 23 bp, Homo sapiens
tagctctcgctctttgtcactct

SEQ ID NO: 104352 - DNA, 23 bp, Homo sapiens
agggtctcactctgtcacccagg

SEQ ID NO: 104353 - DNA, 23 bp, Homo sapiens
agtgcttctcagactctcacagg

SEQ ID NO: 104354 - DNA, 22 bp, Homo sapiens
tcggcctcactcactccctcac

SEQ ID NO: 104355 - DNA, 23 bp, Homo sapiens
agacagaagacactgtgctattc

SEQ ID NO: 104356 - DNA, 23 bp, Homo sapiens
tcacactgaatgtctgagtgtgt

SEQ ID NO: 104357 - DNA, 23 bp, Homo sapiens
agtgctactgtgggtggtgaaca

SEQ ID NO: 104358 - DNA, 23 bp, Homo sapiens
tgagttcattgtagattctggat

SEQ ID NO: 104359 - DNA, 23 bp, Homo sapiens
tgagttcattgtagattctggat

SEQ ID NO: 104360 - DNA, 23 bp, Homo sapiens
gggtctgtctgtctgtctgcatt

SEQ ID NO: 104361 - DNA, 22 bp, Homo sapiens
tatatgtatatagggtttggta

SEQ ID NO: 104362 - DNA, 22 bp, Homo sapiens
tgacgatgctgcaagatctgct

SEQ ID NO: 104363 - DNA, 21 bp, Homo sapiens
aatttgccagatatggtagtg

SEQ ID NO: 104364 - DNA, 23 bp, Homo sapiens
tatgttgattttgtatcctgaaa

SEQ ID NO: 104365 - DNA, 22 bp, Homo sapiens
aacagtttttttggtgtagtgt

SEQ ID NO: 104366 - DNA, 21 bp, Homo sapiens
tgaactgtctggtaaactact

SEQ ID NO: 104367 - DNA, 23 bp, Homo sapiens
tggagtctcactctgtcacccag

SEQ ID NO: 104368 - DNA, 21 bp, Homo sapiens
aggctaagccctttgcatgaa

SEQ ID NO: 104369 - DNA, 22 bp, Homo sapiens
agaggtactgtcatttccattt

SEQ ID NO: 104370 - DNA, 23 bp, Homo sapiens
ctcaggcccagttcactcagcag

SEQ ID NO: 104371 - DNA, 18 bp, Homo sapiens
tgtcaggttggaggagct

SEQ ID NO: 104372 - DNA, 20 bp, Homo sapiens
tctctctctgtctggccagc

SEQ ID NO: 104373 - DNA, 23 bp, Homo sapiens
tgtctcactctgtcacctaggct

SEQ ID NO: 104374 - DNA, 23 bp, Homo sapiens
tttatttatgtatcatattgttc

SEQ ID NO: 104375 - DNA, 23 bp, Homo sapiens
attcatccaacatgtaggctttg

SEQ ID NO: 104376 - DNA, 23 bp, Homo sapiens
ctgtagtctcagctactctggag

SEQ ID NO: 104377 - DNA, 22 bp, Homo sapiens
aaaaattgtatatgtgtatgta

SEQ ID NO: 104378 - DNA, 20 bp, Homo sapiens
agtcagggtctcactctgtt

SEQ ID NO: 104379 - DNA, 23 bp, Homo sapiens
tacagtagtgtgatcatagctca

SEQ ID NO: 104380 - DNA, 19 bp, Homo sapiens
acatcatatatattctaaa

SEQ ID NO: 104381 - DNA, 22 bp, Homo sapiens
atacatcatatgtattctaaaa

SEQ ID NO: 104382 - DNA, 18 bp, Homo sapiens
agggttgttgtggggatt

SEQ ID NO: 104383 - DNA, 20 bp, Homo sapiens
cagagtaaattcataggctt

SEQ ID NO: 104384 - DNA, 23 bp, Homo sapiens
attccttcaactctgtggctctg

SEQ ID NO: 104385 - DNA, 23 bp, Homo sapiens
gtttgttgtacagatcatttcat

SEQ ID NO: 104386 - DNA, 23 bp, Homo sapiens
ttgttggatgtacatactgtttt

SEQ ID NO: 104387 - DNA, 19 bp, Homo sapiens
tgctggactggaagttaca

SEQ ID NO: 104388 - DNA, 21 bp, Homo sapiens
tgagaggtgaaaagagatagg

SEQ ID NO: 104389 - DNA, 21 bp, Homo sapiens
tgggtccctccctgattccct

SEQ ID NO: 104390 - DNA, 20 bp, Homo sapiens
agcacatctgtgtgtgcaca

SEQ ID NO: 104391 - DNA, 20 bp, Homo sapiens
ctgaccgtctgtctctcgct

SEQ ID NO: 104392 - DNA, 23 bp, Homo sapiens
tgaccgaagagactgtggttact

SEQ ID NO: 104393 - DNA, 21 bp, Homo sapiens
tgcctgaagttacacagctca

SEQ ID NO: 104394 - DNA, 23 bp, Homo sapiens
tgacacagtctggctttgagctt

SEQ ID NO: 104395 - DNA, 20 bp, Homo sapiens
agaggaatgaggtttgtgct

SEQ ID NO: 104396 - DNA, 18 bp, Homo sapiens
tgaggtggatcctgattg

SEQ ID NO: 104397 - DNA, 22 bp, Homo sapiens
ttgcactggtttgtaagctcca

SEQ ID NO: 104398 - DNA, 23 bp, Homo sapiens
tgagatggagtctcactctgtca

SEQ ID NO: 104399 - DNA, 23 bp, Homo sapiens
tgtgtgtatatgtatgtgtgtgc

SEQ ID NO: 104400 - DNA, 23 bp, Homo sapiens
gatctagaggatgtcttttgaga

SEQ ID NO: 104401 - DNA, 21 bp, Homo sapiens
gaggtagttggttgtaatgaa

SEQ ID NO: 104402 - DNA, 23 bp, Homo sapiens
tgagacagagtctcactctgtca

SEQ ID NO: 104403 - DNA, 20 bp, Homo sapiens
tcactacaacctccatctct

SEQ ID NO: 104404 - DNA, 23 bp, Homo sapiens
tcacagcctccctgtctcagcag

SEQ ID NO: 104405 - DNA, 23 bp, Homo sapiens
ttgacactggctgttgatgttga

SEQ ID NO: 104406 - DNA, 23 bp, Homo sapiens
tctcgctcactcagtgctccatg

SEQ ID NO: 104407 - DNA, 22 bp, Homo sapiens
actcactttctctgtctgctca

SEQ ID NO: 104408 - DNA, 19 bp, Homo sapiens
ctgaggtgggcagatcatc

SEQ ID NO: 104409 - DNA, 20 bp, Homo sapiens
ttaagatggagtctcgctct

SEQ ID NO: 104410 - DNA, 23 bp, Homo sapiens
agtcactctcagtgtccctcttt

SEQ ID NO: 104411 - DNA, 18 bp, Homo sapiens
tgatggtacagtttctgc

SEQ ID NO: 104412 - DNA, 23 bp, Homo sapiens
tgtaaacatccttgactggaagc

SEQ ID NO: 104413 - DNA, 23 bp, Homo sapiens
gctttcagtcggatgtttacagc

SEQ ID NO: 104414 - DNA, 20 bp, Homo sapiens
ttctgccatggaaaacatca

SEQ ID NO: 104415 - DNA, 19 bp, Homo sapiens
aagtctttagtcctagcta

SEQ ID NO: 104416 - DNA, 23 bp, Homo sapiens
tttgagacggagtctcggtctgt

SEQ ID NO: 104417 - DNA, 23 bp, Homo sapiens
ttatctcatttagttgttgagag

SEQ ID NO: 104418 - DNA, 23 bp, Homo sapiens
agagtctcactctgtcacccagg

SEQ ID NO: 104419 - DNA, 18 bp, Homo sapiens
tctgactcacactgaggc

SEQ ID NO: 104420 - DNA, 19 bp, Homo sapiens
taggtagtaggtagaatag

SEQ ID NO: 104421 - DNA, 23 bp, Homo sapiens
ttctactactcctagctagtggg

SEQ ID NO: 104422 - DNA, 23 bp, Homo sapiens
aatctgcaacaactttgagacac

SEQ ID NO: 104423 - DNA, 23 bp, Homo sapiens
ccctggctgtctgagtgccagca

SEQ ID NO: 104424 - DNA, 23 bp, Homo sapiens
tggagtctctctctgtcacccaa

SEQ ID NO: 104425 - DNA, 23 bp, Homo sapiens
aggccatttcatgccaaagggac

SEQ ID NO: 104426 - DNA, 23 bp, Homo sapiens
cgaggtgtgtgtgtgtcagtgtg

SEQ ID NO: 104427 - DNA, 21 bp, Homo sapiens
tgtgtatatatgtatatatgt

SEQ ID NO: 104428 - DNA, 23 bp, Homo sapiens
tggagtctcactctgtcacccag

SEQ ID NO: 104429 - DNA, 20 bp, Homo sapiens
atgtgctttttttacagctt

SEQ ID NO: 104430 - DNA, 18 bp, Homo sapiens
caggatttttgttttttt

SEQ ID NO: 104431 - DNA, 21 bp, Homo sapiens
agactccgtctcaaaaaaagc

SEQ ID NO: 104432 - DNA, 20 bp, Homo sapiens
acccagagtgggtagctcct

SEQ ID NO: 104433 - DNA, 22 bp, Homo sapiens
atatgtgtatatgtatatgtgt

SEQ ID NO: 104434 - DNA, 23 bp, Homo sapiens
ctggctcagactgtgtctcaggc

SEQ ID NO: 104435 - DNA, 23 bp, Homo sapiens
ccctgagggccagcatgtgcctg

SEQ ID NO: 104436 - DNA, 23 bp, Homo sapiens
ttattagtctcagtttataaatg

SEQ ID NO: 104437 - DNA, 23 bp, Homo sapiens
tgagttcattgtagattctggat

SEQ ID NO: 104438 - DNA, 23 bp, Homo sapiens
tgagttcattgtagattctggat

SEQ ID NO: 104439 - DNA, 19 bp, Homo sapiens
cagggtcttgctgttgtca

SEQ ID NO: 104440 - DNA, 23 bp, Homo sapiens
acacccagtgacagtcttctttc

SEQ ID NO: 104441 - DNA, 23 bp, Homo sapiens
cggagtctcactctgtcacccag

SEQ ID NO: 104442 - DNA, 23 bp, Homo sapiens
tggagtctcactctgtcacccag

SEQ ID NO: 104443 - DNA, 23 bp, Homo sapiens
agacagaacaaacattggagtgt

SEQ ID NO: 104444 - DNA, 23 bp, Homo sapiens
aattatcttctagtccgggagta

SEQ ID NO: 104445 - DNA, 23 bp, Homo sapiens
ttcactgacactcagtctggctc

SEQ ID NO: 104446 - DNA, 23 bp, Homo sapiens
tgtgtgtgtgtgactctgtggtt

SEQ ID NO: 104447 - DNA, 23 bp, Homo sapiens
tatgtatacatgtatgtatatat

SEQ ID NO: 104448 - DNA, 23 bp, Homo sapiens
tgtgatggaggtgctgcaggagg

SEQ ID NO: 104449 - DNA, 23 bp, Homo sapiens
agagaccctcagtcagtgcctct

SEQ ID NO: 104450 - DNA, 22 bp, Homo sapiens
tcatggttgagtgcctgatact

SEQ ID NO: 104451 - DNA, 23 bp, Homo sapiens
gacagtgtcccactctgtcaccc

SEQ ID NO: 104452 - DNA, 21 bp, Homo sapiens
agtgcatatttattggacatt

SEQ ID NO: 104453 - DNA, 23 bp, Homo sapiens
aacagtccatttgaaatgactta

SEQ ID NO: 104454 - DNA, 23 bp, Homo sapiens
gagtctcgctcagtcacaggctg

SEQ ID NO: 104455 - DNA, 22 bp, Homo sapiens
agagagaagttagagatcagaa

SEQ ID NO: 104456 - DNA, 22 bp, Homo sapiens
gtggtaggatcacttgaaccca

SEQ ID NO: 104457 - DNA, 18 bp, Homo sapiens
acagtgagctatgatcat

SEQ ID NO: 104458 - DNA, 23 bp, Homo sapiens
tatgccattttttacctatcaga

SEQ ID NO: 104459 - DNA, 23 bp, Homo sapiens
gagagagtgaagtgtgtgtgcag

SEQ ID NO: 104460 - DNA, 23 bp, Homo sapiens
tctgtctctctgcgtctctcctg

SEQ ID NO: 104461 - DNA, 23 bp, Homo sapiens
agatggagtctcactctgtcacc

SEQ ID NO: 104462 - DNA, 23 bp, Homo sapiens
agagtctcactctgtcacccagg

SEQ ID NO: 104463 - DNA, 21 bp, Homo sapiens
tctcacgggctcacttcccgc

SEQ ID NO: 104464 - DNA, 22 bp, Homo sapiens
ctgcttcctcagtctctgtcag

SEQ ID NO: 104465 - DNA, 23 bp, Homo sapiens
tatggctatatatacatatatgt

SEQ ID NO: 104466 - DNA, 23 bp, Homo sapiens
tggtgtctcactctgtcacccag

SEQ ID NO: 104467 - DNA, 23 bp, Homo sapiens
tctgtctctctcacagataaagg

SEQ ID NO: 104468 - DNA, 23 bp, Homo sapiens
ctgcaaccctgtgcagagtcctc

SEQ ID NO: 104469 - DNA, 22 bp, Homo sapiens
tggagttctgtctctgtcaggg

SEQ ID NO: 104470 - DNA, 23 bp, Homo sapiens
tggagtctcactctgtcacccag

SEQ ID NO: 104471 - DNA, 23 bp, Homo sapiens
tggagtctcactctgtcacccag

SEQ ID NO: 104472 - DNA, 22 bp, Homo sapiens
tctctccctgtcacccaggctg

SEQ ID NO: 104473 - DNA, 20 bp, Homo sapiens
tcgactcactacaacctctg

SEQ ID NO: 104474 - DNA, 23 bp, Homo sapiens
tatgtacatacacacatatgtgt

SEQ ID NO: 104475 - DNA, 21 bp, Homo sapiens
agagtctcactctgtcaccca

SEQ ID NO: 104476 - DNA, 23 bp, Homo sapiens
caggctctgtctgtgactagagt

SEQ ID NO: 104477 - DNA, 20 bp, Homo sapiens
tgaggcagtgtctcactctg

SEQ ID NO: 104478 - DNA, 23 bp, Homo sapiens
tttttgtgtatttcatgatgtgt

SEQ ID NO: 104479 - DNA, 23 bp, Homo sapiens
cttgctcctctcaaagtctaagg

SEQ ID NO: 104480 - DNA, 23 bp, Homo sapiens
agacacagtttcactctgtcacc

SEQ ID NO: 104481 - DNA, 21 bp, Homo sapiens
ttctgagattacatgctctag

SEQ ID NO: 104482 - DNA, 23 bp, Homo sapiens
tgagttcattgtagattctggat

SEQ ID NO: 104483 - DNA, 23 bp, Homo sapiens
tgagttcattgtagattctggat

SEQ ID NO: 104484 - DNA, 21 bp, Homo sapiens
tagctgcatttcatatgtttt

SEQ ID NO: 104485 - DNA, 23 bp, Homo sapiens
atgacagagcaagactgtctcaa

SEQ ID NO: 104486 - DNA, 23 bp, Homo sapiens
cagtctctctctgtcacccaggc

SEQ ID NO: 104487 - DNA, 23 bp, Homo sapiens
tggagtctcactctgtcacccag

SEQ ID NO: 104488 - DNA, 21 bp, Homo sapiens
tagtgacagggagtttctacc

SEQ ID NO: 104489 - DNA, 23 bp, Homo sapiens
tcacccaccttctcacagtcact

SEQ ID NO: 104490 - DNA, 23 bp, Homo sapiens
tggcagggactctgatttttctc

SEQ ID NO: 104491 - DNA, 23 bp, Homo sapiens
tcagactcactgtctaaataggg

SEQ ID NO: 104492 - DNA, 23 bp, Homo sapiens
tttcctgctacagatagggaaac

SEQ ID NO: 104493 - DNA, 23 bp, Homo sapiens
acattttcagcatctgcatgtgc

SEQ ID NO: 104494 - DNA, 22 bp, Homo sapiens
tatgagagaacagagtggggag

SEQ ID NO: 104495 - DNA, 23 bp, Homo sapiens
agggcgtaatacattgtgcagag

SEQ ID NO: 104496 - DNA, 23 bp, Homo sapiens
gtctgtatgtgtgtgcctgtgtg

SEQ ID NO: 104497 - DNA, 21 bp, Homo sapiens
gcaaactttctctctcacatt

SEQ ID NO: 104498 - DNA, 23 bp, Homo sapiens
tctgtgaagaaagtcagtggtag

SEQ ID NO: 104499 - DNA, 19 bp, Homo sapiens
tgtcttggctatgcaggct

SEQ ID NO: 104500 - DNA, 23 bp, Homo sapiens
tctgtgaagaaagtcaatggtag

SEQ ID NO: 104501 - DNA, 23 bp, Homo sapiens
tgagttcattgtagattctggat

SEQ ID NO: 104502 - DNA, 23 bp, Homo sapiens
tgagttcattgtagattctggat

SEQ ID NO: 104503 - DNA, 23 bp, Homo sapiens
agtctcactctgtcacccaggct

SEQ ID NO: 104504 - DNA, 18 bp, Homo sapiens
tggcatgatcatggctca

SEQ ID NO: 104505 - DNA, 19 bp, Homo sapiens
ctctcgctctgtcacccag

SEQ ID NO: 104506 - DNA, 23 bp, Homo sapiens
ttcttgaaccacaacagctctgg

SEQ ID NO: 104507 - DNA, 21 bp, Homo sapiens
gctcactcactcacacactcc

SEQ ID NO: 104508 - DNA, 19 bp, Homo sapiens
ttgagcattttttcatgtt

SEQ ID NO: 104509 - DNA, 23 bp, Homo sapiens
tgagttcattgtagattctggat

SEQ ID NO: 104510 - DNA, 23 bp, Homo sapiens
tgagttcattgtagattctggat

SEQ ID NO: 104511 - DNA, 21 bp, Homo sapiens
ggcaagaagaaggtcaggaag

SEQ ID NO: 104512 - DNA, 23 bp, Homo sapiens
tgtgaagaaagtcaatggtagtt

SEQ ID NO: 104513 - DNA, 23 bp, Homo sapiens
acattgtatatatatatatgtgt

SEQ ID NO: 104514 - DNA, 22 bp, Homo sapiens
agtgattatatatatgtctgta

SEQ ID NO: 104515 - DNA, 18 bp, Homo sapiens
atatatatgcacactaag

SEQ ID NO: 104516 - DNA, 19 bp, Homo sapiens
ttgctaagtatagaagtgt

SEQ ID NO: 104517 - DNA, 23 bp, Homo sapiens
taaatcgaatgtagtagtccggc

SEQ ID NO: 104518 - DNA, 21 bp, Homo sapiens
ttggcagtgcttcttatgttt

SEQ ID NO: 104519 - DNA, 23 bp, Homo sapiens
tgtgtgtatatatgtatatgtgt

SEQ ID NO: 104520 - DNA, 18 bp, Homo sapiens
tatacacacatatacata

SEQ ID NO: 104521 - DNA, 22 bp, Homo sapiens
tgtgtgtatatatatatgtgtg

SEQ ID NO: 104522 - DNA, 20 bp, Homo sapiens
tgtgtatatatatatgtgtg

SEQ ID NO: 104523 - DNA, 23 bp, Homo sapiens
tgacttgaccattctctctagct

SEQ ID NO: 104524 - DNA, 20 bp, Homo sapiens
tgaggtagaagcatcacttg

SEQ ID NO: 104525 - DNA, 23 bp, Homo sapiens
aggagcatgacacagagcacaga

SEQ ID NO: 104526 - DNA, 20 bp, Homo sapiens
tcagcatgttggccaggctg

SEQ ID NO: 104527 - DNA, 19 bp, Homo sapiens
tgacaggcgtgagtcacca

SEQ ID NO: 104528 - DNA, 20 bp, Homo sapiens
taagcaaatattttctatat

SEQ ID NO: 104529 - DNA, 18 bp, Homo sapiens
tggcgtgatcttggctta

SEQ ID NO: 104530 - DNA, 23 bp, Homo sapiens
cggagtctcactctgtcacccag

SEQ ID NO: 104531 - DNA, 23 bp, Homo sapiens
agaatctcactctgtcacccagg

SEQ ID NO: 104532 - DNA, 23 bp, Homo sapiens
cggagtctcactctgtcacccag

SEQ ID NO: 104533 - DNA, 23 bp, Homo sapiens
gagtctcactctgtcacccaggc

SEQ ID NO: 104534 - DNA, 23 bp, Homo sapiens
atgtatatacatgtatatgtgtg

SEQ ID NO: 104535 - DNA, 18 bp, Homo sapiens
tgagatccttgagaagag

SEQ ID NO: 104536 - DNA, 23 bp, Homo sapiens
gacagactctcgctctgtcatcc

SEQ ID NO: 104537 - DNA, 23 bp, Homo sapiens
tgacagggtctcactctgtctcc

SEQ ID NO: 104538 - DNA, 23 bp, Homo sapiens
tttgtcatagcttgatttaagca

SEQ ID NO: 104539 - DNA, 22 bp, Homo sapiens
catagcagaagtcagagagctc

SEQ ID NO: 104540 - DNA, 20 bp, Homo sapiens
tatatatatgtatatatgtg

SEQ ID NO: 104541 - DNA, 21 bp, Homo sapiens
tgaggtaggaggatcacttga

SEQ ID NO: 104542 - DNA, 23 bp, Homo sapiens
tctgtcgctcagattctagactg

SEQ ID NO: 104543 - DNA, 22 bp, Homo sapiens
aaagacctctccctccactgag

SEQ ID NO: 104544 - DNA, 23 bp, Homo sapiens
ttccttaacttcactgtccctct

SEQ ID NO: 104545 - DNA, 23 bp, Homo sapiens
ctgactgcactggtgctgctcac

SEQ ID NO: 104546 - DNA, 23 bp, Homo sapiens
cacacacacacacactgtcacat

SEQ ID NO: 104547 - DNA, 23 bp, Homo sapiens
tattagagacaggttctctctct

SEQ ID NO: 104548 - DNA, 23 bp, Homo sapiens
ttggagctgagtcaataggatgt

SEQ ID NO: 104549 - DNA, 23 bp, Homo sapiens
taagcactgaagagagagtgctg

SEQ ID NO: 104550 - DNA, 18 bp, Homo sapiens
agactgtgagcttctgga

SEQ ID NO: 104551 - DNA, 21 bp, Homo sapiens
aggtctcactctgtcactcag

SEQ ID NO: 104552 - DNA, 23 bp, Homo sapiens
tgaggttttaggttgttaagaga

SEQ ID NO: 104553 - DNA, 22 bp, Homo sapiens
tatacacacacacacactatat

SEQ ID NO: 104554 - DNA, 19 bp, Homo sapiens
tgcatatatatagtgtgtg

SEQ ID NO: 104555 - DNA, 20 bp, Homo sapiens
tcactgcagtctcaaactgc

SEQ ID NO: 104556 - DNA, 19 bp, Homo sapiens
tagctgtcttctgtttctc

SEQ ID NO: 104557 - DNA, 23 bp, Homo sapiens
ctgaccacactctgactcagtcc

SEQ ID NO: 104558 - DNA, 20 bp, Homo sapiens
gtatatatatgtgtgtgcat

SEQ ID NO: 104559 - DNA, 22 bp, Homo sapiens
tttggaagtgattttgatgact

SEQ ID NO: 104560 - DNA, 21 bp, Homo sapiens
ctgtcagtcactcacaccctg

SEQ ID NO: 104561 - DNA, 23 bp, Homo sapiens
tgcagagtgaacagtgacaggtc

SEQ ID NO: 104562 - DNA, 23 bp, Homo sapiens
ctcccagagcccctggaactctg

SEQ ID NO: 104563 - DNA, 23 bp, Homo sapiens
tcccagagcccctggaactctgg

SEQ ID NO: 104564 - DNA, 23 bp, Homo sapiens
tcccagagcccctggaactctgg

SEQ ID NO: 104565 - DNA, 23 bp, Homo sapiens
tcccagagcccctggaactctgg

SEQ ID NO: 104566 - DNA, 23 bp, Homo sapiens
gtttctctcactgacagaatacc

SEQ ID NO: 104567 - DNA, 23 bp, Homo sapiens
ttgctctgtgtctctctcattcc

SEQ ID NO: 104568 - DNA, 23 bp, Homo sapiens
aaaatggcagaggtacaagtgag

SEQ ID NO: 104569 - DNA, 22 bp, Homo sapiens
ctatatgtatatatatactgta

SEQ ID NO: 104570 - DNA, 22 bp, Homo sapiens
tatatacaccatatgtgtacat

SEQ ID NO: 104571 - DNA, 23 bp, Homo sapiens
tctgatcctctcactctctttgg

SEQ ID NO: 104572 - DNA, 21 bp, Homo sapiens
aaacagccaagacagcactct

SEQ ID NO: 104573 - DNA, 20 bp, Homo sapiens
agactgtgagatactaaagg

SEQ ID NO: 104574 - DNA, 19 bp, Homo sapiens
ttttgtattacgaatgctc

SEQ ID NO: 104575 - DNA, 23 bp, Homo sapiens
tttgcatatggtatgaggtagga

SEQ ID NO: 104576 - DNA, 22 bp, Homo sapiens
tgtgctagaaactactctgcag

SEQ ID NO: 104577 - DNA, 22 bp, Homo sapiens
acacacacacatatgtgtatat

SEQ ID NO: 104578 - DNA, 22 bp, Homo sapiens
tcacactgtgaagttttgctcc

SEQ ID NO: 104579 - DNA, 23 bp, Homo sapiens
tctctgagcctcagattcctcaa

SEQ ID NO: 104580 - DNA, 23 bp, Homo sapiens
tatctgcttatacttgtgaccct

SEQ ID NO: 104581 - DNA, 18 bp, Homo sapiens
ttgctctgtgtccaaaca

SEQ ID NO: 104582 - DNA, 22 bp, Homo sapiens
acatagtagttgctcagtaaat

SEQ ID NO: 104583 - DNA, 23 bp, Homo sapiens
atttttgcttccatatgaaattt

SEQ ID NO: 104584 - DNA, 21 bp, Homo sapiens
ttagtggatattcactatcct

SEQ ID NO: 104585 - DNA, 23 bp, Homo sapiens
tataaagaatggatatctattta

SEQ ID NO: 104586 - DNA, 18 bp, Homo sapiens
tgtggtagaagtcacagg

SEQ ID NO: 104587 - DNA, 23 bp, Homo sapiens
agtcatcacagtcgtctgtatcc

SEQ ID NO: 104588 - DNA, 23 bp, Homo sapiens
tgatgatcatgatcatgatgctt

SEQ ID NO: 104589 - DNA, 20 bp, Homo sapiens
gacaggcaatgggtcactca

SEQ ID NO: 104590 - DNA, 23 bp, Homo sapiens
gttaagtgtacatgcttctggct

SEQ ID NO: 104591 - DNA, 23 bp, Homo sapiens
gacagagtctcgctctgtcaccc

SEQ ID NO: 104592 - DNA, 23 bp, Homo sapiens
aagagtctccctctgtcacccag

SEQ ID NO: 104593 - DNA, 21 bp, Homo sapiens
tgcaactctactgaaattgtt

SEQ ID NO: 104594 - DNA, 20 bp, Homo sapiens
tgctctagtagaaaggggat

SEQ ID NO: 104595 - DNA, 19 bp, Homo sapiens
tgtgaagtttagaagtatg

SEQ ID NO: 104596 - DNA, 23 bp, Homo sapiens
attctgtcactctgtgtcagtag

SEQ ID NO: 104597 - DNA, 23 bp, Homo sapiens
tcactgaagaaattcagcaccag

SEQ ID NO: 104598 - DNA, 21 bp, Homo sapiens
aaagttctttataaagaactt

SEQ ID NO: 104599 - DNA, 22 bp, Homo sapiens
ttttcttagtagacacggggta

SEQ ID NO: 104600 - DNA, 23 bp, Homo sapiens
ctcagccaccctctctcagccct

SEQ ID NO: 104601 - DNA, 18 bp, Homo sapiens
atgactcttcagttccag

SEQ ID NO: 104602 - DNA, 22 bp, Homo sapiens
tacagtagtctgttcattgctt

SEQ ID NO: 104603 - DNA, 21 bp, Homo sapiens
tatatatatatgtgcacacag

SEQ ID NO: 104604 - DNA, 23 bp, Homo sapiens
gctcacagaggaaagtgaggact

SEQ ID NO: 104605 - DNA, 23 bp, Homo sapiens
ctctctgagtcacgatttcctca

SEQ ID NO: 104606 - DNA, 23 bp, Homo sapiens
tgagttcattgtagattctggat

SEQ ID NO: 104607 - DNA, 23 bp, Homo sapiens
tgagttcattgtagattctggat

SEQ ID NO: 104608 - DNA, 23 bp, Homo sapiens
tgcctctctctctcagttccccc

SEQ ID NO: 104609 - DNA, 21 bp, Homo sapiens
tctgaattgtgagcaaggtgt

SEQ ID NO: 104610 - DNA, 22 bp, Homo sapiens
aaagtcagtggtagcttgatga

SEQ ID NO: 104611 - DNA, 23 bp, Homo sapiens
acttgtctctgcctcacttgcgt

SEQ ID NO: 104612 - DNA, 23 bp, Homo sapiens
tgagttcattgtagattctggat

SEQ ID NO: 104613 - DNA, 23 bp, Homo sapiens
tgagttcattgtagattctggat

SEQ ID NO: 104614 - DNA, 23 bp, Homo sapiens
agatggagtctcactctgtcacc

SEQ ID NO: 104615 - DNA, 23 bp, Homo sapiens
tgagtctgtcactttctctctct

SEQ ID NO: 104616 - DNA, 23 bp, Homo sapiens
tggagtctcactctgtcacccag

SEQ ID NO: 104617 - DNA, 22 bp, Homo sapiens
tgtttctcagagaacccagatg

SEQ ID NO: 104618 - DNA, 19 bp, Homo sapiens
ctgagaaaacaataagagg

SEQ ID NO: 104619 - DNA, 23 bp, Homo sapiens
ttctgtacctactgtgtgtgtgt

SEQ ID NO: 104620 - DNA, 23 bp, Homo sapiens
atgtgcatgtatgtatatgtata

SEQ ID NO: 104621 - DNA, 22 bp, Homo sapiens
tgtatgtatgtacatacctgct

SEQ ID NO: 104622 - DNA, 19 bp, Homo sapiens
tgtgtatatatatatctgt

SEQ ID NO: 104623 - DNA, 23 bp, Homo sapiens
tgtgagactgttttgcaactgta

SEQ ID NO: 104624 - DNA, 18 bp, Homo sapiens
tgaagtgtctctgttctg

SEQ ID NO: 104625 - DNA, 23 bp, Homo sapiens
gtctcagagccagtaaatagtga

SEQ ID NO: 104626 - DNA, 23 bp, Homo sapiens
atgtgtcactgtttggtctttgt

SEQ ID NO: 104627 - DNA, 23 bp, Homo sapiens
tctgctcttagtttctctcaaac

SEQ ID NO: 104628 - DNA, 18 bp, Homo sapiens
agtttattcttcctctgc

SEQ ID NO: 104629 - DNA, 23 bp, Homo sapiens
gggaaaggtttttgtctgttttg

SEQ ID NO: 104630 - DNA, 23 bp, Homo sapiens
agactgagtctcgctctgtcacc

SEQ ID NO: 104631 - DNA, 21 bp, Homo sapiens
ttcttaatagtgaaatggcta

SEQ ID NO: 104632 - DNA, 23 bp, Homo sapiens
atgtatgtatgtatgtatgtatg

SEQ ID NO: 104633 - DNA, 22 bp, Homo sapiens
agcagagtaaagaagtctttag

SEQ ID NO: 104634 - DNA, 21 bp, Homo sapiens
acttcttggtctgcagactgt

SEQ ID NO: 104635 - DNA, 23 bp, Homo sapiens
tgagttcattgtagattctggat

SEQ ID NO: 104636 - DNA, 23 bp, Homo sapiens
tgagttcattgtagattctggat

SEQ ID NO: 104637 - DNA, 23 bp, Homo sapiens
tgagttcattgtagattctggat

SEQ ID NO: 104638 - DNA, 23 bp, Homo sapiens
tgagttcattgtagattctggat

SEQ ID NO: 104639 - DNA, 23 bp, Homo sapiens
cagaggttgaataatgagcatta

SEQ ID NO: 104640 - DNA, 22 bp, Homo sapiens
tctttgaaggtcatattgtggt

SEQ ID NO: 104641 - DNA, 23 bp, Homo sapiens
tggagtctcactctgtcacccag

SEQ ID NO: 104642 - DNA, 21 bp, Homo sapiens
tgtctccaagaggaatgcagg

SEQ ID NO: 104643 - DNA, 21 bp, Homo sapiens
aaactgcttcagcaatcatgt

SEQ ID NO: 104644 - DNA, 23 bp, Homo sapiens
atgtgtgtatatatatgtgtatg

SEQ ID NO: 104645 - DNA, 23 bp, Homo sapiens
tatgtgtatatatgcgtatgtat

SEQ ID NO: 104646 - DNA, 23 bp, Homo sapiens
actcagtgagactgtcccttttc

SEQ ID NO: 104647 - DNA, 18 bp, Homo sapiens
atgcctgtagttccagct

SEQ ID NO: 104648 - DNA, 23 bp, Homo sapiens
aggatgacttgagaccaggaggt

SEQ ID NO: 104649 - DNA, 23 bp, Homo sapiens
acaagtgttgatgttgtagtctt

SEQ ID NO: 104650 - DNA, 23 bp, Homo sapiens
aagcatgacatgcggtgtgtgtg

SEQ ID NO: 104651 - DNA, 23 bp, Homo sapiens
gtttcactcactctgtcatttca

SEQ ID NO: 104652 - DNA, 23 bp, Homo sapiens
acagagtctcactctgtcgccca

SEQ ID NO: 104653 - DNA, 23 bp, Homo sapiens
ttaaatactgatttagttcttta

SEQ ID NO: 104654 - DNA, 23 bp, Homo sapiens
tctatttctcctagtcatttttg

SEQ ID NO: 104655 - DNA, 18 bp, Homo sapiens
tctcgctctgtcacccag

SEQ ID NO: 104656 - DNA, 20 bp, Homo sapiens
agaaatgaaaagaggaatgg

SEQ ID NO: 104657 - DNA, 23 bp, Homo sapiens
ttttgagacggactctcactctg

SEQ ID NO: 104658 - DNA, 23 bp, Homo sapiens
cattgtcctccacctcctgatag

SEQ ID NO: 104659 - DNA, 20 bp, Homo sapiens
aatactgtaaatgattatga

SEQ ID NO: 104660 - DNA, 20 bp, Homo sapiens
tttgcaatttttttctgtta

SEQ ID NO: 104661 - DNA, 23 bp, Homo sapiens
tctcctgatgtatagatggacgc

SEQ ID NO: 104662 - DNA, 23 bp, Homo sapiens
agtgctttgtatttggagtcagg

SEQ ID NO: 104663 - DNA, 23 bp, Homo sapiens
aaactcactgtgtgactttgggc

SEQ ID NO: 104664 - DNA, 21 bp, Homo sapiens
agatcatttattttctaggtt

SEQ ID NO: 104665 - DNA, 23 bp, Homo sapiens
tatgcttgtggttccagttaggc

SEQ ID NO: 104666 - DNA, 19 bp, Homo sapiens
tatgtcttttatatttcat

SEQ ID NO: 104667 - DNA, 19 bp, Homo sapiens
actgtgaggtccctccagt

SEQ ID NO: 104668 - DNA, 23 bp, Homo sapiens
gacgctcacactgtcgctctctg

SEQ ID NO: 104669 - DNA, 23 bp, Homo sapiens
ttttttgagacggagtctcactc

SEQ ID NO: 104670 - DNA, 21 bp, Homo sapiens
ttgtatgtatatgtatatgtc

SEQ ID NO: 104671 - DNA, 23 bp, Homo sapiens
cataaatcactttcatcatcttc

SEQ ID NO: 104672 - DNA, 21 bp, Homo sapiens
tcactgcagtctctgtctcct

SEQ ID NO: 104673 - DNA, 18 bp, Homo sapiens
tattgtactacagttttg

SEQ ID NO: 104674 - DNA, 19 bp, Homo sapiens
agagtttagctcttgtcct

SEQ ID NO: 104675 - DNA, 23 bp, Homo sapiens
tggcatgatctcggcttactgca

SEQ ID NO: 104676 - DNA, 23 bp, Homo sapiens
tctttttcagattgtgttatggc

SEQ ID NO: 104677 - DNA, 21 bp, Homo sapiens
tatttgtgtgttcactcatag

SEQ ID NO: 104678 - DNA, 23 bp, Homo sapiens
aaatgctactctctgggaaacaa

SEQ ID NO: 104679 - DNA, 23 bp, Homo sapiens
tgagttcattgtagattctggat

SEQ ID NO: 104680 - DNA, 23 bp, Homo sapiens
tgagttcattgtagattctggat

SEQ ID NO: 104681 - DNA, 21 bp, Homo sapiens
tgagaagagggaagtgtgtac

SEQ ID NO: 104682 - DNA, 23 bp, Homo sapiens
gtctctctctgtcactcaggctg

SEQ ID NO: 104683 - DNA, 22 bp, Homo sapiens
tgtgtatatatgtatatctgtg

SEQ ID NO: 104684 - DNA, 23 bp, Homo sapiens
agatatacatacatatgtgtatg

SEQ ID NO: 104685 - DNA, 23 bp, Homo sapiens
gacagagtctcgctctgtcaccc

SEQ ID NO: 104686 - DNA, 23 bp, Homo sapiens
agggatcatgttgaaatagctgt

SEQ ID NO: 104687 - DNA, 23 bp, Homo sapiens
aaaactgactttgtttttagtgt

SEQ ID NO: 104688 - DNA, 23 bp, Homo sapiens
acagagtctcactctgtcgccca

SEQ ID NO: 104689 - DNA, 23 bp, Homo sapiens
ctatctcactctgtcacccaggc

SEQ ID NO: 104690 - DNA, 22 bp, Homo sapiens
tgtcagtagactgtgagcagct

SEQ ID NO: 104691 - DNA, 23 bp, Homo sapiens
acagtcttattctctctcccaaa

SEQ ID NO: 104692 - DNA, 20 bp, Homo sapiens
tgagccacacacagtgactc

SEQ ID NO: 104693 - DNA, 23 bp, Homo sapiens
gctgtgtgcctctgactcagagt

SEQ ID NO: 104694 - DNA, 21 bp, Homo sapiens
cattcatagactctgtctcta

SEQ ID NO: 104695 - DNA, 22 bp, Homo sapiens
ggaaaggatagatctatgtagt

SEQ ID NO: 104696 - DNA, 23 bp, Homo sapiens
atatgtatgtatacatgtatgca

SEQ ID NO: 104697 - DNA, 23 bp, Homo sapiens
atgtgtgtatatatgtgtgtgta

SEQ ID NO: 104698 - DNA, 23 bp, Homo sapiens
gtatgtgtgtatgtatatatgtg

SEQ ID NO: 104699 - DNA, 23 bp, Homo sapiens
acatacacacatatatacataca

SEQ ID NO: 104700 - DNA, 23 bp, Homo sapiens
acagtttactgaatgttgggttt

SEQ ID NO: 104701 - DNA, 21 bp, Homo sapiens
gtctcgctctgtcaccctggc

SEQ ID NO: 104702 - DNA, 22 bp, Homo sapiens
aattcagtacataactgtgttg

SEQ ID NO: 104703 - DNA, 23 bp, Homo sapiens
tgacagaagtgtgtgagaaaacg

SEQ ID NO: 104704 - DNA, 23 bp, Homo sapiens
gagactgagtctcattctgtcac

SEQ ID NO: 104705 - DNA, 23 bp, Homo sapiens
tgagttcattgtagattctggat

SEQ ID NO: 104706 - DNA, 23 bp, Homo sapiens
tgagttcattgtagattctggat

SEQ ID NO: 104707 - DNA, 20 bp, Homo sapiens
tctcactgattctgtcaccc

SEQ ID NO: 104708 - DNA, 19 bp, Homo sapiens
acacacacacacaaactgc

SEQ ID NO: 104709 - DNA, 23 bp, Homo sapiens
tctgcttctgtctgtgtgtctgt

SEQ ID NO: 104710 - DNA, 23 bp, Homo sapiens
agagtgtcactctgtcacccagg

SEQ ID NO: 104711 - DNA, 23 bp, Homo sapiens
cggctcactgagacctctgcctc

SEQ ID NO: 104712 - DNA, 23 bp, Homo sapiens
atatatgcatgtgtgtgtgtgtg

SEQ ID NO: 104713 - DNA, 23 bp, Homo sapiens
tgtatatttgtatatgttcatat

SEQ ID NO: 104714 - DNA, 21 bp, Homo sapiens
ttagtgtggcttgaggtactg

SEQ ID NO: 104715 - DNA, 22 bp, Homo sapiens
ggagtcagtggtgagtgaccag

SEQ ID NO: 104716 - DNA, 23 bp, Homo sapiens
tgagttcattgtagattctggat

SEQ ID NO: 104717 - DNA, 23 bp, Homo sapiens
tgagttcattgtagattctggat

SEQ ID NO: 104718 - DNA, 21 bp, Homo sapiens
tatgtgtatatgtatatatat

SEQ ID NO: 104719 - DNA, 23 bp, Homo sapiens
cagggtctctctgtgtcacccag

SEQ ID NO: 104720 - DNA, 23 bp, Homo sapiens
tgcagtgttgagatcttggctca

SEQ ID NO: 104721 - DNA, 23 bp, Homo sapiens
tgagttcattgtagattctggat

SEQ ID NO: 104722 - DNA, 23 bp, Homo sapiens
tgagttcattgtagattctggat

SEQ ID NO: 104723 - DNA, 18 bp, Homo sapiens
tttaggttatataggttt

SEQ ID NO: 104724 - DNA, 23 bp, Homo sapiens
tctgtgaagaaagtcaatggtag

SEQ ID NO: 104725 - DNA, 23 bp, Homo sapiens
tggagtctcactctgtcacccag

SEQ ID NO: 104726 - DNA, 23 bp, Homo sapiens
ggttcaggtgattctcctgcctc

SEQ ID NO: 104727 - DNA, 23 bp, Homo sapiens
tttgtcaccaaaaattatgatta

SEQ ID NO: 104728 - DNA, 23 bp, Homo sapiens
atatagctggatttgtttttcta

SEQ ID NO: 104729 - DNA, 23 bp, Homo sapiens
gactgcttgacagaactgagaca

SEQ ID NO: 104730 - DNA, 18 bp, Homo sapiens
tttgtggtgaaggactag

SEQ ID NO: 104731 - DNA, 23 bp, Homo sapiens
agaaatggagtctcactctgtca

SEQ ID NO: 104732 - DNA, 21 bp, Homo sapiens
tatgtctacataaatgtgtgt

SEQ ID NO: 104733 - DNA, 18 bp, Homo sapiens
ctattagaaagttaaggt

SEQ ID NO: 104734 - DNA, 22 bp, Homo sapiens
aatgacacttcaaatgtgatga

SEQ ID NO: 104735 - DNA, 23 bp, Homo sapiens
ttgtatgtcgtgctgaaagctac

SEQ ID NO: 104736 - DNA, 20 bp, Homo sapiens
tacacagatctggaaagctt

SEQ ID NO: 104737 - DNA, 23 bp, Homo sapiens
tgtcagtctgtcatcatagtctg

SEQ ID NO: 104738 - DNA, 19 bp, Homo sapiens
cagatgacaagaaagactc

SEQ ID NO: 104739 - DNA, 23 bp, Homo sapiens
gaaaactctagatcttgcagaaa

SEQ ID NO: 104740 - DNA, 23 bp, Homo sapiens
tgacagggtctctgacagcttca

SEQ ID NO: 104741 - DNA, 23 bp, Homo sapiens
tttccatgcatattcttgccatg

SEQ ID NO: 104742 - DNA, 22 bp, Homo sapiens
ataagctagatgaggctctgat

SEQ ID NO: 104743 - DNA, 23 bp, Homo sapiens
tgtgtatatctatatatctatat

SEQ ID NO: 104744 - DNA, 23 bp, Homo sapiens
acaatttcatttctaagtatttg

SEQ ID NO: 104745 - DNA, 22 bp, Homo sapiens
agagtctcactctgtcagccag

SEQ ID NO: 104746 - DNA, 22 bp, Homo sapiens
tatgtctgtggctgttgtaaca

SEQ ID NO: 104747 - DNA, 21 bp, Homo sapiens
taagagagcattcattttcct

SEQ ID NO: 104748 - DNA, 21 bp, Homo sapiens
ttttttagagccactttaggt

SEQ ID NO: 104749 - DNA, 23 bp, Homo sapiens
tacactgaatttgtaaatgttgt

SEQ ID NO: 104750 - DNA, 23 bp, Homo sapiens
tgaaacaagtgcctcagttccta

SEQ ID NO: 104751 - DNA, 22 bp, Homo sapiens
tctcacacactgcatgttgtgt

SEQ ID NO: 104752 - DNA, 21 bp, Homo sapiens
atatgtatatattatgctttg

SEQ ID NO: 104753 - DNA, 23 bp, Homo sapiens
acgtatatatatatatgtgtatg

SEQ ID NO: 104754 - DNA, 23 bp, Homo sapiens
tatatgtgtgtatgtatatgtat

SEQ ID NO: 104755 - DNA, 23 bp, Homo sapiens
cactcacactgagagctgtagac

SEQ ID NO: 104756 - DNA, 23 bp, Homo sapiens
cagactcactgtctatgaggacc

SEQ ID NO: 104757 - DNA, 20 bp, Homo sapiens
atagatggctgtcttcttgc

SEQ ID NO: 104758 - DNA, 22 bp, Homo sapiens
ttaatgcatgtgtatatatgta

SEQ ID NO: 104759 - DNA, 23 bp, Homo sapiens
ggttgttaggtaaattgtttgta

SEQ ID NO: 104760 - DNA, 23 bp, Homo sapiens
agtatatgagcaaaactgatttt

SEQ ID NO: 104761 - DNA, 21 bp, Homo sapiens
agaccatcatatttgcattat

SEQ ID NO: 104762 - DNA, 21 bp, Homo sapiens
tgagactctgagacttgctgg

SEQ ID NO: 104763 - DNA, 23 bp, Homo sapiens
tcagatgagactcagcacttttc

SEQ ID NO: 104764 - DNA, 22 bp, Homo sapiens
agggaacagagagacaaaactc

SEQ ID NO: 104765 - DNA, 23 bp, Homo sapiens
gtatatatgtatgtgtatatgtg

SEQ ID NO: 104766 - DNA, 20 bp, Homo sapiens
ttcacttcagtttttcttgt

SEQ ID NO: 104767 - DNA, 23 bp, Homo sapiens
aaataagaccatactgaatgatt

SEQ ID NO: 104768 - DNA, 21 bp, Homo sapiens
tatatgtatatgtttatgtgt

SEQ ID NO: 104769 - DNA, 18 bp, Homo sapiens
aacacagttgacattgtc

SEQ ID NO: 104770 - DNA, 23 bp, Homo sapiens
gttttcaccatgtgtaggttatt

SEQ ID NO: 104771 - DNA, 23 bp, Homo sapiens
tgaggtagtaggtagataagctg

SEQ ID NO: 104772 - DNA, 20 bp, Homo sapiens
tgtgggtggtacagcacttg

SEQ ID NO: 104773 - DNA, 22 bp, Homo sapiens
tattagacagattgataacaga

SEQ ID NO: 104774 - DNA, 23 bp, Homo sapiens
tttgagacggagtctcactctgt

SEQ ID NO: 104775 - DNA, 23 bp, Homo sapiens
tgagttcattgtagattctggat

SEQ ID NO: 104776 - DNA, 23 bp, Homo sapiens
tgagttcattgtagattctggat

SEQ ID NO: 104777 - DNA, 23 bp, Homo sapiens
atttgcatttaaatgctaaggat

SEQ ID NO: 104778 - DNA, 23 bp, Homo sapiens
caaggtctcactctgtcacccag

SEQ ID NO: 104779 - DNA, 20 bp, Homo sapiens
agtgcagcagcatgaccatg

SEQ ID NO: 104780 - DNA, 23 bp, Homo sapiens
cagtggcatgatcttggctcaac

SEQ ID NO: 104781 - DNA, 23 bp, Homo sapiens
ggttcttgactgtagatactgag

SEQ ID NO: 104782 - DNA, 23 bp, Homo sapiens
cagtgagccaagatcatgccact

SEQ ID NO: 104783 - DNA, 23 bp, Homo sapiens
gagtctcactctgtcacccaggc

SEQ ID NO: 104784 - DNA, 23 bp, Homo sapiens
tcatggcactggctgaattgact

SEQ ID NO: 104785 - DNA, 23 bp, Homo sapiens
tgagttcattgtagattctggat

SEQ ID NO: 104786 - DNA, 23 bp, Homo sapiens
tgagttcattgtagattctggat

SEQ ID NO: 104787 - DNA, 23 bp, Homo sapiens
tgagttcattgtagattctggat

SEQ ID NO: 104788 - DNA, 23 bp, Homo sapiens
tgagttcattgtagattctggat

SEQ ID NO: 104789 - DNA, 20 bp, Homo sapiens
gaaacagttgaaggatgagt

SEQ ID NO: 104790 - DNA, 22 bp, Homo sapiens
ctagagtgaatgtttatgtatt

SEQ ID NO: 104791 - DNA, 23 bp, Homo sapiens
tcaccaaagaagatgtgtgattt

SEQ ID NO: 104792 - DNA, 21 bp, Homo sapiens
tcagagaatcttgtttagtcc

SEQ ID NO: 104793 - DNA, 23 bp, Homo sapiens
ggagtgtctctctgtcacccagg

SEQ ID NO: 104794 - DNA, 19 bp, Homo sapiens
accagcttgatatatagat

SEQ ID NO: 104795 - DNA, 23 bp, Homo sapiens
aagaatatcaagcaaatcaagaa

SEQ ID NO: 104796 - DNA, 22 bp, Homo sapiens
atatacacacacatatgtatgt

SEQ ID NO: 104797 - DNA, 23 bp, Homo sapiens
tatatatgtataggcatatgtat

SEQ ID NO: 104798 - DNA, 23 bp, Homo sapiens
atatagtatgtattcttttgtta

SEQ ID NO: 104799 - DNA, 22 bp, Homo sapiens
acagtctcactctgtcgcccag

SEQ ID NO: 104800 - DNA, 21 bp, Homo sapiens
ttggagccccttgccattctc

SEQ ID NO: 104801 - DNA, 21 bp, Homo sapiens
ttagatttagggctagcctag

SEQ ID NO: 104802 - DNA, 23 bp, Homo sapiens
tgagttcattgtagattctggat

SEQ ID NO: 104803 - DNA, 23 bp, Homo sapiens
tgagttcattgtagattctggat

SEQ ID NO: 104804 - DNA, 22 bp, Homo sapiens
atctggtattaggtactataca

SEQ ID NO: 104805 - DNA, 19 bp, Homo sapiens
atatcacatatgatagatg

SEQ ID NO: 104806 - DNA, 19 bp, Homo sapiens
atatcacatatgatagatg

SEQ ID NO: 104807 - DNA, 19 bp, Homo sapiens
atatcacatatgatagatg

SEQ ID NO: 104808 - DNA, 19 bp, Homo sapiens
atatcacatatgatagatg

SEQ ID NO: 104809 - DNA, 23 bp, Homo sapiens
acttttctgtgtgcttgaagtat

SEQ ID NO: 104810 - DNA, 22 bp, Homo sapiens
tgaatagttgttttgctgtctg

SEQ ID NO: 104811 - DNA, 23 bp, Homo sapiens
aatttccatattgatgtcattgt

SEQ ID NO: 104812 - DNA, 23 bp, Homo sapiens
ctctctctgtctgtctgtcttct

SEQ ID NO: 104813 - DNA, 23 bp, Homo sapiens
tgtgtatatatatatgtatgtgt

SEQ ID NO: 104814 - DNA, 23 bp, Homo sapiens
gacagagtctcgctctgtcaccc

SEQ ID NO: 104815 - DNA, 22 bp, Homo sapiens
aagtcactgtcacagacacacc

SEQ ID NO: 104816 - DNA, 23 bp, Homo sapiens
tgagttcattgtagattctggat

SEQ ID NO: 104817 - DNA, 23 bp, Homo sapiens
tgagttcattgtagattctggat

SEQ ID NO: 104818 - DNA, 22 bp, Homo sapiens
tatgtgtatatatatatgtgtg

SEQ ID NO: 104819 - DNA, 18 bp, Homo sapiens
aacacagacactggagtc

SEQ ID NO: 104820 - DNA, 23 bp, Homo sapiens
cggagtctcactctgtcacccag

SEQ ID NO: 104821 - DNA, 23 bp, Homo sapiens
gagtctcactctgtcacccaggc

SEQ ID NO: 104822 - DNA, 23 bp, Homo sapiens
agagtctcactctgtcacccagg

SEQ ID NO: 104823 - DNA, 23 bp, Homo sapiens
gagtctcactctgtcacccaggc

SEQ ID NO: 104824 - DNA, 20 bp, Homo sapiens
atacgtaatatatacatata

SEQ ID NO: 104825 - DNA, 23 bp, Homo sapiens
tgagttcattgtagattctggat

SEQ ID NO: 104826 - DNA, 23 bp, Homo sapiens
tgagttcattgtagattctggat

SEQ ID NO: 104827 - DNA, 23 bp, Homo sapiens
tttggttttaatttcatatcact

SEQ ID NO: 104828 - DNA, 22 bp, Homo sapiens
ctgagatgactgtgtgcacacg

SEQ ID NO: 104829 - DNA, 21 bp, Homo sapiens
atgtgtatacatagctacata

SEQ ID NO: 104830 - DNA, 23 bp, Homo sapiens
taggaccctgctatatatgtgta

SEQ ID NO: 104831 - DNA, 23 bp, Homo sapiens
atatgtgtatgtatgcatatgtc

SEQ ID NO: 104832 - DNA, 23 bp, Homo sapiens
tgagttcattgtagattctggat

SEQ ID NO: 104833 - DNA, 23 bp, Homo sapiens
tgagttcattgtagattctggat

SEQ ID NO: 104834 - DNA, 22 bp, Homo sapiens
tagttagaatttcaatgagagt

SEQ ID NO: 104835 - DNA, 23 bp, Homo sapiens
tggagtctcactctgtcacccag

SEQ ID NO: 104836 - DNA, 23 bp, Homo sapiens
tttgagatcatgtagccatagaa

SEQ ID NO: 104837 - DNA, 21 bp, Homo sapiens
tttttctttagaaaacagaat

SEQ ID NO: 104838 - DNA, 23 bp, Homo sapiens
gactgagtctcgctctgtcaccc

SEQ ID NO: 104839 - DNA, 19 bp, Homo sapiens
agactgaagatacagagga

SEQ ID NO: 104840 - DNA, 22 bp, Homo sapiens
tctgtgcttcatttgataggat

SEQ ID NO: 104841 - DNA, 23 bp, Homo sapiens
cccagaagttcgagattacagtg

SEQ ID NO: 104842 - DNA, 21 bp, Homo sapiens
agccaagatcgtgccactgca

SEQ ID NO: 104843 - DNA, 21 bp, Homo sapiens
gaacgcagtggcacaatcatg

SEQ ID NO: 104844 - DNA, 23 bp, Homo sapiens
tgagttcattgtagattctggat

SEQ ID NO: 104845 - DNA, 23 bp, Homo sapiens
tgagttcattgtagattctggat

SEQ ID NO: 104846 - DNA, 21 bp, Homo sapiens
agtgtgaagtgagccagcaga

SEQ ID NO: 104847 - DNA, 18 bp, Homo sapiens
tgttccagcttctcgcag

SEQ ID NO: 104848 - DNA, 18 bp, Homo sapiens
tatacacatatgtgtggt

SEQ ID NO: 104849 - DNA, 23 bp, Homo sapiens
tatatgtatatatgtatatgtgt

SEQ ID NO: 104850 - DNA, 19 bp, Homo sapiens
tatgcgtatatatacacat

SEQ ID NO: 104851 - DNA, 18 bp, Homo sapiens
tacgcatatgtatgcata

SEQ ID NO: 104852 - DNA, 19 bp, Homo sapiens
tgcgtagtatgtgtagtga

SEQ ID NO: 104853 - DNA, 18 bp, Homo sapiens
tgaatgaatgaatgaatg

SEQ ID NO: 104854 - DNA, 21 bp, Homo sapiens
atatgtatatgtgcatgtagt

SEQ ID NO: 104855 - DNA, 23 bp, Homo sapiens
ttcccttatagaagttgctgggt

SEQ ID NO: 104856 - DNA, 22 bp, Homo sapiens
tatttccatatgaaatctaaat

SEQ ID NO: 104857 - DNA, 23 bp, Homo sapiens
agtgactcactgcagtctcaacc

SEQ ID NO: 104858 - DNA, 22 bp, Homo sapiens
tgagtctgactgtgtcacccac

SEQ ID NO: 104859 - DNA, 21 bp, Homo sapiens
aacggcagatcttggctcact

SEQ ID NO: 104860 - DNA, 23 bp, Homo sapiens
tgtgtatatatatatcagcagtg

SEQ ID NO: 104861 - DNA, 23 bp, Homo sapiens
ttgttgctagcttaaaaattgtt

SEQ ID NO: 104862 - DNA, 19 bp, Homo sapiens
tgataacgttgtatagcat

SEQ ID NO: 104863 - DNA, 23 bp, Homo sapiens
tatatgtatatatgcatatgtgt

SEQ ID NO: 104864 - DNA, 23 bp, Homo sapiens
agacagtctcgctctgtcaccca

SEQ ID NO: 104865 - DNA, 22 bp, Homo sapiens
ttttgagacagggtcttgctct

SEQ ID NO: 104866 - DNA, 23 bp, Homo sapiens
atttttttctttggagaatcttg

SEQ ID NO: 104867 - DNA, 20 bp, Homo sapiens
tatgtgtatgtatatatatg

SEQ ID NO: 104868 - DNA, 23 bp, Homo sapiens
tattccaacttaacacgtatggt

SEQ ID NO: 104869 - DNA, 22 bp, Homo sapiens
tttgcatattgagctggattaa

SEQ ID NO: 104870 - DNA, 23 bp, Homo sapiens
gacagagtctcactctgtcacct

SEQ ID NO: 104871 - DNA, 19 bp, Homo sapiens
ttgcattgtctgaaaagtg

SEQ ID NO: 104872 - DNA, 23 bp, Homo sapiens
tgagttcattgtagattctggat

SEQ ID NO: 104873 - DNA, 23 bp, Homo sapiens
tgagttcattgtagattctggat

SEQ ID NO: 104874 - DNA, 23 bp, Homo sapiens
taactcaatctctgtctccattt

SEQ ID NO: 104875 - DNA, 22 bp, Homo sapiens
tgtgtgtatatatgtatatatg

SEQ ID NO: 104876 - DNA, 19 bp, Homo sapiens
atacacacccacatatttg

SEQ ID NO: 104877 - DNA, 22 bp, Homo sapiens
atcactgtgctctgcctccctt

SEQ ID NO: 104878 - DNA, 23 bp, Homo sapiens
tgagttcattgtagattctggat

SEQ ID NO: 104879 - DNA, 23 bp, Homo sapiens
tgagttcattgtagattctggat

SEQ ID NO: 104880 - DNA, 23 bp, Homo sapiens
ttttcttggcttaacaaatctaa

SEQ ID NO: 104881 - DNA, 23 bp, Homo sapiens
aagtgtgtatatatatatgtgtg

SEQ ID NO: 104882 - DNA, 23 bp, Homo sapiens
cggagtctcgctctgtctcccag

SEQ ID NO: 104883 - DNA, 21 bp, Homo sapiens
aatctcacacccagttctctg

SEQ ID NO: 104884 - DNA, 23 bp, Homo sapiens
catattggttctgtattgattct

SEQ ID NO: 104885 - DNA, 23 bp, Homo sapiens
agctacagagagaaaaggatatt

SEQ ID NO: 104886 - DNA, 22 bp, Homo sapiens
aaggaattggctcactcaatga

SEQ ID NO: 104887 - DNA, 19 bp, Homo sapiens
tctcactcactctgttgcc

SEQ ID NO: 104888 - DNA, 22 bp, Homo sapiens
tcacaggggtttgttgtacaga

SEQ ID NO: 104889 - DNA, 23 bp, Homo sapiens
gtggtgtgagagcctgtcctcag

SEQ ID NO: 104890 - DNA, 19 bp, Homo sapiens
tttttttgctctgcttctg

SEQ ID NO: 104891 - DNA, 19 bp, Homo sapiens
atttctgcaggttctcatg

SEQ ID NO: 104892 - DNA, 23 bp, Homo sapiens
tataattgtgccaggtacttttg

SEQ ID NO: 104893 - DNA, 23 bp, Homo sapiens
actctgtcagtgtggttaggata

SEQ ID NO: 104894 - DNA, 20 bp, Homo sapiens
gtggcagactcttttctttt

SEQ ID NO: 104895 - DNA, 23 bp, Homo sapiens
gacagagtctcgctctgtcaccc

SEQ ID NO: 104896 - DNA, 21 bp, Homo sapiens
tgggtctgaccctcgcacagt

SEQ ID NO: 104897 - DNA, 23 bp, Homo sapiens
gtatgaatgtatgcgtgtgtgtg

SEQ ID NO: 104898 - DNA, 19 bp, Homo sapiens
acgtatacatatatgtatg

SEQ ID NO: 104899 - DNA, 21 bp, Homo sapiens
tgtgaagaaagtcattggtag

SEQ ID NO: 104900 - DNA, 21 bp, Homo sapiens
tgtgaagaaagtcattggtag

SEQ ID NO: 104901 - DNA, 23 bp, Homo sapiens
cggagtctcactctgtcacccag

SEQ ID NO: 104902 - DNA, 23 bp, Homo sapiens
tggattctgagatgatatgattt

SEQ ID NO: 104903 - DNA, 22 bp, Homo sapiens
taggaacatccacagaacctct

SEQ ID NO: 104904 - DNA, 18 bp, Homo sapiens
tacataagtatgtgtaca

SEQ ID NO: 104905 - DNA, 22 bp, Homo sapiens
tatatgcatatatatacgcata

SEQ ID NO: 104906 - DNA, 23 bp, Homo sapiens
tatatgtgtgtatctatatatgt

SEQ ID NO: 104907 - DNA, 23 bp, Homo sapiens
atatgtgtgtatatatgtgtgtg

SEQ ID NO: 104908 - DNA, 20 bp, Homo sapiens
atgtgtgtgtatatatacac

SEQ ID NO: 104909 - DNA, 20 bp, Homo sapiens
tatgtgtgtgtatatataca

SEQ ID NO: 104910 - DNA, 23 bp, Homo sapiens
gtagagttgttgctcaagtcaag

SEQ ID NO: 104911 - DNA, 21 bp, Homo sapiens
ggtggtgtttactctcctccc

SEQ ID NO: 104912 - DNA, 23 bp, Homo sapiens
tcacacacttagactcacttacc

SEQ ID NO: 104913 - DNA, 18 bp, Homo sapiens
tacaggcatgagccaccg

SEQ ID NO: 104914 - DNA, 23 bp, Homo sapiens
aatagtcctggctactcagaagg

SEQ ID NO: 104915 - DNA, 23 bp, Homo sapiens
aggcagagtagttagctgagatc

SEQ ID NO: 104916 - DNA, 23 bp, Homo sapiens
gagatgagtctcactcattcagt

SEQ ID NO: 104917 - DNA, 22 bp, Homo sapiens
aatagcaagaaaagaaatggat

SEQ ID NO: 104918 - DNA, 23 bp, Homo sapiens
tgtctttgtatttgaatgtgatt

SEQ ID NO: 104919 - DNA, 23 bp, Homo sapiens
cagggtctcactctgtcactcag

SEQ ID NO: 104920 - DNA, 20 bp, Homo sapiens
acacgtgtatatatatgtgt

SEQ ID NO: 104921 - DNA, 19 bp, Homo sapiens
ttcgtatatatacgtgtat

SEQ ID NO: 104922 - DNA, 23 bp, Homo sapiens
gtctcactctgtctcccaggctg

SEQ ID NO: 104923 - DNA, 23 bp, Homo sapiens
caaggtctcactctgtcacccag

SEQ ID NO: 104924 - DNA, 23 bp, Homo sapiens
tttgtgtctctgtcacattttgg

SEQ ID NO: 104925 - DNA, 23 bp, Homo sapiens
tgcctcactcactggctgagcaa

SEQ ID NO: 104926 - DNA, 20 bp, Homo sapiens
atagttctacttaagtgaat

SEQ ID NO: 104927 - DNA, 23 bp, Homo sapiens
agagtctcactctgtcacccagg

SEQ ID NO: 104928 - DNA, 20 bp, Homo sapiens
cagagtagatgacaaattcc

SEQ ID NO: 104929 - DNA, 23 bp, Homo sapiens
aattgtattctaattttggtttc

SEQ ID NO: 104930 - DNA, 21 bp, Homo sapiens
gagaggatgtattttcaatga

SEQ ID NO: 104931 - DNA, 23 bp, Homo sapiens
tgagttcattgtagattctggat

SEQ ID NO: 104932 - DNA, 23 bp, Homo sapiens
tgagttcattgtagattctggat

SEQ ID NO: 104933 - DNA, 23 bp, Homo sapiens
tgcctgacagcctgacagccatg

SEQ ID NO: 104934 - DNA, 21 bp, Homo sapiens
tgttgattttgtatcttttct

SEQ ID NO: 104935 - DNA, 23 bp, Homo sapiens
agagtctcactctgtcacccagg

SEQ ID NO: 104936 - DNA, 20 bp, Homo sapiens
tgtgcacatatgtatatatg

SEQ ID NO: 104937 - DNA, 23 bp, Homo sapiens
cggagtctcgctctgtctcccag

SEQ ID NO: 104938 - DNA, 23 bp, Homo sapiens
acagagtctcgctctgtctccca

SEQ ID NO: 104939 - DNA, 23 bp, Homo sapiens
tgagttcattgtagattctggat

SEQ ID NO: 104940 - DNA, 23 bp, Homo sapiens
tgagttcattgtagattctggat

SEQ ID NO: 104941 - DNA, 23 bp, Homo sapiens
gacagagtctcgctctgtcaccc

SEQ ID NO: 104942 - DNA, 21 bp, Homo sapiens
tgtcacagaagtatgtgaggt

SEQ ID NO: 104943 - DNA, 23 bp, Homo sapiens
acaggcagaggaaagctgatcag

SEQ ID NO: 104944 - DNA, 19 bp, Homo sapiens
aaagttcagattttgttgt

SEQ ID NO: 104945 - DNA, 23 bp, Homo sapiens
tgactttcgttggatttagtgta

SEQ ID NO: 104946 - DNA, 23 bp, Homo sapiens
tgagttcattgtagattctggat

SEQ ID NO: 104947 - DNA, 23 bp, Homo sapiens
tgagttcattgtagattctggat

SEQ ID NO: 104948 - DNA, 22 bp, Homo sapiens
ttacagagagcagacactggac

SEQ ID NO: 104949 - DNA, 19 bp, Homo sapiens
tatggataaagcatgtgct

SEQ ID NO: 104950 - DNA, 22 bp, Homo sapiens
atagatgacacagattctgctt

SEQ ID NO: 104951 - DNA, 23 bp, Homo sapiens
gtgtcactctcactgtgctcccc

SEQ ID NO: 104952 - DNA, 23 bp, Homo sapiens
tgtgtttctatgtgtatatgtat

SEQ ID NO: 104953 - DNA, 21 bp, Homo sapiens
gtgttaatgtgttattgtggc

SEQ ID NO: 104954 - DNA, 20 bp, Homo sapiens
tattgaggttgtattagtct

SEQ ID NO: 104955 - DNA, 23 bp, Homo sapiens
taatgtttccaaatgtattggaa

SEQ ID NO: 104956 - DNA, 23 bp, Homo sapiens
ctcactcactgtgtctgggtcct

SEQ ID NO: 104957 - DNA, 19 bp, Homo sapiens
tatggagatatgggagctg

SEQ ID NO: 104958 - DNA, 23 bp, Homo sapiens
tgagttcattgtagattctggat

SEQ ID NO: 104959 - DNA, 23 bp, Homo sapiens
tgagttcattgtagattctggat

SEQ ID NO: 104960 - DNA, 23 bp, Homo sapiens
tgagttcattgtagattctggat

SEQ ID NO: 104961 - DNA, 23 bp, Homo sapiens
tgagttcattgtagattctggat

SEQ ID NO: 104962 - DNA, 21 bp, Homo sapiens
agatcaatatcaagatttgtt

SEQ ID NO: 104963 - DNA, 21 bp, Homo sapiens
tgtacatatgtatatatgtgt

SEQ ID NO: 104964 - DNA, 22 bp, Homo sapiens
atacatgcatatgtatatatgt

SEQ ID NO: 104965 - DNA, 19 bp, Homo sapiens
tctctgtgcccctgtctct

SEQ ID NO: 104966 - DNA, 18 bp, Homo sapiens
tccatgtatttgaagaaa

SEQ ID NO: 104967 - DNA, 21 bp, Homo sapiens
tagagtgatgagagtctgcac

SEQ ID NO: 104968 - DNA, 23 bp, Homo sapiens
tgaattctctgtctgaaaggtca

SEQ ID NO: 104969 - DNA, 22 bp, Homo sapiens
tgtctcagagactttatttagt

SEQ ID NO: 104970 - DNA, 23 bp, Homo sapiens
tggctcgctggctgcgtggctcg

SEQ ID NO: 104971 - DNA, 22 bp, Homo sapiens
tctctgtatttctctgtcattg

SEQ ID NO: 104972 - DNA, 23 bp, Homo sapiens
tctgtgtgtgtatgtatatgtat

SEQ ID NO: 104973 - DNA, 20 bp, Homo sapiens
tgtatatatgtatcttattc

SEQ ID NO: 104974 - DNA, 23 bp, Homo sapiens
tgtgtgtgtgtttatgtataggc

SEQ ID NO: 104975 - DNA, 23 bp, Homo sapiens
atatatgtatatatacatatcat

SEQ ID NO: 104976 - DNA, 20 bp, Homo sapiens
tagtggtgctaaaataaagt

SEQ ID NO: 104977 - DNA, 23 bp, Homo sapiens
tggatgtgtaatgattatgttgt

SEQ ID NO: 104978 - DNA, 19 bp, Homo sapiens
taactcacatggtaagtat

SEQ ID NO: 104979 - DNA, 23 bp, Homo sapiens
catcccagtggcattttctcctg

SEQ ID NO: 104980 - DNA, 18 bp, Homo sapiens
agggccatttttaatcat

SEQ ID NO: 104981 - DNA, 23 bp, Homo sapiens
gagcaatataaatgtgaaatgct

SEQ ID NO: 104982 - DNA, 22 bp, Homo sapiens
aacaccatgcagaatctttatt

SEQ ID NO: 104983 - DNA, 21 bp, Homo sapiens
gaggaactcaggaatggtagt

SEQ ID NO: 104984 - DNA, 21 bp, Homo sapiens
agtgtgtgtgtatatatacag

SEQ ID NO: 104985 - DNA, 23 bp, Homo sapiens
tctctactacaatgtcactgtct

SEQ ID NO: 104986 - DNA, 23 bp, Homo sapiens
tgagttcattgtagattctggat

SEQ ID NO: 104987 - DNA, 23 bp, Homo sapiens
tgagttcattgtagattctggat

SEQ ID NO: 104988 - DNA, 21 bp, Homo sapiens
atatgaaatagaaaatgaatg

SEQ ID NO: 104989 - DNA, 23 bp, Homo sapiens
ttagtgtatatgtatatatgtgt

SEQ ID NO: 104990 - DNA, 22 bp, Homo sapiens
tgaggttggaggatcatttgag

SEQ ID NO: 104991 - DNA, 23 bp, Homo sapiens
tggctctggttgttcttaagaag

SEQ ID NO: 104992 - DNA, 20 bp, Homo sapiens
tgaggtaggaggatcacttg

SEQ ID NO: 104993 - DNA, 20 bp, Homo sapiens
ttatgtatatatatatctgt

SEQ ID NO: 104994 - DNA, 23 bp, Homo sapiens
caaggtctcactctgtcacccag

SEQ ID NO: 104995 - DNA, 23 bp, Homo sapiens
gagtgaggtgatcttggctcact

SEQ ID NO: 104996 - DNA, 18 bp, Homo sapiens
atacacacatatatacat

SEQ ID NO: 104997 - DNA, 20 bp, Homo sapiens
actctgagtccagatctcct

SEQ ID NO: 104998 - DNA, 23 bp, Homo sapiens
tatcacatgtacatatatgtgtg

SEQ ID NO: 104999 - DNA, 23 bp, Homo sapiens
tgtgtctgtgtctgtctgtgtct

SEQ ID NO: 105000 - DNA, 23 bp, Homo sapiens
gaggttcagagaagtttggaaat

SEQ ID NO: 105001 - DNA, 21 bp, Homo sapiens
attgacaatttctatttctga

SEQ ID NO: 105002 - DNA, 23 bp, Homo sapiens
tcttcttgtccttcagattacga

SEQ ID NO: 105003 - DNA, 23 bp, Homo sapiens
aaatagtctttgttgttgtcaaa

SEQ ID NO: 105004 - DNA, 22 bp, Homo sapiens
attgccattctaactggtgtga

SEQ ID NO: 105005 - DNA, 21 bp, Homo sapiens
tgtgaagaaagtcaatggtag

SEQ ID NO: 105006 - DNA, 23 bp, Homo sapiens
aattgaatcatagatgtagacat

SEQ ID NO: 105007 - DNA, 23 bp, Homo sapiens
aatgtacaacatgaattctactg

SEQ ID NO: 105008 - DNA, 19 bp, Homo sapiens
ttttgattccatatgaatt

SEQ ID NO: 105009 - DNA, 21 bp, Homo sapiens
atgtgtgtatatatatgtgta

SEQ ID NO: 105010 - DNA, 23 bp, Homo sapiens
atacgtgtgtgtgtgtgtgtgtg

SEQ ID NO: 105011 - DNA, 23 bp, Homo sapiens
tgagttcattgtagattctggat

SEQ ID NO: 105012 - DNA, 23 bp, Homo sapiens
tgagttcattgtagattctggat

SEQ ID NO: 105013 - DNA, 20 bp, Homo sapiens
ttatgtataattgtatacac

SEQ ID NO: 105014 - DNA, 23 bp, Homo sapiens
agttctttctgtatctgtaagga

SEQ ID NO: 105015 - DNA, 23 bp, Homo sapiens
tagaggttcaaggttgtattgca

SEQ ID NO: 105016 - DNA, 19 bp, Homo sapiens
ttttaacattttcataaag

SEQ ID NO: 105017 - DNA, 22 bp, Homo sapiens
ttctttgtcaagaagtttatag

SEQ ID NO: 105018 - DNA, 21 bp, Homo sapiens
ttttgcaaggtttttcatgtc

SEQ ID NO: 105019 - DNA, 22 bp, Homo sapiens
gagagatttttgaatgctgatt

SEQ ID NO: 105020 - DNA, 23 bp, Homo sapiens
tgagttcattgtagattctggat

SEQ ID NO: 105021 - DNA, 23 bp, Homo sapiens
tgagttcattgtagattctggat

SEQ ID NO: 105022 - DNA, 23 bp, Homo sapiens
agaagtcattttcttgtggtata

SEQ ID NO: 105023 - DNA, 23 bp, Homo sapiens
ttttttgttttgttgctgaaatt

SEQ ID NO: 105024 - DNA, 18 bp, Homo sapiens
gtgtatatatatacacta

SEQ ID NO: 105025 - DNA, 23 bp, Homo sapiens
taaatggttgtattctttcgagt

SEQ ID NO: 105026 - DNA, 23 bp, Homo sapiens
tgagttcattgtagattctggat

SEQ ID NO: 105027 - DNA, 23 bp, Homo sapiens
tgagttcattgtagattctggat

SEQ ID NO: 105028 - DNA, 23 bp, Homo sapiens
tgagttcattgtagattctggat

SEQ ID NO: 105029 - DNA, 23 bp, Homo sapiens
tgagttcattgtagattctggat

SEQ ID NO: 105030 - DNA, 23 bp, Homo sapiens
tgagttcattgtagattctggat

SEQ ID NO: 105031 - DNA, 23 bp, Homo sapiens
tgagttcattgtagattctggat

SEQ ID NO: 105032 - DNA, 22 bp, Homo sapiens
tattttacctaggaaacataag

SEQ ID NO: 105033 - DNA, 22 bp, Homo sapiens
tgtggctttcctttcatatctg

SEQ ID NO: 105034 - DNA, 18 bp, Homo sapiens
tatatatatatgctgtat

SEQ ID NO: 105035 - DNA, 20 bp, Homo sapiens
tgtatctatatatatgctgt

SEQ ID NO: 105036 - DNA, 22 bp, Homo sapiens
atatgctgtatatatcaggtat

SEQ ID NO: 105037 - DNA, 23 bp, Homo sapiens
tatatgtatgtatgtatatatgt

SEQ ID NO: 105038 - DNA, 23 bp, Homo sapiens
gtgtttgtgtatatgtatatatg

SEQ ID NO: 105039 - DNA, 23 bp, Homo sapiens
ttatgtatataagtatatgtata

SEQ ID NO: 105040 - DNA, 23 bp, Homo sapiens
tgcttatatgtatgtaagtatat

SEQ ID NO: 105041 - DNA, 23 bp, Homo sapiens
tgtcagctacttcattcctgttg

SEQ ID NO: 105042 - DNA, 20 bp, Homo sapiens
ttatgtctatatgtatatat

SEQ ID NO: 105043 - DNA, 19 bp, Homo sapiens
ttccttctggtgggtctgt

SEQ ID NO: 105044 - DNA, 23 bp, Homo sapiens
ttcacagtgagtgttacagctct

SEQ ID NO: 105045 - DNA, 22 bp, Homo sapiens
actgtgtatcctgatacagttt

SEQ ID NO: 105046 - DNA, 20 bp, Homo sapiens
tatgtgagtgcgtctatata

SEQ ID NO: 105047 - DNA, 23 bp, Homo sapiens
aggatatcaaatgtgtagtcata

SEQ ID NO: 105048 - DNA, 21 bp, Homo sapiens
tatatatatatgtatatgtgt

SEQ ID NO: 105049 - DNA, 23 bp, Homo sapiens
tatacagattatatatttatgtg

SEQ ID NO: 105050 - DNA, 19 bp, Homo sapiens
tacattatatatgtatatg

SEQ ID NO: 105051 - DNA, 23 bp, Homo sapiens
acatacagaccttacctttaagg

SEQ ID NO: 105052 - DNA, 23 bp, Homo sapiens
tatgtatatctatttgtatatgt

SEQ ID NO: 105053 - DNA, 23 bp, Homo sapiens
acatagagagagttagtttttgg

SEQ ID NO: 105054 - DNA, 19 bp, Homo sapiens
gtatgagtgttacctacat

SEQ ID NO: 105055 - DNA, 23 bp, Homo sapiens
tattctctctgttattcttggaa

SEQ ID NO: 105056 - DNA, 23 bp, Homo sapiens
tgtatggtaaagttctgtatttg

SEQ ID NO: 105057 - DNA, 22 bp, Homo sapiens
ttgtggtactgattggtggagg

SEQ ID NO: 105058 - DNA, 22 bp, Homo sapiens
agtcagtctgacttatagggcc

SEQ ID NO: 105059 - DNA, 21 bp, Homo sapiens
taactgcattgagaccagtta

SEQ ID NO: 105060 - DNA, 23 bp, Homo sapiens
gcagtgagccaagatcgtgccac

SEQ ID NO: 105061 - DNA, 23 bp, Homo sapiens
tcctaaagtcatggagacataag

SEQ ID NO: 105062 - DNA, 22 bp, Homo sapiens
agtctctctgactttcaagcct

SEQ ID NO: 105063 - DNA, 18 bp, Homo sapiens
tggtgattttctatttat

SEQ ID NO: 105064 - DNA, 21 bp, Homo sapiens
atctgtgcatgtgcatgtgta

SEQ ID NO: 105065 - DNA, 23 bp, Homo sapiens
tacagactctcactctgtctcca

SEQ ID NO: 105066 - DNA, 22 bp, Homo sapiens
ttcaccaccttctccacccagc

SEQ ID NO: 105067 - DNA, 23 bp, Homo sapiens
ttagagttctctgcagattgggt

SEQ ID NO: 105068 - DNA, 23 bp, Homo sapiens
agacggagtctcgctctgtcgct

SEQ ID NO: 105069 - DNA, 23 bp, Homo sapiens
tgtgtctgtcactgcctcttctg

SEQ ID NO: 105070 - DNA, 23 bp, Homo sapiens
tgagttcattgtagattctggat

SEQ ID NO: 105071 - DNA, 23 bp, Homo sapiens
tgagttcattgtagattctggat

SEQ ID NO: 105072 - DNA, 23 bp, Homo sapiens
cctctctgtgacactccctccca

SEQ ID NO: 105073 - DNA, 23 bp, Homo sapiens
atagagaagtcattttgtagagg

SEQ ID NO: 105074 - DNA, 22 bp, Homo sapiens
ttttgagacggagtctctgtcg

SEQ ID NO: 105075 - DNA, 23 bp, Homo sapiens
actctggcaggcagttctgtgtg

SEQ ID NO: 105076 - DNA, 23 bp, Homo sapiens
tggctcactctccctgtgctctg

SEQ ID NO: 105077 - DNA, 23 bp, Homo sapiens
gcctgtctgtctgtctgtctgtc

SEQ ID NO: 105078 - DNA, 21 bp, Homo sapiens
tactgaacttctttagggaga

SEQ ID NO: 105079 - DNA, 22 bp, Homo sapiens
aatgaccttcaagaaaggaaca

SEQ ID NO: 105080 - DNA, 23 bp, Homo sapiens
acagttctctgagcctcagttct

SEQ ID NO: 105081 - DNA, 23 bp, Homo sapiens
tggtgaggcagagagatactggt

SEQ ID NO: 105082 - DNA, 23 bp, Homo sapiens
gcaataccttgtgaaatcgattg

SEQ ID NO: 105083 - DNA, 22 bp, Homo sapiens
ttgcgagatcctggctttgtgt

SEQ ID NO: 105084 - DNA, 23 bp, Homo sapiens
gccagtgttcagagttcctgtga

SEQ ID NO: 105085 - DNA, 23 bp, Homo sapiens
ccctggctgtctctgtctctgga

SEQ ID NO: 105086 - DNA, 23 bp, Homo sapiens
ttacttgtgtatttcatattcac

SEQ ID NO: 105087 - DNA, 23 bp, Homo sapiens
tatacagtgcttgtgagtgatga

SEQ ID NO: 105088 - DNA, 23 bp, Homo sapiens
tgagttcattgtagattctggat

SEQ ID NO: 105089 - DNA, 23 bp, Homo sapiens
tgagttcattgtagattctggat

SEQ ID NO: 105090 - DNA, 23 bp, Homo sapiens
tgagttcattgtagattctggat

SEQ ID NO: 105091 - DNA, 23 bp, Homo sapiens
tgagttcattgtagattctggat

SEQ ID NO: 105092 - DNA, 23 bp, Homo sapiens
ctgatgagaagaatgtgtattct

SEQ ID NO: 105093 - DNA, 20 bp, Homo sapiens
acacacacacatatacatat

SEQ ID NO: 105094 - DNA, 22 bp, Homo sapiens
acagagtgagactctgtttcaa

SEQ ID NO: 105095 - DNA, 23 bp, Homo sapiens
caagatctctctctctgtcaccc

SEQ ID NO: 105096 - DNA, 23 bp, Homo sapiens
tattttctgctatgactcactgt

SEQ ID NO: 105097 - DNA, 23 bp, Homo sapiens
aggatcagtgggtgtgttggggg

SEQ ID NO: 105098 - DNA, 23 bp, Homo sapiens
tacaaccaggtgatggacaatgg

SEQ ID NO: 105099 - DNA, 23 bp, Homo sapiens
ggaagaagcagcagtagcctgac

SEQ ID NO: 105100 - DNA, 19 bp, Homo sapiens
atatatgtacatgaatgtg

SEQ ID NO: 105101 - DNA, 23 bp, Homo sapiens
tgagtctcactctgtcacccaag

SEQ ID NO: 105102 - DNA, 18 bp, Homo sapiens
tatctttcccagtttttg

SEQ ID NO: 105103 - DNA, 22 bp, Homo sapiens
agagtctcgctctgtcacccag

SEQ ID NO: 105104 - DNA, 23 bp, Homo sapiens
ggagtctctctctgtcacccagg

SEQ ID NO: 105105 - DNA, 22 bp, Homo sapiens
ctgaggtagaagaatcacttga

SEQ ID NO: 105106 - DNA, 23 bp, Homo sapiens
tgacatggcttttcttttctttt

SEQ ID NO: 105107 - DNA, 23 bp, Homo sapiens
ttattggtgaatgcacttactgt

SEQ ID NO: 105108 - DNA, 20 bp, Homo sapiens
taattgtatgtgctatactt

SEQ ID NO: 105109 - DNA, 23 bp, Homo sapiens
gacagagtctcgctctgtcaccc

SEQ ID NO: 105110 - DNA, 23 bp, Homo sapiens
ctatacatggatagtagattcgt

SEQ ID NO: 105111 - DNA, 23 bp, Homo sapiens
acaccatgtctcttcagaaggca

SEQ ID NO: 105112 - DNA, 22 bp, Homo sapiens
atgaagggttatttattgacca

SEQ ID NO: 105113 - DNA, 23 bp, Homo sapiens
tggaaagtctggaaactgattga

SEQ ID NO: 105114 - DNA, 23 bp, Homo sapiens
catttgacctagaagttttctgc

SEQ ID NO: 105115 - DNA, 18 bp, Homo sapiens
taggtgcatatatttata

SEQ ID NO: 105116 - DNA, 20 bp, Homo sapiens
tatctgtagtcctagctact

SEQ ID NO: 105117 - DNA, 18 bp, Homo sapiens
agaggttgcagtgagcct

SEQ ID NO: 105118 - DNA, 23 bp, Homo sapiens
tgagacactgactctctctctct

SEQ ID NO: 105119 - DNA, 19 bp, Homo sapiens
atccacctgaactgctttc

SEQ ID NO: 105120 - DNA, 20 bp, Homo sapiens
tttgttcttttgcttaggat

SEQ ID NO: 105121 - DNA, 22 bp, Homo sapiens
atctcttactctgtgactctgt

SEQ ID NO: 105122 - DNA, 23 bp, Homo sapiens
atagtcagctatgattatgtcac

SEQ ID NO: 105123 - DNA, 21 bp, Homo sapiens
tataacagttttgtgtcccag

SEQ ID NO: 105124 - DNA, 23 bp, Homo sapiens
tgagtcactgcatttggtggagt

SEQ ID NO: 105125 - DNA, 23 bp, Homo sapiens
tcacagactgaccctctctttgg

SEQ ID NO: 105126 - DNA, 18 bp, Homo sapiens
tgagatcatggtggaagg

SEQ ID NO: 105127 - DNA, 19 bp, Homo sapiens
tctgtgtgtatgtgagtga

SEQ ID NO: 105128 - DNA, 23 bp, Homo sapiens
gacagagtgatcagagagtccag

SEQ ID NO: 105129 - DNA, 23 bp, Homo sapiens
tggagtctcgctctgtctcccag

SEQ ID NO: 105130 - DNA, 23 bp, Homo sapiens
agagtctcactctgtcacccagg

SEQ ID NO: 105131 - DNA, 21 bp, Homo sapiens
agtggtgcgatctctgctcct

SEQ ID NO: 105132 - DNA, 23 bp, Homo sapiens
tgtgcctctcagtgtgtccctgc

SEQ ID NO: 105133 - DNA, 23 bp, Homo sapiens
cccacagcttcattacacagttg

SEQ ID NO: 105134 - DNA, 23 bp, Homo sapiens
ctcagttctatcactgtcaccta

SEQ ID NO: 105135 - DNA, 21 bp, Homo sapiens
agtgcagtagtgcgatcatag

SEQ ID NO: 105136 - DNA, 20 bp, Homo sapiens
atatgtatcctatttgttct

SEQ ID NO: 105137 - DNA, 23 bp, Homo sapiens
cataagagtcaaagaagtcccaa

SEQ ID NO: 105138 - DNA, 23 bp, Homo sapiens
gtgactctcagtaactcttttgc

SEQ ID NO: 105139 - DNA, 23 bp, Homo sapiens
tctctcactggatttgtaagctt

SEQ ID NO: 105140 - DNA, 23 bp, Homo sapiens
ttattcagcttctgtaaacactg

SEQ ID NO: 105141 - DNA, 23 bp, Homo sapiens
gaggagagagaatagacagagag

SEQ ID NO: 105142 - DNA, 23 bp, Homo sapiens
agtgtctggctgtctctcatttc

SEQ ID NO: 105143 - DNA, 21 bp, Homo sapiens
agcaatagtcatgggatgaga

SEQ ID NO: 105144 - DNA, 18 bp, Homo sapiens
tcccaagtagctgggatt

SEQ ID NO: 105145 - DNA, 23 bp, Homo sapiens
gtatatgtatgtatatgtatatg

SEQ ID NO: 105146 - DNA, 23 bp, Homo sapiens
tgagttcattgtagattctggat

SEQ ID NO: 105147 - DNA, 23 bp, Homo sapiens
tgagttcattgtagattctggat

SEQ ID NO: 105148 - DNA, 23 bp, Homo sapiens
tctgtgaagaaagtcaatggtag

SEQ ID NO: 105149 - DNA, 22 bp, Homo sapiens
ctgtctgtgggtctctcagtgg

SEQ ID NO: 105150 - DNA, 23 bp, Homo sapiens
agacagggtcgctctctgtcact

SEQ ID NO: 105151 - DNA, 21 bp, Homo sapiens
tctctgtagcttagttgcctc

SEQ ID NO: 105152 - DNA, 18 bp, Homo sapiens
gtgatttccatgctcatt

SEQ ID NO: 105153 - DNA, 23 bp, Homo sapiens
ttaaatggagaactaggtctaag

SEQ ID NO: 105154 - DNA, 21 bp, Homo sapiens
gaaatgaacagagaaagctca

SEQ ID NO: 105155 - DNA, 23 bp, Homo sapiens
gtagcatcaattgtattgtgtct

SEQ ID NO: 105156 - DNA, 23 bp, Homo sapiens
tgagttcattgtagattctggat

SEQ ID NO: 105157 - DNA, 23 bp, Homo sapiens
tgagttcattgtagattctggat

SEQ ID NO: 105158 - DNA, 22 bp, Homo sapiens
tgttctttttgcttaggattgt

SEQ ID NO: 105159 - DNA, 22 bp, Homo sapiens
aaaaagcatgaagtgttgagtc

SEQ ID NO: 105160 - DNA, 23 bp, Homo sapiens
atagctagacacacacacacaca

SEQ ID NO: 105161 - DNA, 23 bp, Homo sapiens
cagtgagcttccttgtattgttc

SEQ ID NO: 105162 - DNA, 23 bp, Homo sapiens
gtcagggtctcactttgtcactc

SEQ ID NO: 105163 - DNA, 21 bp, Homo sapiens
tatgtgtatatgtaaatgtat

SEQ ID NO: 105164 - DNA, 22 bp, Homo sapiens
atatatgtatatgtatatgtgt

SEQ ID NO: 105165 - DNA, 23 bp, Homo sapiens
cagggtgaacatggtgttaagga

SEQ ID NO: 105166 - DNA, 23 bp, Homo sapiens
aattcagttgtctcagtgtcacc

SEQ ID NO: 105167 - DNA, 22 bp, Homo sapiens
tcagatgtgattttgatgttct

SEQ ID NO: 105168 - DNA, 23 bp, Homo sapiens
gacagagtctcgctctgtcaccc

SEQ ID NO: 105169 - DNA, 23 bp, Homo sapiens
tttctcaccctggtttgaggtgc

SEQ ID NO: 105170 - DNA, 23 bp, Homo sapiens
ttagaccaggaatcaggtaacct

SEQ ID NO: 105171 - DNA, 23 bp, Homo sapiens
tgagttcattgtagattctggat

SEQ ID NO: 105172 - DNA, 23 bp, Homo sapiens
tgagttcattgtagattctggat

SEQ ID NO: 105173 - DNA, 22 bp, Homo sapiens
actgaggcttgtgtttacctct

SEQ ID NO: 105174 - DNA, 23 bp, Homo sapiens
tggttggttcttgattcccatgt

SEQ ID NO: 105175 - DNA, 23 bp, Homo sapiens
ttgacaggaattttgaatggtcc

SEQ ID NO: 105176 - DNA, 23 bp, Homo sapiens
ttagaccaggaatcaggtaacct

SEQ ID NO: 105177 - DNA, 19 bp, Homo sapiens
tctctctgtcagtatttgg

SEQ ID NO: 105178 - DNA, 23 bp, Homo sapiens
gatctacaggctcaccatcatga

SEQ ID NO: 105179 - DNA, 23 bp, Homo sapiens
agagtctcactctgtcacccagg

SEQ ID NO: 105180 - DNA, 18 bp, Homo sapiens
tgagacagagtctcactg

SEQ ID NO: 105181 - DNA, 22 bp, Homo sapiens
actcagcttcctctttgccacc

SEQ ID NO: 105182 - DNA, 23 bp, Homo sapiens
attcatcttcttccgctcttttt

SEQ ID NO: 105183 - DNA, 23 bp, Homo sapiens
ggagtctctctctgtcactcagg

SEQ ID NO: 105184 - DNA, 23 bp, Homo sapiens
tgagttcattgtagattctggat

SEQ ID NO: 105185 - DNA, 23 bp, Homo sapiens
tgagttcattgtagattctggat

SEQ ID NO: 105186 - DNA, 23 bp, Homo sapiens
ctcaaactgcatgagcatgtgca

SEQ ID NO: 105187 - DNA, 19 bp, Homo sapiens
tgacagccacactcactgc

SEQ ID NO: 105188 - DNA, 19 bp, Homo sapiens
tctctctgtcagtatttgg

SEQ ID NO: 105189 - DNA, 23 bp, Homo sapiens
tggattcatttattttgaaatgg

SEQ ID NO: 105190 - DNA, 23 bp, Homo sapiens
tctttactgtgcatttgaagtat

SEQ ID NO: 105191 - DNA, 23 bp, Homo sapiens
tgagttcattgtagattctggat

SEQ ID NO: 105192 - DNA, 23 bp, Homo sapiens
tgagttcattgtagattctggat

SEQ ID NO: 105193 - DNA, 23 bp, Homo sapiens
tgagttcattgtagattctggat

SEQ ID NO: 105194 - DNA, 23 bp, Homo sapiens
tgagttcattgtagattctggat

SEQ ID NO: 105195 - DNA, 23 bp, Homo sapiens
acacagtgtctcactctttttcc

SEQ ID NO: 105196 - DNA, 23 bp, Homo sapiens
tggagtctcactctgtcacccag

SEQ ID NO: 105197 - DNA, 23 bp, Homo sapiens
acacagtgtctcactctttttcc

SEQ ID NO: 105198 - DNA, 23 bp, Homo sapiens
tggagtctcactctgtcacccag

SEQ ID NO: 105199 - DNA, 19 bp, Homo sapiens
tgtgtgtatatatgtgtgt

SEQ ID NO: 105200 - DNA, 22 bp, Homo sapiens
ggatctcacaaagtacattctc

SEQ ID NO: 105201 - DNA, 18 bp, Homo sapiens
aggcaagaggattgcttg

SEQ ID NO: 105202 - DNA, 23 bp, Homo sapiens
ggcaacaaagtgagactctgtct

SEQ ID NO: 105203 - DNA, 23 bp, Homo sapiens
atgtggctgtgcatgtgcttgtg

SEQ ID NO: 105204 - DNA, 21 bp, Homo sapiens
tacagtgagctatgattgtgc

SEQ ID NO: 105205 - DNA, 23 bp, Homo sapiens
gacggagtctctggctctgtcgc

SEQ ID NO: 105206 - DNA, 21 bp, Homo sapiens
aatcttgatagaactaggctt

SEQ ID NO: 105207 - DNA, 23 bp, Homo sapiens
ggcagagtctcactctcacccag

SEQ ID NO: 105208 - DNA, 22 bp, Homo sapiens
tctctactactagtgtgagagt

SEQ ID NO: 105209 - DNA, 22 bp, Homo sapiens
atatatgtatatgtaggtgtat

SEQ ID NO: 105210 - DNA, 18 bp, Homo sapiens
atatgtatatatgtatgt

SEQ ID NO: 105211 - DNA, 21 bp, Homo sapiens
attactacatatatgtgtgtg

SEQ ID NO: 105212 - DNA, 23 bp, Homo sapiens
gtctatctgtccctctgacactg

SEQ ID NO: 105213 - DNA, 23 bp, Homo sapiens
tgagttcattgtagattctggat

SEQ ID NO: 105214 - DNA, 23 bp, Homo sapiens
tgagttcattgtagattctggat

SEQ ID NO: 105215 - DNA, 23 bp, Homo sapiens
tgagttcattgtagattctggat

SEQ ID NO: 105216 - DNA, 23 bp, Homo sapiens
tgagttcattgtagattctggat

SEQ ID NO: 105217 - DNA, 21 bp, Homo sapiens
cttgagtctgggagtttgagg

SEQ ID NO: 105218 - DNA, 23 bp, Homo sapiens
actgagcctgtctcagagtgtgt

SEQ ID NO: 105219 - DNA, 23 bp, Homo sapiens
tggagtctcactctgtcacccag

SEQ ID NO: 105220 - DNA, 23 bp, Homo sapiens
tatatgtgtgtatgtatatgtgt

SEQ ID NO: 105221 - DNA, 23 bp, Homo sapiens
tgtatgtatgtatatatctgtgt

SEQ ID NO: 105222 - DNA, 20 bp, Homo sapiens
gttcacatttccaggagaaa

SEQ ID NO: 105223 - DNA, 23 bp, Homo sapiens
aaactggttcttgaggaagagta

SEQ ID NO: 105224 - DNA, 23 bp, Homo sapiens
atatatctctatatatatgtaac

SEQ ID NO: 105225 - DNA, 23 bp, Homo sapiens
atgtgtgtgtatatatatatgtg

SEQ ID NO: 105226 - DNA, 23 bp, Homo sapiens
gctctgacagtctgtgaatctcc

SEQ ID NO: 105227 - DNA, 20 bp, Homo sapiens
ctcgctctgtcactcaggct

SEQ ID NO: 105228 - DNA, 23 bp, Homo sapiens
gacagtctcactctgtcacccag

SEQ ID NO: 105229 - DNA, 18 bp, Homo sapiens
tgtgaacctgactcactg

SEQ ID NO: 105230 - DNA, 23 bp, Homo sapiens
aggctgaggtaagaggatcactt

SEQ ID NO: 105231 - DNA, 22 bp, Homo sapiens
agacagtgagctcacttcctga

SEQ ID NO: 105232 - DNA, 23 bp, Homo sapiens
acagaatctcactctgtcaccca

SEQ ID NO: 105233 - DNA, 18 bp, Homo sapiens
cagcggcatgattttgac

SEQ ID NO: 105234 - DNA, 19 bp, Homo sapiens
tgcaatggtgtgatctctg

SEQ ID NO: 105235 - DNA, 23 bp, Homo sapiens
atagacgtgatcatcagctccac

SEQ ID NO: 105236 - DNA, 23 bp, Homo sapiens
ctctgagactctctttgttcata

SEQ ID NO: 105237 - DNA, 21 bp, Homo sapiens
atgaggtttcgccatgttggc

SEQ ID NO: 105238 - DNA, 23 bp, Homo sapiens
atggggagtgtgatggctgtgtg

SEQ ID NO: 105239 - DNA, 23 bp, Homo sapiens
gtctcgctctgtcgctcaggctg

SEQ ID NO: 105240 - DNA, 23 bp, Homo sapiens
gagatagagtctcactctgtcac

SEQ ID NO: 105241 - DNA, 23 bp, Homo sapiens
tctgactcactcactgccttttg

SEQ ID NO: 105242 - DNA, 22 bp, Homo sapiens
acacgatatgcatatcatatgt

SEQ ID NO: 105243 - DNA, 23 bp, Homo sapiens
tctgactcactcactgccttttg

SEQ ID NO: 105244 - DNA, 23 bp, Homo sapiens
tatttggtgtgcaagacttgtga

SEQ ID NO: 105245 - DNA, 18 bp, Homo sapiens
aggttgattctttttttt

SEQ ID NO: 105246 - DNA, 23 bp, Homo sapiens
actgccacactctctggctgccc

SEQ ID NO: 105247 - DNA, 23 bp, Homo sapiens
ccactctctcccagtgtcctcag

SEQ ID NO: 105248 - DNA, 23 bp, Homo sapiens
gagacagagtctcactctgttac

SEQ ID NO: 105249 - DNA, 19 bp, Homo sapiens
ttccagattatcaggttct

SEQ ID NO: 105250 - DNA, 23 bp, Homo sapiens
actggctgagtacaggagtttga

SEQ ID NO: 105251 - DNA, 23 bp, Homo sapiens
ttcggttatctagctttatgaag

SEQ ID NO: 105252 - DNA, 23 bp, Homo sapiens
atacagctagataaccaaagata

SEQ ID NO: 105253 - DNA, 22 bp, Homo sapiens
gctctcactctctctcactcgc

SEQ ID NO: 105254 - DNA, 21 bp, Homo sapiens
caaagaaggctgtgggagggt

SEQ ID NO: 105255 - DNA, 23 bp, Homo sapiens
caggatctcactctgtcgctcag

SEQ ID NO: 105256 - DNA, 23 bp, Homo sapiens
acttaactggctctctcagtctc

SEQ ID NO: 105257 - DNA, 23 bp, Homo sapiens
cggtcggtctgtgtgtccctgtc

SEQ ID NO: 105258 - DNA, 21 bp, Homo sapiens
atgaatgaatgaatgaatggc

SEQ ID NO: 105259 - DNA, 21 bp, Homo sapiens
tgtgtatatatatgtgtgtgt

SEQ ID NO: 105260 - DNA, 23 bp, Homo sapiens
atgtatctatatatatatctgtg

SEQ ID NO: 105261 - DNA, 23 bp, Homo sapiens
actggcctcactctctgtgacag

SEQ ID NO: 105262 - DNA, 23 bp, Homo sapiens
atgaatctatatataggaatata

SEQ ID NO: 105263 - DNA, 22 bp, Homo sapiens
atatatgaatctatatatagga

SEQ ID NO: 105264 - DNA, 20 bp, Homo sapiens
atatgaatctatatatagga

SEQ ID NO: 105265 - DNA, 23 bp, Homo sapiens
actctctgcctctctgtgccgct

SEQ ID NO: 105266 - DNA, 23 bp, Homo sapiens
atctagagcaggaagtgttggca

SEQ ID NO: 105267 - DNA, 18 bp, Homo sapiens
cagacggtaagaactctg

SEQ ID NO: 105268 - DNA, 23 bp, Homo sapiens
tgagttcattgtagattctggat

SEQ ID NO: 105269 - DNA, 23 bp, Homo sapiens
tgagttcattgtagattctggat

SEQ ID NO: 105270 - DNA, 23 bp, Homo sapiens
tatcacactggttgagtagttat

SEQ ID NO: 105271 - DNA, 22 bp, Homo sapiens
tgacagagcaaatcttatcact

SEQ ID NO: 105272 - DNA, 23 bp, Homo sapiens
tttgtcacactcattctctgtcc

SEQ ID NO: 105273 - DNA, 18 bp, Homo sapiens
tgtgccattctctctcac

SEQ ID NO: 105274 - DNA, 19 bp, Homo sapiens
taccactctggttttcctg

SEQ ID NO: 105275 - DNA, 20 bp, Homo sapiens
agggattgatgcttctgata

SEQ ID NO: 105276 - DNA, 22 bp, Homo sapiens
ttgcatcaattgagatgatcat

SEQ ID NO: 105277 - DNA, 23 bp, Homo sapiens
tcagggtcttcatgatgtgattg

SEQ ID NO: 105278 - DNA, 23 bp, Homo sapiens
gatctctccctgtctctctgtgt

SEQ ID NO: 105279 - DNA, 23 bp, Homo sapiens
agagagaccacacagagtcacga

SEQ ID NO: 105280 - DNA, 21 bp, Homo sapiens
tacaatgtatatatatgtgta

SEQ ID NO: 105281 - DNA, 23 bp, Homo sapiens
aaggtaagactctaatctggttg

SEQ ID NO: 105282 - DNA, 23 bp, Homo sapiens
gactgctctcacctcttgctgac

SEQ ID NO: 105283 - DNA, 22 bp, Homo sapiens
tcttgagattgggagattatcc

SEQ ID NO: 105284 - DNA, 21 bp, Homo sapiens
tactctgtgtgtgtgtgtgtg

SEQ ID NO: 105285 - DNA, 23 bp, Homo sapiens
atataccatatataatcagtaag

SEQ ID NO: 105286 - DNA, 20 bp, Homo sapiens
tgtgtgcacagtctcactgt

SEQ ID NO: 105287 - DNA, 23 bp, Homo sapiens
gattcagcaacaggaactgattc

SEQ ID NO: 105288 - DNA, 23 bp, Homo sapiens
tataggtgttcttggtgctattt

SEQ ID NO: 105289 - DNA, 23 bp, Homo sapiens
tcgctgtcagtctctctccctct

SEQ ID NO: 105290 - DNA, 23 bp, Homo sapiens
tgtgtggatgtattatcatgcat

SEQ ID NO: 105291 - DNA, 22 bp, Homo sapiens
cacaatgtcatgatggatatct

SEQ ID NO: 105292 - DNA, 23 bp, Homo sapiens
tctctcagaaagattatagttta

SEQ ID NO: 105293 - DNA, 23 bp, Homo sapiens
tgtgggacactcagtgcctcagc

SEQ ID NO: 105294 - DNA, 21 bp, Homo sapiens
tgaggtagaaggatctcttga

SEQ ID NO: 105295 - DNA, 21 bp, Homo sapiens
cagtgatctgtgctcatgcca

SEQ ID NO: 105296 - DNA, 23 bp, Homo sapiens
cagggtctcactctgtcacccag

SEQ ID NO: 105297 - DNA, 23 bp, Homo sapiens
agtgtctcttgcagtctgtctct

SEQ ID NO: 105298 - DNA, 23 bp, Homo sapiens
tctcactctgtctcccagtggcg

SEQ ID NO: 105299 - DNA, 23 bp, Homo sapiens
agagtctcactctgtcacccagg

SEQ ID NO: 105300 - DNA, 22 bp, Homo sapiens
ctcactgtaacctctgcctcct

SEQ ID NO: 105301 - DNA, 23 bp, Homo sapiens
tggcatagtcagaaatgagactg

SEQ ID NO: 105302 - DNA, 22 bp, Homo sapiens
attattgtgctatgtcgttgtg

SEQ ID NO: 105303 - DNA, 23 bp, Homo sapiens
agagtctcactctgtcacccagg

SEQ ID NO: 105304 - DNA, 22 bp, Homo sapiens
tccttcaaactagctgagtcag

SEQ ID NO: 105305 - DNA, 23 bp, Homo sapiens
tgagttcattgtagattctggat

SEQ ID NO: 105306 - DNA, 23 bp, Homo sapiens
tgagttcattgtagattctggat

SEQ ID NO: 105307 - DNA, 18 bp, Homo sapiens
tgtatgtgtatatgtatg

SEQ ID NO: 105308 - DNA, 20 bp, Homo sapiens
ctcacagaggagactgtgca

SEQ ID NO: 105309 - DNA, 23 bp, Homo sapiens
atctctcagtgcctgtgtagagt

SEQ ID NO: 105310 - DNA, 23 bp, Homo sapiens
cagagtctcactctgtcgctcag

SEQ ID NO: 105311 - DNA, 21 bp, Homo sapiens
agcctggcatagtggtgtgtt

SEQ ID NO: 105312 - DNA, 20 bp, Homo sapiens
ctgaggtaggaggatcattt

SEQ ID NO: 105313 - DNA, 21 bp, Homo sapiens
tatgggtaaaaattgctttct

SEQ ID NO: 105314 - DNA, 21 bp, Homo sapiens
ttattattgatatcccaaaca

SEQ ID NO: 105315 - DNA, 23 bp, Homo sapiens
cggagtctcactctgtcacccag

SEQ ID NO: 105316 - DNA, 23 bp, Homo sapiens
gagtctcactctgtcacccaggc

SEQ ID NO: 105317 - DNA, 21 bp, Homo sapiens
tttgtatttttagtacagaca

SEQ ID NO: 105318 - DNA, 23 bp, Homo sapiens
tatatgtatatatacgtatgtgt

SEQ ID NO: 105319 - DNA, 18 bp, Homo sapiens
tatgtgtatatgtgtata

SEQ ID NO: 105320 - DNA, 22 bp, Homo sapiens
gagtgcaatgttgtatggggta

SEQ ID NO: 105321 - DNA, 23 bp, Homo sapiens
aagagatgagagactgcacattg

SEQ ID NO: 105322 - DNA, 22 bp, Homo sapiens
aattgcactccagcctgggtga

SEQ ID NO: 105323 - DNA, 20 bp, Homo sapiens
atgtatgtatacgtatgtat

SEQ ID NO: 105324 - DNA, 23 bp, Homo sapiens
tggactctcagtgtctgtgtccc

SEQ ID NO: 105325 - DNA, 19 bp, Homo sapiens
aaagtccttgtagagctct

SEQ ID NO: 105326 - DNA, 23 bp, Homo sapiens
agacaaggtctcgctctgtcact

SEQ ID NO: 105327 - DNA, 23 bp, Homo sapiens
tgagttcattgtagattctggat

SEQ ID NO: 105328 - DNA, 23 bp, Homo sapiens
tgagttcattgtagattctggat

SEQ ID NO: 105329 - DNA, 22 bp, Homo sapiens
atataaggatatgtagtatttc

SEQ ID NO: 105330 - DNA, 23 bp, Homo sapiens
tcttttttggctccatatgaatt

SEQ ID NO: 105331 - DNA, 23 bp, Homo sapiens
attagtagcttgataggaatagc

SEQ ID NO: 105332 - DNA, 23 bp, Homo sapiens
tgagttcattgtagattctggat

SEQ ID NO: 105333 - DNA, 23 bp, Homo sapiens
tgagttcattgtagattctggat

SEQ ID NO: 105334 - DNA, 23 bp, Homo sapiens
tgaagcccactgtgtgttgagtg

SEQ ID NO: 105335 - DNA, 18 bp, Homo sapiens
gtgtagatataggtttat

SEQ ID NO: 105336 - DNA, 21 bp, Homo sapiens
atatactttatataaatgtct

SEQ ID NO: 105337 - DNA, 23 bp, Homo sapiens
tgagttcattgtagattctggat

SEQ ID NO: 105338 - DNA, 23 bp, Homo sapiens
tgagttcattgtagattctggat

SEQ ID NO: 105339 - DNA, 23 bp, Homo sapiens
ggtcacagtttgagttgagtcag

SEQ ID NO: 105340 - DNA, 20 bp, Homo sapiens
tgattctaaactgtggtggg

SEQ ID NO: 105341 - DNA, 20 bp, Homo sapiens
atacacacagaatatgtata

SEQ ID NO: 105342 - DNA, 21 bp, Homo sapiens
tatacacacagaatatgtata

SEQ ID NO: 105343 - DNA, 22 bp, Homo sapiens
tgtgaagaaagtcattggtagc

SEQ ID NO: 105344 - DNA, 20 bp, Homo sapiens
attctgtgaagaaagtcgtt

SEQ ID NO: 105345 - DNA, 22 bp, Homo sapiens
gacagcacacagacagcactga

SEQ ID NO: 105346 - DNA, 20 bp, Homo sapiens
atagtacagattatgtagaa

SEQ ID NO: 105347 - DNA, 23 bp, Homo sapiens
tgagttcattgtagattctggat

SEQ ID NO: 105348 - DNA, 23 bp, Homo sapiens
tgagttcattgtagattctggat

SEQ ID NO: 105349 - DNA, 22 bp, Homo sapiens
ttcactttcgtactcagtgcat

SEQ ID NO: 105350 - DNA, 23 bp, Homo sapiens
tccactgagtacagactgaggag

SEQ ID NO: 105351 - DNA, 23 bp, Homo sapiens
actgagagatttacgtgtgactt

SEQ ID NO: 105352 - DNA, 23 bp, Homo sapiens
tgagttcattgtagattctggat

SEQ ID NO: 105353 - DNA, 23 bp, Homo sapiens
tgagttcattgtagattctggat

SEQ ID NO: 105354 - DNA, 22 bp, Homo sapiens
tgagtcagcatgtggtttagct

SEQ ID NO: 105355 - DNA, 22 bp, Homo sapiens
ttgagacagacccatctggttc

SEQ ID NO: 105356 - DNA, 23 bp, Homo sapiens
tgagttcattgtagattctggat

SEQ ID NO: 105357 - DNA, 23 bp, Homo sapiens
tgagttcattgtagattctggat

SEQ ID NO: 105358 - DNA, 23 bp, Homo sapiens
agtctcgctctgtctctccaggc

SEQ ID NO: 105359 - DNA, 23 bp, Homo sapiens
tgaagatatagaaagcagtggtt

SEQ ID NO: 105360 - DNA, 19 bp, Homo sapiens
attgtgactggttgtcctg

SEQ ID NO: 105361 - DNA, 22 bp, Homo sapiens
aactgacattgcaaaagacaga

SEQ ID NO: 105362 - DNA, 23 bp, Homo sapiens
gggtctcactctgtcacccaggc

SEQ ID NO: 105363 - DNA, 23 bp, Homo sapiens
agatgtttcacagattaccttgt

SEQ ID NO: 105364 - DNA, 20 bp, Homo sapiens
tctgtgtgactctggctgtc

SEQ ID NO: 105365 - DNA, 21 bp, Homo sapiens
gacggggtgactcagtccctg

SEQ ID NO: 105366 - DNA, 21 bp, Homo sapiens
tgaggtaggaggatcacttga

SEQ ID NO: 105367 - DNA, 20 bp, Homo sapiens
atcttgctggtgatttggga

SEQ ID NO: 105368 - DNA, 23 bp, Homo sapiens
gtccgtgtctctctctatcttga

SEQ ID NO: 105369 - DNA, 23 bp, Homo sapiens
gacagagtctcgctctgtcaccc

SEQ ID NO: 105370 - DNA, 23 bp, Homo sapiens
ctgtctatctatctatctatatc

SEQ ID NO: 105371 - DNA, 23 bp, Homo sapiens
tatagatatagatatagatatgc

SEQ ID NO: 105372 - DNA, 23 bp, Homo sapiens
agagtctcactctgtcacccagg

SEQ ID NO: 105373 - DNA, 23 bp, Homo sapiens
tctgtagctgcttcagtgtttcc

SEQ ID NO: 105374 - DNA, 23 bp, Homo sapiens
acttctgtttttcatgtactcca

SEQ ID NO: 105375 - DNA, 21 bp, Homo sapiens
tgagtggtatagcatgtgaat

SEQ ID NO: 105376 - DNA, 23 bp, Homo sapiens
tgtgtatatatatatatgtgtgt

SEQ ID NO: 105377 - DNA, 23 bp, Homo sapiens
agactgagtctacacagtgagca

SEQ ID NO: 105378 - DNA, 22 bp, Homo sapiens
aatgcctctgtcaggggaatga

SEQ ID NO: 105379 - DNA, 23 bp, Homo sapiens
gcctctcagaagggtgtctgctc

SEQ ID NO: 105380 - DNA, 22 bp, Homo sapiens
acaagtacatatatatagtata

SEQ ID NO: 105381 - DNA, 23 bp, Homo sapiens
acaagtacatatatatacttgta

SEQ ID NO: 105382 - DNA, 21 bp, Homo sapiens
tacaagtacatatatatactt

SEQ ID NO: 105383 - DNA, 23 bp, Homo sapiens
tcccagagcccctggaactctgg

SEQ ID NO: 105384 - DNA, 23 bp, Homo sapiens
atgaacgttgtattcttttgtat

SEQ ID NO: 105385 - DNA, 23 bp, Homo sapiens
tctgacaggagacagagctcagg

SEQ ID NO: 105386 - DNA, 21 bp, Homo sapiens
ggcaagatgaaagagtggaca

SEQ ID NO: 105387 - DNA, 20 bp, Homo sapiens
agtctcgcactgtcgctcag

SEQ ID NO: 105388 - DNA, 19 bp, Homo sapiens
gtctcgctctgtcacccag

SEQ ID NO: 105389 - DNA, 20 bp, Homo sapiens
taaaaatggctgggattttg

SEQ ID NO: 105390 - DNA, 23 bp, Homo sapiens
tcaggcactctgtcccagggaga

SEQ ID NO: 105391 - DNA, 23 bp, Homo sapiens
taacattgtatatgaaatatttt

SEQ ID NO: 105392 - DNA, 23 bp, Homo sapiens
acagaagtcagagattggtagtg

SEQ ID NO: 105393 - DNA, 23 bp, Homo sapiens
gacagagtctcgctctgtcaccc

SEQ ID NO: 105394 - DNA, 23 bp, Homo sapiens
tgagttcattgtagattctggat

SEQ ID NO: 105395 - DNA, 23 bp, Homo sapiens
tgagttcattgtagattctggat

SEQ ID NO: 105396 - DNA, 21 bp, Homo sapiens
tcatggactttttgtttttct

SEQ ID NO: 105397 - DNA, 21 bp, Homo sapiens
tgagaggaaagtgagcacagt

SEQ ID NO: 105398 - DNA, 22 bp, Homo sapiens
tatgtatgtatatatgtgtgta

SEQ ID NO: 105399 - DNA, 23 bp, Homo sapiens
atctgtgaagaaagtcaatggta

SEQ ID NO: 105400 - DNA, 22 bp, Homo sapiens
tgtgtatatatgtatatatgca

SEQ ID NO: 105401 - DNA, 20 bp, Homo sapiens
atgtatatatgcatgtgcat

SEQ ID NO: 105402 - DNA, 23 bp, Homo sapiens
ttgtggttctgcatctggatgtg

SEQ ID NO: 105403 - DNA, 20 bp, Homo sapiens
taagatacttgatttgaatg

SEQ ID NO: 105404 - DNA, 19 bp, Homo sapiens
tatgtatgtgtgttatgtg

SEQ ID NO: 105405 - DNA, 23 bp, Homo sapiens
acaggagtgagattggtgagtca

SEQ ID NO: 105406 - DNA, 21 bp, Homo sapiens
tgtgtatatatgtaaatatgt

SEQ ID NO: 105407 - DNA, 23 bp, Homo sapiens
gacagagtctcgctctgtcaccc

SEQ ID NO: 105408 - DNA, 18 bp, Homo sapiens
tggcgtgatcttggctca

SEQ ID NO: 105409 - DNA, 23 bp, Homo sapiens
tatctgaaattcttatcatgttc

SEQ ID NO: 105410 - DNA, 22 bp, Homo sapiens
tgtgtgtatatatatatgtgtg

SEQ ID NO: 105411 - DNA, 23 bp, Homo sapiens
atacacacatatatatatgtgta

SEQ ID NO: 105412 - DNA, 23 bp, Homo sapiens
agagtctcactctgtcacccagg

SEQ ID NO: 105413 - DNA, 23 bp, Homo sapiens
gagtctcactctgtcacccaggc

SEQ ID NO: 105414 - DNA, 22 bp, Homo sapiens
tttgtccttgctatagtttgct

SEQ ID NO: 105415 - DNA, 23 bp, Homo sapiens
acatagtctaagtttaacctgtc

SEQ ID NO: 105416 - DNA, 21 bp, Homo sapiens
ttttagagagaagttagtagt

SEQ ID NO: 105417 - DNA, 23 bp, Homo sapiens
tatatgtacatatatatgtgtgt

SEQ ID NO: 105418 - DNA, 23 bp, Homo sapiens
tgagttcattgtagattctggat

SEQ ID NO: 105419 - DNA, 23 bp, Homo sapiens
tgagttcattgtagattctggat

SEQ ID NO: 105420 - DNA, 20 bp, Homo sapiens
accattgaagaagagattgg

SEQ ID NO: 105421 - DNA, 23 bp, Homo sapiens
ctgcctcaggctgctgagtagct

SEQ ID NO: 105422 - DNA, 19 bp, Homo sapiens
gaggccctgaaagttgtga

SEQ ID NO: 105423 - DNA, 23 bp, Homo sapiens
accagagagtggattgtgtttga

SEQ ID NO: 105424 - DNA, 20 bp, Homo sapiens
atacacacacatgtatatat

SEQ ID NO: 105425 - DNA, 23 bp, Homo sapiens
tatgtgtatatatacatatgtgt

SEQ ID NO: 105426 - DNA, 19 bp, Homo sapiens
tgagtcaagttagagagct

SEQ ID NO: 105427 - DNA, 23 bp, Homo sapiens
atctctctacatatgtatgtgta

SEQ ID NO: 105428 - DNA, 23 bp, Homo sapiens
atatatacacatatatatgtaga

SEQ ID NO: 105429 - DNA, 23 bp, Homo sapiens
tggagtacagtggcacagtcacg

SEQ ID NO: 105430 - DNA, 23 bp, Homo sapiens
tgtgaagaaggtgcttgcttctc

SEQ ID NO: 105431 - DNA, 23 bp, Homo sapiens
gtgtgtttgtgcatgtgcacctg

SEQ ID NO: 105432 - DNA, 23 bp, Homo sapiens
tgtgtgcatgcatgtgtgtgtgt

SEQ ID NO: 105433 - DNA, 23 bp, Homo sapiens
tggtgacttcactggctgtcagg

SEQ ID NO: 105434 - DNA, 23 bp, Homo sapiens
tgagccactgtctgtctcatagc

SEQ ID NO: 105435 - DNA, 20 bp, Homo sapiens
ctatgcctcagtgtctgcct

SEQ ID NO: 105436 - DNA, 22 bp, Homo sapiens
ctgacaggagacagagcacagg

SEQ ID NO: 105437 - DNA, 23 bp, Homo sapiens
agtagtgctcgctcacctgccag

SEQ ID NO: 105438 - DNA, 23 bp, Homo sapiens
tgagttcattgtagattctggat

SEQ ID NO: 105439 - DNA, 23 bp, Homo sapiens
tgagttcattgtagattctggat

SEQ ID NO: 105440 - DNA, 23 bp, Homo sapiens
tgagttcattgtagattctggat

SEQ ID NO: 105441 - DNA, 23 bp, Homo sapiens
tgagttcattgtagattctggat

SEQ ID NO: 105442 - DNA, 21 bp, Homo sapiens
tacaaagttctggtcaatgca

SEQ ID NO: 105443 - DNA, 18 bp, Homo sapiens
ttttcaaacagtcacaca

SEQ ID NO: 105444 - DNA, 23 bp, Homo sapiens
tcaatactgtttttctttttctt

SEQ ID NO: 105445 - DNA, 23 bp, Homo sapiens
ttagagacaggagtgtcgctctg

SEQ ID NO: 105446 - DNA, 23 bp, Homo sapiens
agacggagtctcgctctgtcgct

SEQ ID NO: 105447 - DNA, 23 bp, Homo sapiens
tgtatctctgtgtttcttgatct

SEQ ID NO: 105448 - DNA, 23 bp, Homo sapiens
atgacctacatatatatgtgtat

SEQ ID NO: 105449 - DNA, 23 bp, Homo sapiens
tatgtgtatatgtgtctgtgtgt

SEQ ID NO: 105450 - DNA, 21 bp, Homo sapiens
gtatatatgtatctgtgtata

SEQ ID NO: 105451 - DNA, 22 bp, Homo sapiens
tctggctgcatgacctcagtga

SEQ ID NO: 105452 - DNA, 22 bp, Homo sapiens
taggagagaagacacagagctc

SEQ ID NO: 105453 - DNA, 22 bp, Homo sapiens
ctccctgtgtgtctgactcaca

SEQ ID NO: 105454 - DNA, 23 bp, Homo sapiens
agttgtgtgtgtattcagtttct

SEQ ID NO: 105455 - DNA, 22 bp, Homo sapiens
aaatactctaaaattgttgtgg

SEQ ID NO: 105456 - DNA, 23 bp, Homo sapiens
tctagcatctgaaaaaaagttgt

SEQ ID NO: 105457 - DNA, 21 bp, Homo sapiens
agggcaagttcagtatcggtc

SEQ ID NO: 105458 - DNA, 23 bp, Homo sapiens
aggatgtatgtggtaatactgat

SEQ ID NO: 105459 - DNA, 23 bp, Homo sapiens
ttgtggtaattgcatgtttagtt

SEQ ID NO: 105460 - DNA, 23 bp, Homo sapiens
acagagtctcactctgtcgccca

SEQ ID NO: 105461 - DNA, 20 bp, Homo sapiens
gcaacaagaaggcacagcag

SEQ ID NO: 105462 - DNA, 21 bp, Homo sapiens
ttttctttaagaatgctgaat

SEQ ID NO: 105463 - DNA, 23 bp, Homo sapiens
tggctcactgaaagctctgcctc

SEQ ID NO: 105464 - DNA, 23 bp, Homo sapiens
tggagtctcactctgtcacccag

SEQ ID NO: 105465 - DNA, 23 bp, Homo sapiens
ggagtctcactctgtcacctagg

SEQ ID NO: 105466 - DNA, 23 bp, Homo sapiens
actctctgattctgtttaccttg

SEQ ID NO: 105467 - DNA, 22 bp, Homo sapiens
aatctggcactgctatatttat

SEQ ID NO: 105468 - DNA, 23 bp, Homo sapiens
gtcacgcagtcactctgcctcct

SEQ ID NO: 105469 - DNA, 23 bp, Homo sapiens
tgtgtgtattgtgtgtctgtgta

SEQ ID NO: 105470 - DNA, 20 bp, Homo sapiens
tggcatggagtttggtttca

SEQ ID NO: 105471 - DNA, 23 bp, Homo sapiens
gagacagagtctctctctgtcgc

SEQ ID NO: 105472 - DNA, 19 bp, Homo sapiens
ggaaatgagatgtatcagt

SEQ ID NO: 105473 - DNA, 19 bp, Homo sapiens
atgtatataagtatggtgt

SEQ ID NO: 105474 - DNA, 22 bp, Homo sapiens
tatctgcgtgtatattgagtgt

SEQ ID NO: 105475 - DNA, 23 bp, Homo sapiens
actggaagcatcatacacagctg

SEQ ID NO: 105476 - DNA, 22 bp, Homo sapiens
ccatctgaattgtataagttta

SEQ ID NO: 105477 - DNA, 23 bp, Homo sapiens
atcactcccacactcaatgtagt

SEQ ID NO: 105478 - DNA, 23 bp, Homo sapiens
agctctgtgagtgatctctgccc

SEQ ID NO: 105479 - DNA, 23 bp, Homo sapiens
atgactgttgaagcgaatgagag

SEQ ID NO: 105480 - DNA, 23 bp, Homo sapiens
tgtgtatgagacataatggttag

SEQ ID NO: 105481 - DNA, 23 bp, Homo sapiens
tgagttcattgtagattctggat

SEQ ID NO: 105482 - DNA, 23 bp, Homo sapiens
tgagttcattgtagattctggat

SEQ ID NO: 105483 - DNA, 21 bp, Homo sapiens
gagtctcgcactgtcacccag

SEQ ID NO: 105484 - DNA, 23 bp, Homo sapiens
tgagttcattgtagattctggat

SEQ ID NO: 105485 - DNA, 23 bp, Homo sapiens
tgagttcattgtagattctggat

SEQ ID NO: 105486 - DNA, 21 bp, Homo sapiens
tgtggacccctctgggcttgc

SEQ ID NO: 105487 - DNA, 19 bp, Homo sapiens
tgtgttccagggtctcaca

SEQ ID NO: 105488 - DNA, 23 bp, Homo sapiens
attctcacctggatgattgctgt

SEQ ID NO: 105489 - DNA, 19 bp, Homo sapiens
tcacacaggctagagtgca

SEQ ID NO: 105490 - DNA, 18 bp, Homo sapiens
tagccagagacagcttgg

SEQ ID NO: 105491 - DNA, 23 bp, Homo sapiens
tggagtctcactctgtcacccag

SEQ ID NO: 105492 - DNA, 23 bp, Homo sapiens
atgagtttagatctaggtgcttg

SEQ ID NO: 105493 - DNA, 23 bp, Homo sapiens
atacatagtgaaatgattactta

SEQ ID NO: 105494 - DNA, 23 bp, Homo sapiens
tctatcactgtatatgtatatac

SEQ ID NO: 105495 - DNA, 23 bp, Homo sapiens
tgccaggctctgtgtgagtgact

SEQ ID NO: 105496 - DNA, 20 bp, Homo sapiens
gctcactgtaacctctgtct

SEQ ID NO: 105497 - DNA, 23 bp, Homo sapiens
agagtctcactctgtcactcagg

SEQ ID NO: 105498 - DNA, 23 bp, Homo sapiens
tgacagagtcacgctctgtcacc

SEQ ID NO: 105499 - DNA, 23 bp, Homo sapiens
tttttcaagacggagtctcactc

SEQ ID NO: 105500 - DNA, 19 bp, Homo sapiens
acagtgactgtaacagtgt

SEQ ID NO: 105501 - DNA, 23 bp, Homo sapiens
tgtgtgtgtgattgcgtgcatgt

SEQ ID NO: 105502 - DNA, 23 bp, Homo sapiens
accgagtctcgctctgtcaccca

SEQ ID NO: 105503 - DNA, 23 bp, Homo sapiens
tggagtctcactctgtcacccag

SEQ ID NO: 105504 - DNA, 18 bp, Homo sapiens
acatgtgtgcatatgtgt

SEQ ID NO: 105505 - DNA, 18 bp, Homo sapiens
tgcatgtatgtattttgg

SEQ ID NO: 105506 - DNA, 22 bp, Homo sapiens
ataaatgtgtgcatgtgcatgt

SEQ ID NO: 105507 - DNA, 18 bp, Homo sapiens
tacatgcacatatatata

SEQ ID NO: 105508 - DNA, 23 bp, Homo sapiens
ctcccagagcccctggaactctg

SEQ ID NO: 105509 - DNA, 23 bp, Homo sapiens
tcccagagcccctggaactctgg

SEQ ID NO: 105510 - DNA, 23 bp, Homo sapiens
tcccagagcccctggaactctgg

SEQ ID NO: 105511 - DNA, 23 bp, Homo sapiens
tcccagagcccctggaactctgg

SEQ ID NO: 105512 - DNA, 23 bp, Homo sapiens
cgtgtctgtgtctgtgacagtcc

SEQ ID NO: 105513 - DNA, 23 bp, Homo sapiens
ttacctctccaagacctatgaag

SEQ ID NO: 105514 - DNA, 18 bp, Homo sapiens
tgtgtgtgtatatatata

SEQ ID NO: 105515 - DNA, 20 bp, Homo sapiens
tgtcattatatatatgtgtg

SEQ ID NO: 105516 - DNA, 22 bp, Homo sapiens
taatgtgtatgtatatatgtgt

SEQ ID NO: 105517 - DNA, 23 bp, Homo sapiens
tgagttcattgtagattctggat

SEQ ID NO: 105518 - DNA, 23 bp, Homo sapiens
tgagttcattgtagattctggat

SEQ ID NO: 105519 - DNA, 23 bp, Homo sapiens
gagagagtctcactctgtcaccc

SEQ ID NO: 105520 - DNA, 23 bp, Homo sapiens
agaccttaaattatgatctgggt

SEQ ID NO: 105521 - DNA, 23 bp, Homo sapiens
gtctcactctgtcactcaggctg

SEQ ID NO: 105522 - DNA, 23 bp, Homo sapiens
ctggattcatgttaggttgtata

SEQ ID NO: 105523 - DNA, 21 bp, Homo sapiens
tatagagctcagtgagatgat

SEQ ID NO: 105524 - DNA, 20 bp, Homo sapiens
tatgtgtgtgtatatatata

SEQ ID NO: 105525 - DNA, 23 bp, Homo sapiens
gtgtgtatatatatatgtgtgtg

SEQ ID NO: 105526 - DNA, 23 bp, Homo sapiens
atatgtgtgtatatatatgtgta

SEQ ID NO: 105527 - DNA, 21 bp, Homo sapiens
tatgtgtatatatatgtgtgt

SEQ ID NO: 105528 - DNA, 23 bp, Homo sapiens
atatgtgtatatatatgtgtgcg

SEQ ID NO: 105529 - DNA, 23 bp, Homo sapiens
tgagttcattgtagattctggat

SEQ ID NO: 105530 - DNA, 23 bp, Homo sapiens
tgagttcattgtagattctggat

SEQ ID NO: 105531 - DNA, 23 bp, Homo sapiens
actacagtctatgtttatgtatt

SEQ ID NO: 105532 - DNA, 22 bp, Homo sapiens
atataggctgagtatatgttct

SEQ ID NO: 105533 - DNA, 20 bp, Homo sapiens
tacagtggtatgattttggc

SEQ ID NO: 105534 - DNA, 23 bp, Homo sapiens
acctgtacatatgtatgtgtgtg

SEQ ID NO: 105535 - DNA, 23 bp, Homo sapiens
tgtgtgtgcatgtctgtgtgtgt

SEQ ID NO: 105536 - DNA, 22 bp, Homo sapiens
cttttttggttccatatgaaat

SEQ ID NO: 105537 - DNA, 23 bp, Homo sapiens
gggtctcacactgtcacccaggc

SEQ ID NO: 105538 - DNA, 23 bp, Homo sapiens
gactcggactgtgtgtcagactg

SEQ ID NO: 105539 - DNA, 20 bp, Homo sapiens
ctctttctgtctgcttgttc

SEQ ID NO: 105540 - DNA, 20 bp, Homo sapiens
agctggaacttaaagtggtg

SEQ ID NO: 105541 - DNA, 22 bp, Homo sapiens
gactctcgctctgtttcccatg

SEQ ID NO: 105542 - DNA, 23 bp, Homo sapiens
ctctcactctgataatagtttcg

SEQ ID NO: 105543 - DNA, 20 bp, Homo sapiens
agtctcgctctgtcacccag

SEQ ID NO: 105544 - DNA, 23 bp, Homo sapiens
atgattagtgatgttgaacatct

SEQ ID NO: 105545 - DNA, 22 bp, Homo sapiens
atgaaagtcagactgatatctg

SEQ ID NO: 105546 - DNA, 23 bp, Homo sapiens
catgtgttgtatgctggagaacc

SEQ ID NO: 105547 - DNA, 23 bp, Homo sapiens
tgagttcattgtagattctggat

SEQ ID NO: 105548 - DNA, 23 bp, Homo sapiens
tgagttcattgtagattctggat

SEQ ID NO: 105549 - DNA, 23 bp, Homo sapiens
tgagttcattgtagattctggat

SEQ ID NO: 105550 - DNA, 23 bp, Homo sapiens
tgagttcattgtagattctggat

SEQ ID NO: 105551 - DNA, 23 bp, Homo sapiens
tgtgcatttgaaatgaatgtgtt

SEQ ID NO: 105552 - DNA, 21 bp, Homo sapiens
atatggtaacagtgtgtgtca

SEQ ID NO: 105553 - DNA, 21 bp, Homo sapiens
ctctgtcagccagtgtccctg

SEQ ID NO: 105554 - DNA, 23 bp, Homo sapiens
tggtataatgtataagtatactg

SEQ ID NO: 105555 - DNA, 23 bp, Homo sapiens
tcagtacatatatatagcagtct

SEQ ID NO: 105556 - DNA, 23 bp, Homo sapiens
tataggtatatatacatatgtgt

SEQ ID NO: 105557 - DNA, 19 bp, Homo sapiens
tatgtgtgtgtgtgtatat

SEQ ID NO: 105558 - DNA, 19 bp, Homo sapiens
gatcagtctcttttgtctt

SEQ ID NO: 105559 - DNA, 20 bp, Homo sapiens
tataagcacattgaactttg

SEQ ID NO: 105560 - DNA, 23 bp, Homo sapiens
tagtgtgtagtctgttgagggct

SEQ ID NO: 105561 - DNA, 19 bp, Homo sapiens
agtcattttatattgtcat

SEQ ID NO: 105562 - DNA, 23 bp, Homo sapiens
tattgtgtttaggaatgctgtta

SEQ ID NO: 105563 - DNA, 23 bp, Homo sapiens
tgagttcattgtagattctggat

SEQ ID NO: 105564 - DNA, 23 bp, Homo sapiens
tgagttcattgtagattctggat

SEQ ID NO: 105565 - DNA, 23 bp, Homo sapiens
gtagatcttcctccatcccttta

SEQ ID NO: 105566 - DNA, 23 bp, Homo sapiens
tgagttcattgtagattctggat

SEQ ID NO: 105567 - DNA, 23 bp, Homo sapiens
tgagttcattgtagattctggat

SEQ ID NO: 105568 - DNA, 19 bp, Homo sapiens
tgtgtgtatatatatgtgt

SEQ ID NO: 105569 - DNA, 23 bp, Homo sapiens
agagtctcactctgtcacccagg

SEQ ID NO: 105570 - DNA, 19 bp, Homo sapiens
agtgtactgaataatgtga

SEQ ID NO: 105571 - DNA, 19 bp, Homo sapiens
attgcattgtctattaggc

SEQ ID NO: 105572 - DNA, 22 bp, Homo sapiens
agagacagggtctcactctctt

SEQ ID NO: 105573 - DNA, 23 bp, Homo sapiens
tcacagaagactgactggatagt

SEQ ID NO: 105574 - DNA, 20 bp, Homo sapiens
tctgacagcctcagtgctat

SEQ ID NO: 105575 - DNA, 23 bp, Homo sapiens
tgagttcattgtagattctggat

SEQ ID NO: 105576 - DNA, 23 bp, Homo sapiens
tgagttcattgtagattctggat

SEQ ID NO: 105577 - DNA, 23 bp, Homo sapiens
taattgagcaatagttttccatg

SEQ ID NO: 105578 - DNA, 22 bp, Homo sapiens
ttaggcaggatatctattggat

SEQ ID NO: 105579 - DNA, 19 bp, Homo sapiens
tatgctattataaatgtgt

SEQ ID NO: 105580 - DNA, 21 bp, Homo sapiens
atatacattctgtatatgtgt

SEQ ID NO: 105581 - DNA, 23 bp, Homo sapiens
tgtgtttgtagctggtattgatg

SEQ ID NO: 105582 - DNA, 19 bp, Homo sapiens
tatacaccctgcatatata

SEQ ID NO: 105583 - DNA, 20 bp, Homo sapiens
aagatgttggcagagggagt

SEQ ID NO: 105584 - DNA, 23 bp, Homo sapiens
agagactcactgtgtcacccagg

SEQ ID NO: 105585 - DNA, 21 bp, Homo sapiens
ctcactctgtctctccttgtg

SEQ ID NO: 105586 - DNA, 21 bp, Homo sapiens
tgaggtaggaggatcacttga

SEQ ID NO: 105587 - DNA, 23 bp, Homo sapiens
caaggtctcactctgtcgctcag

SEQ ID NO: 105588 - DNA, 19 bp, Homo sapiens
tgaatagatctgtgtgtct

SEQ ID NO: 105589 - DNA, 23 bp, Homo sapiens
aaaacaccatagactgggtggct

SEQ ID NO: 105590 - DNA, 20 bp, Homo sapiens
aatgtcacaattcattctga

SEQ ID NO: 105591 - DNA, 23 bp, Homo sapiens
agggagtcccactctgtcactca

SEQ ID NO: 105592 - DNA, 23 bp, Homo sapiens
tgagttcattgtagattctggat

SEQ ID NO: 105593 - DNA, 23 bp, Homo sapiens
tgagttcattgtagattctggat

SEQ ID NO: 105594 - DNA, 23 bp, Homo sapiens
tggagacttgtctctttctataa

SEQ ID NO: 105595 - DNA, 23 bp, Homo sapiens
gttcagagagatttgcctcagac

SEQ ID NO: 105596 - DNA, 22 bp, Homo sapiens
aatggtatatgtacaattgtat

SEQ ID NO: 105597 - DNA, 23 bp, Homo sapiens
tgtacatgtgtatatatgtatat

SEQ ID NO: 105598 - DNA, 23 bp, Homo sapiens
attcaagagagcaattcagtatt

SEQ ID NO: 105599 - DNA, 23 bp, Homo sapiens
tgagttcattgtagattctggat

SEQ ID NO: 105600 - DNA, 23 bp, Homo sapiens
tgagttcattgtagattctggat

SEQ ID NO: 105601 - DNA, 23 bp, Homo sapiens
atatatgtgtatatatatgtgtg

SEQ ID NO: 105602 - DNA, 18 bp, Homo sapiens
tcacacacacatacatat

SEQ ID NO: 105603 - DNA, 23 bp, Homo sapiens
gtgtgtatatacatatgtgtgtc

SEQ ID NO: 105604 - DNA, 20 bp, Homo sapiens
tcaccacgatctccactccc

SEQ ID NO: 105605 - DNA, 21 bp, Homo sapiens
tctttgtggaacactatttgg

SEQ ID NO: 105606 - DNA, 23 bp, Homo sapiens
agtattccatctgcaagcattct

SEQ ID NO: 105607 - DNA, 23 bp, Homo sapiens
gttttcactcagaaacagagtga

SEQ ID NO: 105608 - DNA, 20 bp, Homo sapiens
ttgagaagagcttttgtagt

SEQ ID NO: 105609 - DNA, 23 bp, Homo sapiens
accgagtctcgctctgtcaccca

SEQ ID NO: 105610 - DNA, 23 bp, Homo sapiens
atatgcatatatatactagatgt

SEQ ID NO: 105611 - DNA, 23 bp, Homo sapiens
agaatgactatagttaatgatga

SEQ ID NO: 105612 - DNA, 23 bp, Homo sapiens
aaagaaagtggatgtgatgtgtt

SEQ ID NO: 105613 - DNA, 22 bp, Homo sapiens
cttgtgttgtgtttttctagta

SEQ ID NO: 105614 - DNA, 23 bp, Homo sapiens
tgagttcattgtagattctggat

SEQ ID NO: 105615 - DNA, 23 bp, Homo sapiens
tgagttcattgtagattctggat

SEQ ID NO: 105616 - DNA, 23 bp, Homo sapiens
actgtgagagatagatttctgtt

SEQ ID NO: 105617 - DNA, 23 bp, Homo sapiens
ttgtgcattatgtatcagtcggg

SEQ ID NO: 105618 - DNA, 23 bp, Homo sapiens
tgagttcattgtagattctggat

SEQ ID NO: 105619 - DNA, 23 bp, Homo sapiens
tgagttcattgtagattctggat

SEQ ID NO: 105620 - DNA, 23 bp, Homo sapiens
acagagtctcgctctgtcaccca

SEQ ID NO: 105621 - DNA, 21 bp, Homo sapiens
aattattctaggaaaagtttt

SEQ ID NO: 105622 - DNA, 20 bp, Homo sapiens
gaatgctcatgtgtatgcct

SEQ ID NO: 105623 - DNA, 23 bp, Homo sapiens
tgtgtaaagataagcatcaaatt

SEQ ID NO: 105624 - DNA, 23 bp, Homo sapiens
tgagtgttttaatccaatcctga

SEQ ID NO: 105625 - DNA, 23 bp, Homo sapiens
taatgcatgtaattaagagtgtg

SEQ ID NO: 105626 - DNA, 23 bp, Homo sapiens
tgagttcattgtagattctggat

SEQ ID NO: 105627 - DNA, 23 bp, Homo sapiens
tgagttcattgtagattctggat

SEQ ID NO: 105628 - DNA, 20 bp, Homo sapiens
tgagttaagactttgagagg

SEQ ID NO: 105629 - DNA, 20 bp, Homo sapiens
agagtcaggaatggtttcct

SEQ ID NO: 105630 - DNA, 23 bp, Homo sapiens
gatgactgtgatctgactctcag

SEQ ID NO: 105631 - DNA, 21 bp, Homo sapiens
ctgacgctcactgagtagcac

SEQ ID NO: 105632 - DNA, 20 bp, Homo sapiens
acacaggaagggaaactttt

SEQ ID NO: 105633 - DNA, 23 bp, Homo sapiens
tgcatgtagaaagtatttttttt

SEQ ID NO: 105634 - DNA, 18 bp, Homo sapiens
tagatatatagttttgtc

SEQ ID NO: 105635 - DNA, 23 bp, Homo sapiens
acagacacaagtgacagtgctga

SEQ ID NO: 105636 - DNA, 21 bp, Homo sapiens
tgattgcagatgtcccaggag

SEQ ID NO: 105637 - DNA, 22 bp, Homo sapiens
tctgaagaaggagacatagtct

SEQ ID NO: 105638 - DNA, 22 bp, Homo sapiens
atcttgactcactgcaacctct

SEQ ID NO: 105639 - DNA, 21 bp, Homo sapiens
gtgagagaacactgagtcctc

SEQ ID NO: 105640 - DNA, 21 bp, Homo sapiens
tcagttttgaaaaagtgatga

SEQ ID NO: 105641 - DNA, 20 bp, Homo sapiens
taagctcttctcagctttgt

SEQ ID NO: 105642 - DNA, 23 bp, Homo sapiens
tgagttcattgtagattctggat

SEQ ID NO: 105643 - DNA, 23 bp, Homo sapiens
tgagttcattgtagattctggat

SEQ ID NO: 105644 - DNA, 23 bp, Homo sapiens
tagtttttgttttctatacaagc

SEQ ID NO: 105645 - DNA, 21 bp, Homo sapiens
atgacagttgtgtgccaccac

SEQ ID NO: 105646 - DNA, 23 bp, Homo sapiens
tcactgcaagctagtctgggcaa

SEQ ID NO: 105647 - DNA, 18 bp, Homo sapiens
atagcaaggctctgtctt

SEQ ID NO: 105648 - DNA, 23 bp, Homo sapiens
agtctcactctgtcacccaggct

SEQ ID NO: 105649 - DNA, 23 bp, Homo sapiens
ggagtctcactctgtcacccagg

SEQ ID NO: 105650 - DNA, 23 bp, Homo sapiens
aacagttgtcaggagttttcatg

SEQ ID NO: 105651 - DNA, 23 bp, Homo sapiens
agactgagtctcactctgtcacc

SEQ ID NO: 105652 - DNA, 23 bp, Homo sapiens
cggagtctcactgtgtcacccag

SEQ ID NO: 105653 - DNA, 23 bp, Homo sapiens
aaggtctctctctgtcacccagg

SEQ ID NO: 105654 - DNA, 23 bp, Homo sapiens
tgagttcattgtagattctggat

SEQ ID NO: 105655 - DNA, 23 bp, Homo sapiens
tgagttcattgtagattctggat

SEQ ID NO: 105656 - DNA, 23 bp, Homo sapiens
ggtcactgagagagttctttttt

SEQ ID NO: 105657 - DNA, 23 bp, Homo sapiens
agagtctttctctgtcacccagg

SEQ ID NO: 105658 - DNA, 22 bp, Homo sapiens
catccctggctccctctttgag

SEQ ID NO: 105659 - DNA, 20 bp, Homo sapiens
tggcagacactgtctcagtc

SEQ ID NO: 105660 - DNA, 23 bp, Homo sapiens
gggtctcactgtgtcactcgggc

SEQ ID NO: 105661 - DNA, 23 bp, Homo sapiens
tgcagtggcatgatcttggctca

SEQ ID NO: 105662 - DNA, 22 bp, Homo sapiens
tctctgcctgactctatgaact

SEQ ID NO: 105663 - DNA, 23 bp, Homo sapiens
gtcagtcagagatttaggctaag

SEQ ID NO: 105664 - DNA, 20 bp, Homo sapiens
ggggcactctctctgtgact

SEQ ID NO: 105665 - DNA, 22 bp, Homo sapiens
ctgcctgcatgcctctctgcct

SEQ ID NO: 105666 - DNA, 19 bp, Homo sapiens
tcagtcactcatactctcc

SEQ ID NO: 105667 - DNA, 19 bp, Homo sapiens
agatcacagacaaagggga

SEQ ID NO: 105668 - DNA, 23 bp, Homo sapiens
tgcaccaagactctggtgtctgg

SEQ ID NO: 105669 - DNA, 21 bp, Homo sapiens
aaggagcaccagctttggagt

SEQ ID NO: 105670 - DNA, 23 bp, Homo sapiens
tctgtcactccctgactctctcc

SEQ ID NO: 105671 - DNA, 20 bp, Homo sapiens
tgcaacttgaggtcaaaaga

SEQ ID NO: 105672 - DNA, 23 bp, Homo sapiens
gcagagtgactcagtctccctct

SEQ ID NO: 105673 - DNA, 23 bp, Homo sapiens
gagacagagtctcactctgtcac

SEQ ID NO: 105674 - DNA, 23 bp, Homo sapiens
tgctctgacaggtctgatgactg

SEQ ID NO: 105675 - DNA, 23 bp, Homo sapiens
ctgtctgtctgtctgtcggtctg

SEQ ID NO: 105676 - DNA, 23 bp, Homo sapiens
tcacactcacactctcagtagtt

SEQ ID NO: 105677 - DNA, 23 bp, Homo sapiens
gagaaaagatgatgtggttcctg

SEQ ID NO: 105678 - DNA, 23 bp, Homo sapiens
tgagacagtctcagtctgtcacc

SEQ ID NO: 105679 - DNA, 21 bp, Homo sapiens
tgtgtatatatgtatatatgt

SEQ ID NO: 105680 - DNA, 23 bp, Homo sapiens
tggttcctagagtggatttgaag

SEQ ID NO: 105681 - DNA, 22 bp, Homo sapiens
tatatctcacttccctcagcca

SEQ ID NO: 105682 - DNA, 23 bp, Homo sapiens
cagtctcactctgtcacccaggc

SEQ ID NO: 105683 - DNA, 18 bp, Homo sapiens
tacagtggcacgatctca

SEQ ID NO: 105684 - DNA, 23 bp, Homo sapiens
gacagagtctcgctctgtcaccc

SEQ ID NO: 105685 - DNA, 19 bp, Homo sapiens
tccagctactcagaaggct

SEQ ID NO: 105686 - DNA, 21 bp, Homo sapiens
tgaggtaggaggatcacttga

SEQ ID NO: 105687 - DNA, 23 bp, Homo sapiens
tgagacagagtctcgctctctca

SEQ ID NO: 105688 - DNA, 21 bp, Homo sapiens
tgtttcaaggagtggctgact

SEQ ID NO: 105689 - DNA, 21 bp, Homo sapiens
aactcagagctggcttctgtg

SEQ ID NO: 105690 - DNA, 23 bp, Homo sapiens
aactttctgacccacagtctact

SEQ ID NO: 105691 - DNA, 23 bp, Homo sapiens
atatgtgtatatgtatacatatg

SEQ ID NO: 105692 - DNA, 20 bp, Homo sapiens
taggaggttgagactgcagt

SEQ ID NO: 105693 - DNA, 21 bp, Homo sapiens
tgatacagggtcttgttctgt

SEQ ID NO: 105694 - DNA, 23 bp, Homo sapiens
tctgcctgcctgtgtccctggca

SEQ ID NO: 105695 - DNA, 23 bp, Homo sapiens
aagagtgaagacagagcccacac

SEQ ID NO: 105696 - DNA, 23 bp, Homo sapiens
tggctgatgatgttcactttgac

SEQ ID NO: 105697 - DNA, 23 bp, Homo sapiens
tgtgtgcctctctgtgcctctgg

SEQ ID NO: 105698 - DNA, 23 bp, Homo sapiens
tatatgtgtgtgtgtgtatatat

SEQ ID NO: 105699 - DNA, 19 bp, Homo sapiens
tggatcagaaaataattgg

SEQ ID NO: 105700 - DNA, 21 bp, Homo sapiens
tctgtgaacctcagtttcccc

SEQ ID NO: 105701 - DNA, 22 bp, Homo sapiens
ttatcagggacccaaacttggg

SEQ ID NO: 105702 - DNA, 23 bp, Homo sapiens
actgagtctcactctgtcgccca

SEQ ID NO: 105703 - DNA, 23 bp, Homo sapiens
tgagttcattgtagattctggat

SEQ ID NO: 105704 - DNA, 23 bp, Homo sapiens
tgagttcattgtagattctggat

SEQ ID NO: 105705 - DNA, 22 bp, Homo sapiens
gtctcactctgtcactcaggct

SEQ ID NO: 105706 - DNA, 23 bp, Homo sapiens
tctctcaggctctgtccttccct

SEQ ID NO: 105707 - DNA, 23 bp, Homo sapiens
gtcatgtctgtggagctgctaag

SEQ ID NO: 105708 - DNA, 21 bp, Homo sapiens
ctcacggcattctatgtctct

SEQ ID NO: 105709 - DNA, 19 bp, Homo sapiens
tttgcatatatatgtgtat

SEQ ID NO: 105710 - DNA, 23 bp, Homo sapiens
atatatttgcatatatatgtgta

SEQ ID NO: 105711 - DNA, 23 bp, Homo sapiens
tggagtctcactctgtcacccag

SEQ ID NO: 105712 - DNA, 23 bp, Homo sapiens
cacactctgactctgctaagccc

SEQ ID NO: 105713 - DNA, 23 bp, Homo sapiens
ttagaccaggaatcaggtaacct

SEQ ID NO: 105714 - DNA, 23 bp, Homo sapiens
tctctgtggctcacactctggtc

SEQ ID NO: 105715 - DNA, 23 bp, Homo sapiens
aaactcaggttcataaagcttga

SEQ ID NO: 105716 - DNA, 23 bp, Homo sapiens
gtgcctgttgttctcttagtctg

SEQ ID NO: 105717 - DNA, 23 bp, Homo sapiens
tgtgtgcctctgtgtgtgtgtgc

SEQ ID NO: 105718 - DNA, 23 bp, Homo sapiens
ggtggagtctctctctgtcaccc

SEQ ID NO: 105719 - DNA, 23 bp, Homo sapiens
gcctatcacacacccaaagtgtg

SEQ ID NO: 105720 - DNA, 20 bp, Homo sapiens
cgatgtggtcagagtgcagt

SEQ ID NO: 105721 - DNA, 23 bp, Homo sapiens
tttgagacagtgtctccctctgt

SEQ ID NO: 105722 - DNA, 23 bp, Homo sapiens
actcacagtgtcatacaagtgca

SEQ ID NO: 105723 - DNA, 21 bp, Homo sapiens
aagtgcctccttaagttttgc

SEQ ID NO: 105724 - DNA, 23 bp, Homo sapiens
tttggttttgagacagagtctca

SEQ ID NO: 105725 - DNA, 19 bp, Homo sapiens
tgtatttgcatgtgtgtgt

SEQ ID NO: 105726 - DNA, 23 bp, Homo sapiens
tgagttcattgtagattctggat

SEQ ID NO: 105727 - DNA, 23 bp, Homo sapiens
tgagttcattgtagattctggat

SEQ ID NO: 105728 - DNA, 23 bp, Homo sapiens
actgtctcagtcacaattttgca

SEQ ID NO: 105729 - DNA, 23 bp, Homo sapiens
actcacactggctgtgtgacctg

SEQ ID NO: 105730 - DNA, 20 bp, Homo sapiens
tcactgcagccttgatcttc

SEQ ID NO: 105731 - DNA, 18 bp, Homo sapiens
aggcagcctagtcttggg

SEQ ID NO: 105732 - DNA, 18 bp, Homo sapiens
gtccatctctctgtctgt

SEQ ID NO: 105733 - DNA, 18 bp, Homo sapiens
tctgtcttgagagtctgg

SEQ ID NO: 105734 - DNA, 23 bp, Homo sapiens
agtctctctgtctgtccctctgt

SEQ ID NO: 105735 - DNA, 23 bp, Homo sapiens
agttcagtgtgagctgtgagtgc

SEQ ID NO: 105736 - DNA, 23 bp, Homo sapiens
gacagagtctcgctctgtcaccc

SEQ ID NO: 105737 - DNA, 23 bp, Homo sapiens
agagtctcactctgtcacccagg

SEQ ID NO: 105738 - DNA, 23 bp, Homo sapiens
tggagtctcactctgtcacccag

SEQ ID NO: 105739 - DNA, 21 bp, Homo sapiens
attgagcaagtctattggtgc

SEQ ID NO: 105740 - DNA, 23 bp, Homo sapiens
tagcatatgctcactttgtgtct

SEQ ID NO: 105741 - DNA, 23 bp, Homo sapiens
gggtctcactctgtcacccaggc

SEQ ID NO: 105742 - DNA, 23 bp, Homo sapiens
ctgagtggcaaagatgtagggaa

SEQ ID NO: 105743 - DNA, 18 bp, Homo sapiens
gcagtctctgtctcacac

SEQ ID NO: 105744 - DNA, 18 bp, Homo sapiens
tgtagtcccttccttagt

SEQ ID NO: 105745 - DNA, 18 bp, Homo sapiens
tctctctgtcattaatcg

SEQ ID NO: 105746 - DNA, 23 bp, Homo sapiens
agagtggttgaacactgccagtg

SEQ ID NO: 105747 - DNA, 21 bp, Homo sapiens
tcagggactctgtgtcactca

SEQ ID NO: 105748 - DNA, 23 bp, Homo sapiens
aacactagtctatatgttgctgt

SEQ ID NO: 105749 - DNA, 23 bp, Homo sapiens
taacacttagataagtaaagttt

SEQ ID NO: 105750 - DNA, 23 bp, Homo sapiens
tgagttcattgtagattctggat

SEQ ID NO: 105751 - DNA, 23 bp, Homo sapiens
tgagttcattgtagattctggat

SEQ ID NO: 105752 - DNA, 18 bp, Homo sapiens
actggtagaaagttggta

SEQ ID NO: 105753 - DNA, 22 bp, Homo sapiens
tgagaagtgatcagagtcaaga

SEQ ID NO: 105754 - DNA, 21 bp, Homo sapiens
tgagatggagtctcactctgt

SEQ ID NO: 105755 - DNA, 22 bp, Homo sapiens
taaagtgcatcagcaagtgact

SEQ ID NO: 105756 - DNA, 23 bp, Homo sapiens
cagtgtctcactctgtcacccag

SEQ ID NO: 105757 - DNA, 23 bp, Homo sapiens
acagagtctcactctgtcgccca

SEQ ID NO: 105758 - DNA, 18 bp, Homo sapiens
agccagaacaggcaggag

SEQ ID NO: 105759 - DNA, 23 bp, Homo sapiens
aagacagttgatgttgttctgag

SEQ ID NO: 105760 - DNA, 20 bp, Homo sapiens
tgaggtaggaggatcacttg

SEQ ID NO: 105761 - DNA, 23 bp, Homo sapiens
tatgagacagtgtctcgctctgt

SEQ ID NO: 105762 - DNA, 20 bp, Homo sapiens
atactcactgcaatatattt

SEQ ID NO: 105763 - DNA, 23 bp, Homo sapiens
atatgtgtgcaacgtgtgtgtgt

SEQ ID NO: 105764 - DNA, 19 bp, Homo sapiens
tgagatggagcctcgctct

SEQ ID NO: 105765 - DNA, 20 bp, Homo sapiens
tgagacagtctcactctgtc

SEQ ID NO: 105766 - DNA, 18 bp, Homo sapiens
atgaagaatagttttgat

SEQ ID NO: 105767 - DNA, 20 bp, Homo sapiens
atatatgtgtgtgtgtgtat

SEQ ID NO: 105768 - DNA, 23 bp, Homo sapiens
actgtgtgtgcaaaagctcagat

SEQ ID NO: 105769 - DNA, 18 bp, Homo sapiens
agacagggtctcgctctg

SEQ ID NO: 105770 - DNA, 22 bp, Homo sapiens
agatggttggtatacaagtgtt

SEQ ID NO: 105771 - DNA, 23 bp, Homo sapiens
ttctgtaactgtacattctggta

SEQ ID NO: 105772 - DNA, 23 bp, Homo sapiens
aataagtgcaaaatgtgtacact

SEQ ID NO: 105773 - DNA, 20 bp, Homo sapiens
agatactccatgttcatgta

SEQ ID NO: 105774 - DNA, 20 bp, Homo sapiens
gcaacacagtgaattctcta

SEQ ID NO: 105775 - DNA, 23 bp, Homo sapiens
cagagtctcactctgtcacccag

SEQ ID NO: 105776 - DNA, 21 bp, Homo sapiens
tgtatatatatacatatgtgt

SEQ ID NO: 105777 - DNA, 23 bp, Homo sapiens
tatatgtatatatacatgtgtgt

SEQ ID NO: 105778 - DNA, 21 bp, Homo sapiens
tatgtatatatacgtgtgtgt

SEQ ID NO: 105779 - DNA, 20 bp, Homo sapiens
cagagcagactatggcttct

SEQ ID NO: 105780 - DNA, 23 bp, Homo sapiens
ggcagagattacagtgagcccag

SEQ ID NO: 105781 - DNA, 23 bp, Homo sapiens
ctgcacttcagcctgggtgacag

SEQ ID NO: 105782 - DNA, 23 bp, Homo sapiens
ggtgcacctgtagtctcagctgc

SEQ ID NO: 105783 - DNA, 23 bp, Homo sapiens
cagtgagcaatgattgtgccatt

SEQ ID NO: 105784 - DNA, 23 bp, Homo sapiens
agagtctcactctgtcacccagg

SEQ ID NO: 105785 - DNA, 23 bp, Homo sapiens
gagtctcactctgtcacccaggc

SEQ ID NO: 105786 - DNA, 23 bp, Homo sapiens
gacagagtctcgctctgtcaccc

SEQ ID NO: 105787 - DNA, 23 bp, Homo sapiens
cggtctcactctgtcactcaggc

SEQ ID NO: 105788 - DNA, 23 bp, Homo sapiens
aagtctcactctgtcacccaggc

SEQ ID NO: 105789 - DNA, 20 bp, Homo sapiens
agtggctgattttgttttgt

SEQ ID NO: 105790 - DNA, 22 bp, Homo sapiens
ttctgtctggaagaggagtgac

SEQ ID NO: 105791 - DNA, 23 bp, Homo sapiens
tgagtctcgctctgttcaccagg

SEQ ID NO: 105792 - DNA, 21 bp, Homo sapiens
tgcctgtgttcccagctactt

SEQ ID NO: 105793 - DNA, 23 bp, Homo sapiens
actcccagagcccctggaactct

SEQ ID NO: 105794 - DNA, 23 bp, Homo sapiens
actcccagagcccctggaactct

SEQ ID NO: 105795 - DNA, 23 bp, Homo sapiens
actcccagagcccctggaactct

SEQ ID NO: 105796 - DNA, 23 bp, Homo sapiens
tgtgacagcttcttgatctgtcc

SEQ ID NO: 105797 - DNA, 23 bp, Homo sapiens
tggctgtgttcaacaggtgttgc

SEQ ID NO: 105798 - DNA, 23 bp, Homo sapiens
ttttctactactgatttacttct

SEQ ID NO: 105799 - DNA, 21 bp, Homo sapiens
tctcactctgtcacccaggct

SEQ ID NO: 105800 - DNA, 19 bp, Homo sapiens
gtctcgctctgtcacccag

SEQ ID NO: 105801 - DNA, 23 bp, Homo sapiens
tgatgttgccactctctgtccct

SEQ ID NO: 105802 - DNA, 23 bp, Homo sapiens
tgtgagacagagtctctctctgt

SEQ ID NO: 105803 - DNA, 23 bp, Homo sapiens
gacagagtctcgctctgtcaccc

SEQ ID NO: 105804 - DNA, 21 bp, Homo sapiens
tgtgtgtgggtgtgaatatat

SEQ ID NO: 105805 - DNA, 21 bp, Homo sapiens
tatctctctctgtcagtcgct

SEQ ID NO: 105806 - DNA, 19 bp, Homo sapiens
aatacagatattatatatg

SEQ ID NO: 105807 - DNA, 23 bp, Homo sapiens
tgttatgtatatgtatatgtatc

SEQ ID NO: 105808 - DNA, 23 bp, Homo sapiens
atatatctgaatatatataggtg

SEQ ID NO: 105809 - DNA, 23 bp, Homo sapiens
tttccaagtgctttgaggcagtg

SEQ ID NO: 105810 - DNA, 23 bp, Homo sapiens
tttgaggaacattttcatggtgt

SEQ ID NO: 105811 - DNA, 18 bp, Homo sapiens
cctctgtgtctgtgtgtg

SEQ ID NO: 105812 - DNA, 23 bp, Homo sapiens
aaaggggctgaatgaaatgtgag

SEQ ID NO: 105813 - DNA, 21 bp, Homo sapiens
taatagcacctacctcatagg

SEQ ID NO: 105814 - DNA, 19 bp, Homo sapiens
tgtgtgttttaatgaactg

SEQ ID NO: 105815 - DNA, 23 bp, Homo sapiens
gactgagtctcgctctgtcaccc

SEQ ID NO: 105816 - DNA, 23 bp, Homo sapiens
tttgtgtctgattatgttatcaa

SEQ ID NO: 105817 - DNA, 21 bp, Homo sapiens
gtggtgatgatatgaatgtat

SEQ ID NO: 105818 - DNA, 23 bp, Homo sapiens
tgagttcattgtagattctggat

SEQ ID NO: 105819 - DNA, 23 bp, Homo sapiens
tgagttcattgtagattctggat

SEQ ID NO: 105820 - DNA, 23 bp, Homo sapiens
tgtcaatttttgtttttgatgca

SEQ ID NO: 105821 - DNA, 18 bp, Homo sapiens
tatgcatatatatatcat

SEQ ID NO: 105822 - DNA, 19 bp, Homo sapiens
tatgcatatatatagttca

SEQ ID NO: 105823 - DNA, 21 bp, Homo sapiens
aaactgacagaatacagtgta

SEQ ID NO: 105824 - DNA, 23 bp, Homo sapiens
atactgtattctgacagttcatg

SEQ ID NO: 105825 - DNA, 23 bp, Homo sapiens
tgtatgtgtctgtgtgtgtgtgc

SEQ ID NO: 105826 - DNA, 18 bp, Homo sapiens
atgttaaaaaaagcttat

SEQ ID NO: 105827 - DNA, 23 bp, Homo sapiens
atgactgatataatgtatgtgtg

SEQ ID NO: 105828 - DNA, 19 bp, Homo sapiens
aaactgattcttgttacct

SEQ ID NO: 105829 - DNA, 23 bp, Homo sapiens
tggagtctcactctgtcacccag

SEQ ID NO: 105830 - DNA, 23 bp, Homo sapiens
aaatatgtagtggttgggttcta

SEQ ID NO: 105831 - DNA, 21 bp, Homo sapiens
tcgatagatttaaaatgaaat

SEQ ID NO: 105832 - DNA, 22 bp, Homo sapiens
gtagttcttcatttggatactt

SEQ ID NO: 105833 - DNA, 19 bp, Homo sapiens
tatatgcatgtatacacat

SEQ ID NO: 105834 - DNA, 23 bp, Homo sapiens
tatatgcatgtatacacagatat

SEQ ID NO: 105835 - DNA, 23 bp, Homo sapiens
ctatatatttctagttgtagagt

SEQ ID NO: 105836 - DNA, 23 bp, Homo sapiens
tctagatggaaaagcaatgataa

SEQ ID NO: 105837 - DNA, 22 bp, Homo sapiens
caacgttgcttaagttgtctaa

SEQ ID NO: 105838 - DNA, 18 bp, Homo sapiens
tgcatctgtagtcccagc

SEQ ID NO: 105839 - DNA, 21 bp, Homo sapiens
ctttctgtagttagtgtgcac

SEQ ID NO: 105840 - DNA, 23 bp, Homo sapiens
tagaaagtatttctaatgtactg

SEQ ID NO: 105841 - DNA, 23 bp, Homo sapiens
atacacgttgtatagatgtatgt

SEQ ID NO: 105842 - DNA, 21 bp, Homo sapiens
tacattacacacatatgtgtt

SEQ ID NO: 105843 - DNA, 23 bp, Homo sapiens
tctttctgtgagcgttttttctc

SEQ ID NO: 105844 - DNA, 23 bp, Homo sapiens
aatgtgtatatgtatatgtgtgt

SEQ ID NO: 105845 - DNA, 21 bp, Homo sapiens
tagatagatatgaagagagtg

SEQ ID NO: 105846 - DNA, 23 bp, Homo sapiens
gggagtctcgctctgtctccctg

SEQ ID NO: 105847 - DNA, 23 bp, Homo sapiens
gagtctcactctgtcacccaggc

SEQ ID NO: 105848 - DNA, 23 bp, Homo sapiens
gtgtgtgtgtgtgtgtatacgta

SEQ ID NO: 105849 - DNA, 19 bp, Homo sapiens
cacacacacatatatgtgt

SEQ ID NO: 105850 - DNA, 22 bp, Homo sapiens
tatatgtgtgtgtgtatatacg

SEQ ID NO: 105851 - DNA, 23 bp, Homo sapiens
tttccactatatgaattgtttat

SEQ ID NO: 105852 - DNA, 22 bp, Homo sapiens
ttctctgtgtcttagcagcacc

SEQ ID NO: 105853 - DNA, 22 bp, Homo sapiens
ttcttaggcttttgttctatac

SEQ ID NO: 105854 - DNA, 23 bp, Homo sapiens
gtaataggtagtataggattaca

SEQ ID NO: 105855 - DNA, 23 bp, Homo sapiens
tgagttcattgtagattctggat

SEQ ID NO: 105856 - DNA, 23 bp, Homo sapiens
tgagttcattgtagattctggat

SEQ ID NO: 105857 - DNA, 23 bp, Homo sapiens
gtgttgagtttaggttctgaata

SEQ ID NO: 105858 - DNA, 23 bp, Homo sapiens
aattgaagtggtattgatcagca

SEQ ID NO: 105859 - DNA, 20 bp, Homo sapiens
aggattcagtctctgaaagc

SEQ ID NO: 105860 - DNA, 21 bp, Homo sapiens
tcagattgaaatcctgtgaat

SEQ ID NO: 105861 - DNA, 19 bp, Homo sapiens
tgcagtgagctatgattgt

SEQ ID NO: 105862 - DNA, 23 bp, Homo sapiens
caaaagttccatacaaatgctga

SEQ ID NO: 105863 - DNA, 19 bp, Homo sapiens
ttgcatatgttgaaccagc

SEQ ID NO: 105864 - DNA, 23 bp, Homo sapiens
aggctttttgatgtgctgctgga

SEQ ID NO: 105865 - DNA, 23 bp, Homo sapiens
tgagttgtgtttgctttgcttgc

SEQ ID NO: 105866 - DNA, 22 bp, Homo sapiens
tagctccaaaggaaatgagaat

SEQ ID NO: 105867 - DNA, 23 bp, Homo sapiens
tttttctgtttttctagatgaaa

SEQ ID NO: 105868 - DNA, 23 bp, Homo sapiens
acagagtctcgctctgtcaccca

SEQ ID NO: 105869 - DNA, 23 bp, Homo sapiens
tggcgtctcactctgtcacccag

SEQ ID NO: 105870 - DNA, 21 bp, Homo sapiens
attatcatcggtattgctctg

SEQ ID NO: 105871 - DNA, 23 bp, Homo sapiens
aatcctctgtctgaaaggtcaca

SEQ ID NO: 105872 - DNA, 21 bp, Homo sapiens
ttggtgaggtcatgttttcct

SEQ ID NO: 105873 - DNA, 23 bp, Homo sapiens
tcaatgagttgtgaagttgaagg

SEQ ID NO: 105874 - DNA, 19 bp, Homo sapiens
ataagtttttttctttttg

SEQ ID NO: 105875 - DNA, 23 bp, Homo sapiens
cagcagtgtataagtgtttcgtt

SEQ ID NO: 105876 - DNA, 21 bp, Homo sapiens
tatgcatatatatacatatgt

SEQ ID NO: 105877 - DNA, 21 bp, Homo sapiens
tgtgaagaaagtcattggtag

SEQ ID NO: 105878 - DNA, 23 bp, Homo sapiens
tttcagacagacactgatgtctc

SEQ ID NO: 105879 - DNA, 22 bp, Homo sapiens
ccctgggtccctgtgtgcctga

SEQ ID NO: 105880 - DNA, 23 bp, Homo sapiens
gcctcactctgtcactcacgctg

SEQ ID NO: 105881 - DNA, 22 bp, Homo sapiens
ctcactgcacgctctgcttcct

SEQ ID NO: 105882 - DNA, 23 bp, Homo sapiens
gaattcagtctctctctctcacc

SEQ ID NO: 105883 - DNA, 23 bp, Homo sapiens
atatgtgtgcatgtatatagata

SEQ ID NO: 105884 - DNA, 23 bp, Homo sapiens
atggagtctcactcactctgtca

SEQ ID NO: 105885 - DNA, 19 bp, Homo sapiens
aaatgtaatttgtctcagg

SEQ ID NO: 105886 - DNA, 23 bp, Homo sapiens
tttgtctctgctgtctctctctg

SEQ ID NO: 105887 - DNA, 21 bp, Homo sapiens
tatgtatatttgtacatatgt

SEQ ID NO: 105888 - DNA, 20 bp, Homo sapiens
tgaggtaggaggatcacttg

SEQ ID NO: 105889 - DNA, 22 bp, Homo sapiens
tctcagtctcaggtattttgtt

SEQ ID NO: 105890 - DNA, 23 bp, Homo sapiens
tttacaagatggagtcttgctct

SEQ ID NO: 105891 - DNA, 23 bp, Homo sapiens
catgactcactgcagtctcagcc

SEQ ID NO: 105892 - DNA, 21 bp, Homo sapiens
atctcggctcactgcaggctg

SEQ ID NO: 105893 - DNA, 18 bp, Homo sapiens
agaggaagtcagattatt

SEQ ID NO: 105894 - DNA, 23 bp, Homo sapiens
tacagagatgaaggtgatactgt

SEQ ID NO: 105895 - DNA, 23 bp, Homo sapiens
tgagtctcgctcgctctgtcgcc

SEQ ID NO: 105896 - DNA, 23 bp, Homo sapiens
gttttcttgtagagacagggtct

SEQ ID NO: 105897 - DNA, 21 bp, Homo sapiens
actggttttacccaatctatg

SEQ ID NO: 105898 - DNA, 23 bp, Homo sapiens
acagatgagtgggtggtcagcag

SEQ ID NO: 105899 - DNA, 23 bp, Homo sapiens
ttcattatttctcaaactgttct

SEQ ID NO: 105900 - DNA, 22 bp, Homo sapiens
tgatgtgagactgcctatgttc

SEQ ID NO: 105901 - DNA, 20 bp, Homo sapiens
tatacatatatgtacatatg

SEQ ID NO: 105902 - DNA, 20 bp, Homo sapiens
tacacacatatgcatatatg

SEQ ID NO: 105903 - DNA, 23 bp, Homo sapiens
aagagagaacagtcagtggagta

SEQ ID NO: 105904 - DNA, 23 bp, Homo sapiens
atttctgacagtgtttggtgtat

SEQ ID NO: 105905 - DNA, 19 bp, Homo sapiens
tatgtatgcatgtgtgtgt

SEQ ID NO: 105906 - DNA, 22 bp, Homo sapiens
tgagagggaaggataccactca

SEQ ID NO: 105907 - DNA, 23 bp, Homo sapiens
gagtctgtttctctctctcctat

SEQ ID NO: 105908 - DNA, 23 bp, Homo sapiens
ttgaacttggatggcactgtcaa

SEQ ID NO: 105909 - DNA, 23 bp, Homo sapiens
actgtgacaagaacctgacagct

SEQ ID NO: 105910 - DNA, 19 bp, Homo sapiens
tgagatggagtctcactct

SEQ ID NO: 105911 - DNA, 23 bp, Homo sapiens
gggtctcactctgtcacccaggc

SEQ ID NO: 105912 - DNA, 18 bp, Homo sapiens
actaggcgcagggtcttt

SEQ ID NO: 105913 - DNA, 23 bp, Homo sapiens
ttctgagacagactctcgctctg

SEQ ID NO: 105914 - DNA, 23 bp, Homo sapiens
gacagagtctcgctctgtcaccc

SEQ ID NO: 105915 - DNA, 23 bp, Homo sapiens
acagagtctcgctctgtcaccca

SEQ ID NO: 105916 - DNA, 23 bp, Homo sapiens
gttctctctctcagggcatggga

SEQ ID NO: 105917 - DNA, 20 bp, Homo sapiens
aaggacagtgcttaacttgt

SEQ ID NO: 105918 - DNA, 23 bp, Homo sapiens
ctcccagagcccctggaactctg

SEQ ID NO: 105919 - DNA, 23 bp, Homo sapiens
gactgagtctcgctctgtcaccc

SEQ ID NO: 105920 - DNA, 23 bp, Homo sapiens
tgcagtggcatgatcttggctca

SEQ ID NO: 105921 - DNA, 23 bp, Homo sapiens
tataccatcactttatttatctt

SEQ ID NO: 105922 - DNA, 23 bp, Homo sapiens
ttcatgagtcatattcttgttga

SEQ ID NO: 105923 - DNA, 22 bp, Homo sapiens
atgtggataagctgctgactga

SEQ ID NO: 105924 - DNA, 23 bp, Homo sapiens
tgtcgctctgtcgctcagtctgg

SEQ ID NO: 105925 - DNA, 22 bp, Homo sapiens
tttattctgaggaggcaagaat

SEQ ID NO: 105926 - DNA, 23 bp, Homo sapiens
gacagagtctcgctctgtcaccc

SEQ ID NO: 105927 - DNA, 21 bp, Homo sapiens
tgagcttctaggatgtattca

SEQ ID NO: 105928 - DNA, 23 bp, Homo sapiens
tgtcttggtgacagtctctgtga

SEQ ID NO: 105929 - DNA, 23 bp, Homo sapiens
cggagtctcgctctgtctcccag

SEQ ID NO: 105930 - DNA, 21 bp, Homo sapiens
aacactctgatcctagtacct

SEQ ID NO: 105931 - DNA, 22 bp, Homo sapiens
atcatggtcattctctgtctca

SEQ ID NO: 105932 - DNA, 18 bp, Homo sapiens
tgtggtgtgcatgcctat

SEQ ID NO: 105933 - DNA, 23 bp, Homo sapiens
atgtgtgtgtgcatgtgcatcag

SEQ ID NO: 105934 - DNA, 20 bp, Homo sapiens
cacgcactctcagtcggcct

SEQ ID NO: 105935 - DNA, 23 bp, Homo sapiens
tgtctgtccctcagtggatgcca

SEQ ID NO: 105936 - DNA, 23 bp, Homo sapiens
gagtctcactctgtcacccaggc

SEQ ID NO: 105937 - DNA, 21 bp, Homo sapiens
tcagtgtgtctctgtgtccta

SEQ ID NO: 105938 - DNA, 23 bp, Homo sapiens
gtgtctggctctctgtaactgag

SEQ ID NO: 105939 - DNA, 19 bp, Homo sapiens
ggcctctgtgtctccctct

SEQ ID NO: 105940 - DNA, 22 bp, Homo sapiens
ttcctctcacaggctctctcag

SEQ ID NO: 105941 - DNA, 23 bp, Homo sapiens
tctagtgagaacagactgagtgg

SEQ ID NO: 105942 - DNA, 21 bp, Homo sapiens
tgtctgtctggattcttcttg

SEQ ID NO: 105943 - DNA, 23 bp, Homo sapiens
aagctcactgtactgtgtgtgct

SEQ ID NO: 105944 - DNA, 23 bp, Homo sapiens
tggagtctcactctgtcacccag

SEQ ID NO: 105945 - DNA, 20 bp, Homo sapiens
aggaccagactatggaagac

SEQ ID NO: 105946 - DNA, 21 bp, Homo sapiens
catgtgtgtctgtatgcatgt

SEQ ID NO: 105947 - DNA, 23 bp, Homo sapiens
ctgtgtctgtctgtgtatgtgca

SEQ ID NO: 105948 - DNA, 23 bp, Homo sapiens
tgtgagtcacactctctgcttgc

SEQ ID NO: 105949 - DNA, 20 bp, Homo sapiens
tcaagcttgagtaggatggt

SEQ ID NO: 105950 - DNA, 23 bp, Homo sapiens
tggaagaaatgtgaatttgttga

SEQ ID NO: 105951 - DNA, 23 bp, Homo sapiens
tgtgcctgtgtcccagtgtggct

SEQ ID NO: 105952 - DNA, 23 bp, Homo sapiens
agagtctcactctgtcacccagg

SEQ ID NO: 105953 - DNA, 18 bp, Homo sapiens
acagtagtgagccaccac

SEQ ID NO: 105954 - DNA, 23 bp, Homo sapiens
atttttgtagagatagggtctca

SEQ ID NO: 105955 - DNA, 23 bp, Homo sapiens
tgcttctctgcatagctgacagt

SEQ ID NO: 105956 - DNA, 23 bp, Homo sapiens
tatatttctgttgagcctaggag

SEQ ID NO: 105957 - DNA, 23 bp, Homo sapiens
atatgtgccatgttggtgtgctg

SEQ ID NO: 105958 - DNA, 18 bp, Homo sapiens
ttcatatataatgtgtat

SEQ ID NO: 105959 - DNA, 22 bp, Homo sapiens
agagtctcgctctgtcacccag

SEQ ID NO: 105960 - DNA, 19 bp, Homo sapiens
aatggtgcgatctctgctc

SEQ ID NO: 105961 - DNA, 23 bp, Homo sapiens
tgtatgcatatatgtatatatgt

SEQ ID NO: 105962 - DNA, 19 bp, Homo sapiens
tatgtgcatacatatagag

SEQ ID NO: 105963 - DNA, 22 bp, Homo sapiens
tatatgtatatgtgtatatgtg

SEQ ID NO: 105964 - DNA, 21 bp, Homo sapiens
tctatagatatctagatatct

SEQ ID NO: 105965 - DNA, 21 bp, Homo sapiens
tatatctagatatctatatct

SEQ ID NO: 105966 - DNA, 21 bp, Homo sapiens
tatatctagatatctatatct

SEQ ID NO: 105967 - DNA, 21 bp, Homo sapiens
tatatctagatatctatatct

SEQ ID NO: 105968 - DNA, 21 bp, Homo sapiens
tgttattttaacaatgagttt

SEQ ID NO: 105969 - DNA, 23 bp, Homo sapiens
accatatgtgtgtgtgtgtatat

SEQ ID NO: 105970 - DNA, 23 bp, Homo sapiens
tttggcttgcatttactatgttt

SEQ ID NO: 105971 - DNA, 23 bp, Homo sapiens
aaaaaacatagtaagcatagctt

SEQ ID NO: 105972 - DNA, 23 bp, Homo sapiens
attctcactccctgtgtctgtcc

SEQ ID NO: 105973 - DNA, 23 bp, Homo sapiens
aaagtctgagaagactataggtt

SEQ ID NO: 105974 - DNA, 23 bp, Homo sapiens
cagcatgcttgtttttgagttga

SEQ ID NO: 105975 - DNA, 23 bp, Homo sapiens
catctgacactgtctctgaatgg

SEQ ID NO: 105976 - DNA, 21 bp, Homo sapiens
agacagggtctggctctgttg

SEQ ID NO: 105977 - DNA, 23 bp, Homo sapiens
acagacagaacagtgtgtggaga

SEQ ID NO: 105978 - DNA, 23 bp, Homo sapiens
acctttgcatctgtctctgactg

SEQ ID NO: 105979 - DNA, 20 bp, Homo sapiens
aagactgaagaaagagaggt

SEQ ID NO: 105980 - DNA, 19 bp, Homo sapiens
tatgtttctgtgggtctct

SEQ ID NO: 105981 - DNA, 22 bp, Homo sapiens
tatctccctcatatatatgtgt

SEQ ID NO: 105982 - DNA, 20 bp, Homo sapiens
tcagtgtgtgaaattgtgga

SEQ ID NO: 105983 - DNA, 23 bp, Homo sapiens
tctcactttctctctggctcact

SEQ ID NO: 105984 - DNA, 23 bp, Homo sapiens
acagagaagtatgtgtggtcaag

SEQ ID NO: 105985 - DNA, 21 bp, Homo sapiens
tgcacacacacctttctcttt

SEQ ID NO: 105986 - DNA, 23 bp, Homo sapiens
acagagtctcactctgtcgccca

SEQ ID NO: 105987 - DNA, 21 bp, Homo sapiens
atatgtgtgtatatatatgtg

SEQ ID NO: 105988 - DNA, 23 bp, Homo sapiens
actgtctcactgggtgactcttg

SEQ ID NO: 105989 - DNA, 22 bp, Homo sapiens
aatagagtctgaagagtctttg

SEQ ID NO: 105990 - DNA, 23 bp, Homo sapiens
cagagtctcactctgtcacccag

SEQ ID NO: 105991 - DNA, 19 bp, Homo sapiens
tgtgatcttggttcactgg

SEQ ID NO: 105992 - DNA, 19 bp, Homo sapiens
tgcatatatatatgtatgt

SEQ ID NO: 105993 - DNA, 23 bp, Homo sapiens
aatgacagagaatttctatgaaa

SEQ ID NO: 105994 - DNA, 23 bp, Homo sapiens
ttgtttcataatgaaattttctg

SEQ ID NO: 105995 - DNA, 23 bp, Homo sapiens
taggtgagtatttatggtctatg

SEQ ID NO: 105996 - DNA, 23 bp, Homo sapiens
tggagtctcactctgtctcccag

SEQ ID NO: 105997 - DNA, 19 bp, Homo sapiens
agtagtgcgatctcagctc

SEQ ID NO: 105998 - DNA, 19 bp, Homo sapiens
tgggagtgagggtaagttc

SEQ ID NO: 105999 - DNA, 23 bp, Homo sapiens
agagtctcactctgtcacccagg

SEQ ID NO: 106000 - DNA, 23 bp, Homo sapiens
gggtctcactctgtcactcaggc

SEQ ID NO: 106001 - DNA, 23 bp, Homo sapiens
ctgccactgtcccactctccctc

SEQ ID NO: 106002 - DNA, 23 bp, Homo sapiens
tacacacacgtatatatacctgt

SEQ ID NO: 106003 - DNA, 23 bp, Homo sapiens
tgataaagtaatgtcattaactt

SEQ ID NO: 106004 - DNA, 22 bp, Homo sapiens
agcaaatgacagtcctctattc

SEQ ID NO: 106005 - DNA, 23 bp, Homo sapiens
ccaggctggctggctgaatccct

SEQ ID NO: 106006 - DNA, 22 bp, Homo sapiens
tgtaactatttcattatgtatt

SEQ ID NO: 106007 - DNA, 23 bp, Homo sapiens
tgctcacatttctctctctgcag

SEQ ID NO: 106008 - DNA, 23 bp, Homo sapiens
tcactccctgtgaccgtcagtgg

SEQ ID NO: 106009 - DNA, 23 bp, Homo sapiens
tctcagtgtacacacatggtgct

SEQ ID NO: 106010 - DNA, 23 bp, Homo sapiens
tgaggtagaaggatcatttgagc

SEQ ID NO: 106011 - DNA, 22 bp, Homo sapiens
ctccgtgtgtgtgtgtgtgctg

SEQ ID NO: 106012 - DNA, 20 bp, Homo sapiens
agtgtcccactctgtcaccc

SEQ ID NO: 106013 - DNA, 21 bp, Homo sapiens
tggagtctcactctgtctccc

SEQ ID NO: 106014 - DNA, 18 bp, Homo sapiens
cattggtttaggttatca

SEQ ID NO: 106015 - DNA, 20 bp, Homo sapiens
ggaatgaatagatgaatgtt

SEQ ID NO: 106016 - DNA, 21 bp, Homo sapiens
ctgtggaaatggaattgtgac

SEQ ID NO: 106017 - DNA, 20 bp, Homo sapiens
acacaactggcaaatctggt

SEQ ID NO: 106018 - DNA, 23 bp, Homo sapiens
tgagttcattgtagattctggat

SEQ ID NO: 106019 - DNA, 23 bp, Homo sapiens
tgagttcattgtagattctggat

SEQ ID NO: 106020 - DNA, 22 bp, Homo sapiens
atatatgtatatgtatatgtgt

SEQ ID NO: 106021 - DNA, 22 bp, Homo sapiens
gggtctcactctgtcgctcagg

SEQ ID NO: 106022 - DNA, 18 bp, Homo sapiens
ttgaattcaactttggag

SEQ ID NO: 106023 - DNA, 23 bp, Homo sapiens
attctgtgtcattttcttctggg

SEQ ID NO: 106024 - DNA, 23 bp, Homo sapiens
agcattgacagtatacagtgacc

SEQ ID NO: 106025 - DNA, 22 bp, Homo sapiens
gatgtttttgggttacagtgtg

SEQ ID NO: 106026 - DNA, 18 bp, Homo sapiens
tctcacccattctgcagt

SEQ ID NO: 106027 - DNA, 22 bp, Homo sapiens
tctgcagttttgataaggtggt

SEQ ID NO: 106028 - DNA, 23 bp, Homo sapiens
tgggtctgagtttcggtttcttg

SEQ ID NO: 106029 - DNA, 19 bp, Homo sapiens
tgtatgtatatgtatatat

SEQ ID NO: 106030 - DNA, 23 bp, Homo sapiens
tcagagtcacaggctccctggaa

SEQ ID NO: 106031 - DNA, 23 bp, Homo sapiens
ggtgggtctgtctctccctgtcc

SEQ ID NO: 106032 - DNA, 23 bp, Homo sapiens
atatgtgtgtatacatatatgtg

SEQ ID NO: 106033 - DNA, 21 bp, Homo sapiens
atatactgggtatgatttcaa

SEQ ID NO: 106034 - DNA, 23 bp, Homo sapiens
agactgaggctctgagtctctgg

SEQ ID NO: 106035 - DNA, 20 bp, Homo sapiens
tatatgtgtctgtatatatg

SEQ ID NO: 106036 - DNA, 23 bp, Homo sapiens
tatttatgtacatgtatatgtat

SEQ ID NO: 106037 - DNA, 23 bp, Homo sapiens
acagagtctcgctctgacaccca

SEQ ID NO: 106038 - DNA, 21 bp, Homo sapiens
acaagtcttttgtaggagtct

SEQ ID NO: 106039 - DNA, 23 bp, Homo sapiens
gggtagtaaggtcaatgagcagt

SEQ ID NO: 106040 - DNA, 18 bp, Homo sapiens
tgtgatgatgaggaaagg

SEQ ID NO: 106041 - DNA, 23 bp, Homo sapiens
ttatttcattttgtacatgtgac

SEQ ID NO: 106042 - DNA, 23 bp, Homo sapiens
aaacagtaggttaacagattatg

SEQ ID NO: 106043 - DNA, 21 bp, Homo sapiens
aagaatacaaaggtattctta

SEQ ID NO: 106044 - DNA, 23 bp, Homo sapiens
gcaaaactttgggaaatgtgaat

SEQ ID NO: 106045 - DNA, 19 bp, Homo sapiens
gagtgaactcagaattgtg

SEQ ID NO: 106046 - DNA, 23 bp, Homo sapiens
tgagttcattgtagattctggat

SEQ ID NO: 106047 - DNA, 23 bp, Homo sapiens
tgagttcattgtagattctggat

SEQ ID NO: 106048 - DNA, 23 bp, Homo sapiens
tatgagagcaagtttttggagat

SEQ ID NO: 106049 - DNA, 23 bp, Homo sapiens
ctctgaggaagttttctgattat

SEQ ID NO: 106050 - DNA, 22 bp, Homo sapiens
tgacagacaggtaatcgtgaag

SEQ ID NO: 106051 - DNA, 21 bp, Homo sapiens
atagtcctagaaataatatgt

SEQ ID NO: 106052 - DNA, 19 bp, Homo sapiens
tatttggttgtaataactg

SEQ ID NO: 106053 - DNA, 23 bp, Homo sapiens
ttgtgagatgagagagaggtgca

SEQ ID NO: 106054 - DNA, 23 bp, Homo sapiens
ctcctcagtcttactctctgctt

SEQ ID NO: 106055 - DNA, 23 bp, Homo sapiens
tggagtctcactctgtcacccag

SEQ ID NO: 106056 - DNA, 21 bp, Homo sapiens
tgaaccaagaattggaacagt

SEQ ID NO: 106057 - DNA, 23 bp, Homo sapiens
acagagtcacgctctgtcaccca

SEQ ID NO: 106058 - DNA, 23 bp, Homo sapiens
cagcgtctcactctgtcacccag

SEQ ID NO: 106059 - DNA, 23 bp, Homo sapiens
atgtgtgtgtatatatatgtgtg

SEQ ID NO: 106060 - DNA, 21 bp, Homo sapiens
ttacacacacgcatatatatg

SEQ ID NO: 106061 - DNA, 21 bp, Homo sapiens
atatgtgtatatatgtgtgtg

SEQ ID NO: 106062 - DNA, 23 bp, Homo sapiens
atatgtatatgtatatgtatata

SEQ ID NO: 106063 - DNA, 22 bp, Homo sapiens
tagactactgtgaatgctgttg

SEQ ID NO: 106064 - DNA, 21 bp, Homo sapiens
tatggatggatgagtacgtat

SEQ ID NO: 106065 - DNA, 22 bp, Homo sapiens
tgacagtctcactctgtcgccc

SEQ ID NO: 106066 - DNA, 22 bp, Homo sapiens
agacagagtctctctttgtcac

SEQ ID NO: 106067 - DNA, 20 bp, Homo sapiens
tttttggtagaggtggggtt

SEQ ID NO: 106068 - DNA, 23 bp, Homo sapiens
tgagttcattgtagattctggat

SEQ ID NO: 106069 - DNA, 23 bp, Homo sapiens
tgagttcattgtagattctggat

SEQ ID NO: 106070 - DNA, 19 bp, Homo sapiens
tcctttaccacctctgaga

SEQ ID NO: 106071 - DNA, 22 bp, Homo sapiens
ttgtctcagagggtaaagagag

SEQ ID NO: 106072 - DNA, 23 bp, Homo sapiens
ggactctcactctgtcactcagg

SEQ ID NO: 106073 - DNA, 23 bp, Homo sapiens
atgtatatatgaatgtatatgta

SEQ ID NO: 106074 - DNA, 20 bp, Homo sapiens
atatatgtatgtatatgaat

SEQ ID NO: 106075 - DNA, 22 bp, Homo sapiens
aaaagtgctgttaaaggtgcta

SEQ ID NO: 106076 - DNA, 23 bp, Homo sapiens
agacagagtctcactctgtcgcc

SEQ ID NO: 106077 - DNA, 23 bp, Homo sapiens
catgactcactgcagtctcagcc

SEQ ID NO: 106078 - DNA, 23 bp, Homo sapiens
agacagtctcattctgtcaccta

SEQ ID NO: 106079 - DNA, 19 bp, Homo sapiens
acacgtatatatatctaga

SEQ ID NO: 106080 - DNA, 23 bp, Homo sapiens
tatatgtacatgtctatctctct

SEQ ID NO: 106081 - DNA, 23 bp, Homo sapiens
gaagtcagaagtttgagaccagt

SEQ ID NO: 106082 - DNA, 22 bp, Homo sapiens
ttctgagacggagtctcactct

SEQ ID NO: 106083 - DNA, 23 bp, Homo sapiens
acatgtgtctctgtatgtgagtg

SEQ ID NO: 106084 - DNA, 23 bp, Homo sapiens
gacagtctcgctctgtcacccag

SEQ ID NO: 106085 - DNA, 23 bp, Homo sapiens
tggagtctcactctgtcacccag

SEQ ID NO: 106086 - DNA, 19 bp, Homo sapiens
gagccactgtgccaggccc

SEQ ID NO: 106087 - DNA, 23 bp, Homo sapiens
cagacggagtctcgctctgtcac

SEQ ID NO: 106088 - DNA, 22 bp, Homo sapiens
acagcgggagaagttgatctct

SEQ ID NO: 106089 - DNA, 18 bp, Homo sapiens
ttatgtgcagtctgtcca

SEQ ID NO: 106090 - DNA, 22 bp, Homo sapiens
tgtgtgtgtatatatatgtgtg

SEQ ID NO: 106091 - DNA, 23 bp, Homo sapiens
atggagtctcactctgtcaccca

SEQ ID NO: 106092 - DNA, 23 bp, Homo sapiens
tggagtctcactctgtcacccag

SEQ ID NO: 106093 - DNA, 23 bp, Homo sapiens
gacagagtctcgctctgtcaccc

SEQ ID NO: 106094 - DNA, 23 bp, Homo sapiens
gtcctctctcactcactgccact

SEQ ID NO: 106095 - DNA, 23 bp, Homo sapiens
gattgagtctctgctactcatga

SEQ ID NO: 106096 - DNA, 18 bp, Homo sapiens
tgaggtaggaggttcgct

SEQ ID NO: 106097 - DNA, 23 bp, Homo sapiens
ctctgagactctggcagacttga

SEQ ID NO: 106098 - DNA, 23 bp, Homo sapiens
gatggagtctcactctgtctcca

SEQ ID NO: 106099 - DNA, 21 bp, Homo sapiens
tgaggtagcaggatcacttga

SEQ ID NO: 106100 - DNA, 23 bp, Homo sapiens
gaggtctcactctgtcaccctgg

SEQ ID NO: 106101 - DNA, 23 bp, Homo sapiens
ttgactctcagagttcacaaagc

SEQ ID NO: 106102 - DNA, 23 bp, Homo sapiens
tagatgtctatatatatagatat

SEQ ID NO: 106103 - DNA, 23 bp, Homo sapiens
tgagttcattgtagattctggat

SEQ ID NO: 106104 - DNA, 23 bp, Homo sapiens
tgagttcattgtagattctggat

SEQ ID NO: 106105 - DNA, 23 bp, Homo sapiens
cagggtctcactctgtcacccgg

SEQ ID NO: 106106 - DNA, 18 bp, Homo sapiens
aattctctggtgtcaact

SEQ ID NO: 106107 - DNA, 22 bp, Homo sapiens
caatgtgctactgaaatgatca

SEQ ID NO: 106108 - DNA, 23 bp, Homo sapiens
tgtgtctgtctctttctctaaac

SEQ ID NO: 106109 - DNA, 22 bp, Homo sapiens
ttctatgaagaaagtcaatggt

SEQ ID NO: 106110 - DNA, 23 bp, Homo sapiens
tcagagctcttggagctggcttg

SEQ ID NO: 106111 - DNA, 23 bp, Homo sapiens
gacagagtctcgctctgtcaccc

SEQ ID NO: 106112 - DNA, 21 bp, Homo sapiens
ttctctttgcattgcctttct

SEQ ID NO: 106113 - DNA, 23 bp, Homo sapiens
tggcagtagagaaagcagaaacc

SEQ ID NO: 106114 - DNA, 23 bp, Homo sapiens
gcaagactcaaaaaagtgaggac

SEQ ID NO: 106115 - DNA, 20 bp, Homo sapiens
tctacagtaagccacagcca

SEQ ID NO: 106116 - DNA, 23 bp, Homo sapiens
tggagtctcactctgtcacccag

SEQ ID NO: 106117 - DNA, 18 bp, Homo sapiens
tatacacacatatacttg

SEQ ID NO: 106118 - DNA, 22 bp, Homo sapiens
tttggaattttatatatgtgga

SEQ ID NO: 106119 - DNA, 23 bp, Homo sapiens
ctctctctgactccctctctcac

SEQ ID NO: 106120 - DNA, 23 bp, Homo sapiens
tggagtctcactctgtcacccag

SEQ ID NO: 106121 - DNA, 23 bp, Homo sapiens
gactgagtctcgctctgtcactg

SEQ ID NO: 106122 - DNA, 23 bp, Homo sapiens
gtgtagactgagagcctgagtgt

SEQ ID NO: 106123 - DNA, 23 bp, Homo sapiens
gaatctcactcactttgtctccc

SEQ ID NO: 106124 - DNA, 23 bp, Homo sapiens
tgagttcattgtagattctggat

SEQ ID NO: 106125 - DNA, 23 bp, Homo sapiens
tatatgtatgtgtgtttgtggat

SEQ ID NO: 106126 - DNA, 21 bp, Homo sapiens
aatctgtgtctgtgtctgtgc

SEQ ID NO: 106127 - DNA, 23 bp, Homo sapiens
tgagttcattgtagattctggat

SEQ ID NO: 106128 - DNA, 23 bp, Homo sapiens
tgagttcattgtagattctggat

SEQ ID NO: 106129 - DNA, 18 bp, Homo sapiens
attgcatatgtttatata

SEQ ID NO: 106130 - DNA, 23 bp, Homo sapiens
atgaggtttcaccatgttggcca

SEQ ID NO: 106131 - DNA, 22 bp, Homo sapiens
tgcctggtaaacttcctgaaga

SEQ ID NO: 106132 - DNA, 20 bp, Homo sapiens
ctttgtcctcttgctcatca

SEQ ID NO: 106133 - DNA, 23 bp, Homo sapiens
atagttgtgtatatgtatacata

SEQ ID NO: 106134 - DNA, 23 bp, Homo sapiens
aagaccaactccatgtggaagag

SEQ ID NO: 106135 - DNA, 20 bp, Homo sapiens
tgtttcagggaattggctga

SEQ ID NO: 106136 - DNA, 23 bp, Homo sapiens
tcagcctgactccctcactgggt

SEQ ID NO: 106137 - DNA, 23 bp, Homo sapiens
atgaggtttcaccatgttggcca

SEQ ID NO: 106138 - DNA, 22 bp, Homo sapiens
tgcctggtaaacttcctgaaga

SEQ ID NO: 106139 - DNA, 19 bp, Homo sapiens
atatgagtatatatgaata

SEQ ID NO: 106140 - DNA, 20 bp, Homo sapiens
tcacagatgagactcagcac

SEQ ID NO: 106141 - DNA, 23 bp, Homo sapiens
tctgacaagagtcagagctcagg

SEQ ID NO: 106142 - DNA, 23 bp, Homo sapiens
aattagtgggcttttcttatgta

SEQ ID NO: 106143 - DNA, 23 bp, Homo sapiens
tgtgtgtgtgtaaatgtgtgtgt

SEQ ID NO: 106144 - DNA, 23 bp, Homo sapiens
tgagttcattgtagattctggat

SEQ ID NO: 106145 - DNA, 23 bp, Homo sapiens
tgagttcattgtagattctggat

SEQ ID NO: 106146 - DNA, 22 bp, Homo sapiens
cataagacagggagatgaagac

SEQ ID NO: 106147 - DNA, 23 bp, Homo sapiens
atgtgtgtgtgcatatatatgtg

SEQ ID NO: 106148 - DNA, 19 bp, Homo sapiens
tgaggtaatttttaaatta

SEQ ID NO: 106149 - DNA, 23 bp, Homo sapiens
tggggattgactttctcttttag

SEQ ID NO: 106150 - DNA, 23 bp, Homo sapiens
agagggtctcactctgtcactca

SEQ ID NO: 106151 - DNA, 21 bp, Homo sapiens
tatatgtatgtatatacatgt

SEQ ID NO: 106152 - DNA, 22 bp, Homo sapiens
tatatgtgtgtatatacatgtg

SEQ ID NO: 106153 - DNA, 23 bp, Homo sapiens
catatgtgtgtatatatgtatgt

SEQ ID NO: 106154 - DNA, 23 bp, Homo sapiens
tatgtgtgtatatatgtatgtat

SEQ ID NO: 106155 - DNA, 20 bp, Homo sapiens
tatatgtatgtatgtatgta

SEQ ID NO: 106156 - DNA, 23 bp, Homo sapiens
tgagttcattgtagattctggat

SEQ ID NO: 106157 - DNA, 23 bp, Homo sapiens
tgagttcattgtagattctggat

SEQ ID NO: 106158 - DNA, 21 bp, Homo sapiens
tgtgtccagctatatggatct

SEQ ID NO: 106159 - DNA, 23 bp, Homo sapiens
aatgactgggtctgtctgtgcct

SEQ ID NO: 106160 - DNA, 20 bp, Homo sapiens
ataagaaagaaaacggaagt

SEQ ID NO: 106161 - DNA, 23 bp, Homo sapiens
tttctctttttcttgttgaatct

SEQ ID NO: 106162 - DNA, 23 bp, Homo sapiens
tgtgtatatatgtgtgtgtgtgt

SEQ ID NO: 106163 - DNA, 19 bp, Homo sapiens
gtgtatagtatatatgtag

SEQ ID NO: 106164 - DNA, 21 bp, Homo sapiens
tatatagtatacatgcataca

SEQ ID NO: 106165 - DNA, 20 bp, Homo sapiens
ctgctgctggaacacatcac

SEQ ID NO: 106166 - DNA, 22 bp, Homo sapiens
ttgcaggtgtgtcagtttcact

SEQ ID NO: 106167 - DNA, 21 bp, Homo sapiens
attttgttttttaaatgagga

SEQ ID NO: 106168 - DNA, 20 bp, Homo sapiens
agagaactgtgataggacaa

SEQ ID NO: 106169 - DNA, 23 bp, Homo sapiens
tgtgacagcttcttgatctgtcc

SEQ ID NO: 106170 - DNA, 23 bp, Homo sapiens
gacagagtctcgctctgtcaccc

SEQ ID NO: 106171 - DNA, 23 bp, Homo sapiens
tgagtctcaccctgtcacccagg

SEQ ID NO: 106172 - DNA, 18 bp, Homo sapiens
ctgatcaactgggtgtag

SEQ ID NO: 106173 - DNA, 22 bp, Homo sapiens
gtctcactctgtctgccaggct

SEQ ID NO: 106174 - DNA, 19 bp, Homo sapiens
tacagagatggtgttttgc

SEQ ID NO: 106175 - DNA, 23 bp, Homo sapiens
cagatggagtctctctgtcaccc

SEQ ID NO: 106176 - DNA, 23 bp, Homo sapiens
tctctttgactgctagccctgga

SEQ ID NO: 106177 - DNA, 23 bp, Homo sapiens
tataactgatttgttgatgaaat

SEQ ID NO: 106178 - DNA, 23 bp, Homo sapiens
tgagttcattgtagattctggat

SEQ ID NO: 106179 - DNA, 23 bp, Homo sapiens
tgagttcattgtagattctggat

SEQ ID NO: 106180 - DNA, 23 bp, Homo sapiens
tttaatttgtctggagtgtggct

SEQ ID NO: 106181 - DNA, 23 bp, Homo sapiens
ttttgagacggagtcttgctctg

SEQ ID NO: 106182 - DNA, 23 bp, Homo sapiens
acttgagtctgggaggttgaggt

SEQ ID NO: 106183 - DNA, 23 bp, Homo sapiens
ttgtggatgacatatggttgggt

SEQ ID NO: 106184 - DNA, 20 bp, Homo sapiens
tgacaggagctcttgctgat

SEQ ID NO: 106185 - DNA, 21 bp, Homo sapiens
tctcaggaggaccttgtgagt

SEQ ID NO: 106186 - DNA, 19 bp, Homo sapiens
gtgtagatgccagttagtg

SEQ ID NO: 106187 - DNA, 23 bp, Homo sapiens
tggagtctcactctgtcacccag

SEQ ID NO: 106188 - DNA, 22 bp, Homo sapiens
gaagggtttcagcaaaggaact

SEQ ID NO: 106189 - DNA, 22 bp, Homo sapiens
tgtctttcataaactagctcta

SEQ ID NO: 106190 - DNA, 23 bp, Homo sapiens
tgtatgtatgtatgtatgtatat

SEQ ID NO: 106191 - DNA, 22 bp, Homo sapiens
atatatgtatgtatgtatatgt

SEQ ID NO: 106192 - DNA, 18 bp, Homo sapiens
tatactttaagttctggg

SEQ ID NO: 106193 - DNA, 21 bp, Homo sapiens
aggtttattaaaaagtgttct

SEQ ID NO: 106194 - DNA, 22 bp, Homo sapiens
ctaaagataatgttactgaatg

SEQ ID NO: 106195 - DNA, 22 bp, Homo sapiens
tgggtgtgtgtatatatgtatc

SEQ ID NO: 106196 - DNA, 23 bp, Homo sapiens
tatcactgggtgtatgtgtgtgt

SEQ ID NO: 106197 - DNA, 19 bp, Homo sapiens
tatatcactgggtgtatat

SEQ ID NO: 106198 - DNA, 23 bp, Homo sapiens
tgggtgtatatacatattgggta

SEQ ID NO: 106199 - DNA, 23 bp, Homo sapiens
ggggtctcactctgtcacccagg

SEQ ID NO: 106200 - DNA, 23 bp, Homo sapiens
tagtaagagatatatatagtgag

SEQ ID NO: 106201 - DNA, 23 bp, Homo sapiens
agagttgcactcttcacagctcg

SEQ ID NO: 106202 - DNA, 19 bp, Homo sapiens
taaatggttgtaaatgtta

SEQ ID NO: 106203 - DNA, 22 bp, Homo sapiens
aacacactgagtaattcatctg

SEQ ID NO: 106204 - DNA, 23 bp, Homo sapiens
tgagatggagtctcactctgtca

SEQ ID NO: 106205 - DNA, 23 bp, Homo sapiens
aatggtggttctatcttaagttc

SEQ ID NO: 106206 - DNA, 22 bp, Homo sapiens
tgagacagagtctcactctgtt

SEQ ID NO: 106207 - DNA, 23 bp, Homo sapiens
gggtgagagtgagacaccatctc

SEQ ID NO: 106208 - DNA, 23 bp, Homo sapiens
tgagacagagtctcgctctgtcg

SEQ ID NO: 106209 - DNA, 23 bp, Homo sapiens
tgaggatttagttagatgctgtg

SEQ ID NO: 106210 - DNA, 23 bp, Homo sapiens
tgattgactttcaaatggattgt

SEQ ID NO: 106211 - DNA, 20 bp, Homo sapiens
agactgagtgcagtggcaca

SEQ ID NO: 106212 - DNA, 21 bp, Homo sapiens
tacctgtatagatatgtaccc

SEQ ID NO: 106213 - DNA, 23 bp, Homo sapiens
gagggagtctcactctgtcaccc

SEQ ID NO: 106214 - DNA, 23 bp, Homo sapiens
gggagtctcactctgtcacccag

SEQ ID NO: 106215 - DNA, 23 bp, Homo sapiens
tgagttcattgtagattctggat

SEQ ID NO: 106216 - DNA, 23 bp, Homo sapiens
tgagttcattgtagattctggat

SEQ ID NO: 106217 - DNA, 23 bp, Homo sapiens
acagagtctcactctgtcgccca

SEQ ID NO: 106218 - DNA, 22 bp, Homo sapiens
ttgagacagggtctcacttgtc

SEQ ID NO: 106219 - DNA, 22 bp, Homo sapiens
tatatctatatatatgtgtgtg

SEQ ID NO: 106220 - DNA, 23 bp, Homo sapiens
gcttgtatgtgtatatgtatatg

SEQ ID NO: 106221 - DNA, 23 bp, Homo sapiens
tatgtatacaaacacacagacat

SEQ ID NO: 106222 - DNA, 23 bp, Homo sapiens
gttagtgtttcaccatgttgccc

SEQ ID NO: 106223 - DNA, 23 bp, Homo sapiens
cggagtctcactctgtcacccag

SEQ ID NO: 106224 - DNA, 23 bp, Homo sapiens
gagtctcactctgtcacccaggc

SEQ ID NO: 106225 - DNA, 21 bp, Homo sapiens
tatcacagggaaagaagaaat

SEQ ID NO: 106226 - DNA, 22 bp, Homo sapiens
atattgtgctttagtatttttg

SEQ ID NO: 106227 - DNA, 21 bp, Homo sapiens
tatacctatatgtatatatgt

SEQ ID NO: 106228 - DNA, 21 bp, Homo sapiens
tcttctgaggaactttttttg

SEQ ID NO: 106229 - DNA, 21 bp, Homo sapiens
taaaaaaatttgtgcagcgtg

SEQ ID NO: 106230 - DNA, 23 bp, Homo sapiens
ggctgcagtgagctatgattgtg

SEQ ID NO: 106231 - DNA, 23 bp, Homo sapiens
ttaatgctaggttttgttttttt

SEQ ID NO: 106232 - DNA, 20 bp, Homo sapiens
atgtatgtgtgtatgtgtat

SEQ ID NO: 106233 - DNA, 23 bp, Homo sapiens
tttaaacacggttttcatattca

SEQ ID NO: 106234 - DNA, 18 bp, Homo sapiens
tgtggtaggaggatcact

SEQ ID NO: 106235 - DNA, 23 bp, Homo sapiens
aaactggattccttttcaataga

SEQ ID NO: 106236 - DNA, 23 bp, Homo sapiens
ttcacaactcactcactcagtgc

SEQ ID NO: 106237 - DNA, 22 bp, Homo sapiens
ctatagctatacctctctctgc

SEQ ID NO: 106238 - DNA, 23 bp, Homo sapiens
acagggtctcactctgtcaccca

SEQ ID NO: 106239 - DNA, 23 bp, Homo sapiens
gggtctcactctgtcacccaggc

SEQ ID NO: 106240 - DNA, 23 bp, Homo sapiens
gggtctcactctgtcacccaggc

SEQ ID NO: 106241 - DNA, 22 bp, Homo sapiens
atcatggtcattctctgtctca

SEQ ID NO: 106242 - DNA, 23 bp, Homo sapiens
agtgcctgaccaaaagttgtgtg

SEQ ID NO: 106243 - DNA, 19 bp, Homo sapiens
aggtgcttaatatttattt

SEQ ID NO: 106244 - DNA, 23 bp, Homo sapiens
tgagagatgaaagtgatacccag

SEQ ID NO: 106245 - DNA, 23 bp, Homo sapiens
atgatgaaagttgaatagatgtg

SEQ ID NO: 106246 - DNA, 23 bp, Homo sapiens
tctggttttcatttgtttccatt

SEQ ID NO: 106247 - DNA, 19 bp, Homo sapiens
taatgagaaagaaatggag

SEQ ID NO: 106248 - DNA, 23 bp, Homo sapiens
acacagtttattttttgcacatt

SEQ ID NO: 106249 - DNA, 23 bp, Homo sapiens
tacatgtgcagaatgtgcaggtt

SEQ ID NO: 106250 - DNA, 23 bp, Homo sapiens
tgaagtctcgctctgtctcccag

SEQ ID NO: 106251 - DNA, 23 bp, Homo sapiens
gtgaatctctctctgagtctcag

SEQ ID NO: 106252 - DNA, 23 bp, Homo sapiens
atttatgtatttgattatgggag

SEQ ID NO: 106253 - DNA, 23 bp, Homo sapiens
gacagagtctcgctctgtcaccc

SEQ ID NO: 106254 - DNA, 23 bp, Homo sapiens
tgagatggagtctcactctgtac

SEQ ID NO: 106255 - DNA, 19 bp, Homo sapiens
cactggtgtgtgtttctgt

SEQ ID NO: 106256 - DNA, 23 bp, Homo sapiens
gacagagtctcgctctgtcaccc

SEQ ID NO: 106257 - DNA, 23 bp, Homo sapiens
actgagtcacgctctgtcaccca

SEQ ID NO: 106258 - DNA, 21 bp, Homo sapiens
cagaggttttattttgtatat

SEQ ID NO: 106259 - DNA, 23 bp, Homo sapiens
actgagtctcgctctgtcagcca

SEQ ID NO: 106260 - DNA, 23 bp, Homo sapiens
cggagtctcgctctgtcgctcag

SEQ ID NO: 106261 - DNA, 22 bp, Homo sapiens
ttttgagacggagtcttgctct

SEQ ID NO: 106262 - DNA, 21 bp, Homo sapiens
acatgtgcagaatgtgcaggt

SEQ ID NO: 106263 - DNA, 23 bp, Homo sapiens
tgacagtctctgtttctataatg

SEQ ID NO: 106264 - DNA, 23 bp, Homo sapiens
ctctctcgctctctctatgtgtg

SEQ ID NO: 106265 - DNA, 21 bp, Homo sapiens
atagagatgtaaattatttgt

SEQ ID NO: 106266 - DNA, 20 bp, Homo sapiens
tgcgtgtgtgtaagtatata

SEQ ID NO: 106267 - DNA, 20 bp, Homo sapiens
acatatatatacacacacat

SEQ ID NO: 106268 - DNA, 19 bp, Homo sapiens
tcactgcaagctctgcctc

SEQ ID NO: 106269 - DNA, 23 bp, Homo sapiens
atacacacacacacatatgtgtg

SEQ ID NO: 106270 - DNA, 22 bp, Homo sapiens
cagcaaggggtatctctttgtc

SEQ ID NO: 106271 - DNA, 23 bp, Homo sapiens
gtgccctcactctgtctgtcggg

SEQ ID NO: 106272 - DNA, 23 bp, Homo sapiens
ggatagtgtttcctaataatgtg

SEQ ID NO: 106273 - DNA, 19 bp, Homo sapiens
aaacaagttctctctctgt

SEQ ID NO: 106274 - DNA, 23 bp, Homo sapiens
gggtctcactctgtcacccaggc

SEQ ID NO: 106275 - DNA, 23 bp, Homo sapiens
tataatcatgttatctgtatata

SEQ ID NO: 106276 - DNA, 20 bp, Homo sapiens
tgtgtatatatttaggtatc

SEQ ID NO: 106277 - DNA, 23 bp, Homo sapiens
tcatagcatgtatatagatttgt

SEQ ID NO: 106278 - DNA, 23 bp, Homo sapiens
gggtctcactctgtcacccaggc

SEQ ID NO: 106279 - DNA, 23 bp, Homo sapiens
gagtctcactctgtcacccaggc

SEQ ID NO: 106280 - DNA, 23 bp, Homo sapiens
aaaagcaggacattgtgccagga

SEQ ID NO: 106281 - DNA, 23 bp, Homo sapiens
tggagtctcactctgtcacccag

SEQ ID NO: 106282 - DNA, 23 bp, Homo sapiens
ttctcacactctgcctctcatct

SEQ ID NO: 106283 - DNA, 23 bp, Homo sapiens
tccagtgttgggagctagaacat

SEQ ID NO: 106284 - DNA, 23 bp, Homo sapiens
ttactgagacaagaaagtgtcca

SEQ ID NO: 106285 - DNA, 23 bp, Homo sapiens
ggctgaggtaggaggatcacttg

SEQ ID NO: 106286 - DNA, 21 bp, Homo sapiens
actgcttctacattatggtga

SEQ ID NO: 106287 - DNA, 23 bp, Homo sapiens
atatatgtgtatatatctgtatg

SEQ ID NO: 106288 - DNA, 20 bp, Homo sapiens
tgtctctgtatctatctttt

SEQ ID NO: 106289 - DNA, 23 bp, Homo sapiens
tgtgtacatgcaagtgtgtgtgg

SEQ ID NO: 106290 - DNA, 22 bp, Homo sapiens
atgtatgtgtacatatgtgtgc

SEQ ID NO: 106291 - DNA, 20 bp, Homo sapiens
tatgtatatgtatacatgtg

SEQ ID NO: 106292 - DNA, 21 bp, Homo sapiens
tacgtgctttatatttatgta

SEQ ID NO: 106293 - DNA, 23 bp, Homo sapiens
atgtcagttcatgctctgtcagt

SEQ ID NO: 106294 - DNA, 22 bp, Homo sapiens
ggctgtgaactttcctcttagc

SEQ ID NO: 106295 - DNA, 18 bp, Homo sapiens
tatctagtatgtgtgcac

SEQ ID NO: 106296 - DNA, 23 bp, Homo sapiens
ttatgggagaatatcaaatgcat

SEQ ID NO: 106297 - DNA, 23 bp, Homo sapiens
ttatgaagataatgccagtgatc

SEQ ID NO: 106298 - DNA, 22 bp, Homo sapiens
tatatgtgtatatatatgtcac

SEQ ID NO: 106299 - DNA, 23 bp, Homo sapiens
tttcaggatgtgttgtgattgtg

SEQ ID NO: 106300 - DNA, 23 bp, Homo sapiens
gtgtgtctgtatatatgtgtgtg

SEQ ID NO: 106301 - DNA, 20 bp, Homo sapiens
atacatatacataactgtat

SEQ ID NO: 106302 - DNA, 22 bp, Homo sapiens
tggagtctcgctctgtcaccag

SEQ ID NO: 106303 - DNA, 23 bp, Homo sapiens
agactgttaatgtttgttttttg

SEQ ID NO: 106304 - DNA, 21 bp, Homo sapiens
atagaactccttatggtgtca

SEQ ID NO: 106305 - DNA, 23 bp, Homo sapiens
tttccacattttgttgcctcaaa

SEQ ID NO: 106306 - DNA, 23 bp, Homo sapiens
gaagtgtctgttcatatactgtg

SEQ ID NO: 106307 - DNA, 23 bp, Homo sapiens
tacatgtgcagaatgtgcaggtt

SEQ ID NO: 106308 - DNA, 23 bp, Homo sapiens
tggagtctcactctgtcacccag

SEQ ID NO: 106309 - DNA, 23 bp, Homo sapiens
tgaaatacacattttgttcaagt

SEQ ID NO: 106310 - DNA, 19 bp, Homo sapiens
tggtaaagttaaatctttg

SEQ ID NO: 106311 - DNA, 23 bp, Homo sapiens
atttgtgtgtgtatccatattgt

SEQ ID NO: 106312 - DNA, 20 bp, Homo sapiens
aatgtggatgtgatgtgctt

SEQ ID NO: 106313 - DNA, 23 bp, Homo sapiens
ttcacagggtcactgaaggctgt

SEQ ID NO: 106314 - DNA, 23 bp, Homo sapiens
ggagtctcactctgtcacccagg

SEQ ID NO: 106315 - DNA, 22 bp, Homo sapiens
tgtgatcttggttcactgcaag

SEQ ID NO: 106316 - DNA, 23 bp, Homo sapiens
tgagacaaagcctcactctgtcg

SEQ ID NO: 106317 - DNA, 23 bp, Homo sapiens
tattttctttggataagtatttt

SEQ ID NO: 106318 - DNA, 21 bp, Homo sapiens
cacttttctttggataagtgt

SEQ ID NO: 106319 - DNA, 23 bp, Homo sapiens
tacacacaaatatatatgtgtgt

SEQ ID NO: 106320 - DNA, 18 bp, Homo sapiens
gtgtgtgtgtgtctgtgt

SEQ ID NO: 106321 - DNA, 23 bp, Homo sapiens
ttttcagttgtttgaattctgag

SEQ ID NO: 106322 - DNA, 18 bp, Homo sapiens
gtatacacacatatgtat

SEQ ID NO: 106323 - DNA, 22 bp, Homo sapiens
agagaaagtgtgtgtgtgtgta

SEQ ID NO: 106324 - DNA, 23 bp, Homo sapiens
aggtagtctgtgactctaactga

SEQ ID NO: 106325 - DNA, 21 bp, Homo sapiens
attaggagaaataggattgag

SEQ ID NO: 106326 - DNA, 23 bp, Homo sapiens
ttttcaaagggaatgcttccagt

SEQ ID NO: 106327 - DNA, 19 bp, Homo sapiens
ataatgaactttatgaaat

SEQ ID NO: 106328 - DNA, 23 bp, Homo sapiens
aggcaggttccctttgttctgtt

SEQ ID NO: 106329 - DNA, 19 bp, Homo sapiens
aatgaaaggaagaaaccac

SEQ ID NO: 106330 - DNA, 23 bp, Homo sapiens
gactctcactctgtcacccaggc

SEQ ID NO: 106331 - DNA, 21 bp, Homo sapiens
aagtatctatatgtataagct

SEQ ID NO: 106332 - DNA, 22 bp, Homo sapiens
taggtatctatacatatgtata

SEQ ID NO: 106333 - DNA, 23 bp, Homo sapiens
tctctggattagaagatttaatt

SEQ ID NO: 106334 - DNA, 23 bp, Homo sapiens
tcccaggactagtgattttcaag

SEQ ID NO: 106335 - DNA, 22 bp, Homo sapiens
tctatgtatatgtatatatgtg

SEQ ID NO: 106336 - DNA, 23 bp, Homo sapiens
ttctgctgttgataacagtctgt

SEQ ID NO: 106337 - DNA, 23 bp, Homo sapiens
tggagtctcactctgtcacccag

SEQ ID NO: 106338 - DNA, 23 bp, Homo sapiens
ggagtctcactctgtctcccagg

SEQ ID NO: 106339 - DNA, 23 bp, Homo sapiens
tgagttcattgtagattctggat

SEQ ID NO: 106340 - DNA, 23 bp, Homo sapiens
tgagttcattgtagattctggat

SEQ ID NO: 106341 - DNA, 23 bp, Homo sapiens
taacatgttgatatggtttggct

SEQ ID NO: 106342 - DNA, 23 bp, Homo sapiens
cacagtctcactctgtcacccag

SEQ ID NO: 106343 - DNA, 23 bp, Homo sapiens
agaagaggatttggaaccagctt

SEQ ID NO: 106344 - DNA, 21 bp, Homo sapiens
atgggttatcttccttatttt

SEQ ID NO: 106345 - DNA, 19 bp, Homo sapiens
acagtcatggtagaaggtg

SEQ ID NO: 106346 - DNA, 23 bp, Homo sapiens
agtctcgctcactcagtgctcaa

SEQ ID NO: 106347 - DNA, 23 bp, Homo sapiens
gagggtctcactctgtcatccag

SEQ ID NO: 106348 - DNA, 21 bp, Homo sapiens
tatgtatatatatatgtgtgt

SEQ ID NO: 106349 - DNA, 23 bp, Homo sapiens
acagacagaacagtgtgtggaga

SEQ ID NO: 106350 - DNA, 23 bp, Homo sapiens
tgtctgtgtgtgtgtgcatgcat

SEQ ID NO: 106351 - DNA, 22 bp, Homo sapiens
aatgactctgttggatatgtcc

SEQ ID NO: 106352 - DNA, 20 bp, Homo sapiens
acgaaaagtcatcagaacgc

SEQ ID NO: 106353 - DNA, 20 bp, Homo sapiens
acctgggactacaggcacac

SEQ ID NO: 106354 - DNA, 19 bp, Homo sapiens
tttttgtacagatggggtt

SEQ ID NO: 106355 - DNA, 19 bp, Homo sapiens
tctgcattatggtgaattg

SEQ ID NO: 106356 - DNA, 20 bp, Homo sapiens
taatgcacttgaatcctcct

SEQ ID NO: 106357 - DNA, 20 bp, Homo sapiens
tgaggtaggaggatcacttg

SEQ ID NO: 106358 - DNA, 23 bp, Homo sapiens
agacagggtctcgctgtgttctg

SEQ ID NO: 106359 - DNA, 22 bp, Homo sapiens
tatatgagtgcatgtatgtagt

SEQ ID NO: 106360 - DNA, 23 bp, Homo sapiens
gagacggagtctcgctctgtcac

SEQ ID NO: 106361 - DNA, 23 bp, Homo sapiens
ccaagtctcactctgtcacccag

SEQ ID NO: 106362 - DNA, 21 bp, Homo sapiens
tcacaggcactcactgtgtgt

SEQ ID NO: 106363 - DNA, 23 bp, Homo sapiens
tgtctgtctgtctgtctgtcttt

SEQ ID NO: 106364 - DNA, 23 bp, Homo sapiens
gccagtgatgagagttgctgttc

SEQ ID NO: 106365 - DNA, 23 bp, Homo sapiens
attctctgagttaatgtgtggtt

SEQ ID NO: 106366 - DNA, 23 bp, Homo sapiens
ttttttgaatacattgtgtttct

SEQ ID NO: 106367 - DNA, 18 bp, Homo sapiens
cagtgcttttccattcat

SEQ ID NO: 106368 - DNA, 23 bp, Homo sapiens
tatctatgtatatatatgtgtgt

SEQ ID NO: 106369 - DNA, 23 bp, Homo sapiens
tgtctcaccctgtgacttagaat

SEQ ID NO: 106370 - DNA, 19 bp, Homo sapiens
taggtctcagcctcatttt

SEQ ID NO: 106371 - DNA, 23 bp, Homo sapiens
atctgagacagcttatattcttt

SEQ ID NO: 106372 - DNA, 23 bp, Homo sapiens
ggagtctcactctgtctcccagg

SEQ ID NO: 106373 - DNA, 23 bp, Homo sapiens
cacgcatgtttgtgtatgtgtat

SEQ ID NO: 106374 - DNA, 23 bp, Homo sapiens
tgagagatggagagaatgggaca

SEQ ID NO: 106375 - DNA, 22 bp, Homo sapiens
gactcagtctctctctctctct

SEQ ID NO: 106376 - DNA, 23 bp, Homo sapiens
tgactattgttggtgtatgggaa

SEQ ID NO: 106377 - DNA, 23 bp, Homo sapiens
agagtctcacactgtcacccagg

SEQ ID NO: 106378 - DNA, 20 bp, Homo sapiens
ttgagatgaggttaagattt

SEQ ID NO: 106379 - DNA, 20 bp, Homo sapiens
tatatgtatgtatttatgta

SEQ ID NO: 106380 - DNA, 22 bp, Homo sapiens
acataatatatgtatatgtatc

SEQ ID NO: 106381 - DNA, 22 bp, Homo sapiens
tatgcctgagtaagtaaagact

SEQ ID NO: 106382 - DNA, 23 bp, Homo sapiens
tgttcaaatcagagcttgctttg

SEQ ID NO: 106383 - DNA, 23 bp, Homo sapiens
agccagagagatctgggttctga

SEQ ID NO: 106384 - DNA, 23 bp, Homo sapiens
gacagagtctcgctctgtcaccc

SEQ ID NO: 106385 - DNA, 19 bp, Homo sapiens
cagtggagagtgtctccca

SEQ ID NO: 106386 - DNA, 23 bp, Homo sapiens
gagactcagtctttctgtgtctg

SEQ ID NO: 106387 - DNA, 23 bp, Homo sapiens
acactctcactcactctcgctga

SEQ ID NO: 106388 - DNA, 20 bp, Homo sapiens
ttcacagctaattcttttct

SEQ ID NO: 106389 - DNA, 22 bp, Homo sapiens
tctcagtgattatctctaggtg

SEQ ID NO: 106390 - DNA, 22 bp, Homo sapiens
tgccaggctctatctctgactc

SEQ ID NO: 106391 - DNA, 23 bp, Homo sapiens
cctctgacagatgagagtgggaa

SEQ ID NO: 106392 - DNA, 23 bp, Homo sapiens
acaggatctggctctgttgctca

SEQ ID NO: 106393 - DNA, 23 bp, Homo sapiens
tggagtctcactctgtcacccag

SEQ ID NO: 106394 - DNA, 23 bp, Homo sapiens
gggctctgtgtttctctccgtgt

SEQ ID NO: 106395 - DNA, 23 bp, Homo sapiens
tagtgtgtgtgttcttgtcttag

SEQ ID NO: 106396 - DNA, 23 bp, Homo sapiens
tgcctgactccctttctctcact

SEQ ID NO: 106397 - DNA, 23 bp, Homo sapiens
atgcagtgtgttaagagtgagct

SEQ ID NO: 106398 - DNA, 23 bp, Homo sapiens
gtgagcctgtgtctgtgcctgac

SEQ ID NO: 106399 - DNA, 23 bp, Homo sapiens
taatctcctattatttttatctg

SEQ ID NO: 106400 - DNA, 23 bp, Homo sapiens
tgtgtatctctgtgtgtgtgtgt

SEQ ID NO: 106401 - DNA, 23 bp, Homo sapiens
ggcttagttttctccttaatctg

SEQ ID NO: 106402 - DNA, 23 bp, Homo sapiens
ctctgtgtctctgaatagctgga

SEQ ID NO: 106403 - DNA, 23 bp, Homo sapiens
gagacagggtctctgtcacccag

SEQ ID NO: 106404 - DNA, 19 bp, Homo sapiens
gtatgtatgtatgtgtgtg

SEQ ID NO: 106405 - DNA, 19 bp, Homo sapiens
tacatgttgatgtatacat

SEQ ID NO: 106406 - DNA, 23 bp, Homo sapiens
catttatgtgtgtgtgtacatct

SEQ ID NO: 106407 - DNA, 21 bp, Homo sapiens
tgtctatatatgtatatatgt

SEQ ID NO: 106408 - DNA, 20 bp, Homo sapiens
tatatgtggcatgtatatac

SEQ ID NO: 106409 - DNA, 23 bp, Homo sapiens
tggcatgtatatatgtatgtatc

SEQ ID NO: 106410 - DNA, 22 bp, Homo sapiens
tatctgtggcatttatatatgt

SEQ ID NO: 106411 - DNA, 18 bp, Homo sapiens
tctatgtggcatgtatat

SEQ ID NO: 106412 - DNA, 22 bp, Homo sapiens
tatatgtggcatgtatatttgt

SEQ ID NO: 106413 - DNA, 23 bp, Homo sapiens
agcatgtatctatatgtatatat

SEQ ID NO: 106414 - DNA, 22 bp, Homo sapiens
tatgtggcgtttatatatgtat

SEQ ID NO: 106415 - DNA, 19 bp, Homo sapiens
tatgtggcgtttatatatg

SEQ ID NO: 106416 - DNA, 23 bp, Homo sapiens
gagacagagtctcgctctgttgc

SEQ ID NO: 106417 - DNA, 23 bp, Homo sapiens
agagcaggtgttcctgtctctga

SEQ ID NO: 106418 - DNA, 22 bp, Homo sapiens
acacatgtgtgtttgtacatgt

SEQ ID NO: 106419 - DNA, 21 bp, Homo sapiens
agagagtctggttacacaggg

SEQ ID NO: 106420 - DNA, 23 bp, Homo sapiens
gcagagctttgctcttgttgccc

SEQ ID NO: 106421 - DNA, 23 bp, Homo sapiens
tatgagacaggatctcactgtgt

SEQ ID NO: 106422 - DNA, 22 bp, Homo sapiens
acaggctgcctcagtgcctcag

SEQ ID NO: 106423 - DNA, 23 bp, Homo sapiens
gacagggtctcactctctgtcgc

SEQ ID NO: 106424 - DNA, 20 bp, Homo sapiens
tgtgtatatataaaattgtg

SEQ ID NO: 106425 - DNA, 23 bp, Homo sapiens
agacagtgtctcactctgcctct

SEQ ID NO: 106426 - DNA, 20 bp, Homo sapiens
tgaggtaggaggatcacttg

SEQ ID NO: 106427 - DNA, 23 bp, Homo sapiens
gggtctcactctgtcacccaggc

SEQ ID NO: 106428 - DNA, 22 bp, Homo sapiens
ttgagacacagtctcgctctgt

SEQ ID NO: 106429 - DNA, 19 bp, Homo sapiens
gaaggcttagaagagtgtg

SEQ ID NO: 106430 - DNA, 21 bp, Homo sapiens
aaagcttctaggttgtcttgt

SEQ ID NO: 106431 - DNA, 23 bp, Homo sapiens
ttcttcaaaagttttgaagttgg

SEQ ID NO: 106432 - DNA, 23 bp, Homo sapiens
tgagttcattgtagattctggat

SEQ ID NO: 106433 - DNA, 23 bp, Homo sapiens
tgagttcattgtagattctggat

SEQ ID NO: 106434 - DNA, 23 bp, Homo sapiens
tgagagtagagattgtgctcagc

SEQ ID NO: 106435 - DNA, 18 bp, Homo sapiens
tggcactgtcactgggcc

SEQ ID NO: 106436 - DNA, 23 bp, Homo sapiens
tgaggcagggtctcgctctgttg

SEQ ID NO: 106437 - DNA, 20 bp, Homo sapiens
atatgtgtacagtgtgtgca

SEQ ID NO: 106438 - DNA, 23 bp, Homo sapiens
tttgcttttcttccctgaggctg

SEQ ID NO: 106439 - DNA, 23 bp, Homo sapiens
tctgtccgtggctccctgagtca

SEQ ID NO: 106440 - DNA, 23 bp, Homo sapiens
acagagtctcactctgtcgccca

SEQ ID NO: 106441 - DNA, 23 bp, Homo sapiens
catgactcactgcagtctcagcc

SEQ ID NO: 106442 - DNA, 23 bp, Homo sapiens
ttttgagacggagtctcaccctt

SEQ ID NO: 106443 - DNA, 21 bp, Homo sapiens
tgaggtaggaggatcacttga

SEQ ID NO: 106444 - DNA, 19 bp, Homo sapiens
aatttgtagagcatggtgg

SEQ ID NO: 106445 - DNA, 18 bp, Homo sapiens
atgtgcctgcagtatcag

SEQ ID NO: 106446 - DNA, 23 bp, Homo sapiens
tctcactcactctgtcagccaca

SEQ ID NO: 106447 - DNA, 22 bp, Homo sapiens
tcacttgcattttgtttatttt

SEQ ID NO: 106448 - DNA, 23 bp, Homo sapiens
tgagacagagtctcgctctgtca

SEQ ID NO: 106449 - DNA, 22 bp, Homo sapiens
gtgtctatgtctgtgtccatat

SEQ ID NO: 106450 - DNA, 23 bp, Homo sapiens
gaatctcactctgtcacccaggc

SEQ ID NO: 106451 - DNA, 23 bp, Homo sapiens
ttttctgagaaaggtattgttat

SEQ ID NO: 106452 - DNA, 21 bp, Homo sapiens
tctcccactctgtgagttgat

SEQ ID NO: 106453 - DNA, 20 bp, Homo sapiens
tctgaggatgggactctact

SEQ ID NO: 106454 - DNA, 23 bp, Homo sapiens
ttgagacagggtctcactctgtt

SEQ ID NO: 106455 - DNA, 23 bp, Homo sapiens
tcagctttttcaggttgaagtgc

SEQ ID NO: 106456 - DNA, 20 bp, Homo sapiens
tgagacagagactcccactg

SEQ ID NO: 106457 - DNA, 21 bp, Homo sapiens
tatgtgtgtatatatgtgtgt

SEQ ID NO: 106458 - DNA, 23 bp, Homo sapiens
agtgagaagagacaggggacatg

SEQ ID NO: 106459 - DNA, 23 bp, Homo sapiens
ttgaggtggagtctcgctctgtc

SEQ ID NO: 106460 - DNA, 20 bp, Homo sapiens
gacagagtctcgctctgtcg

SEQ ID NO: 106461 - DNA, 19 bp, Homo sapiens
agacagggtctctctgtgt

SEQ ID NO: 106462 - DNA, 20 bp, Homo sapiens
atctccaaaaaaaagagaga

SEQ ID NO: 106463 - DNA, 23 bp, Homo sapiens
acggagtctcgctctgtcaccca

SEQ ID NO: 106464 - DNA, 23 bp, Homo sapiens
gagacagagtctggctctgtcac

SEQ ID NO: 106465 - DNA, 23 bp, Homo sapiens
cggagtctcactctgtcacccag

SEQ ID NO: 106466 - DNA, 18 bp, Homo sapiens
agaggaaggagcctgttt

SEQ ID NO: 106467 - DNA, 23 bp, Homo sapiens
aagccttacactcagaaagtata

SEQ ID NO: 106468 - DNA, 19 bp, Homo sapiens
tgaggcaggaggatctttt

SEQ ID NO: 106469 - DNA, 21 bp, Homo sapiens
tgaggtaggaggatcacttga

SEQ ID NO: 106470 - DNA, 23 bp, Homo sapiens
tacacacacacatatgtatacac

SEQ ID NO: 106471 - DNA, 23 bp, Homo sapiens
tgtgcgtatatatatgtatgtgt

SEQ ID NO: 106472 - DNA, 23 bp, Homo sapiens
gagcctcactgtgtctcagggct

SEQ ID NO: 106473 - DNA, 21 bp, Homo sapiens
agcagatcagactggaaccag

SEQ ID NO: 106474 - DNA, 19 bp, Homo sapiens
tttttctatgtttgctggt

SEQ ID NO: 106475 - DNA, 23 bp, Homo sapiens
acttaagttggacatcttcaaat

SEQ ID NO: 106476 - DNA, 20 bp, Homo sapiens
attgagatggagccttgctg

SEQ ID NO: 106477 - DNA, 21 bp, Homo sapiens
gtagagagtgtttactgtatc

SEQ ID NO: 106478 - DNA, 23 bp, Homo sapiens
tgaaaattttttttgctgtggga

SEQ ID NO: 106479 - DNA, 23 bp, Homo sapiens
tcagtcattctctctgagccttc

SEQ ID NO: 106480 - DNA, 18 bp, Homo sapiens
atgtacgttatatataca

SEQ ID NO: 106481 - DNA, 19 bp, Homo sapiens
atgtatatatacatgtata

SEQ ID NO: 106482 - DNA, 23 bp, Homo sapiens
gatttgattatttgaattcctgt

SEQ ID NO: 106483 - DNA, 20 bp, Homo sapiens
ttctgatctgtgaaagctga

SEQ ID NO: 106484 - DNA, 23 bp, Homo sapiens
tatgttcattttgtatcctgtaa

SEQ ID NO: 106485 - DNA, 23 bp, Homo sapiens
ttttagtggagtccttaggtttt

SEQ ID NO: 106486 - DNA, 23 bp, Homo sapiens
gacagagtctcgctctgtcaccc

SEQ ID NO: 106487 - DNA, 23 bp, Homo sapiens
acctaggagtggaattgtagtca

SEQ ID NO: 106488 - DNA, 21 bp, Homo sapiens
tttgttgttcttaagctgtca

SEQ ID NO: 106489 - DNA, 22 bp, Homo sapiens
aaatcatacttagtaaatgtgt

SEQ ID NO: 106490 - DNA, 23 bp, Homo sapiens
tgagactatctcactctgtcacc

SEQ ID NO: 106491 - DNA, 22 bp, Homo sapiens
gtctcgctcactcagtgctcaa

SEQ ID NO: 106492 - DNA, 23 bp, Homo sapiens
gagaccctgtctcaaaaacataa

SEQ ID NO: 106493 - DNA, 23 bp, Homo sapiens
tggagtctcactctgtcacccag

SEQ ID NO: 106494 - DNA, 23 bp, Homo sapiens
cctgggtgacagagcgagactcc

SEQ ID NO: 106495 - DNA, 23 bp, Homo sapiens
atattgctacatcacccaggcta

SEQ ID NO: 106496 - DNA, 21 bp, Homo sapiens
tgagatggagtctcgctctgt

SEQ ID NO: 106497 - DNA, 23 bp, Homo sapiens
gagtctcactctgtcaccctggc

SEQ ID NO: 106498 - DNA, 22 bp, Homo sapiens
cctgtcacagtcagtttgggga

SEQ ID NO: 106499 - DNA, 23 bp, Homo sapiens
ttgtacagagaattatttatgag

SEQ ID NO: 106500 - DNA, 22 bp, Homo sapiens
tgtcacaagtgagtgagctgaa

SEQ ID NO: 106501 - DNA, 23 bp, Homo sapiens
tgagtttgttacaaaaatgaggt

SEQ ID NO: 106502 - DNA, 23 bp, Homo sapiens
cactctctcaccatgtgatgtct

SEQ ID NO: 106503 - DNA, 23 bp, Homo sapiens
actccctcagtctcacaccagat

SEQ ID NO: 106504 - DNA, 23 bp, Homo sapiens
tgagttcattgtagattctggat

SEQ ID NO: 106505 - DNA, 23 bp, Homo sapiens
tgagttcattgtagattctggat

SEQ ID NO: 106506 - DNA, 23 bp, Homo sapiens
agaggagagcgaagactgtgctc

SEQ ID NO: 106507 - DNA, 23 bp, Homo sapiens
tataacagcacctaatcaaggga

SEQ ID NO: 106508 - DNA, 23 bp, Homo sapiens
gtgtctgtgtctgtgtgtgtatg

SEQ ID NO: 106509 - DNA, 19 bp, Homo sapiens
tatttagtagagatggggt

SEQ ID NO: 106510 - DNA, 19 bp, Homo sapiens
gagagatatatatatctca

SEQ ID NO: 106511 - DNA, 23 bp, Homo sapiens
tctgtgtgtgtgtgtgtgtatcc

SEQ ID NO: 106512 - DNA, 23 bp, Homo sapiens
agacatggaggaactctgaatgc

SEQ ID NO: 106513 - DNA, 23 bp, Homo sapiens
taaggtacatgtttgtcagattg

SEQ ID NO: 106514 - DNA, 23 bp, Homo sapiens
gttaaagctgccttcccaaatca

SEQ ID NO: 106515 - DNA, 23 bp, Homo sapiens
gcactccagtctgggtgacagag

SEQ ID NO: 106516 - DNA, 22 bp, Homo sapiens
tttgagacagggtctcattttg

SEQ ID NO: 106517 - DNA, 23 bp, Homo sapiens
tgtgtgtatatatatgtgtgtgt

SEQ ID NO: 106518 - DNA, 20 bp, Homo sapiens
tatgtatatatatgtgtgtg

SEQ ID NO: 106519 - DNA, 23 bp, Homo sapiens
tctattgagtcagagtatctttt

SEQ ID NO: 106520 - DNA, 23 bp, Homo sapiens
tgagatggagtctcactcacttt

SEQ ID NO: 106521 - DNA, 23 bp, Homo sapiens
acagggtctcactctgtcaccca

SEQ ID NO: 106522 - DNA, 23 bp, Homo sapiens
gggtctcactctgtcacccaggc

SEQ ID NO: 106523 - DNA, 23 bp, Homo sapiens
gggtctcactctgtcacccaggc

SEQ ID NO: 106524 - DNA, 23 bp, Homo sapiens
tctgtcaccctgactagagtgca

SEQ ID NO: 106525 - DNA, 19 bp, Homo sapiens
agagaggcagaagatggcc

SEQ ID NO: 106526 - DNA, 23 bp, Homo sapiens
aaaggcacttcatcttttattct

SEQ ID NO: 106527 - DNA, 23 bp, Homo sapiens
tgagttcattgtagattctggat

SEQ ID NO: 106528 - DNA, 23 bp, Homo sapiens
tgagttcattgtagattctggat

SEQ ID NO: 106529 - DNA, 22 bp, Homo sapiens
aatatacatattgtattacatg

SEQ ID NO: 106530 - DNA, 23 bp, Homo sapiens
atgtctgtatatctttatctgtg

SEQ ID NO: 106531 - DNA, 23 bp, Homo sapiens
taccaaatgcttatactcctgtt

SEQ ID NO: 106532 - DNA, 19 bp, Homo sapiens
aagggaatggcttttctca

SEQ ID NO: 106533 - DNA, 20 bp, Homo sapiens
atatatgtatatatgtatac

SEQ ID NO: 106534 - DNA, 23 bp, Homo sapiens
tgtgtatatgtatacatatatgt

SEQ ID NO: 106535 - DNA, 23 bp, Homo sapiens
tgggtgacacagtgagactgtct

SEQ ID NO: 106536 - DNA, 23 bp, Homo sapiens
tgacagttcttactgttgtgaca

SEQ ID NO: 106537 - DNA, 22 bp, Homo sapiens
aatgtaggtggtgataagtttt

SEQ ID NO: 106538 - DNA, 19 bp, Homo sapiens
attatactttaagttctag

SEQ ID NO: 106539 - DNA, 18 bp, Homo sapiens
tgtgtgtgtatgtgtctg

SEQ ID NO: 106540 - DNA, 23 bp, Homo sapiens
gacagagtctcactctgttgcca

SEQ ID NO: 106541 - DNA, 20 bp, Homo sapiens
tgtgtgaatatgtgtacata

SEQ ID NO: 106542 - DNA, 22 bp, Homo sapiens
attgacagtcattttctctcag

SEQ ID NO: 106543 - DNA, 22 bp, Homo sapiens
ttattgctatggatatgtctgc

SEQ ID NO: 106544 - DNA, 23 bp, Homo sapiens
gtatacatgtgtatgtatacata

SEQ ID NO: 106545 - DNA, 23 bp, Homo sapiens
aaaaatgtgtttttcttgttggt

SEQ ID NO: 106546 - DNA, 23 bp, Homo sapiens
tcaaccaacattattaattcagt

SEQ ID NO: 106547 - DNA, 18 bp, Homo sapiens
agagtctataggtgtttg

SEQ ID NO: 106548 - DNA, 23 bp, Homo sapiens
tgggtggctctctgtgtgcctgg

SEQ ID NO: 106549 - DNA, 23 bp, Homo sapiens
tatgtgtatatatagaaatgtgt

SEQ ID NO: 106550 - DNA, 20 bp, Homo sapiens
aaaaagtcttctcccagtct

SEQ ID NO: 106551 - DNA, 23 bp, Homo sapiens
tgagttcattgtagattctggat

SEQ ID NO: 106552 - DNA, 23 bp, Homo sapiens
tgagttcattgtagattctggat

SEQ ID NO: 106553 - DNA, 22 bp, Homo sapiens
tgaggtctctgcttttgaactg

SEQ ID NO: 106554 - DNA, 22 bp, Homo sapiens
ctctctctctctgcctctattc

SEQ ID NO: 106555 - DNA, 22 bp, Homo sapiens
ctgtgaagagagtgtggtcaga

SEQ ID NO: 106556 - DNA, 23 bp, Homo sapiens
gtgtaacagcaactccatgtgga

SEQ ID NO: 106557 - DNA, 23 bp, Homo sapiens
ttccagtggagatgctgttactt

SEQ ID NO: 106558 - DNA, 23 bp, Homo sapiens
atgacctatgaattgacagacaa

SEQ ID NO: 106559 - DNA, 21 bp, Homo sapiens
ttttgagacggaatcttgctc

SEQ ID NO: 106560 - DNA, 21 bp, Homo sapiens
agctttatcacttattgtagg

SEQ ID NO: 106561 - DNA, 23 bp, Homo sapiens
tgagcatttgaaatgtgattgtg

SEQ ID NO: 106562 - DNA, 23 bp, Homo sapiens
tgcctgactgcctgactcactct

SEQ ID NO: 106563 - DNA, 21 bp, Homo sapiens
tgtgaagaaagtcattggtag

SEQ ID NO: 106564 - DNA, 21 bp, Homo sapiens
tttcatgaatatatgtatttg

SEQ ID NO: 106565 - DNA, 23 bp, Homo sapiens
tctgtcatcttttgcacctctaa

SEQ ID NO: 106566 - DNA, 23 bp, Homo sapiens
ggactcaggatagctgcctgtat

SEQ ID NO: 106567 - DNA, 23 bp, Homo sapiens
tgagttcattgtagattctggat

SEQ ID NO: 106568 - DNA, 23 bp, Homo sapiens
tgagttcattgtagattctggat

SEQ ID NO: 106569 - DNA, 23 bp, Homo sapiens
atctccaagaaagatcttgggaa

SEQ ID NO: 106570 - DNA, 23 bp, Homo sapiens
agtgacttgagtgagaggcaaat

SEQ ID NO: 106571 - DNA, 23 bp, Homo sapiens
tgagttcattgtagattctggat

SEQ ID NO: 106572 - DNA, 23 bp, Homo sapiens
tgagttcattgtagattctggat

SEQ ID NO: 106573 - DNA, 23 bp, Homo sapiens
tgtggaaatgttttccctgcaaa

SEQ ID NO: 106574 - DNA, 23 bp, Homo sapiens
tttgtgtcagtttatctattaat

SEQ ID NO: 106575 - DNA, 23 bp, Homo sapiens
tagtactgtatttctttttttgt

SEQ ID NO: 106576 - DNA, 21 bp, Homo sapiens
aagcaacatttactaatggga

SEQ ID NO: 106577 - DNA, 21 bp, Homo sapiens
acacatgtatgtatatgtaga

SEQ ID NO: 106578 - DNA, 23 bp, Homo sapiens
atgagtctcactctgacacccag

SEQ ID NO: 106579 - DNA, 23 bp, Homo sapiens
tggtgctgtgatcttgactcact

SEQ ID NO: 106580 - DNA, 18 bp, Homo sapiens
cagaacaattctctatct

SEQ ID NO: 106581 - DNA, 23 bp, Homo sapiens
gacagagtctcgctctgtcaccc

SEQ ID NO: 106582 - DNA, 23 bp, Homo sapiens
tggagtctcactctgtcacccag

SEQ ID NO: 106583 - DNA, 23 bp, Homo sapiens
gacaaccagattgagtcacaatt

SEQ ID NO: 106584 - DNA, 23 bp, Homo sapiens
agagagagtctcactctgttgcc

SEQ ID NO: 106585 - DNA, 23 bp, Homo sapiens
agtgtgattctctcagtttgtca

SEQ ID NO: 106586 - DNA, 23 bp, Homo sapiens
tagattagtgtttttcctgaagt

SEQ ID NO: 106587 - DNA, 23 bp, Homo sapiens
tgtgtgtgtatatatatgtgtgt

SEQ ID NO: 106588 - DNA, 22 bp, Homo sapiens
aggggctagtgtgtcagctctg

SEQ ID NO: 106589 - DNA, 23 bp, Homo sapiens
tgtgtgtgtgtctctctctgcca

SEQ ID NO: 106590 - DNA, 23 bp, Homo sapiens
tgtcactctgtctatgtgcatta

SEQ ID NO: 106591 - DNA, 21 bp, Homo sapiens
atatgcatatgaaagaaaatt

SEQ ID NO: 106592 - DNA, 23 bp, Homo sapiens
atatatgcatatgtatatgttca

SEQ ID NO: 106593 - DNA, 23 bp, Homo sapiens
tgagactctgtctcaaaaagggg

SEQ ID NO: 106594 - DNA, 23 bp, Homo sapiens
tgagacagagtctcgctctgtcg

SEQ ID NO: 106595 - DNA, 23 bp, Homo sapiens
ggagtctctctctgtcacccagg

SEQ ID NO: 106596 - DNA, 23 bp, Homo sapiens
attctgactggcaaagatgtatc

SEQ ID NO: 106597 - DNA, 23 bp, Homo sapiens
tgagatggagtctcgctctgtca

SEQ ID NO: 106598 - DNA, 23 bp, Homo sapiens
tgagttcattgtagattctggat

SEQ ID NO: 106599 - DNA, 23 bp, Homo sapiens
tgagttcattgtagattctggat

SEQ ID NO: 106600 - DNA, 19 bp, Homo sapiens
ctattcagagtcttgacga

SEQ ID NO: 106601 - DNA, 23 bp, Homo sapiens
tgtctggcactgtgcctggctct

SEQ ID NO: 106602 - DNA, 23 bp, Homo sapiens
tacacacacctatttattgtgtg

SEQ ID NO: 106603 - DNA, 18 bp, Homo sapiens
gctagtatattgtatgtt

SEQ ID NO: 106604 - DNA, 20 bp, Homo sapiens
tgcatattatatacgtattg

SEQ ID NO: 106605 - DNA, 23 bp, Homo sapiens
gaaaagatactagtttgagccaa

SEQ ID NO: 106606 - DNA, 21 bp, Homo sapiens
ttaattcttgtttaggtagtg

SEQ ID NO: 106607 - DNA, 23 bp, Homo sapiens
tttcccatgattatccattgttt

SEQ ID NO: 106608 - DNA, 23 bp, Homo sapiens
tgataaccttcttttctgtccct

SEQ ID NO: 106609 - DNA, 19 bp, Homo sapiens
tgtctctgactctcttcag

SEQ ID NO: 106610 - DNA, 23 bp, Homo sapiens
tgtctctgtgagtattttatgac

SEQ ID NO: 106611 - DNA, 23 bp, Homo sapiens
gttgtagacagaagagtctctgc

SEQ ID NO: 106612 - DNA, 20 bp, Homo sapiens
ccatatattatatatctgtg

SEQ ID NO: 106613 - DNA, 23 bp, Homo sapiens
atataatactagtcctacagtgt

SEQ ID NO: 106614 - DNA, 23 bp, Homo sapiens
agtgagaacactgtgtgctgtgc

SEQ ID NO: 106615 - DNA, 18 bp, Homo sapiens
acacacacacatacacaa

SEQ ID NO: 106616 - DNA, 23 bp, Homo sapiens
tgtgactagttgaagagtgaggc

SEQ ID NO: 106617 - DNA, 23 bp, Homo sapiens
aggtttgttgactgcttctcctt

SEQ ID NO: 106618 - DNA, 23 bp, Homo sapiens
tgggagtggattagttatcatga

SEQ ID NO: 106619 - DNA, 23 bp, Homo sapiens
aatacttgtaagagttttgactt

SEQ ID NO: 106620 - DNA, 23 bp, Homo sapiens
gaaaagagcttattctgtacaga

SEQ ID NO: 106621 - DNA, 22 bp, Homo sapiens
gtacatacacacactatatact

SEQ ID NO: 106622 - DNA, 23 bp, Homo sapiens
taagacttcaggctctagagccc

SEQ ID NO: 106623 - DNA, 23 bp, Homo sapiens
ctctgctactctgtcactgagaa

SEQ ID NO: 106624 - DNA, 23 bp, Homo sapiens
tgtatagttttttgaggaactac

SEQ ID NO: 106625 - DNA, 23 bp, Homo sapiens
acagcagctatattttacagttt

SEQ ID NO: 106626 - DNA, 20 bp, Homo sapiens
tgaggttctgtgtggacata

SEQ ID NO: 106627 - DNA, 19 bp, Homo sapiens
tcttttagacagggtctca

SEQ ID NO: 106628 - DNA, 22 bp, Homo sapiens
tttctgcatctatttagataat

SEQ ID NO: 106629 - DNA, 23 bp, Homo sapiens
taatatgaagatgtcattgtttg

SEQ ID NO: 106630 - DNA, 22 bp, Homo sapiens
ctctggtttaagtatcaggtat

SEQ ID NO: 106631 - DNA, 22 bp, Homo sapiens
ctgttgtcagtgtcactcacac

SEQ ID NO: 106632 - DNA, 23 bp, Homo sapiens
agacacagtctcgctctgtcacc

SEQ ID NO: 106633 - DNA, 23 bp, Homo sapiens
gagtgtggatagagaagagaaga

SEQ ID NO: 106634 - DNA, 22 bp, Homo sapiens
tcactgcatcttgtatttatgt

SEQ ID NO: 106635 - DNA, 23 bp, Homo sapiens
acactcactatatgtatttgttc

SEQ ID NO: 106636 - DNA, 23 bp, Homo sapiens
gtatctgtctgagatattttagg

SEQ ID NO: 106637 - DNA, 21 bp, Homo sapiens
tatcaaaaatgtcctagcaga

SEQ ID NO: 106638 - DNA, 22 bp, Homo sapiens
ttgtatcttgatcatgctgcta

SEQ ID NO: 106639 - DNA, 22 bp, Homo sapiens
tgtgtatatatgtatatgtgta

SEQ ID NO: 106640 - DNA, 23 bp, Homo sapiens
catgcacatgcacatatgtgtgt

SEQ ID NO: 106641 - DNA, 22 bp, Homo sapiens
cacactctctctctgattcctg

SEQ ID NO: 106642 - DNA, 20 bp, Homo sapiens
tacacctatatatattcaga

SEQ ID NO: 106643 - DNA, 20 bp, Homo sapiens
atatctgaatatatatacgt

SEQ ID NO: 106644 - DNA, 23 bp, Homo sapiens
tatctgagatgtatatatgtgta

SEQ ID NO: 106645 - DNA, 23 bp, Homo sapiens
atatctgagagatatatgtatgt

SEQ ID NO: 106646 - DNA, 23 bp, Homo sapiens
atgtgctttctgtctgtctgtct

SEQ ID NO: 106647 - DNA, 23 bp, Homo sapiens
tctgtctctctctcaattttgct

SEQ ID NO: 106648 - DNA, 22 bp, Homo sapiens
atatatgtacatttactagtgc

SEQ ID NO: 106649 - DNA, 20 bp, Homo sapiens
atatgtgtatatacatatgt

SEQ ID NO: 106650 - DNA, 20 bp, Homo sapiens
atatgtgtatatacatatgt

SEQ ID NO: 106651 - DNA, 20 bp, Homo sapiens
atatgtgtatatacatatgt

SEQ ID NO: 106652 - DNA, 23 bp, Homo sapiens
tgtgtatatatgtgtgtgtgtgt

SEQ ID NO: 106653 - DNA, 23 bp, Homo sapiens
ataaagagatgctgttttttttg

SEQ ID NO: 106654 - DNA, 20 bp, Homo sapiens
agtgagagaggttgacaaga

SEQ ID NO: 106655 - DNA, 23 bp, Homo sapiens
tgtctctctgtgattgttgtttt

SEQ ID NO: 106656 - DNA, 18 bp, Homo sapiens
gtgtgtctcgctgcccca

SEQ ID NO: 106657 - DNA, 19 bp, Homo sapiens
gagtagtggttaagagctt

SEQ ID NO: 106658 - DNA, 23 bp, Homo sapiens
tgtacttggttatgtctgtgagg

SEQ ID NO: 106659 - DNA, 22 bp, Homo sapiens
aagaggatctagttcacagaca

SEQ ID NO: 106660 - DNA, 23 bp, Homo sapiens
ggagtctcactctgtcactcagg

SEQ ID NO: 106661 - DNA, 22 bp, Homo sapiens
aatgtttcattttatatctgta

SEQ ID NO: 106662 - DNA, 20 bp, Homo sapiens
aggaagagtcagacctggga

SEQ ID NO: 106663 - DNA, 23 bp, Homo sapiens
tgtttccatctctgtctctcact

SEQ ID NO: 106664 - DNA, 22 bp, Homo sapiens
ttactgcatgatgttaggttga

SEQ ID NO: 106665 - DNA, 23 bp, Homo sapiens
agtctcactctgtcacccaggct

SEQ ID NO: 106666 - DNA, 22 bp, Homo sapiens
atgacagttcctgtttttgcct

SEQ ID NO: 106667 - DNA, 20 bp, Homo sapiens
aaacacactgagtgttcatg

SEQ ID NO: 106668 - DNA, 23 bp, Homo sapiens
ggagagcgacagtatttctcctt

SEQ ID NO: 106669 - DNA, 23 bp, Homo sapiens
agactgggtgtcactctgtcgcc

SEQ ID NO: 106670 - DNA, 21 bp, Homo sapiens
gtgagaacactgtgtgcacag

SEQ ID NO: 106671 - DNA, 23 bp, Homo sapiens
gggtgacagagtgagactctgct

SEQ ID NO: 106672 - DNA, 19 bp, Homo sapiens
agagaattcactgtgttgc

SEQ ID NO: 106673 - DNA, 23 bp, Homo sapiens
gagttgagagaggaagctctaat

SEQ ID NO: 106674 - DNA, 23 bp, Homo sapiens
cttgagacggagtctcactcttt

SEQ ID NO: 106675 - DNA, 23 bp, Homo sapiens
gacagtgtcactgaggctgtgct

SEQ ID NO: 106676 - DNA, 20 bp, Homo sapiens
cacagaggttagaggaaggg

SEQ ID NO: 106677 - DNA, 23 bp, Homo sapiens
agacggggtctgactgtgttgcc

SEQ ID NO: 106678 - DNA, 23 bp, Homo sapiens
aactttgtgtactgttacctttt

SEQ ID NO: 106679 - DNA, 23 bp, Homo sapiens
ttctgtgaagaaagtcaatggtg

SEQ ID NO: 106680 - DNA, 21 bp, Homo sapiens
aggagtctcactctgtcaccc

SEQ ID NO: 106681 - DNA, 23 bp, Homo sapiens
ccagagtgtgtgtgtctgtgcca

SEQ ID NO: 106682 - DNA, 23 bp, Homo sapiens
tattatttctgaatggaagtcac

SEQ ID NO: 106683 - DNA, 23 bp, Homo sapiens
ttatatgaactttaaaggagaat

SEQ ID NO: 106684 - DNA, 23 bp, Homo sapiens
tccctgattcaaaaggcttgtgt

SEQ ID NO: 106685 - DNA, 19 bp, Homo sapiens
aaggttttagaggaagaag

SEQ ID NO: 106686 - DNA, 20 bp, Homo sapiens
acaggattgagaggtgacag

SEQ ID NO: 106687 - DNA, 20 bp, Homo sapiens
ttattcaagtttgagatacc

SEQ ID NO: 106688 - DNA, 23 bp, Homo sapiens
cagactctctctcacacacaagg

SEQ ID NO: 106689 - DNA, 23 bp, Homo sapiens
tgagttcattgtagattctggat

SEQ ID NO: 106690 - DNA, 23 bp, Homo sapiens
tgagttcattgtagattctggat

SEQ ID NO: 106691 - DNA, 23 bp, Homo sapiens
ttccagttctcagagggaatgat

SEQ ID NO: 106692 - DNA, 20 bp, Homo sapiens
atacagcatatattttgtta

SEQ ID NO: 106693 - DNA, 19 bp, Homo sapiens
gagagaagagagacagacc

SEQ ID NO: 106694 - DNA, 22 bp, Homo sapiens
gttttatcctcagaaaaggcaa

SEQ ID NO: 106695 - DNA, 20 bp, Homo sapiens
agacagaagtgtcagagggc

SEQ ID NO: 106696 - DNA, 23 bp, Homo sapiens
tctatgaggctggtattcatata

SEQ ID NO: 106697 - DNA, 23 bp, Homo sapiens
gtgtctgtgtgtatttatgcatg

SEQ ID NO: 106698 - DNA, 18 bp, Homo sapiens
gtttatgcatgtgcatgt

SEQ ID NO: 106699 - DNA, 19 bp, Homo sapiens
tataacagagtgccataga

SEQ ID NO: 106700 - DNA, 18 bp, Homo sapiens
aagcatatgtatgtgtat

SEQ ID NO: 106701 - DNA, 21 bp, Homo sapiens
tatagtgtgtgtttatatccc

SEQ ID NO: 106702 - DNA, 23 bp, Homo sapiens
gtctcactgtcactcaggctggc

SEQ ID NO: 106703 - DNA, 18 bp, Homo sapiens
ttcttgatcgtgaccagg

SEQ ID NO: 106704 - DNA, 23 bp, Homo sapiens
ctctgtgtcaaaaccaagcttct

SEQ ID NO: 106705 - DNA, 23 bp, Homo sapiens
cagggtctcactctgtcacccag

SEQ ID NO: 106706 - DNA, 19 bp, Homo sapiens
tttcacatggtggcttaga

SEQ ID NO: 106707 - DNA, 23 bp, Homo sapiens
ctagcaccatttgaaatcagtgt

SEQ ID NO: 106708 - DNA, 20 bp, Homo sapiens
aaacaagatgagccagtttt

SEQ ID NO: 106709 - DNA, 23 bp, Homo sapiens
tttgtttgtttgttttagacgga

SEQ ID NO: 106710 - DNA, 23 bp, Homo sapiens
tgagttcattgtagattctggat

SEQ ID NO: 106711 - DNA, 23 bp, Homo sapiens
tgagttcattgtagattctggat

SEQ ID NO: 106712 - DNA, 19 bp, Homo sapiens
ttgagacagagtcttgttt

SEQ ID NO: 106713 - DNA, 20 bp, Homo sapiens
tacatgtgcagaatgtgcag

SEQ ID NO: 106714 - DNA, 23 bp, Homo sapiens
ttttgagacggagtcttgctctg

SEQ ID NO: 106715 - DNA, 20 bp, Homo sapiens
atgtatatatacatatgtat

SEQ ID NO: 106716 - DNA, 19 bp, Homo sapiens
tatctagctgtcccataga

SEQ ID NO: 106717 - DNA, 20 bp, Homo sapiens
gcagatatctggctcgacca

SEQ ID NO: 106718 - DNA, 23 bp, Homo sapiens
aacagtgggtgcttttgaagata

SEQ ID NO: 106719 - DNA, 23 bp, Homo sapiens
tgacttcaatatcatttgggatt

SEQ ID NO: 106720 - DNA, 23 bp, Homo sapiens
ttagtgtgttcttcttttcactc

SEQ ID NO: 106721 - DNA, 20 bp, Homo sapiens
agaccttgttgcttccacag

SEQ ID NO: 106722 - DNA, 21 bp, Homo sapiens
agaagtaggactttctttaga

SEQ ID NO: 106723 - DNA, 19 bp, Homo sapiens
tgagacagagtctcactct

SEQ ID NO: 106724 - DNA, 23 bp, Homo sapiens
tcaggggcacttgattgcttgtt

SEQ ID NO: 106725 - DNA, 19 bp, Homo sapiens
aaagagcaggaaaaaggaa

SEQ ID NO: 106726 - DNA, 23 bp, Homo sapiens
ccactcagtttctctgtgaaaga

SEQ ID NO: 106727 - DNA, 23 bp, Homo sapiens
tgactctgggtctctgtggctgt

SEQ ID NO: 106728 - DNA, 23 bp, Homo sapiens
acaaggtctcactctgtcaccca

SEQ ID NO: 106729 - DNA, 20 bp, Homo sapiens
tgcacacacacacagaggca

SEQ ID NO: 106730 - DNA, 21 bp, Homo sapiens
ctctcagcctctgtttccagt

SEQ ID NO: 106731 - DNA, 20 bp, Homo sapiens
cataagacaggttttctttt

SEQ ID NO: 106732 - DNA, 23 bp, Homo sapiens
cggagtctcgctctgtcgctcag

SEQ ID NO: 106733 - DNA, 22 bp, Homo sapiens
attgtgatctagtaaatgtgtc

SEQ ID NO: 106734 - DNA, 20 bp, Homo sapiens
ttatgttgagaaaatcttgc

SEQ ID NO: 106735 - DNA, 23 bp, Homo sapiens
tgagatttcttaatcatctttga

SEQ ID NO: 106736 - DNA, 23 bp, Homo sapiens
gggtctcactctgtcacccaggc

SEQ ID NO: 106737 - DNA, 23 bp, Homo sapiens
tatggcttttcattcctatgtga

SEQ ID NO: 106738 - DNA, 23 bp, Homo sapiens
gacagagtctcgctctgtcaccc

SEQ ID NO: 106739 - DNA, 22 bp, Homo sapiens
atgtatacacacacacacacat

SEQ ID NO: 106740 - DNA, 19 bp, Homo sapiens
gacaaactctctctctctc

SEQ ID NO: 106741 - DNA, 19 bp, Homo sapiens
tatgtatgtatgtgtctat

SEQ ID NO: 106742 - DNA, 23 bp, Homo sapiens
ctgtgtgtgtgcatgtgcatgtg

SEQ ID NO: 106743 - DNA, 23 bp, Homo sapiens
tgtgtgcatgtgtgtgcattcag

SEQ ID NO: 106744 - DNA, 20 bp, Homo sapiens
tacttacattgcaaaggttc

SEQ ID NO: 106745 - DNA, 21 bp, Homo sapiens
ttacccaggctggtaatcatg

SEQ ID NO: 106746 - DNA, 23 bp, Homo sapiens
tgagatggagtctcactctgtcg

SEQ ID NO: 106747 - DNA, 18 bp, Homo sapiens
tcaggaggctgaggtagg

SEQ ID NO: 106748 - DNA, 23 bp, Homo sapiens
tgtgtgtatatatatatgtgtgt

SEQ ID NO: 106749 - DNA, 23 bp, Homo sapiens
gacagagtctcgctctgtcaccc

SEQ ID NO: 106750 - DNA, 21 bp, Homo sapiens
ttcacagaagagagagaggcc

SEQ ID NO: 106751 - DNA, 22 bp, Homo sapiens
ggctgagttctgtctggctgtg

SEQ ID NO: 106752 - DNA, 23 bp, Homo sapiens
ttgagacagagtcttgctctgtc

SEQ ID NO: 106753 - DNA, 19 bp, Homo sapiens
atctctcattatttgctgg

SEQ ID NO: 106754 - DNA, 19 bp, Homo sapiens
aaaaaaggatggaatggtt

SEQ ID NO: 106755 - DNA, 23 bp, Homo sapiens
atttcagagccagctttattggg

SEQ ID NO: 106756 - DNA, 22 bp, Homo sapiens
ttagcttagtttaggtctatga

SEQ ID NO: 106757 - DNA, 18 bp, Homo sapiens
ttgggtatgtgtgtggga

SEQ ID NO: 106758 - DNA, 23 bp, Homo sapiens
agacttgagtgcatctgctaagg

SEQ ID NO: 106759 - DNA, 21 bp, Homo sapiens
agggagagtagacaatttgat

SEQ ID NO: 106760 - DNA, 21 bp, Homo sapiens
aacagagtgagactccgtctc

SEQ ID NO: 106761 - DNA, 23 bp, Homo sapiens
gagaccgagtctcactctgtcac

SEQ ID NO: 106762 - DNA, 23 bp, Homo sapiens
gaaatgaagtctcactgtgtcac

SEQ ID NO: 106763 - DNA, 23 bp, Homo sapiens
tgagacagagtctcgctgtgtcg

SEQ ID NO: 106764 - DNA, 19 bp, Homo sapiens
acagcctaaacagaagcaa

SEQ ID NO: 106765 - DNA, 23 bp, Homo sapiens
aggatggtctcgatctcttgagt

SEQ ID NO: 106766 - DNA, 19 bp, Homo sapiens
agacaaggtcttgctctgt

SEQ ID NO: 106767 - DNA, 23 bp, Homo sapiens
cagagtctcactctgtcacccag

SEQ ID NO: 106768 - DNA, 21 bp, Homo sapiens
tgaaatgaacgttcaggctgc

SEQ ID NO: 106769 - DNA, 18 bp, Homo sapiens
aggatttactgcagctta

SEQ ID NO: 106770 - DNA, 23 bp, Homo sapiens
tctctctcagtttacactcagct

SEQ ID NO: 106771 - DNA, 23 bp, Homo sapiens
ttctgtgtcagtcagtgagtcgc

SEQ ID NO: 106772 - DNA, 18 bp, Homo sapiens
tagtttctattttttaac

SEQ ID NO: 106773 - DNA, 22 bp, Homo sapiens
ttggtaggttttgtgtttctag

SEQ ID NO: 106774 - DNA, 23 bp, Homo sapiens
agtatcacagttcttaggaaaag

SEQ ID NO: 106775 - DNA, 21 bp, Homo sapiens
ttatctattcacagtgacact

SEQ ID NO: 106776 - DNA, 18 bp, Homo sapiens
ctcacacctgtaatccca

SEQ ID NO: 106777 - DNA, 23 bp, Homo sapiens
aggaagttgaggctgcagtgagc

SEQ ID NO: 106778 - DNA, 22 bp, Homo sapiens
cacagttctgtggctgcagttc

SEQ ID NO: 106779 - DNA, 23 bp, Homo sapiens
agtgagccatgatcctgccattg

SEQ ID NO: 106780 - DNA, 23 bp, Homo sapiens
agagtctcactctgtcacccagg

SEQ ID NO: 106781 - DNA, 23 bp, Homo sapiens
tgacttggatttgctggctcttt

SEQ ID NO: 106782 - DNA, 23 bp, Homo sapiens
gagacagagtctcgctctgtcac

SEQ ID NO: 106783 - DNA, 23 bp, Homo sapiens
gagacagagtctcgctctgtcgc

SEQ ID NO: 106784 - DNA, 23 bp, Homo sapiens
accctgcctgtgacccagtttgg

SEQ ID NO: 106785 - DNA, 23 bp, Homo sapiens
tgctattctaacagtataggaga

SEQ ID NO: 106786 - DNA, 22 bp, Homo sapiens
aaaagtgtgaagaattcagggt

SEQ ID NO: 106787 - DNA, 23 bp, Homo sapiens
cagacactctctgtgcctgtctg

SEQ ID NO: 106788 - DNA, 23 bp, Homo sapiens
cacaggtattcagcatctttaag

SEQ ID NO: 106789 - DNA, 23 bp, Homo sapiens
cagacagactgtcagtctcgtga

SEQ ID NO: 106790 - DNA, 21 bp, Homo sapiens
ctgtctcactgtctacactcc

SEQ ID NO: 106791 - DNA, 22 bp, Homo sapiens
gttgaatgcttgtcataaagtt

SEQ ID NO: 106792 - DNA, 23 bp, Homo sapiens
gtgtgcatgtgtgggtgtgtgga

SEQ ID NO: 106793 - DNA, 18 bp, Homo sapiens
gcagccagagagaggaga

SEQ ID NO: 106794 - DNA, 23 bp, Homo sapiens
ggttctcactctccctgtctcct

SEQ ID NO: 106795 - DNA, 23 bp, Homo sapiens
ctcactctgtctcactctgtcat

SEQ ID NO: 106796 - DNA, 18 bp, Homo sapiens
tggtgagaagagtggtga

SEQ ID NO: 106797 - DNA, 20 bp, Homo sapiens
ttttttttgttttggttagc

SEQ ID NO: 106798 - DNA, 19 bp, Homo sapiens
tacaaggagggcaggagca

SEQ ID NO: 106799 - DNA, 23 bp, Homo sapiens
tgtgtgcatatatatgtgtgtgt

SEQ ID NO: 106800 - DNA, 23 bp, Homo sapiens
acagagtctctcgctctgtcacc

SEQ ID NO: 106801 - DNA, 23 bp, Homo sapiens
ttgactgtatttgagtgtgacta

SEQ ID NO: 106802 - DNA, 23 bp, Homo sapiens
tcagaagtttgagactacagtga

SEQ ID NO: 106803 - DNA, 22 bp, Homo sapiens
tggagtctctctctgtctccca

SEQ ID NO: 106804 - DNA, 23 bp, Homo sapiens
tataaatccttttgatatgatga

SEQ ID NO: 106805 - DNA, 23 bp, Homo sapiens
cctgagttctcttggtccagaga

SEQ ID NO: 106806 - DNA, 22 bp, Homo sapiens
aagtgcttgaaggtgagaccta

SEQ ID NO: 106807 - DNA, 23 bp, Homo sapiens
tctatatctatatctatatgtgt

SEQ ID NO: 106808 - DNA, 23 bp, Homo sapiens
gtattgtctttttgatgtactgt

SEQ ID NO: 106809 - DNA, 23 bp, Homo sapiens
aatagtctcactgacaatgtact

SEQ ID NO: 106810 - DNA, 20 bp, Homo sapiens
atgttatctaagttaactga

SEQ ID NO: 106811 - DNA, 22 bp, Homo sapiens
atacctatatatagatatgtat

SEQ ID NO: 106812 - DNA, 19 bp, Homo sapiens
tgacaggagacagtctggt

SEQ ID NO: 106813 - DNA, 23 bp, Homo sapiens
aggtagatgcttgtttactgtgg

SEQ ID NO: 106814 - DNA, 22 bp, Homo sapiens
gtacagctgcatttgacaggtg

SEQ ID NO: 106815 - DNA, 19 bp, Homo sapiens
tttcgactggaaatatatt

SEQ ID NO: 106816 - DNA, 20 bp, Homo sapiens
tggtaaatatttaggattgg

SEQ ID NO: 106817 - DNA, 23 bp, Homo sapiens
tgagttcattgtagattctggat

SEQ ID NO: 106818 - DNA, 23 bp, Homo sapiens
tgagttcattgtagattctggat

SEQ ID NO: 106819 - DNA, 23 bp, Homo sapiens
aacattcaacgctgtcggtgagt

SEQ ID NO: 106820 - DNA, 22 bp, Homo sapiens
accatcgaccgttgattgtacc

SEQ ID NO: 106821 - DNA, 23 bp, Homo sapiens
acattcattgctgtcggtgggtt

SEQ ID NO: 106822 - DNA, 18 bp, Homo sapiens
aacaatgaatgcaactgt

SEQ ID NO: 106823 - DNA, 18 bp, Homo sapiens
atggacatatatatggac

SEQ ID NO: 106824 - DNA, 23 bp, Homo sapiens
tcaacaagaagagtattcttgtt

SEQ ID NO: 106825 - DNA, 23 bp, Homo sapiens
tatgtctgtgtatgtatttttcc

SEQ ID NO: 106826 - DNA, 23 bp, Homo sapiens
gatatactttcagattttgtaaa

SEQ ID NO: 106827 - DNA, 21 bp, Homo sapiens
tgaggtaaattgtaagaattc

SEQ ID NO: 106828 - DNA, 21 bp, Homo sapiens
tatcaccatccctatgaatac

SEQ ID NO: 106829 - DNA, 20 bp, Homo sapiens
tgagagagcaagagcatgtg

SEQ ID NO: 106830 - DNA, 23 bp, Homo sapiens
cccaggtctctcttcctcttctt

SEQ ID NO: 106831 - DNA, 23 bp, Homo sapiens
aaagactctgcatttcatttaca

SEQ ID NO: 106832 - DNA, 21 bp, Homo sapiens
tgaggtaggaggatcacttga

SEQ ID NO: 106833 - DNA, 23 bp, Homo sapiens
tgtatgtgtgtatatatgtgtgt

SEQ ID NO: 106834 - DNA, 23 bp, Homo sapiens
atgtgtatatatgtatgtgtgtg

SEQ ID NO: 106835 - DNA, 23 bp, Homo sapiens
tgagttcattgtagattctggat

SEQ ID NO: 106836 - DNA, 23 bp, Homo sapiens
tgagttcattgtagattctggat

SEQ ID NO: 106837 - DNA, 21 bp, Homo sapiens
tgtgtatatccatatgtgtgt

SEQ ID NO: 106838 - DNA, 23 bp, Homo sapiens
tgagttcattgtagattctggat

SEQ ID NO: 106839 - DNA, 23 bp, Homo sapiens
tgagttcattgtagattctggat

SEQ ID NO: 106840 - DNA, 20 bp, Homo sapiens
tatgcatataattacacata

SEQ ID NO: 106841 - DNA, 23 bp, Homo sapiens
tgagttcattgtagattctggat

SEQ ID NO: 106842 - DNA, 23 bp, Homo sapiens
tgagttcattgtagattctggat

SEQ ID NO: 106843 - DNA, 23 bp, Homo sapiens
tgagttcattgtagattctggat

SEQ ID NO: 106844 - DNA, 20 bp, Homo sapiens
tgagtttggcctaaccaagt

SEQ ID NO: 106845 - DNA, 23 bp, Homo sapiens
agagtctcactctgtcacccagg

SEQ ID NO: 106846 - DNA, 23 bp, Homo sapiens
gagtctcactctgtcacccaggc

SEQ ID NO: 106847 - DNA, 22 bp, Homo sapiens
atcattacagattgtatacatg

SEQ ID NO: 106848 - DNA, 23 bp, Homo sapiens
acaacagtatggtttggctctgt

SEQ ID NO: 106849 - DNA, 23 bp, Homo sapiens
tatgtgtgtgtatatatatgtgt

SEQ ID NO: 106850 - DNA, 18 bp, Homo sapiens
tttagatttagctttgca

SEQ ID NO: 106851 - DNA, 23 bp, Homo sapiens
ttcacattttatttatctgtgtg

SEQ ID NO: 106852 - DNA, 23 bp, Homo sapiens
tgacattgtatatgtatatgtaa

SEQ ID NO: 106853 - DNA, 22 bp, Homo sapiens
atatatgtgcatatacgtgtct

SEQ ID NO: 106854 - DNA, 22 bp, Homo sapiens
tggtagacttctgattttcagg

SEQ ID NO: 106855 - DNA, 19 bp, Homo sapiens
tacgaagtaagtagatgtt

SEQ ID NO: 106856 - DNA, 22 bp, Homo sapiens
atgttatagtagaagagatgtt

SEQ ID NO: 106857 - DNA, 23 bp, Homo sapiens
taattgcttgaaaactattgtct

SEQ ID NO: 106858 - DNA, 20 bp, Homo sapiens
gtgtatatatatgtgtgtgt

SEQ ID NO: 106859 - DNA, 23 bp, Homo sapiens
cctaggagtggaattgttgggtt

SEQ ID NO: 106860 - DNA, 21 bp, Homo sapiens
ttctatgtgttctgttttaga

SEQ ID NO: 106861 - DNA, 22 bp, Homo sapiens
agagcgggtgagtttaaggttt

SEQ ID NO: 106862 - DNA, 23 bp, Homo sapiens
agtgcgaggtagttctgacacaa

SEQ ID NO: 106863 - DNA, 22 bp, Homo sapiens
atatgaatttctgttcatgagt

SEQ ID NO: 106864 - DNA, 23 bp, Homo sapiens
gtatgtgtatgtatatgtatatg

SEQ ID NO: 106865 - DNA, 20 bp, Homo sapiens
acacacacacacatatatgt

SEQ ID NO: 106866 - DNA, 19 bp, Homo sapiens
tgtaagacatgacttgctg

SEQ ID NO: 106867 - DNA, 23 bp, Homo sapiens
attgtggattttgtatcctgtga

SEQ ID NO: 106868 - DNA, 23 bp, Homo sapiens
tgtgtgcgtgtgtgtatgtgtat

SEQ ID NO: 106869 - DNA, 23 bp, Homo sapiens
taataagtgatattggaatgtag

SEQ ID NO: 106870 - DNA, 22 bp, Homo sapiens
tcattctggtgtctgagagaca

SEQ ID NO: 106871 - DNA, 23 bp, Homo sapiens
aaatgtgtatatgtatgtgtgtg

SEQ ID NO: 106872 - DNA, 23 bp, Homo sapiens
tgtatacatttgtgtggcatata

SEQ ID NO: 106873 - DNA, 23 bp, Homo sapiens
tttatgtgcatatgtatatattt

SEQ ID NO: 106874 - DNA, 23 bp, Homo sapiens
tgtaaagttagtggtttggtttt

SEQ ID NO: 106875 - DNA, 19 bp, Homo sapiens
tacatataaagcatagcta

SEQ ID NO: 106876 - DNA, 23 bp, Homo sapiens
gacagtgtctcgctctgtcaccc

SEQ ID NO: 106877 - DNA, 23 bp, Homo sapiens
aataagctcaagagagtgaggac

SEQ ID NO: 106878 - DNA, 23 bp, Homo sapiens
catatatatagtgtgtttgtgtg

SEQ ID NO: 106879 - DNA, 23 bp, Homo sapiens
gtgtgcctgtgtgtctgtgtgta

SEQ ID NO: 106880 - DNA, 23 bp, Homo sapiens
tgtgtgtgtatatatgctcatac

SEQ ID NO: 106881 - DNA, 23 bp, Homo sapiens
tagatgtatgtatgtgtgtatgc

SEQ ID NO: 106882 - DNA, 22 bp, Homo sapiens
atacatgtgtatatatatgtgt

SEQ ID NO: 106883 - DNA, 23 bp, Homo sapiens
tatatatgtgtgtatatatatgc

SEQ ID NO: 106884 - DNA, 22 bp, Homo sapiens
tatatgcatatgtatatatata

SEQ ID NO: 106885 - DNA, 18 bp, Homo sapiens
tatatgtatatgtatatc

SEQ ID NO: 106886 - DNA, 23 bp, Homo sapiens
atcatgtctgggaatctaagttg

SEQ ID NO: 106887 - DNA, 21 bp, Homo sapiens
tgtgttattatatactataga

SEQ ID NO: 106888 - DNA, 23 bp, Homo sapiens
tgagttcattgtagattctggat

SEQ ID NO: 106889 - DNA, 23 bp, Homo sapiens
tgagttcattgtagattctggat

SEQ ID NO: 106890 - DNA, 20 bp, Homo sapiens
tgtatgtatgtatatgtata

SEQ ID NO: 106891 - DNA, 23 bp, Homo sapiens
atatatgtatacatgtatacaca

SEQ ID NO: 106892 - DNA, 21 bp, Homo sapiens
actatgtatatgtatatgtgt

SEQ ID NO: 106893 - DNA, 23 bp, Homo sapiens
agtgtatacatatacactatata

SEQ ID NO: 106894 - DNA, 22 bp, Homo sapiens
tatgtgcatatatgtgtctgtg

SEQ ID NO: 106895 - DNA, 23 bp, Homo sapiens
ctctctctgacactgtggcacca

SEQ ID NO: 106896 - DNA, 20 bp, Homo sapiens
tggtgtcctcatggttcaga

SEQ ID NO: 106897 - DNA, 20 bp, Homo sapiens
cacacacacatatatatatg

SEQ ID NO: 106898 - DNA, 22 bp, Homo sapiens
tgacagtctctgactttgaact

SEQ ID NO: 106899 - DNA, 23 bp, Homo sapiens
tgtgtgtgtgtatgtgtatatat

SEQ ID NO: 106900 - DNA, 22 bp, Homo sapiens
tatatgtgtgtgtgtatacaca

SEQ ID NO: 106901 - DNA, 23 bp, Homo sapiens
tcagaagtgagaaacttgttctg

SEQ ID NO: 106902 - DNA, 23 bp, Homo sapiens
aaatgacttgcctatactgttct

SEQ ID NO: 106903 - DNA, 21 bp, Homo sapiens
taggagctaaaatattttata

SEQ ID NO: 106904 - DNA, 21 bp, Homo sapiens
atagtgtatacaatatgtaat

SEQ ID NO: 106905 - DNA, 21 bp, Homo sapiens
tcaggaactcactctgtctga

SEQ ID NO: 106906 - DNA, 23 bp, Homo sapiens
agaaatgttttagaataatgatt

SEQ ID NO: 106907 - DNA, 23 bp, Homo sapiens
ttgtgtatatatgtatgtgtgtg

SEQ ID NO: 106908 - DNA, 23 bp, Homo sapiens
ctgggtgacacagtgagtctctg

SEQ ID NO: 106909 - DNA, 19 bp, Homo sapiens
caaggattagatcttctgg

SEQ ID NO: 106910 - DNA, 23 bp, Homo sapiens
atatacagacaaccatttattgt

SEQ ID NO: 106911 - DNA, 22 bp, Homo sapiens
acgcatattatggatgtgtgtc

SEQ ID NO: 106912 - DNA, 22 bp, Homo sapiens
tatatactagtatacttacata

SEQ ID NO: 106913 - DNA, 20 bp, Homo sapiens
tctcagacacactgactgcc

SEQ ID NO: 106914 - DNA, 21 bp, Homo sapiens
atatgtatatatatgtgtatg

SEQ ID NO: 106915 - DNA, 23 bp, Homo sapiens
aacagaggagagtgaggacaagc

SEQ ID NO: 106916 - DNA, 21 bp, Homo sapiens
tgagtctgtttgtcactctat

SEQ ID NO: 106917 - DNA, 22 bp, Homo sapiens
taaccatgatgaccttcagaca

SEQ ID NO: 106918 - DNA, 23 bp, Homo sapiens
tgtgtgtgtatgtatatgtgtgt

SEQ ID NO: 106919 - DNA, 21 bp, Homo sapiens
attttaagataagcaatggat

SEQ ID NO: 106920 - DNA, 23 bp, Homo sapiens
tcactgtcacactctgaggtctt

SEQ ID NO: 106921 - DNA, 18 bp, Homo sapiens
tacagtcagcacacaggg

SEQ ID NO: 106922 - DNA, 20 bp, Homo sapiens
tctggccaactgaaagggat

SEQ ID NO: 106923 - DNA, 19 bp, Homo sapiens
ttgagactagtctcgcctt

SEQ ID NO: 106924 - DNA, 23 bp, Homo sapiens
aagtatatatgtatttcattagt

SEQ ID NO: 106925 - DNA, 19 bp, Homo sapiens
tgtgtgtgtgtgtgtgtat

SEQ ID NO: 106926 - DNA, 21 bp, Homo sapiens
tttacatactattacatatga

SEQ ID NO: 106927 - DNA, 22 bp, Homo sapiens
tgtgtatatgtgtatgtgtgtg

SEQ ID NO: 106928 - DNA, 20 bp, Homo sapiens
caaacagcttagagtgaact

SEQ ID NO: 106929 - DNA, 18 bp, Homo sapiens
tatactgtatatgtatat

SEQ ID NO: 106930 - DNA, 22 bp, Homo sapiens
tatgtatatatgtatgtatatg

SEQ ID NO: 106931 - DNA, 23 bp, Homo sapiens
ttgtggttgatgacagaagtgag

SEQ ID NO: 106932 - DNA, 23 bp, Homo sapiens
tgcatgtctgtttttctaggctt

SEQ ID NO: 106933 - DNA, 18 bp, Homo sapiens
taaatacttcattagagc

SEQ ID NO: 106934 - DNA, 23 bp, Homo sapiens
ttataggaaggatagaagtaata

SEQ ID NO: 106935 - DNA, 23 bp, Homo sapiens
ataaccacaatttgttcatctgt

SEQ ID NO: 106936 - DNA, 21 bp, Homo sapiens
ctgaggaagaagaatgtcatg

SEQ ID NO: 106937 - DNA, 20 bp, Homo sapiens
tctggatgagtaagtgaaac

SEQ ID NO: 106938 - DNA, 23 bp, Homo sapiens
ttaccagattttccagaatattg

SEQ ID NO: 106939 - DNA, 20 bp, Homo sapiens
tgggtgacttttgtaggtgt

SEQ ID NO: 106940 - DNA, 22 bp, Homo sapiens
ttatagcagctcaattctctct

SEQ ID NO: 106941 - DNA, 22 bp, Homo sapiens
tatggcagagaggatagctttt

SEQ ID NO: 106942 - DNA, 21 bp, Homo sapiens
tatgtgtatatatgcatatgt

SEQ ID NO: 106943 - DNA, 23 bp, Homo sapiens
attgtggttttgatttgcatttc

SEQ ID NO: 106944 - DNA, 21 bp, Homo sapiens
gaagtgtctgtccttaccctt

SEQ ID NO: 106945 - DNA, 20 bp, Homo sapiens
ttcctgaatgttataggaca

SEQ ID NO: 106946 - DNA, 22 bp, Homo sapiens
agcctcagggatttttctcggt

SEQ ID NO: 106947 - DNA, 23 bp, Homo sapiens
atatgtgtgtgtatagtctttca

SEQ ID NO: 106948 - DNA, 23 bp, Homo sapiens
taactgtgatatctatatgtatc

SEQ ID NO: 106949 - DNA, 19 bp, Homo sapiens
aatcacagttatataccac

SEQ ID NO: 106950 - DNA, 23 bp, Homo sapiens
tcacatggtccaaatcacttctg

SEQ ID NO: 106951 - DNA, 23 bp, Homo sapiens
acatgtttgcaaatataatgaaa

SEQ ID NO: 106952 - DNA, 21 bp, Homo sapiens
tttagtcaagatacagaaggc

SEQ ID NO: 106953 - DNA, 21 bp, Homo sapiens
tacagatatttcaaaatatgt

SEQ ID NO: 106954 - DNA, 19 bp, Homo sapiens
agtttcaatgctattttaa

SEQ ID NO: 106955 - DNA, 23 bp, Homo sapiens
ttgaccagagattttgaagtact

SEQ ID NO: 106956 - DNA, 18 bp, Homo sapiens
actctcagtctgaggctg

SEQ ID NO: 106957 - DNA, 23 bp, Homo sapiens
tacacacacacatatatatgact

SEQ ID NO: 106958 - DNA, 23 bp, Homo sapiens
tgtgtgtatgtgtatatatgtgt

SEQ ID NO: 106959 - DNA, 20 bp, Homo sapiens
aacaaaataaaattgtgttt

SEQ ID NO: 106960 - DNA, 23 bp, Homo sapiens
ttacaaacttttgttttgttttc

SEQ ID NO: 106961 - DNA, 23 bp, Homo sapiens
tctctatatatctatatctctac

SEQ ID NO: 106962 - DNA, 23 bp, Homo sapiens
aactgctaattttcaaggctgtc

SEQ ID NO: 106963 - DNA, 23 bp, Homo sapiens
tgagttcattgtagattctggat

SEQ ID NO: 106964 - DNA, 23 bp, Homo sapiens
tgagttcattgtagattctggat

SEQ ID NO: 106965 - DNA, 21 bp, Homo sapiens
tatgtgtatatgtatgtgtgt

SEQ ID NO: 106966 - DNA, 23 bp, Homo sapiens
tgtatgtatgcatgtgtatatgt

SEQ ID NO: 106967 - DNA, 23 bp, Homo sapiens
tacacacacacatacatatacct

SEQ ID NO: 106968 - DNA, 23 bp, Homo sapiens
tgagacaaggtctcactctgtta

SEQ ID NO: 106969 - DNA, 21 bp, Homo sapiens
tagtgagacagggtgtccttt

SEQ ID NO: 106970 - DNA, 21 bp, Homo sapiens
ttttctctttcagtatgatgt

SEQ ID NO: 106971 - DNA, 20 bp, Homo sapiens
tgtgcatgtgcatgcgcata

SEQ ID NO: 106972 - DNA, 23 bp, Homo sapiens
acagggggagaattagcagtgtt

SEQ ID NO: 106973 - DNA, 18 bp, Homo sapiens
aggttattattactgata

SEQ ID NO: 106974 - DNA, 23 bp, Homo sapiens
atggtacttagattgttaatttg

SEQ ID NO: 106975 - DNA, 20 bp, Homo sapiens
gtgtgtgtgtgtgtgtgtgt

SEQ ID NO: 106976 - DNA, 19 bp, Homo sapiens
agacttgaattttagtaca

SEQ ID NO: 106977 - DNA, 23 bp, Homo sapiens
aagatattgatgatgatgttgat

SEQ ID NO: 106978 - DNA, 21 bp, Homo sapiens
taattgtaattgtatatgtat

SEQ ID NO: 106979 - DNA, 21 bp, Homo sapiens
tgttaagtaagaatgctgaat

SEQ ID NO: 106980 - DNA, 23 bp, Homo sapiens
gaagactctacttagctgtctct

SEQ ID NO: 106981 - DNA, 22 bp, Homo sapiens
attcttggtggtgtactagctg

SEQ ID NO: 106982 - DNA, 22 bp, Homo sapiens
aagttcatatatatatatgtga

SEQ ID NO: 106983 - DNA, 23 bp, Homo sapiens
tcacacctgtaatctctgcactt

SEQ ID NO: 106984 - DNA, 23 bp, Homo sapiens
tgaagtcagaagtttgagaccag

SEQ ID NO: 106985 - DNA, 23 bp, Homo sapiens
tcaggcagtttttttaaggcttt

SEQ ID NO: 106986 - DNA, 23 bp, Homo sapiens
tgagttcattgtagattctggat

SEQ ID NO: 106987 - DNA, 23 bp, Homo sapiens
tgagttcattgtagattctggat

SEQ ID NO: 106988 - DNA, 23 bp, Homo sapiens
tgagttcattgtagattctggat

SEQ ID NO: 106989 - DNA, 23 bp, Homo sapiens
tgagttcattgtagattctggat

SEQ ID NO: 106990 - DNA, 20 bp, Homo sapiens
acatatatacatgcatatct

SEQ ID NO: 106991 - DNA, 22 bp, Homo sapiens
agacagggttttgctctgtcac

SEQ ID NO: 106992 - DNA, 23 bp, Homo sapiens
tctgacagaactgtgtgtcctga

SEQ ID NO: 106993 - DNA, 21 bp, Homo sapiens
gatttcttaggaatagagtcc

SEQ ID NO: 106994 - DNA, 19 bp, Homo sapiens
aaacagacagatatcttgg

SEQ ID NO: 106995 - DNA, 23 bp, Homo sapiens
aggctgtgagttcatgctgagtg

SEQ ID NO: 106996 - DNA, 19 bp, Homo sapiens
atatatataacacctgggt

SEQ ID NO: 106997 - DNA, 23 bp, Homo sapiens
gttactttagttatctttgtgtt

SEQ ID NO: 106998 - DNA, 23 bp, Homo sapiens
agagaatacagaatccagaaaat

SEQ ID NO: 106999 - DNA, 23 bp, Homo sapiens
agacagagtctcgctatgttgcc

SEQ ID NO: 107000 - DNA, 22 bp, Homo sapiens
attgtcaatttcttattgtgtg

SEQ ID NO: 107001 - DNA, 18 bp, Homo sapiens
agagaagttggcagcaaa

SEQ ID NO: 107002 - DNA, 23 bp, Homo sapiens
ctgcccctgtcactctgtggccc

SEQ ID NO: 107003 - DNA, 23 bp, Homo sapiens
ttacatgtttatgtatgtatatg

SEQ ID NO: 107004 - DNA, 23 bp, Homo sapiens
tggaatgtgatgtacaatgcagt

SEQ ID NO: 107005 - DNA, 18 bp, Homo sapiens
agtgtaggttctttctat

SEQ ID NO: 107006 - DNA, 23 bp, Homo sapiens
tagacagtacaaagagaggaatt

SEQ ID NO: 107007 - DNA, 23 bp, Homo sapiens
tctcaggaacttctttctgatct

SEQ ID NO: 107008 - DNA, 23 bp, Homo sapiens
gtagttggagcaggcttcttggg

SEQ ID NO: 107009 - DNA, 22 bp, Homo sapiens
ttgggggtagttggagcagtct

SEQ ID NO: 107010 - DNA, 23 bp, Homo sapiens
ctcccagagcccctggaactctg

SEQ ID NO: 107011 - DNA, 23 bp, Homo sapiens
tcccagagcccctggaactctgg

SEQ ID NO: 107012 - DNA, 23 bp, Homo sapiens
tcccagagcccctggaactctgg

SEQ ID NO: 107013 - DNA, 23 bp, Homo sapiens
tcccagagcccctggaactctgg

SEQ ID NO: 107014 - DNA, 21 bp, Homo sapiens
aatccttatagaatgtctaca

SEQ ID NO: 107015 - DNA, 23 bp, Homo sapiens
accaagacattcatatggtatgt

SEQ ID NO: 107016 - DNA, 21 bp, Homo sapiens
ttaagcatattttgtgtgtgt

SEQ ID NO: 107017 - DNA, 22 bp, Homo sapiens
atatacacacatatatatgtgt

SEQ ID NO: 107018 - DNA, 23 bp, Homo sapiens
tgagttcattgtagattctggat

SEQ ID NO: 107019 - DNA, 23 bp, Homo sapiens
tgagttcattgtagattctggat

SEQ ID NO: 107020 - DNA, 19 bp, Homo sapiens
attcttttgagtttctgat

SEQ ID NO: 107021 - DNA, 23 bp, Homo sapiens
atatgtatatgtatatgtatatg

SEQ ID NO: 107022 - DNA, 19 bp, Homo sapiens
atatatgaagattccatat

SEQ ID NO: 107023 - DNA, 21 bp, Homo sapiens
tacagtgcctggtttctctct

SEQ ID NO: 107024 - DNA, 21 bp, Homo sapiens
tattgcacattacaaaatagc

SEQ ID NO: 107025 - DNA, 20 bp, Homo sapiens
atgtgtgtatatatatgtaa

SEQ ID NO: 107026 - DNA, 23 bp, Homo sapiens
tcatttcattggtgttggtgggt

SEQ ID NO: 107027 - DNA, 22 bp, Homo sapiens
ttaagatggagtctcgctcagt

SEQ ID NO: 107028 - DNA, 23 bp, Homo sapiens
acacaggagatgaagcagaagtg

SEQ ID NO: 107029 - DNA, 22 bp, Homo sapiens
tttaagtctttcagctttgttg

SEQ ID NO: 107030 - DNA, 23 bp, Homo sapiens
ttttgagtcggagtcttgctctg

SEQ ID NO: 107031 - DNA, 20 bp, Homo sapiens
tagacagaacaatgagaggt

SEQ ID NO: 107032 - DNA, 22 bp, Homo sapiens
tggctcttgagacccttcttgt

SEQ ID NO: 107033 - DNA, 23 bp, Homo sapiens
tatgtgtatatatacgtgtgtgt

SEQ ID NO: 107034 - DNA, 19 bp, Homo sapiens
tacagtggcgtgatcttgg

SEQ ID NO: 107035 - DNA, 22 bp, Homo sapiens
taggtgctttccatatctcatc

SEQ ID NO: 107036 - DNA, 23 bp, Homo sapiens
ttacagttgaaagaactgagggt

SEQ ID NO: 107037 - DNA, 23 bp, Homo sapiens
tagagggtgaactgagagggcac

SEQ ID NO: 107038 - DNA, 18 bp, Homo sapiens
atctgagatttgaattca

SEQ ID NO: 107039 - DNA, 23 bp, Homo sapiens
ttttagatcagaaatcatgttga

SEQ ID NO: 107040 - DNA, 23 bp, Homo sapiens
tgagagagaaatgttgaaatccc

SEQ ID NO: 107041 - DNA, 23 bp, Homo sapiens
gatttgtctatttctttttcagt

SEQ ID NO: 107042 - DNA, 22 bp, Homo sapiens
atctagagaagtgtggcctttc

SEQ ID NO: 107043 - DNA, 18 bp, Homo sapiens
agcacttagtagatactg

SEQ ID NO: 107044 - DNA, 23 bp, Homo sapiens
tgagttcattgtagattctggat

SEQ ID NO: 107045 - DNA, 22 bp, Homo sapiens
tatgattatttgattatctgtc

SEQ ID NO: 107046 - DNA, 23 bp, Homo sapiens
agagtctcactctgtcacccagg

SEQ ID NO: 107047 - DNA, 21 bp, Homo sapiens
taatctcacaggcaattttga

SEQ ID NO: 107048 - DNA, 23 bp, Homo sapiens
gacagagtctcgctctgtcaccc

SEQ ID NO: 107049 - DNA, 23 bp, Homo sapiens
cgctttgtctctctctggctgcc

SEQ ID NO: 107050 - DNA, 22 bp, Homo sapiens
aaagtgctattaaattcactgt

SEQ ID NO: 107051 - DNA, 22 bp, Homo sapiens
acttgtgaatacttggtggcac

SEQ ID NO: 107052 - DNA, 20 bp, Homo sapiens
attcaaagaggtaaccagga

SEQ ID NO: 107053 - DNA, 23 bp, Homo sapiens
tttgtcacccagctttcaagttc

SEQ ID NO: 107054 - DNA, 20 bp, Homo sapiens
agtctcgctctgtcactcag

SEQ ID NO: 107055 - DNA, 23 bp, Homo sapiens
atatatgtatatatatatgtgta

SEQ ID NO: 107056 - DNA, 23 bp, Homo sapiens
tatatgtgtgtatatatatgtgt

SEQ ID NO: 107057 - DNA, 23 bp, Homo sapiens
gaaatgtcaatttcttcttcatt

SEQ ID NO: 107058 - DNA, 23 bp, Homo sapiens
gggtctcactctgtcactcaggc

SEQ ID NO: 107059 - DNA, 23 bp, Homo sapiens
tatatatatgtatgcatatttac

SEQ ID NO: 107060 - DNA, 23 bp, Homo sapiens
caaaatgcagaaagaccactgtg

SEQ ID NO: 107061 - DNA, 22 bp, Homo sapiens
tatatatttgtgacatatgtca

SEQ ID NO: 107062 - DNA, 21 bp, Homo sapiens
acagtcttgctctgtcactca

SEQ ID NO: 107063 - DNA, 18 bp, Homo sapiens
cagtggcatgatcatgac

SEQ ID NO: 107064 - DNA, 19 bp, Homo sapiens
ggcaggagagtgagtgcag

SEQ ID NO: 107065 - DNA, 18 bp, Homo sapiens
tcttagctatacaggctc

SEQ ID NO: 107066 - DNA, 19 bp, Homo sapiens
ttctgtgaagaaagtcaat

SEQ ID NO: 107067 - DNA, 23 bp, Homo sapiens
tcactcacacagagcctggcaca

SEQ ID NO: 107068 - DNA, 23 bp, Homo sapiens
ggagtctcactctgtcacccagg

SEQ ID NO: 107069 - DNA, 22 bp, Homo sapiens
tgagaactctccaaactgcttt

SEQ ID NO: 107070 - DNA, 23 bp, Homo sapiens
tgtgtgggagtctaagtctcttt

SEQ ID NO: 107071 - DNA, 23 bp, Homo sapiens
ctgctgagattggggactctttt

SEQ ID NO: 107072 - DNA, 23 bp, Homo sapiens
agacaaggtctcactctgtcatg

SEQ ID NO: 107073 - DNA, 23 bp, Homo sapiens
atatagctacagtctcagctgtg

SEQ ID NO: 107074 - DNA, 23 bp, Homo sapiens
aacaaggtcgtctcgctctctca

SEQ ID NO: 107075 - DNA, 23 bp, Homo sapiens
atatatgtatatcaaatcattac

SEQ ID NO: 107076 - DNA, 22 bp, Homo sapiens
tcactgcagactctctcagact

SEQ ID NO: 107077 - DNA, 23 bp, Homo sapiens
ttttaaatggagtctggctctgt

SEQ ID NO: 107078 - DNA, 23 bp, Homo sapiens
cttagagactattgtattactgg

SEQ ID NO: 107079 - DNA, 23 bp, Homo sapiens
cgcacacacacacacactttcat

SEQ ID NO: 107080 - DNA, 23 bp, Homo sapiens
acagagtctcgctctgtcgctca

SEQ ID NO: 107081 - DNA, 21 bp, Homo sapiens
acagtcttgctctgtcactca

SEQ ID NO: 107082 - DNA, 23 bp, Homo sapiens
tgcagtggcatgatcttggctca

SEQ ID NO: 107083 - DNA, 18 bp, Homo sapiens
tgacacagagtctcactc

SEQ ID NO: 107084 - DNA, 23 bp, Homo sapiens
tcaactttctatggttagctttt

SEQ ID NO: 107085 - DNA, 19 bp, Homo sapiens
tggattgaaacctattatg

SEQ ID NO: 107086 - DNA, 23 bp, Homo sapiens
ctaattcagtgtgtttttctttt

SEQ ID NO: 107087 - DNA, 23 bp, Homo sapiens
aagaaaaacacactgaattagaa

SEQ ID NO: 107088 - DNA, 23 bp, Homo sapiens
tgagttcattgtagattctggat

SEQ ID NO: 107089 - DNA, 23 bp, Homo sapiens
tgagttcattgtagattctggat

SEQ ID NO: 107090 - DNA, 23 bp, Homo sapiens
agagtctcactctctcccctagg

SEQ ID NO: 107091 - DNA, 23 bp, Homo sapiens
cacacacacatatgtgagacagg

SEQ ID NO: 107092 - DNA, 23 bp, Homo sapiens
tgattagatgatgaacttgtagg

SEQ ID NO: 107093 - DNA, 23 bp, Homo sapiens
gaaatgtgtatgtatataggtat

SEQ ID NO: 107094 - DNA, 23 bp, Homo sapiens
tctctcaaactgtctggtctctt

SEQ ID NO: 107095 - DNA, 22 bp, Homo sapiens
tgacagagtaagactctgtctt

SEQ ID NO: 107096 - DNA, 21 bp, Homo sapiens
tttgagacagggtcttgttat

SEQ ID NO: 107097 - DNA, 22 bp, Homo sapiens
tgagttcctgctttcaattctt

SEQ ID NO: 107098 - DNA, 22 bp, Homo sapiens
tacagaagtgaaattgttggat

SEQ ID NO: 107099 - DNA, 23 bp, Homo sapiens
tgaatctgcatactctaaagatt

SEQ ID NO: 107100 - DNA, 23 bp, Homo sapiens
aggcagagtcttgctctgtcacc

SEQ ID NO: 107101 - DNA, 22 bp, Homo sapiens
tgaagtcttgttctgtcaccaa

SEQ ID NO: 107102 - DNA, 23 bp, Homo sapiens
ttttgagacataatcttgctctg

SEQ ID NO: 107103 - DNA, 23 bp, Homo sapiens
acaggtctcactctgtcacccag

SEQ ID NO: 107104 - DNA, 20 bp, Homo sapiens
ttgagacgagtcttgctctg

SEQ ID NO: 107105 - DNA, 23 bp, Homo sapiens
tcagtctttcactgagtgtgtcc

SEQ ID NO: 107106 - DNA, 23 bp, Homo sapiens
tgtcacttctgtctttcctgatc

SEQ ID NO: 107107 - DNA, 19 bp, Homo sapiens
aagaggaagtataggaagg

SEQ ID NO: 107108 - DNA, 23 bp, Homo sapiens
agaggctggctgcatgttgtatc

SEQ ID NO: 107109 - DNA, 23 bp, Homo sapiens
aaagtcgcacagtctcagctcac

SEQ ID NO: 107110 - DNA, 23 bp, Homo sapiens
atagtctagcaaatgaaatgttt

SEQ ID NO: 107111 - DNA, 23 bp, Homo sapiens
gaacactgagaagtgatttcctt

SEQ ID NO: 107112 - DNA, 22 bp, Homo sapiens
tctcactctgtcacacaggctg

SEQ ID NO: 107113 - DNA, 18 bp, Homo sapiens
catggctcactacggcct

SEQ ID NO: 107114 - DNA, 23 bp, Homo sapiens
gggtctcactctgtcacccaggc

SEQ ID NO: 107115 - DNA, 23 bp, Homo sapiens
tgcagtggcatgatcttggctca

SEQ ID NO: 107116 - DNA, 23 bp, Homo sapiens
gggtctcactctgtcacccaggc

SEQ ID NO: 107117 - DNA, 20 bp, Homo sapiens
tgcagtggcatgatcttggc

SEQ ID NO: 107118 - DNA, 23 bp, Homo sapiens
aacaagcagggtgttgaaacagt

SEQ ID NO: 107119 - DNA, 23 bp, Homo sapiens
agttatactcatattgtagtact

SEQ ID NO: 107120 - DNA, 23 bp, Homo sapiens
ctaatgtatgtttatgtgggtgt

SEQ ID NO: 107121 - DNA, 23 bp, Homo sapiens
tgatcagtctgtacaatggctgt

SEQ ID NO: 107122 - DNA, 18 bp, Homo sapiens
atttcatcaagaattggt

SEQ ID NO: 107123 - DNA, 23 bp, Homo sapiens
ctttgtagaacatcctgtgtttc

SEQ ID NO: 107124 - DNA, 19 bp, Homo sapiens
tgttcttggcatgcacaga

SEQ ID NO: 107125 - DNA, 23 bp, Homo sapiens
gtgtgtctctgtgtgtctgtgtt

SEQ ID NO: 107126 - DNA, 23 bp, Homo sapiens
atgtgcatcagtcagagattttg

SEQ ID NO: 107127 - DNA, 22 bp, Homo sapiens
tatatgtatatatatgtgtgtg

SEQ ID NO: 107128 - DNA, 21 bp, Homo sapiens
tgccagcatctgttatttttt

SEQ ID NO: 107129 - DNA, 23 bp, Homo sapiens
ggtaaagatggagtttgagcctg

SEQ ID NO: 107130 - DNA, 23 bp, Homo sapiens
aattcagccagatgttgacctca

SEQ ID NO: 107131 - DNA, 18 bp, Homo sapiens
taactttaagttctggga

SEQ ID NO: 107132 - DNA, 22 bp, Homo sapiens
atatgtgctgaatgtgcaggtt

SEQ ID NO: 107133 - DNA, 23 bp, Homo sapiens
tgcctggctccctctgtgagctg

SEQ ID NO: 107134 - DNA, 21 bp, Homo sapiens
tatgtgtacatatatgtatgt

SEQ ID NO: 107135 - DNA, 23 bp, Homo sapiens
tcttcttatctatccatctattt

SEQ ID NO: 107136 - DNA, 23 bp, Homo sapiens
ctctgtgaagaaagtcaatggta

SEQ ID NO: 107137 - DNA, 18 bp, Homo sapiens
ttctgcaggagtttgggc

SEQ ID NO: 107138 - DNA, 21 bp, Homo sapiens
ttatggagccaattcttgcct

SEQ ID NO: 107139 - DNA, 23 bp, Homo sapiens
agtctcactctgtcacccaggct

SEQ ID NO: 107140 - DNA, 19 bp, Homo sapiens
tctcaggttcaagtgactc

SEQ ID NO: 107141 - DNA, 23 bp, Homo sapiens
ggtctgagagcctcagtctcagc

SEQ ID NO: 107142 - DNA, 18 bp, Homo sapiens
atatgcaattgtatacat

SEQ ID NO: 107143 - DNA, 19 bp, Homo sapiens
ttatacgcacgtatagatg

SEQ ID NO: 107144 - DNA, 23 bp, Homo sapiens
tgagttcattgtagattctggat

SEQ ID NO: 107145 - DNA, 23 bp, Homo sapiens
tgagttcattgtagattctggat

SEQ ID NO: 107146 - DNA, 19 bp, Homo sapiens
atatatgtgtgcatgtaca

SEQ ID NO: 107147 - DNA, 23 bp, Homo sapiens
tgcatgtatatcattacgcatac

SEQ ID NO: 107148 - DNA, 18 bp, Homo sapiens
gtgtgatcttggctcact

SEQ ID NO: 107149 - DNA, 23 bp, Homo sapiens
gaactctgaaaactgaagtaggg

SEQ ID NO: 107150 - DNA, 23 bp, Homo sapiens
tattcctctgcatgtaatgtgtc

SEQ ID NO: 107151 - DNA, 22 bp, Homo sapiens
atgtgtatatatatgtgtgtat

SEQ ID NO: 107152 - DNA, 21 bp, Homo sapiens
atatgagctacatgtggtgat

SEQ ID NO: 107153 - DNA, 19 bp, Homo sapiens
ttttagtagagatggtgtt

SEQ ID NO: 107154 - DNA, 22 bp, Homo sapiens
aagctagtgcaggcagtctaga

SEQ ID NO: 107155 - DNA, 20 bp, Homo sapiens
acacctggagagtctgagct

SEQ ID NO: 107156 - DNA, 22 bp, Homo sapiens
atagaactgtgaagccagtgag

SEQ ID NO: 107157 - DNA, 23 bp, Homo sapiens
tctgaactgagctgaaagtggtg

SEQ ID NO: 107158 - DNA, 23 bp, Homo sapiens
tgcaggaatgtagagggctatct

SEQ ID NO: 107159 - DNA, 23 bp, Homo sapiens
gacatctgtggttttcttctttt

SEQ ID NO: 107160 - DNA, 23 bp, Homo sapiens
tgaaatggagtctcactctgtcc

SEQ ID NO: 107161 - DNA, 20 bp, Homo sapiens
ctgagtggcttaaaccatag

SEQ ID NO: 107162 - DNA, 23 bp, Homo sapiens
actgtgtaaacagttgactgcac

SEQ ID NO: 107163 - DNA, 23 bp, Homo sapiens
agagtctcactcactctgttgcc

SEQ ID NO: 107164 - DNA, 21 bp, Homo sapiens
agagtgcagtggcaccatctt

SEQ ID NO: 107165 - DNA, 22 bp, Homo sapiens
tgtgtatgtgtatatatataca

SEQ ID NO: 107166 - DNA, 23 bp, Homo sapiens
tatatgtatatatacatatgtgt

SEQ ID NO: 107167 - DNA, 23 bp, Homo sapiens
agctcagagatgacagagagggc

SEQ ID NO: 107168 - DNA, 23 bp, Homo sapiens
tatatgtgtatatatatatgtgt

SEQ ID NO: 107169 - DNA, 23 bp, Homo sapiens
aaagtttgccagtgttttgctat

SEQ ID NO: 107170 - DNA, 23 bp, Homo sapiens
ctagctgtgtgtgtgtgtggggg

SEQ ID NO: 107171 - DNA, 23 bp, Homo sapiens
tgagacggagtctcactctgtcg

SEQ ID NO: 107172 - DNA, 23 bp, Homo sapiens
ttgctctgggtgagtcagtgagt

SEQ ID NO: 107173 - DNA, 19 bp, Homo sapiens
tatgtccttgatttctcat

SEQ ID NO: 107174 - DNA, 23 bp, Homo sapiens
gggtctcactctgtcacccaggc

SEQ ID NO: 107175 - DNA, 23 bp, Homo sapiens
tacatatgtgtgtgtatttgtgt

SEQ ID NO: 107176 - DNA, 23 bp, Homo sapiens
gggtctcactctgtcacccaggc

SEQ ID NO: 107177 - DNA, 21 bp, Homo sapiens
acagcaatatgttatctctca

SEQ ID NO: 107178 - DNA, 23 bp, Homo sapiens
cttctggctctgtgtctctctgt

SEQ ID NO: 107179 - DNA, 23 bp, Homo sapiens
taaaggtagagagatagctgatg

SEQ ID NO: 107180 - DNA, 19 bp, Homo sapiens
acagtgggattaatttatc

SEQ ID NO: 107181 - DNA, 23 bp, Homo sapiens
ctgagtctcactctgtcacccag

SEQ ID NO: 107182 - DNA, 19 bp, Homo sapiens
ataggtatatatgtatcca

SEQ ID NO: 107183 - DNA, 23 bp, Homo sapiens
acatgtgcagaatgtgcagtttc

SEQ ID NO: 107184 - DNA, 23 bp, Homo sapiens
tttatgagcattactatttcata

SEQ ID NO: 107185 - DNA, 22 bp, Homo sapiens
tattaatagtattgcaatgaat

SEQ ID NO: 107186 - DNA, 21 bp, Homo sapiens
agttctcttggcttcatgttg

SEQ ID NO: 107187 - DNA, 21 bp, Homo sapiens
tcagaatgtattgctgtcgtt

SEQ ID NO: 107188 - DNA, 23 bp, Homo sapiens
cttatcagagtcaggtttcattt

SEQ ID NO: 107189 - DNA, 23 bp, Homo sapiens
tgagttcattgtagattctggat

SEQ ID NO: 107190 - DNA, 23 bp, Homo sapiens
tgagttcattgtagattctggat

SEQ ID NO: 107191 - DNA, 23 bp, Homo sapiens
attgatttgcatatgttgaacca

SEQ ID NO: 107192 - DNA, 23 bp, Homo sapiens
tatgcaatgtatacatgtatgga

SEQ ID NO: 107193 - DNA, 22 bp, Homo sapiens
acagatttgagactgagctcac

SEQ ID NO: 107194 - DNA, 20 bp, Homo sapiens
ggcttactcctgcaatccca

SEQ ID NO: 107195 - DNA, 23 bp, Homo sapiens
ttggatcacaatatccttggaat

SEQ ID NO: 107196 - DNA, 20 bp, Homo sapiens
tttggctatcctggatctct

SEQ ID NO: 107197 - DNA, 19 bp, Homo sapiens
gtctcgctctgtcacccag

SEQ ID NO: 107198 - DNA, 23 bp, Homo sapiens
tgagttcattgtagattctggat

SEQ ID NO: 107199 - DNA, 23 bp, Homo sapiens
tgagttcattgtagattctggat

SEQ ID NO: 107200 - DNA, 22 bp, Homo sapiens
tgtctatgagcaaaggaaacct

SEQ ID NO: 107201 - DNA, 23 bp, Homo sapiens
tgtgtctgcctgtctacacttgc

SEQ ID NO: 107202 - DNA, 23 bp, Homo sapiens
acagcaggcacagacaggcagtc

SEQ ID NO: 107203 - DNA, 21 bp, Homo sapiens
tgtatgtatatatgtacatgt

SEQ ID NO: 107204 - DNA, 21 bp, Homo sapiens
ttcgactaagtgttatctttt

SEQ ID NO: 107205 - DNA, 22 bp, Homo sapiens
aggtaactttgtggagtgatgg

SEQ ID NO: 107206 - DNA, 23 bp, Homo sapiens
gacagggtctcactctgtcaccc

SEQ ID NO: 107207 - DNA, 23 bp, Homo sapiens
tttggtgataatatcacattgta

SEQ ID NO: 107208 - DNA, 23 bp, Homo sapiens
gtgtgtgtgtgtgcatgttgtat

SEQ ID NO: 107209 - DNA, 23 bp, Homo sapiens
atatatgtgtgtatatatatgtg

SEQ ID NO: 107210 - DNA, 23 bp, Homo sapiens
cagggtctcactctgtcacccag

SEQ ID NO: 107211 - DNA, 23 bp, Homo sapiens
aatgatctagatttgtgtacaga

SEQ ID NO: 107212 - DNA, 22 bp, Homo sapiens
tgacagaagacagagaggtgct

SEQ ID NO: 107213 - DNA, 23 bp, Homo sapiens
tagactgagaatatgttcccgtt

SEQ ID NO: 107214 - DNA, 20 bp, Homo sapiens
tgtagtaatccaagtgaggg

SEQ ID NO: 107215 - DNA, 22 bp, Homo sapiens
taatgtgtatatgtttatatac

SEQ ID NO: 107216 - DNA, 19 bp, Homo sapiens
tttgatagaagtgagagag

SEQ ID NO: 107217 - DNA, 20 bp, Homo sapiens
acagcatttatatacatttt

SEQ ID NO: 107218 - DNA, 23 bp, Homo sapiens
tcagtggctctgtgtcacatgac

SEQ ID NO: 107219 - DNA, 22 bp, Homo sapiens
acatgtgcacattgtgcaggtt

SEQ ID NO: 107220 - DNA, 23 bp, Homo sapiens
gataagtgcattatgtattgtta

SEQ ID NO: 107221 - DNA, 23 bp, Homo sapiens
ataatgtgtatatgtatttctgt

SEQ ID NO: 107222 - DNA, 19 bp, Homo sapiens
aagtatatatatgtacttg

SEQ ID NO: 107223 - DNA, 22 bp, Homo sapiens
atatatgtacttgtatatatgt

SEQ ID NO: 107224 - DNA, 23 bp, Homo sapiens
tgtgtgcacatgtgtgttcaagt

SEQ ID NO: 107225 - DNA, 23 bp, Homo sapiens
cacatatactacctggcacacag

SEQ ID NO: 107226 - DNA, 22 bp, Homo sapiens
atctgtttggtgcatttctact

SEQ ID NO: 107227 - DNA, 23 bp, Homo sapiens
tgtatagtttttgaatgctcaga

SEQ ID NO: 107228 - DNA, 23 bp, Homo sapiens
atatagtgtgaggtatggattta

SEQ ID NO: 107229 - DNA, 23 bp, Homo sapiens
ttaaagtctcagctagtcaggag

SEQ ID NO: 107230 - DNA, 19 bp, Homo sapiens
tgggaggttcgagattgca

SEQ ID NO: 107231 - DNA, 23 bp, Homo sapiens
attctgactgtgtttccagaatc

SEQ ID NO: 107232 - DNA, 23 bp, Homo sapiens
tttttggttccatatgaaattta

SEQ ID NO: 107233 - DNA, 22 bp, Homo sapiens
tctaattctgtgaagaaaagat

SEQ ID NO: 107234 - DNA, 22 bp, Homo sapiens
aaacagagagagcagtcagagg

SEQ ID NO: 107235 - DNA, 23 bp, Homo sapiens
tttgagacggagtctcgctctgt

SEQ ID NO: 107236 - DNA, 18 bp, Homo sapiens
agaagctcaattacttgt

SEQ ID NO: 107237 - DNA, 23 bp, Homo sapiens
caggcagtctgactggcagttat

SEQ ID NO: 107238 - DNA, 23 bp, Homo sapiens
aaagtgagtcatatttttgtctg

SEQ ID NO: 107239 - DNA, 23 bp, Homo sapiens
tgtatgtgcatatctatatctat

SEQ ID NO: 107240 - DNA, 21 bp, Homo sapiens
aggcatggtgatgcacacttg

SEQ ID NO: 107241 - DNA, 21 bp, Homo sapiens
tgaggtaggaggatcacttga

SEQ ID NO: 107242 - DNA, 23 bp, Homo sapiens
tatctcactgtggttgtgatctg

SEQ ID NO: 107243 - DNA, 21 bp, Homo sapiens
ttagacactgttctggcactc

SEQ ID NO: 107244 - DNA, 23 bp, Homo sapiens
gggtctcactctgtcactcaggc

SEQ ID NO: 107245 - DNA, 23 bp, Homo sapiens
agagatgactcactgtctcacac

SEQ ID NO: 107246 - DNA, 22 bp, Homo sapiens
acgattatagattctatgctgt

SEQ ID NO: 107247 - DNA, 23 bp, Homo sapiens
tgtgtgtatatatgtatatgtgt

SEQ ID NO: 107248 - DNA, 23 bp, Homo sapiens
tctccctgtctcagtatcttcag

SEQ ID NO: 107249 - DNA, 23 bp, Homo sapiens
tatacctgctagaggttgtccag

SEQ ID NO: 107250 - DNA, 21 bp, Homo sapiens
tgcaatgaacaagaagtgtag

SEQ ID NO: 107251 - DNA, 20 bp, Homo sapiens
aagagagtctcactttgtca

SEQ ID NO: 107252 - DNA, 23 bp, Homo sapiens
ccgagtctcactctgtcacccag

SEQ ID NO: 107253 - DNA, 19 bp, Homo sapiens
aggtattttattctctttg

SEQ ID NO: 107254 - DNA, 18 bp, Homo sapiens
tttgtctgttattgatgt

SEQ ID NO: 107255 - DNA, 23 bp, Homo sapiens
gacagagtctcgctctgtcaccc

SEQ ID NO: 107256 - DNA, 23 bp, Homo sapiens
tatgtgtatatatatgtgtgtgt

SEQ ID NO: 107257 - DNA, 23 bp, Homo sapiens
ctcagtcactcactgactctcag

SEQ ID NO: 107258 - DNA, 21 bp, Homo sapiens
ctgacagtacagagggaccag

SEQ ID NO: 107259 - DNA, 23 bp, Homo sapiens
aagccgatcatctgaacatgttg

SEQ ID NO: 107260 - DNA, 23 bp, Homo sapiens
tctctgtgtgtgtgtctgtctgt

SEQ ID NO: 107261 - DNA, 19 bp, Homo sapiens
agaacagtcagaattcagt

SEQ ID NO: 107262 - DNA, 23 bp, Homo sapiens
tgtatgtatgtgtatatatgtat

SEQ ID NO: 107263 - DNA, 23 bp, Homo sapiens
tgtgtgtatatgtatacgtatat

SEQ ID NO: 107264 - DNA, 23 bp, Homo sapiens
atatgtgtgtatatgtatacgta

SEQ ID NO: 107265 - DNA, 23 bp, Homo sapiens
atatgtgtgtatatgtatacgta

SEQ ID NO: 107266 - DNA, 20 bp, Homo sapiens
acaatgtatgtatatatgta

SEQ ID NO: 107267 - DNA, 22 bp, Homo sapiens
tttccttgccctaggtcactag

SEQ ID NO: 107268 - DNA, 18 bp, Homo sapiens
ttttttttttttggtatg

SEQ ID NO: 107269 - DNA, 22 bp, Homo sapiens
tacattatatacttatgtgtgt

SEQ ID NO: 107270 - DNA, 22 bp, Homo sapiens
catatactcatatacatgtgga

SEQ ID NO: 107271 - DNA, 23 bp, Homo sapiens
tcactctgttatactgcctccag

SEQ ID NO: 107272 - DNA, 18 bp, Homo sapiens
tgtgtgcctgtgtctgtg

SEQ ID NO: 107273 - DNA, 21 bp, Homo sapiens
tgatgagtgttattgacttag

SEQ ID NO: 107274 - DNA, 21 bp, Homo sapiens
tgactgtcactgtctgtgggg

SEQ ID NO: 107275 - DNA, 23 bp, Homo sapiens
gaactctgtgtctgtgtgtgcct

SEQ ID NO: 107276 - DNA, 19 bp, Homo sapiens
tgtgaagaagagaagcaga

SEQ ID NO: 107277 - DNA, 23 bp, Homo sapiens
gcaatgactcttatcactttcaa

SEQ ID NO: 107278 - DNA, 23 bp, Homo sapiens
tgagttcattgtagattctggat

SEQ ID NO: 107279 - DNA, 23 bp, Homo sapiens
tgagttcattgtagattctggat

SEQ ID NO: 107280 - DNA, 23 bp, Homo sapiens
gacggagtctcactctgtcaccc

SEQ ID NO: 107281 - DNA, 20 bp, Homo sapiens
gtgtgtgtgtgtatgtgtat

SEQ ID NO: 107282 - DNA, 23 bp, Homo sapiens
tagtatatgtatatgtatacaca

SEQ ID NO: 107283 - DNA, 23 bp, Homo sapiens
aatctctctctgtgtctctgagc

SEQ ID NO: 107284 - DNA, 22 bp, Homo sapiens
tcattctttatgtggctgtgta

SEQ ID NO: 107285 - DNA, 23 bp, Homo sapiens
gatatatgtatatgtatacatca

SEQ ID NO: 107286 - DNA, 19 bp, Homo sapiens
tgtgtgtatgcatgtgtat

SEQ ID NO: 107287 - DNA, 19 bp, Homo sapiens
aaatgtccaatatgcatga

SEQ ID NO: 107288 - DNA, 23 bp, Homo sapiens
tatggtggaagtagtatgtttag

SEQ ID NO: 107289 - DNA, 23 bp, Homo sapiens
gggactgagtccactatgtcttt

SEQ ID NO: 107290 - DNA, 23 bp, Homo sapiens
tataatgatgatcaagtccaggt

SEQ ID NO: 107291 - DNA, 23 bp, Homo sapiens
gtatatggttgttgaatgtttct

SEQ ID NO: 107292 - DNA, 23 bp, Homo sapiens
tgtcactcagactggaagtgtgg

SEQ ID NO: 107293 - DNA, 21 bp, Homo sapiens
tcactgcagtcttgactcaag

SEQ ID NO: 107294 - DNA, 18 bp, Homo sapiens
atggaggactgactgtat

SEQ ID NO: 107295 - DNA, 23 bp, Homo sapiens
tgtgtctgtgtgcatgtgtgtgt

SEQ ID NO: 107296 - DNA, 21 bp, Homo sapiens
tctcagcatattgaaacctga

SEQ ID NO: 107297 - DNA, 23 bp, Homo sapiens
ttttgtatctgaggaagctagtc

SEQ ID NO: 107298 - DNA, 22 bp, Homo sapiens
atggaggtggagtcttgttctg

SEQ ID NO: 107299 - DNA, 23 bp, Homo sapiens
cggagtctcgctctgtcgctcag

SEQ ID NO: 107300 - DNA, 23 bp, Homo sapiens
acctagtagactgtataaatgtt

SEQ ID NO: 107301 - DNA, 22 bp, Homo sapiens
tttattaatgtacagggactgg

SEQ ID NO: 107302 - DNA, 22 bp, Homo sapiens
tatatgtatatctatgtgtgtg

SEQ ID NO: 107303 - DNA, 22 bp, Homo sapiens
tgtgtatatatgtatatatgtg

SEQ ID NO: 107304 - DNA, 23 bp, Homo sapiens
tatgtgtatatatatatgtgtgt

SEQ ID NO: 107305 - DNA, 20 bp, Homo sapiens
agtgtgaataacatgtcagt

SEQ ID NO: 107306 - DNA, 20 bp, Homo sapiens
actgtctgtgggtctctcag

SEQ ID NO: 107307 - DNA, 23 bp, Homo sapiens
gacagagtctcgctctgtcaccc

SEQ ID NO: 107308 - DNA, 19 bp, Homo sapiens
tacatatttatggactatg

SEQ ID NO: 107309 - DNA, 23 bp, Homo sapiens
aggtccatgttttggtgcagatt

SEQ ID NO: 107310 - DNA, 23 bp, Homo sapiens
ctgggtgacagtgtgacactctg

SEQ ID NO: 107311 - DNA, 23 bp, Homo sapiens
aattcatccaaccctgtgtgtct

SEQ ID NO: 107312 - DNA, 23 bp, Homo sapiens
ttgttttgcttgctgttgttatc

SEQ ID NO: 107313 - DNA, 22 bp, Homo sapiens
tgtcactcactgattcaccaaa

SEQ ID NO: 107314 - DNA, 23 bp, Homo sapiens
tttgacaggatgagtagacaggc

SEQ ID NO: 107315 - DNA, 22 bp, Homo sapiens
atttactatggctattgtcttt

SEQ ID NO: 107316 - DNA, 20 bp, Homo sapiens
agagatgagggtatcgccat

SEQ ID NO: 107317 - DNA, 18 bp, Homo sapiens
ggtcccacagtctcactg

SEQ ID NO: 107318 - DNA, 19 bp, Homo sapiens
tttttgtatggataggtgt

SEQ ID NO: 107319 - DNA, 23 bp, Homo sapiens
tgagtctcactctgtcacccagg

SEQ ID NO: 107320 - DNA, 23 bp, Homo sapiens
tatgtatatatgtatgtatgatg

SEQ ID NO: 107321 - DNA, 23 bp, Homo sapiens
tacacacacgtatgtatgtgaca

SEQ ID NO: 107322 - DNA, 23 bp, Homo sapiens
acaaagtctccctctgtcaccca

SEQ ID NO: 107323 - DNA, 23 bp, Homo sapiens
tccctcactctctgcctctcctg

SEQ ID NO: 107324 - DNA, 23 bp, Homo sapiens
tagtacagacagggtctcatctg

SEQ ID NO: 107325 - DNA, 18 bp, Homo sapiens
taccaagtagctgggatt

SEQ ID NO: 107326 - DNA, 20 bp, Homo sapiens
tttttggtacagatggggtt

SEQ ID NO: 107327 - DNA, 23 bp, Homo sapiens
ttttaagttctttgagaaattgc

SEQ ID NO: 107328 - DNA, 23 bp, Homo sapiens
aagacagacacacactcagtggt

SEQ ID NO: 107329 - DNA, 23 bp, Homo sapiens
gagacacagtgtcgctctgtcac

SEQ ID NO: 107330 - DNA, 18 bp, Homo sapiens
gtgtaattggccctgtga

SEQ ID NO: 107331 - DNA, 22 bp, Homo sapiens
tgtttcatttcacagcctgctc

SEQ ID NO: 107332 - DNA, 23 bp, Homo sapiens
tacagaacagagggagctgatgt

SEQ ID NO: 107333 - DNA, 23 bp, Homo sapiens
gggtctcactctgtcacccaggc

SEQ ID NO: 107334 - DNA, 23 bp, Homo sapiens
agtagaggtagataacagtacct

SEQ ID NO: 107335 - DNA, 23 bp, Homo sapiens
cgactcagtctctgagtgggtgg

SEQ ID NO: 107336 - DNA, 23 bp, Homo sapiens
ttgtcagagctacatgttgcaaa

SEQ ID NO: 107337 - DNA, 23 bp, Homo sapiens
agtcggagtctcactcccagtct

SEQ ID NO: 107338 - DNA, 23 bp, Homo sapiens
tctgtgcctcagtgtctctgaaa

SEQ ID NO: 107339 - DNA, 23 bp, Homo sapiens
tcccagtcagactctgtgtctcc

SEQ ID NO: 107340 - DNA, 23 bp, Homo sapiens
gctcaaagagtgcatagttctgt

SEQ ID NO: 107341 - DNA, 19 bp, Homo sapiens
tggcagagaactgtgaaag

SEQ ID NO: 107342 - DNA, 23 bp, Homo sapiens
tgtgagcctgagtgcctccttaa

SEQ ID NO: 107343 - DNA, 23 bp, Homo sapiens
tgagttcattgtagattctggat

SEQ ID NO: 107344 - DNA, 23 bp, Homo sapiens
tgagttcattgtagattctggat

SEQ ID NO: 107345 - DNA, 23 bp, Homo sapiens
tgagttcattgtagattctggat

SEQ ID NO: 107346 - DNA, 23 bp, Homo sapiens
tgagttcattgtagattctggat

SEQ ID NO: 107347 - DNA, 23 bp, Homo sapiens
taagctccatttacaggactttg

SEQ ID NO: 107348 - DNA, 23 bp, Homo sapiens
tttctctctcagtaagtcactgt

SEQ ID NO: 107349 - DNA, 22 bp, Homo sapiens
atatatgtatattcagcatgta

SEQ ID NO: 107350 - DNA, 23 bp, Homo sapiens
tgagttcattgtagattctggat

SEQ ID NO: 107351 - DNA, 23 bp, Homo sapiens
tgagttcattgtagattctggat

SEQ ID NO: 107352 - DNA, 23 bp, Homo sapiens
ttagtgtgtgcttgaagagaggt

SEQ ID NO: 107353 - DNA, 20 bp, Homo sapiens
tatgtatattcatgtacatg

SEQ ID NO: 107354 - DNA, 18 bp, Homo sapiens
caactacatgcagtgtgt

SEQ ID NO: 107355 - DNA, 21 bp, Homo sapiens
tgactattgttgtgaatgcaa

SEQ ID NO: 107356 - DNA, 23 bp, Homo sapiens
tgtaagcctaagaattcaccaag

SEQ ID NO: 107357 - DNA, 23 bp, Homo sapiens
agacagtagatacactgcacata

SEQ ID NO: 107358 - DNA, 23 bp, Homo sapiens
gtgagttgagtcttgctctgtca

SEQ ID NO: 107359 - DNA, 23 bp, Homo sapiens
tgagcaaggacaagttttgtgtt

SEQ ID NO: 107360 - DNA, 23 bp, Homo sapiens
tgtgatgcctctgtatttgttct

SEQ ID NO: 107361 - DNA, 22 bp, Homo sapiens
ttctgtcactataacatgtctt

SEQ ID NO: 107362 - DNA, 23 bp, Homo sapiens
tgtgtgtctctgtatgtgagatg

SEQ ID NO: 107363 - DNA, 19 bp, Homo sapiens
agcacactgatgggtcttg

SEQ ID NO: 107364 - DNA, 21 bp, Homo sapiens
ttcactcatggtttggctctc

SEQ ID NO: 107365 - DNA, 23 bp, Homo sapiens
tttctcagagattttgttcatcc

SEQ ID NO: 107366 - DNA, 23 bp, Homo sapiens
tgagttaattagaagaactggtc

SEQ ID NO: 107367 - DNA, 23 bp, Homo sapiens
agagtctcactctgtcacccagg

SEQ ID NO: 107368 - DNA, 23 bp, Homo sapiens
tcacagggtctgtgtctgcctga

SEQ ID NO: 107369 - DNA, 21 bp, Homo sapiens
tttcatgtttttaattggagg

SEQ ID NO: 107370 - DNA, 21 bp, Homo sapiens
atagtgtctccagtagaagag

SEQ ID NO: 107371 - DNA, 23 bp, Homo sapiens
gggatcttgaaagtgctgtgttt

SEQ ID NO: 107372 - DNA, 23 bp, Homo sapiens
tgggactgactgactctgctgga

SEQ ID NO: 107373 - DNA, 23 bp, Homo sapiens
tctctacagccttaccagcatct

SEQ ID NO: 107374 - DNA, 21 bp, Homo sapiens
tgactagaggcttttcccttg

SEQ ID NO: 107375 - DNA, 22 bp, Homo sapiens
atggagtctcgttttgttgccc

SEQ ID NO: 107376 - DNA, 23 bp, Homo sapiens
acagtactgagtgaggagctggt

SEQ ID NO: 107377 - DNA, 20 bp, Homo sapiens
tatatatatgattacatatg

SEQ ID NO: 107378 - DNA, 23 bp, Homo sapiens
gcagcaagtgaacatgtgtctga

SEQ ID NO: 107379 - DNA, 23 bp, Homo sapiens
gccactgtctctctgtggctggg

SEQ ID NO: 107380 - DNA, 21 bp, Homo sapiens
tctggctgtcccagaactgag

SEQ ID NO: 107381 - DNA, 23 bp, Homo sapiens
gtctctgactttctctctctcat

SEQ ID NO: 107382 - DNA, 19 bp, Homo sapiens
accaagattctgtctgaaa

SEQ ID NO: 107383 - DNA, 23 bp, Homo sapiens
agagtgagatgggatctgtctct

SEQ ID NO: 107384 - DNA, 23 bp, Homo sapiens
gtctctgtctgtcactcaggctg

SEQ ID NO: 107385 - DNA, 22 bp, Homo sapiens
atcacaactcactgcagccttg

SEQ ID NO: 107386 - DNA, 22 bp, Homo sapiens
tgggacggagagtggaaagctt

SEQ ID NO: 107387 - DNA, 23 bp, Homo sapiens
tgtcagtctctttgtctgcccta

SEQ ID NO: 107388 - DNA, 23 bp, Homo sapiens
tctttggttatctagctgtatga

SEQ ID NO: 107389 - DNA, 22 bp, Homo sapiens
ataaagctagataaccgaaagt

SEQ ID NO: 107390 - DNA, 19 bp, Homo sapiens
aaacagaatcttgctctat

SEQ ID NO: 107391 - DNA, 19 bp, Homo sapiens
tgcagtgaaccgacatcat

SEQ ID NO: 107392 - DNA, 23 bp, Homo sapiens
tgagatggagtctggctctgtcg

SEQ ID NO: 107393 - DNA, 23 bp, Homo sapiens
agacagggactgagaggggtttt

SEQ ID NO: 107394 - DNA, 23 bp, Homo sapiens
tgagatggagtcccactctgttg

SEQ ID NO: 107395 - DNA, 23 bp, Homo sapiens
tgagacggagtctcgctgtgtct

SEQ ID NO: 107396 - DNA, 23 bp, Homo sapiens
taaccactgcaaatctttttttt

SEQ ID NO: 107397 - DNA, 23 bp, Homo sapiens
tttggttgagaagaggtctcact

SEQ ID NO: 107398 - DNA, 23 bp, Homo sapiens
agtggtacggtcacttgaagcca

SEQ ID NO: 107399 - DNA, 21 bp, Homo sapiens
agagctgggagattcagggga

SEQ ID NO: 107400 - DNA, 23 bp, Homo sapiens
gacagagtctctcgctctgtcac

SEQ ID NO: 107401 - DNA, 23 bp, Homo sapiens
gcctgcactgactgactcgctgt

SEQ ID NO: 107402 - DNA, 23 bp, Homo sapiens
attgtgactgcgtttattctctc

SEQ ID NO: 107403 - DNA, 23 bp, Homo sapiens
ttttgagacagagtcttgctctg

SEQ ID NO: 107404 - DNA, 23 bp, Homo sapiens
tttttagtagagacgggctttca

SEQ ID NO: 107405 - DNA, 23 bp, Homo sapiens
ggagtctcactctgtcacctagg

SEQ ID NO: 107406 - DNA, 23 bp, Homo sapiens
gggtctcactctgtcacccaggc

SEQ ID NO: 107407 - DNA, 23 bp, Homo sapiens
gggtctcactctgtcaccctcgc

SEQ ID NO: 107408 - DNA, 23 bp, Homo sapiens
gagtagagtggcgcaatcttggc

SEQ ID NO: 107409 - DNA, 23 bp, Homo sapiens
cagagtctctgtgtgtttcccag

SEQ ID NO: 107410 - DNA, 23 bp, Homo sapiens
agcagaacatggaagtatgtggg

SEQ ID NO: 107411 - DNA, 22 bp, Homo sapiens
tgtgagggagattaaagaagtt

SEQ ID NO: 107412 - DNA, 20 bp, Homo sapiens
gtgagcctctgtgcctggca

SEQ ID NO: 107413 - DNA, 18 bp, Homo sapiens
agtgagctactgcacctg

SEQ ID NO: 107414 - DNA, 23 bp, Homo sapiens
tctgtagataattgtttggattt

SEQ ID NO: 107415 - DNA, 23 bp, Homo sapiens
tgtgtgtatatatatatgtgtgt

SEQ ID NO: 107416 - DNA, 19 bp, Homo sapiens
gaggaggagtgaagctggt

SEQ ID NO: 107417 - DNA, 20 bp, Homo sapiens
tgagacagagtctcgctctg

SEQ ID NO: 107418 - DNA, 23 bp, Homo sapiens
gacggtgtctcgctctgtcaccc

SEQ ID NO: 107419 - DNA, 23 bp, Homo sapiens
agtctcactgtgtcacccaggct

SEQ ID NO: 107420 - DNA, 22 bp, Homo sapiens
tacaggcatgaggctctgtgcc

SEQ ID NO: 107421 - DNA, 23 bp, Homo sapiens
ttcttgggacagggtctcactct

SEQ ID NO: 107422 - DNA, 23 bp, Homo sapiens
atggagtctcactctgtcaccca

SEQ ID NO: 107423 - DNA, 22 bp, Homo sapiens
gagtctcactctgtcacccagg

SEQ ID NO: 107424 - DNA, 23 bp, Homo sapiens
tactagattagagattttgctga

SEQ ID NO: 107425 - DNA, 18 bp, Homo sapiens
agtgagcctccctctttt

SEQ ID NO: 107426 - DNA, 23 bp, Homo sapiens
aagaaagtgaggatagctgcatg

SEQ ID NO: 107427 - DNA, 23 bp, Homo sapiens
aggcaaacagattttgttgttct

SEQ ID NO: 107428 - DNA, 21 bp, Homo sapiens
tgtctggctccctcactcccc

SEQ ID NO: 107429 - DNA, 23 bp, Homo sapiens
gagacagagtctcgctctgtcgc

SEQ ID NO: 107430 - DNA, 19 bp, Homo sapiens
taagatagtctcgctctgt

SEQ ID NO: 107431 - DNA, 23 bp, Homo sapiens
agtagagagaaatgagtgagcag

SEQ ID NO: 107432 - DNA, 23 bp, Homo sapiens
tgttctctgtgtccctcagtctg

SEQ ID NO: 107433 - DNA, 22 bp, Homo sapiens
gagagagagcagttggagctgg

SEQ ID NO: 107434 - DNA, 23 bp, Homo sapiens
tttgagacggagtctcgctctgt

SEQ ID NO: 107435 - DNA, 23 bp, Homo sapiens
cttttagacagagcttcttgata

SEQ ID NO: 107436 - DNA, 20 bp, Homo sapiens
aaaaggaacagataggctgt

SEQ ID NO: 107437 - DNA, 23 bp, Homo sapiens
tgagttcattgtagattctggat

SEQ ID NO: 107438 - DNA, 23 bp, Homo sapiens
tgagttcattgtagattctggat

SEQ ID NO: 107439 - DNA, 23 bp, Homo sapiens
acagggtcttgctctgtcacgtg

SEQ ID NO: 107440 - DNA, 23 bp, Homo sapiens
ctctctctgagtctgtttcctca

SEQ ID NO: 107441 - DNA, 22 bp, Homo sapiens
tgcacactgagaattgtcatgg

SEQ ID NO: 107442 - DNA, 23 bp, Homo sapiens
tgagttcattgtagattctggat

SEQ ID NO: 107443 - DNA, 23 bp, Homo sapiens
tgagttcattgtagattctggat

SEQ ID NO: 107444 - DNA, 23 bp, Homo sapiens
tatagttttatatacatatgtga

SEQ ID NO: 107445 - DNA, 23 bp, Homo sapiens
ctctgtgagtcagtcacttacct

SEQ ID NO: 107446 - DNA, 23 bp, Homo sapiens
agagtctcactctgtcacccagg

SEQ ID NO: 107447 - DNA, 23 bp, Homo sapiens
aggtcatgcaggtaataagtggc

SEQ ID NO: 107448 - DNA, 20 bp, Homo sapiens
agtgtatatatgtatatatg

SEQ ID NO: 107449 - DNA, 20 bp, Homo sapiens
atatatactttacgtaaagt

SEQ ID NO: 107450 - DNA, 19 bp, Homo sapiens
atatatactttacgtaaag

SEQ ID NO: 107451 - DNA, 23 bp, Homo sapiens
tctctccctgtgtctttcccaac

SEQ ID NO: 107452 - DNA, 22 bp, Homo sapiens
aaaaggaggtgagacagagaga

SEQ ID NO: 107453 - DNA, 23 bp, Homo sapiens
agagtctcactctgtcacccagg

SEQ ID NO: 107454 - DNA, 23 bp, Homo sapiens
tgtgaggtgacggtgagtgtttt

SEQ ID NO: 107455 - DNA, 22 bp, Homo sapiens
tctcgctctgtctcccaggctg

SEQ ID NO: 107456 - DNA, 23 bp, Homo sapiens
cttcccactctcactcagcctca

SEQ ID NO: 107457 - DNA, 19 bp, Homo sapiens
tgcatttgtagtcccagct

SEQ ID NO: 107458 - DNA, 23 bp, Homo sapiens
ggagtctcactctgtcacccagg

SEQ ID NO: 107459 - DNA, 19 bp, Homo sapiens
tttgacaacactgggtcag

SEQ ID NO: 107460 - DNA, 20 bp, Homo sapiens
tgacagagcacagactttgt

SEQ ID NO: 107461 - DNA, 22 bp, Homo sapiens
ttgagagtctccctctgtcgcc

SEQ ID NO: 107462 - DNA, 23 bp, Homo sapiens
gtataaggttcctctgcagccag

SEQ ID NO: 107463 - DNA, 23 bp, Homo sapiens
cggagtctcactgtgtcacccag

SEQ ID NO: 107464 - DNA, 22 bp, Homo sapiens
tatatgcatgtcttctagaaga

SEQ ID NO: 107465 - DNA, 22 bp, Homo sapiens
agagcctggacatgttttccat

SEQ ID NO: 107466 - DNA, 23 bp, Homo sapiens
ggtctcactctgtctctctacct

SEQ ID NO: 107467 - DNA, 23 bp, Homo sapiens
ggagtctcactctgtcactcagg

SEQ ID NO: 107468 - DNA, 22 bp, Homo sapiens
tgtctctacaaaagaaaacttt

SEQ ID NO: 107469 - DNA, 22 bp, Homo sapiens
tttgagacggagtttcactctg

SEQ ID NO: 107470 - DNA, 23 bp, Homo sapiens
ctctgtgtgtgtgtgtgtgtata

SEQ ID NO: 107471 - DNA, 23 bp, Homo sapiens
tatagtgtatgtgtatatatgca

SEQ ID NO: 107472 - DNA, 23 bp, Homo sapiens
tgaaatcaactaagtcagtgaga

SEQ ID NO: 107473 - DNA, 23 bp, Homo sapiens
agagtctcactctgtcacccagg

SEQ ID NO: 107474 - DNA, 23 bp, Homo sapiens
cagggtctcactgtgtccctcag

SEQ ID NO: 107475 - DNA, 23 bp, Homo sapiens
atgagttttcagtctgagtgaca

SEQ ID NO: 107476 - DNA, 23 bp, Homo sapiens
ttatatttcagaagattgtgaac

SEQ ID NO: 107477 - DNA, 22 bp, Homo sapiens
tcacagtctttgtgtcacagat

SEQ ID NO: 107478 - DNA, 23 bp, Homo sapiens
tttctcaccctggtttgaggtgc

SEQ ID NO: 107479 - DNA, 23 bp, Homo sapiens
tgtcaaccatttttttccatgat

SEQ ID NO: 107480 - DNA, 18 bp, Homo sapiens
tgaacatctggagatagt

SEQ ID NO: 107481 - DNA, 23 bp, Homo sapiens
agtgtctcactttgtcactcagg

SEQ ID NO: 107482 - DNA, 21 bp, Homo sapiens
agagtggcacgatgtcatctc

SEQ ID NO: 107483 - DNA, 23 bp, Homo sapiens
ttcagtgactgtagtcagtgagt

SEQ ID NO: 107484 - DNA, 21 bp, Homo sapiens
tctgtgagtgagtgaaatctc

SEQ ID NO: 107485 - DNA, 19 bp, Homo sapiens
agagaacagtcaaagctct

SEQ ID NO: 107486 - DNA, 19 bp, Homo sapiens
tgaggtcaatgtgaagggt

SEQ ID NO: 107487 - DNA, 19 bp, Homo sapiens
tctctctgtcagtatttgg

SEQ ID NO: 107488 - DNA, 23 bp, Homo sapiens
tggattcatttattttgaaatgg

SEQ ID NO: 107489 - DNA, 23 bp, Homo sapiens
tttctcaccctggtttgaggtgc

SEQ ID NO: 107490 - DNA, 23 bp, Homo sapiens
ttcagtgactgtagtcagtgagt

SEQ ID NO: 107491 - DNA, 21 bp, Homo sapiens
tctgtgagtgagtgaaatctc

SEQ ID NO: 107492 - DNA, 19 bp, Homo sapiens
agagaacagtcaaagctct

SEQ ID NO: 107493 - DNA, 19 bp, Homo sapiens
tgaggtcaatgtgaagggt

SEQ ID NO: 107494 - DNA, 23 bp, Homo sapiens
gactgagtctcactctgtcacct

SEQ ID NO: 107495 - DNA, 20 bp, Homo sapiens
agtggtgtgatcttagctca

SEQ ID NO: 107496 - DNA, 23 bp, Homo sapiens
tacatgtgcagtatgtgcaggtt

SEQ ID NO: 107497 - DNA, 22 bp, Homo sapiens
tggagtctcactctgtggccca

SEQ ID NO: 107498 - DNA, 23 bp, Homo sapiens
tacagtatatatgtatatgtgta

SEQ ID NO: 107499 - DNA, 22 bp, Homo sapiens
atatacacctatatatagtgtg

SEQ ID NO: 107500 - DNA, 23 bp, Homo sapiens
aaaactctcaatttcaaaaaatg

SEQ ID NO: 107501 - DNA, 23 bp, Homo sapiens
gatagtcttgctctgtctcatct

SEQ ID NO: 107502 - DNA, 19 bp, Homo sapiens
tctctctgtcagtatttgg

SEQ ID NO: 107503 - DNA, 19 bp, Homo sapiens
tctctctgtcagtatttgg

SEQ ID NO: 107504 - DNA, 23 bp, Homo sapiens
tggagtctcactctgtcacccag

SEQ ID NO: 107505 - DNA, 18 bp, Homo sapiens
gactctgtgtcgctgtgt

SEQ ID NO: 107506 - DNA, 22 bp, Homo sapiens
atgtgccactgctatattacag

SEQ ID NO: 107507 - DNA, 23 bp, Homo sapiens
ttgtgacagggtctcattctgtc

SEQ ID NO: 107508 - DNA, 23 bp, Homo sapiens
cagacgtgtactaccacactctg

SEQ ID NO: 107509 - DNA, 23 bp, Homo sapiens
ctcttacactcagtttcttcatc

SEQ ID NO: 107510 - DNA, 23 bp, Homo sapiens
tttttttgagacggagtcttgcg

SEQ ID NO: 107511 - DNA, 23 bp, Homo sapiens
tctctgtgatccactctctctct

SEQ ID NO: 107512 - DNA, 23 bp, Homo sapiens
tttgagacggagtctcgctctgt

SEQ ID NO: 107513 - DNA, 18 bp, Homo sapiens
tgtctctctatgtctctg

SEQ ID NO: 107514 - DNA, 23 bp, Homo sapiens
tgtgtctgtcttttctcagagtg

SEQ ID NO: 107515 - DNA, 23 bp, Homo sapiens
atctcaggtgtgagtgcagtaaa

SEQ ID NO: 107516 - DNA, 22 bp, Homo sapiens
atgtgccactgctatattacag

SEQ ID NO: 107517 - DNA, 23 bp, Homo sapiens
ttgtgacagggtctcattctgtc

SEQ ID NO: 107518 - DNA, 22 bp, Homo sapiens
acggagtctcgctctgtcaccc

SEQ ID NO: 107519 - DNA, 23 bp, Homo sapiens
gagggagtctcgctctgtcaccc

SEQ ID NO: 107520 - DNA, 23 bp, Homo sapiens
aaaaaacagcttttcttccggga

SEQ ID NO: 107521 - DNA, 20 bp, Homo sapiens
aggaagtttgtttttttgtt

SEQ ID NO: 107522 - DNA, 22 bp, Homo sapiens
aaatctcagtggtaattaactg

SEQ ID NO: 107523 - DNA, 18 bp, Homo sapiens
tgtgtgtgtgtgtgtgtg

SEQ ID NO: 107524 - DNA, 23 bp, Homo sapiens
atctgtgtgtatgtgtttgcatg

SEQ ID NO: 107525 - DNA, 23 bp, Homo sapiens
gggtctcactctctcactatgga

SEQ ID NO: 107526 - DNA, 23 bp, Homo sapiens
ctctgtaaagaaagaggactgga

SEQ ID NO: 107527 - DNA, 22 bp, Homo sapiens
ctgtgtgtgtctctgcatgtga

SEQ ID NO: 107528 - DNA, 20 bp, Homo sapiens
cagcacactgatgggtcttg

SEQ ID NO: 107529 - DNA, 23 bp, Homo sapiens
tggagtctcactctgtcacccag

SEQ ID NO: 107530 - DNA, 23 bp, Homo sapiens
tgagttcattgtagattctggat

SEQ ID NO: 107531 - DNA, 23 bp, Homo sapiens
tgagttcattgtagattctggat

SEQ ID NO: 107532 - DNA, 21 bp, Homo sapiens
gtgtgtgtgcatgtgcatgtg

SEQ ID NO: 107533 - DNA, 23 bp, Homo sapiens
tggagtctcactctgtcacccag

SEQ ID NO: 107534 - DNA, 23 bp, Homo sapiens
tggttggttcttgattcccatgt

SEQ ID NO: 107535 - DNA, 23 bp, Homo sapiens
ttgacaggaattttgaatggtcc

SEQ ID NO: 107536 - DNA, 23 bp, Homo sapiens
attcatcttcttccgctcttttt

SEQ ID NO: 107537 - DNA, 23 bp, Homo sapiens
ggagtctctctctgtcactcagg

SEQ ID NO: 107538 - DNA, 22 bp, Homo sapiens
tgacttctgcaactagagtcaa

SEQ ID NO: 107539 - DNA, 20 bp, Homo sapiens
gtcagactgtctgtctgggg

SEQ ID NO: 107540 - DNA, 18 bp, Homo sapiens
ctgggacacgatgtcttc

SEQ ID NO: 107541 - DNA, 23 bp, Homo sapiens
ttttcaaactacagacagttttg

SEQ ID NO: 107542 - DNA, 23 bp, Homo sapiens
gttttgaattctgatttgtaatc

SEQ ID NO: 107543 - DNA, 19 bp, Homo sapiens
gcatgttgtatgtgtggag

SEQ ID NO: 107544 - DNA, 23 bp, Homo sapiens
gagacagagtctcactctgttac

SEQ ID NO: 107545 - DNA, 18 bp, Homo sapiens
tctgcacttcctgctccc

SEQ ID NO: 107546 - DNA, 18 bp, Homo sapiens
tcacattggctttcatga

SEQ ID NO: 107547 - DNA, 19 bp, Homo sapiens
ctctgcttcttctttgctg

SEQ ID NO: 107548 - DNA, 18 bp, Homo sapiens
aatgaaagtgctaggtaa

SEQ ID NO: 107549 - DNA, 22 bp, Homo sapiens
tgactgatgatactgaccatct

SEQ ID NO: 107550 - DNA, 23 bp, Homo sapiens
attttctctggttgtatttccac

SEQ ID NO: 107551 - DNA, 23 bp, Homo sapiens
tgtctctgtggctgatttctgat

SEQ ID NO: 107552 - DNA, 21 bp, Homo sapiens
atatgtgtatatatatatgtg

SEQ ID NO: 107553 - DNA, 20 bp, Homo sapiens
atatatgtatatatgtatac

SEQ ID NO: 107554 - DNA, 20 bp, Homo sapiens
tgtatatatgtatatatgta

SEQ ID NO: 107555 - DNA, 23 bp, Homo sapiens
tgagttcattgtagattctggat

SEQ ID NO: 107556 - DNA, 23 bp, Homo sapiens
tgagttcattgtagattctggat

SEQ ID NO: 107557 - DNA, 23 bp, Homo sapiens
ttatctttggtattctgtctgta

SEQ ID NO: 107558 - DNA, 23 bp, Homo sapiens
tgagttcattgtagattctggat

SEQ ID NO: 107559 - DNA, 23 bp, Homo sapiens
tgagttcattgtagattctggat

SEQ ID NO: 107560 - DNA, 23 bp, Homo sapiens
tacatgtgcacattgtgcaggtt

SEQ ID NO: 107561 - DNA, 23 bp, Homo sapiens
tgagttcattgtagattctggat

SEQ ID NO: 107562 - DNA, 23 bp, Homo sapiens
tgagttcattgtagattctggat

SEQ ID NO: 107563 - DNA, 21 bp, Homo sapiens
acatgtgcacattgtgcaggt

SEQ ID NO: 107564 - DNA, 19 bp, Homo sapiens
gtatgtatatatatgtata

SEQ ID NO: 107565 - DNA, 23 bp, Homo sapiens
cagtctgtcacccacactggagt

SEQ ID NO: 107566 - DNA, 23 bp, Homo sapiens
atgtgtatatatacatatgtgtg

SEQ ID NO: 107567 - DNA, 23 bp, Homo sapiens
tatgtgtatatatacatatgtgt

SEQ ID NO: 107568 - DNA, 21 bp, Homo sapiens
tatatatgtatatgtatacac

SEQ ID NO: 107569 - DNA, 20 bp, Homo sapiens
gtatatataactgtatgcgt

SEQ ID NO: 107570 - DNA, 23 bp, Homo sapiens
atatcaaggtctcagtatgataa

SEQ ID NO: 107571 - DNA, 23 bp, Homo sapiens
tgattacatactgaaatgatgaa

SEQ ID NO: 107572 - DNA, 23 bp, Homo sapiens
cttagaagatcaggaggtggtat

SEQ ID NO: 107573 - DNA, 23 bp, Homo sapiens
tgagtcggagtctcactctgtcg

SEQ ID NO: 107574 - DNA, 23 bp, Homo sapiens
gtctcagagaacagtgtcagggg

SEQ ID NO: 107575 - DNA, 23 bp, Homo sapiens
gatagtattcacaggagtgttgt

SEQ ID NO: 107576 - DNA, 22 bp, Homo sapiens
ttttagtagagatggggtttca

SEQ ID NO: 107577 - DNA, 23 bp, Homo sapiens
gctagaagtttgagaccactcgg

SEQ ID NO: 107578 - DNA, 23 bp, Homo sapiens
tggagtctcactctgtcgctcag

SEQ ID NO: 107579 - DNA, 20 bp, Homo sapiens
actgtgctctctgtctctga

SEQ ID NO: 107580 - DNA, 23 bp, Homo sapiens
tgagttcattgtagattctggat

SEQ ID NO: 107581 - DNA, 23 bp, Homo sapiens
tgagttcattgtagattctggat

SEQ ID NO: 107582 - DNA, 19 bp, Homo sapiens
atacacacacttatacatt

SEQ ID NO: 107583 - DNA, 23 bp, Homo sapiens
tgtatttgaatgtatatatgtgt

SEQ ID NO: 107584 - DNA, 18 bp, Homo sapiens
tctttttatggaggaatg

SEQ ID NO: 107585 - DNA, 21 bp, Homo sapiens
tgtgtgtgtgtatatatatac

SEQ ID NO: 107586 - DNA, 20 bp, Homo sapiens
gcaatactagaatatttgaa

SEQ ID NO: 107587 - DNA, 22 bp, Homo sapiens
acactaatgatcatgtacaatg

SEQ ID NO: 107588 - DNA, 23 bp, Homo sapiens
actctctttttctctctggtagt

SEQ ID NO: 107589 - DNA, 23 bp, Homo sapiens
gttcacatacaaaccagttttac

SEQ ID NO: 107590 - DNA, 23 bp, Homo sapiens
aaattatgtttttgtatgtgtca

SEQ ID NO: 107591 - DNA, 23 bp, Homo sapiens
acagacacacatataaatgtgta

SEQ ID NO: 107592 - DNA, 18 bp, Homo sapiens
tgtatatatatatgtgtg

SEQ ID NO: 107593 - DNA, 21 bp, Homo sapiens
tgaggtagaaggatcacctga

SEQ ID NO: 107594 - DNA, 23 bp, Homo sapiens
tgagttcattgtagattctggat

SEQ ID NO: 107595 - DNA, 23 bp, Homo sapiens
tgagttcattgtagattctggat

SEQ ID NO: 107596 - DNA, 23 bp, Homo sapiens
aaagaagtcagagaggagagtcc

SEQ ID NO: 107597 - DNA, 23 bp, Homo sapiens
aaactgtctctgcgtctctcagc

SEQ ID NO: 107598 - DNA, 22 bp, Homo sapiens
ctgccacactcagtcattggct

SEQ ID NO: 107599 - DNA, 23 bp, Homo sapiens
ttctgtgtctgtgagtccctcag

SEQ ID NO: 107600 - DNA, 21 bp, Homo sapiens
tgtgaagaaagtcattggtag

SEQ ID NO: 107601 - DNA, 23 bp, Homo sapiens
tatacattgtatagagagatgta

SEQ ID NO: 107602 - DNA, 23 bp, Homo sapiens
tctgtggagctgttagtgtagtg

SEQ ID NO: 107603 - DNA, 23 bp, Homo sapiens
gacaaggtcttgctctgttaccc

SEQ ID NO: 107604 - DNA, 23 bp, Homo sapiens
ggctccctgtgtgggtctgcagt

SEQ ID NO: 107605 - DNA, 21 bp, Homo sapiens
tcagtgtcacactctcaggtc

SEQ ID NO: 107606 - DNA, 23 bp, Homo sapiens
ttaacttccctctgtctcagttt

SEQ ID NO: 107607 - DNA, 21 bp, Homo sapiens
tggcagagctgtgtctctatg

SEQ ID NO: 107608 - DNA, 22 bp, Homo sapiens
tctaatctgtgattgatgatcc

SEQ ID NO: 107609 - DNA, 23 bp, Homo sapiens
tttcattatcattccattagact

SEQ ID NO: 107610 - DNA, 23 bp, Homo sapiens
acagagtctcgctctgtcaccca

SEQ ID NO: 107611 - DNA, 19 bp, Homo sapiens
aatgcaagatgtactattt

SEQ ID NO: 107612 - DNA, 18 bp, Homo sapiens
tctggttctttagagtga

SEQ ID NO: 107613 - DNA, 23 bp, Homo sapiens
cttttagagacagggtctcagtc

SEQ ID NO: 107614 - DNA, 23 bp, Homo sapiens
cagagtctcactctgtctcccag

SEQ ID NO: 107615 - DNA, 23 bp, Homo sapiens
tgtgtgtgtatatatatacgtgt

SEQ ID NO: 107616 - DNA, 23 bp, Homo sapiens
gagtctctgcttgttctatgtgt

SEQ ID NO: 107617 - DNA, 23 bp, Homo sapiens
tatgatctagagggacacagagg

SEQ ID NO: 107618 - DNA, 22 bp, Homo sapiens
tgtaattctgttctttctctgg

SEQ ID NO: 107619 - DNA, 23 bp, Homo sapiens
tgagttcattgtagattctggat

SEQ ID NO: 107620 - DNA, 23 bp, Homo sapiens
tgagttcattgtagattctggat

SEQ ID NO: 107621 - DNA, 23 bp, Homo sapiens
tctgtctgcttttgtagcagtat

SEQ ID NO: 107622 - DNA, 23 bp, Homo sapiens
taaggtgtacagcatgatgtttt

SEQ ID NO: 107623 - DNA, 23 bp, Homo sapiens
tttgaggttacagtgagctgtga

SEQ ID NO: 107624 - DNA, 21 bp, Homo sapiens
acactgggtgacaggctcagt

SEQ ID NO: 107625 - DNA, 23 bp, Homo sapiens
tgtctgagatgtgactttgtact

SEQ ID NO: 107626 - DNA, 21 bp, Homo sapiens
tgatagtgcatgaccagctga

SEQ ID NO: 107627 - DNA, 21 bp, Homo sapiens
ttgagttactatccttttggt

SEQ ID NO: 107628 - DNA, 23 bp, Homo sapiens
ttgatttctgtgtattgatgttg

SEQ ID NO: 107629 - DNA, 23 bp, Homo sapiens
ttgacacagggtctcactgttga

SEQ ID NO: 107630 - DNA, 22 bp, Homo sapiens
tatctttgtaattctaactgta

SEQ ID NO: 107631 - DNA, 23 bp, Homo sapiens
ccgtctcactctgtcacccaggc

SEQ ID NO: 107632 - DNA, 23 bp, Homo sapiens
tgactgacagcatcctgaatgct

SEQ ID NO: 107633 - DNA, 23 bp, Homo sapiens
agacagagtctcgctctgtcgct

SEQ ID NO: 107634 - DNA, 23 bp, Homo sapiens
tggagtctcactctgtcacccag

SEQ ID NO: 107635 - DNA, 23 bp, Homo sapiens
tgagatggagtctggctctgtcg

SEQ ID NO: 107636 - DNA, 23 bp, Homo sapiens
tcacaggggatatgatggcttag

SEQ ID NO: 107637 - DNA, 23 bp, Homo sapiens
agctctgtgtctgtgactcttct

SEQ ID NO: 107638 - DNA, 22 bp, Homo sapiens
atgtgtttggttttgtaccagt

SEQ ID NO: 107639 - DNA, 21 bp, Homo sapiens
tgtagtatagtttgaagtcag

SEQ ID NO: 107640 - DNA, 23 bp, Homo sapiens
cggagtctcactctgtcacccag

SEQ ID NO: 107641 - DNA, 23 bp, Homo sapiens
ttagagtatttttttctgtctct

SEQ ID NO: 107642 - DNA, 19 bp, Homo sapiens
ctctatatatatgtgtgtg

SEQ ID NO: 107643 - DNA, 23 bp, Homo sapiens
atatgtgtatatatatatgtgta

SEQ ID NO: 107644 - DNA, 22 bp, Homo sapiens
atatgtgtatatatatatgtgt

SEQ ID NO: 107645 - DNA, 22 bp, Homo sapiens
tttctgtggtatcggttgtact

SEQ ID NO: 107646 - DNA, 19 bp, Homo sapiens
tctatctatctctattacc

SEQ ID NO: 107647 - DNA, 21 bp, Homo sapiens
ctattttttttttgctttgag

SEQ ID NO: 107648 - DNA, 23 bp, Homo sapiens
agagtggaaagagaccaggccca

SEQ ID NO: 107649 - DNA, 22 bp, Homo sapiens
tgcctctgacactgtctctcct

SEQ ID NO: 107650 - DNA, 21 bp, Homo sapiens
tgatcactcattcactctcag

SEQ ID NO: 107651 - DNA, 23 bp, Homo sapiens
gacagagtctcgctctgtcaccc

SEQ ID NO: 107652 - DNA, 23 bp, Homo sapiens
tgagttcattgtagattctggat

SEQ ID NO: 107653 - DNA, 23 bp, Homo sapiens
tgagttcattgtagattctggat

SEQ ID NO: 107654 - DNA, 23 bp, Homo sapiens
agcctagagagactgaatgattt

SEQ ID NO: 107655 - DNA, 23 bp, Homo sapiens
ggctgactctgtgagtgtgtgtg

SEQ ID NO: 107656 - DNA, 23 bp, Homo sapiens
acagaggagaaagtgaggagtct

SEQ ID NO: 107657 - DNA, 22 bp, Homo sapiens
gtgacagagagagagatcttgt

SEQ ID NO: 107658 - DNA, 23 bp, Homo sapiens
tgaaacagagtctcactctgttg

SEQ ID NO: 107659 - DNA, 23 bp, Homo sapiens
atgacaagttgaaatgagatcaa

SEQ ID NO: 107660 - DNA, 19 bp, Homo sapiens
tttgcatttaatttcatcg

SEQ ID NO: 107661 - DNA, 23 bp, Homo sapiens
tggaattgtagttgtgattggca

SEQ ID NO: 107662 - DNA, 23 bp, Homo sapiens
tatcaactgtaattcttcagaat

SEQ ID NO: 107663 - DNA, 23 bp, Homo sapiens
ttctgtgtctctcactctgggag

SEQ ID NO: 107664 - DNA, 23 bp, Homo sapiens
tgtgtattcatatgtgtgtgtat

SEQ ID NO: 107665 - DNA, 23 bp, Homo sapiens
catgtgtatagatgtatatgtgt

SEQ ID NO: 107666 - DNA, 18 bp, Homo sapiens
aacttcaaagagagcaga

SEQ ID NO: 107667 - DNA, 23 bp, Homo sapiens
atgcaagactttttcttttcttt

SEQ ID NO: 107668 - DNA, 23 bp, Homo sapiens
ttagtattgttaatgatgttgag

SEQ ID NO: 107669 - DNA, 21 bp, Homo sapiens
tggattgacctgtgcaacaca

SEQ ID NO: 107670 - DNA, 18 bp, Homo sapiens
agttttgattatgtgata

SEQ ID NO: 107671 - DNA, 23 bp, Homo sapiens
aaagtgttttctttgctaatgtt

SEQ ID NO: 107672 - DNA, 23 bp, Homo sapiens
tctttctgagtctctgtgagagg

SEQ ID NO: 107673 - DNA, 23 bp, Homo sapiens
tgccagtgactgcagctgcagag

SEQ ID NO: 107674 - DNA, 21 bp, Homo sapiens
tttgtcatcttcacattgagt

SEQ ID NO: 107675 - DNA, 23 bp, Homo sapiens
ggtttgtctcactgtctcagggg

SEQ ID NO: 107676 - DNA, 23 bp, Homo sapiens
atgttcctatatgtatatgtgtg

SEQ ID NO: 107677 - DNA, 21 bp, Homo sapiens
actagcaccaagaaactttgg

SEQ ID NO: 107678 - DNA, 23 bp, Homo sapiens
gaccttctaagttttttgtttgt

SEQ ID NO: 107679 - DNA, 23 bp, Homo sapiens
tctgtctgtctgcctgtctctct

SEQ ID NO: 107680 - DNA, 21 bp, Homo sapiens
taacagccttgttccttgctg

SEQ ID NO: 107681 - DNA, 21 bp, Homo sapiens
gacagacagacagacaggctg

SEQ ID NO: 107682 - DNA, 21 bp, Homo sapiens
tgtatgcatgctagtgtgtgt

SEQ ID NO: 107683 - DNA, 23 bp, Homo sapiens
tgagacggagtctcactctgtca

SEQ ID NO: 107684 - DNA, 19 bp, Homo sapiens
tgtcttaatcttcctgaag

SEQ ID NO: 107685 - DNA, 23 bp, Homo sapiens
tgagttcattgtagattctggat

SEQ ID NO: 107686 - DNA, 23 bp, Homo sapiens
tgagttcattgtagattctggat

SEQ ID NO: 107687 - DNA, 22 bp, Homo sapiens
tttgtcactagtagaaatcagg

SEQ ID NO: 107688 - DNA, 20 bp, Homo sapiens
aagtctcaggttaccatgtg

SEQ ID NO: 107689 - DNA, 20 bp, Homo sapiens
attccacacaagccacatga

SEQ ID NO: 107690 - DNA, 23 bp, Homo sapiens
actgtgcctcacaccctgcctca

SEQ ID NO: 107691 - DNA, 22 bp, Homo sapiens
aaaatcagtgtgctactcatct

SEQ ID NO: 107692 - DNA, 23 bp, Homo sapiens
cactgtgcctcactccctgcctc

SEQ ID NO: 107693 - DNA, 23 bp, Homo sapiens
actgtgcctcacaccctgcctca

SEQ ID NO: 107694 - DNA, 23 bp, Homo sapiens
actgtgcctcacaccctgcctca

SEQ ID NO: 107695 - DNA, 22 bp, Homo sapiens
tctggctggctggctggctggg

SEQ ID NO: 107696 - DNA, 23 bp, Homo sapiens
ttgaggtggagttttgctcttgt

SEQ ID NO: 107697 - DNA, 23 bp, Homo sapiens
gacggagtctcactctgtcgccc

SEQ ID NO: 107698 - DNA, 22 bp, Homo sapiens
agacagggtcttactctgtcac

SEQ ID NO: 107699 - DNA, 23 bp, Homo sapiens
tggctggctcagtgactggcaca

SEQ ID NO: 107700 - DNA, 23 bp, Homo sapiens
atgagagcattctagtctgctag

SEQ ID NO: 107701 - DNA, 23 bp, Homo sapiens
gagtctcacactgtcacccaggc

SEQ ID NO: 107702 - DNA, 23 bp, Homo sapiens
tcagctcactgtaacctctgcct

SEQ ID NO: 107703 - DNA, 20 bp, Homo sapiens
agtggttttaataagttgaa

SEQ ID NO: 107704 - DNA, 22 bp, Homo sapiens
aataaatcagaggcagggtttt

SEQ ID NO: 107705 - DNA, 23 bp, Homo sapiens
tgagacaagagtctcgctctgtc

SEQ ID NO: 107706 - DNA, 23 bp, Homo sapiens
tatgtctttgctagaaatgatac

SEQ ID NO: 107707 - DNA, 20 bp, Homo sapiens
gcagtgatcatagctcattg

SEQ ID NO: 107708 - DNA, 18 bp, Homo sapiens
actcagtttcactcagtt

SEQ ID NO: 107709 - DNA, 23 bp, Homo sapiens
cactaggatgttgcatgttgtat

SEQ ID NO: 107710 - DNA, 20 bp, Homo sapiens
tatagatatatatcatatgt

SEQ ID NO: 107711 - DNA, 19 bp, Homo sapiens
atagatatatatcatatgt

SEQ ID NO: 107712 - DNA, 23 bp, Homo sapiens
atacagatagatatcatatgtat

SEQ ID NO: 107713 - DNA, 23 bp, Homo sapiens
atacagatagatatcatatgtat

SEQ ID NO: 107714 - DNA, 22 bp, Homo sapiens
tatatgatacagatagatatca

SEQ ID NO: 107715 - DNA, 23 bp, Homo sapiens
atatagatagatatcatatgtat

SEQ ID NO: 107716 - DNA, 23 bp, Homo sapiens
atatagatagatatcatatgtat

SEQ ID NO: 107717 - DNA, 21 bp, Homo sapiens
tagatatcatatgtatttata

SEQ ID NO: 107718 - DNA, 23 bp, Homo sapiens
ggtgtgtgcctatagtctcagct

SEQ ID NO: 107719 - DNA, 21 bp, Homo sapiens
tgaggtaggaggatcacttga

SEQ ID NO: 107720 - DNA, 23 bp, Homo sapiens
gactgtctctctgaccctcttca

SEQ ID NO: 107721 - DNA, 23 bp, Homo sapiens
taagagacagtggtaggaggaag

SEQ ID NO: 107722 - DNA, 19 bp, Homo sapiens
ttagctggttattttgccc

SEQ ID NO: 107723 - DNA, 21 bp, Homo sapiens
acagtggtgggattgcaggat

SEQ ID NO: 107724 - DNA, 23 bp, Homo sapiens
aaggaactccatactgctttcca

SEQ ID NO: 107725 - DNA, 23 bp, Homo sapiens
agagtgtcactctgtcacccagg

SEQ ID NO: 107726 - DNA, 23 bp, Homo sapiens
tttgagacggagtctcactcttt

SEQ ID NO: 107727 - DNA, 22 bp, Homo sapiens
gattgtcttggctatgcagact

SEQ ID NO: 107728 - DNA, 23 bp, Homo sapiens
atatgtgtgtatatatatgtgtg

SEQ ID NO: 107729 - DNA, 19 bp, Homo sapiens
tgtccatacatatgtgtgt

SEQ ID NO: 107730 - DNA, 23 bp, Homo sapiens
tatatatctttatgtgtatgtgc

SEQ ID NO: 107731 - DNA, 23 bp, Homo sapiens
atatatctttatgtgtatatatg

SEQ ID NO: 107732 - DNA, 23 bp, Homo sapiens
tgtgtgtgtatctttatatgtgt

SEQ ID NO: 107733 - DNA, 23 bp, Homo sapiens
tttctgtatgtatgtgtgtgtgt

SEQ ID NO: 107734 - DNA, 22 bp, Homo sapiens
tcatttctatttttcttttagt

SEQ ID NO: 107735 - DNA, 18 bp, Homo sapiens
aaatagcttcttctcaga

SEQ ID NO: 107736 - DNA, 20 bp, Homo sapiens
tatatgtatgtatatatgta

SEQ ID NO: 107737 - DNA, 20 bp, Homo sapiens
aatttgtgaaagtttgtagt

SEQ ID NO: 107738 - DNA, 23 bp, Homo sapiens
agttgtgaatatctagaggtgag

SEQ ID NO: 107739 - DNA, 21 bp, Homo sapiens
ttgatttcatagagttcataa

SEQ ID NO: 107740 - DNA, 23 bp, Homo sapiens
aataattgtgattttgttgagat

SEQ ID NO: 107741 - DNA, 19 bp, Homo sapiens
atgtgtgtgtatatatata

SEQ ID NO: 107742 - DNA, 23 bp, Homo sapiens
atccatatttgtacgtgtgtgta

SEQ ID NO: 107743 - DNA, 21 bp, Homo sapiens
atagcaggtgttcttcagtgt

SEQ ID NO: 107744 - DNA, 23 bp, Homo sapiens
attccataatgtgcattccaact

SEQ ID NO: 107745 - DNA, 22 bp, Homo sapiens
ttgttgttgagatggagtctcg

SEQ ID NO: 107746 - DNA, 23 bp, Homo sapiens
tgtgattgtatgtgtgtgcgtct

SEQ ID NO: 107747 - DNA, 23 bp, Homo sapiens
tacaggtcaagtgattttcttgt

SEQ ID NO: 107748 - DNA, 23 bp, Homo sapiens
agagtctctctctgtcacccagg

SEQ ID NO: 107749 - DNA, 23 bp, Homo sapiens
tgagacagagtctcgctctgtcg

SEQ ID NO: 107750 - DNA, 22 bp, Homo sapiens
tgcatgaggcccacataatgta

SEQ ID NO: 107751 - DNA, 23 bp, Homo sapiens
ttatcacagctgagtgagctcac

SEQ ID NO: 107752 - DNA, 23 bp, Homo sapiens
tgtgtaatgctctgtgtcctttg

SEQ ID NO: 107753 - DNA, 23 bp, Homo sapiens
tgagttcattgtagattctggat

SEQ ID NO: 107754 - DNA, 23 bp, Homo sapiens
tgagttcattgtagattctggat

SEQ ID NO: 107755 - DNA, 19 bp, Homo sapiens
cggtggattcttgatgaga

SEQ ID NO: 107756 - DNA, 23 bp, Homo sapiens
taatctgaatatgtatttatgta

SEQ ID NO: 107757 - DNA, 23 bp, Homo sapiens
tgagttcattgtagattctggat

SEQ ID NO: 107758 - DNA, 23 bp, Homo sapiens
tgagttcattgtagattctggat

SEQ ID NO: 107759 - DNA, 21 bp, Homo sapiens
ctctcactgtgtccctccctc

SEQ ID NO: 107760 - DNA, 23 bp, Homo sapiens
ttgacacggtctcactgtctccc

SEQ ID NO: 107761 - DNA, 23 bp, Homo sapiens
tgagatggagtctcactctgtcg

SEQ ID NO: 107762 - DNA, 23 bp, Homo sapiens
tgaaaagtctatttgttgttgcc

SEQ ID NO: 107763 - DNA, 23 bp, Homo sapiens
atgttgtatgtatatatgtatgt

SEQ ID NO: 107764 - DNA, 22 bp, Homo sapiens
atgtatgtatatatgtatgtac

SEQ ID NO: 107765 - DNA, 23 bp, Homo sapiens
atctgtgtgtgtgtatatataat

SEQ ID NO: 107766 - DNA, 23 bp, Homo sapiens
atatgtaaagttgttaatggaag

SEQ ID NO: 107767 - DNA, 23 bp, Homo sapiens
tctagtcctttaaatgcagaatg

SEQ ID NO: 107768 - DNA, 20 bp, Homo sapiens
tatatatgtattgaaagggg

SEQ ID NO: 107769 - DNA, 19 bp, Homo sapiens
tatgttttatataatttgt

SEQ ID NO: 107770 - DNA, 23 bp, Homo sapiens
tgatataagggtgaatatgaaat

SEQ ID NO: 107771 - DNA, 22 bp, Homo sapiens
tatttcatataattgatatgag

SEQ ID NO: 107772 - DNA, 21 bp, Homo sapiens
agagagcgtgtgtgtgtgtgt

SEQ ID NO: 107773 - DNA, 19 bp, Homo sapiens
agtgttaattatcatatct

SEQ ID NO: 107774 - DNA, 21 bp, Homo sapiens
gagagccaccaagttgtgtct

SEQ ID NO: 107775 - DNA, 23 bp, Homo sapiens
tgtgagcaacaaggttgtttatt

SEQ ID NO: 107776 - DNA, 23 bp, Homo sapiens
atatgtgtgtatatatatatgtg

SEQ ID NO: 107777 - DNA, 23 bp, Homo sapiens
ataagtatatgtatatgtgtgtg

SEQ ID NO: 107778 - DNA, 23 bp, Homo sapiens
ttggactactggggcacatatta

SEQ ID NO: 107779 - DNA, 19 bp, Homo sapiens
tggttcaaacaatttttgt

SEQ ID NO: 107780 - DNA, 23 bp, Homo sapiens
agttggagtctcactctgtcacc

SEQ ID NO: 107781 - DNA, 23 bp, Homo sapiens
tggaatgcagtgacacgatcttg

SEQ ID NO: 107782 - DNA, 23 bp, Homo sapiens
ttcactgtgggtttcaatgggct

SEQ ID NO: 107783 - DNA, 21 bp, Homo sapiens
tatgtgtatatatatacgtat

SEQ ID NO: 107784 - DNA, 21 bp, Homo sapiens
aaagtcagtggtagcttgatg

SEQ ID NO: 107785 - DNA, 22 bp, Homo sapiens
ttctttgtcaagaagtttatag

SEQ ID NO: 107786 - DNA, 21 bp, Homo sapiens
ttttgcaaggtttttcatgtc

SEQ ID NO: 107787 - DNA, 23 bp, Homo sapiens
atccacacggagtacttgtgctc

SEQ ID NO: 107788 - DNA, 23 bp, Homo sapiens
acacagtccttatgtgtgtgtgt

SEQ ID NO: 107789 - DNA, 23 bp, Homo sapiens
agatgagtgtcaggaaagcttat

SEQ ID NO: 107790 - DNA, 23 bp, Homo sapiens
agatgagtgtcaggaaagcttat

SEQ ID NO: 107791 - DNA, 20 bp, Homo sapiens
tagtatatatatatgtgtgt

SEQ ID NO: 107792 - DNA, 22 bp, Homo sapiens
tatatgcatgtactatgtgtgt

SEQ ID NO: 107793 - DNA, 22 bp, Homo sapiens
tgtgtatatatgtatatatgta

SEQ ID NO: 107794 - DNA, 23 bp, Homo sapiens
atatgtgtatatatatgtgtgtg

SEQ ID NO: 107795 - DNA, 19 bp, Homo sapiens
tgatctgaaaaattcctga

SEQ ID NO: 107796 - DNA, 18 bp, Homo sapiens
agagaagactgaatgatc

SEQ ID NO: 107797 - DNA, 23 bp, Homo sapiens
ttaagattagtagcagtatgtat

SEQ ID NO: 107798 - DNA, 23 bp, Homo sapiens
atatatgtgtatatatgtagtta

SEQ ID NO: 107799 - DNA, 21 bp, Homo sapiens
atatgtatataagatgtatag

SEQ ID NO: 107800 - DNA, 23 bp, Homo sapiens
aaagcatgtgttattttgttgta

SEQ ID NO: 107801 - DNA, 23 bp, Homo sapiens
ttatgaagataatgtggtgttgt

SEQ ID NO: 107802 - DNA, 23 bp, Homo sapiens
ttcaaacagcatagcttatcttc

SEQ ID NO: 107803 - DNA, 23 bp, Homo sapiens
tagtaaatgtaaggatttgtttg

SEQ ID NO: 107804 - DNA, 21 bp, Homo sapiens
acacacacaatatatatgtgt

SEQ ID NO: 107805 - DNA, 23 bp, Homo sapiens
ttggtgtcagaagtgagagtggt

SEQ ID NO: 107806 - DNA, 20 bp, Homo sapiens
atacacacacataaatatgt

SEQ ID NO: 107807 - DNA, 23 bp, Homo sapiens
ctgtgtttctgtgtgagtgtgtg

SEQ ID NO: 107808 - DNA, 23 bp, Homo sapiens
gatgaagctgacttgatcatggt

SEQ ID NO: 107809 - DNA, 23 bp, Homo sapiens
atatgtgggtctggaatccaagt

SEQ ID NO: 107810 - DNA, 21 bp, Homo sapiens
atctgacaggagacagagctc

SEQ ID NO: 107811 - DNA, 19 bp, Homo sapiens
tatttatttatgcatagtg

SEQ ID NO: 107812 - DNA, 20 bp, Homo sapiens
ttagatgaccaaatccctag

SEQ ID NO: 107813 - DNA, 23 bp, Homo sapiens
tgtgggatacatgaggaaggggt

SEQ ID NO: 107814 - DNA, 19 bp, Homo sapiens
aagagaggaagttcttttt

SEQ ID NO: 107815 - DNA, 23 bp, Homo sapiens
tttaagtttcctttactagatga

SEQ ID NO: 107816 - DNA, 23 bp, Homo sapiens
tcatgagagtagtcagtctcctg

SEQ ID NO: 107817 - DNA, 23 bp, Homo sapiens
tggagtctcactctgtcacccag

SEQ ID NO: 107818 - DNA, 18 bp, Homo sapiens
tggttatgttatctatat

SEQ ID NO: 107819 - DNA, 23 bp, Homo sapiens
tgattgccattctaactggtgtg

SEQ ID NO: 107820 - DNA, 20 bp, Homo sapiens
actttatatatgtatacata

SEQ ID NO: 107821 - DNA, 23 bp, Homo sapiens
tttatatatgtatacatatacat

SEQ ID NO: 107822 - DNA, 23 bp, Homo sapiens
ccataggtttttgaggaacaggt

SEQ ID NO: 107823 - DNA, 19 bp, Homo sapiens
tgagatggagtctcactct

SEQ ID NO: 107824 - DNA, 23 bp, Homo sapiens
actgatgagtgtgagcaaagcag

SEQ ID NO: 107825 - DNA, 23 bp, Homo sapiens
tgtctctctgtctgttattggtg

SEQ ID NO: 107826 - DNA, 19 bp, Homo sapiens
cagtgaactatgctcagtg

SEQ ID NO: 107827 - DNA, 23 bp, Homo sapiens
cagtcagagaaaacagagaagtt

SEQ ID NO: 107828 - DNA, 22 bp, Homo sapiens
tatatacacacatatatgtaca

SEQ ID NO: 107829 - DNA, 23 bp, Homo sapiens
tatgtgtgtgtatgtatatgtga

SEQ ID NO: 107830 - DNA, 23 bp, Homo sapiens
tatgtgtgtgtatgtatatgtga

SEQ ID NO: 107831 - DNA, 23 bp, Homo sapiens
gttgtgtcactattgtcattcag

SEQ ID NO: 107832 - DNA, 23 bp, Homo sapiens
tctgaatgtcaatgagtgagaca

SEQ ID NO: 107833 - DNA, 23 bp, Homo sapiens
aatgacagtatttataaatgaca

SEQ ID NO: 107834 - DNA, 23 bp, Homo sapiens
tcttttttggttccatatgaatt

SEQ ID NO: 107835 - DNA, 23 bp, Homo sapiens
ttgtttgctcttgattctccagt

SEQ ID NO: 107836 - DNA, 21 bp, Homo sapiens
ttgtgatattaggttgctaac

SEQ ID NO: 107837 - DNA, 19 bp, Homo sapiens
acgacccagactattctct

SEQ ID NO: 107838 - DNA, 20 bp, Homo sapiens
agacaggaagaactctaggt

SEQ ID NO: 107839 - DNA, 23 bp, Homo sapiens
gaggtgtctctgtgtctcttttc

SEQ ID NO: 107840 - DNA, 23 bp, Homo sapiens
agatggagtctcgctctgtcacc

SEQ ID NO: 107841 - DNA, 20 bp, Homo sapiens
agtctcgctctgtcgctcag

SEQ ID NO: 107842 - DNA, 23 bp, Homo sapiens
tttgagacggagtctcgctctgt

SEQ ID NO: 107843 - DNA, 23 bp, Homo sapiens
tgagatggagtctcactctgtcg

SEQ ID NO: 107844 - DNA, 19 bp, Homo sapiens
aattttgatgatagtgatg

SEQ ID NO: 107845 - DNA, 23 bp, Homo sapiens
acaatcagaagggtaaacaactg

SEQ ID NO: 107846 - DNA, 19 bp, Homo sapiens
ttgacaaaagagaaagagg

SEQ ID NO: 107847 - DNA, 23 bp, Homo sapiens
gtctataggtaattgacagagat

SEQ ID NO: 107848 - DNA, 18 bp, Homo sapiens
tgaattctgcctagagtg

SEQ ID NO: 107849 - DNA, 23 bp, Homo sapiens
tgaggttgatgaactaggttttt

SEQ ID NO: 107850 - DNA, 19 bp, Homo sapiens
gtttatttctttttattgc

SEQ ID NO: 107851 - DNA, 22 bp, Homo sapiens
tctggtagaatgttatatagta

SEQ ID NO: 107852 - DNA, 22 bp, Homo sapiens
acatgtgcagaaagtgcaggtt

SEQ ID NO: 107853 - DNA, 23 bp, Homo sapiens
tgtatatatatatgtatacgtat

SEQ ID NO: 107854 - DNA, 23 bp, Homo sapiens
atatgtgtttgatacatatatgt

SEQ ID NO: 107855 - DNA, 23 bp, Homo sapiens
ttctactggaaatgtatactttt

SEQ ID NO: 107856 - DNA, 23 bp, Homo sapiens
atgtctttcctatagaattgcaa

SEQ ID NO: 107857 - DNA, 23 bp, Homo sapiens
gttaagaactatatgtatatatg

SEQ ID NO: 107858 - DNA, 23 bp, Homo sapiens
tgagttcattgtagattctggat

SEQ ID NO: 107859 - DNA, 23 bp, Homo sapiens
tgagttcattgtagattctggat

SEQ ID NO: 107860 - DNA, 23 bp, Homo sapiens
atcttcattgcttttcattctgt

SEQ ID NO: 107861 - DNA, 23 bp, Homo sapiens
atccactgtcagttaaacatatc

SEQ ID NO: 107862 - DNA, 19 bp, Homo sapiens
aacactatagatattgttg

SEQ ID NO: 107863 - DNA, 23 bp, Homo sapiens
acacacacctatatgtatgtgta

SEQ ID NO: 107864 - DNA, 19 bp, Homo sapiens
aagaggtttttttcttctt

SEQ ID NO: 107865 - DNA, 23 bp, Homo sapiens
taagaacttcctactctgtgtat

SEQ ID NO: 107866 - DNA, 23 bp, Homo sapiens
tctgactctcttcggtgacgggt

SEQ ID NO: 107867 - DNA, 23 bp, Homo sapiens
ttattgcttaagaatacgcgtag

SEQ ID NO: 107868 - DNA, 23 bp, Homo sapiens
ttatgaattttgtgaaagcagtg

SEQ ID NO: 107869 - DNA, 23 bp, Homo sapiens
ttaaaatctgtttttgaatttca

SEQ ID NO: 107870 - DNA, 22 bp, Homo sapiens
tgatctgtcactttttgtttct

SEQ ID NO: 107871 - DNA, 23 bp, Homo sapiens
agagtggcacctatgcttgtctt

SEQ ID NO: 107872 - DNA, 22 bp, Homo sapiens
tgtgcaatttcagagagaatac

SEQ ID NO: 107873 - DNA, 23 bp, Homo sapiens
tagggagtagagtgtgaccacag

SEQ ID NO: 107874 - DNA, 23 bp, Homo sapiens
agtcattttaagtctctcaccac

SEQ ID NO: 107875 - DNA, 18 bp, Homo sapiens
tcagtgagctataattgt

SEQ ID NO: 107876 - DNA, 20 bp, Homo sapiens
tttatattgcttatcttgag

SEQ ID NO: 107877 - DNA, 23 bp, Homo sapiens
tgagttcattgtagattctggat

SEQ ID NO: 107878 - DNA, 23 bp, Homo sapiens
tgagttcattgtagattctggat

SEQ ID NO: 107879 - DNA, 23 bp, Homo sapiens
actatatctgcatgtatttgtgt

SEQ ID NO: 107880 - DNA, 23 bp, Homo sapiens
ttcaatgtgtttatgtaagtgtg

SEQ ID NO: 107881 - DNA, 23 bp, Homo sapiens
tgtcactttttgaagcttttctc

SEQ ID NO: 107882 - DNA, 18 bp, Homo sapiens
aaagtgacaccagtactt

SEQ ID NO: 107883 - DNA, 23 bp, Homo sapiens
cttctctggatttgtttcatctg

SEQ ID NO: 107884 - DNA, 23 bp, Homo sapiens
taggatgatttgaattctgtgag

SEQ ID NO: 107885 - DNA, 23 bp, Homo sapiens
tgtaatagtcttgacattgcaat

SEQ ID NO: 107886 - DNA, 21 bp, Homo sapiens
acagtgtttataatgtactag

SEQ ID NO: 107887 - DNA, 22 bp, Homo sapiens
actgtgagctcacagaggacag

SEQ ID NO: 107888 - DNA, 23 bp, Homo sapiens
tggcaattgttaactagcagtat

SEQ ID NO: 107889 - DNA, 23 bp, Homo sapiens
ctaggatgcaaactaaggtagtt

SEQ ID NO: 107890 - DNA, 23 bp, Homo sapiens
ttctgtatttgtatttgttatgg

SEQ ID NO: 107891 - DNA, 18 bp, Homo sapiens
taaaccatgatgatgcaa

SEQ ID NO: 107892 - DNA, 23 bp, Homo sapiens
gggtctcactctgtcactcaggc

SEQ ID NO: 107893 - DNA, 20 bp, Homo sapiens
tacagtggtgtgatcttagc

SEQ ID NO: 107894 - DNA, 20 bp, Homo sapiens
aacagtttaattatgtttgt

SEQ ID NO: 107895 - DNA, 22 bp, Homo sapiens
tttgttcatttgcttaggattg

SEQ ID NO: 107896 - DNA, 20 bp, Homo sapiens
taatagggagcaaagcaaat

SEQ ID NO: 107897 - DNA, 18 bp, Homo sapiens
tttggcaggcttttactg

SEQ ID NO: 107898 - DNA, 23 bp, Homo sapiens
cttctgtggctgctttcatgggc

SEQ ID NO: 107899 - DNA, 23 bp, Homo sapiens
tggagtctcactctgtcacccag

SEQ ID NO: 107900 - DNA, 21 bp, Homo sapiens
tgcacacctatagttccagct

SEQ ID NO: 107901 - DNA, 22 bp, Homo sapiens
ttgatgtggctgcattcctagt

SEQ ID NO: 107902 - DNA, 20 bp, Homo sapiens
tgtgtgtgcatatgtatgtg

SEQ ID NO: 107903 - DNA, 23 bp, Homo sapiens
tgtgcgtgtgtgtatatatatag

SEQ ID NO: 107904 - DNA, 22 bp, Homo sapiens
atgtatatatgtatgtgtgtgt

SEQ ID NO: 107905 - DNA, 23 bp, Homo sapiens
tttgtgcctggtttatttctctc

SEQ ID NO: 107906 - DNA, 22 bp, Homo sapiens
tttcacagagttggaattaaga

SEQ ID NO: 107907 - DNA, 23 bp, Homo sapiens
tctccctgactctgtgactctat

SEQ ID NO: 107908 - DNA, 23 bp, Homo sapiens
tttactggtaatagtggtaggcg

SEQ ID NO: 107909 - DNA, 23 bp, Homo sapiens
aattatgaccttgttattgtctt

SEQ ID NO: 107910 - DNA, 22 bp, Homo sapiens
tgggttcaagttgacaagcagt

SEQ ID NO: 107911 - DNA, 23 bp, Homo sapiens
tctcagaagtgtgagtgaagtct

SEQ ID NO: 107912 - DNA, 23 bp, Homo sapiens
ctgtctctctgggtgacctcagg

SEQ ID NO: 107913 - DNA, 23 bp, Homo sapiens
acatatgtatagatagagaatag

SEQ ID NO: 107914 - DNA, 19 bp, Homo sapiens
atttctctatatattaatg

SEQ ID NO: 107915 - DNA, 23 bp, Homo sapiens
tggagtctcactctgtctctcag

SEQ ID NO: 107916 - DNA, 23 bp, Homo sapiens
tgtcaatcgcaattccttttctt

SEQ ID NO: 107917 - DNA, 23 bp, Homo sapiens
actgagtctcactctatcaccca

SEQ ID NO: 107918 - DNA, 23 bp, Homo sapiens
gttcacactgggagatgaagtgg

SEQ ID NO: 107919 - DNA, 23 bp, Homo sapiens
agataggatctggatagggttgg

SEQ ID NO: 107920 - DNA, 22 bp, Homo sapiens
acgaagtctcgctctgttgtcc

SEQ ID NO: 107921 - DNA, 18 bp, Homo sapiens
tgtgagtctgtgtgtgtg

SEQ ID NO: 107922 - DNA, 23 bp, Homo sapiens
cagggtctcactcactctgttgc

SEQ ID NO: 107923 - DNA, 23 bp, Homo sapiens
gatggagtctctctctgtcaccc

SEQ ID NO: 107924 - DNA, 23 bp, Homo sapiens
gtgttgagagtaatgtatttctt

SEQ ID NO: 107925 - DNA, 23 bp, Homo sapiens
ggcagaggtagaaatgagctgag

SEQ ID NO: 107926 - DNA, 21 bp, Homo sapiens
tatgtgtatatacatatgtgt

SEQ ID NO: 107927 - DNA, 23 bp, Homo sapiens
gagaccgagtctcgctctgtcac

SEQ ID NO: 107928 - DNA, 18 bp, Homo sapiens
tggcatgatctcggctca

SEQ ID NO: 107929 - DNA, 23 bp, Homo sapiens
ccgagtctcgctctgtcacccag

SEQ ID NO: 107930 - DNA, 20 bp, Homo sapiens
tatgtatatatatacgcgtg

SEQ ID NO: 107931 - DNA, 23 bp, Homo sapiens
atacgtgtatatatatgtgtgtg

SEQ ID NO: 107932 - DNA, 22 bp, Homo sapiens
atacacacgtatatatagtgtg

SEQ ID NO: 107933 - DNA, 22 bp, Homo sapiens
aaaatggtttatcactttctgg

SEQ ID NO: 107934 - DNA, 21 bp, Homo sapiens
tttgagatggagtctagctct

SEQ ID NO: 107935 - DNA, 19 bp, Homo sapiens
aatgtaattttcctttctg

SEQ ID NO: 107936 - DNA, 23 bp, Homo sapiens
aagagacaggatcttgttttgtc

SEQ ID NO: 107937 - DNA, 23 bp, Homo sapiens
tctcagtagagagtgaagagctg

SEQ ID NO: 107938 - DNA, 23 bp, Homo sapiens
agctaagtctttggctttggaaa

SEQ ID NO: 107939 - DNA, 23 bp, Homo sapiens
tggcacacatttgtggtcccagc

SEQ ID NO: 107940 - DNA, 18 bp, Homo sapiens
tgcagtgagccatatttg

SEQ ID NO: 107941 - DNA, 20 bp, Homo sapiens
aatgagcaagggaaagattt

SEQ ID NO: 107942 - DNA, 21 bp, Homo sapiens
aaatgcatgatttctgagaat

SEQ ID NO: 107943 - DNA, 23 bp, Homo sapiens
taaagtaggctggactaagctgt

SEQ ID NO: 107944 - DNA, 22 bp, Homo sapiens
ttttcagtttacagtgggtttg

SEQ ID NO: 107945 - DNA, 21 bp, Homo sapiens
aatgtgatttttaaaaggagt

SEQ ID NO: 107946 - DNA, 22 bp, Homo sapiens
tgtggttttgatttgcatttct

SEQ ID NO: 107947 - DNA, 18 bp, Homo sapiens
agtctcgctctgtcaccc

SEQ ID NO: 107948 - DNA, 23 bp, Homo sapiens
ttagaggttcgctcagatttgtt

SEQ ID NO: 107949 - DNA, 23 bp, Homo sapiens
atgtgtatatatgtatatgtgta

SEQ ID NO: 107950 - DNA, 18 bp, Homo sapiens
acatatacacatacatac

SEQ ID NO: 107951 - DNA, 21 bp, Homo sapiens
agcactctggttcaattgttg

SEQ ID NO: 107952 - DNA, 19 bp, Homo sapiens
atatgtacacatacttatg

SEQ ID NO: 107953 - DNA, 20 bp, Homo sapiens
atcttgtgggaaggctagta

SEQ ID NO: 107954 - DNA, 18 bp, Homo sapiens
tttccactctaattcttt

SEQ ID NO: 107955 - DNA, 20 bp, Homo sapiens
gactcccacaatctctctct

SEQ ID NO: 107956 - DNA, 23 bp, Homo sapiens
ataagactgtttttgttttgttt

SEQ ID NO: 107957 - DNA, 23 bp, Homo sapiens
agaaaatgactatagcttttact

SEQ ID NO: 107958 - DNA, 23 bp, Homo sapiens
tctcaagagagagagctcaggat

SEQ ID NO: 107959 - DNA, 18 bp, Homo sapiens
tgcaaactctgcctcctg

SEQ ID NO: 107960 - DNA, 22 bp, Homo sapiens
tcacaaattgggtttctcatga

SEQ ID NO: 107961 - DNA, 22 bp, Homo sapiens
tctgagactctgagatttgtgt

SEQ ID NO: 107962 - DNA, 21 bp, Homo sapiens
tttagagttgtgtgcagagtg

SEQ ID NO: 107963 - DNA, 23 bp, Homo sapiens
tggtagagtctttaggtttttcc

SEQ ID NO: 107964 - DNA, 22 bp, Homo sapiens
ttatctcaggtttttttggcca

SEQ ID NO: 107965 - DNA, 23 bp, Homo sapiens
tgtgtatatatatgtatgtgtat

SEQ ID NO: 107966 - DNA, 19 bp, Homo sapiens
tatatatgtatgtatgtgt

SEQ ID NO: 107967 - DNA, 20 bp, Homo sapiens
tatgttcatatatgtgtgtg

SEQ ID NO: 107968 - DNA, 23 bp, Homo sapiens
aatcaagttcttctgctggaata

SEQ ID NO: 107969 - DNA, 23 bp, Homo sapiens
tgcctgactgtgtctctcccagt

SEQ ID NO: 107970 - DNA, 23 bp, Homo sapiens
tctgtgtgtgtctgcgtcctaat

SEQ ID NO: 107971 - DNA, 23 bp, Homo sapiens
acaactggtctttctgctgccag

SEQ ID NO: 107972 - DNA, 19 bp, Homo sapiens
tggtctctgcaaaacctga

SEQ ID NO: 107973 - DNA, 22 bp, Homo sapiens
acgctgtgagggtgtggtgtgt

SEQ ID NO: 107974 - DNA, 21 bp, Homo sapiens
taagtgttcagtggatgcaga

SEQ ID NO: 107975 - DNA, 23 bp, Homo sapiens
tgagttcattgtagattctggat

SEQ ID NO: 107976 - DNA, 23 bp, Homo sapiens
tgagttcattgtagattctggat

SEQ ID NO: 107977 - DNA, 23 bp, Homo sapiens
agagtctcactctgtcacccagg

SEQ ID NO: 107978 - DNA, 21 bp, Homo sapiens
taactgcatgaggtgcagata

SEQ ID NO: 107979 - DNA, 23 bp, Homo sapiens
atgtatatctgtaataatgatga

SEQ ID NO: 107980 - DNA, 23 bp, Homo sapiens
gagtggttttctaatgtaaagaa

SEQ ID NO: 107981 - DNA, 21 bp, Homo sapiens
tttgagatggagtcttgctct

SEQ ID NO: 107982 - DNA, 18 bp, Homo sapiens
taatctcttgtcagatgg

SEQ ID NO: 107983 - DNA, 23 bp, Homo sapiens
gcaggatggtttttgattcaggt

SEQ ID NO: 107984 - DNA, 23 bp, Homo sapiens
ttcctgagtcttcaggatgttct

SEQ ID NO: 107985 - DNA, 21 bp, Homo sapiens
tctggggatctttaatgcctt

SEQ ID NO: 107986 - DNA, 23 bp, Homo sapiens
agagtctcactctgtcacccagg

SEQ ID NO: 107987 - DNA, 23 bp, Homo sapiens
ccacttcactctgtgtgtatgtc

SEQ ID NO: 107988 - DNA, 23 bp, Homo sapiens
tatcactgtctctcttctgcctt

SEQ ID NO: 107989 - DNA, 23 bp, Homo sapiens
aaggaactctaggagaagatgca

SEQ ID NO: 107990 - DNA, 23 bp, Homo sapiens
tttaaaactttcaaatcaggata

SEQ ID NO: 107991 - DNA, 22 bp, Homo sapiens
agatttgaattagttttggcca

SEQ ID NO: 107992 - DNA, 22 bp, Homo sapiens
tacaatgtatttatgtatgcat

SEQ ID NO: 107993 - DNA, 23 bp, Homo sapiens
actgcatacatgtgagtatgtgt

SEQ ID NO: 107994 - DNA, 23 bp, Homo sapiens
atatgtgtagatatgtagatatg

SEQ ID NO: 107995 - DNA, 21 bp, Homo sapiens
aagtgcatagaaatggcagtg

SEQ ID NO: 107996 - DNA, 23 bp, Homo sapiens
tctctctctgtgtgcctcagttt

SEQ ID NO: 107997 - DNA, 23 bp, Homo sapiens
tgtgacgatcttgtatggagtct

SEQ ID NO: 107998 - DNA, 23 bp, Homo sapiens
gggtctcactctgtcacccaggc

SEQ ID NO: 107999 - DNA, 20 bp, Homo sapiens
taaggtgattgtagtggaga

SEQ ID NO: 108000 - DNA, 23 bp, Homo sapiens
atgttccagagtttcgttgtgag

SEQ ID NO: 108001 - DNA, 23 bp, Homo sapiens
aacttctgaactgtttttgaagt

SEQ ID NO: 108002 - DNA, 18 bp, Homo sapiens
cagtgagctatgattgtg

SEQ ID NO: 108003 - DNA, 22 bp, Homo sapiens
atcactgtgctctgcctccctt

SEQ ID NO: 108004 - DNA, 21 bp, Homo sapiens
agtcaattacatgctaagaga

SEQ ID NO: 108005 - DNA, 22 bp, Homo sapiens
actgaggtagatgtgtggtcga

SEQ ID NO: 108006 - DNA, 21 bp, Homo sapiens
tggagtgagaaaatgatgata

SEQ ID NO: 108007 - DNA, 20 bp, Homo sapiens
tgctgcaggtaatcttttgg

SEQ ID NO: 108008 - DNA, 23 bp, Homo sapiens
gataaggtctggttctgttgccc

SEQ ID NO: 108009 - DNA, 20 bp, Homo sapiens
attcaaatatgtgggtgtgt

SEQ ID NO: 108010 - DNA, 19 bp, Homo sapiens
acacacacatgcctatttg

SEQ ID NO: 108011 - DNA, 23 bp, Homo sapiens
ttctttggaagttgattgtgaag

SEQ ID NO: 108012 - DNA, 21 bp, Homo sapiens
aatcacaatcttctgacaaag

SEQ ID NO: 108013 - DNA, 20 bp, Homo sapiens
attttgagagaatttgttca

SEQ ID NO: 108014 - DNA, 18 bp, Homo sapiens
agtacagtggtgcaatct

SEQ ID NO: 108015 - DNA, 19 bp, Homo sapiens
tttggataagtatatgttt

SEQ ID NO: 108016 - DNA, 23 bp, Homo sapiens
tgagttcattgtagattctggat

SEQ ID NO: 108017 - DNA, 23 bp, Homo sapiens
tgagttcattgtagattctggat

SEQ ID NO: 108018 - DNA, 23 bp, Homo sapiens
cctgagtgcctctcagcctggct

SEQ ID NO: 108019 - DNA, 19 bp, Homo sapiens
ggagggaggcaaaggtgtt

SEQ ID NO: 108020 - DNA, 23 bp, Homo sapiens
ttttgactcaggttatttagaag

SEQ ID NO: 108021 - DNA, 23 bp, Homo sapiens
tacagtgtttggtatgcaaatca

SEQ ID NO: 108022 - DNA, 23 bp, Homo sapiens
accatctctgggtctgtaactca

SEQ ID NO: 108023 - DNA, 23 bp, Homo sapiens
tatgtgtacatgcatgtgtgtgt

SEQ ID NO: 108024 - DNA, 21 bp, Homo sapiens
ctttaaaagtagaaacagctt

SEQ ID NO: 108025 - DNA, 23 bp, Homo sapiens
agtagttggtttgtctggagcat

SEQ ID NO: 108026 - DNA, 19 bp, Homo sapiens
atactccagacgaaccagt

SEQ ID NO: 108027 - DNA, 23 bp, Homo sapiens
ttttgagacggagtcttgctctg

SEQ ID NO: 108028 - DNA, 22 bp, Homo sapiens
taaagtacaagagaatgcttga

SEQ ID NO: 108029 - DNA, 23 bp, Homo sapiens
gggtctcactctgtcacccaggc

SEQ ID NO: 108030 - DNA, 20 bp, Homo sapiens
caagaggtaaacagttcatt

SEQ ID NO: 108031 - DNA, 23 bp, Homo sapiens
tttgagacaggatctcactctgt

SEQ ID NO: 108032 - DNA, 20 bp, Homo sapiens
tatctacatggcatatgtat

SEQ ID NO: 108033 - DNA, 23 bp, Homo sapiens
catatgtgtatgtattgtatatg

SEQ ID NO: 108034 - DNA, 23 bp, Homo sapiens
tgagagagattcaggagtacatt

SEQ ID NO: 108035 - DNA, 20 bp, Homo sapiens
taaagacaggatctcattgt

SEQ ID NO: 108036 - DNA, 23 bp, Homo sapiens
atcagagcgagcagactagcaga

SEQ ID NO: 108037 - DNA, 20 bp, Homo sapiens
tttaggattatatatatatg

SEQ ID NO: 108038 - DNA, 20 bp, Homo sapiens
tgttttcagtatcatcttgg

SEQ ID NO: 108039 - DNA, 23 bp, Homo sapiens
ttggagtacttaggaaaggtata

SEQ ID NO: 108040 - DNA, 18 bp, Homo sapiens
tgcaaggatatacagtgt

SEQ ID NO: 108041 - DNA, 22 bp, Homo sapiens
tttctcacagttctagaggctg

SEQ ID NO: 108042 - DNA, 22 bp, Homo sapiens
aaagtcatttcattttgttctt

SEQ ID NO: 108043 - DNA, 21 bp, Homo sapiens
atatatgttcatatatattcg

SEQ ID NO: 108044 - DNA, 21 bp, Homo sapiens
aaactctgagaagattccacg

SEQ ID NO: 108045 - DNA, 23 bp, Homo sapiens
atatagaatcaagatgttgggtt

SEQ ID NO: 108046 - DNA, 21 bp, Homo sapiens
tcaaatagaatgagacctggt

SEQ ID NO: 108047 - DNA, 21 bp, Homo sapiens
tttggctaatactgatatctc

SEQ ID NO: 108048 - DNA, 23 bp, Homo sapiens
tgcctcaggtaatatatagttta

SEQ ID NO: 108049 - DNA, 23 bp, Homo sapiens
tatgtacagtgtatgtatttagg

SEQ ID NO: 108050 - DNA, 23 bp, Homo sapiens
agagatagggtctcgctctgttg

SEQ ID NO: 108051 - DNA, 21 bp, Homo sapiens
aattttttcttttatctggac

SEQ ID NO: 108052 - DNA, 22 bp, Homo sapiens
tatgagtgtagactgagggcac

SEQ ID NO: 108053 - DNA, 22 bp, Homo sapiens
tctgcatttttttaaatcagtt

SEQ ID NO: 108054 - DNA, 22 bp, Homo sapiens
aaggagtggttataaattcaag

SEQ ID NO: 108055 - DNA, 21 bp, Homo sapiens
aaatatgtatatgtacatgta

SEQ ID NO: 108056 - DNA, 21 bp, Homo sapiens
tgtgaagaaagtcaatggtag

SEQ ID NO: 108057 - DNA, 20 bp, Homo sapiens
tgagtctcactctgtcgccc

SEQ ID NO: 108058 - DNA, 23 bp, Homo sapiens
taatgttcttgtgattgtatctg

SEQ ID NO: 108059 - DNA, 23 bp, Homo sapiens
ttctatggattagtatctgtgac

SEQ ID NO: 108060 - DNA, 22 bp, Homo sapiens
tgtgaggaataaatttctgtta

SEQ ID NO: 108061 - DNA, 21 bp, Homo sapiens
tatacgcacatatagatagct

SEQ ID NO: 108062 - DNA, 23 bp, Homo sapiens
tgagttcattgtagattctggat

SEQ ID NO: 108063 - DNA, 23 bp, Homo sapiens
tgagttcattgtagattctggat

SEQ ID NO: 108064 - DNA, 23 bp, Homo sapiens
ttttgagtgaaatactttgcata

SEQ ID NO: 108065 - DNA, 23 bp, Homo sapiens
aaatgctgagtagatagttggat

SEQ ID NO: 108066 - DNA, 23 bp, Homo sapiens
atgcctgtatatatgtgtgtgtg

SEQ ID NO: 108067 - DNA, 23 bp, Homo sapiens
tgagttcattgtagattctggat

SEQ ID NO: 108068 - DNA, 23 bp, Homo sapiens
tgagttcattgtagattctggat

SEQ ID NO: 108069 - DNA, 22 bp, Homo sapiens
gagtctcactctgtcacccagg

SEQ ID NO: 108070 - DNA, 23 bp, Homo sapiens
gagtctctctctgtcacccaggc

SEQ ID NO: 108071 - DNA, 22 bp, Homo sapiens
tgtatactatatgaaaatggct

SEQ ID NO: 108072 - DNA, 20 bp, Homo sapiens
tcttttcttttttgagacag

SEQ ID NO: 108073 - DNA, 21 bp, Homo sapiens
ttgactgatgagactggggtg

SEQ ID NO: 108074 - DNA, 19 bp, Homo sapiens
cactgtaagaattgagtga

SEQ ID NO: 108075 - DNA, 23 bp, Homo sapiens
ttgccactgacagtatgtgctgt

SEQ ID NO: 108076 - DNA, 23 bp, Homo sapiens
cagtgcatgaatgtttatgtata

SEQ ID NO: 108077 - DNA, 23 bp, Homo sapiens
tgagtctcactctgtcacccagg

SEQ ID NO: 108078 - DNA, 19 bp, Homo sapiens
agtcagtttcacagtctgc

SEQ ID NO: 108079 - DNA, 21 bp, Homo sapiens
tatatgtatatgtatatgtat

SEQ ID NO: 108080 - DNA, 23 bp, Homo sapiens
tacatatgtgtgtatgtatatgt

SEQ ID NO: 108081 - DNA, 23 bp, Homo sapiens
tatgtacgtgtgtgtgtgtatat

SEQ ID NO: 108082 - DNA, 18 bp, Homo sapiens
acacacacacacatacat

SEQ ID NO: 108083 - DNA, 23 bp, Homo sapiens
tcttcctatgtttccaacagtgt

SEQ ID NO: 108084 - DNA, 21 bp, Homo sapiens
tgaggaggactttatgtagat

SEQ ID NO: 108085 - DNA, 23 bp, Homo sapiens
ggggtcttgttttgttatccagg

SEQ ID NO: 108086 - DNA, 23 bp, Homo sapiens
atatgtgtatatatatgtgtgtg

SEQ ID NO: 108087 - DNA, 23 bp, Homo sapiens
tgagttcattgtagattctggat

SEQ ID NO: 108088 - DNA, 23 bp, Homo sapiens
tgagttcattgtagattctggat

SEQ ID NO: 108089 - DNA, 23 bp, Homo sapiens
aatgaggaacacatacttctccg

SEQ ID NO: 108090 - DNA, 22 bp, Homo sapiens
ttacaggatttgaaatgtgtta

SEQ ID NO: 108091 - DNA, 20 bp, Homo sapiens
agtcagtctggtaattttct

SEQ ID NO: 108092 - DNA, 20 bp, Homo sapiens
gatttttcataatgtacgag

SEQ ID NO: 108093 - DNA, 18 bp, Homo sapiens
taggaatgttgtttgtag

SEQ ID NO: 108094 - DNA, 22 bp, Homo sapiens
atgtgctaaatgaatgcatgaa

SEQ ID NO: 108095 - DNA, 21 bp, Homo sapiens
gtgctttaaatatatatgtgt

SEQ ID NO: 108096 - DNA, 19 bp, Homo sapiens
tcaactatatatttacagt

SEQ ID NO: 108097 - DNA, 23 bp, Homo sapiens
cggagtctcactctgtcacccag

SEQ ID NO: 108098 - DNA, 23 bp, Homo sapiens
agagagttactggttaggttgag

SEQ ID NO: 108099 - DNA, 21 bp, Homo sapiens
tcaatggatctctagctgtta

SEQ ID NO: 108100 - DNA, 19 bp, Homo sapiens
agggagatctagtgcagat

SEQ ID NO: 108101 - DNA, 23 bp, Homo sapiens
cagtctcactctgactgtgtacc

SEQ ID NO: 108102 - DNA, 23 bp, Homo sapiens
ttaatatagatgtagatgtatat

SEQ ID NO: 108103 - DNA, 23 bp, Homo sapiens
ctctaaggttttctaggtataag

SEQ ID NO: 108104 - DNA, 23 bp, Homo sapiens
gattgatttcatcttttcctatt

SEQ ID NO: 108105 - DNA, 23 bp, Homo sapiens
tgtatttttgattctttagaaag

SEQ ID NO: 108106 - DNA, 23 bp, Homo sapiens
gacagagtctcgctctgtcaccc

SEQ ID NO: 108107 - DNA, 23 bp, Homo sapiens
tgacaactctgtctgtgactgtc

SEQ ID NO: 108108 - DNA, 23 bp, Homo sapiens
aacactggaacctagtaccagac

SEQ ID NO: 108109 - DNA, 23 bp, Homo sapiens
atgtgtgcatgtgtatgtatgca

SEQ ID NO: 108110 - DNA, 23 bp, Homo sapiens
atgcatgtgcatatgtatacata

SEQ ID NO: 108111 - DNA, 21 bp, Homo sapiens
tgcaaagtattgttcataggt

SEQ ID NO: 108112 - DNA, 18 bp, Homo sapiens
ggtgggaggatgatttga

SEQ ID NO: 108113 - DNA, 23 bp, Homo sapiens
tatacacacatattttcatgtat

SEQ ID NO: 108114 - DNA, 23 bp, Homo sapiens
tgtacatacatatgtgtgtgtat

SEQ ID NO: 108115 - DNA, 22 bp, Homo sapiens
tgagaagtaggcccactgtttt

SEQ ID NO: 108116 - DNA, 20 bp, Homo sapiens
agcatttgtgtttctttgga

SEQ ID NO: 108117 - DNA, 23 bp, Homo sapiens
tgtcagaagaacaagaactgttc

SEQ ID NO: 108118 - DNA, 21 bp, Homo sapiens
tatgtacacataatcatgtgt

SEQ ID NO: 108119 - DNA, 23 bp, Homo sapiens
atacagctttatctgatctgaat

SEQ ID NO: 108120 - DNA, 18 bp, Homo sapiens
attagtatagggaaaggt

SEQ ID NO: 108121 - DNA, 23 bp, Homo sapiens
tttatggttgtgtagtattctgt

SEQ ID NO: 108122 - DNA, 23 bp, Homo sapiens
tgcatatgtagcacattttcttg

SEQ ID NO: 108123 - DNA, 23 bp, Homo sapiens
gcttatcactagagacagaaact

SEQ ID NO: 108124 - DNA, 20 bp, Homo sapiens
gggtgccagcctttatgtgg

SEQ ID NO: 108125 - DNA, 23 bp, Homo sapiens
acagatacaacagaggcagcaca

SEQ ID NO: 108126 - DNA, 19 bp, Homo sapiens
ttgagttgattatggtgag

SEQ ID NO: 108127 - DNA, 23 bp, Homo sapiens
gtccctctcagtgggtgactgaa

SEQ ID NO: 108128 - DNA, 23 bp, Homo sapiens
tttttttcaactcctagtccagc

SEQ ID NO: 108129 - DNA, 21 bp, Homo sapiens
agtctggctctgtgtcgccca

SEQ ID NO: 108130 - DNA, 22 bp, Homo sapiens
tatgaatagcagtttgttctct

SEQ ID NO: 108131 - DNA, 23 bp, Homo sapiens
agtgtagtggttttcaaatctag

SEQ ID NO: 108132 - DNA, 23 bp, Homo sapiens
atatatctatatgtaaatctatc

SEQ ID NO: 108133 - DNA, 22 bp, Homo sapiens
ttgacagttctgtgagaggaca

SEQ ID NO: 108134 - DNA, 23 bp, Homo sapiens
cctagagctttctgttttgggag

SEQ ID NO: 108135 - DNA, 20 bp, Homo sapiens
ttaggtttttttaagtgtaa

SEQ ID NO: 108136 - DNA, 23 bp, Homo sapiens
tcatgtgtatataaatatgtgtg

SEQ ID NO: 108137 - DNA, 23 bp, Homo sapiens
ttcttgtttcaggtgatcttctc

SEQ ID NO: 108138 - DNA, 23 bp, Homo sapiens
tgagttcattgtagattctggat

SEQ ID NO: 108139 - DNA, 23 bp, Homo sapiens
tgagttcattgtagattctggat

SEQ ID NO: 108140 - DNA, 20 bp, Homo sapiens
gctgaagactgactctgtcc

SEQ ID NO: 108141 - DNA, 23 bp, Homo sapiens
tcactggatgcagagcctctcaa

SEQ ID NO: 108142 - DNA, 23 bp, Homo sapiens
aatgacagtggaagaattctgtg

SEQ ID NO: 108143 - DNA, 23 bp, Homo sapiens
tcagagtcaacacagagtgcagt

SEQ ID NO: 108144 - DNA, 23 bp, Homo sapiens
tgtgtgtgtgtgtgtatatgcat

SEQ ID NO: 108145 - DNA, 23 bp, Homo sapiens
catctgtctcattctctctgcct

SEQ ID NO: 108146 - DNA, 21 bp, Homo sapiens
tcattctctatagtcataaga

SEQ ID NO: 108147 - DNA, 22 bp, Homo sapiens
agatgaagctctgtgtcagtct

SEQ ID NO: 108148 - DNA, 19 bp, Homo sapiens
gcttccagtcttgccatgt

SEQ ID NO: 108149 - DNA, 22 bp, Homo sapiens
ttctatatgtgtatgtgtgtgt

SEQ ID NO: 108150 - DNA, 23 bp, Homo sapiens
aaatctgctgatgtaaagctgta

SEQ ID NO: 108151 - DNA, 23 bp, Homo sapiens
atagcatgtttatatttctcttt

SEQ ID NO: 108152 - DNA, 23 bp, Homo sapiens
cagggtctcactcactctgtcgc

SEQ ID NO: 108153 - DNA, 21 bp, Homo sapiens
tctctctcccagactggagtg

SEQ ID NO: 108154 - DNA, 21 bp, Homo sapiens
actgatttttgtatgttgttt

SEQ ID NO: 108155 - DNA, 23 bp, Homo sapiens
ggataacattctactgtgtggat

SEQ ID NO: 108156 - DNA, 22 bp, Homo sapiens
attacatgaagtatctgtcttc

SEQ ID NO: 108157 - DNA, 19 bp, Homo sapiens
acgtatatatatgtgtgtg

SEQ ID NO: 108158 - DNA, 21 bp, Homo sapiens
ttgcagctaatatagtgtgtg

SEQ ID NO: 108159 - DNA, 23 bp, Homo sapiens
tgagttcattgtagattctggat

SEQ ID NO: 108160 - DNA, 23 bp, Homo sapiens
tgagttcattgtagattctggat

SEQ ID NO: 108161 - DNA, 22 bp, Homo sapiens
aatgatagcagatgctcagttg

SEQ ID NO: 108162 - DNA, 23 bp, Homo sapiens
gacagagtctcgctctgtcaccc

SEQ ID NO: 108163 - DNA, 23 bp, Homo sapiens
agtgcttgacatatgtaggtgct

SEQ ID NO: 108164 - DNA, 21 bp, Homo sapiens
ttaatcacctattaatatgta

SEQ ID NO: 108165 - DNA, 23 bp, Homo sapiens
tgtgtatatgtgtatatgtgtgt

SEQ ID NO: 108166 - DNA, 23 bp, Homo sapiens
tgtgtgtatatgtgtatatgtgt

SEQ ID NO: 108167 - DNA, 18 bp, Homo sapiens
tgtgtgtgtatatatgtg

SEQ ID NO: 108168 - DNA, 23 bp, Homo sapiens
atactcagtgggtctttaccacg

SEQ ID NO: 108169 - DNA, 22 bp, Homo sapiens
tttttttctcgagacagagtct

SEQ ID NO: 108170 - DNA, 22 bp, Homo sapiens
acagtggccatagtctttttat

SEQ ID NO: 108171 - DNA, 22 bp, Homo sapiens
atactataattttatatgtgtg

SEQ ID NO: 108172 - DNA, 18 bp, Homo sapiens
actggtgactgaggactg

SEQ ID NO: 108173 - DNA, 22 bp, Homo sapiens
atgtggaactggtcaccttctt

SEQ ID NO: 108174 - DNA, 23 bp, Homo sapiens
tgtgtgtatttatatgtatgtgt

SEQ ID NO: 108175 - DNA, 23 bp, Homo sapiens
tgtgtgtgtatatatatatgtgt

SEQ ID NO: 108176 - DNA, 23 bp, Homo sapiens
ctagtttggactacctgctgttg

SEQ ID NO: 108177 - DNA, 23 bp, Homo sapiens
ttccatatgtgttggttagatct

SEQ ID NO: 108178 - DNA, 23 bp, Homo sapiens
tgagttcattgtagattctggat

SEQ ID NO: 108179 - DNA, 23 bp, Homo sapiens
tgagttcattgtagattctggat

SEQ ID NO: 108180 - DNA, 21 bp, Homo sapiens
tgaggtaggaggatcacttga

SEQ ID NO: 108181 - DNA, 23 bp, Homo sapiens
ttacagatcagagagatgttcac

SEQ ID NO: 108182 - DNA, 23 bp, Homo sapiens
tgagttcattgtagattctggat

SEQ ID NO: 108183 - DNA, 23 bp, Homo sapiens
tgagttcattgtagattctggat

SEQ ID NO: 108184 - DNA, 22 bp, Homo sapiens
ataatgcaaatgaattgttaaa

SEQ ID NO: 108185 - DNA, 23 bp, Homo sapiens
atagatatatgtgtgtgtgtgta

SEQ ID NO: 108186 - DNA, 20 bp, Homo sapiens
tctgtatcctgtatcctgct

SEQ ID NO: 108187 - DNA, 23 bp, Homo sapiens
attccatgtatatatatgtgtgt

SEQ ID NO: 108188 - DNA, 20 bp, Homo sapiens
ttactctgtgtaaggaggtt

SEQ ID NO: 108189 - DNA, 22 bp, Homo sapiens
atattggatccaattcatatat

SEQ ID NO: 108190 - DNA, 18 bp, Homo sapiens
tgttgaatattgttaatt

SEQ ID NO: 108191 - DNA, 23 bp, Homo sapiens
tgagttcattgtagattctggat

SEQ ID NO: 108192 - DNA, 23 bp, Homo sapiens
tgagttcattgtagattctggat

SEQ ID NO: 108193 - DNA, 20 bp, Homo sapiens
gaggcagagattgcagtgag

SEQ ID NO: 108194 - DNA, 23 bp, Homo sapiens
ttgtatgctagttgtatgtttag

SEQ ID NO: 108195 - DNA, 20 bp, Homo sapiens
ctgtgcatagtttcactccc

SEQ ID NO: 108196 - DNA, 19 bp, Homo sapiens
aggtatacatatgtatata

SEQ ID NO: 108197 - DNA, 19 bp, Homo sapiens
aggtatacatatgtatata

SEQ ID NO: 108198 - DNA, 23 bp, Homo sapiens
gctgaggattttgtatctgtatt

SEQ ID NO: 108199 - DNA, 23 bp, Homo sapiens
ttgatctgtggttttctggtgat

SEQ ID NO: 108200 - DNA, 23 bp, Homo sapiens
aacttgcatgtagaacccaatat

SEQ ID NO: 108201 - DNA, 19 bp, Homo sapiens
tgtgaatatatattcatgt

SEQ ID NO: 108202 - DNA, 22 bp, Homo sapiens
tatgtgtacatatatattcatg

SEQ ID NO: 108203 - DNA, 21 bp, Homo sapiens
actcactcagtcattgttctt

SEQ ID NO: 108204 - DNA, 20 bp, Homo sapiens
agatgtagatatatagatgt

SEQ ID NO: 108205 - DNA, 22 bp, Homo sapiens
aatgtggtcattatgaaatttg

SEQ ID NO: 108206 - DNA, 20 bp, Homo sapiens
gtatatatacatatgtgtgt

SEQ ID NO: 108207 - DNA, 22 bp, Homo sapiens
tatgtgtatatatacatatgtg

SEQ ID NO: 108208 - DNA, 23 bp, Homo sapiens
tattcttgtactgtatctattct

SEQ ID NO: 108209 - DNA, 22 bp, Homo sapiens
atattcttatactgtatctata

SEQ ID NO: 108210 - DNA, 23 bp, Homo sapiens
tgagttcattgtagattctggat

SEQ ID NO: 108211 - DNA, 23 bp, Homo sapiens
tgagttcattgtagattctggat

SEQ ID NO: 108212 - DNA, 23 bp, Homo sapiens
aatccaaggaagattgtggttca

SEQ ID NO: 108213 - DNA, 23 bp, Homo sapiens
tgagacaggatctcactttgtca

SEQ ID NO: 108214 - DNA, 23 bp, Homo sapiens
tgtgtgtatatatgtgtgtgtgt

SEQ ID NO: 108215 - DNA, 19 bp, Homo sapiens
gagagagtgagagagggag

SEQ ID NO: 108216 - DNA, 23 bp, Homo sapiens
atatgtgtttatgtatatgtatg

SEQ ID NO: 108217 - DNA, 23 bp, Homo sapiens
agctctacagaatttgtttctct

SEQ ID NO: 108218 - DNA, 21 bp, Homo sapiens
acatgtgcacaatgtgcagga

SEQ ID NO: 108219 - DNA, 23 bp, Homo sapiens
aatagaagggccacaggatgaga

SEQ ID NO: 108220 - DNA, 23 bp, Homo sapiens
tgagttcattgtagattctggat

SEQ ID NO: 108221 - DNA, 23 bp, Homo sapiens
tgagttcattgtagattctggat

SEQ ID NO: 108222 - DNA, 21 bp, Homo sapiens
aaagtcatatgcattttctag

SEQ ID NO: 108223 - DNA, 18 bp, Homo sapiens
aatacgtccactttactt

SEQ ID NO: 108224 - DNA, 23 bp, Homo sapiens
caaagaattctccttttgggctt

SEQ ID NO: 108225 - DNA, 19 bp, Homo sapiens
gagtgtgaagagtggaggt

SEQ ID NO: 108226 - DNA, 23 bp, Homo sapiens
tggagtctcactctgtcacccag

SEQ ID NO: 108227 - DNA, 23 bp, Homo sapiens
tggagtctcactctgtcacccag

SEQ ID NO: 108228 - DNA, 23 bp, Homo sapiens
tgaaggttgtattcttatgtgtt

SEQ ID NO: 108229 - DNA, 22 bp, Homo sapiens
tataagcatctatgtgtatgtg

SEQ ID NO: 108230 - DNA, 22 bp, Homo sapiens
ttatatacagctggttttagat

SEQ ID NO: 108231 - DNA, 23 bp, Homo sapiens
tttgagacggagtctcactctgt

SEQ ID NO: 108232 - DNA, 23 bp, Homo sapiens
tgaaagcatatcaagctgtatat

SEQ ID NO: 108233 - DNA, 21 bp, Homo sapiens
atctatatatccagctatctg

SEQ ID NO: 108234 - DNA, 23 bp, Homo sapiens
tctatagatgtatgtatatatgt

SEQ ID NO: 108235 - DNA, 18 bp, Homo sapiens
tatatttctttactgttt

SEQ ID NO: 108236 - DNA, 21 bp, Homo sapiens
ttccccgatgcacatttttcc

SEQ ID NO: 108237 - DNA, 23 bp, Homo sapiens
tgtgtatatatatatgtgtgtgt

SEQ ID NO: 108238 - DNA, 23 bp, Homo sapiens
cggagtctcgctctgtctcccat

SEQ ID NO: 108239 - DNA, 19 bp, Homo sapiens
aggcttaggatggactctg

SEQ ID NO: 108240 - DNA, 22 bp, Homo sapiens
cacagccaacatcagtgtatgg

SEQ ID NO: 108241 - DNA, 23 bp, Homo sapiens
ttaaattgtgtaaatttagagca

SEQ ID NO: 108242 - DNA, 20 bp, Homo sapiens
tcttacttgataactatgca

SEQ ID NO: 108243 - DNA, 18 bp, Homo sapiens
cttctctgcctcgagctg

SEQ ID NO: 108244 - DNA, 23 bp, Homo sapiens
tctatcagtgcatttcattagga

SEQ ID NO: 108245 - DNA, 23 bp, Homo sapiens
ctcacagatgagattcagcaaag

SEQ ID NO: 108246 - DNA, 20 bp, Homo sapiens
tatgtgtgtgaatgtgtatg

SEQ ID NO: 108247 - DNA, 21 bp, Homo sapiens
tacacatatatgcatttatgt

SEQ ID NO: 108248 - DNA, 19 bp, Homo sapiens
tggtatatatatgtgtgtg

SEQ ID NO: 108249 - DNA, 22 bp, Homo sapiens
aattctgacttgtatttttctc

SEQ ID NO: 108250 - DNA, 23 bp, Homo sapiens
aagacagtcacgaagcagtttct

SEQ ID NO: 108251 - DNA, 23 bp, Homo sapiens
gaatgtatctctgttggtaagtt

SEQ ID NO: 108252 - DNA, 20 bp, Homo sapiens
tatgtcacattttctttatc

SEQ ID NO: 108253 - DNA, 23 bp, Homo sapiens
acagagtctcactctgtcgccca

SEQ ID NO: 108254 - DNA, 23 bp, Homo sapiens
tttgttctttttgcttaggactg

SEQ ID NO: 108255 - DNA, 23 bp, Homo sapiens
tttggctccatatgaaatgtaaa

SEQ ID NO: 108256 - DNA, 23 bp, Homo sapiens
gaactgtctgtgggtctctcagt

SEQ ID NO: 108257 - DNA, 23 bp, Homo sapiens
tgtaacatgtatgtgtatgtgta

SEQ ID NO: 108258 - DNA, 23 bp, Homo sapiens
gacatggtctcactctgtcaccc

SEQ ID NO: 108259 - DNA, 23 bp, Homo sapiens
cagggtctcactctgttgctcag

SEQ ID NO: 108260 - DNA, 23 bp, Homo sapiens
tcagccactgtctgtcttcatcc

SEQ ID NO: 108261 - DNA, 23 bp, Homo sapiens
tagtttatttgcataaggttgct

SEQ ID NO: 108262 - DNA, 23 bp, Homo sapiens
aacaaactgccaaatgttttcca

SEQ ID NO: 108263 - DNA, 23 bp, Homo sapiens
agctcagacttttacatgagagg

SEQ ID NO: 108264 - DNA, 21 bp, Homo sapiens
aacaatgtacaaggccttatg

SEQ ID NO: 108265 - DNA, 23 bp, Homo sapiens
ttttgaggtggagtctcactctg

SEQ ID NO: 108266 - DNA, 23 bp, Homo sapiens
acagggtctctcactctgttgcc

SEQ ID NO: 108267 - DNA, 23 bp, Homo sapiens
tacaagtggcatgatcttggctc

SEQ ID NO: 108268 - DNA, 23 bp, Homo sapiens
tctgtgaagaaagtcactggtag

SEQ ID NO: 108269 - DNA, 23 bp, Homo sapiens
attccgtcactctgatttcagtg

SEQ ID NO: 108270 - DNA, 23 bp, Homo sapiens
agaggtgtttggatttggaatct

SEQ ID NO: 108271 - DNA, 23 bp, Homo sapiens
aaagacacagtatttgctgatag

SEQ ID NO: 108272 - DNA, 20 bp, Homo sapiens
tgagacacagtcgcactctg

SEQ ID NO: 108273 - DNA, 23 bp, Homo sapiens
ttttctagtccttaaccaattca

SEQ ID NO: 108274 - DNA, 23 bp, Homo sapiens
tatgagttggattactgaattat

SEQ ID NO: 108275 - DNA, 23 bp, Homo sapiens
tgagttcattgtagattctggat

SEQ ID NO: 108276 - DNA, 22 bp, Homo sapiens
ggtactttgagtttcatgggag

SEQ ID NO: 108277 - DNA, 23 bp, Homo sapiens
atcttattcagctttgagtgctc

SEQ ID NO: 108278 - DNA, 22 bp, Homo sapiens
acttcttatcctttctagcagt

SEQ ID NO: 108279 - DNA, 23 bp, Homo sapiens
actgatgtgaaagtgatttgaga

SEQ ID NO: 108280 - DNA, 23 bp, Homo sapiens
attttatctggtttccttttcac

SEQ ID NO: 108281 - DNA, 23 bp, Homo sapiens
tggagtctcactctgtcacccag

SEQ ID NO: 108282 - DNA, 20 bp, Homo sapiens
aggtactatatatagcatat

SEQ ID NO: 108283 - DNA, 22 bp, Homo sapiens
acagttgtgaagagggtgggaa

SEQ ID NO: 108284 - DNA, 21 bp, Homo sapiens
acattctttgtatatgtgtga

SEQ ID NO: 108285 - DNA, 23 bp, Homo sapiens
ctcccagagcccctggaactctg

SEQ ID NO: 108286 - DNA, 23 bp, Homo sapiens
tcccagagcccctggaactctgg

SEQ ID NO: 108287 - DNA, 23 bp, Homo sapiens
tcccagagcccctggaactctgg

SEQ ID NO: 108288 - DNA, 23 bp, Homo sapiens
tcccagagcccctggaactctgg

SEQ ID NO: 108289 - DNA, 23 bp, Homo sapiens
ggtagtgcatacctgtagtccca

SEQ ID NO: 108290 - DNA, 23 bp, Homo sapiens
acggagtctcgctctgtcaccca

SEQ ID NO: 108291 - DNA, 19 bp, Homo sapiens
gtctcgctctgtcacccac

SEQ ID NO: 108292 - DNA, 23 bp, Homo sapiens
ttatcacagtgctgatgctgtct

SEQ ID NO: 108293 - DNA, 22 bp, Homo sapiens
tacagtactgtgataactgaag

SEQ ID NO: 108294 - DNA, 23 bp, Homo sapiens
cctgtcagtgtcagtctcactgc

SEQ ID NO: 108295 - DNA, 23 bp, Homo sapiens
tgaaaagagtggttatttttctt

SEQ ID NO: 108296 - DNA, 23 bp, Homo sapiens
aatagctgctttgtgatgttgct

SEQ ID NO: 108297 - DNA, 23 bp, Homo sapiens
aagtttgtaaagtacttagcaga

SEQ ID NO: 108298 - DNA, 23 bp, Homo sapiens
tatatgtatatatacatatgtgt

SEQ ID NO: 108299 - DNA, 18 bp, Homo sapiens
acacatatatacatgtgt

SEQ ID NO: 108300 - DNA, 23 bp, Homo sapiens
ttttctagaacttttggtcctgt

SEQ ID NO: 108301 - DNA, 23 bp, Homo sapiens
tctgtgtgtgtcactcattgggg

SEQ ID NO: 108302 - DNA, 19 bp, Homo sapiens
aaaattcaagatgtaagag

SEQ ID NO: 108303 - DNA, 23 bp, Homo sapiens
atcttgtacttagagagtatctt

SEQ ID NO: 108304 - DNA, 20 bp, Homo sapiens
catcatggttctctctgagc

SEQ ID NO: 108305 - DNA, 23 bp, Homo sapiens
tttgagacggagtctggctctgt

SEQ ID NO: 108306 - DNA, 23 bp, Homo sapiens
atatctgagactgggtaatttat

SEQ ID NO: 108307 - DNA, 23 bp, Homo sapiens
tgtctcactgtctggctcagacc

SEQ ID NO: 108308 - DNA, 23 bp, Homo sapiens
gagtctcactctgtcacccaggc

SEQ ID NO: 108309 - DNA, 23 bp, Homo sapiens
agtgcagcagcatgattttggct

SEQ ID NO: 108310 - DNA, 23 bp, Homo sapiens
cggagtctcactctgtcacccag

SEQ ID NO: 108311 - DNA, 23 bp, Homo sapiens
tgaggagttcatactctgtgtga

SEQ ID NO: 108312 - DNA, 18 bp, Homo sapiens
tacaagatgtgtaggctt

SEQ ID NO: 108313 - DNA, 23 bp, Homo sapiens
acagagggagactgtctcactgt

SEQ ID NO: 108314 - DNA, 23 bp, Homo sapiens
agtagtcaacaaggtcaggtgct

SEQ ID NO: 108315 - DNA, 23 bp, Homo sapiens
tgagttcattgtagattctggat

SEQ ID NO: 108316 - DNA, 23 bp, Homo sapiens
tgagttcattgtagattctggat

SEQ ID NO: 108317 - DNA, 23 bp, Homo sapiens
tatcagagaatatatgtgtgttg

SEQ ID NO: 108318 - DNA, 23 bp, Homo sapiens
ttgagttttgatttccttctggt

SEQ ID NO: 108319 - DNA, 18 bp, Homo sapiens
tatgggtacatatgggta

SEQ ID NO: 108320 - DNA, 21 bp, Homo sapiens
atatgtatacatgtatatgtt

SEQ ID NO: 108321 - DNA, 23 bp, Homo sapiens
tgtgtacatatacatatgtattt

SEQ ID NO: 108322 - DNA, 20 bp, Homo sapiens
tatgtacatttagcccagct

SEQ ID NO: 108323 - DNA, 23 bp, Homo sapiens
ctatgtgctgttgaatagaatgt

SEQ ID NO: 108324 - DNA, 23 bp, Homo sapiens
ctctgactcagtgtgtgactctg

SEQ ID NO: 108325 - DNA, 18 bp, Homo sapiens
tattgttcgtagcacaga

SEQ ID NO: 108326 - DNA, 23 bp, Homo sapiens
taatctgtgcattgtagaaaggc

SEQ ID NO: 108327 - DNA, 23 bp, Homo sapiens
tgagacggagtctcactctgtcg

SEQ ID NO: 108328 - DNA, 21 bp, Homo sapiens
agggatgactctctcatagct

SEQ ID NO: 108329 - DNA, 23 bp, Homo sapiens
tgagacggagtctcgctctgtca

SEQ ID NO: 108330 - DNA, 23 bp, Homo sapiens
agtgacttcttcaagacactttt

SEQ ID NO: 108331 - DNA, 22 bp, Homo sapiens
agtgcaacggtgtgatctcagc

SEQ ID NO: 108332 - DNA, 23 bp, Homo sapiens
agagtctctctctgtcacccagg

SEQ ID NO: 108333 - DNA, 21 bp, Homo sapiens
atgtctgtttaaatgtgtgag

SEQ ID NO: 108334 - DNA, 23 bp, Homo sapiens
tatagcaggtatatgtgcagaat

SEQ ID NO: 108335 - DNA, 20 bp, Homo sapiens
tttttgaagatgactaatct

SEQ ID NO: 108336 - DNA, 18 bp, Homo sapiens
tctgtgagtatgtccacc

SEQ ID NO: 108337 - DNA, 21 bp, Homo sapiens
agtctcactgagtcacacact

SEQ ID NO: 108338 - DNA, 23 bp, Homo sapiens
ttggtagagatgggggtctccct

SEQ ID NO: 108339 - DNA, 23 bp, Homo sapiens
atagctctcagtctgtctgtcta

SEQ ID NO: 108340 - DNA, 21 bp, Homo sapiens
atatgtgtatatatatgtgtg

SEQ ID NO: 108341 - DNA, 23 bp, Homo sapiens
ctccatctgcaacagcatctgca

SEQ ID NO: 108342 - DNA, 23 bp, Homo sapiens
tgagttcattgtagattctggat

SEQ ID NO: 108343 - DNA, 23 bp, Homo sapiens
tgagttcattgtagattctggat

SEQ ID NO: 108344 - DNA, 23 bp, Homo sapiens
tcagtggtagcttgattcggata

SEQ ID NO: 108345 - DNA, 22 bp, Homo sapiens
ttagccagtatggttttgatct

SEQ ID NO: 108346 - DNA, 23 bp, Homo sapiens
tgagttcattgtagattctggat

SEQ ID NO: 108347 - DNA, 23 bp, Homo sapiens
tgagttcattgtagattctggat

SEQ ID NO: 108348 - DNA, 22 bp, Homo sapiens
ttggctcttttttctgaacatg

SEQ ID NO: 108349 - DNA, 21 bp, Homo sapiens
aactctgttccagttcaagga

SEQ ID NO: 108350 - DNA, 20 bp, Homo sapiens
ttttttctttggagacggag

SEQ ID NO: 108351 - DNA, 23 bp, Homo sapiens
ctctgtcactagtttgtgagctc

SEQ ID NO: 108352 - DNA, 21 bp, Homo sapiens
tgtacactgacacaacatccc

SEQ ID NO: 108353 - DNA, 23 bp, Homo sapiens
ttcatgttgcatatgcaatgtca

SEQ ID NO: 108354 - DNA, 23 bp, Homo sapiens
tgtgtgtatgtatatatgtatgt

SEQ ID NO: 108355 - DNA, 22 bp, Homo sapiens
tctagactttttctttttgaga

SEQ ID NO: 108356 - DNA, 20 bp, Homo sapiens
tatatctggtagatatatat

SEQ ID NO: 108357 - DNA, 20 bp, Homo sapiens
tatatatctggtagatatat

SEQ ID NO: 108358 - DNA, 19 bp, Homo sapiens
tgagtgtgtttgtctggca

SEQ ID NO: 108359 - DNA, 23 bp, Homo sapiens
atatgtatatgtgcatatatgta

SEQ ID NO: 108360 - DNA, 21 bp, Homo sapiens
tatcacacacatatatatcac

SEQ ID NO: 108361 - DNA, 22 bp, Homo sapiens
taagacagacatacaaaacgca

SEQ ID NO: 108362 - DNA, 21 bp, Homo sapiens
acatgtgcacaatgtgcaggt

SEQ ID NO: 108363 - DNA, 23 bp, Homo sapiens
tgaattacttgctgtcagactca

SEQ ID NO: 108364 - DNA, 23 bp, Homo sapiens
tttttgggttccatatgaaattt

SEQ ID NO: 108365 - DNA, 23 bp, Homo sapiens
tacttctccatattactgacacc

SEQ ID NO: 108366 - DNA, 23 bp, Homo sapiens
ctggaagacttgtctcgctctgt

SEQ ID NO: 108367 - DNA, 23 bp, Homo sapiens
gacagagaggactctgcctggca

SEQ ID NO: 108368 - DNA, 23 bp, Homo sapiens
tatattgtatgtgtatatgtgta

SEQ ID NO: 108369 - DNA, 23 bp, Homo sapiens
gcatgtttcttgatttgcctctg

SEQ ID NO: 108370 - DNA, 23 bp, Homo sapiens
tgagttcattgtagattctggat

SEQ ID NO: 108371 - DNA, 23 bp, Homo sapiens
tgagttcattgtagattctggat

SEQ ID NO: 108372 - DNA, 23 bp, Homo sapiens
ctctgcctctcagagtggctgtg

SEQ ID NO: 108373 - DNA, 21 bp, Homo sapiens
tgccagcctgcctgtgaggct

SEQ ID NO: 108374 - DNA, 18 bp, Homo sapiens
tacacacagacagatgta

SEQ ID NO: 108375 - DNA, 23 bp, Homo sapiens
ttagactcaagttgttatttggt

SEQ ID NO: 108376 - DNA, 23 bp, Homo sapiens
ctgcagctttagagtccgtctgt

SEQ ID NO: 108377 - DNA, 23 bp, Homo sapiens
tgcctgcctgcctgcctgcctgg

SEQ ID NO: 108378 - DNA, 23 bp, Homo sapiens
acagatgagacagaagccagtcc

SEQ ID NO: 108379 - DNA, 22 bp, Homo sapiens
tttatcttgtatattcctgttt

SEQ ID NO: 108380 - DNA, 20 bp, Homo sapiens
aaagtggatgctttgcttct

SEQ ID NO: 108381 - DNA, 22 bp, Homo sapiens
atgtgagctgcaaatattttct

SEQ ID NO: 108382 - DNA, 18 bp, Homo sapiens
ttgttgtagaggtgggtt

SEQ ID NO: 108383 - DNA, 22 bp, Homo sapiens
ctgcaattttctgtggctccag

SEQ ID NO: 108384 - DNA, 23 bp, Homo sapiens
aaatactcctcctgctcctctaa

SEQ ID NO: 108385 - DNA, 20 bp, Homo sapiens
taacagtgttgagaggtggg

SEQ ID NO: 108386 - DNA, 23 bp, Homo sapiens
tgagacagtctctctccgtcacc

SEQ ID NO: 108387 - DNA, 23 bp, Homo sapiens
agtctctgtgcctcagtttccac

SEQ ID NO: 108388 - DNA, 19 bp, Homo sapiens
tgattgtatgtatgaatga

SEQ ID NO: 108389 - DNA, 23 bp, Homo sapiens
atatctatgtgtgtgtgtgtgtg

SEQ ID NO: 108390 - DNA, 23 bp, Homo sapiens
tatacatatatacatgtagagag

SEQ ID NO: 108391 - DNA, 22 bp, Homo sapiens
aatgttattaatgtgtatgtgt

SEQ ID NO: 108392 - DNA, 18 bp, Homo sapiens
tatatatacacatacctt

SEQ ID NO: 108393 - DNA, 23 bp, Homo sapiens
tatgtttacttgtctcttgctgg

SEQ ID NO: 108394 - DNA, 23 bp, Homo sapiens
ttgatagactgtatgcttcctga

SEQ ID NO: 108395 - DNA, 23 bp, Homo sapiens
tgtatgtatatatataactgtgt

SEQ ID NO: 108396 - DNA, 21 bp, Homo sapiens
aaatctgtctctctctctctc

SEQ ID NO: 108397 - DNA, 22 bp, Homo sapiens
atacacacacacatatatatgt

SEQ ID NO: 108398 - DNA, 23 bp, Homo sapiens
tatgtgtatatatatgtgtgtgt

SEQ ID NO: 108399 - DNA, 22 bp, Homo sapiens
agtgtgctaggaattttattgg

SEQ ID NO: 108400 - DNA, 22 bp, Homo sapiens
tcagaaatgatttaagcctaga

SEQ ID NO: 108401 - DNA, 23 bp, Homo sapiens
tctgcctgtgagcctgtaaaatc

SEQ ID NO: 108402 - DNA, 23 bp, Homo sapiens
gagtctcagtctgtcacccaggc

SEQ ID NO: 108403 - DNA, 23 bp, Homo sapiens
aagctgaggctggctgtttgcct

SEQ ID NO: 108404 - DNA, 23 bp, Homo sapiens
tccactggacaaggtgctgaagg

SEQ ID NO: 108405 - DNA, 20 bp, Homo sapiens
atactttaagttttggggta

SEQ ID NO: 108406 - DNA, 23 bp, Homo sapiens
tgagttcattgtagattctggat

SEQ ID NO: 108407 - DNA, 23 bp, Homo sapiens
tgagttcattgtagattctggat

SEQ ID NO: 108408 - DNA, 23 bp, Homo sapiens
aatgtttttcttattctgagagt

SEQ ID NO: 108409 - DNA, 23 bp, Homo sapiens
ccagtctcactctcactgtgccc

SEQ ID NO: 108410 - DNA, 18 bp, Homo sapiens
tgtgtaagtacgttctat

SEQ ID NO: 108411 - DNA, 18 bp, Homo sapiens
tatactttaagttctggg

SEQ ID NO: 108412 - DNA, 23 bp, Homo sapiens
ataattcagtgtctaactaatgt

SEQ ID NO: 108413 - DNA, 18 bp, Homo sapiens
gtatacactatatatact

SEQ ID NO: 108414 - DNA, 23 bp, Homo sapiens
ctacagacaacagtaactctgag

SEQ ID NO: 108415 - DNA, 23 bp, Homo sapiens
acactggcattagagtcagaaaa

SEQ ID NO: 108416 - DNA, 22 bp, Homo sapiens
tccttctaagattttttgtatt

SEQ ID NO: 108417 - DNA, 20 bp, Homo sapiens
aaacacagaagagctttggt

SEQ ID NO: 108418 - DNA, 23 bp, Homo sapiens
tactgtgtgccaggcactgttct

SEQ ID NO: 108419 - DNA, 23 bp, Homo sapiens
tctccctctgtggctgtgtctcc

SEQ ID NO: 108420 - DNA, 23 bp, Homo sapiens
ttctgtgaagaaagtcaatggta

SEQ ID NO: 108421 - DNA, 19 bp, Homo sapiens
tgatctagggacagccagt

SEQ ID NO: 108422 - DNA, 22 bp, Homo sapiens
agggtctcactctgtcacccag

SEQ ID NO: 108423 - DNA, 23 bp, Homo sapiens
ctaactcacagaattgagagttg

SEQ ID NO: 108424 - DNA, 23 bp, Homo sapiens
tgagacggagtctcgctctgtca

SEQ ID NO: 108425 - DNA, 21 bp, Homo sapiens
tgagatggagtctcgctctgt

SEQ ID NO: 108426 - DNA, 19 bp, Homo sapiens
atccagactggagtgcctg

SEQ ID NO: 108427 - DNA, 23 bp, Homo sapiens
gacagagtctcgctctgtcaccc

SEQ ID NO: 108428 - DNA, 19 bp, Homo sapiens
aggcagagtcttgctctgt

SEQ ID NO: 108429 - DNA, 19 bp, Homo sapiens
tggcagggttttagctttc

SEQ ID NO: 108430 - DNA, 23 bp, Homo sapiens
tgagacggagtctcgctgtgaca

SEQ ID NO: 108431 - DNA, 23 bp, Homo sapiens
tctgtatatgtatctttatcaaa

SEQ ID NO: 108432 - DNA, 18 bp, Homo sapiens
tgcatatatatatagtgt

SEQ ID NO: 108433 - DNA, 23 bp, Homo sapiens
gacagagtctcgctctgtcaccc

SEQ ID NO: 108434 - DNA, 23 bp, Homo sapiens
acagagtctcgctctgtcaccca

SEQ ID NO: 108435 - DNA, 23 bp, Homo sapiens
gattgtgttgattgttgtctgga

SEQ ID NO: 108436 - DNA, 22 bp, Homo sapiens
acagactaattgacaaggtagg

SEQ ID NO: 108437 - DNA, 18 bp, Homo sapiens
agagcaagaccttttttt

SEQ ID NO: 108438 - DNA, 18 bp, Homo sapiens
tgagacaaagtctcactc

SEQ ID NO: 108439 - DNA, 23 bp, Homo sapiens
tccctgtgtctgtggctccctcc

SEQ ID NO: 108440 - DNA, 23 bp, Homo sapiens
ttcatcttcatcatcatcaagtg

SEQ ID NO: 108441 - DNA, 23 bp, Homo sapiens
ttttagtgtcttcttgtatatgg

SEQ ID NO: 108442 - DNA, 22 bp, Homo sapiens
tatgtgtgtgtatgtatacata

SEQ ID NO: 108443 - DNA, 23 bp, Homo sapiens
catatatgtagttgtatacaata

SEQ ID NO: 108444 - DNA, 23 bp, Homo sapiens
tttgtgtgtgtgtgcagagagtg

SEQ ID NO: 108445 - DNA, 23 bp, Homo sapiens
gaccgagtctcgctctgtcaccc

SEQ ID NO: 108446 - DNA, 23 bp, Homo sapiens
gtctctctcagtgtttgttctta

SEQ ID NO: 108447 - DNA, 23 bp, Homo sapiens
tccactgtgagggtttttgtttc

SEQ ID NO: 108448 - DNA, 23 bp, Homo sapiens
agtctctgctagttgtttgtggt

SEQ ID NO: 108449 - DNA, 23 bp, Homo sapiens
acagggtctctctctgtcactta

SEQ ID NO: 108450 - DNA, 22 bp, Homo sapiens
ttggacctagagaattgtgtgg

SEQ ID NO: 108451 - DNA, 19 bp, Homo sapiens
atctggtccaaattgttcc

SEQ ID NO: 108452 - DNA, 23 bp, Homo sapiens
agaggtgacagtgatgagtgggc

SEQ ID NO: 108453 - DNA, 23 bp, Homo sapiens
tggctctctgtctctgtgtcacc

SEQ ID NO: 108454 - DNA, 23 bp, Homo sapiens
gctgactctcagctgctgtgtga

SEQ ID NO: 108455 - DNA, 19 bp, Homo sapiens
ctagtcctccaccagcact

SEQ ID NO: 108456 - DNA, 21 bp, Homo sapiens
gtcagtggctaacttgtgatg

SEQ ID NO: 108457 - DNA, 18 bp, Homo sapiens
tgagggtttgttctgtgc

SEQ ID NO: 108458 - DNA, 23 bp, Homo sapiens
cggagtctcactctgtcacccag

SEQ ID NO: 108459 - DNA, 19 bp, Homo sapiens
tgagcctcagcctggccta

SEQ ID NO: 108460 - DNA, 21 bp, Homo sapiens
atttctggcttctctctctct

SEQ ID NO: 108461 - DNA, 21 bp, Homo sapiens
ctagtagctgagagtacagat

SEQ ID NO: 108462 - DNA, 23 bp, Homo sapiens
tgaaactccatctctctctctct

SEQ ID NO: 108463 - DNA, 23 bp, Homo sapiens
ctctgtagattcactgctgtcta

SEQ ID NO: 108464 - DNA, 21 bp, Homo sapiens
tggctgttagctgaattgtgc

SEQ ID NO: 108465 - DNA, 23 bp, Homo sapiens
gagaatctcactctgtcacccag

SEQ ID NO: 108466 - DNA, 21 bp, Homo sapiens
aaacagagacaagttctcact

SEQ ID NO: 108467 - DNA, 19 bp, Homo sapiens
tgtgagccacagtgctcgg

SEQ ID NO: 108468 - DNA, 23 bp, Homo sapiens
atggagtctcactctgtcaccca

SEQ ID NO: 108469 - DNA, 23 bp, Homo sapiens
gttagtccttttgttattgtgag

SEQ ID NO: 108470 - DNA, 23 bp, Homo sapiens
agatggacatttttgctgtttcc

SEQ ID NO: 108471 - DNA, 23 bp, Homo sapiens
tgtcactctctggtaaaggtgtg

SEQ ID NO: 108472 - DNA, 23 bp, Homo sapiens
gacagagtctcgctctgtcaccc

SEQ ID NO: 108473 - DNA, 23 bp, Homo sapiens
tgcagtggcatgatcttggctca

SEQ ID NO: 108474 - DNA, 18 bp, Homo sapiens
atgtgctgcatctcggtt

SEQ ID NO: 108475 - DNA, 23 bp, Homo sapiens
tgagaccaaggaagaactttgtg

SEQ ID NO: 108476 - DNA, 21 bp, Homo sapiens
attgagctcacctaggactct

SEQ ID NO: 108477 - DNA, 21 bp, Homo sapiens
tgttctgtaagtttgaatttc

SEQ ID NO: 108478 - DNA, 23 bp, Homo sapiens
taattgtctgggattcaaaatcc

SEQ ID NO: 108479 - DNA, 22 bp, Homo sapiens
ctccttccttttgacttcctag

SEQ ID NO: 108480 - DNA, 23 bp, Homo sapiens
aggagtcagaggatgcagtgagc

SEQ ID NO: 108481 - DNA, 23 bp, Homo sapiens
tgagacggagtctggctctgtca

SEQ ID NO: 108482 - DNA, 23 bp, Homo sapiens
cagagtctcactctgtcatccag

SEQ ID NO: 108483 - DNA, 18 bp, Homo sapiens
gtctggctctgtcgctca

SEQ ID NO: 108484 - DNA, 20 bp, Homo sapiens
acagacccaggaaaggatgt

SEQ ID NO: 108485 - DNA, 23 bp, Homo sapiens
aaatgtatcctaatcttatgtat

SEQ ID NO: 108486 - DNA, 23 bp, Homo sapiens
gagatagaatctcactctgtcac

SEQ ID NO: 108487 - DNA, 23 bp, Homo sapiens
tgagacagagtctcgctctgtcg

SEQ ID NO: 108488 - DNA, 20 bp, Homo sapiens
tttggacattactttgatag

SEQ ID NO: 108489 - DNA, 23 bp, Homo sapiens
tattgctttttcagttatgtggg

SEQ ID NO: 108490 - DNA, 23 bp, Homo sapiens
attgtggttttgatatgcatttg

SEQ ID NO: 108491 - DNA, 23 bp, Homo sapiens
gagaaaatacgtaaatgttgaag

SEQ ID NO: 108492 - DNA, 23 bp, Homo sapiens
atctttttcattcgttatcatgt

SEQ ID NO: 108493 - DNA, 18 bp, Homo sapiens
atgtatatatatatatgt

SEQ ID NO: 108494 - DNA, 23 bp, Homo sapiens
gacagagtctcgctctgtcaccc

SEQ ID NO: 108495 - DNA, 21 bp, Homo sapiens
catcagaaaagatacagaaca

SEQ ID NO: 108496 - DNA, 19 bp, Homo sapiens
agtggagttggtaatagct

SEQ ID NO: 108497 - DNA, 19 bp, Homo sapiens
aaagcagggtctcactctg

SEQ ID NO: 108498 - DNA, 23 bp, Homo sapiens
gcctggcacagagtgtttactgc

SEQ ID NO: 108499 - DNA, 23 bp, Homo sapiens
agacggagtctcactctgtcacc

SEQ ID NO: 108500 - DNA, 23 bp, Homo sapiens
cggagtctcactctgtcacccag

SEQ ID NO: 108501 - DNA, 23 bp, Homo sapiens
gagtctcactctgtcacccaggc

SEQ ID NO: 108502 - DNA, 23 bp, Homo sapiens
tgagttcattgtagattctggat

SEQ ID NO: 108503 - DNA, 23 bp, Homo sapiens
tgagttcattgtagattctggat

SEQ ID NO: 108504 - DNA, 23 bp, Homo sapiens
tgtgggtatgtatatgtgtgtgt

SEQ ID NO: 108505 - DNA, 21 bp, Homo sapiens
tatatttaacaagctcttaca

SEQ ID NO: 108506 - DNA, 23 bp, Homo sapiens
tcttagaggatagactttcagtt

SEQ ID NO: 108507 - DNA, 23 bp, Homo sapiens
gatactagctgtgggtctgttgt

SEQ ID NO: 108508 - DNA, 22 bp, Homo sapiens
ttatttcaccaggtacatgcta

SEQ ID NO: 108509 - DNA, 23 bp, Homo sapiens
cagtagagactcagaatatgttg

SEQ ID NO: 108510 - DNA, 23 bp, Homo sapiens
tgtttctgtgtgtgtatgtacac

SEQ ID NO: 108511 - DNA, 23 bp, Homo sapiens
tgtccatctgtattgatggagtt

SEQ ID NO: 108512 - DNA, 23 bp, Homo sapiens
tccctgtagttgccaaagtcaga

SEQ ID NO: 108513 - DNA, 23 bp, Homo sapiens
ttctgtctctctgtcaactgatc

SEQ ID NO: 108514 - DNA, 23 bp, Homo sapiens
atagtagtaaggagatgaatgtg

SEQ ID NO: 108515 - DNA, 23 bp, Homo sapiens
tgagttcattgtagattctggat

SEQ ID NO: 108516 - DNA, 23 bp, Homo sapiens
tgagttcattgtagattctggat

SEQ ID NO: 108517 - DNA, 18 bp, Homo sapiens
ttagacgtagtctccctc

SEQ ID NO: 108518 - DNA, 22 bp, Homo sapiens
aaaattgtgattttcttgaaga

SEQ ID NO: 108519 - DNA, 22 bp, Homo sapiens
tatggtgatttgtaatcagtga

SEQ ID NO: 108520 - DNA, 22 bp, Homo sapiens
actattgtaattgttttggggt

SEQ ID NO: 108521 - DNA, 23 bp, Homo sapiens
tgagttcattgtagattctggat

SEQ ID NO: 108522 - DNA, 23 bp, Homo sapiens
tgagttcattgtagattctggat

SEQ ID NO: 108523 - DNA, 20 bp, Homo sapiens
tagatgcataaatatttaga

SEQ ID NO: 108524 - DNA, 21 bp, Homo sapiens
aagacagatgagagagagaga

SEQ ID NO: 108525 - DNA, 23 bp, Homo sapiens
agggagtggatcttgtttctttt

SEQ ID NO: 108526 - DNA, 23 bp, Homo sapiens
atcacagtggctgttgagcacct

SEQ ID NO: 108527 - DNA, 23 bp, Homo sapiens
gttactcactctgtgtcttctcc

SEQ ID NO: 108528 - DNA, 20 bp, Homo sapiens
ttttgtcttggtagtatgga

SEQ ID NO: 108529 - DNA, 22 bp, Homo sapiens
agtcccatcccttctagaagtc

SEQ ID NO: 108530 - DNA, 22 bp, Homo sapiens
acatgtgcacattgtgcaggtt

SEQ ID NO: 108531 - DNA, 23 bp, Homo sapiens
tggcccaagactgtttttggtgt

SEQ ID NO: 108532 - DNA, 21 bp, Homo sapiens
ttacatttgttgaggatggtt

SEQ ID NO: 108533 - DNA, 23 bp, Homo sapiens
acactgagcatcatccagtgcag

SEQ ID NO: 108534 - DNA, 22 bp, Homo sapiens
tgtccctgtctcatagggctgt

SEQ ID NO: 108535 - DNA, 23 bp, Homo sapiens
agagaactcagacagaacagaga

SEQ ID NO: 108536 - DNA, 23 bp, Homo sapiens
acagcaagtcactgactctctct

SEQ ID NO: 108537 - DNA, 21 bp, Homo sapiens
agacaagagggaggtgagaac

SEQ ID NO: 108538 - DNA, 23 bp, Homo sapiens
ctggctctgagtgtgtgagcggc

SEQ ID NO: 108539 - DNA, 21 bp, Homo sapiens
actcacagacattagggaacc

SEQ ID NO: 108540 - DNA, 23 bp, Homo sapiens
aagcctcagtagagtgtgtgcag

SEQ ID NO: 108541 - DNA, 23 bp, Homo sapiens
acaagagagtgccaaggttctct

SEQ ID NO: 108542 - DNA, 23 bp, Homo sapiens
gtgacagactgagtgagtctctg

SEQ ID NO: 108543 - DNA, 23 bp, Homo sapiens
agtgtgcatagtagtctgggtgc

SEQ ID NO: 108544 - DNA, 23 bp, Homo sapiens
ggctgaggtaggaggatcatttg

SEQ ID NO: 108545 - DNA, 23 bp, Homo sapiens
agatggagtctcactgtgtcacc

SEQ ID NO: 108546 - DNA, 23 bp, Homo sapiens
gactgagtctcgctctgtcaccc

SEQ ID NO: 108547 - DNA, 20 bp, Homo sapiens
atattctatgtatatgtata

SEQ ID NO: 108548 - DNA, 23 bp, Homo sapiens
tgagttcattgtagattctggat

SEQ ID NO: 108549 - DNA, 23 bp, Homo sapiens
tgagttcattgtagattctggat

SEQ ID NO: 108550 - DNA, 19 bp, Homo sapiens
agacagaagaatgactgct

SEQ ID NO: 108551 - DNA, 20 bp, Homo sapiens
tgtgtgtctgtgtgtgaccg

SEQ ID NO: 108552 - DNA, 20 bp, Homo sapiens
gcctgtctctctcagcctct

SEQ ID NO: 108553 - DNA, 23 bp, Homo sapiens
tgagatggagtctctgtctctca

SEQ ID NO: 108554 - DNA, 23 bp, Homo sapiens
tgcctgtctgcctcactagcagc

SEQ ID NO: 108555 - DNA, 20 bp, Homo sapiens
taccctcaggtactgaagcc

SEQ ID NO: 108556 - DNA, 23 bp, Homo sapiens
ttttcagtagagagggagtagac

SEQ ID NO: 108557 - DNA, 23 bp, Homo sapiens
agggtctctctctgtcactcagg

SEQ ID NO: 108558 - DNA, 22 bp, Homo sapiens
cagagcagtgttagctgttaga

SEQ ID NO: 108559 - DNA, 23 bp, Homo sapiens
gtgtgtgtgtgtgtacttataga

SEQ ID NO: 108560 - DNA, 23 bp, Homo sapiens
cagagtgtcactcactgtcgccc

SEQ ID NO: 108561 - DNA, 22 bp, Homo sapiens
attctgtcacccagactggagt

SEQ ID NO: 108562 - DNA, 23 bp, Homo sapiens
tgagacagagtctcactctgtca

SEQ ID NO: 108563 - DNA, 21 bp, Homo sapiens
tgaggttgcaggatcacttga

SEQ ID NO: 108564 - DNA, 23 bp, Homo sapiens
gacagagtctcgctctgtcaccc

SEQ ID NO: 108565 - DNA, 23 bp, Homo sapiens
tcagggtctcactctgtcgccca

SEQ ID NO: 108566 - DNA, 23 bp, Homo sapiens
ttggagactgagttttgctctgt

SEQ ID NO: 108567 - DNA, 20 bp, Homo sapiens
taagatgtacttcttgccaa

SEQ ID NO: 108568 - DNA, 23 bp, Homo sapiens
gacttgatgcagcatagttgtgg

SEQ ID NO: 108569 - DNA, 23 bp, Homo sapiens
tgagttcattgtagattctggat

SEQ ID NO: 108570 - DNA, 23 bp, Homo sapiens
tgagttcattgtagattctggat

SEQ ID NO: 108571 - DNA, 23 bp, Homo sapiens
atcatgtggtttttaattgtttt

SEQ ID NO: 108572 - DNA, 19 bp, Homo sapiens
agtggtttaaatttgcatt

SEQ ID NO: 108573 - DNA, 21 bp, Homo sapiens
tcttgctttgtgaagtgtctg

SEQ ID NO: 108574 - DNA, 23 bp, Homo sapiens
acagagtctcactctgtcgccca

SEQ ID NO: 108575 - DNA, 21 bp, Homo sapiens
taaatatcaggttctagctgc

SEQ ID NO: 108576 - DNA, 23 bp, Homo sapiens
atattactctgctggcaatgtct

SEQ ID NO: 108577 - DNA, 22 bp, Homo sapiens
tttgagacagggtctcactctg

SEQ ID NO: 108578 - DNA, 23 bp, Homo sapiens
ctgccagtctctgtgtcagtggc

SEQ ID NO: 108579 - DNA, 22 bp, Homo sapiens
aagaaagaaaaagaagcttgct

SEQ ID NO: 108580 - DNA, 20 bp, Homo sapiens
ttttctttttttgtttttgt

SEQ ID NO: 108581 - DNA, 18 bp, Homo sapiens
ctagagtgcagtggcacg

SEQ ID NO: 108582 - DNA, 23 bp, Homo sapiens
cagggtctcactctgtcacccag

SEQ ID NO: 108583 - DNA, 20 bp, Homo sapiens
tgatagacgggtgacatttt

SEQ ID NO: 108584 - DNA, 19 bp, Homo sapiens
taatgcaaatgctatgtaa

SEQ ID NO: 108585 - DNA, 22 bp, Homo sapiens
ctgtctctggcactaaggtctg

SEQ ID NO: 108586 - DNA, 22 bp, Homo sapiens
aatcatctggttttttttcttt

SEQ ID NO: 108587 - DNA, 20 bp, Homo sapiens
ttacagacatgagccactcc

SEQ ID NO: 108588 - DNA, 20 bp, Homo sapiens
acggagtctcactctgtcgc

SEQ ID NO: 108589 - DNA, 23 bp, Homo sapiens
acacacacagtctactgtctggg

SEQ ID NO: 108590 - DNA, 21 bp, Homo sapiens
tcatagggtctcgctctgtca

SEQ ID NO: 108591 - DNA, 20 bp, Homo sapiens
tgagacagagtctcactctg

SEQ ID NO: 108592 - DNA, 23 bp, Homo sapiens
tgcctctggctctctcagtcgct

SEQ ID NO: 108593 - DNA, 23 bp, Homo sapiens
cagttgtcagtactgtgtctgga

SEQ ID NO: 108594 - DNA, 23 bp, Homo sapiens
tgtatatatacatgtacatatag

SEQ ID NO: 108595 - DNA, 23 bp, Homo sapiens
agtgaggacacagtgacctcatc

SEQ ID NO: 108596 - DNA, 19 bp, Homo sapiens
agcactgttgtcagcacca

SEQ ID NO: 108597 - DNA, 19 bp, Homo sapiens
tgggtgggtctggccagtc

SEQ ID NO: 108598 - DNA, 20 bp, Homo sapiens
gtgtatatatgtatatatgt

SEQ ID NO: 108599 - DNA, 19 bp, Homo sapiens
tgtgtatacatatacacgt

SEQ ID NO: 108600 - DNA, 19 bp, Homo sapiens
ctcacagatgagtgtgagg

SEQ ID NO: 108601 - DNA, 23 bp, Homo sapiens
gtcatgtcagaggtttgcaaggt

SEQ ID NO: 108602 - DNA, 22 bp, Homo sapiens
ttttgaagtggagtctcactct

SEQ ID NO: 108603 - DNA, 22 bp, Homo sapiens
tatgtggattcaatttctttaa

SEQ ID NO: 108604 - DNA, 22 bp, Homo sapiens
aagcatatctaagtgtatgtat

SEQ ID NO: 108605 - DNA, 22 bp, Homo sapiens
taagtgaaaggattattagagt

SEQ ID NO: 108606 - DNA, 23 bp, Homo sapiens
tgagttcattgtagattctggat

SEQ ID NO: 108607 - DNA, 23 bp, Homo sapiens
tgagttcattgtagattctggat

SEQ ID NO: 108608 - DNA, 19 bp, Homo sapiens
tggcgtgatcttggcttac

SEQ ID NO: 108609 - DNA, 23 bp, Homo sapiens
tagattcaaggtcttgctgtatt

SEQ ID NO: 108610 - DNA, 20 bp, Homo sapiens
acagagctagacaaaatttt

SEQ ID NO: 108611 - DNA, 23 bp, Homo sapiens
agatggagtctcgctctgtcacc

SEQ ID NO: 108612 - DNA, 22 bp, Homo sapiens
cagcagagacaatttcacttca

SEQ ID NO: 108613 - DNA, 23 bp, Homo sapiens
taatgtgtctagtctctatctct

SEQ ID NO: 108614 - DNA, 23 bp, Homo sapiens
tcagcatcactcactctctgttt

SEQ ID NO: 108615 - DNA, 19 bp, Homo sapiens
tttgtgggaattatttgag

SEQ ID NO: 108616 - DNA, 18 bp, Homo sapiens
ctctttattgtttgtcct

SEQ ID NO: 108617 - DNA, 23 bp, Homo sapiens
tttcaagaggaacacatttcaat

SEQ ID NO: 108618 - DNA, 23 bp, Homo sapiens
tgagttcattgtagattctggat

SEQ ID NO: 108619 - DNA, 23 bp, Homo sapiens
tgagttcattgtagattctggat

SEQ ID NO: 108620 - DNA, 23 bp, Homo sapiens
tctcaggcaccctgtgtgtcact

SEQ ID NO: 108621 - DNA, 20 bp, Homo sapiens
tcttgccagtgtgtttggga

SEQ ID NO: 108622 - DNA, 23 bp, Homo sapiens
caaggagcaaatgaaatgattct

SEQ ID NO: 108623 - DNA, 22 bp, Homo sapiens
aaaagggaaccatttggtgtgt

SEQ ID NO: 108624 - DNA, 23 bp, Homo sapiens
tcaccatctctgagtcatttggg

SEQ ID NO: 108625 - DNA, 23 bp, Homo sapiens
gaacagagtcagaagagtcagag

SEQ ID NO: 108626 - DNA, 22 bp, Homo sapiens
acagtgatgggtcttggtgtgg

SEQ ID NO: 108627 - DNA, 23 bp, Homo sapiens
atctcgactcactgcaacctctg

SEQ ID NO: 108628 - DNA, 23 bp, Homo sapiens
tgtgagaactcattgtgctgagt

SEQ ID NO: 108629 - DNA, 22 bp, Homo sapiens
cgactgggtagaacctggctgt

SEQ ID NO: 108630 - DNA, 23 bp, Homo sapiens
tctccctcagtcactctgcctta

SEQ ID NO: 108631 - DNA, 19 bp, Homo sapiens
aaatgagtaggtaatggga

SEQ ID NO: 108632 - DNA, 20 bp, Homo sapiens
tatgattcatcctgtgccag

SEQ ID NO: 108633 - DNA, 23 bp, Homo sapiens
gggtctcactctgtcactcaggt

SEQ ID NO: 108634 - DNA, 22 bp, Homo sapiens
atgcagtggggagatcttggct

SEQ ID NO: 108635 - DNA, 23 bp, Homo sapiens
ccttgactctgtggaaaggtggg

SEQ ID NO: 108636 - DNA, 23 bp, Homo sapiens
atacaaaggggttacagattctg

SEQ ID NO: 108637 - DNA, 23 bp, Homo sapiens
tggagtctcactctgtcacacag

SEQ ID NO: 108638 - DNA, 21 bp, Homo sapiens
tctgtcacccaggcttgagtg

SEQ ID NO: 108639 - DNA, 23 bp, Homo sapiens
tcacagcctccctgtctcagcag

SEQ ID NO: 108640 - DNA, 23 bp, Homo sapiens
tgcagctgtgtttctgcactggg

SEQ ID NO: 108641 - DNA, 23 bp, Homo sapiens
tccagtgtggggtttccttttct

SEQ ID NO: 108642 - DNA, 23 bp, Homo sapiens
agacagtctcactctgtcggcca

SEQ ID NO: 108643 - DNA, 21 bp, Homo sapiens
tggagtctcgctctgtcaccc

SEQ ID NO: 108644 - DNA, 23 bp, Homo sapiens
tgtgtgtatatacatatgtgtgt

SEQ ID NO: 108645 - DNA, 23 bp, Homo sapiens
attcctgtcccagtctgtgtcac

SEQ ID NO: 108646 - DNA, 21 bp, Homo sapiens
atggttcttgcttttggcatc

SEQ ID NO: 108647 - DNA, 23 bp, Homo sapiens
tttgagatggagatttgcttgtt

SEQ ID NO: 108648 - DNA, 23 bp, Homo sapiens
gacaaagtctcgctctgtcaccc

SEQ ID NO: 108649 - DNA, 23 bp, Homo sapiens
cacactctgaactaagctcaagg

SEQ ID NO: 108650 - DNA, 19 bp, Homo sapiens
gacacagttttactctgtc

SEQ ID NO: 108651 - DNA, 22 bp, Homo sapiens
ctctctgtgtctctggatttct

SEQ ID NO: 108652 - DNA, 19 bp, Homo sapiens
aagtgctgggtttggtgca

SEQ ID NO: 108653 - DNA, 23 bp, Homo sapiens
gggtctcactctgtcacccaggc

SEQ ID NO: 108654 - DNA, 20 bp, Homo sapiens
agcagcagataaattattga

SEQ ID NO: 108655 - DNA, 23 bp, Homo sapiens
gggtctcactctgtcacccaggc

SEQ ID NO: 108656 - DNA, 23 bp, Homo sapiens
caccagtaatctcagcactttgg

SEQ ID NO: 108657 - DNA, 23 bp, Homo sapiens
gccaaggtggaagaatcacttga

SEQ ID NO: 108658 - DNA, 22 bp, Homo sapiens
agaatagtatatgaacacttga

SEQ ID NO: 108659 - DNA, 23 bp, Homo sapiens
aggactgtgtgtgtgtgtgtgtg

SEQ ID NO: 108660 - DNA, 23 bp, Homo sapiens
tagacagtgcattttgactctgt

SEQ ID NO: 108661 - DNA, 20 bp, Homo sapiens
ccagtgactttcactctctg

SEQ ID NO: 108662 - DNA, 23 bp, Homo sapiens
aaatgtggtgatggttgtgcaac

SEQ ID NO: 108663 - DNA, 23 bp, Homo sapiens
tctctctgtgtttgtcattgagc

SEQ ID NO: 108664 - DNA, 23 bp, Homo sapiens
ggcctgtgactcagtgcctgtgt

SEQ ID NO: 108665 - DNA, 18 bp, Homo sapiens
actgtctctgagtccctg

SEQ ID NO: 108666 - DNA, 23 bp, Homo sapiens
gcaagtgacttagctgtgcctca

SEQ ID NO: 108667 - DNA, 22 bp, Homo sapiens
catatgtgtgtcagtgatgggt

SEQ ID NO: 108668 - DNA, 23 bp, Homo sapiens
agactgagtctcgctctgtcacc

SEQ ID NO: 108669 - DNA, 23 bp, Homo sapiens
actctgcttctgtctgactcaca

SEQ ID NO: 108670 - DNA, 18 bp, Homo sapiens
aacacctgagagaggaca

SEQ ID NO: 108671 - DNA, 21 bp, Homo sapiens
ctcactctgtcactcaggctg

SEQ ID NO: 108672 - DNA, 19 bp, Homo sapiens
aatgcagtcagtggcaggt

SEQ ID NO: 108673 - DNA, 23 bp, Homo sapiens
agagtctcactctgtcacccagg

SEQ ID NO: 108674 - DNA, 23 bp, Homo sapiens
gagtctcactctgtcacccaggc

SEQ ID NO: 108675 - DNA, 23 bp, Homo sapiens
ctggctctcctctctgtctctgt

SEQ ID NO: 108676 - DNA, 22 bp, Homo sapiens
tgaaactccatctcaaaagaaa

SEQ ID NO: 108677 - DNA, 23 bp, Homo sapiens
agacagagtcttgctctgtcacc

SEQ ID NO: 108678 - DNA, 23 bp, Homo sapiens
aatcagcattctatttttgtttt

SEQ ID NO: 108679 - DNA, 19 bp, Homo sapiens
tcacccaggctggaatgca

SEQ ID NO: 108680 - DNA, 23 bp, Homo sapiens
tgagacagagtctggctgtgttg

SEQ ID NO: 108681 - DNA, 23 bp, Homo sapiens
gagacggagtctcgctctgtcac

SEQ ID NO: 108682 - DNA, 19 bp, Homo sapiens
cagctgctacagtcaggct

SEQ ID NO: 108683 - DNA, 23 bp, Homo sapiens
ccagattctgagctcctctttgg

SEQ ID NO: 108684 - DNA, 23 bp, Homo sapiens
tctgcacagtagatagagagctc

SEQ ID NO: 108685 - DNA, 22 bp, Homo sapiens
tacatcagagtggttaggagct

SEQ ID NO: 108686 - DNA, 23 bp, Homo sapiens
gacagggtctcactctgccaccc

SEQ ID NO: 108687 - DNA, 23 bp, Homo sapiens
tggctcgctctctctcttaaggc

SEQ ID NO: 108688 - DNA, 19 bp, Homo sapiens
tatgtatatatgtgtgtac

SEQ ID NO: 108689 - DNA, 21 bp, Homo sapiens
attctcagcaatcccagcact

SEQ ID NO: 108690 - DNA, 23 bp, Homo sapiens
tgggcgacagagcgagactctgt

SEQ ID NO: 108691 - DNA, 23 bp, Homo sapiens
atgggtcagggagtcttgtctgc

SEQ ID NO: 108692 - DNA, 18 bp, Homo sapiens
gagtacagagatatttga

SEQ ID NO: 108693 - DNA, 23 bp, Homo sapiens
ttgtgctcgtagtccagcacttt

SEQ ID NO: 108694 - DNA, 18 bp, Homo sapiens
gagtgcttgggaatctga

SEQ ID NO: 108695 - DNA, 21 bp, Homo sapiens
tttggcagagattgttgactg

SEQ ID NO: 108696 - DNA, 18 bp, Homo sapiens
tgatagttatagaaattg

SEQ ID NO: 108697 - DNA, 23 bp, Homo sapiens
gacagagtctcgctctgtcaccc

SEQ ID NO: 108698 - DNA, 23 bp, Homo sapiens
tggagtctcactctgtcacccag

SEQ ID NO: 108699 - DNA, 22 bp, Homo sapiens
ttttttagtagagatggggttt

SEQ ID NO: 108700 - DNA, 23 bp, Homo sapiens
gcatgctgactgaatactgatga

SEQ ID NO: 108701 - DNA, 23 bp, Homo sapiens
agactccatctcaaaacaaaaca

SEQ ID NO: 108702 - DNA, 23 bp, Homo sapiens
ttgagacaagatctcgctctgtc

SEQ ID NO: 108703 - DNA, 18 bp, Homo sapiens
tatgtatatgtatacata

SEQ ID NO: 108704 - DNA, 23 bp, Homo sapiens
atacgtatgtaagtatatatgta

SEQ ID NO: 108705 - DNA, 23 bp, Homo sapiens
cagagtctgatgacagagtccac

SEQ ID NO: 108706 - DNA, 22 bp, Homo sapiens
tcaagagagtttgtgacttgcc

SEQ ID NO: 108707 - DNA, 21 bp, Homo sapiens
gtgcttctggtcatcccatca

SEQ ID NO: 108708 - DNA, 23 bp, Homo sapiens
ggctctctgactgactgcttccc

SEQ ID NO: 108709 - DNA, 23 bp, Homo sapiens
ccacacactgtctctcaatctgt

SEQ ID NO: 108710 - DNA, 22 bp, Homo sapiens
agtaggtctagtgtgggcctga

SEQ ID NO: 108711 - DNA, 22 bp, Homo sapiens
ttcctgatttgtctcccactct

SEQ ID NO: 108712 - DNA, 22 bp, Homo sapiens
aaatgtgtgaaattgatgcaaa

SEQ ID NO: 108713 - DNA, 20 bp, Homo sapiens
gatttgggtttctctctctt

SEQ ID NO: 108714 - DNA, 22 bp, Homo sapiens
actccagctgggttaaggcaga

SEQ ID NO: 108715 - DNA, 23 bp, Homo sapiens
ctcagcagctaactctgtctctt

SEQ ID NO: 108716 - DNA, 23 bp, Homo sapiens
tatggtagatttgtattcatgaa

SEQ ID NO: 108717 - DNA, 22 bp, Homo sapiens
agaggtagaaggatgtaaggat

SEQ ID NO: 108718 - DNA, 23 bp, Homo sapiens
tgagttcattgtagattctggat

SEQ ID NO: 108719 - DNA, 23 bp, Homo sapiens
tgagttcattgtagattctggat

SEQ ID NO: 108720 - DNA, 21 bp, Homo sapiens
ctgtggctctgacagcccatg

SEQ ID NO: 108721 - DNA, 18 bp, Homo sapiens
tctgtccctttctctctg

SEQ ID NO: 108722 - DNA, 23 bp, Homo sapiens
tcagaaggaggacagtgggtcat

SEQ ID NO: 108723 - DNA, 23 bp, Homo sapiens
tgcgtctgtcactgtgactaagt

SEQ ID NO: 108724 - DNA, 22 bp, Homo sapiens
tgagatgtggattacgtttgtt

SEQ ID NO: 108725 - DNA, 23 bp, Homo sapiens
tatcagtgagaggttgagttgag

SEQ ID NO: 108726 - DNA, 22 bp, Homo sapiens
ctgaggtaggaggttcacttga

SEQ ID NO: 108727 - DNA, 19 bp, Homo sapiens
gccctgaggtattgtgtgt

SEQ ID NO: 108728 - DNA, 22 bp, Homo sapiens
atgtgtatatatatatatgtgt

SEQ ID NO: 108729 - DNA, 23 bp, Homo sapiens
atacatgtgtgtgtgcatatata

SEQ ID NO: 108730 - DNA, 23 bp, Homo sapiens
acatatatgtatgtgtgtgtgtg

SEQ ID NO: 108731 - DNA, 22 bp, Homo sapiens
tagacaagttacttcatacgta

SEQ ID NO: 108732 - DNA, 23 bp, Homo sapiens
ctggttactgtggttaccatgtg

SEQ ID NO: 108733 - DNA, 22 bp, Homo sapiens
tgactgcaagttctgtagaagt

SEQ ID NO: 108734 - DNA, 22 bp, Homo sapiens
tctgtcacccagtctagagtgc

SEQ ID NO: 108735 - DNA, 23 bp, Homo sapiens
ttagagaattgttagagtgattg

SEQ ID NO: 108736 - DNA, 23 bp, Homo sapiens
taagtgacagtcactgttttatt

SEQ ID NO: 108737 - DNA, 23 bp, Homo sapiens
acagggcttcactctgtctccca

SEQ ID NO: 108738 - DNA, 21 bp, Homo sapiens
tctgagactgagtctccctct

SEQ ID NO: 108739 - DNA, 21 bp, Homo sapiens
tctgtgtgcctaagacgctgg

SEQ ID NO: 108740 - DNA, 18 bp, Homo sapiens
ccttgctgtatgcaatct

SEQ ID NO: 108741 - DNA, 20 bp, Homo sapiens
tatacacatgtagttttaca

SEQ ID NO: 108742 - DNA, 23 bp, Homo sapiens
agtctcgctctgtcacccaggct

SEQ ID NO: 108743 - DNA, 23 bp, Homo sapiens
tgtctgacagctgacagtgtgga

SEQ ID NO: 108744 - DNA, 18 bp, Homo sapiens
acagaggctggaagacag

SEQ ID NO: 108745 - DNA, 19 bp, Homo sapiens
tatgccagtatgacttttt

SEQ ID NO: 108746 - DNA, 23 bp, Homo sapiens
gacagagtctcgctctgtcaccc

SEQ ID NO: 108747 - DNA, 23 bp, Homo sapiens
cggtctcactctgtcacccaggc

SEQ ID NO: 108748 - DNA, 23 bp, Homo sapiens
tagcagtggaaattttttgtctg

SEQ ID NO: 108749 - DNA, 23 bp, Homo sapiens
gccactgtctcactatatgatct

SEQ ID NO: 108750 - DNA, 23 bp, Homo sapiens
tttgagacagggtctcactctgt

SEQ ID NO: 108751 - DNA, 23 bp, Homo sapiens
gactgagtctcactctgtcgccc

SEQ ID NO: 108752 - DNA, 23 bp, Homo sapiens
tgagacagtctcactctgttact

SEQ ID NO: 108753 - DNA, 19 bp, Homo sapiens
acagagtttctctcatcta

SEQ ID NO: 108754 - DNA, 22 bp, Homo sapiens
tcaggactgacgcactctctgc

SEQ ID NO: 108755 - DNA, 18 bp, Homo sapiens
atccttttaaatatatgt

SEQ ID NO: 108756 - DNA, 18 bp, Homo sapiens
tgacagttttcttgtttt

SEQ ID NO: 108757 - DNA, 23 bp, Homo sapiens
tctaacagcaactgcaactgtca

SEQ ID NO: 108758 - DNA, 21 bp, Homo sapiens
tcagtccctcactctgtctac

SEQ ID NO: 108759 - DNA, 23 bp, Homo sapiens
tttgtccctgactctctgggtga

SEQ ID NO: 108760 - DNA, 20 bp, Homo sapiens
ggttctaggtggcatagaca

SEQ ID NO: 108761 - DNA, 23 bp, Homo sapiens
cagagtctcactctgtcactcag

SEQ ID NO: 108762 - DNA, 23 bp, Homo sapiens
cggagtctcactctgtcacccag

SEQ ID NO: 108763 - DNA, 23 bp, Homo sapiens
gagtctcactctgtcacccaggc

SEQ ID NO: 108764 - DNA, 23 bp, Homo sapiens
ctctgccactcactggctctgag

SEQ ID NO: 108765 - DNA, 23 bp, Homo sapiens
tcagcctgtcactgcctgtctgc

SEQ ID NO: 108766 - DNA, 23 bp, Homo sapiens
agagcattgttctgagccagtct

SEQ ID NO: 108767 - DNA, 20 bp, Homo sapiens
aacacacaccattgcaagcc

SEQ ID NO: 108768 - DNA, 23 bp, Homo sapiens
agggtctcagctgttccagtctc

SEQ ID NO: 108769 - DNA, 23 bp, Homo sapiens
tctctctgtccctccctgactcc

SEQ ID NO: 108770 - DNA, 23 bp, Homo sapiens
ttccacgcagagtgagtgcccgt

SEQ ID NO: 108771 - DNA, 21 bp, Homo sapiens
tatgaggtagtttttcttttt

SEQ ID NO: 108772 - DNA, 23 bp, Homo sapiens
tgagttcattgtagattctggat

SEQ ID NO: 108773 - DNA, 23 bp, Homo sapiens
tgagttcattgtagattctggat

SEQ ID NO: 108774 - DNA, 21 bp, Homo sapiens
tctgcccctctgtctttgcta

SEQ ID NO: 108775 - DNA, 23 bp, Homo sapiens
tgagttcattgtagattctggat

SEQ ID NO: 108776 - DNA, 23 bp, Homo sapiens
tgagttcattgtagattctggat

SEQ ID NO: 108777 - DNA, 23 bp, Homo sapiens
taggtcttgtcctcttgtgtccc

SEQ ID NO: 108778 - DNA, 23 bp, Homo sapiens
tgagttcattgtagattctggat

SEQ ID NO: 108779 - DNA, 23 bp, Homo sapiens
tgagttcattgtagattctggat

SEQ ID NO: 108780 - DNA, 23 bp, Homo sapiens
gaggctctgtcaccttctccagc

SEQ ID NO: 108781 - DNA, 22 bp, Homo sapiens
tcactccctgggtgggtgcctc

SEQ ID NO: 108782 - DNA, 23 bp, Homo sapiens
atctcctctgtcactgtctgtgc

SEQ ID NO: 108783 - DNA, 23 bp, Homo sapiens
gtcatgtgactgcctctctgggg

SEQ ID NO: 108784 - DNA, 23 bp, Homo sapiens
tctgcaagtgaggagagtgaggt

SEQ ID NO: 108785 - DNA, 21 bp, Homo sapiens
tcgttgctgctgtggctgtgt

SEQ ID NO: 108786 - DNA, 23 bp, Homo sapiens
aaactctctctgtgtattctgtt

SEQ ID NO: 108787 - DNA, 23 bp, Homo sapiens
tctggcactcagtctctctgctc

SEQ ID NO: 108788 - DNA, 23 bp, Homo sapiens
agtagttatgacagttggaaatt

SEQ ID NO: 108789 - DNA, 23 bp, Homo sapiens
catctgtctgtctgtcatactag

SEQ ID NO: 108790 - DNA, 23 bp, Homo sapiens
ctacagtctcactctctgaatgc

SEQ ID NO: 108791 - DNA, 21 bp, Homo sapiens
agcctggagaacggaatccct

SEQ ID NO: 108792 - DNA, 23 bp, Homo sapiens
tataatgaagtaacagagcaggt

SEQ ID NO: 108793 - DNA, 23 bp, Homo sapiens
cacctacttggttgtttcgtgtt

SEQ ID NO: 108794 - DNA, 23 bp, Homo sapiens
tagttgagtgaaaactgaatgca

SEQ ID NO: 108795 - DNA, 22 bp, Homo sapiens
tcagagtctgaaaacccttcct

SEQ ID NO: 108796 - DNA, 23 bp, Homo sapiens
ttgtcactgtgtctgtggatggc

SEQ ID NO: 108797 - DNA, 23 bp, Homo sapiens
ttgtgtcccggagtctgtgctct

SEQ ID NO: 108798 - DNA, 19 bp, Homo sapiens
tgtgtgtgtgtgtgtacat

SEQ ID NO: 108799 - DNA, 23 bp, Homo sapiens
agacagggactggctctgttggt

SEQ ID NO: 108800 - DNA, 23 bp, Homo sapiens
tcctctgagactaaagagaggcc

SEQ ID NO: 108801 - DNA, 23 bp, Homo sapiens
tcagagaacagagtcagaacttc

SEQ ID NO: 108802 - DNA, 19 bp, Homo sapiens
ttttgagaccgagtctcac

SEQ ID NO: 108803 - DNA, 23 bp, Homo sapiens
agagtctcactctgtcacccagg

SEQ ID NO: 108804 - DNA, 23 bp, Homo sapiens
gagtctcactctgtcacccaggc

SEQ ID NO: 108805 - DNA, 23 bp, Homo sapiens
atctgtcactgtctctcatcacc

SEQ ID NO: 108806 - DNA, 23 bp, Homo sapiens
tagttgcaggaaaacaagctcag

SEQ ID NO: 108807 - DNA, 21 bp, Homo sapiens
cagagtgagattcgtctctca

SEQ ID NO: 108808 - DNA, 21 bp, Homo sapiens
ttttgctctttcaccaggctg

SEQ ID NO: 108809 - DNA, 23 bp, Homo sapiens
tggagtctcactctgtcacccag

SEQ ID NO: 108810 - DNA, 19 bp, Homo sapiens
acaaaagagagttaagtga

SEQ ID NO: 108811 - DNA, 19 bp, Homo sapiens
ttatgagacggagtgttgc

SEQ ID NO: 108812 - DNA, 20 bp, Homo sapiens
atatagatagatatatatag

SEQ ID NO: 108813 - DNA, 23 bp, Homo sapiens
tgaggtggagtctcgctctgtcg

SEQ ID NO: 108814 - DNA, 23 bp, Homo sapiens
agagtaagactctgtctcaattt

SEQ ID NO: 108815 - DNA, 21 bp, Homo sapiens
tgagacaaggtctcactctgt

SEQ ID NO: 108816 - DNA, 22 bp, Homo sapiens
gcaagatcactgtgtgaattat

SEQ ID NO: 108817 - DNA, 22 bp, Homo sapiens
gagacagagtctcgctgtgtca

SEQ ID NO: 108818 - DNA, 19 bp, Homo sapiens
agcgtgtgcctgtaatccc

SEQ ID NO: 108819 - DNA, 23 bp, Homo sapiens
tgagatggagtctcactctgtcg

SEQ ID NO: 108820 - DNA, 18 bp, Homo sapiens
tggaaggatcacttgagc

SEQ ID NO: 108821 - DNA, 23 bp, Homo sapiens
aatgaggttgcagtgagccttga

SEQ ID NO: 108822 - DNA, 21 bp, Homo sapiens
tactgcacgctctgcctcctg

SEQ ID NO: 108823 - DNA, 19 bp, Homo sapiens
tgacagagcgagacttttt

SEQ ID NO: 108824 - DNA, 23 bp, Homo sapiens
gagacagagtctcgctctgtcac

SEQ ID NO: 108825 - DNA, 21 bp, Homo sapiens
tgagatggagtctcgctctgt

SEQ ID NO: 108826 - DNA, 22 bp, Homo sapiens
agaagcactgtgagaattggtt

SEQ ID NO: 108827 - DNA, 18 bp, Homo sapiens
tctcgctctgtcacccag

SEQ ID NO: 108828 - DNA, 23 bp, Homo sapiens
gagggagtctcgctctgtcaccc

SEQ ID NO: 108829 - DNA, 23 bp, Homo sapiens
agactgagtctcgctctgtcatc

SEQ ID NO: 108830 - DNA, 23 bp, Homo sapiens
gttttggaactagatagaggtaa

SEQ ID NO: 108831 - DNA, 22 bp, Homo sapiens
cagggtctcactctgtcaccca

SEQ ID NO: 108832 - DNA, 20 bp, Homo sapiens
tgcaatggtgtgatctcagc

SEQ ID NO: 108833 - DNA, 23 bp, Homo sapiens
tatgaagtgtgggcatcaagctg

SEQ ID NO: 108834 - DNA, 23 bp, Homo sapiens
tgagatggagtttcactcttgtt

SEQ ID NO: 108835 - DNA, 23 bp, Homo sapiens
taggcagaggcagattctgccag

SEQ ID NO: 108836 - DNA, 22 bp, Homo sapiens
tggagtctcgctctgtctcccg

SEQ ID NO: 108837 - DNA, 19 bp, Homo sapiens
gacagaattaagtgagctc

SEQ ID NO: 108838 - DNA, 23 bp, Homo sapiens
tcccagcctgcctctgtgcctgg

SEQ ID NO: 108839 - DNA, 23 bp, Homo sapiens
ctgtctgtctgtctgtccgtctg

SEQ ID NO: 108840 - DNA, 23 bp, Homo sapiens
aaaatgtctggatgttcatacta

SEQ ID NO: 108841 - DNA, 20 bp, Homo sapiens
tgagatggagtcccactcta

SEQ ID NO: 108842 - DNA, 19 bp, Homo sapiens
agtcctgagattacaggtg

SEQ ID NO: 108843 - DNA, 23 bp, Homo sapiens
gtgtatatacatatgtgtgtgtg

SEQ ID NO: 108844 - DNA, 23 bp, Homo sapiens
tgagatggagtctcactgtgtca

SEQ ID NO: 108845 - DNA, 23 bp, Homo sapiens
agactgaagggctttgtttttgt

SEQ ID NO: 108846 - DNA, 23 bp, Homo sapiens
tgagacagagtctcactctgtca

SEQ ID NO: 108847 - DNA, 23 bp, Homo sapiens
agacagagtctcgctctgtcacc

SEQ ID NO: 108848 - DNA, 22 bp, Homo sapiens
cagagaacatcctctccagctg

SEQ ID NO: 108849 - DNA, 18 bp, Homo sapiens
atcacaggcatgagccac

SEQ ID NO: 108850 - DNA, 22 bp, Homo sapiens
ttgtctcagggtcacttaggct

SEQ ID NO: 108851 - DNA, 22 bp, Homo sapiens
ggattacaggcatgaaccactg

SEQ ID NO: 108852 - DNA, 23 bp, Homo sapiens
ttagttgagtgtggtggcatgtg

SEQ ID NO: 108853 - DNA, 23 bp, Homo sapiens
tggctctctgggtgactttgggc

SEQ ID NO: 108854 - DNA, 23 bp, Homo sapiens
ctcacctctctaaggctctctct

SEQ ID NO: 108855 - DNA, 19 bp, Homo sapiens
cctgcctctctcagtgtct

SEQ ID NO: 108856 - DNA, 23 bp, Homo sapiens
gcatctctctgtctctgaggcct

SEQ ID NO: 108857 - DNA, 19 bp, Homo sapiens
aggagctcacacagggctt

SEQ ID NO: 108858 - DNA, 23 bp, Homo sapiens
tgagagggagtctcactctgtcg

SEQ ID NO: 108859 - DNA, 20 bp, Homo sapiens
actgatagagcccgcagttt

SEQ ID NO: 108860 - DNA, 21 bp, Homo sapiens
ctctcaccctctgtgaccttg

SEQ ID NO: 108861 - DNA, 21 bp, Homo sapiens
tgtctcagtcctttatttctg

SEQ ID NO: 108862 - DNA, 19 bp, Homo sapiens
aactcactacagcttcaga

SEQ ID NO: 108863 - DNA, 20 bp, Homo sapiens
tgaggacatttatgcataag

SEQ ID NO: 108864 - DNA, 23 bp, Homo sapiens
tcgctgtctctctgcctctgtct

SEQ ID NO: 108865 - DNA, 20 bp, Homo sapiens
ttgagatggagtctcactct

SEQ ID NO: 108866 - DNA, 23 bp, Homo sapiens
tggagtctcactctgtcacccag

SEQ ID NO: 108867 - DNA, 23 bp, Homo sapiens
gggaaaactgaggctcagagagg

SEQ ID NO: 108868 - DNA, 23 bp, Homo sapiens
gtctcatgtgagtgagctcagag

SEQ ID NO: 108869 - DNA, 23 bp, Homo sapiens
cactctgtcacccagactggagt

SEQ ID NO: 108870 - DNA, 20 bp, Homo sapiens
tttgagacggagtctcgctc

SEQ ID NO: 108871 - DNA, 19 bp, Homo sapiens
tggctgtgtagcctcaggc

SEQ ID NO: 108872 - DNA, 19 bp, Homo sapiens
tctgtcacccagtctggag

SEQ ID NO: 108873 - DNA, 23 bp, Homo sapiens
gagacagagtctctctgtcaccc

SEQ ID NO: 108874 - DNA, 22 bp, Homo sapiens
aagatagtacttcaagggctgg

SEQ ID NO: 108875 - DNA, 21 bp, Homo sapiens
tctctgggtcagtgtgctgaa

SEQ ID NO: 108876 - DNA, 19 bp, Homo sapiens
aggagcattgagctagatg

SEQ ID NO: 108877 - DNA, 23 bp, Homo sapiens
gctcaggctcagtgagtgtgtct

SEQ ID NO: 108878 - DNA, 23 bp, Homo sapiens
agggtgcctcagaccctgggttc

SEQ ID NO: 108879 - DNA, 23 bp, Homo sapiens
ctcagacactctctctccctggc

SEQ ID NO: 108880 - DNA, 23 bp, Homo sapiens
tggagtctcactctgtcacccag

SEQ ID NO: 108881 - DNA, 23 bp, Homo sapiens
cagtctcactcggtcactcaggc

SEQ ID NO: 108882 - DNA, 23 bp, Homo sapiens
ctccaggttgttgatcctgagaa

SEQ ID NO: 108883 - DNA, 23 bp, Homo sapiens
tcactctcagacacaactccctg

SEQ ID NO: 108884 - DNA, 21 bp, Homo sapiens
tgaggtaggaggatcacttga

SEQ ID NO: 108885 - DNA, 18 bp, Homo sapiens
tctagtgtctgatataca

SEQ ID NO: 108886 - DNA, 23 bp, Homo sapiens
tgtactacctggtgtgtgaatgt

SEQ ID NO: 108887 - DNA, 22 bp, Homo sapiens
ttttgagatggagtcttgctct

SEQ ID NO: 108888 - DNA, 23 bp, Homo sapiens
tcgctctgtcgctccgtgggtcc

SEQ ID NO: 108889 - DNA, 23 bp, Homo sapiens
agagtctcactctgtcatccagg

SEQ ID NO: 108890 - DNA, 22 bp, Homo sapiens
atcactctccagggacagtgac

SEQ ID NO: 108891 - DNA, 18 bp, Homo sapiens
tgagcatggtctgatttt

SEQ ID NO: 108892 - DNA, 21 bp, Homo sapiens
caggtaaaaggttgttatgtt

SEQ ID NO: 108893 - DNA, 23 bp, Homo sapiens
tactgagactgatatgggatact

SEQ ID NO: 108894 - DNA, 23 bp, Homo sapiens
gactgagtctctctctgtcaccc

SEQ ID NO: 108895 - DNA, 23 bp, Homo sapiens
tgtgcacgtgtgtgtgtgtgtgt

SEQ ID NO: 108896 - DNA, 23 bp, Homo sapiens
tgcctctctctgagcctcagtct

SEQ ID NO: 108897 - DNA, 18 bp, Homo sapiens
ggaggcagtgtcaggcag

SEQ ID NO: 108898 - DNA, 23 bp, Homo sapiens
gtgtgtgtctctctttggctgtg

SEQ ID NO: 108899 - DNA, 23 bp, Homo sapiens
gagtggaaagatgactggatggg

SEQ ID NO: 108900 - DNA, 19 bp, Homo sapiens
cttcacattcaagtctgtc

SEQ ID NO: 108901 - DNA, 23 bp, Homo sapiens
tttctgtctgtgtcagttctcac

SEQ ID NO: 108902 - DNA, 18 bp, Homo sapiens
acccaaggctttggcact

SEQ ID NO: 108903 - DNA, 21 bp, Homo sapiens
accctagagagttaggtgaag

SEQ ID NO: 108904 - DNA, 23 bp, Homo sapiens
agagagtggttatatatacatat

SEQ ID NO: 108905 - DNA, 18 bp, Homo sapiens
tgccactgtctctgtggc

SEQ ID NO: 108906 - DNA, 23 bp, Homo sapiens
gagtcagtgtctcgctctgtcgc

SEQ ID NO: 108907 - DNA, 23 bp, Homo sapiens
ctgagacggtgtctcgctctgtc

SEQ ID NO: 108908 - DNA, 23 bp, Homo sapiens
acaaggtctcactctgtcaccca

SEQ ID NO: 108909 - DNA, 18 bp, Homo sapiens
cagtggtatgatcttagc

SEQ ID NO: 108910 - DNA, 23 bp, Homo sapiens
cctgtgcctctgagagactggcg

SEQ ID NO: 108911 - DNA, 23 bp, Homo sapiens
tctctgtctccctctcagctgtc

SEQ ID NO: 108912 - DNA, 23 bp, Homo sapiens
tccatctctcggactcacagcct

SEQ ID NO: 108913 - DNA, 18 bp, Homo sapiens
tatttccttgtatatata

SEQ ID NO: 108914 - DNA, 19 bp, Homo sapiens
cacacattctgtctctggc

SEQ ID NO: 108915 - DNA, 22 bp, Homo sapiens
tgccagagacactgagtcttgt

SEQ ID NO: 108916 - DNA, 23 bp, Homo sapiens
ttttgagacagaatctcgctctg

SEQ ID NO: 108917 - DNA, 22 bp, Homo sapiens
gagtctccctgtcacccaggct

SEQ ID NO: 108918 - DNA, 21 bp, Homo sapiens
tcactgcaacctctgcctctg

SEQ ID NO: 108919 - DNA, 20 bp, Homo sapiens
acatatgtgtgtgtgtgtat

SEQ ID NO: 108920 - DNA, 23 bp, Homo sapiens
tcactctgcctgtcaccctggct

SEQ ID NO: 108921 - DNA, 23 bp, Homo sapiens
tctgagcctcagtctctgcatct

SEQ ID NO: 108922 - DNA, 23 bp, Homo sapiens
cctctctgggtctcagaagggtt

SEQ ID NO: 108923 - DNA, 22 bp, Homo sapiens
caggtaagactccatctttttt

SEQ ID NO: 108924 - DNA, 23 bp, Homo sapiens
tgtgacagagtctcgctctgtca

SEQ ID NO: 108925 - DNA, 23 bp, Homo sapiens
agacaaggtctcgctctgtcacc

SEQ ID NO: 108926 - DNA, 23 bp, Homo sapiens
tgacagagtgagaccctgtctca

SEQ ID NO: 108927 - DNA, 20 bp, Homo sapiens
gagacagtcttgctctgtca

SEQ ID NO: 108928 - DNA, 23 bp, Homo sapiens
gacatgttggatttgaaatgagt

SEQ ID NO: 108929 - DNA, 23 bp, Homo sapiens
agatagagcaaaacttgagagtt

SEQ ID NO: 108930 - DNA, 18 bp, Homo sapiens
tgtgctattttatttatt

SEQ ID NO: 108931 - DNA, 23 bp, Homo sapiens
cggagtctcactctgtcacccag

SEQ ID NO: 108932 - DNA, 19 bp, Homo sapiens
tgagctaccactcacggcc

SEQ ID NO: 108933 - DNA, 21 bp, Homo sapiens
aaatcttcttgatcatatgtt

SEQ ID NO: 108934 - DNA, 23 bp, Homo sapiens
tggagcatgagttgtcacttctt

SEQ ID NO: 108935 - DNA, 23 bp, Homo sapiens
acagtcagggtctgtgtctgtct

SEQ ID NO: 108936 - DNA, 23 bp, Homo sapiens
tgctccactgaagttgtaatttg

SEQ ID NO: 108937 - DNA, 23 bp, Homo sapiens
ctgggtctgagtctgactctgcc

SEQ ID NO: 108938 - DNA, 22 bp, Homo sapiens
ttagagacagggtcttgttatt

SEQ ID NO: 108939 - DNA, 19 bp, Homo sapiens
gaagtctcgctctgtcacc

SEQ ID NO: 108940 - DNA, 23 bp, Homo sapiens
gggagtggaatccatatcagtgg

SEQ ID NO: 108941 - DNA, 23 bp, Homo sapiens
cggagtctcgctctgtctcccag

SEQ ID NO: 108942 - DNA, 21 bp, Homo sapiens
gggtgttcacagtggagatgg

SEQ ID NO: 108943 - DNA, 23 bp, Homo sapiens
cgtagagatgtggtttcaccatg

SEQ ID NO: 108944 - DNA, 23 bp, Homo sapiens
tgtccatggtgctgaggctgaga

SEQ ID NO: 108945 - DNA, 23 bp, Homo sapiens
tttcagacacgtgagagagagct

SEQ ID NO: 108946 - DNA, 22 bp, Homo sapiens
tagctgactacagatgtgtgag

SEQ ID NO: 108947 - DNA, 23 bp, Homo sapiens
ttcagtctctctgagtctcagtc

SEQ ID NO: 108948 - DNA, 23 bp, Homo sapiens
aggtagtctgggaggattccaga

SEQ ID NO: 108949 - DNA, 23 bp, Homo sapiens
ttttttaggtggagtttcgctct

SEQ ID NO: 108950 - DNA, 23 bp, Homo sapiens
tcccagcctctgttgtgtggtta

SEQ ID NO: 108951 - DNA, 23 bp, Homo sapiens
aaggagcaacagaagcaggtctc

SEQ ID NO: 108952 - DNA, 23 bp, Homo sapiens
ttgagacggagtctcactctgtc

SEQ ID NO: 108953 - DNA, 18 bp, Homo sapiens
tgctaagtatgaaaagtg

SEQ ID NO: 108954 - DNA, 23 bp, Homo sapiens
gagatggagtctcactctgtggc

SEQ ID NO: 108955 - DNA, 20 bp, Homo sapiens
ccttagatgttgcaatagtg

SEQ ID NO: 108956 - DNA, 18 bp, Homo sapiens
atgaggttttgtcatgtt

SEQ ID NO: 108957 - DNA, 22 bp, Homo sapiens
gggtctcactctgtcacccagg

SEQ ID NO: 108958 - DNA, 23 bp, Homo sapiens
agaggaaatagcttggtttgtgt

SEQ ID NO: 108959 - DNA, 22 bp, Homo sapiens
tgaactcagggttttctttttc

SEQ ID NO: 108960 - DNA, 23 bp, Homo sapiens
tgagatggaatctcactctgtca

SEQ ID NO: 108961 - DNA, 23 bp, Homo sapiens
gtctgagagtcgagtgtgtcctg

SEQ ID NO: 108962 - DNA, 23 bp, Homo sapiens
agatggagtctctctctgacgct

SEQ ID NO: 108963 - DNA, 21 bp, Homo sapiens
cagtggcatgatcttggctca

SEQ ID NO: 108964 - DNA, 23 bp, Homo sapiens
aggctgacacagtgacttctggc

SEQ ID NO: 108965 - DNA, 23 bp, Homo sapiens
ccacttagtgctgtgtgacctca

SEQ ID NO: 108966 - DNA, 23 bp, Homo sapiens
tctccatcactgtgtgtctctgt

SEQ ID NO: 108967 - DNA, 20 bp, Homo sapiens
tcttcctgacttacctgaag

SEQ ID NO: 108968 - DNA, 23 bp, Homo sapiens
ttatatgtgcatgggagtattgt

SEQ ID NO: 108969 - DNA, 22 bp, Homo sapiens
atctgtgtgtgcatgtgcaagt

SEQ ID NO: 108970 - DNA, 23 bp, Homo sapiens
aaagttgtttgtatttctaaagt

SEQ ID NO: 108971 - DNA, 23 bp, Homo sapiens
agagcagacactgagtacactcc

SEQ ID NO: 108972 - DNA, 19 bp, Homo sapiens
aggttggtcttgaactcct

SEQ ID NO: 108973 - DNA, 23 bp, Homo sapiens
gccagtcttgtctctgtgtgacc

SEQ ID NO: 108974 - DNA, 22 bp, Homo sapiens
agacagaagaggctgtgcacgt

SEQ ID NO: 108975 - DNA, 18 bp, Homo sapiens
tgagcaggttgagtcggg

SEQ ID NO: 108976 - DNA, 23 bp, Homo sapiens
tgtctctcagtctttgtgacact

SEQ ID NO: 108977 - DNA, 23 bp, Homo sapiens
gaatgaatgaatgaatgaatgag

SEQ ID NO: 108978 - DNA, 19 bp, Homo sapiens
tcagtcttatccactctgt

SEQ ID NO: 108979 - DNA, 23 bp, Homo sapiens
atgtaccagctgtgtgaccttgg

SEQ ID NO: 108980 - DNA, 23 bp, Homo sapiens
ctctctgagtctctgtgtaacag

SEQ ID NO: 108981 - DNA, 19 bp, Homo sapiens
tgtgactatttctctctcc

SEQ ID NO: 108982 - DNA, 20 bp, Homo sapiens
tctctgaggctgttttctca

SEQ ID NO: 108983 - DNA, 23 bp, Homo sapiens
gggtgttcttcagcatgtcctgc

SEQ ID NO: 108984 - DNA, 23 bp, Homo sapiens
gctctctctgtcacacagtggcg

SEQ ID NO: 108985 - DNA, 18 bp, Homo sapiens
agtcttagaaaatgactg

SEQ ID NO: 108986 - DNA, 23 bp, Homo sapiens
acagagtctcactctctcaccca

SEQ ID NO: 108987 - DNA, 22 bp, Homo sapiens
agacaacgtcgtgctctgtcac

SEQ ID NO: 108988 - DNA, 21 bp, Homo sapiens
gattcagtgggatgttgtgtg

SEQ ID NO: 108989 - DNA, 19 bp, Homo sapiens
tttcagacagagccttgct

SEQ ID NO: 108990 - DNA, 23 bp, Homo sapiens
ttgagacagagttttcgctcttg

SEQ ID NO: 108991 - DNA, 22 bp, Homo sapiens
tgtgtatatatatatatgtgtg

SEQ ID NO: 108992 - DNA, 21 bp, Homo sapiens
tctcagtgattgtatgctgtg

SEQ ID NO: 108993 - DNA, 23 bp, Homo sapiens
gtaaattttttagtagagatggg

SEQ ID NO: 108994 - DNA, 22 bp, Homo sapiens
tcagctgtttttgtttttgtga

SEQ ID NO: 108995 - DNA, 23 bp, Homo sapiens
gtcaagcactcagtctgtgggtc

SEQ ID NO: 108996 - DNA, 23 bp, Homo sapiens
ttgagacagagtcttgctctgtc

SEQ ID NO: 108997 - DNA, 22 bp, Homo sapiens
aacgacctggatgttttctgtg

SEQ ID NO: 108998 - DNA, 22 bp, Homo sapiens
agagtgagaccctgtctcaaaa

SEQ ID NO: 108999 - DNA, 20 bp, Homo sapiens
tgagacggagttccactctt

SEQ ID NO: 109000 - DNA, 23 bp, Homo sapiens
tatgtgtgtctctatgtatacac

SEQ ID NO: 109001 - DNA, 23 bp, Homo sapiens
ctttctctctgtgtctgacctgt

SEQ ID NO: 109002 - DNA, 21 bp, Homo sapiens
taatagctattgaagcttttt

SEQ ID NO: 109003 - DNA, 23 bp, Homo sapiens
agagtctcactctgtcacccagg

SEQ ID NO: 109004 - DNA, 23 bp, Homo sapiens
tgtctgctgatgcagcacaccgt

SEQ ID NO: 109005 - DNA, 23 bp, Homo sapiens
agggtctcgctgtgtcgctcgga

SEQ ID NO: 109006 - DNA, 20 bp, Homo sapiens
agtctcgctctgtcgctcag

SEQ ID NO: 109007 - DNA, 22 bp, Homo sapiens
ataccaccagatgtctaacagt

SEQ ID NO: 109008 - DNA, 23 bp, Homo sapiens
tctggaagaggttgaattttgaa

SEQ ID NO: 109009 - DNA, 18 bp, Homo sapiens
cgtctcactacaacctcc

SEQ ID NO: 109010 - DNA, 21 bp, Homo sapiens
tttgagatggaatctcgctct

SEQ ID NO: 109011 - DNA, 18 bp, Homo sapiens
tgtcactgtcacactgtc

SEQ ID NO: 109012 - DNA, 22 bp, Homo sapiens
tggagtctcactctgacaccca

SEQ ID NO: 109013 - DNA, 21 bp, Homo sapiens
tctccctgtgtccctctcaca

SEQ ID NO: 109014 - DNA, 21 bp, Homo sapiens
tgggtgtctctgggcctgtct

SEQ ID NO: 109015 - DNA, 20 bp, Homo sapiens
tttgagacagggtctcactc

SEQ ID NO: 109016 - DNA, 20 bp, Homo sapiens
tgtgggtccctctatccctc

SEQ ID NO: 109017 - DNA, 23 bp, Homo sapiens
tctgggattgcagggacactgac

SEQ ID NO: 109018 - DNA, 23 bp, Homo sapiens
agatggaggtctcactctgttgt

SEQ ID NO: 109019 - DNA, 23 bp, Homo sapiens
acagagtctctttctgtcaccca

SEQ ID NO: 109020 - DNA, 23 bp, Homo sapiens
ttgaggtggagtctctctctgtt

SEQ ID NO: 109021 - DNA, 19 bp, Homo sapiens
tgagatggagtctcactct

SEQ ID NO: 109022 - DNA, 23 bp, Homo sapiens
tggagtctcactctgtcacccag

SEQ ID NO: 109023 - DNA, 19 bp, Homo sapiens
tgagatggagtctcgctct

SEQ ID NO: 109024 - DNA, 23 bp, Homo sapiens
tgagacggagtctcgctctgtca

SEQ ID NO: 109025 - DNA, 23 bp, Homo sapiens
atttgtagttgttataccctagt

SEQ ID NO: 109026 - DNA, 21 bp, Homo sapiens
tgagacagggtctcgctctgt

SEQ ID NO: 109027 - DNA, 23 bp, Homo sapiens
taaaccactgtgacctgccagtg

SEQ ID NO: 109028 - DNA, 23 bp, Homo sapiens
gagacagagtctggctctgttgc

SEQ ID NO: 109029 - DNA, 21 bp, Homo sapiens
tctggctctgtcactcaggcg

SEQ ID NO: 109030 - DNA, 20 bp, Homo sapiens
attgagattctctctctgga

SEQ ID NO: 109031 - DNA, 23 bp, Homo sapiens
tccacagtggctgaactatttcc

SEQ ID NO: 109032 - DNA, 23 bp, Homo sapiens
taatggcaccctgattttgttct

SEQ ID NO: 109033 - DNA, 20 bp, Homo sapiens
ttgctgagagaattaagtgt

SEQ ID NO: 109034 - DNA, 23 bp, Homo sapiens
cggagtctcgctctgtctcccag

SEQ ID NO: 109035 - DNA, 23 bp, Homo sapiens
aagagctgtcagtcaaagaactt

SEQ ID NO: 109036 - DNA, 22 bp, Homo sapiens
actggagagatggttctcttgg

SEQ ID NO: 109037 - DNA, 21 bp, Homo sapiens
tatgtgtgtatatatacgtat

SEQ ID NO: 109038 - DNA, 23 bp, Homo sapiens
gtgtctgtgtctgtctcagatgg

SEQ ID NO: 109039 - DNA, 18 bp, Homo sapiens
tgtatttatatgctgtat

SEQ ID NO: 109040 - DNA, 22 bp, Homo sapiens
ctgtcactgactcattgtgcaa

SEQ ID NO: 109041 - DNA, 23 bp, Homo sapiens
ggagtctcactctgtcacccagg

SEQ ID NO: 109042 - DNA, 18 bp, Homo sapiens
aagcccatcctgtttgtg

SEQ ID NO: 109043 - DNA, 23 bp, Homo sapiens
gtcaccgtccctgactggctggc

SEQ ID NO: 109044 - DNA, 23 bp, Homo sapiens
tgagttcattgtagattctggat

SEQ ID NO: 109045 - DNA, 23 bp, Homo sapiens
tgagttcattgtagattctggat

SEQ ID NO: 109046 - DNA, 22 bp, Homo sapiens
ttctctgtttttataaagctgt

SEQ ID NO: 109047 - DNA, 19 bp, Homo sapiens
atgtggccaaagatctccc

SEQ ID NO: 109048 - DNA, 23 bp, Homo sapiens
gtcaccgtccctgactggctggc

SEQ ID NO: 109049 - DNA, 23 bp, Homo sapiens
aggtttttgtagctctgtgttta

SEQ ID NO: 109050 - DNA, 19 bp, Homo sapiens
ttgaatatctccattgctt

SEQ ID NO: 109051 - DNA, 22 bp, Homo sapiens
aagtctgagtggttttcagttt

SEQ ID NO: 109052 - DNA, 21 bp, Homo sapiens
aggctccctccctcactcact

SEQ ID NO: 109053 - DNA, 22 bp, Homo sapiens
gcctctctccctgtcttacatg

SEQ ID NO: 109054 - DNA, 23 bp, Homo sapiens
acactgtctctgtgttaagctgg

SEQ ID NO: 109055 - DNA, 23 bp, Homo sapiens
tctctctcactctcatattttgg

SEQ ID NO: 109056 - DNA, 19 bp, Homo sapiens
tctcactctgtcacccagg

SEQ ID NO: 109057 - DNA, 23 bp, Homo sapiens
ggcagagtctcactctgtcgccc

SEQ ID NO: 109058 - DNA, 23 bp, Homo sapiens
gtcagagtctcgctctgtcaccc

SEQ ID NO: 109059 - DNA, 19 bp, Homo sapiens
caagaacctgcctctaaaa

SEQ ID NO: 109060 - DNA, 23 bp, Homo sapiens
cggagtctcactctgtcacccag

SEQ ID NO: 109061 - DNA, 21 bp, Homo sapiens
tgtgtgtgtgtgacggagtct

SEQ ID NO: 109062 - DNA, 23 bp, Homo sapiens
gacagagtctcgctctgtcaccc

SEQ ID NO: 109063 - DNA, 22 bp, Homo sapiens
tgcagtggctagatcttgtctc

SEQ ID NO: 109064 - DNA, 23 bp, Homo sapiens
gacagagtctcgctctgtcgctc

SEQ ID NO: 109065 - DNA, 23 bp, Homo sapiens
tatgtgtgatatttggtgtgagt

SEQ ID NO: 109066 - DNA, 20 bp, Homo sapiens
acagagtcttgctctgtcac

SEQ ID NO: 109067 - DNA, 23 bp, Homo sapiens
gagacagggtctggctctgtgac

SEQ ID NO: 109068 - DNA, 22 bp, Homo sapiens
aagtggcagttgagctggatca

SEQ ID NO: 109069 - DNA, 23 bp, Homo sapiens
gccagagtctcgctctgtcaccc

SEQ ID NO: 109070 - DNA, 22 bp, Homo sapiens
agagtctcgctctgtcacccag

SEQ ID NO: 109071 - DNA, 23 bp, Homo sapiens
ctgtgctctgtctgtctgtaatc

SEQ ID NO: 109072 - DNA, 20 bp, Homo sapiens
tccatgagtggaaaactgag

SEQ ID NO: 109073 - DNA, 22 bp, Homo sapiens
tgtgtatatatatatctgtaca

SEQ ID NO: 109074 - DNA, 21 bp, Homo sapiens
tgagacagtctcactctgtct

SEQ ID NO: 109075 - DNA, 21 bp, Homo sapiens
atcacgactcacagcagcctc

SEQ ID NO: 109076 - DNA, 23 bp, Homo sapiens
gaatctcactctgtcacccaggc

SEQ ID NO: 109077 - DNA, 23 bp, Homo sapiens
tttgagacggagtctcactctat

SEQ ID NO: 109078 - DNA, 19 bp, Homo sapiens
ttccacagccagcatgctg

SEQ ID NO: 109079 - DNA, 23 bp, Homo sapiens
tggtggctctcactgtgactgtg

SEQ ID NO: 109080 - DNA, 21 bp, Homo sapiens
agtaagattctgtctcaaaaa

SEQ ID NO: 109081 - DNA, 23 bp, Homo sapiens
tttgagagtcttgttctgttgct

SEQ ID NO: 109082 - DNA, 23 bp, Homo sapiens
caacatagtgacactccgtctct

SEQ ID NO: 109083 - DNA, 23 bp, Homo sapiens
tgacatggagtctcgctctgtca

SEQ ID NO: 109084 - DNA, 20 bp, Homo sapiens
tgacagagcgagaccttgtc

SEQ ID NO: 109085 - DNA, 23 bp, Homo sapiens
caaagtctcactgtgtcacccag

SEQ ID NO: 109086 - DNA, 20 bp, Homo sapiens
tgtgggtgacagtggccctg

SEQ ID NO: 109087 - DNA, 22 bp, Homo sapiens
tgggacagagcgagactccgtc

SEQ ID NO: 109088 - DNA, 23 bp, Homo sapiens
gagtctcgctgtgtcccaggctg

SEQ ID NO: 109089 - DNA, 23 bp, Homo sapiens
gagatggagtctctatctgtcac

SEQ ID NO: 109090 - DNA, 23 bp, Homo sapiens
ttctgtgaagtcacacaggtcac

SEQ ID NO: 109091 - DNA, 20 bp, Homo sapiens
agggtgaagtcacagaggtc

SEQ ID NO: 109092 - DNA, 23 bp, Homo sapiens
agcactgagtgaggacacacagg

SEQ ID NO: 109093 - DNA, 23 bp, Homo sapiens
tgagattagtgagaggtgacagc

SEQ ID NO: 109094 - DNA, 23 bp, Homo sapiens
aaaactagcaagactctctctct

SEQ ID NO: 109095 - DNA, 23 bp, Homo sapiens
ttgagacggagtctcactctgtc

SEQ ID NO: 109096 - DNA, 23 bp, Homo sapiens
ttgagacagggtctctcactctg

SEQ ID NO: 109097 - DNA, 23 bp, Homo sapiens
ggctgaggtaggaggatcacttg

SEQ ID NO: 109098 - DNA, 21 bp, Homo sapiens
tgtgttcaaaaagtattggta

SEQ ID NO: 109099 - DNA, 23 bp, Homo sapiens
tagcacagtgcctggtaagtact

SEQ ID NO: 109100 - DNA, 23 bp, Homo sapiens
gactgactgactgactggctatg

SEQ ID NO: 109101 - DNA, 23 bp, Homo sapiens
tgagatggagtctcactctgtcg

SEQ ID NO: 109102 - DNA, 19 bp, Homo sapiens
ctctgtctcaaaacaaaca

SEQ ID NO: 109103 - DNA, 18 bp, Homo sapiens
tttttgaggcagtcttgc

SEQ ID NO: 109104 - DNA, 23 bp, Homo sapiens
gatgtcagtcagtggttctcaag

SEQ ID NO: 109105 - DNA, 22 bp, Homo sapiens
tggctgtgtatagtcagtgtat

SEQ ID NO: 109106 - DNA, 23 bp, Homo sapiens
cggagtctcactctgtcacccag

SEQ ID NO: 109107 - DNA, 23 bp, Homo sapiens
gagtctcactctgtcacccaggc

SEQ ID NO: 109108 - DNA, 23 bp, Homo sapiens
actctctgtctcagggtgaggac

SEQ ID NO: 109109 - DNA, 23 bp, Homo sapiens
aggtctcactctgtcacccaggc

SEQ ID NO: 109110 - DNA, 23 bp, Homo sapiens
gagtctcagtctgtcactcaggc

SEQ ID NO: 109111 - DNA, 23 bp, Homo sapiens
tggcagtgtcttagctggttgtt

SEQ ID NO: 109112 - DNA, 19 bp, Homo sapiens
aatcagcaagtatactgcc

SEQ ID NO: 109113 - DNA, 19 bp, Homo sapiens
tagaagtgctgcacgttgt

SEQ ID NO: 109114 - DNA, 21 bp, Homo sapiens
gacagggtctcactccgtcac

SEQ ID NO: 109115 - DNA, 23 bp, Homo sapiens
tctgtcactgggtggctgttttc

SEQ ID NO: 109116 - DNA, 22 bp, Homo sapiens
agagtctcgctctgtcacccag

SEQ ID NO: 109117 - DNA, 23 bp, Homo sapiens
gacagtctcgctctgtcacccag

SEQ ID NO: 109118 - DNA, 23 bp, Homo sapiens
aacaaatgggaagagtttgactt

SEQ ID NO: 109119 - DNA, 22 bp, Homo sapiens
atttttagtagaggcagggttt

SEQ ID NO: 109120 - DNA, 23 bp, Homo sapiens
gtttgttgttgagatatgaagtg

SEQ ID NO: 109121 - DNA, 22 bp, Homo sapiens
tagcaaatttttcgatgtatag

SEQ ID NO: 109122 - DNA, 23 bp, Homo sapiens
tcccactctgttgctcactctgt

SEQ ID NO: 109123 - DNA, 23 bp, Homo sapiens
acagggtcttactcactctgtca

SEQ ID NO: 109124 - DNA, 23 bp, Homo sapiens
agagtctcactctgtcacccagg

SEQ ID NO: 109125 - DNA, 23 bp, Homo sapiens
tgtgtgtgtgtgcacctgcatgt

SEQ ID NO: 109126 - DNA, 22 bp, Homo sapiens
tgtgtttgcacgtgtgtatgtg

SEQ ID NO: 109127 - DNA, 23 bp, Homo sapiens
gtgacagagagagactctgtctc

SEQ ID NO: 109128 - DNA, 23 bp, Homo sapiens
acagggtctcactctgtctccca

SEQ ID NO: 109129 - DNA, 23 bp, Homo sapiens
ctgggtctctgtccccctgtctc

SEQ ID NO: 109130 - DNA, 23 bp, Homo sapiens
gagtctctctctgtcactcaggc

SEQ ID NO: 109131 - DNA, 23 bp, Homo sapiens
gacagagtctcgctgtgtcaccc

SEQ ID NO: 109132 - DNA, 23 bp, Homo sapiens
tgtgtcacacacaatgttaaggg

SEQ ID NO: 109133 - DNA, 23 bp, Homo sapiens
ctgtgcattctgaatgtggtgtg

SEQ ID NO: 109134 - DNA, 22 bp, Homo sapiens
tgagtcacactgactgaagtgg

SEQ ID NO: 109135 - DNA, 21 bp, Homo sapiens
agtctgcgtggtaaacttttt

SEQ ID NO: 109136 - DNA, 19 bp, Homo sapiens
atcagcatttacagatgat

SEQ ID NO: 109137 - DNA, 23 bp, Homo sapiens
accttttctcagaaatcttaaag

SEQ ID NO: 109138 - DNA, 23 bp, Homo sapiens
gagacagagtctcgctctgtcac

SEQ ID NO: 109139 - DNA, 23 bp, Homo sapiens
tgtctccctgtttgtctctggaa

SEQ ID NO: 109140 - DNA, 23 bp, Homo sapiens
atatctctctctgtctctctctc

SEQ ID NO: 109141 - DNA, 23 bp, Homo sapiens
tgtatatatgttatgtagctata

SEQ ID NO: 109142 - DNA, 23 bp, Homo sapiens
tctctgcctggctcccttttacc

SEQ ID NO: 109143 - DNA, 20 bp, Homo sapiens
tccaattcagagggcagtgt

SEQ ID NO: 109144 - DNA, 23 bp, Homo sapiens
ctcagtccgtctgtcactgtaga

SEQ ID NO: 109145 - DNA, 23 bp, Homo sapiens
aacagaatacagagaggcaatga

SEQ ID NO: 109146 - DNA, 20 bp, Homo sapiens
ttctgaaaaaattcaggtgg

SEQ ID NO: 109147 - DNA, 23 bp, Homo sapiens
atgtgtgtatatatatacacgta

SEQ ID NO: 109148 - DNA, 19 bp, Homo sapiens
tatatacacgtatatatgt

SEQ ID NO: 109149 - DNA, 23 bp, Homo sapiens
gagagagtctcgctctgtcaccc

SEQ ID NO: 109150 - DNA, 22 bp, Homo sapiens
tgagagcaggtgctatccagga

SEQ ID NO: 109151 - DNA, 23 bp, Homo sapiens
gtctcgctctgtcacccagtgac

SEQ ID NO: 109152 - DNA, 23 bp, Homo sapiens
caggcagtgtgagtactgttggt

SEQ ID NO: 109153 - DNA, 23 bp, Homo sapiens
gacagagtctcgctctgtcaccc

SEQ ID NO: 109154 - DNA, 20 bp, Homo sapiens
attagtcagggacagatggg

SEQ ID NO: 109155 - DNA, 23 bp, Homo sapiens
acacacatctgtctgtgtgatga

SEQ ID NO: 109156 - DNA, 23 bp, Homo sapiens
tttgagacggagtctcactcagt

SEQ ID NO: 109157 - DNA, 23 bp, Homo sapiens
tctgacactcagtgcttctggct

SEQ ID NO: 109158 - DNA, 23 bp, Homo sapiens
cggagtctcactctgtcacccag

SEQ ID NO: 109159 - DNA, 19 bp, Homo sapiens
tgagacagtctgtcactcc

SEQ ID NO: 109160 - DNA, 23 bp, Homo sapiens
agggtcactgttactctctcctt

SEQ ID NO: 109161 - DNA, 23 bp, Homo sapiens
ctgactcactgcttctcttctgc

SEQ ID NO: 109162 - DNA, 23 bp, Homo sapiens
cggagtctcactctgtcacccag

SEQ ID NO: 109163 - DNA, 23 bp, Homo sapiens
gagtctcactctgtcacccaggc

SEQ ID NO: 109164 - DNA, 23 bp, Homo sapiens
tgtagtttttgagaagtgcatgg

SEQ ID NO: 109165 - DNA, 23 bp, Homo sapiens
gagggtgcctggctctgtccctc

SEQ ID NO: 109166 - DNA, 23 bp, Homo sapiens
atttaacctgtggttccagacca

SEQ ID NO: 109167 - DNA, 23 bp, Homo sapiens
ggctgtctcactgagagtgtgtt

SEQ ID NO: 109168 - DNA, 23 bp, Homo sapiens
ctacctcactgtctctttcttct

SEQ ID NO: 109169 - DNA, 23 bp, Homo sapiens
atatgtattagtatatgtatgtg

SEQ ID NO: 109170 - DNA, 22 bp, Homo sapiens
ccctctctgtctctgcctgggt

SEQ ID NO: 109171 - DNA, 19 bp, Homo sapiens
tttctatatttgtatgtcc

SEQ ID NO: 109172 - DNA, 23 bp, Homo sapiens
ttttgagacggagtcttgctctg

SEQ ID NO: 109173 - DNA, 23 bp, Homo sapiens
ctgactctcccactgtttgtcct

SEQ ID NO: 109174 - DNA, 23 bp, Homo sapiens
tgagatggagtctcactctgtca

SEQ ID NO: 109175 - DNA, 21 bp, Homo sapiens
tctgtcagcctgtgagctgtc

SEQ ID NO: 109176 - DNA, 22 bp, Homo sapiens
aggaacagcaactggagctgga

SEQ ID NO: 109177 - DNA, 23 bp, Homo sapiens
tgagacgtagtctcgctctgtcg

SEQ ID NO: 109178 - DNA, 23 bp, Homo sapiens
tgtgtgtctgcctgtctgtctgc

SEQ ID NO: 109179 - DNA, 23 bp, Homo sapiens
tctggctgtgtcacttgggtgag

SEQ ID NO: 109180 - DNA, 23 bp, Homo sapiens
tctctggctgcctgtgtggcttc

SEQ ID NO: 109181 - DNA, 23 bp, Homo sapiens
tgatctgaaaggtaaagtttact

SEQ ID NO: 109182 - DNA, 23 bp, Homo sapiens
ttctctggcactctgagtctgga

SEQ ID NO: 109183 - DNA, 22 bp, Homo sapiens
tgtgtgcgtgcgtgcgtgtctg

SEQ ID NO: 109184 - DNA, 23 bp, Homo sapiens
tgtgtgtgcgtgtgtgtgcgcgt

SEQ ID NO: 109185 - DNA, 19 bp, Homo sapiens
atctcagagagctttcaac

SEQ ID NO: 109186 - DNA, 23 bp, Homo sapiens
gtgtcactgcctccctctgacag

SEQ ID NO: 109187 - DNA, 23 bp, Homo sapiens
ctctccctctctgactcagtttc

SEQ ID NO: 109188 - DNA, 21 bp, Homo sapiens
ggtacatcttgacttaccaca

SEQ ID NO: 109189 - DNA, 23 bp, Homo sapiens
ctcacaactgactcagtctcagg

SEQ ID NO: 109190 - DNA, 23 bp, Homo sapiens
ccttagtcactctctggctctgc

SEQ ID NO: 109191 - DNA, 23 bp, Homo sapiens
tgagacggtgtctcgctctgtcg

SEQ ID NO: 109192 - DNA, 21 bp, Homo sapiens
tgagacagagtttcactctgt

SEQ ID NO: 109193 - DNA, 23 bp, Homo sapiens
tttgagacggagtctggctctgt

SEQ ID NO: 109194 - DNA, 23 bp, Homo sapiens
ttgaatcaaccgtgcctgtcacg

SEQ ID NO: 109195 - DNA, 23 bp, Homo sapiens
tggagtctcactctgtcacccag

SEQ ID NO: 109196 - DNA, 23 bp, Homo sapiens
tccctgggtccctgtatccagag

SEQ ID NO: 109197 - DNA, 20 bp, Homo sapiens
tcactctcagaagggagccc

SEQ ID NO: 109198 - DNA, 23 bp, Homo sapiens
agagtctcactctgtcacccagg

SEQ ID NO: 109199 - DNA, 23 bp, Homo sapiens
gagtctcactctgtcacccaggc

SEQ ID NO: 109200 - DNA, 23 bp, Homo sapiens
gggtcccactctgtgtgtgtgtg

SEQ ID NO: 109201 - DNA, 19 bp, Homo sapiens
gtctcgctctgtcacccag

SEQ ID NO: 109202 - DNA, 23 bp, Homo sapiens
atctgtgtctgtcactgcatgtc

SEQ ID NO: 109203 - DNA, 23 bp, Homo sapiens
agacagtctcgctctgtcaccca

SEQ ID NO: 109204 - DNA, 23 bp, Homo sapiens
ttgagacagtcttgctctgtctg

SEQ ID NO: 109205 - DNA, 23 bp, Homo sapiens
tctcaaccactctcactctgacc

SEQ ID NO: 109206 - DNA, 23 bp, Homo sapiens
gggtctcactctgtcacccaggc

SEQ ID NO: 109207 - DNA, 23 bp, Homo sapiens
gggtctcactctgtcacccaggc

SEQ ID NO: 109208 - DNA, 22 bp, Homo sapiens
tcgctcgctcgctcgctcgctc

SEQ ID NO: 109209 - DNA, 21 bp, Homo sapiens
tgagatggagtctcactctgt

SEQ ID NO: 109210 - DNA, 23 bp, Homo sapiens
ggttctgggtgactctgtctctc

SEQ ID NO: 109211 - DNA, 23 bp, Homo sapiens
tctgtcacagtctgtggttccta

SEQ ID NO: 109212 - DNA, 23 bp, Homo sapiens
gagacacagtctcgctctgtcgc

SEQ ID NO: 109213 - DNA, 19 bp, Homo sapiens
gctgcctgccttaaagctg

SEQ ID NO: 109214 - DNA, 21 bp, Homo sapiens
atacagtcttgctctgttacc

SEQ ID NO: 109215 - DNA, 23 bp, Homo sapiens
tagtgatacaaggttgttttgat

SEQ ID NO: 109216 - DNA, 19 bp, Homo sapiens
tcaccatattactagaata

SEQ ID NO: 109217 - DNA, 23 bp, Homo sapiens
tgacatggtctggctctgtcacc

SEQ ID NO: 109218 - DNA, 22 bp, Homo sapiens
atcatggtcattctctgtctca

SEQ ID NO: 109219 - DNA, 22 bp, Homo sapiens
cctgtcacagtcagtttgggga

SEQ ID NO: 109220 - DNA, 23 bp, Homo sapiens
cagagtctcactctgtcgctcag

SEQ ID NO: 109221 - DNA, 23 bp, Homo sapiens
agtccctctgtctgtgtgtgcct

SEQ ID NO: 109222 - DNA, 21 bp, Homo sapiens
gatgattagttaaggtcctag

SEQ ID NO: 109223 - DNA, 23 bp, Homo sapiens
catgactcactgcagtctcagcc

SEQ ID NO: 109224 - DNA, 22 bp, Homo sapiens
atcatggtcattctctgtctca

SEQ ID NO: 109225 - DNA, 23 bp, Homo sapiens
acacagtcagtctctgtctcttc

SEQ ID NO: 109226 - DNA, 23 bp, Homo sapiens
gaatagctggtagaaagtattga

SEQ ID NO: 109227 - DNA, 23 bp, Homo sapiens
atgtatgtatgtatatatgtgtg

SEQ ID NO: 109228 - DNA, 22 bp, Homo sapiens
ttgcataatacagagtactaga

SEQ ID NO: 109229 - DNA, 18 bp, Homo sapiens
tatactttaagttctagg

SEQ ID NO: 109230 - DNA, 23 bp, Homo sapiens
tacatgtgcacaatgtgcaggtt

SEQ ID NO: 109231 - DNA, 21 bp, Homo sapiens
tgtgtgtcacacaaagaacag

SEQ ID NO: 109232 - DNA, 23 bp, Homo sapiens
cctgtgtgtcacacacagagaac

SEQ ID NO: 109233 - DNA, 21 bp, Homo sapiens
tgtgtgtcacacaaagaacag

SEQ ID NO: 109234 - DNA, 23 bp, Homo sapiens
cctgtgtgtcacacacagagaac

SEQ ID NO: 109235 - DNA, 23 bp, Homo sapiens
aatggctgaggagtgtgggtgca

SEQ ID NO: 109236 - DNA, 23 bp, Homo sapiens
tgtcagtgactcactgcgtgggc

SEQ ID NO: 109237 - DNA, 18 bp, Homo sapiens
ccagagcatgtggtgctg

SEQ ID NO: 109238 - DNA, 23 bp, Homo sapiens
tctcactcacgctgtgcctcaca

SEQ ID NO: 109239 - DNA, 21 bp, Homo sapiens
tgagcagggctgagaacttgc

SEQ ID NO: 109240 - DNA, 23 bp, Homo sapiens
tacagtctgcaacagcaagtggt

SEQ ID NO: 109241 - DNA, 20 bp, Homo sapiens
gggacagtcacaagagagag

SEQ ID NO: 109242 - DNA, 23 bp, Homo sapiens
atgtgtgtgcatgtgtgtacatg

SEQ ID NO: 109243 - DNA, 21 bp, Homo sapiens
tttgttcttactgaaatgttg

SEQ ID NO: 109244 - DNA, 21 bp, Homo sapiens
tttgtgagctcatgttggcct

SEQ ID NO: 109245 - DNA, 22 bp, Homo sapiens
tgaatctcagcggttttgtgag

SEQ ID NO: 109246 - DNA, 18 bp, Homo sapiens
tctgagcagttttgtgag

SEQ ID NO: 109247 - DNA, 23 bp, Homo sapiens
atccatgcataagaaatgtaaag

SEQ ID NO: 109248 - DNA, 22 bp, Homo sapiens
aatatgtatgttgtagtatggt

SEQ ID NO: 109249 - DNA, 23 bp, Homo sapiens
agtgtgcaagttcaagcctccat

SEQ ID NO: 109250 - DNA, 23 bp, Homo sapiens
atgtgtatatatatatgtgtatg

SEQ ID NO: 109251 - DNA, 18 bp, Homo sapiens
agatgatgatgctgggga

SEQ ID NO: 109252 - DNA, 22 bp, Homo sapiens
ggcagtgtcagagtctctctct

SEQ ID NO: 109253 - DNA, 20 bp, Homo sapiens
tgccgcagggactctcgtgt

SEQ ID NO: 109254 - DNA, 21 bp, Homo sapiens
cttggaagactgttggcttag

SEQ ID NO: 109255 - DNA, 23 bp, Homo sapiens
cagtctcactctgtcacccaggc

SEQ ID NO: 109256 - DNA, 19 bp, Homo sapiens
agacagagtctcactctgc

SEQ ID NO: 109257 - DNA, 23 bp, Homo sapiens
tgatttcagtgagctttctttct

SEQ ID NO: 109258 - DNA, 18 bp, Homo sapiens
catcaatagacttgattg

SEQ ID NO: 109259 - DNA, 23 bp, Homo sapiens
tcttgagcaactaaaattcagtc

SEQ ID NO: 109260 - DNA, 22 bp, Homo sapiens
tgagatggagttttgctcttgt

SEQ ID NO: 109261 - DNA, 23 bp, Homo sapiens
ttttagcatttctattcacagcc

SEQ ID NO: 109262 - DNA, 23 bp, Homo sapiens
gtgacagtgaagagagactgcag

SEQ ID NO: 109263 - DNA, 21 bp, Homo sapiens
tgtagactttacacagcacct

SEQ ID NO: 109264 - DNA, 23 bp, Homo sapiens
gagattggcagagctagaattca

SEQ ID NO: 109265 - DNA, 23 bp, Homo sapiens
gagagagcatttgtgttgagaaa

SEQ ID NO: 109266 - DNA, 23 bp, Homo sapiens
tgtgtctgtctgtctgtctgtcc

SEQ ID NO: 109267 - DNA, 19 bp, Homo sapiens
gtctcgctctgtcacccag

SEQ ID NO: 109268 - DNA, 23 bp, Homo sapiens
taatttctgcaagagcttcaggt

SEQ ID NO: 109269 - DNA, 22 bp, Homo sapiens
gcctgtctgagactctctctca

SEQ ID NO: 109270 - DNA, 23 bp, Homo sapiens
tttgagacagagtctcttctgtt

SEQ ID NO: 109271 - DNA, 23 bp, Homo sapiens
atatgtgtatatgtaaatacttt

SEQ ID NO: 109272 - DNA, 22 bp, Homo sapiens
atcactttttggaattcagtgg

SEQ ID NO: 109273 - DNA, 19 bp, Homo sapiens
tatatgcattttttcttat

SEQ ID NO: 109274 - DNA, 23 bp, Homo sapiens
tcagatttttagatttgggatgt

SEQ ID NO: 109275 - DNA, 21 bp, Homo sapiens
tttactgaatttgtttattag

SEQ ID NO: 109276 - DNA, 19 bp, Homo sapiens
taaccagtttttagtggag

SEQ ID NO: 109277 - DNA, 20 bp, Homo sapiens
ttcacacacactgacagtcc

SEQ ID NO: 109278 - DNA, 23 bp, Homo sapiens
tgtatctgtgcatgtgcatctgt

SEQ ID NO: 109279 - DNA, 22 bp, Homo sapiens
acatatgttagggtgcttgaca

SEQ ID NO: 109280 - DNA, 23 bp, Homo sapiens
tttgtgctagcttatgaaatgta

SEQ ID NO: 109281 - DNA, 23 bp, Homo sapiens
atgtgtctgactctgtgctgttt

SEQ ID NO: 109282 - DNA, 21 bp, Homo sapiens
tctgtcagcatgacctgggtt

SEQ ID NO: 109283 - DNA, 23 bp, Homo sapiens
ctgtgtgcctgtgtctatgcctc

SEQ ID NO: 109284 - DNA, 23 bp, Homo sapiens
tatgtgtgaatttgatcttgtca

SEQ ID NO: 109285 - DNA, 21 bp, Homo sapiens
ttagttgatgcaatttcttca

SEQ ID NO: 109286 - DNA, 22 bp, Homo sapiens
catatatgtatatgtatgtgta

SEQ ID NO: 109287 - DNA, 23 bp, Homo sapiens
tctgagagtctctgtctgccacc

SEQ ID NO: 109288 - DNA, 23 bp, Homo sapiens
ctcactgtcactgtgaggagtgg

SEQ ID NO: 109289 - DNA, 23 bp, Homo sapiens
ttgttctcacactcggtgtctgg

SEQ ID NO: 109290 - DNA, 19 bp, Homo sapiens
gtgagtaaagagagaggtc

SEQ ID NO: 109291 - DNA, 18 bp, Homo sapiens
tactgtatagatgtatat

SEQ ID NO: 109292 - DNA, 23 bp, Homo sapiens
attacacagtatatgtatatgct

SEQ ID NO: 109293 - DNA, 23 bp, Homo sapiens
tttcagtcacaagtaattgcttt

SEQ ID NO: 109294 - DNA, 23 bp, Homo sapiens
tgagttcattgtagattctggat

SEQ ID NO: 109295 - DNA, 23 bp, Homo sapiens
tgagttcattgtagattctggat

SEQ ID NO: 109296 - DNA, 23 bp, Homo sapiens
gcccagtgtctgtgtgtctctga

SEQ ID NO: 109297 - DNA, 23 bp, Homo sapiens
atatgtgtgtgtatgatatatat

SEQ ID NO: 109298 - DNA, 18 bp, Homo sapiens
atgtatgtatatgtgtat

SEQ ID NO: 109299 - DNA, 23 bp, Homo sapiens
tgtatatgtgtatatgtgtatgt

SEQ ID NO: 109300 - DNA, 23 bp, Homo sapiens
gtagtgtgtgtgcactgtgtgtc

SEQ ID NO: 109301 - DNA, 23 bp, Homo sapiens
ctgagagaacacagtctcttgtt

SEQ ID NO: 109302 - DNA, 20 bp, Homo sapiens
catggctgattctttatgtg

SEQ ID NO: 109303 - DNA, 20 bp, Homo sapiens
tctctcggtctctctgaggg

SEQ ID NO: 109304 - DNA, 23 bp, Homo sapiens
tgtgggtgagagaaaacacagag

SEQ ID NO: 109305 - DNA, 23 bp, Homo sapiens
taagtattgtatatgtacatata

SEQ ID NO: 109306 - DNA, 23 bp, Homo sapiens
atgtgtggatatgactgtgtgta

SEQ ID NO: 109307 - DNA, 23 bp, Homo sapiens
acggagtctcgctctctcaccca

SEQ ID NO: 109308 - DNA, 20 bp, Homo sapiens
tagtgcatgcatgtatatat

SEQ ID NO: 109309 - DNA, 23 bp, Homo sapiens
gtatgtgtgtgtgtgcatgtcca

SEQ ID NO: 109310 - DNA, 23 bp, Homo sapiens
gagatggagtctctctctgtcac

SEQ ID NO: 109311 - DNA, 19 bp, Homo sapiens
tgcctctctgtctcatgag

SEQ ID NO: 109312 - DNA, 23 bp, Homo sapiens
ggtcagaaagtagagagacagga

SEQ ID NO: 109313 - DNA, 19 bp, Homo sapiens
ttcatgatgggatagaatg

SEQ ID NO: 109314 - DNA, 23 bp, Homo sapiens
cctgcctgcctgtctgcctacct

SEQ ID NO: 109315 - DNA, 23 bp, Homo sapiens
ccctctctgtctctgagggtctg

SEQ ID NO: 109316 - DNA, 23 bp, Homo sapiens
acaggattctttttcacaatgca

SEQ ID NO: 109317 - DNA, 23 bp, Homo sapiens
tcagtgtagattcagtgcagtat

SEQ ID NO: 109318 - DNA, 19 bp, Homo sapiens
tgtgatgttccttgtttca

SEQ ID NO: 109319 - DNA, 22 bp, Homo sapiens
ctgtgcctgggattctgccagg

SEQ ID NO: 109320 - DNA, 21 bp, Homo sapiens
tcacagtagtgagtgagttct

SEQ ID NO: 109321 - DNA, 23 bp, Homo sapiens
cactctgtcacccagtctggagt

SEQ ID NO: 109322 - DNA, 23 bp, Homo sapiens
tatgtgcttaatcttcagttact

SEQ ID NO: 109323 - DNA, 23 bp, Homo sapiens
tttagaatgctaaggaaatctct

SEQ ID NO: 109324 - DNA, 23 bp, Homo sapiens
atgtgtatatatgtatgtgtgtg

SEQ ID NO: 109325 - DNA, 23 bp, Homo sapiens
gaggctgtgtaatttagttcata

SEQ ID NO: 109326 - DNA, 21 bp, Homo sapiens
ttctgtttttgtaagctgtaa

SEQ ID NO: 109327 - DNA, 22 bp, Homo sapiens
ttgaaaagtacagatattgttg

SEQ ID NO: 109328 - DNA, 23 bp, Homo sapiens
cacctctgactctctctgtgtgc

SEQ ID NO: 109329 - DNA, 23 bp, Homo sapiens
ctcactgaacagagactgttcat

SEQ ID NO: 109330 - DNA, 19 bp, Homo sapiens
tccctgaggcccagggact

SEQ ID NO: 109331 - DNA, 23 bp, Homo sapiens
tccctgtcactgtcactggaaag

SEQ ID NO: 109332 - DNA, 19 bp, Homo sapiens
attgagaaagatgtgtgga

SEQ ID NO: 109333 - DNA, 21 bp, Homo sapiens
aatgaggaaatgacttctcaa

SEQ ID NO: 109334 - DNA, 23 bp, Homo sapiens
tctccctccctgtctctatttcc

SEQ ID NO: 109335 - DNA, 23 bp, Homo sapiens
tcagcctctcagtcagtccagga

SEQ ID NO: 109336 - DNA, 23 bp, Homo sapiens
gtgcccctctctctgtgggtgcc

SEQ ID NO: 109337 - DNA, 23 bp, Homo sapiens
tgcatgtgtatatatgtgtatgt

SEQ ID NO: 109338 - DNA, 23 bp, Homo sapiens
atatatgtgcatgcacacacaca

SEQ ID NO: 109339 - DNA, 20 bp, Homo sapiens
tgtcacaaagctttggaact

SEQ ID NO: 109340 - DNA, 18 bp, Homo sapiens
tcccagctactcaagagg

SEQ ID NO: 109341 - DNA, 22 bp, Homo sapiens
ctcagtctgtggagaagcttgt

SEQ ID NO: 109342 - DNA, 23 bp, Homo sapiens
agagctcctaggttgtttactat

SEQ ID NO: 109343 - DNA, 22 bp, Homo sapiens
gtgtgcatgcatatgtgtgcat

SEQ ID NO: 109344 - DNA, 23 bp, Homo sapiens
agtgtgtgtgcatgtgcatgtgt

SEQ ID NO: 109345 - DNA, 20 bp, Homo sapiens
acatttagccagagcctgtc

SEQ ID NO: 109346 - DNA, 23 bp, Homo sapiens
tgggtccctgcttccctggatcc

SEQ ID NO: 109347 - DNA, 22 bp, Homo sapiens
tcacctgttttgacttcctgct

SEQ ID NO: 109348 - DNA, 22 bp, Homo sapiens
tttttcagtctaaagtgtgccc

SEQ ID NO: 109349 - DNA, 23 bp, Homo sapiens
gacagagtctcgctctgtcaccc

SEQ ID NO: 109350 - DNA, 23 bp, Homo sapiens
tatatatatgtatatgtgtgtgt

SEQ ID NO: 109351 - DNA, 23 bp, Homo sapiens
agaatggctgggtgtcttgactg

SEQ ID NO: 109352 - DNA, 21 bp, Homo sapiens
tcatgctgcttgcaatttttg

SEQ ID NO: 109353 - DNA, 23 bp, Homo sapiens
cactctgtgtgactaacctgtgt

SEQ ID NO: 109354 - DNA, 23 bp, Homo sapiens
tgtttctcagtgccaccttgagc

SEQ ID NO: 109355 - DNA, 20 bp, Homo sapiens
gcttgaggtgaagctggtga

SEQ ID NO: 109356 - DNA, 23 bp, Homo sapiens
gacagagtctcgctctgtcaccc

SEQ ID NO: 109357 - DNA, 18 bp, Homo sapiens
atatgtattctatatata

SEQ ID NO: 109358 - DNA, 19 bp, Homo sapiens
tgtgaatgatgattacccc

SEQ ID NO: 109359 - DNA, 21 bp, Homo sapiens
tgggtgatcatggataagtca

SEQ ID NO: 109360 - DNA, 23 bp, Homo sapiens
gagacagtctcactctgttaccc

SEQ ID NO: 109361 - DNA, 21 bp, Homo sapiens
tctctgccacactgtctcctg

SEQ ID NO: 109362 - DNA, 19 bp, Homo sapiens
tctcagtgatgtctgagcc

SEQ ID NO: 109363 - DNA, 23 bp, Homo sapiens
tgagttcattgtagattctggat

SEQ ID NO: 109364 - DNA, 23 bp, Homo sapiens
tgagttcattgtagattctggat

SEQ ID NO: 109365 - DNA, 21 bp, Homo sapiens
tgagactgggagaggagactg

SEQ ID NO: 109366 - DNA, 23 bp, Homo sapiens
tttaaggttttctaggtgtatga

SEQ ID NO: 109367 - DNA, 23 bp, Homo sapiens
ttaatacttgatatgatttcaat

SEQ ID NO: 109368 - DNA, 23 bp, Homo sapiens
atacaggaaatatatatgtgtgt

SEQ ID NO: 109369 - DNA, 21 bp, Homo sapiens
ctcacactcagagactcagct

SEQ ID NO: 109370 - DNA, 18 bp, Homo sapiens
tcactgaggcagaaacag

SEQ ID NO: 109371 - DNA, 21 bp, Homo sapiens
aatgagggatgtcatgtgctg

SEQ ID NO: 109372 - DNA, 23 bp, Homo sapiens
gaagtctcacactgtcacccagg

SEQ ID NO: 109373 - DNA, 21 bp, Homo sapiens
tatacgtatatatacgtatat

SEQ ID NO: 109374 - DNA, 23 bp, Homo sapiens
tatacgtatatatacgtatatat

SEQ ID NO: 109375 - DNA, 21 bp, Homo sapiens
tgagagatgtcagtgtgcacc

SEQ ID NO: 109376 - DNA, 18 bp, Homo sapiens
tggacacacacaaagctc

SEQ ID NO: 109377 - DNA, 22 bp, Homo sapiens
tgaaatcagagaggattagaag

SEQ ID NO: 109378 - DNA, 23 bp, Homo sapiens
gacgaagaggagcacagatcatc

SEQ ID NO: 109379 - DNA, 23 bp, Homo sapiens
tctgtctatctgtctggctttgt

SEQ ID NO: 109380 - DNA, 23 bp, Homo sapiens
cagggattagattttcataagga

SEQ ID NO: 109381 - DNA, 19 bp, Homo sapiens
aatgttgtatcgctggtgg

SEQ ID NO: 109382 - DNA, 23 bp, Homo sapiens
ttgagttgtgtgctgtttgcttt

SEQ ID NO: 109383 - DNA, 23 bp, Homo sapiens
tagagtgtatatattattgtgtg

SEQ ID NO: 109384 - DNA, 23 bp, Homo sapiens
tgttacagcttctccatcacttt

SEQ ID NO: 109385 - DNA, 23 bp, Homo sapiens
tggaatgataagaactctaccgg

SEQ ID NO: 109386 - DNA, 23 bp, Homo sapiens
tgagttcattgtagattctggat

SEQ ID NO: 109387 - DNA, 23 bp, Homo sapiens
tgagttcattgtagattctggat

SEQ ID NO: 109388 - DNA, 22 bp, Homo sapiens
tatgtgtatatatatgtgtatg

SEQ ID NO: 109389 - DNA, 21 bp, Homo sapiens
tggggtacaatgaaatattct

SEQ ID NO: 109390 - DNA, 23 bp, Homo sapiens
tgagttcattgtagattctggat

SEQ ID NO: 109391 - DNA, 23 bp, Homo sapiens
tgagttcattgtagattctggat

SEQ ID NO: 109392 - DNA, 23 bp, Homo sapiens
tgagttcattgtagattctggat

SEQ ID NO: 109393 - DNA, 23 bp, Homo sapiens
tgagttcattgtagattctggat

SEQ ID NO: 109394 - DNA, 19 bp, Homo sapiens
tacatgtatgtatatatgt

SEQ ID NO: 109395 - DNA, 23 bp, Homo sapiens
gcatgtatgtatatatgtataca

SEQ ID NO: 109396 - DNA, 22 bp, Homo sapiens
catgtatgtatatatgtataca

SEQ ID NO: 109397 - DNA, 21 bp, Homo sapiens
gtgtatgtatgtatatatgta

SEQ ID NO: 109398 - DNA, 22 bp, Homo sapiens
tcactcactgagcttttcctca

SEQ ID NO: 109399 - DNA, 22 bp, Homo sapiens
tcactcactgagcttttcctca

SEQ ID NO: 109400 - DNA, 23 bp, Homo sapiens
tgagttcattgtagattctggat

SEQ ID NO: 109401 - DNA, 23 bp, Homo sapiens
tgagttcattgtagattctggat

SEQ ID NO: 109402 - DNA, 19 bp, Homo sapiens
tgatgttttcaaaacctgc

SEQ ID NO: 109403 - DNA, 23 bp, Homo sapiens
agagacttgagagagtacacaga

SEQ ID NO: 109404 - DNA, 23 bp, Homo sapiens
cggagtctcactctgtcacccag

SEQ ID NO: 109405 - DNA, 23 bp, Homo sapiens
gagtctcactctgtcacccaggc

SEQ ID NO: 109406 - DNA, 23 bp, Homo sapiens
ttttctcacagagattttatttt

SEQ ID NO: 109407 - DNA, 23 bp, Homo sapiens
ttctgtgaagaaagtcattggta

SEQ ID NO: 109408 - DNA, 23 bp, Homo sapiens
agatggagtctcactctgtcacc

SEQ ID NO: 109409 - DNA, 21 bp, Homo sapiens
ccactcactatctgagtcctt

SEQ ID NO: 109410 - DNA, 23 bp, Homo sapiens
tatgtgtgtatgtatatctgtgt

SEQ ID NO: 109411 - DNA, 20 bp, Homo sapiens
tgtgtctatatatatgtgtg

SEQ ID NO: 109412 - DNA, 23 bp, Homo sapiens
tacatgattggtgaagaaatgat

SEQ ID NO: 109413 - DNA, 23 bp, Homo sapiens
tgagttcattgtagattctggat

SEQ ID NO: 109414 - DNA, 23 bp, Homo sapiens
tgagttcattgtagattctggat

SEQ ID NO: 109415 - DNA, 23 bp, Homo sapiens
tatgtcaggttgctttcttgtgc

SEQ ID NO: 109416 - DNA, 20 bp, Homo sapiens
acacagaagaaagagggcag

SEQ ID NO: 109417 - DNA, 23 bp, Homo sapiens
agcaccttctgtcagtcactgat

SEQ ID NO: 109418 - DNA, 22 bp, Homo sapiens
actgtgccactcactagctgtg

SEQ ID NO: 109419 - DNA, 23 bp, Homo sapiens
atgtgtgcatgtatgtgtatgtg

SEQ ID NO: 109420 - DNA, 23 bp, Homo sapiens
cacacacacacatatgtgtatgt

SEQ ID NO: 109421 - DNA, 23 bp, Homo sapiens
ttatgtatgtgtgtctgtgtgtg

SEQ ID NO: 109422 - DNA, 23 bp, Homo sapiens
gttacaggcagtgtatgtgttca

SEQ ID NO: 109423 - DNA, 23 bp, Homo sapiens
gagaccgagtctcactctgcctc

SEQ ID NO: 109424 - DNA, 21 bp, Homo sapiens
tgaggttggttgtctggtggg

SEQ ID NO: 109425 - DNA, 23 bp, Homo sapiens
cagggtctcactgtgtcacccag

SEQ ID NO: 109426 - DNA, 23 bp, Homo sapiens
cctggatttctgacccacagaaa

SEQ ID NO: 109427 - DNA, 22 bp, Homo sapiens
tgtggttgtaatgcagcattgg

SEQ ID NO: 109428 - DNA, 23 bp, Homo sapiens
tgtgtcactgtgtcacttgctcc

SEQ ID NO: 109429 - DNA, 23 bp, Homo sapiens
tgcagccacacacattcttgttt

SEQ ID NO: 109430 - DNA, 23 bp, Homo sapiens
tgcttttatgtgtttgtcttatt

SEQ ID NO: 109431 - DNA, 23 bp, Homo sapiens
catctgtccgtccgtctgtctgt

SEQ ID NO: 109432 - DNA, 18 bp, Homo sapiens
tggatgttgaatgagggt

SEQ ID NO: 109433 - DNA, 21 bp, Homo sapiens
atggaggagagagtgctgaat

SEQ ID NO: 109434 - DNA, 23 bp, Homo sapiens
tgagttcattgtagattctggat

SEQ ID NO: 109435 - DNA, 23 bp, Homo sapiens
tgagttcattgtagattctggat

SEQ ID NO: 109436 - DNA, 22 bp, Homo sapiens
tccatagttctctggcaggtgg

SEQ ID NO: 109437 - DNA, 22 bp, Homo sapiens
gatgaggtgagagtctgcagag

SEQ ID NO: 109438 - DNA, 23 bp, Homo sapiens
tgtctcaggctctctgaaaggca

SEQ ID NO: 109439 - DNA, 21 bp, Homo sapiens
tttgttgaatgatatgagatg

SEQ ID NO: 109440 - DNA, 23 bp, Homo sapiens
tgacttgtgtctctttctccaaa

SEQ ID NO: 109441 - DNA, 22 bp, Homo sapiens
ttaagaaggttgtggtacggtt

SEQ ID NO: 109442 - DNA, 23 bp, Homo sapiens
tatgtaatagtatttgggttggg

SEQ ID NO: 109443 - DNA, 23 bp, Homo sapiens
tgtcttgttatagctgtctgtgt

SEQ ID NO: 109444 - DNA, 20 bp, Homo sapiens
agcacccagcttaatttatg

SEQ ID NO: 109445 - DNA, 23 bp, Homo sapiens
gagacagagtctcactgtgtcat

SEQ ID NO: 109446 - DNA, 23 bp, Homo sapiens
atgtgtccaagtatatacatgat

SEQ ID NO: 109447 - DNA, 23 bp, Homo sapiens
tttctctctgactctaaggccca

SEQ ID NO: 109448 - DNA, 23 bp, Homo sapiens
tctgtgaagaaagtcaatggtag

SEQ ID NO: 109449 - DNA, 23 bp, Homo sapiens
tatatgtatacacacatatgtgt

SEQ ID NO: 109450 - DNA, 23 bp, Homo sapiens
aacagtgaagctgaagcagtgtc

SEQ ID NO: 109451 - DNA, 23 bp, Homo sapiens
tctgtggttgttggatgaaatgt

SEQ ID NO: 109452 - DNA, 18 bp, Homo sapiens
tttaggactagcaccagg

SEQ ID NO: 109453 - DNA, 23 bp, Homo sapiens
ctctcagtatctgactatttcct

SEQ ID NO: 109454 - DNA, 22 bp, Homo sapiens
acagagtgcagacagaggtcag

SEQ ID NO: 109455 - DNA, 23 bp, Homo sapiens
aatatggccctgtgtgttttgtg

SEQ ID NO: 109456 - DNA, 18 bp, Homo sapiens
tcacttgatgtcaggagt

SEQ ID NO: 109457 - DNA, 20 bp, Homo sapiens
gacccatttgaaaactgaga

SEQ ID NO: 109458 - DNA, 23 bp, Homo sapiens
tctcagaattcagtgtgtatagg

SEQ ID NO: 109459 - DNA, 18 bp, Homo sapiens
acatgacagtgttttctg

SEQ ID NO: 109460 - DNA, 23 bp, Homo sapiens
agacagagtctcactctatctcc

SEQ ID NO: 109461 - DNA, 19 bp, Homo sapiens
acagtggagtgatctctcg

SEQ ID NO: 109462 - DNA, 23 bp, Homo sapiens
acctactttttctctgagacctt

SEQ ID NO: 109463 - DNA, 23 bp, Homo sapiens
gtctcactctgttgctctgtcac

SEQ ID NO: 109464 - DNA, 23 bp, Homo sapiens
aggtctgtgtgacttttgctaat

SEQ ID NO: 109465 - DNA, 22 bp, Homo sapiens
tatgtatgtatgtgtgtgtgta

SEQ ID NO: 109466 - DNA, 23 bp, Homo sapiens
tcagctaggttgagacacagctg

SEQ ID NO: 109467 - DNA, 23 bp, Homo sapiens
tgtctcactctctgtctgcctct

SEQ ID NO: 109468 - DNA, 23 bp, Homo sapiens
agacaaggtctcactctgtcacc

SEQ ID NO: 109469 - DNA, 22 bp, Homo sapiens
aaagagctaggattacaggtgt

SEQ ID NO: 109470 - DNA, 23 bp, Homo sapiens
tccctgtctgactgtctgtgcca

SEQ ID NO: 109471 - DNA, 20 bp, Homo sapiens
tagtcactagttcctggctt

SEQ ID NO: 109472 - DNA, 23 bp, Homo sapiens
tgtgtatatctgctgttggttct

SEQ ID NO: 109473 - DNA, 22 bp, Homo sapiens
acaaatctgaatttgaatgtgt

SEQ ID NO: 109474 - DNA, 23 bp, Homo sapiens
gacacacactctctggtttgcca

SEQ ID NO: 109475 - DNA, 21 bp, Homo sapiens
atgtaagtcttgtcctcctct

SEQ ID NO: 109476 - DNA, 21 bp, Homo sapiens
gtgtgtgtgcacaagcctgtg

SEQ ID NO: 109477 - DNA, 22 bp, Homo sapiens
aagtcagggagggaaaacagtc

SEQ ID NO: 109478 - DNA, 23 bp, Homo sapiens
tggcacactgaaaagactgtgct

SEQ ID NO: 109479 - DNA, 23 bp, Homo sapiens
agtctccctctgtcacccaggct

SEQ ID NO: 109480 - DNA, 21 bp, Homo sapiens
tccgtatgccagtcatctggt

SEQ ID NO: 109481 - DNA, 20 bp, Homo sapiens
tgggattgctgcattttgct

SEQ ID NO: 109482 - DNA, 23 bp, Homo sapiens
tattagctggttattgtgctcgt

SEQ ID NO: 109483 - DNA, 21 bp, Homo sapiens
agagaagttggtaggaatgaa

SEQ ID NO: 109484 - DNA, 23 bp, Homo sapiens
atagatatgcatatatatacata

SEQ ID NO: 109485 - DNA, 20 bp, Homo sapiens
acacagacacatttttatat

SEQ ID NO: 109486 - DNA, 23 bp, Homo sapiens
atgtatatgtacatatgcatgtg

SEQ ID NO: 109487 - DNA, 23 bp, Homo sapiens
tctgtctcccagtctgtgtggga

SEQ ID NO: 109488 - DNA, 22 bp, Homo sapiens
tggaatgtaatgaacattgagt

SEQ ID NO: 109489 - DNA, 22 bp, Homo sapiens
ctgagtctcactctgtcgccca

SEQ ID NO: 109490 - DNA, 21 bp, Homo sapiens
cagccactctctctgcctcag

SEQ ID NO: 109491 - DNA, 20 bp, Homo sapiens
aatcagagatgacccagggt

SEQ ID NO: 109492 - DNA, 23 bp, Homo sapiens
tgagttcattgtagattctggat

SEQ ID NO: 109493 - DNA, 23 bp, Homo sapiens
tgagttcattgtagattctggat

SEQ ID NO: 109494 - DNA, 20 bp, Homo sapiens
aaatttctatttctatttca

SEQ ID NO: 109495 - DNA, 23 bp, Homo sapiens
tggaaattcacgacgacgctgac

SEQ ID NO: 109496 - DNA, 23 bp, Homo sapiens
tcagcgcctgctttgtgccattc

SEQ ID NO: 109497 - DNA, 21 bp, Homo sapiens
atgtgtatatatatatttgta

SEQ ID NO: 109498 - DNA, 23 bp, Homo sapiens
ttgagagttcagagagaggagtg

SEQ ID NO: 109499 - DNA, 23 bp, Homo sapiens
ctcactctgtcacccaagctaga

SEQ ID NO: 109500 - DNA, 23 bp, Homo sapiens
agagagacagggtctcactctgt

SEQ ID NO: 109501 - DNA, 23 bp, Homo sapiens
aaaatcagccaggcatggtggct

SEQ ID NO: 109502 - DNA, 23 bp, Homo sapiens
tgagttcattgtagattctggat

SEQ ID NO: 109503 - DNA, 23 bp, Homo sapiens
tgagttcattgtagattctggat

SEQ ID NO: 109504 - DNA, 23 bp, Homo sapiens
taagacttcctttatggtgtgtt

SEQ ID NO: 109505 - DNA, 23 bp, Homo sapiens
caatgtgtctctgagtctccgtg

SEQ ID NO: 109506 - DNA, 23 bp, Homo sapiens
tgagtctcactctgtcacccagg

SEQ ID NO: 109507 - DNA, 23 bp, Homo sapiens
aaaaaaaagaggcaccagctttg

SEQ ID NO: 109508 - DNA, 21 bp, Homo sapiens
gtctccctctgtcacccagtc

SEQ ID NO: 109509 - DNA, 18 bp, Homo sapiens
tctgtgtgtgagtgtgtg

SEQ ID NO: 109510 - DNA, 23 bp, Homo sapiens
ggtgcctctgtcagcctgtgggt

SEQ ID NO: 109511 - DNA, 23 bp, Homo sapiens
aggaatctgtgagtggcttgctg

SEQ ID NO: 109512 - DNA, 23 bp, Homo sapiens
gctcaggctctctcacagactgc

SEQ ID NO: 109513 - DNA, 23 bp, Homo sapiens
tgagcttcctctgtgtccggctc

SEQ ID NO: 109514 - DNA, 18 bp, Homo sapiens
catgaggctgtggagggt

SEQ ID NO: 109515 - DNA, 23 bp, Homo sapiens
tagtctgtgcttcttctatgtgt

SEQ ID NO: 109516 - DNA, 23 bp, Homo sapiens
ttcagtgacattttcttatggca

SEQ ID NO: 109517 - DNA, 23 bp, Homo sapiens
ctttttcaggttgagaaagttct

SEQ ID NO: 109518 - DNA, 23 bp, Homo sapiens
tgggagacttctcattttgttct

SEQ ID NO: 109519 - DNA, 23 bp, Homo sapiens
tcacacctgtaatctcagtactt

SEQ ID NO: 109520 - DNA, 21 bp, Homo sapiens
tgaggtaggaggatcagttga

SEQ ID NO: 109521 - DNA, 20 bp, Homo sapiens
cagagtctcactctgtcact

SEQ ID NO: 109522 - DNA, 23 bp, Homo sapiens
gtatgtatgtgtgtgcgtgtgtg

SEQ ID NO: 109523 - DNA, 19 bp, Homo sapiens
atgattgactggagttggt

SEQ ID NO: 109524 - DNA, 19 bp, Homo sapiens
tatgcatttcagttgccta

SEQ ID NO: 109525 - DNA, 23 bp, Homo sapiens
tgggtgagtcagtccctgtctca

SEQ ID NO: 109526 - DNA, 18 bp, Homo sapiens
ttactactgtctcagatc

SEQ ID NO: 109527 - DNA, 23 bp, Homo sapiens
cagggtctcactctgtcacccgg

SEQ ID NO: 109528 - DNA, 21 bp, Homo sapiens
tgtgtgcgtgtgtgagtgggt

SEQ ID NO: 109529 - DNA, 23 bp, Homo sapiens
actgaagaatcagagcagagcct

SEQ ID NO: 109530 - DNA, 19 bp, Homo sapiens
tgtctctccctagcttttc

SEQ ID NO: 109531 - DNA, 18 bp, Homo sapiens
acgcctgtagttccaggt

SEQ ID NO: 109532 - DNA, 18 bp, Homo sapiens
tgaggtacaaggatcaat

SEQ ID NO: 109533 - DNA, 23 bp, Homo sapiens
ctgtctctctcaccctatcctga

SEQ ID NO: 109534 - DNA, 20 bp, Homo sapiens
tcactgcaacctttgcctct

SEQ ID NO: 109535 - DNA, 19 bp, Homo sapiens
attgccagggtttttctgc

SEQ ID NO: 109536 - DNA, 22 bp, Homo sapiens
taactcaggtatagagatcctt

SEQ ID NO: 109537 - DNA, 18 bp, Homo sapiens
tatagcagcaacaggaag

SEQ ID NO: 109538 - DNA, 23 bp, Homo sapiens
ggtctcactctgtctcccaggct

SEQ ID NO: 109539 - DNA, 23 bp, Homo sapiens
tgcagacagtgaagtctctgagg

SEQ ID NO: 109540 - DNA, 23 bp, Homo sapiens
acctggataactgaaactgtctt

SEQ ID NO: 109541 - DNA, 23 bp, Homo sapiens
tgagacagtttcacactgtcacc

SEQ ID NO: 109542 - DNA, 23 bp, Homo sapiens
atggagtctcactctgtcaccca

SEQ ID NO: 109543 - DNA, 18 bp, Homo sapiens
cagtggtatgatctcagc

SEQ ID NO: 109544 - DNA, 23 bp, Homo sapiens
gacagtgtctccctctgtcaccc

SEQ ID NO: 109545 - DNA, 23 bp, Homo sapiens
tcactctctgggtcactgtgccg

SEQ ID NO: 109546 - DNA, 22 bp, Homo sapiens
accacacccagctaatcttttt

SEQ ID NO: 109547 - DNA, 23 bp, Homo sapiens
actgagtctcactctgtcgccca

SEQ ID NO: 109548 - DNA, 21 bp, Homo sapiens
tatacacacacatatatatgt

SEQ ID NO: 109549 - DNA, 19 bp, Homo sapiens
ttttttgtgttttttttga

SEQ ID NO: 109550 - DNA, 18 bp, Homo sapiens
tgcttgtagtcccagcta

SEQ ID NO: 109551 - DNA, 23 bp, Homo sapiens
acgctgaggtaggaggatcactt

SEQ ID NO: 109552 - DNA, 23 bp, Homo sapiens
tggagtctcactctgtcacccag

SEQ ID NO: 109553 - DNA, 23 bp, Homo sapiens
tgtctctccctctcattcactgg

SEQ ID NO: 109554 - DNA, 23 bp, Homo sapiens
gtgactctctgactgtgagtagt

SEQ ID NO: 109555 - DNA, 21 bp, Homo sapiens
tgaggtaggaggatcacttga

SEQ ID NO: 109556 - DNA, 23 bp, Homo sapiens
agtgcagcagcatgatcttggct

SEQ ID NO: 109557 - DNA, 23 bp, Homo sapiens
tggagtctcactctgtcacccag

SEQ ID NO: 109558 - DNA, 23 bp, Homo sapiens
agagtctcactctgtcacccagg

SEQ ID NO: 109559 - DNA, 23 bp, Homo sapiens
gagtctcactctgtcacccaggc

SEQ ID NO: 109560 - DNA, 20 bp, Homo sapiens
tctggaacagagtctcgctc

SEQ ID NO: 109561 - DNA, 23 bp, Homo sapiens
ggccgctcacactgtgtgtctcc

SEQ ID NO: 109562 - DNA, 18 bp, Homo sapiens
acgtatatatatgtgtgt

SEQ ID NO: 109563 - DNA, 23 bp, Homo sapiens
aagagcacagtcactttgactca

SEQ ID NO: 109564 - DNA, 23 bp, Homo sapiens
gtaagagaagagttctacccttt

SEQ ID NO: 109565 - DNA, 23 bp, Homo sapiens
actctatatctctctggatctca

SEQ ID NO: 109566 - DNA, 23 bp, Homo sapiens
tagcagcatgagaatggactaat

SEQ ID NO: 109567 - DNA, 23 bp, Homo sapiens
acatatatgtgtgtgtgtgtatt

SEQ ID NO: 109568 - DNA, 18 bp, Homo sapiens
tggtagtcattgctctct

SEQ ID NO: 109569 - DNA, 22 bp, Homo sapiens
gagacagtgtctcactctgttg

SEQ ID NO: 109570 - DNA, 23 bp, Homo sapiens
ttgaacactgtctgatttggtaa

SEQ ID NO: 109571 - DNA, 22 bp, Homo sapiens
tctggttgtttgaaggtgtgtg

SEQ ID NO: 109572 - DNA, 23 bp, Homo sapiens
tgagttcattgtagattctggat

SEQ ID NO: 109573 - DNA, 23 bp, Homo sapiens
tgagttcattgtagattctggat

SEQ ID NO: 109574 - DNA, 23 bp, Homo sapiens
agagtctcactctgtcacccagg

SEQ ID NO: 109575 - DNA, 23 bp, Homo sapiens
ggtctcactctgtcactcaggct

SEQ ID NO: 109576 - DNA, 23 bp, Homo sapiens
ggtttctctggttctgtcattta

SEQ ID NO: 109577 - DNA, 23 bp, Homo sapiens
ccctctcacccactctcagagct

SEQ ID NO: 109578 - DNA, 19 bp, Homo sapiens
atatctatatatagatgtg

SEQ ID NO: 109579 - DNA, 23 bp, Homo sapiens
gaaaacacaagtacatggagaag

SEQ ID NO: 109580 - DNA, 21 bp, Homo sapiens
tacacacatcttcacaaccaa

SEQ ID NO: 109581 - DNA, 23 bp, Homo sapiens
gtagctgctttggaaaacagttt

SEQ ID NO: 109582 - DNA, 23 bp, Homo sapiens
tagaatttccgtatgatccagca

SEQ ID NO: 109583 - DNA, 23 bp, Homo sapiens
atgaaaacaagattgtagttatg

SEQ ID NO: 109584 - DNA, 20 bp, Homo sapiens
tatgagtatgtatatgctca

SEQ ID NO: 109585 - DNA, 23 bp, Homo sapiens
atgtgagtatatatatatgtgtg

SEQ ID NO: 109586 - DNA, 23 bp, Homo sapiens
tttgtactttttgcttaggattg

SEQ ID NO: 109587 - DNA, 23 bp, Homo sapiens
ttctgtgaagaaaatcaatagta

SEQ ID NO: 109588 - DNA, 19 bp, Homo sapiens
gatgagagtgagctctcgc

SEQ ID NO: 109589 - DNA, 23 bp, Homo sapiens
tctctctgtgcctctgtttgcat

SEQ ID NO: 109590 - DNA, 23 bp, Homo sapiens
aagcactcatcagagggaggcat

SEQ ID NO: 109591 - DNA, 23 bp, Homo sapiens
tttacagaagaaacagaggtctc

SEQ ID NO: 109592 - DNA, 23 bp, Homo sapiens
gggctcactatcatgccacacgc

SEQ ID NO: 109593 - DNA, 22 bp, Homo sapiens
agacagaagagacagagctagg

SEQ ID NO: 109594 - DNA, 23 bp, Homo sapiens
cttcttggctcttctacctctgg

SEQ ID NO: 109595 - DNA, 23 bp, Homo sapiens
gggtctcactctgtcacccaggc

SEQ ID NO: 109596 - DNA, 23 bp, Homo sapiens
agtgagtgagtgagtgagtgagt

SEQ ID NO: 109597 - DNA, 23 bp, Homo sapiens
tctctgtagctgacactcacttc

SEQ ID NO: 109598 - DNA, 23 bp, Homo sapiens
atctaccagtgcagtttggtaga

SEQ ID NO: 109599 - DNA, 19 bp, Homo sapiens
tcacactgtgagcttttgc

SEQ ID NO: 109600 - DNA, 23 bp, Homo sapiens
ctgtcttctgtgtcgctcacact

SEQ ID NO: 109601 - DNA, 19 bp, Homo sapiens
aggcacagtggctcactcc

SEQ ID NO: 109602 - DNA, 20 bp, Homo sapiens
agaggtaggaggatcacttg

SEQ ID NO: 109603 - DNA, 20 bp, Homo sapiens
atacactcagaaatggaatt

SEQ ID NO: 109604 - DNA, 23 bp, Homo sapiens
accaccatcagtgaattttttta

SEQ ID NO: 109605 - DNA, 20 bp, Homo sapiens
tggatgaatgaatatcttga

SEQ ID NO: 109606 - DNA, 23 bp, Homo sapiens
cagtctgatgtagttcccattgc

SEQ ID NO: 109607 - DNA, 21 bp, Homo sapiens
agaggaatgaattagctcttc

SEQ ID NO: 109608 - DNA, 23 bp, Homo sapiens
tcagaaatgtgttagcatttgtt

SEQ ID NO: 109609 - DNA, 19 bp, Homo sapiens
tgaggctggctggctgctt

SEQ ID NO: 109610 - DNA, 20 bp, Homo sapiens
tacttccaggtgagtgtgag

SEQ ID NO: 109611 - DNA, 21 bp, Homo sapiens
tgaccatggctcactgcagcc

SEQ ID NO: 109612 - DNA, 23 bp, Homo sapiens
tttagtgaatttcatattttgat

SEQ ID NO: 109613 - DNA, 20 bp, Homo sapiens
tcacactcattgtctcagga

SEQ ID NO: 109614 - DNA, 21 bp, Homo sapiens
tgtgctctcactctgtctccc

SEQ ID NO: 109615 - DNA, 19 bp, Homo sapiens
aagttcatccgtgttgtag

SEQ ID NO: 109616 - DNA, 20 bp, Homo sapiens
gagctgcctagagacctcgt

SEQ ID NO: 109617 - DNA, 22 bp, Homo sapiens
attcagggggccatttttgggt

SEQ ID NO: 109618 - DNA, 18 bp, Homo sapiens
tggctagaaccacagaca

SEQ ID NO: 109619 - DNA, 19 bp, Homo sapiens
tgtgtgtatatatatgtgt

SEQ ID NO: 109620 - DNA, 22 bp, Homo sapiens
tagatctatatagatatagatc

SEQ ID NO: 109621 - DNA, 19 bp, Homo sapiens
tacactattgacaatagtg

SEQ ID NO: 109622 - DNA, 22 bp, Homo sapiens
tgtggtctgagggtatgttggc

SEQ ID NO: 109623 - DNA, 22 bp, Homo sapiens
ttttcggctgagcatgtggtta

SEQ ID NO: 109624 - DNA, 20 bp, Homo sapiens
tatgatgtatatatctgttt

SEQ ID NO: 109625 - DNA, 22 bp, Homo sapiens
tatgcatgtgtgtatacatgaa

SEQ ID NO: 109626 - DNA, 22 bp, Homo sapiens
acccttttgtagaagttagctg

SEQ ID NO: 109627 - DNA, 19 bp, Homo sapiens
atgtgtatgtagacccaca

SEQ ID NO: 109628 - DNA, 21 bp, Homo sapiens
acacacagtgtgtatgtagac

SEQ ID NO: 109629 - DNA, 23 bp, Homo sapiens
acacacagtgtgtatgtagacac

SEQ ID NO: 109630 - DNA, 23 bp, Homo sapiens
acacacacagtgtgtatgtagac

SEQ ID NO: 109631 - DNA, 23 bp, Homo sapiens
tatgtgtgtatatatatatgtgt

SEQ ID NO: 109632 - DNA, 20 bp, Homo sapiens
atattcacatatatatgtac

SEQ ID NO: 109633 - DNA, 22 bp, Homo sapiens
aatagtgtttttacatatgtca

SEQ ID NO: 109634 - DNA, 23 bp, Homo sapiens
atctatacatttaatctactaca

SEQ ID NO: 109635 - DNA, 23 bp, Homo sapiens
ttttttggttccatatgaaattt

SEQ ID NO: 109636 - DNA, 18 bp, Homo sapiens
attctgtatatattctgt

SEQ ID NO: 109637 - DNA, 23 bp, Homo sapiens
atttgtagttcaattgggattac

SEQ ID NO: 109638 - DNA, 22 bp, Homo sapiens
atataggtggttatacatatct

SEQ ID NO: 109639 - DNA, 20 bp, Homo sapiens
acctatatataaataggtag

SEQ ID NO: 109640 - DNA, 21 bp, Homo sapiens
tatgggtatatatctatatct

SEQ ID NO: 109641 - DNA, 19 bp, Homo sapiens
atataggtagatatctata

SEQ ID NO: 109642 - DNA, 22 bp, Homo sapiens
tgtgtatatatgtatatatgtg

SEQ ID NO: 109643 - DNA, 23 bp, Homo sapiens
atatgtatatatatatgtgtgtg

SEQ ID NO: 109644 - DNA, 22 bp, Homo sapiens
tatagcacttttcatactgtgt

SEQ ID NO: 109645 - DNA, 18 bp, Homo sapiens
tggcagactggaaggtgg

SEQ ID NO: 109646 - DNA, 20 bp, Homo sapiens
tgtcttcctccctgtcagac

SEQ ID NO: 109647 - DNA, 23 bp, Homo sapiens
agcattcttcagggcaatcaagt

SEQ ID NO: 109648 - DNA, 19 bp, Homo sapiens
tatgaaaagactaactgca

SEQ ID NO: 109649 - DNA, 18 bp, Homo sapiens
agtgattcatatatttgg

SEQ ID NO: 109650 - DNA, 23 bp, Homo sapiens
tgagttcattgtagattctggat

SEQ ID NO: 109651 - DNA, 23 bp, Homo sapiens
tgagttcattgtagattctggat

SEQ ID NO: 109652 - DNA, 23 bp, Homo sapiens
actctggacatggaagtgtgagt

SEQ ID NO: 109653 - DNA, 23 bp, Homo sapiens
tagcatgattctttttcttcttc

SEQ ID NO: 109654 - DNA, 23 bp, Homo sapiens
tgagttcattgtagattctggat

SEQ ID NO: 109655 - DNA, 23 bp, Homo sapiens
tgagttcattgtagattctggat

SEQ ID NO: 109656 - DNA, 21 bp, Homo sapiens
atgaatatatacatgtatgta

SEQ ID NO: 109657 - DNA, 21 bp, Homo sapiens
atatgtatatatgtatatatg

SEQ ID NO: 109658 - DNA, 23 bp, Homo sapiens
tggctgtctctctgtcacttggc

SEQ ID NO: 109659 - DNA, 23 bp, Homo sapiens
agagtctgtgcttaggcaggtgg

SEQ ID NO: 109660 - DNA, 23 bp, Homo sapiens
tgagtctagagagagaggatagg

SEQ ID NO: 109661 - DNA, 23 bp, Homo sapiens
ttcttcccacaggcacctcagac

SEQ ID NO: 109662 - DNA, 22 bp, Homo sapiens
tttagttattcaggataggatg

SEQ ID NO: 109663 - DNA, 22 bp, Homo sapiens
ttattcagagagaaaaagttct

SEQ ID NO: 109664 - DNA, 23 bp, Homo sapiens
agagtctcacactgcctctcctg

SEQ ID NO: 109665 - DNA, 23 bp, Homo sapiens
tgtccgcctctgtgcctcgctct

SEQ ID NO: 109666 - DNA, 23 bp, Homo sapiens
tgtagagtgtggaattcatctgg

SEQ ID NO: 109667 - DNA, 19 bp, Homo sapiens
aaagagtgcctcattttct

SEQ ID NO: 109668 - DNA, 23 bp, Homo sapiens
acgcagtctcgctctgtcaccca

SEQ ID NO: 109669 - DNA, 19 bp, Homo sapiens
gggtctctctctgcctctc

SEQ ID NO: 109670 - DNA, 23 bp, Homo sapiens
agatggagtctcactctgtcacc

SEQ ID NO: 109671 - DNA, 23 bp, Homo sapiens
cagtggtgtgatcttggctcact

SEQ ID NO: 109672 - DNA, 23 bp, Homo sapiens
agtctcatcaactccctgtctac

SEQ ID NO: 109673 - DNA, 23 bp, Homo sapiens
agactgggtctgtctgtgactct

SEQ ID NO: 109674 - DNA, 22 bp, Homo sapiens
agtctcgctctgtcactcaggc

SEQ ID NO: 109675 - DNA, 23 bp, Homo sapiens
agagaccagtttagatgctgttg

SEQ ID NO: 109676 - DNA, 23 bp, Homo sapiens
tggagtctcactctgtcacccag

SEQ ID NO: 109677 - DNA, 23 bp, Homo sapiens
gtgacaaaagcgaaactccgtct

SEQ ID NO: 109678 - DNA, 21 bp, Homo sapiens
agagtcccactctgtcaccca

SEQ ID NO: 109679 - DNA, 19 bp, Homo sapiens
aaccactctctccaatgtc

SEQ ID NO: 109680 - DNA, 23 bp, Homo sapiens
tacatgtatatatacatatgtgt

SEQ ID NO: 109681 - DNA, 20 bp, Homo sapiens
tctctatcactggattccca

SEQ ID NO: 109682 - DNA, 23 bp, Homo sapiens
tgagtaggggaaacagtgatatt

SEQ ID NO: 109683 - DNA, 23 bp, Homo sapiens
tgtaattcaggatctaaaacttt

SEQ ID NO: 109684 - DNA, 22 bp, Homo sapiens
taacacggtgcatatatcctgt

SEQ ID NO: 109685 - DNA, 23 bp, Homo sapiens
tttttggttccatatgaaattta

SEQ ID NO: 109686 - DNA, 21 bp, Homo sapiens
tgtgatgaaggtcaatggtag

SEQ ID NO: 109687 - DNA, 23 bp, Homo sapiens
cagtctgctactattttgttgag

SEQ ID NO: 109688 - DNA, 23 bp, Homo sapiens
gttcatcagtgatattgtagttt

SEQ ID NO: 109689 - DNA, 19 bp, Homo sapiens
caagtctctcctggctccg

SEQ ID NO: 109690 - DNA, 23 bp, Homo sapiens
atgtatgtgtatgtatatgtgtg

SEQ ID NO: 109691 - DNA, 20 bp, Homo sapiens
tatacacacacacatacatg

SEQ ID NO: 109692 - DNA, 23 bp, Homo sapiens
tgagttcattgtagattctggat

SEQ ID NO: 109693 - DNA, 23 bp, Homo sapiens
tgagttcattgtagattctggat

SEQ ID NO: 109694 - DNA, 19 bp, Homo sapiens
tctttagatatcagattgg

SEQ ID NO: 109695 - DNA, 21 bp, Homo sapiens
tgtgaccctggaaatgttatc

SEQ ID NO: 109696 - DNA, 19 bp, Homo sapiens
gtgtgtgtgtatgcacgtg

SEQ ID NO: 109697 - DNA, 22 bp, Homo sapiens
gattgcaaagatccacgggaga

SEQ ID NO: 109698 - DNA, 23 bp, Homo sapiens
tgagttcattgtagattctggat

SEQ ID NO: 109699 - DNA, 23 bp, Homo sapiens
tgagttcattgtagattctggat

SEQ ID NO: 109700 - DNA, 19 bp, Homo sapiens
tatgtatctgtatatatgt

SEQ ID NO: 109701 - DNA, 23 bp, Homo sapiens
gtatcagtatatgtatatatgta

SEQ ID NO: 109702 - DNA, 21 bp, Homo sapiens
tacacgtatatatgtatatgt

SEQ ID NO: 109703 - DNA, 18 bp, Homo sapiens
agacagtttgaggttaca

SEQ ID NO: 109704 - DNA, 19 bp, Homo sapiens
agacagatgattgagagga

SEQ ID NO: 109705 - DNA, 23 bp, Homo sapiens
tacctaggagtggaaatgttgag

SEQ ID NO: 109706 - DNA, 23 bp, Homo sapiens
tgtctggatgaagtggaaccctt

SEQ ID NO: 109707 - DNA, 23 bp, Homo sapiens
catacaggattacatttgctggg

SEQ ID NO: 109708 - DNA, 23 bp, Homo sapiens
caactaagtgaatgctagttgtt

SEQ ID NO: 109709 - DNA, 22 bp, Homo sapiens
tgcttcagagctctgttctcag

SEQ ID NO: 109710 - DNA, 23 bp, Homo sapiens
gtatatatatgtatggaaatata

SEQ ID NO: 109711 - DNA, 20 bp, Homo sapiens
gtatatatacatatgtgtat

SEQ ID NO: 109712 - DNA, 23 bp, Homo sapiens
tgtatgtatatatgtatatatgt

SEQ ID NO: 109713 - DNA, 23 bp, Homo sapiens
acacacagagacatatatatgtg

SEQ ID NO: 109714 - DNA, 23 bp, Homo sapiens
atagagagtccagagtgaccaca

SEQ ID NO: 109715 - DNA, 22 bp, Homo sapiens
atatatgtgtgtatatatatgt

SEQ ID NO: 109716 - DNA, 23 bp, Homo sapiens
tcagctagatctaggtgcatttc

SEQ ID NO: 109717 - DNA, 23 bp, Homo sapiens
ctgaagactatctgaagaactga

SEQ ID NO: 109718 - DNA, 23 bp, Homo sapiens
agactgagttcagctgttcttcc

SEQ ID NO: 109719 - DNA, 21 bp, Homo sapiens
acaactgctctcagaccagaa

SEQ ID NO: 109720 - DNA, 19 bp, Homo sapiens
tgacatgaagcacacaact

SEQ ID NO: 109721 - DNA, 23 bp, Homo sapiens
tgagttcattgtagattctggat

SEQ ID NO: 109722 - DNA, 23 bp, Homo sapiens
tgagttcattgtagattctggat

SEQ ID NO: 109723 - DNA, 21 bp, Homo sapiens
gacccagtaagattaaatgga

SEQ ID NO: 109724 - DNA, 23 bp, Homo sapiens
tcacttcactctctctcagagaa

SEQ ID NO: 109725 - DNA, 23 bp, Homo sapiens
agacggagtctcactctgtcacc

SEQ ID NO: 109726 - DNA, 23 bp, Homo sapiens
tttttggttggtagagatgtgaa

SEQ ID NO: 109727 - DNA, 23 bp, Homo sapiens
gttttgtgtatggtatgggatag

SEQ ID NO: 109728 - DNA, 23 bp, Homo sapiens
tgagatgaagtctcactctgtca

SEQ ID NO: 109729 - DNA, 23 bp, Homo sapiens
aggctgaggtaggagaatgtcgt

SEQ ID NO: 109730 - DNA, 22 bp, Homo sapiens
gagcatgtatatagctatgttt

SEQ ID NO: 109731 - DNA, 21 bp, Homo sapiens
tgggtgagtcagtgagtgagt

SEQ ID NO: 109732 - DNA, 23 bp, Homo sapiens
tggctcactgcaagctctgtctc

SEQ ID NO: 109733 - DNA, 23 bp, Homo sapiens
tgtgtgtgtgcatgtgcatgtgt

SEQ ID NO: 109734 - DNA, 23 bp, Homo sapiens
cggagtctcactctgtcacccag

SEQ ID NO: 109735 - DNA, 19 bp, Homo sapiens
gaatgaaaccatgtctctc

SEQ ID NO: 109736 - DNA, 20 bp, Homo sapiens
tggaaggatcacttgtaccc

SEQ ID NO: 109737 - DNA, 21 bp, Homo sapiens
tgacaagtgtagagcattagt

SEQ ID NO: 109738 - DNA, 23 bp, Homo sapiens
gacagattctcactctgtcactt

SEQ ID NO: 109739 - DNA, 18 bp, Homo sapiens
taggttctcttaaggaaa

SEQ ID NO: 109740 - DNA, 23 bp, Homo sapiens
aatctcagttgttaacttttttt

SEQ ID NO: 109741 - DNA, 23 bp, Homo sapiens
gacagagtctcgctctgtcaccc

SEQ ID NO: 109742 - DNA, 23 bp, Homo sapiens
acaatgctactctcactctccta

SEQ ID NO: 109743 - DNA, 23 bp, Homo sapiens
ctcattgtggttttgatttgcat

SEQ ID NO: 109744 - DNA, 22 bp, Homo sapiens
tatttgttcgtcatttctgttt

SEQ ID NO: 109745 - DNA, 23 bp, Homo sapiens
tcacttctgattatgttgttttg

SEQ ID NO: 109746 - DNA, 23 bp, Homo sapiens
tgagttcattgtagattctggat

SEQ ID NO: 109747 - DNA, 23 bp, Homo sapiens
tgagttcattgtagattctggat

SEQ ID NO: 109748 - DNA, 23 bp, Homo sapiens
tatctgtctggtagaattctcac

SEQ ID NO: 109749 - DNA, 23 bp, Homo sapiens
tgtgtgtgtgattttgcatgtgc

SEQ ID NO: 109750 - DNA, 23 bp, Homo sapiens
agtctcacacactattacaagtc

SEQ ID NO: 109751 - DNA, 23 bp, Homo sapiens
gagtctcactctgtcacccaggc

SEQ ID NO: 109752 - DNA, 21 bp, Homo sapiens
attccccttgatgtttctgct

SEQ ID NO: 109753 - DNA, 23 bp, Homo sapiens
gagagcaaagttgaaaggggcag

SEQ ID NO: 109754 - DNA, 23 bp, Homo sapiens
tgggtcagaatttgtatccatta

SEQ ID NO: 109755 - DNA, 23 bp, Homo sapiens
tgaggtaggaggatcacttgagc

SEQ ID NO: 109756 - DNA, 23 bp, Homo sapiens
tggagtctcactctgtcacccag

SEQ ID NO: 109757 - DNA, 19 bp, Homo sapiens
actgcaacctctgcttcct

SEQ ID NO: 109758 - DNA, 21 bp, Homo sapiens
tgtttcaactgctggctgact

SEQ ID NO: 109759 - DNA, 22 bp, Homo sapiens
atacacacatatatatgtgtat

SEQ ID NO: 109760 - DNA, 23 bp, Homo sapiens
aatatgtacaaagtgcttagaac

SEQ ID NO: 109761 - DNA, 23 bp, Homo sapiens
gtgtctgtgagagtatttccaga

SEQ ID NO: 109762 - DNA, 23 bp, Homo sapiens
gagactgaggagagataggctct

SEQ ID NO: 109763 - DNA, 22 bp, Homo sapiens
agttgagggagcaagttctttt

SEQ ID NO: 109764 - DNA, 23 bp, Homo sapiens
tctctgtcagtccattttctatg

SEQ ID NO: 109765 - DNA, 19 bp, Homo sapiens
tcagggagccagtatgggt

SEQ ID NO: 109766 - DNA, 23 bp, Homo sapiens
tgacagagagctcactcactcag

SEQ ID NO: 109767 - DNA, 23 bp, Homo sapiens
tgaactcagtgaggtaggtctgt

SEQ ID NO: 109768 - DNA, 19 bp, Homo sapiens
atcctgcaggtaataaatg

SEQ ID NO: 109769 - DNA, 23 bp, Homo sapiens
ggaagagtctcactctgtcaccc

SEQ ID NO: 109770 - DNA, 22 bp, Homo sapiens
agtatcagtctttttcatgagt

SEQ ID NO: 109771 - DNA, 23 bp, Homo sapiens
aaatctgtgaccatctgtactgt

SEQ ID NO: 109772 - DNA, 23 bp, Homo sapiens
ttgaggaatgaagtagaacttaa

SEQ ID NO: 109773 - DNA, 19 bp, Homo sapiens
tgtgtgtgtgtatatatac

SEQ ID NO: 109774 - DNA, 23 bp, Homo sapiens
actaagtctcactctgtcgccca

SEQ ID NO: 109775 - DNA, 23 bp, Homo sapiens
tgactgtcagtcattctgtctgt

SEQ ID NO: 109776 - DNA, 21 bp, Homo sapiens
tcccacagagcagtgctgaga

SEQ ID NO: 109777 - DNA, 19 bp, Homo sapiens
caacatagtgagactccat

SEQ ID NO: 109778 - DNA, 23 bp, Homo sapiens
gacagggtctcactctgtcaccc

SEQ ID NO: 109779 - DNA, 22 bp, Homo sapiens
tatgtatatatatacacgtatt

SEQ ID NO: 109780 - DNA, 23 bp, Homo sapiens
tatttgcacattgattttgtatc

SEQ ID NO: 109781 - DNA, 21 bp, Homo sapiens
tccttcactgtctctttcact

SEQ ID NO: 109782 - DNA, 22 bp, Homo sapiens
tttcaccatgttgaccaggctg

SEQ ID NO: 109783 - DNA, 20 bp, Homo sapiens
agtctcgctctgtcgctcag

SEQ ID NO: 109784 - DNA, 19 bp, Homo sapiens
tcatcctgtgactcagtct

SEQ ID NO: 109785 - DNA, 23 bp, Homo sapiens
gtctctctctctctctgtgctga

SEQ ID NO: 109786 - DNA, 18 bp, Homo sapiens
tacatacatagtgtgtgt

SEQ ID NO: 109787 - DNA, 23 bp, Homo sapiens
tgagttcattgtagattctggat

SEQ ID NO: 109788 - DNA, 23 bp, Homo sapiens
tgagttcattgtagattctggat

SEQ ID NO: 109789 - DNA, 23 bp, Homo sapiens
ttattttgttattgcaggagtag

SEQ ID NO: 109790 - DNA, 22 bp, Homo sapiens
ttctcttgcaattgaaatctta

SEQ ID NO: 109791 - DNA, 23 bp, Homo sapiens
gacagagtctcgctctgtcaccc

SEQ ID NO: 109792 - DNA, 23 bp, Homo sapiens
acagagtctcgctctgtcaccca

SEQ ID NO: 109793 - DNA, 22 bp, Homo sapiens
taatttgtagtataagaaagca

SEQ ID NO: 109794 - DNA, 23 bp, Homo sapiens
ttttgtatttaaatgtaatgaca

SEQ ID NO: 109795 - DNA, 20 bp, Homo sapiens
tggagcatcagaaacggctt

SEQ ID NO: 109796 - DNA, 22 bp, Homo sapiens
agaggaagtagcttgtgaagtt

SEQ ID NO: 109797 - DNA, 23 bp, Homo sapiens
tactgagagaaatatgtgagctc

SEQ ID NO: 109798 - DNA, 22 bp, Homo sapiens
tctcatgttcatcaggaggttt

SEQ ID NO: 109799 - DNA, 18 bp, Homo sapiens
tgtttgtcagatatggct

SEQ ID NO: 109800 - DNA, 20 bp, Homo sapiens
tatgtgtgtgtatatatata

SEQ ID NO: 109801 - DNA, 23 bp, Homo sapiens
agtttcctgtagatgggatttag

SEQ ID NO: 109802 - DNA, 21 bp, Homo sapiens
tatgtgtgtatatatatgtgt

SEQ ID NO: 109803 - DNA, 23 bp, Homo sapiens
tgagttcattgtagattctggat

SEQ ID NO: 109804 - DNA, 23 bp, Homo sapiens
tgagttcattgtagattctggat

SEQ ID NO: 109805 - DNA, 23 bp, Homo sapiens
tgagttcattgtagattctggat

SEQ ID NO: 109806 - DNA, 23 bp, Homo sapiens
tgagttcattgtagattctggat

SEQ ID NO: 109807 - DNA, 19 bp, Homo sapiens
aggagcagaatctgatgat

SEQ ID NO: 109808 - DNA, 21 bp, Homo sapiens
tttgagatggagtctagctct

SEQ ID NO: 109809 - DNA, 20 bp, Homo sapiens
gtgttgaagaggaatggtga

SEQ ID NO: 109810 - DNA, 18 bp, Homo sapiens
ttcagcattatgttggct

SEQ ID NO: 109811 - DNA, 18 bp, Homo sapiens
accccaaccacattctct

SEQ ID NO: 109812 - DNA, 23 bp, Homo sapiens
tgtcaaaagtgagtgtggtcttg

SEQ ID NO: 109813 - DNA, 23 bp, Homo sapiens
tgagttcattgtagattctggat

SEQ ID NO: 109814 - DNA, 23 bp, Homo sapiens
agaagtcatgctggagaggctgg

SEQ ID NO: 109815 - DNA, 23 bp, Homo sapiens
caaaacaaggggtattgtttttg

SEQ ID NO: 109816 - DNA, 23 bp, Homo sapiens
atagactctagtgtatgtgtgta

SEQ ID NO: 109817 - DNA, 23 bp, Homo sapiens
tctcagacttctggtctctctct

SEQ ID NO: 109818 - DNA, 23 bp, Homo sapiens
tctcacagtctctgtgggtcagg

SEQ ID NO: 109819 - DNA, 23 bp, Homo sapiens
gggtgtgtatatgtatgtgtgtg

SEQ ID NO: 109820 - DNA, 21 bp, Homo sapiens
tctcctctttctggatgctca

SEQ ID NO: 109821 - DNA, 23 bp, Homo sapiens
tgaggctagaaacagagctggaa

SEQ ID NO: 109822 - DNA, 19 bp, Homo sapiens
tgcatagaaataaatgtgt

SEQ ID NO: 109823 - DNA, 22 bp, Homo sapiens
gagtctcactctgtggctcagg

SEQ ID NO: 109824 - DNA, 23 bp, Homo sapiens
cacactgtgaaatagtattcaga

SEQ ID NO: 109825 - DNA, 18 bp, Homo sapiens
gcagtgcttgattcaaca

SEQ ID NO: 109826 - DNA, 23 bp, Homo sapiens
tgactgtacacactgaggtgtac

SEQ ID NO: 109827 - DNA, 23 bp, Homo sapiens
tgacagtcacataggtgtaacag

SEQ ID NO: 109828 - DNA, 21 bp, Homo sapiens
agctgcattgaccatgaactt

SEQ ID NO: 109829 - DNA, 23 bp, Homo sapiens
tgtagcagcatttgaatggcttc

SEQ ID NO: 109830 - DNA, 20 bp, Homo sapiens
tattccatgttttatgtaga

SEQ ID NO: 109831 - DNA, 23 bp, Homo sapiens
gagtctacatattatatgtatgg

SEQ ID NO: 109832 - DNA, 21 bp, Homo sapiens
tgatattctcttcctttcaag

SEQ ID NO: 109833 - DNA, 22 bp, Homo sapiens
agtgtgaaaaagttgtagagac

SEQ ID NO: 109834 - DNA, 23 bp, Homo sapiens
cagagctctgtttctgtgactta

SEQ ID NO: 109835 - DNA, 23 bp, Homo sapiens
actgatggaggttaacatatggg

SEQ ID NO: 109836 - DNA, 23 bp, Homo sapiens
ttacttggattagttctgtattt

SEQ ID NO: 109837 - DNA, 23 bp, Homo sapiens
taatactgcatctttatatgtgt

SEQ ID NO: 109838 - DNA, 22 bp, Homo sapiens
tgtatgtatatatacatgtatg

SEQ ID NO: 109839 - DNA, 20 bp, Homo sapiens
ctgtcaacatttcgtactgc

SEQ ID NO: 109840 - DNA, 23 bp, Homo sapiens
ggaggactgatgatagagaggac

SEQ ID NO: 109841 - DNA, 23 bp, Homo sapiens
catatatgtagatgatatagatt

SEQ ID NO: 109842 - DNA, 23 bp, Homo sapiens
ataagctgcttgatgattgctct

SEQ ID NO: 109843 - DNA, 21 bp, Homo sapiens
aaaagagacaagggtggtggt

SEQ ID NO: 109844 - DNA, 23 bp, Homo sapiens
ggctcactgattggctcacagtt

SEQ ID NO: 109845 - DNA, 21 bp, Homo sapiens
gtctcactgtcactcaggctg

SEQ ID NO: 109846 - DNA, 23 bp, Homo sapiens
tagctcactgccatgtgagagtg

SEQ ID NO: 109847 - DNA, 23 bp, Homo sapiens
tgagacaggctctgactctgtca

SEQ ID NO: 109848 - DNA, 23 bp, Homo sapiens
cagagtctcactctgtcatccag

SEQ ID NO: 109849 - DNA, 22 bp, Homo sapiens
atgtgagtagagactcttagag

SEQ ID NO: 109850 - DNA, 22 bp, Homo sapiens
tgagaaagagactgctcataga

SEQ ID NO: 109851 - DNA, 23 bp, Homo sapiens
tgtgattctatttgtctgtctgt

SEQ ID NO: 109852 - DNA, 18 bp, Homo sapiens
attcagtgttacttacaa

SEQ ID NO: 109853 - DNA, 23 bp, Homo sapiens
tttagtgcaataattggcatgtc

SEQ ID NO: 109854 - DNA, 22 bp, Homo sapiens
atatgtatatatatgtgtgtgt

SEQ ID NO: 109855 - DNA, 23 bp, Homo sapiens
ctaagtctcgctctgtcacccac

SEQ ID NO: 109856 - DNA, 20 bp, Homo sapiens
atggaatatttttccattgt

SEQ ID NO: 109857 - DNA, 23 bp, Homo sapiens
ggaagaaaaactttacatgctga

SEQ ID NO: 109858 - DNA, 19 bp, Homo sapiens
gaggaatacaaagcagatg

SEQ ID NO: 109859 - DNA, 23 bp, Homo sapiens
ttgtgtctgtttgtgtatatatg

SEQ ID NO: 109860 - DNA, 23 bp, Homo sapiens
gtgtatatatattcattatgata

SEQ ID NO: 109861 - DNA, 23 bp, Homo sapiens
tggagtctcactctgtcacccag

SEQ ID NO: 109862 - DNA, 23 bp, Homo sapiens
tgtgtttgtgtgtgcatgtgtat

SEQ ID NO: 109863 - DNA, 20 bp, Homo sapiens
atatacacacctatacatat

SEQ ID NO: 109864 - DNA, 22 bp, Homo sapiens
tgtatgtatatatgtatagatt

SEQ ID NO: 109865 - DNA, 18 bp, Homo sapiens
aaaagagaacagggtggg

SEQ ID NO: 109866 - DNA, 22 bp, Homo sapiens
tgcatgcaggtttccaagtcca

SEQ ID NO: 109867 - DNA, 19 bp, Homo sapiens
ttggatgcatggatgtccg

SEQ ID NO: 109868 - DNA, 23 bp, Homo sapiens
tatggtatgatatgatttgtgta

SEQ ID NO: 109869 - DNA, 23 bp, Homo sapiens
aatgattttatatatgtgtgtgt

SEQ ID NO: 109870 - DNA, 23 bp, Homo sapiens
ctcactgtctcagtgattggttt

SEQ ID NO: 109871 - DNA, 19 bp, Homo sapiens
taatgctgagagtggggga

SEQ ID NO: 109872 - DNA, 23 bp, Homo sapiens
tgtcacagtgactgtgattccca

SEQ ID NO: 109873 - DNA, 20 bp, Homo sapiens
ttgagtcacagtaagcttga

SEQ ID NO: 109874 - DNA, 23 bp, Homo sapiens
tgagaagactgagagcagagaga

SEQ ID NO: 109875 - DNA, 23 bp, Homo sapiens
tctagactcaccttctctaatca

SEQ ID NO: 109876 - DNA, 21 bp, Homo sapiens
caccaacagtgtaaaagtgtt

SEQ ID NO: 109877 - DNA, 23 bp, Homo sapiens
ttcatctattcatgcttctcact

SEQ ID NO: 109878 - DNA, 23 bp, Homo sapiens
ctcagcatttcagcaggtactgc

SEQ ID NO: 109879 - DNA, 23 bp, Homo sapiens
gagtctcactctgtcacccaggc

SEQ ID NO: 109880 - DNA, 21 bp, Homo sapiens
atctaccatgttaaaggcctt

SEQ ID NO: 109881 - DNA, 23 bp, Homo sapiens
tgagtctcactctgtcacccagg

SEQ ID NO: 109882 - DNA, 23 bp, Homo sapiens
ttgctttgtaaagttgaaagtat

SEQ ID NO: 109883 - DNA, 23 bp, Homo sapiens
actgagtctcgctctgtcaccca

SEQ ID NO: 109884 - DNA, 21 bp, Homo sapiens
agtgcaacagcaagatttcgg

SEQ ID NO: 109885 - DNA, 23 bp, Homo sapiens
tagtatgtacttacctaatcagt

SEQ ID NO: 109886 - DNA, 20 bp, Homo sapiens
aaaaggtggttattttaggc

SEQ ID NO: 109887 - DNA, 23 bp, Homo sapiens
acagagtctcactctgtcgccca

SEQ ID NO: 109888 - DNA, 21 bp, Homo sapiens
atggaagaaaatggaatgtcc

SEQ ID NO: 109889 - DNA, 20 bp, Homo sapiens
tgaggtaggaggatcacttg

SEQ ID NO: 109890 - DNA, 20 bp, Homo sapiens
tgtgttgtatggacctagtt

SEQ ID NO: 109891 - DNA, 22 bp, Homo sapiens
actctcagagtgaggttagaga

SEQ ID NO: 109892 - DNA, 22 bp, Homo sapiens
tatcactctgaagagtgagtga

SEQ ID NO: 109893 - DNA, 23 bp, Homo sapiens
tttgagacagggtcttactctgt

SEQ ID NO: 109894 - DNA, 18 bp, Homo sapiens
cagtggcatgatcatgtc

SEQ ID NO: 109895 - DNA, 21 bp, Homo sapiens
tttgtaattgcttctggagac

SEQ ID NO: 109896 - DNA, 22 bp, Homo sapiens
tttgtgtatatatatatgtgtg

SEQ ID NO: 109897 - DNA, 23 bp, Homo sapiens
actgtctctgtctctgtttatcc

SEQ ID NO: 109898 - DNA, 23 bp, Homo sapiens
gtgtatatgcatgtgtgtgtata

SEQ ID NO: 109899 - DNA, 23 bp, Homo sapiens
tggaagagtttgtggtaaggttg

SEQ ID NO: 109900 - DNA, 22 bp, Homo sapiens
ggtctcactctgtcacccagct

SEQ ID NO: 109901 - DNA, 20 bp, Homo sapiens
tctgtgtgcactgtgtgcac

SEQ ID NO: 109902 - DNA, 23 bp, Homo sapiens
attgttggatttgatttgctatg

SEQ ID NO: 109903 - DNA, 23 bp, Homo sapiens
agggtctcactctgtcatttagg

SEQ ID NO: 109904 - DNA, 18 bp, Homo sapiens
cctgtaatctcagctact

SEQ ID NO: 109905 - DNA, 23 bp, Homo sapiens
tgagaagactgacattgtttttc

SEQ ID NO: 109906 - DNA, 21 bp, Homo sapiens
ttctgcattcaatatgttgta

SEQ ID NO: 109907 - DNA, 23 bp, Homo sapiens
tgtttttgtccttctgattggaa

SEQ ID NO: 109908 - DNA, 20 bp, Homo sapiens
tttcaaacagaagggatttg

SEQ ID NO: 109909 - DNA, 23 bp, Homo sapiens
tatatgtgcatatgtatgtgtat

SEQ ID NO: 109910 - DNA, 23 bp, Homo sapiens
tgcagtggcatgatcttggctca

SEQ ID NO: 109911 - DNA, 23 bp, Homo sapiens
tggagtctcactctgtcacccag

SEQ ID NO: 109912 - DNA, 23 bp, Homo sapiens
gtgtgatcttggctcactgcaac

SEQ ID NO: 109913 - DNA, 18 bp, Homo sapiens
tgcccattgaatgtgatg

SEQ ID NO: 109914 - DNA, 23 bp, Homo sapiens
ctcccagagcccctggaactctg

SEQ ID NO: 109915 - DNA, 23 bp, Homo sapiens
tcccagagcccctggaactctgg

SEQ ID NO: 109916 - DNA, 23 bp, Homo sapiens
tcccagagcccctggaactctgg

SEQ ID NO: 109917 - DNA, 23 bp, Homo sapiens
tcccagagcccctggaactctgg

SEQ ID NO: 109918 - DNA, 23 bp, Homo sapiens
attctgttaggttttctacatgt

SEQ ID NO: 109919 - DNA, 23 bp, Homo sapiens
tgatcagtctcgctctgtcgctc

SEQ ID NO: 109920 - DNA, 23 bp, Homo sapiens
aggctgtgagccaagattgtgcc

SEQ ID NO: 109921 - DNA, 23 bp, Homo sapiens
tgtctcagtcactctgtgctgtt

SEQ ID NO: 109922 - DNA, 23 bp, Homo sapiens
atttcatctgattttgtttatgt

SEQ ID NO: 109923 - DNA, 23 bp, Homo sapiens
tgggcctgagtttggtgctgtag

SEQ ID NO: 109924 - DNA, 21 bp, Homo sapiens
cctctcggtcactgggtccca

SEQ ID NO: 109925 - DNA, 20 bp, Homo sapiens
tgtcagactgattcttttct

SEQ ID NO: 109926 - DNA, 18 bp, Homo sapiens
atctatttaagccttagt

SEQ ID NO: 109927 - DNA, 18 bp, Homo sapiens
ctctctcagtccctctgg

SEQ ID NO: 109928 - DNA, 23 bp, Homo sapiens
tggagtctcactctgtcacccag

SEQ ID NO: 109929 - DNA, 20 bp, Homo sapiens
aaactgaaaatacagagcag

SEQ ID NO: 109930 - DNA, 21 bp, Homo sapiens
atacacacacatatatgtatg

SEQ ID NO: 109931 - DNA, 23 bp, Homo sapiens
tggagtctcactctgtcactcag

SEQ ID NO: 109932 - DNA, 21 bp, Homo sapiens
attgagagccatagtgttttc

SEQ ID NO: 109933 - DNA, 23 bp, Homo sapiens
taaggttgatattgttatgtgtg

SEQ ID NO: 109934 - DNA, 23 bp, Homo sapiens
gtgccagggtgcctgcctctgtg

SEQ ID NO: 109935 - DNA, 19 bp, Homo sapiens
tggcttggtgtcttaactc

SEQ ID NO: 109936 - DNA, 21 bp, Homo sapiens
attttgaagcatatgatataa

SEQ ID NO: 109937 - DNA, 19 bp, Homo sapiens
cacacttctctctctctct

SEQ ID NO: 109938 - DNA, 22 bp, Homo sapiens
ctttcacgaaatgcttctgagc

SEQ ID NO: 109939 - DNA, 22 bp, Homo sapiens
tttttagtatttctaatactca

SEQ ID NO: 109940 - DNA, 23 bp, Homo sapiens
tcccagagcccctggaactctgg

SEQ ID NO: 109941 - DNA, 23 bp, Homo sapiens
tcccagagcccctggaactctgg

SEQ ID NO: 109942 - DNA, 23 bp, Homo sapiens
tcccagagcccctggaactctgg

SEQ ID NO: 109943 - DNA, 23 bp, Homo sapiens
aagagtctatgcagtcagagttg

SEQ ID NO: 109944 - DNA, 23 bp, Homo sapiens
tctgtctttttcactgttgttac

SEQ ID NO: 109945 - DNA, 23 bp, Homo sapiens
actggagaagcagcttggtttct

SEQ ID NO: 109946 - DNA, 23 bp, Homo sapiens
ctcagtctgtcactctgccttat

SEQ ID NO: 109947 - DNA, 23 bp, Homo sapiens
tatatatgtgtatgtatatgcat

SEQ ID NO: 109948 - DNA, 23 bp, Homo sapiens
tatacgtatatatgcgtgtgtat

SEQ ID NO: 109949 - DNA, 23 bp, Homo sapiens
tatacgtatatatgcgtatgtat

SEQ ID NO: 109950 - DNA, 23 bp, Homo sapiens
gtttgtgtttaaggaactggttc

SEQ ID NO: 109951 - DNA, 23 bp, Homo sapiens
atgtgtgtatatatgtgtgtgtg

SEQ ID NO: 109952 - DNA, 23 bp, Homo sapiens
tggagtctcactctgtcacccag

SEQ ID NO: 109953 - DNA, 20 bp, Homo sapiens
attgcacagatgggtgccct

SEQ ID NO: 109954 - DNA, 23 bp, Homo sapiens
tcagtcactctgtgcctccctga

SEQ ID NO: 109955 - DNA, 18 bp, Homo sapiens
tatctatgtatgtgtgtg

SEQ ID NO: 109956 - DNA, 23 bp, Homo sapiens
agacagagtctcactctgtcacc

SEQ ID NO: 109957 - DNA, 19 bp, Homo sapiens
acagtgagctgtctcagcc

SEQ ID NO: 109958 - DNA, 18 bp, Homo sapiens
tgttttctatgccacaga

SEQ ID NO: 109959 - DNA, 23 bp, Homo sapiens
tctctctgacacactctcctttt

SEQ ID NO: 109960 - DNA, 21 bp, Homo sapiens
tatacacacacatatatatgt

SEQ ID NO: 109961 - DNA, 23 bp, Homo sapiens
tatatgtatatatatatgtgtgt

SEQ ID NO: 109962 - DNA, 23 bp, Homo sapiens
aggagattgaggttgcagacaga

SEQ ID NO: 109963 - DNA, 20 bp, Homo sapiens
ctctggctgtgtgtcacctt

SEQ ID NO: 109964 - DNA, 22 bp, Homo sapiens
ctcttgctctctctgtgaagaa

SEQ ID NO: 109965 - DNA, 23 bp, Homo sapiens
gacagagtctcgctctgtcaccc

SEQ ID NO: 109966 - DNA, 23 bp, Homo sapiens
agcctggctcagtgcctgcttgc

SEQ ID NO: 109967 - DNA, 23 bp, Homo sapiens
tgagtcactctgtctttggtgcc

SEQ ID NO: 109968 - DNA, 23 bp, Homo sapiens
tgagttcattgtagattctggat

SEQ ID NO: 109969 - DNA, 23 bp, Homo sapiens
tgagttcattgtagattctggat

SEQ ID NO: 109970 - DNA, 23 bp, Homo sapiens
gtgcctggctctgtgccacaggc

SEQ ID NO: 109971 - DNA, 20 bp, Homo sapiens
ctgtctagtttgctgattga

SEQ ID NO: 109972 - DNA, 23 bp, Homo sapiens
taggtctctgagtcaatggtgca

SEQ ID NO: 109973 - DNA, 20 bp, Homo sapiens
tttttaacttcaggaactga

SEQ ID NO: 109974 - DNA, 23 bp, Homo sapiens
tctctcacacacacacaactgcg

SEQ ID NO: 109975 - DNA, 20 bp, Homo sapiens
aactccatctcaaaaacaaa

SEQ ID NO: 109976 - DNA, 23 bp, Homo sapiens
tgagttcattgtagattctggat

SEQ ID NO: 109977 - DNA, 23 bp, Homo sapiens
tgagttcattgtagattctggat

SEQ ID NO: 109978 - DNA, 23 bp, Homo sapiens
tacactactgtcattgttcttgt

SEQ ID NO: 109979 - DNA, 23 bp, Homo sapiens
tatgtgtatatatatgtatgtct

SEQ ID NO: 109980 - DNA, 23 bp, Homo sapiens
aggctccctgtgtccctctaggc

SEQ ID NO: 109981 - DNA, 21 bp, Homo sapiens
tctggctcggagcctgggtga

SEQ ID NO: 109982 - DNA, 23 bp, Homo sapiens
tgaacatgtctgagagtcattgc

SEQ ID NO: 109983 - DNA, 23 bp, Homo sapiens
actctctgtgagtcaagcctttg

SEQ ID NO: 109984 - DNA, 22 bp, Homo sapiens
agagagtgtgctcagaggcctg

SEQ ID NO: 109985 - DNA, 21 bp, Homo sapiens
atatatatatatgtatacgta

SEQ ID NO: 109986 - DNA, 22 bp, Homo sapiens
atgtgtgtatatatatagatgt

SEQ ID NO: 109987 - DNA, 22 bp, Homo sapiens
tatgtgtatatatatgtctgtg

SEQ ID NO: 109988 - DNA, 21 bp, Homo sapiens
tgggtcagtgaaactaggagg

SEQ ID NO: 109989 - DNA, 23 bp, Homo sapiens
tgagttcattgtagattctggat

SEQ ID NO: 109990 - DNA, 23 bp, Homo sapiens
tgagttcattgtagattctggat

SEQ ID NO: 109991 - DNA, 22 bp, Homo sapiens
tctttccaaagccagaccaggg

SEQ ID NO: 109992 - DNA, 23 bp, Homo sapiens
tgtccctctgtcaccctcaccct

SEQ ID NO: 109993 - DNA, 23 bp, Homo sapiens
ccgagtctcactctgtcacccag

SEQ ID NO: 109994 - DNA, 20 bp, Homo sapiens
acacagtctcactttgtcac

SEQ ID NO: 109995 - DNA, 23 bp, Homo sapiens
gtaatttgttgaatactgtactg

SEQ ID NO: 109996 - DNA, 23 bp, Homo sapiens
ttgtagatttgtgatttactagg

SEQ ID NO: 109997 - DNA, 18 bp, Homo sapiens
tgtcactggttctgaaga

SEQ ID NO: 109998 - DNA, 23 bp, Homo sapiens
tgtctcactgtcttactggatat

SEQ ID NO: 109999 - DNA, 23 bp, Homo sapiens
atatgtgtatatatatatgtgta

SEQ ID NO: 110000 - DNA, 23 bp, Homo sapiens
tgagttcattgtagattctggat

SEQ ID NO: 110001 - DNA, 23 bp, Homo sapiens
tgagttcattgtagattctggat

SEQ ID NO: 110002 - DNA, 23 bp, Homo sapiens
atattgaattcttgtgattttgt

SEQ ID NO: 110003 - DNA, 19 bp, Homo sapiens
gtagagagtgtggaaaggt

SEQ ID NO: 110004 - DNA, 21 bp, Homo sapiens
tgtgagagcaggtgcatcagg

SEQ ID NO: 110005 - DNA, 21 bp, Homo sapiens
agaatcaaggtctcccaggca

SEQ ID NO: 110006 - DNA, 23 bp, Homo sapiens
tctctctcactcacacttcggag

SEQ ID NO: 110007 - DNA, 23 bp, Homo sapiens
cacctctctctgtgtctctgtgg

SEQ ID NO: 110008 - DNA, 22 bp, Homo sapiens
aggtgtgagtcattgctcctgg

SEQ ID NO: 110009 - DNA, 23 bp, Homo sapiens
agagacagggtctcactctgttt

SEQ ID NO: 110010 - DNA, 22 bp, Homo sapiens
tttgtctctggctctgttccac

SEQ ID NO: 110011 - DNA, 23 bp, Homo sapiens
tgagttcattgtagattctggat

SEQ ID NO: 110012 - DNA, 23 bp, Homo sapiens
tgagttcattgtagattctggat

SEQ ID NO: 110013 - DNA, 23 bp, Homo sapiens
gaggttgagagaagctgattgag

SEQ ID NO: 110014 - DNA, 23 bp, Homo sapiens
cagatggtgtctctctctgtcgc

SEQ ID NO: 110015 - DNA, 23 bp, Homo sapiens
gacagagtctcgctctgtcaccc

SEQ ID NO: 110016 - DNA, 23 bp, Homo sapiens
tgtgtgtgtgtatgtatatatat

SEQ ID NO: 110017 - DNA, 23 bp, Homo sapiens
gtatatatgtatatatacatatg

SEQ ID NO: 110018 - DNA, 19 bp, Homo sapiens
tatgcgtatatatacacat

SEQ ID NO: 110019 - DNA, 22 bp, Homo sapiens
aatttgtggaatgtaatcatat

SEQ ID NO: 110020 - DNA, 23 bp, Homo sapiens
gagtctcactctgtcacccaggc

SEQ ID NO: 110021 - DNA, 18 bp, Homo sapiens
tgtggtacaatgtgaaaa

SEQ ID NO: 110022 - DNA, 22 bp, Homo sapiens
tttacagtgctttagaagagaa

SEQ ID NO: 110023 - DNA, 19 bp, Homo sapiens
tatatatgtatgtatacac

SEQ ID NO: 110024 - DNA, 23 bp, Homo sapiens
aaacatgctatttttgtacttgt

SEQ ID NO: 110025 - DNA, 22 bp, Homo sapiens
acatgtgcagaatgtgcaggtt

SEQ ID NO: 110026 - DNA, 23 bp, Homo sapiens
tgagttcattgtagattctggat

SEQ ID NO: 110027 - DNA, 23 bp, Homo sapiens
tgagttcattgtagattctggat

SEQ ID NO: 110028 - DNA, 18 bp, Homo sapiens
tgtataaatatatgtgac

SEQ ID NO: 110029 - DNA, 23 bp, Homo sapiens
acagagtctcactgtgtcaccag

SEQ ID NO: 110030 - DNA, 23 bp, Homo sapiens
tgagttcattgtagattctggat

SEQ ID NO: 110031 - DNA, 23 bp, Homo sapiens
tgagttcattgtagattctggat

SEQ ID NO: 110032 - DNA, 21 bp, Homo sapiens
ttttatgttttaaacaaagga

SEQ ID NO: 110033 - DNA, 23 bp, Homo sapiens
tgtgtgtgtatatctcatagata

SEQ ID NO: 110034 - DNA, 21 bp, Homo sapiens
tatgtgtgtgtatatatatac

SEQ ID NO: 110035 - DNA, 23 bp, Homo sapiens
ggatgtgtgtacatatgtatagt

SEQ ID NO: 110036 - DNA, 21 bp, Homo sapiens
tatgtgtgtatatatacgtat

SEQ ID NO: 110037 - DNA, 18 bp, Homo sapiens
ctacctggtaaccttggt

SEQ ID NO: 110038 - DNA, 23 bp, Homo sapiens
cagtagtgggaatactggatcat

SEQ ID NO: 110039 - DNA, 20 bp, Homo sapiens
actatcaggaagaaaaatgg

SEQ ID NO: 110040 - DNA, 23 bp, Homo sapiens
aggttctctctctgtcatcctgg

SEQ ID NO: 110041 - DNA, 23 bp, Homo sapiens
tatatacacgtacatatatgtct

SEQ ID NO: 110042 - DNA, 20 bp, Homo sapiens
atacatacacaaacatatgt

SEQ ID NO: 110043 - DNA, 22 bp, Homo sapiens
acttctgaggtattcatgttca

SEQ ID NO: 110044 - DNA, 22 bp, Homo sapiens
aaataggactatttatagatct

SEQ ID NO: 110045 - DNA, 20 bp, Homo sapiens
tagataggactatttataga

SEQ ID NO: 110046 - DNA, 23 bp, Homo sapiens
agcagcatttctgattattttct

SEQ ID NO: 110047 - DNA, 23 bp, Homo sapiens
tatggcagaggatgaagtgtgac

SEQ ID NO: 110048 - DNA, 23 bp, Homo sapiens
tgagttcattgtagattctggat

SEQ ID NO: 110049 - DNA, 23 bp, Homo sapiens
tgagttcattgtagattctggat

SEQ ID NO: 110050 - DNA, 23 bp, Homo sapiens
cactccctctgtcacacactctg

SEQ ID NO: 110051 - DNA, 23 bp, Homo sapiens
ttttttagatggagttttgctct

SEQ ID NO: 110052 - DNA, 19 bp, Homo sapiens
tttgtttgtttgttttcgt

SEQ ID NO: 110053 - DNA, 23 bp, Homo sapiens
aaatagcatgtttacaaatacaa

SEQ ID NO: 110054 - DNA, 23 bp, Homo sapiens
tctgtccctgagtctctggctgg

SEQ ID NO: 110055 - DNA, 23 bp, Homo sapiens
tgagttcattgtagattctggat

SEQ ID NO: 110056 - DNA, 23 bp, Homo sapiens
tgagttcattgtagattctggat

SEQ ID NO: 110057 - DNA, 22 bp, Homo sapiens
tagagacagggtgacatacggg

SEQ ID NO: 110058 - DNA, 23 bp, Homo sapiens
cctgactctctccctgacatatt

SEQ ID NO: 110059 - DNA, 23 bp, Homo sapiens
gtcaccagactatgacatgacag

SEQ ID NO: 110060 - DNA, 23 bp, Homo sapiens
agtctgtcacatttgcttgatat

SEQ ID NO: 110061 - DNA, 23 bp, Homo sapiens
tgcctctctgtcactcttgctgc

SEQ ID NO: 110062 - DNA, 18 bp, Homo sapiens
gatccagctttgcatgta

SEQ ID NO: 110063 - DNA, 23 bp, Homo sapiens
agtcaacatgtaggttgttttca

SEQ ID NO: 110064 - DNA, 23 bp, Homo sapiens
aagatcagtgattttgtagttat

SEQ ID NO: 110065 - DNA, 23 bp, Homo sapiens
tttgctgcaaaactgatttctct

SEQ ID NO: 110066 - DNA, 23 bp, Homo sapiens
ttcttgactccttagcttgcaga

SEQ ID NO: 110067 - DNA, 23 bp, Homo sapiens
ttcacattttgatcatgtgagtc

SEQ ID NO: 110068 - DNA, 20 bp, Homo sapiens
tgctgctgggaatgtgcact

SEQ ID NO: 110069 - DNA, 23 bp, Homo sapiens
gtgactctctgcatgtgcatgtc

SEQ ID NO: 110070 - DNA, 21 bp, Homo sapiens
aatgtatagatatatatgtgt

SEQ ID NO: 110071 - DNA, 23 bp, Homo sapiens
acactaactctctgtgccatgca

SEQ ID NO: 110072 - DNA, 23 bp, Homo sapiens
tgagcctggaagttctttttgta

SEQ ID NO: 110073 - DNA, 23 bp, Homo sapiens
tgagttcattgtagattctggat

SEQ ID NO: 110074 - DNA, 23 bp, Homo sapiens
tgagttcattgtagattctggat

SEQ ID NO: 110075 - DNA, 22 bp, Homo sapiens
atgtatgtatatatgtatgtat

SEQ ID NO: 110076 - DNA, 23 bp, Homo sapiens
atgtatatgtgtatgtatatgtg

SEQ ID NO: 110077 - DNA, 23 bp, Homo sapiens
tgagttcattgtagattctggat

SEQ ID NO: 110078 - DNA, 23 bp, Homo sapiens
tgagttcattgtagattctggat

SEQ ID NO: 110079 - DNA, 18 bp, Homo sapiens
tggctcactgcaagctcc

SEQ ID NO: 110080 - DNA, 23 bp, Homo sapiens
gacagagtctcgctctgtcaccc

SEQ ID NO: 110081 - DNA, 20 bp, Homo sapiens
atgactcacactcaagtatt

SEQ ID NO: 110082 - DNA, 23 bp, Homo sapiens
ttttctttttgagatggagtctc

SEQ ID NO: 110083 - DNA, 23 bp, Homo sapiens
ccatgacagaacacacagaggac

SEQ ID NO: 110084 - DNA, 23 bp, Homo sapiens
atgcagcaacatgtttttgatgt

SEQ ID NO: 110085 - DNA, 18 bp, Homo sapiens
aatacacttgcaaatatg

SEQ ID NO: 110086 - DNA, 23 bp, Homo sapiens
gtctttggttttctgcctgtaca

SEQ ID NO: 110087 - DNA, 23 bp, Homo sapiens
tgtatgtgtgtgtatatatatac

SEQ ID NO: 110088 - DNA, 19 bp, Homo sapiens
tgggccacagttttttttc

SEQ ID NO: 110089 - DNA, 23 bp, Homo sapiens
atgtttgtgtgcatgtgtgtgtg

SEQ ID NO: 110090 - DNA, 21 bp, Homo sapiens
gagtggcatgatcttggctca

SEQ ID NO: 110091 - DNA, 23 bp, Homo sapiens
tatctggaactacaggtgtgtgc

SEQ ID NO: 110092 - DNA, 23 bp, Homo sapiens
attagaactgctagacgtgcaca

SEQ ID NO: 110093 - DNA, 23 bp, Homo sapiens
tcttaccttgacactccatgaca

SEQ ID NO: 110094 - DNA, 23 bp, Homo sapiens
tgattaagtgtctgatttatgtc

SEQ ID NO: 110095 - DNA, 23 bp, Homo sapiens
taagtctctctcctgtctcagtc

SEQ ID NO: 110096 - DNA, 23 bp, Homo sapiens
tccctgggtctctgcctctctca

SEQ ID NO: 110097 - DNA, 20 bp, Homo sapiens
aaagtcagtggtagcttgat

SEQ ID NO: 110098 - DNA, 23 bp, Homo sapiens
acagagtctccctctgtcgctca

SEQ ID NO: 110099 - DNA, 23 bp, Homo sapiens
tctgtccctcgctctgtcagccc

SEQ ID NO: 110100 - DNA, 21 bp, Homo sapiens
aacacagttgacagtgtgcag

SEQ ID NO: 110101 - DNA, 23 bp, Homo sapiens
tgactctcagactgacatggtgg

SEQ ID NO: 110102 - DNA, 23 bp, Homo sapiens
gacagagtctcgctctgtcaccc

SEQ ID NO: 110103 - DNA, 23 bp, Homo sapiens
agtctttctttgtctctctgagg

SEQ ID NO: 110104 - DNA, 22 bp, Homo sapiens
gccctgccactcactggctgtg

SEQ ID NO: 110105 - DNA, 23 bp, Homo sapiens
tgtctctcactcaccgtctctgc

SEQ ID NO: 110106 - DNA, 23 bp, Homo sapiens
ttgtctccctctctctgtggctg

SEQ ID NO: 110107 - DNA, 23 bp, Homo sapiens
tacagttgtgagacaccacacaa

SEQ ID NO: 110108 - DNA, 21 bp, Homo sapiens
agagatgatgtcttggtatgt

SEQ ID NO: 110109 - DNA, 20 bp, Homo sapiens
tgagttctctgcctgcctgt

SEQ ID NO: 110110 - DNA, 21 bp, Homo sapiens
ttctttgtgtcttcatggggg

SEQ ID NO: 110111 - DNA, 23 bp, Homo sapiens
ctgtctgttactcactgtgcctc

SEQ ID NO: 110112 - DNA, 20 bp, Homo sapiens
acactcagggacagttgtgt

SEQ ID NO: 110113 - DNA, 22 bp, Homo sapiens
tctcacaagagacagagctcag

SEQ ID NO: 110114 - DNA, 23 bp, Homo sapiens
caaacttcctgtacaggaggctg

SEQ ID NO: 110115 - DNA, 23 bp, Homo sapiens
tgagacagtctgacactctgacc

SEQ ID NO: 110116 - DNA, 22 bp, Homo sapiens
atatgtgtgtatatatatgtgt

SEQ ID NO: 110117 - DNA, 23 bp, Homo sapiens
atatgtgtatatgtgtatgtgtg

SEQ ID NO: 110118 - DNA, 22 bp, Homo sapiens
agtgcagtggcatcatgatctc

SEQ ID NO: 110119 - DNA, 23 bp, Homo sapiens
tcataatctgtttttctaatagg

SEQ ID NO: 110120 - DNA, 21 bp, Homo sapiens
tttggcttctattgttgctgt

SEQ ID NO: 110121 - DNA, 23 bp, Homo sapiens
tgagttcattgtagattctggat

SEQ ID NO: 110122 - DNA, 23 bp, Homo sapiens
tgagttcattgtagattctggat

SEQ ID NO: 110123 - DNA, 23 bp, Homo sapiens
tatgtgtctgtgtttatatatac

SEQ ID NO: 110124 - DNA, 19 bp, Homo sapiens
gtatataaatatgtataca

SEQ ID NO: 110125 - DNA, 23 bp, Homo sapiens
attttagacattttgttttcttt

SEQ ID NO: 110126 - DNA, 23 bp, Homo sapiens
agggtctcactctgtcacccaga

SEQ ID NO: 110127 - DNA, 23 bp, Homo sapiens
ataatgatgatgatgatgatgat

SEQ ID NO: 110128 - DNA, 23 bp, Homo sapiens
tgtcacacacggcctgagtgcct

SEQ ID NO: 110129 - DNA, 23 bp, Homo sapiens
tggagtctcactctgtcacccag

SEQ ID NO: 110130 - DNA, 23 bp, Homo sapiens
cagggtctcactctgtcacccag

SEQ ID NO: 110131 - DNA, 19 bp, Homo sapiens
tatatctacacatggaaat

SEQ ID NO: 110132 - DNA, 18 bp, Homo sapiens
agcctgagaatggactaa

SEQ ID NO: 110133 - DNA, 23 bp, Homo sapiens
tgacactgtgggtcactccctgt

SEQ ID NO: 110134 - DNA, 22 bp, Homo sapiens
aggggaccagctgctggagcag

SEQ ID NO: 110135 - DNA, 19 bp, Homo sapiens
tcacacactgtcatcttcc

SEQ ID NO: 110136 - DNA, 19 bp, Homo sapiens
tgcagtgaaccgagattgt

SEQ ID NO: 110137 - DNA, 23 bp, Homo sapiens
acagtgagaccctctctctctct

SEQ ID NO: 110138 - DNA, 18 bp, Homo sapiens
tttcaccatgttggccag

SEQ ID NO: 110139 - DNA, 23 bp, Homo sapiens
gggtctcactctgtcacccaggc

SEQ ID NO: 110140 - DNA, 22 bp, Homo sapiens
agtctcacagtgttttaggtgg

SEQ ID NO: 110141 - DNA, 22 bp, Homo sapiens
ctgtctgtttctgtgggtgtag

SEQ ID NO: 110142 - DNA, 21 bp, Homo sapiens
agagtctcactctgtcaccca

SEQ ID NO: 110143 - DNA, 23 bp, Homo sapiens
agagtctcactctgtcacccagg

SEQ ID NO: 110144 - DNA, 19 bp, Homo sapiens
tcacctccgctttgtgcca

SEQ ID NO: 110145 - DNA, 23 bp, Homo sapiens
tgagtctcactcacagtttgcca

SEQ ID NO: 110146 - DNA, 23 bp, Homo sapiens
ggctctctgtctcagagtctgtc

SEQ ID NO: 110147 - DNA, 23 bp, Homo sapiens
gagtctctctctgtcactcaggc

SEQ ID NO: 110148 - DNA, 21 bp, Homo sapiens
tttgttcttggacccatggtg

SEQ ID NO: 110149 - DNA, 23 bp, Homo sapiens
tacagtcagcatacatagagact

SEQ ID NO: 110150 - DNA, 23 bp, Homo sapiens
tcactgggtcagtctctgtcttt

SEQ ID NO: 110151 - DNA, 21 bp, Homo sapiens
aaacattatatatatatgtgt

SEQ ID NO: 110152 - DNA, 23 bp, Homo sapiens
tatatatgtatatgtatatgact

SEQ ID NO: 110153 - DNA, 23 bp, Homo sapiens
gaggctcgctgagtaaagtctgt

SEQ ID NO: 110154 - DNA, 23 bp, Homo sapiens
gacagagtctcgctctgtcaccc

SEQ ID NO: 110155 - DNA, 23 bp, Homo sapiens
tatgctggaccaggaatgtgtgt

SEQ ID NO: 110156 - DNA, 22 bp, Homo sapiens
gcttggctggctggctggctct

SEQ ID NO: 110157 - DNA, 23 bp, Homo sapiens
tatacttatctatgtatatgtgt

SEQ ID NO: 110158 - DNA, 18 bp, Homo sapiens
tgtgtgtatatgtatgtg

SEQ ID NO: 110159 - DNA, 23 bp, Homo sapiens
acacttgtgtctctctcaccttg

SEQ ID NO: 110160 - DNA, 23 bp, Homo sapiens
tgaatgagatgactgtcagcaca

SEQ ID NO: 110161 - DNA, 21 bp, Homo sapiens
agtgctggttgtgatggggaa

SEQ ID NO: 110162 - DNA, 22 bp, Homo sapiens
aggatagtgcctggaatgtagg

SEQ ID NO: 110163 - DNA, 22 bp, Homo sapiens
atcacgtagacttctgcatcct

SEQ ID NO: 110164 - DNA, 23 bp, Homo sapiens
cctgtctccctgtgagtctgtct

SEQ ID NO: 110165 - DNA, 23 bp, Homo sapiens
atgtgtatacatgtatatatgta

SEQ ID NO: 110166 - DNA, 22 bp, Homo sapiens
tgacactgcagctccaccagct

SEQ ID NO: 110167 - DNA, 23 bp, Homo sapiens
aagtgaagatgggaaagggtgag

SEQ ID NO: 110168 - DNA, 23 bp, Homo sapiens
gtctcttcctctctctttgtgga

SEQ ID NO: 110169 - DNA, 23 bp, Homo sapiens
cagagtctcactctgtcacccag

SEQ ID NO: 110170 - DNA, 20 bp, Homo sapiens
cagtggctgaatccagctat

SEQ ID NO: 110171 - DNA, 23 bp, Homo sapiens
atctctggttctgtctctctgtg

SEQ ID NO: 110172 - DNA, 21 bp, Homo sapiens
tgtgtatatgtatgtgtgtgt

SEQ ID NO: 110173 - DNA, 23 bp, Homo sapiens
tatgtatgtgtatatgtataggt

SEQ ID NO: 110174 - DNA, 21 bp, Homo sapiens
tctgtggaagtgttctgaatt

SEQ ID NO: 110175 - DNA, 23 bp, Homo sapiens
ttctgtgaagaaagtcaatggta

SEQ ID NO: 110176 - DNA, 22 bp, Homo sapiens
tatcagcttcaagccagtgcct

SEQ ID NO: 110177 - DNA, 23 bp, Homo sapiens
tcacaaacagcttctgcatgtgc

SEQ ID NO: 110178 - DNA, 23 bp, Homo sapiens
gggtctcactctgtcacccaggc

SEQ ID NO: 110179 - DNA, 19 bp, Homo sapiens
agcctgcctgtgtgtgaac

SEQ ID NO: 110180 - DNA, 23 bp, Homo sapiens
gagtgagagtactgagacagtag

SEQ ID NO: 110181 - DNA, 23 bp, Homo sapiens
gactgagtctcgctctgtcaccc

SEQ ID NO: 110182 - DNA, 23 bp, Homo sapiens
tgtcacagatgagactttggatg

SEQ ID NO: 110183 - DNA, 23 bp, Homo sapiens
tgacagtgactctgtccctgact

SEQ ID NO: 110184 - DNA, 21 bp, Homo sapiens
tctctgagcctcagacattat

SEQ ID NO: 110185 - DNA, 23 bp, Homo sapiens
cacagtgtctccctgtgtctgtc

SEQ ID NO: 110186 - DNA, 21 bp, Homo sapiens
tgtgccactgtactgcagcct

SEQ ID NO: 110187 - DNA, 23 bp, Homo sapiens
gaatctcactctgtcacccaggc

SEQ ID NO: 110188 - DNA, 23 bp, Homo sapiens
ctgtctacaacgtggtctttttc

SEQ ID NO: 110189 - DNA, 23 bp, Homo sapiens
aagagagtcatactatttttgtt

SEQ ID NO: 110190 - DNA, 22 bp, Homo sapiens
agacacaaagtagaagccatga

SEQ ID NO: 110191 - DNA, 21 bp, Homo sapiens
ttctccattatgatgagttgt

SEQ ID NO: 110192 - DNA, 23 bp, Homo sapiens
taattatttcattatgtattaca

SEQ ID NO: 110193 - DNA, 23 bp, Homo sapiens
aataaagtgcacaatagatgtaa

SEQ ID NO: 110194 - DNA, 23 bp, Homo sapiens
atatgtatagttgtagtttatcc

SEQ ID NO: 110195 - DNA, 23 bp, Homo sapiens
ttctgtgaagaaagtcaatggta

SEQ ID NO: 110196 - DNA, 23 bp, Homo sapiens
tggagtctcactctgtcacccag

SEQ ID NO: 110197 - DNA, 21 bp, Homo sapiens
tttttcttttttgagataggg

SEQ ID NO: 110198 - DNA, 23 bp, Homo sapiens
tctgcaactttactgaatttgtt

SEQ ID NO: 110199 - DNA, 19 bp, Homo sapiens
tctcgctatgttttccagg

SEQ ID NO: 110200 - DNA, 22 bp, Homo sapiens
gagtgacttgactgaggtcaca

SEQ ID NO: 110201 - DNA, 23 bp, Homo sapiens
tgagttcattgtagattctggat

SEQ ID NO: 110202 - DNA, 23 bp, Homo sapiens
tgagttcattgtagattctggat

SEQ ID NO: 110203 - DNA, 23 bp, Homo sapiens
acagagtctcactgtgtccccca

SEQ ID NO: 110204 - DNA, 22 bp, Homo sapiens
aacctgaaacaccttctcgctg

SEQ ID NO: 110205 - DNA, 23 bp, Homo sapiens
tgtgaagcgtgtgactcagcctg

SEQ ID NO: 110206 - DNA, 21 bp, Homo sapiens
gacgctggtagtgagttctct

SEQ ID NO: 110207 - DNA, 21 bp, Homo sapiens
tctcactggctcagtggcacc

SEQ ID NO: 110208 - DNA, 23 bp, Homo sapiens
cctgtgtgacagtcagactctgt

SEQ ID NO: 110209 - DNA, 22 bp, Homo sapiens
tgtgacagcttcttgatctgtc

SEQ ID NO: 110210 - DNA, 23 bp, Homo sapiens
tgaggaatatttgagatcttcag

SEQ ID NO: 110211 - DNA, 23 bp, Homo sapiens
gagtctcactctgtcacccaggc

SEQ ID NO: 110212 - DNA, 23 bp, Homo sapiens
gggtctcactctgtcacccaggc

SEQ ID NO: 110213 - DNA, 20 bp, Homo sapiens
tgcagtggcatgatcttggc

SEQ ID NO: 110214 - DNA, 23 bp, Homo sapiens
ggctccctgactcactggctggg

SEQ ID NO: 110215 - DNA, 23 bp, Homo sapiens
agcactgttgctctctctctctt

SEQ ID NO: 110216 - DNA, 23 bp, Homo sapiens
cctgtctgtgtgactctcaggga

SEQ ID NO: 110217 - DNA, 23 bp, Homo sapiens
gctcaggctggcactcatcccag

SEQ ID NO: 110218 - DNA, 23 bp, Homo sapiens
gcagtgtgtctctctgtcacccc

SEQ ID NO: 110219 - DNA, 22 bp, Homo sapiens
ataagaagtctagagattggtt

SEQ ID NO: 110220 - DNA, 23 bp, Homo sapiens
ctgacagcttctctctctctctg

SEQ ID NO: 110221 - DNA, 22 bp, Homo sapiens
ctgtgacagaagacagcctcca

SEQ ID NO: 110222 - DNA, 20 bp, Homo sapiens
atgtttgaagatgtgagcaa

SEQ ID NO: 110223 - DNA, 23 bp, Homo sapiens
attgagacggagttttgctctta

SEQ ID NO: 110224 - DNA, 20 bp, Homo sapiens
ttacacagcctctcagtgcc

SEQ ID NO: 110225 - DNA, 23 bp, Homo sapiens
tgtgggtatatatatgtatgtgt

SEQ ID NO: 110226 - DNA, 20 bp, Homo sapiens
acatatgtgtgcatatgtgt

SEQ ID NO: 110227 - DNA, 23 bp, Homo sapiens
tgtgtatgtatatgtatgtgtat

SEQ ID NO: 110228 - DNA, 23 bp, Homo sapiens
tatgggtatatatatgtatgtgt

SEQ ID NO: 110229 - DNA, 23 bp, Homo sapiens
agagtctcactctgtcacccagg

SEQ ID NO: 110230 - DNA, 23 bp, Homo sapiens
ccctcagtgtgtgcctgtgtcct

SEQ ID NO: 110231 - DNA, 21 bp, Homo sapiens
gtctgcctgtctgtctgtgtc

SEQ ID NO: 110232 - DNA, 23 bp, Homo sapiens
cattgtgtgaagaaacacaggag

SEQ ID NO: 110233 - DNA, 23 bp, Homo sapiens
actctgtgagtctttttcctctc

SEQ ID NO: 110234 - DNA, 18 bp, Homo sapiens
cagcaggctagagagaag

SEQ ID NO: 110235 - DNA, 18 bp, Homo sapiens
atgcctttttgtatatgt

SEQ ID NO: 110236 - DNA, 21 bp, Homo sapiens
tatttgcaaatgtatatgcat

SEQ ID NO: 110237 - DNA, 23 bp, Homo sapiens
tctcaaagcaaatgaaatgatat

SEQ ID NO: 110238 - DNA, 23 bp, Homo sapiens
tgagttcattgtagattctggat

SEQ ID NO: 110239 - DNA, 21 bp, Homo sapiens
tgtttaaatatttagtctaga

SEQ ID NO: 110240 - DNA, 23 bp, Homo sapiens
tatatgtctgtggtatgcatgta

SEQ ID NO: 110241 - DNA, 23 bp, Homo sapiens
tgagttcattgtagattctggat

SEQ ID NO: 110242 - DNA, 23 bp, Homo sapiens
tgagttcattgtagattctggat

SEQ ID NO: 110243 - DNA, 23 bp, Homo sapiens
tggctgaagagagtgatgtcagt

SEQ ID NO: 110244 - DNA, 23 bp, Homo sapiens
agatccttgtatatgaaatcaaa

SEQ ID NO: 110245 - DNA, 23 bp, Homo sapiens
ctcaatgtggttgtgatttgcat

SEQ ID NO: 110246 - DNA, 18 bp, Homo sapiens
gaggttgcagtgagccaa

SEQ ID NO: 110247 - DNA, 23 bp, Homo sapiens
tattgccactggatgttttcagc

SEQ ID NO: 110248 - DNA, 23 bp, Homo sapiens
atactgcatgtatataggtagat

SEQ ID NO: 110249 - DNA, 23 bp, Homo sapiens
ataaatagagttttagtagttat

SEQ ID NO: 110250 - DNA, 23 bp, Homo sapiens
ggagtctcactctgtgtcccagg

SEQ ID NO: 110251 - DNA, 23 bp, Homo sapiens
tgagtctctgtctgataggttct

SEQ ID NO: 110252 - DNA, 20 bp, Homo sapiens
atatgtcaggtggggagtgt

SEQ ID NO: 110253 - DNA, 23 bp, Homo sapiens
ctttgtgtgtgtgcatgtgtgtg

SEQ ID NO: 110254 - DNA, 18 bp, Homo sapiens
atgtgtatatacatatgt

SEQ ID NO: 110255 - DNA, 23 bp, Homo sapiens
ctttaggtagtagttagtattaa

SEQ ID NO: 110256 - DNA, 23 bp, Homo sapiens
ttactacttctgccacccagaaa

SEQ ID NO: 110257 - DNA, 23 bp, Homo sapiens
gggtctcactctgtcacccaggc

SEQ ID NO: 110258 - DNA, 23 bp, Homo sapiens
tatacgtatatatacgtatgtat

SEQ ID NO: 110259 - DNA, 23 bp, Homo sapiens
atgtgagggagggtgcctgcctg

SEQ ID NO: 110260 - DNA, 23 bp, Homo sapiens
ctaagttcagcagcagcagacag

SEQ ID NO: 110261 - DNA, 23 bp, Homo sapiens
agtaacctgaggctgtctgaact

SEQ ID NO: 110262 - DNA, 23 bp, Homo sapiens
tgagttcattgtagattctggat

SEQ ID NO: 110263 - DNA, 23 bp, Homo sapiens
tgagttcattgtagattctggat

SEQ ID NO: 110264 - DNA, 23 bp, Homo sapiens
agtctgtctcttctgtagtctgg

SEQ ID NO: 110265 - DNA, 23 bp, Homo sapiens
tctagagattcgctgaagctcat

SEQ ID NO: 110266 - DNA, 23 bp, Homo sapiens
tgaggtagaaggatcagttgagg

SEQ ID NO: 110267 - DNA, 18 bp, Homo sapiens
cacaccgtctctcagaga

SEQ ID NO: 110268 - DNA, 23 bp, Homo sapiens
tatgtatatatgtatgtgtgtgt

SEQ ID NO: 110269 - DNA, 23 bp, Homo sapiens
ttagtagagagagtttcaccatg

SEQ ID NO: 110270 - DNA, 23 bp, Homo sapiens
cagtgtcattctgcatctcaaag

SEQ ID NO: 110271 - DNA, 23 bp, Homo sapiens
tacccagtctcaggttgttcttt

SEQ ID NO: 110272 - DNA, 20 bp, Homo sapiens
attgtgaaaggcattcttta

SEQ ID NO: 110273 - DNA, 21 bp, Homo sapiens
taggatcattagaaaagattc

SEQ ID NO: 110274 - DNA, 23 bp, Homo sapiens
ctgtgtgtgactgtgtgtgtgtg

SEQ ID NO: 110275 - DNA, 23 bp, Homo sapiens
gagaactgacacagctgaaggaa

SEQ ID NO: 110276 - DNA, 23 bp, Homo sapiens
actgcctgagtcactgtctctgg

SEQ ID NO: 110277 - DNA, 23 bp, Homo sapiens
atatgtctatatgtatatgtaca

SEQ ID NO: 110278 - DNA, 23 bp, Homo sapiens
atctcttacactgtatgtgtgta

SEQ ID NO: 110279 - DNA, 22 bp, Homo sapiens
ataagtgagaggtgacagtgtg

SEQ ID NO: 110280 - DNA, 20 bp, Homo sapiens
tctgtgctgaagataagcaa

SEQ ID NO: 110281 - DNA, 23 bp, Homo sapiens
ttgaagacttttgtatttctagt

SEQ ID NO: 110282 - DNA, 23 bp, Homo sapiens
cagagtctcactctgtcatccag

SEQ ID NO: 110283 - DNA, 23 bp, Homo sapiens
acagagtctcgctctgtcaccca

SEQ ID NO: 110284 - DNA, 23 bp, Homo sapiens
gatcacttagatggttacatagt

SEQ ID NO: 110285 - DNA, 22 bp, Homo sapiens
tatgtatatatgtatgtatgca

SEQ ID NO: 110286 - DNA, 23 bp, Homo sapiens
atatgtatatatgtatgtatgca

SEQ ID NO: 110287 - DNA, 21 bp, Homo sapiens
gttgagacaggcagattacct

SEQ ID NO: 110288 - DNA, 23 bp, Homo sapiens
tggctgtcagtctctgtgggaaa

SEQ ID NO: 110289 - DNA, 22 bp, Homo sapiens
atctgtatatatgtatatgata

SEQ ID NO: 110290 - DNA, 18 bp, Homo sapiens
acacgtatagtatatata

SEQ ID NO: 110291 - DNA, 19 bp, Homo sapiens
ccaggagctcacattgagt

SEQ ID NO: 110292 - DNA, 23 bp, Homo sapiens
tctacctgtctgtctcactagtt

SEQ ID NO: 110293 - DNA, 23 bp, Homo sapiens
cctgagtgagtgcacactgtgga

SEQ ID NO: 110294 - DNA, 22 bp, Homo sapiens
cttcctgcatggagtccagcca

SEQ ID NO: 110295 - DNA, 23 bp, Homo sapiens
cacagtctcactctgtcactcag

SEQ ID NO: 110296 - DNA, 23 bp, Homo sapiens
tgagttcattgtagattctggat

SEQ ID NO: 110297 - DNA, 23 bp, Homo sapiens
tgagttcattgtagattctggat

SEQ ID NO: 110298 - DNA, 23 bp, Homo sapiens
tttatggttgtatagtattccat

SEQ ID NO: 110299 - DNA, 23 bp, Homo sapiens
atgtatcacattttctttatctg

SEQ ID NO: 110300 - DNA, 23 bp, Homo sapiens
atttctatagtgtctctctgtct

SEQ ID NO: 110301 - DNA, 23 bp, Homo sapiens
tgagttcattgtagattctggat

SEQ ID NO: 110302 - DNA, 23 bp, Homo sapiens
tgagttcattgtagattctggat

SEQ ID NO: 110303 - DNA, 23 bp, Homo sapiens
aggcctatagtctcagctactca

SEQ ID NO: 110304 - DNA, 18 bp, Homo sapiens
tgaggttggaggatggat

SEQ ID NO: 110305 - DNA, 22 bp, Homo sapiens
gtactgagatacattatcagtg

SEQ ID NO: 110306 - DNA, 23 bp, Homo sapiens
tctctgatgggtatcgctcagta

SEQ ID NO: 110307 - DNA, 23 bp, Homo sapiens
tgagttcattgtagattctggat

SEQ ID NO: 110308 - DNA, 23 bp, Homo sapiens
tgagttcattgtagattctggat

SEQ ID NO: 110309 - DNA, 23 bp, Homo sapiens
cccaccctcactctctgtctccg

SEQ ID NO: 110310 - DNA, 19 bp, Homo sapiens
atgtgtgtatctatatgtg

SEQ ID NO: 110311 - DNA, 21 bp, Homo sapiens
cacacatatatatgtgtgtgt

SEQ ID NO: 110312 - DNA, 23 bp, Homo sapiens
gctctggctcagtccctgtgtgc

SEQ ID NO: 110313 - DNA, 19 bp, Homo sapiens
tgagttcttaaatgaattg

SEQ ID NO: 110314 - DNA, 23 bp, Homo sapiens
taggtacatattcatggagtatg

SEQ ID NO: 110315 - DNA, 22 bp, Homo sapiens
taattaaaggtaagtaaagaat

SEQ ID NO: 110316 - DNA, 20 bp, Homo sapiens
ctgcagtggaactaagtttt

SEQ ID NO: 110317 - DNA, 23 bp, Homo sapiens
tctacctgtctgtctcactagtt

SEQ ID NO: 110318 - DNA, 22 bp, Homo sapiens
aggcagccagtggaactggaga

SEQ ID NO: 110319 - DNA, 20 bp, Homo sapiens
acagaagtgggggtgcacag

SEQ ID NO: 110320 - DNA, 21 bp, Homo sapiens
aagaagtcttactttttagag

SEQ ID NO: 110321 - DNA, 23 bp, Homo sapiens
agttaggctttgtttactctttg

SEQ ID NO: 110322 - DNA, 20 bp, Homo sapiens
tctgcatccctccctgcctg

SEQ ID NO: 110323 - DNA, 23 bp, Homo sapiens
gtgttaggtagaaaaagcagaaa

SEQ ID NO: 110324 - DNA, 23 bp, Homo sapiens
cactctctctgtcagagtcgcct

SEQ ID NO: 110325 - DNA, 21 bp, Homo sapiens
atctgtagactgctgaatggt

SEQ ID NO: 110326 - DNA, 23 bp, Homo sapiens
aatggcatgatcttggctcagta

SEQ ID NO: 110327 - DNA, 22 bp, Homo sapiens
atttggaatgaaatggagtatg

SEQ ID NO: 110328 - DNA, 21 bp, Homo sapiens
ttggtgtgagatttgagtggg

SEQ ID NO: 110329 - DNA, 22 bp, Homo sapiens
aggaggaagacagtgtgcacac

SEQ ID NO: 110330 - DNA, 21 bp, Homo sapiens
gacacagtctctctctgtcgc

SEQ ID NO: 110331 - DNA, 23 bp, Homo sapiens
ctgtgtctccctcactcaccgac

SEQ ID NO: 110332 - DNA, 23 bp, Homo sapiens
cacacagtctcagccactttctc

SEQ ID NO: 110333 - DNA, 22 bp, Homo sapiens
actctctctctctatctgctca

SEQ ID NO: 110334 - DNA, 22 bp, Homo sapiens
tgtgagcatacagtgagatgtg

SEQ ID NO: 110335 - DNA, 23 bp, Homo sapiens
tctccctctggcactctgggcat

SEQ ID NO: 110336 - DNA, 23 bp, Homo sapiens
atcactgtgtgtgtatctactca

SEQ ID NO: 110337 - DNA, 18 bp, Homo sapiens
ctctccgactcactgccc

SEQ ID NO: 110338 - DNA, 22 bp, Homo sapiens
tctgagtgctcagagtgctcat

SEQ ID NO: 110339 - DNA, 23 bp, Homo sapiens
agttaggctttgtttactctttg

SEQ ID NO: 110340 - DNA, 18 bp, Homo sapiens
tgtttgttttgcgacaga

SEQ ID NO: 110341 - DNA, 23 bp, Homo sapiens
tgtgtgtgttggagtctcactct

SEQ ID NO: 110342 - DNA, 23 bp, Homo sapiens
tgagttcattgtagattctggat

SEQ ID NO: 110343 - DNA, 23 bp, Homo sapiens
tgagttcattgtagattctggat

SEQ ID NO: 110344 - DNA, 23 bp, Homo sapiens
ctcagggtctctgtctgacagcc

SEQ ID NO: 110345 - DNA, 19 bp, Homo sapiens
tgtctctgtgccttcctgt

SEQ ID NO: 110346 - DNA, 19 bp, Homo sapiens
ttgacagtaaggcatagtt

SEQ ID NO: 110347 - DNA, 18 bp, Homo sapiens
aggatattatatatctgt

SEQ ID NO: 110348 - DNA, 22 bp, Homo sapiens
tttggtgggtctagttgggatt

SEQ ID NO: 110349 - DNA, 23 bp, Homo sapiens
ctgaccctctctgtcactctctg

SEQ ID NO: 110350 - DNA, 23 bp, Homo sapiens
tgagtctcactctgtctcccagg

SEQ ID NO: 110351 - DNA, 21 bp, Homo sapiens
tagggtatagtagattaagaa

SEQ ID NO: 110352 - DNA, 22 bp, Homo sapiens
ttgagatggagtcttgctctgt

SEQ ID NO: 110353 - DNA, 23 bp, Homo sapiens
gtcatccatctagaatctgtttt

SEQ ID NO: 110354 - DNA, 23 bp, Homo sapiens
acagagtctcgctctgtcactca

SEQ ID NO: 110355 - DNA, 18 bp, Homo sapiens
taggagatgagtatgttt

SEQ ID NO: 110356 - DNA, 19 bp, Homo sapiens
aagagtagaatatatgtac

SEQ ID NO: 110357 - DNA, 22 bp, Homo sapiens
tagagttgtgagcactttcttt

SEQ ID NO: 110358 - DNA, 23 bp, Homo sapiens
ttagacagtctcacactattgcc

SEQ ID NO: 110359 - DNA, 22 bp, Homo sapiens
atagaatactagtttagtactt

SEQ ID NO: 110360 - DNA, 22 bp, Homo sapiens
tttagcaccatttacatgtgag

SEQ ID NO: 110361 - DNA, 20 bp, Homo sapiens
agatttcagcaccaaaatgt

SEQ ID NO: 110362 - DNA, 23 bp, Homo sapiens
atatcagaagtcactgctaatct

SEQ ID NO: 110363 - DNA, 18 bp, Homo sapiens
atgtgtgtatgcatgtat

SEQ ID NO: 110364 - DNA, 21 bp, Homo sapiens
tgaggtaggaggatcacttga

SEQ ID NO: 110365 - DNA, 20 bp, Homo sapiens
tatgtgtgtatatatgtatg

SEQ ID NO: 110366 - DNA, 21 bp, Homo sapiens
tgcatgtataaatatatgtat

SEQ ID NO: 110367 - DNA, 23 bp, Homo sapiens
tgtgtatatatgtacatatgtgt

SEQ ID NO: 110368 - DNA, 23 bp, Homo sapiens
atgtgtgtatatgtatatatgtg

SEQ ID NO: 110369 - DNA, 20 bp, Homo sapiens
acatttttttttttgctaag

SEQ ID NO: 110370 - DNA, 23 bp, Homo sapiens
taaggtagaagtagataggtgat

SEQ ID NO: 110371 - DNA, 20 bp, Homo sapiens
gtccttcttgacaggatgtg

SEQ ID NO: 110372 - DNA, 19 bp, Homo sapiens
tatctatatataaacatgt

SEQ ID NO: 110373 - DNA, 18 bp, Homo sapiens
tgattggtttttgttatt

SEQ ID NO: 110374 - DNA, 20 bp, Homo sapiens
tctgtgttttactgtctgct

SEQ ID NO: 110375 - DNA, 19 bp, Homo sapiens
agctggaacttaaaacagt

SEQ ID NO: 110376 - DNA, 23 bp, Homo sapiens
tgagttcattgtagattctggat

SEQ ID NO: 110377 - DNA, 23 bp, Homo sapiens
tgagttcattgtagattctggat

SEQ ID NO: 110378 - DNA, 23 bp, Homo sapiens
tgagttcattgtagattctggat

SEQ ID NO: 110379 - DNA, 23 bp, Homo sapiens
tgagttcattgtagattctggat

SEQ ID NO: 110380 - DNA, 22 bp, Homo sapiens
gagtctcactctgtcaccaagc

SEQ ID NO: 110381 - DNA, 21 bp, Homo sapiens
agacaaggtctcactgtcact

SEQ ID NO: 110382 - DNA, 18 bp, Homo sapiens
gggcttttattttgtcta

SEQ ID NO: 110383 - DNA, 22 bp, Homo sapiens
aaacactgaagacagagagagc

SEQ ID NO: 110384 - DNA, 21 bp, Homo sapiens
atatatgtttacatgtataca

SEQ ID NO: 110385 - DNA, 21 bp, Homo sapiens
tatgtgtatatgtatatgtat

SEQ ID NO: 110386 - DNA, 20 bp, Homo sapiens
tatgtatatgtatatgtatg

SEQ ID NO: 110387 - DNA, 23 bp, Homo sapiens
acatatgtatatgtatatgtatg

SEQ ID NO: 110388 - DNA, 20 bp, Homo sapiens
aaatgtttaatattttatgt

SEQ ID NO: 110389 - DNA, 23 bp, Homo sapiens
tcgactcactgtaacctgggtct

SEQ ID NO: 110390 - DNA, 23 bp, Homo sapiens
cagtctctcattgagtgcctgtg

SEQ ID NO: 110391 - DNA, 23 bp, Homo sapiens
agagagagtatagagagtggtgc

SEQ ID NO: 110392 - DNA, 23 bp, Homo sapiens
tatgagtgctgcctagagtttgc

SEQ ID NO: 110393 - DNA, 22 bp, Homo sapiens
tacatatatatgtagtatgtat

SEQ ID NO: 110394 - DNA, 22 bp, Homo sapiens
tcagttgcttgtgattgactaa

SEQ ID NO: 110395 - DNA, 21 bp, Homo sapiens
tgtgttctctggctcctcgag

SEQ ID NO: 110396 - DNA, 23 bp, Homo sapiens
cactgtggagatcgaggtgctac

SEQ ID NO: 110397 - DNA, 23 bp, Homo sapiens
gtgacggagtctcactctgtcac

SEQ ID NO: 110398 - DNA, 21 bp, Homo sapiens
tggtgagatcttggctcactg

SEQ ID NO: 110399 - DNA, 21 bp, Homo sapiens
gagctagtgtgatcttttggg

SEQ ID NO: 110400 - DNA, 19 bp, Homo sapiens
tgtgtatatatatatatgt

SEQ ID NO: 110401 - DNA, 22 bp, Homo sapiens
tgtgtatatatatgtatgtgta

SEQ ID NO: 110402 - DNA, 23 bp, Homo sapiens
tgaatgctatatgtttgccatgg

SEQ ID NO: 110403 - DNA, 23 bp, Homo sapiens
tgagttcattgtagattctggat

SEQ ID NO: 110404 - DNA, 23 bp, Homo sapiens
tgagttcattgtagattctggat

SEQ ID NO: 110405 - DNA, 23 bp, Homo sapiens
acacagtcaaggcactggcagac

SEQ ID NO: 110406 - DNA, 23 bp, Homo sapiens
cagtctcactctgtcacccaggc

SEQ ID NO: 110407 - DNA, 23 bp, Homo sapiens
ctgcctgcctgcctgcctgcctc

SEQ ID NO: 110408 - DNA, 23 bp, Homo sapiens
tgctatgttaagcagtatgcttg

SEQ ID NO: 110409 - DNA, 23 bp, Homo sapiens
cactgccttttttttctgaaaca

SEQ ID NO: 110410 - DNA, 21 bp, Homo sapiens
tgtatatatatatatgtgtgt

SEQ ID NO: 110411 - DNA, 22 bp, Homo sapiens
tatgtgtgtatatatatacgtg

SEQ ID NO: 110412 - DNA, 19 bp, Homo sapiens
tgtacactgagtacagagt

SEQ ID NO: 110413 - DNA, 23 bp, Homo sapiens
tgagttcattgtagattctggat

SEQ ID NO: 110414 - DNA, 23 bp, Homo sapiens
tgagttcattgtagattctggat

SEQ ID NO: 110415 - DNA, 23 bp, Homo sapiens
ctaggaacatttgagaacttgat

SEQ ID NO: 110416 - DNA, 22 bp, Homo sapiens
aagctctcagccagatttcttc

SEQ ID NO: 110417 - DNA, 18 bp, Homo sapiens
tgtctatcctttcccagg

SEQ ID NO: 110418 - DNA, 23 bp, Homo sapiens
cacacactcactccttcactctg

SEQ ID NO: 110419 - DNA, 19 bp, Homo sapiens
actgtgcctgtgtgcctcc

SEQ ID NO: 110420 - DNA, 23 bp, Homo sapiens
attcagtatatatgtatatgtga

SEQ ID NO: 110421 - DNA, 23 bp, Homo sapiens
gttgagagacaatgagctagtgt

SEQ ID NO: 110422 - DNA, 20 bp, Homo sapiens
atagctacatatgaactcaa

SEQ ID NO: 110423 - DNA, 21 bp, Homo sapiens
tgtcactctgtttccctgttc

SEQ ID NO: 110424 - DNA, 19 bp, Homo sapiens
catttgagcctcatctttt

SEQ ID NO: 110425 - DNA, 22 bp, Homo sapiens
tggcagacacttctagaagaga

SEQ ID NO: 110426 - DNA, 23 bp, Homo sapiens
actgcaaaattgttttccagaaa

SEQ ID NO: 110427 - DNA, 20 bp, Homo sapiens
atgtatgtgtgcatgtggat

SEQ ID NO: 110428 - DNA, 20 bp, Homo sapiens
atgtgtgctgtatgtggtgt

SEQ ID NO: 110429 - DNA, 21 bp, Homo sapiens
gcgagtgaagtgtgtgagggc

SEQ ID NO: 110430 - DNA, 19 bp, Homo sapiens
tgtgtatatatatacatgt

SEQ ID NO: 110431 - DNA, 22 bp, Homo sapiens
cctgtcagtctctgagtgactt

SEQ ID NO: 110432 - DNA, 22 bp, Homo sapiens
atatgattctatttatatgaaa

SEQ ID NO: 110433 - DNA, 23 bp, Homo sapiens
ggcagacagaaaatagagtggag

SEQ ID NO: 110434 - DNA, 23 bp, Homo sapiens
tatatgtgtgtatatatatgtat

SEQ ID NO: 110435 - DNA, 20 bp, Homo sapiens
ggacagttctgtgcctggag

SEQ ID NO: 110436 - DNA, 19 bp, Homo sapiens
cagccactcagaggctgag

SEQ ID NO: 110437 - DNA, 23 bp, Homo sapiens
actctctgcctgtctcagggcct

SEQ ID NO: 110438 - DNA, 19 bp, Homo sapiens
tgaggcagagtctcgctct

SEQ ID NO: 110439 - DNA, 23 bp, Homo sapiens
ttctggtggaagtctcatatgat

SEQ ID NO: 110440 - DNA, 20 bp, Homo sapiens
tcactgtcattttagtttct

SEQ ID NO: 110441 - DNA, 22 bp, Homo sapiens
ttctgcattgttcagtggaatg

SEQ ID NO: 110442 - DNA, 20 bp, Homo sapiens
acagtctcgctcagtcaccc

SEQ ID NO: 110443 - DNA, 21 bp, Homo sapiens
ttctgtgaagaaagtcagtgg

SEQ ID NO: 110444 - DNA, 19 bp, Homo sapiens
tgaggtggaaggatcattt

SEQ ID NO: 110445 - DNA, 21 bp, Homo sapiens
tatctgactcactgtttctgg

SEQ ID NO: 110446 - DNA, 21 bp, Homo sapiens
tcatctgttttggtctgggtc

SEQ ID NO: 110447 - DNA, 18 bp, Homo sapiens
ccccagcaaatcatgaga

SEQ ID NO: 110448 - DNA, 19 bp, Homo sapiens
agactgcagacagtggcca

SEQ ID NO: 110449 - DNA, 23 bp, Homo sapiens
actcccagcctgtgctctgtctg

SEQ ID NO: 110450 - DNA, 23 bp, Homo sapiens
tcttttgcagatatcccagcctg

SEQ ID NO: 110451 - DNA, 23 bp, Homo sapiens
gaatgtgtgtctgcttgtgcatg

SEQ ID NO: 110452 - DNA, 23 bp, Homo sapiens
tcagtgtccattctctctctgtg

SEQ ID NO: 110453 - DNA, 21 bp, Homo sapiens
ttcatgatattgacatgtctt

SEQ ID NO: 110454 - DNA, 23 bp, Homo sapiens
tgtgtgtgtgtgtaatagaagcc

SEQ ID NO: 110455 - DNA, 23 bp, Homo sapiens
ttctctggacaatgcttatctct

SEQ ID NO: 110456 - DNA, 23 bp, Homo sapiens
tagctgtatatatatatatgtgt

SEQ ID NO: 110457 - DNA, 23 bp, Homo sapiens
ctccagtggctctgtgtgcgtct

SEQ ID NO: 110458 - DNA, 23 bp, Homo sapiens
atctgagagacaaaagagagaac

SEQ ID NO: 110459 - DNA, 23 bp, Homo sapiens
cacggtgcatttgtgtggaatgt

SEQ ID NO: 110460 - DNA, 23 bp, Homo sapiens
cggagtctcgctctgtcactcag

SEQ ID NO: 110461 - DNA, 22 bp, Homo sapiens
ggtagagcagacacacagtcct

SEQ ID NO: 110462 - DNA, 23 bp, Homo sapiens
gttccactgtgtcttagaagtca

SEQ ID NO: 110463 - DNA, 23 bp, Homo sapiens
tgagttcattgtagattctggat

SEQ ID NO: 110464 - DNA, 23 bp, Homo sapiens
tgagttcattgtagattctggat

SEQ ID NO: 110465 - DNA, 23 bp, Homo sapiens
agtctcactgtcactcaatcctc

SEQ ID NO: 110466 - DNA, 23 bp, Homo sapiens
tctcaaggtgctaggatgacagg

SEQ ID NO: 110467 - DNA, 23 bp, Homo sapiens
caggctctgtgactcactcacag

SEQ ID NO: 110468 - DNA, 21 bp, Homo sapiens
cactgtatttgtgtatggaat

SEQ ID NO: 110469 - DNA, 23 bp, Homo sapiens
agaacacacacacagtatgtgtg

SEQ ID NO: 110470 - DNA, 21 bp, Homo sapiens
acctgacttttgaagctgtcg

SEQ ID NO: 110471 - DNA, 23 bp, Homo sapiens
attgggatggatttgttaggaat

SEQ ID NO: 110472 - DNA, 23 bp, Homo sapiens
tctatggttttgtagctcttctt

SEQ ID NO: 110473 - DNA, 23 bp, Homo sapiens
tgagttcattgtagattctggat

SEQ ID NO: 110474 - DNA, 23 bp, Homo sapiens
tgagttcattgtagattctggat

SEQ ID NO: 110475 - DNA, 23 bp, Homo sapiens
tgagttcattgtagattctggat

SEQ ID NO: 110476 - DNA, 23 bp, Homo sapiens
tgagttcattgtagattctggat

SEQ ID NO: 110477 - DNA, 23 bp, Homo sapiens
atttgtagtctggctccagagtc

SEQ ID NO: 110478 - DNA, 23 bp, Homo sapiens
tgagttcattgtagattctggat

SEQ ID NO: 110479 - DNA, 23 bp, Homo sapiens
tgagttcattgtagattctggat

SEQ ID NO: 110480 - DNA, 23 bp, Homo sapiens
tgagttcattgtagattctggat

SEQ ID NO: 110481 - DNA, 23 bp, Homo sapiens
tgagttcattgtagattctggat

SEQ ID NO: 110482 - DNA, 22 bp, Homo sapiens
tgttgaatgatgaaagggcttt

SEQ ID NO: 110483 - DNA, 19 bp, Homo sapiens
ttaaccttccatatagttt

SEQ ID NO: 110484 - DNA, 18 bp, Homo sapiens
tctcttaggctctattca

SEQ ID NO: 110485 - DNA, 23 bp, Homo sapiens
tattctgtttgctactattgagg

SEQ ID NO: 110486 - DNA, 19 bp, Homo sapiens
gtagtctcaattacttggg

SEQ ID NO: 110487 - DNA, 23 bp, Homo sapiens
tctgtgtcttagtttaagttcag

SEQ ID NO: 110488 - DNA, 23 bp, Homo sapiens
atgtgtgtatatgtatatatgtg

SEQ ID NO: 110489 - DNA, 23 bp, Homo sapiens
atgtgtgtatatgtatatatgtg

SEQ ID NO: 110490 - DNA, 23 bp, Homo sapiens
atgtgtgtatatgtatatatgtg

SEQ ID NO: 110491 - DNA, 23 bp, Homo sapiens
atatgtatatatgtatgtgtgtg

SEQ ID NO: 110492 - DNA, 21 bp, Homo sapiens
tatgtgtatataatatataga

SEQ ID NO: 110493 - DNA, 19 bp, Homo sapiens
acacacacatatgtagttg

SEQ ID NO: 110494 - DNA, 23 bp, Homo sapiens
ttatgagtaagtactggagctaa

SEQ ID NO: 110495 - DNA, 23 bp, Homo sapiens
taatttacaagtggtgcctggga

SEQ ID NO: 110496 - DNA, 19 bp, Homo sapiens
atgtgcaggatgtgcaggt

SEQ ID NO: 110497 - DNA, 23 bp, Homo sapiens
tgagttcattgtagattctggat

SEQ ID NO: 110498 - DNA, 23 bp, Homo sapiens
tgagttcattgtagattctggat

SEQ ID NO: 110499 - DNA, 23 bp, Homo sapiens
tcagaaggaaattgtaagagatg

SEQ ID NO: 110500 - DNA, 21 bp, Homo sapiens
tcacactctttctgttttaca

SEQ ID NO: 110501 - DNA, 23 bp, Homo sapiens
atcactgttagcatacagacaca

SEQ ID NO: 110502 - DNA, 23 bp, Homo sapiens
ttgtatgttgattttgtatcctg

SEQ ID NO: 110503 - DNA, 20 bp, Homo sapiens
tatgtgtgcattgtagaatg

SEQ ID NO: 110504 - DNA, 23 bp, Homo sapiens
tgtctctggttcttgttgtgctg

SEQ ID NO: 110505 - DNA, 18 bp, Homo sapiens
acaggcacacagtgatta

SEQ ID NO: 110506 - DNA, 23 bp, Homo sapiens
acagagtctcactctgtcgccca

SEQ ID NO: 110507 - DNA, 23 bp, Homo sapiens
aatacagagaagatggtgtcctc

SEQ ID NO: 110508 - DNA, 23 bp, Homo sapiens
tcactctcattcaccctgtcttt

SEQ ID NO: 110509 - DNA, 23 bp, Homo sapiens
gaggttcaggaagctctatcagt

SEQ ID NO: 110510 - DNA, 23 bp, Homo sapiens
gctcacactgtctgtctctgtgg

SEQ ID NO: 110511 - DNA, 18 bp, Homo sapiens
gtgcatatatatgcatat

SEQ ID NO: 110512 - DNA, 19 bp, Homo sapiens
tatgtatatatgtatatgt

SEQ ID NO: 110513 - DNA, 22 bp, Homo sapiens
atatgcatatatgtatatgtgt

SEQ ID NO: 110514 - DNA, 23 bp, Homo sapiens
tgagttcattgtagattctggat

SEQ ID NO: 110515 - DNA, 23 bp, Homo sapiens
tgagttcattgtagattctggat

SEQ ID NO: 110516 - DNA, 23 bp, Homo sapiens
tgagttcattgtagattctggat

SEQ ID NO: 110517 - DNA, 23 bp, Homo sapiens
ttttggttccatatgaaattaaa

SEQ ID NO: 110518 - DNA, 23 bp, Homo sapiens
aaagtcagtggtagcttgatgtg

SEQ ID NO: 110519 - DNA, 23 bp, Homo sapiens
tgcctgcctggctcccactctgc

SEQ ID NO: 110520 - DNA, 23 bp, Homo sapiens
actgagtctcgctctgtcgctca

SEQ ID NO: 110521 - DNA, 22 bp, Homo sapiens
tacctattcaaactcttgttat

SEQ ID NO: 110522 - DNA, 23 bp, Homo sapiens
gacagagtctcgctctgtcaccc

SEQ ID NO: 110523 - DNA, 23 bp, Homo sapiens
tgacacactcaaatggctcagaa

SEQ ID NO: 110524 - DNA, 20 bp, Homo sapiens
tttgtacttgttcatcagat

SEQ ID NO: 110525 - DNA, 20 bp, Homo sapiens
gacgtgtgggtgcacagtct

SEQ ID NO: 110526 - DNA, 23 bp, Homo sapiens
tggagtctcactctgtcacccag

SEQ ID NO: 110527 - DNA, 18 bp, Homo sapiens
tgcctggcacagtctctg

SEQ ID NO: 110528 - DNA, 20 bp, Homo sapiens
tttgagagacagtctcactc

SEQ ID NO: 110529 - DNA, 23 bp, Homo sapiens
gggtctcactctgtcacccaggc

SEQ ID NO: 110530 - DNA, 22 bp, Homo sapiens
tctgtgcgtgtgtgatttgcca

SEQ ID NO: 110531 - DNA, 23 bp, Homo sapiens
atggtagtgtgattcttgttgtg

SEQ ID NO: 110532 - DNA, 23 bp, Homo sapiens
tactgattgctgcagatggagga

SEQ ID NO: 110533 - DNA, 23 bp, Homo sapiens
tgagacggagtctcgctctgtct

SEQ ID NO: 110534 - DNA, 23 bp, Homo sapiens
tatgatgaatgaattggtcagtg

SEQ ID NO: 110535 - DNA, 23 bp, Homo sapiens
ttatttagagaggaaaggttttg

SEQ ID NO: 110536 - DNA, 23 bp, Homo sapiens
tcagtgactgtcagaaagggcct

SEQ ID NO: 110537 - DNA, 23 bp, Homo sapiens
gcctccctgaattgactgaagga

SEQ ID NO: 110538 - DNA, 23 bp, Homo sapiens
cagatgttgaacatttaggttgt

SEQ ID NO: 110539 - DNA, 23 bp, Homo sapiens
tcttgtatgtacatctttgtgca

SEQ ID NO: 110540 - DNA, 23 bp, Homo sapiens
ttttgcacttgagccactgagat

SEQ ID NO: 110541 - DNA, 21 bp, Homo sapiens
atctgagtcctgtctggctga

SEQ ID NO: 110542 - DNA, 21 bp, Homo sapiens
tatgtagcctgatggtggctt

SEQ ID NO: 110543 - DNA, 23 bp, Homo sapiens
ctctgtctgtgactgtgacagtt

SEQ ID NO: 110544 - DNA, 22 bp, Homo sapiens
aatgacctacatcatggcagac

SEQ ID NO: 110545 - DNA, 23 bp, Homo sapiens
aggctgtcttctctggctcccgc

SEQ ID NO: 110546 - DNA, 18 bp, Homo sapiens
tgatggatgtaatcggtt

SEQ ID NO: 110547 - DNA, 21 bp, Homo sapiens
gcatgagtatattacttctag

SEQ ID NO: 110548 - DNA, 23 bp, Homo sapiens
tggcagaacaatgttgagccaac

SEQ ID NO: 110549 - DNA, 23 bp, Homo sapiens
tgtctgcctctgtgtcaggaact

SEQ ID NO: 110550 - DNA, 23 bp, Homo sapiens
tgagttcattgtagattctggat

SEQ ID NO: 110551 - DNA, 23 bp, Homo sapiens
tgagttcattgtagattctggat

SEQ ID NO: 110552 - DNA, 22 bp, Homo sapiens
ggctgggtgattggctgcctga

SEQ ID NO: 110553 - DNA, 20 bp, Homo sapiens
aataagcatgtattagtttc

SEQ ID NO: 110554 - DNA, 23 bp, Homo sapiens
tatgaatctcttttagtttatta

SEQ ID NO: 110555 - DNA, 22 bp, Homo sapiens
tgagcttcttggatgtttagat

SEQ ID NO: 110556 - DNA, 23 bp, Homo sapiens
ttcttgaattagatgcttagttc

SEQ ID NO: 110557 - DNA, 23 bp, Homo sapiens
tgagttcattgtagattctggat

SEQ ID NO: 110558 - DNA, 23 bp, Homo sapiens
tgagttcattgtagattctggat

SEQ ID NO: 110559 - DNA, 23 bp, Homo sapiens
ttctgtcactgggtctgatggag

SEQ ID NO: 110560 - DNA, 23 bp, Homo sapiens
aatgatgttgaaatcttttcatg

SEQ ID NO: 110561 - DNA, 23 bp, Homo sapiens
agggtctcactctgtcaccctgg

SEQ ID NO: 110562 - DNA, 21 bp, Homo sapiens
ctggtcactggttgagttctg

SEQ ID NO: 110563 - DNA, 23 bp, Homo sapiens
tgacctgtccttatgtgtccgta

SEQ ID NO: 110564 - DNA, 23 bp, Homo sapiens
tctctctctccctgagggcgtgg

SEQ ID NO: 110565 - DNA, 23 bp, Homo sapiens
tgagttcattgtagattctggat

SEQ ID NO: 110566 - DNA, 23 bp, Homo sapiens
tgagttcattgtagattctggat

SEQ ID NO: 110567 - DNA, 23 bp, Homo sapiens
tacttgatacataacaattgtac

SEQ ID NO: 110568 - DNA, 22 bp, Homo sapiens
attcagtgtgatgttgtgatgc

SEQ ID NO: 110569 - DNA, 18 bp, Homo sapiens
actgcaacctctgcttcc

SEQ ID NO: 110570 - DNA, 23 bp, Homo sapiens
tctgtcactgtctcactttgccc

SEQ ID NO: 110571 - DNA, 23 bp, Homo sapiens
tctgtcactgtctcactttgccc

SEQ ID NO: 110572 - DNA, 23 bp, Homo sapiens
tctgtcactgtctcactttgccc

SEQ ID NO: 110573 - DNA, 20 bp, Homo sapiens
tcactctctgtctgtggccc

SEQ ID NO: 110574 - DNA, 23 bp, Homo sapiens
tgagttcattgtagattctggat

SEQ ID NO: 110575 - DNA, 23 bp, Homo sapiens
tgagttcattgtagattctggat

SEQ ID NO: 110576 - DNA, 23 bp, Homo sapiens
tctgtcactgtctcactttgccc

SEQ ID NO: 110577 - DNA, 23 bp, Homo sapiens
tctgtcactgtctcactttgccc

SEQ ID NO: 110578 - DNA, 23 bp, Homo sapiens
ggagtctcactcactctgttgcc

SEQ ID NO: 110579 - DNA, 19 bp, Homo sapiens
actggagtgtagtggcatg

SEQ ID NO: 110580 - DNA, 21 bp, Homo sapiens
tttttagtagacacggggtgt

SEQ ID NO: 110581 - DNA, 20 bp, Homo sapiens
tcactgcaacctctgcctct

SEQ ID NO: 110582 - DNA, 18 bp, Homo sapiens
ctggctgcctgtttccca

SEQ ID NO: 110583 - DNA, 20 bp, Homo sapiens
ctagaagcatatctgcagtc

SEQ ID NO: 110584 - DNA, 23 bp, Homo sapiens
taagtctctgactcactgtgagc

SEQ ID NO: 110585 - DNA, 23 bp, Homo sapiens
gcactgcaagaaatgaggctaga

SEQ ID NO: 110586 - DNA, 22 bp, Homo sapiens
tgaaagaccaagtccaagtcat

SEQ ID NO: 110587 - DNA, 18 bp, Homo sapiens
agtggagacagagagcag

SEQ ID NO: 110588 - DNA, 23 bp, Homo sapiens
gagacagagtctcgctctgtcac

SEQ ID NO: 110589 - DNA, 18 bp, Homo sapiens
cagtatgtgtgatgttgc

SEQ ID NO: 110590 - DNA, 23 bp, Homo sapiens
tccataagatatatgtatgtatg

SEQ ID NO: 110591 - DNA, 19 bp, Homo sapiens
agaggcaggtgagtaagtg

SEQ ID NO: 110592 - DNA, 20 bp, Homo sapiens
attgagcacattcattttgc

SEQ ID NO: 110593 - DNA, 23 bp, Homo sapiens
tcagaagtgtttttgttttaaag

SEQ ID NO: 110594 - DNA, 23 bp, Homo sapiens
ggaaaatcttcaattgagattca

SEQ ID NO: 110595 - DNA, 19 bp, Homo sapiens
tatatgcatgtttatgcat

SEQ ID NO: 110596 - DNA, 23 bp, Homo sapiens
gatgacagaggtgagtgtggtga

SEQ ID NO: 110597 - DNA, 23 bp, Homo sapiens
ctcacctctacttggcattatgt

SEQ ID NO: 110598 - DNA, 18 bp, Homo sapiens
gatgatgaaggcagaaat

SEQ ID NO: 110599 - DNA, 23 bp, Homo sapiens
tcattaactgactcctactggag

SEQ ID NO: 110600 - DNA, 20 bp, Homo sapiens
tcagtattgcaggtgtttgt

SEQ ID NO: 110601 - DNA, 23 bp, Homo sapiens
tgagttcattgtagattctggat

SEQ ID NO: 110602 - DNA, 23 bp, Homo sapiens
tgagttcattgtagattctggat

SEQ ID NO: 110603 - DNA, 22 bp, Homo sapiens
tgtgatcacggttcactgcagc

SEQ ID NO: 110604 - DNA, 23 bp, Homo sapiens
tcaatgtgaaagtcatatggctg

SEQ ID NO: 110605 - DNA, 23 bp, Homo sapiens
gatgactagtgatattgaacatc

SEQ ID NO: 110606 - DNA, 23 bp, Homo sapiens
gcctggctctgtgacttaatggt

SEQ ID NO: 110607 - DNA, 23 bp, Homo sapiens
tgagttcattgtagattctggat

SEQ ID NO: 110608 - DNA, 23 bp, Homo sapiens
tgagttcattgtagattctggat

SEQ ID NO: 110609 - DNA, 23 bp, Homo sapiens
cagagtctcactctgtcatccag

SEQ ID NO: 110610 - DNA, 23 bp, Homo sapiens
gggtctcactctgtcacccaggc

SEQ ID NO: 110611 - DNA, 23 bp, Homo sapiens
ctgaggtaagaggttcacttgag

SEQ ID NO: 110612 - DNA, 23 bp, Homo sapiens
tcccagaacattctgagcactgt

SEQ ID NO: 110613 - DNA, 18 bp, Homo sapiens
tatgtgtgtgtgtatata

SEQ ID NO: 110614 - DNA, 18 bp, Homo sapiens
atatataattttgcatag

SEQ ID NO: 110615 - DNA, 23 bp, Homo sapiens
actatcttttgttctctttgagc

SEQ ID NO: 110616 - DNA, 23 bp, Homo sapiens
tgagttcattgtagattctggat

SEQ ID NO: 110617 - DNA, 23 bp, Homo sapiens
tgagttcattgtagattctggat

SEQ ID NO: 110618 - DNA, 23 bp, Homo sapiens
gcagtgttcagagttgttcttca

SEQ ID NO: 110619 - DNA, 22 bp, Homo sapiens
atgactgcagagaaagcttgga

SEQ ID NO: 110620 - DNA, 21 bp, Homo sapiens
tgcatatatatgcatatatat

SEQ ID NO: 110621 - DNA, 23 bp, Homo sapiens
tgagttcattgtagattctggat

SEQ ID NO: 110622 - DNA, 23 bp, Homo sapiens
tgagttcattgtagattctggat

SEQ ID NO: 110623 - DNA, 23 bp, Homo sapiens
cagagtctctctctgtcacccag

SEQ ID NO: 110624 - DNA, 23 bp, Homo sapiens
tcagtatctgtctgctaagcatg

SEQ ID NO: 110625 - DNA, 20 bp, Homo sapiens
atatgtgtgtatatatatgt

SEQ ID NO: 110626 - DNA, 22 bp, Homo sapiens
atttctctctccttttctggac

SEQ ID NO: 110627 - DNA, 22 bp, Homo sapiens
caggctctcactgtcacccagg

SEQ ID NO: 110628 - DNA, 20 bp, Homo sapiens
tcacagtgaaccggtctctt

SEQ ID NO: 110629 - DNA, 19 bp, Homo sapiens
tgtgtatatataatgtata

SEQ ID NO: 110630 - DNA, 23 bp, Homo sapiens
tcagagtagtcagtgtccacatg

SEQ ID NO: 110631 - DNA, 23 bp, Homo sapiens
acagaggttacagtgagcagaga

SEQ ID NO: 110632 - DNA, 23 bp, Homo sapiens
actgcactcctgcctgggtgaca

SEQ ID NO: 110633 - DNA, 23 bp, Homo sapiens
aagtctctctctgtctcccaggc

SEQ ID NO: 110634 - DNA, 23 bp, Homo sapiens
tcacagtatttcaaactgtttca

SEQ ID NO: 110635 - DNA, 23 bp, Homo sapiens
gactgagtctcactctgtgccca

SEQ ID NO: 110636 - DNA, 23 bp, Homo sapiens
atggagtctcactctgtctccca

SEQ ID NO: 110637 - DNA, 23 bp, Homo sapiens
ggagtctcactctgtctcccagg

SEQ ID NO: 110638 - DNA, 21 bp, Homo sapiens
ctggcagaaggttctattctt

SEQ ID NO: 110639 - DNA, 23 bp, Homo sapiens
tgagttcattgtagattctggat

SEQ ID NO: 110640 - DNA, 23 bp, Homo sapiens
tgagttcattgtagattctggat

SEQ ID NO: 110641 - DNA, 23 bp, Homo sapiens
gacagtgtctcactctgtctccc

SEQ ID NO: 110642 - DNA, 23 bp, Homo sapiens
tctgtcacaggatatttggagtg

SEQ ID NO: 110643 - DNA, 23 bp, Homo sapiens
tgtctgtgtctgcgtgcatgtgt

SEQ ID NO: 110644 - DNA, 23 bp, Homo sapiens
tatgtgtgtgtatatgtatatat

SEQ ID NO: 110645 - DNA, 23 bp, Homo sapiens
tgtgtgtgtatatgtatatgtat

SEQ ID NO: 110646 - DNA, 20 bp, Homo sapiens
tacatatacacacacatata

SEQ ID NO: 110647 - DNA, 23 bp, Homo sapiens
tgagttcattgtagattctggat

SEQ ID NO: 110648 - DNA, 23 bp, Homo sapiens
tgagttcattgtagattctggat

SEQ ID NO: 110649 - DNA, 18 bp, Homo sapiens
tatcattttttcttatgc

SEQ ID NO: 110650 - DNA, 23 bp, Homo sapiens
agtgaagtgatattcatgatcaa

SEQ ID NO: 110651 - DNA, 23 bp, Homo sapiens
agtgcaattactttcagttgaga

SEQ ID NO: 110652 - DNA, 20 bp, Homo sapiens
gacatgtttatttgttttag

SEQ ID NO: 110653 - DNA, 23 bp, Homo sapiens
tgagttcattgtagattctggat

SEQ ID NO: 110654 - DNA, 23 bp, Homo sapiens
tgagttcattgtagattctggat

SEQ ID NO: 110655 - DNA, 23 bp, Homo sapiens
ttctctctctcagtgattcttca

SEQ ID NO: 110656 - DNA, 20 bp, Homo sapiens
ctcactgcattctcaaactc

SEQ ID NO: 110657 - DNA, 23 bp, Homo sapiens
agcataaaagactgacatgagaa

SEQ ID NO: 110658 - DNA, 20 bp, Homo sapiens
tatggctgagatataagcca

SEQ ID NO: 110659 - DNA, 23 bp, Homo sapiens
aacactctctctctcattttggt

SEQ ID NO: 110660 - DNA, 18 bp, Homo sapiens
aagcattatttcatatct

SEQ ID NO: 110661 - DNA, 21 bp, Homo sapiens
aatgtgtgtgtatatatgtgt

SEQ ID NO: 110662 - DNA, 23 bp, Homo sapiens
accttctaacacacactctcact

SEQ ID NO: 110663 - DNA, 23 bp, Homo sapiens
agatttgtgtgaggacacagagc

SEQ ID NO: 110664 - DNA, 23 bp, Homo sapiens
agtactcagcatgtagtttctct

SEQ ID NO: 110665 - DNA, 23 bp, Homo sapiens
taactgtcagttgttttctgtag

SEQ ID NO: 110666 - DNA, 20 bp, Homo sapiens
ttgtgcttcagtttatttat

SEQ ID NO: 110667 - DNA, 23 bp, Homo sapiens
gaacactagtcatattggactag

SEQ ID NO: 110668 - DNA, 23 bp, Homo sapiens
tagtgtgtgtatatatatgtgtg

SEQ ID NO: 110669 - DNA, 23 bp, Homo sapiens
tatatctatatctatatatgtgt

SEQ ID NO: 110670 - DNA, 22 bp, Homo sapiens
tatccatatataatgtagtata

SEQ ID NO: 110671 - DNA, 23 bp, Homo sapiens
tattgtgatagatgtaggtatct

SEQ ID NO: 110672 - DNA, 23 bp, Homo sapiens
actatagatgtactacacaaagg

SEQ ID NO: 110673 - DNA, 22 bp, Homo sapiens
attctcagtgattgatcttttt

SEQ ID NO: 110674 - DNA, 23 bp, Homo sapiens
cggagtctcactctgtcacccag

SEQ ID NO: 110675 - DNA, 23 bp, Homo sapiens
tgagttcattgtagattctggat

SEQ ID NO: 110676 - DNA, 23 bp, Homo sapiens
tgagttcattgtagattctggat

SEQ ID NO: 110677 - DNA, 23 bp, Homo sapiens
ttttttgcttagtattgtcttgg

SEQ ID NO: 110678 - DNA, 23 bp, Homo sapiens
tagaaattctggtaaatgttgtc

SEQ ID NO: 110679 - DNA, 19 bp, Homo sapiens
ctcttgactgtgagtttct

SEQ ID NO: 110680 - DNA, 23 bp, Homo sapiens
tctatatctatatatggatatct

SEQ ID NO: 110681 - DNA, 23 bp, Homo sapiens
tatacctagatatacctagatat

SEQ ID NO: 110682 - DNA, 23 bp, Homo sapiens
tggagagatgactgacagaactc

SEQ ID NO: 110683 - DNA, 22 bp, Homo sapiens
atatgtgtgatatgttaagtgt

SEQ ID NO: 110684 - DNA, 23 bp, Homo sapiens
ggagtctcactctgtggctcagg

SEQ ID NO: 110685 - DNA, 18 bp, Homo sapiens
tacctgtgtagggaccag

SEQ ID NO: 110686 - DNA, 23 bp, Homo sapiens
gtcggtgggtctctccctgtgtg

SEQ ID NO: 110687 - DNA, 22 bp, Homo sapiens
tctcaggttcagcttctcctgc

SEQ ID NO: 110688 - DNA, 23 bp, Homo sapiens
tgagttcattgtagattctggat

SEQ ID NO: 110689 - DNA, 23 bp, Homo sapiens
tgagttcattgtagattctggat

SEQ ID NO: 110690 - DNA, 23 bp, Homo sapiens
gcaaccttagtaactctgtgcaa

SEQ ID NO: 110691 - DNA, 23 bp, Homo sapiens
agagtctcactctgtcttccagg

SEQ ID NO: 110692 - DNA, 20 bp, Homo sapiens
ctcactgcaacctctgtctc

SEQ ID NO: 110693 - DNA, 21 bp, Homo sapiens
atcagtgatgaaagagagcac

SEQ ID NO: 110694 - DNA, 23 bp, Homo sapiens
tgagttcattgtagattctggat

SEQ ID NO: 110695 - DNA, 23 bp, Homo sapiens
tgagttcattgtagattctggat

SEQ ID NO: 110696 - DNA, 23 bp, Homo sapiens
agtaatgtcctaggcctttgggt

SEQ ID NO: 110697 - DNA, 23 bp, Homo sapiens
tgagttcattgtagattctggat

SEQ ID NO: 110698 - DNA, 23 bp, Homo sapiens
tgagttcattgtagattctggat

SEQ ID NO: 110699 - DNA, 23 bp, Homo sapiens
gactgagtctcgctctgtcaccc

SEQ ID NO: 110700 - DNA, 21 bp, Homo sapiens
gtagactacagagacagaggc

SEQ ID NO: 110701 - DNA, 23 bp, Homo sapiens
ggatcttcagttcagattttgta

SEQ ID NO: 110702 - DNA, 23 bp, Homo sapiens
cattgcttctgaaaatcttaaca

SEQ ID NO: 110703 - DNA, 23 bp, Homo sapiens
atcaaatctcactctgtcaccca

SEQ ID NO: 110704 - DNA, 22 bp, Homo sapiens
caaagaactagagatagcatat

SEQ ID NO: 110705 - DNA, 23 bp, Homo sapiens
agactgagtctcgctctgtcacc

SEQ ID NO: 110706 - DNA, 21 bp, Homo sapiens
tgtttctcgtacttcttaaat

SEQ ID NO: 110707 - DNA, 22 bp, Homo sapiens
atatatatatgcatgtgtgtgt

SEQ ID NO: 110708 - DNA, 23 bp, Homo sapiens
tatgtgtgtgtatatatatatgt

SEQ ID NO: 110709 - DNA, 21 bp, Homo sapiens
tgtattgttttctagctgctt

SEQ ID NO: 110710 - DNA, 23 bp, Homo sapiens
tatctgtatatgtatattatatg

SEQ ID NO: 110711 - DNA, 23 bp, Homo sapiens
tgtgtgtgtgtgtgtttaaccaa

SEQ ID NO: 110712 - DNA, 23 bp, Homo sapiens
tgcctctctgcctccctgactcc

SEQ ID NO: 110713 - DNA, 23 bp, Homo sapiens
acagagactcactctgtcgccca

SEQ ID NO: 110714 - DNA, 23 bp, Homo sapiens
ttttctgaggtcacttgtgtgtg

SEQ ID NO: 110715 - DNA, 23 bp, Homo sapiens
tgacatctcaatttgttcttcag

SEQ ID NO: 110716 - DNA, 19 bp, Homo sapiens
aggagctagattgtgtcat

SEQ ID NO: 110717 - DNA, 20 bp, Homo sapiens
tgtgactacttttgttagcc

SEQ ID NO: 110718 - DNA, 23 bp, Homo sapiens
tattggaagtggaagaattttta

SEQ ID NO: 110719 - DNA, 20 bp, Homo sapiens
agagcaggaggaagagagag

SEQ ID NO: 110720 - DNA, 19 bp, Homo sapiens
tgtatgagagagaaggcac

SEQ ID NO: 110721 - DNA, 19 bp, Homo sapiens
cagttggtggagaagtcag

SEQ ID NO: 110722 - DNA, 23 bp, Homo sapiens
ctgtgtagaaatgtgattggacc

SEQ ID NO: 110723 - DNA, 23 bp, Homo sapiens
tcactctcactctgagtaatcag

SEQ ID NO: 110724 - DNA, 23 bp, Homo sapiens
gaaatgtgaatccttcaacattg

SEQ ID NO: 110725 - DNA, 23 bp, Homo sapiens
tcagctagactcagacactcact

SEQ ID NO: 110726 - DNA, 22 bp, Homo sapiens
ttagaacaaagagtgtatgtgt

SEQ ID NO: 110727 - DNA, 22 bp, Homo sapiens
atacacacacacaaatatgtga

SEQ ID NO: 110728 - DNA, 23 bp, Homo sapiens
taactctgtgaaaaaagtcagta

SEQ ID NO: 110729 - DNA, 23 bp, Homo sapiens
gtgtatatgtatgtatgtgtata

SEQ ID NO: 110730 - DNA, 21 bp, Homo sapiens
tgtatttatgcatgtatatgt

SEQ ID NO: 110731 - DNA, 21 bp, Homo sapiens
aaagtccttgttcacatggtg

SEQ ID NO: 110732 - DNA, 23 bp, Homo sapiens
agagtctcactctgtcacccagg

SEQ ID NO: 110733 - DNA, 23 bp, Homo sapiens
agtcagaagtaagagtggaatct

SEQ ID NO: 110734 - DNA, 22 bp, Homo sapiens
tttgttctttttgcttaggatt

SEQ ID NO: 110735 - DNA, 23 bp, Homo sapiens
taattctgtgaagaaagtcagtg

SEQ ID NO: 110736 - DNA, 23 bp, Homo sapiens
aagctgaaaatagaggaccaaga

SEQ ID NO: 110737 - DNA, 23 bp, Homo sapiens
gagtctcactctgtcacccaggc

SEQ ID NO: 110738 - DNA, 22 bp, Homo sapiens
tcagtgtgagataggacctggt

SEQ ID NO: 110739 - DNA, 23 bp, Homo sapiens
ttctgccttcagtgctcctggtt

SEQ ID NO: 110740 - DNA, 23 bp, Homo sapiens
atgcgcttatatatatgtgtgtg

SEQ ID NO: 110741 - DNA, 22 bp, Homo sapiens
gttttttggttccatatgaaat

SEQ ID NO: 110742 - DNA, 23 bp, Homo sapiens
acagagtctcactctgtcgccca

SEQ ID NO: 110743 - DNA, 23 bp, Homo sapiens
tgagttcattgtagattctggat

SEQ ID NO: 110744 - DNA, 23 bp, Homo sapiens
tgagttcattgtagattctggat

SEQ ID NO: 110745 - DNA, 23 bp, Homo sapiens
tgagttcattgtagattctggat

SEQ ID NO: 110746 - DNA, 23 bp, Homo sapiens
tgagttcattgtagattctggat

SEQ ID NO: 110747 - DNA, 23 bp, Homo sapiens
tcgtcaaagtcattctccatcca

SEQ ID NO: 110748 - DNA, 19 bp, Homo sapiens
actgaattgccactcattt

SEQ ID NO: 110749 - DNA, 23 bp, Homo sapiens
tagagtggcaatttaatgacaca

SEQ ID NO: 110750 - DNA, 21 bp, Homo sapiens
tctgtaagtatttatatatgt

SEQ ID NO: 110751 - DNA, 22 bp, Homo sapiens
taactacaactggatctggtta

SEQ ID NO: 110752 - DNA, 21 bp, Homo sapiens
tagcagaggtcttgtagtgtg

SEQ ID NO: 110753 - DNA, 23 bp, Homo sapiens
atctccacttactgcaagctctg

SEQ ID NO: 110754 - DNA, 19 bp, Homo sapiens
ttgaccttgatgtatggaa

SEQ ID NO: 110755 - DNA, 23 bp, Homo sapiens
tgagttcattgtagattctggat

SEQ ID NO: 110756 - DNA, 23 bp, Homo sapiens
tgagttcattgtagattctggat

SEQ ID NO: 110757 - DNA, 23 bp, Homo sapiens
tgagaatacagtgagaagatggc

SEQ ID NO: 110758 - DNA, 21 bp, Homo sapiens
agcctgtggaagtacacacac

SEQ ID NO: 110759 - DNA, 21 bp, Homo sapiens
accacattccatttcttatcc

SEQ ID NO: 110760 - DNA, 23 bp, Homo sapiens
ttgttggcacattttgctgtttc

SEQ ID NO: 110761 - DNA, 22 bp, Homo sapiens
caaaatttctatgcaaaactga

SEQ ID NO: 110762 - DNA, 23 bp, Homo sapiens
atggagtctcactctgtcaccca

SEQ ID NO: 110763 - DNA, 23 bp, Homo sapiens
agtggtgtgatctttgctcactg

SEQ ID NO: 110764 - DNA, 21 bp, Homo sapiens
actgaagagtcatcttcttcc

SEQ ID NO: 110765 - DNA, 23 bp, Homo sapiens
agagttcactctgcgtttgctct

SEQ ID NO: 110766 - DNA, 22 bp, Homo sapiens
gtgtacagagaaggttgagaac

SEQ ID NO: 110767 - DNA, 23 bp, Homo sapiens
tattaatgtctaggttttgctat

SEQ ID NO: 110768 - DNA, 19 bp, Homo sapiens
agtggtcaactatgtttgt

SEQ ID NO: 110769 - DNA, 23 bp, Homo sapiens
aaggacctaggaaattgagatga

SEQ ID NO: 110770 - DNA, 21 bp, Homo sapiens
atgataatgatgatgatgatg

SEQ ID NO: 110771 - DNA, 21 bp, Homo sapiens
tatgtgtatatatatgtatgt

SEQ ID NO: 110772 - DNA, 23 bp, Homo sapiens
catgagactcattcaccatgcca

SEQ ID NO: 110773 - DNA, 23 bp, Homo sapiens
gcatcactgtgagactctgtctc

SEQ ID NO: 110774 - DNA, 20 bp, Homo sapiens
agtctcgctctgtcactcgc

SEQ ID NO: 110775 - DNA, 21 bp, Homo sapiens
taatgctttttatgagattga

SEQ ID NO: 110776 - DNA, 23 bp, Homo sapiens
tgagttcattgtagattctggat

SEQ ID NO: 110777 - DNA, 23 bp, Homo sapiens
tgagttcattgtagattctggat

SEQ ID NO: 110778 - DNA, 23 bp, Homo sapiens
cggagtctcgctctgtctcccag

SEQ ID NO: 110779 - DNA, 21 bp, Homo sapiens
gcagtccctatctctgtgtca

SEQ ID NO: 110780 - DNA, 23 bp, Homo sapiens
cagggtctcactctgtcacccag

SEQ ID NO: 110781 - DNA, 23 bp, Homo sapiens
tgcagtgttgtgatcttggctca

SEQ ID NO: 110782 - DNA, 19 bp, Homo sapiens
agagttctttatgcattct

SEQ ID NO: 110783 - DNA, 23 bp, Homo sapiens
ttcttagtctgcagtggatcttt

SEQ ID NO: 110784 - DNA, 21 bp, Homo sapiens
tctgattaacataacgaagtg

SEQ ID NO: 110785 - DNA, 23 bp, Homo sapiens
agtctgctcattctttgagagtc

SEQ ID NO: 110786 - DNA, 19 bp, Homo sapiens
gaagcatgagagattttgt

SEQ ID NO: 110787 - DNA, 21 bp, Homo sapiens
tcagggtgccaatgtggtcag

SEQ ID NO: 110788 - DNA, 23 bp, Homo sapiens
tgtagagcctactctctctctgt

SEQ ID NO: 110789 - DNA, 20 bp, Homo sapiens
actctcgactacctttaatg

SEQ ID NO: 110790 - DNA, 23 bp, Homo sapiens
cctatgagaatctaatgccactg

SEQ ID NO: 110791 - DNA, 23 bp, Homo sapiens
attctagggtgtttaaagatttt

SEQ ID NO: 110792 - DNA, 23 bp, Homo sapiens
ttaaatactttttgaattgatga

SEQ ID NO: 110793 - DNA, 23 bp, Homo sapiens
gaaatcagagtgaacagagacag

SEQ ID NO: 110794 - DNA, 23 bp, Homo sapiens
tgagttcattgtagattctggat

SEQ ID NO: 110795 - DNA, 23 bp, Homo sapiens
tgagttcattgtagattctggat

SEQ ID NO: 110796 - DNA, 22 bp, Homo sapiens
tttggttgatgtacttctctcg

SEQ ID NO: 110797 - DNA, 21 bp, Homo sapiens
tgagtcaaatgttctctggtt

SEQ ID NO: 110798 - DNA, 23 bp, Homo sapiens
aaacttccatttgaagtctagac

SEQ ID NO: 110799 - DNA, 23 bp, Homo sapiens
ggagtttctctgtgagaaatgca

SEQ ID NO: 110800 - DNA, 23 bp, Homo sapiens
atactggatcaggatctgcatca

SEQ ID NO: 110801 - DNA, 23 bp, Homo sapiens
tttttatcaaggaaaagcattga

SEQ ID NO: 110802 - DNA, 22 bp, Homo sapiens
tatatgtatatattcatatgtg

SEQ ID NO: 110803 - DNA, 22 bp, Homo sapiens
tgtgtgtgtgtgtgtgcgcgcg

SEQ ID NO: 110804 - DNA, 23 bp, Homo sapiens
atgtgtgtgtgcatgtgtatgtg

SEQ ID NO: 110805 - DNA, 22 bp, Homo sapiens
tcacaaggtgctcagttgggga

SEQ ID NO: 110806 - DNA, 18 bp, Homo sapiens
ttacacatgtttagatca

SEQ ID NO: 110807 - DNA, 23 bp, Homo sapiens
tgtgttgattgttgtgtgagagc

SEQ ID NO: 110808 - DNA, 22 bp, Homo sapiens
atatgtgtatatatcatgtgta

SEQ ID NO: 110809 - DNA, 19 bp, Homo sapiens
atgtgtatatatcgtgtat

SEQ ID NO: 110810 - DNA, 23 bp, Homo sapiens
tggagtctctctctgtcacccag

SEQ ID NO: 110811 - DNA, 23 bp, Homo sapiens
tgaagaaagtcaatggtagctca

SEQ ID NO: 110812 - DNA, 23 bp, Homo sapiens
atatgtgtatatgtatataagtg

SEQ ID NO: 110813 - DNA, 23 bp, Homo sapiens
atatgtgtatatgtatataagtg

SEQ ID NO: 110814 - DNA, 23 bp, Homo sapiens
atatgtgtatatgtatataagtg

SEQ ID NO: 110815 - DNA, 23 bp, Homo sapiens
atatgtatacatatatatgtgta

SEQ ID NO: 110816 - DNA, 23 bp, Homo sapiens
atatgtgtatatgtatataagtg

SEQ ID NO: 110817 - DNA, 22 bp, Homo sapiens
atatatgtacatatgtatacat

SEQ ID NO: 110818 - DNA, 23 bp, Homo sapiens
tgagttcattgtagattctggat

SEQ ID NO: 110819 - DNA, 23 bp, Homo sapiens
tgagttcattgtagattctggat

SEQ ID NO: 110820 - DNA, 22 bp, Homo sapiens
aataggtatgtgtgtgtataca

SEQ ID NO: 110821 - DNA, 21 bp, Homo sapiens
tgtataaatgcatgtgtgtat

SEQ ID NO: 110822 - DNA, 19 bp, Homo sapiens
tcaatttttattgcagtgt

SEQ ID NO: 110823 - DNA, 23 bp, Homo sapiens
ctttatggctgagcatgtattca

SEQ ID NO: 110824 - DNA, 18 bp, Homo sapiens
tctctctcacattgttca

SEQ ID NO: 110825 - DNA, 23 bp, Homo sapiens
tttcagtggtacaccaaagaaat

SEQ ID NO: 110826 - DNA, 23 bp, Homo sapiens
tgagttcattgtagattctggat

SEQ ID NO: 110827 - DNA, 23 bp, Homo sapiens
tgagttcattgtagattctggat

SEQ ID NO: 110828 - DNA, 23 bp, Homo sapiens
tgagttcattgtagattctggat

SEQ ID NO: 110829 - DNA, 23 bp, Homo sapiens
tgagttcattgtagattctggat

SEQ ID NO: 110830 - DNA, 20 bp, Homo sapiens
tatgtgtgtgtatatatttg

SEQ ID NO: 110831 - DNA, 23 bp, Homo sapiens
tgagttcattgtagattctggat

SEQ ID NO: 110832 - DNA, 23 bp, Homo sapiens
tgagttcattgtagattctggat

SEQ ID NO: 110833 - DNA, 23 bp, Homo sapiens
aagtttctatgagtgtattcaag

SEQ ID NO: 110834 - DNA, 23 bp, Homo sapiens
aaatcactctgagtacaagcgga

SEQ ID NO: 110835 - DNA, 23 bp, Homo sapiens
tctctatatctcagtttctacat

SEQ ID NO: 110836 - DNA, 23 bp, Homo sapiens
catatgtgtatatgtaagtgtgt

SEQ ID NO: 110837 - DNA, 21 bp, Homo sapiens
agtcctttagattagtttaat

SEQ ID NO: 110838 - DNA, 23 bp, Homo sapiens
tctctgtgactcagtttcttcat

SEQ ID NO: 110839 - DNA, 21 bp, Homo sapiens
ctgactgaagagactttgtac

SEQ ID NO: 110840 - DNA, 23 bp, Homo sapiens
tatctatttgctgtttctgatac

SEQ ID NO: 110841 - DNA, 20 bp, Homo sapiens
tcactcactcctttctcttt

SEQ ID NO: 110842 - DNA, 23 bp, Homo sapiens
taacattagtgaccttgaagatg

SEQ ID NO: 110843 - DNA, 18 bp, Homo sapiens
ctgcactgagctgtgatc

SEQ ID NO: 110844 - DNA, 23 bp, Homo sapiens
tctttttgatatgttgtttgact

SEQ ID NO: 110845 - DNA, 23 bp, Homo sapiens
tgagatctgtatcactctccctc

SEQ ID NO: 110846 - DNA, 22 bp, Homo sapiens
attcgatggagatgaaaggcat

SEQ ID NO: 110847 - DNA, 23 bp, Homo sapiens
tgtctctgtctctcccacattgc

SEQ ID NO: 110848 - DNA, 22 bp, Homo sapiens
ctgagtacatagctctgtgcta

SEQ ID NO: 110849 - DNA, 22 bp, Homo sapiens
gaaactggaaatatataggttc

SEQ ID NO: 110850 - DNA, 23 bp, Homo sapiens
accgagtctcgctctgtcaccca

SEQ ID NO: 110851 - DNA, 23 bp, Homo sapiens
tcagttactcacaaaacatggct

SEQ ID NO: 110852 - DNA, 23 bp, Homo sapiens
tgagttcattgtagattctggat

SEQ ID NO: 110853 - DNA, 23 bp, Homo sapiens
tgagttcattgtagattctggat

SEQ ID NO: 110854 - DNA, 23 bp, Homo sapiens
tctctgcctcactgactcaggtg

SEQ ID NO: 110855 - DNA, 20 bp, Homo sapiens
tatacatattttgtaaatct

SEQ ID NO: 110856 - DNA, 23 bp, Homo sapiens
gacagagtctcgctctgtcaccc

SEQ ID NO: 110857 - DNA, 23 bp, Homo sapiens
tatatgtatatatatatgtgtgt

SEQ ID NO: 110858 - DNA, 23 bp, Homo sapiens
gtctcgctcactcagtgctcgat

SEQ ID NO: 110859 - DNA, 20 bp, Homo sapiens
atctgtatatatatatgtga

SEQ ID NO: 110860 - DNA, 23 bp, Homo sapiens
ttgttatagaagcacaaatggac

SEQ ID NO: 110861 - DNA, 22 bp, Homo sapiens
tacagctatgtttgttctcagt

SEQ ID NO: 110862 - DNA, 23 bp, Homo sapiens
tatatgtatgcatatgtatatgt

SEQ ID NO: 110863 - DNA, 22 bp, Homo sapiens
atgatttggctctctgtttgtc

SEQ ID NO: 110864 - DNA, 21 bp, Homo sapiens
acgtagacacatattacatga

SEQ ID NO: 110865 - DNA, 23 bp, Homo sapiens
ttcaaagtaattcaattgggtaa

SEQ ID NO: 110866 - DNA, 23 bp, Homo sapiens
tgagttcattgtagattctggat

SEQ ID NO: 110867 - DNA, 23 bp, Homo sapiens
tgagttcattgtagattctggat

SEQ ID NO: 110868 - DNA, 23 bp, Homo sapiens
agcttgattacctgctcagtaag

SEQ ID NO: 110869 - DNA, 23 bp, Homo sapiens
aaacattgaacagttggctttta

SEQ ID NO: 110870 - DNA, 23 bp, Homo sapiens
agagttctctgctattgtttggt

SEQ ID NO: 110871 - DNA, 23 bp, Homo sapiens
tctctgtctgtctgtctgtctgt

SEQ ID NO: 110872 - DNA, 23 bp, Homo sapiens
aatctctgtctgtctgtctgtct

SEQ ID NO: 110873 - DNA, 23 bp, Homo sapiens
atctctgtatctgttattggtct

SEQ ID NO: 110874 - DNA, 20 bp, Homo sapiens
tgtgtgtggcttatgtatga

SEQ ID NO: 110875 - DNA, 20 bp, Homo sapiens
tcacagaagacacacacaca

SEQ ID NO: 110876 - DNA, 21 bp, Homo sapiens
tgagacacagtctcgctctgt

SEQ ID NO: 110877 - DNA, 18 bp, Homo sapiens
gagaacaatatctctaga

SEQ ID NO: 110878 - DNA, 23 bp, Homo sapiens
ttgattctctgcatgtgaatctg

SEQ ID NO: 110879 - DNA, 23 bp, Homo sapiens
aaacagaaacttataattcagca

SEQ ID NO: 110880 - DNA, 22 bp, Homo sapiens
agaatggatgttctaataccat

SEQ ID NO: 110881 - DNA, 19 bp, Homo sapiens
atggtcaagaaagatttat

SEQ ID NO: 110882 - DNA, 23 bp, Homo sapiens
tttgactggctttgttcataggg

SEQ ID NO: 110883 - DNA, 23 bp, Homo sapiens
tctcagtcacattgtgtgttcga

SEQ ID NO: 110884 - DNA, 23 bp, Homo sapiens
atctcagtagaccctggtgtcag

SEQ ID NO: 110885 - DNA, 23 bp, Homo sapiens
atctgagtatttatatatgtgag

SEQ ID NO: 110886 - DNA, 23 bp, Homo sapiens
tacagtcatcagaatgggttcca

SEQ ID NO: 110887 - DNA, 23 bp, Homo sapiens
tttgttctttttgctcagaattg

SEQ ID NO: 110888 - DNA, 23 bp, Homo sapiens
ttctgtgaagaaagtcaatggta

SEQ ID NO: 110889 - DNA, 19 bp, Homo sapiens
catacacatgtatgcaatt

SEQ ID NO: 110890 - DNA, 23 bp, Homo sapiens
tttaatctccaagtatttggggt

SEQ ID NO: 110891 - DNA, 21 bp, Homo sapiens
aactccattgtaatctgagag

SEQ ID NO: 110892 - DNA, 22 bp, Homo sapiens
acactccctgtcacacaccctg

SEQ ID NO: 110893 - DNA, 23 bp, Homo sapiens
tggagtctcactctgtcacccag

SEQ ID NO: 110894 - DNA, 23 bp, Homo sapiens
tcagtgtctatctgactgtataa

SEQ ID NO: 110895 - DNA, 22 bp, Homo sapiens
ttatcttgtagcttctatagtt

SEQ ID NO: 110896 - DNA, 23 bp, Homo sapiens
acctctctctgtctgggtttctc

SEQ ID NO: 110897 - DNA, 23 bp, Homo sapiens
atgtatgtatacatatgtataca

SEQ ID NO: 110898 - DNA, 23 bp, Homo sapiens
tatgtatgtatatgtatagtata

SEQ ID NO: 110899 - DNA, 20 bp, Homo sapiens
tacacacatatatatgtgta

SEQ ID NO: 110900 - DNA, 23 bp, Homo sapiens
catttacatactccttttcttgt

SEQ ID NO: 110901 - DNA, 23 bp, Homo sapiens
acagactctcactctttttactg

SEQ ID NO: 110902 - DNA, 23 bp, Homo sapiens
gttatgattgattaaagtgctgt

SEQ ID NO: 110903 - DNA, 22 bp, Homo sapiens
aaactcacctgtaaacatgttt

SEQ ID NO: 110904 - DNA, 21 bp, Homo sapiens
ttttgaggtgacagtcattgt

SEQ ID NO: 110905 - DNA, 22 bp, Homo sapiens
tatgcgtatatgtatatatgta

SEQ ID NO: 110906 - DNA, 23 bp, Homo sapiens
ctctttacttgccaaaagaattg

SEQ ID NO: 110907 - DNA, 22 bp, Homo sapiens
tatttaaactggagtctcactc

SEQ ID NO: 110908 - DNA, 18 bp, Homo sapiens
tatctgtgctttgtatat

SEQ ID NO: 110909 - DNA, 23 bp, Homo sapiens
tatgaatgtgtgtgtaggtacat

SEQ ID NO: 110910 - DNA, 23 bp, Homo sapiens
tatatatatgtgtgtatgtttat

SEQ ID NO: 110911 - DNA, 23 bp, Homo sapiens
accaagtctcactctgtcaccga

SEQ ID NO: 110912 - DNA, 23 bp, Homo sapiens
tctgtgtctctgaggctctgagc

SEQ ID NO: 110913 - DNA, 23 bp, Homo sapiens
tcaggtacaaagaattataatag

SEQ ID NO: 110914 - DNA, 22 bp, Homo sapiens
tataattgttatctgctaggtc

SEQ ID NO: 110915 - DNA, 22 bp, Homo sapiens
ggtgccagtgaaaagagatggt

SEQ ID NO: 110916 - DNA, 23 bp, Homo sapiens
tactgtgatcacggctcactgga

SEQ ID NO: 110917 - DNA, 20 bp, Homo sapiens
gggagactattgtatttgta

SEQ ID NO: 110918 - DNA, 23 bp, Homo sapiens
tatgtgtatatatgtatgtgtgt

SEQ ID NO: 110919 - DNA, 23 bp, Homo sapiens
ttgaaacagcaactgcagctgca

SEQ ID NO: 110920 - DNA, 21 bp, Homo sapiens
tttggaactatttgtgaagac

SEQ ID NO: 110921 - DNA, 23 bp, Homo sapiens
tttggctgggtatgaattcttga

SEQ ID NO: 110922 - DNA, 23 bp, Homo sapiens
actgtaattctatatttatatgt

SEQ ID NO: 110923 - DNA, 21 bp, Homo sapiens
tagagtattcagctcattgtt

SEQ ID NO: 110924 - DNA, 18 bp, Homo sapiens
tgcagtctcagctacttg

SEQ ID NO: 110925 - DNA, 22 bp, Homo sapiens
tatgccagtcatagggcttgtg

SEQ ID NO: 110926 - DNA, 23 bp, Homo sapiens
tgtgggagagcatatattttgaa

SEQ ID NO: 110927 - DNA, 21 bp, Homo sapiens
caagtttttgtttttcttttg

SEQ ID NO: 110928 - DNA, 20 bp, Homo sapiens
atacgtatatatatatatgt

SEQ ID NO: 110929 - DNA, 20 bp, Homo sapiens
atacgtatatatatatatgt

SEQ ID NO: 110930 - DNA, 23 bp, Homo sapiens
atgcagcactctctgtaatggat

SEQ ID NO: 110931 - DNA, 23 bp, Homo sapiens
gacagagtctcgctctgtcaccc

SEQ ID NO: 110932 - DNA, 23 bp, Homo sapiens
agagaacctttacaagtaaacag

SEQ ID NO: 110933 - DNA, 21 bp, Homo sapiens
tcacaaagaaaacagtagcat

SEQ ID NO: 110934 - DNA, 23 bp, Homo sapiens
actgtgtctgtgtgagttctggc

SEQ ID NO: 110935 - DNA, 23 bp, Homo sapiens
tactattctgattttgtttttca

SEQ ID NO: 110936 - DNA, 23 bp, Homo sapiens
aaaatcattaagtattggagttc

SEQ ID NO: 110937 - DNA, 18 bp, Homo sapiens
tctctgggtgccagcatg

SEQ ID NO: 110938 - DNA, 19 bp, Homo sapiens
ctagatctgtcactcctct

SEQ ID NO: 110939 - DNA, 23 bp, Homo sapiens
agatggagtctcactctgtcacc

SEQ ID NO: 110940 - DNA, 23 bp, Homo sapiens
tctctcactcagtctgtttcaag

SEQ ID NO: 110941 - DNA, 23 bp, Homo sapiens
actctctgtcactgagcctcagc

SEQ ID NO: 110942 - DNA, 19 bp, Homo sapiens
tcactgcaagctctgtctc

SEQ ID NO: 110943 - DNA, 23 bp, Homo sapiens
tagtagacagtgttgttagaggc

SEQ ID NO: 110944 - DNA, 23 bp, Homo sapiens
ctcactgtgtcactcggactgga

SEQ ID NO: 110945 - DNA, 23 bp, Homo sapiens
gacagtctcactctgtcacccag

SEQ ID NO: 110946 - DNA, 18 bp, Homo sapiens
tgcagtgtgtgattgcag

SEQ ID NO: 110947 - DNA, 23 bp, Homo sapiens
tgtctagattattcactgagtgt

SEQ ID NO: 110948 - DNA, 23 bp, Homo sapiens
gacatcacacacattcactgaga

SEQ ID NO: 110949 - DNA, 20 bp, Homo sapiens
gtcttgttccatgaaaggtt

SEQ ID NO: 110950 - DNA, 22 bp, Homo sapiens
atgtgtgtgtatatgtacatat

SEQ ID NO: 110951 - DNA, 18 bp, Homo sapiens
tatacatatatgtgtatg

SEQ ID NO: 110952 - DNA, 23 bp, Homo sapiens
tgtgttagtccatttgcattgct

SEQ ID NO: 110953 - DNA, 18 bp, Homo sapiens
ggccagtgagtgtagaga

SEQ ID NO: 110954 - DNA, 23 bp, Homo sapiens
attctcattttcttgttcactca

SEQ ID NO: 110955 - DNA, 23 bp, Homo sapiens
aagctgccaggaagttctaactg

SEQ ID NO: 110956 - DNA, 23 bp, Homo sapiens
ttttgaaatgaaaagatgaatcc

SEQ ID NO: 110957 - DNA, 23 bp, Homo sapiens
aaactgtctcattctgtcaccta

SEQ ID NO: 110958 - DNA, 23 bp, Homo sapiens
tgagttcattgtagattctggat

SEQ ID NO: 110959 - DNA, 23 bp, Homo sapiens
tgagttcattgtagattctggat

SEQ ID NO: 110960 - DNA, 19 bp, Homo sapiens
tctctggctccatgtgacc

SEQ ID NO: 110961 - DNA, 22 bp, Homo sapiens
tctctgtcctttctcggtctct

SEQ ID NO: 110962 - DNA, 19 bp, Homo sapiens
tgagtgaccacactcagcc

SEQ ID NO: 110963 - DNA, 23 bp, Homo sapiens
ttttttatgacatgttgaaatca

SEQ ID NO: 110964 - DNA, 23 bp, Homo sapiens
ctgtaatctgaacactttgggat

SEQ ID NO: 110965 - DNA, 23 bp, Homo sapiens
ctttaaaacttagttcatagggc

SEQ ID NO: 110966 - DNA, 20 bp, Homo sapiens
tggcaagatgttaccattgg

SEQ ID NO: 110967 - DNA, 23 bp, Homo sapiens
ggtacacagtatctctcagtatt

SEQ ID NO: 110968 - DNA, 23 bp, Homo sapiens
gactgagtctcgctctgtcaccc

SEQ ID NO: 110969 - DNA, 22 bp, Homo sapiens
agagactagagacagaggagta

SEQ ID NO: 110970 - DNA, 23 bp, Homo sapiens
tagattgtgtaaagaggtcaaag

SEQ ID NO: 110971 - DNA, 21 bp, Homo sapiens
tatctctatatatctatatct

SEQ ID NO: 110972 - DNA, 19 bp, Homo sapiens
tagtaagtatatatatttg

SEQ ID NO: 110973 - DNA, 23 bp, Homo sapiens
tgagttcattgtagattctggat

SEQ ID NO: 110974 - DNA, 23 bp, Homo sapiens
tgagttcattgtagattctggat

SEQ ID NO: 110975 - DNA, 22 bp, Homo sapiens
tgcatgcgtgtgtgtgtgcgtg

SEQ ID NO: 110976 - DNA, 23 bp, Homo sapiens
tggagtctcactctgtcacccag

SEQ ID NO: 110977 - DNA, 23 bp, Homo sapiens
atgtgtgtatatatatatgtgtg

SEQ ID NO: 110978 - DNA, 23 bp, Homo sapiens
tgagttcattgtagattctggat

SEQ ID NO: 110979 - DNA, 23 bp, Homo sapiens
tgagttcattgtagattctggat

SEQ ID NO: 110980 - DNA, 23 bp, Homo sapiens
taccctgtagaaccgaatttgtg

SEQ ID NO: 110981 - DNA, 23 bp, Homo sapiens
atgtgtatatatgtacatgtgta

SEQ ID NO: 110982 - DNA, 18 bp, Homo sapiens
atgtgtgtatgtgtgtgt

SEQ ID NO: 110983 - DNA, 19 bp, Homo sapiens
agaaacggtgctaatgtgt

SEQ ID NO: 110984 - DNA, 23 bp, Homo sapiens
ctgtcattctcactggctctaat

SEQ ID NO: 110985 - DNA, 23 bp, Homo sapiens
tttttggttccatatgaaattta

SEQ ID NO: 110986 - DNA, 20 bp, Homo sapiens
ttggggaggataacagatgt

SEQ ID NO: 110987 - DNA, 23 bp, Homo sapiens
cacacagactgattttcaattcc

SEQ ID NO: 110988 - DNA, 23 bp, Homo sapiens
atacacacacatatatatgtgtg

SEQ ID NO: 110989 - DNA, 21 bp, Homo sapiens
tatgtgtgtgtatatatatac

SEQ ID NO: 110990 - DNA, 20 bp, Homo sapiens
gtgtgtgtatatatatacac

SEQ ID NO: 110991 - DNA, 23 bp, Homo sapiens
atagatgtcttatttatttgttc

SEQ ID NO: 110992 - DNA, 20 bp, Homo sapiens
tcagttgattgacatttgag

SEQ ID NO: 110993 - DNA, 20 bp, Homo sapiens
atgtgtatagatatatatgt

SEQ ID NO: 110994 - DNA, 21 bp, Homo sapiens
tgtgcatatatgtatatatat

SEQ ID NO: 110995 - DNA, 20 bp, Homo sapiens
atgtgtatagatatatatgt

SEQ ID NO: 110996 - DNA, 18 bp, Homo sapiens
tgagacagagtctcactc

SEQ ID NO: 110997 - DNA, 23 bp, Homo sapiens
tctgagcctcacaaatgaaatct

SEQ ID NO: 110998 - DNA, 23 bp, Homo sapiens
tcagtactgagattgttcatctg

SEQ ID NO: 110999 - DNA, 21 bp, Homo sapiens
tcccagacagagaatgatgag

SEQ ID NO: 111000 - DNA, 18 bp, Homo sapiens
aagaaggtactgagcatg

SEQ ID NO: 111001 - DNA, 23 bp, Homo sapiens
agagtctcactctgtcacccagg

SEQ ID NO: 111002 - DNA, 23 bp, Homo sapiens
tgagttcattgtagattctggat

SEQ ID NO: 111003 - DNA, 23 bp, Homo sapiens
tgagttcattgtagattctggat

SEQ ID NO: 111004 - DNA, 23 bp, Homo sapiens
ttgcgaatgttgaaccagccttg

SEQ ID NO: 111005 - DNA, 19 bp, Homo sapiens
acgtgctgatgttgttaca

SEQ ID NO: 111006 - DNA, 23 bp, Homo sapiens
acatctcagatgagtgtgagcac

SEQ ID NO: 111007 - DNA, 23 bp, Homo sapiens
acgtgtatatatatatatgtgtg

SEQ ID NO: 111008 - DNA, 23 bp, Homo sapiens
ttgagactccatctgtttgagaa

SEQ ID NO: 111009 - DNA, 21 bp, Homo sapiens
catgcatcacttactcatagg

SEQ ID NO: 111010 - DNA, 23 bp, Homo sapiens
ggtgtgggtgtgtgtatatacac

SEQ ID NO: 111011 - DNA, 19 bp, Homo sapiens
atacacatatgtatacata

SEQ ID NO: 111012 - DNA, 23 bp, Homo sapiens
cagagtctcgctctgtcgctcag

SEQ ID NO: 111013 - DNA, 23 bp, Homo sapiens
agattttgaagttcactaagcaa

SEQ ID NO: 111014 - DNA, 23 bp, Homo sapiens
tgaaaagatctactaattgccta

SEQ ID NO: 111015 - DNA, 18 bp, Homo sapiens
tatgtgtctttgtataca

SEQ ID NO: 111016 - DNA, 20 bp, Homo sapiens
tgtgagtcaattaaacctct

SEQ ID NO: 111017 - DNA, 23 bp, Homo sapiens
aaaatgtgcatgttgaagctgtg

SEQ ID NO: 111018 - DNA, 23 bp, Homo sapiens
ccatttgctattgacaaagtaca

SEQ ID NO: 111019 - DNA, 18 bp, Homo sapiens
tgtctgagcaaagggtaa

SEQ ID NO: 111020 - DNA, 23 bp, Homo sapiens
atatattatgtatacatgtatag

SEQ ID NO: 111021 - DNA, 23 bp, Homo sapiens
tggagtctcactctgtcacccag

SEQ ID NO: 111022 - DNA, 20 bp, Homo sapiens
ttgaggagggcattggaaga

SEQ ID NO: 111023 - DNA, 23 bp, Homo sapiens
tccatgacttctcatattgctct

SEQ ID NO: 111024 - DNA, 23 bp, Homo sapiens
tgtatgactgccatcatgcgtgt

SEQ ID NO: 111025 - DNA, 23 bp, Homo sapiens
tgagttcattgtagattctggat

SEQ ID NO: 111026 - DNA, 23 bp, Homo sapiens
tgagttcattgtagattctggat

SEQ ID NO: 111027 - DNA, 18 bp, Homo sapiens
tcggttcactgcaacctc

SEQ ID NO: 111028 - DNA, 20 bp, Homo sapiens
gatattactgttttcttgaa

SEQ ID NO: 111029 - DNA, 23 bp, Homo sapiens
ctgaaacagaagacagagtgctg

SEQ ID NO: 111030 - DNA, 18 bp, Homo sapiens
accaattttaactagaga

SEQ ID NO: 111031 - DNA, 20 bp, Homo sapiens
aaggaagattctctgtgttt

SEQ ID NO: 111032 - DNA, 23 bp, Homo sapiens
acagagtcactgcctggtagaga

SEQ ID NO: 111033 - DNA, 23 bp, Homo sapiens
gggaggctctctctctctctcga

SEQ ID NO: 111034 - DNA, 23 bp, Homo sapiens
tgagttcattgtagattctggat

SEQ ID NO: 111035 - DNA, 23 bp, Homo sapiens
tgagttcattgtagattctggat

SEQ ID NO: 111036 - DNA, 18 bp, Homo sapiens
tgggatcttgatgggaat

SEQ ID NO: 111037 - DNA, 23 bp, Homo sapiens
tgagttcattgtagattctggat

SEQ ID NO: 111038 - DNA, 23 bp, Homo sapiens
tgagttcattgtagattctggat

SEQ ID NO: 111039 - DNA, 23 bp, Homo sapiens
tatttcacagattttgatgtttt

SEQ ID NO: 111040 - DNA, 23 bp, Homo sapiens
ttatctgtggaaaacagatagaa

SEQ ID NO: 111041 - DNA, 23 bp, Homo sapiens
gggacactctctctctgatgtgg

SEQ ID NO: 111042 - DNA, 22 bp, Homo sapiens
agagatgaatgtgagcagacag

SEQ ID NO: 111043 - DNA, 23 bp, Homo sapiens
aatttggttctactaatagcaca

SEQ ID NO: 111044 - DNA, 20 bp, Homo sapiens
atgaaactttcaagtaattg

SEQ ID NO: 111045 - DNA, 21 bp, Homo sapiens
tcagtctctttttctgtctta

SEQ ID NO: 111046 - DNA, 23 bp, Homo sapiens
gaattgctatgacagagagagat

SEQ ID NO: 111047 - DNA, 22 bp, Homo sapiens
ataagacacagcattagaagat

SEQ ID NO: 111048 - DNA, 18 bp, Homo sapiens
tctttatttgcttgagtg

SEQ ID NO: 111049 - DNA, 22 bp, Homo sapiens
atacacatatgtatatgtgtgt

SEQ ID NO: 111050 - DNA, 22 bp, Homo sapiens
gtctcactctgtcacccaggct

SEQ ID NO: 111051 - DNA, 23 bp, Homo sapiens
gagaagatacttgatagaatttc

SEQ ID NO: 111052 - DNA, 23 bp, Homo sapiens
tatacactggatcatatgtgtgt

SEQ ID NO: 111053 - DNA, 21 bp, Homo sapiens
tatgcgtgtatatatgtatgt

SEQ ID NO: 111054 - DNA, 18 bp, Homo sapiens
ggctgtacatgcacataa

SEQ ID NO: 111055 - DNA, 23 bp, Homo sapiens
gtactgtgcatgtatgagtgttt

SEQ ID NO: 111056 - DNA, 23 bp, Homo sapiens
tcactctctcaagtgtgcagatt

SEQ ID NO: 111057 - DNA, 23 bp, Homo sapiens
tgagttcattgtagattctggat

SEQ ID NO: 111058 - DNA, 23 bp, Homo sapiens
tgagttcattgtagattctggat

SEQ ID NO: 111059 - DNA, 23 bp, Homo sapiens
tgtgaatagagatagctattgaa

SEQ ID NO: 111060 - DNA, 23 bp, Homo sapiens
taatatgtacatatacatgttaa

SEQ ID NO: 111061 - DNA, 23 bp, Homo sapiens
tgacacactgagaccctgtctct

SEQ ID NO: 111062 - DNA, 23 bp, Homo sapiens
atttaggcagtgtttcatatgtc

SEQ ID NO: 111063 - DNA, 23 bp, Homo sapiens
tgagttcattgtagattctggat

SEQ ID NO: 111064 - DNA, 23 bp, Homo sapiens
tgagttcattgtagattctggat

SEQ ID NO: 111065 - DNA, 23 bp, Homo sapiens
catgtatgtacatatgtgtgtgt

SEQ ID NO: 111066 - DNA, 23 bp, Homo sapiens
tgagttcattgtagattctggat

SEQ ID NO: 111067 - DNA, 23 bp, Homo sapiens
tgagttcattgtagattctggat

SEQ ID NO: 111068 - DNA, 21 bp, Homo sapiens
tacagtaatgatttagtactt

SEQ ID NO: 111069 - DNA, 23 bp, Homo sapiens
tgagttcattgtagattctggat

SEQ ID NO: 111070 - DNA, 21 bp, Homo sapiens
taagtgacgtaaactggagaa

SEQ ID NO: 111071 - DNA, 23 bp, Homo sapiens
atacacacatatatatgtgtata

SEQ ID NO: 111072 - DNA, 18 bp, Homo sapiens
atacacacacatatatgt

SEQ ID NO: 111073 - DNA, 23 bp, Homo sapiens
atatatgtgtatatgtatatatg

SEQ ID NO: 111074 - DNA, 23 bp, Homo sapiens
tatatatgtgtatatgtatatat

SEQ ID NO: 111075 - DNA, 23 bp, Homo sapiens
ggctgtcactctgtcacccaggc

SEQ ID NO: 111076 - DNA, 23 bp, Homo sapiens
cagtggtgtgatcatagctgact

SEQ ID NO: 111077 - DNA, 23 bp, Homo sapiens
ttgaaagtatttcatttaggata

SEQ ID NO: 111078 - DNA, 23 bp, Homo sapiens
tgagttcattgtagattctggat

SEQ ID NO: 111079 - DNA, 23 bp, Homo sapiens
tgagttcattgtagattctggat

SEQ ID NO: 111080 - DNA, 23 bp, Homo sapiens
aaaggattgtttatgttgtgccc

SEQ ID NO: 111081 - DNA, 23 bp, Homo sapiens
tttgtatatatatacatttgtgt

SEQ ID NO: 111082 - DNA, 21 bp, Homo sapiens
tttgtatatatatacatttgt

SEQ ID NO: 111083 - DNA, 22 bp, Homo sapiens
atagaaatagcattgggtctgt

SEQ ID NO: 111084 - DNA, 23 bp, Homo sapiens
tgagttcattgtagattctggat

SEQ ID NO: 111085 - DNA, 23 bp, Homo sapiens
tgagttcattgtagattctggat

SEQ ID NO: 111086 - DNA, 23 bp, Homo sapiens
actcctttcttattgtgagacaa

SEQ ID NO: 111087 - DNA, 22 bp, Homo sapiens
tgtggttgtaagttgtatcctt

SEQ ID NO: 111088 - DNA, 19 bp, Homo sapiens
tccctctctcggtctctca

SEQ ID NO: 111089 - DNA, 22 bp, Homo sapiens
ttcagactgtgactgattgagg

SEQ ID NO: 111090 - DNA, 23 bp, Homo sapiens
tacatactttctggtggagttgt

SEQ ID NO: 111091 - DNA, 22 bp, Homo sapiens
tgacaacaagcaggagtgacca

SEQ ID NO: 111092 - DNA, 23 bp, Homo sapiens
atttgtctgaggttcttttgtat

SEQ ID NO: 111093 - DNA, 23 bp, Homo sapiens
gtgtgtctgtcaggtttcgatat

SEQ ID NO: 111094 - DNA, 22 bp, Homo sapiens
tgtgtgtatatatgtatgtatg

SEQ ID NO: 111095 - DNA, 23 bp, Homo sapiens
tgagttcattgtagattctggat

SEQ ID NO: 111096 - DNA, 23 bp, Homo sapiens
tgagttcattgtagattctggat

SEQ ID NO: 111097 - DNA, 23 bp, Homo sapiens
cggagtctcactctgtcacccag

SEQ ID NO: 111098 - DNA, 23 bp, Homo sapiens
tataccactgtctgcatggaggc

SEQ ID NO: 111099 - DNA, 23 bp, Homo sapiens
gaggcagtatgtacaaagtggat

SEQ ID NO: 111100 - DNA, 21 bp, Homo sapiens
tatgtgtgtgtgtgtatatat

SEQ ID NO: 111101 - DNA, 23 bp, Homo sapiens
agagtgaagagaaacagtttgtt

SEQ ID NO: 111102 - DNA, 21 bp, Homo sapiens
atctgcttctttataatgtct

SEQ ID NO: 111103 - DNA, 23 bp, Homo sapiens
ttttacctaaactagctgagata

SEQ ID NO: 111104 - DNA, 22 bp, Homo sapiens
tcttaggcacagagtttctggt

SEQ ID NO: 111105 - DNA, 22 bp, Homo sapiens
tggctcactgcagcctctgcct

SEQ ID NO: 111106 - DNA, 23 bp, Homo sapiens
acagagtttttgatgatgattta

SEQ ID NO: 111107 - DNA, 23 bp, Homo sapiens
gtgtgtgtgtatatctatacaca

SEQ ID NO: 111108 - DNA, 23 bp, Homo sapiens
tttttgaatttgaatttgtactg

SEQ ID NO: 111109 - DNA, 23 bp, Homo sapiens
agagtctcactctgtcacccagg

SEQ ID NO: 111110 - DNA, 23 bp, Homo sapiens
gagtctcactctgtcacccaggc

SEQ ID NO: 111111 - DNA, 19 bp, Homo sapiens
tgtatatgtatatgtatat

SEQ ID NO: 111112 - DNA, 23 bp, Homo sapiens
tgtatatgtatatgtatatgtgt

SEQ ID NO: 111113 - DNA, 23 bp, Homo sapiens
tgaggtggagtctcactctgtca

SEQ ID NO: 111114 - DNA, 23 bp, Homo sapiens
gtcggagtctcgctcgctctgtc

SEQ ID NO: 111115 - DNA, 23 bp, Homo sapiens
cggagtctcactgtgtctccagg

SEQ ID NO: 111116 - DNA, 23 bp, Homo sapiens
tggttatcagagccttgctcagt

SEQ ID NO: 111117 - DNA, 23 bp, Homo sapiens
actctgcaagttgttgttgttgt

SEQ ID NO: 111118 - DNA, 23 bp, Homo sapiens
agacacagggagctttgaagaat

SEQ ID NO: 111119 - DNA, 23 bp, Homo sapiens
tgagttcattgtagattctggat

SEQ ID NO: 111120 - DNA, 23 bp, Homo sapiens
tgagttcattgtagattctggat

SEQ ID NO: 111121 - DNA, 19 bp, Homo sapiens
tgtgtatatgtatatacat

SEQ ID NO: 111122 - DNA, 22 bp, Homo sapiens
tgtggtttattgtagcattgat

SEQ ID NO: 111123 - DNA, 19 bp, Homo sapiens
aagaggaaaattttcagcc

SEQ ID NO: 111124 - DNA, 19 bp, Homo sapiens
ctggggatcatgaggctga

SEQ ID NO: 111125 - DNA, 18 bp, Homo sapiens
ataagtacatgtatctgt

SEQ ID NO: 111126 - DNA, 23 bp, Homo sapiens
ttatgtcttgtagaagttaccaa

SEQ ID NO: 111127 - DNA, 23 bp, Homo sapiens
gactgagtctcgctctgtcaccc

SEQ ID NO: 111128 - DNA, 23 bp, Homo sapiens
tgagttcattgtagattctggat

SEQ ID NO: 111129 - DNA, 23 bp, Homo sapiens
tgagttcattgtagattctggat

SEQ ID NO: 111130 - DNA, 22 bp, Homo sapiens
tgaacagtatggaagagtgtgg

SEQ ID NO: 111131 - DNA, 23 bp, Homo sapiens
gtcactgtctttctctctatgca

SEQ ID NO: 111132 - DNA, 23 bp, Homo sapiens
tatgtatgtatgtatatgtgtgt

SEQ ID NO: 111133 - DNA, 19 bp, Homo sapiens
acacacatatatacacgca

SEQ ID NO: 111134 - DNA, 21 bp, Homo sapiens
tgtgaagaaagtcattggtag

SEQ ID NO: 111135 - DNA, 23 bp, Homo sapiens
tgagttcattgtagattctggat

SEQ ID NO: 111136 - DNA, 23 bp, Homo sapiens
tgagttcattgtagattctggat

SEQ ID NO: 111137 - DNA, 22 bp, Homo sapiens
tgtgtgtgtatatatatatgtg

SEQ ID NO: 111138 - DNA, 22 bp, Homo sapiens
atatctatatatctatatgtat

SEQ ID NO: 111139 - DNA, 20 bp, Homo sapiens
gttaatattgttatgtgtga

SEQ ID NO: 111140 - DNA, 22 bp, Homo sapiens
atgatgttagctggttattttg

SEQ ID NO: 111141 - DNA, 19 bp, Homo sapiens
tagatacatgtatacatgt

SEQ ID NO: 111142 - DNA, 21 bp, Homo sapiens
tctatgcatatatacatgtat

SEQ ID NO: 111143 - DNA, 18 bp, Homo sapiens
tacatatatatgtgttgt

SEQ ID NO: 111144 - DNA, 23 bp, Homo sapiens
atgtgtatatatatgtatgtgtg

SEQ ID NO: 111145 - DNA, 23 bp, Homo sapiens
atgagaagaagtagcagtgatct

SEQ ID NO: 111146 - DNA, 20 bp, Homo sapiens
tatatacatgtatgcacgtg

SEQ ID NO: 111147 - DNA, 23 bp, Homo sapiens
ttgtgaggaatgaagtctgggtg

SEQ ID NO: 111148 - DNA, 20 bp, Homo sapiens
atatatgcttatatatatgt

SEQ ID NO: 111149 - DNA, 18 bp, Homo sapiens
tctctactcgggattgtg

SEQ ID NO: 111150 - DNA, 23 bp, Homo sapiens
atctcagagccagtggaagagat

SEQ ID NO: 111151 - DNA, 23 bp, Homo sapiens
ccatctcactctgcctctctctc

SEQ ID NO: 111152 - DNA, 20 bp, Homo sapiens
attgctttacaatattcttt

SEQ ID NO: 111153 - DNA, 23 bp, Homo sapiens
agggtctcactctgtcactcagg

SEQ ID NO: 111154 - DNA, 22 bp, Homo sapiens
agactgacattttttttttttg

SEQ ID NO: 111155 - DNA, 18 bp, Homo sapiens
ttacagaagaatgcatat

SEQ ID NO: 111156 - DNA, 22 bp, Homo sapiens
acttgtgcatatgtgtttctct

SEQ ID NO: 111157 - DNA, 18 bp, Homo sapiens
tgcaataattatgggagt

SEQ ID NO: 111158 - DNA, 23 bp, Homo sapiens
aggcaaactcagaactcagtgcc

SEQ ID NO: 111159 - DNA, 23 bp, Homo sapiens
atctgtctctctctctctctggg

SEQ ID NO: 111160 - DNA, 22 bp, Homo sapiens
tggagacagactctcgctctgt

SEQ ID NO: 111161 - DNA, 23 bp, Homo sapiens
tgagttcattgtagattctggat

SEQ ID NO: 111162 - DNA, 23 bp, Homo sapiens
tgagttcattgtagattctggat

SEQ ID NO: 111163 - DNA, 23 bp, Homo sapiens
tgagttcattgtagattctggat

SEQ ID NO: 111164 - DNA, 23 bp, Homo sapiens
tgagttcattgtagattctggat

SEQ ID NO: 111165 - DNA, 21 bp, Homo sapiens
tctaaacatcctacagtgcac

SEQ ID NO: 111166 - DNA, 23 bp, Homo sapiens
aagcaagtctactggtggcattt

SEQ ID NO: 111167 - DNA, 23 bp, Homo sapiens
tgtgtctctgtgtcacattttgg

SEQ ID NO: 111168 - DNA, 18 bp, Homo sapiens
atgtatcattttgtattc

SEQ ID NO: 111169 - DNA, 23 bp, Homo sapiens
catatgtgtatatgtatatatgt

SEQ ID NO: 111170 - DNA, 23 bp, Homo sapiens
tatgctgtataatgaggttttgg

SEQ ID NO: 111171 - DNA, 19 bp, Homo sapiens
tgacagtacaaagtgagga

SEQ ID NO: 111172 - DNA, 23 bp, Homo sapiens
tgagaccgagtctcactgtgtca

SEQ ID NO: 111173 - DNA, 22 bp, Homo sapiens
tttcagagaagtttctttgtag

SEQ ID NO: 111174 - DNA, 21 bp, Homo sapiens
aagtcctgctgctacagccag

SEQ ID NO: 111175 - DNA, 23 bp, Homo sapiens
ctcccagagcccctggaactctg

SEQ ID NO: 111176 - DNA, 23 bp, Homo sapiens
tcccagagcccctggaactctgg

SEQ ID NO: 111177 - DNA, 23 bp, Homo sapiens
tcccagagcccctggaactctgg

SEQ ID NO: 111178 - DNA, 23 bp, Homo sapiens
tcccagagcccctggaactctgg

SEQ ID NO: 111179 - DNA, 23 bp, Homo sapiens
cgtctgtgtctgtgtgtgtgcat

SEQ ID NO: 111180 - DNA, 23 bp, Homo sapiens
tgagatggagtttcactctcact

SEQ ID NO: 111181 - DNA, 23 bp, Homo sapiens
tacaaggatgtgtgtatatatgt

SEQ ID NO: 111182 - DNA, 23 bp, Homo sapiens
aattttcagaattccagttcttc

SEQ ID NO: 111183 - DNA, 23 bp, Homo sapiens
acaggtaaagggctagaaatttt

SEQ ID NO: 111184 - DNA, 23 bp, Homo sapiens
gatggagtctcactctgtcaccc

SEQ ID NO: 111185 - DNA, 22 bp, Homo sapiens
ggaaatcatggcagtgaggtct

SEQ ID NO: 111186 - DNA, 23 bp, Homo sapiens
acacatctcagtgagtacatgcc

SEQ ID NO: 111187 - DNA, 20 bp, Homo sapiens
tacacacacacatatatatc

SEQ ID NO: 111188 - DNA, 23 bp, Homo sapiens
cagcacagagaaagcagaagaga

SEQ ID NO: 111189 - DNA, 22 bp, Homo sapiens
actgctagtatgtatatattaa

SEQ ID NO: 111190 - DNA, 23 bp, Homo sapiens
gtattcttttgagtttctgatta

SEQ ID NO: 111191 - DNA, 23 bp, Homo sapiens
atatgtacatatacatacacata

SEQ ID NO: 111192 - DNA, 23 bp, Homo sapiens
atgtgtatatatgtatatgtgtg

SEQ ID NO: 111193 - DNA, 23 bp, Homo sapiens
gacggagtgtccctctgtcactc

SEQ ID NO: 111194 - DNA, 23 bp, Homo sapiens
atggtttactaggagaacacatg

SEQ ID NO: 111195 - DNA, 23 bp, Homo sapiens
cagacccagtgacaggtgtgtga

SEQ ID NO: 111196 - DNA, 23 bp, Homo sapiens
ggagtctcactctgtcacccagg

SEQ ID NO: 111197 - DNA, 23 bp, Homo sapiens
tggagtctcactctgtcacccag

SEQ ID NO: 111198 - DNA, 23 bp, Homo sapiens
tatgtgtgtgtatatgtatgtgt

SEQ ID NO: 111199 - DNA, 23 bp, Homo sapiens
tgagttcattgtagattctggat

SEQ ID NO: 111200 - DNA, 23 bp, Homo sapiens
tgagttcattgtagattctggat

SEQ ID NO: 111201 - DNA, 23 bp, Homo sapiens
acagagtctcactctgtcgccca

SEQ ID NO: 111202 - DNA, 23 bp, Homo sapiens
tgtctcactctgtcacctaggct

SEQ ID NO: 111203 - DNA, 18 bp, Homo sapiens
acagtggtgtgatctcag

SEQ ID NO: 111204 - DNA, 18 bp, Homo sapiens
aagtgctgggattacagg

SEQ ID NO: 111205 - DNA, 23 bp, Homo sapiens
atttgggctgaaaatgaagttca

SEQ ID NO: 111206 - DNA, 18 bp, Homo sapiens
ttttttccctttctgttg

SEQ ID NO: 111207 - DNA, 23 bp, Homo sapiens
ggctcacacctgtaatcccagca

SEQ ID NO: 111208 - DNA, 22 bp, Homo sapiens
tgaggtagctggatcatttgag

SEQ ID NO: 111209 - DNA, 23 bp, Homo sapiens
agagtctcactctgtcacccagg

SEQ ID NO: 111210 - DNA, 23 bp, Homo sapiens
agacaagagtctcactctgtcac

SEQ ID NO: 111211 - DNA, 21 bp, Homo sapiens
ctcactcaagtgattctcttg

SEQ ID NO: 111212 - DNA, 23 bp, Homo sapiens
tttctgtctgactctgactcccc

SEQ ID NO: 111213 - DNA, 21 bp, Homo sapiens
tgagatggagtcactctgttg

SEQ ID NO: 111214 - DNA, 23 bp, Homo sapiens
gtgtctctgggtccctgtgtcca

SEQ ID NO: 111215 - DNA, 22 bp, Homo sapiens
tacagtgacacgatttcagctc

SEQ ID NO: 111216 - DNA, 21 bp, Homo sapiens
cgtgtgccaccacactcagct

SEQ ID NO: 111217 - DNA, 22 bp, Homo sapiens
tttcaccatgttgaccaggctg

SEQ ID NO: 111218 - DNA, 19 bp, Homo sapiens
tcactgcaacctccaactg

SEQ ID NO: 111219 - DNA, 23 bp, Homo sapiens
tcacagtagaatgtctgctccag

SEQ ID NO: 111220 - DNA, 22 bp, Homo sapiens
tcagaacacagtcaggttagag

SEQ ID NO: 111221 - DNA, 23 bp, Homo sapiens
catgagtaagcagtgtgtgatgt

SEQ ID NO: 111222 - DNA, 19 bp, Homo sapiens
ttcttggtctgagagatga

SEQ ID NO: 111223 - DNA, 23 bp, Homo sapiens
gtccaaacagagcagagagtgcc

SEQ ID NO: 111224 - DNA, 23 bp, Homo sapiens
gactgatgactggcactgcagag

SEQ ID NO: 111225 - DNA, 23 bp, Homo sapiens
tcacagtcactctgacttccttc

SEQ ID NO: 111226 - DNA, 21 bp, Homo sapiens
agactggcaggtttcgctgtc

SEQ ID NO: 111227 - DNA, 23 bp, Homo sapiens
cagtaaccagcagtttgcagaaa

SEQ ID NO: 111228 - DNA, 23 bp, Homo sapiens
tatgtgtatatatatgtatgtgt

SEQ ID NO: 111229 - DNA, 23 bp, Homo sapiens
cctcactctatcgctctgtgttt

SEQ ID NO: 111230 - DNA, 23 bp, Homo sapiens
tgagttcattgtagattctggat

SEQ ID NO: 111231 - DNA, 23 bp, Homo sapiens
tgagttcattgtagattctggat

SEQ ID NO: 111232 - DNA, 23 bp, Homo sapiens
tctatctatctatctgtctgtct

SEQ ID NO: 111233 - DNA, 20 bp, Homo sapiens
tgtggttttaatttgtattt

SEQ ID NO: 111234 - DNA, 22 bp, Homo sapiens
atttgtatttcttcttctgaga

SEQ ID NO: 111235 - DNA, 18 bp, Homo sapiens
tacaacttttgtttgtca

SEQ ID NO: 111236 - DNA, 23 bp, Homo sapiens
tgagtgtagacactgtgctcttg

SEQ ID NO: 111237 - DNA, 19 bp, Homo sapiens
agaagtaaagttcctgttt

SEQ ID NO: 111238 - DNA, 22 bp, Homo sapiens
gatttcagtggatatcagattg

SEQ ID NO: 111239 - DNA, 22 bp, Homo sapiens
ttttggtgcataagtaaatata

SEQ ID NO: 111240 - DNA, 23 bp, Homo sapiens
acagagccagagtttgctcttca

SEQ ID NO: 111241 - DNA, 23 bp, Homo sapiens
tgtgtgtgtgtatatatatatgt

SEQ ID NO: 111242 - DNA, 18 bp, Homo sapiens
gtatgtctatgcttacag

SEQ ID NO: 111243 - DNA, 20 bp, Homo sapiens
ccctgagcatgtactgtgtg

SEQ ID NO: 111244 - DNA, 23 bp, Homo sapiens
tgacagatcagagtgagaggcgc

SEQ ID NO: 111245 - DNA, 23 bp, Homo sapiens
tatttgtctggttatgttattgt

SEQ ID NO: 111246 - DNA, 23 bp, Homo sapiens
ttgtgttacatgttactctcaga

SEQ ID NO: 111247 - DNA, 23 bp, Homo sapiens
tggagtctcactctgtcacccag

SEQ ID NO: 111248 - DNA, 23 bp, Homo sapiens
agagtctcactctgtcatccagg

SEQ ID NO: 111249 - DNA, 23 bp, Homo sapiens
tcactgccagactctctccaacc

SEQ ID NO: 111250 - DNA, 23 bp, Homo sapiens
tgatggagtctcacactgtcacc

SEQ ID NO: 111251 - DNA, 23 bp, Homo sapiens
tgggtctcactctgtctcccagg

SEQ ID NO: 111252 - DNA, 21 bp, Homo sapiens
aatgcagtggtgggggtggga

SEQ ID NO: 111253 - DNA, 22 bp, Homo sapiens
aggtgtgagccactgtgcctgg

SEQ ID NO: 111254 - DNA, 23 bp, Homo sapiens
atgtatcagtgacttttctgtag

SEQ ID NO: 111255 - DNA, 23 bp, Homo sapiens
cagagtctcactgtgtcatccag

SEQ ID NO: 111256 - DNA, 21 bp, Homo sapiens
cagtggcaggatcttggctca

SEQ ID NO: 111257 - DNA, 23 bp, Homo sapiens
gacagagtctcgctctgtcaccc

SEQ ID NO: 111258 - DNA, 23 bp, Homo sapiens
ttacaaattgtcttaaagttctg

SEQ ID NO: 111259 - DNA, 23 bp, Homo sapiens
agtttgagaggcattggattaga

SEQ ID NO: 111260 - DNA, 23 bp, Homo sapiens
tctaaagatagatttgttattat

SEQ ID NO: 111261 - DNA, 22 bp, Homo sapiens
tgtaactcagtttttcatctgc

SEQ ID NO: 111262 - DNA, 23 bp, Homo sapiens
acagagtctcactgtgtcaccca

SEQ ID NO: 111263 - DNA, 18 bp, Homo sapiens
tgagatcttggatcactg

SEQ ID NO: 111264 - DNA, 23 bp, Homo sapiens
tctgtctgtgtgtgagtgagtgc

SEQ ID NO: 111265 - DNA, 19 bp, Homo sapiens
acacagcaagaccctgtct

SEQ ID NO: 111266 - DNA, 23 bp, Homo sapiens
tgacacagagtcttctcactctg

SEQ ID NO: 111267 - DNA, 21 bp, Homo sapiens
ctggctctcactctctcgccc

SEQ ID NO: 111268 - DNA, 23 bp, Homo sapiens
gacagagtctcgctctgtcaccc

SEQ ID NO: 111269 - DNA, 19 bp, Homo sapiens
tagggtttcagacaatttt

SEQ ID NO: 111270 - DNA, 23 bp, Homo sapiens
ccaagtctcgctctgtcacccag

SEQ ID NO: 111271 - DNA, 20 bp, Homo sapiens
gaaaaaggtggagatttcgt

SEQ ID NO: 111272 - DNA, 23 bp, Homo sapiens
catcaagttgttcatctgtttgg

SEQ ID NO: 111273 - DNA, 23 bp, Homo sapiens
actgggtctctgtggctctctct

SEQ ID NO: 111274 - DNA, 23 bp, Homo sapiens
tgagttcattgtagattctggat

SEQ ID NO: 111275 - DNA, 23 bp, Homo sapiens
tgagttcattgtagattctggat

SEQ ID NO: 111276 - DNA, 23 bp, Homo sapiens
attcctttaaaatgtaatcatca

SEQ ID NO: 111277 - DNA, 23 bp, Homo sapiens
ttatgtgagtccttatgcattag

SEQ ID NO: 111278 - DNA, 21 bp, Homo sapiens
attgcctacaataacaattga

SEQ ID NO: 111279 - DNA, 23 bp, Homo sapiens
tgtttattgaacaggtgctgggt

SEQ ID NO: 111280 - DNA, 23 bp, Homo sapiens
atctctgtgtgagtggttgtgaa

SEQ ID NO: 111281 - DNA, 23 bp, Homo sapiens
ttagatgttgttatcttaacatc

SEQ ID NO: 111282 - DNA, 23 bp, Homo sapiens
ttatctgtaatagatgttaagat

SEQ ID NO: 111283 - DNA, 19 bp, Homo sapiens
tttgaggattaggttttgt

SEQ ID NO: 111284 - DNA, 23 bp, Homo sapiens
tgagttcattgtagattctggat

SEQ ID NO: 111285 - DNA, 23 bp, Homo sapiens
tgagttcattgtagattctggat

SEQ ID NO: 111286 - DNA, 23 bp, Homo sapiens
gacagggtctcactctgccactg

SEQ ID NO: 111287 - DNA, 18 bp, Homo sapiens
aagtgagactttgaggag

SEQ ID NO: 111288 - DNA, 23 bp, Homo sapiens
tctctctctctgtgttacatggc

SEQ ID NO: 111289 - DNA, 23 bp, Homo sapiens
cggagtctcgctctgtctcccag

SEQ ID NO: 111290 - DNA, 23 bp, Homo sapiens
gtatgcatgcatctgtgtctaaa

SEQ ID NO: 111291 - DNA, 21 bp, Homo sapiens
tgggaggtaggctgtttccaa

SEQ ID NO: 111292 - DNA, 23 bp, Homo sapiens
gagacggagtctcacactgtctc

SEQ ID NO: 111293 - DNA, 23 bp, Homo sapiens
tcagacttctgactttgttcttc

SEQ ID NO: 111294 - DNA, 23 bp, Homo sapiens
atacacacacatatacatatgta

SEQ ID NO: 111295 - DNA, 23 bp, Homo sapiens
atacacacacacatatatatatg

SEQ ID NO: 111296 - DNA, 23 bp, Homo sapiens
tatacacacacatatatatatgt

SEQ ID NO: 111297 - DNA, 23 bp, Homo sapiens
tatacacacacatatatatatgt

SEQ ID NO: 111298 - DNA, 23 bp, Homo sapiens
aagtacatttgattttgaatttc

SEQ ID NO: 111299 - DNA, 23 bp, Homo sapiens
tgagttcattgtagattctggat

SEQ ID NO: 111300 - DNA, 23 bp, Homo sapiens
tgagttcattgtagattctggat

SEQ ID NO: 111301 - DNA, 20 bp, Homo sapiens
acataagagtgacagcacat

SEQ ID NO: 111302 - DNA, 23 bp, Homo sapiens
tcatattgctgtagtttggggct

SEQ ID NO: 111303 - DNA, 19 bp, Homo sapiens
agtaaattattatttgtga

SEQ ID NO: 111304 - DNA, 22 bp, Homo sapiens
aggcttcaaaatcttcactctg

SEQ ID NO: 111305 - DNA, 23 bp, Homo sapiens
aacacatgtgttatacatgttat

SEQ ID NO: 111306 - DNA, 20 bp, Homo sapiens
ataacacgtgttatacatgt

SEQ ID NO: 111307 - DNA, 23 bp, Homo sapiens
tgtccactttttgatgggtttgt

SEQ ID NO: 111308 - DNA, 22 bp, Homo sapiens
tagtacaaaggtctagctggaa

SEQ ID NO: 111309 - DNA, 22 bp, Homo sapiens
tctgtcaggcagttttactggt

SEQ ID NO: 111310 - DNA, 21 bp, Homo sapiens
ttgtgcttcatcaaatgctgt

SEQ ID NO: 111311 - DNA, 23 bp, Homo sapiens
tcacagcaattgctcttgaaaaa

SEQ ID NO: 111312 - DNA, 23 bp, Homo sapiens
ttgagtccagaaggtggaggttg

SEQ ID NO: 111313 - DNA, 22 bp, Homo sapiens
tagttgtcagatgaaactgtac

SEQ ID NO: 111314 - DNA, 23 bp, Homo sapiens
tggttgtagctggtattgattac

SEQ ID NO: 111315 - DNA, 23 bp, Homo sapiens
tgagttcattgtagattctggat

SEQ ID NO: 111316 - DNA, 23 bp, Homo sapiens
tgagttcattgtagattctggat

SEQ ID NO: 111317 - DNA, 23 bp, Homo sapiens
tgagttcattgtagattctggat

SEQ ID NO: 111318 - DNA, 23 bp, Homo sapiens
tgagttcattgtagattctggat

SEQ ID NO: 111319 - DNA, 23 bp, Homo sapiens
cggagtctcactctgtcacccag

SEQ ID NO: 111320 - DNA, 23 bp, Homo sapiens
agtctctagaagctgctgtgtct

SEQ ID NO: 111321 - DNA, 22 bp, Homo sapiens
tttggagcaataagatgtgatt

SEQ ID NO: 111322 - DNA, 23 bp, Homo sapiens
tggagtctcactctgtcacccag

SEQ ID NO: 111323 - DNA, 23 bp, Homo sapiens
agagtcagcatgaccaagtgata

SEQ ID NO: 111324 - DNA, 22 bp, Homo sapiens
cagcattgtaaagtgttttgta

SEQ ID NO: 111325 - DNA, 23 bp, Homo sapiens
tgtacatatatgtatatgtacat

SEQ ID NO: 111326 - DNA, 23 bp, Homo sapiens
aataggatatatatatatgtgtg

SEQ ID NO: 111327 - DNA, 23 bp, Homo sapiens
tatgcatgtatctatatatgtat

SEQ ID NO: 111328 - DNA, 20 bp, Homo sapiens
atatgtatgtatatatatgt

SEQ ID NO: 111329 - DNA, 21 bp, Homo sapiens
ttctggttcatgtcatcttca

SEQ ID NO: 111330 - DNA, 23 bp, Homo sapiens
gttgaggaagtagctactattct

SEQ ID NO: 111331 - DNA, 23 bp, Homo sapiens
atatgtgtgtatgtatatgtgtg

SEQ ID NO: 111332 - DNA, 23 bp, Homo sapiens
gtgtatatatatgtatgtgtgtg

SEQ ID NO: 111333 - DNA, 21 bp, Homo sapiens
cttgtgagaagaaagacagca

SEQ ID NO: 111334 - DNA, 23 bp, Homo sapiens
tgagaggtgacagtgtgctggca

SEQ ID NO: 111335 - DNA, 21 bp, Homo sapiens
tatctgggactacagctgcac

SEQ ID NO: 111336 - DNA, 23 bp, Homo sapiens
atgttgtctgtctggtcttgaac

SEQ ID NO: 111337 - DNA, 20 bp, Homo sapiens
cattcctgtagtcccagcta

SEQ ID NO: 111338 - DNA, 21 bp, Homo sapiens
tgagtcattttcttgatctct

SEQ ID NO: 111339 - DNA, 23 bp, Homo sapiens
tagttggagagtgtcaaaggaat

SEQ ID NO: 111340 - DNA, 18 bp, Homo sapiens
tgtgctcatggagaggag

SEQ ID NO: 111341 - DNA, 22 bp, Homo sapiens
cttcctggatgtgtcaacttgg

SEQ ID NO: 111342 - DNA, 23 bp, Homo sapiens
tgtgtgtgtgtatgtgtatatgt

SEQ ID NO: 111343 - DNA, 21 bp, Homo sapiens
tacacatacccatatgtatat

SEQ ID NO: 111344 - DNA, 21 bp, Homo sapiens
tatccatcactgcctgtgctt

SEQ ID NO: 111345 - DNA, 18 bp, Homo sapiens
ttttctgaacgtttcctg

SEQ ID NO: 111346 - DNA, 20 bp, Homo sapiens
tggtactaggaagaaaagtt

SEQ ID NO: 111347 - DNA, 22 bp, Homo sapiens
tcttatctgccttgtctccctg

SEQ ID NO: 111348 - DNA, 23 bp, Homo sapiens
tatgacccatgttcatctcacag

SEQ ID NO: 111349 - DNA, 23 bp, Homo sapiens
agggtcacactctgtcacttagg

SEQ ID NO: 111350 - DNA, 23 bp, Homo sapiens
tgcagagagaagagacagtgggg

SEQ ID NO: 111351 - DNA, 23 bp, Homo sapiens
actcagcctgcctctctgggtcc

SEQ ID NO: 111352 - DNA, 18 bp, Homo sapiens
tcactccttttcctactg

SEQ ID NO: 111353 - DNA, 23 bp, Homo sapiens
gtcactggatcaacaaagtggtt

SEQ ID NO: 111354 - DNA, 20 bp, Homo sapiens
gagtggtgtcctcataggta

SEQ ID NO: 111355 - DNA, 23 bp, Homo sapiens
cttttcttggggctcagtgagtt

SEQ ID NO: 111356 - DNA, 22 bp, Homo sapiens
cagtcaatattgttctgtgagg

SEQ ID NO: 111357 - DNA, 20 bp, Homo sapiens
aaagaagtagtggaggatga

SEQ ID NO: 111358 - DNA, 23 bp, Homo sapiens
aagatggtgttgaatagtctctg

SEQ ID NO: 111359 - DNA, 20 bp, Homo sapiens
tgacacaggatggtctttct

SEQ ID NO: 111360 - DNA, 22 bp, Homo sapiens
aaagtgaggtaactggaagaag

SEQ ID NO: 111361 - DNA, 22 bp, Homo sapiens
gagatggagtctcactctgtca

SEQ ID NO: 111362 - DNA, 23 bp, Homo sapiens
ttctctcttgaaatgtttccaac

SEQ ID NO: 111363 - DNA, 23 bp, Homo sapiens
tatgtgtgtgtgtgtacatgtgt

SEQ ID NO: 111364 - DNA, 22 bp, Homo sapiens
tccagagaagagagtgtgccca

SEQ ID NO: 111365 - DNA, 23 bp, Homo sapiens
gtatctcaggaaggtgttggcag

SEQ ID NO: 111366 - DNA, 23 bp, Homo sapiens
gtgagtgtgtgtgtgcctgtgtg

SEQ ID NO: 111367 - DNA, 22 bp, Homo sapiens
tagaggagccactgaatgaggt

SEQ ID NO: 111368 - DNA, 23 bp, Homo sapiens
gtctgtctgcatcttgttattgg

SEQ ID NO: 111369 - DNA, 22 bp, Homo sapiens
ttcaagtaattcaggataggtt

SEQ ID NO: 111370 - DNA, 23 bp, Homo sapiens
cactctgtcactcagactgcagt

SEQ ID NO: 111371 - DNA, 23 bp, Homo sapiens
ttttgagacggagtctcacactg

SEQ ID NO: 111372 - DNA, 23 bp, Homo sapiens
acagagtctcgctctgtcaccca

SEQ ID NO: 111373 - DNA, 23 bp, Homo sapiens
ggagtctcacactgtcacccagg

SEQ ID NO: 111374 - DNA, 23 bp, Homo sapiens
cagtgtctcactctgtcacccag

SEQ ID NO: 111375 - DNA, 19 bp, Homo sapiens
aagagcctacagcatcagc

SEQ ID NO: 111376 - DNA, 21 bp, Homo sapiens
tatatgcatatatatacatat

SEQ ID NO: 111377 - DNA, 23 bp, Homo sapiens
gtgagtcagcgctgactgtctct

SEQ ID NO: 111378 - DNA, 19 bp, Homo sapiens
cacagatgtgagtcagcac

SEQ ID NO: 111379 - DNA, 23 bp, Homo sapiens
ctgactccctgacagcctccccc

SEQ ID NO: 111380 - DNA, 23 bp, Homo sapiens
cctctctgtgtctcagtcttcct

SEQ ID NO: 111381 - DNA, 21 bp, Homo sapiens
gtgtgcgtgtgcgtgcgcatg

SEQ ID NO: 111382 - DNA, 22 bp, Homo sapiens
tgtgtgcgtgtgtgcgtgcgtg

SEQ ID NO: 111383 - DNA, 21 bp, Homo sapiens
ttctggatctctgtgtgtctc

SEQ ID NO: 111384 - DNA, 23 bp, Homo sapiens
actctgactcagtgcctgtcatg

SEQ ID NO: 111385 - DNA, 23 bp, Homo sapiens
tgtatgtatatgtatatgtatgt

SEQ ID NO: 111386 - DNA, 23 bp, Homo sapiens
cggtgtctcagtttctcatctgt

SEQ ID NO: 111387 - DNA, 23 bp, Homo sapiens
agatgggaatactaagagtatct

SEQ ID NO: 111388 - DNA, 23 bp, Homo sapiens
tgtctctgtgtctgtattcggac

SEQ ID NO: 111389 - DNA, 23 bp, Homo sapiens
gtctatgtgtcaggtaaagtaga

SEQ ID NO: 111390 - DNA, 22 bp, Homo sapiens
gatgccatggaagagacagcca

SEQ ID NO: 111391 - DNA, 23 bp, Homo sapiens
tgagacaagaaagtgacctggga

SEQ ID NO: 111392 - DNA, 22 bp, Homo sapiens
tagcagcataagaacagactga

SEQ ID NO: 111393 - DNA, 22 bp, Homo sapiens
tttcagctgtttttatagttgt

SEQ ID NO: 111394 - DNA, 23 bp, Homo sapiens
gtagatccatatgaattcagtaa

SEQ ID NO: 111395 - DNA, 19 bp, Homo sapiens
tgacttattttatgtgtga

SEQ ID NO: 111396 - DNA, 19 bp, Homo sapiens
tctgtcaggcactggaatg

SEQ ID NO: 111397 - DNA, 23 bp, Homo sapiens
agacagaagacactgtggaaaga

SEQ ID NO: 111398 - DNA, 23 bp, Homo sapiens
aattctttacccagtgaagctat

SEQ ID NO: 111399 - DNA, 21 bp, Homo sapiens
atatccataatatgtatttca

SEQ ID NO: 111400 - DNA, 21 bp, Homo sapiens
tcagtgcctgagagattttgg

SEQ ID NO: 111401 - DNA, 23 bp, Homo sapiens
tgtctcagaggctctctcatttt

SEQ ID NO: 111402 - DNA, 21 bp, Homo sapiens
tatgtgttgcttaatgatggg

SEQ ID NO: 111403 - DNA, 23 bp, Homo sapiens
tttctctattcttggtgtgttgt

SEQ ID NO: 111404 - DNA, 23 bp, Homo sapiens
actcactgagtcacaatgtatca

SEQ ID NO: 111405 - DNA, 23 bp, Homo sapiens
agattatttctttttgagatagg

SEQ ID NO: 111406 - DNA, 23 bp, Homo sapiens
tctctcagtgtgcaaaagaacag

SEQ ID NO: 111407 - DNA, 21 bp, Homo sapiens
aatgcagacatcgcctccaaa

SEQ ID NO: 111408 - DNA, 21 bp, Homo sapiens
tggagaatggctgttcttttt

SEQ ID NO: 111409 - DNA, 18 bp, Homo sapiens
agaacagagtgagcaaag

SEQ ID NO: 111410 - DNA, 23 bp, Homo sapiens
acatgtgcacaatgtgcaggttt

SEQ ID NO: 111411 - DNA, 23 bp, Homo sapiens
atacatgtatcatgttggtgtgc

SEQ ID NO: 111412 - DNA, 23 bp, Homo sapiens
tgagttcattgtagattctggat

SEQ ID NO: 111413 - DNA, 23 bp, Homo sapiens
tgagttcattgtagattctggat

SEQ ID NO: 111414 - DNA, 21 bp, Homo sapiens
ggcctcactctccctctcata

SEQ ID NO: 111415 - DNA, 23 bp, Homo sapiens
acagagtctcactctgtcgccca

SEQ ID NO: 111416 - DNA, 23 bp, Homo sapiens
acagagtctcactctgtcgccca

SEQ ID NO: 111417 - DNA, 22 bp, Homo sapiens
cacaggttttcaaatggttttc

SEQ ID NO: 111418 - DNA, 19 bp, Homo sapiens
aatttgttcttttttgggg

SEQ ID NO: 111419 - DNA, 23 bp, Homo sapiens
actctgtcacccagactaaagtg

SEQ ID NO: 111420 - DNA, 22 bp, Homo sapiens
aggtgcatcagtgaaagaggac

SEQ ID NO: 111421 - DNA, 23 bp, Homo sapiens
tgacccatgagagtgagctgtgt

SEQ ID NO: 111422 - DNA, 22 bp, Homo sapiens
aacagctctttgcttgttcttt

SEQ ID NO: 111423 - DNA, 23 bp, Homo sapiens
aaattgagaatttcattaccaag

SEQ ID NO: 111424 - DNA, 23 bp, Homo sapiens
actggtgagtcaaacttgagtga

SEQ ID NO: 111425 - DNA, 21 bp, Homo sapiens
atgtgtgtatatatgtgtatg

SEQ ID NO: 111426 - DNA, 23 bp, Homo sapiens
tgctagtagcaaatatatgcttt

SEQ ID NO: 111427 - DNA, 23 bp, Homo sapiens
ctcagtgagtctgctatacctgt

SEQ ID NO: 111428 - DNA, 20 bp, Homo sapiens
tgactcatggctttgagctg

SEQ ID NO: 111429 - DNA, 22 bp, Homo sapiens
aagtcagccagactgtctgagt

SEQ ID NO: 111430 - DNA, 22 bp, Homo sapiens
agtgcaagggtgtgatctcagc

SEQ ID NO: 111431 - DNA, 23 bp, Homo sapiens
gacagtctcgctctgtctcccag

SEQ ID NO: 111432 - DNA, 23 bp, Homo sapiens
tgagtctcactctgtcacccagg

SEQ ID NO: 111433 - DNA, 23 bp, Homo sapiens
ttgcagagacagaagtcagcctg

SEQ ID NO: 111434 - DNA, 23 bp, Homo sapiens
tttctgactggctgtctctgtga

SEQ ID NO: 111435 - DNA, 23 bp, Homo sapiens
cagagtctcactctgtcacccag

SEQ ID NO: 111436 - DNA, 22 bp, Homo sapiens
gtgtgtgtgtgtgtgtgcatgc

SEQ ID NO: 111437 - DNA, 18 bp, Homo sapiens
tattgaacataatgggta

SEQ ID NO: 111438 - DNA, 22 bp, Homo sapiens
ttatgtaagtatgtatttatgt

SEQ ID NO: 111439 - DNA, 22 bp, Homo sapiens
tgtgtatatatgtatatatgtg

SEQ ID NO: 111440 - DNA, 23 bp, Homo sapiens
tataatatgtgtatgtatacata

SEQ ID NO: 111441 - DNA, 23 bp, Homo sapiens
agctccattgtctgggtccagga

SEQ ID NO: 111442 - DNA, 23 bp, Homo sapiens
tccaggatcacacactgcatcta

SEQ ID NO: 111443 - DNA, 21 bp, Homo sapiens
tgatatagttgtatgtgcata

SEQ ID NO: 111444 - DNA, 18 bp, Homo sapiens
ttggtaggatgtgatgag

SEQ ID NO: 111445 - DNA, 21 bp, Homo sapiens
attatcacagcctaattttga

SEQ ID NO: 111446 - DNA, 23 bp, Homo sapiens
tgaacaggtgtgtggctcagttc

SEQ ID NO: 111447 - DNA, 19 bp, Homo sapiens
tgtgtatatgtatgcatat

SEQ ID NO: 111448 - DNA, 21 bp, Homo sapiens
tatgtgtatatgtacatgtgt

SEQ ID NO: 111449 - DNA, 23 bp, Homo sapiens
atatgtgtgtatatatatgtgtg

SEQ ID NO: 111450 - DNA, 23 bp, Homo sapiens
gagatggagtctcgctctgtcac

SEQ ID NO: 111451 - DNA, 18 bp, Homo sapiens
tctctctgcctgtccctg

SEQ ID NO: 111452 - DNA, 22 bp, Homo sapiens
attcaggaagaagtttgtttag

SEQ ID NO: 111453 - DNA, 20 bp, Homo sapiens
tgtatctatatatgtgtgta

SEQ ID NO: 111454 - DNA, 23 bp, Homo sapiens
agacagagtctcgctctgtctac

SEQ ID NO: 111455 - DNA, 22 bp, Homo sapiens
tgtgtatatatacatatatgtg

SEQ ID NO: 111456 - DNA, 23 bp, Homo sapiens
tatgtgtatatatacatatgtgt

SEQ ID NO: 111457 - DNA, 23 bp, Homo sapiens
tatgtgtatacatacatatatgt

SEQ ID NO: 111458 - DNA, 21 bp, Homo sapiens
atatgtgtatacatacatata

SEQ ID NO: 111459 - DNA, 23 bp, Homo sapiens
tatatgtgtatacatatgtgtgt

SEQ ID NO: 111460 - DNA, 19 bp, Homo sapiens
tatgtgtatatatacatat

SEQ ID NO: 111461 - DNA, 23 bp, Homo sapiens
tccctctgtgcctgctacactct

SEQ ID NO: 111462 - DNA, 23 bp, Homo sapiens
aatatagtgagaccctatctaca

SEQ ID NO: 111463 - DNA, 23 bp, Homo sapiens
actctgtctctgccacttttcac

SEQ ID NO: 111464 - DNA, 18 bp, Homo sapiens
agctggattgttgagggc

SEQ ID NO: 111465 - DNA, 23 bp, Homo sapiens
tcagtctcattctctgtccagtt

SEQ ID NO: 111466 - DNA, 20 bp, Homo sapiens
aaagctaggtcagacactct

SEQ ID NO: 111467 - DNA, 20 bp, Homo sapiens
tactatgtatataattctgt

SEQ ID NO: 111468 - DNA, 22 bp, Homo sapiens
tatgtgccatatatatgtgtat

SEQ ID NO: 111469 - DNA, 23 bp, Homo sapiens
tctgtggtttgttgactgctact

SEQ ID NO: 111470 - DNA, 23 bp, Homo sapiens
tggcggtgtctctctctgactgt

SEQ ID NO: 111471 - DNA, 18 bp, Homo sapiens
acacgcactctgaatgtt

SEQ ID NO: 111472 - DNA, 19 bp, Homo sapiens
tcaatcctaatcctgagtg

SEQ ID NO: 111473 - DNA, 22 bp, Homo sapiens
taaatttcagtaggaatttagg

SEQ ID NO: 111474 - DNA, 23 bp, Homo sapiens
tgagttcattgtagattctggat

SEQ ID NO: 111475 - DNA, 23 bp, Homo sapiens
tgagttcattgtagattctggat

SEQ ID NO: 111476 - DNA, 18 bp, Homo sapiens
ttgaggctgtagtgacta

SEQ ID NO: 111477 - DNA, 20 bp, Homo sapiens
tgcacaacctctctctcttt

SEQ ID NO: 111478 - DNA, 23 bp, Homo sapiens
aaggcctagttgtttgtgtatgt

SEQ ID NO: 111479 - DNA, 22 bp, Homo sapiens
tttttcattgtagagtgccttt

SEQ ID NO: 111480 - DNA, 23 bp, Homo sapiens
tatgtgcatatatatgtatatgt

SEQ ID NO: 111481 - DNA, 23 bp, Homo sapiens
gcatctctgtaactctctgtgtg

SEQ ID NO: 111482 - DNA, 18 bp, Homo sapiens
ctggcagcctcagagcag

SEQ ID NO: 111483 - DNA, 23 bp, Homo sapiens
aatcagactggttgatttctggg

SEQ ID NO: 111484 - DNA, 23 bp, Homo sapiens
gagtctcgctctgtctgtcgccc

SEQ ID NO: 111485 - DNA, 23 bp, Homo sapiens
gggtctcactctgtcacccaggc

SEQ ID NO: 111486 - DNA, 18 bp, Homo sapiens
acagtggtgcgatctcag

SEQ ID NO: 111487 - DNA, 23 bp, Homo sapiens
aggagtctcactctgtcacccag

SEQ ID NO: 111488 - DNA, 23 bp, Homo sapiens
gacactgtgcctgtctgccactc

SEQ ID NO: 111489 - DNA, 23 bp, Homo sapiens
taagcacagagtcatttgtgact

SEQ ID NO: 111490 - DNA, 23 bp, Homo sapiens
gcctgtagtcccagtgatgtggg

SEQ ID NO: 111491 - DNA, 20 bp, Homo sapiens
cactgtcacactgtcaccca

SEQ ID NO: 111492 - DNA, 23 bp, Homo sapiens
agaccgagtctcactctgtgtcc

SEQ ID NO: 111493 - DNA, 19 bp, Homo sapiens
agttggctttcattgggct

SEQ ID NO: 111494 - DNA, 23 bp, Homo sapiens
gttgagagtgtggacagagtgac

SEQ ID NO: 111495 - DNA, 22 bp, Homo sapiens
accagcctctctgactgtctgt

SEQ ID NO: 111496 - DNA, 23 bp, Homo sapiens
ttttaagtgatagcgctatggct

SEQ ID NO: 111497 - DNA, 18 bp, Homo sapiens
actgagacagatggctgt

SEQ ID NO: 111498 - DNA, 22 bp, Homo sapiens
agaactgagcttattgtcatct

SEQ ID NO: 111499 - DNA, 23 bp, Homo sapiens
ttattctaccttgctcttggctt

SEQ ID NO: 111500 - DNA, 18 bp, Homo sapiens
gtccctgtgtttgctgat

SEQ ID NO: 111501 - DNA, 23 bp, Homo sapiens
tgagatggagtctcgctctctca

SEQ ID NO: 111502 - DNA, 23 bp, Homo sapiens
tgttaactaaacttgaattgaga

SEQ ID NO: 111503 - DNA, 23 bp, Homo sapiens
gtctgcgtctgtgtgtctgtgtg

SEQ ID NO: 111504 - DNA, 23 bp, Homo sapiens
aggctctgtcactcactgaatcg

SEQ ID NO: 111505 - DNA, 19 bp, Homo sapiens
aggttgcagtgagttgaga

SEQ ID NO: 111506 - DNA, 18 bp, Homo sapiens
tagacagacagataggta

SEQ ID NO: 111507 - DNA, 21 bp, Homo sapiens
tggagtctgtctggctctctc

SEQ ID NO: 111508 - DNA, 20 bp, Homo sapiens
actggtaggaagggacttca

SEQ ID NO: 111509 - DNA, 23 bp, Homo sapiens
gtgcccctgactgactgtctgat

SEQ ID NO: 111510 - DNA, 23 bp, Homo sapiens
agagtctcactctgtctcccagg

SEQ ID NO: 111511 - DNA, 23 bp, Homo sapiens
acagagtctcactctgtcgccca

SEQ ID NO: 111512 - DNA, 23 bp, Homo sapiens
ctgagtttcactctgtcactcag

SEQ ID NO: 111513 - DNA, 23 bp, Homo sapiens
gagctaggttctcactctgtcat

SEQ ID NO: 111514 - DNA, 18 bp, Homo sapiens
tgtatatgtatatgtgtg

SEQ ID NO: 111515 - DNA, 22 bp, Homo sapiens
agacagagtctcgctctgtcac

SEQ ID NO: 111516 - DNA, 23 bp, Homo sapiens
gacagagtctcgctctgtcaccc

SEQ ID NO: 111517 - DNA, 23 bp, Homo sapiens
gttcactgtctggctgtctcact

SEQ ID NO: 111518 - DNA, 23 bp, Homo sapiens
tgacagatgacagagtagaaagc

SEQ ID NO: 111519 - DNA, 19 bp, Homo sapiens
tgtgtggatgtgtgtgcat

SEQ ID NO: 111520 - DNA, 21 bp, Homo sapiens
gtgtgtctgcatgtgcatatg

SEQ ID NO: 111521 - DNA, 21 bp, Homo sapiens
tgtgcgtctgtgtgtgcctgt

SEQ ID NO: 111522 - DNA, 23 bp, Homo sapiens
tctgtctctgacaggggctcttc

SEQ ID NO: 111523 - DNA, 19 bp, Homo sapiens
gttagcagagcaggtgctg

SEQ ID NO: 111524 - DNA, 23 bp, Homo sapiens
gttctcacaccctctgtcgctgg

SEQ ID NO: 111525 - DNA, 23 bp, Homo sapiens
tctgtgtgtgtctgtgtcctcat

SEQ ID NO: 111526 - DNA, 23 bp, Homo sapiens
gggtctcactctgtcacccaggc

SEQ ID NO: 111527 - DNA, 23 bp, Homo sapiens
acacagtcatattctctcacata

SEQ ID NO: 111528 - DNA, 20 bp, Homo sapiens
atggacaaggactgctgtga

SEQ ID NO: 111529 - DNA, 23 bp, Homo sapiens
atgtgtatatgtattgtagatat

SEQ ID NO: 111530 - DNA, 23 bp, Homo sapiens
ttggtggttgttgttcctgtctt

SEQ ID NO: 111531 - DNA, 23 bp, Homo sapiens
tggatgacatgtgttaatgttca

SEQ ID NO: 111532 - DNA, 21 bp, Homo sapiens
accacaaaaggttttgtgtgg

SEQ ID NO: 111533 - DNA, 23 bp, Homo sapiens
gaacctgtgtgtgtgtctgtgtc

SEQ ID NO: 111534 - DNA, 21 bp, Homo sapiens
cgtgtctgtctgtcccgatgg

SEQ ID NO: 111535 - DNA, 22 bp, Homo sapiens
ctgaggtaggaggatgtcttga

SEQ ID NO: 111536 - DNA, 23 bp, Homo sapiens
ctgtctatctgtctgtctgtcta

SEQ ID NO: 111537 - DNA, 23 bp, Homo sapiens
cggagtctcactctgtcacccag

SEQ ID NO: 111538 - DNA, 23 bp, Homo sapiens
ttaaagtgacatgtttatttcta

SEQ ID NO: 111539 - DNA, 19 bp, Homo sapiens
attctcttaagtgtgaaac

SEQ ID NO: 111540 - DNA, 21 bp, Homo sapiens
tgtgcccctgtaattccagct

SEQ ID NO: 111541 - DNA, 23 bp, Homo sapiens
ctgggagacagatgttgcagtga

SEQ ID NO: 111542 - DNA, 22 bp, Homo sapiens
ctgaggtaggaggatcatttga

SEQ ID NO: 111543 - DNA, 20 bp, Homo sapiens
gggtgacagagtgagactgt

SEQ ID NO: 111544 - DNA, 23 bp, Homo sapiens
agagtctcactctgtcacccagg

SEQ ID NO: 111545 - DNA, 20 bp, Homo sapiens
agagagagaaaaaaatcaga

SEQ ID NO: 111546 - DNA, 23 bp, Homo sapiens
gactgtgtgtgtctcgctcagga

SEQ ID NO: 111547 - DNA, 21 bp, Homo sapiens
agagagcggttttgatcactc

SEQ ID NO: 111548 - DNA, 23 bp, Homo sapiens
ccagctcagtctctctctttgtg

SEQ ID NO: 111549 - DNA, 23 bp, Homo sapiens
gtgtgtgtatatgtgtctgtgtg

SEQ ID NO: 111550 - DNA, 23 bp, Homo sapiens
gatgtgactgtgatctgagtcac

SEQ ID NO: 111551 - DNA, 23 bp, Homo sapiens
aaacaaaataaggaaagctgtgg

SEQ ID NO: 111552 - DNA, 23 bp, Homo sapiens
acacactcactctgactttctta

SEQ ID NO: 111553 - DNA, 23 bp, Homo sapiens
tatgaccttgatctcatgctcag

SEQ ID NO: 111554 - DNA, 23 bp, Homo sapiens
cggagtctcgctctgtcgctcag

SEQ ID NO: 111555 - DNA, 23 bp, Homo sapiens
cactgtgtatctctgtgtacctg

SEQ ID NO: 111556 - DNA, 22 bp, Homo sapiens
tatgtatgtatgtatatatgtc

SEQ ID NO: 111557 - DNA, 23 bp, Homo sapiens
taggtgttgagtgtgagcacacg

SEQ ID NO: 111558 - DNA, 23 bp, Homo sapiens
cacacactcagccacactgtatt

SEQ ID NO: 111559 - DNA, 23 bp, Homo sapiens
cagactctgaagaatgtgagctc

SEQ ID NO: 111560 - DNA, 22 bp, Homo sapiens
tttggtggatttagtttacatt

SEQ ID NO: 111561 - DNA, 23 bp, Homo sapiens
gctgaggtaggaggatcacttga

SEQ ID NO: 111562 - DNA, 23 bp, Homo sapiens
agacggagtctcactcactctat

SEQ ID NO: 111563 - DNA, 23 bp, Homo sapiens
ctgtgactgtctctgtctgtccc

SEQ ID NO: 111564 - DNA, 23 bp, Homo sapiens
atgtgtatatatatgagtgtgta

SEQ ID NO: 111565 - DNA, 22 bp, Homo sapiens
tatgtgtatatatatacagtat

SEQ ID NO: 111566 - DNA, 22 bp, Homo sapiens
atatgtgtatatatatgtgtgt

SEQ ID NO: 111567 - DNA, 20 bp, Homo sapiens
tctgtgtgtgtgtgtatata

SEQ ID NO: 111568 - DNA, 23 bp, Homo sapiens
atgcgaatcaatgcagttgagtg

SEQ ID NO: 111569 - DNA, 22 bp, Homo sapiens
gtctctctgtgtgtccaaatcc

SEQ ID NO: 111570 - DNA, 23 bp, Homo sapiens
tcaggcagcaaacacacaaaagc

SEQ ID NO: 111571 - DNA, 23 bp, Homo sapiens
tcgctgcctgtttccctgtgtgc

SEQ ID NO: 111572 - DNA, 21 bp, Homo sapiens
ggtcacataactgagtgtgca

SEQ ID NO: 111573 - DNA, 20 bp, Homo sapiens
taagtatatatatatatgtg

SEQ ID NO: 111574 - DNA, 19 bp, Homo sapiens
tatgcatatatatagtata

SEQ ID NO: 111575 - DNA, 18 bp, Homo sapiens
tatacatatatacatgta

SEQ ID NO: 111576 - DNA, 23 bp, Homo sapiens
ttgagtgtgcatgtgatatgtga

SEQ ID NO: 111577 - DNA, 23 bp, Homo sapiens
tttgcatgtgcatgtgatatgca

SEQ ID NO: 111578 - DNA, 20 bp, Homo sapiens
gtgctttctgaggactgtct

SEQ ID NO: 111579 - DNA, 22 bp, Homo sapiens
aatggaagtgtttatgttgttg

SEQ ID NO: 111580 - DNA, 20 bp, Homo sapiens
taacaacgtgctacaaacag

SEQ ID NO: 111581 - DNA, 23 bp, Homo sapiens
tagctctagatggacttgtctct

SEQ ID NO: 111582 - DNA, 23 bp, Homo sapiens
ctagagtgttaagagttcgtctt

SEQ ID NO: 111583 - DNA, 23 bp, Homo sapiens
gtgtggctgtcactgagactgag

SEQ ID NO: 111584 - DNA, 22 bp, Homo sapiens
taagtgcattatttatttgttt

SEQ ID NO: 111585 - DNA, 23 bp, Homo sapiens
tctgactccctgactctcccctt

SEQ ID NO: 111586 - DNA, 23 bp, Homo sapiens
gactgctctgtaacagccacagg

SEQ ID NO: 111587 - DNA, 23 bp, Homo sapiens
atcagagtggctgttcagcagca

SEQ ID NO: 111588 - DNA, 19 bp, Homo sapiens
tgcaaggtggtgggtttct

SEQ ID NO: 111589 - DNA, 23 bp, Homo sapiens
gacagagtctcactctgtcaccc

SEQ ID NO: 111590 - DNA, 23 bp, Homo sapiens
agagtctcactctgtcacccagg

SEQ ID NO: 111591 - DNA, 23 bp, Homo sapiens
tggagtctcactctgtcacccag

SEQ ID NO: 111592 - DNA, 21 bp, Homo sapiens
tgtggctcagaaacacaattc

SEQ ID NO: 111593 - DNA, 23 bp, Homo sapiens
atgtgtccgtccctctctgtgtg

SEQ ID NO: 111594 - DNA, 23 bp, Homo sapiens
tttgtcagagaagtcactgagca

SEQ ID NO: 111595 - DNA, 20 bp, Homo sapiens
tcagagtgcacactcggaga

SEQ ID NO: 111596 - DNA, 19 bp, Homo sapiens
tcagagtgcacactcggag

SEQ ID NO: 111597 - DNA, 20 bp, Homo sapiens
cactcagagtgtgcactcag

SEQ ID NO: 111598 - DNA, 19 bp, Homo sapiens
catgaggcttcaggctcag

SEQ ID NO: 111599 - DNA, 23 bp, Homo sapiens
gtcggtctgagaaaatcatgtca

SEQ ID NO: 111600 - DNA, 23 bp, Homo sapiens
tgcctggctccctctatgcaggg

SEQ ID NO: 111601 - DNA, 23 bp, Homo sapiens
acagagtctcactctgtcgccca

SEQ ID NO: 111602 - DNA, 23 bp, Homo sapiens
agtcactgtgtatctctgagcct

SEQ ID NO: 111603 - DNA, 22 bp, Homo sapiens
gtgagtggctgagtccctctca

SEQ ID NO: 111604 - DNA, 19 bp, Homo sapiens
gtgtgtgtgtgtgtgtgtg

SEQ ID NO: 111605 - DNA, 22 bp, Homo sapiens
tgtgtgtgtgtctgtgcgtctg

SEQ ID NO: 111606 - DNA, 23 bp, Homo sapiens
tgtctgtgtgtgtttatgatgtg

SEQ ID NO: 111607 - DNA, 23 bp, Homo sapiens
cacactcattggattcagaccct

SEQ ID NO: 111608 - DNA, 22 bp, Homo sapiens
tctggctccgtgtcttcactcc

SEQ ID NO: 111609 - DNA, 19 bp, Homo sapiens
tctgtagtaccagctcctt

SEQ ID NO: 111610 - DNA, 21 bp, Homo sapiens
tgtgagtgtgcatgagcatgc

SEQ ID NO: 111611 - DNA, 21 bp, Homo sapiens
atgtgtgtgtcagtgtgtgtg

SEQ ID NO: 111612 - DNA, 23 bp, Homo sapiens
agagtctccctctcactcaggct

SEQ ID NO: 111613 - DNA, 23 bp, Homo sapiens
agatgctatggctctgtctctct

SEQ ID NO: 111614 - DNA, 18 bp, Homo sapiens
tcaggatgtgcagctgct

SEQ ID NO: 111615 - DNA, 23 bp, Homo sapiens
caaatcactaggtattgatatgt

SEQ ID NO: 111616 - DNA, 23 bp, Homo sapiens
ctgggggcctctctgagcctcac

SEQ ID NO: 111617 - DNA, 20 bp, Homo sapiens
agaggtccaggaggtggcag

SEQ ID NO: 111618 - DNA, 23 bp, Homo sapiens
tgtctggaaatgtactgatttag

SEQ ID NO: 111619 - DNA, 23 bp, Homo sapiens
cacatgctgctagttaattcatt

SEQ ID NO: 111620 - DNA, 23 bp, Homo sapiens
ttgtattcttttgagtttctgat

SEQ ID NO: 111621 - DNA, 23 bp, Homo sapiens
ctgagtccacctgcagctgggtg

SEQ ID NO: 111622 - DNA, 18 bp, Homo sapiens
tgatgatttaatctgtag

SEQ ID NO: 111623 - DNA, 23 bp, Homo sapiens
atgactgacagcacagtcagact

SEQ ID NO: 111624 - DNA, 19 bp, Homo sapiens
tgtttctgaggcataaaca

SEQ ID NO: 111625 - DNA, 22 bp, Homo sapiens
gtctcagtttctctctccagag

SEQ ID NO: 111626 - DNA, 22 bp, Homo sapiens
tctgtcactgttatactacatc

SEQ ID NO: 111627 - DNA, 22 bp, Homo sapiens
tctcactctgtcactggggctg

SEQ ID NO: 111628 - DNA, 23 bp, Homo sapiens
tgtgtgtctgtgtgtctgccaag

SEQ ID NO: 111629 - DNA, 21 bp, Homo sapiens
tgtctttccccttagagttgt

SEQ ID NO: 111630 - DNA, 23 bp, Homo sapiens
tttgagatggagtcttgctctgt

SEQ ID NO: 111631 - DNA, 20 bp, Homo sapiens
aagctttaggtgatagctgt

SEQ ID NO: 111632 - DNA, 23 bp, Homo sapiens
agtctctccctgtcacccaggct

SEQ ID NO: 111633 - DNA, 18 bp, Homo sapiens
tagacattttcttcttgt

SEQ ID NO: 111634 - DNA, 21 bp, Homo sapiens
aaagtctcgctctgtctccag

SEQ ID NO: 111635 - DNA, 23 bp, Homo sapiens
tggctgactgacagcctcactga

SEQ ID NO: 111636 - DNA, 22 bp, Homo sapiens
agagaggtcacagaggggactg

SEQ ID NO: 111637 - DNA, 22 bp, Homo sapiens
cacatgtgtctctctcttccag

SEQ ID NO: 111638 - DNA, 23 bp, Homo sapiens
agactgagtgtacacagggtgct

SEQ ID NO: 111639 - DNA, 23 bp, Homo sapiens
atggctccgagggtgtgttgagg

SEQ ID NO: 111640 - DNA, 23 bp, Homo sapiens
ttttctctgcctttacagtttga

SEQ ID NO: 111641 - DNA, 23 bp, Homo sapiens
gtcagagtctcactctgttaccc

SEQ ID NO: 111642 - DNA, 18 bp, Homo sapiens
ctgaggaggcgaaactgc

SEQ ID NO: 111643 - DNA, 19 bp, Homo sapiens
tgagaacagttttagatgt

SEQ ID NO: 111644 - DNA, 23 bp, Homo sapiens
ttctgtgagtctcagtttcccca

SEQ ID NO: 111645 - DNA, 22 bp, Homo sapiens
tatgtgtgcatgtgcatgtgca

SEQ ID NO: 111646 - DNA, 22 bp, Homo sapiens
tgcgtgtgtgcatttgcatgtg

SEQ ID NO: 111647 - DNA, 23 bp, Homo sapiens
ttcgtgtgtgcatgtgcgtgtgc

SEQ ID NO: 111648 - DNA, 22 bp, Homo sapiens
gtgtgtgcatttgcatgtgcat

SEQ ID NO: 111649 - DNA, 23 bp, Homo sapiens
gtgtgtgtgcatttgcatgtgca

SEQ ID NO: 111650 - DNA, 23 bp, Homo sapiens
tgtgtattcacgtgtgcatgtgc

SEQ ID NO: 111651 - DNA, 21 bp, Homo sapiens
tcacagcctgtctctctctct

SEQ ID NO: 111652 - DNA, 23 bp, Homo sapiens
tgcagggtctgtgtgtgtgtgtg

SEQ ID NO: 111653 - DNA, 23 bp, Homo sapiens
gtgtgatgtgtgtgtgcacatct

SEQ ID NO: 111654 - DNA, 23 bp, Homo sapiens
acacatactccttgagctcgtga

SEQ ID NO: 111655 - DNA, 23 bp, Homo sapiens
gacagagagatgagagactgcag

SEQ ID NO: 111656 - DNA, 23 bp, Homo sapiens
tctgacactgactggctgggtgg

SEQ ID NO: 111657 - DNA, 23 bp, Homo sapiens
tgctcatctctcagtctctgtgt

SEQ ID NO: 111658 - DNA, 23 bp, Homo sapiens
tatatgcttgtttatatttgctt

SEQ ID NO: 111659 - DNA, 19 bp, Homo sapiens
ggtgtgagtgtatacaaat

SEQ ID NO: 111660 - DNA, 23 bp, Homo sapiens
tgactgcagatgctgctcagctg

SEQ ID NO: 111661 - DNA, 21 bp, Homo sapiens
atgcaagctcatgcagttatg

SEQ ID NO: 111662 - DNA, 23 bp, Homo sapiens
aatctgggtgccaatgctgacct

SEQ ID NO: 111663 - DNA, 23 bp, Homo sapiens
tagagtagtgtgtacattgcaga

SEQ ID NO: 111664 - DNA, 18 bp, Homo sapiens
tgtgtacattgtttgcag

SEQ ID NO: 111665 - DNA, 23 bp, Homo sapiens
tgagttcattgtagattctggat

SEQ ID NO: 111666 - DNA, 23 bp, Homo sapiens
tgagttcattgtagattctggat

SEQ ID NO: 111667 - DNA, 23 bp, Homo sapiens
tcagaagagacagaactgtgtgg

SEQ ID NO: 111668 - DNA, 23 bp, Homo sapiens
acgctggatctttcctgcactgt

SEQ ID NO: 111669 - DNA, 23 bp, Homo sapiens
tgtgtgtatatctctgtgtgtgt

SEQ ID NO: 111670 - DNA, 19 bp, Homo sapiens
agctggcttcactccccca

SEQ ID NO: 111671 - DNA, 22 bp, Homo sapiens
tctgtgtcgctgagaccctggg

SEQ ID NO: 111672 - DNA, 23 bp, Homo sapiens
acactctgtggctcagtggcgct

SEQ ID NO: 111673 - DNA, 23 bp, Homo sapiens
catatgtatgtatgcatatgtgt

SEQ ID NO: 111674 - DNA, 23 bp, Homo sapiens
gtgtgtacatgtgtatgtgtgtg

SEQ ID NO: 111675 - DNA, 23 bp, Homo sapiens
aacacacaggcagctttgaactg

SEQ ID NO: 111676 - DNA, 23 bp, Homo sapiens
ttcacctttgttcttggaatgca

SEQ ID NO: 111677 - DNA, 23 bp, Homo sapiens
cagtgtgcgtgtgtagtgtccag

SEQ ID NO: 111678 - DNA, 19 bp, Homo sapiens
aagacagagtctcattctg

SEQ ID NO: 111679 - DNA, 23 bp, Homo sapiens
tgtaactgcatttccatgtcatt

SEQ ID NO: 111680 - DNA, 23 bp, Homo sapiens
aacagcaagtgcaattaactagt

SEQ ID NO: 111681 - DNA, 21 bp, Homo sapiens
atcactgcctgctttgagggg

SEQ ID NO: 111682 - DNA, 23 bp, Homo sapiens
tcactgactgagtgtctgtaacc

SEQ ID NO: 111683 - DNA, 22 bp, Homo sapiens
aagacagaaccagggtatgcca

SEQ ID NO: 111684 - DNA, 23 bp, Homo sapiens
gacagagtctcgctctgtcaccc

SEQ ID NO: 111685 - DNA, 23 bp, Homo sapiens
ctttggtcagtctgtctgtccct

SEQ ID NO: 111686 - DNA, 23 bp, Homo sapiens
tctgtgatactgtctctcatgtg

SEQ ID NO: 111687 - DNA, 22 bp, Homo sapiens
agagtgtgtgcatagtctatgc

SEQ ID NO: 111688 - DNA, 23 bp, Homo sapiens
tttgacaatttattctaacctgt

SEQ ID NO: 111689 - DNA, 19 bp, Homo sapiens
tgggagtgtgtgtcctgca

SEQ ID NO: 111690 - DNA, 21 bp, Homo sapiens
ttcaggatgagattatcttct

SEQ ID NO: 111691 - DNA, 20 bp, Homo sapiens
tgtgcatgtgtgtgcgtatg

SEQ ID NO: 111692 - DNA, 22 bp, Homo sapiens
gattcttctgtgatttcctttc

SEQ ID NO: 111693 - DNA, 19 bp, Homo sapiens
aatcacccagaaaaccctt

SEQ ID NO: 111694 - DNA, 23 bp, Homo sapiens
gtgtctgtgtctgtgtctcccca

SEQ ID NO: 111695 - DNA, 23 bp, Homo sapiens
tcagactatctctaatacccagt

SEQ ID NO: 111696 - DNA, 23 bp, Homo sapiens
gtcaccctgactgtctgggtgac

SEQ ID NO: 111697 - DNA, 22 bp, Homo sapiens
gacactctgcacttggaggaca

SEQ ID NO: 111698 - DNA, 20 bp, Homo sapiens
cagtggagagttggtgctct

SEQ ID NO: 111699 - DNA, 23 bp, Homo sapiens
ttgactgtggaaaggtttccaga

SEQ ID NO: 111700 - DNA, 23 bp, Homo sapiens
atgtatgtgtatatgtatattta

SEQ ID NO: 111701 - DNA, 23 bp, Homo sapiens
tgtcagcctccctgtgtccctgt

SEQ ID NO: 111702 - DNA, 23 bp, Homo sapiens
cagtgaacactgttgtattgaac

SEQ ID NO: 111703 - DNA, 23 bp, Homo sapiens
tggaagagaagtgatatccttga

SEQ ID NO: 111704 - DNA, 18 bp, Homo sapiens
tgtcaacagtttttgggg

SEQ ID NO: 111705 - DNA, 18 bp, Homo sapiens
atcaaagtttttgattac

SEQ ID NO: 111706 - DNA, 18 bp, Homo sapiens
tcactgtctgtctcgaga

SEQ ID NO: 111707 - DNA, 20 bp, Homo sapiens
agtctcattctgtcactcag

SEQ ID NO: 111708 - DNA, 22 bp, Homo sapiens
caacagacaactctgtctgcac

SEQ ID NO: 111709 - DNA, 20 bp, Homo sapiens
tttggtttttcactatggga

SEQ ID NO: 111710 - DNA, 23 bp, Homo sapiens
gtgtgtacatgtgcatgtgtatg

SEQ ID NO: 111711 - DNA, 23 bp, Homo sapiens
tatgtgtgtgtgtatgatgtatg

SEQ ID NO: 111712 - DNA, 22 bp, Homo sapiens
aatcagatttcacttcctctcc

SEQ ID NO: 111713 - DNA, 23 bp, Homo sapiens
tgacagagtgagaccttgtctcg

SEQ ID NO: 111714 - DNA, 23 bp, Homo sapiens
agatggagtctcactctgtcacc

SEQ ID NO: 111715 - DNA, 19 bp, Homo sapiens
ctgaagacacactaccact

SEQ ID NO: 111716 - DNA, 19 bp, Homo sapiens
ataaatggaatcggacagt

SEQ ID NO: 111717 - DNA, 22 bp, Homo sapiens
gggagtgtgtgagcgtgccttg

SEQ ID NO: 111718 - DNA, 23 bp, Homo sapiens
ggcaactgtctcactgagtcaat

SEQ ID NO: 111719 - DNA, 20 bp, Homo sapiens
ttagctatctaaggttggtg

SEQ ID NO: 111720 - DNA, 22 bp, Homo sapiens
agagaaacttgaagatgatgta

SEQ ID NO: 111721 - DNA, 21 bp, Homo sapiens
ggagtctcgctctgtcaccag

SEQ ID NO: 111722 - DNA, 23 bp, Homo sapiens
gccagatgactgagaggacacgt

SEQ ID NO: 111723 - DNA, 23 bp, Homo sapiens
ggagtctcactctgtctcccagg

SEQ ID NO: 111724 - DNA, 23 bp, Homo sapiens
aagcagcatatgaaatcggtgag

SEQ ID NO: 111725 - DNA, 23 bp, Homo sapiens
tggagtctcactctgtcacccag

SEQ ID NO: 111726 - DNA, 23 bp, Homo sapiens
tacgctaataaagctgtatgtac

SEQ ID NO: 111727 - DNA, 23 bp, Homo sapiens
gaccctctgacacttttatggtt

SEQ ID NO: 111728 - DNA, 23 bp, Homo sapiens
atcttgactcactgcaacctctg

SEQ ID NO: 111729 - DNA, 23 bp, Homo sapiens
tggagtctcactctgtcacccag

SEQ ID NO: 111730 - DNA, 23 bp, Homo sapiens
atacgtatatatgtatatgtgta

SEQ ID NO: 111731 - DNA, 21 bp, Homo sapiens
ttctctcagatttagttcgct

SEQ ID NO: 111732 - DNA, 21 bp, Homo sapiens
tatacacacacatagatgtct

SEQ ID NO: 111733 - DNA, 20 bp, Homo sapiens
ctgtgtcactcagtgtccta

SEQ ID NO: 111734 - DNA, 23 bp, Homo sapiens
atcacttgattctgggaggttga

SEQ ID NO: 111735 - DNA, 23 bp, Homo sapiens
tatgaatgtatatataggtatgt

SEQ ID NO: 111736 - DNA, 23 bp, Homo sapiens
atgcatgtacacaaatgtatata

SEQ ID NO: 111737 - DNA, 22 bp, Homo sapiens
tctgtcacagtttcttttaagt

SEQ ID NO: 111738 - DNA, 19 bp, Homo sapiens
agactgtcagtcatggagg

SEQ ID NO: 111739 - DNA, 23 bp, Homo sapiens
agatggagtctcactctgtcacc

SEQ ID NO: 111740 - DNA, 23 bp, Homo sapiens
cagctctctctgtcagagccccc

SEQ ID NO: 111741 - DNA, 23 bp, Homo sapiens
gtcagagtctcgctctctcaccc

SEQ ID NO: 111742 - DNA, 19 bp, Homo sapiens
tatgcagattattgtgatg

SEQ ID NO: 111743 - DNA, 23 bp, Homo sapiens
tgacaacgtcttgctctgtgtca

SEQ ID NO: 111744 - DNA, 23 bp, Homo sapiens
actcagacagcagacactggggt

SEQ ID NO: 111745 - DNA, 21 bp, Homo sapiens
atatctttttgtaaaaaggag

SEQ ID NO: 111746 - DNA, 22 bp, Homo sapiens
ggctgactcactgtctcggtgc

SEQ ID NO: 111747 - DNA, 23 bp, Homo sapiens
tatcagctgctccatgatcccat

SEQ ID NO: 111748 - DNA, 21 bp, Homo sapiens
tggtgagaagtgactgagctc

SEQ ID NO: 111749 - DNA, 23 bp, Homo sapiens
atgtgtgtatatatatgagtgat

SEQ ID NO: 111750 - DNA, 23 bp, Homo sapiens
atactgtatatatatatgtgtgt

SEQ ID NO: 111751 - DNA, 20 bp, Homo sapiens
ccactcatgagagtgaggac

SEQ ID NO: 111752 - DNA, 23 bp, Homo sapiens
ctctggctctgtctctggctgcg

SEQ ID NO: 111753 - DNA, 23 bp, Homo sapiens
ggtggagtctcactctgtcaccc

SEQ ID NO: 111754 - DNA, 20 bp, Homo sapiens
agtctcgctctgtcgctcag

SEQ ID NO: 111755 - DNA, 23 bp, Homo sapiens
tctgtatctatctgtgtgtgtgt

SEQ ID NO: 111756 - DNA, 20 bp, Homo sapiens
ttttttcttgagttgctctg

SEQ ID NO: 111757 - DNA, 23 bp, Homo sapiens
gccactctcactgcgtgatttca

SEQ ID NO: 111758 - DNA, 23 bp, Homo sapiens
tgagacaaggtcttgctctgttg

SEQ ID NO: 111759 - DNA, 23 bp, Homo sapiens
tgtgtatatatgtatatgtgtat

SEQ ID NO: 111760 - DNA, 23 bp, Homo sapiens
tgtatgtgtatatgtatatgtgt

SEQ ID NO: 111761 - DNA, 23 bp, Homo sapiens
tgtccgtgactctgggtctgtct

SEQ ID NO: 111762 - DNA, 23 bp, Homo sapiens
agatgaggaatagaaaacatttt

SEQ ID NO: 111763 - DNA, 19 bp, Homo sapiens
atcactttgggaatggttt

SEQ ID NO: 111764 - DNA, 21 bp, Homo sapiens
tatgacattctgaagagtatc

SEQ ID NO: 111765 - DNA, 20 bp, Homo sapiens
tgaggtaggaggatcacttg

SEQ ID NO: 111766 - DNA, 23 bp, Homo sapiens
tcaaggtctcactctgtcacccc

SEQ ID NO: 111767 - DNA, 23 bp, Homo sapiens
gctttctctgtctctttgagatg

SEQ ID NO: 111768 - DNA, 21 bp, Homo sapiens
attgcactccagcctgggtga

SEQ ID NO: 111769 - DNA, 21 bp, Homo sapiens
tttagacaagaaagtgtgctc

SEQ ID NO: 111770 - DNA, 23 bp, Homo sapiens
tttgggaggcagagattgcagtg

SEQ ID NO: 111771 - DNA, 23 bp, Homo sapiens
ttgagacggagtttcactcttgt

SEQ ID NO: 111772 - DNA, 23 bp, Homo sapiens
gggtctcactctgtcacccaggc

SEQ ID NO: 111773 - DNA, 23 bp, Homo sapiens
tgtcccactcagtccctctttca

SEQ ID NO: 111774 - DNA, 22 bp, Homo sapiens
ccctgcctgtaaaatgtctaag

SEQ ID NO: 111775 - DNA, 23 bp, Homo sapiens
acagctgtgagaattcagtgagg

SEQ ID NO: 111776 - DNA, 23 bp, Homo sapiens
gagactgagtcttgctctgtcac

SEQ ID NO: 111777 - DNA, 22 bp, Homo sapiens
ttagagtgtgacttcttttttt

SEQ ID NO: 111778 - DNA, 23 bp, Homo sapiens
tttgagagggagtctcactctgt

SEQ ID NO: 111779 - DNA, 23 bp, Homo sapiens
tgagatggagtgtccctctgcca

SEQ ID NO: 111780 - DNA, 20 bp, Homo sapiens
atctctctgggtgatctccc

SEQ ID NO: 111781 - DNA, 23 bp, Homo sapiens
tctctctttctcactgcaagaca

SEQ ID NO: 111782 - DNA, 23 bp, Homo sapiens
tctctgtctcacactgtgcctgt

SEQ ID NO: 111783 - DNA, 23 bp, Homo sapiens
gagtctcactctgacacccaggc

SEQ ID NO: 111784 - DNA, 20 bp, Homo sapiens
atgtgtgtgtatatatacgt

SEQ ID NO: 111785 - DNA, 23 bp, Homo sapiens
tgtgcatatatatgtgaatatat

SEQ ID NO: 111786 - DNA, 22 bp, Homo sapiens
atgtacatatatatatgtgtgt

SEQ ID NO: 111787 - DNA, 23 bp, Homo sapiens
atcaagatgaggttcttctttgc

SEQ ID NO: 111788 - DNA, 21 bp, Homo sapiens
agtgtttcatcctgagatagg

SEQ ID NO: 111789 - DNA, 23 bp, Homo sapiens
gtcagatctgtgtcaggaaagat

SEQ ID NO: 111790 - DNA, 23 bp, Homo sapiens
ttcaagatcagttttgcaggtat

SEQ ID NO: 111791 - DNA, 21 bp, Homo sapiens
attcactgtgtagagagctgc

SEQ ID NO: 111792 - DNA, 22 bp, Homo sapiens
tggaaagaatagaagaaacagg

SEQ ID NO: 111793 - DNA, 23 bp, Homo sapiens
gtcagagtctcgctctgtcaccc

SEQ ID NO: 111794 - DNA, 22 bp, Homo sapiens
ttcagtggcgagatcttggctc

SEQ ID NO: 111795 - DNA, 22 bp, Homo sapiens
ttttgagatggagtcttgctct

SEQ ID NO: 111796 - DNA, 19 bp, Homo sapiens
ggagtcttactctgtcact

SEQ ID NO: 111797 - DNA, 22 bp, Homo sapiens
taagacatatgatttcacagtg

SEQ ID NO: 111798 - DNA, 21 bp, Homo sapiens
ctgaggttggaggatcacttg

SEQ ID NO: 111799 - DNA, 19 bp, Homo sapiens
tgcatggtcactgaagtct

SEQ ID NO: 111800 - DNA, 19 bp, Homo sapiens
agggtagatcttggcatgt

SEQ ID NO: 111801 - DNA, 22 bp, Homo sapiens
ttccaggtgatcatggctgatt

SEQ ID NO: 111802 - DNA, 23 bp, Homo sapiens
atggagtctcactctgtcaccca

SEQ ID NO: 111803 - DNA, 19 bp, Homo sapiens
tgcgagtgttctaatgtct

SEQ ID NO: 111804 - DNA, 21 bp, Homo sapiens
tccctctctctctctgtgtgc

SEQ ID NO: 111805 - DNA, 23 bp, Homo sapiens
tgagatggagtctcactcattct

SEQ ID NO: 111806 - DNA, 23 bp, Homo sapiens
atatgtatgtatatgtatgtgta

SEQ ID NO: 111807 - DNA, 19 bp, Homo sapiens
tttatacatgtatgtatgc

SEQ ID NO: 111808 - DNA, 23 bp, Homo sapiens
gtgtgtgtatatatatgtatgtg

SEQ ID NO: 111809 - DNA, 18 bp, Homo sapiens
atcagtaagagctttcct

SEQ ID NO: 111810 - DNA, 22 bp, Homo sapiens
attgtggttttaatttgcattt

SEQ ID NO: 111811 - DNA, 22 bp, Homo sapiens
tctgatgattagaaatgttgag

SEQ ID NO: 111812 - DNA, 23 bp, Homo sapiens
agatgtttcttggtgtcttagga

SEQ ID NO: 111813 - DNA, 23 bp, Homo sapiens
actgaagtttagttggtaaaact

SEQ ID NO: 111814 - DNA, 23 bp, Homo sapiens
tggaaggagtgcttgctgattgg

SEQ ID NO: 111815 - DNA, 23 bp, Homo sapiens
tgagttcattgtagattctggat

SEQ ID NO: 111816 - DNA, 23 bp, Homo sapiens
tgagttcattgtagattctggat

SEQ ID NO: 111817 - DNA, 23 bp, Homo sapiens
ctctcagtatcagtgagtatttg

SEQ ID NO: 111818 - DNA, 19 bp, Homo sapiens
ttatgttttcttcgttaga

SEQ ID NO: 111819 - DNA, 23 bp, Homo sapiens
tcatgcagtctgagaaatctgat

SEQ ID NO: 111820 - DNA, 22 bp, Homo sapiens
tgtcactttttctattagggtt

SEQ ID NO: 111821 - DNA, 23 bp, Homo sapiens
agatggagtttggctcttgttgc

SEQ ID NO: 111822 - DNA, 19 bp, Homo sapiens
gataggtaagtagatagaa

SEQ ID NO: 111823 - DNA, 18 bp, Homo sapiens
cttttaggacaaactgct

SEQ ID NO: 111824 - DNA, 19 bp, Homo sapiens
atacgtatgtatatgtgta

SEQ ID NO: 111825 - DNA, 18 bp, Homo sapiens
acaaactttttgtctctc

SEQ ID NO: 111826 - DNA, 21 bp, Homo sapiens
tgtatacatatacttatgtgt

SEQ ID NO: 111827 - DNA, 23 bp, Homo sapiens
tccctctgactctctctctctcg

SEQ ID NO: 111828 - DNA, 23 bp, Homo sapiens
agtcagagtgcttgttctttctc

SEQ ID NO: 111829 - DNA, 23 bp, Homo sapiens
catgtacacacatgtgtgtgtac

SEQ ID NO: 111830 - DNA, 21 bp, Homo sapiens
tatacgtatatgtatatatgt

SEQ ID NO: 111831 - DNA, 23 bp, Homo sapiens
atattgaactagttttccaaggg

SEQ ID NO: 111832 - DNA, 23 bp, Homo sapiens
tatatgcttatacatacacgtgt

SEQ ID NO: 111833 - DNA, 19 bp, Homo sapiens
atatgtatatatacacgtg

SEQ ID NO: 111834 - DNA, 19 bp, Homo sapiens
gtgtatatatgtatatatg

SEQ ID NO: 111835 - DNA, 23 bp, Homo sapiens
tgtgaggaagaagtttctattgt

SEQ ID NO: 111836 - DNA, 21 bp, Homo sapiens
ttctcactggtgttatatgga

SEQ ID NO: 111837 - DNA, 23 bp, Homo sapiens
cgatgtctcactctgtcacccag

SEQ ID NO: 111838 - DNA, 20 bp, Homo sapiens
gacaacatgatgaaaccctg

SEQ ID NO: 111839 - DNA, 19 bp, Homo sapiens
tattctgagcttaacaaaa

SEQ ID NO: 111840 - DNA, 23 bp, Homo sapiens
cttatgatggatttattgttgtt

SEQ ID NO: 111841 - DNA, 20 bp, Homo sapiens
ttttgagacggagtctcgct

SEQ ID NO: 111842 - DNA, 23 bp, Homo sapiens
tgtgtgtatatatatgtgtgtgt

SEQ ID NO: 111843 - DNA, 23 bp, Homo sapiens
ttgagatggagttttgctcttgt

SEQ ID NO: 111844 - DNA, 23 bp, Homo sapiens
tctgtgcctgtgtgcccatgtgc

SEQ ID NO: 111845 - DNA, 23 bp, Homo sapiens
gggtctcactgtgtcacccaagc

SEQ ID NO: 111846 - DNA, 21 bp, Homo sapiens
tgtgtgtgccacaacagggag

SEQ ID NO: 111847 - DNA, 23 bp, Homo sapiens
ctgtctgtgtctgtgtgtgtgct

SEQ ID NO: 111848 - DNA, 18 bp, Homo sapiens
atcacagacagactttga

SEQ ID NO: 111849 - DNA, 23 bp, Homo sapiens
tgagttcattgtagattctggat

SEQ ID NO: 111850 - DNA, 23 bp, Homo sapiens
tgagttcattgtagattctggat

SEQ ID NO: 111851 - DNA, 23 bp, Homo sapiens
tgactgcatctccatgagtagat

SEQ ID NO: 111852 - DNA, 23 bp, Homo sapiens
attagtgtatttttaaatgtgtc

SEQ ID NO: 111853 - DNA, 23 bp, Homo sapiens
atacacatatgtgtgtgtgtgta

SEQ ID NO: 111854 - DNA, 23 bp, Homo sapiens
tgtgctagattttgagactgtgt

SEQ ID NO: 111855 - DNA, 23 bp, Homo sapiens
tctatatttgtcacacactctct

SEQ ID NO: 111856 - DNA, 23 bp, Homo sapiens
attgatgtatgtttcgttagcag

SEQ ID NO: 111857 - DNA, 21 bp, Homo sapiens
tttgctaaagtaagagttgga

SEQ ID NO: 111858 - DNA, 19 bp, Homo sapiens
atacttctttctttatttt

SEQ ID NO: 111859 - DNA, 22 bp, Homo sapiens
agtgaatgaatatatatatgta

SEQ ID NO: 111860 - DNA, 23 bp, Homo sapiens
attaagggtgccaaatgtagcca

SEQ ID NO: 111861 - DNA, 23 bp, Homo sapiens
actctcagtgtatttcttctaca

SEQ ID NO: 111862 - DNA, 23 bp, Homo sapiens
tttgtgtacttgatccagccaag

SEQ ID NO: 111863 - DNA, 22 bp, Homo sapiens
tatatacatgtatacacataca

SEQ ID NO: 111864 - DNA, 20 bp, Homo sapiens
atatgtatatatacctatat

SEQ ID NO: 111865 - DNA, 22 bp, Homo sapiens
tgtatgtatgttcgatattata

SEQ ID NO: 111866 - DNA, 20 bp, Homo sapiens
attcacacagggtgttaaaa

SEQ ID NO: 111867 - DNA, 23 bp, Homo sapiens
aaagatctctctctctctctctc

SEQ ID NO: 111868 - DNA, 18 bp, Homo sapiens
ttggtcttgctgtcttag

SEQ ID NO: 111869 - DNA, 18 bp, Homo sapiens
tgtgtgtatatatgtgtg

SEQ ID NO: 111870 - DNA, 21 bp, Homo sapiens
tgtgatccttatcctccctct

SEQ ID NO: 111871 - DNA, 23 bp, Homo sapiens
tgattctcactgtgaatttagtg

SEQ ID NO: 111872 - DNA, 23 bp, Homo sapiens
tgagacacagcagagtgtgagct

SEQ ID NO: 111873 - DNA, 23 bp, Homo sapiens
ctgaagcttctacagtgtgggag

SEQ ID NO: 111874 - DNA, 23 bp, Homo sapiens
tgagttcattgtagattctggat

SEQ ID NO: 111875 - DNA, 23 bp, Homo sapiens
tgagttcattgtagattctggat

SEQ ID NO: 111876 - DNA, 23 bp, Homo sapiens
atgtatgtatgtatgtgtgtgtg

SEQ ID NO: 111877 - DNA, 23 bp, Homo sapiens
atatatgtatatgtatgtgtgtg

SEQ ID NO: 111878 - DNA, 18 bp, Homo sapiens
ttgtttcattatttaggt

SEQ ID NO: 111879 - DNA, 23 bp, Homo sapiens
tgagttcattgtagattctggat

SEQ ID NO: 111880 - DNA, 23 bp, Homo sapiens
tgagttcattgtagattctggat

SEQ ID NO: 111881 - DNA, 23 bp, Homo sapiens
tctctgactgtgagtcaggggct

SEQ ID NO: 111882 - DNA, 23 bp, Homo sapiens
tttgaaatagcttatctttttgt

SEQ ID NO: 111883 - DNA, 23 bp, Homo sapiens
atgtgtgtatatgtatatgtgtg

SEQ ID NO: 111884 - DNA, 22 bp, Homo sapiens
acatatacacacacacatacat

SEQ ID NO: 111885 - DNA, 23 bp, Homo sapiens
atttgttgtgcatatgttgtttt

SEQ ID NO: 111886 - DNA, 23 bp, Homo sapiens
gtgtgtgtctgtctgtggctctg

SEQ ID NO: 111887 - DNA, 18 bp, Homo sapiens
tcacaccttgtgttgcct

SEQ ID NO: 111888 - DNA, 22 bp, Homo sapiens
aaaaagtaaataagcatttgat

SEQ ID NO: 111889 - DNA, 21 bp, Homo sapiens
atagggtgttaaccaatggat

SEQ ID NO: 111890 - DNA, 21 bp, Homo sapiens
ttacaggtgtgagtcaccaca

SEQ ID NO: 111891 - DNA, 23 bp, Homo sapiens
gtggcatgcttctgtattcccag

SEQ ID NO: 111892 - DNA, 22 bp, Homo sapiens
ctgaggtaggaggatcacttga

SEQ ID NO: 111893 - DNA, 23 bp, Homo sapiens
cagagactctgcttcttcatctg

SEQ ID NO: 111894 - DNA, 22 bp, Homo sapiens
agtctggaaatagatgctgaat

SEQ ID NO: 111895 - DNA, 23 bp, Homo sapiens
gacagggtctcactctgtctctt

SEQ ID NO: 111896 - DNA, 23 bp, Homo sapiens
cagggtctcactctgtctcccag

SEQ ID NO: 111897 - DNA, 19 bp, Homo sapiens
ttagcttgaacaaggtttt

SEQ ID NO: 111898 - DNA, 20 bp, Homo sapiens
acagagtcttgctctgtcac

SEQ ID NO: 111899 - DNA, 23 bp, Homo sapiens
cggagtctcactctgtcacccag

SEQ ID NO: 111900 - DNA, 23 bp, Homo sapiens
tctttctctgtcacccagtctgg

SEQ ID NO: 111901 - DNA, 22 bp, Homo sapiens
tttaggaagtaggttggaaaga

SEQ ID NO: 111902 - DNA, 18 bp, Homo sapiens
agtagaaaacattccatg

SEQ ID NO: 111903 - DNA, 23 bp, Homo sapiens
agtgaggtgacagtgtccattct

SEQ ID NO: 111904 - DNA, 23 bp, Homo sapiens
ccgagtctcactctgtcacccag

SEQ ID NO: 111905 - DNA, 18 bp, Homo sapiens
tgcagtgagccatgattg

SEQ ID NO: 111906 - DNA, 19 bp, Homo sapiens
tgagagcagtgagtcagca

SEQ ID NO: 111907 - DNA, 23 bp, Homo sapiens
acagaacactgataatttactgt

SEQ ID NO: 111908 - DNA, 22 bp, Homo sapiens
atacaacatttgttttgaatga

SEQ ID NO: 111909 - DNA, 23 bp, Homo sapiens
tgacagtctgttaaggcaggtgt

SEQ ID NO: 111910 - DNA, 23 bp, Homo sapiens
aaactcacactctttagcaatgt

SEQ ID NO: 111911 - DNA, 18 bp, Homo sapiens
aacattcatcagatccca

SEQ ID NO: 111912 - DNA, 18 bp, Homo sapiens
cactggttttcttctctt

SEQ ID NO: 111913 - DNA, 20 bp, Homo sapiens
tacagtattgatatagtaat

SEQ ID NO: 111914 - DNA, 18 bp, Homo sapiens
agtggggctcttgtttat

SEQ ID NO: 111915 - DNA, 20 bp, Homo sapiens
tgagacagagtctcgctctc

SEQ ID NO: 111916 - DNA, 23 bp, Homo sapiens
tgagttcattgtagattctggat

SEQ ID NO: 111917 - DNA, 23 bp, Homo sapiens
tgagttcattgtagattctggat

SEQ ID NO: 111918 - DNA, 23 bp, Homo sapiens
tggctcgctcgctctctccgttt

SEQ ID NO: 111919 - DNA, 23 bp, Homo sapiens
gacggagtctgtcactgtctcct

SEQ ID NO: 111920 - DNA, 23 bp, Homo sapiens
ctatctgtctgtctgtctgtctc

SEQ ID NO: 111921 - DNA, 18 bp, Homo sapiens
tggatccctgtcaagctc

SEQ ID NO: 111922 - DNA, 20 bp, Homo sapiens
tctgtctcccagactagagt

SEQ ID NO: 111923 - DNA, 21 bp, Homo sapiens
tagtttcatgttggacctttt

SEQ ID NO: 111924 - DNA, 23 bp, Homo sapiens
tggagtctcactctgtcacccag

SEQ ID NO: 111925 - DNA, 23 bp, Homo sapiens
aatgagagccctttctatctcac

SEQ ID NO: 111926 - DNA, 23 bp, Homo sapiens
tcacagcttgtacatttttgcat

SEQ ID NO: 111927 - DNA, 22 bp, Homo sapiens
tcatatgctcagtctcctaggt

SEQ ID NO: 111928 - DNA, 22 bp, Homo sapiens
acagtgcttgtgatatcactga

SEQ ID NO: 111929 - DNA, 19 bp, Homo sapiens
ctagttaagtgatttttct

SEQ ID NO: 111930 - DNA, 20 bp, Homo sapiens
tccttctatgtctgctgcat

SEQ ID NO: 111931 - DNA, 23 bp, Homo sapiens
ctgagtctcactctgtcgcccag

SEQ ID NO: 111932 - DNA, 21 bp, Homo sapiens
tgtgtgtgtgtatatatatag

SEQ ID NO: 111933 - DNA, 23 bp, Homo sapiens
tgtttaagtggtactcataggct

SEQ ID NO: 111934 - DNA, 18 bp, Homo sapiens
tgtgtatatatatttgtg

SEQ ID NO: 111935 - DNA, 23 bp, Homo sapiens
tggcacagagtgtggttaggaag

SEQ ID NO: 111936 - DNA, 23 bp, Homo sapiens
agaattgaaatctagcaatagtt

SEQ ID NO: 111937 - DNA, 22 bp, Homo sapiens
attaacaatgatgtttgctgta

SEQ ID NO: 111938 - DNA, 23 bp, Homo sapiens
cacacatatgtgtgtgtatatat

SEQ ID NO: 111939 - DNA, 20 bp, Homo sapiens
tatgtatatatatgtgtgtg

SEQ ID NO: 111940 - DNA, 23 bp, Homo sapiens
acagagtctcgctctgtcaccca

SEQ ID NO: 111941 - DNA, 23 bp, Homo sapiens
tgagttcattgtagattctggat

SEQ ID NO: 111942 - DNA, 23 bp, Homo sapiens
tgagttcattgtagattctggat

SEQ ID NO: 111943 - DNA, 23 bp, Homo sapiens
agtctctcagctaaacctttgga

SEQ ID NO: 111944 - DNA, 18 bp, Homo sapiens
atacatgtgtgtgtcctg

SEQ ID NO: 111945 - DNA, 21 bp, Homo sapiens
tgccagtgtcatttttgtgat

SEQ ID NO: 111946 - DNA, 23 bp, Homo sapiens
agttgcatagtcacaaaagtgat

SEQ ID NO: 111947 - DNA, 18 bp, Homo sapiens
ctactcaggagaatggta

SEQ ID NO: 111948 - DNA, 19 bp, Homo sapiens
aaagcttatatatattagc

SEQ ID NO: 111949 - DNA, 19 bp, Homo sapiens
taagcttatatatattagc

SEQ ID NO: 111950 - DNA, 20 bp, Homo sapiens
taagcttatatatattagca

SEQ ID NO: 111951 - DNA, 23 bp, Homo sapiens
agcccctcactctctgactgtcc

SEQ ID NO: 111952 - DNA, 23 bp, Homo sapiens
tcaatgtcaggctgtctcactct

SEQ ID NO: 111953 - DNA, 22 bp, Homo sapiens
gacagagtctcactccgtctcc

SEQ ID NO: 111954 - DNA, 21 bp, Homo sapiens
atttccactcactgcaacctc

SEQ ID NO: 111955 - DNA, 20 bp, Homo sapiens
tttctgggtacatagtaggt

SEQ ID NO: 111956 - DNA, 19 bp, Homo sapiens
tctgagacagagtctggct

SEQ ID NO: 111957 - DNA, 23 bp, Homo sapiens
gacagagtctcgctctgtcaccc

SEQ ID NO: 111958 - DNA, 23 bp, Homo sapiens
gcctctcacagcctccatgactg

SEQ ID NO: 111959 - DNA, 23 bp, Homo sapiens
gagacagagtctcgctctgtcgc

SEQ ID NO: 111960 - DNA, 23 bp, Homo sapiens
agtggtacacttgtgtatctcaa

SEQ ID NO: 111961 - DNA, 23 bp, Homo sapiens
cggagtctcactctgtcacccag

SEQ ID NO: 111962 - DNA, 23 bp, Homo sapiens
ccctgtgtctgagtgtctgtgtc

SEQ ID NO: 111963 - DNA, 21 bp, Homo sapiens
tgtgccaggtcctggtgctga

SEQ ID NO: 111964 - DNA, 22 bp, Homo sapiens
gaagtcttgtctgcacattaga

SEQ ID NO: 111965 - DNA, 23 bp, Homo sapiens
caaaatgagctttggaaaggtaa

SEQ ID NO: 111966 - DNA, 23 bp, Homo sapiens
tcacttgtgtgtctgtatgtgtc

SEQ ID NO: 111967 - DNA, 23 bp, Homo sapiens
tagaccctatagatatgaacaga

SEQ ID NO: 111968 - DNA, 23 bp, Homo sapiens
gttaagtcctagtggtggtgaaa

SEQ ID NO: 111969 - DNA, 22 bp, Homo sapiens
aggtgagaagtgactgagctgg

SEQ ID NO: 111970 - DNA, 23 bp, Homo sapiens
gagtctctctctgtcacccaggc

SEQ ID NO: 111971 - DNA, 19 bp, Homo sapiens
tcccactcacagtttggag

SEQ ID NO: 111972 - DNA, 23 bp, Homo sapiens
gtgcatcttgaattcttttcttg

SEQ ID NO: 111973 - DNA, 22 bp, Homo sapiens
aaaggattgaagggtggtgtat

SEQ ID NO: 111974 - DNA, 23 bp, Homo sapiens
atacagcatgtttactgaagtca

SEQ ID NO: 111975 - DNA, 23 bp, Homo sapiens
tttctagcacaatttctttatag

SEQ ID NO: 111976 - DNA, 23 bp, Homo sapiens
tgagatggagtctcactctgtcg

SEQ ID NO: 111977 - DNA, 21 bp, Homo sapiens
tgtttagtctcctcattggta

SEQ ID NO: 111978 - DNA, 22 bp, Homo sapiens
tatgtgtatatatatgtgtgtg

SEQ ID NO: 111979 - DNA, 23 bp, Homo sapiens
tgtatatgtatatatgtatatgt

SEQ ID NO: 111980 - DNA, 23 bp, Homo sapiens
atgtatgcatatgtatatatgta

SEQ ID NO: 111981 - DNA, 23 bp, Homo sapiens
gactgagtctcgctctgtcaccc

SEQ ID NO: 111982 - DNA, 23 bp, Homo sapiens
tgagttcattgtagattctggat

SEQ ID NO: 111983 - DNA, 23 bp, Homo sapiens
tgagttcattgtagattctggat

SEQ ID NO: 111984 - DNA, 23 bp, Homo sapiens
atttctttctacttagtggcagg

SEQ ID NO: 111985 - DNA, 23 bp, Homo sapiens
agagagcaaggtctatgtgagtc

SEQ ID NO: 111986 - DNA, 23 bp, Homo sapiens
gagtctcgctctgtcacacaggc

SEQ ID NO: 111987 - DNA, 22 bp, Homo sapiens
attatgaatataatcatgtact

SEQ ID NO: 111988 - DNA, 23 bp, Homo sapiens
ttatttggttccatatgaaattt

SEQ ID NO: 111989 - DNA, 23 bp, Homo sapiens
atcactgtctgtctttgaatctg

SEQ ID NO: 111990 - DNA, 23 bp, Homo sapiens
gatacatgtgcaggatgtgcagg

SEQ ID NO: 111991 - DNA, 19 bp, Homo sapiens
agagaagctggttggctct

SEQ ID NO: 111992 - DNA, 19 bp, Homo sapiens
atgtggtccagggtctggt

SEQ ID NO: 111993 - DNA, 23 bp, Homo sapiens
ttgagactgatacttagctgttt

SEQ ID NO: 111994 - DNA, 23 bp, Homo sapiens
tctcaagaagcgtgactcagtgc

SEQ ID NO: 111995 - DNA, 18 bp, Homo sapiens
ttagccagagttttgctg

SEQ ID NO: 111996 - DNA, 22 bp, Homo sapiens
tgtccctgaagtttcaccttta

SEQ ID NO: 111997 - DNA, 19 bp, Homo sapiens
cacacacatatatgtgtat

SEQ ID NO: 111998 - DNA, 23 bp, Homo sapiens
atgtatatgtatgtgtatatgtg

SEQ ID NO: 111999 - DNA, 20 bp, Homo sapiens
ttgaggggatttttctctgt

SEQ ID NO: 112000 - DNA, 23 bp, Homo sapiens
tgtgacggagtctcgctctgtct

SEQ ID NO: 112001 - DNA, 22 bp, Homo sapiens
tgggatcaaaggaagtttctgc

SEQ ID NO: 112002 - DNA, 22 bp, Homo sapiens
ttgttgactgtagactcacagc

SEQ ID NO: 112003 - DNA, 23 bp, Homo sapiens
gcaagtctgtcagtgctgttttt

SEQ ID NO: 112004 - DNA, 23 bp, Homo sapiens
ctgtgagtgaatgaacagttcat

SEQ ID NO: 112005 - DNA, 23 bp, Homo sapiens
tgaatagtgctcagtctgtctct

SEQ ID NO: 112006 - DNA, 23 bp, Homo sapiens
aaatacctctatattgtttgaca

SEQ ID NO: 112007 - DNA, 21 bp, Homo sapiens
atgaagtggttatttattgag

SEQ ID NO: 112008 - DNA, 23 bp, Homo sapiens
tttgtatttcaccatgaaaaagt

SEQ ID NO: 112009 - DNA, 23 bp, Homo sapiens
tgtgtctatctgtgtcctaatct

SEQ ID NO: 112010 - DNA, 23 bp, Homo sapiens
acatacgtgtgtgtgtgtgtgtg

SEQ ID NO: 112011 - DNA, 18 bp, Homo sapiens
taagaccttcctgtctgt

SEQ ID NO: 112012 - DNA, 20 bp, Homo sapiens
tttgaggcacatattgaaat

SEQ ID NO: 112013 - DNA, 23 bp, Homo sapiens
aatctgagtctcaatttctacac

SEQ ID NO: 112014 - DNA, 18 bp, Homo sapiens
tttgtaataaagattcca

SEQ ID NO: 112015 - DNA, 22 bp, Homo sapiens
ttgagacagagtctcgctctgt

SEQ ID NO: 112016 - DNA, 23 bp, Homo sapiens
tgctcagagtattcagtgaggtt

SEQ ID NO: 112017 - DNA, 21 bp, Homo sapiens
agaactcctgcatctcccagc

SEQ ID NO: 112018 - DNA, 23 bp, Homo sapiens
tttcacagccacatttcatcaca

SEQ ID NO: 112019 - DNA, 22 bp, Homo sapiens
aagtggttgagtgaatgtagtg

SEQ ID NO: 112020 - DNA, 23 bp, Homo sapiens
ttaatgacatggaaatgcttagg

SEQ ID NO: 112021 - DNA, 23 bp, Homo sapiens
tgatcatacactgaaaatgttct

SEQ ID NO: 112022 - DNA, 21 bp, Homo sapiens
ttcataatgatttccaaagga

SEQ ID NO: 112023 - DNA, 19 bp, Homo sapiens
tatgtatatatgtagatat

SEQ ID NO: 112024 - DNA, 20 bp, Homo sapiens
tgcaacattgaagttgaagc

SEQ ID NO: 112025 - DNA, 20 bp, Homo sapiens
tgactcctttagctttgatt

SEQ ID NO: 112026 - DNA, 21 bp, Homo sapiens
tgagtcatcaacatggtgctt

SEQ ID NO: 112027 - DNA, 22 bp, Homo sapiens
tatgtatatatatatgtgtata

SEQ ID NO: 112028 - DNA, 23 bp, Homo sapiens
tatgtatatatatatatgtgtat

SEQ ID NO: 112029 - DNA, 20 bp, Homo sapiens
atgtcaatataatatattga

SEQ ID NO: 112030 - DNA, 23 bp, Homo sapiens
tatatgtatgtgtgcatgtgtat

SEQ ID NO: 112031 - DNA, 23 bp, Homo sapiens
ccaacatctactgttttttgatt

SEQ ID NO: 112032 - DNA, 23 bp, Homo sapiens
tttggtagaaagttgtttagaaa

SEQ ID NO: 112033 - DNA, 21 bp, Homo sapiens
tgagacatactagatttgggt

SEQ ID NO: 112034 - DNA, 21 bp, Homo sapiens
tgagacggagtttcgctctgt

SEQ ID NO: 112035 - DNA, 23 bp, Homo sapiens
tgagttcattgtagattctggat

SEQ ID NO: 112036 - DNA, 23 bp, Homo sapiens
tgagttcattgtagattctggat

SEQ ID NO: 112037 - DNA, 20 bp, Homo sapiens
tcttagacttttctttgttg

SEQ ID NO: 112038 - DNA, 23 bp, Homo sapiens
gtgtgtgtatatatatatgtgtg

SEQ ID NO: 112039 - DNA, 23 bp, Homo sapiens
ggaatattactagagttagctga

SEQ ID NO: 112040 - DNA, 22 bp, Homo sapiens
aatcaccaataaatagcttctg

SEQ ID NO: 112041 - DNA, 23 bp, Homo sapiens
gtctccctctgtcaccccgacta

SEQ ID NO: 112042 - DNA, 23 bp, Homo sapiens
acacgtatatatatgtgtataca

SEQ ID NO: 112043 - DNA, 23 bp, Homo sapiens
aaatcacagtgaacaagctctct

SEQ ID NO: 112044 - DNA, 23 bp, Homo sapiens
tgagttcattgtagattctggat

SEQ ID NO: 112045 - DNA, 23 bp, Homo sapiens
tgagttcattgtagattctggat

SEQ ID NO: 112046 - DNA, 23 bp, Homo sapiens
atatgtcttattgtatatgtaac

SEQ ID NO: 112047 - DNA, 23 bp, Homo sapiens
tgagttcattgtagattctggat

SEQ ID NO: 112048 - DNA, 23 bp, Homo sapiens
tgagttcattgtagattctggat

SEQ ID NO: 112049 - DNA, 23 bp, Homo sapiens
tataccaacttatgcatatgtgt

SEQ ID NO: 112050 - DNA, 19 bp, Homo sapiens
tttatgtatatgtgcatac

SEQ ID NO: 112051 - DNA, 21 bp, Homo sapiens
tatatgtgcatatatatgtat

SEQ ID NO: 112052 - DNA, 20 bp, Homo sapiens
tgcctaaagttacataagag

SEQ ID NO: 112053 - DNA, 22 bp, Homo sapiens
atatatctccatatatatatct

SEQ ID NO: 112054 - DNA, 23 bp, Homo sapiens
ggacctagctcatgacactgatg

SEQ ID NO: 112055 - DNA, 21 bp, Homo sapiens
atatctatatgtatctcatag

SEQ ID NO: 112056 - DNA, 23 bp, Homo sapiens
aagagcatgagataaagtgagca

SEQ ID NO: 112057 - DNA, 18 bp, Homo sapiens
atgtagccagtttatgtt

SEQ ID NO: 112058 - DNA, 23 bp, Homo sapiens
aaattgaagctatttttgtaatg

SEQ ID NO: 112059 - DNA, 21 bp, Homo sapiens
tttctttgtagtactctttgg

SEQ ID NO: 112060 - DNA, 18 bp, Homo sapiens
tcctagctactcaggagg

SEQ ID NO: 112061 - DNA, 23 bp, Homo sapiens
ctcgctcactctcggtgccttct

SEQ ID NO: 112062 - DNA, 23 bp, Homo sapiens
tgactgatgagagagagaagtgg

SEQ ID NO: 112063 - DNA, 18 bp, Homo sapiens
tgtgatgggagtgggaat

SEQ ID NO: 112064 - DNA, 23 bp, Homo sapiens
tctccatctcagtggctgcatct

SEQ ID NO: 112065 - DNA, 18 bp, Homo sapiens
tgatcaacatagtgagac

SEQ ID NO: 112066 - DNA, 20 bp, Homo sapiens
atactacactgctgttttct

SEQ ID NO: 112067 - DNA, 23 bp, Homo sapiens
agagtctcactctgtcacccagg

SEQ ID NO: 112068 - DNA, 23 bp, Homo sapiens
acatatacacacacatatacaca

SEQ ID NO: 112069 - DNA, 20 bp, Homo sapiens
atttatgtacatatacatgt

SEQ ID NO: 112070 - DNA, 23 bp, Homo sapiens
tgtgtatgtacttgtttgtcttc

SEQ ID NO: 112071 - DNA, 22 bp, Homo sapiens
atatgcaaaatgttggcatagc

SEQ ID NO: 112072 - DNA, 21 bp, Homo sapiens
acgtgcattagagagaggaca

SEQ ID NO: 112073 - DNA, 23 bp, Homo sapiens
ttttgaattaatgctgaagtgag

SEQ ID NO: 112074 - DNA, 23 bp, Homo sapiens
tgctttgttttgaagtatgagga

SEQ ID NO: 112075 - DNA, 23 bp, Homo sapiens
atgtgcacaacatgcaggtttgt

SEQ ID NO: 112076 - DNA, 23 bp, Homo sapiens
tcaatatttgtttttgttgcaat

SEQ ID NO: 112077 - DNA, 19 bp, Homo sapiens
tttgccaaagccaatgttg

SEQ ID NO: 112078 - DNA, 23 bp, Homo sapiens
tatatacacacacatatacttat

SEQ ID NO: 112079 - DNA, 23 bp, Homo sapiens
gctcatttctgtctctgttagct

SEQ ID NO: 112080 - DNA, 23 bp, Homo sapiens
atcttgttcattgtaaatttgta

SEQ ID NO: 112081 - DNA, 23 bp, Homo sapiens
atttatgatgagtaccaatggtt

SEQ ID NO: 112082 - DNA, 21 bp, Homo sapiens
atattgagcattgactgggca

SEQ ID NO: 112083 - DNA, 23 bp, Homo sapiens
tggagtctcactctgtcacccag

SEQ ID NO: 112084 - DNA, 20 bp, Homo sapiens
tctaagaaaaggcaacttag

SEQ ID NO: 112085 - DNA, 21 bp, Homo sapiens
tgaggtaggaggatgacttga

SEQ ID NO: 112086 - DNA, 18 bp, Homo sapiens
ttcgtccatttcatctct

SEQ ID NO: 112087 - DNA, 23 bp, Homo sapiens
tatagtatatatgtatatgtgag

SEQ ID NO: 112088 - DNA, 18 bp, Homo sapiens
tcctttggcaagatccac

SEQ ID NO: 112089 - DNA, 23 bp, Homo sapiens
tagacagaatttactgagctgaa

SEQ ID NO: 112090 - DNA, 22 bp, Homo sapiens
ctgttttttgaggatgctgaat

SEQ ID NO: 112091 - DNA, 22 bp, Homo sapiens
gcgtccgtgtgaagagaccacc

SEQ ID NO: 112092 - DNA, 23 bp, Homo sapiens
gtgagcaacatggttgtttattt

SEQ ID NO: 112093 - DNA, 23 bp, Homo sapiens
tatactcctttaaattgaggtaa

SEQ ID NO: 112094 - DNA, 23 bp, Homo sapiens
tgagttcattgtagattctggat

SEQ ID NO: 112095 - DNA, 23 bp, Homo sapiens
tgagttcattgtagattctggat

SEQ ID NO: 112096 - DNA, 23 bp, Homo sapiens
actttctgagaagtaaagagcca

SEQ ID NO: 112097 - DNA, 22 bp, Homo sapiens
tgagacagagtctggctctgtt

SEQ ID NO: 112098 - DNA, 23 bp, Homo sapiens
tgagttcattgtagattctggat

SEQ ID NO: 112099 - DNA, 23 bp, Homo sapiens
tgagttcattgtagattctggat

SEQ ID NO: 112100 - DNA, 19 bp, Homo sapiens
cgaagtgcatcctgtggtc

SEQ ID NO: 112101 - DNA, 18 bp, Homo sapiens
ttgcagatgaaaaactga

SEQ ID NO: 112102 - DNA, 23 bp, Homo sapiens
tgtaactcagtttttcatctgca

SEQ ID NO: 112103 - DNA, 23 bp, Homo sapiens
ggggtctcactctgtcacccagg

SEQ ID NO: 112104 - DNA, 23 bp, Homo sapiens
ttgctctgtcacccagtctggag

SEQ ID NO: 112105 - DNA, 22 bp, Homo sapiens
tacaaagtatttgtaatagtcc

SEQ ID NO: 112106 - DNA, 20 bp, Homo sapiens
gtttcaggcattggttctca

SEQ ID NO: 112107 - DNA, 23 bp, Homo sapiens
gtgtgggagacatttgagagagt

SEQ ID NO: 112108 - DNA, 23 bp, Homo sapiens
ttttagcaagcttactattgtaa

SEQ ID NO: 112109 - DNA, 19 bp, Homo sapiens
aaacaccaagtgctccacg

SEQ ID NO: 112110 - DNA, 23 bp, Homo sapiens
attgatgattttgttactgtctt

SEQ ID NO: 112111 - DNA, 21 bp, Homo sapiens
atacgtatacatgtatatgta

SEQ ID NO: 112112 - DNA, 23 bp, Homo sapiens
atatgtatatatgtatatgtgca

SEQ ID NO: 112113 - DNA, 18 bp, Homo sapiens
atatgtgtatatacgtat

SEQ ID NO: 112114 - DNA, 18 bp, Homo sapiens
aacatagtgagacctcat

SEQ ID NO: 112115 - DNA, 21 bp, Homo sapiens
tacccactagatgtcagtaac

SEQ ID NO: 112116 - DNA, 23 bp, Homo sapiens
ttgtgacaacagtgtgttcagac

SEQ ID NO: 112117 - DNA, 23 bp, Homo sapiens
tcaagtgtatacttttagtagaa

SEQ ID NO: 112118 - DNA, 23 bp, Homo sapiens
ttggacctcagtctcaatgtgtg

SEQ ID NO: 112119 - DNA, 23 bp, Homo sapiens
gtgtgtgtgtgtgtgcacgtgta

SEQ ID NO: 112120 - DNA, 23 bp, Homo sapiens
tgagacggtctgtcactgcctgc

SEQ ID NO: 112121 - DNA, 23 bp, Homo sapiens
ggatagcatttcttactcttcac

SEQ ID NO: 112122 - DNA, 23 bp, Homo sapiens
tggagtctcactctgtcacccag

SEQ ID NO: 112123 - DNA, 18 bp, Homo sapiens
aacagacagtggctagac

SEQ ID NO: 112124 - DNA, 22 bp, Homo sapiens
taaacagagtctccctttgtcc

SEQ ID NO: 112125 - DNA, 23 bp, Homo sapiens
agagtctcactctgtcacccagg

SEQ ID NO: 112126 - DNA, 23 bp, Homo sapiens
gagtctcactctgtcacccaggc

SEQ ID NO: 112127 - DNA, 22 bp, Homo sapiens
ttttatgcatatagtccaccat

SEQ ID NO: 112128 - DNA, 20 bp, Homo sapiens
tttatgcatatagtccacta

SEQ ID NO: 112129 - DNA, 21 bp, Homo sapiens
tatacagtccgctatatatgt

SEQ ID NO: 112130 - DNA, 23 bp, Homo sapiens
tatacagtccgctatatatgttc

SEQ ID NO: 112131 - DNA, 23 bp, Homo sapiens
tatacagtccgctatatatgttc

SEQ ID NO: 112132 - DNA, 22 bp, Homo sapiens
tggagtctcgctctgtcaccag

SEQ ID NO: 112133 - DNA, 23 bp, Homo sapiens
gcctcactctgtcactctgcctt

SEQ ID NO: 112134 - DNA, 23 bp, Homo sapiens
acagagtctcgctctgtctctca

SEQ ID NO: 112135 - DNA, 23 bp, Homo sapiens
ccctgagcttaattattccatct

SEQ ID NO: 112136 - DNA, 23 bp, Homo sapiens
gggtctcactctgactctcaggc

SEQ ID NO: 112137 - DNA, 23 bp, Homo sapiens
ataggtgattatgactgtattcc

SEQ ID NO: 112138 - DNA, 21 bp, Homo sapiens
ttctggtcgataagaattgat

SEQ ID NO: 112139 - DNA, 23 bp, Homo sapiens
ctgactgacactcatattgaaaa

SEQ ID NO: 112140 - DNA, 21 bp, Homo sapiens
cagtgtaatagaattgggagg

SEQ ID NO: 112141 - DNA, 22 bp, Homo sapiens
gacaagctttcactctgttgac

SEQ ID NO: 112142 - DNA, 23 bp, Homo sapiens
tgaaattctgagagtctgttctt

SEQ ID NO: 112143 - DNA, 22 bp, Homo sapiens
attaacctctcataggtacagg

SEQ ID NO: 112144 - DNA, 22 bp, Homo sapiens
ttacagcagctccaacagattg

SEQ ID NO: 112145 - DNA, 23 bp, Homo sapiens
ttctgaaacttcatatcagttca

SEQ ID NO: 112146 - DNA, 23 bp, Homo sapiens
tggagtctcactctgtcacccag

SEQ ID NO: 112147 - DNA, 23 bp, Homo sapiens
tggaaatggctctgatagcactc

SEQ ID NO: 112148 - DNA, 23 bp, Homo sapiens
tttgatggagtctcgctctgtca

SEQ ID NO: 112149 - DNA, 23 bp, Homo sapiens
tcagaccctccctctctcgctga

SEQ ID NO: 112150 - DNA, 21 bp, Homo sapiens
catgcctgtagttccagctac

SEQ ID NO: 112151 - DNA, 23 bp, Homo sapiens
agtatgaggctacagtgagctat

SEQ ID NO: 112152 - DNA, 23 bp, Homo sapiens
aagaagtctctctctgtcaccta

SEQ ID NO: 112153 - DNA, 22 bp, Homo sapiens
tgaggttgcagtgagccatact

SEQ ID NO: 112154 - DNA, 23 bp, Homo sapiens
gacagagtctcgctctgtcaccc

SEQ ID NO: 112155 - DNA, 23 bp, Homo sapiens
tgagagggagtctcgctctgtca

SEQ ID NO: 112156 - DNA, 23 bp, Homo sapiens
gtctcactctcttgcacacactg

SEQ ID NO: 112157 - DNA, 23 bp, Homo sapiens
tttgagacggagtctcactctgt

SEQ ID NO: 112158 - DNA, 23 bp, Homo sapiens
tacatgtgccatgttggtgtgct

SEQ ID NO: 112159 - DNA, 23 bp, Homo sapiens
tacatgtgcacaatgtgcaggtt

SEQ ID NO: 112160 - DNA, 23 bp, Homo sapiens
gggtctcactctgtcacccaggc

SEQ ID NO: 112161 - DNA, 23 bp, Homo sapiens
gggtctcactctgtcacccaggc

SEQ ID NO: 112162 - DNA, 23 bp, Homo sapiens
attttacagcaattcatgtcaaa

SEQ ID NO: 112163 - DNA, 23 bp, Homo sapiens
ttatagagaggatggtggaagct

SEQ ID NO: 112164 - DNA, 23 bp, Homo sapiens
ttcactcactgcattttttcact

SEQ ID NO: 112165 - DNA, 23 bp, Homo sapiens
gggtctcagtctgtcactcaggc

SEQ ID NO: 112166 - DNA, 20 bp, Homo sapiens
ttactgcaatgataatacag

SEQ ID NO: 112167 - DNA, 23 bp, Homo sapiens
tgtcagttgacagtgagaattcc

SEQ ID NO: 112168 - DNA, 23 bp, Homo sapiens
ttggaatctgtttctataatagc

SEQ ID NO: 112169 - DNA, 22 bp, Homo sapiens
gagtggattgatgtgaggagtt

SEQ ID NO: 112170 - DNA, 23 bp, Homo sapiens
agagtctcactctgtcacccagg

SEQ ID NO: 112171 - DNA, 23 bp, Homo sapiens
gagtctcactctgtcacccaggc

SEQ ID NO: 112172 - DNA, 23 bp, Homo sapiens
tttgtgtgtgtgtatcttgtgta

SEQ ID NO: 112173 - DNA, 23 bp, Homo sapiens
tgtatctctgtatctgtgtctat

SEQ ID NO: 112174 - DNA, 19 bp, Homo sapiens
caagatggagtctcattct

SEQ ID NO: 112175 - DNA, 23 bp, Homo sapiens
cagtccgtcagtccctgggtcat

SEQ ID NO: 112176 - DNA, 23 bp, Homo sapiens
tgtgtctctgtgactgagtatga

SEQ ID NO: 112177 - DNA, 23 bp, Homo sapiens
agagtggtacaagatgagggagg

SEQ ID NO: 112178 - DNA, 21 bp, Homo sapiens
tcactagagaatttgatgttg

SEQ ID NO: 112179 - DNA, 19 bp, Homo sapiens
tcactgaaagctctgcctc

SEQ ID NO: 112180 - DNA, 23 bp, Homo sapiens
tgagacagagtctctctctgcca

SEQ ID NO: 112181 - DNA, 22 bp, Homo sapiens
aggaaacaggaggtgtttggtt

SEQ ID NO: 112182 - DNA, 23 bp, Homo sapiens
gggtctcactctgtcacccaggc

SEQ ID NO: 112183 - DNA, 23 bp, Homo sapiens
aatttgatttgctagtattttgt

SEQ ID NO: 112184 - DNA, 22 bp, Homo sapiens
atattgacctgcagttttcatt

SEQ ID NO: 112185 - DNA, 20 bp, Homo sapiens
tctcactctgtcacccaggg

SEQ ID NO: 112186 - DNA, 23 bp, Homo sapiens
tgtgtgtgcctgtagttccagct

SEQ ID NO: 112187 - DNA, 23 bp, Homo sapiens
tcagtctcactgtttcttttaag

SEQ ID NO: 112188 - DNA, 20 bp, Homo sapiens
atatgtatatatgtatgtgt

SEQ ID NO: 112189 - DNA, 22 bp, Homo sapiens
tattaacaggtattgttattgt

SEQ ID NO: 112190 - DNA, 22 bp, Homo sapiens
tctaaagatcttgaatgacttt

SEQ ID NO: 112191 - DNA, 19 bp, Homo sapiens
tatctctgtgaaagtttat

SEQ ID NO: 112192 - DNA, 23 bp, Homo sapiens
tgagttcattgtagattctggat

SEQ ID NO: 112193 - DNA, 23 bp, Homo sapiens
tgagttcattgtagattctggat

SEQ ID NO: 112194 - DNA, 23 bp, Homo sapiens
ctttcactctcactttgccaaaa

SEQ ID NO: 112195 - DNA, 21 bp, Homo sapiens
aacacaattgtacatggagac

SEQ ID NO: 112196 - DNA, 20 bp, Homo sapiens
tgacagttgtctctgacctc

SEQ ID NO: 112197 - DNA, 23 bp, Homo sapiens
tcacactctttctcaatttcatt

SEQ ID NO: 112198 - DNA, 23 bp, Homo sapiens
tttactcgttgatatatatgtgt

SEQ ID NO: 112199 - DNA, 23 bp, Homo sapiens
atcaacgagtacataaagacact

SEQ ID NO: 112200 - DNA, 23 bp, Homo sapiens
taggacagagtatgtaattatga

SEQ ID NO: 112201 - DNA, 20 bp, Homo sapiens
tgggtagttgatcccttttc

SEQ ID NO: 112202 - DNA, 23 bp, Homo sapiens
aatgtgttcttgtatatgtgtat

SEQ ID NO: 112203 - DNA, 23 bp, Homo sapiens
ttacagtgagctatcattgtgtc

SEQ ID NO: 112204 - DNA, 23 bp, Homo sapiens
tcagtgtgtctctctctgcggct

SEQ ID NO: 112205 - DNA, 23 bp, Homo sapiens
acttagttcaaatagcttagcat

SEQ ID NO: 112206 - DNA, 22 bp, Homo sapiens
gtgtgtgtatgtgtgtatatat

SEQ ID NO: 112207 - DNA, 21 bp, Homo sapiens
tatggatatatatatcttagt

SEQ ID NO: 112208 - DNA, 23 bp, Homo sapiens
aaagtgactactgaagatgtgaa

SEQ ID NO: 112209 - DNA, 23 bp, Homo sapiens
tcatatttcatcttcagcctgaa

SEQ ID NO: 112210 - DNA, 22 bp, Homo sapiens
tcttttctcttgctttgtggct

SEQ ID NO: 112211 - DNA, 22 bp, Homo sapiens
tgagatagaatctctctctgtc

SEQ ID NO: 112212 - DNA, 19 bp, Homo sapiens
tcattgttcatcaaggata

SEQ ID NO: 112213 - DNA, 23 bp, Homo sapiens
gagtacagagtttttgttgggga

SEQ ID NO: 112214 - DNA, 23 bp, Homo sapiens
taagttcagcaagtacttaggcc

SEQ ID NO: 112215 - DNA, 23 bp, Homo sapiens
tacatatgaatggaatgtataga

SEQ ID NO: 112216 - DNA, 23 bp, Homo sapiens
aatctgaatgtttttctttcaaa

SEQ ID NO: 112217 - DNA, 22 bp, Homo sapiens
attatctcgatgtctaatgcta

SEQ ID NO: 112218 - DNA, 23 bp, Homo sapiens
tgagttcattgtagattctggat

SEQ ID NO: 112219 - DNA, 23 bp, Homo sapiens
tgagttcattgtagattctggat

SEQ ID NO: 112220 - DNA, 23 bp, Homo sapiens
tgagttcattgtagattctggat

SEQ ID NO: 112221 - DNA, 23 bp, Homo sapiens
tgagttcattgtagattctggat

SEQ ID NO: 112222 - DNA, 23 bp, Homo sapiens
tgcaactttactgaatttgttta

SEQ ID NO: 112223 - DNA, 23 bp, Homo sapiens
ctttattaccttttctgatactt

SEQ ID NO: 112224 - DNA, 23 bp, Homo sapiens
acagctataagtcacgataagat

SEQ ID NO: 112225 - DNA, 21 bp, Homo sapiens
tttgagaaggagtcttgctct

SEQ ID NO: 112226 - DNA, 23 bp, Homo sapiens
ctcagtatatgtgtgtatatgta

SEQ ID NO: 112227 - DNA, 23 bp, Homo sapiens
tggatggatggatgattagctgt

SEQ ID NO: 112228 - DNA, 20 bp, Homo sapiens
tataggtacatatatgtata

SEQ ID NO: 112229 - DNA, 23 bp, Homo sapiens
cagggtctcactctgtcacacag

SEQ ID NO: 112230 - DNA, 23 bp, Homo sapiens
aggtgcaatcatgtctcactgca

SEQ ID NO: 112231 - DNA, 18 bp, Homo sapiens
tgcacatgaatgataatg

SEQ ID NO: 112232 - DNA, 21 bp, Homo sapiens
atcctggatttattttcttta

SEQ ID NO: 112233 - DNA, 21 bp, Homo sapiens
atttctagatttccaatgagt

SEQ ID NO: 112234 - DNA, 20 bp, Homo sapiens
gaaaagcagatcattgtgca

SEQ ID NO: 112235 - DNA, 23 bp, Homo sapiens
actctgtcactcagactagagcg

SEQ ID NO: 112236 - DNA, 23 bp, Homo sapiens
agtgcagaatcagcactctcctg

SEQ ID NO: 112237 - DNA, 21 bp, Homo sapiens
agagagaggtcagagtgcaca

SEQ ID NO: 112238 - DNA, 23 bp, Homo sapiens
tgagttcattgtagattctggat

SEQ ID NO: 112239 - DNA, 23 bp, Homo sapiens
tgagttcattgtagattctggat

SEQ ID NO: 112240 - DNA, 23 bp, Homo sapiens
tattatgctacattttcttttct

SEQ ID NO: 112241 - DNA, 20 bp, Homo sapiens
tctctaaataaataactcag

SEQ ID NO: 112242 - DNA, 23 bp, Homo sapiens
aacagagttgagactctgtctca

SEQ ID NO: 112243 - DNA, 22 bp, Homo sapiens
gggtctcactctgtcgctcagc

SEQ ID NO: 112244 - DNA, 23 bp, Homo sapiens
tctctctctctcttttgagacag

SEQ ID NO: 112245 - DNA, 19 bp, Homo sapiens
tactggggaatgttttcag

SEQ ID NO: 112246 - DNA, 23 bp, Homo sapiens
attatggagcagataaacaagat

SEQ ID NO: 112247 - DNA, 23 bp, Homo sapiens
tgtctggctctgtgtcttgtgtg

SEQ ID NO: 112248 - DNA, 22 bp, Homo sapiens
tctgactctgtcactttaatca

SEQ ID NO: 112249 - DNA, 23 bp, Homo sapiens
tgagttcattgtagattctggat

SEQ ID NO: 112250 - DNA, 23 bp, Homo sapiens
tgagttcattgtagattctggat

SEQ ID NO: 112251 - DNA, 23 bp, Homo sapiens
tgagttcattgtagattctggat

SEQ ID NO: 112252 - DNA, 23 bp, Homo sapiens
tgagttcattgtagattctggat

SEQ ID NO: 112253 - DNA, 18 bp, Homo sapiens
taagcttcagatatatgg

SEQ ID NO: 112254 - DNA, 22 bp, Homo sapiens
tgtgcgtgtgtgtatgtatata

SEQ ID NO: 112255 - DNA, 23 bp, Homo sapiens
tgtctcagtttctctttcacacc

SEQ ID NO: 112256 - DNA, 23 bp, Homo sapiens
agtggaagacaatctctactcac

SEQ ID NO: 112257 - DNA, 23 bp, Homo sapiens
aacttcaagtatatgtacaatta

SEQ ID NO: 112258 - DNA, 19 bp, Homo sapiens
tcagattagattaaggtct

SEQ ID NO: 112259 - DNA, 21 bp, Homo sapiens
aaggaatcattatcattgtat

SEQ ID NO: 112260 - DNA, 22 bp, Homo sapiens
atgtggaaataatcagaagtga

SEQ ID NO: 112261 - DNA, 21 bp, Homo sapiens
aatacaagaaagactgcagga

SEQ ID NO: 112262 - DNA, 23 bp, Homo sapiens
aacagtgttgattttttttctaa

SEQ ID NO: 112263 - DNA, 23 bp, Homo sapiens
tttgagcttgtataggtttgatt

SEQ ID NO: 112264 - DNA, 23 bp, Homo sapiens
agagctttgaacatgtaattgtt

SEQ ID NO: 112265 - DNA, 22 bp, Homo sapiens
caagccttgtgatttagttcta

SEQ ID NO: 112266 - DNA, 21 bp, Homo sapiens
ttttgagacggagtctcactc

SEQ ID NO: 112267 - DNA, 22 bp, Homo sapiens
ctgaggtagaagaatcacttga

SEQ ID NO: 112268 - DNA, 21 bp, Homo sapiens
tttatggttttatacttcttt

SEQ ID NO: 112269 - DNA, 21 bp, Homo sapiens
tacatgtggaattattttata

SEQ ID NO: 112270 - DNA, 18 bp, Homo sapiens
ttgagctttattttattt

SEQ ID NO: 112271 - DNA, 23 bp, Homo sapiens
tgactcacagactgtgttgctac

SEQ ID NO: 112272 - DNA, 23 bp, Homo sapiens
tgagttcattgtagattctggat

SEQ ID NO: 112273 - DNA, 23 bp, Homo sapiens
tgagttcattgtagattctggat

SEQ ID NO: 112274 - DNA, 23 bp, Homo sapiens
tttgagacggagtctcactctgt

SEQ ID NO: 112275 - DNA, 22 bp, Homo sapiens
tcatactctctctgaaacctct

SEQ ID NO: 112276 - DNA, 23 bp, Homo sapiens
atgtgtatatatatttgtgtgtg

SEQ ID NO: 112277 - DNA, 23 bp, Homo sapiens
agtccactgtagactatcagttg

SEQ ID NO: 112278 - DNA, 21 bp, Homo sapiens
tatatgtatatatatatgtgt

SEQ ID NO: 112279 - DNA, 22 bp, Homo sapiens
aacgtgtatatacatgtgtgtg

SEQ ID NO: 112280 - DNA, 23 bp, Homo sapiens
tgtgtgtatatatacatatgtgt

SEQ ID NO: 112281 - DNA, 23 bp, Homo sapiens
cagccactcactgtctatgagac

SEQ ID NO: 112282 - DNA, 23 bp, Homo sapiens
aatatctgcttcaggtttcctta

SEQ ID NO: 112283 - DNA, 20 bp, Homo sapiens
tttgtgtatgatttacttgt

SEQ ID NO: 112284 - DNA, 23 bp, Homo sapiens
atatatgtgcatttgtacacatg

SEQ ID NO: 112285 - DNA, 20 bp, Homo sapiens
tttccacttgtgcgtcatct

SEQ ID NO: 112286 - DNA, 18 bp, Homo sapiens
tatgtgtgtgtgtgtgta

SEQ ID NO: 112287 - DNA, 18 bp, Homo sapiens
ttatatgtatatgtgtgt

SEQ ID NO: 112288 - DNA, 23 bp, Homo sapiens
gtcatagatttctcgatttcaaa

SEQ ID NO: 112289 - DNA, 23 bp, Homo sapiens
tatgtgtgtgtatatctatctat

SEQ ID NO: 112290 - DNA, 21 bp, Homo sapiens
atactgagtatatatattctc

SEQ ID NO: 112291 - DNA, 19 bp, Homo sapiens
tatgtgtgtgcatatatat

SEQ ID NO: 112292 - DNA, 20 bp, Homo sapiens
tatatatgtacatgtacatg

SEQ ID NO: 112293 - DNA, 23 bp, Homo sapiens
atgtatatatgtatatgtacacg

SEQ ID NO: 112294 - DNA, 23 bp, Homo sapiens
cacatgtatacatgtatgtatgt

SEQ ID NO: 112295 - DNA, 23 bp, Homo sapiens
tacacgtgtatatgtatacactt

SEQ ID NO: 112296 - DNA, 18 bp, Homo sapiens
atgcatgtatacatgtat

SEQ ID NO: 112297 - DNA, 21 bp, Homo sapiens
tatatgtgtatacatgcatag

SEQ ID NO: 112298 - DNA, 21 bp, Homo sapiens
atatgtatatgtatacacgta

SEQ ID NO: 112299 - DNA, 23 bp, Homo sapiens
tatatatgtatatgtatacgtgt

SEQ ID NO: 112300 - DNA, 23 bp, Homo sapiens
tatgtgactcagtcaaagcagat

SEQ ID NO: 112301 - DNA, 23 bp, Homo sapiens
tgtatgtatgcatatatgtgtgt

SEQ ID NO: 112302 - DNA, 23 bp, Homo sapiens
tctatgtatctatatatgtgtct

SEQ ID NO: 112303 - DNA, 21 bp, Homo sapiens
tatctgtatattatatctaga

SEQ ID NO: 112304 - DNA, 21 bp, Homo sapiens
atatctatgtgcatgtgtgtg

SEQ ID NO: 112305 - DNA, 23 bp, Homo sapiens
catatgtatgtatgcaaaagtat

SEQ ID NO: 112306 - DNA, 23 bp, Homo sapiens
atatatgtgtgtatatatatgtg

SEQ ID NO: 112307 - DNA, 23 bp, Homo sapiens
atacacacacatatatacacaca

SEQ ID NO: 112308 - DNA, 23 bp, Homo sapiens
acatatgtgtgtgtatatgcgtg

SEQ ID NO: 112309 - DNA, 23 bp, Homo sapiens
atatgtgtgtatatatatgtatg

SEQ ID NO: 112310 - DNA, 21 bp, Homo sapiens
taagagagtgttatctcctcc

SEQ ID NO: 112311 - DNA, 22 bp, Homo sapiens
tgacggagtgagacactgtctc

SEQ ID NO: 112312 - DNA, 23 bp, Homo sapiens
tattgagacggagtcttgctctg

SEQ ID NO: 112313 - DNA, 23 bp, Homo sapiens
ctgagaagacagcttgaggttag

SEQ ID NO: 112314 - DNA, 21 bp, Homo sapiens
atttatatgtgcatatgtata

SEQ ID NO: 112315 - DNA, 21 bp, Homo sapiens
tggcaggctcagagtactctc

SEQ ID NO: 112316 - DNA, 23 bp, Homo sapiens
tgagttcattgtagattctggat

SEQ ID NO: 112317 - DNA, 23 bp, Homo sapiens
tgagttcattgtagattctggat

SEQ ID NO: 112318 - DNA, 21 bp, Homo sapiens
atcaccaattttatcgtgtat

SEQ ID NO: 112319 - DNA, 21 bp, Homo sapiens
acagtagaaatagattgatct

SEQ ID NO: 112320 - DNA, 21 bp, Homo sapiens
atataacacattttatatatg

SEQ ID NO: 112321 - DNA, 23 bp, Homo sapiens
atgtatgtgtatgtgtatgtgtg

SEQ ID NO: 112322 - DNA, 23 bp, Homo sapiens
tgcctgttgatcatttgtatgtc

SEQ ID NO: 112323 - DNA, 22 bp, Homo sapiens
acacacgtgtatacacgtatat

SEQ ID NO: 112324 - DNA, 20 bp, Homo sapiens
tacatgtatatatgtatatg

SEQ ID NO: 112325 - DNA, 22 bp, Homo sapiens
aaattgatgcttgttttgaaaa

SEQ ID NO: 112326 - DNA, 20 bp, Homo sapiens
aaatgcattaattccagaaa

SEQ ID NO: 112327 - DNA, 23 bp, Homo sapiens
tagagaagagagagagatcagta

SEQ ID NO: 112328 - DNA, 22 bp, Homo sapiens
taccaacagatgttggttttaa

SEQ ID NO: 112329 - DNA, 23 bp, Homo sapiens
taatagctattctgactggtgta

SEQ ID NO: 112330 - DNA, 18 bp, Homo sapiens
ggaggtaggagttgcctt

SEQ ID NO: 112331 - DNA, 23 bp, Homo sapiens
atttgaagatttactggtggata

SEQ ID NO: 112332 - DNA, 20 bp, Homo sapiens
aattgcatgattagtcaatg

SEQ ID NO: 112333 - DNA, 23 bp, Homo sapiens
taagagcttcgtgatcagatttg

SEQ ID NO: 112334 - DNA, 23 bp, Homo sapiens
attagagagattaagttcttgat

SEQ ID NO: 112335 - DNA, 22 bp, Homo sapiens
aacctgcatcccttttcagtca

SEQ ID NO: 112336 - DNA, 20 bp, Homo sapiens
acacacacatatatatgtgt

SEQ ID NO: 112337 - DNA, 23 bp, Homo sapiens
tgagttcattgtagattctggat

SEQ ID NO: 112338 - DNA, 23 bp, Homo sapiens
tgagttcattgtagattctggat

SEQ ID NO: 112339 - DNA, 21 bp, Homo sapiens
tgacacaagtgagtgaccaga

SEQ ID NO: 112340 - DNA, 20 bp, Homo sapiens
aggatgcacagttttatgta

SEQ ID NO: 112341 - DNA, 20 bp, Homo sapiens
tgtgtatatgtatacacata

SEQ ID NO: 112342 - DNA, 23 bp, Homo sapiens
atatgtgtgtatatgtatacatg

SEQ ID NO: 112343 - DNA, 23 bp, Homo sapiens
acaatcactgatctaggtagatt

SEQ ID NO: 112344 - DNA, 21 bp, Homo sapiens
gtttcaggatatttaatctct

SEQ ID NO: 112345 - DNA, 18 bp, Homo sapiens
agagctagatggtagaat

SEQ ID NO: 112346 - DNA, 20 bp, Homo sapiens
tgtctatcagctatccaagt

SEQ ID NO: 112347 - DNA, 23 bp, Homo sapiens
ttaaaacatgtttaacatggagt

SEQ ID NO: 112348 - DNA, 23 bp, Homo sapiens
tatgtgatatacatatgtgtatg

SEQ ID NO: 112349 - DNA, 23 bp, Homo sapiens
acaagagtctcgctctgtcaccc

SEQ ID NO: 112350 - DNA, 23 bp, Homo sapiens
agacagagtctcactctgtcgcc

SEQ ID NO: 112351 - DNA, 23 bp, Homo sapiens
acagagtctcactctgtcgccca

SEQ ID NO: 112352 - DNA, 23 bp, Homo sapiens
taagaggtgattatgttgttaag

SEQ ID NO: 112353 - DNA, 21 bp, Homo sapiens
ttgcaagactgggttagttct

SEQ ID NO: 112354 - DNA, 20 bp, Homo sapiens
gagaagagtctgttcatatc

SEQ ID NO: 112355 - DNA, 21 bp, Homo sapiens
tgagaatgggactgatggctt

SEQ ID NO: 112356 - DNA, 22 bp, Homo sapiens
tatcacactttgcttacttaca

SEQ ID NO: 112357 - DNA, 23 bp, Homo sapiens
tacatgtgctatatgttttgaaa

SEQ ID NO: 112358 - DNA, 23 bp, Homo sapiens
atacacacacacatttagatgtg

SEQ ID NO: 112359 - DNA, 23 bp, Homo sapiens
gtgtgtgtgtgtctgtgtgtaga

SEQ ID NO: 112360 - DNA, 23 bp, Homo sapiens
tggagtctcactctgtcacccag

SEQ ID NO: 112361 - DNA, 22 bp, Homo sapiens
tggcactgatgagaagtctctg

SEQ ID NO: 112362 - DNA, 21 bp, Homo sapiens
tgcatatatatatacacatat

SEQ ID NO: 112363 - DNA, 22 bp, Homo sapiens
acatgtgcacaatgtgcaggtt

SEQ ID NO: 112364 - DNA, 22 bp, Homo sapiens
tttttgcttgggattgtcttga

SEQ ID NO: 112365 - DNA, 23 bp, Homo sapiens
atttcatttgactacctagtgac

SEQ ID NO: 112366 - DNA, 23 bp, Homo sapiens
agtgtagaagtgttcctgatcat

SEQ ID NO: 112367 - DNA, 23 bp, Homo sapiens
ttgtgtgtgtgtgtatacatata

SEQ ID NO: 112368 - DNA, 19 bp, Homo sapiens
ttatcagtagattagatat

SEQ ID NO: 112369 - DNA, 20 bp, Homo sapiens
taatggtcttgtgtgggaga

SEQ ID NO: 112370 - DNA, 23 bp, Homo sapiens
gacagtgtctcgctctgtctcca

SEQ ID NO: 112371 - DNA, 19 bp, Homo sapiens
tatgtgtatatatatacgt

SEQ ID NO: 112372 - DNA, 19 bp, Homo sapiens
tgtctgtttttcaaattca

SEQ ID NO: 112373 - DNA, 22 bp, Homo sapiens
gtgtgtgtgtgtgtgtgtacat

SEQ ID NO: 112374 - DNA, 21 bp, Homo sapiens
aaaatgcatgtgtaaactgta

SEQ ID NO: 112375 - DNA, 23 bp, Homo sapiens
tgagttcattgtagattctggat

SEQ ID NO: 112376 - DNA, 23 bp, Homo sapiens
agtgtgaggtagtatctcactgt

SEQ ID NO: 112377 - DNA, 20 bp, Homo sapiens
ctcagctctcattctctctc

SEQ ID NO: 112378 - DNA, 23 bp, Homo sapiens
gtatgtatgtatgtatgtatgta

SEQ ID NO: 112379 - DNA, 23 bp, Homo sapiens
attttttgatttgcaactgtagt

SEQ ID NO: 112380 - DNA, 23 bp, Homo sapiens
ttcttttacagtctgttcatctg

SEQ ID NO: 112381 - DNA, 23 bp, Homo sapiens
gatttgacttgaagattatagat

SEQ ID NO: 112382 - DNA, 23 bp, Homo sapiens
tgagacagggtctgactctgtca

SEQ ID NO: 112383 - DNA, 23 bp, Homo sapiens
atatgtgcatatatatatgtgtg

SEQ ID NO: 112384 - DNA, 23 bp, Homo sapiens
tttactgaggtagaaggtccctg

SEQ ID NO: 112385 - DNA, 23 bp, Homo sapiens
atctcacaagtaggttcagtgtg

SEQ ID NO: 112386 - DNA, 19 bp, Homo sapiens
ctgagaagtaggcagaatc

SEQ ID NO: 112387 - DNA, 23 bp, Homo sapiens
agaagtacagaagtgagtgtggt

SEQ ID NO: 112388 - DNA, 23 bp, Homo sapiens
tagggactcactctgtcacccag

SEQ ID NO: 112389 - DNA, 18 bp, Homo sapiens
aggctctgaatttcattt

SEQ ID NO: 112390 - DNA, 23 bp, Homo sapiens
gagacagagtctcactctgtcac

SEQ ID NO: 112391 - DNA, 23 bp, Homo sapiens
tcactctttgtgtgtctgcatcc

SEQ ID NO: 112392 - DNA, 23 bp, Homo sapiens
ctacctttgaagtcattgccaaa

SEQ ID NO: 112393 - DNA, 22 bp, Homo sapiens
tgtgtatttctacataggtgta

SEQ ID NO: 112394 - DNA, 18 bp, Homo sapiens
tttctaagcaattgagaa

SEQ ID NO: 112395 - DNA, 20 bp, Homo sapiens
aacctattgtgtgtaaggtt

SEQ ID NO: 112396 - DNA, 23 bp, Homo sapiens
tgagttcattgtagattctggat

SEQ ID NO: 112397 - DNA, 23 bp, Homo sapiens
tgagttcattgtagattctggat

SEQ ID NO: 112398 - DNA, 18 bp, Homo sapiens
attcttcaggagattgat

SEQ ID NO: 112399 - DNA, 18 bp, Homo sapiens
aaatgtaagaatagagac

SEQ ID NO: 112400 - DNA, 23 bp, Homo sapiens
tatatcacacacatatatagtgt

SEQ ID NO: 112401 - DNA, 19 bp, Homo sapiens
cagaatttctttttgttca

SEQ ID NO: 112402 - DNA, 19 bp, Homo sapiens
tgtgtatatatgtagatac

SEQ ID NO: 112403 - DNA, 23 bp, Homo sapiens
atgtgtatatatatacatgtgtg

SEQ ID NO: 112404 - DNA, 23 bp, Homo sapiens
tgagttcattgtagattctggat

SEQ ID NO: 112405 - DNA, 23 bp, Homo sapiens
tgagttcattgtagattctggat

SEQ ID NO: 112406 - DNA, 23 bp, Homo sapiens
atcactctggcagttacatgaga

SEQ ID NO: 112407 - DNA, 23 bp, Homo sapiens
agtgagcttttttttgcttctca

SEQ ID NO: 112408 - DNA, 23 bp, Homo sapiens
tatgtgctgtggaatactattca

SEQ ID NO: 112409 - DNA, 22 bp, Homo sapiens
aatcagtggtggctacacagaa

SEQ ID NO: 112410 - DNA, 22 bp, Homo sapiens
atacatgtatatatgtatacat

SEQ ID NO: 112411 - DNA, 20 bp, Homo sapiens
atagtgaagggtttcactat

SEQ ID NO: 112412 - DNA, 23 bp, Homo sapiens
gacggagtctcactgtgtcaccc

SEQ ID NO: 112413 - DNA, 21 bp, Homo sapiens
gaggatattttttaagatagg

SEQ ID NO: 112414 - DNA, 22 bp, Homo sapiens
tttaagtatgaggaatgtgttt

SEQ ID NO: 112415 - DNA, 23 bp, Homo sapiens
ttgtgtttatattttattctgag

SEQ ID NO: 112416 - DNA, 22 bp, Homo sapiens
aaatgtgtctggaattggtggg

SEQ ID NO: 112417 - DNA, 21 bp, Homo sapiens
tgttttttaggtccatttggt

SEQ ID NO: 112418 - DNA, 23 bp, Homo sapiens
tttctgtctagatgatctgttta

SEQ ID NO: 112419 - DNA, 23 bp, Homo sapiens
agtgttaagtgaaatgatgaaat

SEQ ID NO: 112420 - DNA, 20 bp, Homo sapiens
ttgtatttggagtattgttc

SEQ ID NO: 112421 - DNA, 23 bp, Homo sapiens
tatttgaatatttttaggtgaga

SEQ ID NO: 112422 - DNA, 23 bp, Homo sapiens
tgttggagatctgattttgtttt

SEQ ID NO: 112423 - DNA, 23 bp, Homo sapiens
tgagttcattgtagattctggat

SEQ ID NO: 112424 - DNA, 23 bp, Homo sapiens
tgagttcattgtagattctggat

SEQ ID NO: 112425 - DNA, 23 bp, Homo sapiens
attctttgttatgagtgcctgct

SEQ ID NO: 112426 - DNA, 23 bp, Homo sapiens
agtcagtagagtgagtggtgagt

SEQ ID NO: 112427 - DNA, 23 bp, Homo sapiens
acattactgtacattctgtggac

SEQ ID NO: 112428 - DNA, 23 bp, Homo sapiens
atattttgatagtatatcataag

SEQ ID NO: 112429 - DNA, 22 bp, Homo sapiens
tctgtctctgtctctctatcac

SEQ ID NO: 112430 - DNA, 23 bp, Homo sapiens
tatactatgtgatatatatgtgt

SEQ ID NO: 112431 - DNA, 23 bp, Homo sapiens
tatcttaaccatcccaaattcat

SEQ ID NO: 112432 - DNA, 23 bp, Homo sapiens
tacatgtatacacatgtatatgt

SEQ ID NO: 112433 - DNA, 23 bp, Homo sapiens
tatgtgtatatatagatatgtgt

SEQ ID NO: 112434 - DNA, 23 bp, Homo sapiens
ctgtttcattgatctgtgtgtct

SEQ ID NO: 112435 - DNA, 23 bp, Homo sapiens
atgtgtgtatatatgtatatgtg

SEQ ID NO: 112436 - DNA, 23 bp, Homo sapiens
atgtgtatatatgtatatatgtg

SEQ ID NO: 112437 - DNA, 23 bp, Homo sapiens
atatgtatgtatatatatgtgta

SEQ ID NO: 112438 - DNA, 23 bp, Homo sapiens
taatactttatgtggttgccaag

SEQ ID NO: 112439 - DNA, 23 bp, Homo sapiens
aaagagactgatttgccttccag

SEQ ID NO: 112440 - DNA, 21 bp, Homo sapiens
atgtatatatatatgtgtata

SEQ ID NO: 112441 - DNA, 20 bp, Homo sapiens
atatgtatatatatatatgt

SEQ ID NO: 112442 - DNA, 23 bp, Homo sapiens
tgtgtccctgtgtgccttttttc

SEQ ID NO: 112443 - DNA, 23 bp, Homo sapiens
tgagttcattgtagattctggat

SEQ ID NO: 112444 - DNA, 23 bp, Homo sapiens
tgagttcattgtagattctggat

SEQ ID NO: 112445 - DNA, 23 bp, Homo sapiens
ctttagtgttttagttgatgccc

SEQ ID NO: 112446 - DNA, 23 bp, Homo sapiens
tatcagtgtgacatttatgaagc

SEQ ID NO: 112447 - DNA, 23 bp, Homo sapiens
tactgtactgtttttgttggatt

SEQ ID NO: 112448 - DNA, 23 bp, Homo sapiens
tatggagagactgtaactactgc

SEQ ID NO: 112449 - DNA, 23 bp, Homo sapiens
aactctctcagcacctccatgtg

SEQ ID NO: 112450 - DNA, 21 bp, Homo sapiens
tgtgtatatatgtatgtgtat

SEQ ID NO: 112451 - DNA, 23 bp, Homo sapiens
atatgtgtgtatatatgtgtgtg

SEQ ID NO: 112452 - DNA, 20 bp, Homo sapiens
atatgcacatacagccacat

SEQ ID NO: 112453 - DNA, 23 bp, Homo sapiens
tgagttcattgtagattctggat

SEQ ID NO: 112454 - DNA, 23 bp, Homo sapiens
tgagttcattgtagattctggat

SEQ ID NO: 112455 - DNA, 19 bp, Homo sapiens
atagagtctcactatgttg

SEQ ID NO: 112456 - DNA, 23 bp, Homo sapiens
tcaattcttttctaacagtagtc

SEQ ID NO: 112457 - DNA, 23 bp, Homo sapiens
tacgtttttaaagatgaatactg

SEQ ID NO: 112458 - DNA, 23 bp, Homo sapiens
ggctctgtcagtgagtgctttag

SEQ ID NO: 112459 - DNA, 21 bp, Homo sapiens
ttgtgtatgtatatacacaat

SEQ ID NO: 112460 - DNA, 23 bp, Homo sapiens
aaaacacagggtatttgaactct

SEQ ID NO: 112461 - DNA, 22 bp, Homo sapiens
agacttaagtctttattccatt

SEQ ID NO: 112462 - DNA, 21 bp, Homo sapiens
tcatgagccaaaagagaagaa

SEQ ID NO: 112463 - DNA, 21 bp, Homo sapiens
ttttctatatatatatatgtc

SEQ ID NO: 112464 - DNA, 18 bp, Homo sapiens
taggcctatatttttgcc

SEQ ID NO: 112465 - DNA, 23 bp, Homo sapiens
ttgttggatgaatagtttgcaaa

SEQ ID NO: 112466 - DNA, 23 bp, Homo sapiens
ttaaagcaagcattccttaagaa

SEQ ID NO: 112467 - DNA, 22 bp, Homo sapiens
ttaattgtgtttgagttagtct

SEQ ID NO: 112468 - DNA, 22 bp, Homo sapiens
atgtcacagggggtgtacactc

SEQ ID NO: 112469 - DNA, 23 bp, Homo sapiens
aatgtcacagggtgtgtacaccc

SEQ ID NO: 112470 - DNA, 22 bp, Homo sapiens
agctcttgcatgctttgttgtt

SEQ ID NO: 112471 - DNA, 23 bp, Homo sapiens
agttgtatcaagaaacagagcac

SEQ ID NO: 112472 - DNA, 19 bp, Homo sapiens
attcctgtttactctccca

SEQ ID NO: 112473 - DNA, 21 bp, Homo sapiens
tatatagcatgtatatgttat

SEQ ID NO: 112474 - DNA, 23 bp, Homo sapiens
tatatatttgtggtttgggattc

SEQ ID NO: 112475 - DNA, 23 bp, Homo sapiens
atatgtgtatatgtatatgcata

SEQ ID NO: 112476 - DNA, 22 bp, Homo sapiens
atatatgtatacatatctatgt

SEQ ID NO: 112477 - DNA, 18 bp, Homo sapiens
tatgtgtgtgtatgcgta

SEQ ID NO: 112478 - DNA, 20 bp, Homo sapiens
tatgtacatgtgtatatgtg

SEQ ID NO: 112479 - DNA, 23 bp, Homo sapiens
tgagttcattgtagattctggat

SEQ ID NO: 112480 - DNA, 23 bp, Homo sapiens
tgagttcattgtagattctggat

SEQ ID NO: 112481 - DNA, 22 bp, Homo sapiens
acagcctcatcagtatctgttt

SEQ ID NO: 112482 - DNA, 23 bp, Homo sapiens
gccagagtctcgctctgtcaccc

SEQ ID NO: 112483 - DNA, 19 bp, Homo sapiens
atgctatattatatattgt

SEQ ID NO: 112484 - DNA, 23 bp, Homo sapiens
tcagaagagagtcaggagtcagg

SEQ ID NO: 112485 - DNA, 20 bp, Homo sapiens
gacagtaaagactgaggtgt

SEQ ID NO: 112486 - DNA, 20 bp, Homo sapiens
tgtgatatatatatgtgtat

SEQ ID NO: 112487 - DNA, 23 bp, Homo sapiens
ctctctgtatgtgtctgtgtcca

SEQ ID NO: 112488 - DNA, 23 bp, Homo sapiens
tatagtgtgatgagtctgtgcac

SEQ ID NO: 112489 - DNA, 20 bp, Homo sapiens
acttactcactgtaacacct

SEQ ID NO: 112490 - DNA, 23 bp, Homo sapiens
tcactcccagagcccctggaact

SEQ ID NO: 112491 - DNA, 23 bp, Homo sapiens
aggctctctgactgactccttcc

SEQ ID NO: 112492 - DNA, 23 bp, Homo sapiens
agagcaaatgtctattttttatg

SEQ ID NO: 112493 - DNA, 22 bp, Homo sapiens
tatgaccatgtatatgtggttt

SEQ ID NO: 112494 - DNA, 18 bp, Homo sapiens
gtgtgtatgacatatatc

SEQ ID NO: 112495 - DNA, 23 bp, Homo sapiens
gagaagagactgaaagagcactg

SEQ ID NO: 112496 - DNA, 22 bp, Homo sapiens
gtgaccattctttgagctgttt

SEQ ID NO: 112497 - DNA, 22 bp, Homo sapiens
tgaggtaaaaggatcatttgag

SEQ ID NO: 112498 - DNA, 23 bp, Homo sapiens
acattgtctcacacttgtcacac

SEQ ID NO: 112499 - DNA, 23 bp, Homo sapiens
aggactcagacaagagtgagata

SEQ ID NO: 112500 - DNA, 23 bp, Homo sapiens
gacggagtctcgctctgtcgctc

SEQ ID NO: 112501 - DNA, 23 bp, Homo sapiens
gtctcactcactctgtcacccag

SEQ ID NO: 112502 - DNA, 20 bp, Homo sapiens
ttttcttaggattgtcttgg

SEQ ID NO: 112503 - DNA, 23 bp, Homo sapiens
tgagttcattgtagattctggat

SEQ ID NO: 112504 - DNA, 23 bp, Homo sapiens
tgagttcattgtagattctggat

SEQ ID NO: 112505 - DNA, 23 bp, Homo sapiens
agtagtacaagaaaccctcatgt

SEQ ID NO: 112506 - DNA, 20 bp, Homo sapiens
tccatgtgtgtttctgaaga

SEQ ID NO: 112507 - DNA, 23 bp, Homo sapiens
gagtctcactctgtcacctaggc

SEQ ID NO: 112508 - DNA, 22 bp, Homo sapiens
atatacacacacatatatatgt

SEQ ID NO: 112509 - DNA, 22 bp, Homo sapiens
tatacacacatatatatgtgtg

SEQ ID NO: 112510 - DNA, 23 bp, Homo sapiens
gacacggtctcactctgtcatcc

SEQ ID NO: 112511 - DNA, 22 bp, Homo sapiens
tgtgatcatggatcactgcagc

SEQ ID NO: 112512 - DNA, 23 bp, Homo sapiens
tatctccaaataaaaagttttct

SEQ ID NO: 112513 - DNA, 22 bp, Homo sapiens
ttatattcactttgtataattg

SEQ ID NO: 112514 - DNA, 20 bp, Homo sapiens
tgagtatatttatacagaat

SEQ ID NO: 112515 - DNA, 23 bp, Homo sapiens
atttaggatgtatatatttgctt

SEQ ID NO: 112516 - DNA, 21 bp, Homo sapiens
acgtatatatatatgtgtgtg

SEQ ID NO: 112517 - DNA, 23 bp, Homo sapiens
tggagtctcactctgtcacccgg

SEQ ID NO: 112518 - DNA, 23 bp, Homo sapiens
agagtctcactctgtcacccagg

SEQ ID NO: 112519 - DNA, 23 bp, Homo sapiens
tagacagtataaatatatgtgtg

SEQ ID NO: 112520 - DNA, 18 bp, Homo sapiens
tcctggatctgtgctttt

SEQ ID NO: 112521 - DNA, 23 bp, Homo sapiens
agagcaagtcctacagggttgag

SEQ ID NO: 112522 - DNA, 21 bp, Homo sapiens
tcagttaaaatgtgtgtccaa

SEQ ID NO: 112523 - DNA, 23 bp, Homo sapiens
tctctgtctctctctctgtgtcc

SEQ ID NO: 112524 - DNA, 23 bp, Homo sapiens
tagtctctctctctaactctctg

SEQ ID NO: 112525 - DNA, 23 bp, Homo sapiens
tctcagtgtcggttgattgtcag

SEQ ID NO: 112526 - DNA, 23 bp, Homo sapiens
gtcactgccagtctgtctgcatg

SEQ ID NO: 112527 - DNA, 23 bp, Homo sapiens
agtatatttcaatttttgtagta

SEQ ID NO: 112528 - DNA, 23 bp, Homo sapiens
ttacactgacaattatatatgct

SEQ ID NO: 112529 - DNA, 18 bp, Homo sapiens
ttgttgtgtaaacatgta

SEQ ID NO: 112530 - DNA, 18 bp, Homo sapiens
agtgctttgaagagactt

SEQ ID NO: 112531 - DNA, 23 bp, Homo sapiens
caattctgttgcatctcttgctc

SEQ ID NO: 112532 - DNA, 19 bp, Homo sapiens
cagttgatagattatagcg

SEQ ID NO: 112533 - DNA, 22 bp, Homo sapiens
catatctgtctttcctgtatgt

SEQ ID NO: 112534 - DNA, 23 bp, Homo sapiens
tagaaggagtctcactctgtcac

SEQ ID NO: 112535 - DNA, 22 bp, Homo sapiens
ggtaaggtattcttgcctttgt

SEQ ID NO: 112536 - DNA, 23 bp, Homo sapiens
tgtggctctgtctccctggttgt

SEQ ID NO: 112537 - DNA, 23 bp, Homo sapiens
gccagccacagaatggtgatatt

SEQ ID NO: 112538 - DNA, 23 bp, Homo sapiens
ctaatctcaagccatttacagtc

SEQ ID NO: 112539 - DNA, 23 bp, Homo sapiens
taagaggtcttagatttcagtct

SEQ ID NO: 112540 - DNA, 22 bp, Homo sapiens
ttatctctatatatctatatct

SEQ ID NO: 112541 - DNA, 19 bp, Homo sapiens
tagagatatatagatctat

SEQ ID NO: 112542 - DNA, 23 bp, Homo sapiens
aaagagcatgttatttgtgttta

SEQ ID NO: 112543 - DNA, 23 bp, Homo sapiens
ggaatgaaaacaagtattatagt

SEQ ID NO: 112544 - DNA, 19 bp, Homo sapiens
gctatgatcatgtctctgc

SEQ ID NO: 112545 - DNA, 23 bp, Homo sapiens
gtatctctctctctctcagctga

SEQ ID NO: 112546 - DNA, 23 bp, Homo sapiens
ggatgacttgatcctgggacgtt

SEQ ID NO: 112547 - DNA, 23 bp, Homo sapiens
tgtatggtagttgcatgtttagt

SEQ ID NO: 112548 - DNA, 23 bp, Homo sapiens
ctgacaaactattttctagagtg

SEQ ID NO: 112549 - DNA, 23 bp, Homo sapiens
tttgagacggagtctcactctat

SEQ ID NO: 112550 - DNA, 23 bp, Homo sapiens
ttgtctggttttctagctctttg

SEQ ID NO: 112551 - DNA, 20 bp, Homo sapiens
atatccatctcaaatggctt

SEQ ID NO: 112552 - DNA, 20 bp, Homo sapiens
taagtgtgtctaagttttga

SEQ ID NO: 112553 - DNA, 23 bp, Homo sapiens
tatattttacagtagtaagtgat

SEQ ID NO: 112554 - DNA, 21 bp, Homo sapiens
aagggaatagagattggcaga

SEQ ID NO: 112555 - DNA, 18 bp, Homo sapiens
ttttgtattcttggtgag

SEQ ID NO: 112556 - DNA, 23 bp, Homo sapiens
ctctggttgtatcttgtattgta

SEQ ID NO: 112557 - DNA, 23 bp, Homo sapiens
tggagtctcactctgtcacccag

SEQ ID NO: 112558 - DNA, 22 bp, Homo sapiens
tctctgtgtaacgttttggtaa

SEQ ID NO: 112559 - DNA, 23 bp, Homo sapiens
tgatctttgctattactgttgta

SEQ ID NO: 112560 - DNA, 23 bp, Homo sapiens
cgtggctcacagtgtctgtcaga

SEQ ID NO: 112561 - DNA, 19 bp, Homo sapiens
tgagatgaagccttgctct

SEQ ID NO: 112562 - DNA, 22 bp, Homo sapiens
aggaatgattagatgtttgtag

SEQ ID NO: 112563 - DNA, 23 bp, Homo sapiens
tacatgtacaaatacatatgtat

SEQ ID NO: 112564 - DNA, 23 bp, Homo sapiens
atattatgtgtatatgtatatat

SEQ ID NO: 112565 - DNA, 19 bp, Homo sapiens
tagagagtgcagttacaat

SEQ ID NO: 112566 - DNA, 23 bp, Homo sapiens
actggcactgtctgtcttgacaa

SEQ ID NO: 112567 - DNA, 23 bp, Homo sapiens
tggagtctcactctgtcacccag

SEQ ID NO: 112568 - DNA, 22 bp, Homo sapiens
atatgtatatgtatgtgtgtgt

SEQ ID NO: 112569 - DNA, 23 bp, Homo sapiens
ctcactctgtcactcaggctgga

SEQ ID NO: 112570 - DNA, 23 bp, Homo sapiens
atatgtgtgtatatatatgtgtg

SEQ ID NO: 112571 - DNA, 23 bp, Homo sapiens
acagggtctcactctcacccagg

SEQ ID NO: 112572 - DNA, 23 bp, Homo sapiens
ttactactacatggtcagaatgt

SEQ ID NO: 112573 - DNA, 23 bp, Homo sapiens
taccagtgtcttaggagcctgtt

SEQ ID NO: 112574 - DNA, 18 bp, Homo sapiens
aaaccaggcacagaaagg

SEQ ID NO: 112575 - DNA, 23 bp, Homo sapiens
actgtttctgaagaagtataact

SEQ ID NO: 112576 - DNA, 20 bp, Homo sapiens
tgactctgtgataaacattt

SEQ ID NO: 112577 - DNA, 20 bp, Homo sapiens
attagtggatcaaaaaacaa

SEQ ID NO: 112578 - DNA, 23 bp, Homo sapiens
ttgagaaagggtctcactctgtt

SEQ ID NO: 112579 - DNA, 23 bp, Homo sapiens
ggggtacagtgtcatgttttgat

SEQ ID NO: 112580 - DNA, 23 bp, Homo sapiens
acacaaacacacacataatgtgg

SEQ ID NO: 112581 - DNA, 23 bp, Homo sapiens
gtgtctctctggtattgctgtgg

SEQ ID NO: 112582 - DNA, 23 bp, Homo sapiens
aaagtgaggtagattgtgttgct

SEQ ID NO: 112583 - DNA, 23 bp, Homo sapiens
ggatcaaatgatatatgtgtgtg

SEQ ID NO: 112584 - DNA, 23 bp, Homo sapiens
agggagtgtctctctgtcaccca

SEQ ID NO: 112585 - DNA, 22 bp, Homo sapiens
gtagacatgtgaatttgttctg

SEQ ID NO: 112586 - DNA, 23 bp, Homo sapiens
acaccttaccatttcattcatta

SEQ ID NO: 112587 - DNA, 23 bp, Homo sapiens
tcttgtgtgctttctctcactct

SEQ ID NO: 112588 - DNA, 20 bp, Homo sapiens
agtcaggcagaagaagcaga

SEQ ID NO: 112589 - DNA, 23 bp, Homo sapiens
tatatgtgtatatatatgtgtgt

SEQ ID NO: 112590 - DNA, 20 bp, Homo sapiens
ctgaggtagtagaatggcgt

SEQ ID NO: 112591 - DNA, 23 bp, Homo sapiens
tctgactctgtctttcatttgtt

SEQ ID NO: 112592 - DNA, 22 bp, Homo sapiens
tcttgctctgtcaccaggctga

SEQ ID NO: 112593 - DNA, 22 bp, Homo sapiens
atatttctctatttttagttga

SEQ ID NO: 112594 - DNA, 20 bp, Homo sapiens
attgagttaagtgatttgtg

SEQ ID NO: 112595 - DNA, 23 bp, Homo sapiens
tagcctgaccttgcctgtgccct

SEQ ID NO: 112596 - DNA, 22 bp, Homo sapiens
tttcaatttttattccactgtg

SEQ ID NO: 112597 - DNA, 23 bp, Homo sapiens
tgtcttacagctgagaatgcagt

SEQ ID NO: 112598 - DNA, 23 bp, Homo sapiens
ttattcttgcatttatgttccta

SEQ ID NO: 112599 - DNA, 22 bp, Homo sapiens
acatgtgcacaatgtgcaggtt

SEQ ID NO: 112600 - DNA, 19 bp, Homo sapiens
tatagtcagctttcatgac

SEQ ID NO: 112601 - DNA, 23 bp, Homo sapiens
acagggtctcactctgtggccca

SEQ ID NO: 112602 - DNA, 23 bp, Homo sapiens
tttgttctttttgcttaggattg

SEQ ID NO: 112603 - DNA, 18 bp, Homo sapiens
ttctgtgaagaaagtcag

SEQ ID NO: 112604 - DNA, 20 bp, Homo sapiens
gatagttaatgaagcttttt

SEQ ID NO: 112605 - DNA, 18 bp, Homo sapiens
tatgagaggtaaaatttt

SEQ ID NO: 112606 - DNA, 19 bp, Homo sapiens
ttctttttttttaatagag

SEQ ID NO: 112607 - DNA, 23 bp, Homo sapiens
tgagacagtcttgctctgtcacc

SEQ ID NO: 112608 - DNA, 23 bp, Homo sapiens
taacttggcagtcaatgtcgact

SEQ ID NO: 112609 - DNA, 23 bp, Homo sapiens
aactgcacataatgtatacagtt

SEQ ID NO: 112610 - DNA, 20 bp, Homo sapiens
atagttgctgcacagatgcc

SEQ ID NO: 112611 - DNA, 23 bp, Homo sapiens
aaaacacagtcacactttttttt

SEQ ID NO: 112612 - DNA, 20 bp, Homo sapiens
tcagggtcttactgtgtcac

SEQ ID NO: 112613 - DNA, 22 bp, Homo sapiens
agtgcagtagtgtgatagctca

SEQ ID NO: 112614 - DNA, 23 bp, Homo sapiens
tgctgcatcttatgtctgtttct

SEQ ID NO: 112615 - DNA, 23 bp, Homo sapiens
atacatgtgcaggatgtgcaggt

SEQ ID NO: 112616 - DNA, 23 bp, Homo sapiens
tttttgcacattgattttgtatc

SEQ ID NO: 112617 - DNA, 23 bp, Homo sapiens
tgagtggaagtaggtaggtttgt

SEQ ID NO: 112618 - DNA, 23 bp, Homo sapiens
cagggtctcactctctcacccag

SEQ ID NO: 112619 - DNA, 23 bp, Homo sapiens
gggtctcactctgtcacccaggc

SEQ ID NO: 112620 - DNA, 23 bp, Homo sapiens
tgagttcattgtagattctggat

SEQ ID NO: 112621 - DNA, 23 bp, Homo sapiens
tgagttcattgtagattctggat

SEQ ID NO: 112622 - DNA, 23 bp, Homo sapiens
tgagttcattgtagattctggat

SEQ ID NO: 112623 - DNA, 23 bp, Homo sapiens
tgagttcattgtagattctggat

SEQ ID NO: 112624 - DNA, 23 bp, Homo sapiens
aggtatattctatgtatctacct

SEQ ID NO: 112625 - DNA, 18 bp, Homo sapiens
tttaggaacttttgggaa

SEQ ID NO: 112626 - DNA, 23 bp, Homo sapiens
tctctctatctatctattgatct

SEQ ID NO: 112627 - DNA, 22 bp, Homo sapiens
aagatagtagagcaggtggtaa

SEQ ID NO: 112628 - DNA, 23 bp, Homo sapiens
atacatgtgcaggatgtgcaggt

SEQ ID NO: 112629 - DNA, 19 bp, Homo sapiens
ttatttgtttttcttgtct

SEQ ID NO: 112630 - DNA, 21 bp, Homo sapiens
acatgtgcacaatgtgcaggt

SEQ ID NO: 112631 - DNA, 22 bp, Homo sapiens
agggagtcttgagatgatgaga

SEQ ID NO: 112632 - DNA, 23 bp, Homo sapiens
tatatcactgtcaatatcctggg

SEQ ID NO: 112633 - DNA, 23 bp, Homo sapiens
tgagttcattgtagattctggat

SEQ ID NO: 112634 - DNA, 23 bp, Homo sapiens
tgagttcattgtagattctggat

SEQ ID NO: 112635 - DNA, 23 bp, Homo sapiens
actctctgtgtctccattgccca

SEQ ID NO: 112636 - DNA, 23 bp, Homo sapiens
tctgtcagtgggtccctcatgtt

SEQ ID NO: 112637 - DNA, 19 bp, Homo sapiens
tgtgctcctagagcagcag

SEQ ID NO: 112638 - DNA, 20 bp, Homo sapiens
tgcctgtagtcatagctgct

SEQ ID NO: 112639 - DNA, 22 bp, Homo sapiens
agtgagccatgatcatgccact

SEQ ID NO: 112640 - DNA, 20 bp, Homo sapiens
cttgactggtgctcttcttg

SEQ ID NO: 112641 - DNA, 21 bp, Homo sapiens
aaggttcatctttgtgatgtt

SEQ ID NO: 112642 - DNA, 20 bp, Homo sapiens
tatttactattagtaatagt

SEQ ID NO: 112643 - DNA, 22 bp, Homo sapiens
ctgacagcttcacttagagtta

SEQ ID NO: 112644 - DNA, 19 bp, Homo sapiens
agtttcattcctgacagtg

SEQ ID NO: 112645 - DNA, 19 bp, Homo sapiens
tgacagatgagagaatgga

SEQ ID NO: 112646 - DNA, 21 bp, Homo sapiens
agaagcattgttgaggaagaa

SEQ ID NO: 112647 - DNA, 18 bp, Homo sapiens
taaggtagtatgacattg

SEQ ID NO: 112648 - DNA, 21 bp, Homo sapiens
gtgacatgttgttttggaact

SEQ ID NO: 112649 - DNA, 23 bp, Homo sapiens
gtatgattttgaataaggctctg

SEQ ID NO: 112650 - DNA, 23 bp, Homo sapiens
aaagttgtgcttttggggttttg

SEQ ID NO: 112651 - DNA, 23 bp, Homo sapiens
tgcctgcgtgtatgcacgtgtgt

SEQ ID NO: 112652 - DNA, 23 bp, Homo sapiens
ttgatggggtttatgttgagaaa

SEQ ID NO: 112653 - DNA, 23 bp, Homo sapiens
catgaacttttcaaagtatcttt

SEQ ID NO: 112654 - DNA, 23 bp, Homo sapiens
tgagttcattgtagattctggat

SEQ ID NO: 112655 - DNA, 23 bp, Homo sapiens
tgagttcattgtagattctggat

SEQ ID NO: 112656 - DNA, 23 bp, Homo sapiens
tatattcactatgtatatgtgtg

SEQ ID NO: 112657 - DNA, 23 bp, Homo sapiens
cggagtctcactgtgtcgctcag

SEQ ID NO: 112658 - DNA, 23 bp, Homo sapiens
tgagttcattgtagattctggat

SEQ ID NO: 112659 - DNA, 23 bp, Homo sapiens
tgagttcattgtagattctggat

SEQ ID NO: 112660 - DNA, 20 bp, Homo sapiens
tctgaaggaagtcaatggta

SEQ ID NO: 112661 - DNA, 22 bp, Homo sapiens
atgtgcacaacgtgcaggtttg

SEQ ID NO: 112662 - DNA, 21 bp, Homo sapiens
aaaaagatcaaaaggccttct

SEQ ID NO: 112663 - DNA, 23 bp, Homo sapiens
tattacgttgtagattattgtat

SEQ ID NO: 112664 - DNA, 23 bp, Homo sapiens
tgagttcattgtagattctggat

SEQ ID NO: 112665 - DNA, 23 bp, Homo sapiens
tgagttcattgtagattctggat

SEQ ID NO: 112666 - DNA, 19 bp, Homo sapiens
tgtgtgtgtgtgtgtgtat

SEQ ID NO: 112667 - DNA, 23 bp, Homo sapiens
agagagaagagagtgtgtgtatt

SEQ ID NO: 112668 - DNA, 23 bp, Homo sapiens
gactactgtatttgtatttaact

SEQ ID NO: 112669 - DNA, 20 bp, Homo sapiens
tactgttaaatacaaataca

SEQ ID NO: 112670 - DNA, 23 bp, Homo sapiens
ataaagtgacatcacagcatgtc

SEQ ID NO: 112671 - DNA, 22 bp, Homo sapiens
tgacttcttgatgtaaccttca

SEQ ID NO: 112672 - DNA, 23 bp, Homo sapiens
tgaaaggttgttgaaatttgtca

SEQ ID NO: 112673 - DNA, 21 bp, Homo sapiens
taagctagcatatggtatgtt

SEQ ID NO: 112674 - DNA, 21 bp, Homo sapiens
cactctgcaactgcatctcca

SEQ ID NO: 112675 - DNA, 22 bp, Homo sapiens
tcacttgagcctgggaggttga

SEQ ID NO: 112676 - DNA, 23 bp, Homo sapiens
cttgtaattttgtatttctgaca

SEQ ID NO: 112677 - DNA, 21 bp, Homo sapiens
agaaagagagtcttgctgtgt

SEQ ID NO: 112678 - DNA, 23 bp, Homo sapiens
tggattagatatgttttggtgat

SEQ ID NO: 112679 - DNA, 23 bp, Homo sapiens
cggagtctcactctgtcacccag

SEQ ID NO: 112680 - DNA, 23 bp, Homo sapiens
ttggtagtatggaggatgtgtag

SEQ ID NO: 112681 - DNA, 23 bp, Homo sapiens
caacctgtatatatatatgtgtg

SEQ ID NO: 112682 - DNA, 23 bp, Homo sapiens
tttccttaacaaaagtgtcactt

SEQ ID NO: 112683 - DNA, 23 bp, Homo sapiens
gtggaatcaaaatatgtttgtaa

SEQ ID NO: 112684 - DNA, 23 bp, Homo sapiens
tcaatgatgattctgtgcacttt

SEQ ID NO: 112685 - DNA, 19 bp, Homo sapiens
gcctgactcactgactgtc

SEQ ID NO: 112686 - DNA, 18 bp, Homo sapiens
atctagatgaaaaatgat

SEQ ID NO: 112687 - DNA, 20 bp, Homo sapiens
tatgaagtggaaatcctagg

SEQ ID NO: 112688 - DNA, 23 bp, Homo sapiens
gacagagtctcgctctgtcaccc

SEQ ID NO: 112689 - DNA, 22 bp, Homo sapiens
tatgttagccattctaatacat

SEQ ID NO: 112690 - DNA, 23 bp, Homo sapiens
aaggcacttgatgttgaaaagct

SEQ ID NO: 112691 - DNA, 22 bp, Homo sapiens
tttcagctcttactttaagtct

SEQ ID NO: 112692 - DNA, 23 bp, Homo sapiens
tggaatctcactctgtctcccag

SEQ ID NO: 112693 - DNA, 23 bp, Homo sapiens
tgtggattcatctgtggattcat

SEQ ID NO: 112694 - DNA, 22 bp, Homo sapiens
ttgccttatctttgcagaaaat

SEQ ID NO: 112695 - DNA, 22 bp, Homo sapiens
tatacagtagtgcctctgtttt

SEQ ID NO: 112696 - DNA, 22 bp, Homo sapiens
aaccagaggcaggctctgtgtg

SEQ ID NO: 112697 - DNA, 23 bp, Homo sapiens
tatacatatatatgtatatgtgt

SEQ ID NO: 112698 - DNA, 23 bp, Homo sapiens
tggagtctcactgtgtcgctcag

SEQ ID NO: 112699 - DNA, 18 bp, Homo sapiens
tggcttgatctcggctca

SEQ ID NO: 112700 - DNA, 23 bp, Homo sapiens
ggagtctctcagtcactgtgtag

SEQ ID NO: 112701 - DNA, 21 bp, Homo sapiens
atgttttgatacagatatgct

SEQ ID NO: 112702 - DNA, 21 bp, Homo sapiens
acatatgtacatacacaggtc

SEQ ID NO: 112703 - DNA, 22 bp, Homo sapiens
tgtgaagaatgtcaatggtagt

SEQ ID NO: 112704 - DNA, 22 bp, Homo sapiens
agaggtagatggatgtaaggaa

SEQ ID NO: 112705 - DNA, 23 bp, Homo sapiens
ttcatacatgttttcatttgctt

SEQ ID NO: 112706 - DNA, 22 bp, Homo sapiens
taagaagatcatatgtgtgtgt

SEQ ID NO: 112707 - DNA, 23 bp, Homo sapiens
tatacatctttttctgtcaatat

SEQ ID NO: 112708 - DNA, 23 bp, Homo sapiens
cagggtctactgagatggacctg

SEQ ID NO: 112709 - DNA, 21 bp, Homo sapiens
aaaatcagtgttcaagtcatt

SEQ ID NO: 112710 - DNA, 23 bp, Homo sapiens
ttatgtagtagaaatgcaggtgt

SEQ ID NO: 112711 - DNA, 23 bp, Homo sapiens
actgcatgtcaagtgttattgaa

SEQ ID NO: 112712 - DNA, 23 bp, Homo sapiens
gaagattctatgcacttgctgtt

SEQ ID NO: 112713 - DNA, 19 bp, Homo sapiens
tggcagtgatgagagtggc

SEQ ID NO: 112714 - DNA, 22 bp, Homo sapiens
ttatgtcaatttttaaatgtat

SEQ ID NO: 112715 - DNA, 23 bp, Homo sapiens
tagaaagaaattggtatggttgg

SEQ ID NO: 112716 - DNA, 23 bp, Homo sapiens
tgagttcattgtagattctggat

SEQ ID NO: 112717 - DNA, 23 bp, Homo sapiens
tgagttcattgtagattctggat

SEQ ID NO: 112718 - DNA, 22 bp, Homo sapiens
atctctgaaggtcctattgtct

SEQ ID NO: 112719 - DNA, 19 bp, Homo sapiens
tgtgtgtgtgcgcgcgtgt

SEQ ID NO: 112720 - DNA, 19 bp, Homo sapiens
atgtgtgtgtgtgtgcatg

SEQ ID NO: 112721 - DNA, 21 bp, Homo sapiens
tattctgttatattttatatg

SEQ ID NO: 112722 - DNA, 22 bp, Homo sapiens
agacagacagacagttattccc

SEQ ID NO: 112723 - DNA, 23 bp, Homo sapiens
tggaagagcagctccatctgttt

SEQ ID NO: 112724 - DNA, 23 bp, Homo sapiens
ggaaatgactggttgtagtgaga

SEQ ID NO: 112725 - DNA, 23 bp, Homo sapiens
tatgatatactgcctgatgttat

SEQ ID NO: 112726 - DNA, 19 bp, Homo sapiens
tctgccacagtcactcacc

SEQ ID NO: 112727 - DNA, 23 bp, Homo sapiens
ggaacagtgagatgggtgctggt

SEQ ID NO: 112728 - DNA, 23 bp, Homo sapiens
tgagttcattgtagattctggat

SEQ ID NO: 112729 - DNA, 23 bp, Homo sapiens
tgagttcattgtagattctggat

SEQ ID NO: 112730 - DNA, 23 bp, Homo sapiens
tgagttcattgtagattctggat

SEQ ID NO: 112731 - DNA, 23 bp, Homo sapiens
tgagttcattgtagattctggat

SEQ ID NO: 112732 - DNA, 22 bp, Homo sapiens
tatatagatttacaaaatatgt

SEQ ID NO: 112733 - DNA, 21 bp, Homo sapiens
ttatatagatttacaaaatat

SEQ ID NO: 112734 - DNA, 22 bp, Homo sapiens
tatatagatttacaaaatatgt

SEQ ID NO: 112735 - DNA, 21 bp, Homo sapiens
ttatatagatttacaaaatat

SEQ ID NO: 112736 - DNA, 21 bp, Homo sapiens
tgggtcatgttaggaataact

SEQ ID NO: 112737 - DNA, 18 bp, Homo sapiens
atagaagtaagttgtaaa

SEQ ID NO: 112738 - DNA, 23 bp, Homo sapiens
tgtgacagagtctcactcttgtc

SEQ ID NO: 112739 - DNA, 22 bp, Homo sapiens
ttagttgtgtatatgttaatag

SEQ ID NO: 112740 - DNA, 20 bp, Homo sapiens
acagagaagtgacattggtg

SEQ ID NO: 112741 - DNA, 23 bp, Homo sapiens
tattttaattagttaatcaaggt

SEQ ID NO: 112742 - DNA, 23 bp, Homo sapiens
acttttgtatagtacaataagat

SEQ ID NO: 112743 - DNA, 23 bp, Homo sapiens
cttacatgttgatctcttgtgtt

SEQ ID NO: 112744 - DNA, 20 bp, Homo sapiens
taaggttctgttttggtttg

SEQ ID NO: 112745 - DNA, 22 bp, Homo sapiens
tgtcaccctatgtcaggctttc

SEQ ID NO: 112746 - DNA, 21 bp, Homo sapiens
tgagacagagtctcgctctgt

SEQ ID NO: 112747 - DNA, 22 bp, Homo sapiens
aggcctcatgtaccagcagttg

SEQ ID NO: 112748 - DNA, 23 bp, Homo sapiens
tgtgctatatacatgtgttatac

SEQ ID NO: 112749 - DNA, 23 bp, Homo sapiens
ttagccaatactttgtggacaga

SEQ ID NO: 112750 - DNA, 18 bp, Homo sapiens
ctgagttctgtaccactc

SEQ ID NO: 112751 - DNA, 23 bp, Homo sapiens
tgagttcattgtagattctggat

SEQ ID NO: 112752 - DNA, 23 bp, Homo sapiens
tgagttcattgtagattctggat

SEQ ID NO: 112753 - DNA, 18 bp, Homo sapiens
ttgagtagcaagtttcct

SEQ ID NO: 112754 - DNA, 23 bp, Homo sapiens
cggagtctcactctgtcacccag

SEQ ID NO: 112755 - DNA, 23 bp, Homo sapiens
tatttctggacgctaaacatgtg

SEQ ID NO: 112756 - DNA, 23 bp, Homo sapiens
acacacacacatatatatgtgtg

SEQ ID NO: 112757 - DNA, 23 bp, Homo sapiens
cactggctggctggctggctggc

SEQ ID NO: 112758 - DNA, 21 bp, Homo sapiens
agtgagtcttggaagttgctt

SEQ ID NO: 112759 - DNA, 23 bp, Homo sapiens
aatgtgaggtaagtatctctccc

SEQ ID NO: 112760 - DNA, 19 bp, Homo sapiens
ttgagatggagtctctctg

SEQ ID NO: 112761 - DNA, 20 bp, Homo sapiens
tatagtcatatactatatgt

SEQ ID NO: 112762 - DNA, 23 bp, Homo sapiens
gtctgcctctctctctgctagtc

SEQ ID NO: 112763 - DNA, 23 bp, Homo sapiens
tccagattttcttcttgttttca

SEQ ID NO: 112764 - DNA, 23 bp, Homo sapiens
tcttttttggttccatatgaaat

SEQ ID NO: 112765 - DNA, 23 bp, Homo sapiens
ctcagagagcatgctgtttgcca

SEQ ID NO: 112766 - DNA, 18 bp, Homo sapiens
aatggcatcttgctgcag

SEQ ID NO: 112767 - DNA, 23 bp, Homo sapiens
tacttaagagagagagatcacat

SEQ ID NO: 112768 - DNA, 19 bp, Homo sapiens
tacacacacacgtatatat

SEQ ID NO: 112769 - DNA, 23 bp, Homo sapiens
tgagttcattgtagattctggat

SEQ ID NO: 112770 - DNA, 23 bp, Homo sapiens
tgagttcattgtagattctggat

SEQ ID NO: 112771 - DNA, 23 bp, Homo sapiens
tcagaatgattgtttttggaaag

SEQ ID NO: 112772 - DNA, 23 bp, Homo sapiens
ttccaatactatgttgaatagaa

SEQ ID NO: 112773 - DNA, 23 bp, Homo sapiens
tcagaagatcctttagtgaaaat

SEQ ID NO: 112774 - DNA, 23 bp, Homo sapiens
tgcatcacattttctttatttgt

SEQ ID NO: 112775 - DNA, 22 bp, Homo sapiens
acatgtgcatattgtgcaggtt

SEQ ID NO: 112776 - DNA, 21 bp, Homo sapiens
tgaggtaggaggatcacttga

SEQ ID NO: 112777 - DNA, 23 bp, Homo sapiens
acacagcagtaagacaggcatga

SEQ ID NO: 112778 - DNA, 23 bp, Homo sapiens
tcccagagcccctggaactctgg

SEQ ID NO: 112779 - DNA, 23 bp, Homo sapiens
tcccagagcccctggaactctgg

SEQ ID NO: 112780 - DNA, 23 bp, Homo sapiens
tcccagagcccctggaactctgg

SEQ ID NO: 112781 - DNA, 22 bp, Homo sapiens
tctactttttcaattcggatgc

SEQ ID NO: 112782 - DNA, 23 bp, Homo sapiens
tccagtactatgttgaatagaag

SEQ ID NO: 112783 - DNA, 23 bp, Homo sapiens
tgagttcattgtagattctggat

SEQ ID NO: 112784 - DNA, 23 bp, Homo sapiens
tgagttcattgtagattctggat

SEQ ID NO: 112785 - DNA, 20 bp, Homo sapiens
tacactctagaatgtgtgta

SEQ ID NO: 112786 - DNA, 23 bp, Homo sapiens
gttgtagctggtattgatagcta

SEQ ID NO: 112787 - DNA, 19 bp, Homo sapiens
agagcctctggaactctgg

SEQ ID NO: 112788 - DNA, 20 bp, Homo sapiens
ggcagagattacagtgagct

SEQ ID NO: 112789 - DNA, 23 bp, Homo sapiens
cacagagaagagacagaccatcc

SEQ ID NO: 112790 - DNA, 23 bp, Homo sapiens
tgagttcattgtagattctggat

SEQ ID NO: 112791 - DNA, 23 bp, Homo sapiens
gaaactgcagccacttcagcact

SEQ ID NO: 112792 - DNA, 23 bp, Homo sapiens
ctctgtgtgtgcctgagcagctg

SEQ ID NO: 112793 - DNA, 22 bp, Homo sapiens
aagagtttgtcacttatttttt

SEQ ID NO: 112794 - DNA, 23 bp, Homo sapiens
tgtgcgtgtgtgtgtgtatgtat

SEQ ID NO: 112795 - DNA, 23 bp, Homo sapiens
cggagtctcgctctgtctcccag

SEQ ID NO: 112796 - DNA, 23 bp, Homo sapiens
tgtttgagctagtctattgttgt

SEQ ID NO: 112797 - DNA, 18 bp, Homo sapiens
aatgtatatatgtataca

SEQ ID NO: 112798 - DNA, 22 bp, Homo sapiens
gatttgtaattttgctcctaac

SEQ ID NO: 112799 - DNA, 23 bp, Homo sapiens
aaacacagattatagaatggagt

SEQ ID NO: 112800 - DNA, 20 bp, Homo sapiens
atgaggatatatgtatatat

SEQ ID NO: 112801 - DNA, 23 bp, Homo sapiens
tgtatggaactaattccttgttg

SEQ ID NO: 112802 - DNA, 23 bp, Homo sapiens
tgagttcattgtagattctggat

SEQ ID NO: 112803 - DNA, 23 bp, Homo sapiens
tgagttcattgtagattctggat

SEQ ID NO: 112804 - DNA, 23 bp, Homo sapiens
ttagaatttcaagaagtagagct

SEQ ID NO: 112805 - DNA, 21 bp, Homo sapiens
ttttcttagtatttcatacct

SEQ ID NO: 112806 - DNA, 22 bp, Homo sapiens
ttgacagtactttgtgtgcact

SEQ ID NO: 112807 - DNA, 23 bp, Homo sapiens
tactgatgctcagaaagtaatgt

SEQ ID NO: 112808 - DNA, 23 bp, Homo sapiens
gggtgactgtctgtctctcttga

SEQ ID NO: 112809 - DNA, 23 bp, Homo sapiens
ttgactgagtctcgcactgtcac

SEQ ID NO: 112810 - DNA, 21 bp, Homo sapiens
cattttggtagatgttctctt

SEQ ID NO: 112811 - DNA, 23 bp, Homo sapiens
tgtatatgtatgcatatatgtac

SEQ ID NO: 112812 - DNA, 23 bp, Homo sapiens
tatgtgtgtggatagctatatgt

SEQ ID NO: 112813 - DNA, 18 bp, Homo sapiens
atgtgtatatatatatgt

SEQ ID NO: 112814 - DNA, 19 bp, Homo sapiens
tatgtgtgtatacatacac

SEQ ID NO: 112815 - DNA, 20 bp, Homo sapiens
tttgtggctacatagtaggt

SEQ ID NO: 112816 - DNA, 21 bp, Homo sapiens
tgtgtgtatatatacatgtgt

SEQ ID NO: 112817 - DNA, 23 bp, Homo sapiens
actgaatctcactctgtcaccca

SEQ ID NO: 112818 - DNA, 23 bp, Homo sapiens
agtgtgtgtgtatgtatacacat

SEQ ID NO: 112819 - DNA, 21 bp, Homo sapiens
tgtgtgtgtatgtgtatgcgt

SEQ ID NO: 112820 - DNA, 23 bp, Homo sapiens
tacattgtgcatatgtaaacata

SEQ ID NO: 112821 - DNA, 23 bp, Homo sapiens
aaatttcttcatgattttgtaac

SEQ ID NO: 112822 - DNA, 23 bp, Homo sapiens
atatgtatataattatatgtgtg

SEQ ID NO: 112823 - DNA, 23 bp, Homo sapiens
tgagttcattgtagattctggat

SEQ ID NO: 112824 - DNA, 23 bp, Homo sapiens
tgagttcattgtagattctggat

SEQ ID NO: 112825 - DNA, 23 bp, Homo sapiens
acaatacaatgttagcagaagtg

SEQ ID NO: 112826 - DNA, 23 bp, Homo sapiens
aacagatgtgtttttcttgcata

SEQ ID NO: 112827 - DNA, 22 bp, Homo sapiens
cataagaactttagatatgcat

SEQ ID NO: 112828 - DNA, 23 bp, Homo sapiens
cactctatcactgtgaccttagg

SEQ ID NO: 112829 - DNA, 18 bp, Homo sapiens
atcttgttgtggaaaagt

SEQ ID NO: 112830 - DNA, 23 bp, Homo sapiens
tggagtctcactctgtcacccag

SEQ ID NO: 112831 - DNA, 23 bp, Homo sapiens
tgtgaagaaagtcaatggtagct

SEQ ID NO: 112832 - DNA, 19 bp, Homo sapiens
tgtcccattgttattcact

SEQ ID NO: 112833 - DNA, 23 bp, Homo sapiens
gaaaggtgttgaaaatgtactgt

SEQ ID NO: 112834 - DNA, 20 bp, Homo sapiens
tcagagagtgcaatggctgc

SEQ ID NO: 112835 - DNA, 19 bp, Homo sapiens
aaacctcttgaatacacaa

SEQ ID NO: 112836 - DNA, 20 bp, Homo sapiens
ggtgtgatcttggctcactg

SEQ ID NO: 112837 - DNA, 22 bp, Homo sapiens
aaagtcagtggtagcttgatga

SEQ ID NO: 112838 - DNA, 23 bp, Homo sapiens
tagggtctcactgtgtcgctcag

SEQ ID NO: 112839 - DNA, 23 bp, Homo sapiens
ttgatgtttgtggaattattctg

SEQ ID NO: 112840 - DNA, 23 bp, Homo sapiens
tgtggaactatgtatgtttgtct

SEQ ID NO: 112841 - DNA, 23 bp, Homo sapiens
tatagatatctatgtgtatatat

SEQ ID NO: 112842 - DNA, 21 bp, Homo sapiens
tcagagttgggactgtgcaga

SEQ ID NO: 112843 - DNA, 20 bp, Homo sapiens
tgaggtaggaggatcacttg

SEQ ID NO: 112844 - DNA, 18 bp, Homo sapiens
agcagtatgtgctatgag

SEQ ID NO: 112845 - DNA, 20 bp, Homo sapiens
ttgaggaatcacttacagat

SEQ ID NO: 112846 - DNA, 23 bp, Homo sapiens
agtgcatgcctgtagtcccagct

SEQ ID NO: 112847 - DNA, 18 bp, Homo sapiens
atctgagtgaggtaagga

SEQ ID NO: 112848 - DNA, 23 bp, Homo sapiens
ggagtctcactcactctgttgcc

SEQ ID NO: 112849 - DNA, 23 bp, Homo sapiens
cacagcaatgagactgttaaaga

SEQ ID NO: 112850 - DNA, 20 bp, Homo sapiens
atttgagtcttgctctgtca

SEQ ID NO: 112851 - DNA, 23 bp, Homo sapiens
aagctagtcacatttttaagttg

SEQ ID NO: 112852 - DNA, 18 bp, Homo sapiens
tgcaacttctgcctcctg

SEQ ID NO: 112853 - DNA, 19 bp, Homo sapiens
tgagtctcgcactgtcacc

SEQ ID NO: 112854 - DNA, 23 bp, Homo sapiens
accgtctgtgggtctctcagccg

SEQ ID NO: 112855 - DNA, 23 bp, Homo sapiens
cggagtctcgctctgtcgctcag

SEQ ID NO: 112856 - DNA, 23 bp, Homo sapiens
agagtctcactctgtcacccagg

SEQ ID NO: 112857 - DNA, 23 bp, Homo sapiens
gagtctcactctgtcacccaggc

SEQ ID NO: 112858 - DNA, 20 bp, Homo sapiens
atctatgtttatcaaggcta

SEQ ID NO: 112859 - DNA, 23 bp, Homo sapiens
ttctctgccaggttttgatatca

SEQ ID NO: 112860 - DNA, 23 bp, Homo sapiens
gagactcactctgtcacccaggc

SEQ ID NO: 112861 - DNA, 22 bp, Homo sapiens
tgaacagtcagtttttgttaag

SEQ ID NO: 112862 - DNA, 23 bp, Homo sapiens
atcctcatcatggagttgttcta

SEQ ID NO: 112863 - DNA, 18 bp, Homo sapiens
agatcaatttcttacaat

SEQ ID NO: 112864 - DNA, 18 bp, Homo sapiens
tggcagagtctcactctc

SEQ ID NO: 112865 - DNA, 19 bp, Homo sapiens
gcaacatgtgcctgtggtc

SEQ ID NO: 112866 - DNA, 23 bp, Homo sapiens
agccatgttcacgccattgcact

SEQ ID NO: 112867 - DNA, 23 bp, Homo sapiens
ggatggttgggagaggattgagg

SEQ ID NO: 112868 - DNA, 21 bp, Homo sapiens
atgtgtatatatattggtgta

SEQ ID NO: 112869 - DNA, 18 bp, Homo sapiens
ttctttttgcttaggatt

SEQ ID NO: 112870 - DNA, 23 bp, Homo sapiens
ttctgtgaagaaagtcaatggta

SEQ ID NO: 112871 - DNA, 23 bp, Homo sapiens
tgagacagagtctcgctctgttg

SEQ ID NO: 112872 - DNA, 18 bp, Homo sapiens
ttcaacaatggctgcttc

SEQ ID NO: 112873 - DNA, 23 bp, Homo sapiens
tctctctctctctctgaggttcc

SEQ ID NO: 112874 - DNA, 23 bp, Homo sapiens
tgagttcattgtagattctggat

SEQ ID NO: 112875 - DNA, 23 bp, Homo sapiens
tgagttcattgtagattctggat

SEQ ID NO: 112876 - DNA, 23 bp, Homo sapiens
gctttgaagttgaatgtgtttag

SEQ ID NO: 112877 - DNA, 23 bp, Homo sapiens
tgactagagaattagaagaagtg

SEQ ID NO: 112878 - DNA, 23 bp, Homo sapiens
tttattctatggtgattccaatt

SEQ ID NO: 112879 - DNA, 18 bp, Homo sapiens
tagtgattgccacagcat

SEQ ID NO: 112880 - DNA, 23 bp, Homo sapiens
tactttggaaaactgacagttct

SEQ ID NO: 112881 - DNA, 23 bp, Homo sapiens
actttcactctgaggtatagacc

SEQ ID NO: 112882 - DNA, 20 bp, Homo sapiens
aacacactgcaccccaaccc

SEQ ID NO: 112883 - DNA, 20 bp, Homo sapiens
taaagatggagtctcactgt

SEQ ID NO: 112884 - DNA, 22 bp, Homo sapiens
ttttagtagagatggggtttca

SEQ ID NO: 112885 - DNA, 23 bp, Homo sapiens
ccttagctcttgtgagtgtattt

SEQ ID NO: 112886 - DNA, 19 bp, Homo sapiens
tgttagcaagacaaggaat

SEQ ID NO: 112887 - DNA, 21 bp, Homo sapiens
ctgtgtctgtatgatgtatgc

SEQ ID NO: 112888 - DNA, 23 bp, Homo sapiens
tgtatgtgtgtgatatatatgtc

SEQ ID NO: 112889 - DNA, 23 bp, Homo sapiens
acagagtctcgctctgtcgctca

SEQ ID NO: 112890 - DNA, 23 bp, Homo sapiens
gactattgttggtgtataggaat

SEQ ID NO: 112891 - DNA, 23 bp, Homo sapiens
tggctcccacacaaagatgtgat

SEQ ID NO: 112892 - DNA, 23 bp, Homo sapiens
ttactgttaccttatgttatttt

SEQ ID NO: 112893 - DNA, 20 bp, Homo sapiens
tgcagaaggaattacatgtg

SEQ ID NO: 112894 - DNA, 23 bp, Homo sapiens
tacatatgtatgtgtatacgtgt

SEQ ID NO: 112895 - DNA, 23 bp, Homo sapiens
catatgtatatgtgtatgtgtat

SEQ ID NO: 112896 - DNA, 22 bp, Homo sapiens
atatatgtatatgtatatgtgt

SEQ ID NO: 112897 - DNA, 21 bp, Homo sapiens
tatgtgtatatgtatatgtgt

SEQ ID NO: 112898 - DNA, 19 bp, Homo sapiens
tatgtgtatatgtatatgt

SEQ ID NO: 112899 - DNA, 21 bp, Homo sapiens
tatgtgtgtgtatatataccc

SEQ ID NO: 112900 - DNA, 23 bp, Homo sapiens
tgcatctacttcatcaggttttt

SEQ ID NO: 112901 - DNA, 23 bp, Homo sapiens
taaacttagttttagatgacatt

SEQ ID NO: 112902 - DNA, 18 bp, Homo sapiens
tgacagcttggatgaact

SEQ ID NO: 112903 - DNA, 21 bp, Homo sapiens
ctttgaatctgtagattgctg

SEQ ID NO: 112904 - DNA, 23 bp, Homo sapiens
tgagttcattgtagattctggat

SEQ ID NO: 112905 - DNA, 23 bp, Homo sapiens
tgagttcattgtagattctggat

SEQ ID NO: 112906 - DNA, 23 bp, Homo sapiens
taatgagactttgtatttctgtg

SEQ ID NO: 112907 - DNA, 23 bp, Homo sapiens
aggagaatttttaaggagttacg

SEQ ID NO: 112908 - DNA, 19 bp, Homo sapiens
tggtgaaggaggggaagtg

SEQ ID NO: 112909 - DNA, 20 bp, Homo sapiens
ttatgtataaatatatatgt

SEQ ID NO: 112910 - DNA, 23 bp, Homo sapiens
tacatgtgcacaatgtgcaggtt

SEQ ID NO: 112911 - DNA, 23 bp, Homo sapiens
tgtgctttgaatatgagtatctt

SEQ ID NO: 112912 - DNA, 23 bp, Homo sapiens
ttataggtaccatagcatactcg

SEQ ID NO: 112913 - DNA, 18 bp, Homo sapiens
tgagatgatatctcactg

SEQ ID NO: 112914 - DNA, 19 bp, Homo sapiens
agtatgtatgtattatact

SEQ ID NO: 112915 - DNA, 18 bp, Homo sapiens
gtatgtatgtattatact

SEQ ID NO: 112916 - DNA, 23 bp, Homo sapiens
gtctcactctgtcacccaggctg

SEQ ID NO: 112917 - DNA, 22 bp, Homo sapiens
tataacagttgctggtatcttg

SEQ ID NO: 112918 - DNA, 22 bp, Homo sapiens
ttttaagatggagtcttgctca

SEQ ID NO: 112919 - DNA, 22 bp, Homo sapiens
agtgaggttcttggatgatttg

SEQ ID NO: 112920 - DNA, 23 bp, Homo sapiens
tattgatatatatgttaggtgta

SEQ ID NO: 112921 - DNA, 23 bp, Homo sapiens
tgtatatgcgatggaaatgtaca

SEQ ID NO: 112922 - DNA, 23 bp, Homo sapiens
tcagtaagtcccttatctttctc

SEQ ID NO: 112923 - DNA, 23 bp, Homo sapiens
atcacgccactgtcagtcactgt

SEQ ID NO: 112924 - DNA, 18 bp, Homo sapiens
gagaagaagtaaggaaat

SEQ ID NO: 112925 - DNA, 23 bp, Homo sapiens
taaagtttatatgtatttcatat

SEQ ID NO: 112926 - DNA, 19 bp, Homo sapiens
tagaatgtatataaattga

SEQ ID NO: 112927 - DNA, 23 bp, Homo sapiens
tggagtctcactctgtcacccag

SEQ ID NO: 112928 - DNA, 22 bp, Homo sapiens
tattgaacttctatgccaatga

SEQ ID NO: 112929 - DNA, 21 bp, Homo sapiens
cagaggacagaattagctcaa

SEQ ID NO: 112930 - DNA, 23 bp, Homo sapiens
tccttctctgccactctgcctct

SEQ ID NO: 112931 - DNA, 23 bp, Homo sapiens
tgtagtcagtggtgttggtgtgg

SEQ ID NO: 112932 - DNA, 23 bp, Homo sapiens
ttttgtgacttatatttctctcc

SEQ ID NO: 112933 - DNA, 19 bp, Homo sapiens
taggtataggtatatatgt

SEQ ID NO: 112934 - DNA, 22 bp, Homo sapiens
tttctatggaaatggaatctta

SEQ ID NO: 112935 - DNA, 19 bp, Homo sapiens
tgtattcatttttgtatgc

SEQ ID NO: 112936 - DNA, 23 bp, Homo sapiens
agagaggtaaatcttagctaaga

SEQ ID NO: 112937 - DNA, 22 bp, Homo sapiens
agagatgaaggtgatgtgtgca

SEQ ID NO: 112938 - DNA, 23 bp, Homo sapiens
tccctgtgtgtctgcctgtgtct

SEQ ID NO: 112939 - DNA, 21 bp, Homo sapiens
ctagactagtcacattggatt

SEQ ID NO: 112940 - DNA, 22 bp, Homo sapiens
tgactgccattactgtatcaca

SEQ ID NO: 112941 - DNA, 20 bp, Homo sapiens
tgctggtcaaaaatgtgcag

SEQ ID NO: 112942 - DNA, 23 bp, Homo sapiens
ttctctgagtgaatagtgagact

SEQ ID NO: 112943 - DNA, 20 bp, Homo sapiens
tactatgtcagtttgaaaaa

SEQ ID NO: 112944 - DNA, 23 bp, Homo sapiens
aaagaacacagagaggtgagaat

SEQ ID NO: 112945 - DNA, 18 bp, Homo sapiens
tgagagacatttaggttg

SEQ ID NO: 112946 - DNA, 19 bp, Homo sapiens
gtggtggtgatggtagttc

SEQ ID NO: 112947 - DNA, 23 bp, Homo sapiens
tgttatggaactctactgtttta

SEQ ID NO: 112948 - DNA, 23 bp, Homo sapiens
gagtacagttgtgtgccaccaca

SEQ ID NO: 112949 - DNA, 21 bp, Homo sapiens
gtgtgtgtatgtgtgtgtata

SEQ ID NO: 112950 - DNA, 21 bp, Homo sapiens
atgtatatatgcatgtatatg

SEQ ID NO: 112951 - DNA, 21 bp, Homo sapiens
tatgtacacattatgaaatga

SEQ ID NO: 112952 - DNA, 23 bp, Homo sapiens
tgagttcattgtagattctggat

SEQ ID NO: 112953 - DNA, 23 bp, Homo sapiens
tgagttcattgtagattctggat

SEQ ID NO: 112954 - DNA, 20 bp, Homo sapiens
atttgcatatatatgcaatt

SEQ ID NO: 112955 - DNA, 21 bp, Homo sapiens
attactgcctatacatgtctt

SEQ ID NO: 112956 - DNA, 23 bp, Homo sapiens
ataagagagtggtagagagtaaa

SEQ ID NO: 112957 - DNA, 22 bp, Homo sapiens
tatgtgtgtgcatatatacaca

SEQ ID NO: 112958 - DNA, 23 bp, Homo sapiens
agactgagtctcgctctgtcatc

SEQ ID NO: 112959 - DNA, 23 bp, Homo sapiens
tcttttttggttccatatgaaat

SEQ ID NO: 112960 - DNA, 21 bp, Homo sapiens
tgtgatgaaagtcaatggtag

SEQ ID NO: 112961 - DNA, 19 bp, Homo sapiens
tccatgtatgtattataca

SEQ ID NO: 112962 - DNA, 18 bp, Homo sapiens
tgagtgacactctccctg

SEQ ID NO: 112963 - DNA, 23 bp, Homo sapiens
agtgctctgagactctcacatat

SEQ ID NO: 112964 - DNA, 22 bp, Homo sapiens
tgaggatacagtgagaagacag

SEQ ID NO: 112965 - DNA, 23 bp, Homo sapiens
atctcagtaagtttatgtagagt

SEQ ID NO: 112966 - DNA, 23 bp, Homo sapiens
taacagtgtgttctgcacgtgat

SEQ ID NO: 112967 - DNA, 23 bp, Homo sapiens
ctgtgcaatagataactcaaatg

SEQ ID NO: 112968 - DNA, 23 bp, Homo sapiens
tatggctgtgattttgtagataa

SEQ ID NO: 112969 - DNA, 23 bp, Homo sapiens
ttttagttgagacaggtttcacc

SEQ ID NO: 112970 - DNA, 23 bp, Homo sapiens
ctgggtgacacagtgagactctg

SEQ ID NO: 112971 - DNA, 20 bp, Homo sapiens
tgtgtgtgtgtatatgtata

SEQ ID NO: 112972 - DNA, 23 bp, Homo sapiens
tgtatatactttcacatatgaca

SEQ ID NO: 112973 - DNA, 18 bp, Homo sapiens
tatacatatatatgcata

SEQ ID NO: 112974 - DNA, 20 bp, Homo sapiens
aatgttttctgggtggtgtt

SEQ ID NO: 112975 - DNA, 21 bp, Homo sapiens
tttttattgaacagctgcctg

SEQ ID NO: 112976 - DNA, 23 bp, Homo sapiens
aaagaagtttcacaaatcataat

SEQ ID NO: 112977 - DNA, 23 bp, Homo sapiens
agtttggtattactgataggtga

SEQ ID NO: 112978 - DNA, 23 bp, Homo sapiens
tgagttcattgtagattctggat

SEQ ID NO: 112979 - DNA, 23 bp, Homo sapiens
tgagttcattgtagattctggat

SEQ ID NO: 112980 - DNA, 21 bp, Homo sapiens
ttttagtgtgttaatgtagta

SEQ ID NO: 112981 - DNA, 23 bp, Homo sapiens
taagagacagggtctcatgttgc

SEQ ID NO: 112982 - DNA, 23 bp, Homo sapiens
tggttgtgactagaattggtgat

SEQ ID NO: 112983 - DNA, 22 bp, Homo sapiens
atgcctgtatttttctgtttgc

SEQ ID NO: 112984 - DNA, 19 bp, Homo sapiens
gtgtgtgtgtgtgtgtgtg

SEQ ID NO: 112985 - DNA, 22 bp, Homo sapiens
agacactcagagagtgagtgga

SEQ ID NO: 112986 - DNA, 22 bp, Homo sapiens
tgtgtgtctatgtagtgtgtga

SEQ ID NO: 112987 - DNA, 23 bp, Homo sapiens
tgagttcattgtagattctggat

SEQ ID NO: 112988 - DNA, 23 bp, Homo sapiens
tgagttcattgtagattctggat

SEQ ID NO: 112989 - DNA, 23 bp, Homo sapiens
gagtgtgtgtgtacatgcacgtg

SEQ ID NO: 112990 - DNA, 23 bp, Homo sapiens
tgtgtctgtgtgtgtctgtgctt

SEQ ID NO: 112991 - DNA, 23 bp, Homo sapiens
atgtgtgttggtgtagacttctt

SEQ ID NO: 112992 - DNA, 22 bp, Homo sapiens
atatgtgtatatgtatatgtgt

SEQ ID NO: 112993 - DNA, 23 bp, Homo sapiens
tgagacagagtctcgctctgtca

SEQ ID NO: 112994 - DNA, 20 bp, Homo sapiens
tatcaatgcaatgcaatggt

SEQ ID NO: 112995 - DNA, 23 bp, Homo sapiens
gacagagtctcgctctgtcaccc

SEQ ID NO: 112996 - DNA, 21 bp, Homo sapiens
attgaccctagttagctattg

SEQ ID NO: 112997 - DNA, 22 bp, Homo sapiens
tcactgcagtctctgtctccag

SEQ ID NO: 112998 - DNA, 21 bp, Homo sapiens
tatgtgtgtgtgtatgtccat

SEQ ID NO: 112999 - DNA, 23 bp, Homo sapiens
tctcactttatcactctgtcacc

SEQ ID NO: 113000 - DNA, 19 bp, Homo sapiens
tgtgtgtgtatatatatac

SEQ ID NO: 113001 - DNA, 21 bp, Homo sapiens
tgtgtgtatatatatacgtat

SEQ ID NO: 113002 - DNA, 23 bp, Homo sapiens
atatgtgtatatatgtatatatg

SEQ ID NO: 113003 - DNA, 21 bp, Homo sapiens
cacacgtatatataaatgtgt

SEQ ID NO: 113004 - DNA, 23 bp, Homo sapiens
atgtgtatatgtatatgtataca

SEQ ID NO: 113005 - DNA, 23 bp, Homo sapiens
tgtgtatatgtatatgtatacgc

SEQ ID NO: 113006 - DNA, 23 bp, Homo sapiens
agaggcagagagcctccctctgt

SEQ ID NO: 113007 - DNA, 18 bp, Homo sapiens
aggagaacactttgtttc

SEQ ID NO: 113008 - DNA, 23 bp, Homo sapiens
agatagtcttaacataatgttct

SEQ ID NO: 113009 - DNA, 18 bp, Homo sapiens
gtgggtcaggctgtccca

SEQ ID NO: 113010 - DNA, 22 bp, Homo sapiens
tggcagtgaatatactctgtat

SEQ ID NO: 113011 - DNA, 23 bp, Homo sapiens
agatggagtcttgccttgcagcc

SEQ ID NO: 113012 - DNA, 19 bp, Homo sapiens
aatggtgtgatctcagctc

SEQ ID NO: 113013 - DNA, 19 bp, Homo sapiens
atgaggaataagttgtggt

SEQ ID NO: 113014 - DNA, 23 bp, Homo sapiens
tttcagacagggtctcactgtca

SEQ ID NO: 113015 - DNA, 23 bp, Homo sapiens
tttatggttttcatggtatagat

SEQ ID NO: 113016 - DNA, 19 bp, Homo sapiens
aactgcactccagcctggg

SEQ ID NO: 113017 - DNA, 23 bp, Homo sapiens
tttcagagaaggagtctctctct

SEQ ID NO: 113018 - DNA, 19 bp, Homo sapiens
acccaaatgtatgtctgtg

SEQ ID NO: 113019 - DNA, 23 bp, Homo sapiens
tctcagactcccaagtagctgag

SEQ ID NO: 113020 - DNA, 20 bp, Homo sapiens
tggcttatgattcccatagc

SEQ ID NO: 113021 - DNA, 22 bp, Homo sapiens
ttaatataagaatgtctttctc

SEQ ID NO: 113022 - DNA, 20 bp, Homo sapiens
tcagtggttttagtggttgc

SEQ ID NO: 113023 - DNA, 23 bp, Homo sapiens
taaaactagactgtgtgctccct

SEQ ID NO: 113024 - DNA, 22 bp, Homo sapiens
cacacacacacatacatgtgca

SEQ ID NO: 113025 - DNA, 20 bp, Homo sapiens
cactggattaatcaaagtgg

SEQ ID NO: 113026 - DNA, 23 bp, Homo sapiens
agtatctgtgtatatatatagtg

SEQ ID NO: 113027 - DNA, 23 bp, Homo sapiens
tataaattacaggaggtaaaaga

SEQ ID NO: 113028 - DNA, 19 bp, Homo sapiens
gagaacagtggtgtttggt

SEQ ID NO: 113029 - DNA, 23 bp, Homo sapiens
ttttgagaccgactctaactctg

SEQ ID NO: 113030 - DNA, 23 bp, Homo sapiens
tatatgtgtgtgtatatgtatat

SEQ ID NO: 113031 - DNA, 19 bp, Homo sapiens
tacatatacacacacatat

SEQ ID NO: 113032 - DNA, 23 bp, Homo sapiens
tggagaaggagcagaatgtcaag

SEQ ID NO: 113033 - DNA, 22 bp, Homo sapiens
attcagacacaggaatgccaga

SEQ ID NO: 113034 - DNA, 19 bp, Homo sapiens
tatgagcattacatatata

SEQ ID NO: 113035 - DNA, 21 bp, Homo sapiens
tatatatatatgtgtgtgcgt

SEQ ID NO: 113036 - DNA, 23 bp, Homo sapiens
gacagagtctcgctctgtcaccc

SEQ ID NO: 113037 - DNA, 18 bp, Homo sapiens
tctgtgcgtataggtttt

SEQ ID NO: 113038 - DNA, 23 bp, Homo sapiens
tttgagacagagtctcgctctgt

SEQ ID NO: 113039 - DNA, 23 bp, Homo sapiens
aaggatctagatgcagttcaggc

SEQ ID NO: 113040 - DNA, 22 bp, Homo sapiens
attgcattagattagttcttca

SEQ ID NO: 113041 - DNA, 18 bp, Homo sapiens
aaatactaaagtcttgag

SEQ ID NO: 113042 - DNA, 23 bp, Homo sapiens
ttttttcattttgttcaggtata

SEQ ID NO: 113043 - DNA, 23 bp, Homo sapiens
tcactcttgtctgtctgtcactc

SEQ ID NO: 113044 - DNA, 23 bp, Homo sapiens
tatatttgattatatagcatagt

SEQ ID NO: 113045 - DNA, 23 bp, Homo sapiens
cagggtctcactctgtcacccag

SEQ ID NO: 113046 - DNA, 19 bp, Homo sapiens
aggtggtaggatcattaga

SEQ ID NO: 113047 - DNA, 23 bp, Homo sapiens
ttttgccactggaagaattgaga

SEQ ID NO: 113048 - DNA, 23 bp, Homo sapiens
cagggtctcactctgtcacccag

SEQ ID NO: 113049 - DNA, 18 bp, Homo sapiens
aacagcttcttaaggttt

SEQ ID NO: 113050 - DNA, 23 bp, Homo sapiens
agcttacagactattgagaaaga

SEQ ID NO: 113051 - DNA, 23 bp, Homo sapiens
gacagagtctcgctctgtcaccc

SEQ ID NO: 113052 - DNA, 23 bp, Homo sapiens
gttttgtggatcttttttgaaaa

SEQ ID NO: 113053 - DNA, 23 bp, Homo sapiens
tgtgtctgaatgactgcctcatg

SEQ ID NO: 113054 - DNA, 23 bp, Homo sapiens
attgctacaggaaaacataagat

SEQ ID NO: 113055 - DNA, 20 bp, Homo sapiens
tatgcatatatatgcatata

SEQ ID NO: 113056 - DNA, 23 bp, Homo sapiens
atatgcatatatatgcatatatg

SEQ ID NO: 113057 - DNA, 23 bp, Homo sapiens
gagacggagtctcactctgtcac

SEQ ID NO: 113058 - DNA, 23 bp, Homo sapiens
ctaaaagttttgaactcaaacct

SEQ ID NO: 113059 - DNA, 23 bp, Homo sapiens
gaaatcagagtagagagtgccta

SEQ ID NO: 113060 - DNA, 23 bp, Homo sapiens
gtgtatgtatatatatatgtgtg

SEQ ID NO: 113061 - DNA, 21 bp, Homo sapiens
tgtgagagtaaggtggttgtt

SEQ ID NO: 113062 - DNA, 22 bp, Homo sapiens
tgagacagtcttgctctgtcac

SEQ ID NO: 113063 - DNA, 23 bp, Homo sapiens
tgagttcattgtagattctggat

SEQ ID NO: 113064 - DNA, 23 bp, Homo sapiens
tgagttcattgtagattctggat

SEQ ID NO: 113065 - DNA, 22 bp, Homo sapiens
acattgtatttctatatgaatg

SEQ ID NO: 113066 - DNA, 19 bp, Homo sapiens
tatgtatatttatatatgt

SEQ ID NO: 113067 - DNA, 23 bp, Homo sapiens
tgttatcaaaatgacagcagcgt

SEQ ID NO: 113068 - DNA, 23 bp, Homo sapiens
agatttcctcttggtgcagcatg

SEQ ID NO: 113069 - DNA, 23 bp, Homo sapiens
tgagttcattgtagattctggat

SEQ ID NO: 113070 - DNA, 23 bp, Homo sapiens
gacagagtctcgctctgtcaccc

SEQ ID NO: 113071 - DNA, 23 bp, Homo sapiens
tcctattgttttcagtatgttaa

SEQ ID NO: 113072 - DNA, 23 bp, Homo sapiens
caatggattatacagagtgagca

SEQ ID NO: 113073 - DNA, 21 bp, Homo sapiens
gctctgttctcttctgtgtga

SEQ ID NO: 113074 - DNA, 23 bp, Homo sapiens
tgagttcattgtagattctggat

SEQ ID NO: 113075 - DNA, 23 bp, Homo sapiens
tgagttcattgtagattctggat

SEQ ID NO: 113076 - DNA, 23 bp, Homo sapiens
tacatcacactttgcttggagca

SEQ ID NO: 113077 - DNA, 21 bp, Homo sapiens
tatgtgtatatgtatatttgt

SEQ ID NO: 113078 - DNA, 18 bp, Homo sapiens
taggtgaacagaagcagt

SEQ ID NO: 113079 - DNA, 23 bp, Homo sapiens
ttctttgcttttgaaggaaggag

SEQ ID NO: 113080 - DNA, 23 bp, Homo sapiens
tttgagacggagtctcgctctat

SEQ ID NO: 113081 - DNA, 22 bp, Homo sapiens
ttctcttcctcacaatctggtt

SEQ ID NO: 113082 - DNA, 22 bp, Homo sapiens
aaaagcaaaagcagatgagtga

SEQ ID NO: 113083 - DNA, 23 bp, Homo sapiens
attaaggaatactgtgggttctt

SEQ ID NO: 113084 - DNA, 23 bp, Homo sapiens
tgagactgtctccctctgtcccc

SEQ ID NO: 113085 - DNA, 18 bp, Homo sapiens
tgagaggactgtgtggcc

SEQ ID NO: 113086 - DNA, 23 bp, Homo sapiens
ctaagtgaatctgtgtctgtctg

SEQ ID NO: 113087 - DNA, 20 bp, Homo sapiens
gcgtgagacactgcacctgg

SEQ ID NO: 113088 - DNA, 23 bp, Homo sapiens
ctctctcagactctctcttgact

SEQ ID NO: 113089 - DNA, 21 bp, Homo sapiens
atgggtgtgtggttaagacgt

SEQ ID NO: 113090 - DNA, 23 bp, Homo sapiens
tgagttcattgtagattctggat

SEQ ID NO: 113091 - DNA, 23 bp, Homo sapiens
tgagttcattgtagattctggat

SEQ ID NO: 113092 - DNA, 20 bp, Homo sapiens
ttcactgttttcttgttgat

SEQ ID NO: 113093 - DNA, 22 bp, Homo sapiens
ggagtctctctctgtcacacag

SEQ ID NO: 113094 - DNA, 23 bp, Homo sapiens
gtcttttgaatcctatgtgaggg

SEQ ID NO: 113095 - DNA, 18 bp, Homo sapiens
gaacatcacgtttactga

SEQ ID NO: 113096 - DNA, 19 bp, Homo sapiens
gtctcgctctgtcacccag

SEQ ID NO: 113097 - DNA, 19 bp, Homo sapiens
tgacagtgagcacagaccc

SEQ ID NO: 113098 - DNA, 22 bp, Homo sapiens
tggtgacagtggctgtcatggg

SEQ ID NO: 113099 - DNA, 21 bp, Homo sapiens
tatacacatatgtatatatgt

SEQ ID NO: 113100 - DNA, 21 bp, Homo sapiens
tatacacatatgtatatatgt

SEQ ID NO: 113101 - DNA, 23 bp, Homo sapiens
atatacacatatgtatatgtgta

SEQ ID NO: 113102 - DNA, 23 bp, Homo sapiens
catatacacatatgtatatgtgt

SEQ ID NO: 113103 - DNA, 23 bp, Homo sapiens
tgtatatgtatatgtatatgtat

SEQ ID NO: 113104 - DNA, 23 bp, Homo sapiens
aatgaggaaggtagtgttatcac

SEQ ID NO: 113105 - DNA, 23 bp, Homo sapiens
tgagttcattgtagattctggat

SEQ ID NO: 113106 - DNA, 23 bp, Homo sapiens
tgagttcattgtagattctggat

SEQ ID NO: 113107 - DNA, 19 bp, Homo sapiens
gccactgtctttctcctga

SEQ ID NO: 113108 - DNA, 23 bp, Homo sapiens
cctgtctctgtggctctctgtgc

SEQ ID NO: 113109 - DNA, 23 bp, Homo sapiens
tgtgtgtctgtgtgtccctgtgg

SEQ ID NO: 113110 - DNA, 23 bp, Homo sapiens
gtgacggtgtgtccatgtggtga

SEQ ID NO: 113111 - DNA, 23 bp, Homo sapiens
tcctggatgtcctaattaatttt

SEQ ID NO: 113112 - DNA, 22 bp, Homo sapiens
taattgcatgcaaaaggtatct

SEQ ID NO: 113113 - DNA, 21 bp, Homo sapiens
taagagcaagacagatgttac

SEQ ID NO: 113114 - DNA, 20 bp, Homo sapiens
aaagtctgtcctctgcctca

SEQ ID NO: 113115 - DNA, 23 bp, Homo sapiens
tctgtcactgtctcactttgccc

SEQ ID NO: 113116 - DNA, 23 bp, Homo sapiens
tctgtcactgtctcactttgccc

SEQ ID NO: 113117 - DNA, 19 bp, Homo sapiens
tcaccattctaactggtgt

SEQ ID NO: 113118 - DNA, 19 bp, Homo sapiens
atggggattcaccatattg

SEQ ID NO: 113119 - DNA, 23 bp, Homo sapiens
ccagagtctcgctctgtcaccca

SEQ ID NO: 113120 - DNA, 23 bp, Homo sapiens
gggtctcactctgtcacccaggc

SEQ ID NO: 113121 - DNA, 23 bp, Homo sapiens
atcactttttttttttttgagag

SEQ ID NO: 113122 - DNA, 20 bp, Homo sapiens
tgacagaccccagtttccag

SEQ ID NO: 113123 - DNA, 19 bp, Homo sapiens
gtggtgaaacactgtctct

SEQ ID NO: 113124 - DNA, 23 bp, Homo sapiens
tttgagacggagtctccctctgt

SEQ ID NO: 113125 - DNA, 22 bp, Homo sapiens
agacagagtcttactctgtcac

SEQ ID NO: 113126 - DNA, 23 bp, Homo sapiens
tcttgctctctctctgtcaccca

SEQ ID NO: 113127 - DNA, 23 bp, Homo sapiens
tctgtcactgtctcactttgccc

SEQ ID NO: 113128 - DNA, 22 bp, Homo sapiens
gagtctcactctgtcacccagg

SEQ ID NO: 113129 - DNA, 19 bp, Homo sapiens
tacatatatatacatatgt

SEQ ID NO: 113130 - DNA, 19 bp, Homo sapiens
tgtgtgtgtatatatatac

SEQ ID NO: 113131 - DNA, 23 bp, Homo sapiens
gacagagtctcgctctgtcaccc

SEQ ID NO: 113132 - DNA, 21 bp, Homo sapiens
ttttttcaatatcattttgtg

SEQ ID NO: 113133 - DNA, 20 bp, Homo sapiens
tcaggaaaacagaggtaaag

SEQ ID NO: 113134 - DNA, 18 bp, Homo sapiens
tgcttgtggtggtggagc

SEQ ID NO: 113135 - DNA, 19 bp, Homo sapiens
tgtcactgtgcctggctgc

SEQ ID NO: 113136 - DNA, 20 bp, Homo sapiens
gtctgccactgtgtctgcct

SEQ ID NO: 113137 - DNA, 23 bp, Homo sapiens
tctctccctctctgcctgacact

SEQ ID NO: 113138 - DNA, 20 bp, Homo sapiens
tcacagatgaggcagtggac

SEQ ID NO: 113139 - DNA, 23 bp, Homo sapiens
ggtgtgagaggctgtgactgagg

SEQ ID NO: 113140 - DNA, 23 bp, Homo sapiens
acactgaacactcacagcactct

SEQ ID NO: 113141 - DNA, 23 bp, Homo sapiens
tgggttgtgtctctgtctggggc

SEQ ID NO: 113142 - DNA, 23 bp, Homo sapiens
tagagtttgactgtattagtaaa

SEQ ID NO: 113143 - DNA, 23 bp, Homo sapiens
ttgcatgcagtgaaaactctgtc

SEQ ID NO: 113144 - DNA, 20 bp, Homo sapiens
tttgtgaagtgtataagatc

SEQ ID NO: 113145 - DNA, 22 bp, Homo sapiens
tattgccccagtgtttgttgtc

SEQ ID NO: 113146 - DNA, 23 bp, Homo sapiens
caatgatgagactgaggtcttgc

SEQ ID NO: 113147 - DNA, 23 bp, Homo sapiens
agtgtctgatgaagctctcaaag

SEQ ID NO: 113148 - DNA, 20 bp, Homo sapiens
acatgtgctgaaagtgcagg

SEQ ID NO: 113149 - DNA, 18 bp, Homo sapiens
agagactgccattccttt

SEQ ID NO: 113150 - DNA, 23 bp, Homo sapiens
gaagtcattattttctagtgtga

SEQ ID NO: 113151 - DNA, 19 bp, Homo sapiens
attattttagtggtcactg

SEQ ID NO: 113152 - DNA, 22 bp, Homo sapiens
atagcagttatagcattgtcaa

SEQ ID NO: 113153 - DNA, 20 bp, Homo sapiens
aggatatatatgtatatgtg

SEQ ID NO: 113154 - DNA, 23 bp, Homo sapiens
tcgtatgtatagtagcaggagct

SEQ ID NO: 113155 - DNA, 23 bp, Homo sapiens
ttttgagacggagtctctctctg

SEQ ID NO: 113156 - DNA, 23 bp, Homo sapiens
gtgtgactctgtgagtccctcac

SEQ ID NO: 113157 - DNA, 20 bp, Homo sapiens
acagagtttggctttttttt

SEQ ID NO: 113158 - DNA, 23 bp, Homo sapiens
ataatgtctgcatttatattgat

SEQ ID NO: 113159 - DNA, 19 bp, Homo sapiens
cagtgacctttggatttgg

SEQ ID NO: 113160 - DNA, 22 bp, Homo sapiens
acagaagtcacagaggtcttga

SEQ ID NO: 113161 - DNA, 22 bp, Homo sapiens
ggagagagatgtcagtctgaac

SEQ ID NO: 113162 - DNA, 21 bp, Homo sapiens
aaatagctgcatttagtctta

SEQ ID NO: 113163 - DNA, 22 bp, Homo sapiens
atgtgtatatatatgtatgtat

SEQ ID NO: 113164 - DNA, 23 bp, Homo sapiens
ctctgcctctgtccgtctctgcc

SEQ ID NO: 113165 - DNA, 23 bp, Homo sapiens
ctctgtgtcacactgcctctctt

SEQ ID NO: 113166 - DNA, 23 bp, Homo sapiens
gacagagtctcgctctgtcaccc

SEQ ID NO: 113167 - DNA, 23 bp, Homo sapiens
acagagtctcgctctgtcaccca

SEQ ID NO: 113168 - DNA, 23 bp, Homo sapiens
tgagtggttttgcattgtgtctt

SEQ ID NO: 113169 - DNA, 23 bp, Homo sapiens
cggagtctcactctgtcacccag

SEQ ID NO: 113170 - DNA, 21 bp, Homo sapiens
ttaattgtttttataaaaggg

SEQ ID NO: 113171 - DNA, 22 bp, Homo sapiens
atgtgatcttggataggttagt

SEQ ID NO: 113172 - DNA, 21 bp, Homo sapiens
tctcaccctgtcacccaggct

SEQ ID NO: 113173 - DNA, 23 bp, Homo sapiens
tgtctgtgtagaaagtagaagac

SEQ ID NO: 113174 - DNA, 23 bp, Homo sapiens
tccgagtctctgtgtgactgggc

SEQ ID NO: 113175 - DNA, 18 bp, Homo sapiens
tttgtcgttcttggatgt

SEQ ID NO: 113176 - DNA, 22 bp, Homo sapiens
tttgtgttacctgctcttactc

SEQ ID NO: 113177 - DNA, 23 bp, Homo sapiens
tcatgaagtctcactctgtcacc

SEQ ID NO: 113178 - DNA, 23 bp, Homo sapiens
caagtgctctctctctctgtctg

SEQ ID NO: 113179 - DNA, 18 bp, Homo sapiens
tgtggactgcaggtgctg

SEQ ID NO: 113180 - DNA, 23 bp, Homo sapiens
tccctgtctctgagtctttctgg

SEQ ID NO: 113181 - DNA, 20 bp, Homo sapiens
atctgttaagattttgatct

SEQ ID NO: 113182 - DNA, 22 bp, Homo sapiens
tcttcctggttggtgaatggat

SEQ ID NO: 113183 - DNA, 18 bp, Homo sapiens
tcagagggcagagtgaga

SEQ ID NO: 113184 - DNA, 19 bp, Homo sapiens
ttcaggtagatacaggatt

SEQ ID NO: 113185 - DNA, 21 bp, Homo sapiens
acagatcttaaaatatgatgc

SEQ ID NO: 113186 - DNA, 23 bp, Homo sapiens
gtatagtgtattagttttctgtt

SEQ ID NO: 113187 - DNA, 19 bp, Homo sapiens
tctttattaatgtaggtat

SEQ ID NO: 113188 - DNA, 23 bp, Homo sapiens
tggtataaactctgagtgatgat

SEQ ID NO: 113189 - DNA, 19 bp, Homo sapiens
ataggtagataggtgatag

SEQ ID NO: 113190 - DNA, 20 bp, Homo sapiens
acatcctgcatcactcactg

SEQ ID NO: 113191 - DNA, 23 bp, Homo sapiens
tgtatatatgtatgctatatata

SEQ ID NO: 113192 - DNA, 23 bp, Homo sapiens
tgtgatgtgtgagtttctttatt

SEQ ID NO: 113193 - DNA, 23 bp, Homo sapiens
aatcctcacattttctttggttt

SEQ ID NO: 113194 - DNA, 23 bp, Homo sapiens
tatattgaaactggtttggtagc

SEQ ID NO: 113195 - DNA, 23 bp, Homo sapiens
tgcaggaaaagtatgccttatga

SEQ ID NO: 113196 - DNA, 23 bp, Homo sapiens
tcttgtgagacttactcactgtc

SEQ ID NO: 113197 - DNA, 20 bp, Homo sapiens
tttctgagaagccagctgcc

SEQ ID NO: 113198 - DNA, 22 bp, Homo sapiens
ttttgagcttccttagggagag

SEQ ID NO: 113199 - DNA, 23 bp, Homo sapiens
tcattgcttttgaattgatgagc

SEQ ID NO: 113200 - DNA, 23 bp, Homo sapiens
tgagacggagtctcgctctgtca

SEQ ID NO: 113201 - DNA, 22 bp, Homo sapiens
acaagtgctgaatgtgcaggtt

SEQ ID NO: 113202 - DNA, 22 bp, Homo sapiens
tatatgtgtatatatatgtgtg

SEQ ID NO: 113203 - DNA, 23 bp, Homo sapiens
tatgtgtttgtgtggttagcatg

SEQ ID NO: 113204 - DNA, 23 bp, Homo sapiens
atcttgtatgaattcatatgaaa

SEQ ID NO: 113205 - DNA, 22 bp, Homo sapiens
agttggtgcaaatgttttgcga

SEQ ID NO: 113206 - DNA, 23 bp, Homo sapiens
tgagtctcactctgtcatttagg

SEQ ID NO: 113207 - DNA, 22 bp, Homo sapiens
tctttctctgtttcttattcag

SEQ ID NO: 113208 - DNA, 19 bp, Homo sapiens
ccacaacatggctgtctca

SEQ ID NO: 113209 - DNA, 20 bp, Homo sapiens
tggcagtgactttttctttt

SEQ ID NO: 113210 - DNA, 21 bp, Homo sapiens
tgaggcagagagtttcatgta

SEQ ID NO: 113211 - DNA, 18 bp, Homo sapiens
tgagtcttgccacctggt

SEQ ID NO: 113212 - DNA, 23 bp, Homo sapiens
aagagcatttgtttccagttttg

SEQ ID NO: 113213 - DNA, 23 bp, Homo sapiens
tgtatgtgtatatatatagttgt

SEQ ID NO: 113214 - DNA, 19 bp, Homo sapiens
tctcacattttctgtttgg

SEQ ID NO: 113215 - DNA, 23 bp, Homo sapiens
tctgagacagtgtgtgaacctgg

SEQ ID NO: 113216 - DNA, 23 bp, Homo sapiens
tgtctgtcagtgtctatagtgag

SEQ ID NO: 113217 - DNA, 20 bp, Homo sapiens
ttagcattttttgttgttca

SEQ ID NO: 113218 - DNA, 18 bp, Homo sapiens
tgagagctagcatttctg

SEQ ID NO: 113219 - DNA, 21 bp, Homo sapiens
aaagatcttccatatagtgtt

SEQ ID NO: 113220 - DNA, 18 bp, Homo sapiens
atgtgtatatacacatgt

SEQ ID NO: 113221 - DNA, 23 bp, Homo sapiens
aatctttttttaatggagtgaaa

SEQ ID NO: 113222 - DNA, 23 bp, Homo sapiens
tatatgtatatatatgtatgtgt

SEQ ID NO: 113223 - DNA, 23 bp, Homo sapiens
tatatgtatatatatgtatgtgt

SEQ ID NO: 113224 - DNA, 23 bp, Homo sapiens
tatatgtatatatatgtatgtgt

SEQ ID NO: 113225 - DNA, 22 bp, Homo sapiens
tatatgtatatatatgtatgtg

SEQ ID NO: 113226 - DNA, 22 bp, Homo sapiens
acacacacacatatacatatac

SEQ ID NO: 113227 - DNA, 23 bp, Homo sapiens
atatatgtatatgtatacatata

SEQ ID NO: 113228 - DNA, 21 bp, Homo sapiens
tatagcatatatatagcatac

SEQ ID NO: 113229 - DNA, 19 bp, Homo sapiens
agtgttgggtgtaagtatt

SEQ ID NO: 113230 - DNA, 23 bp, Homo sapiens
gttgacagcttcatcattgcatt

SEQ ID NO: 113231 - DNA, 23 bp, Homo sapiens
tggctgcctgcctctttgcacct

SEQ ID NO: 113232 - DNA, 22 bp, Homo sapiens
tctaggtgccacaagatgaaga

SEQ ID NO: 113233 - DNA, 21 bp, Homo sapiens
agggtcagacagacttcctgg

SEQ ID NO: 113234 - DNA, 22 bp, Homo sapiens
aattcagtggatttttcttaat

SEQ ID NO: 113235 - DNA, 21 bp, Homo sapiens
atgagagaagaaacattgcac

SEQ ID NO: 113236 - DNA, 20 bp, Homo sapiens
tgtatatatgtatatatgtg

SEQ ID NO: 113237 - DNA, 21 bp, Homo sapiens
tataggtgtatataggtatat

SEQ ID NO: 113238 - DNA, 22 bp, Homo sapiens
tgttatgtatattatgttagat

SEQ ID NO: 113239 - DNA, 21 bp, Homo sapiens
acagagtctcgctttgtcgct

SEQ ID NO: 113240 - DNA, 21 bp, Homo sapiens
taatacatgcaaatggtatga

SEQ ID NO: 113241 - DNA, 21 bp, Homo sapiens
tcactgcagtctctgtctccc

SEQ ID NO: 113242 - DNA, 23 bp, Homo sapiens
tgtgtgtatatatatatatgtgt

SEQ ID NO: 113243 - DNA, 22 bp, Homo sapiens
tttcaccatgttggccagggtg

SEQ ID NO: 113244 - DNA, 23 bp, Homo sapiens
cggagtctcactctgtcacccag

SEQ ID NO: 113245 - DNA, 23 bp, Homo sapiens
tccctgtgagaggagcagagggt

SEQ ID NO: 113246 - DNA, 23 bp, Homo sapiens
ttagggtcaggatcagatctagc

SEQ ID NO: 113247 - DNA, 23 bp, Homo sapiens
ttttttgagacagagtatctctc

SEQ ID NO: 113248 - DNA, 23 bp, Homo sapiens
tatgtgcatgtcatatgtatatg

SEQ ID NO: 113249 - DNA, 23 bp, Homo sapiens
ggagtgtcactctgtctctcagg

SEQ ID NO: 113250 - DNA, 20 bp, Homo sapiens
tactatatatatgtgtatgt

SEQ ID NO: 113251 - DNA, 21 bp, Homo sapiens
tatacacacatgtatatatgt

SEQ ID NO: 113252 - DNA, 19 bp, Homo sapiens
tgtggatgcaagtgtgtgt

SEQ ID NO: 113253 - DNA, 22 bp, Homo sapiens
ttgctgcagcatctgcatcctg

SEQ ID NO: 113254 - DNA, 23 bp, Homo sapiens
tctgttgcagcatctgcatcctg

SEQ ID NO: 113255 - DNA, 23 bp, Homo sapiens
tctcagtatctctgacacctcac

SEQ ID NO: 113256 - DNA, 21 bp, Homo sapiens
acaacagggattagaggagct

SEQ ID NO: 113257 - DNA, 23 bp, Homo sapiens
actttgtctctctcagtgaggcc

SEQ ID NO: 113258 - DNA, 22 bp, Homo sapiens
tcacggcctgtgtgtctctcac

SEQ ID NO: 113259 - DNA, 23 bp, Homo sapiens
gtccctcactctgtctctttagg

SEQ ID NO: 113260 - DNA, 23 bp, Homo sapiens
ttctgcagctgttttgtcaccat

SEQ ID NO: 113261 - DNA, 23 bp, Homo sapiens
tctgagaacagagccagcacaga

SEQ ID NO: 113262 - DNA, 23 bp, Homo sapiens
gccaggcacactctgaccctctc

SEQ ID NO: 113263 - DNA, 20 bp, Homo sapiens
agagtgtttgctttgtgttg

SEQ ID NO: 113264 - DNA, 23 bp, Homo sapiens
actctgtcataggcagtgttcag

SEQ ID NO: 113265 - DNA, 23 bp, Homo sapiens
tgagtgatcacagtgagcccttg

SEQ ID NO: 113266 - DNA, 23 bp, Homo sapiens
cagggtctctctctctctctctc

SEQ ID NO: 113267 - DNA, 22 bp, Homo sapiens
attgagctcgctgtctgaggga

SEQ ID NO: 113268 - DNA, 23 bp, Homo sapiens
ctctctcacactggcagtttaca

SEQ ID NO: 113269 - DNA, 23 bp, Homo sapiens
gagacacagtctcactctgttgc

SEQ ID NO: 113270 - DNA, 22 bp, Homo sapiens
gaccaatacaacagagctgatt

SEQ ID NO: 113271 - DNA, 23 bp, Homo sapiens
tggagtctcactctgtcacccag

SEQ ID NO: 113272 - DNA, 21 bp, Homo sapiens
tgatctctgaggttcctttca

SEQ ID NO: 113273 - DNA, 23 bp, Homo sapiens
tgagacggagactcactctgtca

SEQ ID NO: 113274 - DNA, 20 bp, Homo sapiens
tcacagttgacagagagctg

SEQ ID NO: 113275 - DNA, 23 bp, Homo sapiens
ttctctgtttcttaatctgagtc

SEQ ID NO: 113276 - DNA, 21 bp, Homo sapiens
cagaaagtctgggaactattg

SEQ ID NO: 113277 - DNA, 23 bp, Homo sapiens
agttgtcactgactctctgattt

SEQ ID NO: 113278 - DNA, 23 bp, Homo sapiens
ggtgggtctgtgactgcctgtct

SEQ ID NO: 113279 - DNA, 23 bp, Homo sapiens
aaaagacagtacagtcacagctc

SEQ ID NO: 113280 - DNA, 23 bp, Homo sapiens
atatgtgtatatatattcgtacg

SEQ ID NO: 113281 - DNA, 23 bp, Homo sapiens
gacagagtctcgctctgtcaccc

SEQ ID NO: 113282 - DNA, 18 bp, Homo sapiens
atatgtatacatacatac

SEQ ID NO: 113283 - DNA, 23 bp, Homo sapiens
ggtgagtctcactctgtcgccca

SEQ ID NO: 113284 - DNA, 22 bp, Homo sapiens
tttgtctattgactatgtctag

SEQ ID NO: 113285 - DNA, 18 bp, Homo sapiens
agacactggatatgttct

SEQ ID NO: 113286 - DNA, 23 bp, Homo sapiens
tcagatgactgagagctctcctt

SEQ ID NO: 113287 - DNA, 20 bp, Homo sapiens
taaaaatgacattttgttct

SEQ ID NO: 113288 - DNA, 23 bp, Homo sapiens
tatgtgtgcttgtgcatgtgcat

SEQ ID NO: 113289 - DNA, 23 bp, Homo sapiens
tgagttcattgtagattctggat

SEQ ID NO: 113290 - DNA, 23 bp, Homo sapiens
tgagttcattgtagattctggat

SEQ ID NO: 113291 - DNA, 20 bp, Homo sapiens
tatctatatatgtatatatg

SEQ ID NO: 113292 - DNA, 23 bp, Homo sapiens
acagcacagcctactgacgcggt

SEQ ID NO: 113293 - DNA, 19 bp, Homo sapiens
tatactatatatgatatac

SEQ ID NO: 113294 - DNA, 23 bp, Homo sapiens
catgcacacacacatgtgcgtgc

SEQ ID NO: 113295 - DNA, 23 bp, Homo sapiens
atgtgtgtagatgtatgtatgtg

SEQ ID NO: 113296 - DNA, 21 bp, Homo sapiens
attgcttcaagagagggtctt

SEQ ID NO: 113297 - DNA, 22 bp, Homo sapiens
cttttccatttgatttcagtgt

SEQ ID NO: 113298 - DNA, 19 bp, Homo sapiens
tgagcctgataggctgggt

SEQ ID NO: 113299 - DNA, 23 bp, Homo sapiens
ctcacagtgtcactcagtaaata

SEQ ID NO: 113300 - DNA, 23 bp, Homo sapiens
tatgtgcttgtgtatgtgtgtgt

SEQ ID NO: 113301 - DNA, 23 bp, Homo sapiens
acattacattgttcattcagagg

SEQ ID NO: 113302 - DNA, 21 bp, Homo sapiens
agcgtgtattgtttcctgact

SEQ ID NO: 113303 - DNA, 22 bp, Homo sapiens
acatgtgcacattgtgcaggtt

SEQ ID NO: 113304 - DNA, 23 bp, Homo sapiens
tgagttcattgtagattctggat

SEQ ID NO: 113305 - DNA, 23 bp, Homo sapiens
tgagttcattgtagattctggat

SEQ ID NO: 113306 - DNA, 23 bp, Homo sapiens
gtattctgacctggaaactgtct

SEQ ID NO: 113307 - DNA, 23 bp, Homo sapiens
ctgatgatgcaatagaaaagaat

SEQ ID NO: 113308 - DNA, 23 bp, Homo sapiens
agtgagagagacagagtgaggga

SEQ ID NO: 113309 - DNA, 19 bp, Homo sapiens
gtgcaatatataatagtat

SEQ ID NO: 113310 - DNA, 21 bp, Homo sapiens
atgtgtgtgtatgtatatcta

SEQ ID NO: 113311 - DNA, 23 bp, Homo sapiens
tggagtctcactctgtcacccag

SEQ ID NO: 113312 - DNA, 23 bp, Homo sapiens
tcttaactcaggctgcttagagc

SEQ ID NO: 113313 - DNA, 23 bp, Homo sapiens
tataatttgtataactatagata

SEQ ID NO: 113314 - DNA, 23 bp, Homo sapiens
gtgtttactgagtcggtgggtat

SEQ ID NO: 113315 - DNA, 20 bp, Homo sapiens
cactgactcagtgaacgcac

SEQ ID NO: 113316 - DNA, 19 bp, Homo sapiens
attctatttatatagtaca

SEQ ID NO: 113317 - DNA, 23 bp, Homo sapiens
gcctgtgtgtgtctctgcatgtg

SEQ ID NO: 113318 - DNA, 23 bp, Homo sapiens
acacagcacactgatgggtcttg

SEQ ID NO: 113319 - DNA, 21 bp, Homo sapiens
tatgtgtgtatatatatatga

SEQ ID NO: 113320 - DNA, 21 bp, Homo sapiens
tggaatttaaagtagtttttt

SEQ ID NO: 113321 - DNA, 23 bp, Homo sapiens
ttaagtttgaatagcattccatt

SEQ ID NO: 113322 - DNA, 23 bp, Homo sapiens
acaaggtaggataggaaatgtag

SEQ ID NO: 113323 - DNA, 21 bp, Homo sapiens
tcatatctaatgtagataata

SEQ ID NO: 113324 - DNA, 23 bp, Homo sapiens
tttagaagtgattttgttgatgt

SEQ ID NO: 113325 - DNA, 22 bp, Homo sapiens
acaagtgtattcttccaaagag

SEQ ID NO: 113326 - DNA, 23 bp, Homo sapiens
tgctattgtcaatgtttgccctc

SEQ ID NO: 113327 - DNA, 23 bp, Homo sapiens
aaatggctatggtagaactgaga

SEQ ID NO: 113328 - DNA, 23 bp, Homo sapiens
tgtgatgcatttggaatcattgt

SEQ ID NO: 113329 - DNA, 22 bp, Homo sapiens
taattctgaaattgttcatgtg

SEQ ID NO: 113330 - DNA, 19 bp, Homo sapiens
ttctgtgaagagagtcaat

SEQ ID NO: 113331 - DNA, 23 bp, Homo sapiens
tatacacatgtatacatgtaaac

SEQ ID NO: 113332 - DNA, 20 bp, Homo sapiens
atatatacatgtatacatgt

SEQ ID NO: 113333 - DNA, 23 bp, Homo sapiens
tgtgtatatatgtatgtgtgtgt

SEQ ID NO: 113334 - DNA, 23 bp, Homo sapiens
agaaactcagagcatgttcttta

SEQ ID NO: 113335 - DNA, 22 bp, Homo sapiens
cagtgtctcactctgtcactca

SEQ ID NO: 113336 - DNA, 22 bp, Homo sapiens
ttcattagtcacaatagagatg

SEQ ID NO: 113337 - DNA, 23 bp, Homo sapiens
atgtgtatatatatgtatgtgta

SEQ ID NO: 113338 - DNA, 23 bp, Homo sapiens
tgtatgtatgtatgtagttctct

SEQ ID NO: 113339 - DNA, 19 bp, Homo sapiens
tttggaaattatttcaaag

SEQ ID NO: 113340 - DNA, 23 bp, Homo sapiens
tgaatgagtagatatgtgaaaga

SEQ ID NO: 113341 - DNA, 19 bp, Homo sapiens
agaggaggatcacttgagg

SEQ ID NO: 113342 - DNA, 23 bp, Homo sapiens
agggactgttttgttattcttgt

SEQ ID NO: 113343 - DNA, 23 bp, Homo sapiens
tgagttcattgtagattctggat

SEQ ID NO: 113344 - DNA, 23 bp, Homo sapiens
tgagttcattgtagattctggat

SEQ ID NO: 113345 - DNA, 21 bp, Homo sapiens
ttgtgtgtgtgtatacactta

SEQ ID NO: 113346 - DNA, 19 bp, Homo sapiens
atgtgtgtgtgtgtgtgtg

SEQ ID NO: 113347 - DNA, 21 bp, Homo sapiens
tttcccagaggttttgttcat

SEQ ID NO: 113348 - DNA, 23 bp, Homo sapiens
tgagttcattgtagattctggat

SEQ ID NO: 113349 - DNA, 23 bp, Homo sapiens
tgagttcattgtagattctggat

SEQ ID NO: 113350 - DNA, 18 bp, Homo sapiens
actgcaccatcattagag

SEQ ID NO: 113351 - DNA, 19 bp, Homo sapiens
atatggtcttatagtatgg

SEQ ID NO: 113352 - DNA, 21 bp, Homo sapiens
ttcaaaacttattcattggtg

SEQ ID NO: 113353 - DNA, 21 bp, Homo sapiens
tatacacacacatatagatat

SEQ ID NO: 113354 - DNA, 23 bp, Homo sapiens
aaacaagtggaaatcatttttat

SEQ ID NO: 113355 - DNA, 23 bp, Homo sapiens
acaatgactatgattatacttac

SEQ ID NO: 113356 - DNA, 20 bp, Homo sapiens
ctcttgtgattatattgtac

SEQ ID NO: 113357 - DNA, 22 bp, Homo sapiens
tataggtatatatatatatgta

SEQ ID NO: 113358 - DNA, 23 bp, Homo sapiens
ctctctctgtgtgtgtgctcctg

SEQ ID NO: 113359 - DNA, 21 bp, Homo sapiens
gacagcaattatatagaatta

SEQ ID NO: 113360 - DNA, 23 bp, Homo sapiens
tgagttcattgtagattctggat

SEQ ID NO: 113361 - DNA, 23 bp, Homo sapiens
tgagttcattgtagattctggat

SEQ ID NO: 113362 - DNA, 23 bp, Homo sapiens
agtcagagtctcgctctgtcacc

SEQ ID NO: 113363 - DNA, 18 bp, Homo sapiens
tacaatcctactgtgtct

SEQ ID NO: 113364 - DNA, 20 bp, Homo sapiens
atactgtctttctcactctc

SEQ ID NO: 113365 - DNA, 23 bp, Homo sapiens
ttcctaaactctgtaacactcac

SEQ ID NO: 113366 - DNA, 22 bp, Homo sapiens
atatttgtatacattggtatat

SEQ ID NO: 113367 - DNA, 23 bp, Homo sapiens
tggagtctcactctgtcacccag

SEQ ID NO: 113368 - DNA, 18 bp, Homo sapiens
gttgtctcaaataatcct

SEQ ID NO: 113369 - DNA, 23 bp, Homo sapiens
aactgtgcttaagatttcacata

SEQ ID NO: 113370 - DNA, 22 bp, Homo sapiens
ttcttatctaagtgatctgttt

SEQ ID NO: 113371 - DNA, 20 bp, Homo sapiens
ttgtttggaaaatgagcaca

SEQ ID NO: 113372 - DNA, 23 bp, Homo sapiens
aagtgaactagtgaaagggaaga

SEQ ID NO: 113373 - DNA, 21 bp, Homo sapiens
actctcagtgacacacttggg

SEQ ID NO: 113374 - DNA, 23 bp, Homo sapiens
cattctggtttcagtggaaagtg

SEQ ID NO: 113375 - DNA, 19 bp, Homo sapiens
gtaaaacgtctacaaggag

SEQ ID NO: 113376 - DNA, 19 bp, Homo sapiens
tgaggtaggaggatcactt

SEQ ID NO: 113377 - DNA, 23 bp, Homo sapiens
attgtcaatgaaatagttgattg

SEQ ID NO: 113378 - DNA, 19 bp, Homo sapiens
atatatatgtatgctgata

SEQ ID NO: 113379 - DNA, 20 bp, Homo sapiens
atgtatgtggaagcaatatg

SEQ ID NO: 113380 - DNA, 23 bp, Homo sapiens
tgggttggaattcttttctctct

SEQ ID NO: 113381 - DNA, 23 bp, Homo sapiens
tttgagacggagtctcattctgt

SEQ ID NO: 113382 - DNA, 19 bp, Homo sapiens
tgagatggagtctcactct

SEQ ID NO: 113383 - DNA, 23 bp, Homo sapiens
tcagtctggcagacaattggcag

SEQ ID NO: 113384 - DNA, 19 bp, Homo sapiens
ctctctctctcaggctcac

SEQ ID NO: 113385 - DNA, 18 bp, Homo sapiens
agtatgaagagagtgagc

SEQ ID NO: 113386 - DNA, 19 bp, Homo sapiens
acagggtgcattttttttt

SEQ ID NO: 113387 - DNA, 23 bp, Homo sapiens
gacagtctcactctgtcacccag

SEQ ID NO: 113388 - DNA, 21 bp, Homo sapiens
tctctaggtgtgccagtcatc

SEQ ID NO: 113389 - DNA, 23 bp, Homo sapiens
tggagtctcactctgtcacccag

SEQ ID NO: 113390 - DNA, 23 bp, Homo sapiens
gcaatggtgtgatcttggctcac

SEQ ID NO: 113391 - DNA, 23 bp, Homo sapiens
atctcagttgaccgagagctttc

SEQ ID NO: 113392 - DNA, 23 bp, Homo sapiens
agagatgctatgttcatagatta

SEQ ID NO: 113393 - DNA, 18 bp, Homo sapiens
aatgcaattcttatcaaa

SEQ ID NO: 113394 - DNA, 23 bp, Homo sapiens
attgtctgcctcacttcactagt

SEQ ID NO: 113395 - DNA, 22 bp, Homo sapiens
tggaatcttaagctgtatggtg

SEQ ID NO: 113396 - DNA, 23 bp, Homo sapiens
tcagctttaattctctgtttcct

SEQ ID NO: 113397 - DNA, 22 bp, Homo sapiens
gtaggctgtgtggataggaggt

SEQ ID NO: 113398 - DNA, 23 bp, Homo sapiens
gacaaggtctcactgtctcccag

SEQ ID NO: 113399 - DNA, 23 bp, Homo sapiens
gactgagtctcgctctgtcaccc

SEQ ID NO: 113400 - DNA, 23 bp, Homo sapiens
atgagaggaggcaagtgtgatgg

SEQ ID NO: 113401 - DNA, 23 bp, Homo sapiens
tcagcccttctaagtgtctctct

SEQ ID NO: 113402 - DNA, 23 bp, Homo sapiens
gacagagtctcgctctgtcaccc

SEQ ID NO: 113403 - DNA, 19 bp, Homo sapiens
tttctgcattgtctttctg

SEQ ID NO: 113404 - DNA, 22 bp, Homo sapiens
gataatgatgatgatgatgatg

SEQ ID NO: 113405 - DNA, 23 bp, Homo sapiens
tgtcacacacggcctgagtgcct

SEQ ID NO: 113406 - DNA, 23 bp, Homo sapiens
tggagtctcactctgtcacccag

SEQ ID NO: 113407 - DNA, 23 bp, Homo sapiens
tgaagtcagaagtttgagaccag

SEQ ID NO: 113408 - DNA, 23 bp, Homo sapiens
tgagacggagtctcactctgtcg

SEQ ID NO: 113409 - DNA, 23 bp, Homo sapiens
tgcacagagtgctagtaggttct

SEQ ID NO: 113410 - DNA, 23 bp, Homo sapiens
tagagtggtctttttgttgttga

SEQ ID NO: 113411 - DNA, 19 bp, Homo sapiens
tgagttcttaaatgaattg

SEQ ID NO: 113412 - DNA, 23 bp, Homo sapiens
taggtacatattcatggagtatg

SEQ ID NO: 113413 - DNA, 19 bp, Homo sapiens
tgagttcttaaatgaattg

SEQ ID NO: 113414 - DNA, 23 bp, Homo sapiens
taggtacatattcatggagtatg

SEQ ID NO: 113415 - DNA, 22 bp, Homo sapiens
taattaaaggtaagtaaagaat

SEQ ID NO: 113416 - DNA, 20 bp, Homo sapiens
ctgcagtggaactaagtttt

SEQ ID NO: 113417 - DNA, 23 bp, Homo sapiens
tctacctgtctgtctcactagtt

SEQ ID NO: 113418 - DNA, 22 bp, Homo sapiens
aggcagccagtggaactggaga

SEQ ID NO: 113419 - DNA, 19 bp, Homo sapiens
tgagccaccatgcctggct

SEQ ID NO: 113420 - DNA, 22 bp, Homo sapiens
agacagaagtgggggtgcacag

SEQ ID NO: 113421 - DNA, 21 bp, Homo sapiens
aagaagtcttactttttagag

SEQ ID NO: 113422 - DNA, 23 bp, Homo sapiens
tttttagttcttcaggtgattgt

SEQ ID NO: 113423 - DNA, 23 bp, Homo sapiens
tatatagttttccaggaaagcat

SEQ ID NO: 113424 - DNA, 21 bp, Homo sapiens
aagaagtcttactttttagag

SEQ ID NO: 113425 - DNA, 22 bp, Homo sapiens
tatatatttgttgttgtcgttg

SEQ ID NO: 113426 - DNA, 23 bp, Homo sapiens
agttaggctttgtttactctttg

SEQ ID NO: 113427 - DNA, 23 bp, Homo sapiens
atatacacacacatatatatgtg

SEQ ID NO: 113428 - DNA, 23 bp, Homo sapiens
acaagaggaacactctggaaatg

SEQ ID NO: 113429 - DNA, 21 bp, Homo sapiens
tgtgtgtgcatgtgtatctgc

SEQ ID NO: 113430 - DNA, 19 bp, Homo sapiens
gtatgtgtaaatgcacctg

SEQ ID NO: 113431 - DNA, 23 bp, Homo sapiens
caatgagcttgacatagaggtga

SEQ ID NO: 113432 - DNA, 23 bp, Homo sapiens
tttggcacgcagagaatggcaaa

SEQ ID NO: 113433 - DNA, 23 bp, Homo sapiens
tacagtagtgtggtcattggaat

SEQ ID NO: 113434 - DNA, 23 bp, Homo sapiens
tgtcacgctgtgtcacagaggag

SEQ ID NO: 113435 - DNA, 21 bp, Homo sapiens
tgactagctccatgaaaggct

SEQ ID NO: 113436 - DNA, 23 bp, Homo sapiens
tgtgcagtgatgagattgcagct

SEQ ID NO: 113437 - DNA, 23 bp, Homo sapiens
atgaggtatcattatgttgtcca

SEQ ID NO: 113438 - DNA, 23 bp, Homo sapiens
ttctgtgaagaaagtcaatggta

SEQ ID NO: 113439 - DNA, 23 bp, Homo sapiens
tcaggatctcactctgtcactca

SEQ ID NO: 113440 - DNA, 22 bp, Homo sapiens
tgcactctggctcagttctgca

SEQ ID NO: 113441 - DNA, 23 bp, Homo sapiens
ggtctgtgggtgagagaggggca

SEQ ID NO: 113442 - DNA, 23 bp, Homo sapiens
atctctgactgtctatctacaca

SEQ ID NO: 113443 - DNA, 23 bp, Homo sapiens
tagatacgtagctattgagatat

SEQ ID NO: 113444 - DNA, 21 bp, Homo sapiens
acagtactctgtgtgtattgt

SEQ ID NO: 113445 - DNA, 23 bp, Homo sapiens
atatgtgcatatatgtatatatg

SEQ ID NO: 113446 - DNA, 23 bp, Homo sapiens
tttttagatgcatttcaaagggc

SEQ ID NO: 113447 - DNA, 19 bp, Homo sapiens
tgtgtttatatatatgtca

SEQ ID NO: 113448 - DNA, 23 bp, Homo sapiens
tacattgtatatgttgtgtatat

SEQ ID NO: 113449 - DNA, 19 bp, Homo sapiens
atctgaatgagtttctcct

SEQ ID NO: 113450 - DNA, 23 bp, Homo sapiens
cagaccactcactctgtcactct

SEQ ID NO: 113451 - DNA, 23 bp, Homo sapiens
atatgtatatatgtatatgtgta

SEQ ID NO: 113452 - DNA, 22 bp, Homo sapiens
caatctgtgttttactgaatgg

SEQ ID NO: 113453 - DNA, 23 bp, Homo sapiens
tgagttcattgtagattctggat

SEQ ID NO: 113454 - DNA, 23 bp, Homo sapiens
tgagttcattgtagattctggat

SEQ ID NO: 113455 - DNA, 22 bp, Homo sapiens
tcagatgatcctgagaaaggga

SEQ ID NO: 113456 - DNA, 20 bp, Homo sapiens
aggggctcagatttttttct

SEQ ID NO: 113457 - DNA, 23 bp, Homo sapiens
agatagagttttgctcttgtcac

SEQ ID NO: 113458 - DNA, 21 bp, Homo sapiens
tatgtgtatatatgtatatgt

SEQ ID NO: 113459 - DNA, 23 bp, Homo sapiens
aatgtcactggtatttttgagaa

SEQ ID NO: 113460 - DNA, 18 bp, Homo sapiens
atgaccttggcagttctg

SEQ ID NO: 113461 - DNA, 23 bp, Homo sapiens
tggagtctcactctgtcacccag

SEQ ID NO: 113462 - DNA, 22 bp, Homo sapiens
cacagtctctgacacagccagg

SEQ ID NO: 113463 - DNA, 21 bp, Homo sapiens
ctgtgagaggaggaggaggag

SEQ ID NO: 113464 - DNA, 23 bp, Homo sapiens
acagagtctcgctctgtcaccca

SEQ ID NO: 113465 - DNA, 23 bp, Homo sapiens
cattgaaatagactgtgtttctc

SEQ ID NO: 113466 - DNA, 23 bp, Homo sapiens
tgagagtgaaacaacaggaactg

SEQ ID NO: 113467 - DNA, 23 bp, Homo sapiens
agagagtgctctgtgtgcttcag

SEQ ID NO: 113468 - DNA, 23 bp, Homo sapiens
gattcagcaacaggagctgcact

SEQ ID NO: 113469 - DNA, 22 bp, Homo sapiens
tctaaatgtgtgatcttttgag

SEQ ID NO: 113470 - DNA, 23 bp, Homo sapiens
actttacaacctagtctcagaag

SEQ ID NO: 113471 - DNA, 23 bp, Homo sapiens
gagtgtgtggatgttggtaattt

SEQ ID NO: 113472 - DNA, 22 bp, Homo sapiens
ttatcactttataaaacactca

SEQ ID NO: 113473 - DNA, 23 bp, Homo sapiens
gaagtctgtctctctctctgctt

SEQ ID NO: 113474 - DNA, 23 bp, Homo sapiens
tatatgtgtatatgtatatatgt

SEQ ID NO: 113475 - DNA, 23 bp, Homo sapiens
aatcagtttcttaatctgagtgt

SEQ ID NO: 113476 - DNA, 21 bp, Homo sapiens
ttagagcaatttgaggagggt

SEQ ID NO: 113477 - DNA, 23 bp, Homo sapiens
agacagggtctcactctgttgct

SEQ ID NO: 113478 - DNA, 23 bp, Homo sapiens
ttttgagacggagtcttgctctg

SEQ ID NO: 113479 - DNA, 20 bp, Homo sapiens
atggcactggatgtcaacag

SEQ ID NO: 113480 - DNA, 23 bp, Homo sapiens
tgttcatttgatgtagaagagaa

SEQ ID NO: 113481 - DNA, 20 bp, Homo sapiens
tagtggtgcatgtctgtggt

SEQ ID NO: 113482 - DNA, 23 bp, Homo sapiens
tcagctcactgaaacctctgcct

SEQ ID NO: 113483 - DNA, 23 bp, Homo sapiens
gagtctcactctgtcacccaggc

SEQ ID NO: 113484 - DNA, 23 bp, Homo sapiens
agattctggaatgtaaaggtgaa

SEQ ID NO: 113485 - DNA, 23 bp, Homo sapiens
ttctttttcactgagttaatttc

SEQ ID NO: 113486 - DNA, 23 bp, Homo sapiens
gatgagtagtgatgttgaacatc

SEQ ID NO: 113487 - DNA, 23 bp, Homo sapiens
tttgagacagggtctcactctgt

SEQ ID NO: 113488 - DNA, 23 bp, Homo sapiens
atgggagggactgtaatgacaca

SEQ ID NO: 113489 - DNA, 23 bp, Homo sapiens
ctctctgcctccctctctgcatg

SEQ ID NO: 113490 - DNA, 23 bp, Homo sapiens
aagtgagaactcagagacctgtt

SEQ ID NO: 113491 - DNA, 23 bp, Homo sapiens
tcacagaagatagagatgccttc

SEQ ID NO: 113492 - DNA, 23 bp, Homo sapiens
tcactctctgtttatcttaggga

SEQ ID NO: 113493 - DNA, 23 bp, Homo sapiens
gatttctctgcatatgtatgtaa

SEQ ID NO: 113494 - DNA, 23 bp, Homo sapiens
ctgtggaagaaatctctctcaat

SEQ ID NO: 113495 - DNA, 20 bp, Homo sapiens
atgctaatatgttgttgaga

SEQ ID NO: 113496 - DNA, 21 bp, Homo sapiens
tgtaaatgtatccatatcaat

SEQ ID NO: 113497 - DNA, 23 bp, Homo sapiens
caggtctcactctgtcacccagg

SEQ ID NO: 113498 - DNA, 23 bp, Homo sapiens
ttctccaggtgaaaaagaataaa

SEQ ID NO: 113499 - DNA, 19 bp, Homo sapiens
aatatctatatgtatatct

SEQ ID NO: 113500 - DNA, 23 bp, Homo sapiens
ataagtgtagagagtggagcttc

SEQ ID NO: 113501 - DNA, 20 bp, Homo sapiens
tatatgcataatatatgata

SEQ ID NO: 113502 - DNA, 22 bp, Homo sapiens
ttgtgtgtgtgtgtgtgtgact

SEQ ID NO: 113503 - DNA, 23 bp, Homo sapiens
cagtgatgtggaaatcttttcag

SEQ ID NO: 113504 - DNA, 20 bp, Homo sapiens
tggagtgcagtggctcgtct

SEQ ID NO: 113505 - DNA, 22 bp, Homo sapiens
tattaaatgtgctatagcattg

SEQ ID NO: 113506 - DNA, 23 bp, Homo sapiens
tgacttatgatgttgaacatctt

SEQ ID NO: 113507 - DNA, 23 bp, Homo sapiens
cccagtctgtgtgtgtgtgagtg

SEQ ID NO: 113508 - DNA, 23 bp, Homo sapiens
aaggagtaccttgtatagtttgg

SEQ ID NO: 113509 - DNA, 22 bp, Homo sapiens
tttcagaggccttttctgtgtt

SEQ ID NO: 113510 - DNA, 23 bp, Homo sapiens
agcacttaagaagcactccatga

SEQ ID NO: 113511 - DNA, 23 bp, Homo sapiens
ttcagtggaaatgttggtttatg

SEQ ID NO: 113512 - DNA, 23 bp, Homo sapiens
acatttgtctgggtttgcagctg

SEQ ID NO: 113513 - DNA, 23 bp, Homo sapiens
tgcctctctctgtgtatctggat

SEQ ID NO: 113514 - DNA, 23 bp, Homo sapiens
ctctgggtgagtcagtgagtgag

SEQ ID NO: 113515 - DNA, 23 bp, Homo sapiens
tgagttcattgtagattctggat

SEQ ID NO: 113516 - DNA, 23 bp, Homo sapiens
tgagttcattgtagattctggat

SEQ ID NO: 113517 - DNA, 23 bp, Homo sapiens
tatgggtatatatatgtatgtgt

SEQ ID NO: 113518 - DNA, 23 bp, Homo sapiens
tatgggtatatatatgtatgtgt

SEQ ID NO: 113519 - DNA, 23 bp, Homo sapiens
tatgggtatatatatgtatgtgt

SEQ ID NO: 113520 - DNA, 22 bp, Homo sapiens
tgtatgggtgtatatatgtatg

SEQ ID NO: 113521 - DNA, 23 bp, Homo sapiens
tatgggtatatatatgtatgtgt

SEQ ID NO: 113522 - DNA, 23 bp, Homo sapiens
tgggtgtatatatgtatgtgtag

SEQ ID NO: 113523 - DNA, 23 bp, Homo sapiens
atatgtatgggtatatatgggta

SEQ ID NO: 113524 - DNA, 23 bp, Homo sapiens
atatgtatgtatatgtatgcata

SEQ ID NO: 113525 - DNA, 23 bp, Homo sapiens
gtctcgcactctgtcacgctggc

SEQ ID NO: 113526 - DNA, 21 bp, Homo sapiens
aaatgaaatcacaggatagtc

SEQ ID NO: 113527 - DNA, 23 bp, Homo sapiens
tcagagcagagagacagcagagt

SEQ ID NO: 113528 - DNA, 23 bp, Homo sapiens
tttatggtgcatttagcagggtt

SEQ ID NO: 113529 - DNA, 22 bp, Homo sapiens
ctcactgtatgtgtctgggcat

SEQ ID NO: 113530 - DNA, 23 bp, Homo sapiens
agagtcttagtttgcattcaagt

SEQ ID NO: 113531 - DNA, 20 bp, Homo sapiens
aaggagtttgtttttctctg

SEQ ID NO: 113532 - DNA, 23 bp, Homo sapiens
tgtgagtgtgtgcaagtgtgtgc

SEQ ID NO: 113533 - DNA, 23 bp, Homo sapiens
caggatctcactctgtcactcag

SEQ ID NO: 113534 - DNA, 22 bp, Homo sapiens
tttttagtataagtatatgtaa

SEQ ID NO: 113535 - DNA, 23 bp, Homo sapiens
taagagatcattgagagctcatg

SEQ ID NO: 113536 - DNA, 23 bp, Homo sapiens
ttcacagatgtttggaatcagaa

SEQ ID NO: 113537 - DNA, 23 bp, Homo sapiens
tcacagtggtgactgtgctctga

SEQ ID NO: 113538 - DNA, 23 bp, Homo sapiens
atgggagacagaaaggatcctct

SEQ ID NO: 113539 - DNA, 23 bp, Homo sapiens
atgtgtatatatgtatgtgtgtg

SEQ ID NO: 113540 - DNA, 22 bp, Homo sapiens
agtctcattgtcttatcctacc

SEQ ID NO: 113541 - DNA, 20 bp, Homo sapiens
ttgacactggggaaggagca

SEQ ID NO: 113542 - DNA, 23 bp, Homo sapiens
gagacggagtctcactctgtcac

SEQ ID NO: 113543 - DNA, 23 bp, Homo sapiens
cggagtctcactctgtcacccag

SEQ ID NO: 113544 - DNA, 21 bp, Homo sapiens
ttgcaataaaaggaactgaca

SEQ ID NO: 113545 - DNA, 23 bp, Homo sapiens
gggtctcactctgtcacccaggc

SEQ ID NO: 113546 - DNA, 18 bp, Homo sapiens
ggacagaggtacttttct

SEQ ID NO: 113547 - DNA, 23 bp, Homo sapiens
tgagacagagtctcgctctgtca

SEQ ID NO: 113548 - DNA, 23 bp, Homo sapiens
tgagacagagtctcgctctgtca

SEQ ID NO: 113549 - DNA, 18 bp, Homo sapiens
tgagtccgtatctagtct

SEQ ID NO: 113550 - DNA, 23 bp, Homo sapiens
ataagagtaattgttaatttcta

SEQ ID NO: 113551 - DNA, 23 bp, Homo sapiens
cactgcctgtctctgtgttttga

SEQ ID NO: 113552 - DNA, 23 bp, Homo sapiens
tgagttcattgtagattctggat

SEQ ID NO: 113553 - DNA, 23 bp, Homo sapiens
tgagttcattgtagattctggat

SEQ ID NO: 113554 - DNA, 22 bp, Homo sapiens
taccacacccagctaagttaaa

SEQ ID NO: 113555 - DNA, 23 bp, Homo sapiens
ttttttgcttgtaattgctttgt

SEQ ID NO: 113556 - DNA, 23 bp, Homo sapiens
tctcactttttgtttctctagga

SEQ ID NO: 113557 - DNA, 22 bp, Homo sapiens
atatgtgcagaatgtgcagctt

SEQ ID NO: 113558 - DNA, 21 bp, Homo sapiens
tatttctgtatgttataaacc

SEQ ID NO: 113559 - DNA, 23 bp, Homo sapiens
taattgctttataaatcagttca

SEQ ID NO: 113560 - DNA, 19 bp, Homo sapiens
ccatatatatgtgtatgtg

SEQ ID NO: 113561 - DNA, 21 bp, Homo sapiens
attgtaaatgatatttcatag

SEQ ID NO: 113562 - DNA, 22 bp, Homo sapiens
tgtttgttacctgtgaactctg

SEQ ID NO: 113563 - DNA, 22 bp, Homo sapiens
tcagagctctcttctctctatg

SEQ ID NO: 113564 - DNA, 21 bp, Homo sapiens
tcagagctacactataggcta

SEQ ID NO: 113565 - DNA, 23 bp, Homo sapiens
tctgggtgcctggctgcctcttc

SEQ ID NO: 113566 - DNA, 23 bp, Homo sapiens
agtttctctcacaggctatgctc

SEQ ID NO: 113567 - DNA, 22 bp, Homo sapiens
acagccactgcaaatgaggaga

SEQ ID NO: 113568 - DNA, 23 bp, Homo sapiens
tctgtcacttagtctctaatggt

SEQ ID NO: 113569 - DNA, 22 bp, Homo sapiens
tgtgccctaagtgtctctctct

SEQ ID NO: 113570 - DNA, 23 bp, Homo sapiens
cagtctcgctctgtcacccggac

SEQ ID NO: 113571 - DNA, 23 bp, Homo sapiens
aaagacctttaactgcagctgta

SEQ ID NO: 113572 - DNA, 23 bp, Homo sapiens
ctcactctgtcactcaaactgga

SEQ ID NO: 113573 - DNA, 22 bp, Homo sapiens
ctgaggtaggaggatcacttga

SEQ ID NO: 113574 - DNA, 22 bp, Homo sapiens
taggagtacagtttgactttct

SEQ ID NO: 113575 - DNA, 22 bp, Homo sapiens
aagagagtcatactatttttgt

SEQ ID NO: 113576 - DNA, 18 bp, Homo sapiens
ttattttgtataagtatg

SEQ ID NO: 113577 - DNA, 21 bp, Homo sapiens
ttctccattatgatgagttgt

SEQ ID NO: 113578 - DNA, 23 bp, Homo sapiens
taattatttcattatgtattaca

SEQ ID NO: 113579 - DNA, 23 bp, Homo sapiens
aataaagtgcacaatagatgtaa

SEQ ID NO: 113580 - DNA, 23 bp, Homo sapiens
atatgtatagttgtagtttatcc

SEQ ID NO: 113581 - DNA, 23 bp, Homo sapiens
tgagttcattgtagattctggat

SEQ ID NO: 113582 - DNA, 23 bp, Homo sapiens
tgagttcattgtagattctggat

SEQ ID NO: 113583 - DNA, 23 bp, Homo sapiens
tgagttcattgtagattctggat

SEQ ID NO: 113584 - DNA, 23 bp, Homo sapiens
tgagttcattgtagattctggat

SEQ ID NO: 113585 - DNA, 23 bp, Homo sapiens
gtatgacttgtaattttcttctt

SEQ ID NO: 113586 - DNA, 23 bp, Homo sapiens
acaaggtctcactctgtcaccca

SEQ ID NO: 113587 - DNA, 23 bp, Homo sapiens
ttcttcttcttgagacagagtct

SEQ ID NO: 113588 - DNA, 19 bp, Homo sapiens
ctgctgctcaggctggagt

SEQ ID NO: 113589 - DNA, 23 bp, Homo sapiens
agacggagtctcgctctgtcacc

SEQ ID NO: 113590 - DNA, 23 bp, Homo sapiens
agtttctctctctgcctcagatc

SEQ ID NO: 113591 - DNA, 21 bp, Homo sapiens
agtgtggtggtgcatgtctgt

SEQ ID NO: 113592 - DNA, 23 bp, Homo sapiens
aaaaagcagctaaatttgtggat

SEQ ID NO: 113593 - DNA, 23 bp, Homo sapiens
tcactcagcctctccctctctgc

SEQ ID NO: 113594 - DNA, 23 bp, Homo sapiens
ccaagttgttgggactacaggca

SEQ ID NO: 113595 - DNA, 23 bp, Homo sapiens
tgtgagacgcagtctcgctctgt

SEQ ID NO: 113596 - DNA, 23 bp, Homo sapiens
tctctgggtgtctgggtggctcc

SEQ ID NO: 113597 - DNA, 20 bp, Homo sapiens
taaagatggagtctcactct

SEQ ID NO: 113598 - DNA, 23 bp, Homo sapiens
aggatatcagagtctcctgtctc

SEQ ID NO: 113599 - DNA, 23 bp, Homo sapiens
agaagagtgatgagtgtcaggag

SEQ ID NO: 113600 - DNA, 23 bp, Homo sapiens
tagcaactttattttgtataagt

SEQ ID NO: 113601 - DNA, 18 bp, Homo sapiens
ttattttgtataagtatg

SEQ ID NO: 113602 - DNA, 22 bp, Homo sapiens
acatgtgcacaatgtgcaggtt

SEQ ID NO: 113603 - DNA, 23 bp, Homo sapiens
tccatttgaattgttttacttat

SEQ ID NO: 113604 - DNA, 21 bp, Homo sapiens
ttttgcaattaaaataactca

SEQ ID NO: 113605 - DNA, 23 bp, Homo sapiens
tgacttggagtctctctcacaat

SEQ ID NO: 113606 - DNA, 21 bp, Homo sapiens
tgagattctaggatgtatact

SEQ ID NO: 113607 - DNA, 23 bp, Homo sapiens
ggtacagagagagcagagagagc

SEQ ID NO: 113608 - DNA, 22 bp, Homo sapiens
tgtgtgtatatatatatatgtg

SEQ ID NO: 113609 - DNA, 18 bp, Homo sapiens
tgaatatataaatgtatg

SEQ ID NO: 113610 - DNA, 23 bp, Homo sapiens
aagtgaagatgggaaagggtgag

SEQ ID NO: 113611 - DNA, 23 bp, Homo sapiens
gtctcttcctctctctttgtgga

SEQ ID NO: 113612 - DNA, 23 bp, Homo sapiens
cagagtctcactctgtcacccag

SEQ ID NO: 113613 - DNA, 22 bp, Homo sapiens
ttacagcactagaaaactttaa

SEQ ID NO: 113614 - DNA, 23 bp, Homo sapiens
atcacagtgggtgtacactctgt

SEQ ID NO: 113615 - DNA, 23 bp, Homo sapiens
tcacagggtgtacacccactgtg

SEQ ID NO: 113616 - DNA, 18 bp, Homo sapiens
aggtagatattactccta

SEQ ID NO: 113617 - DNA, 21 bp, Homo sapiens
tgtgtgtgtatatatatgtat

SEQ ID NO: 113618 - DNA, 21 bp, Homo sapiens
tgtgtatatgtatgtgtgtgt

SEQ ID NO: 113619 - DNA, 23 bp, Homo sapiens
tatgtatgtgtatatgtataggt

SEQ ID NO: 113620 - DNA, 23 bp, Homo sapiens
tgcctgtctgtctgtcttattgg

SEQ ID NO: 113621 - DNA, 23 bp, Homo sapiens
tcacattctgtgtgattctattt

SEQ ID NO: 113622 - DNA, 23 bp, Homo sapiens
atgacaaagttttagaaatggag

SEQ ID NO: 113623 - DNA, 20 bp, Homo sapiens
tcactgtctggatgtggtga

SEQ ID NO: 113624 - DNA, 19 bp, Homo sapiens
tgagatggagtctcactct

SEQ ID NO: 113625 - DNA, 23 bp, Homo sapiens
gactgagtctcgctctgtcaccc

SEQ ID NO: 113626 - DNA, 23 bp, Homo sapiens
atttatgtatatgtatgtgtgtg

SEQ ID NO: 113627 - DNA, 23 bp, Homo sapiens
atatatataacatgaggccgggt

SEQ ID NO: 113628 - DNA, 21 bp, Homo sapiens
tgtgtatgtatgtgtatggtg

SEQ ID NO: 113629 - DNA, 22 bp, Homo sapiens
tgtgaatgaacagtcagagctg

SEQ ID NO: 113630 - DNA, 21 bp, Homo sapiens
ttgtacataaggtaccaagtg

SEQ ID NO: 113631 - DNA, 23 bp, Homo sapiens
ttttgttcttgattgctgaatgt

SEQ ID NO: 113632 - DNA, 23 bp, Homo sapiens
ttgaatcatcctcatattcctgg

SEQ ID NO: 113633 - DNA, 19 bp, Homo sapiens
tgagaggtgagactgaagt

SEQ ID NO: 113634 - DNA, 21 bp, Homo sapiens
ttgttctggagatcctgggat

SEQ ID NO: 113635 - DNA, 23 bp, Homo sapiens
atagacagtgaatatcttttttg

SEQ ID NO: 113636 - DNA, 21 bp, Homo sapiens
ggagtctcactctgtctccca

SEQ ID NO: 113637 - DNA, 23 bp, Homo sapiens
ctgacacacttatctgtgagtat

SEQ ID NO: 113638 - DNA, 21 bp, Homo sapiens
tttgtcacccaagatgtagtg

SEQ ID NO: 113639 - DNA, 18 bp, Homo sapiens
gggacttgtttctcctaa

SEQ ID NO: 113640 - DNA, 23 bp, Homo sapiens
agacagtctcgctctgtcaccca

SEQ ID NO: 113641 - DNA, 23 bp, Homo sapiens
tgagttcattgtagattctggat

SEQ ID NO: 113642 - DNA, 23 bp, Homo sapiens
tgagttcattgtagattctggat

SEQ ID NO: 113643 - DNA, 18 bp, Homo sapiens
agtggcatgatcatggct

SEQ ID NO: 113644 - DNA, 22 bp, Homo sapiens
tgagacagagtcttgctctgtc

SEQ ID NO: 113645 - DNA, 22 bp, Homo sapiens
tacatgtgcacaatgtgcaggt

SEQ ID NO: 113646 - DNA, 23 bp, Homo sapiens
aagtctcactctgtcacccaggc

SEQ ID NO: 113647 - DNA, 21 bp, Homo sapiens
tgaggtaggaggatcatttga

SEQ ID NO: 113648 - DNA, 20 bp, Homo sapiens
agtctcgctctgtcgctcag

SEQ ID NO: 113649 - DNA, 23 bp, Homo sapiens
tatatgtaccaaatgtattctta

SEQ ID NO: 113650 - DNA, 21 bp, Homo sapiens
atctcgactcactgcaacctc

SEQ ID NO: 113651 - DNA, 23 bp, Homo sapiens
cggagtctcactctgtcttccag

SEQ ID NO: 113652 - DNA, 19 bp, Homo sapiens
ttgtgtataaatatatatg

SEQ ID NO: 113653 - DNA, 23 bp, Homo sapiens
attctagagagacgcagatttaa

SEQ ID NO: 113654 - DNA, 21 bp, Homo sapiens
tagaagaatttcaagattgtt

SEQ ID NO: 113655 - DNA, 23 bp, Homo sapiens
tcactgggtcagtctctgtcttt

SEQ ID NO: 113656 - DNA, 22 bp, Homo sapiens
tgcatatgtgcatttatctttt

SEQ ID NO: 113657 - DNA, 23 bp, Homo sapiens
gaggctcgctgagtaaagtctgt

SEQ ID NO: 113658 - DNA, 23 bp, Homo sapiens
cagcgatcagtgagagaggatga

SEQ ID NO: 113659 - DNA, 23 bp, Homo sapiens
acagttcattgacaatgtgtttt

SEQ ID NO: 113660 - DNA, 23 bp, Homo sapiens
gttaacagtgagcaaagcaagtg

SEQ ID NO: 113661 - DNA, 23 bp, Homo sapiens
tttgagactgagttttgctcttg

SEQ ID NO: 113662 - DNA, 23 bp, Homo sapiens
tgagttcattgtagattctggat

SEQ ID NO: 113663 - DNA, 23 bp, Homo sapiens
tgagttcattgtagattctggat

SEQ ID NO: 113664 - DNA, 23 bp, Homo sapiens
ttaagttccttatagatgctgga

SEQ ID NO: 113665 - DNA, 23 bp, Homo sapiens
agactcactgactcacacgtatg

SEQ ID NO: 113666 - DNA, 23 bp, Homo sapiens
tgtgacagtctgtgcctgtgatc

SEQ ID NO: 113667 - DNA, 23 bp, Homo sapiens
gggtctcactctgtcacccaggc

SEQ ID NO: 113668 - DNA, 23 bp, Homo sapiens
catcacactccctattttggctg

SEQ ID NO: 113669 - DNA, 22 bp, Homo sapiens
aatgtggaaagtaaaactctgt

SEQ ID NO: 113670 - DNA, 21 bp, Homo sapiens
caatgtatatgaaggtgtttt

SEQ ID NO: 113671 - DNA, 19 bp, Homo sapiens
ggaggttgaagctgcagtg

SEQ ID NO: 113672 - DNA, 23 bp, Homo sapiens
tatgtgtctgtgtttatatatac

SEQ ID NO: 113673 - DNA, 19 bp, Homo sapiens
gtatataaatatgtataca

SEQ ID NO: 113674 - DNA, 23 bp, Homo sapiens
attttagacattttgttttcttt

SEQ ID NO: 113675 - DNA, 23 bp, Homo sapiens
atttggttccagtttgtggtcac

SEQ ID NO: 113676 - DNA, 22 bp, Homo sapiens
atttggaatgaaatggagtatg

SEQ ID NO: 113677 - DNA, 21 bp, Homo sapiens
ttggtgtgagatttgagtggg

SEQ ID NO: 113678 - DNA, 22 bp, Homo sapiens
aggaggaagacagtgtgcacac

SEQ ID NO: 113679 - DNA, 23 bp, Homo sapiens
gtgcctattctctgccatttact

SEQ ID NO: 113680 - DNA, 23 bp, Homo sapiens
tataaatgtaaatcagtatggaa

SEQ ID NO: 113681 - DNA, 21 bp, Homo sapiens
gacacagtctctctctgtcgc

SEQ ID NO: 113682 - DNA, 23 bp, Homo sapiens
ctgtgtctccctcactcaccgac

SEQ ID NO: 113683 - DNA, 21 bp, Homo sapiens
tggctggctggatggctggct

SEQ ID NO: 113684 - DNA, 23 bp, Homo sapiens
tggctggctgggtggctggctgg

SEQ ID NO: 113685 - DNA, 21 bp, Homo sapiens
tggctggctgggtggcaggct

SEQ ID NO: 113686 - DNA, 23 bp, Homo sapiens
atagagagtgaagagacatcctt

SEQ ID NO: 113687 - DNA, 23 bp, Homo sapiens
atttggttccagtttgtggtcac

SEQ ID NO: 113688 - DNA, 23 bp, Homo sapiens
tcgctctgtcacccagactgaag

SEQ ID NO: 113689 - DNA, 19 bp, Homo sapiens
gtggtacagtctcggctca

SEQ ID NO: 113690 - DNA, 23 bp, Homo sapiens
tgtgggaatgtaatgttacttta

SEQ ID NO: 113691 - DNA, 23 bp, Homo sapiens
gtagactcacatacatgtagtac

SEQ ID NO: 113692 - DNA, 23 bp, Homo sapiens
tcagaggtaaactcttctgggta

SEQ ID NO: 113693 - DNA, 23 bp, Homo sapiens
actcacagtgagtttctctctcc

SEQ ID NO: 113694 - DNA, 23 bp, Homo sapiens
tacttgtatctatagaattcact

SEQ ID NO: 113695 - DNA, 23 bp, Homo sapiens
cactgagcttcctggttctttgg

SEQ ID NO: 113696 - DNA, 23 bp, Homo sapiens
ggaagagactcagcacactgggc

SEQ ID NO: 113697 - DNA, 22 bp, Homo sapiens
tttcaggaagccaaggaattct

SEQ ID NO: 113698 - DNA, 23 bp, Homo sapiens
tttgagatgtagtcttgctctgt

SEQ ID NO: 113699 - DNA, 23 bp, Homo sapiens
tgagttcattgtagattctggat

SEQ ID NO: 113700 - DNA, 23 bp, Homo sapiens
tgagttcattgtagattctggat

SEQ ID NO: 113701 - DNA, 23 bp, Homo sapiens
gcctctctctctgagtctggtcc

SEQ ID NO: 113702 - DNA, 23 bp, Homo sapiens
atcagctcacagtccagccccac

SEQ ID NO: 113703 - DNA, 19 bp, Homo sapiens
tatgtgtcaggcactgttg

SEQ ID NO: 113704 - DNA, 23 bp, Homo sapiens
tgagttcattgtagattctggat

SEQ ID NO: 113705 - DNA, 23 bp, Homo sapiens
tgagttcattgtagattctggat

SEQ ID NO: 113706 - DNA, 23 bp, Homo sapiens
tgagtctcactctgtctcccagg

SEQ ID NO: 113707 - DNA, 23 bp, Homo sapiens
agctgagtctgcagagtgagcag

SEQ ID NO: 113708 - DNA, 23 bp, Homo sapiens
gacagagtctcgctctgtcaccc

SEQ ID NO: 113709 - DNA, 23 bp, Homo sapiens
tggagtctcactctgtcacccag

SEQ ID NO: 113710 - DNA, 23 bp, Homo sapiens
gagactcactctgtcacccaggc

SEQ ID NO: 113711 - DNA, 23 bp, Homo sapiens
tgagatggagtctcactctgtcg

SEQ ID NO: 113712 - DNA, 23 bp, Homo sapiens
gttgaatgagtgagtgaatgaac

SEQ ID NO: 113713 - DNA, 23 bp, Homo sapiens
acagagtctcgcactgtcaccca

SEQ ID NO: 113714 - DNA, 23 bp, Homo sapiens
ctcacccactctctgtgttcagg

SEQ ID NO: 113715 - DNA, 23 bp, Homo sapiens
cccctgtaggagcactgatgtgg

SEQ ID NO: 113716 - DNA, 23 bp, Homo sapiens
tatgtatgtatgtatttttgaga

SEQ ID NO: 113717 - DNA, 20 bp, Homo sapiens
aaatatcatcatcaccacca

SEQ ID NO: 113718 - DNA, 23 bp, Homo sapiens
acatgtgagttgtagcttttttt

SEQ ID NO: 113719 - DNA, 23 bp, Homo sapiens
aatggagcctcgctcacactgtc

SEQ ID NO: 113720 - DNA, 21 bp, Homo sapiens
ttctgcagtacctgattggtg

SEQ ID NO: 113721 - DNA, 23 bp, Homo sapiens
gagtctctctctctctctcttca

SEQ ID NO: 113722 - DNA, 23 bp, Homo sapiens
tgagttcattgtagattctggat

SEQ ID NO: 113723 - DNA, 23 bp, Homo sapiens
tgagttcattgtagattctggat

SEQ ID NO: 113724 - DNA, 23 bp, Homo sapiens
gagtctcactctgtcacccaggc

SEQ ID NO: 113725 - DNA, 23 bp, Homo sapiens
ttgtttgaatttcaaaatgtgtg

SEQ ID NO: 113726 - DNA, 19 bp, Homo sapiens
ctgctttcaagttggctgt

SEQ ID NO: 113727 - DNA, 19 bp, Homo sapiens
aaaatggtctatttgagca

SEQ ID NO: 113728 - DNA, 23 bp, Homo sapiens
atgtcagtgtatatatatcagcc

SEQ ID NO: 113729 - DNA, 20 bp, Homo sapiens
agcagcagagtaaaagtgtt

SEQ ID NO: 113730 - DNA, 23 bp, Homo sapiens
tgagttcattgtagattctggat

SEQ ID NO: 113731 - DNA, 23 bp, Homo sapiens
tgagttcattgtagattctggat

SEQ ID NO: 113732 - DNA, 18 bp, Homo sapiens
aggtaaacaatacctaag

SEQ ID NO: 113733 - DNA, 23 bp, Homo sapiens
tgtcttcttggagaagtgtctgt

SEQ ID NO: 113734 - DNA, 23 bp, Homo sapiens
tgtctctgtatctgtctcttgat

SEQ ID NO: 113735 - DNA, 22 bp, Homo sapiens
tatgtatgtatgtgtgtgtatt

SEQ ID NO: 113736 - DNA, 22 bp, Homo sapiens
tttagctaatcaagcattttgt

SEQ ID NO: 113737 - DNA, 21 bp, Homo sapiens
atatcagagatggcatgtcag

SEQ ID NO: 113738 - DNA, 19 bp, Homo sapiens
ccgtgaagcttctgatgtg

SEQ ID NO: 113739 - DNA, 21 bp, Homo sapiens
aagagtgaagacagtgacgag

SEQ ID NO: 113740 - DNA, 23 bp, Homo sapiens
tatgtttggtaatgtaggacata

SEQ ID NO: 113741 - DNA, 23 bp, Homo sapiens
tctcctgtctcagtctctgagca

SEQ ID NO: 113742 - DNA, 23 bp, Homo sapiens
aaatcagagggtaatagatgtag

SEQ ID NO: 113743 - DNA, 22 bp, Homo sapiens
acagagtgtaatgaggaagtcc

SEQ ID NO: 113744 - DNA, 23 bp, Homo sapiens
tgagttcattgtagattctggat

SEQ ID NO: 113745 - DNA, 23 bp, Homo sapiens
tgagttcattgtagattctggat

SEQ ID NO: 113746 - DNA, 23 bp, Homo sapiens
gacagagtctcgctctgtcactc

SEQ ID NO: 113747 - DNA, 21 bp, Homo sapiens
ttccagaattgaaaagtattc

SEQ ID NO: 113748 - DNA, 22 bp, Homo sapiens
attggccctcaatttcttctga

SEQ ID NO: 113749 - DNA, 23 bp, Homo sapiens
tgccactctgccactctgacacc

SEQ ID NO: 113750 - DNA, 18 bp, Homo sapiens
taattgttcctgatatcc

SEQ ID NO: 113751 - DNA, 23 bp, Homo sapiens
agaattctgcttttgaagttgtg

SEQ ID NO: 113752 - DNA, 19 bp, Homo sapiens
ttttcagatgttttctatt

SEQ ID NO: 113753 - DNA, 18 bp, Homo sapiens
aatatgtaaatgtgtata

SEQ ID NO: 113754 - DNA, 23 bp, Homo sapiens
gtttcagcaagtgtatgttggca

SEQ ID NO: 113755 - DNA, 19 bp, Homo sapiens
tatatgtatatatgtatac

SEQ ID NO: 113756 - DNA, 19 bp, Homo sapiens
tatatgtatatatgtatac

SEQ ID NO: 113757 - DNA, 19 bp, Homo sapiens
tatatgtatatatgtatac

SEQ ID NO: 113758 - DNA, 19 bp, Homo sapiens
tactttatatatgtatatg

SEQ ID NO: 113759 - DNA, 19 bp, Homo sapiens
tactttatatatgtatatg

SEQ ID NO: 113760 - DNA, 23 bp, Homo sapiens
atatgtatatatgtatatgttat

SEQ ID NO: 113761 - DNA, 21 bp, Homo sapiens
tatatgtatatatgtatatgt

SEQ ID NO: 113762 - DNA, 23 bp, Homo sapiens
atatgtatatatgtatatatgtt

SEQ ID NO: 113763 - DNA, 22 bp, Homo sapiens
tatatacttcatgtatatatgt

SEQ ID NO: 113764 - DNA, 23 bp, Homo sapiens
atactcttctgtgtgggtctgaa

SEQ ID NO: 113765 - DNA, 23 bp, Homo sapiens
cttagtgtggttttgatttgcat

SEQ ID NO: 113766 - DNA, 22 bp, Homo sapiens
aatgtacttcttggccatttgt

SEQ ID NO: 113767 - DNA, 18 bp, Homo sapiens
agtgagtgctgtttcact

SEQ ID NO: 113768 - DNA, 23 bp, Homo sapiens
ttcagtgtgtgtttcttatgggc

SEQ ID NO: 113769 - DNA, 23 bp, Homo sapiens
ttttgacgtggaatctcactctg

SEQ ID NO: 113770 - DNA, 21 bp, Homo sapiens
tttcaacaggtatcatattta

SEQ ID NO: 113771 - DNA, 23 bp, Homo sapiens
tagatagatagatagatagatag

SEQ ID NO: 113772 - DNA, 22 bp, Homo sapiens
ttcactcatgatttggctctct

SEQ ID NO: 113773 - DNA, 22 bp, Homo sapiens
ttgttgttgagatggagtctcg

SEQ ID NO: 113774 - DNA, 23 bp, Homo sapiens
acagactgacactgcttggcttc

SEQ ID NO: 113775 - DNA, 23 bp, Homo sapiens
gactgagggaaacatgagatgtc

SEQ ID NO: 113776 - DNA, 22 bp, Homo sapiens
aggaatgttttgtagttttcag

SEQ ID NO: 113777 - DNA, 23 bp, Homo sapiens
agagagagagagaaatcagtgcc

SEQ ID NO: 113778 - DNA, 20 bp, Homo sapiens
atacgtatatgtacatatgt

SEQ ID NO: 113779 - DNA, 19 bp, Homo sapiens
tgtgtgtatgtgtgtgtat

SEQ ID NO: 113780 - DNA, 23 bp, Homo sapiens
tcccagagcccctggaactctgg

SEQ ID NO: 113781 - DNA, 23 bp, Homo sapiens
tcccagagcccctggaactctgg

SEQ ID NO: 113782 - DNA, 23 bp, Homo sapiens
tcccagagcccctggaactctgg

SEQ ID NO: 113783 - DNA, 21 bp, Homo sapiens
atgtgtgtgtatggggtctca

SEQ ID NO: 113784 - DNA, 23 bp, Homo sapiens
tttcttagtctcaaaactgttga

SEQ ID NO: 113785 - DNA, 23 bp, Homo sapiens
agaataacaacctcattgtcatc

SEQ ID NO: 113786 - DNA, 18 bp, Homo sapiens
agcacacacacaaatatg

SEQ ID NO: 113787 - DNA, 23 bp, Homo sapiens
ttcagcttatattttgaaggtaa

SEQ ID NO: 113788 - DNA, 23 bp, Homo sapiens
tgtgtgtgcgtgtgtgtatgtgt

SEQ ID NO: 113789 - DNA, 20 bp, Homo sapiens
ataggatatctgtgtgtaca

SEQ ID NO: 113790 - DNA, 23 bp, Homo sapiens
atagcacactctggttcatatgt

SEQ ID NO: 113791 - DNA, 23 bp, Homo sapiens
agagtctcactctgtcacccagg

SEQ ID NO: 113792 - DNA, 22 bp, Homo sapiens
tctgccactgtatgtgtcctga

SEQ ID NO: 113793 - DNA, 21 bp, Homo sapiens
ttggtgcataaagatgctttg

SEQ ID NO: 113794 - DNA, 18 bp, Homo sapiens
tacaagtctcatatctgt

SEQ ID NO: 113795 - DNA, 21 bp, Homo sapiens
gtcttgtcactgactgactct

SEQ ID NO: 113796 - DNA, 23 bp, Homo sapiens
ttatttcaaatgtatgggtgaat

SEQ ID NO: 113797 - DNA, 22 bp, Homo sapiens
atgtgcagaacatgcaggtttg

SEQ ID NO: 113798 - DNA, 21 bp, Homo sapiens
tgtatgcatttatgtgtgtgt

SEQ ID NO: 113799 - DNA, 20 bp, Homo sapiens
aaatggtgtcactggtatga

SEQ ID NO: 113800 - DNA, 22 bp, Homo sapiens
taaggtagagatgatggctgag

SEQ ID NO: 113801 - DNA, 19 bp, Homo sapiens
agccaacagtctttgctga

SEQ ID NO: 113802 - DNA, 19 bp, Homo sapiens
tatagtaagttatatatag

SEQ ID NO: 113803 - DNA, 18 bp, Homo sapiens
atacgtgtatatacgtat

SEQ ID NO: 113804 - DNA, 19 bp, Homo sapiens
tatacgtgtatatacgtaa

SEQ ID NO: 113805 - DNA, 23 bp, Homo sapiens
tagtttaagagattatgatcaag

SEQ ID NO: 113806 - DNA, 23 bp, Homo sapiens
tatgctataggagcatagacaca

SEQ ID NO: 113807 - DNA, 23 bp, Homo sapiens
agcagcatttctgattattttct

SEQ ID NO: 113808 - DNA, 23 bp, Homo sapiens
tgtccctgtatattttcttgtat

SEQ ID NO: 113809 - DNA, 20 bp, Homo sapiens
ttttgtctttttgcaaatgt

SEQ ID NO: 113810 - DNA, 18 bp, Homo sapiens
tatgtgtgtatatgtata

SEQ ID NO: 113811 - DNA, 19 bp, Homo sapiens
acacacacacatataccac

SEQ ID NO: 113812 - DNA, 20 bp, Homo sapiens
agagcatttcagattttgga

SEQ ID NO: 113813 - DNA, 23 bp, Homo sapiens
tgaatgtgtgcatgtgtgtgtat

SEQ ID NO: 113814 - DNA, 21 bp, Homo sapiens
tatatgtttgtgtatatgtgt

SEQ ID NO: 113815 - DNA, 22 bp, Homo sapiens
tatgtgtgtgcatatatacata

SEQ ID NO: 113816 - DNA, 18 bp, Homo sapiens
atgtatgtgtgtatatac

SEQ ID NO: 113817 - DNA, 22 bp, Homo sapiens
tacgtgcatatatacatatgtg

SEQ ID NO: 113818 - DNA, 23 bp, Homo sapiens
tagtggtatatctaaaaagctgt

SEQ ID NO: 113819 - DNA, 23 bp, Homo sapiens
atgtgtgtgtgtgtatatatata

SEQ ID NO: 113820 - DNA, 22 bp, Homo sapiens
ttaagagagactcattgatggg

SEQ ID NO: 113821 - DNA, 22 bp, Homo sapiens
tatatgactgtcttaatgtttt

SEQ ID NO: 113822 - DNA, 21 bp, Homo sapiens
agggggggtacatgtgcaagt

SEQ ID NO: 113823 - DNA, 23 bp, Homo sapiens
tgagttcattgtagattctggat

SEQ ID NO: 113824 - DNA, 23 bp, Homo sapiens
tgagttcattgtagattctggat

SEQ ID NO: 113825 - DNA, 23 bp, Homo sapiens
atgtgtgtgcatgtatatatgtg

SEQ ID NO: 113826 - DNA, 20 bp, Homo sapiens
tacatatacatatgtgttag

SEQ ID NO: 113827 - DNA, 23 bp, Homo sapiens
tatataagtatatgtatatgtgt

SEQ ID NO: 113828 - DNA, 22 bp, Homo sapiens
ggtgcctcggtctttctctctg

SEQ ID NO: 113829 - DNA, 23 bp, Homo sapiens
tttatttctttaagtcaccgagt

SEQ ID NO: 113830 - DNA, 23 bp, Homo sapiens
ctggcacattttgaaatgacagt

SEQ ID NO: 113831 - DNA, 23 bp, Homo sapiens
tatagtgctaacagtgctgctat

SEQ ID NO: 113832 - DNA, 19 bp, Homo sapiens
tgtggaaaacttttttttt

SEQ ID NO: 113833 - DNA, 22 bp, Homo sapiens
tgacaagatggaatggtgctga

SEQ ID NO: 113834 - DNA, 21 bp, Homo sapiens
ttgtgttagtctttaccattt

SEQ ID NO: 113835 - DNA, 18 bp, Homo sapiens
ataactatatgtatagtc

SEQ ID NO: 113836 - DNA, 23 bp, Homo sapiens
tatatgtgtactttagtatacgt

SEQ ID NO: 113837 - DNA, 18 bp, Homo sapiens
aagattatatatatgtgt

SEQ ID NO: 113838 - DNA, 23 bp, Homo sapiens
tgtgtgtgtatatctattgtgta

SEQ ID NO: 113839 - DNA, 19 bp, Homo sapiens
tatgtgtgtgtatatatag

SEQ ID NO: 113840 - DNA, 20 bp, Homo sapiens
ttatgtgtgtatatatatga

SEQ ID NO: 113841 - DNA, 20 bp, Homo sapiens
tagacagtagaaagagtaga

SEQ ID NO: 113842 - DNA, 23 bp, Homo sapiens
atgtgtgtatatgtgtatgtgtg

SEQ ID NO: 113843 - DNA, 23 bp, Homo sapiens
atatgtatgtatatatatgtgta

SEQ ID NO: 113844 - DNA, 23 bp, Homo sapiens
tatatgtatgtatatatatgtat

SEQ ID NO: 113845 - DNA, 22 bp, Homo sapiens
atatatgtatgtatatatatgt

SEQ ID NO: 113846 - DNA, 21 bp, Homo sapiens
tcaatacttgtggccatagct

SEQ ID NO: 113847 - DNA, 23 bp, Homo sapiens
tgagttcattgtagattctggat

SEQ ID NO: 113848 - DNA, 23 bp, Homo sapiens
tgagttcattgtagattctggat

SEQ ID NO: 113849 - DNA, 19 bp, Homo sapiens
tcccagagcccctggaact

SEQ ID NO: 113850 - DNA, 23 bp, Homo sapiens
gctctctgactgactccttgcca

SEQ ID NO: 113851 - DNA, 22 bp, Homo sapiens
aaggtgtccagtttatttcatg

SEQ ID NO: 113852 - DNA, 20 bp, Homo sapiens
aagagaagagagtttgtaca

SEQ ID NO: 113853 - DNA, 22 bp, Homo sapiens
atacacacacacatatatatgt

SEQ ID NO: 113854 - DNA, 23 bp, Homo sapiens
tatatgtatatgtatacatatgt

SEQ ID NO: 113855 - DNA, 18 bp, Homo sapiens
tatgcatatatatttgta

SEQ ID NO: 113856 - DNA, 23 bp, Homo sapiens
tactgtcatcagtatcacctagg

SEQ ID NO: 113857 - DNA, 19 bp, Homo sapiens
tgactctctttgtctcttc

SEQ ID NO: 113858 - DNA, 22 bp, Homo sapiens
tatatgcatatatatgtgtgtg

SEQ ID NO: 113859 - DNA, 20 bp, Homo sapiens
atagcattcagagatatgtc

SEQ ID NO: 113860 - DNA, 23 bp, Homo sapiens
ggttcttgcatgtaaactagatt

SEQ ID NO: 113861 - DNA, 23 bp, Homo sapiens
ttgatgtggatttcttctgatga

SEQ ID NO: 113862 - DNA, 22 bp, Homo sapiens
tgtgaagacattaaggtaaagt

SEQ ID NO: 113863 - DNA, 23 bp, Homo sapiens
tgaatgagcatctgattttgttt

SEQ ID NO: 113864 - DNA, 21 bp, Homo sapiens
cagtgttgtcaggttccagga

SEQ ID NO: 113865 - DNA, 23 bp, Homo sapiens
tgaagaaaaacagcagtgagttt

SEQ ID NO: 113866 - DNA, 19 bp, Homo sapiens
tcagggtttatgatgtgaa

SEQ ID NO: 113867 - DNA, 23 bp, Homo sapiens
tgagttcattgtagattctggat

SEQ ID NO: 113868 - DNA, 23 bp, Homo sapiens
tgagttcattgtagattctggat

SEQ ID NO: 113869 - DNA, 21 bp, Homo sapiens
gaggcactgactggctcacac

SEQ ID NO: 113870 - DNA, 22 bp, Homo sapiens
aagactctaaggtattgatcca

SEQ ID NO: 113871 - DNA, 18 bp, Homo sapiens
agagacaccacagaggtg

SEQ ID NO: 113872 - DNA, 19 bp, Homo sapiens
ataaattagctatagattt

SEQ ID NO: 113873 - DNA, 23 bp, Homo sapiens
gagccaggaactgtgtgtgaaga

SEQ ID NO: 113874 - DNA, 23 bp, Homo sapiens
ttttgagacggagtctaaccctg

SEQ ID NO: 113875 - DNA, 23 bp, Homo sapiens
ggagagtgactgtagagcctcag

SEQ ID NO: 113876 - DNA, 19 bp, Homo sapiens
tcaggacacccttttctca

SEQ ID NO: 113877 - DNA, 21 bp, Homo sapiens
aaaggacaagtaacggaatga

SEQ ID NO: 113878 - DNA, 22 bp, Homo sapiens
tagtagtgttgcgattttgttc

SEQ ID NO: 113879 - DNA, 23 bp, Homo sapiens
acctagttgtttttaggtacttc

SEQ ID NO: 113880 - DNA, 18 bp, Homo sapiens
ccttagtcagaattggaa

SEQ ID NO: 113881 - DNA, 21 bp, Homo sapiens
ttgagacagggtctcactctg

SEQ ID NO: 113882 - DNA, 23 bp, Homo sapiens
agacagagtctcactctgtcgcc

SEQ ID NO: 113883 - DNA, 18 bp, Homo sapiens
atgctagtacctgcctca

SEQ ID NO: 113884 - DNA, 21 bp, Homo sapiens
tatgcatctaataacataact

SEQ ID NO: 113885 - DNA, 20 bp, Homo sapiens
tgtatatatgtatatgtgtg

SEQ ID NO: 113886 - DNA, 23 bp, Homo sapiens
gagatggagtctggctctgtcgc

SEQ ID NO: 113887 - DNA, 22 bp, Homo sapiens
caggctggcgatgatgagtgcc

SEQ ID NO: 113888 - DNA, 23 bp, Homo sapiens
tgagatggagtctcactctgtcg

SEQ ID NO: 113889 - DNA, 23 bp, Homo sapiens
ttgagacagtttcactcttgttg

SEQ ID NO: 113890 - DNA, 18 bp, Homo sapiens
ctctctctctctctcttg

SEQ ID NO: 113891 - DNA, 23 bp, Homo sapiens
tgtgactgtgtctgtggctgtgg

SEQ ID NO: 113892 - DNA, 22 bp, Homo sapiens
acatgtgagtctgctgtgcacc

SEQ ID NO: 113893 - DNA, 23 bp, Homo sapiens
gagtctgatcacagtgcccttac

SEQ ID NO: 113894 - DNA, 23 bp, Homo sapiens
gtgaggctgttgatgctgctggc

SEQ ID NO: 113895 - DNA, 20 bp, Homo sapiens
ctgccccacagacaccctca

SEQ ID NO: 113896 - DNA, 22 bp, Homo sapiens
ttcatgtggcctttcctctgca

SEQ ID NO: 113897 - DNA, 23 bp, Homo sapiens
acagagtctcactctctcacttg

SEQ ID NO: 113898 - DNA, 19 bp, Homo sapiens
tcactctctcaggaatgga

SEQ ID NO: 113899 - DNA, 23 bp, Homo sapiens
agtgtgacaggaacaatatagag

SEQ ID NO: 113900 - DNA, 23 bp, Homo sapiens
tgagttcattgtagattctggat

SEQ ID NO: 113901 - DNA, 23 bp, Homo sapiens
tgagttcattgtagattctggat

SEQ ID NO: 113902 - DNA, 23 bp, Homo sapiens
tgtgtgtgtgtacttgttaactt

SEQ ID NO: 113903 - DNA, 23 bp, Homo sapiens
tgagttcattgtagattctggat

SEQ ID NO: 113904 - DNA, 23 bp, Homo sapiens
tgagttcattgtagattctggat

SEQ ID NO: 113905 - DNA, 23 bp, Homo sapiens
tcagtggatttctaggtgtatga

SEQ ID NO: 113906 - DNA, 21 bp, Homo sapiens
atcagttttcaagaaatgtgg

SEQ ID NO: 113907 - DNA, 23 bp, Homo sapiens
atgactagtgatgttgtacatgt

SEQ ID NO: 113908 - DNA, 21 bp, Homo sapiens
ttctcttgagaaatgtctatt

SEQ ID NO: 113909 - DNA, 23 bp, Homo sapiens
tgtctgtgtgtctgtgtggtagt

SEQ ID NO: 113910 - DNA, 21 bp, Homo sapiens
tctgtctctcagtctctgggc

SEQ ID NO: 113911 - DNA, 20 bp, Homo sapiens
atacgtatacatatgtgtgt

SEQ ID NO: 113912 - DNA, 22 bp, Homo sapiens
tgtgtatatatgtatatgtata

SEQ ID NO: 113913 - DNA, 19 bp, Homo sapiens
taagaccttcttgctgtgt

SEQ ID NO: 113914 - DNA, 20 bp, Homo sapiens
aggatgaagactgacttgag

SEQ ID NO: 113915 - DNA, 23 bp, Homo sapiens
agaatgtcaatggtagtttaatg

SEQ ID NO: 113916 - DNA, 22 bp, Homo sapiens
tgagatcatccaaatttagaga

SEQ ID NO: 113917 - DNA, 23 bp, Homo sapiens
tgagacaggatcttactctgttg

SEQ ID NO: 113918 - DNA, 23 bp, Homo sapiens
agacactcctgtgatattgttgt

SEQ ID NO: 113919 - DNA, 23 bp, Homo sapiens
ctatgattagtgattttgaacat

SEQ ID NO: 113920 - DNA, 22 bp, Homo sapiens
tatcacagtgggtgtacacaca

SEQ ID NO: 113921 - DNA, 23 bp, Homo sapiens
ccctatgattagtgattttgaac

SEQ ID NO: 113922 - DNA, 22 bp, Homo sapiens
tagtctctgtctgactttcagg

SEQ ID NO: 113923 - DNA, 23 bp, Homo sapiens
tgaatcagaacctgcatttgact

SEQ ID NO: 113924 - DNA, 22 bp, Homo sapiens
acacagtagtaagtatttgtat

SEQ ID NO: 113925 - DNA, 23 bp, Homo sapiens
cggagtctcgctctgtctcccag

SEQ ID NO: 113926 - DNA, 23 bp, Homo sapiens
atagagagaactgagaatgcact

SEQ ID NO: 113927 - DNA, 21 bp, Homo sapiens
aaactttttaagtggttggtg

SEQ ID NO: 113928 - DNA, 23 bp, Homo sapiens
aaaaccaagcaaatcagaatctc

SEQ ID NO: 113929 - DNA, 20 bp, Homo sapiens
aatattgtcaagtattcctc

SEQ ID NO: 113930 - DNA, 18 bp, Homo sapiens
agactctcattctgtcac

SEQ ID NO: 113931 - DNA, 19 bp, Homo sapiens
aagtgctgggatgacaggc

SEQ ID NO: 113932 - DNA, 23 bp, Homo sapiens
agatggagtctcactctgtcacc

SEQ ID NO: 113933 - DNA, 23 bp, Homo sapiens
aagtctcactctgtcacccaggc

SEQ ID NO: 113934 - DNA, 23 bp, Homo sapiens
ccgagtctcactctgtcgctcag

SEQ ID NO: 113935 - DNA, 23 bp, Homo sapiens
tgagatggagtctcactctgtca

SEQ ID NO: 113936 - DNA, 22 bp, Homo sapiens
agaacagcatacacattgagaa

SEQ ID NO: 113937 - DNA, 23 bp, Homo sapiens
tttgagacggagttttgctcttg

SEQ ID NO: 113938 - DNA, 22 bp, Homo sapiens
ggccacatatagttgggtctgt

SEQ ID NO: 113939 - DNA, 20 bp, Homo sapiens
gaaagacgttgcattcctga

SEQ ID NO: 113940 - DNA, 23 bp, Homo sapiens
aaattattcattttgttgttctg

SEQ ID NO: 113941 - DNA, 23 bp, Homo sapiens
actctctctgtgtgtgctttgat

SEQ ID NO: 113942 - DNA, 18 bp, Homo sapiens
cacagtgacaggagatgg

SEQ ID NO: 113943 - DNA, 22 bp, Homo sapiens
ttatgtgtatatatatctgtgt

SEQ ID NO: 113944 - DNA, 21 bp, Homo sapiens
atatagtatgtgtatacgtgt

SEQ ID NO: 113945 - DNA, 18 bp, Homo sapiens
gggtcagtgatttggttc

SEQ ID NO: 113946 - DNA, 23 bp, Homo sapiens
acagagtctcactctgtcgccca

SEQ ID NO: 113947 - DNA, 20 bp, Homo sapiens
acaacatagtgagaccttgt

SEQ ID NO: 113948 - DNA, 23 bp, Homo sapiens
tgaagctagattttgtgggtgtt

SEQ ID NO: 113949 - DNA, 23 bp, Homo sapiens
tcatgggtgagctctgactcatc

SEQ ID NO: 113950 - DNA, 23 bp, Homo sapiens
tgagatggagtctcactctgtca

SEQ ID NO: 113951 - DNA, 23 bp, Homo sapiens
tttttgtagttgttatctattga

SEQ ID NO: 113952 - DNA, 21 bp, Homo sapiens
tgaggtagaaggatcacttgt

SEQ ID NO: 113953 - DNA, 21 bp, Homo sapiens
tgttgattttgtatcctacaa

SEQ ID NO: 113954 - DNA, 23 bp, Homo sapiens
gagactgcaggtgcatgtgacca

SEQ ID NO: 113955 - DNA, 23 bp, Homo sapiens
aatctatgaatttgatatgatca

SEQ ID NO: 113956 - DNA, 20 bp, Homo sapiens
actgctcctgatctcttgga

SEQ ID NO: 113957 - DNA, 23 bp, Homo sapiens
aactgagagcacagagtgagcag

SEQ ID NO: 113958 - DNA, 23 bp, Homo sapiens
gtcctgcagctttactgaattta

SEQ ID NO: 113959 - DNA, 18 bp, Homo sapiens
cactgcctatccattctc

SEQ ID NO: 113960 - DNA, 22 bp, Homo sapiens
atgtatgtatgtatatgtgtgt

SEQ ID NO: 113961 - DNA, 21 bp, Homo sapiens
atatacacacacatatgtgta

SEQ ID NO: 113962 - DNA, 23 bp, Homo sapiens
aatacaatgcaaatgctatgtaa

SEQ ID NO: 113963 - DNA, 23 bp, Homo sapiens
gtgtatgtatatatgtatatgtg

SEQ ID NO: 113964 - DNA, 20 bp, Homo sapiens
atatgtgtatacatatgtat

SEQ ID NO: 113965 - DNA, 21 bp, Homo sapiens
atatgtatatatgtatatatg

SEQ ID NO: 113966 - DNA, 18 bp, Homo sapiens
tggttctgtgacattttc

SEQ ID NO: 113967 - DNA, 23 bp, Homo sapiens
gggtctcactctgtcacccaggc

SEQ ID NO: 113968 - DNA, 21 bp, Homo sapiens
tatatgcatatatacacgtgt

SEQ ID NO: 113969 - DNA, 22 bp, Homo sapiens
tgtgtatatatatgtatatgtg

SEQ ID NO: 113970 - DNA, 23 bp, Homo sapiens
atgcagacagaaatgacactggt

SEQ ID NO: 113971 - DNA, 23 bp, Homo sapiens
agtttgtgactatggcatatttg

SEQ ID NO: 113972 - DNA, 21 bp, Homo sapiens
gtggcagtatgtgtatatgcc

SEQ ID NO: 113973 - DNA, 22 bp, Homo sapiens
tcagacaggacacagtgggctt

SEQ ID NO: 113974 - DNA, 21 bp, Homo sapiens
tgagatggagtttcactgtgt

SEQ ID NO: 113975 - DNA, 23 bp, Homo sapiens
gtatgtatatatgtatctatatg

SEQ ID NO: 113976 - DNA, 19 bp, Homo sapiens
gttaatgtatggactatgt

SEQ ID NO: 113977 - DNA, 22 bp, Homo sapiens
tgtgtgcatatatacatatgtg

SEQ ID NO: 113978 - DNA, 21 bp, Homo sapiens
tgtgtgtatatatatgtgtgt

SEQ ID NO: 113979 - DNA, 21 bp, Homo sapiens
taggacctacttttttgcctg

SEQ ID NO: 113980 - DNA, 23 bp, Homo sapiens
gcatcctctctgtctctctgcta

SEQ ID NO: 113981 - DNA, 23 bp, Homo sapiens
attagctagcttgtggaatgaga

SEQ ID NO: 113982 - DNA, 20 bp, Homo sapiens
aatgtacatacattttatgt

SEQ ID NO: 113983 - DNA, 23 bp, Homo sapiens
atccctcttgatgttggacttaa

SEQ ID NO: 113984 - DNA, 19 bp, Homo sapiens
atgcacaatgagctctgta

SEQ ID NO: 113985 - DNA, 22 bp, Homo sapiens
acatgtgcacattctgcaggtt

SEQ ID NO: 113986 - DNA, 22 bp, Homo sapiens
attaatgtaaggaagattgggg

SEQ ID NO: 113987 - DNA, 23 bp, Homo sapiens
tgagatggagtcccactctgtca

SEQ ID NO: 113988 - DNA, 23 bp, Homo sapiens
aatgtgcaattcaatgtgtgtgt

SEQ ID NO: 113989 - DNA, 23 bp, Homo sapiens
tgtgtgtatatatatgtgtgtgt

SEQ ID NO: 113990 - DNA, 19 bp, Homo sapiens
tgagatggagtctcactct

SEQ ID NO: 113991 - DNA, 23 bp, Homo sapiens
cgtgagtctgtctgtctgtctgt

SEQ ID NO: 113992 - DNA, 23 bp, Homo sapiens
tttcaacaacttatttcaaggga

SEQ ID NO: 113993 - DNA, 23 bp, Homo sapiens
tttgatatcacagggatgttgta

SEQ ID NO: 113994 - DNA, 20 bp, Homo sapiens
tgaggtaggaggatcacttg

SEQ ID NO: 113995 - DNA, 18 bp, Homo sapiens
ctatatttttgttagtca

SEQ ID NO: 113996 - DNA, 19 bp, Homo sapiens
ttgtagtttgaatagttca

SEQ ID NO: 113997 - DNA, 23 bp, Homo sapiens
tttggatagtaaagaagagcttg

SEQ ID NO: 113998 - DNA, 22 bp, Homo sapiens
tgtctgagacggagtcttgttc

SEQ ID NO: 113999 - DNA, 23 bp, Homo sapiens
ttttgagatggagtctcactctg

SEQ ID NO: 114000 - DNA, 23 bp, Homo sapiens
ttctgtgtctgtttatgattcgc

SEQ ID NO: 114001 - DNA, 22 bp, Homo sapiens
gacagggtcttactctgtcacc

SEQ ID NO: 114002 - DNA, 23 bp, Homo sapiens
agagtctcactctgtcttccagg

SEQ ID NO: 114003 - DNA, 18 bp, Homo sapiens
tctgaactttattttttg

SEQ ID NO: 114004 - DNA, 19 bp, Homo sapiens
tatttttttggagacaggg

SEQ ID NO: 114005 - DNA, 21 bp, Homo sapiens
agtctcgctctgtctcccagg

SEQ ID NO: 114006 - DNA, 23 bp, Homo sapiens
tgcttgtcagagtcactcagagt

SEQ ID NO: 114007 - DNA, 22 bp, Homo sapiens
tcactgtcagactaataactgt

SEQ ID NO: 114008 - DNA, 23 bp, Homo sapiens
aggctgtgagccaagattgtgcc

SEQ ID NO: 114009 - DNA, 23 bp, Homo sapiens
aggctgtgagccaagattgtgcc

SEQ ID NO: 114010 - DNA, 23 bp, Homo sapiens
tgaggctgcagtgagttatgatt

SEQ ID NO: 114011 - DNA, 19 bp, Homo sapiens
ctcgctaacaattggcaga

SEQ ID NO: 114012 - DNA, 23 bp, Homo sapiens
ccacctgagtccctctgacagtg

SEQ ID NO: 114013 - DNA, 18 bp, Homo sapiens
actcactctctggcttcc

SEQ ID NO: 114014 - DNA, 23 bp, Homo sapiens
tgagacggagtctcgctctgtca

SEQ ID NO: 114015 - DNA, 21 bp, Homo sapiens
ttatcagtttgatagctgtga

SEQ ID NO: 114016 - DNA, 22 bp, Homo sapiens
atcagagcatattatgtttttg

SEQ ID NO: 114017 - DNA, 19 bp, Homo sapiens
ttttgagatggagtcttac

SEQ ID NO: 114018 - DNA, 23 bp, Homo sapiens
atcatcatcatcatcctctgctc

SEQ ID NO: 114019 - DNA, 23 bp, Homo sapiens
ctctgtctcagctgcttgatctg

SEQ ID NO: 114020 - DNA, 23 bp, Homo sapiens
attgagacggagtctccctctgt

SEQ ID NO: 114021 - DNA, 23 bp, Homo sapiens
aatgtgcacctccagctcagact

SEQ ID NO: 114022 - DNA, 23 bp, Homo sapiens
gtcggtgtctcactctgtcgccc

SEQ ID NO: 114023 - DNA, 22 bp, Homo sapiens
atggatcatcttgtgctaccac

SEQ ID NO: 114024 - DNA, 20 bp, Homo sapiens
aagacagggtcttgctctgt

SEQ ID NO: 114025 - DNA, 22 bp, Homo sapiens
atatcacattttgtttatctgt

SEQ ID NO: 114026 - DNA, 23 bp, Homo sapiens
tctgtgaagaaagtcaatggtag

SEQ ID NO: 114027 - DNA, 18 bp, Homo sapiens
atggtcttgtgtccaaga

SEQ ID NO: 114028 - DNA, 23 bp, Homo sapiens
gagccacttctagtaatggtgga

SEQ ID NO: 114029 - DNA, 21 bp, Homo sapiens
atgtgtatatatatacacata

SEQ ID NO: 114030 - DNA, 22 bp, Homo sapiens
tgtggttgttggatgaaatgtt

SEQ ID NO: 114031 - DNA, 23 bp, Homo sapiens
attttttctaagtctgtgaagaa

SEQ ID NO: 114032 - DNA, 23 bp, Homo sapiens
cttctgtgtcagtcacactggga

SEQ ID NO: 114033 - DNA, 22 bp, Homo sapiens
tgacttctatttttattgtgct

SEQ ID NO: 114034 - DNA, 19 bp, Homo sapiens
aaaacagaatgaaaggtca

SEQ ID NO: 114035 - DNA, 22 bp, Homo sapiens
tatctaggaattgaattgctgg

SEQ ID NO: 114036 - DNA, 23 bp, Homo sapiens
tgagactctgtctcaaaaggaaa

SEQ ID NO: 114037 - DNA, 22 bp, Homo sapiens
ttttcttgatacagtgtctcat

SEQ ID NO: 114038 - DNA, 23 bp, Homo sapiens
agactctcactctgtcacccagg

SEQ ID NO: 114039 - DNA, 20 bp, Homo sapiens
cagtggtatgatcttggctc

SEQ ID NO: 114040 - DNA, 21 bp, Homo sapiens
tgttgcttaacaatggggata

SEQ ID NO: 114041 - DNA, 23 bp, Homo sapiens
gcattgtcaggagattttgttgt

SEQ ID NO: 114042 - DNA, 21 bp, Homo sapiens
aatgctttttctggattgact

SEQ ID NO: 114043 - DNA, 18 bp, Homo sapiens
tcactcactctgtcgccc

SEQ ID NO: 114044 - DNA, 23 bp, Homo sapiens
ttgatgttgttgctgttgttgct

SEQ ID NO: 114045 - DNA, 18 bp, Homo sapiens
tgcaaaaacagctcactg

SEQ ID NO: 114046 - DNA, 23 bp, Homo sapiens
taggactgtgaatttcatgattc

SEQ ID NO: 114047 - DNA, 23 bp, Homo sapiens
gacagagtctcgctctgtcaccc

SEQ ID NO: 114048 - DNA, 20 bp, Homo sapiens
agaggagggtcaccagcctg

SEQ ID NO: 114049 - DNA, 23 bp, Homo sapiens
aagatggagtctcactctctcgc

SEQ ID NO: 114050 - DNA, 23 bp, Homo sapiens
ggaatgcagtggcacaatcttga

SEQ ID NO: 114051 - DNA, 23 bp, Homo sapiens
ttgaaagtggttgtgtaatggaa

SEQ ID NO: 114052 - DNA, 23 bp, Homo sapiens
tggctcactgtaacctctgcctc

SEQ ID NO: 114053 - DNA, 19 bp, Homo sapiens
tgagatggagtctcactct

SEQ ID NO: 114054 - DNA, 23 bp, Homo sapiens
tttcagagggagtcttgctctgt

SEQ ID NO: 114055 - DNA, 23 bp, Homo sapiens
acagagtcaccctctgtcaccca

SEQ ID NO: 114056 - DNA, 21 bp, Homo sapiens
ttctaagcaaatgatttgtgt

SEQ ID NO: 114057 - DNA, 19 bp, Homo sapiens
ttgagacaagtcttgctct

SEQ ID NO: 114058 - DNA, 21 bp, Homo sapiens
ttagaagtacttagccattat

SEQ ID NO: 114059 - DNA, 22 bp, Homo sapiens
aactgggcaacaaagtgagacc

SEQ ID NO: 114060 - DNA, 23 bp, Homo sapiens
gagacggagtctcgctctgtcac

SEQ ID NO: 114061 - DNA, 23 bp, Homo sapiens
tatttcatttacttgctgatttc

SEQ ID NO: 114062 - DNA, 19 bp, Homo sapiens
tcactgcaacctctgcttc

SEQ ID NO: 114063 - DNA, 23 bp, Homo sapiens
cttgtctcggtctctccttctgt

SEQ ID NO: 114064 - DNA, 23 bp, Homo sapiens
ctcactcactcacttactctgag

SEQ ID NO: 114065 - DNA, 23 bp, Homo sapiens
tatatagttgtgtgcctgtgtgt

SEQ ID NO: 114066 - DNA, 23 bp, Homo sapiens
gcaacattctcagcaaaccatct

SEQ ID NO: 114067 - DNA, 23 bp, Homo sapiens
tatctgaaaccctttttgttctc

SEQ ID NO: 114068 - DNA, 23 bp, Homo sapiens
ctagtgagagcaatgggattgga

SEQ ID NO: 114069 - DNA, 23 bp, Homo sapiens
cctgtgtcactccctgtctgtct

SEQ ID NO: 114070 - DNA, 23 bp, Homo sapiens
tgagttcattgtagattctggat

SEQ ID NO: 114071 - DNA, 23 bp, Homo sapiens
tgagttcattgtagattctggat

SEQ ID NO: 114072 - DNA, 23 bp, Homo sapiens
ctatgcatgtacttgtgtatgtg

SEQ ID NO: 114073 - DNA, 22 bp, Homo sapiens
tgtgtatgtatgtatatatgta

SEQ ID NO: 114074 - DNA, 21 bp, Homo sapiens
tgctatatatatatgtataca

SEQ ID NO: 114075 - DNA, 21 bp, Homo sapiens
atcaccagtgactttacagaa

SEQ ID NO: 114076 - DNA, 23 bp, Homo sapiens
tgagttcattgtagattctggat

SEQ ID NO: 114077 - DNA, 23 bp, Homo sapiens
tgagttcattgtagattctggat

SEQ ID NO: 114078 - DNA, 22 bp, Homo sapiens
ggtctcactgtcactcaggctg

SEQ ID NO: 114079 - DNA, 21 bp, Homo sapiens
tggtaaaaaatatagtctttg

SEQ ID NO: 114080 - DNA, 23 bp, Homo sapiens
tttgacctagttcatttgaatct

SEQ ID NO: 114081 - DNA, 23 bp, Homo sapiens
aatctgtcaggtttactatttgt

SEQ ID NO: 114082 - DNA, 19 bp, Homo sapiens
atgttggctgtgggtatgt

SEQ ID NO: 114083 - DNA, 23 bp, Homo sapiens
gtgacagatgaatcagtgcacca

SEQ ID NO: 114084 - DNA, 23 bp, Homo sapiens
tgtgtgtgtgagtatatgtgtgt

SEQ ID NO: 114085 - DNA, 22 bp, Homo sapiens
ttctagcctctagaactgtaag

SEQ ID NO: 114086 - DNA, 20 bp, Homo sapiens
tggattgaatggaagaaagt

SEQ ID NO: 114087 - DNA, 19 bp, Homo sapiens
ttctgtgaagaaagtcaat

SEQ ID NO: 114088 - DNA, 23 bp, Homo sapiens
actcacagactgagtaacgtgta

SEQ ID NO: 114089 - DNA, 22 bp, Homo sapiens
agtaggagctacatcttatgtt

SEQ ID NO: 114090 - DNA, 23 bp, Homo sapiens
atatgtgtatatgtatatatgta

SEQ ID NO: 114091 - DNA, 18 bp, Homo sapiens
aacccattcccacaatga

SEQ ID NO: 114092 - DNA, 22 bp, Homo sapiens
tatgtaatgtgtatatctatat

SEQ ID NO: 114093 - DNA, 23 bp, Homo sapiens
ttttagtagagacaggatttggt

SEQ ID NO: 114094 - DNA, 18 bp, Homo sapiens
aatgcgatttaaatgaag

SEQ ID NO: 114095 - DNA, 18 bp, Homo sapiens
tggatgaagttagtctaa

SEQ ID NO: 114096 - DNA, 22 bp, Homo sapiens
aagtattagaaaatggattgaa

SEQ ID NO: 114097 - DNA, 21 bp, Homo sapiens
acatgtgcacattgtgcaggt

SEQ ID NO: 114098 - DNA, 23 bp, Homo sapiens
atgtgtgtctctgtatgtgagat

SEQ ID NO: 114099 - DNA, 21 bp, Homo sapiens
acagcacactgatgggtcttg

SEQ ID NO: 114100 - DNA, 23 bp, Homo sapiens
aacatggtatacatatgtgtgtg

SEQ ID NO: 114101 - DNA, 23 bp, Homo sapiens
tctaatcatcatagtttgaccag

SEQ ID NO: 114102 - DNA, 23 bp, Homo sapiens
tgtaacacttctcattttcttta

SEQ ID NO: 114103 - DNA, 23 bp, Homo sapiens
ttctttagctgcacagaagctct

SEQ ID NO: 114104 - DNA, 22 bp, Homo sapiens
ttattggacaatttctactaga

SEQ ID NO: 114105 - DNA, 19 bp, Homo sapiens
ataatgttgaatatatatg

SEQ ID NO: 114106 - DNA, 23 bp, Homo sapiens
tatgtggttttgatttgcatttc

SEQ ID NO: 114107 - DNA, 21 bp, Homo sapiens
agtaagcttaagtatttctag

SEQ ID NO: 114108 - DNA, 22 bp, Homo sapiens
tacatgtgcacaatgtgcaggt

SEQ ID NO: 114109 - DNA, 23 bp, Homo sapiens
ataggtttatgtggatctggaaa

SEQ ID NO: 114110 - DNA, 23 bp, Homo sapiens
aatctcactctgtctgtcaccca

SEQ ID NO: 114111 - DNA, 20 bp, Homo sapiens
agtcaatctcatgggaggtg

SEQ ID NO: 114112 - DNA, 23 bp, Homo sapiens
aaaagtttatttgtaaatgagtt

SEQ ID NO: 114113 - DNA, 23 bp, Homo sapiens
taatctcagctggcaactgtgag

SEQ ID NO: 114114 - DNA, 23 bp, Homo sapiens
tactgcatcaggaactgattgga

SEQ ID NO: 114115 - DNA, 19 bp, Homo sapiens
atcagttcctaatgcattg

SEQ ID NO: 114116 - DNA, 22 bp, Homo sapiens
tgtgtaggtgtggctgtgtgta

SEQ ID NO: 114117 - DNA, 23 bp, Homo sapiens
cggagtctcgctctgtctcccag

SEQ ID NO: 114118 - DNA, 23 bp, Homo sapiens
aaagtctatatatatatgtgtgt

SEQ ID NO: 114119 - DNA, 23 bp, Homo sapiens
tcactctgccactctgtcaccca

SEQ ID NO: 114120 - DNA, 23 bp, Homo sapiens
agttgccttgaaaatggaaactt

SEQ ID NO: 114121 - DNA, 21 bp, Homo sapiens
agaaagtttgttttttttcaa

SEQ ID NO: 114122 - DNA, 23 bp, Homo sapiens
cttttcttctttttctgagacag

SEQ ID NO: 114123 - DNA, 23 bp, Homo sapiens
acagaacaaggttaacagagaga

SEQ ID NO: 114124 - DNA, 19 bp, Homo sapiens
taatgcaaggtttactttt

SEQ ID NO: 114125 - DNA, 23 bp, Homo sapiens
aaaagatgagatccttcagaagg

SEQ ID NO: 114126 - DNA, 23 bp, Homo sapiens
agatggagtctcgctctgtcacc

SEQ ID NO: 114127 - DNA, 22 bp, Homo sapiens
tcaatggcattttgtagatgtt

SEQ ID NO: 114128 - DNA, 23 bp, Homo sapiens
atgagtctcactctgtcacccag

SEQ ID NO: 114129 - DNA, 23 bp, Homo sapiens
tattatgaattcttttgaaaagt

SEQ ID NO: 114130 - DNA, 18 bp, Homo sapiens
agcaaattcttagactga

SEQ ID NO: 114131 - DNA, 23 bp, Homo sapiens
acgtagcaagattctgtctctaa

SEQ ID NO: 114132 - DNA, 20 bp, Homo sapiens
tcactctgtcactgaggctg

SEQ ID NO: 114133 - DNA, 23 bp, Homo sapiens
tctcactgactctcaagccttga

SEQ ID NO: 114134 - DNA, 23 bp, Homo sapiens
ttttgagacggagtcttgctctg

SEQ ID NO: 114135 - DNA, 23 bp, Homo sapiens
ggttgcagtgagccaagattgtg

SEQ ID NO: 114136 - DNA, 23 bp, Homo sapiens
gaaagtgttgggattacatgcgt

SEQ ID NO: 114137 - DNA, 21 bp, Homo sapiens
ctcactgcagtctcagtctcc

SEQ ID NO: 114138 - DNA, 20 bp, Homo sapiens
ccctgggtccctgcgtgcca

SEQ ID NO: 114139 - DNA, 23 bp, Homo sapiens
tgtcaattatttttgctgatact

SEQ ID NO: 114140 - DNA, 23 bp, Homo sapiens
cagagtctcactctgtcacccag

SEQ ID NO: 114141 - DNA, 18 bp, Homo sapiens
ctgtaataccagcacttt

SEQ ID NO: 114142 - DNA, 20 bp, Homo sapiens
aattttgggcattttatact

SEQ ID NO: 114143 - DNA, 19 bp, Homo sapiens
tttgttctttttgcttagg

SEQ ID NO: 114144 - DNA, 23 bp, Homo sapiens
ttctgtgaagaaagtcaatagta

SEQ ID NO: 114145 - DNA, 23 bp, Homo sapiens
ttatgtcagctttttagtctgcc

SEQ ID NO: 114146 - DNA, 23 bp, Homo sapiens
tgagttcattgtagattctggat

SEQ ID NO: 114147 - DNA, 23 bp, Homo sapiens
tgagttcattgtagattctggat

SEQ ID NO: 114148 - DNA, 23 bp, Homo sapiens
agcctgagttctgatcatggagt

SEQ ID NO: 114149 - DNA, 23 bp, Homo sapiens
aaatatctggatcacaaagcctt

SEQ ID NO: 114150 - DNA, 23 bp, Homo sapiens
tacaaagcaatagaaaactgcat

SEQ ID NO: 114151 - DNA, 23 bp, Homo sapiens
atgtgtgtatatatgttgagatg

SEQ ID NO: 114152 - DNA, 22 bp, Homo sapiens
tgtgtgtatatatgtgtatgtg

SEQ ID NO: 114153 - DNA, 19 bp, Homo sapiens
gcatgtatatatgtgtgta

SEQ ID NO: 114154 - DNA, 23 bp, Homo sapiens
gtatgtgtatgtttatatgtgtg

SEQ ID NO: 114155 - DNA, 23 bp, Homo sapiens
tgtgtgtgtatatatgtgtgtgt

SEQ ID NO: 114156 - DNA, 23 bp, Homo sapiens
tgagttcattgtagattctggat

SEQ ID NO: 114157 - DNA, 23 bp, Homo sapiens
tgagttcattgtagattctggat

SEQ ID NO: 114158 - DNA, 23 bp, Homo sapiens
ctctccactgttttactcactgt

SEQ ID NO: 114159 - DNA, 23 bp, Homo sapiens
agaagtgatttagttgttgggta

SEQ ID NO: 114160 - DNA, 23 bp, Homo sapiens
tatttccaaatgtaatgtgattt

SEQ ID NO: 114161 - DNA, 23 bp, Homo sapiens
tgagtctcgctctgtcactcagt

SEQ ID NO: 114162 - DNA, 21 bp, Homo sapiens
gtctctcactctgtggcccag

SEQ ID NO: 114163 - DNA, 19 bp, Homo sapiens
gtctcgctctgtcacccag

SEQ ID NO: 114164 - DNA, 23 bp, Homo sapiens
gtatgacaatgaatttgcattgg

SEQ ID NO: 114165 - DNA, 23 bp, Homo sapiens
gtgtgtatatatatacatatgtg

SEQ ID NO: 114166 - DNA, 18 bp, Homo sapiens
agggctttttttttcttt

SEQ ID NO: 114167 - DNA, 23 bp, Homo sapiens
gtaaatgtacaggtttaaattcc

SEQ ID NO: 114168 - DNA, 21 bp, Homo sapiens
aattccagttctcttactgtg

SEQ ID NO: 114169 - DNA, 23 bp, Homo sapiens
ttcattacactgtggattgagga

SEQ ID NO: 114170 - DNA, 23 bp, Homo sapiens
tgtgtgtgtgtatacatatgtgt

SEQ ID NO: 114171 - DNA, 20 bp, Homo sapiens
tgcacgcatgtatatatgta

SEQ ID NO: 114172 - DNA, 21 bp, Homo sapiens
atatgtatatgtatatgtata

SEQ ID NO: 114173 - DNA, 20 bp, Homo sapiens
tatatacatgtatatgtata

SEQ ID NO: 114174 - DNA, 18 bp, Homo sapiens
atacacacacatatatag

SEQ ID NO: 114175 - DNA, 20 bp, Homo sapiens
ataggtatatataggtgtat

SEQ ID NO: 114176 - DNA, 23 bp, Homo sapiens
tatgtgtgtgcttatgtaattat

SEQ ID NO: 114177 - DNA, 23 bp, Homo sapiens
aaagttctttcttcttgcatgta

SEQ ID NO: 114178 - DNA, 21 bp, Homo sapiens
tcacatgtaatagaatactta

SEQ ID NO: 114179 - DNA, 22 bp, Homo sapiens
aatcagggagtacatgtgcacg

SEQ ID NO: 114180 - DNA, 23 bp, Homo sapiens
aattcattattgaaaactgagat

SEQ ID NO: 114181 - DNA, 21 bp, Homo sapiens
tatagatatgtatatgtctat

SEQ ID NO: 114182 - DNA, 23 bp, Homo sapiens
taaatgtatacatgtatgcactt

SEQ ID NO: 114183 - DNA, 19 bp, Homo sapiens
ttagagtagaatgtgtgga

SEQ ID NO: 114184 - DNA, 23 bp, Homo sapiens
accgagtctcgctctgtcaccca

SEQ ID NO: 114185 - DNA, 23 bp, Homo sapiens
tgttttggttccatatgaaattt

SEQ ID NO: 114186 - DNA, 23 bp, Homo sapiens
taatagcttgtattgtaaaagct

SEQ ID NO: 114187 - DNA, 21 bp, Homo sapiens
tcactgtgtctctatgtggag

SEQ ID NO: 114188 - DNA, 23 bp, Homo sapiens
ggctgcatagtattcctgtgtgt

SEQ ID NO: 114189 - DNA, 22 bp, Homo sapiens
tctgaggctctgtctgggtctg

SEQ ID NO: 114190 - DNA, 21 bp, Homo sapiens
taattctccaattgctatcaa

SEQ ID NO: 114191 - DNA, 19 bp, Homo sapiens
gtgtgtgtgtgtatatagc

SEQ ID NO: 114192 - DNA, 22 bp, Homo sapiens
tatgtgtatacatacacacaca

SEQ ID NO: 114193 - DNA, 23 bp, Homo sapiens
gatacagtggaagagatacttgt

SEQ ID NO: 114194 - DNA, 23 bp, Homo sapiens
cggagtctcactctgtcacccag

SEQ ID NO: 114195 - DNA, 23 bp, Homo sapiens
gagtctcactctgtcacccaggc

SEQ ID NO: 114196 - DNA, 23 bp, Homo sapiens
taatgtggagaaagtgtactgct

SEQ ID NO: 114197 - DNA, 23 bp, Homo sapiens
tcctgtgatgatggtgattcttt

SEQ ID NO: 114198 - DNA, 19 bp, Homo sapiens
tctctttatttattgatga

SEQ ID NO: 114199 - DNA, 18 bp, Homo sapiens
aatgtatatgtatagata

SEQ ID NO: 114200 - DNA, 22 bp, Homo sapiens
taagattatatatatatgtgtg

SEQ ID NO: 114201 - DNA, 23 bp, Homo sapiens
cggagtctcgctctgtcgctcag

SEQ ID NO: 114202 - DNA, 19 bp, Homo sapiens
ttgcagtgatgggatctcc

SEQ ID NO: 114203 - DNA, 23 bp, Homo sapiens
aaatagatgttgacgtgggtgtc

SEQ ID NO: 114204 - DNA, 22 bp, Homo sapiens
ttgccagtgatgacagctgtaa

SEQ ID NO: 114205 - DNA, 23 bp, Homo sapiens
tgcaactttactgaatttgttca

SEQ ID NO: 114206 - DNA, 23 bp, Homo sapiens
gggagtctgtagtgtttctatat

SEQ ID NO: 114207 - DNA, 23 bp, Homo sapiens
tgagttcattgtagattctggat

SEQ ID NO: 114208 - DNA, 23 bp, Homo sapiens
tgagttcattgtagattctggat

SEQ ID NO: 114209 - DNA, 23 bp, Homo sapiens
tatattccaattgtaatgatttc

SEQ ID NO: 114210 - DNA, 21 bp, Homo sapiens
tgtgtgcatttgcatgtgcat

SEQ ID NO: 114211 - DNA, 23 bp, Homo sapiens
tctgtctctcccacactcccagc

SEQ ID NO: 114212 - DNA, 23 bp, Homo sapiens
cagtgcctgcagacttaaccaca

SEQ ID NO: 114213 - DNA, 23 bp, Homo sapiens
tgcctggctcgctgggtcccatg

SEQ ID NO: 114214 - DNA, 18 bp, Homo sapiens
ttgaagttcttgctgcta

SEQ ID NO: 114215 - DNA, 22 bp, Homo sapiens
tgtgtatatatgtatatgtgtg

SEQ ID NO: 114216 - DNA, 22 bp, Homo sapiens
atgtgtatatatgtatatatgt

SEQ ID NO: 114217 - DNA, 23 bp, Homo sapiens
tatatgtgtgtatatatgtgtgt

SEQ ID NO: 114218 - DNA, 23 bp, Homo sapiens
agactgaagtcactgtagagtgc

SEQ ID NO: 114219 - DNA, 23 bp, Homo sapiens
tttctcaatcaaaagatttgtct

SEQ ID NO: 114220 - DNA, 23 bp, Homo sapiens
aaacacagagagctttagaagag

SEQ ID NO: 114221 - DNA, 23 bp, Homo sapiens
attgactaaaaggagaagttttc

SEQ ID NO: 114222 - DNA, 23 bp, Homo sapiens
agatggagtctcactctgtcacc

SEQ ID NO: 114223 - DNA, 23 bp, Homo sapiens
tatgcagcatatgtatcaagagt

SEQ ID NO: 114224 - DNA, 22 bp, Homo sapiens
ttataacttttgtagaattcag

SEQ ID NO: 114225 - DNA, 22 bp, Homo sapiens
atatctttcattttttagggat

SEQ ID NO: 114226 - DNA, 23 bp, Homo sapiens
tgagacaagtctcgctctgtcac

SEQ ID NO: 114227 - DNA, 23 bp, Homo sapiens
gagtctctcactgtcacccaggc

SEQ ID NO: 114228 - DNA, 23 bp, Homo sapiens
ctcctgagtagctgggattacag

SEQ ID NO: 114229 - DNA, 23 bp, Homo sapiens
atgttgctttcctttcaagtgtc

SEQ ID NO: 114230 - DNA, 23 bp, Homo sapiens
ctcgtgtgtctgtgtgtctgacg

SEQ ID NO: 114231 - DNA, 18 bp, Homo sapiens
cagtgagctatgattgta

SEQ ID NO: 114232 - DNA, 18 bp, Homo sapiens
acactgcactccagccag

SEQ ID NO: 114233 - DNA, 23 bp, Homo sapiens
acagagagactccttttcttttt

SEQ ID NO: 114234 - DNA, 23 bp, Homo sapiens
tggagtctcgctctgtcacccag

SEQ ID NO: 114235 - DNA, 23 bp, Homo sapiens
tgacatggagtctcactctgtca

SEQ ID NO: 114236 - DNA, 23 bp, Homo sapiens
tgaatgagagtgaggacacatgg

SEQ ID NO: 114237 - DNA, 20 bp, Homo sapiens
atgtcatatataatatatga

SEQ ID NO: 114238 - DNA, 18 bp, Homo sapiens
tccctcccaggttcaagt

SEQ ID NO: 114239 - DNA, 23 bp, Homo sapiens
tgtcattctgtctgtctgtccat

SEQ ID NO: 114240 - DNA, 22 bp, Homo sapiens
ttgccagaagattcagagctca

SEQ ID NO: 114241 - DNA, 23 bp, Homo sapiens
tttaggaccatctttaagggctc

SEQ ID NO: 114242 - DNA, 23 bp, Homo sapiens
gatgtcacctgaaaatgcagtga

SEQ ID NO: 114243 - DNA, 23 bp, Homo sapiens
aataactgagtcattggtgatgg

SEQ ID NO: 114244 - DNA, 23 bp, Homo sapiens
gacaggctgtgtgtgtcactggg

SEQ ID NO: 114245 - DNA, 23 bp, Homo sapiens
ctctctctctctcaggtgccttt

SEQ ID NO: 114246 - DNA, 23 bp, Homo sapiens
attgtttgatttgaattgctaat

SEQ ID NO: 114247 - DNA, 19 bp, Homo sapiens
atatacaggttttgtgtgt

SEQ ID NO: 114248 - DNA, 23 bp, Homo sapiens
gtagcaagtgtctgtcactggct

SEQ ID NO: 114249 - DNA, 22 bp, Homo sapiens
actgagtcccactctgtcgccc

SEQ ID NO: 114250 - DNA, 23 bp, Homo sapiens
tttctctatgaaaagccttgcct

SEQ ID NO: 114251 - DNA, 23 bp, Homo sapiens
actctggctcttactgactctgt

SEQ ID NO: 114252 - DNA, 20 bp, Homo sapiens
atatgtatatgtatatatgt

SEQ ID NO: 114253 - DNA, 23 bp, Homo sapiens
gagcctccctctctcagtccctg

SEQ ID NO: 114254 - DNA, 19 bp, Homo sapiens
tcagtagggaataggtgcc

SEQ ID NO: 114255 - DNA, 23 bp, Homo sapiens
tgaagtctcactctgtcacccag

SEQ ID NO: 114256 - DNA, 23 bp, Homo sapiens
actttcactctcttactctcagg

SEQ ID NO: 114257 - DNA, 19 bp, Homo sapiens
tttgagatggagtcttgct

SEQ ID NO: 114258 - DNA, 20 bp, Homo sapiens
gtctcactctgtcatccagg

SEQ ID NO: 114259 - DNA, 19 bp, Homo sapiens
tctgtctttctcacatata

SEQ ID NO: 114260 - DNA, 23 bp, Homo sapiens
tacagtagagagcagatagagag

SEQ ID NO: 114261 - DNA, 23 bp, Homo sapiens
tatagtgtatatgtatatatgtg

SEQ ID NO: 114262 - DNA, 21 bp, Homo sapiens
aagcttcacatggactagctc

SEQ ID NO: 114263 - DNA, 19 bp, Homo sapiens
atacacacatatatatgtg

SEQ ID NO: 114264 - DNA, 23 bp, Homo sapiens
gagttccagagacagatactgct

SEQ ID NO: 114265 - DNA, 23 bp, Homo sapiens
cctccctgtgtgcctgtgttctc

SEQ ID NO: 114266 - DNA, 22 bp, Homo sapiens
tatgagtgagaacacacggtgt

SEQ ID NO: 114267 - DNA, 23 bp, Homo sapiens
actccatgtatatatctatagag

SEQ ID NO: 114268 - DNA, 22 bp, Homo sapiens
attctacatcatggtgagttgt

SEQ ID NO: 114269 - DNA, 21 bp, Homo sapiens
tgtgaagaaagtcaatggtag

SEQ ID NO: 114270 - DNA, 23 bp, Homo sapiens
tgagacagagtctcgctctgtcg

SEQ ID NO: 114271 - DNA, 23 bp, Homo sapiens
tagattcagcaagtacatgtgca

SEQ ID NO: 114272 - DNA, 19 bp, Homo sapiens
acagagtcttgctgtgtca

SEQ ID NO: 114273 - DNA, 23 bp, Homo sapiens
tactgtgtatatgtatatatctg

SEQ ID NO: 114274 - DNA, 23 bp, Homo sapiens
gagtctcactctgtcacccaggc

SEQ ID NO: 114275 - DNA, 23 bp, Homo sapiens
tgagttcattgtagattctggat

SEQ ID NO: 114276 - DNA, 23 bp, Homo sapiens
tgagttcattgtagattctggat

SEQ ID NO: 114277 - DNA, 18 bp, Homo sapiens
atagaagcaagagagagg

SEQ ID NO: 114278 - DNA, 21 bp, Homo sapiens
aaggacaaggtcttgctctgt

SEQ ID NO: 114279 - DNA, 19 bp, Homo sapiens
aaggctcagaaaggtgaat

SEQ ID NO: 114280 - DNA, 23 bp, Homo sapiens
tcccagagcccctggaactctgg

SEQ ID NO: 114281 - DNA, 23 bp, Homo sapiens
attcaaacttaatgaacgtagtt

SEQ ID NO: 114282 - DNA, 23 bp, Homo sapiens
cttcaacatggatttgtttttgt

SEQ ID NO: 114283 - DNA, 20 bp, Homo sapiens
aatctgctatttcatttgcg

SEQ ID NO: 114284 - DNA, 23 bp, Homo sapiens
tctacagtgtagatcgtttagtc

SEQ ID NO: 114285 - DNA, 18 bp, Homo sapiens
accagacactgcctctcc

SEQ ID NO: 114286 - DNA, 23 bp, Homo sapiens
taagtgacattttgtagtagtga

SEQ ID NO: 114287 - DNA, 18 bp, Homo sapiens
ttttttgttgttgttggg

SEQ ID NO: 114288 - DNA, 23 bp, Homo sapiens
tgtggaagaagctagttttggaa

SEQ ID NO: 114289 - DNA, 23 bp, Homo sapiens
gtgtgtgtcagtgagtgtctgtg

SEQ ID NO: 114290 - DNA, 23 bp, Homo sapiens
tgtgtgcattactttggctgtgt

SEQ ID NO: 114291 - DNA, 22 bp, Homo sapiens
ttgaggtaggaggttcacttga

SEQ ID NO: 114292 - DNA, 20 bp, Homo sapiens
gcagtgagctgtgatcctgc

SEQ ID NO: 114293 - DNA, 23 bp, Homo sapiens
tggagtctcactctgtcacccag

SEQ ID NO: 114294 - DNA, 23 bp, Homo sapiens
tggagtctcactctgtcacccag

SEQ ID NO: 114295 - DNA, 23 bp, Homo sapiens
tgagttcattgtagattctggat

SEQ ID NO: 114296 - DNA, 23 bp, Homo sapiens
tgagttcattgtagattctggat

SEQ ID NO: 114297 - DNA, 23 bp, Homo sapiens
actgggtctcacactgtcaccca

SEQ ID NO: 114298 - DNA, 23 bp, Homo sapiens
agagagtctcactctgtcaccca

SEQ ID NO: 114299 - DNA, 20 bp, Homo sapiens
tctgggattggtaaatcagt

SEQ ID NO: 114300 - DNA, 22 bp, Homo sapiens
gatgaagtctcactctgtcacc

SEQ ID NO: 114301 - DNA, 23 bp, Homo sapiens
cagagcaagattctgtctcaaaa

SEQ ID NO: 114302 - DNA, 23 bp, Homo sapiens
tgagaaggatctcactctgttgt

SEQ ID NO: 114303 - DNA, 19 bp, Homo sapiens
agattttctcatgcataac

SEQ ID NO: 114304 - DNA, 18 bp, Homo sapiens
acgttctgtgagtcaggg

SEQ ID NO: 114305 - DNA, 23 bp, Homo sapiens
tattaagtgcatattcttttttt

SEQ ID NO: 114306 - DNA, 22 bp, Homo sapiens
acacgacagagagcacacttgg

SEQ ID NO: 114307 - DNA, 21 bp, Homo sapiens
tgtgaagtgcctgctctcgct

SEQ ID NO: 114308 - DNA, 23 bp, Homo sapiens
tgagatggagtctcactctgtca

SEQ ID NO: 114309 - DNA, 23 bp, Homo sapiens
ttttgagacgcagtcttgctctg

SEQ ID NO: 114310 - DNA, 23 bp, Homo sapiens
aggatctatctatctgtctgtct

SEQ ID NO: 114311 - DNA, 23 bp, Homo sapiens
cattagtgatgatgatgatgatg

SEQ ID NO: 114312 - DNA, 18 bp, Homo sapiens
atgaaaaacattaaggat

SEQ ID NO: 114313 - DNA, 23 bp, Homo sapiens
tgttttgtatagaggatgctctt

SEQ ID NO: 114314 - DNA, 23 bp, Homo sapiens
gacagagtctcactctgtggccc

SEQ ID NO: 114315 - DNA, 18 bp, Homo sapiens
acacacacacatatatat

SEQ ID NO: 114316 - DNA, 21 bp, Homo sapiens
tacagtgtatatatatatgcg

SEQ ID NO: 114317 - DNA, 23 bp, Homo sapiens
ccagagtctcactctgtcaccgg

SEQ ID NO: 114318 - DNA, 22 bp, Homo sapiens
acagtatacatgtacagtatac

SEQ ID NO: 114319 - DNA, 23 bp, Homo sapiens
gtctgtcccctttctcactctct

SEQ ID NO: 114320 - DNA, 23 bp, Homo sapiens
ataaggaatgtattgatgtttca

SEQ ID NO: 114321 - DNA, 23 bp, Homo sapiens
acatttcttgtatgttttgcctc

SEQ ID NO: 114322 - DNA, 23 bp, Homo sapiens
tgactagtgtctgtgatttcttc

SEQ ID NO: 114323 - DNA, 23 bp, Homo sapiens
agttgttagtagacactgtggtg

SEQ ID NO: 114324 - DNA, 23 bp, Homo sapiens
tgaattatatgtgtgtgtgtgta

SEQ ID NO: 114325 - DNA, 23 bp, Homo sapiens
atacacacagagattgaaatgtt

SEQ ID NO: 114326 - DNA, 23 bp, Homo sapiens
atatatctgtatgtgtatatatg

SEQ ID NO: 114327 - DNA, 22 bp, Homo sapiens
tgtctctgaagagtttatgttg

SEQ ID NO: 114328 - DNA, 22 bp, Homo sapiens
taaaattggccaatgagtttca

SEQ ID NO: 114329 - DNA, 22 bp, Homo sapiens
tatgtgtacacacatgcacaaa

SEQ ID NO: 114330 - DNA, 20 bp, Homo sapiens
catgtatgtatatgtacatg

SEQ ID NO: 114331 - DNA, 23 bp, Homo sapiens
gctgtctctgtgtggttcctcgt

SEQ ID NO: 114332 - DNA, 21 bp, Homo sapiens
cagggtctcactctgtcaccc

SEQ ID NO: 114333 - DNA, 23 bp, Homo sapiens
tgtgcttgctgtctcagaaaagt

SEQ ID NO: 114334 - DNA, 23 bp, Homo sapiens
gtgagtgtgcatatgtacacaca

SEQ ID NO: 114335 - DNA, 23 bp, Homo sapiens
tctttgggagtgggtcttaactc

SEQ ID NO: 114336 - DNA, 22 bp, Homo sapiens
tacatatatatgatatgtgtgt

SEQ ID NO: 114337 - DNA, 21 bp, Homo sapiens
tctctatataaatatatgtgt

SEQ ID NO: 114338 - DNA, 18 bp, Homo sapiens
tctataacatttctctaa

SEQ ID NO: 114339 - DNA, 20 bp, Homo sapiens
tgtgtatacatatacgtgta

SEQ ID NO: 114340 - DNA, 23 bp, Homo sapiens
gaagaagtagcttgtcttgtttc

SEQ ID NO: 114341 - DNA, 23 bp, Homo sapiens
tcagaagagagaaagcagtgggt

SEQ ID NO: 114342 - DNA, 23 bp, Homo sapiens
atattctttggatatggtatgga

SEQ ID NO: 114343 - DNA, 23 bp, Homo sapiens
atgactttccttattgtaattgg

SEQ ID NO: 114344 - DNA, 23 bp, Homo sapiens
gactggtctcactctgtcaccca

SEQ ID NO: 114345 - DNA, 23 bp, Homo sapiens
taaattgtatttcaaatagccac

SEQ ID NO: 114346 - DNA, 23 bp, Homo sapiens
ggctctctctctgtctgtgtata

SEQ ID NO: 114347 - DNA, 19 bp, Homo sapiens
cagtggtgtgatcttggct

SEQ ID NO: 114348 - DNA, 20 bp, Homo sapiens
acaccgggacaaagtggcac

SEQ ID NO: 114349 - DNA, 23 bp, Homo sapiens
acagagtctcgcactgtcacccg

SEQ ID NO: 114350 - DNA, 18 bp, Homo sapiens
atgcagaagaagggtata

SEQ ID NO: 114351 - DNA, 23 bp, Homo sapiens
gacagagactccctctgtcaccc

SEQ ID NO: 114352 - DNA, 18 bp, Homo sapiens
tatatatgcatgtgtgtg

SEQ ID NO: 114353 - DNA, 22 bp, Homo sapiens
tgatataagcagattgaggtat

SEQ ID NO: 114354 - DNA, 23 bp, Homo sapiens
tgggggtctcactttgttgtcca

SEQ ID NO: 114355 - DNA, 18 bp, Homo sapiens
gcagacagtgacactctg

SEQ ID NO: 114356 - DNA, 23 bp, Homo sapiens
aggttgattccatgtctttgcta

SEQ ID NO: 114357 - DNA, 23 bp, Homo sapiens
tgagttcattgtagattctggat

SEQ ID NO: 114358 - DNA, 23 bp, Homo sapiens
tgagttcattgtagattctggat

SEQ ID NO: 114359 - DNA, 19 bp, Homo sapiens
tatcatatgaacctaacag

SEQ ID NO: 114360 - DNA, 23 bp, Homo sapiens
tctgtgcatctatgttttccttt

SEQ ID NO: 114361 - DNA, 22 bp, Homo sapiens
ttccattttatatatgtgtgta

SEQ ID NO: 114362 - DNA, 23 bp, Homo sapiens
tatgtatgtgtgtatatgtacac

SEQ ID NO: 114363 - DNA, 19 bp, Homo sapiens
tgaggaatttagaagtaat

SEQ ID NO: 114364 - DNA, 23 bp, Homo sapiens
taagtctgtctgcaaaccatatg

SEQ ID NO: 114365 - DNA, 22 bp, Homo sapiens
tggtgtgtgcctgtggtcctag

SEQ ID NO: 114366 - DNA, 20 bp, Homo sapiens
atcatatgtttttttcttgt

SEQ ID NO: 114367 - DNA, 22 bp, Homo sapiens
tgttcctgtagtctcagctgct

SEQ ID NO: 114368 - DNA, 22 bp, Homo sapiens
tttcgagatggagtcttgctct

SEQ ID NO: 114369 - DNA, 23 bp, Homo sapiens
aaaggttggatcagaggacctct

SEQ ID NO: 114370 - DNA, 23 bp, Homo sapiens
cctttcctgctccttcagcttgc

SEQ ID NO: 114371 - DNA, 23 bp, Homo sapiens
agtctcgctctgtcactggctgg

SEQ ID NO: 114372 - DNA, 18 bp, Homo sapiens
gcattggtgagatcttgg

SEQ ID NO: 114373 - DNA, 22 bp, Homo sapiens
tttttagtacatatccattgat

SEQ ID NO: 114374 - DNA, 23 bp, Homo sapiens
atacgcaatttgtatttgtgtgg

SEQ ID NO: 114375 - DNA, 23 bp, Homo sapiens
agttcctttctattcctaagtga

SEQ ID NO: 114376 - DNA, 23 bp, Homo sapiens
cttgataatcagtctcctgttga

SEQ ID NO: 114377 - DNA, 21 bp, Homo sapiens
tatgtctatatatagatatgt

SEQ ID NO: 114378 - DNA, 21 bp, Homo sapiens
tatatctatatatagatatgt

SEQ ID NO: 114379 - DNA, 23 bp, Homo sapiens
acactcttgtatatgtaaggata

SEQ ID NO: 114380 - DNA, 21 bp, Homo sapiens
tgtcagtgtgactctgggact

SEQ ID NO: 114381 - DNA, 18 bp, Homo sapiens
ccatcttttagtattggt

SEQ ID NO: 114382 - DNA, 23 bp, Homo sapiens
taaatgtggtttgattttctttt

SEQ ID NO: 114383 - DNA, 20 bp, Homo sapiens
tgtgtgtatatataggtatg

SEQ ID NO: 114384 - DNA, 18 bp, Homo sapiens
gtgtctgtgtgtgtatat

SEQ ID NO: 114385 - DNA, 19 bp, Homo sapiens
gaaagtcaatggcagcttt

SEQ ID NO: 114386 - DNA, 23 bp, Homo sapiens
tgagttcattgtagattctggat

SEQ ID NO: 114387 - DNA, 23 bp, Homo sapiens
tgagttcattgtagattctggat

SEQ ID NO: 114388 - DNA, 23 bp, Homo sapiens
ataaatggttgcatatgtaatat

SEQ ID NO: 114389 - DNA, 23 bp, Homo sapiens
atttgctgaatatattgcaatga

SEQ ID NO: 114390 - DNA, 18 bp, Homo sapiens
tgctatgtatacatatat

SEQ ID NO: 114391 - DNA, 22 bp, Homo sapiens
ttagatctgtagctgcactgaa

SEQ ID NO: 114392 - DNA, 19 bp, Homo sapiens
tatgtctctacatttgcag

SEQ ID NO: 114393 - DNA, 21 bp, Homo sapiens
taaagtgctgggattacaagt

SEQ ID NO: 114394 - DNA, 23 bp, Homo sapiens
caggtctggaggcggttgtgtgt

SEQ ID NO: 114395 - DNA, 23 bp, Homo sapiens
atgactgtcctgtcaaagcagtt

SEQ ID NO: 114396 - DNA, 20 bp, Homo sapiens
tgtgtatatgtatacatatc

SEQ ID NO: 114397 - DNA, 23 bp, Homo sapiens
tgtgtgtgtgtatatatatacac

SEQ ID NO: 114398 - DNA, 18 bp, Homo sapiens
tatgtgtatatatataca

SEQ ID NO: 114399 - DNA, 22 bp, Homo sapiens
tgcctgcgtgtgtacgtgcatg

SEQ ID NO: 114400 - DNA, 23 bp, Homo sapiens
attatgctgattttgtagatcaa

SEQ ID NO: 114401 - DNA, 19 bp, Homo sapiens
attcctacagataatggtt

SEQ ID NO: 114402 - DNA, 23 bp, Homo sapiens
atagttttctatatgttatgtag

SEQ ID NO: 114403 - DNA, 23 bp, Homo sapiens
tgagttcattgtagattctggat

SEQ ID NO: 114404 - DNA, 23 bp, Homo sapiens
tgagttcattgtagattctggat

SEQ ID NO: 114405 - DNA, 23 bp, Homo sapiens
tctccttgggagaagatactgaa

SEQ ID NO: 114406 - DNA, 23 bp, Homo sapiens
aaaagtttggaacactgaaatta

SEQ ID NO: 114407 - DNA, 23 bp, Homo sapiens
gtgactgcacatgctctgtcact

SEQ ID NO: 114408 - DNA, 20 bp, Homo sapiens
tatttagtatttgctttgat

SEQ ID NO: 114409 - DNA, 23 bp, Homo sapiens
gacagagtctcgctctgtcaccc

SEQ ID NO: 114410 - DNA, 23 bp, Homo sapiens
aattaggttgttgagagaagaaa

SEQ ID NO: 114411 - DNA, 23 bp, Homo sapiens
cagtgtctcactctgtcacccag

SEQ ID NO: 114412 - DNA, 23 bp, Homo sapiens
ttttgagacggagtcttgctctg

SEQ ID NO: 114413 - DNA, 23 bp, Homo sapiens
tgagttcattgtagattctggat

SEQ ID NO: 114414 - DNA, 23 bp, Homo sapiens
tgagttcattgtagattctggat

SEQ ID NO: 114415 - DNA, 23 bp, Homo sapiens
ttttgagatgatgatgatgatga

SEQ ID NO: 114416 - DNA, 21 bp, Homo sapiens
aatcatcatcatcattactgt

SEQ ID NO: 114417 - DNA, 20 bp, Homo sapiens
tgagacagagtttcactctg

SEQ ID NO: 114418 - DNA, 20 bp, Homo sapiens
ctgactttggagatttttgt

SEQ ID NO: 114419 - DNA, 19 bp, Homo sapiens
tgagatggagtcttgctct

SEQ ID NO: 114420 - DNA, 23 bp, Homo sapiens
agatggagtctcactctgtcacc

SEQ ID NO: 114421 - DNA, 21 bp, Homo sapiens
tatacgagatatatcatatga

SEQ ID NO: 114422 - DNA, 21 bp, Homo sapiens
tgaggtagaaggatgacttga

SEQ ID NO: 114423 - DNA, 23 bp, Homo sapiens
agacagggtctcactctgtcatc

SEQ ID NO: 114424 - DNA, 20 bp, Homo sapiens
aactatatatgtatgtgcat

SEQ ID NO: 114425 - DNA, 20 bp, Homo sapiens
aaaggagagaagccagcaga

SEQ ID NO: 114426 - DNA, 22 bp, Homo sapiens
agactgggtctcgctctgtcac

SEQ ID NO: 114427 - DNA, 23 bp, Homo sapiens
tttacactcagtaaattctatgt

SEQ ID NO: 114428 - DNA, 18 bp, Homo sapiens
ttgttgaagtaaacatat

SEQ ID NO: 114429 - DNA, 22 bp, Homo sapiens
tatatgtatatgtatatatgta

SEQ ID NO: 114430 - DNA, 18 bp, Homo sapiens
atgtatatatgtatatgt

SEQ ID NO: 114431 - DNA, 23 bp, Homo sapiens
gtatgtgtgtgtgcatgtgcatg

SEQ ID NO: 114432 - DNA, 23 bp, Homo sapiens
tctgtctctggctctcttcctcc

SEQ ID NO: 114433 - DNA, 21 bp, Homo sapiens
acacagattctctctctgtgc

SEQ ID NO: 114434 - DNA, 23 bp, Homo sapiens
tgagttcattgtagattctggat

SEQ ID NO: 114435 - DNA, 23 bp, Homo sapiens
tgagttcattgtagattctggat

SEQ ID NO: 114436 - DNA, 23 bp, Homo sapiens
tctctgtctcagtctctttgtct

SEQ ID NO: 114437 - DNA, 23 bp, Homo sapiens
gggattttcttgttgatatctga

SEQ ID NO: 114438 - DNA, 23 bp, Homo sapiens
ctaagtccatttgtatgtgcttt

SEQ ID NO: 114439 - DNA, 23 bp, Homo sapiens
tgtgagggtttggaagaattgac

SEQ ID NO: 114440 - DNA, 21 bp, Homo sapiens
cacacttctctctgggacagt

SEQ ID NO: 114441 - DNA, 23 bp, Homo sapiens
tcttgctctgtcacccagtctgg

SEQ ID NO: 114442 - DNA, 23 bp, Homo sapiens
gctggaagagactgaggacactg

SEQ ID NO: 114443 - DNA, 23 bp, Homo sapiens
tttgtgtctgtgactggactttc

SEQ ID NO: 114444 - DNA, 23 bp, Homo sapiens
aagtacaagttcctagagtggag

SEQ ID NO: 114445 - DNA, 23 bp, Homo sapiens
tctcactgtggttttgatttgca

SEQ ID NO: 114446 - DNA, 20 bp, Homo sapiens
atctgtatgtcataggaaga

SEQ ID NO: 114447 - DNA, 23 bp, Homo sapiens
ggaaacacaatgctaattgtgtg

SEQ ID NO: 114448 - DNA, 23 bp, Homo sapiens
tatgtatatgtatgtatatatgt

SEQ ID NO: 114449 - DNA, 21 bp, Homo sapiens
cacacatagaatacatacgtg

SEQ ID NO: 114450 - DNA, 23 bp, Homo sapiens
gagtctcactcactctgtcgccc

SEQ ID NO: 114451 - DNA, 22 bp, Homo sapiens
atgatgatttcatatgatgaaa

SEQ ID NO: 114452 - DNA, 23 bp, Homo sapiens
acagatgagtggcagcagtccag

SEQ ID NO: 114453 - DNA, 23 bp, Homo sapiens
gtgagagttgagtctgagacagg

SEQ ID NO: 114454 - DNA, 23 bp, Homo sapiens
tatttctgtctctgaaacatgtg

SEQ ID NO: 114455 - DNA, 23 bp, Homo sapiens
gggttctgtgcacaaaggagttt

SEQ ID NO: 114456 - DNA, 22 bp, Homo sapiens
actcttgaagagccacaactct

SEQ ID NO: 114457 - DNA, 23 bp, Homo sapiens
tgagttcattgtagattctggat

SEQ ID NO: 114458 - DNA, 23 bp, Homo sapiens
tgagttcattgtagattctggat

SEQ ID NO: 114459 - DNA, 23 bp, Homo sapiens
actgacaacagcaagaagtgtca

SEQ ID NO: 114460 - DNA, 22 bp, Homo sapiens
tatttctgttcagcctgtgagc

SEQ ID NO: 114461 - DNA, 23 bp, Homo sapiens
ggtcacagagaactcagtgtggt

SEQ ID NO: 114462 - DNA, 23 bp, Homo sapiens
tgaagcaaagttcaaagaggaga

SEQ ID NO: 114463 - DNA, 23 bp, Homo sapiens
gggaggcagagatctgtgtttct

SEQ ID NO: 114464 - DNA, 23 bp, Homo sapiens
cagaatctcactctgtcacccag

SEQ ID NO: 114465 - DNA, 19 bp, Homo sapiens
tgaggtaggaggatcattt

SEQ ID NO: 114466 - DNA, 23 bp, Homo sapiens
ctgtctggctcagtcacagcttc

SEQ ID NO: 114467 - DNA, 20 bp, Homo sapiens
cactaattctctctctgagt

SEQ ID NO: 114468 - DNA, 20 bp, Homo sapiens
tgtgtgtactacattttgga

SEQ ID NO: 114469 - DNA, 22 bp, Homo sapiens
gacagggtctcactctgtcacc

SEQ ID NO: 114470 - DNA, 23 bp, Homo sapiens
ttaaacatatacttgcagctgag

SEQ ID NO: 114471 - DNA, 23 bp, Homo sapiens
tatctacttctacagctgttgag

SEQ ID NO: 114472 - DNA, 23 bp, Homo sapiens
ctgtctgtgcttcatctttctcc

SEQ ID NO: 114473 - DNA, 19 bp, Homo sapiens
acacagaagactgtcagaa

SEQ ID NO: 114474 - DNA, 23 bp, Homo sapiens
aaccacaagtacaaatacagcac

SEQ ID NO: 114475 - DNA, 22 bp, Homo sapiens
atatatgtatatgtatatatgt

SEQ ID NO: 114476 - DNA, 23 bp, Homo sapiens
tgaggtggagtctcactctgtca

SEQ ID NO: 114477 - DNA, 23 bp, Homo sapiens
tatgtgtgtgtatatatatgtgt

SEQ ID NO: 114478 - DNA, 23 bp, Homo sapiens
tcattcactgatttttttcattt

SEQ ID NO: 114479 - DNA, 19 bp, Homo sapiens
attgctctaggtgttagga

SEQ ID NO: 114480 - DNA, 22 bp, Homo sapiens
aactctctttgtttttggactc

SEQ ID NO: 114481 - DNA, 23 bp, Homo sapiens
agtgacttatacctgtaatccca

SEQ ID NO: 114482 - DNA, 22 bp, Homo sapiens
ctgcaatacatatgtgtgtata

SEQ ID NO: 114483 - DNA, 22 bp, Homo sapiens
tttaatatgtatatgtaatgtg

SEQ ID NO: 114484 - DNA, 23 bp, Homo sapiens
tactgtttttcttcatgtagcct

SEQ ID NO: 114485 - DNA, 23 bp, Homo sapiens
gacagtctctcactctgttgcca

SEQ ID NO: 114486 - DNA, 23 bp, Homo sapiens
tccctacacagtctctgagtcac

SEQ ID NO: 114487 - DNA, 18 bp, Homo sapiens
tggagttctgattgttcc

SEQ ID NO: 114488 - DNA, 20 bp, Homo sapiens
caagagtgagactccgtctc

SEQ ID NO: 114489 - DNA, 21 bp, Homo sapiens
tttgagacagagtctcaccct

SEQ ID NO: 114490 - DNA, 23 bp, Homo sapiens
tgcacactggcctcactgtctct

SEQ ID NO: 114491 - DNA, 22 bp, Homo sapiens
tctgtctgtgagtcctccctga

SEQ ID NO: 114492 - DNA, 23 bp, Homo sapiens
gaatgaatgaatgaatgggagag

SEQ ID NO: 114493 - DNA, 22 bp, Homo sapiens
atgtatgtatacatgtatgtac

SEQ ID NO: 114494 - DNA, 23 bp, Homo sapiens
attatgtggtgggttccgtctct

SEQ ID NO: 114495 - DNA, 21 bp, Homo sapiens
ctgtctctgtcttactggaag

SEQ ID NO: 114496 - DNA, 23 bp, Homo sapiens
tttgagacagagtctcgctctgt

SEQ ID NO: 114497 - DNA, 22 bp, Homo sapiens
gacagagtctcactctgtcgcc

SEQ ID NO: 114498 - DNA, 23 bp, Homo sapiens
ctctctcaggcacaggaacagaa

SEQ ID NO: 114499 - DNA, 23 bp, Homo sapiens
gggtctcactctgtcacccaggc

SEQ ID NO: 114500 - DNA, 22 bp, Homo sapiens
acagaggcacgatcttggctca

SEQ ID NO: 114501 - DNA, 23 bp, Homo sapiens
catctcacacactctctacttcc

SEQ ID NO: 114502 - DNA, 19 bp, Homo sapiens
gtgtatatatatatgtgtg

SEQ ID NO: 114503 - DNA, 23 bp, Homo sapiens
agagtctcactccctctgtcacc

SEQ ID NO: 114504 - DNA, 23 bp, Homo sapiens
agagtctcactctgtcacccagg

SEQ ID NO: 114505 - DNA, 23 bp, Homo sapiens
tacagtatatttgtatatgtgtg

SEQ ID NO: 114506 - DNA, 19 bp, Homo sapiens
gtctcgctctgtcacccag

SEQ ID NO: 114507 - DNA, 21 bp, Homo sapiens
tgaggtaggaggatcacttga

SEQ ID NO: 114508 - DNA, 23 bp, Homo sapiens
agggtctcactctgtcaccctgg

SEQ ID NO: 114509 - DNA, 23 bp, Homo sapiens
gtctcactctgtcacccaggctg

SEQ ID NO: 114510 - DNA, 23 bp, Homo sapiens
attttggaagttaatgtaaggat

SEQ ID NO: 114511 - DNA, 23 bp, Homo sapiens
aaaagacagtttttatttttcag

SEQ ID NO: 114512 - DNA, 18 bp, Homo sapiens
tcagggtctcactctgtc

SEQ ID NO: 114513 - DNA, 23 bp, Homo sapiens
tttctacatgaagctgctttctt

SEQ ID NO: 114514 - DNA, 19 bp, Homo sapiens
tacaggcttgagccactgt

SEQ ID NO: 114515 - DNA, 19 bp, Homo sapiens
attctctcatcagtggagg

SEQ ID NO: 114516 - DNA, 18 bp, Homo sapiens
tgagaagagagagagaga

SEQ ID NO: 114517 - DNA, 21 bp, Homo sapiens
tatgtacataaatatacatgt

SEQ ID NO: 114518 - DNA, 22 bp, Homo sapiens
taattggtatatttatgtgtat

SEQ ID NO: 114519 - DNA, 23 bp, Homo sapiens
tcacactctcggacagtctgctc

SEQ ID NO: 114520 - DNA, 23 bp, Homo sapiens
cggagtctcactctgtcacccag

SEQ ID NO: 114521 - DNA, 23 bp, Homo sapiens
tcttgagacggagtctcactctg

SEQ ID NO: 114522 - DNA, 23 bp, Homo sapiens
atgtgtgtgcatgtgtatggata

SEQ ID NO: 114523 - DNA, 22 bp, Homo sapiens
catgaatgtatacatgtatgtg

SEQ ID NO: 114524 - DNA, 22 bp, Homo sapiens
ttcagtgtatttgttctagttt

SEQ ID NO: 114525 - DNA, 22 bp, Homo sapiens
tgagtcagtctctctctctctc

SEQ ID NO: 114526 - DNA, 23 bp, Homo sapiens
gggtctctctctgtcacccaggc

SEQ ID NO: 114527 - DNA, 22 bp, Homo sapiens
tctgactccagagcctgtgctc

SEQ ID NO: 114528 - DNA, 23 bp, Homo sapiens
tcacactgaggctctgagtttgg

SEQ ID NO: 114529 - DNA, 20 bp, Homo sapiens
tctctggctgtcactgtcat

SEQ ID NO: 114530 - DNA, 20 bp, Homo sapiens
tatgggacttttggaaaggt

SEQ ID NO: 114531 - DNA, 23 bp, Homo sapiens
acacaacatcctattcttcagaa

SEQ ID NO: 114532 - DNA, 23 bp, Homo sapiens
gctacagtgtgtggtttggagca

SEQ ID NO: 114533 - DNA, 22 bp, Homo sapiens
gttgtttctgctatgccataca

SEQ ID NO: 114534 - DNA, 23 bp, Homo sapiens
gctctgtcacccagtctggagtg

SEQ ID NO: 114535 - DNA, 18 bp, Homo sapiens
tccacctcctgggtttga

SEQ ID NO: 114536 - DNA, 23 bp, Homo sapiens
aagcttttcttgaagtaatgaaa

SEQ ID NO: 114537 - DNA, 22 bp, Homo sapiens
ggctcacagcaacttctgtctc

SEQ ID NO: 114538 - DNA, 23 bp, Homo sapiens
ttggtagaactagttgccatgaa

SEQ ID NO: 114539 - DNA, 23 bp, Homo sapiens
aaagagacgctgtcttcctctgt

SEQ ID NO: 114540 - DNA, 23 bp, Homo sapiens
tgagacggagtctcgctctgtca

SEQ ID NO: 114541 - DNA, 23 bp, Homo sapiens
ccaccatggctggctgtaagcct

SEQ ID NO: 114542 - DNA, 23 bp, Homo sapiens
agacagagtctcactctgtcacc

SEQ ID NO: 114543 - DNA, 21 bp, Homo sapiens
aatgtgatagctaggtgatac

SEQ ID NO: 114544 - DNA, 19 bp, Homo sapiens
taatgctgggcaaggtttc

SEQ ID NO: 114545 - DNA, 21 bp, Homo sapiens
tggagttctgacttgtgttga

SEQ ID NO: 114546 - DNA, 23 bp, Homo sapiens
cggagtctcactctgtcacccag

SEQ ID NO: 114547 - DNA, 23 bp, Homo sapiens
tatagtatagtacgtctacagtg

SEQ ID NO: 114548 - DNA, 20 bp, Homo sapiens
tgtgtatatatatgtgtgat

SEQ ID NO: 114549 - DNA, 23 bp, Homo sapiens
ggagttctctgtctgtctgtggc

SEQ ID NO: 114550 - DNA, 23 bp, Homo sapiens
actgtcagtgtctctggcctggt

SEQ ID NO: 114551 - DNA, 23 bp, Homo sapiens
tgagttcattgtagattctggat

SEQ ID NO: 114552 - DNA, 23 bp, Homo sapiens
tgagttcattgtagattctggat

SEQ ID NO: 114553 - DNA, 23 bp, Homo sapiens
cctcactctgtttgagttcaggc

SEQ ID NO: 114554 - DNA, 23 bp, Homo sapiens
tgtttatctattcaaagtatttg

SEQ ID NO: 114555 - DNA, 22 bp, Homo sapiens
tgactatatatatatgtgtgtg

SEQ ID NO: 114556 - DNA, 23 bp, Homo sapiens
atatatacacatatacatgagaa

SEQ ID NO: 114557 - DNA, 22 bp, Homo sapiens
agttatgttctccctttctttt

SEQ ID NO: 114558 - DNA, 20 bp, Homo sapiens
atgtgcagaacgtgcaggtt

SEQ ID NO: 114559 - DNA, 23 bp, Homo sapiens
atatatgtatatataaatgtgca

SEQ ID NO: 114560 - DNA, 23 bp, Homo sapiens
ttggaaatgatatgaaatctaat

SEQ ID NO: 114561 - DNA, 19 bp, Homo sapiens
acatacatgtatatatgtg

SEQ ID NO: 114562 - DNA, 23 bp, Homo sapiens
cacatatatgtatgtgtatatgt

SEQ ID NO: 114563 - DNA, 23 bp, Homo sapiens
tgtatatgtatatatgtatacgt

SEQ ID NO: 114564 - DNA, 19 bp, Homo sapiens
atatgtgtgtatatatatg

SEQ ID NO: 114565 - DNA, 18 bp, Homo sapiens
acacacacacactatctg

SEQ ID NO: 114566 - DNA, 23 bp, Homo sapiens
tttgacagccacctttcttgccc

SEQ ID NO: 114567 - DNA, 23 bp, Homo sapiens
ttggtgtttttattcctatgtga

SEQ ID NO: 114568 - DNA, 23 bp, Homo sapiens
atgtgggagaatgtgtataggta

SEQ ID NO: 114569 - DNA, 21 bp, Homo sapiens
atttttgtacatgaataagtt

SEQ ID NO: 114570 - DNA, 23 bp, Homo sapiens
atatgtgtgtatatatacgtgta

SEQ ID NO: 114571 - DNA, 23 bp, Homo sapiens
tactggaagacttttgatttact

SEQ ID NO: 114572 - DNA, 20 bp, Homo sapiens
tgtatacatatatacgtgta

SEQ ID NO: 114573 - DNA, 23 bp, Homo sapiens
atatgtgtatatatatgtgtgtg

SEQ ID NO: 114574 - DNA, 23 bp, Homo sapiens
tgtgtgtgcttgtgcatgtgcat

SEQ ID NO: 114575 - DNA, 23 bp, Homo sapiens
catatgtgtttgtatatcttgag

SEQ ID NO: 114576 - DNA, 23 bp, Homo sapiens
ttcagttgtcttattgtagattt

SEQ ID NO: 114577 - DNA, 23 bp, Homo sapiens
aggaccatttattaagactttga

SEQ ID NO: 114578 - DNA, 23 bp, Homo sapiens
tctgagactttgctttctctgac

SEQ ID NO: 114579 - DNA, 23 bp, Homo sapiens
cctctctcccactctgttccctt

SEQ ID NO: 114580 - DNA, 18 bp, Homo sapiens
tgtgtgtgtgtgtatata

SEQ ID NO: 114581 - DNA, 21 bp, Homo sapiens
atgtgcacaacatgcaggttt

SEQ ID NO: 114582 - DNA, 18 bp, Homo sapiens
ggccacagactgacactc

SEQ ID NO: 114583 - DNA, 23 bp, Homo sapiens
tctgcctcgctctgtgcctgtga

SEQ ID NO: 114584 - DNA, 23 bp, Homo sapiens
tgagaatggatgatgttaccaat

SEQ ID NO: 114585 - DNA, 19 bp, Homo sapiens
tgagatggagtctcactct

SEQ ID NO: 114586 - DNA, 19 bp, Homo sapiens
ttttacaaccagctctgct

SEQ ID NO: 114587 - DNA, 23 bp, Homo sapiens
tagtatgtgtggatatgtatgta

SEQ ID NO: 114588 - DNA, 23 bp, Homo sapiens
gagacagagtctcactctgccac

SEQ ID NO: 114589 - DNA, 22 bp, Homo sapiens
tgcctgtctccctcgctccctg

SEQ ID NO: 114590 - DNA, 23 bp, Homo sapiens
gtctctgtctcggtctctgtcag

SEQ ID NO: 114591 - DNA, 20 bp, Homo sapiens
acctttcaatggaagtgtaa

SEQ ID NO: 114592 - DNA, 23 bp, Homo sapiens
ttgtatgtatacatgtatgtgtg

SEQ ID NO: 114593 - DNA, 23 bp, Homo sapiens
atctcagtatttttaatactgag

SEQ ID NO: 114594 - DNA, 23 bp, Homo sapiens
aaacagagtctcgcactgtctcc

SEQ ID NO: 114595 - DNA, 19 bp, Homo sapiens
ctgcaacctctgcttcctg

SEQ ID NO: 114596 - DNA, 23 bp, Homo sapiens
tcaagatgtcaacaggtttggtt

SEQ ID NO: 114597 - DNA, 19 bp, Homo sapiens
aaatgtttatgaggactag

SEQ ID NO: 114598 - DNA, 21 bp, Homo sapiens
aagacagaacagaatcaggac

SEQ ID NO: 114599 - DNA, 23 bp, Homo sapiens
tctcagagtcacagttttctcat

SEQ ID NO: 114600 - DNA, 23 bp, Homo sapiens
ctgtcactcactggctgtgtgct

SEQ ID NO: 114601 - DNA, 19 bp, Homo sapiens
tacctggtttcagagttgg

SEQ ID NO: 114602 - DNA, 23 bp, Homo sapiens
tcactctgtccctgtcactgtgg

SEQ ID NO: 114603 - DNA, 18 bp, Homo sapiens
aggtttcagaggaaagca

SEQ ID NO: 114604 - DNA, 20 bp, Homo sapiens
aagctgaatgccattcgtgt

SEQ ID NO: 114605 - DNA, 23 bp, Homo sapiens
tatatgtacatgtgtatgtgtat

SEQ ID NO: 114606 - DNA, 22 bp, Homo sapiens
tgtgtgtatatatatgtatgtg

SEQ ID NO: 114607 - DNA, 23 bp, Homo sapiens
ttctgtgaagaaagtcaatggta

SEQ ID NO: 114608 - DNA, 19 bp, Homo sapiens
tgtgcatatgtataagtgt

SEQ ID NO: 114609 - DNA, 22 bp, Homo sapiens
agggatacagttctgaaacttg

SEQ ID NO: 114610 - DNA, 23 bp, Homo sapiens
cagattcagcatctgtaactcct

SEQ ID NO: 114611 - DNA, 23 bp, Homo sapiens
gagtctcactctgtcacctagcc

SEQ ID NO: 114612 - DNA, 22 bp, Homo sapiens
ttcttagaagttgaattgttta

SEQ ID NO: 114613 - DNA, 22 bp, Homo sapiens
ttataacaatttcagctcctat

SEQ ID NO: 114614 - DNA, 23 bp, Homo sapiens
tatacgtatatatatatatgtgt

SEQ ID NO: 114615 - DNA, 23 bp, Homo sapiens
acagagtctcactctgtcgccca

SEQ ID NO: 114616 - DNA, 23 bp, Homo sapiens
cactcctgtgtttgtttctttat

SEQ ID NO: 114617 - DNA, 23 bp, Homo sapiens
cggagtctcgctctgtctcccag

SEQ ID NO: 114618 - DNA, 23 bp, Homo sapiens
atttgtgagatggagtctcgctc

SEQ ID NO: 114619 - DNA, 23 bp, Homo sapiens
tcatgtgtttgcctctctacttg

SEQ ID NO: 114620 - DNA, 21 bp, Homo sapiens
agcatatatatatacttatga

SEQ ID NO: 114621 - DNA, 22 bp, Homo sapiens
tatgagcatatatatatgtgtg

SEQ ID NO: 114622 - DNA, 19 bp, Homo sapiens
tatgcacattatttagtgc

SEQ ID NO: 114623 - DNA, 21 bp, Homo sapiens
tttctctgtctgagtttttac

SEQ ID NO: 114624 - DNA, 23 bp, Homo sapiens
ctgaggctctctgcgtggctctg

SEQ ID NO: 114625 - DNA, 23 bp, Homo sapiens
acaacactgcatttgttattcag

SEQ ID NO: 114626 - DNA, 23 bp, Homo sapiens
atttgactgtgcatttcaacatg

SEQ ID NO: 114627 - DNA, 23 bp, Homo sapiens
ataaatatgtagtatactataca

SEQ ID NO: 114628 - DNA, 23 bp, Homo sapiens
gtggattagtgatattgtagaac

SEQ ID NO: 114629 - DNA, 22 bp, Homo sapiens
tttgtatatctatctatatcta

SEQ ID NO: 114630 - DNA, 23 bp, Homo sapiens
tgtgcctcactctcactcaagta

SEQ ID NO: 114631 - DNA, 23 bp, Homo sapiens
tgagacagagtctcgctctgtcc

SEQ ID NO: 114632 - DNA, 18 bp, Homo sapiens
tttcctagattaggaaat

SEQ ID NO: 114633 - DNA, 23 bp, Homo sapiens
atgtttcttgaagaaggcattgt

SEQ ID NO: 114634 - DNA, 23 bp, Homo sapiens
atctatggttttctaggttattg

SEQ ID NO: 114635 - DNA, 22 bp, Homo sapiens
acagacactgttagtctgatgg

SEQ ID NO: 114636 - DNA, 21 bp, Homo sapiens
gtgaccaggcctttctgtctg

SEQ ID NO: 114637 - DNA, 21 bp, Homo sapiens
atatgtatatatgtatttatg

SEQ ID NO: 114638 - DNA, 22 bp, Homo sapiens
ctctacctgcttcttactggat

SEQ ID NO: 114639 - DNA, 21 bp, Homo sapiens
cattgcagtagaaggagtcag

SEQ ID NO: 114640 - DNA, 23 bp, Homo sapiens
gtttcatgtgggtagatccatgg

SEQ ID NO: 114641 - DNA, 22 bp, Homo sapiens
tgtgatgggtgtgtaatggtat

SEQ ID NO: 114642 - DNA, 23 bp, Homo sapiens
gtgatgacacagattctgctttg

SEQ ID NO: 114643 - DNA, 22 bp, Homo sapiens
acacacacacatatacactgtg

SEQ ID NO: 114644 - DNA, 23 bp, Homo sapiens
atgtatgactgcatgtgaatata

SEQ ID NO: 114645 - DNA, 23 bp, Homo sapiens
ttccactgtcatattctggtgtg

SEQ ID NO: 114646 - DNA, 23 bp, Homo sapiens
caaatcaccctgatgttgatgag

SEQ ID NO: 114647 - DNA, 21 bp, Homo sapiens
gttctgcatggttctcaacac

SEQ ID NO: 114648 - DNA, 22 bp, Homo sapiens
agcagtgggtagacaggactta

SEQ ID NO: 114649 - DNA, 21 bp, Homo sapiens
taagaggaggaagatacaaga

SEQ ID NO: 114650 - DNA, 20 bp, Homo sapiens
ttacagttgagcctgagcac

SEQ ID NO: 114651 - DNA, 22 bp, Homo sapiens
cagtcagactcagaggctatcc

SEQ ID NO: 114652 - DNA, 23 bp, Homo sapiens
gccactgtcactcagacccaggg

SEQ ID NO: 114653 - DNA, 20 bp, Homo sapiens
tgaggctgagtaaaggcttt

SEQ ID NO: 114654 - DNA, 23 bp, Homo sapiens
gatgaagtctctctctgtttccc

SEQ ID NO: 114655 - DNA, 19 bp, Homo sapiens
gtttgtttgtttgttttgt

SEQ ID NO: 114656 - DNA, 20 bp, Homo sapiens
tagagtgagcactcagtgac

SEQ ID NO: 114657 - DNA, 23 bp, Homo sapiens
ctctcagtccctcggtcactgag

SEQ ID NO: 114658 - DNA, 23 bp, Homo sapiens
tgccttttggttcgtattccagt

SEQ ID NO: 114659 - DNA, 22 bp, Homo sapiens
ttttgagacggagtctgttgcc

SEQ ID NO: 114660 - DNA, 18 bp, Homo sapiens
tcaggagagtgagagcag

SEQ ID NO: 114661 - DNA, 23 bp, Homo sapiens
tgtgtctgtctgagtctctgctt

SEQ ID NO: 114662 - DNA, 23 bp, Homo sapiens
aggagctatttggttctactctg

SEQ ID NO: 114663 - DNA, 20 bp, Homo sapiens
acatgaaaaaggttgggaag

SEQ ID NO: 114664 - DNA, 18 bp, Homo sapiens
gtgtgaatgtaactattt

SEQ ID NO: 114665 - DNA, 23 bp, Homo sapiens
agagacaggtaagggagtgtctg

SEQ ID NO: 114666 - DNA, 21 bp, Homo sapiens
acagacacacatacataagtg

SEQ ID NO: 114667 - DNA, 23 bp, Homo sapiens
catacacatatgtgtgtgtgtgt

SEQ ID NO: 114668 - DNA, 20 bp, Homo sapiens
tgtgtgtatatatatatgtg

SEQ ID NO: 114669 - DNA, 23 bp, Homo sapiens
ctattcagtttttctacatgtca

SEQ ID NO: 114670 - DNA, 23 bp, Homo sapiens
tgagacggagtctcgctctgtca

SEQ ID NO: 114671 - DNA, 23 bp, Homo sapiens
tgagttcattgtagattctggat

SEQ ID NO: 114672 - DNA, 23 bp, Homo sapiens
tgagttcattgtagattctggat

SEQ ID NO: 114673 - DNA, 23 bp, Homo sapiens
tgagacggagtctcgctctgtgc

SEQ ID NO: 114674 - DNA, 18 bp, Homo sapiens
tgtttatttaatcactta

SEQ ID NO: 114675 - DNA, 20 bp, Homo sapiens
tgtgtgtgaggcatttggca

SEQ ID NO: 114676 - DNA, 21 bp, Homo sapiens
taagtagtgtttatgatgttt

SEQ ID NO: 114677 - DNA, 21 bp, Homo sapiens
tctgactgtctctgattgttc

SEQ ID NO: 114678 - DNA, 23 bp, Homo sapiens
taaagacacagggaggtttgaag

SEQ ID NO: 114679 - DNA, 23 bp, Homo sapiens
ttctcagtctcagactgacccga

SEQ ID NO: 114680 - DNA, 23 bp, Homo sapiens
aggtgtattgaagtatgtgtaca

SEQ ID NO: 114681 - DNA, 23 bp, Homo sapiens
gagacagtctcactctgtcgccc

SEQ ID NO: 114682 - DNA, 23 bp, Homo sapiens
tgagttcattgtagattctggat

SEQ ID NO: 114683 - DNA, 23 bp, Homo sapiens
tgagttcattgtagattctggat

SEQ ID NO: 114684 - DNA, 20 bp, Homo sapiens
aacatcttaaacaggaaagt

SEQ ID NO: 114685 - DNA, 23 bp, Homo sapiens
atttgtgtatatatatatatgag

SEQ ID NO: 114686 - DNA, 21 bp, Homo sapiens
tgtgtgtatatatacatatgt

SEQ ID NO: 114687 - DNA, 23 bp, Homo sapiens
atgatagttgttgttattgctat

SEQ ID NO: 114688 - DNA, 23 bp, Homo sapiens
agatggagtctctctgtgtcacc

SEQ ID NO: 114689 - DNA, 23 bp, Homo sapiens
attacctgctgtttattttatgt

SEQ ID NO: 114690 - DNA, 23 bp, Homo sapiens
ttttagactgtggaaatgatgtt

SEQ ID NO: 114691 - DNA, 20 bp, Homo sapiens
aacttgagagattttcttat

SEQ ID NO: 114692 - DNA, 23 bp, Homo sapiens
agagcatatatatatatgtgtgt

SEQ ID NO: 114693 - DNA, 23 bp, Homo sapiens
ttttttgttgttgacttgcatag

SEQ ID NO: 114694 - DNA, 23 bp, Homo sapiens
tatgtgtgtgtatatatgtgtgt

SEQ ID NO: 114695 - DNA, 23 bp, Homo sapiens
acacacatatatacacacacata

SEQ ID NO: 114696 - DNA, 18 bp, Homo sapiens
tggatatatatatagaga

SEQ ID NO: 114697 - DNA, 19 bp, Homo sapiens
tgtgtatatatatatatgt

SEQ ID NO: 114698 - DNA, 22 bp, Homo sapiens
cataggctaatatttgagcttt

SEQ ID NO: 114699 - DNA, 23 bp, Homo sapiens
atatatgtgtatatgtatgtgta

SEQ ID NO: 114700 - DNA, 23 bp, Homo sapiens
aataatgaagaaataggtttcca

SEQ ID NO: 114701 - DNA, 20 bp, Homo sapiens
aataagagctctcatttttt

SEQ ID NO: 114702 - DNA, 19 bp, Homo sapiens
ttgtttttttgttttgacg

SEQ ID NO: 114703 - DNA, 23 bp, Homo sapiens
gtgtatatacgtatgaatacaca

SEQ ID NO: 114704 - DNA, 19 bp, Homo sapiens
tatatatgtatgtatacac

SEQ ID NO: 114705 - DNA, 23 bp, Homo sapiens
acactctctctttcagttatggc

SEQ ID NO: 114706 - DNA, 18 bp, Homo sapiens
tgagcatatacatacata

SEQ ID NO: 114707 - DNA, 22 bp, Homo sapiens
tatgtacatatatgtatgtgtg

SEQ ID NO: 114708 - DNA, 19 bp, Homo sapiens
tgtgtgtgtatatatatac

SEQ ID NO: 114709 - DNA, 21 bp, Homo sapiens
tgactctctgtgatccttatc

SEQ ID NO: 114710 - DNA, 23 bp, Homo sapiens
ccagtcaccacacagtgtgctgt

SEQ ID NO: 114711 - DNA, 23 bp, Homo sapiens
tttgagacagagtcttgctggtt

SEQ ID NO: 114712 - DNA, 23 bp, Homo sapiens
tttgagacggagtctcgctgtgt

SEQ ID NO: 114713 - DNA, 18 bp, Homo sapiens
gagggtggagactaagtg

SEQ ID NO: 114714 - DNA, 22 bp, Homo sapiens
tctgtgctcagaactgtgactg

SEQ ID NO: 114715 - DNA, 22 bp, Homo sapiens
tttaaggtatttttaatgtaca

SEQ ID NO: 114716 - DNA, 21 bp, Homo sapiens
gcacagaattgagaatccaga

SEQ ID NO: 114717 - DNA, 23 bp, Homo sapiens
tgctgagagaggacagatgagag

SEQ ID NO: 114718 - DNA, 22 bp, Homo sapiens
acacagcttgacatatggacac

SEQ ID NO: 114719 - DNA, 23 bp, Homo sapiens
tctggctcagtgaatcttgttaa

SEQ ID NO: 114720 - DNA, 23 bp, Homo sapiens
acactcacacactctgggggagt

SEQ ID NO: 114721 - DNA, 23 bp, Homo sapiens
ttgacagtagagtgggtgcagag

SEQ ID NO: 114722 - DNA, 23 bp, Homo sapiens
ctccgtgactctcaccgtggcag

SEQ ID NO: 114723 - DNA, 21 bp, Homo sapiens
tttggattgtagccagctcta

SEQ ID NO: 114724 - DNA, 23 bp, Homo sapiens
tctctctgcgtgtctctgcctga

SEQ ID NO: 114725 - DNA, 18 bp, Homo sapiens
gtgagccactgtgcccag

SEQ ID NO: 114726 - DNA, 23 bp, Homo sapiens
gggtctcactctgtcacccaggc

SEQ ID NO: 114727 - DNA, 23 bp, Homo sapiens
atatgtatatatgtatatgtgtg

SEQ ID NO: 114728 - DNA, 20 bp, Homo sapiens
ttgagatggaggtctgctct

SEQ ID NO: 114729 - DNA, 19 bp, Homo sapiens
caggaggctgaggtaggag

SEQ ID NO: 114730 - DNA, 18 bp, Homo sapiens
tacagggagctgaggttg

SEQ ID NO: 114731 - DNA, 23 bp, Homo sapiens
tgtgtacatatatatacgtatat

SEQ ID NO: 114732 - DNA, 23 bp, Homo sapiens
tatatgtatatgtatatgtgtac

SEQ ID NO: 114733 - DNA, 23 bp, Homo sapiens
atatgtatatatatatgtgtaca

SEQ ID NO: 114734 - DNA, 23 bp, Homo sapiens
atatgtatatatatacatgtaca

SEQ ID NO: 114735 - DNA, 20 bp, Homo sapiens
tctctttccctttggagtcc

SEQ ID NO: 114736 - DNA, 21 bp, Homo sapiens
ttcagagaagactgagagctg

SEQ ID NO: 114737 - DNA, 23 bp, Homo sapiens
tcaccatgaccagaaggtgctct

SEQ ID NO: 114738 - DNA, 18 bp, Homo sapiens
tggcgtgatcttggctta

SEQ ID NO: 114739 - DNA, 23 bp, Homo sapiens
ttaattttgaatggagttttgct

SEQ ID NO: 114740 - DNA, 21 bp, Homo sapiens
tctcactctgtcacccaggct

SEQ ID NO: 114741 - DNA, 23 bp, Homo sapiens
cagcgtctcgctctgtcactcag

SEQ ID NO: 114742 - DNA, 21 bp, Homo sapiens
gtgcagtggcgtgatcctggc

SEQ ID NO: 114743 - DNA, 23 bp, Homo sapiens
tctgagacagtcttgctctgtca

SEQ ID NO: 114744 - DNA, 22 bp, Homo sapiens
agagtctcgctctgtcacccag

SEQ ID NO: 114745 - DNA, 23 bp, Homo sapiens
tgtatagttaggtgattgctcta

SEQ ID NO: 114746 - DNA, 22 bp, Homo sapiens
aagttgagtggtatgtacccag

SEQ ID NO: 114747 - DNA, 21 bp, Homo sapiens
tttggatctaagtctgtctgt

SEQ ID NO: 114748 - DNA, 22 bp, Homo sapiens
ctttgcatatcagtgtgcattt

SEQ ID NO: 114749 - DNA, 23 bp, Homo sapiens
acacactgtgtcttttacctgtt

SEQ ID NO: 114750 - DNA, 23 bp, Homo sapiens
gttatagatacagtttaggttac

SEQ ID NO: 114751 - DNA, 21 bp, Homo sapiens
atataggaagaattggattgg

SEQ ID NO: 114752 - DNA, 23 bp, Homo sapiens
tctatatgtatatctatatctat

SEQ ID NO: 114753 - DNA, 22 bp, Homo sapiens
atatatctatatgtatatatct

SEQ ID NO: 114754 - DNA, 21 bp, Homo sapiens
tctcgctctgtcactcaggct

SEQ ID NO: 114755 - DNA, 23 bp, Homo sapiens
actggtgtgtgtctgtgagcctg

SEQ ID NO: 114756 - DNA, 23 bp, Homo sapiens
atgaagtggtggtgctgggactc

SEQ ID NO: 114757 - DNA, 23 bp, Homo sapiens
aagccactgtggttaggttgttc

SEQ ID NO: 114758 - DNA, 18 bp, Homo sapiens
tgtgtgtgcatgtgcatg

SEQ ID NO: 114759 - DNA, 23 bp, Homo sapiens
tgtgtgtgcatgtgtgtgcatgt

SEQ ID NO: 114760 - DNA, 23 bp, Homo sapiens
tgtgtgtgtatgtgcatgtgcat

SEQ ID NO: 114761 - DNA, 22 bp, Homo sapiens
actcaatctctctgagcctcag

SEQ ID NO: 114762 - DNA, 23 bp, Homo sapiens
tttgactgcttacacacactctc

SEQ ID NO: 114763 - DNA, 21 bp, Homo sapiens
tatatgtgtatatgtgtatgt

SEQ ID NO: 114764 - DNA, 22 bp, Homo sapiens
acatgtgcacaatgtgcaggtt

SEQ ID NO: 114765 - DNA, 20 bp, Homo sapiens
cagtctgagtaaggtctcac

SEQ ID NO: 114766 - DNA, 23 bp, Homo sapiens
tgagttcattgtagattctggat

SEQ ID NO: 114767 - DNA, 23 bp, Homo sapiens
tgagttcattgtagattctggat

SEQ ID NO: 114768 - DNA, 22 bp, Homo sapiens
ttttggagaatatagatgaaag

SEQ ID NO: 114769 - DNA, 23 bp, Homo sapiens
gtatatatatatgtatatgtgtg

SEQ ID NO: 114770 - DNA, 22 bp, Homo sapiens
gtatacgtatatgtgtatatga

SEQ ID NO: 114771 - DNA, 18 bp, Homo sapiens
atatatatgtatgctcaa

SEQ ID NO: 114772 - DNA, 23 bp, Homo sapiens
ctcccagagcccctggaactctg

SEQ ID NO: 114773 - DNA, 23 bp, Homo sapiens
tcccagagcccctggaactctgg

SEQ ID NO: 114774 - DNA, 23 bp, Homo sapiens
tcccagagcccctggaactctgg

SEQ ID NO: 114775 - DNA, 23 bp, Homo sapiens
tcccagagcccctggaactctgg

SEQ ID NO: 114776 - DNA, 23 bp, Homo sapiens
tattccacctgagcaagaagctg

SEQ ID NO: 114777 - DNA, 18 bp, Homo sapiens
taactctggatataaatt

SEQ ID NO: 114778 - DNA, 22 bp, Homo sapiens
ttggacttcagagttttatctg

SEQ ID NO: 114779 - DNA, 23 bp, Homo sapiens
tgcattggattagattactgaat

SEQ ID NO: 114780 - DNA, 20 bp, Homo sapiens
atgagttaggagactgtgct

SEQ ID NO: 114781 - DNA, 23 bp, Homo sapiens
ggctcactttctgactcactcac

SEQ ID NO: 114782 - DNA, 21 bp, Homo sapiens
tctcactctgtcacccaggct

SEQ ID NO: 114783 - DNA, 23 bp, Homo sapiens
tccttcaatgtatgaatggaaac

SEQ ID NO: 114784 - DNA, 20 bp, Homo sapiens
tatctctgtgtatatgtaca

SEQ ID NO: 114785 - DNA, 23 bp, Homo sapiens
ttcgagacagagtctcgctctgt

SEQ ID NO: 114786 - DNA, 23 bp, Homo sapiens
aggttatctcttatccttgagct

SEQ ID NO: 114787 - DNA, 19 bp, Homo sapiens
tttcaactaaatgtggtgt

SEQ ID NO: 114788 - DNA, 19 bp, Homo sapiens
tgtgcatgtgtatctgtgt

SEQ ID NO: 114789 - DNA, 23 bp, Homo sapiens
tgtgtgtgtgtatgtgcatgtgt

SEQ ID NO: 114790 - DNA, 21 bp, Homo sapiens
tgtgtatatatatgtatgtat

SEQ ID NO: 114791 - DNA, 23 bp, Homo sapiens
atttgtgtttatatatatctgtc

SEQ ID NO: 114792 - DNA, 23 bp, Homo sapiens
atatatctcacacatatatgtaa

SEQ ID NO: 114793 - DNA, 22 bp, Homo sapiens
taaagagtatatatatatatga

SEQ ID NO: 114794 - DNA, 23 bp, Homo sapiens
atacacactatatatgtgtgtgt

SEQ ID NO: 114795 - DNA, 18 bp, Homo sapiens
atgtggctgtgtatgtgc

SEQ ID NO: 114796 - DNA, 23 bp, Homo sapiens
ctctgcctgtcagtcagtcagga

SEQ ID NO: 114797 - DNA, 21 bp, Homo sapiens
tgtgtatatatatatgtgtgt

SEQ ID NO: 114798 - DNA, 23 bp, Homo sapiens
tgtgtgtatgtatatatatgtgt

SEQ ID NO: 114799 - DNA, 20 bp, Homo sapiens
actctgtggtcttgggcctg

SEQ ID NO: 114800 - DNA, 20 bp, Homo sapiens
ataaaagtgtccaagtacaa

SEQ ID NO: 114801 - DNA, 23 bp, Homo sapiens
aggtgcaggagggattcttttct

SEQ ID NO: 114802 - DNA, 22 bp, Homo sapiens
gacagagtttcgctcttgtcgc

SEQ ID NO: 114803 - DNA, 23 bp, Homo sapiens
ctctgtgtcacacaggctggaat

SEQ ID NO: 114804 - DNA, 20 bp, Homo sapiens
agctacagagagaatatata

SEQ ID NO: 114805 - DNA, 22 bp, Homo sapiens
tacactgtatttgtatatgtat

SEQ ID NO: 114806 - DNA, 23 bp, Homo sapiens
ctatccatatctatatctatatc

SEQ ID NO: 114807 - DNA, 23 bp, Homo sapiens
agttcagtctcagctttttttct

SEQ ID NO: 114808 - DNA, 23 bp, Homo sapiens
tggagtctcactctgtcacccag

SEQ ID NO: 114809 - DNA, 23 bp, Homo sapiens
atgtgtatatatgtatatatgta

SEQ ID NO: 114810 - DNA, 23 bp, Homo sapiens
aggcacaagtttcagagcagtgt

SEQ ID NO: 114811 - DNA, 23 bp, Homo sapiens
acagcctcagttcagctccttga

SEQ ID NO: 114812 - DNA, 22 bp, Homo sapiens
aagaaattaaatgtgaaatcat

SEQ ID NO: 114813 - DNA, 18 bp, Homo sapiens
tcttatagagtggctaaa

SEQ ID NO: 114814 - DNA, 23 bp, Homo sapiens
tgtcgatccactctcagactctc

SEQ ID NO: 114815 - DNA, 23 bp, Homo sapiens
tgtctgcctctctctgtggagcc

SEQ ID NO: 114816 - DNA, 23 bp, Homo sapiens
caggatctctctctgtcactcag

SEQ ID NO: 114817 - DNA, 21 bp, Homo sapiens
agaggctgcttatctgcgact

SEQ ID NO: 114818 - DNA, 21 bp, Homo sapiens
atgtgcaattgaaaagtgtgt

SEQ ID NO: 114819 - DNA, 23 bp, Homo sapiens
tgagttcattgtagattctggat

SEQ ID NO: 114820 - DNA, 23 bp, Homo sapiens
tgagttcattgtagattctggat

SEQ ID NO: 114821 - DNA, 23 bp, Homo sapiens
tgagttcattgtagattctggat

SEQ ID NO: 114822 - DNA, 23 bp, Homo sapiens
tgagttcattgtagattctggat

SEQ ID NO: 114823 - DNA, 23 bp, Homo sapiens
atgaatgtatgcatgagttagtg

SEQ ID NO: 114824 - DNA, 22 bp, Homo sapiens
tatgtgtgtgcgtgtgtgtata

SEQ ID NO: 114825 - DNA, 22 bp, Homo sapiens
tctgaagcaggggctctgttgt

SEQ ID NO: 114826 - DNA, 22 bp, Homo sapiens
atattgaatgcaaagcaatgct

SEQ ID NO: 114827 - DNA, 23 bp, Homo sapiens
gcctctgtgtgcctgtgatttgt

SEQ ID NO: 114828 - DNA, 21 bp, Homo sapiens
aagagatggagctctggagct

SEQ ID NO: 114829 - DNA, 23 bp, Homo sapiens
ggcagaggaaagagaatgtgctc

SEQ ID NO: 114830 - DNA, 23 bp, Homo sapiens
ttggagctgagacactcttcttc

SEQ ID NO: 114831 - DNA, 23 bp, Homo sapiens
catgtgattttcttgctgttaaa

SEQ ID NO: 114832 - DNA, 19 bp, Homo sapiens
ggttaagtgtgtggtacct

SEQ ID NO: 114833 - DNA, 20 bp, Homo sapiens
agcacaagaagattagagag

SEQ ID NO: 114834 - DNA, 23 bp, Homo sapiens
atatagtgaaaccttgtctctac

SEQ ID NO: 114835 - DNA, 23 bp, Homo sapiens
gacagggtctcgctctgttatct

SEQ ID NO: 114836 - DNA, 22 bp, Homo sapiens
atgtgaatatatatgtatgcct

SEQ ID NO: 114837 - DNA, 23 bp, Homo sapiens
tgctctctgagtctgtgtccatc

SEQ ID NO: 114838 - DNA, 23 bp, Homo sapiens
tgctctctgagtctgtgtccatc

SEQ ID NO: 114839 - DNA, 23 bp, Homo sapiens
tgctctctgagtctgtgtccatc

SEQ ID NO: 114840 - DNA, 21 bp, Homo sapiens
ctctctgagtctgtgtccatc

SEQ ID NO: 114841 - DNA, 23 bp, Homo sapiens
tgctctctgagtctgtgtccatc

SEQ ID NO: 114842 - DNA, 23 bp, Homo sapiens
cctccctgtcaccatccctcagg

SEQ ID NO: 114843 - DNA, 21 bp, Homo sapiens
tcacaggctggtttcaggagc

SEQ ID NO: 114844 - DNA, 23 bp, Homo sapiens
ctcaggctctgtctgactccaca

SEQ ID NO: 114845 - DNA, 21 bp, Homo sapiens
tctctgcatgtgtgagtgtcc

SEQ ID NO: 114846 - DNA, 23 bp, Homo sapiens
tgtgtctgagagtgtcatgtcta

SEQ ID NO: 114847 - DNA, 23 bp, Homo sapiens
cttgtctctgcgtgtgtgtcctg

SEQ ID NO: 114848 - DNA, 23 bp, Homo sapiens
agagacttaacagagacagcact

SEQ ID NO: 114849 - DNA, 20 bp, Homo sapiens
gtgtgatgtcattatgtggt

SEQ ID NO: 114850 - DNA, 20 bp, Homo sapiens
atgtcactgggtctatgggg

SEQ ID NO: 114851 - DNA, 23 bp, Homo sapiens
tggcactggcactgttcactgga

SEQ ID NO: 114852 - DNA, 23 bp, Homo sapiens
tggcactggcactgttcactgga

SEQ ID NO: 114853 - DNA, 18 bp, Homo sapiens
cacaggggatgaaatgac

SEQ ID NO: 114854 - DNA, 23 bp, Homo sapiens
tgtttcagcatgtccaactgtga

SEQ ID NO: 114855 - DNA, 23 bp, Homo sapiens
tgagttcattgtagattctggat

SEQ ID NO: 114856 - DNA, 23 bp, Homo sapiens
tgagttcattgtagattctggat

SEQ ID NO: 114857 - DNA, 23 bp, Homo sapiens
tgagttcattgtagattctggat

SEQ ID NO: 114858 - DNA, 23 bp, Homo sapiens
tgagttcattgtagattctggat

SEQ ID NO: 114859 - DNA, 23 bp, Homo sapiens
taacagcaacaccatgtggatgt

SEQ ID NO: 114860 - DNA, 21 bp, Homo sapiens
ctgcatctctgtctctctaga

SEQ ID NO: 114861 - DNA, 23 bp, Homo sapiens
tcagtgggtctcagtgcctctgc

SEQ ID NO: 114862 - DNA, 23 bp, Homo sapiens
gagtctcactctgtcacccacgc

SEQ ID NO: 114863 - DNA, 23 bp, Homo sapiens
tactatttgtttttctgtatcaa

SEQ ID NO: 114864 - DNA, 18 bp, Homo sapiens
tgcaacttctgcctcctg

SEQ ID NO: 114865 - DNA, 23 bp, Homo sapiens
aacattgagtccaagttctatga

SEQ ID NO: 114866 - DNA, 23 bp, Homo sapiens
ataagtgcatatgcataactgtg

SEQ ID NO: 114867 - DNA, 23 bp, Homo sapiens
tgtatgtatcttcatgtgtgtgc

SEQ ID NO: 114868 - DNA, 22 bp, Homo sapiens
atcaccacaaacacgtgagtca

SEQ ID NO: 114869 - DNA, 23 bp, Homo sapiens
tctttcactgtgaggttacgatg

SEQ ID NO: 114870 - DNA, 23 bp, Homo sapiens
atgaccagagtctttttgattag

SEQ ID NO: 114871 - DNA, 23 bp, Homo sapiens
agagccatcagagtcagcacagc

SEQ ID NO: 114872 - DNA, 20 bp, Homo sapiens
tattttctttttctgggggg

SEQ ID NO: 114873 - DNA, 20 bp, Homo sapiens
tgtgtatatgtatatatatg

SEQ ID NO: 114874 - DNA, 23 bp, Homo sapiens
tatatgtatgcatcaattgctga

SEQ ID NO: 114875 - DNA, 23 bp, Homo sapiens
ggtttacagaaaattgagtggag

SEQ ID NO: 114876 - DNA, 23 bp, Homo sapiens
acagtctgcctctctgtctgggt

SEQ ID NO: 114877 - DNA, 23 bp, Homo sapiens
tcattccctgtacatcgtatgtg

SEQ ID NO: 114878 - DNA, 22 bp, Homo sapiens
gctcacagtcaggctctctcat

SEQ ID NO: 114879 - DNA, 21 bp, Homo sapiens
attatataggtaaacatatgt

SEQ ID NO: 114880 - DNA, 23 bp, Homo sapiens
atatatatatgtatttgagacag

SEQ ID NO: 114881 - DNA, 23 bp, Homo sapiens
tatatatgagatggagttctgct

SEQ ID NO: 114882 - DNA, 23 bp, Homo sapiens
atgtacaatgcactgacaggaaa

SEQ ID NO: 114883 - DNA, 23 bp, Homo sapiens
atgtatgttctagtttctagcac

SEQ ID NO: 114884 - DNA, 23 bp, Homo sapiens
catctgtctgtgtctctatgtgg

SEQ ID NO: 114885 - DNA, 23 bp, Homo sapiens
tgctgaatagaagtggtgaaagt

SEQ ID NO: 114886 - DNA, 23 bp, Homo sapiens
tattgatcattgcttataatgtg

SEQ ID NO: 114887 - DNA, 23 bp, Homo sapiens
tgagttcattgtagattctggat

SEQ ID NO: 114888 - DNA, 23 bp, Homo sapiens
tgagttcattgtagattctggat

SEQ ID NO: 114889 - DNA, 20 bp, Homo sapiens
gaaagtcattactttgtgac

SEQ ID NO: 114890 - DNA, 22 bp, Homo sapiens
tatttccatatgtatgtgtatc

SEQ ID NO: 114891 - DNA, 18 bp, Homo sapiens
tatgagtgagaacacacg

SEQ ID NO: 114892 - DNA, 21 bp, Homo sapiens
tgtgtatatatatacatatgt

SEQ ID NO: 114893 - DNA, 19 bp, Homo sapiens
ttatatgtgtaaatgtaca

SEQ ID NO: 114894 - DNA, 20 bp, Homo sapiens
ttagcagaaagagaattgtg

SEQ ID NO: 114895 - DNA, 20 bp, Homo sapiens
tttatcaatcttattttgat

SEQ ID NO: 114896 - DNA, 23 bp, Homo sapiens
agacaagagtctcgctctctgtc

SEQ ID NO: 114897 - DNA, 18 bp, Homo sapiens
tagctctagatatagcta

SEQ ID NO: 114898 - DNA, 19 bp, Homo sapiens
agaaacatagctcttcaag

SEQ ID NO: 114899 - DNA, 22 bp, Homo sapiens
tctggtacaagcatgtattaaa

SEQ ID NO: 114900 - DNA, 23 bp, Homo sapiens
aagtaggatcttgatgtttggca

SEQ ID NO: 114901 - DNA, 22 bp, Homo sapiens
tatgtgtgtatatatatgtgtg

SEQ ID NO: 114902 - DNA, 23 bp, Homo sapiens
attgtctttggtaatgttcttgt

SEQ ID NO: 114903 - DNA, 23 bp, Homo sapiens
tcttgaggtattatgaaaaacta

SEQ ID NO: 114904 - DNA, 21 bp, Homo sapiens
aaagagtagactgagaccaca

SEQ ID NO: 114905 - DNA, 21 bp, Homo sapiens
attgctttagtttctctttca

SEQ ID NO: 114906 - DNA, 20 bp, Homo sapiens
tgacagatgtgagccaccac

SEQ ID NO: 114907 - DNA, 20 bp, Homo sapiens
agagagaacactgtgagggc

SEQ ID NO: 114908 - DNA, 23 bp, Homo sapiens
actctgtctcgctctcttcctgt

SEQ ID NO: 114909 - DNA, 23 bp, Homo sapiens
agtgtgggtcctgcagaaagaag

SEQ ID NO: 114910 - DNA, 23 bp, Homo sapiens
acactgtcagtcacatttgggtc

SEQ ID NO: 114911 - DNA, 19 bp, Homo sapiens
tctagctatttgtggaatg

SEQ ID NO: 114912 - DNA, 23 bp, Homo sapiens
gtgaagtctcgctctgtcacccg

SEQ ID NO: 114913 - DNA, 23 bp, Homo sapiens
tgagttcattgtagattctggat

SEQ ID NO: 114914 - DNA, 23 bp, Homo sapiens
tgagttcattgtagattctggat

SEQ ID NO: 114915 - DNA, 23 bp, Homo sapiens
tgagttcattgtagattctggat

SEQ ID NO: 114916 - DNA, 23 bp, Homo sapiens
tgagttcattgtagattctggat

SEQ ID NO: 114917 - DNA, 19 bp, Homo sapiens
tggaatatatatatgtatg

SEQ ID NO: 114918 - DNA, 23 bp, Homo sapiens
tcacagaggagagaaagctgagc

SEQ ID NO: 114919 - DNA, 23 bp, Homo sapiens
aaagtgtgagaattaagtgagct

SEQ ID NO: 114920 - DNA, 23 bp, Homo sapiens
agagtctcactctgtcacccagg

SEQ ID NO: 114921 - DNA, 23 bp, Homo sapiens
atatacacacatatatacgtgtg

SEQ ID NO: 114922 - DNA, 23 bp, Homo sapiens
gtgtgtgtatatctatatgtgtg

SEQ ID NO: 114923 - DNA, 21 bp, Homo sapiens
tgtgtgtatatatatacgtgt

SEQ ID NO: 114924 - DNA, 21 bp, Homo sapiens
tgtacatatatatacgtgtgt

SEQ ID NO: 114925 - DNA, 23 bp, Homo sapiens
aacaaggcagtgtctgtctctga

SEQ ID NO: 114926 - DNA, 23 bp, Homo sapiens
agacaatgtctctgtctctgatc

SEQ ID NO: 114927 - DNA, 19 bp, Homo sapiens
tcagagtcagcacagaggg

SEQ ID NO: 114928 - DNA, 23 bp, Homo sapiens
tgtctgactcacagcctgtgttt

SEQ ID NO: 114929 - DNA, 23 bp, Homo sapiens
tgagagttgaggctgcagtgagc

SEQ ID NO: 114930 - DNA, 22 bp, Homo sapiens
tctctttttcttgttgaatctc

SEQ ID NO: 114931 - DNA, 23 bp, Homo sapiens
tgagttcattgtagattctggat

SEQ ID NO: 114932 - DNA, 23 bp, Homo sapiens
tgagttcattgtagattctggat

SEQ ID NO: 114933 - DNA, 23 bp, Homo sapiens
ttgagattctgcatgtctaacga

SEQ ID NO: 114934 - DNA, 23 bp, Homo sapiens
tcacaggggatatgatggcttag

SEQ ID NO: 114935 - DNA, 19 bp, Homo sapiens
atttctttgggctttggtt

SEQ ID NO: 114936 - DNA, 21 bp, Homo sapiens
ttcactcatgatttggctctc

SEQ ID NO: 114937 - DNA, 22 bp, Homo sapiens
agaaacacaactgattatgtag

SEQ ID NO: 114938 - DNA, 21 bp, Homo sapiens
atatgtgtatgtatatatatg

SEQ ID NO: 114939 - DNA, 20 bp, Homo sapiens
acggagtctcactctgtcac

SEQ ID NO: 114940 - DNA, 20 bp, Homo sapiens
tttttcattctagtcagagc

SEQ ID NO: 114941 - DNA, 20 bp, Homo sapiens
aggactttctgaaatctgaa

SEQ ID NO: 114942 - DNA, 19 bp, Homo sapiens
attcaagattctatggtgg

SEQ ID NO: 114943 - DNA, 23 bp, Homo sapiens
gaagaggacttggttgtatagta

SEQ ID NO: 114944 - DNA, 23 bp, Homo sapiens
tgagttcattgtagattctggat

SEQ ID NO: 114945 - DNA, 23 bp, Homo sapiens
taatgttgaacatcttttcatgt

SEQ ID NO: 114946 - DNA, 23 bp, Homo sapiens
agagtctcactctgtcacccagg

SEQ ID NO: 114947 - DNA, 22 bp, Homo sapiens
cacagttgtttttttgttgttg

SEQ ID NO: 114948 - DNA, 23 bp, Homo sapiens
tgagttcattgtagattctggat

SEQ ID NO: 114949 - DNA, 23 bp, Homo sapiens
tgagttcattgtagattctggat

SEQ ID NO: 114950 - DNA, 22 bp, Homo sapiens
taagggactgaactaggactgt

SEQ ID NO: 114951 - DNA, 23 bp, Homo sapiens
tgaggtatagatacagaaacaca

SEQ ID NO: 114952 - DNA, 23 bp, Homo sapiens
gacagagtctcactctgtcaccc

SEQ ID NO: 114953 - DNA, 19 bp, Homo sapiens
ctggtaggttgaatggaag

SEQ ID NO: 114954 - DNA, 19 bp, Homo sapiens
agaaaatctgtcccaatta

SEQ ID NO: 114955 - DNA, 22 bp, Homo sapiens
tgagatctaggtgttagcagaa

SEQ ID NO: 114956 - DNA, 23 bp, Homo sapiens
tgtgtgtgtgtgtatatatatgt

SEQ ID NO: 114957 - DNA, 19 bp, Homo sapiens
actggcactttctctctgc

SEQ ID NO: 114958 - DNA, 23 bp, Homo sapiens
gaggacacagtgagaaggcagcc

SEQ ID NO: 114959 - DNA, 23 bp, Homo sapiens
cagtactgagtgtccagtcagag

SEQ ID NO: 114960 - DNA, 22 bp, Homo sapiens
agagtgtagagactgatgccac

SEQ ID NO: 114961 - DNA, 23 bp, Homo sapiens
tagtggaatcttctgtggcacat

SEQ ID NO: 114962 - DNA, 23 bp, Homo sapiens
ctgagtctctgtgtgacttcatg

SEQ ID NO: 114963 - DNA, 20 bp, Homo sapiens
atatacacacacatatacat

SEQ ID NO: 114964 - DNA, 20 bp, Homo sapiens
aggctctgtcagacctgctg

SEQ ID NO: 114965 - DNA, 23 bp, Homo sapiens
ctttctctgtgagtcactcccac

SEQ ID NO: 114966 - DNA, 23 bp, Homo sapiens
tggagtctcactctgtcacccag

SEQ ID NO: 114967 - DNA, 23 bp, Homo sapiens
acagggtctcactctgtcacccg

SEQ ID NO: 114968 - DNA, 21 bp, Homo sapiens
tctcactctgtcacctaggct

SEQ ID NO: 114969 - DNA, 23 bp, Homo sapiens
ttcttggatgtatggtttggtgt

SEQ ID NO: 114970 - DNA, 23 bp, Homo sapiens
tatggatatatatatatatgtgt

SEQ ID NO: 114971 - DNA, 23 bp, Homo sapiens
tatatgtgtatatgtatgtgtat

SEQ ID NO: 114972 - DNA, 18 bp, Homo sapiens
gtatatacatgtatgtgt

SEQ ID NO: 114973 - DNA, 22 bp, Homo sapiens
tatccacttgaacctacactgt

SEQ ID NO: 114974 - DNA, 23 bp, Homo sapiens
gacagagtctcgctctgtcaccc

SEQ ID NO: 114975 - DNA, 23 bp, Homo sapiens
acaagagtctcgctctgtcactc

SEQ ID NO: 114976 - DNA, 19 bp, Homo sapiens
aagagtgcaatcactgctc

SEQ ID NO: 114977 - DNA, 19 bp, Homo sapiens
actttgagggagcatctga

SEQ ID NO: 114978 - DNA, 23 bp, Homo sapiens
agtactgtgtttttggtgttgtc

SEQ ID NO: 114979 - DNA, 23 bp, Homo sapiens
taatgtttgtttttcatttcgaa

SEQ ID NO: 114980 - DNA, 19 bp, Homo sapiens
agagtgacaccctgtctca

SEQ ID NO: 114981 - DNA, 23 bp, Homo sapiens
gacagagtctcgctctgtcaccc

SEQ ID NO: 114982 - DNA, 18 bp, Homo sapiens
aacacacacacacatgaa

SEQ ID NO: 114983 - DNA, 20 bp, Homo sapiens
aaagtactgagattacaggt

SEQ ID NO: 114984 - DNA, 19 bp, Homo sapiens
tcagtctcattcagtcacc

SEQ ID NO: 114985 - DNA, 23 bp, Homo sapiens
tctcagactgtgaggctctgatg

SEQ ID NO: 114986 - DNA, 18 bp, Homo sapiens
atacgctcttgaaggagg

SEQ ID NO: 114987 - DNA, 23 bp, Homo sapiens
aatgcactcactcactcgctcac

SEQ ID NO: 114988 - DNA, 21 bp, Homo sapiens
atatgtatatgtatatatgta

SEQ ID NO: 114989 - DNA, 23 bp, Homo sapiens
atatgtgtatatatatgtgtgtg

SEQ ID NO: 114990 - DNA, 20 bp, Homo sapiens
tggatagagagctaacatat

SEQ ID NO: 114991 - DNA, 23 bp, Homo sapiens
ttcatccttgttctgcagggcct

SEQ ID NO: 114992 - DNA, 23 bp, Homo sapiens
agggactcactctgtctgtgctc

SEQ ID NO: 114993 - DNA, 18 bp, Homo sapiens
agagagccttatccttta

SEQ ID NO: 114994 - DNA, 18 bp, Homo sapiens
tgctttgatgtatatttg

SEQ ID NO: 114995 - DNA, 22 bp, Homo sapiens
tttcacagcctactttcttcct

SEQ ID NO: 114996 - DNA, 22 bp, Homo sapiens
tgaattgagtcacttaaaggaa

SEQ ID NO: 114997 - DNA, 20 bp, Homo sapiens
acacagggcagagactgtct

SEQ ID NO: 114998 - DNA, 23 bp, Homo sapiens
atgctggtgacagaggagaaagt

SEQ ID NO: 114999 - DNA, 23 bp, Homo sapiens
acagagtctcactctgtcgccca

SEQ ID NO: 115000 - DNA, 20 bp, Homo sapiens
ttctctggttgattttgcag

SEQ ID NO: 115001 - DNA, 19 bp, Homo sapiens
tgtggctctgagtttgttg

SEQ ID NO: 115002 - DNA, 23 bp, Homo sapiens
ttacagagacaatcagcatgcct

SEQ ID NO: 115003 - DNA, 23 bp, Homo sapiens
ccactgtgcctggctgagttctg

SEQ ID NO: 115004 - DNA, 22 bp, Homo sapiens
atgagggtgctaattgtgtctg

SEQ ID NO: 115005 - DNA, 20 bp, Homo sapiens
tccctgcctcagtcactcac

SEQ ID NO: 115006 - DNA, 23 bp, Homo sapiens
cacccactgagaggcagtgtggc

SEQ ID NO: 115007 - DNA, 20 bp, Homo sapiens
tctcactctatccctctggt

SEQ ID NO: 115008 - DNA, 23 bp, Homo sapiens
atatttgttgaaataggatgagc

SEQ ID NO: 115009 - DNA, 18 bp, Homo sapiens
ttttgaaacaaaatgatg

SEQ ID NO: 115010 - DNA, 23 bp, Homo sapiens
tcatgcaacatgtaagtgtcctg

SEQ ID NO: 115011 - DNA, 23 bp, Homo sapiens
gtctgtgcctgtgtgtgcatctg

SEQ ID NO: 115012 - DNA, 22 bp, Homo sapiens
acggtgtgtgcttagcaccacg

SEQ ID NO: 115013 - DNA, 23 bp, Homo sapiens
aggtgctgagtcagtggcagtga

SEQ ID NO: 115014 - DNA, 18 bp, Homo sapiens
tgtgagggctatttgtgt

SEQ ID NO: 115015 - DNA, 23 bp, Homo sapiens
tgcctctctgagtctcagcttcc

SEQ ID NO: 115016 - DNA, 23 bp, Homo sapiens
aagtagctgcagtctgtggcact

SEQ ID NO: 115017 - DNA, 23 bp, Homo sapiens
agtttactgtatttgtttatgag

SEQ ID NO: 115018 - DNA, 23 bp, Homo sapiens
gggtctcactctgtcacccaggc

SEQ ID NO: 115019 - DNA, 23 bp, Homo sapiens
gagaacagaactgagtgagcagt

SEQ ID NO: 115020 - DNA, 23 bp, Homo sapiens
aatcactgtcactttctactgtg

SEQ ID NO: 115021 - DNA, 20 bp, Homo sapiens
attagcactggagtggctgt

SEQ ID NO: 115022 - DNA, 22 bp, Homo sapiens
tcacatgcacgcactgtcatga

SEQ ID NO: 115023 - DNA, 19 bp, Homo sapiens
tctctctggctcacttccc

SEQ ID NO: 115024 - DNA, 23 bp, Homo sapiens
ggagtctcactctgtcacccagg

SEQ ID NO: 115025 - DNA, 21 bp, Homo sapiens
gtcagaccttgtgcctgagtg

SEQ ID NO: 115026 - DNA, 22 bp, Homo sapiens
tttgagatggtcattatggcca

SEQ ID NO: 115027 - DNA, 23 bp, Homo sapiens
cgcttgagcctgagaattcgagt

SEQ ID NO: 115028 - DNA, 22 bp, Homo sapiens
tgtctttgcttttctaggtggt

SEQ ID NO: 115029 - DNA, 23 bp, Homo sapiens
ggagtctcactctgtcactcagg

SEQ ID NO: 115030 - DNA, 22 bp, Homo sapiens
cagggcacagactgactgactg

SEQ ID NO: 115031 - DNA, 23 bp, Homo sapiens
tctcaagctccatatcaaatgcc

SEQ ID NO: 115032 - DNA, 21 bp, Homo sapiens
tgagacagactttggctctgt

SEQ ID NO: 115033 - DNA, 23 bp, Homo sapiens
acagcacatctgagccactcact

SEQ ID NO: 115034 - DNA, 23 bp, Homo sapiens
gggacagtgtctcactctgttac

SEQ ID NO: 115035 - DNA, 23 bp, Homo sapiens
tcagcctggctctgtctgtgcca

SEQ ID NO: 115036 - DNA, 23 bp, Homo sapiens
aatgttcctacactctaagctgt

SEQ ID NO: 115037 - DNA, 23 bp, Homo sapiens
taccagggctagattgcagagtc

SEQ ID NO: 115038 - DNA, 23 bp, Homo sapiens
ctctctgggactgcatcttttca

SEQ ID NO: 115039 - DNA, 23 bp, Homo sapiens
cagcctgtgtcagtctcagaccc

SEQ ID NO: 115040 - DNA, 23 bp, Homo sapiens
tgtgtgtgtgcatgtgcatgtgt

SEQ ID NO: 115041 - DNA, 23 bp, Homo sapiens
tgcatgtttgtgtgtgtgcatgc

SEQ ID NO: 115042 - DNA, 23 bp, Homo sapiens
aaagtgtctctgacattggtggg

SEQ ID NO: 115043 - DNA, 21 bp, Homo sapiens
tggctgggtccctgaatcact

SEQ ID NO: 115044 - DNA, 23 bp, Homo sapiens
atgactttatttttttttgagac

SEQ ID NO: 115045 - DNA, 23 bp, Homo sapiens
aaactcagtagaagaaagtttct

SEQ ID NO: 115046 - DNA, 21 bp, Homo sapiens
tcagataaagaaacatttcag

SEQ ID NO: 115047 - DNA, 22 bp, Homo sapiens
tattagcttattttttcagtca

SEQ ID NO: 115048 - DNA, 23 bp, Homo sapiens
actctgtcacccagattggagtg

SEQ ID NO: 115049 - DNA, 20 bp, Homo sapiens
gtgtgcctttagttccagct

SEQ ID NO: 115050 - DNA, 23 bp, Homo sapiens
tgagttcattgtagattctggat

SEQ ID NO: 115051 - DNA, 23 bp, Homo sapiens
tgagttcattgtagattctggat

SEQ ID NO: 115052 - DNA, 23 bp, Homo sapiens
tgagttcattgtagattctggat

SEQ ID NO: 115053 - DNA, 23 bp, Homo sapiens
tgagttcattgtagattctggat

SEQ ID NO: 115054 - DNA, 23 bp, Homo sapiens
tattctgtccatatgtagctgga

SEQ ID NO: 115055 - DNA, 23 bp, Homo sapiens
tgagttcattgtagattctggat

SEQ ID NO: 115056 - DNA, 23 bp, Homo sapiens
tgagttcattgtagattctggat

SEQ ID NO: 115057 - DNA, 23 bp, Homo sapiens
tgagttcattgtagattctggat

SEQ ID NO: 115058 - DNA, 23 bp, Homo sapiens
tgagttcattgtagattctggat

SEQ ID NO: 115059 - DNA, 23 bp, Homo sapiens
tgagttcattgtagattctggat

SEQ ID NO: 115060 - DNA, 23 bp, Homo sapiens
tgagttcattgtagattctggat

SEQ ID NO: 115061 - DNA, 23 bp, Homo sapiens
actgttaagtctatttgttctag

SEQ ID NO: 115062 - DNA, 23 bp, Homo sapiens
tgagttcattgtagattctggat

SEQ ID NO: 115063 - DNA, 23 bp, Homo sapiens
tgagttcattgtagattctggat

SEQ ID NO: 115064 - DNA, 23 bp, Homo sapiens
tgagttcattgtagattctggat

SEQ ID NO: 115065 - DNA, 23 bp, Homo sapiens
tgagttcattgtagattctggat

SEQ ID NO: 115066 - DNA, 23 bp, Homo sapiens
tgagttcattgtagattctggat

SEQ ID NO: 115067 - DNA, 23 bp, Homo sapiens
tgagttcattgtagattctggat

SEQ ID NO: 115068 - DNA, 22 bp, Homo sapiens
taggattgttttggctatgcag

SEQ ID NO: 115069 - DNA, 22 bp, Homo sapiens
tataatgtttgcatgtgtacac

SEQ ID NO: 115070 - DNA, 23 bp, Homo sapiens
ctccttgacactctctttcttgt

SEQ ID NO: 115071 - DNA, 23 bp, Homo sapiens
gggtctcactctgtcacccaggc

SEQ ID NO: 115072 - DNA, 23 bp, Homo sapiens
tgagttcattgtagattctggat

SEQ ID NO: 115073 - DNA, 23 bp, Homo sapiens
tgagttcattgtagattctggat

SEQ ID NO: 115074 - DNA, 23 bp, Homo sapiens
tgagttcattgtagattctggat

SEQ ID NO: 115075 - DNA, 23 bp, Homo sapiens
tgagttcattgtagattctggat

SEQ ID NO: 115076 - DNA, 18 bp, Homo sapiens
agcaggagtgagtggggg

SEQ ID NO: 115077 - DNA, 22 bp, Homo sapiens
tgtctctcacacttatactgct

SEQ ID NO: 115078 - DNA, 23 bp, Homo sapiens
tggtgtcagaagtgagggtggtc

SEQ ID NO: 115079 - DNA, 23 bp, Homo sapiens
tgagttcattgtagattctggat

SEQ ID NO: 115080 - DNA, 23 bp, Homo sapiens
tgagttcattgtagattctggat

SEQ ID NO: 115081 - DNA, 23 bp, Homo sapiens
gtttgagtccctgcttaggaagt

SEQ ID NO: 115082 - DNA, 19 bp, Homo sapiens
attctggaagaaattattt

SEQ ID NO: 115083 - DNA, 23 bp, Homo sapiens
cgtctcactctcacagtgtcccc

SEQ ID NO: 115084 - DNA, 23 bp, Homo sapiens
atgtatttccaaagtgagaacta

SEQ ID NO: 115085 - DNA, 20 bp, Homo sapiens
ttccatgtatatacaggtga

SEQ ID NO: 115086 - DNA, 23 bp, Homo sapiens
taagtatcttctgcttccctttt

SEQ ID NO: 115087 - DNA, 23 bp, Homo sapiens
tgaaagtttttctaaaagatgca

SEQ ID NO: 115088 - DNA, 22 bp, Homo sapiens
tatttgtgtgagctttcctctc

SEQ ID NO: 115089 - DNA, 20 bp, Homo sapiens
gagaggaagtagtttctctt

SEQ ID NO: 115090 - DNA, 23 bp, Homo sapiens
tgagttcattgtagattctggat

SEQ ID NO: 115091 - DNA, 23 bp, Homo sapiens
tgagttcattgtagattctggat

SEQ ID NO: 115092 - DNA, 19 bp, Homo sapiens
gtatatatacatatgtaca

SEQ ID NO: 115093 - DNA, 22 bp, Homo sapiens
taagctagatatgtgtatatat

SEQ ID NO: 115094 - DNA, 23 bp, Homo sapiens
cttgactgtgtgtgttgttttaa

SEQ ID NO: 115095 - DNA, 23 bp, Homo sapiens
tggaaggcacagtcattagctgc

SEQ ID NO: 115096 - DNA, 23 bp, Homo sapiens
ggttcacacttagaagtgatcac

SEQ ID NO: 115097 - DNA, 19 bp, Homo sapiens
tctaagtttatgtgtaaag

SEQ ID NO: 115098 - DNA, 23 bp, Homo sapiens
tgtgtgtctgtgtgtgtaacttg

SEQ ID NO: 115099 - DNA, 21 bp, Homo sapiens
tgtgtgtgcatgtatatacgt

SEQ ID NO: 115100 - DNA, 23 bp, Homo sapiens
tatacacacacatatatatatag

SEQ ID NO: 115101 - DNA, 21 bp, Homo sapiens
ggcttcaaatttatccagttt

SEQ ID NO: 115102 - DNA, 22 bp, Homo sapiens
tctctccctctgttagttcaca

SEQ ID NO: 115103 - DNA, 23 bp, Homo sapiens
tgtgtgtatatgtgtatctatgt

SEQ ID NO: 115104 - DNA, 23 bp, Homo sapiens
acatacacacacaactgtatctg

SEQ ID NO: 115105 - DNA, 21 bp, Homo sapiens
tcacagtatttcttaatgcac

SEQ ID NO: 115106 - DNA, 19 bp, Homo sapiens
agacgaccactaatgttcc

SEQ ID NO: 115107 - DNA, 21 bp, Homo sapiens
gacactggctgagttctgccc

SEQ ID NO: 115108 - DNA, 23 bp, Homo sapiens
atgtgtgtatatatgtatatgtg

SEQ ID NO: 115109 - DNA, 23 bp, Homo sapiens
acctggtcttcctctgtgtgtgt

SEQ ID NO: 115110 - DNA, 23 bp, Homo sapiens
tttttctagagatagggtttcat

SEQ ID NO: 115111 - DNA, 19 bp, Homo sapiens
tgtgaatatatatacacat

SEQ ID NO: 115112 - DNA, 23 bp, Homo sapiens
atatgtgtgtatatgtatataca

SEQ ID NO: 115113 - DNA, 23 bp, Homo sapiens
tatatatgcatatgtataatgta

SEQ ID NO: 115114 - DNA, 19 bp, Homo sapiens
tttattgttcttataggca

SEQ ID NO: 115115 - DNA, 18 bp, Homo sapiens
cctagtgagtgtgaagtg

SEQ ID NO: 115116 - DNA, 23 bp, Homo sapiens
ctgagcctctcactccctctctg

SEQ ID NO: 115117 - DNA, 23 bp, Homo sapiens
gtctctctctgtcactcaggctg

SEQ ID NO: 115118 - DNA, 21 bp, Homo sapiens
aagagacagggtctctctgtg

SEQ ID NO: 115119 - DNA, 21 bp, Homo sapiens
tgacacggtgacactctgtct

SEQ ID NO: 115120 - DNA, 23 bp, Homo sapiens
gagtctcactctgtcacccaggc

SEQ ID NO: 115121 - DNA, 21 bp, Homo sapiens
tctctctttctgtgtggcctt

SEQ ID NO: 115122 - DNA, 23 bp, Homo sapiens
tctgtgaagaaagtcaatggtag

SEQ ID NO: 115123 - DNA, 21 bp, Homo sapiens
tagggagtggctttagcatgt

SEQ ID NO: 115124 - DNA, 20 bp, Homo sapiens
agccagaagtgactaagctc

SEQ ID NO: 115125 - DNA, 20 bp, Homo sapiens
atacacacacatagtgatat

SEQ ID NO: 115126 - DNA, 23 bp, Homo sapiens
cattggtagattgatgaggatgg

SEQ ID NO: 115127 - DNA, 23 bp, Homo sapiens
ctgactgtttctctccctgacac

SEQ ID NO: 115128 - DNA, 22 bp, Homo sapiens
taagctgcagatcaatacggtc

SEQ ID NO: 115129 - DNA, 23 bp, Homo sapiens
gatgtcacattttgtagatctga

SEQ ID NO: 115130 - DNA, 19 bp, Homo sapiens
aacatctctcaaattgagg

SEQ ID NO: 115131 - DNA, 23 bp, Homo sapiens
ggacacactcactcagttaaatg

SEQ ID NO: 115132 - DNA, 19 bp, Homo sapiens
taagctgctgtgagtgcgt

SEQ ID NO: 115133 - DNA, 21 bp, Homo sapiens
tcctgcagtccctgtgttctg

SEQ ID NO: 115134 - DNA, 20 bp, Homo sapiens
tcactgtcttgtgagggcac

SEQ ID NO: 115135 - DNA, 19 bp, Homo sapiens
tttctgcctagaaatcttc

SEQ ID NO: 115136 - DNA, 23 bp, Homo sapiens
ctcactctgtcactgaggctgga

SEQ ID NO: 115137 - DNA, 21 bp, Homo sapiens
agaatacagtgagcagacatg

SEQ ID NO: 115138 - DNA, 21 bp, Homo sapiens
ggttcactgtcctttctttgt

SEQ ID NO: 115139 - DNA, 23 bp, Homo sapiens
tgagttcattgtagattctggat

SEQ ID NO: 115140 - DNA, 23 bp, Homo sapiens
tgagttcattgtagattctggat

SEQ ID NO: 115141 - DNA, 23 bp, Homo sapiens
tgagttcattgtagattctggat

SEQ ID NO: 115142 - DNA, 23 bp, Homo sapiens
tgagttcattgtagattctggat

SEQ ID NO: 115143 - DNA, 23 bp, Homo sapiens
tacatacatatatatacacacac

SEQ ID NO: 115144 - DNA, 23 bp, Homo sapiens
atgtgtgtatatatatatgtgtg

SEQ ID NO: 115145 - DNA, 20 bp, Homo sapiens
agtggaatacttttcaccct

SEQ ID NO: 115146 - DNA, 23 bp, Homo sapiens
tatgtatatgtgtgtgtgtatat

SEQ ID NO: 115147 - DNA, 21 bp, Homo sapiens
tgttgattttgtatcctgcaa

SEQ ID NO: 115148 - DNA, 21 bp, Homo sapiens
tccaaatgtaagatcatatca

SEQ ID NO: 115149 - DNA, 19 bp, Homo sapiens
gtgtggtagaaccatcttt

SEQ ID NO: 115150 - DNA, 23 bp, Homo sapiens
tggagtctctctctgtcacccag

SEQ ID NO: 115151 - DNA, 23 bp, Homo sapiens
agacagaatctcactctgtcacc

SEQ ID NO: 115152 - DNA, 21 bp, Homo sapiens
aagtgtttttcctttcccttt

SEQ ID NO: 115153 - DNA, 21 bp, Homo sapiens
cttagaagtgaggctgctgag

SEQ ID NO: 115154 - DNA, 20 bp, Homo sapiens
agtgaaagtaaatgagagag

SEQ ID NO: 115155 - DNA, 23 bp, Homo sapiens
tgcgtgtgtgtatatctatctat

SEQ ID NO: 115156 - DNA, 21 bp, Homo sapiens
ggctgaagagagtcagcagag

SEQ ID NO: 115157 - DNA, 23 bp, Homo sapiens
tgaggtagatggttgtaagatat

SEQ ID NO: 115158 - DNA, 23 bp, Homo sapiens
ttaacgaaaatttgcttttgagg

SEQ ID NO: 115159 - DNA, 23 bp, Homo sapiens
cacacacacacaccataggatat

SEQ ID NO: 115160 - DNA, 23 bp, Homo sapiens
tgagttcattgtagattctggat

SEQ ID NO: 115161 - DNA, 23 bp, Homo sapiens
tgagttcattgtagattctggat

SEQ ID NO: 115162 - DNA, 22 bp, Homo sapiens
tttggttcctcatgaaatctaa

SEQ ID NO: 115163 - DNA, 23 bp, Homo sapiens
tattgtttttttgaagaaatgtg

SEQ ID NO: 115164 - DNA, 21 bp, Homo sapiens
aacttctgcctgttttcctgt

SEQ ID NO: 115165 - DNA, 20 bp, Homo sapiens
cagtctctgtctctcagatg

SEQ ID NO: 115166 - DNA, 21 bp, Homo sapiens
agaaaaactgttcctcatgtg

SEQ ID NO: 115167 - DNA, 22 bp, Homo sapiens
tataacatacatatgcatgtgt

SEQ ID NO: 115168 - DNA, 23 bp, Homo sapiens
tatgtgcatatatatatgtgtgt

SEQ ID NO: 115169 - DNA, 20 bp, Homo sapiens
tgtgtatatatatacacata

SEQ ID NO: 115170 - DNA, 23 bp, Homo sapiens
tatatgtgtgtatatatgtatgt

SEQ ID NO: 115171 - DNA, 23 bp, Homo sapiens
tctaggttgtgtgttccttatga

SEQ ID NO: 115172 - DNA, 22 bp, Homo sapiens
ggactgtctagttgcaggaaaa

SEQ ID NO: 115173 - DNA, 23 bp, Homo sapiens
tttctgattatgtaattttgtag

SEQ ID NO: 115174 - DNA, 23 bp, Homo sapiens
actctgtcactctgtctccctct

SEQ ID NO: 115175 - DNA, 18 bp, Homo sapiens
aggtagatagatagatag

SEQ ID NO: 115176 - DNA, 23 bp, Homo sapiens
cttgtctcagactctgtttctgg

SEQ ID NO: 115177 - DNA, 23 bp, Homo sapiens
aaacagagcaggaagtaactttt

SEQ ID NO: 115178 - DNA, 20 bp, Homo sapiens
acagtgataatgtgagtcct

SEQ ID NO: 115179 - DNA, 23 bp, Homo sapiens
atggcagttcttatgttaccgtg

SEQ ID NO: 115180 - DNA, 19 bp, Homo sapiens
attgtctgacttattcttg

SEQ ID NO: 115181 - DNA, 23 bp, Homo sapiens
tgagttcattgtagattctggat

SEQ ID NO: 115182 - DNA, 23 bp, Homo sapiens
tgagttcattgtagattctggat

SEQ ID NO: 115183 - DNA, 23 bp, Homo sapiens
tgagtctcactctgtcacccagg

SEQ ID NO: 115184 - DNA, 23 bp, Homo sapiens
tgtgcctctctctgtgtctgttc

SEQ ID NO: 115185 - DNA, 22 bp, Homo sapiens
tctttgctggttttcggcctca

SEQ ID NO: 115186 - DNA, 23 bp, Homo sapiens
actgtcagtgaggtgttgaagtc

SEQ ID NO: 115187 - DNA, 23 bp, Homo sapiens
tttccatttctattcatctgata

SEQ ID NO: 115188 - DNA, 23 bp, Homo sapiens
tctagtgtatttcttgtagaatt

SEQ ID NO: 115189 - DNA, 18 bp, Homo sapiens
tgggatattattactatg

SEQ ID NO: 115190 - DNA, 21 bp, Homo sapiens
tttatagtatatgactatggg

SEQ ID NO: 115191 - DNA, 23 bp, Homo sapiens
cagccactctgtgtgtctgccgt

SEQ ID NO: 115192 - DNA, 23 bp, Homo sapiens
tgtctgcctctgacagagggtga

SEQ ID NO: 115193 - DNA, 23 bp, Homo sapiens
tgacgatgccaatgactctctgt

SEQ ID NO: 115194 - DNA, 23 bp, Homo sapiens
agagagtagtcagagaggtcttt

SEQ ID NO: 115195 - DNA, 23 bp, Homo sapiens
atctctacagatttacgtgtgtc

SEQ ID NO: 115196 - DNA, 20 bp, Homo sapiens
tcacatgcctgtggtcccag

SEQ ID NO: 115197 - DNA, 23 bp, Homo sapiens
ggggtctcactgtgttgagtagg

SEQ ID NO: 115198 - DNA, 23 bp, Homo sapiens
acagagtctcgttctctctctca

SEQ ID NO: 115199 - DNA, 23 bp, Homo sapiens
ttcagcatgacttcacctctctg

SEQ ID NO: 115200 - DNA, 23 bp, Homo sapiens
tggagtctcactctgtcacccag

SEQ ID NO: 115201 - DNA, 23 bp, Homo sapiens
ggaagttgaggctacagtgagcc

SEQ ID NO: 115202 - DNA, 23 bp, Homo sapiens
agacggagtctcactctgtcacc

SEQ ID NO: 115203 - DNA, 20 bp, Homo sapiens
tggtgtgatcttggctcact

SEQ ID NO: 115204 - DNA, 23 bp, Homo sapiens
cggagtctcactctgtcacccag

SEQ ID NO: 115205 - DNA, 23 bp, Homo sapiens
gagtctcactctgtcacccaggc

SEQ ID NO: 115206 - DNA, 23 bp, Homo sapiens
ttgcctccttatgttgggtaaga

SEQ ID NO: 115207 - DNA, 23 bp, Homo sapiens
tggcctcatagtctctgagtctg

SEQ ID NO: 115208 - DNA, 18 bp, Homo sapiens
tagcatgatcttggctca

SEQ ID NO: 115209 - DNA, 23 bp, Homo sapiens
aggcagacagtcagtctctgtgg

SEQ ID NO: 115210 - DNA, 20 bp, Homo sapiens
catctgtgttagacatgctg

SEQ ID NO: 115211 - DNA, 23 bp, Homo sapiens
tccctctcagtctgtgaatggag

SEQ ID NO: 115212 - DNA, 23 bp, Homo sapiens
gacagagtctcgctctgtcaccc

SEQ ID NO: 115213 - DNA, 23 bp, Homo sapiens
agagtctcactctgtcacccagg

SEQ ID NO: 115214 - DNA, 23 bp, Homo sapiens
tatatgatacatatataatgtca

SEQ ID NO: 115215 - DNA, 18 bp, Homo sapiens
cagtggcatgattttggc

SEQ ID NO: 115216 - DNA, 18 bp, Homo sapiens
tatgtatgtatatatgta

SEQ ID NO: 115217 - DNA, 22 bp, Homo sapiens
atcgcttctggtgatttctgag

SEQ ID NO: 115218 - DNA, 23 bp, Homo sapiens
cagagtctcactctgtcgctcag

SEQ ID NO: 115219 - DNA, 23 bp, Homo sapiens
ggtgtctctctctctctctctat

SEQ ID NO: 115220 - DNA, 23 bp, Homo sapiens
gagagagagagagtttatactct

SEQ ID NO: 115221 - DNA, 23 bp, Homo sapiens
tcaatggtagcttgattgagata

SEQ ID NO: 115222 - DNA, 23 bp, Homo sapiens
cagagtctcactctgtcacccag

SEQ ID NO: 115223 - DNA, 18 bp, Homo sapiens
cagtggtgtgatcctggc

SEQ ID NO: 115224 - DNA, 23 bp, Homo sapiens
aaagcattgaaatgaacttagca

SEQ ID NO: 115225 - DNA, 19 bp, Homo sapiens
gcaattttgaaggtcatgt

SEQ ID NO: 115226 - DNA, 23 bp, Homo sapiens
tgagttcattgtagattctggat

SEQ ID NO: 115227 - DNA, 23 bp, Homo sapiens
tgagttcattgtagattctggat

SEQ ID NO: 115228 - DNA, 22 bp, Homo sapiens
gtctcactcactctgttgccaa

SEQ ID NO: 115229 - DNA, 22 bp, Homo sapiens
agtgcagtggcacagtctcagc

SEQ ID NO: 115230 - DNA, 21 bp, Homo sapiens
agtgcccttccaggaagcaga

SEQ ID NO: 115231 - DNA, 23 bp, Homo sapiens
tctcacagtgaaccggtctcttt

SEQ ID NO: 115232 - DNA, 23 bp, Homo sapiens
ttatctatgtgttggttatccag

SEQ ID NO: 115233 - DNA, 20 bp, Homo sapiens
atgtattggttttcattaac

SEQ ID NO: 115234 - DNA, 23 bp, Homo sapiens
tgagttcattgtagattctggat

SEQ ID NO: 115235 - DNA, 23 bp, Homo sapiens
tgagttcattgtagattctggat

SEQ ID NO: 115236 - DNA, 23 bp, Homo sapiens
ttgagtgagcatctgttttcaat

SEQ ID NO: 115237 - DNA, 22 bp, Homo sapiens
agaaaagttggatctattactt

SEQ ID NO: 115238 - DNA, 21 bp, Homo sapiens
tttttcacatctgaatctgct

SEQ ID NO: 115239 - DNA, 20 bp, Homo sapiens
tgtctagtcttagctactca

SEQ ID NO: 115240 - DNA, 19 bp, Homo sapiens
cagtgagccaagactgcac

SEQ ID NO: 115241 - DNA, 23 bp, Homo sapiens
gggtctcactctgtcacccaggc

SEQ ID NO: 115242 - DNA, 23 bp, Homo sapiens
tgtgtgtctgtgtgtgtatacac

SEQ ID NO: 115243 - DNA, 23 bp, Homo sapiens
tttggttgtagatagttatcagt

SEQ ID NO: 115244 - DNA, 23 bp, Homo sapiens
actgtccacaactcacttgtgtt

SEQ ID NO: 115245 - DNA, 19 bp, Homo sapiens
agtggcaagatcatggctc

SEQ ID NO: 115246 - DNA, 23 bp, Homo sapiens
gagttcactgtgttcactgtgtg

SEQ ID NO: 115247 - DNA, 18 bp, Homo sapiens
acatttgtgggcttttca

SEQ ID NO: 115248 - DNA, 23 bp, Homo sapiens
tatatgtatatatatatgtgtgt

SEQ ID NO: 115249 - DNA, 23 bp, Homo sapiens
acagagtctcactctgtcgccca

SEQ ID NO: 115250 - DNA, 23 bp, Homo sapiens
gtctcactctgtcattcaggctg

SEQ ID NO: 115251 - DNA, 23 bp, Homo sapiens
atgttgccacttcaaggaagtct

SEQ ID NO: 115252 - DNA, 20 bp, Homo sapiens
gtgtgaggctgggaaaggtg

SEQ ID NO: 115253 - DNA, 23 bp, Homo sapiens
ttgttcagggaaaatgttgtttt

SEQ ID NO: 115254 - DNA, 23 bp, Homo sapiens
ccaagtatttctagctgtatgag

SEQ ID NO: 115255 - DNA, 23 bp, Homo sapiens
tgagttcattgtagattctggat

SEQ ID NO: 115256 - DNA, 23 bp, Homo sapiens
tgagttcattgtagattctggat

SEQ ID NO: 115257 - DNA, 23 bp, Homo sapiens
tccatgaagaaagtcagttatag

SEQ ID NO: 115258 - DNA, 22 bp, Homo sapiens
agggtcactgctttggcctgtg

SEQ ID NO: 115259 - DNA, 23 bp, Homo sapiens
tgagacaagtctcgctctgtcac

SEQ ID NO: 115260 - DNA, 23 bp, Homo sapiens
tatatgtatatgtgtatgtgtga

SEQ ID NO: 115261 - DNA, 21 bp, Homo sapiens
ggccacactgtctgtctgggt

SEQ ID NO: 115262 - DNA, 20 bp, Homo sapiens
gttttcttgagtaaatgtag

SEQ ID NO: 115263 - DNA, 23 bp, Homo sapiens
tctatttgctaatattttgttaa

SEQ ID NO: 115264 - DNA, 23 bp, Homo sapiens
agaactgagtgttcttatggtgt

SEQ ID NO: 115265 - DNA, 22 bp, Homo sapiens
ttcaagtaatccaggataggct

SEQ ID NO: 115266 - DNA, 23 bp, Homo sapiens
actgccactgtcacagacagggt

SEQ ID NO: 115267 - DNA, 18 bp, Homo sapiens
atctttctagggtgtgtg

SEQ ID NO: 115268 - DNA, 22 bp, Homo sapiens
agaatctgagggagtggaagca

SEQ ID NO: 115269 - DNA, 22 bp, Homo sapiens
ttctatttatttgaaatgccca

SEQ ID NO: 115270 - DNA, 23 bp, Homo sapiens
ctctctggctctgacaccctgtg

SEQ ID NO: 115271 - DNA, 23 bp, Homo sapiens
tgagagaggagagagtcctgtgt

SEQ ID NO: 115272 - DNA, 23 bp, Homo sapiens
ttttgagtgtcagtttccccatc

SEQ ID NO: 115273 - DNA, 23 bp, Homo sapiens
ctctctctctctgggtctcatct

SEQ ID NO: 115274 - DNA, 23 bp, Homo sapiens
gctgtctctctctcagtgcctga

SEQ ID NO: 115275 - DNA, 23 bp, Homo sapiens
aatgtggatcaagtattgaggaa

SEQ ID NO: 115276 - DNA, 23 bp, Homo sapiens
tgggtctcactctgtcacccagg

SEQ ID NO: 115277 - DNA, 20 bp, Homo sapiens
gggactgttctctctaactg

SEQ ID NO: 115278 - DNA, 23 bp, Homo sapiens
tgtcagctgttgctgcactacag

SEQ ID NO: 115279 - DNA, 23 bp, Homo sapiens
tgtgtatatatacatatgtgtgt

SEQ ID NO: 115280 - DNA, 21 bp, Homo sapiens
catatgtgtgtgtatatatac

SEQ ID NO: 115281 - DNA, 19 bp, Homo sapiens
tacatatgtgtgtatatgt

SEQ ID NO: 115282 - DNA, 23 bp, Homo sapiens
tgtgtgtgtgtatgttgggaaac

SEQ ID NO: 115283 - DNA, 18 bp, Homo sapiens
tctgaagcctttaggtat

SEQ ID NO: 115284 - DNA, 22 bp, Homo sapiens
aaaagctccttaagaactggga

SEQ ID NO: 115285 - DNA, 23 bp, Homo sapiens
gagtctcactctgtcacccaggc

SEQ ID NO: 115286 - DNA, 23 bp, Homo sapiens
tgagttcattgtagattctggat

SEQ ID NO: 115287 - DNA, 23 bp, Homo sapiens
tgagttcattgtagattctggat

SEQ ID NO: 115288 - DNA, 23 bp, Homo sapiens
tgactctctcagtcttttgcagg

SEQ ID NO: 115289 - DNA, 23 bp, Homo sapiens
ttgctctgtcttgccttttgatg

SEQ ID NO: 115290 - DNA, 19 bp, Homo sapiens
tacctctagttggctttga

SEQ ID NO: 115291 - DNA, 23 bp, Homo sapiens
tctccctctgtcaccctctgtca

SEQ ID NO: 115292 - DNA, 21 bp, Homo sapiens
ttactggtgttcttgatgtat

SEQ ID NO: 115293 - DNA, 23 bp, Homo sapiens
cccaccctctctgcctgtgtctg

SEQ ID NO: 115294 - DNA, 23 bp, Homo sapiens
ttctctgacgctctgtggctcct

SEQ ID NO: 115295 - DNA, 23 bp, Homo sapiens
tgaaataactgagattttctttt

SEQ ID NO: 115296 - DNA, 23 bp, Homo sapiens
caagtttttggaagagtttagga

SEQ ID NO: 115297 - DNA, 19 bp, Homo sapiens
cagagaaggatctgagctc

SEQ ID NO: 115298 - DNA, 20 bp, Homo sapiens
agggagttgagagagtgcag

SEQ ID NO: 115299 - DNA, 20 bp, Homo sapiens
tgaattctttgaaatttttg

SEQ ID NO: 115300 - DNA, 22 bp, Homo sapiens
atatatgtatatgtatatgtgt

SEQ ID NO: 115301 - DNA, 23 bp, Homo sapiens
atatatgtatatgtatatatgtg

SEQ ID NO: 115302 - DNA, 23 bp, Homo sapiens
tgtatgtatgtatgtatgtatgt

SEQ ID NO: 115303 - DNA, 22 bp, Homo sapiens
tatgtatgtatgtatgtgtgtg

SEQ ID NO: 115304 - DNA, 21 bp, Homo sapiens
gtatggcttgtagagtctgtc

SEQ ID NO: 115305 - DNA, 23 bp, Homo sapiens
ttttttggttccatatgaaattt

SEQ ID NO: 115306 - DNA, 23 bp, Homo sapiens
agtgatgtggggaaactgtgtgt

SEQ ID NO: 115307 - DNA, 23 bp, Homo sapiens
ctcagtctgtcactcaggttgga

SEQ ID NO: 115308 - DNA, 23 bp, Homo sapiens
agatggagtctcactctgtcacc

SEQ ID NO: 115309 - DNA, 23 bp, Homo sapiens
tggagtctcactctgtcacccag

SEQ ID NO: 115310 - DNA, 23 bp, Homo sapiens
tctgtgtgtgtgtgtgtgcaatc

SEQ ID NO: 115311 - DNA, 23 bp, Homo sapiens
gataggtagatagatttatagat

SEQ ID NO: 115312 - DNA, 18 bp, Homo sapiens
ttagggactgtctcttgt

SEQ ID NO: 115313 - DNA, 23 bp, Homo sapiens
acacagacactgagtgtttcttc

SEQ ID NO: 115314 - DNA, 22 bp, Homo sapiens
cccattttatagatgaagttga

SEQ ID NO: 115315 - DNA, 23 bp, Homo sapiens
aatgggtcttctgccagcctctt

SEQ ID NO: 115316 - DNA, 22 bp, Homo sapiens
tctcagaagtgtctgtgcagtt

SEQ ID NO: 115317 - DNA, 23 bp, Homo sapiens
tgtggatttcacttcctatctct

SEQ ID NO: 115318 - DNA, 23 bp, Homo sapiens
tttgactgtctcatatttttttg

SEQ ID NO: 115319 - DNA, 18 bp, Homo sapiens
tgctgcagttggcagtga

SEQ ID NO: 115320 - DNA, 18 bp, Homo sapiens
actgagaacagtgtctgt

SEQ ID NO: 115321 - DNA, 20 bp, Homo sapiens
ttcaagattgttttagctat

SEQ ID NO: 115322 - DNA, 22 bp, Homo sapiens
gtatgtatgtatgtatgtatgt

SEQ ID NO: 115323 - DNA, 20 bp, Homo sapiens
tgactctatcctgcattttc

SEQ ID NO: 115324 - DNA, 23 bp, Homo sapiens
ccagactgactcagtctcaggga

SEQ ID NO: 115325 - DNA, 19 bp, Homo sapiens
agctggtgttgtgaatcag

SEQ ID NO: 115326 - DNA, 22 bp, Homo sapiens
actattaaagtttatcttttgt

SEQ ID NO: 115327 - DNA, 23 bp, Homo sapiens
gggtgtctgtggtgtgtgagctc

SEQ ID NO: 115328 - DNA, 20 bp, Homo sapiens
tagacatcttgtggaggggt

SEQ ID NO: 115329 - DNA, 22 bp, Homo sapiens
ttattgctttttgagatggcag

SEQ ID NO: 115330 - DNA, 19 bp, Homo sapiens
ggctgtctctctctggctc

SEQ ID NO: 115331 - DNA, 22 bp, Homo sapiens
gacagtcaagtctgtgagcaga

SEQ ID NO: 115332 - DNA, 23 bp, Homo sapiens
atatatatatgtgcatgtataca

SEQ ID NO: 115333 - DNA, 19 bp, Homo sapiens
tatatgcatgtatacatat

SEQ ID NO: 115334 - DNA, 23 bp, Homo sapiens
actgagtgcatgtatctttttgg

SEQ ID NO: 115335 - DNA, 18 bp, Homo sapiens
tatacccagtaatgggat

SEQ ID NO: 115336 - DNA, 23 bp, Homo sapiens
ctgagtgtgtctctgtgagcctc

SEQ ID NO: 115337 - DNA, 23 bp, Homo sapiens
cttacagagaaatctgtgtgcag

SEQ ID NO: 115338 - DNA, 20 bp, Homo sapiens
atgcctccctggtttgcacc

SEQ ID NO: 115339 - DNA, 22 bp, Homo sapiens
tgacactgtcccacactgaggc

SEQ ID NO: 115340 - DNA, 21 bp, Homo sapiens
aggaagcagaagatgctgttg

SEQ ID NO: 115341 - DNA, 23 bp, Homo sapiens
tgagtctcactcccagaaattcc

SEQ ID NO: 115342 - DNA, 23 bp, Homo sapiens
actgactctgtctcttaatgtgc

SEQ ID NO: 115343 - DNA, 23 bp, Homo sapiens
tgagttcattgtagattctggat

SEQ ID NO: 115344 - DNA, 23 bp, Homo sapiens
tgagttcattgtagattctggat

SEQ ID NO: 115345 - DNA, 23 bp, Homo sapiens
gtgtgtgtatatatatatgtgtg

SEQ ID NO: 115346 - DNA, 18 bp, Homo sapiens
ggaaagagaggaaactga

SEQ ID NO: 115347 - DNA, 23 bp, Homo sapiens
ttattcagtttttctatttctca

SEQ ID NO: 115348 - DNA, 19 bp, Homo sapiens
tcactagagtttgagctca

SEQ ID NO: 115349 - DNA, 18 bp, Homo sapiens
gtagatatatatctctag

SEQ ID NO: 115350 - DNA, 23 bp, Homo sapiens
tgtaaactggctcaagtttggaa

SEQ ID NO: 115351 - DNA, 23 bp, Homo sapiens
ttagtctgttgtccatccgatct

SEQ ID NO: 115352 - DNA, 23 bp, Homo sapiens
agtcccctgtgtctgtgtctgtg

SEQ ID NO: 115353 - DNA, 23 bp, Homo sapiens
cagggtctcactctgtcgctcag

SEQ ID NO: 115354 - DNA, 22 bp, Homo sapiens
atttttagtagagatggggttt

SEQ ID NO: 115355 - DNA, 23 bp, Homo sapiens
tgtgtatatatatatgtgtgtgt

SEQ ID NO: 115356 - DNA, 22 bp, Homo sapiens
atgagttggagctttgctcagg

SEQ ID NO: 115357 - DNA, 23 bp, Homo sapiens
atatatgtatatgtatatacgtg

SEQ ID NO: 115358 - DNA, 23 bp, Homo sapiens
tgtgtgtacatatgtatatgtgt

SEQ ID NO: 115359 - DNA, 23 bp, Homo sapiens
atatgtgtatatgtgtgtgtgtg

SEQ ID NO: 115360 - DNA, 23 bp, Homo sapiens
atacgtatatatgtatatgtgtg

SEQ ID NO: 115361 - DNA, 23 bp, Homo sapiens
atacgtatatatgtatatgtgtg

SEQ ID NO: 115362 - DNA, 23 bp, Homo sapiens
agagtctcattctgtcacccaag

SEQ ID NO: 115363 - DNA, 23 bp, Homo sapiens
gagtctcactctgtcacccaggc

SEQ ID NO: 115364 - DNA, 23 bp, Homo sapiens
accctggctgcctcaatggcttg

SEQ ID NO: 115365 - DNA, 23 bp, Homo sapiens
gggtctcactctgacacccaggc

SEQ ID NO: 115366 - DNA, 23 bp, Homo sapiens
gagtctcactgtgtcacctaggc

SEQ ID NO: 115367 - DNA, 23 bp, Homo sapiens
gcagtaagagctccctgtaacct

SEQ ID NO: 115368 - DNA, 23 bp, Homo sapiens
ggagtctcactctgtctcccagg

SEQ ID NO: 115369 - DNA, 21 bp, Homo sapiens
actctctgagacaaagttctc

SEQ ID NO: 115370 - DNA, 23 bp, Homo sapiens
tgaggtaggaggatctcttgagc

SEQ ID NO: 115371 - DNA, 23 bp, Homo sapiens
ctctctctggctctctctggcct

SEQ ID NO: 115372 - DNA, 23 bp, Homo sapiens
gactgagtctcgctctgtcaccc

SEQ ID NO: 115373 - DNA, 23 bp, Homo sapiens
tggagtctcactctgtcacccag

SEQ ID NO: 115374 - DNA, 20 bp, Homo sapiens
agtggtggggattgtgggtc

SEQ ID NO: 115375 - DNA, 18 bp, Homo sapiens
tcacatctgtaatcccag

SEQ ID NO: 115376 - DNA, 23 bp, Homo sapiens
agattacagaaaactgtgatggt

SEQ ID NO: 115377 - DNA, 18 bp, Homo sapiens
tacaggctggagtctttg

SEQ ID NO: 115378 - DNA, 20 bp, Homo sapiens
tgtggcatagtgaagtatat

SEQ ID NO: 115379 - DNA, 23 bp, Homo sapiens
gttgagacggactctcgctgtgt

SEQ ID NO: 115380 - DNA, 23 bp, Homo sapiens
tgagatggagtctcactctgtca

SEQ ID NO: 115381 - DNA, 23 bp, Homo sapiens
cagggtctgtctgtctcactcct

SEQ ID NO: 115382 - DNA, 23 bp, Homo sapiens
ctgagtgtcactcacactggcag

SEQ ID NO: 115383 - DNA, 23 bp, Homo sapiens
cggagtctcgctctgtctcccag

SEQ ID NO: 115384 - DNA, 21 bp, Homo sapiens
tctcgctctgtctcccaggct

SEQ ID NO: 115385 - DNA, 23 bp, Homo sapiens
cggagtctcactctgtcacccag

SEQ ID NO: 115386 - DNA, 23 bp, Homo sapiens
ttatcacttgtgtaggtttgtgt

SEQ ID NO: 115387 - DNA, 22 bp, Homo sapiens
agaaattgccaagcttttccag

SEQ ID NO: 115388 - DNA, 23 bp, Homo sapiens
tggagtctcactctgtcacccag

SEQ ID NO: 115389 - DNA, 23 bp, Homo sapiens
tggagtctcactctgtcacccag

SEQ ID NO: 115390 - DNA, 23 bp, Homo sapiens
tagagcatcagtcacactgtcag

SEQ ID NO: 115391 - DNA, 21 bp, Homo sapiens
taacacatgagaaactggaca

SEQ ID NO: 115392 - DNA, 19 bp, Homo sapiens
tgaggtaggaggatcactt

SEQ ID NO: 115393 - DNA, 23 bp, Homo sapiens
ttacttttttttcttttgagaca

SEQ ID NO: 115394 - DNA, 23 bp, Homo sapiens
agacagagtcccgctctgtcact

SEQ ID NO: 115395 - DNA, 23 bp, Homo sapiens
agtccctgactccctccctggct

SEQ ID NO: 115396 - DNA, 19 bp, Homo sapiens
tttgagatggagtcttgct

SEQ ID NO: 115397 - DNA, 21 bp, Homo sapiens
ttagcactaattgaattatgg

SEQ ID NO: 115398 - DNA, 23 bp, Homo sapiens
tctgtgaagaaagtcagtagtag

SEQ ID NO: 115399 - DNA, 23 bp, Homo sapiens
tggacttttggcaggtaagctaa

SEQ ID NO: 115400 - DNA, 23 bp, Homo sapiens
gtgtgttgattttgtattctgca

SEQ ID NO: 115401 - DNA, 23 bp, Homo sapiens
tgaaagatcagagtgaacacaag

SEQ ID NO: 115402 - DNA, 20 bp, Homo sapiens
cagtggtatgatcttggctc

SEQ ID NO: 115403 - DNA, 22 bp, Homo sapiens
actgggtaattttatagcacag

SEQ ID NO: 115404 - DNA, 22 bp, Homo sapiens
tgcctctctgtgtgccacagct

SEQ ID NO: 115405 - DNA, 23 bp, Homo sapiens
aggtctcactctgtcacccaggc

SEQ ID NO: 115406 - DNA, 22 bp, Homo sapiens
tttgcatgtggttttagcaaaa

SEQ ID NO: 115407 - DNA, 22 bp, Homo sapiens
tgttatgttaagatctatgaag

SEQ ID NO: 115408 - DNA, 23 bp, Homo sapiens
agagtctcactctgtcacccagg

SEQ ID NO: 115409 - DNA, 23 bp, Homo sapiens
tctgcctcactcactctatttgg

SEQ ID NO: 115410 - DNA, 18 bp, Homo sapiens
tcactgcaacctctgtct

SEQ ID NO: 115411 - DNA, 21 bp, Homo sapiens
tgagctagagtcttgctctgt

SEQ ID NO: 115412 - DNA, 23 bp, Homo sapiens
actggagtacagtggtatgatct

SEQ ID NO: 115413 - DNA, 23 bp, Homo sapiens
tgggtgcctgtgtgcctggcagt

SEQ ID NO: 115414 - DNA, 23 bp, Homo sapiens
tttcatgaacttattggatgttt

SEQ ID NO: 115415 - DNA, 23 bp, Homo sapiens
tgagcttcaagcttggtttgatt

SEQ ID NO: 115416 - DNA, 19 bp, Homo sapiens
tgtgactgggtatttcttg

SEQ ID NO: 115417 - DNA, 23 bp, Homo sapiens
tgagttcattgtagattctggat

SEQ ID NO: 115418 - DNA, 23 bp, Homo sapiens
tgagttcattgtagattctggat

SEQ ID NO: 115419 - DNA, 22 bp, Homo sapiens
ttggtattcagagtttggggat

SEQ ID NO: 115420 - DNA, 22 bp, Homo sapiens
tctgtctcagtcaatttcacca

SEQ ID NO: 115421 - DNA, 23 bp, Homo sapiens
tctttgcatatttttagtggtta

SEQ ID NO: 115422 - DNA, 23 bp, Homo sapiens
ctctcaggctccctgtaagggaa

SEQ ID NO: 115423 - DNA, 20 bp, Homo sapiens
ttacccagatcatgagcctg

SEQ ID NO: 115424 - DNA, 23 bp, Homo sapiens
tcgctggctggctggctgactgg

SEQ ID NO: 115425 - DNA, 18 bp, Homo sapiens
gtgcttagggagctgctt

SEQ ID NO: 115426 - DNA, 22 bp, Homo sapiens
tgtgggtcttcttcaggtagag

SEQ ID NO: 115427 - DNA, 22 bp, Homo sapiens
taaatccagatgagcaggtgtg

SEQ ID NO: 115428 - DNA, 18 bp, Homo sapiens
agtctgggttttcaattt

SEQ ID NO: 115429 - DNA, 23 bp, Homo sapiens
tccctctctgtgtctctggtact

SEQ ID NO: 115430 - DNA, 22 bp, Homo sapiens
tttctctgtgaggctcagtgtc

SEQ ID NO: 115431 - DNA, 22 bp, Homo sapiens
gacagagtctcactgtgtcgcc

SEQ ID NO: 115432 - DNA, 23 bp, Homo sapiens
tgagttcattgtagattctggat

SEQ ID NO: 115433 - DNA, 23 bp, Homo sapiens
tgagttcattgtagattctggat

SEQ ID NO: 115434 - DNA, 21 bp, Homo sapiens
ctgagagaagtgagaaagcta

SEQ ID NO: 115435 - DNA, 23 bp, Homo sapiens
ccgttcatgaaggaagctgtgtt

SEQ ID NO: 115436 - DNA, 20 bp, Homo sapiens
tgagctaggaggatgtgaga

SEQ ID NO: 115437 - DNA, 23 bp, Homo sapiens
tttgtcctgactctgcaggctta

SEQ ID NO: 115438 - DNA, 20 bp, Homo sapiens
ttgagagatgagacagacct

SEQ ID NO: 115439 - DNA, 22 bp, Homo sapiens
aaagtgacctaaagatttcaaa

SEQ ID NO: 115440 - DNA, 23 bp, Homo sapiens
tcagtaggaataggaggtcattg

SEQ ID NO: 115441 - DNA, 21 bp, Homo sapiens
aaccacacacatatactacac

SEQ ID NO: 115442 - DNA, 23 bp, Homo sapiens
tccactctctcagtcactgtact

SEQ ID NO: 115443 - DNA, 21 bp, Homo sapiens
tacagtggtatgatcacagct

SEQ ID NO: 115444 - DNA, 23 bp, Homo sapiens
ctctctgtgtctgaatttcctca

SEQ ID NO: 115445 - DNA, 19 bp, Homo sapiens
aaccacattccttgttctg

SEQ ID NO: 115446 - DNA, 20 bp, Homo sapiens
tcaactccagggagtttgtg

SEQ ID NO: 115447 - DNA, 21 bp, Homo sapiens
tatgacaacagagagagccca

SEQ ID NO: 115448 - DNA, 22 bp, Homo sapiens
aacatggtgtccttactggcag

SEQ ID NO: 115449 - DNA, 23 bp, Homo sapiens
ctcgctctgtcgctcaggctggg

SEQ ID NO: 115450 - DNA, 23 bp, Homo sapiens
tctcaatctctccctccatctgc

SEQ ID NO: 115451 - DNA, 23 bp, Homo sapiens
atacatgtatagtataatacatg

SEQ ID NO: 115452 - DNA, 23 bp, Homo sapiens
agacagagtctcgctctgtcttc

SEQ ID NO: 115453 - DNA, 22 bp, Homo sapiens
tttaattgactatgataaacct

SEQ ID NO: 115454 - DNA, 20 bp, Homo sapiens
ttgtgtattagtatatgagt

SEQ ID NO: 115455 - DNA, 23 bp, Homo sapiens
tatatgtatatgagtatgtatac

SEQ ID NO: 115456 - DNA, 18 bp, Homo sapiens
aagcctgtagtcccagct

SEQ ID NO: 115457 - DNA, 19 bp, Homo sapiens
tgagatggagtctcactct

SEQ ID NO: 115458 - DNA, 21 bp, Homo sapiens
aaagtgctgggattacaggca

SEQ ID NO: 115459 - DNA, 22 bp, Homo sapiens
tcacactgcattttttaaggga

SEQ ID NO: 115460 - DNA, 23 bp, Homo sapiens
ttaatactgtaagcactttgtgt

SEQ ID NO: 115461 - DNA, 23 bp, Homo sapiens
tgagacagagtctcactctgtca

SEQ ID NO: 115462 - DNA, 23 bp, Homo sapiens
agagtctcactctctcacccatg

SEQ ID NO: 115463 - DNA, 23 bp, Homo sapiens
cagagtctcgctctgtcgctcag

SEQ ID NO: 115464 - DNA, 18 bp, Homo sapiens
tctggctggcagaagtgg

SEQ ID NO: 115465 - DNA, 20 bp, Homo sapiens
acaaggtgctcagtcgggga

SEQ ID NO: 115466 - DNA, 22 bp, Homo sapiens
aggtcagtgaggagacaggggc

SEQ ID NO: 115467 - DNA, 23 bp, Homo sapiens
ggctgaggtaggaggatcacttg

SEQ ID NO: 115468 - DNA, 23 bp, Homo sapiens
tcttttttggttccatatgaaat

SEQ ID NO: 115469 - DNA, 23 bp, Homo sapiens
tctgtgaagaaagtcaatggtag

SEQ ID NO: 115470 - DNA, 23 bp, Homo sapiens
tctgtgtgtgcctgagtggctgc

SEQ ID NO: 115471 - DNA, 22 bp, Homo sapiens
tgattagtgaaattgatctttt

SEQ ID NO: 115472 - DNA, 20 bp, Homo sapiens
tgagagaagctagtgtggtc

SEQ ID NO: 115473 - DNA, 23 bp, Homo sapiens
tcatttggtgaatatctatatct

SEQ ID NO: 115474 - DNA, 19 bp, Homo sapiens
tgtgtatatatgtatagga

SEQ ID NO: 115475 - DNA, 21 bp, Homo sapiens
tgtatatttcctattctgtaa

SEQ ID NO: 115476 - DNA, 21 bp, Homo sapiens
tgtatatatgatacatatgta

SEQ ID NO: 115477 - DNA, 22 bp, Homo sapiens
tgtatatatgatacatatgtat

SEQ ID NO: 115478 - DNA, 21 bp, Homo sapiens
ggtatatatgatacatatgta

SEQ ID NO: 115479 - DNA, 23 bp, Homo sapiens
tggagtctcactctgtcacccag

SEQ ID NO: 115480 - DNA, 23 bp, Homo sapiens
aaagacagtcaagagagagggaa

SEQ ID NO: 115481 - DNA, 20 bp, Homo sapiens
taggttttgttcctgcatat

SEQ ID NO: 115482 - DNA, 23 bp, Homo sapiens
tggagtctcactctgtcacccag

SEQ ID NO: 115483 - DNA, 23 bp, Homo sapiens
agtcattttatttctgtctgata

SEQ ID NO: 115484 - DNA, 22 bp, Homo sapiens
aatgaggtaggctcagtagaag

SEQ ID NO: 115485 - DNA, 23 bp, Homo sapiens
cagtctctctgtgcctcagtttc

SEQ ID NO: 115486 - DNA, 23 bp, Homo sapiens
atccttgtcattttcttgttgag

SEQ ID NO: 115487 - DNA, 18 bp, Homo sapiens
ctctctctctccctgttg

SEQ ID NO: 115488 - DNA, 23 bp, Homo sapiens
agagtctcactctgtcacccagg

SEQ ID NO: 115489 - DNA, 23 bp, Homo sapiens
ctcttcactttctgtttgactct

SEQ ID NO: 115490 - DNA, 23 bp, Homo sapiens
tctgtgtatctgtgtgttacaat

SEQ ID NO: 115491 - DNA, 23 bp, Homo sapiens
gtcagtcagactgtctctccaaa

SEQ ID NO: 115492 - DNA, 23 bp, Homo sapiens
tgagttcattgtagattctggat

SEQ ID NO: 115493 - DNA, 23 bp, Homo sapiens
tgagttcattgtagattctggat

SEQ ID NO: 115494 - DNA, 22 bp, Homo sapiens
ttgacaagtgattgtgttgttg

SEQ ID NO: 115495 - DNA, 18 bp, Homo sapiens
tctgattctctctccgtg

SEQ ID NO: 115496 - DNA, 19 bp, Homo sapiens
gacagctcagaatgcctgt

SEQ ID NO: 115497 - DNA, 23 bp, Homo sapiens
attagaatgtgctggagggtgag

SEQ ID NO: 115498 - DNA, 20 bp, Homo sapiens
tgtctgctttgtttgaggag

SEQ ID NO: 115499 - DNA, 20 bp, Homo sapiens
ttcattgatagacacaatgc

SEQ ID NO: 115500 - DNA, 23 bp, Homo sapiens
tctgtgtcactttctgtctccct

SEQ ID NO: 115501 - DNA, 23 bp, Homo sapiens
actctgtctcccagactagagtg

SEQ ID NO: 115502 - DNA, 22 bp, Homo sapiens
atacacacacgtatacacacac

SEQ ID NO: 115503 - DNA, 20 bp, Homo sapiens
tgaggctgggtgtctggctg

SEQ ID NO: 115504 - DNA, 23 bp, Homo sapiens
tatgtgtatatgtatacaaatat

SEQ ID NO: 115505 - DNA, 23 bp, Homo sapiens
gaactgagaaaagtgactttctg

SEQ ID NO: 115506 - DNA, 21 bp, Homo sapiens
tctccctctctgggcctcggt

SEQ ID NO: 115507 - DNA, 20 bp, Homo sapiens
ttcagagtctgagatggtgc

SEQ ID NO: 115508 - DNA, 21 bp, Homo sapiens
aagtcatgagtttgaaaccag

SEQ ID NO: 115509 - DNA, 23 bp, Homo sapiens
catgacaaggaggatagagtgct

SEQ ID NO: 115510 - DNA, 23 bp, Homo sapiens
gactctttctcagtcagtgtaaa

SEQ ID NO: 115511 - DNA, 22 bp, Homo sapiens
gcatgtgtgtgtgtgtgtgtgt

SEQ ID NO: 115512 - DNA, 23 bp, Homo sapiens
tatgtacatgtatgtatatatgt

SEQ ID NO: 115513 - DNA, 23 bp, Homo sapiens
tgtctctgttgctggcagtctct

SEQ ID NO: 115514 - DNA, 20 bp, Homo sapiens
agtgtcccagacgtgatgga

SEQ ID NO: 115515 - DNA, 21 bp, Homo sapiens
tttttttctggagacacagtc

SEQ ID NO: 115516 - DNA, 18 bp, Homo sapiens
agctctatctttgattta

SEQ ID NO: 115517 - DNA, 23 bp, Homo sapiens
tgtgtacttctgattatcttctt

SEQ ID NO: 115518 - DNA, 23 bp, Homo sapiens
tttgttctttttgcttaggattg

SEQ ID NO: 115519 - DNA, 23 bp, Homo sapiens
atggcttttctttactatctgat

SEQ ID NO: 115520 - DNA, 23 bp, Homo sapiens
tacacacacacatatctgtatct

SEQ ID NO: 115521 - DNA, 23 bp, Homo sapiens
aaaatgtgtcaagtcaggggctg

SEQ ID NO: 115522 - DNA, 22 bp, Homo sapiens
ttcacagtagtcattcagcaca

SEQ ID NO: 115523 - DNA, 23 bp, Homo sapiens
aagtgtcaagttgtacatcaaag

SEQ ID NO: 115524 - DNA, 23 bp, Homo sapiens
tgtcgcttgcacttgtaattatg

SEQ ID NO: 115525 - DNA, 23 bp, Homo sapiens
ttctgtgaagaaagtcaaaggta

SEQ ID NO: 115526 - DNA, 23 bp, Homo sapiens
tgagttcattgtagattctggat

SEQ ID NO: 115527 - DNA, 19 bp, Homo sapiens
acagacactttacgtatgt

SEQ ID NO: 115528 - DNA, 23 bp, Homo sapiens
ttattactgtagtgatggctgtt

SEQ ID NO: 115529 - DNA, 23 bp, Homo sapiens
cagagtctcactctgtcactcag

SEQ ID NO: 115530 - DNA, 22 bp, Homo sapiens
taaacaatgaacacagtttctg

SEQ ID NO: 115531 - DNA, 23 bp, Homo sapiens
tgtattcttctgcagctgctcca

SEQ ID NO: 115532 - DNA, 21 bp, Homo sapiens
tgtgaagaaagtcaatggtag

SEQ ID NO: 115533 - DNA, 19 bp, Homo sapiens
tacgtcttgaaagttttgt

SEQ ID NO: 115534 - DNA, 23 bp, Homo sapiens
acaattatgggtgtggtactcat

SEQ ID NO: 115535 - DNA, 21 bp, Homo sapiens
tgcagtctcgctctgtcaccc

SEQ ID NO: 115536 - DNA, 18 bp, Homo sapiens
agcgtaggcagtgggtaa

SEQ ID NO: 115537 - DNA, 19 bp, Homo sapiens
agctgcttctactgtgcat

SEQ ID NO: 115538 - DNA, 23 bp, Homo sapiens
gagaattgtgttgttaggtgatt

SEQ ID NO: 115539 - DNA, 23 bp, Homo sapiens
tggagtctcactctgtcacccag

SEQ ID NO: 115540 - DNA, 21 bp, Homo sapiens
agacagtgcacactgcggtga

SEQ ID NO: 115541 - DNA, 23 bp, Homo sapiens
tgagtctcacttactctgttgcc

SEQ ID NO: 115542 - DNA, 20 bp, Homo sapiens
agtgagagagagattgaagt

SEQ ID NO: 115543 - DNA, 23 bp, Homo sapiens
gattgtaggatgtttagtggtat

SEQ ID NO: 115544 - DNA, 23 bp, Homo sapiens
tgagttcattgtagattctggat

SEQ ID NO: 115545 - DNA, 23 bp, Homo sapiens
tgagttcattgtagattctggat

SEQ ID NO: 115546 - DNA, 21 bp, Homo sapiens
ttacaaatgcttattgtgagt

SEQ ID NO: 115547 - DNA, 20 bp, Homo sapiens
atatagtattttaaaagggg

SEQ ID NO: 115548 - DNA, 23 bp, Homo sapiens
tagatggatgaatagatgtttga

SEQ ID NO: 115549 - DNA, 21 bp, Homo sapiens
actgtgtgctagaccacagag

SEQ ID NO: 115550 - DNA, 23 bp, Homo sapiens
atatctaaatgtatatctgtatg

SEQ ID NO: 115551 - DNA, 23 bp, Homo sapiens
tatgtgtttgtatatatatgtgt

SEQ ID NO: 115552 - DNA, 20 bp, Homo sapiens
tgaggtaggaggatcacttg

SEQ ID NO: 115553 - DNA, 22 bp, Homo sapiens
aagagttctgactatgttgaag

SEQ ID NO: 115554 - DNA, 23 bp, Homo sapiens
tgctgtggcatgatcttggctca

SEQ ID NO: 115555 - DNA, 20 bp, Homo sapiens
ctctgggtgagtcagtgagt

SEQ ID NO: 115556 - DNA, 23 bp, Homo sapiens
ttaataggtgtcagtgctggttt

SEQ ID NO: 115557 - DNA, 22 bp, Homo sapiens
tgtgtctgtgtgtatatataca

SEQ ID NO: 115558 - DNA, 20 bp, Homo sapiens
acacacacacacacagtttt

SEQ ID NO: 115559 - DNA, 22 bp, Homo sapiens
tatggtagttgcatgtttaaat

SEQ ID NO: 115560 - DNA, 23 bp, Homo sapiens
cagagtgtctgtaccatttcaca

SEQ ID NO: 115561 - DNA, 21 bp, Homo sapiens
tatatatagatgtaaggtgta

SEQ ID NO: 115562 - DNA, 21 bp, Homo sapiens
atttggaaacacagcacattg

SEQ ID NO: 115563 - DNA, 21 bp, Homo sapiens
tgagaggagagagagctgagt

SEQ ID NO: 115564 - DNA, 23 bp, Homo sapiens
ttgtgttttcatggagtctcatt

SEQ ID NO: 115565 - DNA, 23 bp, Homo sapiens
agtcaccatgaccaactggatgt

SEQ ID NO: 115566 - DNA, 23 bp, Homo sapiens
tggagtctcactctgtcacccag

SEQ ID NO: 115567 - DNA, 19 bp, Homo sapiens
gagaagtccaactctagat

SEQ ID NO: 115568 - DNA, 23 bp, Homo sapiens
tcagagtttctttttctctctcc

SEQ ID NO: 115569 - DNA, 19 bp, Homo sapiens
tgtgaagaaagtcaatggt

SEQ ID NO: 115570 - DNA, 22 bp, Homo sapiens
tgtgagtatatatatgtgtgtg

SEQ ID NO: 115571 - DNA, 21 bp, Homo sapiens
gtgcttatatatgcacatatg

SEQ ID NO: 115572 - DNA, 23 bp, Homo sapiens
agcaatgtgtgtgtataaattgt

SEQ ID NO: 115573 - DNA, 23 bp, Homo sapiens
aagtgctatgtattcacactaca

SEQ ID NO: 115574 - DNA, 23 bp, Homo sapiens
gccctgtctgtgtgactgtcagg

SEQ ID NO: 115575 - DNA, 23 bp, Homo sapiens
gttgaaggtgttcacagaaaaga

SEQ ID NO: 115576 - DNA, 23 bp, Homo sapiens
atgtatatgtgtatatgtatgtg

SEQ ID NO: 115577 - DNA, 23 bp, Homo sapiens
tatgaacattatatatatgtgtg

SEQ ID NO: 115578 - DNA, 23 bp, Homo sapiens
ttcatccacactctgagtcactc

SEQ ID NO: 115579 - DNA, 23 bp, Homo sapiens
tgtgtcactcagtggttccgtct

SEQ ID NO: 115580 - DNA, 23 bp, Homo sapiens
gagatggagtcgcactctgtctc

SEQ ID NO: 115581 - DNA, 23 bp, Homo sapiens
atctgtgtgtgtgtatatatata

SEQ ID NO: 115582 - DNA, 23 bp, Homo sapiens
tttgagacggagtctcgctctat

SEQ ID NO: 115583 - DNA, 23 bp, Homo sapiens
tgagttcattgtagattctggat

SEQ ID NO: 115584 - DNA, 23 bp, Homo sapiens
tgagttcattgtagattctggat

SEQ ID NO: 115585 - DNA, 23 bp, Homo sapiens
acagtgtaactctcactctgagg

SEQ ID NO: 115586 - DNA, 23 bp, Homo sapiens
ttctgtgtgtgtgttatatgtgt

SEQ ID NO: 115587 - DNA, 21 bp, Homo sapiens
tgtatacatacatatatatac

SEQ ID NO: 115588 - DNA, 23 bp, Homo sapiens
ctcccagagcccctggaactctg

SEQ ID NO: 115589 - DNA, 23 bp, Homo sapiens
tcccagagcccctggaactctgg

SEQ ID NO: 115590 - DNA, 23 bp, Homo sapiens
tcccagagcccctggaactctgg

SEQ ID NO: 115591 - DNA, 23 bp, Homo sapiens
tcccagagcccctggaactctgg

SEQ ID NO: 115592 - DNA, 23 bp, Homo sapiens
ggtctctctctctgtgtgcctgt

SEQ ID NO: 115593 - DNA, 18 bp, Homo sapiens
taacagtccactgagtag

SEQ ID NO: 115594 - DNA, 18 bp, Homo sapiens
atacgtatacatatgtat

SEQ ID NO: 115595 - DNA, 23 bp, Homo sapiens
tatatgtatatgtatatatgtgt

SEQ ID NO: 115596 - DNA, 18 bp, Homo sapiens
tgtgtgtgtatgtgcatg

SEQ ID NO: 115597 - DNA, 22 bp, Homo sapiens
atatgtgtatatatatgtgtgt

SEQ ID NO: 115598 - DNA, 20 bp, Homo sapiens
tatagcatgtatatatatag

SEQ ID NO: 115599 - DNA, 22 bp, Homo sapiens
ttgccagtggatgaagacacag

SEQ ID NO: 115600 - DNA, 20 bp, Homo sapiens
tttttgtactcattgctagt

SEQ ID NO: 115601 - DNA, 19 bp, Homo sapiens
tgtgtatatatatatgtgt

SEQ ID NO: 115602 - DNA, 23 bp, Homo sapiens
tatttggagataaaggtaggaga

SEQ ID NO: 115603 - DNA, 19 bp, Homo sapiens
atgagcaaaatttctctaa

SEQ ID NO: 115604 - DNA, 23 bp, Homo sapiens
atgtacacacacatatatgtatc

SEQ ID NO: 115605 - DNA, 22 bp, Homo sapiens
cagtggcacagtctcaactcac

SEQ ID NO: 115606 - DNA, 23 bp, Homo sapiens
tgagttcattgtagattctggat

SEQ ID NO: 115607 - DNA, 23 bp, Homo sapiens
tgagttcattgtagattctggat

SEQ ID NO: 115608 - DNA, 23 bp, Homo sapiens
tatatatgcaatggaatactatt

SEQ ID NO: 115609 - DNA, 23 bp, Homo sapiens
tgagttcattgtagattctggat

SEQ ID NO: 115610 - DNA, 23 bp, Homo sapiens
tgagttcattgtagattctggat

SEQ ID NO: 115611 - DNA, 23 bp, Homo sapiens
gatctgtgtctgcttttgttgag

SEQ ID NO: 115612 - DNA, 23 bp, Homo sapiens
actgagtctcactctgccaccca

SEQ ID NO: 115613 - DNA, 23 bp, Homo sapiens
tatgtgcatgtgagtatatgtga

SEQ ID NO: 115614 - DNA, 23 bp, Homo sapiens
atatgtatgtgtgtgtatatata

SEQ ID NO: 115615 - DNA, 20 bp, Homo sapiens
ttatatctttatgatatata

SEQ ID NO: 115616 - DNA, 23 bp, Homo sapiens
tgagttcattgtagattctggat

SEQ ID NO: 115617 - DNA, 23 bp, Homo sapiens
tgagttcattgtagattctggat

SEQ ID NO: 115618 - DNA, 23 bp, Homo sapiens
aatagtaaaacagacacttatgt

SEQ ID NO: 115619 - DNA, 23 bp, Homo sapiens
tctcagaggatatctttatttat

SEQ ID NO: 115620 - DNA, 23 bp, Homo sapiens
tctccccgtcactttcaggtaca

SEQ ID NO: 115621 - DNA, 23 bp, Homo sapiens
tgagttcattgtagattctggat

SEQ ID NO: 115622 - DNA, 23 bp, Homo sapiens
tgagttcattgtagattctggat

SEQ ID NO: 115623 - DNA, 18 bp, Homo sapiens
gagctgttgcttcagatt

SEQ ID NO: 115624 - DNA, 20 bp, Homo sapiens
aagagagatgaaagaaagct

SEQ ID NO: 115625 - DNA, 23 bp, Homo sapiens
agtggatgtctaatgatttctca

SEQ ID NO: 115626 - DNA, 23 bp, Homo sapiens
tgtgcaaatgtatgcatatgtaa

SEQ ID NO: 115627 - DNA, 23 bp, Homo sapiens
catatgtatacatatgtaacaaa

SEQ ID NO: 115628 - DNA, 23 bp, Homo sapiens
atgacagttttgaaatgtagtct

SEQ ID NO: 115629 - DNA, 23 bp, Homo sapiens
tggtcatacagatagctagttta

SEQ ID NO: 115630 - DNA, 19 bp, Homo sapiens
atcttagtagctctgcatc

SEQ ID NO: 115631 - DNA, 19 bp, Homo sapiens
aagggctttgaaaacactt

SEQ ID NO: 115632 - DNA, 23 bp, Homo sapiens
tgaggatgtttctagatgagatt

SEQ ID NO: 115633 - DNA, 18 bp, Homo sapiens
attggtagaagattgtcc

SEQ ID NO: 115634 - DNA, 20 bp, Homo sapiens
tacgtacatatatatgcata

SEQ ID NO: 115635 - DNA, 23 bp, Homo sapiens
atgtatatctacatgtatgtgta

SEQ ID NO: 115636 - DNA, 20 bp, Homo sapiens
ctacatatgtatatctacat

SEQ ID NO: 115637 - DNA, 22 bp, Homo sapiens
tatgtatatatgtatatctaca

SEQ ID NO: 115638 - DNA, 19 bp, Homo sapiens
atatgtatatatgtatatc

SEQ ID NO: 115639 - DNA, 23 bp, Homo sapiens
tatgtatatatatacgtgtatat

SEQ ID NO: 115640 - DNA, 23 bp, Homo sapiens
gacagagtctcactctgtggccc

SEQ ID NO: 115641 - DNA, 18 bp, Homo sapiens
gtgtgatcttggctcact

SEQ ID NO: 115642 - DNA, 23 bp, Homo sapiens
cggagtctcactctgtcacccag

SEQ ID NO: 115643 - DNA, 23 bp, Homo sapiens
gtgtctctagagagagagcacaa

SEQ ID NO: 115644 - DNA, 23 bp, Homo sapiens
tgagttcattgtagattctggat

SEQ ID NO: 115645 - DNA, 23 bp, Homo sapiens
tgagttcattgtagattctggat

SEQ ID NO: 115646 - DNA, 22 bp, Homo sapiens
tatacatatactatacatatgt

SEQ ID NO: 115647 - DNA, 23 bp, Homo sapiens
tgtgtatatatacatatgtgtgt

SEQ ID NO: 115648 - DNA, 23 bp, Homo sapiens
tgatatagatatagatatagatc

SEQ ID NO: 115649 - DNA, 21 bp, Homo sapiens
tatatctagatatctatatat

SEQ ID NO: 115650 - DNA, 23 bp, Homo sapiens
ctatatatctatagatatctata

SEQ ID NO: 115651 - DNA, 23 bp, Homo sapiens
cagggtctccctctgtcactcag

SEQ ID NO: 115652 - DNA, 23 bp, Homo sapiens
tgtttgtgtatatgtatatgtgt

SEQ ID NO: 115653 - DNA, 23 bp, Homo sapiens
tgtgtgtgtatatatatatgtgt

SEQ ID NO: 115654 - DNA, 23 bp, Homo sapiens
tatccactgagagcatggtctat

SEQ ID NO: 115655 - DNA, 23 bp, Homo sapiens
agctacagttcggtttggcactg

SEQ ID NO: 115656 - DNA, 21 bp, Homo sapiens
ttgactgtagaaagagaggtc

SEQ ID NO: 115657 - DNA, 22 bp, Homo sapiens
ctatttcagattgttcagtgat

SEQ ID NO: 115658 - DNA, 23 bp, Homo sapiens
gaaactctactgaatttgtacat

SEQ ID NO: 115659 - DNA, 23 bp, Homo sapiens
acttttagaggaactgtgaaaat

SEQ ID NO: 115660 - DNA, 20 bp, Homo sapiens
tgaggtaaatttgatgtttc

SEQ ID NO: 115661 - DNA, 18 bp, Homo sapiens
aggttttggttagctaag

SEQ ID NO: 115662 - DNA, 20 bp, Homo sapiens
tctcaagttttttcttgact

SEQ ID NO: 115663 - DNA, 23 bp, Homo sapiens
aggatgtgaagtcattatgttct

SEQ ID NO: 115664 - DNA, 23 bp, Homo sapiens
ctggtgtctcactctgtcagatg

SEQ ID NO: 115665 - DNA, 20 bp, Homo sapiens
ttgttttcagagctggcttc

SEQ ID NO: 115666 - DNA, 22 bp, Homo sapiens
agcttgtaggagatgtactagt

SEQ ID NO: 115667 - DNA, 22 bp, Homo sapiens
cagggtctcactctgccactca

SEQ ID NO: 115668 - DNA, 20 bp, Homo sapiens
ctccaaataaaatgtgtgta

SEQ ID NO: 115669 - DNA, 23 bp, Homo sapiens
tgagttcattgtagattctggat

SEQ ID NO: 115670 - DNA, 23 bp, Homo sapiens
tgagttcattgtagattctggat

SEQ ID NO: 115671 - DNA, 22 bp, Homo sapiens
tttcgttttctttacatgtatg

SEQ ID NO: 115672 - DNA, 23 bp, Homo sapiens
agagtctcactctgtctcccagg

SEQ ID NO: 115673 - DNA, 23 bp, Homo sapiens
agtgcagcagagtgatcttggct

SEQ ID NO: 115674 - DNA, 23 bp, Homo sapiens
tgtgtgtgtgtgtgtaactacat

SEQ ID NO: 115675 - DNA, 23 bp, Homo sapiens
aagcagaatgtagttaagaaatc

SEQ ID NO: 115676 - DNA, 19 bp, Homo sapiens
tatgtgtatatatatatgt

SEQ ID NO: 115677 - DNA, 22 bp, Homo sapiens
ataaagctagttaaggaaattc

SEQ ID NO: 115678 - DNA, 19 bp, Homo sapiens
gatcttttaaaatgtgaat

SEQ ID NO: 115679 - DNA, 21 bp, Homo sapiens
taaatcattagatatggaatg

SEQ ID NO: 115680 - DNA, 23 bp, Homo sapiens
tgagttcattgtagattctggat

SEQ ID NO: 115681 - DNA, 23 bp, Homo sapiens
tgagttcattgtagattctggat

SEQ ID NO: 115682 - DNA, 23 bp, Homo sapiens
gagcgatcatcatgccttagcac

SEQ ID NO: 115683 - DNA, 20 bp, Homo sapiens
cctgtagtctcagcactttg

SEQ ID NO: 115684 - DNA, 21 bp, Homo sapiens
tgaggtaggtggatcacttga

SEQ ID NO: 115685 - DNA, 21 bp, Homo sapiens
atggctcagttgtttcctctt

SEQ ID NO: 115686 - DNA, 22 bp, Homo sapiens
tgacttcagactcattcagcag

SEQ ID NO: 115687 - DNA, 23 bp, Homo sapiens
tgagttcattgtagattctggat

SEQ ID NO: 115688 - DNA, 23 bp, Homo sapiens
tgagttcattgtagattctggat

SEQ ID NO: 115689 - DNA, 23 bp, Homo sapiens
atggtgtgtacacagtatcctca

SEQ ID NO: 115690 - DNA, 23 bp, Homo sapiens
tcttttttggttccatatagatt

SEQ ID NO: 115691 - DNA, 21 bp, Homo sapiens
atttttcacattagttacctg

SEQ ID NO: 115692 - DNA, 23 bp, Homo sapiens
ggctgttcactgcgaggaaagat

SEQ ID NO: 115693 - DNA, 23 bp, Homo sapiens
tgagttcattgtagattctggat

SEQ ID NO: 115694 - DNA, 23 bp, Homo sapiens
tgagttcattgtagattctggat

SEQ ID NO: 115695 - DNA, 21 bp, Homo sapiens
atctttgtttttatatctgtt

SEQ ID NO: 115696 - DNA, 23 bp, Homo sapiens
tgagttcattgtagattctggat

SEQ ID NO: 115697 - DNA, 23 bp, Homo sapiens
tgagttcattgtagattctggat

SEQ ID NO: 115698 - DNA, 23 bp, Homo sapiens
tgagttcattgtagattctggat

SEQ ID NO: 115699 - DNA, 23 bp, Homo sapiens
tgagttcattgtagattctggat

SEQ ID NO: 115700 - DNA, 23 bp, Homo sapiens
ttcgtgcctcagacatttgtgtt

SEQ ID NO: 115701 - DNA, 23 bp, Homo sapiens
cacacacacacataaatatgtgt

SEQ ID NO: 115702 - DNA, 22 bp, Homo sapiens
acacgtatgtgtgcatatgtgt

SEQ ID NO: 115703 - DNA, 23 bp, Homo sapiens
tgagttcattgtagattctggat

SEQ ID NO: 115704 - DNA, 23 bp, Homo sapiens
tgagttcattgtagattctggat

SEQ ID NO: 115705 - DNA, 23 bp, Homo sapiens
ataattctacttgatcatgatat

SEQ ID NO: 115706 - DNA, 23 bp, Homo sapiens
acagagtctcactctgtcgccca

SEQ ID NO: 115707 - DNA, 22 bp, Homo sapiens
tggctcacatctgtaatctcag

SEQ ID NO: 115708 - DNA, 23 bp, Homo sapiens
tgaggagtgaatttgtaaaagag

SEQ ID NO: 115709 - DNA, 23 bp, Homo sapiens
atgtatgtgtatatgtatgtatg

SEQ ID NO: 115710 - DNA, 19 bp, Homo sapiens
atgtatttgagcaaaggct

SEQ ID NO: 115711 - DNA, 23 bp, Homo sapiens
ttgaccagagattttgatgatgg

SEQ ID NO: 115712 - DNA, 23 bp, Homo sapiens
tatatgtatgcatatatatgtgt

SEQ ID NO: 115713 - DNA, 23 bp, Homo sapiens
aatatatgcatatgtatacatat

SEQ ID NO: 115714 - DNA, 23 bp, Homo sapiens
tgtctatatatttatctctgtgt

SEQ ID NO: 115715 - DNA, 23 bp, Homo sapiens
atttgtatgtatatgtatacatg

SEQ ID NO: 115716 - DNA, 23 bp, Homo sapiens
taagtgagaatactagaagtcca

SEQ ID NO: 115717 - DNA, 23 bp, Homo sapiens
tgcaacagcatctcctactgtta

SEQ ID NO: 115718 - DNA, 20 bp, Homo sapiens
agtctacagagaacatctgc

SEQ ID NO: 115719 - DNA, 22 bp, Homo sapiens
tgatttgtgctgcttcttagaa

SEQ ID NO: 115720 - DNA, 20 bp, Homo sapiens
ttgaatctttgtttatgtgt

SEQ ID NO: 115721 - DNA, 22 bp, Homo sapiens
aggtcatcaagttcagcatgta

SEQ ID NO: 115722 - DNA, 21 bp, Homo sapiens
aatcatgttgatagtgtgcac

SEQ ID NO: 115723 - DNA, 20 bp, Homo sapiens
tatacacatatacgtatact

SEQ ID NO: 115724 - DNA, 19 bp, Homo sapiens
tgtatatatatatgtgtgt

SEQ ID NO: 115725 - DNA, 21 bp, Homo sapiens
acaaatttggttgaatttgta

SEQ ID NO: 115726 - DNA, 22 bp, Homo sapiens
tgtatgtatatgtatatgtgta

SEQ ID NO: 115727 - DNA, 18 bp, Homo sapiens
atatgtatgtgtgtatgt

SEQ ID NO: 115728 - DNA, 23 bp, Homo sapiens
tgttcttggtctctctcagtggc

SEQ ID NO: 115729 - DNA, 23 bp, Homo sapiens
tgcaccttattcatgggtttgag

SEQ ID NO: 115730 - DNA, 23 bp, Homo sapiens
gacagagtctcactcagtcgctc

SEQ ID NO: 115731 - DNA, 21 bp, Homo sapiens
tatgtggtacatatatctata

SEQ ID NO: 115732 - DNA, 23 bp, Homo sapiens
agcaggttcttttatgactttct

SEQ ID NO: 115733 - DNA, 23 bp, Homo sapiens
tgagttcattgtagattctggat

SEQ ID NO: 115734 - DNA, 23 bp, Homo sapiens
tgagttcattgtagattctggat

SEQ ID NO: 115735 - DNA, 23 bp, Homo sapiens
ttctgtgaagaaagtcattggta

SEQ ID NO: 115736 - DNA, 20 bp, Homo sapiens
agacagagcagtgtgtggag

SEQ ID NO: 115737 - DNA, 22 bp, Homo sapiens
tagtggtgtctgagctcagact

SEQ ID NO: 115738 - DNA, 23 bp, Homo sapiens
tgagatggagtctcactcattct

SEQ ID NO: 115739 - DNA, 23 bp, Homo sapiens
agagtctcactctgtcacccagg

SEQ ID NO: 115740 - DNA, 23 bp, Homo sapiens
gagtctcactctgtcacccaggc

SEQ ID NO: 115741 - DNA, 19 bp, Homo sapiens
tggtgagatgggtactgtg

SEQ ID NO: 115742 - DNA, 22 bp, Homo sapiens
gactgctttttttttgagacag

SEQ ID NO: 115743 - DNA, 23 bp, Homo sapiens
cctgtctgtggaatgatgtatgg

SEQ ID NO: 115744 - DNA, 18 bp, Homo sapiens
acacatgtcagagtcagc

SEQ ID NO: 115745 - DNA, 21 bp, Homo sapiens
ttgacagtagtcagccagcac

SEQ ID NO: 115746 - DNA, 19 bp, Homo sapiens
attctctcttggaaagtgt

SEQ ID NO: 115747 - DNA, 19 bp, Homo sapiens
acgtatatatatgtgtgtg

SEQ ID NO: 115748 - DNA, 23 bp, Homo sapiens
tcaatctctcactatttgagcct

SEQ ID NO: 115749 - DNA, 23 bp, Homo sapiens
tttgggagtgatagaactgttct

SEQ ID NO: 115750 - DNA, 23 bp, Homo sapiens
aatgtgtcagctgagtctctgtc

SEQ ID NO: 115751 - DNA, 21 bp, Homo sapiens
aattgcacttcagagccgctc

SEQ ID NO: 115752 - DNA, 23 bp, Homo sapiens
agagtctcactctgtcacccagg

SEQ ID NO: 115753 - DNA, 23 bp, Homo sapiens
ttgttaccatatgaaagtgatgt

SEQ ID NO: 115754 - DNA, 23 bp, Homo sapiens
agtagcaggattagaattgattg

SEQ ID NO: 115755 - DNA, 19 bp, Homo sapiens
ttttagtagagatggggtt

SEQ ID NO: 115756 - DNA, 23 bp, Homo sapiens
acagagtctcgctctgtcaccca

SEQ ID NO: 115757 - DNA, 21 bp, Homo sapiens
ttcagtagtggcatcgctgaa

SEQ ID NO: 115758 - DNA, 19 bp, Homo sapiens
gactcagaagacagtcagc

SEQ ID NO: 115759 - DNA, 23 bp, Homo sapiens
ttcatgctcactctgtgactgag

SEQ ID NO: 115760 - DNA, 18 bp, Homo sapiens
tcactgcaagctctgcct

SEQ ID NO: 115761 - DNA, 19 bp, Homo sapiens
cagtgggacagagaccggc

SEQ ID NO: 115762 - DNA, 23 bp, Homo sapiens
gaggtctgtgactgtcagctttc

SEQ ID NO: 115763 - DNA, 21 bp, Homo sapiens
agcaatagtgaaattcatgtc

SEQ ID NO: 115764 - DNA, 23 bp, Homo sapiens
agacagaatctcactctgtcacc

SEQ ID NO: 115765 - DNA, 23 bp, Homo sapiens
tgtgtgtatatatatatgtgtgt

SEQ ID NO: 115766 - DNA, 23 bp, Homo sapiens
tatgtgtgtgtatatgtatatgt

SEQ ID NO: 115767 - DNA, 20 bp, Homo sapiens
agtctcgctctgtcgctcag

SEQ ID NO: 115768 - DNA, 20 bp, Homo sapiens
tggcctaggctaatctgtgt

SEQ ID NO: 115769 - DNA, 23 bp, Homo sapiens
agacagagtctcactctgtcacc

SEQ ID NO: 115770 - DNA, 23 bp, Homo sapiens
tgagttcattgtagattctggat

SEQ ID NO: 115771 - DNA, 23 bp, Homo sapiens
tgagttcattgtagattctggat

SEQ ID NO: 115772 - DNA, 19 bp, Homo sapiens
agcttggagtaaatggaga

SEQ ID NO: 115773 - DNA, 23 bp, Homo sapiens
tatgtatgtatatatgtatgtag

SEQ ID NO: 115774 - DNA, 19 bp, Homo sapiens
aacagagttatgcgatgtc

SEQ ID NO: 115775 - DNA, 23 bp, Homo sapiens
gatggtgtctcactctgtcaccc

SEQ ID NO: 115776 - DNA, 22 bp, Homo sapiens
ttaaggttcttccatgttgtag

SEQ ID NO: 115777 - DNA, 23 bp, Homo sapiens
aagagcatctattttgctgtcag

SEQ ID NO: 115778 - DNA, 23 bp, Homo sapiens
gtctctggtagttctttctagta

SEQ ID NO: 115779 - DNA, 22 bp, Homo sapiens
ttttgtagttctgcccctgata

SEQ ID NO: 115780 - DNA, 18 bp, Homo sapiens
aggggatttatttttagt

SEQ ID NO: 115781 - DNA, 23 bp, Homo sapiens
agacagagtctccctctgtcacc

SEQ ID NO: 115782 - DNA, 23 bp, Homo sapiens
aatgtgtatatacatctatgtgt

SEQ ID NO: 115783 - DNA, 23 bp, Homo sapiens
cggagtctcgctctgtctcccag

SEQ ID NO: 115784 - DNA, 23 bp, Homo sapiens
tatatgtttacatgttgtggcac

SEQ ID NO: 115785 - DNA, 21 bp, Homo sapiens
tatgtttatatgttgtagcac

SEQ ID NO: 115786 - DNA, 23 bp, Homo sapiens
ttctgtgaagaaagtcaatggta

SEQ ID NO: 115787 - DNA, 23 bp, Homo sapiens
tttcagaatggtaaatgagcatt

SEQ ID NO: 115788 - DNA, 22 bp, Homo sapiens
tatgtgtgtatatatgtgtgta

SEQ ID NO: 115789 - DNA, 22 bp, Homo sapiens
ccagtttgtgtcactttgttat

SEQ ID NO: 115790 - DNA, 22 bp, Homo sapiens
aatggggctcttaaagatggtc

SEQ ID NO: 115791 - DNA, 22 bp, Homo sapiens
cacatatacatatgaatgtgtg

SEQ ID NO: 115792 - DNA, 23 bp, Homo sapiens
gagagacaacaatcactgcagtt

SEQ ID NO: 115793 - DNA, 23 bp, Homo sapiens
ttcacagtgttgtcacagggaaa

SEQ ID NO: 115794 - DNA, 23 bp, Homo sapiens
tgagttcattgtagattctggat

SEQ ID NO: 115795 - DNA, 23 bp, Homo sapiens
tgagttcattgtagattctggat

SEQ ID NO: 115796 - DNA, 23 bp, Homo sapiens
agacatgtgccatcacacccaga

SEQ ID NO: 115797 - DNA, 23 bp, Homo sapiens
cggagtctcactctgcctgtcag

SEQ ID NO: 115798 - DNA, 18 bp, Homo sapiens
atctccactcactgcact

SEQ ID NO: 115799 - DNA, 22 bp, Homo sapiens
tatatgtatatgattatgtacg

SEQ ID NO: 115800 - DNA, 21 bp, Homo sapiens
ttgacatatgaatttgtagtt

SEQ ID NO: 115801 - DNA, 20 bp, Homo sapiens
ctgacaccctgacaccctgc

SEQ ID NO: 115802 - DNA, 23 bp, Homo sapiens
ttatctctgggtgattctggagt

SEQ ID NO: 115803 - DNA, 23 bp, Homo sapiens
tctctcatgcagtagatgtgtga

SEQ ID NO: 115804 - DNA, 21 bp, Homo sapiens
tgtgaagagtctcagtagtgt

SEQ ID NO: 115805 - DNA, 18 bp, Homo sapiens
ctagccatagtcacacac

SEQ ID NO: 115806 - DNA, 23 bp, Homo sapiens
tgagttcattgtagattctggat

SEQ ID NO: 115807 - DNA, 23 bp, Homo sapiens
tgagttcattgtagattctggat

SEQ ID NO: 115808 - DNA, 23 bp, Homo sapiens
ctgtgttgttatctagactttgc

SEQ ID NO: 115809 - DNA, 22 bp, Homo sapiens
atgtgtgtgtgtgtatataatc

SEQ ID NO: 115810 - DNA, 23 bp, Homo sapiens
agagtctcactctgtcacccagg

SEQ ID NO: 115811 - DNA, 23 bp, Homo sapiens
gagtctcactctgtcacccaggc

SEQ ID NO: 115812 - DNA, 22 bp, Homo sapiens
gttttttggttccatatgaaat

SEQ ID NO: 115813 - DNA, 20 bp, Homo sapiens
tgtgaagaaagtcaatggta

SEQ ID NO: 115814 - DNA, 18 bp, Homo sapiens
acctctttgagttaagga

SEQ ID NO: 115815 - DNA, 22 bp, Homo sapiens
atacgtatatatacatatatgt

SEQ ID NO: 115816 - DNA, 21 bp, Homo sapiens
tatcagtgccatctttgttgg

SEQ ID NO: 115817 - DNA, 20 bp, Homo sapiens
ttcactttgagattacttcc

SEQ ID NO: 115818 - DNA, 19 bp, Homo sapiens
agaaccaagagactgagca

SEQ ID NO: 115819 - DNA, 21 bp, Homo sapiens
tcggagaggctgagatgtaag

SEQ ID NO: 115820 - DNA, 23 bp, Homo sapiens
tagctctcgctctttgtcactct

SEQ ID NO: 115821 - DNA, 21 bp, Homo sapiens
tgtgtgtatgtatatatgtat

SEQ ID NO: 115822 - DNA, 22 bp, Homo sapiens
aacttcctgtgcttctctctag

SEQ ID NO: 115823 - DNA, 23 bp, Homo sapiens
tgtggtagtaccttgaaaagttc

SEQ ID NO: 115824 - DNA, 22 bp, Homo sapiens
gggtctcactgtgtcactcaag

SEQ ID NO: 115825 - DNA, 22 bp, Homo sapiens
tgaacaatatatatgtgtgtgt

SEQ ID NO: 115826 - DNA, 23 bp, Homo sapiens
tgagttcattgtagattctggat

SEQ ID NO: 115827 - DNA, 23 bp, Homo sapiens
tgagttcattgtagattctggat

SEQ ID NO: 115828 - DNA, 21 bp, Homo sapiens
aattcacagatacatttatgt

SEQ ID NO: 115829 - DNA, 23 bp, Homo sapiens
aatattgaatcagcaaggtctgt

SEQ ID NO: 115830 - DNA, 18 bp, Homo sapiens
ctgggaattcaaatgtta

SEQ ID NO: 115831 - DNA, 23 bp, Homo sapiens
tgtctgcctctctgcttggactt

SEQ ID NO: 115832 - DNA, 23 bp, Homo sapiens
aagtcagtggacagagtggagaa

SEQ ID NO: 115833 - DNA, 22 bp, Homo sapiens
taaaatggtctttaaattgttg

SEQ ID NO: 115834 - DNA, 23 bp, Homo sapiens
ttgctcaggattgtctatttggg

SEQ ID NO: 115835 - DNA, 18 bp, Homo sapiens
ctccatttgcagctgttt

SEQ ID NO: 115836 - DNA, 23 bp, Homo sapiens
tgagttcattgtagattctggat

SEQ ID NO: 115837 - DNA, 23 bp, Homo sapiens
tgagttcattgtagattctggat

SEQ ID NO: 115838 - DNA, 23 bp, Homo sapiens
tgtgtctgtgagtgggtgtgatc

SEQ ID NO: 115839 - DNA, 21 bp, Homo sapiens
tgtgaagaaagtcaatggtag

SEQ ID NO: 115840 - DNA, 23 bp, Homo sapiens
gtgtctcactcactctgtcgcct

SEQ ID NO: 115841 - DNA, 20 bp, Homo sapiens
actctaggtctctctctcat

SEQ ID NO: 115842 - DNA, 23 bp, Homo sapiens
agacagatactcatttgggtcag

SEQ ID NO: 115843 - DNA, 23 bp, Homo sapiens
tgagttcattgtagattctggat

SEQ ID NO: 115844 - DNA, 23 bp, Homo sapiens
tgagttcattgtagattctggat

SEQ ID NO: 115845 - DNA, 21 bp, Homo sapiens
gtcagagtctcactctgtcgt

SEQ ID NO: 115846 - DNA, 23 bp, Homo sapiens
gtatatactatgtgaggcatagt

SEQ ID NO: 115847 - DNA, 21 bp, Homo sapiens
atataccatgtatacatatag

SEQ ID NO: 115848 - DNA, 23 bp, Homo sapiens
tttgtcaggatttgatatctgag

SEQ ID NO: 115849 - DNA, 20 bp, Homo sapiens
tgaggtaggaggatcacttg

SEQ ID NO: 115850 - DNA, 19 bp, Homo sapiens
agttttgattttcctttac

SEQ ID NO: 115851 - DNA, 21 bp, Homo sapiens
agctggttgttttaaaagtgt

SEQ ID NO: 115852 - DNA, 23 bp, Homo sapiens
tggagtctcactctgtcacccag

SEQ ID NO: 115853 - DNA, 18 bp, Homo sapiens
tgtgtctgtgtgtcttca

SEQ ID NO: 115854 - DNA, 22 bp, Homo sapiens
aattctgttttagtagatgtga

SEQ ID NO: 115855 - DNA, 23 bp, Homo sapiens
ataggaactgtttttgttgttca

SEQ ID NO: 115856 - DNA, 23 bp, Homo sapiens
ctgtgtgtgtcaccatgtgcttg

SEQ ID NO: 115857 - DNA, 23 bp, Homo sapiens
tttctgactctgtcattcattat

SEQ ID NO: 115858 - DNA, 19 bp, Homo sapiens
agcaatgctatggtgtatg

SEQ ID NO: 115859 - DNA, 22 bp, Homo sapiens
taatgtatatatgtatacctgt

SEQ ID NO: 115860 - DNA, 23 bp, Homo sapiens
ataatgtatatatgtatacctgt

SEQ ID NO: 115861 - DNA, 21 bp, Homo sapiens
tataatgtatatatgtataca

SEQ ID NO: 115862 - DNA, 20 bp, Homo sapiens
gaaatgttatgtaaatatgt

SEQ ID NO: 115863 - DNA, 22 bp, Homo sapiens
tctcagcttccttctctttgtg

SEQ ID NO: 115864 - DNA, 23 bp, Homo sapiens
agcttctttatcagtctctcttt

SEQ ID NO: 115865 - DNA, 23 bp, Homo sapiens
tgctgagtgaagacacagtggtg

SEQ ID NO: 115866 - DNA, 18 bp, Homo sapiens
tggatcctttatgaggtt

SEQ ID NO: 115867 - DNA, 20 bp, Homo sapiens
ctgtgagtgtgtgtctgtgt

SEQ ID NO: 115868 - DNA, 23 bp, Homo sapiens
tgagttcattgtagattctggat

SEQ ID NO: 115869 - DNA, 23 bp, Homo sapiens
tgagttcattgtagattctggat

SEQ ID NO: 115870 - DNA, 20 bp, Homo sapiens
gtctgaaagtgatattgtgc

SEQ ID NO: 115871 - DNA, 21 bp, Homo sapiens
tgattacttttaatggccatc

SEQ ID NO: 115872 - DNA, 23 bp, Homo sapiens
tgagttcattgtagattctggat

SEQ ID NO: 115873 - DNA, 23 bp, Homo sapiens
tgagttcattgtagattctggat

SEQ ID NO: 115874 - DNA, 23 bp, Homo sapiens
tatgcgtatatatacatatatgt

SEQ ID NO: 115875 - DNA, 21 bp, Homo sapiens
tatgtgtatatgtgtgtgtat

SEQ ID NO: 115876 - DNA, 23 bp, Homo sapiens
tatgtatatatacatgtgtgtgt

SEQ ID NO: 115877 - DNA, 22 bp, Homo sapiens
tttgttctttttgcttaggatt

SEQ ID NO: 115878 - DNA, 23 bp, Homo sapiens
ttctgtgaagaaagtcaatggta

SEQ ID NO: 115879 - DNA, 21 bp, Homo sapiens
tcaggttcctggatgttttgt

SEQ ID NO: 115880 - DNA, 23 bp, Homo sapiens
acgctcagtggctgacaggagag

SEQ ID NO: 115881 - DNA, 23 bp, Homo sapiens
aatttgcactatgtgttttcaga

SEQ ID NO: 115882 - DNA, 23 bp, Homo sapiens
ttgggtttgctagaagacattgt

SEQ ID NO: 115883 - DNA, 18 bp, Homo sapiens
gggccagtacatcagcca

SEQ ID NO: 115884 - DNA, 22 bp, Homo sapiens
ttagatgcatttcaagctgaat

SEQ ID NO: 115885 - DNA, 18 bp, Homo sapiens
tacagtttatctttatga

SEQ ID NO: 115886 - DNA, 23 bp, Homo sapiens
tatcatagaatttctgtgtgcaa

SEQ ID NO: 115887 - DNA, 19 bp, Homo sapiens
ctcagcctgactgagggtg

SEQ ID NO: 115888 - DNA, 23 bp, Homo sapiens
aatactgaatttgttgaagttca

SEQ ID NO: 115889 - DNA, 23 bp, Homo sapiens
tagtaagtagatctagaatgcag

SEQ ID NO: 115890 - DNA, 20 bp, Homo sapiens
caactgaaaagtttctgcat

SEQ ID NO: 115891 - DNA, 21 bp, Homo sapiens
tatagctactctatacttatg

SEQ ID NO: 115892 - DNA, 21 bp, Homo sapiens
tagattctgttgtgagtttgc

SEQ ID NO: 115893 - DNA, 22 bp, Homo sapiens
actctttcagactttttgatgt

SEQ ID NO: 115894 - DNA, 23 bp, Homo sapiens
cagaggtttggatatgttgtgtc

SEQ ID NO: 115895 - DNA, 23 bp, Homo sapiens
aatgaaaggttttctatctgttc

SEQ ID NO: 115896 - DNA, 22 bp, Homo sapiens
tcgtgtgtatgtatatgtatgt

SEQ ID NO: 115897 - DNA, 20 bp, Homo sapiens
agactatagccaaatgaatt

SEQ ID NO: 115898 - DNA, 23 bp, Homo sapiens
ggtgtctgtgtctctgactgtca

SEQ ID NO: 115899 - DNA, 23 bp, Homo sapiens
atctgggcctgcaacatgtgata

SEQ ID NO: 115900 - DNA, 23 bp, Homo sapiens
aactggcagctttacaaatcact

SEQ ID NO: 115901 - DNA, 23 bp, Homo sapiens
tgagttcattgtagattctggat

SEQ ID NO: 115902 - DNA, 23 bp, Homo sapiens
tgagttcattgtagattctggat

SEQ ID NO: 115903 - DNA, 23 bp, Homo sapiens
tatgtatatgtatatcctattgg

SEQ ID NO: 115904 - DNA, 23 bp, Homo sapiens
ataggatgtatatgtatatatct

SEQ ID NO: 115905 - DNA, 22 bp, Homo sapiens
ttatcattttcatttgttcctg

SEQ ID NO: 115906 - DNA, 23 bp, Homo sapiens
aaggtctatttgtgtatgtgtgt

SEQ ID NO: 115907 - DNA, 23 bp, Homo sapiens
actgagtctcgcactgtcaccca

SEQ ID NO: 115908 - DNA, 23 bp, Homo sapiens
ttgcagtagacagtgagctctag

SEQ ID NO: 115909 - DNA, 23 bp, Homo sapiens
atatatacatatgtatacgtgta

SEQ ID NO: 115910 - DNA, 23 bp, Homo sapiens
atatgtatatatgtatatatgta

SEQ ID NO: 115911 - DNA, 23 bp, Homo sapiens
tgagttcattgtagattctggat

SEQ ID NO: 115912 - DNA, 23 bp, Homo sapiens
tgagttcattgtagattctggat

SEQ ID NO: 115913 - DNA, 22 bp, Homo sapiens
gtctcagtctctttgtgggtca

SEQ ID NO: 115914 - DNA, 23 bp, Homo sapiens
tctttgtcacttagaaggttgaa

SEQ ID NO: 115915 - DNA, 23 bp, Homo sapiens
tgagttcattgtagattctggat

SEQ ID NO: 115916 - DNA, 23 bp, Homo sapiens
tgagttcattgtagattctggat

SEQ ID NO: 115917 - DNA, 23 bp, Homo sapiens
tgtgtgtgagacagagcctcact

SEQ ID NO: 115918 - DNA, 23 bp, Homo sapiens
atttggaattatattcatgcaga

SEQ ID NO: 115919 - DNA, 23 bp, Homo sapiens
tctgttaggaaatgtgagcaata

SEQ ID NO: 115920 - DNA, 19 bp, Homo sapiens
aagcaggaggaggcagagt

SEQ ID NO: 115921 - DNA, 23 bp, Homo sapiens
tccagtccgtgtctgtgggtctg

SEQ ID NO: 115922 - DNA, 23 bp, Homo sapiens
tctcagactcagcctctgtctca

SEQ ID NO: 115923 - DNA, 23 bp, Homo sapiens
tgactcagcctgtctgagacttt

SEQ ID NO: 115924 - DNA, 23 bp, Homo sapiens
agttctgacactgtttgtccctg

SEQ ID NO: 115925 - DNA, 23 bp, Homo sapiens
agagaagagactgtgtagatact

SEQ ID NO: 115926 - DNA, 23 bp, Homo sapiens
acactgagttttccagtctcaat

SEQ ID NO: 115927 - DNA, 19 bp, Homo sapiens
tgcgggtgtggatagcagg

SEQ ID NO: 115928 - DNA, 23 bp, Homo sapiens
tcagtctctttctctgtcaaatg

SEQ ID NO: 115929 - DNA, 23 bp, Homo sapiens
acccacacagatgggtgtgagca

SEQ ID NO: 115930 - DNA, 20 bp, Homo sapiens
agcctggctccctgcatggc

SEQ ID NO: 115931 - DNA, 19 bp, Homo sapiens
tcgatatagatacagatat

SEQ ID NO: 115932 - DNA, 20 bp, Homo sapiens
cattggtgttgattggcttt

SEQ ID NO: 115933 - DNA, 20 bp, Homo sapiens
tgaggttggaggatcacttg

SEQ ID NO: 115934 - DNA, 23 bp, Homo sapiens
tgtgtgtgtttcagtgtctctgt

SEQ ID NO: 115935 - DNA, 23 bp, Homo sapiens
tctcactgtgactcagtgtgtgc

SEQ ID NO: 115936 - DNA, 18 bp, Homo sapiens
ttgcagtggttgccatct

SEQ ID NO: 115937 - DNA, 23 bp, Homo sapiens
tgagtccctgagtcactgcttgc

SEQ ID NO: 115938 - DNA, 23 bp, Homo sapiens
tggagtctcactctgtcacccag

SEQ ID NO: 115939 - DNA, 22 bp, Homo sapiens
tatgcttgtgtttagctatctt

SEQ ID NO: 115940 - DNA, 19 bp, Homo sapiens
ctggacaatgtcaatcgta

SEQ ID NO: 115941 - DNA, 23 bp, Homo sapiens
ctgacctagaagcttgattagat

SEQ ID NO: 115942 - DNA, 23 bp, Homo sapiens
ctcaggctgtgtcactccctcgc

SEQ ID NO: 115943 - DNA, 23 bp, Homo sapiens
tgagttcattgtagattctggat

SEQ ID NO: 115944 - DNA, 23 bp, Homo sapiens
tgagttcattgtagattctggat

SEQ ID NO: 115945 - DNA, 23 bp, Homo sapiens
ctttctgtgtctgtctcagtctg

SEQ ID NO: 115946 - DNA, 22 bp, Homo sapiens
agacacgctgtctgagtgtcca

SEQ ID NO: 115947 - DNA, 23 bp, Homo sapiens
agcagatacacagcagatgtgtg

SEQ ID NO: 115948 - DNA, 23 bp, Homo sapiens
aactgtagtgtaattggtgaaga

SEQ ID NO: 115949 - DNA, 23 bp, Homo sapiens
tgtgactgactgactctgggcca

SEQ ID NO: 115950 - DNA, 23 bp, Homo sapiens
tgtgagttctgacagtgctctgg

SEQ ID NO: 115951 - DNA, 23 bp, Homo sapiens
gacagagtctcgctctgtcaccc

SEQ ID NO: 115952 - DNA, 23 bp, Homo sapiens
tgtgtctgtctctgtgtccagat

SEQ ID NO: 115953 - DNA, 23 bp, Homo sapiens
ctctgactggctgttaaacatat

SEQ ID NO: 115954 - DNA, 23 bp, Homo sapiens
ttaaagatggagtcacactgtgt

SEQ ID NO: 115955 - DNA, 23 bp, Homo sapiens
gtccacactcactgtgtccctca

SEQ ID NO: 115956 - DNA, 21 bp, Homo sapiens
atcctgtgagctgatgtgtga

SEQ ID NO: 115957 - DNA, 19 bp, Homo sapiens
acgcacacacagactcact

SEQ ID NO: 115958 - DNA, 23 bp, Homo sapiens
tctgtgtgtctctcactgtaagc

SEQ ID NO: 115959 - DNA, 23 bp, Homo sapiens
gtccctctctctgtgcctcagtt

SEQ ID NO: 115960 - DNA, 18 bp, Homo sapiens
aggcagggagtggggctg

SEQ ID NO: 115961 - DNA, 23 bp, Homo sapiens
ctcagcctctctgtgtgtctgct

SEQ ID NO: 115962 - DNA, 23 bp, Homo sapiens
agggagaggagtccgtgcacaca

SEQ ID NO: 115963 - DNA, 23 bp, Homo sapiens
agagcatctggaacagcatgtgc

SEQ ID NO: 115964 - DNA, 18 bp, Homo sapiens
tgtcactggcatgttccg

SEQ ID NO: 115965 - DNA, 23 bp, Homo sapiens
aacaccgtgcatagtcactctct

SEQ ID NO: 115966 - DNA, 23 bp, Homo sapiens
atatctgtgtgcatgtgcatgtg

SEQ ID NO: 115967 - DNA, 23 bp, Homo sapiens
cggagtctcactctgtcacccag

SEQ ID NO: 115968 - DNA, 23 bp, Homo sapiens
tggtcttgtctggctctctcact

SEQ ID NO: 115969 - DNA, 23 bp, Homo sapiens
cgctgtctgtgtctctctccaca

SEQ ID NO: 115970 - DNA, 23 bp, Homo sapiens
cagcctgggtgacagagcgagac

SEQ ID NO: 115971 - DNA, 23 bp, Homo sapiens
tctcagcgtcacactgtgtgtgt

SEQ ID NO: 115972 - DNA, 23 bp, Homo sapiens
agatggagtctcactctgtcacc

SEQ ID NO: 115973 - DNA, 23 bp, Homo sapiens
ttcagtggcacgatctcatctca

SEQ ID NO: 115974 - DNA, 21 bp, Homo sapiens
cctgattttcaaggtcagaga

SEQ ID NO: 115975 - DNA, 23 bp, Homo sapiens
acagaggagactggtgtcagggc

SEQ ID NO: 115976 - DNA, 23 bp, Homo sapiens
cctctgagcctcagtttctgcat

SEQ ID NO: 115977 - DNA, 22 bp, Homo sapiens
cgggcactttctgtctgtctgt

SEQ ID NO: 115978 - DNA, 23 bp, Homo sapiens
ctctctgcatatatatatgtgtg

SEQ ID NO: 115979 - DNA, 22 bp, Homo sapiens
atatatgtatatatatatgaga

SEQ ID NO: 115980 - DNA, 19 bp, Homo sapiens
tctcactgtgtccctccca

SEQ ID NO: 115981 - DNA, 21 bp, Homo sapiens
gtgtgcacagagagaggacac

SEQ ID NO: 115982 - DNA, 22 bp, Homo sapiens
tcagagcgagacccactctttt

SEQ ID NO: 115983 - DNA, 23 bp, Homo sapiens
atctgagtttctcagttagccat

SEQ ID NO: 115984 - DNA, 23 bp, Homo sapiens
aggctctcactctgtcacttagg

SEQ ID NO: 115985 - DNA, 20 bp, Homo sapiens
tatgccaggtactgtacggt

SEQ ID NO: 115986 - DNA, 23 bp, Homo sapiens
agtgggacactcagtgcctgagc

SEQ ID NO: 115987 - DNA, 23 bp, Homo sapiens
acagagtctcactctgtcgccca

SEQ ID NO: 115988 - DNA, 21 bp, Homo sapiens
tgaggtggaaggatcaattga

SEQ ID NO: 115989 - DNA, 23 bp, Homo sapiens
gagacggagtctcactctgtcac

SEQ ID NO: 115990 - DNA, 22 bp, Homo sapiens
agtctcgctctgtcactcaggc

SEQ ID NO: 115991 - DNA, 19 bp, Homo sapiens
gtgagtggctgagtctgtg

SEQ ID NO: 115992 - DNA, 23 bp, Homo sapiens
agagaatttgtttttttgatctt

SEQ ID NO: 115993 - DNA, 22 bp, Homo sapiens
tttcagagtggctgaagtttct

SEQ ID NO: 115994 - DNA, 23 bp, Homo sapiens
ctgcctctctgggactcagtttc

SEQ ID NO: 115995 - DNA, 23 bp, Homo sapiens
tcactgtctctgtcagtgtgatt

SEQ ID NO: 115996 - DNA, 23 bp, Homo sapiens
gagtccattaaacctctttttct

SEQ ID NO: 115997 - DNA, 22 bp, Homo sapiens
ttagcagagtgagaatggacta

SEQ ID NO: 115998 - DNA, 22 bp, Homo sapiens
tcactttgtatgtattaatcaa

SEQ ID NO: 115999 - DNA, 23 bp, Homo sapiens
tccttcttttagtgcatgctgga

SEQ ID NO: 116000 - DNA, 23 bp, Homo sapiens
acttcaagcactgtgactctgtc

SEQ ID NO: 116001 - DNA, 22 bp, Homo sapiens
tcacagcttcttcatctgcaaa

SEQ ID NO: 116002 - DNA, 18 bp, Homo sapiens
tcgatgagagaataattc

SEQ ID NO: 116003 - DNA, 19 bp, Homo sapiens
agttgttctcagtggcaga

SEQ ID NO: 116004 - DNA, 21 bp, Homo sapiens
attcagccactctgtgtcttt

SEQ ID NO: 116005 - DNA, 23 bp, Homo sapiens
tgagttcattgtagattctggat

SEQ ID NO: 116006 - DNA, 23 bp, Homo sapiens
tgagttcattgtagattctggat

SEQ ID NO: 116007 - DNA, 22 bp, Homo sapiens
gaaagaaaacaagttcaaaagg

SEQ ID NO: 116008 - DNA, 18 bp, Homo sapiens
gagtggcatgatcttggc

SEQ ID NO: 116009 - DNA, 23 bp, Homo sapiens
gtctagatgttgctgtgaaggtg

SEQ ID NO: 116010 - DNA, 23 bp, Homo sapiens
tcagtagactttgagtaaagcag

SEQ ID NO: 116011 - DNA, 19 bp, Homo sapiens
tctgtgtgtatatctgtgt

SEQ ID NO: 116012 - DNA, 22 bp, Homo sapiens
aacagcaagagcaactgaaatc

SEQ ID NO: 116013 - DNA, 23 bp, Homo sapiens
tggagtctcactctgtcacccag

SEQ ID NO: 116014 - DNA, 23 bp, Homo sapiens
attcgtatacatgaatatgtgtg

SEQ ID NO: 116015 - DNA, 21 bp, Homo sapiens
cagttgttggatgaaatgttc

SEQ ID NO: 116016 - DNA, 22 bp, Homo sapiens
ttatatgtagtatatattatgt

SEQ ID NO: 116017 - DNA, 22 bp, Homo sapiens
aaagcttatatatgctatttgt

SEQ ID NO: 116018 - DNA, 23 bp, Homo sapiens
taacagagacagggtttcaccat

SEQ ID NO: 116019 - DNA, 23 bp, Homo sapiens
gagtctcactgtgtcactcaggc

SEQ ID NO: 116020 - DNA, 23 bp, Homo sapiens
cggagtctcgctctgtctcccag

SEQ ID NO: 116021 - DNA, 19 bp, Homo sapiens
tgagatgtgccttttctga

SEQ ID NO: 116022 - DNA, 23 bp, Homo sapiens
tgagttcattgtagattctggat

SEQ ID NO: 116023 - DNA, 23 bp, Homo sapiens
tgagttcattgtagattctggat

SEQ ID NO: 116024 - DNA, 23 bp, Homo sapiens
tgagttcattgtagattctggat

SEQ ID NO: 116025 - DNA, 23 bp, Homo sapiens
tgagttcattgtagattctggat

SEQ ID NO: 116026 - DNA, 23 bp, Homo sapiens
tgagttcattgtagattctggat

SEQ ID NO: 116027 - DNA, 23 bp, Homo sapiens
tgagttcattgtagattctggat

SEQ ID NO: 116028 - DNA, 23 bp, Homo sapiens
agctcagtgtgtgtgtgtgtgtg

SEQ ID NO: 116029 - DNA, 21 bp, Homo sapiens
atgagtgaagacagtgaggtg

SEQ ID NO: 116030 - DNA, 22 bp, Homo sapiens
tagtgtatcatgtagagctagc

SEQ ID NO: 116031 - DNA, 19 bp, Homo sapiens
agatacatatacataaggg

SEQ ID NO: 116032 - DNA, 18 bp, Homo sapiens
tatatgtctggtacatat

SEQ ID NO: 116033 - DNA, 23 bp, Homo sapiens
ttgtctgtagtgtgtgacgtgat

SEQ ID NO: 116034 - DNA, 23 bp, Homo sapiens
ttgttatgtgtgaatttgatgtt

SEQ ID NO: 116035 - DNA, 22 bp, Homo sapiens
ttcagcagggtgtcttccctct

SEQ ID NO: 116036 - DNA, 21 bp, Homo sapiens
gtccattgatttgcttgtgtc

SEQ ID NO: 116037 - DNA, 21 bp, Homo sapiens
atggactttcacaggtggctc

SEQ ID NO: 116038 - DNA, 23 bp, Homo sapiens
acagaagagtgagtgctgtgggt

SEQ ID NO: 116039 - DNA, 23 bp, Homo sapiens
ctgagactttctgactctcagtt

SEQ ID NO: 116040 - DNA, 23 bp, Homo sapiens
tcactcagctagttcattgtttt

SEQ ID NO: 116041 - DNA, 21 bp, Homo sapiens
ttaaggtcaagaattggagca

SEQ ID NO: 116042 - DNA, 19 bp, Homo sapiens
atatatgtgtatatatacg

SEQ ID NO: 116043 - DNA, 23 bp, Homo sapiens
tcacagcctccctcagtgtttcc

SEQ ID NO: 116044 - DNA, 20 bp, Homo sapiens
ccctggggtgagtgagactc

SEQ ID NO: 116045 - DNA, 23 bp, Homo sapiens
tgagttcattgtagattctggat

SEQ ID NO: 116046 - DNA, 23 bp, Homo sapiens
tgagttcattgtagattctggat

SEQ ID NO: 116047 - DNA, 23 bp, Homo sapiens
gacagagtctcgctctgtcaccc

SEQ ID NO: 116048 - DNA, 22 bp, Homo sapiens
ttctgtgtctgtatctgtcaag

SEQ ID NO: 116049 - DNA, 19 bp, Homo sapiens
aatggcatgatcatagctc

SEQ ID NO: 116050 - DNA, 23 bp, Homo sapiens
gatgaagaagtaggaactagagt

SEQ ID NO: 116051 - DNA, 23 bp, Homo sapiens
ctatgctgtgtatagatgttttc

SEQ ID NO: 116052 - DNA, 23 bp, Homo sapiens
tgagttcattgtagattctggat

SEQ ID NO: 116053 - DNA, 23 bp, Homo sapiens
tgagttcattgtagattctggat

SEQ ID NO: 116054 - DNA, 21 bp, Homo sapiens
ttatgcatatataaacagata

SEQ ID NO: 116055 - DNA, 23 bp, Homo sapiens
actctgtcacccagactagagtg

SEQ ID NO: 116056 - DNA, 23 bp, Homo sapiens
agccagacagaaaaccaggtgaa

SEQ ID NO: 116057 - DNA, 22 bp, Homo sapiens
tctgtctgtgtgtgtctggctt

SEQ ID NO: 116058 - DNA, 23 bp, Homo sapiens
tctcatctgtgagctctcttctc

SEQ ID NO: 116059 - DNA, 18 bp, Homo sapiens
tggcactgcaggcacctc

SEQ ID NO: 116060 - DNA, 23 bp, Homo sapiens
aaagagtctgcaagtctgaagaa

SEQ ID NO: 116061 - DNA, 23 bp, Homo sapiens
agagaagattcattgctctgcac

SEQ ID NO: 116062 - DNA, 23 bp, Homo sapiens
ttttgtttttgcaggagatcaag

SEQ ID NO: 116063 - DNA, 20 bp, Homo sapiens
tcacactgcttctgttccct

SEQ ID NO: 116064 - DNA, 23 bp, Homo sapiens
gacagagtctggctctgtctccc

SEQ ID NO: 116065 - DNA, 20 bp, Homo sapiens
gtctcactttgtcactcagg

SEQ ID NO: 116066 - DNA, 23 bp, Homo sapiens
tgagttcattgtagattctggat

SEQ ID NO: 116067 - DNA, 23 bp, Homo sapiens
tgagttcattgtagattctggat

SEQ ID NO: 116068 - DNA, 23 bp, Homo sapiens
atgagacaaatgtttttttgttt

SEQ ID NO: 116069 - DNA, 21 bp, Homo sapiens
ctgtgcattgttgaaaggaaa

SEQ ID NO: 116070 - DNA, 19 bp, Homo sapiens
atttgagacagagtctcac

SEQ ID NO: 116071 - DNA, 23 bp, Homo sapiens
agtgcagtgagtgcagtggcttg

SEQ ID NO: 116072 - DNA, 21 bp, Homo sapiens
tcagcatatcataggctgggt

SEQ ID NO: 116073 - DNA, 19 bp, Homo sapiens
agactgagcatctgcatct

SEQ ID NO: 116074 - DNA, 23 bp, Homo sapiens
accgagtctcgctctgtcaccca

SEQ ID NO: 116075 - DNA, 18 bp, Homo sapiens
tgtggtatttgcatcttt

SEQ ID NO: 116076 - DNA, 22 bp, Homo sapiens
ttatgcagggatgtgtggggct

SEQ ID NO: 116077 - DNA, 23 bp, Homo sapiens
tgagttcattgtagattctggat

SEQ ID NO: 116078 - DNA, 23 bp, Homo sapiens
tgagttcattgtagattctggat

SEQ ID NO: 116079 - DNA, 23 bp, Homo sapiens
tgagttcattgtagattctggat

SEQ ID NO: 116080 - DNA, 23 bp, Homo sapiens
tgagttcattgtagattctggat

SEQ ID NO: 116081 - DNA, 23 bp, Homo sapiens
cacacactgtcccagtgctctga

SEQ ID NO: 116082 - DNA, 23 bp, Homo sapiens
aagtgaatgggctcagtaactgt

SEQ ID NO: 116083 - DNA, 23 bp, Homo sapiens
cacaacagtctgagtcacacgtt

SEQ ID NO: 116084 - DNA, 23 bp, Homo sapiens
tgagttcattgtagattctggat

SEQ ID NO: 116085 - DNA, 23 bp, Homo sapiens
tgagttcattgtagattctggat

SEQ ID NO: 116086 - DNA, 19 bp, Homo sapiens
acagagtgggattgatgac

SEQ ID NO: 116087 - DNA, 20 bp, Homo sapiens
gtctacattgctgaatcctt

SEQ ID NO: 116088 - DNA, 21 bp, Homo sapiens
tgtccatgtctgtagtgtgac

SEQ ID NO: 116089 - DNA, 23 bp, Homo sapiens
tctctgtctgtgtgcctgcaaat

SEQ ID NO: 116090 - DNA, 21 bp, Homo sapiens
atgttagagcttccggttctg

SEQ ID NO: 116091 - DNA, 23 bp, Homo sapiens
tatctgtcatagattacccctgt

SEQ ID NO: 116092 - DNA, 23 bp, Homo sapiens
tgagttcattgtagattctggat

SEQ ID NO: 116093 - DNA, 23 bp, Homo sapiens
tgagttcattgtagattctggat

SEQ ID NO: 116094 - DNA, 23 bp, Homo sapiens
gagaaggagtctcactctgtcac

SEQ ID NO: 116095 - DNA, 18 bp, Homo sapiens
tagtccccactacttggg

SEQ ID NO: 116096 - DNA, 19 bp, Homo sapiens
gtgggtagaaggccgcact

SEQ ID NO: 116097 - DNA, 22 bp, Homo sapiens
gaggtctcactctgtcacccag

SEQ ID NO: 116098 - DNA, 20 bp, Homo sapiens
tctcaagtgattttgatgtg

SEQ ID NO: 116099 - DNA, 23 bp, Homo sapiens
agagtctcactctgtcactcagg

SEQ ID NO: 116100 - DNA, 23 bp, Homo sapiens
tgagttcattgtagattctggat

SEQ ID NO: 116101 - DNA, 23 bp, Homo sapiens
tgagttcattgtagattctggat

SEQ ID NO: 116102 - DNA, 23 bp, Homo sapiens
tgagttcattgtagattctggat

SEQ ID NO: 116103 - DNA, 23 bp, Homo sapiens
tgagttcattgtagattctggat

SEQ ID NO: 116104 - DNA, 23 bp, Homo sapiens
agtggacagagcctgcactcagg

SEQ ID NO: 116105 - DNA, 23 bp, Homo sapiens
atgtatatgtatctgtatgtata

SEQ ID NO: 116106 - DNA, 18 bp, Homo sapiens
catatacatacatgtaag

SEQ ID NO: 116107 - DNA, 23 bp, Homo sapiens
acagtgcctgcagactgtgtgca

SEQ ID NO: 116108 - DNA, 23 bp, Homo sapiens
ctcgctctctcagtggctgcggc

SEQ ID NO: 116109 - DNA, 22 bp, Homo sapiens
taggaagttgaggctgcagtga

SEQ ID NO: 116110 - DNA, 18 bp, Homo sapiens
acacacacatacacagag

SEQ ID NO: 116111 - DNA, 23 bp, Homo sapiens
aaagtcacacaagtgagtggcct

SEQ ID NO: 116112 - DNA, 23 bp, Homo sapiens
tatacgtatatatacgtatatga

SEQ ID NO: 116113 - DNA, 18 bp, Homo sapiens
gccacggatagagctctg

SEQ ID NO: 116114 - DNA, 23 bp, Homo sapiens
atatatatacaattgttatgtat

SEQ ID NO: 116115 - DNA, 22 bp, Homo sapiens
cctgtgcagcagtatagtgtca

SEQ ID NO: 116116 - DNA, 23 bp, Homo sapiens
aggctctctgactgactccttcc

SEQ ID NO: 116117 - DNA, 23 bp, Homo sapiens
ccctctgtgtctgattcttgact

SEQ ID NO: 116118 - DNA, 23 bp, Homo sapiens
atttgacatgtatatggaattgc

SEQ ID NO: 116119 - DNA, 20 bp, Homo sapiens
tgtgttaattttgaatcctg

SEQ ID NO: 116120 - DNA, 23 bp, Homo sapiens
tgtagtgtgtctgcatttggttt

SEQ ID NO: 116121 - DNA, 22 bp, Homo sapiens
tcctgggagttctgctgctgtg

SEQ ID NO: 116122 - DNA, 23 bp, Homo sapiens
catatacaggaaatgtatgtata

SEQ ID NO: 116123 - DNA, 18 bp, Homo sapiens
tattcattgtatatgtgt

SEQ ID NO: 116124 - DNA, 23 bp, Homo sapiens
tgagttcattgtagattctggat

SEQ ID NO: 116125 - DNA, 23 bp, Homo sapiens
tgagttcattgtagattctggat

SEQ ID NO: 116126 - DNA, 21 bp, Homo sapiens
ttggtcatcatcctgtttgtt

SEQ ID NO: 116127 - DNA, 23 bp, Homo sapiens
taagttcttgtactggtgggtca

SEQ ID NO: 116128 - DNA, 20 bp, Homo sapiens
atgtatgtatgtatgtatgt

SEQ ID NO: 116129 - DNA, 20 bp, Homo sapiens
actgcaacctctgcttcctg

SEQ ID NO: 116130 - DNA, 23 bp, Homo sapiens
tgagttcattgtagattctggat

SEQ ID NO: 116131 - DNA, 23 bp, Homo sapiens
tgagttcattgtagattctggat

SEQ ID NO: 116132 - DNA, 23 bp, Homo sapiens
gaactgtagacagctctttggta

SEQ ID NO: 116133 - DNA, 23 bp, Homo sapiens
ttgaataatgtatgcagttttat

SEQ ID NO: 116134 - DNA, 20 bp, Homo sapiens
cagtcagatttggcatgaaa

SEQ ID NO: 116135 - DNA, 19 bp, Homo sapiens
ggctcccactgtgcctgtg

SEQ ID NO: 116136 - DNA, 23 bp, Homo sapiens
acagtctctctctcacttgtggg

SEQ ID NO: 116137 - DNA, 22 bp, Homo sapiens
ttttgagacagtgtctcactct

SEQ ID NO: 116138 - DNA, 23 bp, Homo sapiens
gcagagtctcgctctgtcaccca

SEQ ID NO: 116139 - DNA, 23 bp, Homo sapiens
aggctctctgactgactccttcc

SEQ ID NO: 116140 - DNA, 23 bp, Homo sapiens
acagagtctcactgtgtccccca

SEQ ID NO: 116141 - DNA, 23 bp, Homo sapiens
agagaacagagaagtgactggaa

SEQ ID NO: 116142 - DNA, 18 bp, Homo sapiens
tcaggccgtggtattatg

SEQ ID NO: 116143 - DNA, 23 bp, Homo sapiens
gaagagtctggaagaagtttcaa

SEQ ID NO: 116144 - DNA, 23 bp, Homo sapiens
agacattttccatcatatttcat

SEQ ID NO: 116145 - DNA, 20 bp, Homo sapiens
caatgtaatgatgtgtctct

SEQ ID NO: 116146 - DNA, 23 bp, Homo sapiens
tctcgctctcactgatggcaata

SEQ ID NO: 116147 - DNA, 23 bp, Homo sapiens
tgtccaaaagattgcaattatta

SEQ ID NO: 116148 - DNA, 23 bp, Homo sapiens
catctattctggaaacttagctc

SEQ ID NO: 116149 - DNA, 23 bp, Homo sapiens
tacatggatatatatacacatat

SEQ ID NO: 116150 - DNA, 23 bp, Homo sapiens
atatccatgtatatatatgtgta

SEQ ID NO: 116151 - DNA, 23 bp, Homo sapiens
tgtatacatatatatctatacag

SEQ ID NO: 116152 - DNA, 20 bp, Homo sapiens
gtggccctgactctgactct

SEQ ID NO: 116153 - DNA, 23 bp, Homo sapiens
atgtgtatatgtgaatgtgtata

SEQ ID NO: 116154 - DNA, 23 bp, Homo sapiens
tgagttcattgtagattctggat

SEQ ID NO: 116155 - DNA, 23 bp, Homo sapiens
tgagttcattgtagattctggat

SEQ ID NO: 116156 - DNA, 23 bp, Homo sapiens
tatgtgtatatatatgtgtgtgt

SEQ ID NO: 116157 - DNA, 23 bp, Homo sapiens
atacacacacatatatacacaca

SEQ ID NO: 116158 - DNA, 21 bp, Homo sapiens
tatttgtatttaacctatgca

SEQ ID NO: 116159 - DNA, 23 bp, Homo sapiens
aggagtctcactctgtcacccag

SEQ ID NO: 116160 - DNA, 19 bp, Homo sapiens
atgtttgtatggtgtgcgt

SEQ ID NO: 116161 - DNA, 20 bp, Homo sapiens
ttcctctatataatttctgt

SEQ ID NO: 116162 - DNA, 23 bp, Homo sapiens
ttgtatacaaatcttgtatacag

SEQ ID NO: 116163 - DNA, 23 bp, Homo sapiens
cctatgtgtgtctctgtatgtga

SEQ ID NO: 116164 - DNA, 19 bp, Homo sapiens
agcacactgatgggtcttg

SEQ ID NO: 116165 - DNA, 21 bp, Homo sapiens
attctttaaataaatagctgt

SEQ ID NO: 116166 - DNA, 21 bp, Homo sapiens
tatgtgtatatgtatctgtat

SEQ ID NO: 116167 - DNA, 23 bp, Homo sapiens
atgtgtgtatatatatgtgtgtg

SEQ ID NO: 116168 - DNA, 22 bp, Homo sapiens
atatgtgtattacatatgtata

SEQ ID NO: 116169 - DNA, 23 bp, Homo sapiens
tgagttcattgtagattctggat

SEQ ID NO: 116170 - DNA, 23 bp, Homo sapiens
tgagttcattgtagattctggat

SEQ ID NO: 116171 - DNA, 23 bp, Homo sapiens
tgtctatgtatatgtatgtgtgt

SEQ ID NO: 116172 - DNA, 23 bp, Homo sapiens
tgagttcattgtagattctggat

SEQ ID NO: 116173 - DNA, 23 bp, Homo sapiens
tgagttcattgtagattctggat

SEQ ID NO: 116174 - DNA, 23 bp, Homo sapiens
aatatatgtgcatgtgtatgtat

SEQ ID NO: 116175 - DNA, 23 bp, Homo sapiens
tcctaggtcaggcagcattcatg

SEQ ID NO: 116176 - DNA, 22 bp, Homo sapiens
tttagcaagtttatgacttgtg

SEQ ID NO: 116177 - DNA, 22 bp, Homo sapiens
tcacaggtagtaagttgttgaa

SEQ ID NO: 116178 - DNA, 18 bp, Homo sapiens
tgtgacatatgtgtagtt

SEQ ID NO: 116179 - DNA, 23 bp, Homo sapiens
gagagtgacagagtgagacagtg

SEQ ID NO: 116180 - DNA, 22 bp, Homo sapiens
gagaatgttgttgaagctggtt

SEQ ID NO: 116181 - DNA, 23 bp, Homo sapiens
gactgagtctcgctctgtcaccc

SEQ ID NO: 116182 - DNA, 23 bp, Homo sapiens
actgagtctcgctctgtcaccca

SEQ ID NO: 116183 - DNA, 23 bp, Homo sapiens
gttctctgactgaggtatttttt

SEQ ID NO: 116184 - DNA, 23 bp, Homo sapiens
gtctcactgataagatgctgttc

SEQ ID NO: 116185 - DNA, 23 bp, Homo sapiens
tgagttcattgtagattctggat

SEQ ID NO: 116186 - DNA, 23 bp, Homo sapiens
tgagttcattgtagattctggat

SEQ ID NO: 116187 - DNA, 22 bp, Homo sapiens
attttgtagtttacaaaagctc

SEQ ID NO: 116188 - DNA, 22 bp, Homo sapiens
ttgcagcttttgtaaactataa

SEQ ID NO: 116189 - DNA, 23 bp, Homo sapiens
gatggagtctcactctgtcaccc

SEQ ID NO: 116190 - DNA, 20 bp, Homo sapiens
tggcacaatctcagctcaca

SEQ ID NO: 116191 - DNA, 23 bp, Homo sapiens
tagagagaagacagagagctttc

SEQ ID NO: 116192 - DNA, 23 bp, Homo sapiens
tgaagtctgggcaggatttgagt

SEQ ID NO: 116193 - DNA, 23 bp, Homo sapiens
tatccatatatatgcatatgtgt

SEQ ID NO: 116194 - DNA, 18 bp, Homo sapiens
agttgagagattaagagc

SEQ ID NO: 116195 - DNA, 22 bp, Homo sapiens
cagagtctcactctgtcgccca

SEQ ID NO: 116196 - DNA, 23 bp, Homo sapiens
tgaatcagcatcagtatctggca

SEQ ID NO: 116197 - DNA, 22 bp, Homo sapiens
gtctcactctgtcacccaggct

SEQ ID NO: 116198 - DNA, 23 bp, Homo sapiens
ttggaaaagtttgagaaggattg

SEQ ID NO: 116199 - DNA, 20 bp, Homo sapiens
atgtgtatatatatacgtgt

SEQ ID NO: 116200 - DNA, 23 bp, Homo sapiens
cggagtctcactctgtcacccag

SEQ ID NO: 116201 - DNA, 20 bp, Homo sapiens
tgtttatatgtatacatgta

SEQ ID NO: 116202 - DNA, 20 bp, Homo sapiens
tgccagagaagccacgtgta

SEQ ID NO: 116203 - DNA, 20 bp, Homo sapiens
gtgtgcatatatatacataa

SEQ ID NO: 116204 - DNA, 23 bp, Homo sapiens
atatgtgtatatatacatatgtg

SEQ ID NO: 116205 - DNA, 20 bp, Homo sapiens
tgtcctacagataggaagac

SEQ ID NO: 116206 - DNA, 21 bp, Homo sapiens
tgacacagcaagaccttgtct

SEQ ID NO: 116207 - DNA, 23 bp, Homo sapiens
agggtctctctctgtcacccagg

SEQ ID NO: 116208 - DNA, 23 bp, Homo sapiens
gcactgacagtcagtggttcaga

SEQ ID NO: 116209 - DNA, 22 bp, Homo sapiens
gtattcagtctgtaacactctc

SEQ ID NO: 116210 - DNA, 20 bp, Homo sapiens
agggtggctggctgtttccc

SEQ ID NO: 116211 - DNA, 23 bp, Homo sapiens
tggagtctcactctgtcacccag

SEQ ID NO: 116212 - DNA, 21 bp, Homo sapiens
gagtgcctgtcttctgttctt

SEQ ID NO: 116213 - DNA, 23 bp, Homo sapiens
cagcttggtacaggcccagttta

SEQ ID NO: 116214 - DNA, 22 bp, Homo sapiens
tattatagagatttagttgtag

SEQ ID NO: 116215 - DNA, 23 bp, Homo sapiens
tgacttgagattttctagctttc

SEQ ID NO: 116216 - DNA, 23 bp, Homo sapiens
tatttagtgctataaatttccct

SEQ ID NO: 116217 - DNA, 20 bp, Homo sapiens
aatgcacatgtttgtataca

SEQ ID NO: 116218 - DNA, 22 bp, Homo sapiens
tgtgacagtgtctgacagcata

SEQ ID NO: 116219 - DNA, 20 bp, Homo sapiens
ttgacttgatctgtgattgc

SEQ ID NO: 116220 - DNA, 23 bp, Homo sapiens
ctcccagagcccctggaactctg

SEQ ID NO: 116221 - DNA, 23 bp, Homo sapiens
tcccagagcccctggaactctgg

SEQ ID NO: 116222 - DNA, 23 bp, Homo sapiens
tcccagagcccctggaactctgg

SEQ ID NO: 116223 - DNA, 23 bp, Homo sapiens
tcccagagcccctggaactctgg

SEQ ID NO: 116224 - DNA, 23 bp, Homo sapiens
taatttctcagtctctctcatat

SEQ ID NO: 116225 - DNA, 23 bp, Homo sapiens
tatatgtgctatggatgtgtaaa

SEQ ID NO: 116226 - DNA, 23 bp, Homo sapiens
agagtctcactctgtcacccagg

SEQ ID NO: 116227 - DNA, 23 bp, Homo sapiens
taaatccatgattaagttctcta

SEQ ID NO: 116228 - DNA, 22 bp, Homo sapiens
acactggtatatgtgtgtgtat

SEQ ID NO: 116229 - DNA, 23 bp, Homo sapiens
agagtctcactctgtcacccagg

SEQ ID NO: 116230 - DNA, 23 bp, Homo sapiens
caggcagcaatagtatacattta

SEQ ID NO: 116231 - DNA, 23 bp, Homo sapiens
actgactcctctctctctgtgta

SEQ ID NO: 116232 - DNA, 23 bp, Homo sapiens
actgagtctcattctgtcaccca

SEQ ID NO: 116233 - DNA, 23 bp, Homo sapiens
gtgtggggaaacactcagaaatc

SEQ ID NO: 116234 - DNA, 23 bp, Homo sapiens
actatgtctgtgtctcttatttg

SEQ ID NO: 116235 - DNA, 20 bp, Homo sapiens
ttgcagacttaaatgtccct

SEQ ID NO: 116236 - DNA, 21 bp, Homo sapiens
tttgagatctgagagtggaca

SEQ ID NO: 116237 - DNA, 23 bp, Homo sapiens
tctgactctgagttgctggagtt

SEQ ID NO: 116238 - DNA, 23 bp, Homo sapiens
ttgccatctgagcatacaagtgt

SEQ ID NO: 116239 - DNA, 23 bp, Homo sapiens
tatatgtatatatgtatatgtgt

SEQ ID NO: 116240 - DNA, 23 bp, Homo sapiens
ccacactctgtgactgatctgtg

SEQ ID NO: 116241 - DNA, 23 bp, Homo sapiens
cacaccatatatatacacacacc

SEQ ID NO: 116242 - DNA, 23 bp, Homo sapiens
accatacatatatagtgtgtgta

SEQ ID NO: 116243 - DNA, 23 bp, Homo sapiens
tgagttcattgtagattctggat

SEQ ID NO: 116244 - DNA, 23 bp, Homo sapiens
tgagttcattgtagattctggat

SEQ ID NO: 116245 - DNA, 20 bp, Homo sapiens
tgtgtatatatatacacgta

SEQ ID NO: 116246 - DNA, 22 bp, Homo sapiens
atatacgtatatacacatatgt

SEQ ID NO: 116247 - DNA, 22 bp, Homo sapiens
atccaccataaatatatagtaa

SEQ ID NO: 116248 - DNA, 23 bp, Homo sapiens
tggagtctcactctgtcacccag

SEQ ID NO: 116249 - DNA, 23 bp, Homo sapiens
tgagttcattgtagattctggat

SEQ ID NO: 116250 - DNA, 23 bp, Homo sapiens
tgagttcattgtagattctggat

SEQ ID NO: 116251 - DNA, 23 bp, Homo sapiens
acacaagaatgactgcagcaaaa

SEQ ID NO: 116252 - DNA, 23 bp, Homo sapiens
attttgtgacatgagagacatct

SEQ ID NO: 116253 - DNA, 22 bp, Homo sapiens
tggagtctcactctgtcgctca

SEQ ID NO: 116254 - DNA, 23 bp, Homo sapiens
tctgtttctttctctctgcatct

SEQ ID NO: 116255 - DNA, 21 bp, Homo sapiens
agagacttctacagaatgcaa

SEQ ID NO: 116256 - DNA, 20 bp, Homo sapiens
tgtggttccagctactcagg

SEQ ID NO: 116257 - DNA, 23 bp, Homo sapiens
tgtgtatatatgtatatgtgcat

SEQ ID NO: 116258 - DNA, 23 bp, Homo sapiens
ggattgaaatgatgataactcaa

SEQ ID NO: 116259 - DNA, 21 bp, Homo sapiens
tgtgaagaaagtcattggtag

SEQ ID NO: 116260 - DNA, 18 bp, Homo sapiens
atatatgtatgcttgtgt

SEQ ID NO: 116261 - DNA, 21 bp, Homo sapiens
aaactggaagtagttacatgt

SEQ ID NO: 116262 - DNA, 23 bp, Homo sapiens
tctctctgtgtgtgtttgtacat

SEQ ID NO: 116263 - DNA, 23 bp, Homo sapiens
tgtgtgtatatatatgtgtgtat

SEQ ID NO: 116264 - DNA, 20 bp, Homo sapiens
actggtttttgtatgttggt

SEQ ID NO: 116265 - DNA, 23 bp, Homo sapiens
cagtccctatctctgtgtcactc

SEQ ID NO: 116266 - DNA, 21 bp, Homo sapiens
aaaacctagcatatagtgttt

SEQ ID NO: 116267 - DNA, 20 bp, Homo sapiens
aaacttgattaagcttggtg

SEQ ID NO: 116268 - DNA, 23 bp, Homo sapiens
tgagttcattgtagattctggat

SEQ ID NO: 116269 - DNA, 23 bp, Homo sapiens
tgagttcattgtagattctggat

SEQ ID NO: 116270 - DNA, 18 bp, Homo sapiens
tagattagagaaggtggc

SEQ ID NO: 116271 - DNA, 23 bp, Homo sapiens
ggagtctcactctgttactcaga

SEQ ID NO: 116272 - DNA, 23 bp, Homo sapiens
aggacacagtgagaagtcagctg

SEQ ID NO: 116273 - DNA, 23 bp, Homo sapiens
tgagttcattgtagattctggat

SEQ ID NO: 116274 - DNA, 23 bp, Homo sapiens
tgagttcattgtagattctggat

SEQ ID NO: 116275 - DNA, 23 bp, Homo sapiens
tgagttcattgtagattctggat

SEQ ID NO: 116276 - DNA, 22 bp, Homo sapiens
tgtgtgtgtgttttgcatgtat

SEQ ID NO: 116277 - DNA, 22 bp, Homo sapiens
agtgggagtcaggtatgatttt

SEQ ID NO: 116278 - DNA, 23 bp, Homo sapiens
ttcttttggcttaggattgtctt

SEQ ID NO: 116279 - DNA, 21 bp, Homo sapiens
gtagtttttttccaattctgt

SEQ ID NO: 116280 - DNA, 23 bp, Homo sapiens
tattcactgtgggacttgttatt

SEQ ID NO: 116281 - DNA, 23 bp, Homo sapiens
gagagtctgagtctcactctgtc

SEQ ID NO: 116282 - DNA, 19 bp, Homo sapiens
tttctggatgtttagtgta

SEQ ID NO: 116283 - DNA, 19 bp, Homo sapiens
tgtgtctctgtgtttgatg

SEQ ID NO: 116284 - DNA, 23 bp, Homo sapiens
ttgagagggagtctcactctgtc

SEQ ID NO: 116285 - DNA, 20 bp, Homo sapiens
agggagaatgtatatgttca

SEQ ID NO: 116286 - DNA, 19 bp, Homo sapiens
tacatattctccctggaat

SEQ ID NO: 116287 - DNA, 23 bp, Homo sapiens
tgagttcattgtagattctggat

SEQ ID NO: 116288 - DNA, 22 bp, Homo sapiens
tagcagcacatcatggtttaca

SEQ ID NO: 116289 - DNA, 21 bp, Homo sapiens
ttgctgctctagaaatttaag

SEQ ID NO: 116290 - DNA, 22 bp, Homo sapiens
tagcagcacgtaaatattggcg

SEQ ID NO: 116291 - DNA, 23 bp, Homo sapiens
tattactgtgctgctttagtgtg

SEQ ID NO: 116292 - DNA, 18 bp, Homo sapiens
tgactctttctctctgat

SEQ ID NO: 116293 - DNA, 21 bp, Homo sapiens
agggcaaggactgtgtcttgt

SEQ ID NO: 116294 - DNA, 23 bp, Homo sapiens
tgagttcattgtagattctggat

SEQ ID NO: 116295 - DNA, 23 bp, Homo sapiens
tgagttcattgtagattctggat

SEQ ID NO: 116296 - DNA, 21 bp, Homo sapiens
tgaggttctaggatgtataga

SEQ ID NO: 116297 - DNA, 23 bp, Homo sapiens
ttctagaattctgaaaaagttgt

SEQ ID NO: 116298 - DNA, 23 bp, Homo sapiens
tgagttcattgtagattctggat

SEQ ID NO: 116299 - DNA, 23 bp, Homo sapiens
tgagttcattgtagattctggat

SEQ ID NO: 116300 - DNA, 23 bp, Homo sapiens
tagtgagccatgatcatgccact

SEQ ID NO: 116301 - DNA, 18 bp, Homo sapiens
tatgcatatatatactat

SEQ ID NO: 116302 - DNA, 23 bp, Homo sapiens
aagactagagagttagttgttgc

SEQ ID NO: 116303 - DNA, 23 bp, Homo sapiens
cagagtctcactctgtctccagg

SEQ ID NO: 116304 - DNA, 23 bp, Homo sapiens
tctgttactcttttactgtcacc

SEQ ID NO: 116305 - DNA, 23 bp, Homo sapiens
ttttgacaagatccagaaggtca

SEQ ID NO: 116306 - DNA, 23 bp, Homo sapiens
acacacatatgtgtgtgtgtata

SEQ ID NO: 116307 - DNA, 23 bp, Homo sapiens
tacatgtgtttggttaacaaggt

SEQ ID NO: 116308 - DNA, 21 bp, Homo sapiens
tacataaatattcatatgaca

SEQ ID NO: 116309 - DNA, 19 bp, Homo sapiens
atatgtgtgtatatatatg

SEQ ID NO: 116310 - DNA, 23 bp, Homo sapiens
tgtgggaatgcatgatgtgtccc

SEQ ID NO: 116311 - DNA, 23 bp, Homo sapiens
attctgggacaccttgatgtgtc

SEQ ID NO: 116312 - DNA, 23 bp, Homo sapiens
tgagttcattgtagattctggat

SEQ ID NO: 116313 - DNA, 23 bp, Homo sapiens
tgagttcattgtagattctggat

SEQ ID NO: 116314 - DNA, 22 bp, Homo sapiens
attgactgtggtatagttctga

SEQ ID NO: 116315 - DNA, 22 bp, Homo sapiens
tgtgtatatgtgtatatgtgta

SEQ ID NO: 116316 - DNA, 23 bp, Homo sapiens
atgtgtatatgtgtatatgtgtg

SEQ ID NO: 116317 - DNA, 21 bp, Homo sapiens
tgtgtatatatgtatatgtgt

SEQ ID NO: 116318 - DNA, 23 bp, Homo sapiens
atgtgtatatatgtatatgtgta

SEQ ID NO: 116319 - DNA, 23 bp, Homo sapiens
tgagttcattgtagattctggat

SEQ ID NO: 116320 - DNA, 23 bp, Homo sapiens
tgagttcattgtagattctggat

SEQ ID NO: 116321 - DNA, 23 bp, Homo sapiens
gatgtcacaggatcctttaggtg

SEQ ID NO: 116322 - DNA, 23 bp, Homo sapiens
tgtgtggtatggaatgaaatgaa

SEQ ID NO: 116323 - DNA, 18 bp, Homo sapiens
tgtgtgtgtatatatata

SEQ ID NO: 116324 - DNA, 19 bp, Homo sapiens
tatgtatatatatacatgt

SEQ ID NO: 116325 - DNA, 23 bp, Homo sapiens
tatatatgcatatttgtgtgtat

SEQ ID NO: 116326 - DNA, 23 bp, Homo sapiens
agttcttatgctggttctttatc

SEQ ID NO: 116327 - DNA, 19 bp, Homo sapiens
atgtatgtaaatgtgtaga

SEQ ID NO: 116328 - DNA, 23 bp, Homo sapiens
tgagttcattgtagattctggat

SEQ ID NO: 116329 - DNA, 23 bp, Homo sapiens
tgagttcattgtagattctggat

SEQ ID NO: 116330 - DNA, 23 bp, Homo sapiens
gtctcgctctgtcacccaatcac

SEQ ID NO: 116331 - DNA, 23 bp, Homo sapiens
aatgagagtgaagtgaaaggggt

SEQ ID NO: 116332 - DNA, 23 bp, Homo sapiens
ttatctcatgagactcattcact

SEQ ID NO: 116333 - DNA, 21 bp, Homo sapiens
agccagactagttatatgtat

SEQ ID NO: 116334 - DNA, 23 bp, Homo sapiens
ttatagcttggcttttgtcttat

SEQ ID NO: 116335 - DNA, 19 bp, Homo sapiens
agtgtagaacatagattac

SEQ ID NO: 116336 - DNA, 23 bp, Homo sapiens
tacagctccaattctacttttac

SEQ ID NO: 116337 - DNA, 20 bp, Homo sapiens
ctgtcacatttcactctctc

SEQ ID NO: 116338 - DNA, 23 bp, Homo sapiens
aagtgtatatatattcatctgtg

SEQ ID NO: 116339 - DNA, 23 bp, Homo sapiens
tatatgtacataatgcatgcata

SEQ ID NO: 116340 - DNA, 23 bp, Homo sapiens
tgtgtgtatttgtctgtgtctat

SEQ ID NO: 116341 - DNA, 20 bp, Homo sapiens
tacacatatgtatatgtgta

SEQ ID NO: 116342 - DNA, 21 bp, Homo sapiens
tatctatatgtatgcacatac

SEQ ID NO: 116343 - DNA, 21 bp, Homo sapiens
tgtcagaattgtaaagagaga

SEQ ID NO: 116344 - DNA, 23 bp, Homo sapiens
cggagtctcgctctgtcacccag

SEQ ID NO: 116345 - DNA, 21 bp, Homo sapiens
ttagaccaaaatatctgctgt

SEQ ID NO: 116346 - DNA, 23 bp, Homo sapiens
tttagcaccttttagttgccaga

SEQ ID NO: 116347 - DNA, 23 bp, Homo sapiens
tgagttcattgtagattctggat

SEQ ID NO: 116348 - DNA, 23 bp, Homo sapiens
tgagttcattgtagattctggat

SEQ ID NO: 116349 - DNA, 22 bp, Homo sapiens
attcgctcatgattgggctctc

SEQ ID NO: 116350 - DNA, 21 bp, Homo sapiens
tgtctatatatacatgtgtgt

SEQ ID NO: 116351 - DNA, 23 bp, Homo sapiens
atgtgtgtgtagatacatgtatc

SEQ ID NO: 116352 - DNA, 23 bp, Homo sapiens
aatgagagaagacacacagctct

SEQ ID NO: 116353 - DNA, 23 bp, Homo sapiens
tattggtagttctgcagttcttc

SEQ ID NO: 116354 - DNA, 23 bp, Homo sapiens
atttgtcaaattgtatttgtgag

SEQ ID NO: 116355 - DNA, 23 bp, Homo sapiens
gagtctcactctgtcagccaggc

SEQ ID NO: 116356 - DNA, 18 bp, Homo sapiens
ttagagctacataaatag

SEQ ID NO: 116357 - DNA, 22 bp, Homo sapiens
tattggtttttcaccattctct

SEQ ID NO: 116358 - DNA, 23 bp, Homo sapiens
agtgatgtgtgggagcagagaga

SEQ ID NO: 116359 - DNA, 19 bp, Homo sapiens
aagagtacagagtggccag

SEQ ID NO: 116360 - DNA, 23 bp, Homo sapiens
tgagttcattgtagattctggat

SEQ ID NO: 116361 - DNA, 23 bp, Homo sapiens
tgagttcattgtagattctggat

SEQ ID NO: 116362 - DNA, 23 bp, Homo sapiens
tgagttcattgtagattctggat

SEQ ID NO: 116363 - DNA, 23 bp, Homo sapiens
tgagttcattgtagattctggat

SEQ ID NO: 116364 - DNA, 23 bp, Homo sapiens
tatgcacatatgtgtgtgcatgc

SEQ ID NO: 116365 - DNA, 21 bp, Homo sapiens
taaaactgtttcctaattagc

SEQ ID NO: 116366 - DNA, 22 bp, Homo sapiens
acacagagacacatatatatgt

SEQ ID NO: 116367 - DNA, 20 bp, Homo sapiens
tgagtagctgggactatgtg

SEQ ID NO: 116368 - DNA, 23 bp, Homo sapiens
aaggctgtgatgaagttgcagct

SEQ ID NO: 116369 - DNA, 21 bp, Homo sapiens
actgctgacttagactgacag

SEQ ID NO: 116370 - DNA, 22 bp, Homo sapiens
tgtctgtgtgtatatctgtgtg

SEQ ID NO: 116371 - DNA, 23 bp, Homo sapiens
aagatgagtgttgtcagtctgca

SEQ ID NO: 116372 - DNA, 23 bp, Homo sapiens
tgagtgcctcagtccctgtttgc

SEQ ID NO: 116373 - DNA, 23 bp, Homo sapiens
ttccctatgagcatctcattgtc

SEQ ID NO: 116374 - DNA, 23 bp, Homo sapiens
aatgaccttcacttttgttttgg

SEQ ID NO: 116375 - DNA, 20 bp, Homo sapiens
ttattcttgttctgattgat

SEQ ID NO: 116376 - DNA, 23 bp, Homo sapiens
tgagttcattgtagattctggat

SEQ ID NO: 116377 - DNA, 23 bp, Homo sapiens
tgagttcattgtagattctggat

SEQ ID NO: 116378 - DNA, 23 bp, Homo sapiens
tgccatactgtttctaaaatggc

SEQ ID NO: 116379 - DNA, 22 bp, Homo sapiens
gatcaatcacatgaagaagtgt

SEQ ID NO: 116380 - DNA, 23 bp, Homo sapiens
tatacatatgtatacacacataa

SEQ ID NO: 116381 - DNA, 23 bp, Homo sapiens
tttatgtatatatacatatgtat

SEQ ID NO: 116382 - DNA, 21 bp, Homo sapiens
tatacatatgtatgtatatgt

SEQ ID NO: 116383 - DNA, 23 bp, Homo sapiens
ctctgtctgtgtgtctccctcat

SEQ ID NO: 116384 - DNA, 23 bp, Homo sapiens
taaaatgcagattgtgggccccg

SEQ ID NO: 116385 - DNA, 20 bp, Homo sapiens
tcactgcagccttgaattcc

SEQ ID NO: 116386 - DNA, 22 bp, Homo sapiens
tgagctgttcagggaggatatc

SEQ ID NO: 116387 - DNA, 21 bp, Homo sapiens
taaggcaggagaagatgaatg

SEQ ID NO: 116388 - DNA, 23 bp, Homo sapiens
tcatctgaaagtcagatgtttga

SEQ ID NO: 116389 - DNA, 19 bp, Homo sapiens
taaaaggtagtataccata

SEQ ID NO: 116390 - DNA, 23 bp, Homo sapiens
tcactctaaagatgaatgtgcta

SEQ ID NO: 116391 - DNA, 23 bp, Homo sapiens
acagagtctcactctgtcgccca

SEQ ID NO: 116392 - DNA, 21 bp, Homo sapiens
gtgaggtttattttattttag

SEQ ID NO: 116393 - DNA, 23 bp, Homo sapiens
agtctcactctgacacccaggct

SEQ ID NO: 116394 - DNA, 23 bp, Homo sapiens
tgagttcattgtagattctggat

SEQ ID NO: 116395 - DNA, 23 bp, Homo sapiens
tgagttcattgtagattctggat

SEQ ID NO: 116396 - DNA, 23 bp, Homo sapiens
tctgtggttgttggatggaatgt

SEQ ID NO: 116397 - DNA, 23 bp, Homo sapiens
tgagttcattgtagattctggat

SEQ ID NO: 116398 - DNA, 23 bp, Homo sapiens
tgagttcattgtagattctggat

SEQ ID NO: 116399 - DNA, 20 bp, Homo sapiens
tacatacatgtacatatgta

SEQ ID NO: 116400 - DNA, 23 bp, Homo sapiens
tgtatgtatatgtatatgtatgt

SEQ ID NO: 116401 - DNA, 23 bp, Homo sapiens
aaaagtgcattagctgtgtgtgt

SEQ ID NO: 116402 - DNA, 23 bp, Homo sapiens
ttcaaattcactttggctctgtt

SEQ ID NO: 116403 - DNA, 19 bp, Homo sapiens
tatgtatatatatttaggt

SEQ ID NO: 116404 - DNA, 23 bp, Homo sapiens
tgagttcattgtagattctggat

SEQ ID NO: 116405 - DNA, 23 bp, Homo sapiens
tgagttcattgtagattctggat

SEQ ID NO: 116406 - DNA, 23 bp, Homo sapiens
tgagatggagtctctctctgtcg

SEQ ID NO: 116407 - DNA, 20 bp, Homo sapiens
actattattgtatttctctt

SEQ ID NO: 116408 - DNA, 23 bp, Homo sapiens
tgagttcattgtagattctggat

SEQ ID NO: 116409 - DNA, 23 bp, Homo sapiens
tgagttcattgtagattctggat

SEQ ID NO: 116410 - DNA, 23 bp, Homo sapiens
tagaatcttccttgtgtctctct

SEQ ID NO: 116411 - DNA, 23 bp, Homo sapiens
tgagttcattgtagattctggat

SEQ ID NO: 116412 - DNA, 23 bp, Homo sapiens
tgagttcattgtagattctggat

SEQ ID NO: 116413 - DNA, 23 bp, Homo sapiens
acgtggttgtagctagtattgat

SEQ ID NO: 116414 - DNA, 20 bp, Homo sapiens
ttatgtatacatatatatgt

SEQ ID NO: 116415 - DNA, 23 bp, Homo sapiens
tgtatgtgtatttatgtatgtgt

SEQ ID NO: 116416 - DNA, 22 bp, Homo sapiens
ctgaggtagaaggatctcttga

SEQ ID NO: 116417 - DNA, 23 bp, Homo sapiens
aaagtcagtggtagcttgatgag

SEQ ID NO: 116418 - DNA, 19 bp, Homo sapiens
atgggaattcaagatgaga

SEQ ID NO: 116419 - DNA, 23 bp, Homo sapiens
tcaagggtgtgggagtgaggcag

SEQ ID NO: 116420 - DNA, 22 bp, Homo sapiens
acaaactgcttctcttttccca

SEQ ID NO: 116421 - DNA, 23 bp, Homo sapiens
acaggatccaagtctctctatat

SEQ ID NO: 116422 - DNA, 23 bp, Homo sapiens
tttgtgctacttgaggattttga

SEQ ID NO: 116423 - DNA, 20 bp, Homo sapiens
tttgtggtgatgaatgtgtt

SEQ ID NO: 116424 - DNA, 23 bp, Homo sapiens
tcccagagcccctggaactctgg

SEQ ID NO: 116425 - DNA, 20 bp, Homo sapiens
tactggatatatatacatat

SEQ ID NO: 116426 - DNA, 19 bp, Homo sapiens
actggatatatatccatat

SEQ ID NO: 116427 - DNA, 23 bp, Homo sapiens
tgagttcattgtagattctggat

SEQ ID NO: 116428 - DNA, 23 bp, Homo sapiens
tgagttcattgtagattctggat

SEQ ID NO: 116429 - DNA, 23 bp, Homo sapiens
attctgattggggtttctgttcc

SEQ ID NO: 116430 - DNA, 23 bp, Homo sapiens
agttgtaggatgaaatgttctgt

SEQ ID NO: 116431 - DNA, 23 bp, Homo sapiens
ccataccagttgactctgacata

SEQ ID NO: 116432 - DNA, 21 bp, Homo sapiens
tgggttgtttagaagtatgtt

SEQ ID NO: 116433 - DNA, 20 bp, Homo sapiens
atattgtatttgtataaccg

SEQ ID NO: 116434 - DNA, 23 bp, Homo sapiens
aaatgtctggctttagtgaagga

SEQ ID NO: 116435 - DNA, 20 bp, Homo sapiens
aactagttttatgtaaacac

SEQ ID NO: 116436 - DNA, 23 bp, Homo sapiens
tgagacggagtctcactctgtct

SEQ ID NO: 116437 - DNA, 23 bp, Homo sapiens
cagttcactgcaacctctaactc

SEQ ID NO: 116438 - DNA, 23 bp, Homo sapiens
tgagttcattgtagattctggat

SEQ ID NO: 116439 - DNA, 23 bp, Homo sapiens
tgagttcattgtagattctggat

SEQ ID NO: 116440 - DNA, 18 bp, Homo sapiens
cctagcacaatgcttgga

SEQ ID NO: 116441 - DNA, 23 bp, Homo sapiens
tgacagaagattgatacctgttg

SEQ ID NO: 116442 - DNA, 23 bp, Homo sapiens
tgggagtggaaaacaatagttat

SEQ ID NO: 116443 - DNA, 23 bp, Homo sapiens
aggaaacaaatgaagtgagttgt

SEQ ID NO: 116444 - DNA, 23 bp, Homo sapiens
tgagttcattgtagattctggat

SEQ ID NO: 116445 - DNA, 23 bp, Homo sapiens
tgagttcattgtagattctggat

SEQ ID NO: 116446 - DNA, 20 bp, Homo sapiens
attctgtctgactttctagt

SEQ ID NO: 116447 - DNA, 23 bp, Homo sapiens
tgagttcattgtagattctggat

SEQ ID NO: 116448 - DNA, 23 bp, Homo sapiens
tgagttcattgtagattctggat

SEQ ID NO: 116449 - DNA, 18 bp, Homo sapiens
atgaaagaagtcacttgg

SEQ ID NO: 116450 - DNA, 23 bp, Homo sapiens
aggacagagacttaaaggagagt

SEQ ID NO: 116451 - DNA, 18 bp, Homo sapiens
ctgaagtggctatgctgt

SEQ ID NO: 116452 - DNA, 21 bp, Homo sapiens
tagggagagtctggaaacaca

SEQ ID NO: 116453 - DNA, 21 bp, Homo sapiens
tttgactctaatggcagagta

SEQ ID NO: 116454 - DNA, 20 bp, Homo sapiens
ttgacacttgagagtcaggt

SEQ ID NO: 116455 - DNA, 22 bp, Homo sapiens
catcatggtttgaatcctggta

SEQ ID NO: 116456 - DNA, 23 bp, Homo sapiens
tgaatagtgtttatgttctagtg

SEQ ID NO: 116457 - DNA, 23 bp, Homo sapiens
agatgctctctgtctctcagtac

SEQ ID NO: 116458 - DNA, 22 bp, Homo sapiens
caagacaagtcattttgtcttt

SEQ ID NO: 116459 - DNA, 23 bp, Homo sapiens
tgagttcattgtagattctggat

SEQ ID NO: 116460 - DNA, 23 bp, Homo sapiens
tgagttcattgtagattctggat

SEQ ID NO: 116461 - DNA, 18 bp, Homo sapiens
agaggatatatatatata

SEQ ID NO: 116462 - DNA, 22 bp, Homo sapiens
aagaggatatatatacatatat

SEQ ID NO: 116463 - DNA, 23 bp, Homo sapiens
tgagttcattgtagattctggat

SEQ ID NO: 116464 - DNA, 23 bp, Homo sapiens
tgagttcattgtagattctggat

SEQ ID NO: 116465 - DNA, 23 bp, Homo sapiens
ctctgtgtctcagttttcccact

SEQ ID NO: 116466 - DNA, 20 bp, Homo sapiens
tgtgtatatatatacacata

SEQ ID NO: 116467 - DNA, 18 bp, Homo sapiens
tgagacagagtctcactc

SEQ ID NO: 116468 - DNA, 23 bp, Homo sapiens
cagggtctctctctgtcacccag

SEQ ID NO: 116469 - DNA, 23 bp, Homo sapiens
ttctctgtgtctgaaagtggaac

SEQ ID NO: 116470 - DNA, 23 bp, Homo sapiens
ctctgggtgagtcagtgagtgag

SEQ ID NO: 116471 - DNA, 23 bp, Homo sapiens
tgtattcaagtcttgcttgtatg

SEQ ID NO: 116472 - DNA, 20 bp, Homo sapiens
ttatctatacaagtatttag

SEQ ID NO: 116473 - DNA, 23 bp, Homo sapiens
cagtgtctcgctctgtcacccag

SEQ ID NO: 116474 - DNA, 23 bp, Homo sapiens
ttctgcagctctctctctgactg

SEQ ID NO: 116475 - DNA, 22 bp, Homo sapiens
agaggaactagcatgtatcttt

SEQ ID NO: 116476 - DNA, 23 bp, Homo sapiens
atagagctatgcttttcttcact

SEQ ID NO: 116477 - DNA, 23 bp, Homo sapiens
tgtcactgtgtgtgtgtgtgcac

SEQ ID NO: 116478 - DNA, 19 bp, Homo sapiens
tgagcatacatatggtaga

SEQ ID NO: 116479 - DNA, 23 bp, Homo sapiens
tatgcttctggatgtctggtgtt

SEQ ID NO: 116480 - DNA, 21 bp, Homo sapiens
ttgatatttatccataattgt

SEQ ID NO: 116481 - DNA, 22 bp, Homo sapiens
tctctgactccttagcctatct

SEQ ID NO: 116482 - DNA, 23 bp, Homo sapiens
ctctggctgcctgcctgtttgga

SEQ ID NO: 116483 - DNA, 23 bp, Homo sapiens
gtctgtcactgtctcccatcacc

SEQ ID NO: 116484 - DNA, 23 bp, Homo sapiens
tgagttcattgtagattctggat

SEQ ID NO: 116485 - DNA, 23 bp, Homo sapiens
tgagttcattgtagattctggat

SEQ ID NO: 116486 - DNA, 21 bp, Homo sapiens
atatgtgtgtgtatgtatatg

SEQ ID NO: 116487 - DNA, 23 bp, Homo sapiens
atacacagtgaaccctgtctcta

SEQ ID NO: 116488 - DNA, 23 bp, Homo sapiens
tgagatagagtctcactctgtca

SEQ ID NO: 116489 - DNA, 20 bp, Homo sapiens
tgcccatttcttatgctgag

SEQ ID NO: 116490 - DNA, 19 bp, Homo sapiens
atatgtatgtatatatgtg

SEQ ID NO: 116491 - DNA, 19 bp, Homo sapiens
atatgtatgtatatatgtg

SEQ ID NO: 116492 - DNA, 20 bp, Homo sapiens
taagtatgtatatatgtgtg

SEQ ID NO: 116493 - DNA, 22 bp, Homo sapiens
atgtatatatatgtgtatatgt

SEQ ID NO: 116494 - DNA, 23 bp, Homo sapiens
agactgagtctcactctgtcgcc

SEQ ID NO: 116495 - DNA, 23 bp, Homo sapiens
atgtatgtatgtatgtatatatg

SEQ ID NO: 116496 - DNA, 22 bp, Homo sapiens
tttcctgtatatatatatgtga

SEQ ID NO: 116497 - DNA, 23 bp, Homo sapiens
cagagtctcacactgtcacccag

SEQ ID NO: 116498 - DNA, 22 bp, Homo sapiens
cagtagtgcgatctctgttcat

SEQ ID NO: 116499 - DNA, 18 bp, Homo sapiens
tgtgaagaaagtcaatgg

SEQ ID NO: 116500 - DNA, 23 bp, Homo sapiens
tatgtgtgtatatatatatgtgt

SEQ ID NO: 116501 - DNA, 23 bp, Homo sapiens
tatgtgtgtatatatatgtgtgt

SEQ ID NO: 116502 - DNA, 20 bp, Homo sapiens
tgtctatatcccactctctc

SEQ ID NO: 116503 - DNA, 23 bp, Homo sapiens
tgtgtgtatctataaatgtgtgt

SEQ ID NO: 116504 - DNA, 21 bp, Homo sapiens
atacctgcagtcccagcgtct

SEQ ID NO: 116505 - DNA, 23 bp, Homo sapiens
gactgagtctcgctctgtcaccc

SEQ ID NO: 116506 - DNA, 23 bp, Homo sapiens
tgagacggagtctcactctgtca

SEQ ID NO: 116507 - DNA, 20 bp, Homo sapiens
agtgcaacggcatggtctca

SEQ ID NO: 116508 - DNA, 23 bp, Homo sapiens
agagtctcactctgtcacccagg

SEQ ID NO: 116509 - DNA, 23 bp, Homo sapiens
tgagttcattgtagattctggat

SEQ ID NO: 116510 - DNA, 23 bp, Homo sapiens
tgagttcattgtagattctggat

SEQ ID NO: 116511 - DNA, 23 bp, Homo sapiens
tgtcttagctcctgactgtgcac

SEQ ID NO: 116512 - DNA, 23 bp, Homo sapiens
aagagtttggttttctattggaa

SEQ ID NO: 116513 - DNA, 22 bp, Homo sapiens
acattttctctttttaatgagc

SEQ ID NO: 116514 - DNA, 18 bp, Homo sapiens
tatacacatatacatata

SEQ ID NO: 116515 - DNA, 23 bp, Homo sapiens
atatgtatatatacgtgtgtgtg

SEQ ID NO: 116516 - DNA, 23 bp, Homo sapiens
tgggtgacagagacagtcactca

SEQ ID NO: 116517 - DNA, 21 bp, Homo sapiens
agctgtcttcagttcctctgg

SEQ ID NO: 116518 - DNA, 23 bp, Homo sapiens
tctcagtagacccagagcagctc

SEQ ID NO: 116519 - DNA, 20 bp, Homo sapiens
tgagacagagtctcgctctg

SEQ ID NO: 116520 - DNA, 18 bp, Homo sapiens
tatatatatgtatgtgta

SEQ ID NO: 116521 - DNA, 23 bp, Homo sapiens
tatgtgtgtatatatgtatgtgt

SEQ ID NO: 116522 - DNA, 23 bp, Homo sapiens
tggagtctcactctgtcacccag

SEQ ID NO: 116523 - DNA, 21 bp, Homo sapiens
ttcaagtgattctcctgcctc

SEQ ID NO: 116524 - DNA, 23 bp, Homo sapiens
tggagtctcactctgtcacccag

SEQ ID NO: 116525 - DNA, 23 bp, Homo sapiens
acagagtctcgctctgtcaccca

SEQ ID NO: 116526 - DNA, 23 bp, Homo sapiens
ctgactctgtctcagcctctgct

SEQ ID NO: 116527 - DNA, 23 bp, Homo sapiens
ctgtctgtctgtctgtctgtctg

SEQ ID NO: 116528 - DNA, 23 bp, Homo sapiens
tctgtgtgtgtatatctgtgtgt

SEQ ID NO: 116529 - DNA, 23 bp, Homo sapiens
attgtataggatttgttttcata

SEQ ID NO: 116530 - DNA, 23 bp, Homo sapiens
gtacaattctctagtgaaaccat

SEQ ID NO: 116531 - DNA, 23 bp, Homo sapiens
acctttacagtgtttgatcatgt

SEQ ID NO: 116532 - DNA, 23 bp, Homo sapiens
tgtgtgtgtatatatgtgtgtac

SEQ ID NO: 116533 - DNA, 23 bp, Homo sapiens
ttatgaatatttgatctatagtt

SEQ ID NO: 116534 - DNA, 23 bp, Homo sapiens
acacagtctggctctgtctcacc

SEQ ID NO: 116535 - DNA, 23 bp, Homo sapiens
gaggatcacagagactgattaag

SEQ ID NO: 116536 - DNA, 21 bp, Homo sapiens
tctggtactatcttatcatgt

SEQ ID NO: 116537 - DNA, 18 bp, Homo sapiens
ttttgagacagggtctca

SEQ ID NO: 116538 - DNA, 23 bp, Homo sapiens
tgagttcattgtagattctggat

SEQ ID NO: 116539 - DNA, 23 bp, Homo sapiens
tgagttcattgtagattctggat

SEQ ID NO: 116540 - DNA, 23 bp, Homo sapiens
tctcagactccctgtgtgccacc

SEQ ID NO: 116541 - DNA, 23 bp, Homo sapiens
agagtctcactctgtcacccagg

SEQ ID NO: 116542 - DNA, 23 bp, Homo sapiens
gagtctcactctgtcacccaggc

SEQ ID NO: 116543 - DNA, 23 bp, Homo sapiens
gtctcactctctaagatttcttg

SEQ ID NO: 116544 - DNA, 22 bp, Homo sapiens
tcacacaggctcagtggcacct

SEQ ID NO: 116545 - DNA, 23 bp, Homo sapiens
cagagtctcgctctgtcgctcag

SEQ ID NO: 116546 - DNA, 23 bp, Homo sapiens
gctttcacaatgtcactgactga

SEQ ID NO: 116547 - DNA, 23 bp, Homo sapiens
ttctgagactgaagtgtgtgtgg

SEQ ID NO: 116548 - DNA, 23 bp, Homo sapiens
acagtctcagtcactagttctcc

SEQ ID NO: 116549 - DNA, 23 bp, Homo sapiens
gtggtgaggttgttccttgtaga

SEQ ID NO: 116550 - DNA, 21 bp, Homo sapiens
tgaggtattaggaagaattct

SEQ ID NO: 116551 - DNA, 23 bp, Homo sapiens
atggcgtttttagagctttctgt

SEQ ID NO: 116552 - DNA, 23 bp, Homo sapiens
gtctttgtgtcattacttatcag

SEQ ID NO: 116553 - DNA, 23 bp, Homo sapiens
ttctccatatatttaggtgtgtg

SEQ ID NO: 116554 - DNA, 19 bp, Homo sapiens
taaaatgtatgtgtatgtg

SEQ ID NO: 116555 - DNA, 23 bp, Homo sapiens
cacagagcaaagtgtgtgaccac

SEQ ID NO: 116556 - DNA, 18 bp, Homo sapiens
ggttgctgtgagacagca

SEQ ID NO: 116557 - DNA, 23 bp, Homo sapiens
ctttctctgttgtgtatctgtca

SEQ ID NO: 116558 - DNA, 19 bp, Homo sapiens
taagcactatttttacaac

SEQ ID NO: 116559 - DNA, 23 bp, Homo sapiens
agggttgcaaactaatgtagaat

SEQ ID NO: 116560 - DNA, 19 bp, Homo sapiens
agtgcaattgttgggatgt

SEQ ID NO: 116561 - DNA, 19 bp, Homo sapiens
tggtagttgcatgtatcct

SEQ ID NO: 116562 - DNA, 23 bp, Homo sapiens
atctgcttgccttttgaaatgtt

SEQ ID NO: 116563 - DNA, 23 bp, Homo sapiens
tcattctctcagtctttattgag

SEQ ID NO: 116564 - DNA, 23 bp, Homo sapiens
aacaaagttattgaaaagactgg

SEQ ID NO: 116565 - DNA, 23 bp, Homo sapiens
tgagttcattgtagattctggat

SEQ ID NO: 116566 - DNA, 20 bp, Homo sapiens
tgtgtatatatatacatgta

SEQ ID NO: 116567 - DNA, 22 bp, Homo sapiens
tggatatcagactggataggga

SEQ ID NO: 116568 - DNA, 23 bp, Homo sapiens
ttgtgtgacattgatgtgtgtct

SEQ ID NO: 116569 - DNA, 23 bp, Homo sapiens
aaggagctcacagtctattgagt

SEQ ID NO: 116570 - DNA, 21 bp, Homo sapiens
ttcccactagattgtgagctc

SEQ ID NO: 116571 - DNA, 23 bp, Homo sapiens
atgtctcaatttcctaatctgta

SEQ ID NO: 116572 - DNA, 23 bp, Homo sapiens
tttgagaagtgggaggacatagt

SEQ ID NO: 116573 - DNA, 23 bp, Homo sapiens
tcactctctggctgaatgtagag

SEQ ID NO: 116574 - DNA, 21 bp, Homo sapiens
aaaaggaagaaactgaggccc

SEQ ID NO: 116575 - DNA, 23 bp, Homo sapiens
aggttcacagtaaaacatctctt

SEQ ID NO: 116576 - DNA, 20 bp, Homo sapiens
tttaaagtgggttacttgtg

SEQ ID NO: 116577 - DNA, 23 bp, Homo sapiens
gacagagtctcgctctgtctcct

SEQ ID NO: 116578 - DNA, 23 bp, Homo sapiens
tctctctctctgcctctcacatg

SEQ ID NO: 116579 - DNA, 18 bp, Homo sapiens
tgtgaaggacgtagtgag

SEQ ID NO: 116580 - DNA, 23 bp, Homo sapiens
ctctctgtgtgtcataatgaagt

SEQ ID NO: 116581 - DNA, 19 bp, Homo sapiens
agcatgagctgtagcttca

SEQ ID NO: 116582 - DNA, 22 bp, Homo sapiens
ataaggatgctagtcatatggg

SEQ ID NO: 116583 - DNA, 19 bp, Homo sapiens
tgtgtgtatatctatatat

SEQ ID NO: 116584 - DNA, 23 bp, Homo sapiens
tattgatgtcattttgttgatct

SEQ ID NO: 116585 - DNA, 23 bp, Homo sapiens
gatactctatatgtgtatgtgtg

SEQ ID NO: 116586 - DNA, 23 bp, Homo sapiens
tgtctctctctctctctgtgtat

SEQ ID NO: 116587 - DNA, 23 bp, Homo sapiens
tctgactttcactcactggtttc

SEQ ID NO: 116588 - DNA, 23 bp, Homo sapiens
tgagttcattgtagattctggat

SEQ ID NO: 116589 - DNA, 23 bp, Homo sapiens
tgagttcattgtagattctggat

SEQ ID NO: 116590 - DNA, 23 bp, Homo sapiens
gtctcagagtctgtgtcagttca

SEQ ID NO: 116591 - DNA, 22 bp, Homo sapiens
tatgaacaaggcctttctattt

SEQ ID NO: 116592 - DNA, 21 bp, Homo sapiens
tgtgtgtttgtgtgtgtctat

SEQ ID NO: 116593 - DNA, 23 bp, Homo sapiens
agagcagtagattttgtgatccc

SEQ ID NO: 116594 - DNA, 23 bp, Homo sapiens
tgagttcattgtagattctggat

SEQ ID NO: 116595 - DNA, 23 bp, Homo sapiens
tgagttcattgtagattctggat

SEQ ID NO: 116596 - DNA, 18 bp, Homo sapiens
taactgcatgaaatcagg

SEQ ID NO: 116597 - DNA, 23 bp, Homo sapiens
tgtacactgactcactgtggctg

SEQ ID NO: 116598 - DNA, 23 bp, Homo sapiens
ctctgtccctgcctcagtccctc

SEQ ID NO: 116599 - DNA, 21 bp, Homo sapiens
tatatagttgtgtgtgtgtgt

SEQ ID NO: 116600 - DNA, 21 bp, Homo sapiens
gacacagaaatcagtgaagtg

SEQ ID NO: 116601 - DNA, 23 bp, Homo sapiens
ttccctctcacagtctgtgtggc

SEQ ID NO: 116602 - DNA, 21 bp, Homo sapiens
actgaagtcagaaaccagagc

SEQ ID NO: 116603 - DNA, 23 bp, Homo sapiens
taatatgtgtgcatatgtatatg

SEQ ID NO: 116604 - DNA, 23 bp, Homo sapiens
cggagtctcactctgtcacccag

SEQ ID NO: 116605 - DNA, 19 bp, Homo sapiens
cctggctcactcactctca

SEQ ID NO: 116606 - DNA, 23 bp, Homo sapiens
tgcctgtcagtctgtctcactgc

SEQ ID NO: 116607 - DNA, 23 bp, Homo sapiens
tacagagaagaggtagctctgag

SEQ ID NO: 116608 - DNA, 22 bp, Homo sapiens
actctgtcacccaaactagagt

SEQ ID NO: 116609 - DNA, 23 bp, Homo sapiens
cctcactgtctctctccatctca

SEQ ID NO: 116610 - DNA, 23 bp, Homo sapiens
acagagtctcactctgtcgccca

SEQ ID NO: 116611 - DNA, 20 bp, Homo sapiens
caccctcactcagtcacatg

SEQ ID NO: 116612 - DNA, 18 bp, Homo sapiens
tccctcacactgacagcc

SEQ ID NO: 116613 - DNA, 23 bp, Homo sapiens
ggccatttgtacacacagagcac

SEQ ID NO: 116614 - DNA, 22 bp, Homo sapiens
ctgcaggctcagtcaccctctc

SEQ ID NO: 116615 - DNA, 19 bp, Homo sapiens
taagtctgtaggctgcggg

SEQ ID NO: 116616 - DNA, 22 bp, Homo sapiens
tgagttaatgctggaatgagat

SEQ ID NO: 116617 - DNA, 23 bp, Homo sapiens
gacagagtctcgctctgtcaccc

SEQ ID NO: 116618 - DNA, 23 bp, Homo sapiens
tagtgcaatcacagctcactgtg

SEQ ID NO: 116619 - DNA, 22 bp, Homo sapiens
gtatatcacagtggtagataca

SEQ ID NO: 116620 - DNA, 21 bp, Homo sapiens
tatcacagtggcagttatatt

SEQ ID NO: 116621 - DNA, 21 bp, Homo sapiens
cgtctgcctcttgtttgaggt

SEQ ID NO: 116622 - DNA, 23 bp, Homo sapiens
tgagtctcactctgtcatccaag

SEQ ID NO: 116623 - DNA, 23 bp, Homo sapiens
agagtctcactctgtcacccagg

SEQ ID NO: 116624 - DNA, 22 bp, Homo sapiens
tagtgtccttctgtgggtgtgt

SEQ ID NO: 116625 - DNA, 23 bp, Homo sapiens
tccatgtagatatgtatcaatgt

SEQ ID NO: 116626 - DNA, 20 bp, Homo sapiens
atgtatgtatccatatgtgt

SEQ ID NO: 116627 - DNA, 23 bp, Homo sapiens
gacagagtctcgctctgtcaccc

SEQ ID NO: 116628 - DNA, 23 bp, Homo sapiens
acagagtctcgctctgtcaccca

SEQ ID NO: 116629 - DNA, 23 bp, Homo sapiens
tcggtgggtctctccctgtgtgc

SEQ ID NO: 116630 - DNA, 23 bp, Homo sapiens
ggtcggtgggtctctccctgtgt

SEQ ID NO: 116631 - DNA, 23 bp, Homo sapiens
ctgtcagtgactcactgcgtggg

SEQ ID NO: 116632 - DNA, 23 bp, Homo sapiens
ctgtctgtgtgagtctctcagcc

SEQ ID NO: 116633 - DNA, 19 bp, Homo sapiens
gcctgagtcagaccctctc

SEQ ID NO: 116634 - DNA, 23 bp, Homo sapiens
atctctttcactgtctcagtcat

SEQ ID NO: 116635 - DNA, 18 bp, Homo sapiens
taatgaactgtgagcagt

SEQ ID NO: 116636 - DNA, 23 bp, Homo sapiens
ctcacactgtaatcccaacactt

SEQ ID NO: 116637 - DNA, 18 bp, Homo sapiens
gactgcttgagctcacaa

SEQ ID NO: 116638 - DNA, 23 bp, Homo sapiens
gagtctcactctgtcacccaggc

SEQ ID NO: 116639 - DNA, 20 bp, Homo sapiens
agcaacactgtatgtatgta

SEQ ID NO: 116640 - DNA, 23 bp, Homo sapiens
aatgaagttgtagtggaacacag

SEQ ID NO: 116641 - DNA, 23 bp, Homo sapiens
tgtatggctgctttctagctgcc

SEQ ID NO: 116642 - DNA, 19 bp, Homo sapiens
tgagtgatcctgtcggtgt

SEQ ID NO: 116643 - DNA, 23 bp, Homo sapiens
gacagagtctcgctctgtcaccc

SEQ ID NO: 116644 - DNA, 23 bp, Homo sapiens
acagactgtgttagattgaaaat

SEQ ID NO: 116645 - DNA, 23 bp, Homo sapiens
ggtcggtgggtctctccctgtgt

SEQ ID NO: 116646 - DNA, 21 bp, Homo sapiens
catcctcattctgacagaact

SEQ ID NO: 116647 - DNA, 23 bp, Homo sapiens
ggcatgcagaggggaaagcagca

SEQ ID NO: 116648 - DNA, 18 bp, Homo sapiens
ctgcctctctcactgtca

SEQ ID NO: 116649 - DNA, 22 bp, Homo sapiens
atcatggtcattctctgtctca

SEQ ID NO: 116650 - DNA, 21 bp, Homo sapiens
aactagtttttcttgtgtcag

SEQ ID NO: 116651 - DNA, 23 bp, Homo sapiens
tagattctgctacacgatgtgga

SEQ ID NO: 116652 - DNA, 21 bp, Homo sapiens
tatgtatatatatatgtatgt

SEQ ID NO: 116653 - DNA, 23 bp, Homo sapiens
tgtatgtatatatatatgtgtgt

SEQ ID NO: 116654 - DNA, 23 bp, Homo sapiens
tatgtatatatatacgtgtgtgt

SEQ ID NO: 116655 - DNA, 23 bp, Homo sapiens
cagagtccctcacagcctccgtc

SEQ ID NO: 116656 - DNA, 19 bp, Homo sapiens
acaattgaagaaactggtt

SEQ ID NO: 116657 - DNA, 23 bp, Homo sapiens
ggagtctcactctgtctcccagg

SEQ ID NO: 116658 - DNA, 23 bp, Homo sapiens
tttctccctctctctgtggcttc

SEQ ID NO: 116659 - DNA, 18 bp, Homo sapiens
agtggagtgtagctgccg

SEQ ID NO: 116660 - DNA, 23 bp, Homo sapiens
tggagtctcactctgtcacccag

SEQ ID NO: 116661 - DNA, 23 bp, Homo sapiens
gagatggagtctcgctctgtcac

SEQ ID NO: 116662 - DNA, 23 bp, Homo sapiens
tcataaatgtggatgtgcagaac

SEQ ID NO: 116663 - DNA, 20 bp, Homo sapiens
gagtgttcagaccactttat

SEQ ID NO: 116664 - DNA, 23 bp, Homo sapiens
acagagcgtccctctctctgtca

SEQ ID NO: 116665 - DNA, 18 bp, Homo sapiens
ctcccccactgtcacact

SEQ ID NO: 116666 - DNA, 23 bp, Homo sapiens
ctctgtcacccagactgcagtgc

SEQ ID NO: 116667 - DNA, 23 bp, Homo sapiens
gtcagagagaagacacacagctg

SEQ ID NO: 116668 - DNA, 20 bp, Homo sapiens
tgagacagtgtgtcgctctg

SEQ ID NO: 116669 - DNA, 18 bp, Homo sapiens
tcactgccacccaggctg

SEQ ID NO: 116670 - DNA, 19 bp, Homo sapiens
tgtgagccactgcacctgg

SEQ ID NO: 116671 - DNA, 23 bp, Homo sapiens
cattgtcagtgtatagggaattg

SEQ ID NO: 116672 - DNA, 22 bp, Homo sapiens
aggaatgtagtgtgctatgatc

SEQ ID NO: 116673 - DNA, 19 bp, Homo sapiens
gtgagtagtcactgcactc

SEQ ID NO: 116674 - DNA, 23 bp, Homo sapiens
gacagggtcgctctgtcgctcag

SEQ ID NO: 116675 - DNA, 23 bp, Homo sapiens
atctctttcactgtctcagtcat

SEQ ID NO: 116676 - DNA, 23 bp, Homo sapiens
gaattttgctcttgttgcccagg

SEQ ID NO: 116677 - DNA, 23 bp, Homo sapiens
attctgtgcaatagatcactaaa

SEQ ID NO: 116678 - DNA, 23 bp, Homo sapiens
tgttgagacagagtcttactctg

SEQ ID NO: 116679 - DNA, 19 bp, Homo sapiens
tcacactcagtcatccagg

SEQ ID NO: 116680 - DNA, 23 bp, Homo sapiens
ggagtctcactcactctgttgcc

SEQ ID NO: 116681 - DNA, 19 bp, Homo sapiens
tgagggagggaaaggtgac

SEQ ID NO: 116682 - DNA, 22 bp, Homo sapiens
ctctgccactcacagccggtgt

SEQ ID NO: 116683 - DNA, 23 bp, Homo sapiens
tgagatggagtctccctctgttg

SEQ ID NO: 116684 - DNA, 20 bp, Homo sapiens
tttactgaatttgtttatca

SEQ ID NO: 116685 - DNA, 21 bp, Homo sapiens
cgtctgcctcttgtttgaggt

SEQ ID NO: 116686 - DNA, 23 bp, Homo sapiens
ggtcggtgggtctctccctgtgt

SEQ ID NO: 116687 - DNA, 23 bp, Homo sapiens
tcagcatatgtattgtatatata

SEQ ID NO: 116688 - DNA, 18 bp, Homo sapiens
tgactgtgtgtgtatata

SEQ ID NO: 116689 - DNA, 23 bp, Homo sapiens
ctctctctctctctggctaagct

SEQ ID NO: 116690 - DNA, 22 bp, Homo sapiens
tatggtaaatttaagtggtttt

SEQ ID NO: 116691 - DNA, 23 bp, Homo sapiens
gtctctggctctgtgactcttct

SEQ ID NO: 116692 - DNA, 23 bp, Homo sapiens
ttgtactccttttattaagttta

SEQ ID NO: 116693 - DNA, 23 bp, Homo sapiens
tctgagacagagtctcactctat

SEQ ID NO: 116694 - DNA, 21 bp, Homo sapiens
aatccaggaagaggaagggca

SEQ ID NO: 116695 - DNA, 18 bp, Homo sapiens
agagaagagagtcaagaa

SEQ ID NO: 116696 - DNA, 20 bp, Homo sapiens
ggagtctcgctctgtcaccc

SEQ ID NO: 116697 - DNA, 23 bp, Homo sapiens
acagggtctcactatgttgtcca

SEQ ID NO: 116698 - DNA, 23 bp, Homo sapiens
cagggtctgtcactctgtcgccc

SEQ ID NO: 116699 - DNA, 23 bp, Homo sapiens
agagagagatacagttgtgattt

SEQ ID NO: 116700 - DNA, 23 bp, Homo sapiens
gggtctcactctgtcacccaggc

SEQ ID NO: 116701 - DNA, 23 bp, Homo sapiens
gggtctcactctgtcacccaggc

SEQ ID NO: 116702 - DNA, 22 bp, Homo sapiens
tgagatggacgtctcactctgt

SEQ ID NO: 116703 - DNA, 20 bp, Homo sapiens
tctgggctatgagtgagtga

SEQ ID NO: 116704 - DNA, 23 bp, Homo sapiens
ctcggcctttgcttgtaggttct

SEQ ID NO: 116705 - DNA, 18 bp, Homo sapiens
tgacctggagctttactg

SEQ ID NO: 116706 - DNA, 23 bp, Homo sapiens
gtcttcactctgtgcctgagagg

SEQ ID NO: 116707 - DNA, 23 bp, Homo sapiens
cactgacctctgactctttcctc

SEQ ID NO: 116708 - DNA, 21 bp, Homo sapiens
atgagtgaacagagacaggtg

SEQ ID NO: 116709 - DNA, 21 bp, Homo sapiens
caaatccctatcacagctgga

SEQ ID NO: 116710 - DNA, 19 bp, Homo sapiens
tctcagtcttatgctgtga

SEQ ID NO: 116711 - DNA, 23 bp, Homo sapiens
tttgtcacataggtaaacatgtg

SEQ ID NO: 116712 - DNA, 22 bp, Homo sapiens
atatttgtgctatatgctatgt

SEQ ID NO: 116713 - DNA, 23 bp, Homo sapiens
tggagtctcgctctgtctcccag

SEQ ID NO: 116714 - DNA, 23 bp, Homo sapiens
agtctctctctgtcacccaggct

SEQ ID NO: 116715 - DNA, 21 bp, Homo sapiens
agactagactgtgagctccag

SEQ ID NO: 116716 - DNA, 23 bp, Homo sapiens
agatggattctcacactgtcacc

SEQ ID NO: 116717 - DNA, 23 bp, Homo sapiens
tctgtatccttatgtagctgttt

SEQ ID NO: 116718 - DNA, 23 bp, Homo sapiens
ccgagtctcactctgtcacccag

SEQ ID NO: 116719 - DNA, 23 bp, Homo sapiens
agtgtgtgtatatatatatgtgt

SEQ ID NO: 116720 - DNA, 21 bp, Homo sapiens
aagtggaataatttgtcctga

SEQ ID NO: 116721 - DNA, 21 bp, Homo sapiens
tgtcactgagacacatgttcc

SEQ ID NO: 116722 - DNA, 20 bp, Homo sapiens
tgagagctcttttagtgtcc

SEQ ID NO: 116723 - DNA, 23 bp, Homo sapiens
agacagttgatactgaactctgc

SEQ ID NO: 116724 - DNA, 22 bp, Homo sapiens
taacactgtcagcttagcactt

SEQ ID NO: 116725 - DNA, 19 bp, Homo sapiens
atatgtgtgtatatgtatg

SEQ ID NO: 116726 - DNA, 19 bp, Homo sapiens
atgatgtggctgttgaaga

SEQ ID NO: 116727 - DNA, 23 bp, Homo sapiens
actcccagagcccctggtactct

SEQ ID NO: 116728 - DNA, 23 bp, Homo sapiens
tgatataaaatgtagaatagagt

SEQ ID NO: 116729 - DNA, 20 bp, Homo sapiens
tttgaatgtgtttaatatca

SEQ ID NO: 116730 - DNA, 23 bp, Homo sapiens
gagacggagtctcactctgtcac

SEQ ID NO: 116731 - DNA, 18 bp, Homo sapiens
agtaagaatttcttacca

SEQ ID NO: 116732 - DNA, 23 bp, Homo sapiens
atgtatgtgtatatatgtgtatg

SEQ ID NO: 116733 - DNA, 22 bp, Homo sapiens
tatatgtgtatatatatgtgtg

SEQ ID NO: 116734 - DNA, 23 bp, Homo sapiens
tagtaagtggaactgtaatatat

SEQ ID NO: 116735 - DNA, 23 bp, Homo sapiens
cttcaagtaactcactgagtgtc

SEQ ID NO: 116736 - DNA, 23 bp, Homo sapiens
agtcagagtctcgctctgttgcc

SEQ ID NO: 116737 - DNA, 23 bp, Homo sapiens
cataggatcttcatgaactgagt

SEQ ID NO: 116738 - DNA, 20 bp, Homo sapiens
tgactcaattttttcacttt

SEQ ID NO: 116739 - DNA, 22 bp, Homo sapiens
aaagtcctggacttgttgctga

SEQ ID NO: 116740 - DNA, 23 bp, Homo sapiens
cttctgtgactgtctgtgttgag

SEQ ID NO: 116741 - DNA, 23 bp, Homo sapiens
agtctgtggtacttctttgtagt

SEQ ID NO: 116742 - DNA, 23 bp, Homo sapiens
gagtctctctctgtcacctaggc

SEQ ID NO: 116743 - DNA, 23 bp, Homo sapiens
aagggccttcttgctcctgtctg

SEQ ID NO: 116744 - DNA, 23 bp, Homo sapiens
tttcccagtctctatctgtgtga

SEQ ID NO: 116745 - DNA, 22 bp, Homo sapiens
agctgactgacagtggtatggc

SEQ ID NO: 116746 - DNA, 23 bp, Homo sapiens
gcagagtctcgctctgtcaccca

SEQ ID NO: 116747 - DNA, 23 bp, Homo sapiens
aggatagcttttgaagtaagtga

SEQ ID NO: 116748 - DNA, 23 bp, Homo sapiens
caactgtctgaaatatttcttca

SEQ ID NO: 116749 - DNA, 23 bp, Homo sapiens
acactctcatgtacattaactca

SEQ ID NO: 116750 - DNA, 23 bp, Homo sapiens
gtctgttctcacactgctaatga

SEQ ID NO: 116751 - DNA, 23 bp, Homo sapiens
gttggcactattattattgtctt

SEQ ID NO: 116752 - DNA, 18 bp, Homo sapiens
tgaggcacggggtgttag

SEQ ID NO: 116753 - DNA, 23 bp, Homo sapiens
tgggctgtagtgagctatgattg

SEQ ID NO: 116754 - DNA, 20 bp, Homo sapiens
tatcacagtgggtgttggaa

SEQ ID NO: 116755 - DNA, 22 bp, Homo sapiens
cttttttggttccatatgaatt

SEQ ID NO: 116756 - DNA, 23 bp, Homo sapiens
tagtatgtatgtatgtatgtatg

SEQ ID NO: 116757 - DNA, 23 bp, Homo sapiens
atgtgctaatatttgacagtggc

SEQ ID NO: 116758 - DNA, 22 bp, Homo sapiens
acacacagtctgtcaaatatga

SEQ ID NO: 116759 - DNA, 23 bp, Homo sapiens
tatcttcagcatcaagcatgttg

SEQ ID NO: 116760 - DNA, 23 bp, Homo sapiens
tgagttcattgtagattctggat

SEQ ID NO: 116761 - DNA, 23 bp, Homo sapiens
tgagttcattgtagattctggat

SEQ ID NO: 116762 - DNA, 23 bp, Homo sapiens
tgtgtgtgtatatgtatatgtgt

SEQ ID NO: 116763 - DNA, 23 bp, Homo sapiens
atttctcagtatttgaaatggta

SEQ ID NO: 116764 - DNA, 23 bp, Homo sapiens
cggagtctcactctgtcacccag

SEQ ID NO: 116765 - DNA, 20 bp, Homo sapiens
tgtctttttctttatattca

SEQ ID NO: 116766 - DNA, 20 bp, Homo sapiens
gtgtccccttgtgctgaacc

SEQ ID NO: 116767 - DNA, 23 bp, Homo sapiens
tattatgtgcatatgttatatat

SEQ ID NO: 116768 - DNA, 23 bp, Homo sapiens
tgtgtcaccctgtgtgcctgcct

SEQ ID NO: 116769 - DNA, 20 bp, Homo sapiens
catctcatttgcagaacatg

SEQ ID NO: 116770 - DNA, 23 bp, Homo sapiens
acatggaccatgtgtcactcaga

SEQ ID NO: 116771 - DNA, 23 bp, Homo sapiens
gaaacttagagctattgttctgt

SEQ ID NO: 116772 - DNA, 20 bp, Homo sapiens
tgggagtttggtatgcagga

SEQ ID NO: 116773 - DNA, 21 bp, Homo sapiens
acacagtcttgctctgtcacc

SEQ ID NO: 116774 - DNA, 19 bp, Homo sapiens
gtcagggataaaatgtact

SEQ ID NO: 116775 - DNA, 23 bp, Homo sapiens
tgtgtatatatatatacgtgtat

SEQ ID NO: 116776 - DNA, 23 bp, Homo sapiens
tgtttctgagtctgtgttttttc

SEQ ID NO: 116777 - DNA, 21 bp, Homo sapiens
acagcagagtgagactccctc

SEQ ID NO: 116778 - DNA, 23 bp, Homo sapiens
tttgtgtgtgtctgtgactgtct

SEQ ID NO: 116779 - DNA, 18 bp, Homo sapiens
aatagttttctccagggt

SEQ ID NO: 116780 - DNA, 23 bp, Homo sapiens
agaatctcactctgtcactgagg

SEQ ID NO: 116781 - DNA, 21 bp, Homo sapiens
tcatggtggcagcttgatgta

SEQ ID NO: 116782 - DNA, 23 bp, Homo sapiens
tgtatgtatgtatgtatgtgtgt

SEQ ID NO: 116783 - DNA, 23 bp, Homo sapiens
caaagagcatgagcttctgcaga

SEQ ID NO: 116784 - DNA, 23 bp, Homo sapiens
agagaggacacagtggtcctggt

SEQ ID NO: 116785 - DNA, 23 bp, Homo sapiens
gttagtgctgatagagcaggttg

SEQ ID NO: 116786 - DNA, 23 bp, Homo sapiens
ttgagaaggagttttgctcttgt

SEQ ID NO: 116787 - DNA, 20 bp, Homo sapiens
tcacaggttattaaacagag

SEQ ID NO: 116788 - DNA, 23 bp, Homo sapiens
actgaagttacacagcagactgt

SEQ ID NO: 116789 - DNA, 23 bp, Homo sapiens
aggaatatctcatcgtattgtgc

SEQ ID NO: 116790 - DNA, 22 bp, Homo sapiens
tacatgtgcaggatgtgcaggt

SEQ ID NO: 116791 - DNA, 23 bp, Homo sapiens
agacaactgcatttgttgctgtt

SEQ ID NO: 116792 - DNA, 21 bp, Homo sapiens
tacagaattggagttgagtct

SEQ ID NO: 116793 - DNA, 22 bp, Homo sapiens
agatttggtttagaaaaggggt

SEQ ID NO: 116794 - DNA, 23 bp, Homo sapiens
ttctctgatgattagcgattggt

SEQ ID NO: 116795 - DNA, 20 bp, Homo sapiens
ttgtatatcatctttagaga

SEQ ID NO: 116796 - DNA, 21 bp, Homo sapiens
aggggaaatagtatgctctga

SEQ ID NO: 116797 - DNA, 21 bp, Homo sapiens
tcctgcaaaacttgagcttgc

SEQ ID NO: 116798 - DNA, 23 bp, Homo sapiens
tgactggctggcttgctgctttt

SEQ ID NO: 116799 - DNA, 19 bp, Homo sapiens
tgtgtgtgtgtatgtgtgt

SEQ ID NO: 116800 - DNA, 23 bp, Homo sapiens
tgtgtatatatgtgtatatgtgt

SEQ ID NO: 116801 - DNA, 22 bp, Homo sapiens
tgtgtatatatgtatatatgta

SEQ ID NO: 116802 - DNA, 18 bp, Homo sapiens
tatgtgtgtatatatgta

SEQ ID NO: 116803 - DNA, 23 bp, Homo sapiens
tgtgcatttcagaagttgtatcc

SEQ ID NO: 116804 - DNA, 20 bp, Homo sapiens
tattcagatgtacttcatca

SEQ ID NO: 116805 - DNA, 23 bp, Homo sapiens
atgtgtgtgtttaatttttcatt

SEQ ID NO: 116806 - DNA, 23 bp, Homo sapiens
aggaaaggaaaacactctgaatg

SEQ ID NO: 116807 - DNA, 21 bp, Homo sapiens
tgggagtgaaattgctgggtt

SEQ ID NO: 116808 - DNA, 22 bp, Homo sapiens
aacaatcagtttatgtttatct

SEQ ID NO: 116809 - DNA, 23 bp, Homo sapiens
taaactgttttccaaagcaatgt

SEQ ID NO: 116810 - DNA, 23 bp, Homo sapiens
tgagacagagtctcgctccttca

SEQ ID NO: 116811 - DNA, 21 bp, Homo sapiens
aactacatccgctggaaggaa

SEQ ID NO: 116812 - DNA, 18 bp, Homo sapiens
attccctatagtttctgc

SEQ ID NO: 116813 - DNA, 18 bp, Homo sapiens
tgcttccagttgctctct

SEQ ID NO: 116814 - DNA, 21 bp, Homo sapiens
aaaggtcatctactataggct

SEQ ID NO: 116815 - DNA, 23 bp, Homo sapiens
tctcaaagctgtggtagaattca

SEQ ID NO: 116816 - DNA, 23 bp, Homo sapiens
tttttgagatggagtcttgctct

SEQ ID NO: 116817 - DNA, 23 bp, Homo sapiens
gccagtgtcagagtcagatcctg

SEQ ID NO: 116818 - DNA, 23 bp, Homo sapiens
gagactgagtcttgctctgtcac

SEQ ID NO: 116819 - DNA, 23 bp, Homo sapiens
agtgattaagatgtggtactgca

SEQ ID NO: 116820 - DNA, 23 bp, Homo sapiens
agtcctgtcactcactgtcactg

SEQ ID NO: 116821 - DNA, 23 bp, Homo sapiens
tcacagttcagagagatgtaggt

SEQ ID NO: 116822 - DNA, 22 bp, Homo sapiens
tgagacagagtcagtctgtcac

SEQ ID NO: 116823 - DNA, 22 bp, Homo sapiens
caacatagtgagactgtcttct

SEQ ID NO: 116824 - DNA, 22 bp, Homo sapiens
acggagtctcactctgtcacca

SEQ ID NO: 116825 - DNA, 19 bp, Homo sapiens
attaagttccagtggtgca

SEQ ID NO: 116826 - DNA, 23 bp, Homo sapiens
ttttgagacggagtcttgctctg

SEQ ID NO: 116827 - DNA, 19 bp, Homo sapiens
actctcatcccttgttggt

SEQ ID NO: 116828 - DNA, 23 bp, Homo sapiens
gggtctcactctgtcacccaggc

SEQ ID NO: 116829 - DNA, 20 bp, Homo sapiens
tgcagtggcatgatcttggc

SEQ ID NO: 116830 - DNA, 23 bp, Homo sapiens
tgagtgactgtctctgtcaccca

SEQ ID NO: 116831 - DNA, 19 bp, Homo sapiens
aatgcctctgaattctata

SEQ ID NO: 116832 - DNA, 23 bp, Homo sapiens
agtcaggtttttacttcagttaa

SEQ ID NO: 116833 - DNA, 23 bp, Homo sapiens
tgagacagagtctggctctgttg

SEQ ID NO: 116834 - DNA, 23 bp, Homo sapiens
gtcttagtctctctctcagccct

SEQ ID NO: 116835 - DNA, 23 bp, Homo sapiens
tgagatggagtctcactctgtcg

SEQ ID NO: 116836 - DNA, 23 bp, Homo sapiens
acacgtatatatatgtatatgtg

SEQ ID NO: 116837 - DNA, 19 bp, Homo sapiens
atatgtatatatacgtgta

SEQ ID NO: 116838 - DNA, 23 bp, Homo sapiens
tatatatgtgtatatgtatatat

SEQ ID NO: 116839 - DNA, 19 bp, Homo sapiens
tatgtatatatatacgtgt

SEQ ID NO: 116840 - DNA, 22 bp, Homo sapiens
tatgtgtgtgtatatgtgcata

SEQ ID NO: 116841 - DNA, 18 bp, Homo sapiens
atatgtatatatgtgtgt

SEQ ID NO: 116842 - DNA, 23 bp, Homo sapiens
atgtgcatatatgtatatatgtg

SEQ ID NO: 116843 - DNA, 20 bp, Homo sapiens
tgcctgcagtcttagctact

SEQ ID NO: 116844 - DNA, 23 bp, Homo sapiens
gagtctcacactgtcacccaggc

SEQ ID NO: 116845 - DNA, 23 bp, Homo sapiens
agttggatttgtttttccactga

SEQ ID NO: 116846 - DNA, 23 bp, Homo sapiens
gtgacagagtgaaactctctctc

SEQ ID NO: 116847 - DNA, 22 bp, Homo sapiens
ctgggtgacacagtgagactct

SEQ ID NO: 116848 - DNA, 22 bp, Homo sapiens
tttgagacaggggttcacttat

SEQ ID NO: 116849 - DNA, 23 bp, Homo sapiens
tgtagtctcactctgtccctccg

SEQ ID NO: 116850 - DNA, 23 bp, Homo sapiens
cggagtctcactctgtcgctcag

SEQ ID NO: 116851 - DNA, 18 bp, Homo sapiens
tcccaagtagctgggact

SEQ ID NO: 116852 - DNA, 18 bp, Homo sapiens
gtgtgtacattagttata

SEQ ID NO: 116853 - DNA, 21 bp, Homo sapiens
aattagtttccaattctattc

SEQ ID NO: 116854 - DNA, 23 bp, Homo sapiens
ctcttgctccctcagtctgttct

SEQ ID NO: 116855 - DNA, 22 bp, Homo sapiens
acagagaagacagggtgctctt

SEQ ID NO: 116856 - DNA, 21 bp, Homo sapiens
tgaggtagaaggatttcttga

SEQ ID NO: 116857 - DNA, 20 bp, Homo sapiens
aatatctggcttgttgaagt

SEQ ID NO: 116858 - DNA, 23 bp, Homo sapiens
gacagtctcactctgtcacccag

SEQ ID NO: 116859 - DNA, 22 bp, Homo sapiens
atctaatgtatagatatatgta

SEQ ID NO: 116860 - DNA, 19 bp, Homo sapiens
tttacattgatattatatg

SEQ ID NO: 116861 - DNA, 23 bp, Homo sapiens
ttggagacagagtctcgctctgt

SEQ ID NO: 116862 - DNA, 23 bp, Homo sapiens
tgtgcctggctctgtggctgcca

SEQ ID NO: 116863 - DNA, 20 bp, Homo sapiens
tggtgtaagtgtaaatatgt

SEQ ID NO: 116864 - DNA, 19 bp, Homo sapiens
gttgtatgtatttatgtat

SEQ ID NO: 116865 - DNA, 19 bp, Homo sapiens
tatgtatgtgcttatctac

SEQ ID NO: 116866 - DNA, 21 bp, Homo sapiens
tgtttgtctctgtgtagtttc

SEQ ID NO: 116867 - DNA, 20 bp, Homo sapiens
atgtgcagaacgtgcaggtt

SEQ ID NO: 116868 - DNA, 20 bp, Homo sapiens
tgacagagcacagtgagtct

SEQ ID NO: 116869 - DNA, 23 bp, Homo sapiens
agcaagccagtcattagcattgt

SEQ ID NO: 116870 - DNA, 23 bp, Homo sapiens
tacatgtgcacaatgtgcaggtt

SEQ ID NO: 116871 - DNA, 20 bp, Homo sapiens
gtatggacatgtatatgtat

SEQ ID NO: 116872 - DNA, 23 bp, Homo sapiens
taaggagactagttaggagatcc

SEQ ID NO: 116873 - DNA, 23 bp, Homo sapiens
tgagttcattgtagattctggat

SEQ ID NO: 116874 - DNA, 23 bp, Homo sapiens
tgagttcattgtagattctggat

SEQ ID NO: 116875 - DNA, 23 bp, Homo sapiens
tacaccattgatgaaagggctga

SEQ ID NO: 116876 - DNA, 23 bp, Homo sapiens
acagtctctgtcactcattgtca

SEQ ID NO: 116877 - DNA, 20 bp, Homo sapiens
tgagtgaacatagatggcag

SEQ ID NO: 116878 - DNA, 19 bp, Homo sapiens
aggtccaacaggaacccta

SEQ ID NO: 116879 - DNA, 21 bp, Homo sapiens
atatatgtatatgtatatctc

SEQ ID NO: 116880 - DNA, 23 bp, Homo sapiens
actcttacacagtggttaagagc

SEQ ID NO: 116881 - DNA, 23 bp, Homo sapiens
tttgctgagaactctgggacaag

SEQ ID NO: 116882 - DNA, 22 bp, Homo sapiens
acatatgtatgcatgtgtgtgt

SEQ ID NO: 116883 - DNA, 20 bp, Homo sapiens
taacacacccatatatatgt

SEQ ID NO: 116884 - DNA, 20 bp, Homo sapiens
tacagtatacatatatatgt

SEQ ID NO: 116885 - DNA, 21 bp, Homo sapiens
agtatcagtaagtctttgtgg

SEQ ID NO: 116886 - DNA, 19 bp, Homo sapiens
aatgtttatgctttagatg

SEQ ID NO: 116887 - DNA, 19 bp, Homo sapiens
taacagtgcctcactacac

SEQ ID NO: 116888 - DNA, 23 bp, Homo sapiens
ggagtctcactctgtcacccagg

SEQ ID NO: 116889 - DNA, 20 bp, Homo sapiens
agagattagtgagagtgcat

SEQ ID NO: 116890 - DNA, 23 bp, Homo sapiens
ttgaggtatgtatatgtaaactg

SEQ ID NO: 116891 - DNA, 23 bp, Homo sapiens
acaaggctttgtatcagctagta

SEQ ID NO: 116892 - DNA, 23 bp, Homo sapiens
aaagaatttgatttgaattcctt

SEQ ID NO: 116893 - DNA, 18 bp, Homo sapiens
tcttatcactatgacttg

SEQ ID NO: 116894 - DNA, 22 bp, Homo sapiens
acatgtgcagaatgtgcaggtt

SEQ ID NO: 116895 - DNA, 23 bp, Homo sapiens
atggagtctcactctgtcaccca

SEQ ID NO: 116896 - DNA, 22 bp, Homo sapiens
tatgtgtatatatatacacata

SEQ ID NO: 116897 - DNA, 23 bp, Homo sapiens
tgtatctgtctcttcttggagag

SEQ ID NO: 116898 - DNA, 20 bp, Homo sapiens
agaaaaagtgagtctcttct

SEQ ID NO: 116899 - DNA, 19 bp, Homo sapiens
gactgatgtgagatggtat

SEQ ID NO: 116900 - DNA, 23 bp, Homo sapiens
aagactcagtaaaaattatccaa

SEQ ID NO: 116901 - DNA, 23 bp, Homo sapiens
ctgtagtgtttgctgatttccat

SEQ ID NO: 116902 - DNA, 23 bp, Homo sapiens
agtgtgatgtcagtgaacacaga

SEQ ID NO: 116903 - DNA, 20 bp, Homo sapiens
ttgtgattacttgttaatgt

SEQ ID NO: 116904 - DNA, 22 bp, Homo sapiens
aatgtacaatatgcatatatgt

SEQ ID NO: 116905 - DNA, 18 bp, Homo sapiens
agtttttgatggagtttt

SEQ ID NO: 116906 - DNA, 23 bp, Homo sapiens
taagctccttgtagattctggat

SEQ ID NO: 116907 - DNA, 23 bp, Homo sapiens
tctcacagtcattatttgcgtgg

SEQ ID NO: 116908 - DNA, 22 bp, Homo sapiens
agttgaggatgactagtgagtt

SEQ ID NO: 116909 - DNA, 23 bp, Homo sapiens
aataaggtaggataccttactta

SEQ ID NO: 116910 - DNA, 23 bp, Homo sapiens
taattttgactttttgttgacat

SEQ ID NO: 116911 - DNA, 23 bp, Homo sapiens
aatgtgttagcagatttgaagtt

SEQ ID NO: 116912 - DNA, 21 bp, Homo sapiens
tgacaaattattttgatgatg

SEQ ID NO: 116913 - DNA, 21 bp, Homo sapiens
tgttaagtaaagaagtaacaa

SEQ ID NO: 116914 - DNA, 18 bp, Homo sapiens
gagcgagactctgtctct

SEQ ID NO: 116915 - DNA, 22 bp, Homo sapiens
ttgagacggagtatctctctgt

SEQ ID NO: 116916 - DNA, 23 bp, Homo sapiens
ctccaggctgtgtgtgtctctcc

SEQ ID NO: 116917 - DNA, 23 bp, Homo sapiens
tgtgaaagaaattgagagagaag

SEQ ID NO: 116918 - DNA, 23 bp, Homo sapiens
cccagatctggaagagttagtat

SEQ ID NO: 116919 - DNA, 22 bp, Homo sapiens
tataattcatttggtggctggg

SEQ ID NO: 116920 - DNA, 22 bp, Homo sapiens
tggtgtgatcttggctcactgc

SEQ ID NO: 116921 - DNA, 23 bp, Homo sapiens
tggagtctcactctgtcacccag

SEQ ID NO: 116922 - DNA, 22 bp, Homo sapiens
atacacacacatatacatatgt

SEQ ID NO: 116923 - DNA, 23 bp, Homo sapiens
acggagtctggctctgtcactca

SEQ ID NO: 116924 - DNA, 23 bp, Homo sapiens
cagagtctcactctgtcacccaa

SEQ ID NO: 116925 - DNA, 22 bp, Homo sapiens
tgagggggtcagaatgttcagt

SEQ ID NO: 116926 - DNA, 23 bp, Homo sapiens
aatgtatttctggcagctatttt

SEQ ID NO: 116927 - DNA, 22 bp, Homo sapiens
taatttactgaaggaaaagcat

SEQ ID NO: 116928 - DNA, 23 bp, Homo sapiens
gagacagtgtctccctgtgttga

SEQ ID NO: 116929 - DNA, 19 bp, Homo sapiens
ttgttgttgtcgtcgagtt

SEQ ID NO: 116930 - DNA, 18 bp, Homo sapiens
gtatatatatgtgtgtgt

SEQ ID NO: 116931 - DNA, 23 bp, Homo sapiens
tgagttcattgtagattctggat

SEQ ID NO: 116932 - DNA, 23 bp, Homo sapiens
tgagttcattgtagattctggat

SEQ ID NO: 116933 - DNA, 23 bp, Homo sapiens
atgtgtgtatatatatatgtgtg

SEQ ID NO: 116934 - DNA, 22 bp, Homo sapiens
aagagagtcggttttttaaggt

SEQ ID NO: 116935 - DNA, 23 bp, Homo sapiens
tatgttcatatatatatgtgatt

SEQ ID NO: 116936 - DNA, 18 bp, Homo sapiens
tggatatatatccagtat

SEQ ID NO: 116937 - DNA, 23 bp, Homo sapiens
atatatccagtatatctagtata

SEQ ID NO: 116938 - DNA, 23 bp, Homo sapiens
tggcacatgtagacatatgtttg

SEQ ID NO: 116939 - DNA, 22 bp, Homo sapiens
gaattcctagtgagacgttcag

SEQ ID NO: 116940 - DNA, 23 bp, Homo sapiens
tgtgtgtgacaggtctcgctctg

SEQ ID NO: 116941 - DNA, 21 bp, Homo sapiens
ttttagtttttaaacatttgt

SEQ ID NO: 116942 - DNA, 23 bp, Homo sapiens
gtttgaccttagacaatctgatg

SEQ ID NO: 116943 - DNA, 18 bp, Homo sapiens
taggtgctcactgattta

SEQ ID NO: 116944 - DNA, 23 bp, Homo sapiens
gacagagtctcgctctgtcaccc

SEQ ID NO: 116945 - DNA, 23 bp, Homo sapiens
gtttggttttgaaatgtaaagat

SEQ ID NO: 116946 - DNA, 23 bp, Homo sapiens
agaggataatagttgtattacat

SEQ ID NO: 116947 - DNA, 23 bp, Homo sapiens
aggtaatataaaatatgtgattg

SEQ ID NO: 116948 - DNA, 23 bp, Homo sapiens
ttctttaagagtatggctcttca

SEQ ID NO: 116949 - DNA, 21 bp, Homo sapiens
ttatttgagataatcatgcct

SEQ ID NO: 116950 - DNA, 22 bp, Homo sapiens
tgtcactctgtcacccaggctg

SEQ ID NO: 116951 - DNA, 22 bp, Homo sapiens
aaatgtgcagaaagtgcaggtt

SEQ ID NO: 116952 - DNA, 23 bp, Homo sapiens
ggaattgttttgttaacttggtt

SEQ ID NO: 116953 - DNA, 23 bp, Homo sapiens
tgaatcacagctctttcattgca

SEQ ID NO: 116954 - DNA, 22 bp, Homo sapiens
tatttactacttatgaatgtgt

SEQ ID NO: 116955 - DNA, 19 bp, Homo sapiens
atatgagtgaattttatgg

SEQ ID NO: 116956 - DNA, 19 bp, Homo sapiens
acatagtgagaccttatct

SEQ ID NO: 116957 - DNA, 20 bp, Homo sapiens
acagaagaatgtgtgcacat

SEQ ID NO: 116958 - DNA, 23 bp, Homo sapiens
tgtgtgtgtatatgtgtcagtat

SEQ ID NO: 116959 - DNA, 21 bp, Homo sapiens
tgtgtatatatattcatatgt

SEQ ID NO: 116960 - DNA, 18 bp, Homo sapiens
tgtgtgtgtgtgtgtgtg

SEQ ID NO: 116961 - DNA, 23 bp, Homo sapiens
gtcagagtctcgctctgtcaccc

SEQ ID NO: 116962 - DNA, 22 bp, Homo sapiens
tgatgattagtgatgttgaaca

SEQ ID NO: 116963 - DNA, 22 bp, Homo sapiens
agaagggttttcatcatgttgg

SEQ ID NO: 116964 - DNA, 19 bp, Homo sapiens
agatgaagtcttggtctgt

SEQ ID NO: 116965 - DNA, 23 bp, Homo sapiens
gtaatcagtgcaatacttcaagc

SEQ ID NO: 116966 - DNA, 19 bp, Homo sapiens
cctctctcagacccagtct

SEQ ID NO: 116967 - DNA, 20 bp, Homo sapiens
tttctgctttataagctgaa

SEQ ID NO: 116968 - DNA, 23 bp, Homo sapiens
agtcataatcatattgtaagtga

SEQ ID NO: 116969 - DNA, 23 bp, Homo sapiens
gtgagactctgtctctatgcaaa

SEQ ID NO: 116970 - DNA, 20 bp, Homo sapiens
atatatgtacatgtatatgt

SEQ ID NO: 116971 - DNA, 22 bp, Homo sapiens
tatgtgcatatatacacatatg

SEQ ID NO: 116972 - DNA, 23 bp, Homo sapiens
tatttaggagtttttcgtcttga

SEQ ID NO: 116973 - DNA, 23 bp, Homo sapiens
ccaaactctctctcttacactct

SEQ ID NO: 116974 - DNA, 23 bp, Homo sapiens
ataaatgtctgcatttgatggat

SEQ ID NO: 116975 - DNA, 21 bp, Homo sapiens
atgggtatcctattaatatgt

SEQ ID NO: 116976 - DNA, 21 bp, Homo sapiens
tctcgatatatatatatcttg

SEQ ID NO: 116977 - DNA, 21 bp, Homo sapiens
tatctcgatatatatatatct

SEQ ID NO: 116978 - DNA, 23 bp, Homo sapiens
atttatgtattagaatagtggtt

SEQ ID NO: 116979 - DNA, 20 bp, Homo sapiens
atctgtgtagttttgtgtga

SEQ ID NO: 116980 - DNA, 23 bp, Homo sapiens
ctctgttcactgtgcctggcttt

SEQ ID NO: 116981 - DNA, 23 bp, Homo sapiens
atttgtatgtcttcctttgagaa

SEQ ID NO: 116982 - DNA, 23 bp, Homo sapiens
aaagtctgagatcaaggtgtcag

SEQ ID NO: 116983 - DNA, 23 bp, Homo sapiens
ttacaacactttgggaggctgag

SEQ ID NO: 116984 - DNA, 21 bp, Homo sapiens
agcacagaagtttgagaccag

SEQ ID NO: 116985 - DNA, 19 bp, Homo sapiens
acacacatgtagcaggtgt

SEQ ID NO: 116986 - DNA, 23 bp, Homo sapiens
agtctcgctctgtcacccagcct

SEQ ID NO: 116987 - DNA, 23 bp, Homo sapiens
acatggagtctccctctgtcacc

SEQ ID NO: 116988 - DNA, 18 bp, Homo sapiens
actgactcattgtcaaaa

SEQ ID NO: 116989 - DNA, 23 bp, Homo sapiens
tatatccaaatcattcctgtcag

SEQ ID NO: 116990 - DNA, 21 bp, Homo sapiens
agaattggagaaagtatgctg

SEQ ID NO: 116991 - DNA, 18 bp, Homo sapiens
atcaattagcctatggta

SEQ ID NO: 116992 - DNA, 22 bp, Homo sapiens
tgagcatctaggttgtattgtt

SEQ ID NO: 116993 - DNA, 23 bp, Homo sapiens
tttaaagatcaggtcttgctctg

SEQ ID NO: 116994 - DNA, 22 bp, Homo sapiens
tttcagcagttggtaaactgat

SEQ ID NO: 116995 - DNA, 23 bp, Homo sapiens
tgagttcattgtagattctggat

SEQ ID NO: 116996 - DNA, 23 bp, Homo sapiens
tgagttcattgtagattctggat

SEQ ID NO: 116997 - DNA, 23 bp, Homo sapiens
ctttgttctttttgcttaggatt

SEQ ID NO: 116998 - DNA, 18 bp, Homo sapiens
aattctgcaaaaagtcaa

SEQ ID NO: 116999 - DNA, 23 bp, Homo sapiens
agactgtgacccttttggtgtct

SEQ ID NO: 117000 - DNA, 23 bp, Homo sapiens
tgtttatgatcttggagtgaagc

SEQ ID NO: 117001 - DNA, 19 bp, Homo sapiens
taatatgtaaatgatatgc

SEQ ID NO: 117002 - DNA, 23 bp, Homo sapiens
gtcggtgggtctgtccgtgtgtg

SEQ ID NO: 117003 - DNA, 22 bp, Homo sapiens
tgtgttcatggtgagaggcttt

SEQ ID NO: 117004 - DNA, 23 bp, Homo sapiens
agagaagagagtaaacagatagg

SEQ ID NO: 117005 - DNA, 21 bp, Homo sapiens
ttgtcctgtctgtgaagtgtg

SEQ ID NO: 117006 - DNA, 23 bp, Homo sapiens
gggtctcactctgtcacccaggc

SEQ ID NO: 117007 - DNA, 21 bp, Homo sapiens
ttcaagtgattctcctgcctc

SEQ ID NO: 117008 - DNA, 23 bp, Homo sapiens
tatttgatctacttctgattttg

SEQ ID NO: 117009 - DNA, 23 bp, Homo sapiens
atctcactcacttactctggcct

SEQ ID NO: 117010 - DNA, 23 bp, Homo sapiens
agacggagtctctctctgtcacc

SEQ ID NO: 117011 - DNA, 18 bp, Homo sapiens
aagctagacaaaagcatt

SEQ ID NO: 117012 - DNA, 23 bp, Homo sapiens
tctccagtttttgttgttgttgt

SEQ ID NO: 117013 - DNA, 18 bp, Homo sapiens
ctgggattacaggtgtgt

SEQ ID NO: 117014 - DNA, 19 bp, Homo sapiens
tgagagagagtctcgctct

SEQ ID NO: 117015 - DNA, 18 bp, Homo sapiens
tggggtacaaacaggcag

SEQ ID NO: 117016 - DNA, 23 bp, Homo sapiens
tcagtattgtttttcatgttggt

SEQ ID NO: 117017 - DNA, 22 bp, Homo sapiens
tcagatttccctaattgtttca

SEQ ID NO: 117018 - DNA, 23 bp, Homo sapiens
aataagtttcatgattatattgg

SEQ ID NO: 117019 - DNA, 23 bp, Homo sapiens
tccttgtgtgtatttgattaaat

SEQ ID NO: 117020 - DNA, 23 bp, Homo sapiens
cagagatgtttgtctgcacattt

SEQ ID NO: 117021 - DNA, 23 bp, Homo sapiens
ttggagcattagaaaagagtggt

SEQ ID NO: 117022 - DNA, 21 bp, Homo sapiens
tgagagaagtgactctggcca

SEQ ID NO: 117023 - DNA, 18 bp, Homo sapiens
tcatatacatacatgtat

SEQ ID NO: 117024 - DNA, 20 bp, Homo sapiens
tcatatacaggtatgtatgt

SEQ ID NO: 117025 - DNA, 22 bp, Homo sapiens
tatgtgcgtgtatatatgtgtg

SEQ ID NO: 117026 - DNA, 23 bp, Homo sapiens
tttcaccatcttaaataaagtct

SEQ ID NO: 117027 - DNA, 23 bp, Homo sapiens
gatgtgagaactgagagtcctca

SEQ ID NO: 117028 - DNA, 23 bp, Homo sapiens
tgagttcattgtagattctggat

SEQ ID NO: 117029 - DNA, 23 bp, Homo sapiens
tgagttcattgtagattctggat

SEQ ID NO: 117030 - DNA, 23 bp, Homo sapiens
gggagtctcactctgtcactcag

SEQ ID NO: 117031 - DNA, 23 bp, Homo sapiens
attatagacactaaagagtggtg

SEQ ID NO: 117032 - DNA, 18 bp, Homo sapiens
tatactttaagttctagg

SEQ ID NO: 117033 - DNA, 22 bp, Homo sapiens
tacatgtgcagaatgtgcaggt

SEQ ID NO: 117034 - DNA, 22 bp, Homo sapiens
ctgaggtagtaggatcaccaga

SEQ ID NO: 117035 - DNA, 20 bp, Homo sapiens
tttgacatttgaacattaag

SEQ ID NO: 117036 - DNA, 23 bp, Homo sapiens
ttgagtgaagaatgtaagctcta

SEQ ID NO: 117037 - DNA, 23 bp, Homo sapiens
tttaaatgcatatcttagacttt

SEQ ID NO: 117038 - DNA, 21 bp, Homo sapiens
gtaaaatataagcaggaaaag

SEQ ID NO: 117039 - DNA, 23 bp, Homo sapiens
atgtatatatacgtgtgtgtgtg

SEQ ID NO: 117040 - DNA, 23 bp, Homo sapiens
tatatgtatatatatatgtgtgt

SEQ ID NO: 117041 - DNA, 22 bp, Homo sapiens
tatatgtatatatacgtgtgtg

SEQ ID NO: 117042 - DNA, 22 bp, Homo sapiens
atatgtatatatacgtgtgtgt

SEQ ID NO: 117043 - DNA, 23 bp, Homo sapiens
agtgcagaagatgctgattcctt

SEQ ID NO: 117044 - DNA, 22 bp, Homo sapiens
ccaagagatctgattctgttaa

SEQ ID NO: 117045 - DNA, 23 bp, Homo sapiens
tgtgtcctaatttattgcgtaat

SEQ ID NO: 117046 - DNA, 18 bp, Homo sapiens
tgtgcaacaaattactca

SEQ ID NO: 117047 - DNA, 22 bp, Homo sapiens
acagtgtgtctggaattggtgg

SEQ ID NO: 117048 - DNA, 22 bp, Homo sapiens
tggggaatacattagtagcttt

SEQ ID NO: 117049 - DNA, 18 bp, Homo sapiens
tgtgtgcatgtgtgtgtg

SEQ ID NO: 117050 - DNA, 23 bp, Homo sapiens
tgtcatgctctctctctcttgtg

SEQ ID NO: 117051 - DNA, 23 bp, Homo sapiens
ttcttttacaagtgcattgtgtg

SEQ ID NO: 117052 - DNA, 19 bp, Homo sapiens
cgttaaatttacacaatgg

SEQ ID NO: 117053 - DNA, 23 bp, Homo sapiens
tgtatgtatatgtatgtgtatgt

SEQ ID NO: 117054 - DNA, 20 bp, Homo sapiens
aaagactacaaatacatatg

SEQ ID NO: 117055 - DNA, 23 bp, Homo sapiens
agtgctacatatgagaacatagt

SEQ ID NO: 117056 - DNA, 19 bp, Homo sapiens
tagtactgaaattattctc

SEQ ID NO: 117057 - DNA, 23 bp, Homo sapiens
aatagctcttctgactggtgtga

SEQ ID NO: 117058 - DNA, 23 bp, Homo sapiens
tatatgcacacatatatatgtgt

SEQ ID NO: 117059 - DNA, 23 bp, Homo sapiens
tatatgcacacatatatatgtgt

SEQ ID NO: 117060 - DNA, 23 bp, Homo sapiens
tatgtgtgtgtatatatgtgtgt

SEQ ID NO: 117061 - DNA, 23 bp, Homo sapiens
ataccagtactatagatttgtat

SEQ ID NO: 117062 - DNA, 18 bp, Homo sapiens
acacacatacacacacac

SEQ ID NO: 117063 - DNA, 23 bp, Homo sapiens
tgagttcattgtagattctggat

SEQ ID NO: 117064 - DNA, 23 bp, Homo sapiens
tgagttcattgtagattctggat

SEQ ID NO: 117065 - DNA, 23 bp, Homo sapiens
tggatttgaagctctagatgtca

SEQ ID NO: 117066 - DNA, 22 bp, Homo sapiens
ttgaattgtaaactactttcct

SEQ ID NO: 117067 - DNA, 23 bp, Homo sapiens
acttctggatcacttaaggagat

SEQ ID NO: 117068 - DNA, 19 bp, Homo sapiens
atttattgctggatagcca

SEQ ID NO: 117069 - DNA, 23 bp, Homo sapiens
tgagttcattgtagattctggat

SEQ ID NO: 117070 - DNA, 23 bp, Homo sapiens
tgagttcattgtagattctggat

SEQ ID NO: 117071 - DNA, 19 bp, Homo sapiens
tgtgaacattttgtatcct

SEQ ID NO: 117072 - DNA, 23 bp, Homo sapiens
gactgtgagttgagtgggagcag

SEQ ID NO: 117073 - DNA, 23 bp, Homo sapiens
gacagagtctcgctctgtcaccc

SEQ ID NO: 117074 - DNA, 23 bp, Homo sapiens
actgtgttttaaagtgagtcctg

SEQ ID NO: 117075 - DNA, 23 bp, Homo sapiens
ttctctgcccttactttctctaa

SEQ ID NO: 117076 - DNA, 23 bp, Homo sapiens
ttcattatcacagtgaatatgca

SEQ ID NO: 117077 - DNA, 23 bp, Homo sapiens
tctggattgtgacatatgtatac

SEQ ID NO: 117078 - DNA, 23 bp, Homo sapiens
aaatgtcaatggaatttgatgga

SEQ ID NO: 117079 - DNA, 23 bp, Homo sapiens
atcaagccacttaatcagtttgt

SEQ ID NO: 117080 - DNA, 23 bp, Homo sapiens
aatctcagctagatatggagtgt

SEQ ID NO: 117081 - DNA, 23 bp, Homo sapiens
ttagaacttgctgtaagctataa

SEQ ID NO: 117082 - DNA, 23 bp, Homo sapiens
gatagatagatgttcataatctt

SEQ ID NO: 117083 - DNA, 21 bp, Homo sapiens
tatgggtaatattatatatgt

SEQ ID NO: 117084 - DNA, 18 bp, Homo sapiens
tgtaagatgtatttatgt

SEQ ID NO: 117085 - DNA, 22 bp, Homo sapiens
tgtttgaccaaatagttgtgca

SEQ ID NO: 117086 - DNA, 21 bp, Homo sapiens
tatatggaagaatttttatgt

SEQ ID NO: 117087 - DNA, 18 bp, Homo sapiens
atctgtcagcacatcaat

SEQ ID NO: 117088 - DNA, 18 bp, Homo sapiens
tgtatatatatacacaat

SEQ ID NO: 117089 - DNA, 20 bp, Homo sapiens
atgtgtatatatatacatgt

SEQ ID NO: 117090 - DNA, 20 bp, Homo sapiens
tatacagtatatatacatgt

SEQ ID NO: 117091 - DNA, 23 bp, Homo sapiens
acaatgttgtactatatggtatt

SEQ ID NO: 117092 - DNA, 19 bp, Homo sapiens
aagtgctgggattacaggc

SEQ ID NO: 117093 - DNA, 22 bp, Homo sapiens
tactgctagctctgagtggctt

SEQ ID NO: 117094 - DNA, 22 bp, Homo sapiens
aatgagtggtaagtctataagt

SEQ ID NO: 117095 - DNA, 23 bp, Homo sapiens
ttgcaattatgtttggtgggtat

SEQ ID NO: 117096 - DNA, 23 bp, Homo sapiens
acttacatcaaaggggtgagaga

SEQ ID NO: 117097 - DNA, 22 bp, Homo sapiens
aactctctctgggagatctttt

SEQ ID NO: 117098 - DNA, 23 bp, Homo sapiens
cggagtctcgctctgtctcccag

SEQ ID NO: 117099 - DNA, 22 bp, Homo sapiens
taacacaatatgtatgtgtgtg

SEQ ID NO: 117100 - DNA, 22 bp, Homo sapiens
ttatgcaccttactaaatgcat

SEQ ID NO: 117101 - DNA, 21 bp, Homo sapiens
atatgtatgtatatatatgta

SEQ ID NO: 117102 - DNA, 21 bp, Homo sapiens
attgtgattagaaaatgagtc

SEQ ID NO: 117103 - DNA, 23 bp, Homo sapiens
tgatatatttaatgtctcacatt

SEQ ID NO: 117104 - DNA, 21 bp, Homo sapiens
ttattttcacttcaagtagag

SEQ ID NO: 117105 - DNA, 22 bp, Homo sapiens
gaaggagattttttgtttatgt

SEQ ID NO: 117106 - DNA, 22 bp, Homo sapiens
tgaagactgacactgcctgatc

SEQ ID NO: 117107 - DNA, 23 bp, Homo sapiens
acatatatgtgtgtatatgtaca

SEQ ID NO: 117108 - DNA, 22 bp, Homo sapiens
acatgtgtgtgtttatgtgtgt

SEQ ID NO: 117109 - DNA, 22 bp, Homo sapiens
atatatgtacatatatatgtgt

SEQ ID NO: 117110 - DNA, 20 bp, Homo sapiens
acacacacatatatatgtgt

SEQ ID NO: 117111 - DNA, 18 bp, Homo sapiens
aggtatatatatatgtgt

SEQ ID NO: 117112 - DNA, 23 bp, Homo sapiens
tctctttgtggttttgatttgca

SEQ ID NO: 117113 - DNA, 21 bp, Homo sapiens
aagagtcttgctctttcaccc

SEQ ID NO: 117114 - DNA, 23 bp, Homo sapiens
tgagttcattgtagattctggat

SEQ ID NO: 117115 - DNA, 23 bp, Homo sapiens
tgagttcattgtagattctggat

SEQ ID NO: 117116 - DNA, 23 bp, Homo sapiens
tcactgtctgctctttctggctg

SEQ ID NO: 117117 - DNA, 23 bp, Homo sapiens
tatcagattgtcttccagtatct

SEQ ID NO: 117118 - DNA, 23 bp, Homo sapiens
ctaagattctctatttgggctag

SEQ ID NO: 117119 - DNA, 22 bp, Homo sapiens
acaatacactttttgttcttct

SEQ ID NO: 117120 - DNA, 21 bp, Homo sapiens
ttcagcaaatagcagatagga

SEQ ID NO: 117121 - DNA, 23 bp, Homo sapiens
atgcgtgtgtgtgtatgtgtgtg

SEQ ID NO: 117122 - DNA, 20 bp, Homo sapiens
tgtgtagatgtatgtgtgta

SEQ ID NO: 117123 - DNA, 18 bp, Homo sapiens
agaggtatatgttttatt

SEQ ID NO: 117124 - DNA, 19 bp, Homo sapiens
taaaatgtatgctatagta

SEQ ID NO: 117125 - DNA, 19 bp, Homo sapiens
aagttcatgagattgctag

SEQ ID NO: 117126 - DNA, 23 bp, Homo sapiens
tgagttcattgtagattctggat

SEQ ID NO: 117127 - DNA, 23 bp, Homo sapiens
tgagttcattgtagattctggat

SEQ ID NO: 117128 - DNA, 22 bp, Homo sapiens
acatgtgcaaaatgtgcaggtt

SEQ ID NO: 117129 - DNA, 23 bp, Homo sapiens
tgagttcattgtagattctggat

SEQ ID NO: 117130 - DNA, 23 bp, Homo sapiens
tgagttcattgtagattctggat

SEQ ID NO: 117131 - DNA, 23 bp, Homo sapiens
attagagtggttcctatatctgc

SEQ ID NO: 117132 - DNA, 23 bp, Homo sapiens
tcttttttggttccatatgaaat

SEQ ID NO: 117133 - DNA, 19 bp, Homo sapiens
tgtgaagaaagtcaatggt

SEQ ID NO: 117134 - DNA, 23 bp, Homo sapiens
ttaaagtggatttcttgcagata

SEQ ID NO: 117135 - DNA, 21 bp, Homo sapiens
tgggtgtatatacatatgtat

SEQ ID NO: 117136 - DNA, 23 bp, Homo sapiens
tatatgtacatatgtatatgtgt

SEQ ID NO: 117137 - DNA, 22 bp, Homo sapiens
atatgtgtatatatatgtgtgt

SEQ ID NO: 117138 - DNA, 23 bp, Homo sapiens
agaaagtattagttatgtttgat

SEQ ID NO: 117139 - DNA, 23 bp, Homo sapiens
tatctctcacagcaatctctgtc

SEQ ID NO: 117140 - DNA, 19 bp, Homo sapiens
tatgcatatatatgcacat

SEQ ID NO: 117141 - DNA, 19 bp, Homo sapiens
tacacacacacacacatga

SEQ ID NO: 117142 - DNA, 23 bp, Homo sapiens
tttgttctttttgcttaggattg

SEQ ID NO: 117143 - DNA, 22 bp, Homo sapiens
ttctgtgtagaaagtcaatggt

SEQ ID NO: 117144 - DNA, 23 bp, Homo sapiens
tgtgtgcatatacatacgtgtgt

SEQ ID NO: 117145 - DNA, 23 bp, Homo sapiens
atgtgtgtatatacatatgtgtg

SEQ ID NO: 117146 - DNA, 20 bp, Homo sapiens
aggcagagactcttgctctt

SEQ ID NO: 117147 - DNA, 23 bp, Homo sapiens
gacactgggtctctctctgttct

SEQ ID NO: 117148 - DNA, 22 bp, Homo sapiens
actcagacacagtcactgcctg

SEQ ID NO: 117149 - DNA, 23 bp, Homo sapiens
tgagttcattgtagattctggat

SEQ ID NO: 117150 - DNA, 23 bp, Homo sapiens
tgagttcattgtagattctggat

SEQ ID NO: 117151 - DNA, 21 bp, Homo sapiens
ttcaccaggttggccaggctg

SEQ ID NO: 117152 - DNA, 19 bp, Homo sapiens
actcaaggtttgcaaagca

SEQ ID NO: 117153 - DNA, 23 bp, Homo sapiens
atatagtgtgtgtgtgtgtctgt

SEQ ID NO: 117154 - DNA, 19 bp, Homo sapiens
tgagatggagtctcactct

SEQ ID NO: 117155 - DNA, 23 bp, Homo sapiens
gacagagtctcgctctgtcaccc

SEQ ID NO: 117156 - DNA, 22 bp, Homo sapiens
agctcactgcaacttctgtctc

SEQ ID NO: 117157 - DNA, 20 bp, Homo sapiens
atacatataatatatgtgtg

SEQ ID NO: 117158 - DNA, 23 bp, Homo sapiens
ttccagggagaatatgtattcaa

SEQ ID NO: 117159 - DNA, 23 bp, Homo sapiens
ttttttgaacatatacattctcc

SEQ ID NO: 117160 - DNA, 19 bp, Homo sapiens
tagacttatgaaaatggtc

SEQ ID NO: 117161 - DNA, 23 bp, Homo sapiens
tgtgagcagagtgtgaggatgag

SEQ ID NO: 117162 - DNA, 22 bp, Homo sapiens
cctcagtatagactgtgagctc

SEQ ID NO: 117163 - DNA, 19 bp, Homo sapiens
tgtgaacatatttggtagg

SEQ ID NO: 117164 - DNA, 23 bp, Homo sapiens
cacagagcttctctctctccaaa

SEQ ID NO: 117165 - DNA, 18 bp, Homo sapiens
acagatgttcgtcaccac

SEQ ID NO: 117166 - DNA, 19 bp, Homo sapiens
tcatgtgttccaggagcag

SEQ ID NO: 117167 - DNA, 23 bp, Homo sapiens
tcccacactggctgcctctgtaa

SEQ ID NO: 117168 - DNA, 21 bp, Homo sapiens
agacaggttcttgctctgttg

SEQ ID NO: 117169 - DNA, 21 bp, Homo sapiens
atgagaatttgaataacttag

SEQ ID NO: 117170 - DNA, 23 bp, Homo sapiens
atacacacatgtatatatgtctg

SEQ ID NO: 117171 - DNA, 21 bp, Homo sapiens
atgtgtatatatatgtgtgtg

SEQ ID NO: 117172 - DNA, 23 bp, Homo sapiens
gtctctgagtcagaagtgttggc

SEQ ID NO: 117173 - DNA, 23 bp, Homo sapiens
tgagttcattgtagattctggat

SEQ ID NO: 117174 - DNA, 23 bp, Homo sapiens
tgagttcattgtagattctggat

SEQ ID NO: 117175 - DNA, 23 bp, Homo sapiens
tgagttcattgtagattctggat

SEQ ID NO: 117176 - DNA, 19 bp, Homo sapiens
cagagcagccactttctgg

SEQ ID NO: 117177 - DNA, 23 bp, Homo sapiens
agtttctactatgtggtatcctt

SEQ ID NO: 117178 - DNA, 20 bp, Homo sapiens
ctcaccacagtctctgtctc

SEQ ID NO: 117179 - DNA, 23 bp, Homo sapiens
tgctctttcagactttttgatgt

SEQ ID NO: 117180 - DNA, 23 bp, Homo sapiens
tatgtctgtatatatatctgtgt

SEQ ID NO: 117181 - DNA, 22 bp, Homo sapiens
atattgagtttcttattctctg

SEQ ID NO: 117182 - DNA, 23 bp, Homo sapiens
tgagttcattgtagattctggat

SEQ ID NO: 117183 - DNA, 23 bp, Homo sapiens
tgagttcattgtagattctggat

SEQ ID NO: 117184 - DNA, 23 bp, Homo sapiens
tctgtaagtctgtttcttcatct

SEQ ID NO: 117185 - DNA, 22 bp, Homo sapiens
atatatctgagcctgcacaagg

SEQ ID NO: 117186 - DNA, 23 bp, Homo sapiens
cttttagtgtcaggtatagagga

SEQ ID NO: 117187 - DNA, 23 bp, Homo sapiens
cagagtctcactctgtggcccag

SEQ ID NO: 117188 - DNA, 21 bp, Homo sapiens
agttccttgtagattctggat

SEQ ID NO: 117189 - DNA, 23 bp, Homo sapiens
aatgtttgttgaaaatgttgact

SEQ ID NO: 117190 - DNA, 21 bp, Homo sapiens
aataagaccctttgtgttgag

SEQ ID NO: 117191 - DNA, 20 bp, Homo sapiens
ttctgcatttcttcttgtgt

SEQ ID NO: 117192 - DNA, 21 bp, Homo sapiens
atctgctgggtattgttgcct

SEQ ID NO: 117193 - DNA, 21 bp, Homo sapiens
attaatatgcagctctcattg

SEQ ID NO: 117194 - DNA, 21 bp, Homo sapiens
aagacctttatgtaagagtaa

SEQ ID NO: 117195 - DNA, 22 bp, Homo sapiens
atcacactggagtgactgatga

SEQ ID NO: 117196 - DNA, 23 bp, Homo sapiens
ccgagtctccctctgtctcccag

SEQ ID NO: 117197 - DNA, 23 bp, Homo sapiens
tttgagacagagtctcactctgt

SEQ ID NO: 117198 - DNA, 23 bp, Homo sapiens
gtatgatgtgaatccttttaaac

SEQ ID NO: 117199 - DNA, 23 bp, Homo sapiens
ttatggtctgtagatggtgggtg

SEQ ID NO: 117200 - DNA, 19 bp, Homo sapiens
tgcctctttgtttgtttat

SEQ ID NO: 117201 - DNA, 20 bp, Homo sapiens
tgtatatatgcatgtatatg

SEQ ID NO: 117202 - DNA, 23 bp, Homo sapiens
tatgtatgtatgtatatatacat

SEQ ID NO: 117203 - DNA, 21 bp, Homo sapiens
atatgtgtatatatgtatgta

SEQ ID NO: 117204 - DNA, 23 bp, Homo sapiens
gacatgaatatgaaaagttaaag

SEQ ID NO: 117205 - DNA, 21 bp, Homo sapiens
caggtagtgtctttttttatt

SEQ ID NO: 117206 - DNA, 23 bp, Homo sapiens
tgggacagtctcagtctggcaat

SEQ ID NO: 117207 - DNA, 22 bp, Homo sapiens
ttctgtattctgctcataggta

SEQ ID NO: 117208 - DNA, 20 bp, Homo sapiens
tcaatggatggtagtcagag

SEQ ID NO: 117209 - DNA, 19 bp, Homo sapiens
tcactctgtcactcaggct

SEQ ID NO: 117210 - DNA, 23 bp, Homo sapiens
agagtctcactctgtctcccagg

SEQ ID NO: 117211 - DNA, 23 bp, Homo sapiens
gtgtgtgtgcagacagggtctca

SEQ ID NO: 117212 - DNA, 19 bp, Homo sapiens
tatgtgtatatatacgtat

SEQ ID NO: 117213 - DNA, 23 bp, Homo sapiens
atgtgtatatatgtatgtgtata

SEQ ID NO: 117214 - DNA, 23 bp, Homo sapiens
tgagttcattgtagattctggat

SEQ ID NO: 117215 - DNA, 23 bp, Homo sapiens
tgagttcattgtagattctggat

SEQ ID NO: 117216 - DNA, 23 bp, Homo sapiens
tgagttcattgtagattctggat

SEQ ID NO: 117217 - DNA, 23 bp, Homo sapiens
tgagttcattgtagattctggat

SEQ ID NO: 117218 - DNA, 20 bp, Homo sapiens
tgtatgtgtgtttgtgtgtg

SEQ ID NO: 117219 - DNA, 20 bp, Homo sapiens
tgtgtatatatatgtgtgtg

SEQ ID NO: 117220 - DNA, 23 bp, Homo sapiens
acacaccatatatatacacacac

SEQ ID NO: 117221 - DNA, 23 bp, Homo sapiens
tatgttctggatatgaatccttt

SEQ ID NO: 117222 - DNA, 23 bp, Homo sapiens
atggggtctcgctttgttgtcca

SEQ ID NO: 117223 - DNA, 21 bp, Homo sapiens
tgacactgttgttaggtgagt

SEQ ID NO: 117224 - DNA, 20 bp, Homo sapiens
atagtgtatatatatacaca

SEQ ID NO: 117225 - DNA, 20 bp, Homo sapiens
aatacatatattgtatatgt

SEQ ID NO: 117226 - DNA, 22 bp, Homo sapiens
tggaatgataggtagtgttgaa

SEQ ID NO: 117227 - DNA, 23 bp, Homo sapiens
ttctatgtgattacatgtaaacc

SEQ ID NO: 117228 - DNA, 19 bp, Homo sapiens
tcagaacattctcatccca

SEQ ID NO: 117229 - DNA, 23 bp, Homo sapiens
tgtggagcagaagtgagtgatga

SEQ ID NO: 117230 - DNA, 23 bp, Homo sapiens
gttgttaaaggtagcttaggtta

SEQ ID NO: 117231 - DNA, 20 bp, Homo sapiens
accagcatgttattttttga

SEQ ID NO: 117232 - DNA, 23 bp, Homo sapiens
tgagttcattgtagattctggat

SEQ ID NO: 117233 - DNA, 23 bp, Homo sapiens
tgagttcattgtagattctggat

SEQ ID NO: 117234 - DNA, 23 bp, Homo sapiens
cactgactctgtgggtctctggg

SEQ ID NO: 117235 - DNA, 23 bp, Homo sapiens
tttctggaagagaattgtttaag

SEQ ID NO: 117236 - DNA, 23 bp, Homo sapiens
aatgtgtgtgcttacacattctc

SEQ ID NO: 117237 - DNA, 21 bp, Homo sapiens
ggaaagaaaataagtgtgaag

SEQ ID NO: 117238 - DNA, 23 bp, Homo sapiens
tgagttcattgtagattctggat

SEQ ID NO: 117239 - DNA, 23 bp, Homo sapiens
tgagttcattgtagattctggat

SEQ ID NO: 117240 - DNA, 21 bp, Homo sapiens
taggaagattttaaattactg

SEQ ID NO: 117241 - DNA, 21 bp, Homo sapiens
actcagtaatttaatgatctt

SEQ ID NO: 117242 - DNA, 22 bp, Homo sapiens
tatgtgtatatatatatgtgtg

SEQ ID NO: 117243 - DNA, 23 bp, Homo sapiens
ttatatgtgcgtatgtatgcata

SEQ ID NO: 117244 - DNA, 21 bp, Homo sapiens
aagtgcaatggatggtcactg

SEQ ID NO: 117245 - DNA, 23 bp, Homo sapiens
gacagagtctcgctctgtcaccc

SEQ ID NO: 117246 - DNA, 22 bp, Homo sapiens
ttgagtgtgtgtctgtatgtgt

SEQ ID NO: 117247 - DNA, 23 bp, Homo sapiens
tatcacagagtcaaaatgtactc

SEQ ID NO: 117248 - DNA, 23 bp, Homo sapiens
ggagtctcacactgtcacccacg

SEQ ID NO: 117249 - DNA, 23 bp, Homo sapiens
tgagttcattgtagattctggat

SEQ ID NO: 117250 - DNA, 23 bp, Homo sapiens
tgagttcattgtagattctggat

SEQ ID NO: 117251 - DNA, 23 bp, Homo sapiens
tagacagaagtatgtgagctcaa

SEQ ID NO: 117252 - DNA, 21 bp, Homo sapiens
ttttggcataatttgaaatga

SEQ ID NO: 117253 - DNA, 19 bp, Homo sapiens
tatctgtctgtctatgtag

SEQ ID NO: 117254 - DNA, 22 bp, Homo sapiens
tccctcatttttttttctgatt

SEQ ID NO: 117255 - DNA, 23 bp, Homo sapiens
aaggcagactctctttctctgtg

SEQ ID NO: 117256 - DNA, 23 bp, Homo sapiens
tcttttttggttccatatgaaat

SEQ ID NO: 117257 - DNA, 23 bp, Homo sapiens
tctgtgaagaaagtcaatggtag

SEQ ID NO: 117258 - DNA, 23 bp, Homo sapiens
caggactgtctcagtctcttctc

SEQ ID NO: 117259 - DNA, 23 bp, Homo sapiens
tgagttcattgtagattctggat

SEQ ID NO: 117260 - DNA, 23 bp, Homo sapiens
tgagttcattgtagattctggat

SEQ ID NO: 117261 - DNA, 23 bp, Homo sapiens
ctctgggtgtctgagtctcaaag

SEQ ID NO: 117262 - DNA, 22 bp, Homo sapiens
tgaagtactaggttgaatagaa

SEQ ID NO: 117263 - DNA, 23 bp, Homo sapiens
acagagcctgatggtgtctcaga

SEQ ID NO: 117264 - DNA, 22 bp, Homo sapiens
agactctgtctctctgtttctg

SEQ ID NO: 117265 - DNA, 23 bp, Homo sapiens
tgagacggagtctcgctctgtca

SEQ ID NO: 117266 - DNA, 23 bp, Homo sapiens
gtgtgtgtgtgtgattttttcct

SEQ ID NO: 117267 - DNA, 23 bp, Homo sapiens
gtctctcattcactcagtgctca

SEQ ID NO: 117268 - DNA, 21 bp, Homo sapiens
actctctctatatatctgtat

SEQ ID NO: 117269 - DNA, 23 bp, Homo sapiens
aggaagttgatgctggttatcta

SEQ ID NO: 117270 - DNA, 21 bp, Homo sapiens
tgtgtgactggcatttttctc

SEQ ID NO: 117271 - DNA, 20 bp, Homo sapiens
caccagtcactttctcagtc

SEQ ID NO: 117272 - DNA, 21 bp, Homo sapiens
tcaatgaacatgaaaaaacat

SEQ ID NO: 117273 - DNA, 23 bp, Homo sapiens
gtagcacatgagaaagactatcc

SEQ ID NO: 117274 - DNA, 23 bp, Homo sapiens
tgttaagtgcttttcctatgtct

SEQ ID NO: 117275 - DNA, 21 bp, Homo sapiens
tactctactgatagagtagta

SEQ ID NO: 117276 - DNA, 18 bp, Homo sapiens
tatctcctattagttctg

SEQ ID NO: 117277 - DNA, 23 bp, Homo sapiens
gtaatgtgcacatattactttgt

SEQ ID NO: 117278 - DNA, 21 bp, Homo sapiens
acatgtgcacaatgtgcaggt

SEQ ID NO: 117279 - DNA, 20 bp, Homo sapiens
gtcagagtcactattttcca

SEQ ID NO: 117280 - DNA, 22 bp, Homo sapiens
aagcagcatttgaaatgaaaag

SEQ ID NO: 117281 - DNA, 22 bp, Homo sapiens
acacatatatgtacatatagta

SEQ ID NO: 117282 - DNA, 23 bp, Homo sapiens
tacagtatacatatatgtgtgta

SEQ ID NO: 117283 - DNA, 23 bp, Homo sapiens
caaggtctcactctgtcacccag

SEQ ID NO: 117284 - DNA, 23 bp, Homo sapiens
tgcaatggtgtgatcttggctct

SEQ ID NO: 117285 - DNA, 23 bp, Homo sapiens
atttatgtatgcatatgaatata

SEQ ID NO: 117286 - DNA, 23 bp, Homo sapiens
ttatgtatgcatatgtatatatt

SEQ ID NO: 117287 - DNA, 23 bp, Homo sapiens
ttctatgaaatgtctcacaagat

SEQ ID NO: 117288 - DNA, 22 bp, Homo sapiens
ttcatggtatgttctaaggtga

SEQ ID NO: 117289 - DNA, 23 bp, Homo sapiens
tttgtcagtggttttcttgagca

SEQ ID NO: 117290 - DNA, 22 bp, Homo sapiens
aaactgcctgttcagctccttt

SEQ ID NO: 117291 - DNA, 23 bp, Homo sapiens
atatatgaatatgtatatgtata

SEQ ID NO: 117292 - DNA, 23 bp, Homo sapiens
tgagttcattgtagattctggat

SEQ ID NO: 117293 - DNA, 23 bp, Homo sapiens
tgagttcattgtagattctggat

SEQ ID NO: 117294 - DNA, 23 bp, Homo sapiens
tgtgtatatatatatgtgtgtgt

SEQ ID NO: 117295 - DNA, 23 bp, Homo sapiens
aacatatgacagaattgatgagc

SEQ ID NO: 117296 - DNA, 20 bp, Homo sapiens
acttagatggttctatagtt

SEQ ID NO: 117297 - DNA, 21 bp, Homo sapiens
tgtctcagatgagactctgga

SEQ ID NO: 117298 - DNA, 18 bp, Homo sapiens
tgtaaaggagcttagagt

SEQ ID NO: 117299 - DNA, 21 bp, Homo sapiens
ttctccatcttcatctctaag

SEQ ID NO: 117300 - DNA, 21 bp, Homo sapiens
gatcaagaaagttctatattt

SEQ ID NO: 117301 - DNA, 21 bp, Homo sapiens
agagtagtggattcttttgaa

SEQ ID NO: 117302 - DNA, 19 bp, Homo sapiens
tttttctgtcatctattga

SEQ ID NO: 117303 - DNA, 19 bp, Homo sapiens
ggttttcttttccatagct

SEQ ID NO: 117304 - DNA, 19 bp, Homo sapiens
tgtatgtatgtgtatatat

SEQ ID NO: 117305 - DNA, 23 bp, Homo sapiens
tgagttcattgtagattctggat

SEQ ID NO: 117306 - DNA, 23 bp, Homo sapiens
tgagttcattgtagattctggat

SEQ ID NO: 117307 - DNA, 22 bp, Homo sapiens
tttcattatatatatgtgtgtg

SEQ ID NO: 117308 - DNA, 23 bp, Homo sapiens
ttactgtggttttgatttgcacc

SEQ ID NO: 117309 - DNA, 21 bp, Homo sapiens
tttgctatgtgtatgtattct

SEQ ID NO: 117310 - DNA, 20 bp, Homo sapiens
tttgcacatgtaagggaaac

SEQ ID NO: 117311 - DNA, 22 bp, Homo sapiens
ttgttcatgtcctagacatcta

SEQ ID NO: 117312 - DNA, 23 bp, Homo sapiens
tgtgtgtatatatatatgtggag

SEQ ID NO: 117313 - DNA, 22 bp, Homo sapiens
tatatccatggatatatatgca

SEQ ID NO: 117314 - DNA, 22 bp, Homo sapiens
atatgtgtatatatatccatgt

SEQ ID NO: 117315 - DNA, 23 bp, Homo sapiens
aggtagagtctcgctctgtcact

SEQ ID NO: 117316 - DNA, 21 bp, Homo sapiens
tatagtgtatgtatatgtata

SEQ ID NO: 117317 - DNA, 19 bp, Homo sapiens
atagtgtatgtatatgtat

SEQ ID NO: 117318 - DNA, 23 bp, Homo sapiens
ccacatgcaagttttgcaatggg

SEQ ID NO: 117319 - DNA, 23 bp, Homo sapiens
agaactgtcattttctaattcaa

SEQ ID NO: 117320 - DNA, 23 bp, Homo sapiens
atgtatgtatatatgtatgtata

SEQ ID NO: 117321 - DNA, 22 bp, Homo sapiens
atatgtatgtatgtgtgtgtat

SEQ ID NO: 117322 - DNA, 22 bp, Homo sapiens
tgtttccctgttgatgaatgga

SEQ ID NO: 117323 - DNA, 23 bp, Homo sapiens
tgtgtcactctgtcacccaggct

SEQ ID NO: 117324 - DNA, 19 bp, Homo sapiens
tgtaaacatgcatgtgcaa

SEQ ID NO: 117325 - DNA, 21 bp, Homo sapiens
gagtctcgctctgtcgctcag

SEQ ID NO: 117326 - DNA, 23 bp, Homo sapiens
attgtctctcactgggtccctcc

SEQ ID NO: 117327 - DNA, 21 bp, Homo sapiens
tgaggtaggaggatcacttga

SEQ ID NO: 117328 - DNA, 23 bp, Homo sapiens
gtagacatatgtcaaaccttatg

SEQ ID NO: 117329 - DNA, 21 bp, Homo sapiens
agcctggctcccagtatggaa

SEQ ID NO: 117330 - DNA, 23 bp, Homo sapiens
taaagtataatttgtgttgtgtg

SEQ ID NO: 117331 - DNA, 23 bp, Homo sapiens
tgtagcagtgccagagaatgtgg

SEQ ID NO: 117332 - DNA, 23 bp, Homo sapiens
tctatatatctatatctatatct

SEQ ID NO: 117333 - DNA, 20 bp, Homo sapiens
tctgccacccagtctggagt

SEQ ID NO: 117334 - DNA, 18 bp, Homo sapiens
cagtgaaatgatcagagc

SEQ ID NO: 117335 - DNA, 23 bp, Homo sapiens
gagacaggatctcgctctgtcac

SEQ ID NO: 117336 - DNA, 23 bp, Homo sapiens
tgagatggagtctcactctgtcg

SEQ ID NO: 117337 - DNA, 20 bp, Homo sapiens
attgcatagaagtcagttct

SEQ ID NO: 117338 - DNA, 23 bp, Homo sapiens
cattgatgagactagtttccaat

SEQ ID NO: 117339 - DNA, 22 bp, Homo sapiens
ttttagatggagttttgctctt

SEQ ID NO: 117340 - DNA, 20 bp, Homo sapiens
gtctcacagtctgtctctct

SEQ ID NO: 117341 - DNA, 23 bp, Homo sapiens
gatggtgtctcgctctgtcgctc

SEQ ID NO: 117342 - DNA, 23 bp, Homo sapiens
tctttagacaaagtctacttctg

SEQ ID NO: 117343 - DNA, 23 bp, Homo sapiens
cactcaggctagagtgcagttgt

SEQ ID NO: 117344 - DNA, 22 bp, Homo sapiens
tcactgcagccttcagtgcggg

SEQ ID NO: 117345 - DNA, 23 bp, Homo sapiens
aacagagatcagacacagcagta

SEQ ID NO: 117346 - DNA, 21 bp, Homo sapiens
aaagtgctgggattacaggca

SEQ ID NO: 117347 - DNA, 23 bp, Homo sapiens
cagtggcacaaacctgtagtccc

SEQ ID NO: 117348 - DNA, 23 bp, Homo sapiens
ttgcacagactccctcaaatgtg

SEQ ID NO: 117349 - DNA, 23 bp, Homo sapiens
tttgaggtagagtctcgctctgt

SEQ ID NO: 117350 - DNA, 21 bp, Homo sapiens
agtgctaaattacaggcgtga

SEQ ID NO: 117351 - DNA, 23 bp, Homo sapiens
ctcctgcctgtaatcccagcact

SEQ ID NO: 117352 - DNA, 21 bp, Homo sapiens
tccatgtatggatatgtgtac

SEQ ID NO: 117353 - DNA, 23 bp, Homo sapiens
cctcagagaggaaacagagcaga

SEQ ID NO: 117354 - DNA, 22 bp, Homo sapiens
tgtctgtgacagaaaactgtcc

SEQ ID NO: 117355 - DNA, 23 bp, Homo sapiens
acggtctcactctgtcacccagg

SEQ ID NO: 117356 - DNA, 23 bp, Homo sapiens
ggagtctgtgtggttcagtagtg

SEQ ID NO: 117357 - DNA, 23 bp, Homo sapiens
attgtatttctatttcaaagatg

SEQ ID NO: 117358 - DNA, 22 bp, Homo sapiens
aaagctctttttctaggtgatc

SEQ ID NO: 117359 - DNA, 23 bp, Homo sapiens
tcaaatagctaaagttttcctgc

SEQ ID NO: 117360 - DNA, 18 bp, Homo sapiens
tatttggtagtatttact

SEQ ID NO: 117361 - DNA, 23 bp, Homo sapiens
accctgtctccctgagtgactcc

SEQ ID NO: 117362 - DNA, 22 bp, Homo sapiens
agctagtcctgtctctcactct

SEQ ID NO: 117363 - DNA, 19 bp, Homo sapiens
tatgtgctcaatgtccagc

SEQ ID NO: 117364 - DNA, 23 bp, Homo sapiens
gaccatggatgttcaaagtgatt

SEQ ID NO: 117365 - DNA, 20 bp, Homo sapiens
tacatacataacaattgtat

SEQ ID NO: 117366 - DNA, 19 bp, Homo sapiens
tgtgaagaaagtcaatggt

SEQ ID NO: 117367 - DNA, 20 bp, Homo sapiens
tgcagttttactttcttgtg

SEQ ID NO: 117368 - DNA, 18 bp, Homo sapiens
aggatatatattatgtat

SEQ ID NO: 117369 - DNA, 20 bp, Homo sapiens
aaagatgtgtggctggaggt

SEQ ID NO: 117370 - DNA, 21 bp, Homo sapiens
tatacgtacacgtatatatgt

SEQ ID NO: 117371 - DNA, 21 bp, Homo sapiens
tatacgtacacgtatatatgt

SEQ ID NO: 117372 - DNA, 19 bp, Homo sapiens
gtgtataaaatatgtatgt

SEQ ID NO: 117373 - DNA, 23 bp, Homo sapiens
aatgaagtttcatgtagttatag

SEQ ID NO: 117374 - DNA, 20 bp, Homo sapiens
tgaacatgggaaaagcatct

SEQ ID NO: 117375 - DNA, 23 bp, Homo sapiens
tgcctctgtgcctgagacatgta

SEQ ID NO: 117376 - DNA, 21 bp, Homo sapiens
tgccatatatacatgtatgtg

SEQ ID NO: 117377 - DNA, 19 bp, Homo sapiens
tgtgaagaaagtcaatggt

SEQ ID NO: 117378 - DNA, 23 bp, Homo sapiens
cactttttgatcatgtcataggt

SEQ ID NO: 117379 - DNA, 19 bp, Homo sapiens
tacctggatgaagcaggct

SEQ ID NO: 117380 - DNA, 23 bp, Homo sapiens
tatgtatctgtatatgtatatgt

SEQ ID NO: 117381 - DNA, 23 bp, Homo sapiens
ggagtgtagtgagtgctttggct

SEQ ID NO: 117382 - DNA, 22 bp, Homo sapiens
ctacagacttattttcattcct

SEQ ID NO: 117383 - DNA, 22 bp, Homo sapiens
cgtctggctctctctctccctg

SEQ ID NO: 117384 - DNA, 23 bp, Homo sapiens
tgtgccaggcactgtgctgagca

SEQ ID NO: 117385 - DNA, 23 bp, Homo sapiens
tatgtatgtatgtatgtgtgtgt

SEQ ID NO: 117386 - DNA, 23 bp, Homo sapiens
tgtctctgcattataattgtagg

SEQ ID NO: 117387 - DNA, 23 bp, Homo sapiens
tgagttcattgtagattctggat

SEQ ID NO: 117388 - DNA, 23 bp, Homo sapiens
tgagttcattgtagattctggat

SEQ ID NO: 117389 - DNA, 23 bp, Homo sapiens
ctgggtgacagaagagtctctgc

SEQ ID NO: 117390 - DNA, 22 bp, Homo sapiens
tagacctgtgagtgctgcttga

SEQ ID NO: 117391 - DNA, 22 bp, Homo sapiens
catgtgactggatcattttttt

SEQ ID NO: 117392 - DNA, 23 bp, Homo sapiens
gagatggagcctcactctgtcac

SEQ ID NO: 117393 - DNA, 23 bp, Homo sapiens
cggagtctcactctgtcacccag

SEQ ID NO: 117394 - DNA, 23 bp, Homo sapiens
aacagagcaagattctgtctcag

SEQ ID NO: 117395 - DNA, 20 bp, Homo sapiens
tatgtgaattttctcctctg

SEQ ID NO: 117396 - DNA, 23 bp, Homo sapiens
tctctgtctgtctgggattggtc

SEQ ID NO: 117397 - DNA, 20 bp, Homo sapiens
tagagattgtgatggtttga

SEQ ID NO: 117398 - DNA, 23 bp, Homo sapiens
ctgtctgcctgagtggctggcag

SEQ ID NO: 117399 - DNA, 23 bp, Homo sapiens
tgagatggagtctcactctgtcc

SEQ ID NO: 117400 - DNA, 23 bp, Homo sapiens
acgattctcactctgtcgctcag

SEQ ID NO: 117401 - DNA, 18 bp, Homo sapiens
tcttttttattttttgag

SEQ ID NO: 117402 - DNA, 23 bp, Homo sapiens
tcaccacatccatgtcaacgtct

SEQ ID NO: 117403 - DNA, 23 bp, Homo sapiens
actgtgtacagtgtgagggcagg

SEQ ID NO: 117404 - DNA, 23 bp, Homo sapiens
ggcttaggctctgccactgttac

SEQ ID NO: 117405 - DNA, 19 bp, Homo sapiens
tgagatcttgctctgttgc

SEQ ID NO: 117406 - DNA, 21 bp, Homo sapiens
atgtgtatatatatatacgtg

SEQ ID NO: 117407 - DNA, 23 bp, Homo sapiens
taacttcttgttttgttgttcac

SEQ ID NO: 117408 - DNA, 23 bp, Homo sapiens
tccctgtgtgggagagaatagga

SEQ ID NO: 117409 - DNA, 20 bp, Homo sapiens
tgtctcagtgcaacatatta

SEQ ID NO: 117410 - DNA, 23 bp, Homo sapiens
agtaattaacttgcttttgattt

SEQ ID NO: 117411 - DNA, 23 bp, Homo sapiens
tctcagatgagactgtggatttg

SEQ ID NO: 117412 - DNA, 23 bp, Homo sapiens
tggctctctgtttgtctgttaat

SEQ ID NO: 117413 - DNA, 23 bp, Homo sapiens
tgagttcattgtagattctggat

SEQ ID NO: 117414 - DNA, 23 bp, Homo sapiens
tgagttcattgtagattctggat

SEQ ID NO: 117415 - DNA, 23 bp, Homo sapiens
cttctcactcactctcagtgggg

SEQ ID NO: 117416 - DNA, 18 bp, Homo sapiens
tctgagattgggtgattt

SEQ ID NO: 117417 - DNA, 23 bp, Homo sapiens
cagagtctcgcactgtcacccag
